United States Patent 7,888,497 (BIOINFORMATICALLY DETECTABLE GROUP OF NOVEL REGULATORY OLIGONUCLEOTIDES AND USES THEREOF) - sequence listing, part 48

SEQ ID NO: 2010293 - DNA, 22 bp, Homo sapiens
tgcaggaacgagcactggccag

SEQ ID NO: 2010294 - DNA, 23 bp, Homo sapiens
tgcaggaacgagcactggccaga

SEQ ID NO: 2010295 - DNA, 16 bp, Homo sapiens
tgcaggacttctgcct

SEQ ID NO: 2010296 - DNA, 22 bp, Homo sapiens
tgcaggccaggttatgcctcat

SEQ ID NO: 2010297 - DNA, 21 bp, Homo sapiens
tgcaggccgggtggccaatcc

SEQ ID NO: 2010298 - DNA, 16 bp, Homo sapiens
tgcaggcctgctcagg

SEQ ID NO: 2010299 - DNA, 15 bp, Homo sapiens
tgcaggctctgggct

SEQ ID NO: 2010300 - DNA, 16 bp, Homo sapiens
tgcaggctctgggctc

SEQ ID NO: 2010301 - DNA, 16 bp, Homo sapiens
tgcagggaagagggca

SEQ ID NO: 2010302 - DNA, 19 bp, Homo sapiens
tgcagggggtgtgtctgct

SEQ ID NO: 2010303 - DNA, 13 bp, Homo sapiens
tgcagtacaggca

SEQ ID NO: 2010304 - DNA, 18 bp, Homo sapiens
tgcagtagtctctgtgct

SEQ ID NO: 2010305 - DNA, 15 bp, Homo sapiens
tgcagtattgccaca

SEQ ID NO: 2010306 - DNA, 20 bp, Homo sapiens
tgcagtattttattaaagca

SEQ ID NO: 2010307 - DNA, 21 bp, Homo sapiens
tgcagtattttattaaagcaa

SEQ ID NO: 2010308 - DNA, 15 bp, Homo sapiens
tgcagtcatcagaag

SEQ ID NO: 2010309 - DNA, 12 bp, Homo sapiens
tgcagtccagaa

SEQ ID NO: 2010310 - DNA, 20 bp, Homo sapiens
tgcagtccagaataagtgct

SEQ ID NO: 2010311 - DNA, 17 bp, Homo sapiens
tgcagtcccgtggaggg

SEQ ID NO: 2010312 - DNA, 24 bp, Homo sapiens
tgcagtcccgtggagggtagggga

SEQ ID NO: 2010313 - DNA, 21 bp, Homo sapiens
tgcagtccgcagtctggcctg

SEQ ID NO: 2010314 - DNA, 18 bp, Homo sapiens
tgcagtgacgtgcacctg

SEQ ID NO: 2010315 - DNA, 22 bp, Homo sapiens
tgcagtgacgtgcacctgtact

SEQ ID NO: 2010316 - DNA, 16 bp, Homo sapiens
tgcagtgatacatgta

SEQ ID NO: 2010317 - DNA, 18 bp, Homo sapiens
tgcagtgatacatgtact

SEQ ID NO: 2010318 - DNA, 19 bp, Homo sapiens
tgcagttaatggggtagag

SEQ ID NO: 2010319 - DNA, 20 bp, Homo sapiens
tgcagttcaaatcctcacca

SEQ ID NO: 2010320 - DNA, 15 bp, Homo sapiens
tgcataaaccaatga

SEQ ID NO: 2010321 - DNA, 23 bp, Homo sapiens
tgcataagattaaaggaaggaaa

SEQ ID NO: 2010322 - DNA, 21 bp, Homo sapiens
tgcatactgatccctttccca

SEQ ID NO: 2010323 - DNA, 19 bp, Homo sapiens
tgcatagagccacgtatgt

SEQ ID NO: 2010324 - DNA, 19 bp, Homo sapiens
tgcatagttcccatgttaa

SEQ ID NO: 2010325 - DNA, 17 bp, Homo sapiens
tgcatatatacatatat

SEQ ID NO: 2010326 - DNA, 17 bp, Homo sapiens
tgcatatcggaggtggt

SEQ ID NO: 2010327 - DNA, 21 bp, Homo sapiens
tgcatcagaaagggagggctc

SEQ ID NO: 2010328 - DNA, 19 bp, Homo sapiens
tgcatcagctgctgaaaca

SEQ ID NO: 2010329 - DNA, 22 bp, Homo sapiens
tgcatcagctgctgaaacaaca

SEQ ID NO: 2010330 - DNA, 16 bp, Homo sapiens
tgcatccggagaattg

SEQ ID NO: 2010331 - DNA, 15 bp, Homo sapiens
tgcatcctcctccca

SEQ ID NO: 2010332 - DNA, 16 bp, Homo sapiens
tgcatctactcaggcc

SEQ ID NO: 2010333 - DNA, 21 bp, Homo sapiens
tgcatctagaggcttccttca

SEQ ID NO: 2010334 - DNA, 13 bp, Homo sapiens
tgcatctcagccc

SEQ ID NO: 2010335 - DNA, 11 bp, Homo sapiens
tgcatgaaaat

SEQ ID NO: 2010336 - DNA, 18 bp, Homo sapiens
tgcatgattttatacata

SEQ ID NO: 2010337 - DNA, 19 bp, Homo sapiens
tgcatgattttatacatag

SEQ ID NO: 2010338 - DNA, 22 bp, Homo sapiens
tgcatgccaaattgtagttctt

SEQ ID NO: 2010339 - DNA, 16 bp, Homo sapiens
tgcatgctctctgcag

SEQ ID NO: 2010340 - DNA, 13 bp, Homo sapiens
tgcatgctctgga

SEQ ID NO: 2010341 - DNA, 17 bp, Homo sapiens
tgcatgctctggaagcc

SEQ ID NO: 2010342 - DNA, 19 bp, Homo sapiens
tgcatggaatttgtaagtt

SEQ ID NO: 2010343 - DNA, 18 bp, Homo sapiens
tgcatggcttggggagca

SEQ ID NO: 2010344 - DNA, 22 bp, Homo sapiens
tgcatggcttggggagcagagt

SEQ ID NO: 2010345 - DNA, 23 bp, Homo sapiens
tgcatggtgcagttgacagcagg

SEQ ID NO: 2010346 - DNA, 18 bp, Homo sapiens
tgcatgtaaaatgcagtc

SEQ ID NO: 2010347 - DNA, 13 bp, Homo sapiens
tgcatgtatgtct

SEQ ID NO: 2010348 - DNA, 14 bp, Homo sapiens
tgcatgtatgtctt

SEQ ID NO: 2010349 - DNA, 15 bp, Homo sapiens
tgcatgtatgtcttg

SEQ ID NO: 2010350 - DNA, 16 bp, Homo sapiens
tgcatgtatgtcttgg

SEQ ID NO: 2010351 - DNA, 23 bp, Homo sapiens
tgcatgtatgtgcacatgtgtct

SEQ ID NO: 2010352 - DNA, 13 bp, Homo sapiens
tgcatgtatgtgt

SEQ ID NO: 2010353 - DNA, 11 bp, Homo sapiens
tgcatgtgtgt

SEQ ID NO: 2010354 - DNA, 21 bp, Homo sapiens
tgcatgtgtgtgtctgtcttt

SEQ ID NO: 2010355 - DNA, 22 bp, Homo sapiens
tgcatgtgtgttgtccttcagc

SEQ ID NO: 2010356 - DNA, 17 bp, Homo sapiens
tgcatgtgttgtacaat

SEQ ID NO: 2010357 - DNA, 17 bp, Homo sapiens
tgcatgtttactttatt

SEQ ID NO: 2010358 - DNA, 18 bp, Homo sapiens
tgcattactgcatgcact

SEQ ID NO: 2010359 - DNA, 19 bp, Homo sapiens
tgcattagaaatagacagt

SEQ ID NO: 2010360 - DNA, 20 bp, Homo sapiens
tgcattagaaatagacagta

SEQ ID NO: 2010361 - DNA, 14 bp, Homo sapiens
tgcattagaaatta

SEQ ID NO: 2010362 - DNA, 18 bp, Homo sapiens
tgcattccccgctgccca

SEQ ID NO: 2010363 - DNA, 22 bp, Homo sapiens
tgcattcggtacttacccggag

SEQ ID NO: 2010364 - DNA, 20 bp, Homo sapiens
tgcattcttttaaagtttta

SEQ ID NO: 2010365 - DNA, 14 bp, Homo sapiens
tgcattgaatatat

SEQ ID NO: 2010366 - DNA, 17 bp, Homo sapiens
tgcattgttattgtgga

SEQ ID NO: 2010367 - DNA, 17 bp, Homo sapiens
tgcatttataaatgtgt

SEQ ID NO: 2010368 - DNA, 15 bp, Homo sapiens
tgcatttctgtctct

SEQ ID NO: 2010369 - DNA, 22 bp, Homo sapiens
tgcatttcttgacttcacagca

SEQ ID NO: 2010370 - DNA, 21 bp, Homo sapiens
tgcatttgagagaagccacgc

SEQ ID NO: 2010371 - DNA, 16 bp, Homo sapiens
tgccaaagcaaaagaa

SEQ ID NO: 2010372 - DNA, 23 bp, Homo sapiens
tgccaacaccttcttggcttctg

SEQ ID NO: 2010373 - DNA, 22 bp, Homo sapiens
tgccaacatacccttctttaaa

SEQ ID NO: 2010374 - DNA, 23 bp, Homo sapiens
tgccaacatacccttctttaaat

SEQ ID NO: 2010375 - DNA, 18 bp, Homo sapiens
tgccaacctgatgcccct

SEQ ID NO: 2010376 - DNA, 23 bp, Homo sapiens
tgccaacctgatgccccttcccc

SEQ ID NO: 2010377 - DNA, 14 bp, Homo sapiens
tgccaactggtcac

SEQ ID NO: 2010378 - DNA, 18 bp, Homo sapiens
tgccaactggtcactgtg

SEQ ID NO: 2010379 - DNA, 12 bp, Homo sapiens
tgccaagagagg

SEQ ID NO: 2010380 - DNA, 15 bp, Homo sapiens
tgccaagtccaggtc

SEQ ID NO: 2010381 - DNA, 15 bp, Homo sapiens
tgccaatatgtattg

SEQ ID NO: 2010382 - DNA, 19 bp, Homo sapiens
tgccaatatgtattgtaaa

SEQ ID NO: 2010383 - DNA, 21 bp, Homo sapiens
tgccaatgaggtctgaaatgg

SEQ ID NO: 2010384 - DNA, 15 bp, Homo sapiens
tgccaattagcaatt

SEQ ID NO: 2010385 - DNA, 19 bp, Homo sapiens
tgccacaatgcctctccca

SEQ ID NO: 2010386 - DNA, 14 bp, Homo sapiens
tgccacacactgtt

SEQ ID NO: 2010387 - DNA, 13 bp, Homo sapiens
tgccacaccctcc

SEQ ID NO: 2010388 - DNA, 20 bp, Homo sapiens
tgccacaccctccccattca

SEQ ID NO: 2010389 - DNA, 21 bp, Homo sapiens
tgccacactcagtcccccacc

SEQ ID NO: 2010390 - DNA, 22 bp, Homo sapiens
tgccacactcagtcccccacca

SEQ ID NO: 2010391 - DNA, 13 bp, Homo sapiens
tgccacacttcag

SEQ ID NO: 2010392 - DNA, 19 bp, Homo sapiens
tgccttgacaacagactga

SEQ ID NO: 2010393 - DNA, 21 bp, Homo sapiens
tgccttgacaacagactgaat

SEQ ID NO: 2010394 - DNA, 20 bp, Homo sapiens
tgccttgagtctttaatccc

SEQ ID NO: 2010395 - DNA, 20 bp, Homo sapiens
tgccttgatgaagcctgtgc

SEQ ID NO: 2010396 - DNA, 20 bp, Homo sapiens
tgcctttccacctgctttct

SEQ ID NO: 2010397 - DNA, 20 bp, Homo sapiens
tgcctttctctggctccaga

SEQ ID NO: 2010398 - DNA, 13 bp, Homo sapiens
tgcctttgcctct

SEQ ID NO: 2010399 - DNA, 17 bp, Homo sapiens
tgcctttgtttctaaag

SEQ ID NO: 2010400 - DNA, 15 bp, Homo sapiens
tgccttttaaaagaa

SEQ ID NO: 2010401 - DNA, 13 bp, Homo sapiens
tgccttttatagc

SEQ ID NO: 2010402 - DNA, 17 bp, Homo sapiens
tgccttttatagctatt

SEQ ID NO: 2010403 - DNA, 23 bp, Homo sapiens
tgccttttgctgctgctgctgcg

SEQ ID NO: 2010404 - DNA, 21 bp, Homo sapiens
tgcctttttgtttttgtaaaa

SEQ ID NO: 2010405 - DNA, 22 bp, Homo sapiens
tgcgagatcgctggcagagaag

SEQ ID NO: 2010406 - DNA, 20 bp, Homo sapiens
tgcgagcatttccctcccgg

SEQ ID NO: 2010407 - DNA, 22 bp, Homo sapiens
tgcgagcatttccctcccggga

SEQ ID NO: 2010408 - DNA, 19 bp, Homo sapiens
tgcgatctgggttcactgc

SEQ ID NO: 2010409 - DNA, 20 bp, Homo sapiens
tgcgatctgggttcactgca

SEQ ID NO: 2010410 - DNA, 16 bp, Homo sapiens
tgcgatcttcagagca

SEQ ID NO: 2010411 - DNA, 18 bp, Homo sapiens
tgcgcaacaacaaggacc

SEQ ID NO: 2010412 - DNA, 22 bp, Homo sapiens
tgcgcacaaggctgaccaagag

SEQ ID NO: 2010413 - DNA, 22 bp, Homo sapiens
tgcgcctacaggagtgagcact

SEQ ID NO: 2010414 - DNA, 20 bp, Homo sapiens
tgcgcgcatgtaatcccagc

SEQ ID NO: 2010415 - DNA, 21 bp, Homo sapiens
tgcgcgcatgtaatcccagct

SEQ ID NO: 2010416 - DNA, 14 bp, Homo sapiens
tgcgcgtgtgcacg

SEQ ID NO: 2010417 - DNA, 22 bp, Homo sapiens
tgcgctaacccccagcccacag

SEQ ID NO: 2010418 - DNA, 17 bp, Homo sapiens
tgcgctcttggtccctg

SEQ ID NO: 2010419 - DNA, 15 bp, Homo sapiens
tgcgctgctcaacct

SEQ ID NO: 2010420 - DNA, 23 bp, Homo sapiens
tgcgctggtggaccacaggcatc

SEQ ID NO: 2010421 - DNA, 15 bp, Homo sapiens
tgcggacaagtttta

SEQ ID NO: 2010422 - DNA, 13 bp, Homo sapiens
tgcggccaccacc

SEQ ID NO: 2010423 - DNA, 17 bp, Homo sapiens
tgcggccttccaccggg

SEQ ID NO: 2010424 - DNA, 19 bp, Homo sapiens
tgcggccttccaccgggcc

SEQ ID NO: 2010425 - DNA, 17 bp, Homo sapiens
tgcgggagtagttggaa

SEQ ID NO: 2010426 - DNA, 17 bp, Homo sapiens
tgcgggatggtcctggg

SEQ ID NO: 2010427 - DNA, 15 bp, Homo sapiens
tgcggggcagagcca

SEQ ID NO: 2010428 - DNA, 15 bp, Homo sapiens
tgcgggtctgaagga

SEQ ID NO: 2010429 - DNA, 18 bp, Homo sapiens
tgcggtggtgccagaggt

SEQ ID NO: 2010430 - DNA, 23 bp, Homo sapiens
tgcggttcaggaaaattgaatgc

SEQ ID NO: 2010431 - DNA, 15 bp, Homo sapiens
tgcgtacgtttcctg

SEQ ID NO: 2010432 - DNA, 19 bp, Homo sapiens
tgcgtcagaccagtactgg

SEQ ID NO: 2010433 - DNA, 22 bp, Homo sapiens
tgcgtcccccagccctcaggcc

SEQ ID NO: 2010434 - DNA, 19 bp, Homo sapiens
tgcgtcctgacgccctgcg

SEQ ID NO: 2010435 - DNA, 13 bp, Homo sapiens
tgcgtcctgcaga

SEQ ID NO: 2010436 - DNA, 23 bp, Homo sapiens
tgcgtgcacatatgggtgctggc

SEQ ID NO: 2010437 - DNA, 13 bp, Homo sapiens
tgcgtgcgtgtgc

SEQ ID NO: 2010438 - DNA, 18 bp, Homo sapiens
tgcgtgctttatttatgg

SEQ ID NO: 2010439 - DNA, 16 bp, Homo sapiens
tgcgtggctgtggcac

SEQ ID NO: 2010440 - DNA, 14 bp, Homo sapiens
tgcgttggagccac

SEQ ID NO: 2010441 - DNA, 19 bp, Homo sapiens
tgcgttggagccactcctg

SEQ ID NO: 2010442 - DNA, 23 bp, Homo sapiens
tgctaaacgactccgagaacaac

SEQ ID NO: 2010443 - DNA, 19 bp, Homo sapiens
tgctaaatactgtacatag

SEQ ID NO: 2010444 - DNA, 19 bp, Homo sapiens
tgctaaatgcaaacactgt

SEQ ID NO: 2010445 - DNA, 15 bp, Homo sapiens
tgctaaattttcagt

SEQ ID NO: 2010446 - DNA, 19 bp, Homo sapiens
tgctaactgtatgtgtctt

SEQ ID NO: 2010447 - DNA, 12 bp, Homo sapiens
tgctaagaaatg

SEQ ID NO: 2010448 - DNA, 13 bp, Homo sapiens
tgctaagagaagt

SEQ ID NO: 2010449 - DNA, 12 bp, Homo sapiens
tgctaataaaac

SEQ ID NO: 2010450 - DNA, 20 bp, Homo sapiens
tgctaatcttcttatgcaat

SEQ ID NO: 2010451 - DNA, 22 bp, Homo sapiens
tgctaatcttcttatgcaattt

SEQ ID NO: 2010452 - DNA, 15 bp, Homo sapiens
tgctaattaaaaagt

SEQ ID NO: 2010453 - DNA, 15 bp, Homo sapiens
tgctacaaaaacaca

SEQ ID NO: 2010454 - DNA, 19 bp, Homo sapiens
tgctacaaaaacacagcaa

SEQ ID NO: 2010455 - DNA, 12 bp, Homo sapiens
tgctacaataaa

SEQ ID NO: 2010456 - DNA, 17 bp, Homo sapiens
tgctacagtactatgta

SEQ ID NO: 2010457 - DNA, 13 bp, Homo sapiens
tgctaccaaagca

SEQ ID NO: 2010458 - DNA, 19 bp, Homo sapiens
tgctaccaaggcccagcta

SEQ ID NO: 2010459 - DNA, 21 bp, Homo sapiens
tgctaccaaggcccagctatg

SEQ ID NO: 2010460 - DNA, 16 bp, Homo sapiens
tgctacctcactgggg

SEQ ID NO: 2010461 - DNA, 19 bp, Homo sapiens
tgctacgtacatgtgaggc

SEQ ID NO: 2010462 - DNA, 15 bp, Homo sapiens
tgctactcctgtgct

SEQ ID NO: 2010463 - DNA, 16 bp, Homo sapiens
tgctactcctgtgctc

SEQ ID NO: 2010464 - DNA, 14 bp, Homo sapiens
tgctagacagccag

SEQ ID NO: 2010465 - DNA, 17 bp, Homo sapiens
tgctagagcaacccctg

SEQ ID NO: 2010466 - DNA, 20 bp, Homo sapiens
tgctagatatcacttactca

SEQ ID NO: 2010467 - DNA, 21 bp, Homo sapiens
tgctagatatcacttactcag

SEQ ID NO: 2010468 - DNA, 22 bp, Homo sapiens
tgctagatatcacttactcagt

SEQ ID NO: 2010469 - DNA, 20 bp, Homo sapiens
tgctagccggccactttgga

SEQ ID NO: 2010470 - DNA, 23 bp, Homo sapiens
tgctagtactggggagaaataat

SEQ ID NO: 2010471 - DNA, 20 bp, Homo sapiens
tgctataggctggagaagct

SEQ ID NO: 2010472 - DNA, 17 bp, Homo sapiens
tgctatatatataaata

SEQ ID NO: 2010473 - DNA, 18 bp, Homo sapiens
tgctatattttcatgact

SEQ ID NO: 2010474 - DNA, 14 bp, Homo sapiens
tgctatcacacagt

SEQ ID NO: 2010475 - DNA, 16 bp, Homo sapiens
tgctatctctgtgtgc

SEQ ID NO: 2010476 - DNA, 21 bp, Homo sapiens
tgctatctctgtgtgcacaaa

SEQ ID NO: 2010477 - DNA, 15 bp, Homo sapiens
tgctatgacatgcaa

SEQ ID NO: 2010478 - DNA, 15 bp, Homo sapiens
tgctatgccaagcca

SEQ ID NO: 2010479 - DNA, 17 bp, Homo sapiens
tgctatggttttctcca

SEQ ID NO: 2010480 - DNA, 21 bp, Homo sapiens
tgctattctgtgttgaacaca

SEQ ID NO: 2010481 - DNA, 14 bp, Homo sapiens
tgctattgaaatta

SEQ ID NO: 2010482 - DNA, 17 bp, Homo sapiens
tgctattgaaattactg

SEQ ID NO: 2010483 - DNA, 17 bp, Homo sapiens
tgctattgaactgagcc

SEQ ID NO: 2010484 - DNA, 16 bp, Homo sapiens
tgctattgacaagtca

SEQ ID NO: 2010485 - DNA, 18 bp, Homo sapiens
tgctattgttgtgggctt

SEQ ID NO: 2010486 - DNA, 17 bp, Homo sapiens
tgctatttctggcctca

SEQ ID NO: 2010487 - DNA, 19 bp, Homo sapiens
tgctatttctggcctcagc

SEQ ID NO: 2010488 - DNA, 21 bp, Homo sapiens
tgctatttgagcatgcacagc

SEQ ID NO: 2010489 - DNA, 22 bp, Homo sapiens
tgctatttgttgtttttaacaa

SEQ ID NO: 2010490 - DNA, 19 bp, Homo sapiens
tgctattttatttgtattc

SEQ ID NO: 2010491 - DNA, 18 bp, Homo sapiens
tgctcaaatcatttaaga

SEQ ID NO: 2010492 - DNA, 18 bp, Homo sapiens
tgctcaaatctattcaga

SEQ ID NO: 2010493 - DNA, 19 bp, Homo sapiens
tgctcaaatctattcagac

SEQ ID NO: 2010494 - DNA, 15 bp, Homo sapiens
tgctcaaccactgtg

SEQ ID NO: 2010495 - DNA, 18 bp, Homo sapiens
tgctcaaccactgtggcg

SEQ ID NO: 2010496 - DNA, 21 bp, Homo sapiens
tgctcaacctctctccttctg

SEQ ID NO: 2010497 - DNA, 23 bp, Homo sapiens
tgctcaacctctctccttctggc

SEQ ID NO: 2010498 - DNA, 22 bp, Homo sapiens
tgctcaagaagacatggagact

SEQ ID NO: 2010499 - DNA, 16 bp, Homo sapiens
tgctcacatatctgtc

SEQ ID NO: 2010500 - DNA, 19 bp, Homo sapiens
tgctcacgactcttcctgc

SEQ ID NO: 2010501 - DNA, 13 bp, Homo sapiens
tgctcactcagga

SEQ ID NO: 2010502 - DNA, 15 bp, Homo sapiens
tgctcagcaggccct

SEQ ID NO: 2010503 - DNA, 19 bp, Homo sapiens
tgctcagcccttcctagaa

SEQ ID NO: 2010504 - DNA, 19 bp, Homo sapiens
tgctcaggcttgaaatgca

SEQ ID NO: 2010505 - DNA, 17 bp, Homo sapiens
tgctcaggtgcaagtgc

SEQ ID NO: 2010506 - DNA, 13 bp, Homo sapiens
tggagagaagttt

SEQ ID NO: 2010507 - DNA, 19 bp, Homo sapiens
tggagagagtattaaatat

SEQ ID NO: 2010508 - DNA, 12 bp, Homo sapiens
tggagagcagct

SEQ ID NO: 2010509 - DNA, 16 bp, Homo sapiens
tggagagcagctggct

SEQ ID NO: 2010510 - DNA, 20 bp, Homo sapiens
tggagagcagctggctctcc

SEQ ID NO: 2010511 - DNA, 20 bp, Homo sapiens
tggagagccagaacctggag

SEQ ID NO: 2010512 - DNA, 16 bp, Homo sapiens
tggagagccctgggac

SEQ ID NO: 2010513 - DNA, 14 bp, Homo sapiens
tggagagctaggag

SEQ ID NO: 2010514 - DNA, 15 bp, Homo sapiens
tggagagctaggagc

SEQ ID NO: 2010515 - DNA, 22 bp, Homo sapiens
tggagagctaggagcaaagcct

SEQ ID NO: 2010516 - DNA, 21 bp, Homo sapiens
tggagaggagggatgctgcct

SEQ ID NO: 2010517 - DNA, 18 bp, Homo sapiens
tggagagggacgaagaaa

SEQ ID NO: 2010518 - DNA, 20 bp, Homo sapiens
tggagagggacgaagaaagg

SEQ ID NO: 2010519 - DNA, 13 bp, Homo sapiens
tggagaggggcct

SEQ ID NO: 2010520 - DNA, 15 bp, Homo sapiens
tggagaggggcctgg

SEQ ID NO: 2010521 - DNA, 16 bp, Homo sapiens
tggagaggggcctggg

SEQ ID NO: 2010522 - DNA, 15 bp, Homo sapiens
tggagatgatgatga

SEQ ID NO: 2010523 - DNA, 16 bp, Homo sapiens
tggagatgatgatgat

SEQ ID NO: 2010524 - DNA, 13 bp, Homo sapiens
tggagatgcagag

SEQ ID NO: 2010525 - DNA, 18 bp, Homo sapiens
tggagcaagaaggaagga

SEQ ID NO: 2010526 - DNA, 14 bp, Homo sapiens
tggagcaagagaga

SEQ ID NO: 2010527 - DNA, 17 bp, Homo sapiens
tggagcaccaggcacga

SEQ ID NO: 2010528 - DNA, 15 bp, Homo sapiens
tggagcagaatcagt

SEQ ID NO: 2010529 - DNA, 17 bp, Homo sapiens
tggagccactcctgtcc

SEQ ID NO: 2010530 - DNA, 11 bp, Homo sapiens
tggagccagag

SEQ ID NO: 2010531 - DNA, 13 bp, Homo sapiens
tggagccagagag

SEQ ID NO: 2010532 - DNA, 22 bp, Homo sapiens
tggagcccgtgcagtacaggca

SEQ ID NO: 2010533 - DNA, 12 bp, Homo sapiens
tggagccctcag

SEQ ID NO: 2010534 - DNA, 20 bp, Homo sapiens
tggagcctcggtggccatgc

SEQ ID NO: 2010535 - DNA, 21 bp, Homo sapiens
tggagcctggcacaggactga

SEQ ID NO: 2010536 - DNA, 22 bp, Homo sapiens
tggagctaattaaggtttgccc

SEQ ID NO: 2010537 - DNA, 14 bp, Homo sapiens
tggagctgttccat

SEQ ID NO: 2010538 - DNA, 18 bp, Homo sapiens
tggagcttgtacatattg

SEQ ID NO: 2010539 - DNA, 23 bp, Homo sapiens
tggaggaaaaccaagccgtggct

SEQ ID NO: 2010540 - DNA, 20 bp, Homo sapiens
tggaggaaggtgctgagctt

SEQ ID NO: 2010541 - DNA, 13 bp, Homo sapiens
tggaggagaaata

SEQ ID NO: 2010542 - DNA, 14 bp, Homo sapiens
tggaggagaagaat

SEQ ID NO: 2010543 - DNA, 16 bp, Homo sapiens
tggaggaggaggagga

SEQ ID NO: 2010544 - DNA, 17 bp, Homo sapiens
tggaggcaaatttcagc

SEQ ID NO: 2010545 - DNA, 14 bp, Homo sapiens
tggaggcctcacac

SEQ ID NO: 2010546 - DNA, 18 bp, Homo sapiens
tggaggcctcacacccag

SEQ ID NO: 2010547 - DNA, 19 bp, Homo sapiens
tggagggaatgaacctgga

SEQ ID NO: 2010548 - DNA, 13 bp, Homo sapiens
tggagggatgcca

SEQ ID NO: 2010549 - DNA, 22 bp, Homo sapiens
tggagggcagagtgggctgcct

SEQ ID NO: 2010550 - DNA, 22 bp, Homo sapiens
tggagggctagaacctggagag

SEQ ID NO: 2010551 - DNA, 21 bp, Homo sapiens
tggagggctagaacctggagg

SEQ ID NO: 2010552 - DNA, 20 bp, Homo sapiens
tggagggctagaactggaga

SEQ ID NO: 2010553 - DNA, 22 bp, Homo sapiens
tggagggctagaatctggagag

SEQ ID NO: 2010554 - DNA, 12 bp, Homo sapiens
tggagggctgga

SEQ ID NO: 2010555 - DNA, 15 bp, Homo sapiens
tggaggggaaacgca

SEQ ID NO: 2010556 - DNA, 19 bp, Homo sapiens
tggagggggcaagcctgta

SEQ ID NO: 2010557 - DNA, 21 bp, Homo sapiens
tggaggggtgacagtggagga

SEQ ID NO: 2010558 - DNA, 14 bp, Homo sapiens
tggagggtagggga

SEQ ID NO: 2010559 - DNA, 23 bp, Homo sapiens
tggagggtaggggagtgtgggtg

SEQ ID NO: 2010560 - DNA, 14 bp, Homo sapiens
tggaggtacactct

SEQ ID NO: 2010561 - DNA, 18 bp, Homo sapiens
tggaggtcacattcagga

SEQ ID NO: 2010562 - DNA, 20 bp, Homo sapiens
tggaggtcacattcaggaag

SEQ ID NO: 2010563 - DNA, 22 bp, Homo sapiens
tggaggtcacattcaggaagat

SEQ ID NO: 2010564 - DNA, 15 bp, Homo sapiens
tggaggtgagaaaag

SEQ ID NO: 2010565 - DNA, 12 bp, Homo sapiens
tggagtgagatc

SEQ ID NO: 2010566 - DNA, 17 bp, Homo sapiens
tggagtgagcagtagaa

SEQ ID NO: 2010567 - DNA, 17 bp, Homo sapiens
tggagtgcagggaggag

SEQ ID NO: 2010568 - DNA, 15 bp, Homo sapiens
tggagtgcgctcttg

SEQ ID NO: 2010569 - DNA, 23 bp, Homo sapiens
tggagtgcgctcttggtccctgg

SEQ ID NO: 2010570 - DNA, 19 bp, Homo sapiens
tggagtgtgcgtgtgtgca

SEQ ID NO: 2010571 - DNA, 21 bp, Homo sapiens
tggagtgtgcgtgtgtgcatg

SEQ ID NO: 2010572 - DNA, 15 bp, Homo sapiens
tggagttcttgtgcc

SEQ ID NO: 2010573 - DNA, 14 bp, Homo sapiens
tggataagcgtggg

SEQ ID NO: 2010574 - DNA, 19 bp, Homo sapiens
tggataatatccactgcaa

SEQ ID NO: 2010575 - DNA, 23 bp, Homo sapiens
tggatcacagaggcttcttcaga

SEQ ID NO: 2010576 - DNA, 17 bp, Homo sapiens
tggatcagcgtggcctt

SEQ ID NO: 2010577 - DNA, 15 bp, Homo sapiens
tggatctccaaggac

SEQ ID NO: 2010578 - DNA, 21 bp, Homo sapiens
tggatctgggaccctttcctt

SEQ ID NO: 2010579 - DNA, 23 bp, Homo sapiens
tggatctgggaccctttccttcc

SEQ ID NO: 2010580 - DNA, 18 bp, Homo sapiens
tggatctgtccaaggaaa

SEQ ID NO: 2010581 - DNA, 20 bp, Homo sapiens
tggatctgtccaaggaaact

SEQ ID NO: 2010582 - DNA, 17 bp, Homo sapiens
tggatgaaattttctag

SEQ ID NO: 2010583 - DNA, 23 bp, Homo sapiens
tggatgaagattctcctgtgcta

SEQ ID NO: 2010584 - DNA, 23 bp, Homo sapiens
tggatgcctggtggcagctgcgg

SEQ ID NO: 2010585 - DNA, 23 bp, Homo sapiens
tggatgcggaacccaaattacgt

SEQ ID NO: 2010586 - DNA, 19 bp, Homo sapiens
tggatggaaatatgttcta

SEQ ID NO: 2010587 - DNA, 13 bp, Homo sapiens
tggatggacagaa

SEQ ID NO: 2010588 - DNA, 16 bp, Homo sapiens
tggatggatggacaga

SEQ ID NO: 2010589 - DNA, 17 bp, Homo sapiens
tggatgggagtgagaca

SEQ ID NO: 2010590 - DNA, 18 bp, Homo sapiens
tggatgtagtctgaggcc

SEQ ID NO: 2010591 - DNA, 22 bp, Homo sapiens
tggattatagagtatactaaaa

SEQ ID NO: 2010592 - DNA, 19 bp, Homo sapiens
tggattattcatttaaaat

SEQ ID NO: 2010593 - DNA, 15 bp, Homo sapiens
tggattctaaaatgc

SEQ ID NO: 2010594 - DNA, 18 bp, Homo sapiens
tggattgcagtccccagt

SEQ ID NO: 2010595 - DNA, 19 bp, Homo sapiens
tggatttcctattttaaaa

SEQ ID NO: 2010596 - DNA, 17 bp, Homo sapiens
tggatttctgaatggct

SEQ ID NO: 2010597 - DNA, 19 bp, Homo sapiens
tggattttcccctgaagac

SEQ ID NO: 2010598 - DNA, 15 bp, Homo sapiens
tggatttttaaatta

SEQ ID NO: 2010599 - DNA, 16 bp, Homo sapiens
tggatttttaaattat

SEQ ID NO: 2010600 - DNA, 20 bp, Homo sapiens
tggcaaagcggttgcttctg

SEQ ID NO: 2010601 - DNA, 14 bp, Homo sapiens
tggcaaatataaaa

SEQ ID NO: 2010602 - DNA, 15 bp, Homo sapiens
tggcaagaaagctgg

SEQ ID NO: 2010603 - DNA, 19 bp, Homo sapiens
tggcaagaaagctggtaaa

SEQ ID NO: 2010604 - DNA, 15 bp, Homo sapiens
tggcaagcagggaaa

SEQ ID NO: 2010605 - DNA, 21 bp, Homo sapiens
tggcaagcagggaaagctcca

SEQ ID NO: 2010606 - DNA, 22 bp, Homo sapiens
tggcaagcagggaaagctccac

SEQ ID NO: 2010607 - DNA, 14 bp, Homo sapiens
tggcaagtgaattt

SEQ ID NO: 2010608 - DNA, 23 bp, Homo sapiens
tggcaagttttgatatgagtata

SEQ ID NO: 2010609 - DNA, 16 bp, Homo sapiens
tggcaattgtccccag

SEQ ID NO: 2010610 - DNA, 15 bp, Homo sapiens
tggcaattttgtaac

SEQ ID NO: 2010611 - DNA, 22 bp, Homo sapiens
tggcacagacttctggaaggct

SEQ ID NO: 2010612 - DNA, 23 bp, Homo sapiens
tggcacagacttctggaaggctg

SEQ ID NO: 2010613 - DNA, 20 bp, Homo sapiens
tggcacagcccaaagaagga

SEQ ID NO: 2010614 - DNA, 14 bp, Homo sapiens
tggcacaggactga

SEQ ID NO: 2010615 - DNA, 15 bp, Homo sapiens
tggcacagggcagtg

SEQ ID NO: 2010616 - DNA, 21 bp, Homo sapiens
tggcaccactagggtcctggc

SEQ ID NO: 2010617 - DNA, 14 bp, Homo sapiens
tggcaccagatgca

SEQ ID NO: 2010618 - DNA, 15 bp, Homo sapiens
tggcaccagccccct

SEQ ID NO: 2010619 - DNA, 23 bp, Homo sapiens
tggcaccccggatcgaggacaag

SEQ ID NO: 2010620 - DNA, 15 bp, Homo sapiens
tgggcagtgcctcct

SEQ ID NO: 2010621 - DNA, 16 bp, Homo sapiens
tgggcagtgcctcctg

SEQ ID NO: 2010622 - DNA, 19 bp, Homo sapiens
tgggcagtgcctcctggga

SEQ ID NO: 2010623 - DNA, 17 bp, Homo sapiens
tgggcatgctcagccct

SEQ ID NO: 2010624 - DNA, 14 bp, Homo sapiens
tgggcattgggctg

SEQ ID NO: 2010625 - DNA, 15 bp, Homo sapiens
tgggcattgggctga

SEQ ID NO: 2010626 - DNA, 16 bp, Homo sapiens
tgggcattgggctgac

SEQ ID NO: 2010627 - DNA, 17 bp, Homo sapiens
tgggcattgggctgaca

SEQ ID NO: 2010628 - DNA, 18 bp, Homo sapiens
tgggccactgccagcagc

SEQ ID NO: 2010629 - DNA, 15 bp, Homo sapiens
tgggccagctgtcgc

SEQ ID NO: 2010630 - DNA, 14 bp, Homo sapiens
tgggccaggacagg

SEQ ID NO: 2010631 - DNA, 17 bp, Homo sapiens
tgggccaggacaggccc

SEQ ID NO: 2010632 - DNA, 16 bp, Homo sapiens
tgggccaggagctcag

SEQ ID NO: 2010633 - DNA, 17 bp, Homo sapiens
tgggccaggagctcagc

SEQ ID NO: 2010634 - DNA, 19 bp, Homo sapiens
tgggcccaggctctgggaa

SEQ ID NO: 2010635 - DNA, 22 bp, Homo sapiens
tgggcccaggctctgggaaggg

SEQ ID NO: 2010636 - DNA, 22 bp, Homo sapiens
tgggcccataatagttagccct

SEQ ID NO: 2010637 - DNA, 17 bp, Homo sapiens
tgggccccaccacctag

SEQ ID NO: 2010638 - DNA, 17 bp, Homo sapiens
tgggccccatgctctgc

SEQ ID NO: 2010639 - DNA, 13 bp, Homo sapiens
tgggcccctccac

SEQ ID NO: 2010640 - DNA, 17 bp, Homo sapiens
tgggcccgctttgcctg

SEQ ID NO: 2010641 - DNA, 22 bp, Homo sapiens
tgggcccggagtaatcaggcag

SEQ ID NO: 2010642 - DNA, 17 bp, Homo sapiens
tgggccggccagccttg

SEQ ID NO: 2010643 - DNA, 19 bp, Homo sapiens
tgggcctatggagagccct

SEQ ID NO: 2010644 - DNA, 21 bp, Homo sapiens
tgggcctatggagagccctgg

SEQ ID NO: 2010645 - DNA, 22 bp, Homo sapiens
tgggcctatggagagccctggg

SEQ ID NO: 2010646 - DNA, 21 bp, Homo sapiens
tgggcctccccccagcccctc

SEQ ID NO: 2010647 - DNA, 13 bp, Homo sapiens
tgggcctgctgct

SEQ ID NO: 2010648 - DNA, 17 bp, Homo sapiens
tgggcctgctgctgaga

SEQ ID NO: 2010649 - DNA, 18 bp, Homo sapiens
tgggcctgcttttccagg

SEQ ID NO: 2010650 - DNA, 19 bp, Homo sapiens
tgggcctgcttttccagga

SEQ ID NO: 2010651 - DNA, 23 bp, Homo sapiens
tgggcctgcttttccaggatcct

SEQ ID NO: 2010652 - DNA, 20 bp, Homo sapiens
tgggcctggcctgagctggg

SEQ ID NO: 2010653 - DNA, 23 bp, Homo sapiens
tgggcctggcctgagctggggcc

SEQ ID NO: 2010654 - DNA, 16 bp, Homo sapiens
tgggcctgggcctgct

SEQ ID NO: 2010655 - DNA, 16 bp, Homo sapiens
tgggcctgtgcagcag

SEQ ID NO: 2010656 - DNA, 18 bp, Homo sapiens
tgggcctgtgcagcagcc

SEQ ID NO: 2010657 - DNA, 20 bp, Homo sapiens
tgggcctgtgcagcagccca

SEQ ID NO: 2010658 - DNA, 22 bp, Homo sapiens
tgggcctgtgcagcagcccagc

SEQ ID NO: 2010659 - DNA, 17 bp, Homo sapiens
tgggccttgctttgggc

SEQ ID NO: 2010660 - DNA, 14 bp, Homo sapiens
tgggcctttcctgt

SEQ ID NO: 2010661 - DNA, 19 bp, Homo sapiens
tgggcctttcctgtgccaa

SEQ ID NO: 2010662 - DNA, 22 bp, Homo sapiens
tgggcgctctgccctccctggc

SEQ ID NO: 2010663 - DNA, 18 bp, Homo sapiens
tgggcgtttgtaaattct

SEQ ID NO: 2010664 - DNA, 13 bp, Homo sapiens
tgggctactggca

SEQ ID NO: 2010665 - DNA, 19 bp, Homo sapiens
tgggctactggcagctcct

SEQ ID NO: 2010666 - DNA, 22 bp, Homo sapiens
tgggctagggagaatgcagaga

SEQ ID NO: 2010667 - DNA, 21 bp, Homo sapiens
tgggctagtgtgagtggcagc

SEQ ID NO: 2010668 - DNA, 16 bp, Homo sapiens
tgggctagttgggctt

SEQ ID NO: 2010669 - DNA, 22 bp, Homo sapiens
tgggctcaagcagtcctcccac

SEQ ID NO: 2010670 - DNA, 15 bp, Homo sapiens
tgggctcagggctgg

SEQ ID NO: 2010671 - DNA, 17 bp, Homo sapiens
tgggctcctggaaccaa

SEQ ID NO: 2010672 - DNA, 14 bp, Homo sapiens
tgggctcctggctg

SEQ ID NO: 2010673 - DNA, 16 bp, Homo sapiens
tgggctctccacctca

SEQ ID NO: 2010674 - DNA, 17 bp, Homo sapiens
tgggctctccacctcag

SEQ ID NO: 2010675 - DNA, 20 bp, Homo sapiens
tgggctctccacctcagcct

SEQ ID NO: 2010676 - DNA, 23 bp, Homo sapiens
tgggctctccacctcagccttgg

SEQ ID NO: 2010677 - DNA, 12 bp, Homo sapiens
tgggctctgccc

SEQ ID NO: 2010678 - DNA, 18 bp, Homo sapiens
tgggctgaactgagccta

SEQ ID NO: 2010679 - DNA, 21 bp, Homo sapiens
tgggctgaactgagcctagct

SEQ ID NO: 2010680 - DNA, 21 bp, Homo sapiens
tgggctgacacctaccatgct

SEQ ID NO: 2010681 - DNA, 13 bp, Homo sapiens
tgggctgcctggg

SEQ ID NO: 2010682 - DNA, 17 bp, Homo sapiens
tgggctggtgtcacctg

SEQ ID NO: 2010683 - DNA, 12 bp, Homo sapiens
tgggctgtctgt

SEQ ID NO: 2010684 - DNA, 14 bp, Homo sapiens
tgggctgtctgtca

SEQ ID NO: 2010685 - DNA, 16 bp, Homo sapiens
tgggctgtctgtcacc

SEQ ID NO: 2010686 - DNA, 15 bp, Homo sapiens
tgggcttcagtggca

SEQ ID NO: 2010687 - DNA, 18 bp, Homo sapiens
tgggcttcagtggcagct

SEQ ID NO: 2010688 - DNA, 19 bp, Homo sapiens
tgggcttcagtggcagctg

SEQ ID NO: 2010689 - DNA, 20 bp, Homo sapiens
tgggcttcagtggcagctgc

SEQ ID NO: 2010690 - DNA, 20 bp, Homo sapiens
tgggcttctgaaacttcata

SEQ ID NO: 2010691 - DNA, 14 bp, Homo sapiens
tgggcttgttttct

SEQ ID NO: 2010692 - DNA, 15 bp, Homo sapiens
tgggctttaacaaaa

SEQ ID NO: 2010693 - DNA, 19 bp, Homo sapiens
tgggctttaacaaaacaag

SEQ ID NO: 2010694 - DNA, 16 bp, Homo sapiens
tgggctttgatttcca

SEQ ID NO: 2010695 - DNA, 14 bp, Homo sapiens
tgggctttgcaggc

SEQ ID NO: 2010696 - DNA, 17 bp, Homo sapiens
tgggctttgcaggctct

SEQ ID NO: 2010697 - DNA, 22 bp, Homo sapiens
tgggctttgcaggctctgggct

SEQ ID NO: 2010698 - DNA, 14 bp, Homo sapiens
tggggaagactgtg

SEQ ID NO: 2010699 - DNA, 24 bp, Homo sapiens
tggggaagactgtggctgctagca

SEQ ID NO: 2010700 - DNA, 21 bp, Homo sapiens
tggggaagcaagacgtcctgg

SEQ ID NO: 2010701 - DNA, 19 bp, Homo sapiens
tggggaagtgctccccaca

SEQ ID NO: 2010702 - DNA, 12 bp, Homo sapiens
tggggacactaa

SEQ ID NO: 2010703 - DNA, 12 bp, Homo sapiens
tggggagaaagt

SEQ ID NO: 2010704 - DNA, 19 bp, Homo sapiens
tggggagaaataaattttg

SEQ ID NO: 2010705 - DNA, 22 bp, Homo sapiens
tggggagcagagtataggatgg

SEQ ID NO: 2010706 - DNA, 16 bp, Homo sapiens
tggggaggaagggcca

SEQ ID NO: 2010707 - DNA, 23 bp, Homo sapiens
tggggaggaagggccaggagaga

SEQ ID NO: 2010708 - DNA, 15 bp, Homo sapiens
tggggaggcagctcc

SEQ ID NO: 2010709 - DNA, 16 bp, Homo sapiens
tggggaggcagctcca

SEQ ID NO: 2010710 - DNA, 14 bp, Homo sapiens
tggggagggggaag

SEQ ID NO: 2010711 - DNA, 16 bp, Homo sapiens
tggggagttataaaaa

SEQ ID NO: 2010712 - DNA, 17 bp, Homo sapiens
tggggagttataaaaat

SEQ ID NO: 2010713 - DNA, 14 bp, Homo sapiens
tggggatgtgggag

SEQ ID NO: 2010714 - DNA, 15 bp, Homo sapiens
tggggatgtgggagg

SEQ ID NO: 2010715 - DNA, 16 bp, Homo sapiens
tggggattgggaggga

SEQ ID NO: 2010716 - DNA, 19 bp, Homo sapiens
tggggcaagtccctgactc

SEQ ID NO: 2010717 - DNA, 14 bp, Homo sapiens
tggggcagaggggc

SEQ ID NO: 2010718 - DNA, 16 bp, Homo sapiens
tggggcagctcctctg

SEQ ID NO: 2010719 - DNA, 20 bp, Homo sapiens
tggggcagctcctctgtctc

SEQ ID NO: 2010720 - DNA, 20 bp, Homo sapiens
tggggcaggagtagctgagc

SEQ ID NO: 2010721 - DNA, 17 bp, Homo sapiens
tggggcaggctggctgg

SEQ ID NO: 2010722 - DNA, 16 bp, Homo sapiens
tggggcatagaaactg

SEQ ID NO: 2010723 - DNA, 21 bp, Homo sapiens
tggggcatggttccttccctg

SEQ ID NO: 2010724 - DNA, 16 bp, Homo sapiens
tggggcatgtgtgcct

SEQ ID NO: 2010725 - DNA, 17 bp, Homo sapiens
tggggcatgtgtgcctg

SEQ ID NO: 2010726 - DNA, 18 bp, Homo sapiens
tggggcatgtgtgcctgt

SEQ ID NO: 2010727 - DNA, 15 bp, Homo sapiens
tggggccctgggcct

SEQ ID NO: 2010728 - DNA, 17 bp, Homo sapiens
tggggccctgggcctca

SEQ ID NO: 2010729 - DNA, 19 bp, Homo sapiens
tggggcctggagaggggcc

SEQ ID NO: 2010730 - DNA, 12 bp, Homo sapiens
tggggcctggct

SEQ ID NO: 2010731 - DNA, 22 bp, Homo sapiens
tggggcctggcttgctccaggg

SEQ ID NO: 2010732 - DNA, 23 bp, Homo sapiens
tggggcctggcttgctccagggt

SEQ ID NO: 2010733 - DNA, 19 bp, Homo sapiens
tggggcctgtactgcctgc

SEQ ID NO: 2010734 - DNA, 13 bp, Homo sapiens
tggtcgcccagga

SEQ ID NO: 2010735 - DNA, 15 bp, Homo sapiens
tggtcgcccaggaga

SEQ ID NO: 2010736 - DNA, 22 bp, Homo sapiens
tggtcggggagctggggtacag

SEQ ID NO: 2010737 - DNA, 23 bp, Homo sapiens
tggtctagtagcggatctcactc

SEQ ID NO: 2010738 - DNA, 14 bp, Homo sapiens
tggtctccctccag

SEQ ID NO: 2010739 - DNA, 12 bp, Homo sapiens
tggtctcctctg

SEQ ID NO: 2010740 - DNA, 15 bp, Homo sapiens
tggtctgctgacctg

SEQ ID NO: 2010741 - DNA, 17 bp, Homo sapiens
tggtcttgagatgtctt

SEQ ID NO: 2010742 - DNA, 14 bp, Homo sapiens
tggtctttcctctg

SEQ ID NO: 2010743 - DNA, 15 bp, Homo sapiens
tggtgaaaatgtact

SEQ ID NO: 2010744 - DNA, 24 bp, Homo sapiens
tggtgaaaccctgtctctactaaa

SEQ ID NO: 2010745 - DNA, 11 bp, Homo sapiens
tggtgaaatta

SEQ ID NO: 2010746 - DNA, 18 bp, Homo sapiens
tggtgaaatttattagtt

SEQ ID NO: 2010747 - DNA, 19 bp, Homo sapiens
tggtgaaatttattagtta

SEQ ID NO: 2010748 - DNA, 13 bp, Homo sapiens
tggtgaagagtag

SEQ ID NO: 2010749 - DNA, 17 bp, Homo sapiens
tggtgacacacagcagc

SEQ ID NO: 2010750 - DNA, 17 bp, Homo sapiens
tggtgacatgtgcctgt

SEQ ID NO: 2010751 - DNA, 13 bp, Homo sapiens
tggtgacctctgc

SEQ ID NO: 2010752 - DNA, 17 bp, Homo sapiens
tggtgacctctgcctga

SEQ ID NO: 2010753 - DNA, 21 bp, Homo sapiens
tggtgagctgggaagctgtac

SEQ ID NO: 2010754 - DNA, 18 bp, Homo sapiens
tggtgaggcccagcctgt

SEQ ID NO: 2010755 - DNA, 12 bp, Homo sapiens
tggtgatggagt

SEQ ID NO: 2010756 - DNA, 20 bp, Homo sapiens
tggtgcagaaaaaaaaaaag

SEQ ID NO: 2010757 - DNA, 18 bp, Homo sapiens
tggtgcaggatggctttg

SEQ ID NO: 2010758 - DNA, 23 bp, Homo sapiens
tggtgccacttcttaaaggcctg

SEQ ID NO: 2010759 - DNA, 17 bp, Homo sapiens
tggtgcccatcctcccg

SEQ ID NO: 2010760 - DNA, 17 bp, Homo sapiens
tggtgcctggcctggca

SEQ ID NO: 2010761 - DNA, 14 bp, Homo sapiens
tggtgctaactgta

SEQ ID NO: 2010762 - DNA, 23 bp, Homo sapiens
tggtgctataggctggagaagct

SEQ ID NO: 2010763 - DNA, 22 bp, Homo sapiens
tggtgctcacgactcttcctgc

SEQ ID NO: 2010764 - DNA, 18 bp, Homo sapiens
tggtgctgccacacttca

SEQ ID NO: 2010765 - DNA, 13 bp, Homo sapiens
tggtgctgtggcc

SEQ ID NO: 2010766 - DNA, 17 bp, Homo sapiens
tggtgctttcaggtctg

SEQ ID NO: 2010767 - DNA, 21 bp, Homo sapiens
tggtggcaccagatgcaacct

SEQ ID NO: 2010768 - DNA, 13 bp, Homo sapiens
tggtggcagctgc

SEQ ID NO: 2010769 - DNA, 14 bp, Homo sapiens
tggtggcagctgcg

SEQ ID NO: 2010770 - DNA, 17 bp, Homo sapiens
tggtggcgcaagcctgt

SEQ ID NO: 2010771 - DNA, 17 bp, Homo sapiens
tggtggcgggcacctgt

SEQ ID NO: 2010772 - DNA, 15 bp, Homo sapiens
tggtgggagggggag

SEQ ID NO: 2010773 - DNA, 12 bp, Homo sapiens
tggtgggctggc

SEQ ID NO: 2010774 - DNA, 14 bp, Homo sapiens
tggtgggctggccc

SEQ ID NO: 2010775 - DNA, 18 bp, Homo sapiens
tggtgggctggcccagcc

SEQ ID NO: 2010776 - DNA, 12 bp, Homo sapiens
tggtgtaatgca

SEQ ID NO: 2010777 - DNA, 17 bp, Homo sapiens
tggtgtaatgcacaatt

SEQ ID NO: 2010778 - DNA, 18 bp, Homo sapiens
tggtgtagctcctctgct

SEQ ID NO: 2010779 - DNA, 21 bp, Homo sapiens
tggtgtatttttcaggtaggc

SEQ ID NO: 2010780 - DNA, 14 bp, Homo sapiens
tggtgtcaggcagg

SEQ ID NO: 2010781 - DNA, 14 bp, Homo sapiens
tggtgtccacctgg

SEQ ID NO: 2010782 - DNA, 17 bp, Homo sapiens
tggtgtccacctggccc

SEQ ID NO: 2010783 - DNA, 18 bp, Homo sapiens
tggtgtccagacagagcc

SEQ ID NO: 2010784 - DNA, 13 bp, Homo sapiens
tggtgtccctgcg

SEQ ID NO: 2010785 - DNA, 15 bp, Homo sapiens
tggtgtgaaagtcag

SEQ ID NO: 2010786 - DNA, 18 bp, Homo sapiens
tggtgtgaccctctgaat

SEQ ID NO: 2010787 - DNA, 11 bp, Homo sapiens
tggtgtgtttc

SEQ ID NO: 2010788 - DNA, 16 bp, Homo sapiens
tggttactctggtgct

SEQ ID NO: 2010789 - DNA, 15 bp, Homo sapiens
tggttcacactgacc

SEQ ID NO: 2010790 - DNA, 15 bp, Homo sapiens
tggttccatgcctga

SEQ ID NO: 2010791 - DNA, 19 bp, Homo sapiens
tggttccatgcctgagggt

SEQ ID NO: 2010792 - DNA, 22 bp, Homo sapiens
tggttccatgcctgagggtgga

SEQ ID NO: 2010793 - DNA, 20 bp, Homo sapiens
tggttcccaataaaagtgac

SEQ ID NO: 2010794 - DNA, 18 bp, Homo sapiens
tggttcccctgttcactc

SEQ ID NO: 2010795 - DNA, 14 bp, Homo sapiens
tggttcctctacta

SEQ ID NO: 2010796 - DNA, 16 bp, Homo sapiens
tggttccttccctggg

SEQ ID NO: 2010797 - DNA, 16 bp, Homo sapiens
tggttgtcactctaca

SEQ ID NO: 2010798 - DNA, 22 bp, Homo sapiens
tggttgttgcaccatctgcttg

SEQ ID NO: 2010799 - DNA, 19 bp, Homo sapiens
tggtttagcacaatttata

SEQ ID NO: 2010800 - DNA, 18 bp, Homo sapiens
tggtttagtgttctgtat

SEQ ID NO: 2010801 - DNA, 17 bp, Homo sapiens
tggtttcccaagagcta

SEQ ID NO: 2010802 - DNA, 19 bp, Homo sapiens
tggtttctgcgtgctttat

SEQ ID NO: 2010803 - DNA, 15 bp, Homo sapiens
tggtttgcaaggaag

SEQ ID NO: 2010804 - DNA, 17 bp, Homo sapiens
tggtttgcaaggaagcc

SEQ ID NO: 2010805 - DNA, 16 bp, Homo sapiens
tggttttcctaaatgc

SEQ ID NO: 2010806 - DNA, 20 bp, Homo sapiens
tggttttctccaagagctac

SEQ ID NO: 2010807 - DNA, 17 bp, Homo sapiens
tgtaaaaacaaaaagac

SEQ ID NO: 2010808 - DNA, 21 bp, Homo sapiens
tgtaaaaccatgtagttttaa

SEQ ID NO: 2010809 - DNA, 14 bp, Homo sapiens
tgtaaaataagtat

SEQ ID NO: 2010810 - DNA, 17 bp, Homo sapiens
tgtaaaatagcttgtat

SEQ ID NO: 2010811 - DNA, 21 bp, Homo sapiens
tgtaaaatagcttgtatagtg

SEQ ID NO: 2010812 - DNA, 21 bp, Homo sapiens
tgtaaaatcttggcacagaaa

SEQ ID NO: 2010813 - DNA, 15 bp, Homo sapiens
tgtaaaatgaaatta

SEQ ID NO: 2010814 - DNA, 18 bp, Homo sapiens
tgtaaaatgcagtccaga

SEQ ID NO: 2010815 - DNA, 14 bp, Homo sapiens
tgtaaaattgtata

SEQ ID NO: 2010816 - DNA, 21 bp, Homo sapiens
tgtaaaatttatacacacaaa

SEQ ID NO: 2010817 - DNA, 16 bp, Homo sapiens
tgtaaaatttgtttag

SEQ ID NO: 2010818 - DNA, 20 bp, Homo sapiens
tgtaaacaggagacaggaag

SEQ ID NO: 2010819 - DNA, 17 bp, Homo sapiens
tgtaaacagtgcctgct

SEQ ID NO: 2010820 - DNA, 22 bp, Homo sapiens
tgtaaacatgtgttttaattcc

SEQ ID NO: 2010821 - DNA, 17 bp, Homo sapiens
tgtaaacattcatcaag

SEQ ID NO: 2010822 - DNA, 23 bp, Homo sapiens
tgtaaactataaactactgtaat

SEQ ID NO: 2010823 - DNA, 18 bp, Homo sapiens
tgtaaactgcattagaaa

SEQ ID NO: 2010824 - DNA, 13 bp, Homo sapiens
tgtaaagcttgtc

SEQ ID NO: 2010825 - DNA, 19 bp, Homo sapiens
tgtaaagtaggaaaaataa

SEQ ID NO: 2010826 - DNA, 18 bp, Homo sapiens
tgtaaagtatgtaaacag

SEQ ID NO: 2010827 - DNA, 16 bp, Homo sapiens
tgtaaagtgtaaatcc

SEQ ID NO: 2010828 - DNA, 17 bp, Homo sapiens
tgtaaagtgtaaatcct

SEQ ID NO: 2010829 - DNA, 10 bp, Homo sapiens
tgtaaataaa

SEQ ID NO: 2010830 - DNA, 13 bp, Homo sapiens
tgtaaatacaaaa

SEQ ID NO: 2010831 - DNA, 12 bp, Homo sapiens
tgtaaatacacc

SEQ ID NO: 2010832 - DNA, 15 bp, Homo sapiens
tgtaaatacatgtgt

SEQ ID NO: 2010833 - DNA, 20 bp, Homo sapiens
tgtaaatagttttaaatatg

SEQ ID NO: 2010834 - DNA, 14 bp, Homo sapiens
tgtaaatattgtgt

SEQ ID NO: 2010835 - DNA, 17 bp, Homo sapiens
tgtaaatcacttgtaaa

SEQ ID NO: 2010836 - DNA, 19 bp, Homo sapiens
tgtaaatcacttgtaaata

SEQ ID NO: 2010837 - DNA, 20 bp, Homo sapiens
tgtaaatcacttgtaaataa

SEQ ID NO: 2010838 - DNA, 21 bp, Homo sapiens
tgtaaatcacttgtaaataaa

SEQ ID NO: 2010839 - DNA, 12 bp, Homo sapiens
tgtaaatccttt

SEQ ID NO: 2010840 - DNA, 20 bp, Homo sapiens
tgtaaatcctttttctttat

SEQ ID NO: 2010841 - DNA, 22 bp, Homo sapiens
tgtaaatcctttttctttataa

SEQ ID NO: 2010842 - DNA, 21 bp, Homo sapiens
tgtaaatgaccaagaaaaaga

SEQ ID NO: 2010843 - DNA, 23 bp, Homo sapiens
tgtaaatgaccaagaaaaagaaa

SEQ ID NO: 2010844 - DNA, 22 bp, Homo sapiens
tgtaaatgctgtcaactatgat

SEQ ID NO: 2010845 - DNA, 18 bp, Homo sapiens
tgtaaatggagcttgtac

SEQ ID NO: 2010846 - DNA, 20 bp, Homo sapiens
tgtaaatggagcttgtacat

SEQ ID NO: 2010847 - DNA, 15 bp, Homo sapiens
tgtaaattatttcat

SEQ ID NO: 2010848 - DNA, 15 bp, Homo sapiens
tgtaaatttggattt

SEQ ID NO: 2010849 - DNA, 23 bp, Homo sapiens
tgtcctgttattttttatttcca

SEQ ID NO: 2010850 - DNA, 14 bp, Homo sapiens
tgtccttcagagct

SEQ ID NO: 2010851 - DNA, 15 bp, Homo sapiens
tgtccttcagagctc

SEQ ID NO: 2010852 - DNA, 16 bp, Homo sapiens
tgtccttcagagctct

SEQ ID NO: 2010853 - DNA, 14 bp, Homo sapiens
tgtcctttgagaaa

SEQ ID NO: 2010854 - DNA, 22 bp, Homo sapiens
tgtcctttgagaaagaaataat

SEQ ID NO: 2010855 - DNA, 14 bp, Homo sapiens
tgtccttttaggaa

SEQ ID NO: 2010856 - DNA, 20 bp, Homo sapiens
tgtcgattagactggacagc

SEQ ID NO: 2010857 - DNA, 23 bp, Homo sapiens
tgtcgattagactggacagcttg

SEQ ID NO: 2010858 - DNA, 15 bp, Homo sapiens
tgtcgcccagtctgg

SEQ ID NO: 2010859 - DNA, 21 bp, Homo sapiens
tgtcgccccaggccctccctg

SEQ ID NO: 2010860 - DNA, 13 bp, Homo sapiens
tgtcgcctgcccc

SEQ ID NO: 2010861 - DNA, 16 bp, Homo sapiens
tgtcgtgtttacaaaa

SEQ ID NO: 2010862 - DNA, 19 bp, Homo sapiens
tgtctaaagagctttagtc

SEQ ID NO: 2010863 - DNA, 13 bp, Homo sapiens
tgtctacctcaca

SEQ ID NO: 2010864 - DNA, 14 bp, Homo sapiens
tgtctatgggactc

SEQ ID NO: 2010865 - DNA, 15 bp, Homo sapiens
tgtctatgggactca

SEQ ID NO: 2010866 - DNA, 16 bp, Homo sapiens
tgtctatgggactcaa

SEQ ID NO: 2010867 - DNA, 18 bp, Homo sapiens
tgtctattacctgttagt

SEQ ID NO: 2010868 - DNA, 19 bp, Homo sapiens
tgtctattcaaaatatcaa

SEQ ID NO: 2010869 - DNA, 19 bp, Homo sapiens
tgtctcaagagggcactgg

SEQ ID NO: 2010870 - DNA, 20 bp, Homo sapiens
tgtctcagcgaggtgtaaag

SEQ ID NO: 2010871 - DNA, 15 bp, Homo sapiens
tgtctcagtgctggt

SEQ ID NO: 2010872 - DNA, 22 bp, Homo sapiens
tgtctccactaaatgagctcct

SEQ ID NO: 2010873 - DNA, 23 bp, Homo sapiens
tgtctccactaaatgagctcctg

SEQ ID NO: 2010874 - DNA, 15 bp, Homo sapiens
tgtctccataatgcc

SEQ ID NO: 2010875 - DNA, 19 bp, Homo sapiens
tgtctccataatgccactg

SEQ ID NO: 2010876 - DNA, 22 bp, Homo sapiens
tgtctcctacctgctgctgcta

SEQ ID NO: 2010877 - DNA, 15 bp, Homo sapiens
tgtctcgagcgccct

SEQ ID NO: 2010878 - DNA, 17 bp, Homo sapiens
tgtctcgagcgccctgc

SEQ ID NO: 2010879 - DNA, 20 bp, Homo sapiens
tgtctcgtctcctgacatgt

SEQ ID NO: 2010880 - DNA, 15 bp, Homo sapiens
tgtctctagccgggc

SEQ ID NO: 2010881 - DNA, 22 bp, Homo sapiens
tgtctctagccgggccatgctt

SEQ ID NO: 2010882 - DNA, 21 bp, Homo sapiens
tgtctctcattctctttcttt

SEQ ID NO: 2010883 - DNA, 18 bp, Homo sapiens
tgtctctcccaccccggc

SEQ ID NO: 2010884 - DNA, 15 bp, Homo sapiens
tgtctctcttgcttt

SEQ ID NO: 2010885 - DNA, 20 bp, Homo sapiens
tgtctctgctcttgcctgca

SEQ ID NO: 2010886 - DNA, 19 bp, Homo sapiens
tgtctctgtccctcactgc

SEQ ID NO: 2010887 - DNA, 14 bp, Homo sapiens
tgtctcttgtagaa

SEQ ID NO: 2010888 - DNA, 18 bp, Homo sapiens
tgtctcttgtagaagatg

SEQ ID NO: 2010889 - DNA, 20 bp, Homo sapiens
tgtctgaagtcactgcacag

SEQ ID NO: 2010890 - DNA, 16 bp, Homo sapiens
tgtctgaggcctcatc

SEQ ID NO: 2010891 - DNA, 21 bp, Homo sapiens
tgtctgatcgttcaaagcatg

SEQ ID NO: 2010892 - DNA, 15 bp, Homo sapiens
tgtctgccagccagc

SEQ ID NO: 2010893 - DNA, 22 bp, Homo sapiens
tgtctgcccccgtcttctctcc

SEQ ID NO: 2010894 - DNA, 23 bp, Homo sapiens
tgtctgcttagtatctcatcaac

SEQ ID NO: 2010895 - DNA, 13 bp, Homo sapiens
tgtctgcttctgt

SEQ ID NO: 2010896 - DNA, 17 bp, Homo sapiens
tgtctggaaaagcactt

SEQ ID NO: 2010897 - DNA, 14 bp, Homo sapiens
tgtctggaagctga

SEQ ID NO: 2010898 - DNA, 17 bp, Homo sapiens
tgtctggaagctgagca

SEQ ID NO: 2010899 - DNA, 16 bp, Homo sapiens
tgtctggttttaacaa

SEQ ID NO: 2010900 - DNA, 13 bp, Homo sapiens
tgtctgtaagaga

SEQ ID NO: 2010901 - DNA, 18 bp, Homo sapiens
tgtctgtaagagaattct

SEQ ID NO: 2010902 - DNA, 19 bp, Homo sapiens
tgtctgtacacgtgtcctg

SEQ ID NO: 2010903 - DNA, 20 bp, Homo sapiens
tgtctgtacacgtgtcctgt

SEQ ID NO: 2010904 - DNA, 16 bp, Homo sapiens
tgtctgtctgtctgtc

SEQ ID NO: 2010905 - DNA, 13 bp, Homo sapiens
tgtctgtgcagct

SEQ ID NO: 2010906 - DNA, 15 bp, Homo sapiens
tgtctgtggattttt

SEQ ID NO: 2010907 - DNA, 14 bp, Homo sapiens
tgtcttcacaacag

SEQ ID NO: 2010908 - DNA, 19 bp, Homo sapiens
tgtcttcatttcattgtat

SEQ ID NO: 2010909 - DNA, 18 bp, Homo sapiens
tgtcttccaaccccagct

SEQ ID NO: 2010910 - DNA, 22 bp, Homo sapiens
tgtcttccaaccccagctggcc

SEQ ID NO: 2010911 - DNA, 22 bp, Homo sapiens
tgtcttcctagtatattagttt

SEQ ID NO: 2010912 - DNA, 11 bp, Homo sapiens
tgtcttctctc

SEQ ID NO: 2010913 - DNA, 21 bp, Homo sapiens
tgtcttctctcaaagggaagc

SEQ ID NO: 2010914 - DNA, 15 bp, Homo sapiens
tgtcttgcaatggca

SEQ ID NO: 2010915 - DNA, 20 bp, Homo sapiens
tgtcttgcaatggcagcctt

SEQ ID NO: 2010916 - DNA, 16 bp, Homo sapiens
tgtcttgccagccaga

SEQ ID NO: 2010917 - DNA, 16 bp, Homo sapiens
tgtcttgtacatgtgt

SEQ ID NO: 2010918 - DNA, 20 bp, Homo sapiens
tgtcttgtacatgtgtagcc

SEQ ID NO: 2010919 - DNA, 14 bp, Homo sapiens
tgtctttaaggaaa

SEQ ID NO: 2010920 - DNA, 21 bp, Homo sapiens
tgtctttaggcagcagctttt

SEQ ID NO: 2010921 - DNA, 19 bp, Homo sapiens
tgtctttcagcattaggct

SEQ ID NO: 2010922 - DNA, 16 bp, Homo sapiens
tgtcttttttcactac

SEQ ID NO: 2010923 - DNA, 19 bp, Homo sapiens
tgtgaaaatcatgaaaaga

SEQ ID NO: 2010924 - DNA, 16 bp, Homo sapiens
tgtgaaagtatgtgat

SEQ ID NO: 2010925 - DNA, 14 bp, Homo sapiens
tgtgaacatggact

SEQ ID NO: 2010926 - DNA, 16 bp, Homo sapiens
tgtgaaccaccacacc

SEQ ID NO: 2010927 - DNA, 19 bp, Homo sapiens
tgtgaaccaccacacccag

SEQ ID NO: 2010928 - DNA, 22 bp, Homo sapiens
tgtgaaccaccacacccagccc

SEQ ID NO: 2010929 - DNA, 13 bp, Homo sapiens
tgtgaacccagga

SEQ ID NO: 2010930 - DNA, 13 bp, Homo sapiens
tgtgaagaaatgg

SEQ ID NO: 2010931 - DNA, 13 bp, Homo sapiens
tgtgaagacccag

SEQ ID NO: 2010932 - DNA, 17 bp, Homo sapiens
tgtgaagacccagcagg

SEQ ID NO: 2010933 - DNA, 22 bp, Homo sapiens
tgtgaagttacacaattaattg

SEQ ID NO: 2010934 - DNA, 14 bp, Homo sapiens
tgtgaatcagaccc

SEQ ID NO: 2010935 - DNA, 18 bp, Homo sapiens
tgtgaattaaaaaagctc

SEQ ID NO: 2010936 - DNA, 22 bp, Homo sapiens
tgtgaattcccaggttggcctg

SEQ ID NO: 2010937 - DNA, 12 bp, Homo sapiens
tgtgacaaaatt

SEQ ID NO: 2010938 - DNA, 15 bp, Homo sapiens
tgtgacaacctttgt

SEQ ID NO: 2010939 - DNA, 18 bp, Homo sapiens
tgtgacaccagaataatg

SEQ ID NO: 2010940 - DNA, 16 bp, Homo sapiens
tgtgacagaatcttgt

SEQ ID NO: 2010941 - DNA, 20 bp, Homo sapiens
tgtgacagaatcttgtattt

SEQ ID NO: 2010942 - DNA, 21 bp, Homo sapiens
tgtgacaggaagcccaaggca

SEQ ID NO: 2010943 - DNA, 22 bp, Homo sapiens
tgtgacaggaagcccaaggcag

SEQ ID NO: 2010944 - DNA, 13 bp, Homo sapiens
tgtgaccaagtta

SEQ ID NO: 2010945 - DNA, 21 bp, Homo sapiens
tgtgaccacatacgtgttagg

SEQ ID NO: 2010946 - DNA, 21 bp, Homo sapiens
tgtgacccagatcctcacaac

SEQ ID NO: 2010947 - DNA, 15 bp, Homo sapiens
tgtgacctgctgagc

SEQ ID NO: 2010948 - DNA, 22 bp, Homo sapiens
tgtgacctgctgagctctgaga

SEQ ID NO: 2010949 - DNA, 14 bp, Homo sapiens
tgtgaccttctcta

SEQ ID NO: 2010950 - DNA, 15 bp, Homo sapiens
tgtgactccagcctg

SEQ ID NO: 2010951 - DNA, 12 bp, Homo sapiens
tgtgactctctt

SEQ ID NO: 2010952 - DNA, 13 bp, Homo sapiens
tgtgactgaaggg

SEQ ID NO: 2010953 - DNA, 15 bp, Homo sapiens
tgtgagaagaaatga

SEQ ID NO: 2010954 - DNA, 19 bp, Homo sapiens
tgtgagcaagcatttatgt

SEQ ID NO: 2010955 - DNA, 14 bp, Homo sapiens
tgtgagcagtgagt

SEQ ID NO: 2010956 - DNA, 12 bp, Homo sapiens
tgtgagcccctg

SEQ ID NO: 2010957 - DNA, 14 bp, Homo sapiens
tgtgagcccctggt

SEQ ID NO: 2010958 - DNA, 22 bp, Homo sapiens
tgtgagcccctggtcctgaggg

SEQ ID NO: 2010959 - DNA, 18 bp, Homo sapiens
tgtgaggcctggccaggc

SEQ ID NO: 2010960 - DNA, 15 bp, Homo sapiens
tgtgaggctgggcca

SEQ ID NO: 2010961 - DNA, 17 bp, Homo sapiens
tgtgaggctgggccagc

SEQ ID NO: 2010962 - DNA, 19 bp, Homo sapiens
tgtgaggctgggccagcct

SEQ ID NO: 2010963 - DNA, 15 bp, Homo sapiens
tgtgagtcaccaagc

SEQ ID NO: 2010964 - DNA, 20 bp, Homo sapiens
tgttacctttcccatgctga

SEQ ID NO: 2010965 - DNA, 14 bp, Homo sapiens
tgttactccacagc

SEQ ID NO: 2010966 - DNA, 21 bp, Homo sapiens
tgttactgattctcctgtcag

SEQ ID NO: 2010967 - DNA, 15 bp, Homo sapiens
tgttacttaaatagc

SEQ ID NO: 2010968 - DNA, 13 bp, Homo sapiens
tgttactttggaa

SEQ ID NO: 2010969 - DNA, 17 bp, Homo sapiens
tgttactttttagtctt

SEQ ID NO: 2010970 - DNA, 20 bp, Homo sapiens
tgttactttttagtctttta

SEQ ID NO: 2010971 - DNA, 19 bp, Homo sapiens
tgttaggaggctgcatgct

SEQ ID NO: 2010972 - DNA, 23 bp, Homo sapiens
tgttaggaggctgcatgctctgg

SEQ ID NO: 2010973 - DNA, 22 bp, Homo sapiens
tgttatcaaacaccaacataaa

SEQ ID NO: 2010974 - DNA, 14 bp, Homo sapiens
tgttatccacaagc

SEQ ID NO: 2010975 - DNA, 23 bp, Homo sapiens
tgttatcctgctagctgtagaaa

SEQ ID NO: 2010976 - DNA, 19 bp, Homo sapiens
tgttatgtatatagatgtg

SEQ ID NO: 2010977 - DNA, 15 bp, Homo sapiens
tgttattaatattgt

SEQ ID NO: 2010978 - DNA, 20 bp, Homo sapiens
tgttattatcctgcatttta

SEQ ID NO: 2010979 - DNA, 21 bp, Homo sapiens
tgttatttctatttttgtaga

SEQ ID NO: 2010980 - DNA, 18 bp, Homo sapiens
tgttattttcagtatttt

SEQ ID NO: 2010981 - DNA, 19 bp, Homo sapiens
tgttattttctttgaaatt

SEQ ID NO: 2010982 - DNA, 16 bp, Homo sapiens
tgttcacagccagact

SEQ ID NO: 2010983 - DNA, 16 bp, Homo sapiens
tgttcaccatcggcag

SEQ ID NO: 2010984 - DNA, 19 bp, Homo sapiens
tgttcacttttcctccctc

SEQ ID NO: 2010985 - DNA, 22 bp, Homo sapiens
tgttcagaaggttgctctagat

SEQ ID NO: 2010986 - DNA, 22 bp, Homo sapiens
tgttcagctccagctcaccagc

SEQ ID NO: 2010987 - DNA, 15 bp, Homo sapiens
tgttcatccaaggaa

SEQ ID NO: 2010988 - DNA, 14 bp, Homo sapiens
tgttcatggcagat

SEQ ID NO: 2010989 - DNA, 15 bp, Homo sapiens
tgttcattcactgca

SEQ ID NO: 2010990 - DNA, 13 bp, Homo sapiens
tgttcatttcctc

SEQ ID NO: 2010991 - DNA, 22 bp, Homo sapiens
tgttcccaagagcatcatgcct

SEQ ID NO: 2010992 - DNA, 13 bp, Homo sapiens
tgttcccacacac

SEQ ID NO: 2010993 - DNA, 16 bp, Homo sapiens
tgttcccattcttgca

SEQ ID NO: 2010994 - DNA, 18 bp, Homo sapiens
tgttcccccgctggcagc

SEQ ID NO: 2010995 - DNA, 14 bp, Homo sapiens
tgttccctctttct

SEQ ID NO: 2010996 - DNA, 16 bp, Homo sapiens
tgttccctgcaccctg

SEQ ID NO: 2010997 - DNA, 20 bp, Homo sapiens
tgttccctgcaccctggaaa

SEQ ID NO: 2010998 - DNA, 22 bp, Homo sapiens
tgttcccttgaccattggctgc

SEQ ID NO: 2010999 - DNA, 17 bp, Homo sapiens
tgttcctggctttgaca

SEQ ID NO: 2011000 - DNA, 20 bp, Homo sapiens
tgttcgtattctattcaaaa

SEQ ID NO: 2011001 - DNA, 18 bp, Homo sapiens
tgttctactcatatatat

SEQ ID NO: 2011002 - DNA, 14 bp, Homo sapiens
tgttctatatgcat

SEQ ID NO: 2011003 - DNA, 18 bp, Homo sapiens
tgttctcaatgcttttct

SEQ ID NO: 2011004 - DNA, 21 bp, Homo sapiens
tgttctcagctccgtcatctg

SEQ ID NO: 2011005 - DNA, 22 bp, Homo sapiens
tgttctccgggtgtggcctcag

SEQ ID NO: 2011006 - DNA, 22 bp, Homo sapiens
tgttctcctccattgctgttgt

SEQ ID NO: 2011007 - DNA, 16 bp, Homo sapiens
tgttctctgaggacac

SEQ ID NO: 2011008 - DNA, 18 bp, Homo sapiens
tgttctgaataatttctt

SEQ ID NO: 2011009 - DNA, 12 bp, Homo sapiens
tgttctgcactg

SEQ ID NO: 2011010 - DNA, 15 bp, Homo sapiens
tgttctgcactgaaa

SEQ ID NO: 2011011 - DNA, 20 bp, Homo sapiens
tgttctggacctccccctct

SEQ ID NO: 2011012 - DNA, 16 bp, Homo sapiens
tgttctggagctgctg

SEQ ID NO: 2011013 - DNA, 16 bp, Homo sapiens
tgttctggctttacat

SEQ ID NO: 2011014 - DNA, 14 bp, Homo sapiens
tgttctgggacaca

SEQ ID NO: 2011015 - DNA, 15 bp, Homo sapiens
tgttctgggacacag

SEQ ID NO: 2011016 - DNA, 23 bp, Homo sapiens
tgttctgggtgttgaccactcca

SEQ ID NO: 2011017 - DNA, 12 bp, Homo sapiens
tgttctgtattt

SEQ ID NO: 2011018 - DNA, 20 bp, Homo sapiens
tgttctgtgggcttggcctt

SEQ ID NO: 2011019 - DNA, 14 bp, Homo sapiens
tgttctgttgtaaa

SEQ ID NO: 2011020 - DNA, 13 bp, Homo sapiens
tgttctttgggga

SEQ ID NO: 2011021 - DNA, 21 bp, Homo sapiens
tgttgaaaatgagcctgtaat

SEQ ID NO: 2011022 - DNA, 14 bp, Homo sapiens
tgttgaaattatgt

SEQ ID NO: 2011023 - DNA, 21 bp, Homo sapiens
tgttgaaattatgtatgttta

SEQ ID NO: 2011024 - DNA, 22 bp, Homo sapiens
tgttgaatgcccacaggcaaat

SEQ ID NO: 2011025 - DNA, 13 bp, Homo sapiens
tgttgagacagag

SEQ ID NO: 2011026 - DNA, 14 bp, Homo sapiens
tgttgagtgttcat

SEQ ID NO: 2011027 - DNA, 18 bp, Homo sapiens
tgttgagttggacacact

SEQ ID NO: 2011028 - DNA, 19 bp, Homo sapiens
tgttgagttggacacactg

SEQ ID NO: 2011029 - DNA, 19 bp, Homo sapiens
tgttgataaattccactgg

SEQ ID NO: 2011030 - DNA, 22 bp, Homo sapiens
tgttgatcccacttcactgtga

SEQ ID NO: 2011031 - DNA, 20 bp, Homo sapiens
tgttgattgcaggaataagg

SEQ ID NO: 2011032 - DNA, 17 bp, Homo sapiens
tgttgatttgagaaatt

SEQ ID NO: 2011033 - DNA, 17 bp, Homo sapiens
tgttgcaccatctgctt

SEQ ID NO: 2011034 - DNA, 19 bp, Homo sapiens
tgttgcaccatctgcttgg

SEQ ID NO: 2011035 - DNA, 17 bp, Homo sapiens
tgttgcagagatttcct

SEQ ID NO: 2011036 - DNA, 20 bp, Homo sapiens
tgttgccaactaagccctcg

SEQ ID NO: 2011037 - DNA, 14 bp, Homo sapiens
tgttgccatagccc

SEQ ID NO: 2011038 - DNA, 16 bp, Homo sapiens
tgttgccatgaggcct

SEQ ID NO: 2011039 - DNA, 20 bp, Homo sapiens
tgttgccatttctctgctta

SEQ ID NO: 2011040 - DNA, 12 bp, Homo sapiens
tgttgcccaggc

SEQ ID NO: 2011041 - DNA, 15 bp, Homo sapiens
tgttgcccaggcagg

SEQ ID NO: 2011042 - DNA, 15 bp, Homo sapiens
tgttgcccaggctgg

SEQ ID NO: 2011043 - DNA, 19 bp, Homo sapiens
tgttgcccaggctggcctg

SEQ ID NO: 2011044 - DNA, 20 bp, Homo sapiens
tgttgcccaggctggcgtgc

SEQ ID NO: 2011045 - DNA, 12 bp, Homo sapiens
tgttgccctggg

SEQ ID NO: 2011046 - DNA, 15 bp, Homo sapiens
tgttgccttagcact

SEQ ID NO: 2011047 - DNA, 18 bp, Homo sapiens
tgttgcgcacatccctgc

SEQ ID NO: 2011048 - DNA, 14 bp, Homo sapiens
tgttgctcttggaa

SEQ ID NO: 2011049 - DNA, 15 bp, Homo sapiens
tgttgctcttggaaa

SEQ ID NO: 2011050 - DNA, 14 bp, Homo sapiens
tgttgctgaaacac

SEQ ID NO: 2011051 - DNA, 12 bp, Homo sapiens
tgttgctggact

SEQ ID NO: 2011052 - DNA, 16 bp, Homo sapiens
tgttgcttagtcactt

SEQ ID NO: 2011053 - DNA, 20 bp, Homo sapiens
tgttgcttagtcacttattt

SEQ ID NO: 2011054 - DNA, 21 bp, Homo sapiens
tgttggaaaagaatacagaaa

SEQ ID NO: 2011055 - DNA, 16 bp, Homo sapiens
tgttggaattttcaaa

SEQ ID NO: 2011056 - DNA, 16 bp, Homo sapiens
tgttggacagctgctt

SEQ ID NO: 2011057 - DNA, 18 bp, Homo sapiens
tgttggacagctgcttgt

SEQ ID NO: 2011058 - DNA, 13 bp, Homo sapiens
tgttgggaaaaag

SEQ ID NO: 2011059 - DNA, 23 bp, Homo sapiens
tgttgggaaaaaggcctctgtcc

SEQ ID NO: 2011060 - DNA, 16 bp, Homo sapiens
tgttgggaattgcatg

SEQ ID NO: 2011061 - DNA, 14 bp, Homo sapiens
tgttgtaaatattt

SEQ ID NO: 2011062 - DNA, 21 bp, Homo sapiens
tgttgtaaatatttatgtaaa

SEQ ID NO: 2011063 - DNA, 13 bp, Homo sapiens
tgttgtaaatgac

SEQ ID NO: 2011064 - DNA, 17 bp, Homo sapiens
tgttgtaaatgaccaag

SEQ ID NO: 2011065 - DNA, 21 bp, Homo sapiens
tgttgtaaatgaccaagaaaa

SEQ ID NO: 2011066 - DNA, 22 bp, Homo sapiens
tgttgtaaatgaccaagaaaaa

SEQ ID NO: 2011067 - DNA, 15 bp, Homo sapiens
tgttgtagaataata

SEQ ID NO: 2011068 - DNA, 13 bp, Homo sapiens
tgttgtcaagtat

SEQ ID NO: 2011069 - DNA, 12 bp, Homo sapiens
tgttgtgattaa

SEQ ID NO: 2011070 - DNA, 21 bp, Homo sapiens
tgttgtgattttgtacagaat

SEQ ID NO: 2011071 - DNA, 17 bp, Homo sapiens
tgttgttaatgaaaatg

SEQ ID NO: 2011072 - DNA, 11 bp, Homo sapiens
tgttgttattt

SEQ ID NO: 2011073 - DNA, 13 bp, Homo sapiens
tgttgttatttaa

SEQ ID NO: 2011074 - DNA, 14 bp, Homo sapiens
tgttgttcccacac

SEQ ID NO: 2011075 - DNA, 21 bp, Homo sapiens
tgttgttcccacacacaaacc

SEQ ID NO: 2011076 - DNA, 20 bp, Homo sapiens
tgttgttttgttttaaatac

SEQ ID NO: 2011077 - DNA, 20 bp, Homo sapiens
tgtttaaaaaaagtatatat

SEQ ID NO: 2011078 - DNA, 19 bp, Homo sapiens
tgtttaaactttgtgcctt

SEQ ID NO: 2011079 - DNA, 13 bp, Homo sapiens
ttaattttcagta

SEQ ID NO: 2011080 - DNA, 15 bp, Homo sapiens
ttacaaaaatagtag

SEQ ID NO: 2011081 - DNA, 19 bp, Homo sapiens
ttacaaaaggcagcccttt

SEQ ID NO: 2011082 - DNA, 18 bp, Homo sapiens
ttacaaatttttcctgca

SEQ ID NO: 2011083 - DNA, 18 bp, Homo sapiens
ttacaacagtaacacatc

SEQ ID NO: 2011084 - DNA, 15 bp, Homo sapiens
ttacaacattcaact

SEQ ID NO: 2011085 - DNA, 21 bp, Homo sapiens
ttacaagaattgtccatgtgc

SEQ ID NO: 2011086 - DNA, 20 bp, Homo sapiens
ttacaagcgtgagccactgc

SEQ ID NO: 2011087 - DNA, 16 bp, Homo sapiens
ttacaagtgtatatca

SEQ ID NO: 2011088 - DNA, 23 bp, Homo sapiens
ttacaataaaatcttgaaaatgc

SEQ ID NO: 2011089 - DNA, 13 bp, Homo sapiens
ttacaataaatat

SEQ ID NO: 2011090 - DNA, 14 bp, Homo sapiens
ttacaataaatatt

SEQ ID NO: 2011091 - DNA, 13 bp, Homo sapiens
ttacacaattaat

SEQ ID NO: 2011092 - DNA, 23 bp, Homo sapiens
ttacacattctcacaattgtaaa

SEQ ID NO: 2011093 - DNA, 18 bp, Homo sapiens
ttacactctctgtacaaa

SEQ ID NO: 2011094 - DNA, 14 bp, Homo sapiens
ttacactgtatttg

SEQ ID NO: 2011095 - DNA, 17 bp, Homo sapiens
ttacactgtatttgtat

SEQ ID NO: 2011096 - DNA, 20 bp, Homo sapiens
ttacagaacacgctttcaca

SEQ ID NO: 2011097 - DNA, 19 bp, Homo sapiens
ttacagatgagattccctc

SEQ ID NO: 2011098 - DNA, 22 bp, Homo sapiens
ttacagctttacacacacagat

SEQ ID NO: 2011099 - DNA, 15 bp, Homo sapiens
ttacaggtgtactat

SEQ ID NO: 2011100 - DNA, 17 bp, Homo sapiens
ttacaggtgtactatgg

SEQ ID NO: 2011101 - DNA, 15 bp, Homo sapiens
ttacagtaaataaat

SEQ ID NO: 2011102 - DNA, 16 bp, Homo sapiens
ttacagtaaataaatt

SEQ ID NO: 2011103 - DNA, 17 bp, Homo sapiens
ttacagtcaattttaca

SEQ ID NO: 2011104 - DNA, 17 bp, Homo sapiens
ttacagtgtagcttgcc

SEQ ID NO: 2011105 - DNA, 13 bp, Homo sapiens
ttacatctaatgc

SEQ ID NO: 2011106 - DNA, 12 bp, Homo sapiens
ttacatgaacac

SEQ ID NO: 2011107 - DNA, 10 bp, Homo sapiens
ttacatgacc

SEQ ID NO: 2011108 - DNA, 16 bp, Homo sapiens
ttacatgaccagaaaa

SEQ ID NO: 2011109 - DNA, 16 bp, Homo sapiens
ttacatgattcatttt

SEQ ID NO: 2011110 - DNA, 22 bp, Homo sapiens
ttacatgcaatttattaaaatg

SEQ ID NO: 2011111 - DNA, 16 bp, Homo sapiens
ttacatggctgtggtt

SEQ ID NO: 2011112 - DNA, 12 bp, Homo sapiens
ttacatgtttgc

SEQ ID NO: 2011113 - DNA, 13 bp, Homo sapiens
ttacatttttaca

SEQ ID NO: 2011114 - DNA, 16 bp, Homo sapiens
ttacatttttacaata

SEQ ID NO: 2011115 - DNA, 21 bp, Homo sapiens
ttacatttttacaataaataa

SEQ ID NO: 2011116 - DNA, 21 bp, Homo sapiens
ttaccaggcaccaaaagaagt

SEQ ID NO: 2011117 - DNA, 20 bp, Homo sapiens
ttacctaaacagatataaat

SEQ ID NO: 2011118 - DNA, 18 bp, Homo sapiens
ttacctaccacagtgtct

SEQ ID NO: 2011119 - DNA, 21 bp, Homo sapiens
ttacctaccacagtgtctgta

SEQ ID NO: 2011120 - DNA, 15 bp, Homo sapiens
ttacctcccctgcca

SEQ ID NO: 2011121 - DNA, 16 bp, Homo sapiens
ttacctcccctgccag

SEQ ID NO: 2011122 - DNA, 19 bp, Homo sapiens
ttacctcctgcccaggaga

SEQ ID NO: 2011123 - DNA, 15 bp, Homo sapiens
ttacctgcatgtgtt

SEQ ID NO: 2011124 - DNA, 19 bp, Homo sapiens
ttaccttagattagctctg

SEQ ID NO: 2011125 - DNA, 22 bp, Homo sapiens
ttaccttagattagctctggac

SEQ ID NO: 2011126 - DNA, 14 bp, Homo sapiens
ttaccttcaataaa

SEQ ID NO: 2011127 - DNA, 16 bp, Homo sapiens
ttaccttggtatatca

SEQ ID NO: 2011128 - DNA, 22 bp, Homo sapiens
ttacctttattaatgaactgtg

SEQ ID NO: 2011129 - DNA, 15 bp, Homo sapiens
ttacctttcccatgc

SEQ ID NO: 2011130 - DNA, 23 bp, Homo sapiens
ttacctttcccatgctgaattat

SEQ ID NO: 2011131 - DNA, 14 bp, Homo sapiens
ttacgctctctgtc

SEQ ID NO: 2011132 - DNA, 22 bp, Homo sapiens
ttactaaagcagtgttttcacc

SEQ ID NO: 2011133 - DNA, 19 bp, Homo sapiens
ttactaaattgtatacatt

SEQ ID NO: 2011134 - DNA, 17 bp, Homo sapiens
ttactaagccacaagaa

SEQ ID NO: 2011135 - DNA, 19 bp, Homo sapiens
ttactacttgttacctttc

SEQ ID NO: 2011136 - DNA, 21 bp, Homo sapiens
ttactacttgttacctttccc

SEQ ID NO: 2011137 - DNA, 18 bp, Homo sapiens
ttactattaagggaaagg

SEQ ID NO: 2011138 - DNA, 19 bp, Homo sapiens
ttactattttacttctaga

SEQ ID NO: 2011139 - DNA, 13 bp, Homo sapiens
ttactcagccctg

SEQ ID NO: 2011140 - DNA, 22 bp, Homo sapiens
ttactcagccctgggccccacc

SEQ ID NO: 2011141 - DNA, 21 bp, Homo sapiens
ttactctatgccccaaatata

SEQ ID NO: 2011142 - DNA, 14 bp, Homo sapiens
ttactctcaatgca

SEQ ID NO: 2011143 - DNA, 13 bp, Homo sapiens
ttactctgagccc

SEQ ID NO: 2011144 - DNA, 15 bp, Homo sapiens
ttactctgagcccag

SEQ ID NO: 2011145 - DNA, 17 bp, Homo sapiens
ttactcttatcattttt

SEQ ID NO: 2011146 - DNA, 13 bp, Homo sapiens
ttactgaaatgag

SEQ ID NO: 2011147 - DNA, 15 bp, Homo sapiens
ttactgacagaaatg

SEQ ID NO: 2011148 - DNA, 14 bp, Homo sapiens
ttactgagcttctc

SEQ ID NO: 2011149 - DNA, 12 bp, Homo sapiens
ttactgcctttg

SEQ ID NO: 2011150 - DNA, 12 bp, Homo sapiens
ttactggtttca

SEQ ID NO: 2011151 - DNA, 22 bp, Homo sapiens
ttactgtctggttttaacaatt

SEQ ID NO: 2011152 - DNA, 14 bp, Homo sapiens
ttacttaaatagca

SEQ ID NO: 2011153 - DNA, 15 bp, Homo sapiens
ttacttcctatcaag

SEQ ID NO: 2011154 - DNA, 18 bp, Homo sapiens
ttacttcgtgcgcaacaa

SEQ ID NO: 2011155 - DNA, 22 bp, Homo sapiens
ttacttcgtgtccgactcttct

SEQ ID NO: 2011156 - DNA, 15 bp, Homo sapiens
ttacttgaactttcc

SEQ ID NO: 2011157 - DNA, 13 bp, Homo sapiens
ttacttgcacaag

SEQ ID NO: 2011158 - DNA, 19 bp, Homo sapiens
ttacttgcattgaatatat

SEQ ID NO: 2011159 - DNA, 18 bp, Homo sapiens
ttactttaaaataaaaaa

SEQ ID NO: 2011160 - DNA, 21 bp, Homo sapiens
ttactttaatactcacctcct

SEQ ID NO: 2011161 - DNA, 19 bp, Homo sapiens
ttactttatccaatcctca

SEQ ID NO: 2011162 - DNA, 14 bp, Homo sapiens
ttactttgtgttca

SEQ ID NO: 2011163 - DNA, 17 bp, Homo sapiens
ttacttttaaacagtga

SEQ ID NO: 2011164 - DNA, 20 bp, Homo sapiens
ttacttttgttctgtatttt

SEQ ID NO: 2011165 - DNA, 14 bp, Homo sapiens
ttagaaaacattca

SEQ ID NO: 2011166 - DNA, 17 bp, Homo sapiens
ttagaaaacattcatcc

SEQ ID NO: 2011167 - DNA, 20 bp, Homo sapiens
ttagaaaagcaaagggtgct

SEQ ID NO: 2011168 - DNA, 23 bp, Homo sapiens
ttagaaacaaatttttttcttgt

SEQ ID NO: 2011169 - DNA, 15 bp, Homo sapiens
ttagaaatagacagt

SEQ ID NO: 2011170 - DNA, 17 bp, Homo sapiens
ttagaagagcctgactg

SEQ ID NO: 2011171 - DNA, 16 bp, Homo sapiens
ttagaagtcacacagt

SEQ ID NO: 2011172 - DNA, 19 bp, Homo sapiens
ttagaattttagaagagat

SEQ ID NO: 2011173 - DNA, 15 bp, Homo sapiens
ttagacctcagcctg

SEQ ID NO: 2011174 - DNA, 21 bp, Homo sapiens
ttagactagttgaacatctca

SEQ ID NO: 2011175 - DNA, 15 bp, Homo sapiens
ttagactggacagct

SEQ ID NO: 2011176 - DNA, 19 bp, Homo sapiens
ttagactggacagcttgtg

SEQ ID NO: 2011177 - DNA, 16 bp, Homo sapiens
ttagagaatatatttt

SEQ ID NO: 2011178 - DNA, 19 bp, Homo sapiens
ttagagaatatatttttga

SEQ ID NO: 2011179 - DNA, 18 bp, Homo sapiens
ttagaggaaaaaaatgac

SEQ ID NO: 2011180 - DNA, 18 bp, Homo sapiens
ttagagggaggagaatga

SEQ ID NO: 2011181 - DNA, 21 bp, Homo sapiens
ttagagtatgcaagaagaata

SEQ ID NO: 2011182 - DNA, 20 bp, Homo sapiens
ttagatcccatgtcacctca

SEQ ID NO: 2011183 - DNA, 17 bp, Homo sapiens
ttagattagctctggac

SEQ ID NO: 2011184 - DNA, 13 bp, Homo sapiens
ttagattccagga

SEQ ID NO: 2011185 - DNA, 19 bp, Homo sapiens
ttagcaaagagttaatata

SEQ ID NO: 2011186 - DNA, 20 bp, Homo sapiens
ttagcaaagagttaatatat

SEQ ID NO: 2011187 - DNA, 22 bp, Homo sapiens
ttagcaaagatatctcatctct

SEQ ID NO: 2011188 - DNA, 21 bp, Homo sapiens
ttagcagctcttcccctttcc

SEQ ID NO: 2011189 - DNA, 13 bp, Homo sapiens
ttagcccaagagg

SEQ ID NO: 2011190 - DNA, 19 bp, Homo sapiens
ttagcccaagaggtctgag

SEQ ID NO: 2011191 - DNA, 21 bp, Homo sapiens
ttagcccaagaggtctgagcc

SEQ ID NO: 2011192 - DNA, 10 bp, Homo sapiens
ttagcctgga

SEQ ID NO: 2011193 - DNA, 15 bp, Homo sapiens
ttagccttctctgtt

SEQ ID NO: 2011194 - DNA, 17 bp, Homo sapiens
ttcagatcagtgcttga

SEQ ID NO: 2011195 - DNA, 17 bp, Homo sapiens
ttcagatcgtattaatt

SEQ ID NO: 2011196 - DNA, 22 bp, Homo sapiens
ttcagattccacacaaaatgtc

SEQ ID NO: 2011197 - DNA, 21 bp, Homo sapiens
ttcagattcccagagcaaaat

SEQ ID NO: 2011198 - DNA, 15 bp, Homo sapiens
ttcagcacaccccaa

SEQ ID NO: 2011199 - DNA, 17 bp, Homo sapiens
ttcagcaccctgggtgc

SEQ ID NO: 2011200 - DNA, 18 bp, Homo sapiens
ttcagcattaggctttta

SEQ ID NO: 2011201 - DNA, 19 bp, Homo sapiens
ttcagcattattcctccag

SEQ ID NO: 2011202 - DNA, 18 bp, Homo sapiens
ttcagccacaaagtagtt

SEQ ID NO: 2011203 - DNA, 15 bp, Homo sapiens
ttcagcccctcctct

SEQ ID NO: 2011204 - DNA, 18 bp, Homo sapiens
ttcagcccctcctctgcc

SEQ ID NO: 2011205 - DNA, 19 bp, Homo sapiens
ttcagcccctcctctgcca

SEQ ID NO: 2011206 - DNA, 20 bp, Homo sapiens
ttcagcctagccgacctcag

SEQ ID NO: 2011207 - DNA, 19 bp, Homo sapiens
ttcagcctggccatcccca

SEQ ID NO: 2011208 - DNA, 13 bp, Homo sapiens
ttcagccttggga

SEQ ID NO: 2011209 - DNA, 22 bp, Homo sapiens
ttcagctccagctcaccagccc

SEQ ID NO: 2011210 - DNA, 13 bp, Homo sapiens
ttcagctcccata

SEQ ID NO: 2011211 - DNA, 15 bp, Homo sapiens
ttcagctctctgtat

SEQ ID NO: 2011212 - DNA, 16 bp, Homo sapiens
ttcaggaaaaggcctg

SEQ ID NO: 2011213 - DNA, 20 bp, Homo sapiens
ttcaggagagagttgaacct

SEQ ID NO: 2011214 - DNA, 17 bp, Homo sapiens
ttcaggagggtccccag

SEQ ID NO: 2011215 - DNA, 12 bp, Homo sapiens
ttcaggcactga

SEQ ID NO: 2011216 - DNA, 15 bp, Homo sapiens
ttcaggcattttgtt

SEQ ID NO: 2011217 - DNA, 15 bp, Homo sapiens
ttcaggctcttctcc

SEQ ID NO: 2011218 - DNA, 20 bp, Homo sapiens
ttcagggaaatggagggtgg

SEQ ID NO: 2011219 - DNA, 16 bp, Homo sapiens
ttcagggaagcaggca

SEQ ID NO: 2011220 - DNA, 16 bp, Homo sapiens
ttcagggccagaagga

SEQ ID NO: 2011221 - DNA, 22 bp, Homo sapiens
ttcaggggggttgtgaggcctg

SEQ ID NO: 2011222 - DNA, 16 bp, Homo sapiens
ttcagggtatcccaga

SEQ ID NO: 2011223 - DNA, 14 bp, Homo sapiens
ttcagggttggccc

SEQ ID NO: 2011224 - DNA, 16 bp, Homo sapiens
ttcagggttggcccct

SEQ ID NO: 2011225 - DNA, 13 bp, Homo sapiens
ttcaggtaggccc

SEQ ID NO: 2011226 - DNA, 14 bp, Homo sapiens
ttcaggtaggccct

SEQ ID NO: 2011227 - DNA, 14 bp, Homo sapiens
ttcaggtgaaaatg

SEQ ID NO: 2011228 - DNA, 21 bp, Homo sapiens
ttcaggtggagagcactagaa

SEQ ID NO: 2011229 - DNA, 20 bp, Homo sapiens
ttcaggtgtttagttgcaga

SEQ ID NO: 2011230 - DNA, 19 bp, Homo sapiens
ttcaggttttgtaaagatg

SEQ ID NO: 2011231 - DNA, 14 bp, Homo sapiens
ttcagtaggaactg

SEQ ID NO: 2011232 - DNA, 21 bp, Homo sapiens
ttcagtaggctttatgctgtg

SEQ ID NO: 2011233 - DNA, 21 bp, Homo sapiens
ttcagtaggtttgtgtggatg

SEQ ID NO: 2011234 - DNA, 20 bp, Homo sapiens
ttcagtattttggagaaatt

SEQ ID NO: 2011235 - DNA, 12 bp, Homo sapiens
ttcagtccgcct

SEQ ID NO: 2011236 - DNA, 21 bp, Homo sapiens
ttcagtcctggtctgctcagg

SEQ ID NO: 2011237 - DNA, 16 bp, Homo sapiens
ttcagtgagacacaga

SEQ ID NO: 2011238 - DNA, 10 bp, Homo sapiens
ttcagtgccc

SEQ ID NO: 2011239 - DNA, 13 bp, Homo sapiens
ttcagtgctgtgg

SEQ ID NO: 2011240 - DNA, 21 bp, Homo sapiens
ttcagtgctgtggcctgggca

SEQ ID NO: 2011241 - DNA, 13 bp, Homo sapiens
ttcagtggcagct

SEQ ID NO: 2011242 - DNA, 15 bp, Homo sapiens
ttcagtggcagctgc

SEQ ID NO: 2011243 - DNA, 16 bp, Homo sapiens
ttcagtggcagctgct

SEQ ID NO: 2011244 - DNA, 14 bp, Homo sapiens
ttcagtgggagaaa

SEQ ID NO: 2011245 - DNA, 17 bp, Homo sapiens
ttcagttcctctttgca

SEQ ID NO: 2011246 - DNA, 23 bp, Homo sapiens
ttcagttcctctttgcatggaat

SEQ ID NO: 2011247 - DNA, 16 bp, Homo sapiens
ttcagttgatcactgg

SEQ ID NO: 2011248 - DNA, 19 bp, Homo sapiens
ttcagttggctgacttcca

SEQ ID NO: 2011249 - DNA, 19 bp, Homo sapiens
ttcagtttcaattcagtgc

SEQ ID NO: 2011250 - DNA, 16 bp, Homo sapiens
ttcagtttgtttactt

SEQ ID NO: 2011251 - DNA, 13 bp, Homo sapiens
ttcataaactgag

SEQ ID NO: 2011252 - DNA, 21 bp, Homo sapiens
ttcataaactgagcctctttt

SEQ ID NO: 2011253 - DNA, 15 bp, Homo sapiens
ttcataacctagcct

SEQ ID NO: 2011254 - DNA, 16 bp, Homo sapiens
ttcataattagaacaa

SEQ ID NO: 2011255 - DNA, 20 bp, Homo sapiens
ttcataattagaacaatagc

SEQ ID NO: 2011256 - DNA, 20 bp, Homo sapiens
ttcataggcggtcatgtgtg

SEQ ID NO: 2011257 - DNA, 13 bp, Homo sapiens
ttcatatccagct

SEQ ID NO: 2011258 - DNA, 12 bp, Homo sapiens
ttcatcaatttt

SEQ ID NO: 2011259 - DNA, 20 bp, Homo sapiens
ttcatcaatttttatacata

SEQ ID NO: 2011260 - DNA, 21 bp, Homo sapiens
ttcatcaatttttatacatat

SEQ ID NO: 2011261 - DNA, 13 bp, Homo sapiens
ttcatccaaggaa

SEQ ID NO: 2011262 - DNA, 22 bp, Homo sapiens
ttcatccagttgcaataaaata

SEQ ID NO: 2011263 - DNA, 14 bp, Homo sapiens
ttcatcccagcccc

SEQ ID NO: 2011264 - DNA, 16 bp, Homo sapiens
ttcatcccagccccaa

SEQ ID NO: 2011265 - DNA, 18 bp, Homo sapiens
ttcatccctatttatagt

SEQ ID NO: 2011266 - DNA, 17 bp, Homo sapiens
ttcatcctggcctcctt

SEQ ID NO: 2011267 - DNA, 19 bp, Homo sapiens
ttcatcctggcctcctttt

SEQ ID NO: 2011268 - DNA, 17 bp, Homo sapiens
ttcatctatttctgaga

SEQ ID NO: 2011269 - DNA, 17 bp, Homo sapiens
ttcatctgggaggcaga

SEQ ID NO: 2011270 - DNA, 18 bp, Homo sapiens
ttcatctgttgttttgtt

SEQ ID NO: 2011271 - DNA, 23 bp, Homo sapiens
ttcatcttcaaccttaaggactt

SEQ ID NO: 2011272 - DNA, 22 bp, Homo sapiens
ttcatgaaaatagctctttcag

SEQ ID NO: 2011273 - DNA, 18 bp, Homo sapiens
ttcatgagtggatggatg

SEQ ID NO: 2011274 - DNA, 12 bp, Homo sapiens
ttcatgataatg

SEQ ID NO: 2011275 - DNA, 15 bp, Homo sapiens
ttcatgcaatgacat

SEQ ID NO: 2011276 - DNA, 21 bp, Homo sapiens
ttcatgccaattagcaattga

SEQ ID NO: 2011277 - DNA, 16 bp, Homo sapiens
ttcatgccatctgttt

SEQ ID NO: 2011278 - DNA, 12 bp, Homo sapiens
ttcatgcctcag

SEQ ID NO: 2011279 - DNA, 14 bp, Homo sapiens
ttcatgcctcagtt

SEQ ID NO: 2011280 - DNA, 17 bp, Homo sapiens
ttcatgcctcagtttcc

SEQ ID NO: 2011281 - DNA, 18 bp, Homo sapiens
ttcatgctatctctgtgt

SEQ ID NO: 2011282 - DNA, 16 bp, Homo sapiens
ttcatgtaaccaagag

SEQ ID NO: 2011283 - DNA, 15 bp, Homo sapiens
ttcatgtaataaatc

SEQ ID NO: 2011284 - DNA, 18 bp, Homo sapiens
ttcatgtaataaatctga

SEQ ID NO: 2011285 - DNA, 16 bp, Homo sapiens
ttcatgtacagcatgc

SEQ ID NO: 2011286 - DNA, 18 bp, Homo sapiens
ttcatgttttgtgactat

SEQ ID NO: 2011287 - DNA, 16 bp, Homo sapiens
ttcattaaattttcta

SEQ ID NO: 2011288 - DNA, 19 bp, Homo sapiens
ttcattcttgaaagctgtg

SEQ ID NO: 2011289 - DNA, 17 bp, Homo sapiens
ttcattgtataaaaata

SEQ ID NO: 2011290 - DNA, 15 bp, Homo sapiens
ttcatttaaaatgat

SEQ ID NO: 2011291 - DNA, 12 bp, Homo sapiens
ttcatttcattg

SEQ ID NO: 2011292 - DNA, 13 bp, Homo sapiens
ttcatttcattgt

SEQ ID NO: 2011293 - DNA, 15 bp, Homo sapiens
ttcattttcagagtg

SEQ ID NO: 2011294 - DNA, 21 bp, Homo sapiens
ttcatttttgttatccttttt

SEQ ID NO: 2011295 - DNA, 16 bp, Homo sapiens
ttccaaaacctaaaga

SEQ ID NO: 2011296 - DNA, 16 bp, Homo sapiens
ttccaaacctgacaga

SEQ ID NO: 2011297 - DNA, 20 bp, Homo sapiens
ttccaaacttctaaatgttg

SEQ ID NO: 2011298 - DNA, 20 bp, Homo sapiens
ttccaaagcacattgaaaga

SEQ ID NO: 2011299 - DNA, 11 bp, Homo sapiens
ttccaaagctc

SEQ ID NO: 2011300 - DNA, 21 bp, Homo sapiens
ttccaaatgaatgttgtctgt

SEQ ID NO: 2011301 - DNA, 23 bp, Homo sapiens
ttccaacagctcaagtcttccct

SEQ ID NO: 2011302 - DNA, 14 bp, Homo sapiens
ttccaacagtgagt

SEQ ID NO: 2011303 - DNA, 13 bp, Homo sapiens
ttccaaccccagc

SEQ ID NO: 2011304 - DNA, 12 bp, Homo sapiens
ttccaagagctg

SEQ ID NO: 2011305 - DNA, 17 bp, Homo sapiens
ttccaagcccttttaca

SEQ ID NO: 2011306 - DNA, 16 bp, Homo sapiens
ttccaaggagttccat

SEQ ID NO: 2011307 - DNA, 22 bp, Homo sapiens
ttccaagggtcttcctcctaaa

SEQ ID NO: 2011308 - DNA, 19 bp, Homo sapiens
ttccaagttcctgcactcc

SEQ ID NO: 2011309 - DNA, 13 bp, Homo sapiens
ttgaaagaccttc

SEQ ID NO: 2011310 - DNA, 12 bp, Homo sapiens
ttgaaagctgtg

SEQ ID NO: 2011311 - DNA, 21 bp, Homo sapiens
ttgaaagtgaataaacttcag

SEQ ID NO: 2011312 - DNA, 21 bp, Homo sapiens
ttgaaatcagaagcctacttt

SEQ ID NO: 2011313 - DNA, 13 bp, Homo sapiens
ttgaaatcttaaa

SEQ ID NO: 2011314 - DNA, 14 bp, Homo sapiens
ttgaaattatatct

SEQ ID NO: 2011315 - DNA, 21 bp, Homo sapiens
ttgaaattatgtatgtttaca

SEQ ID NO: 2011316 - DNA, 16 bp, Homo sapiens
ttgaaatttactgtga

SEQ ID NO: 2011317 - DNA, 14 bp, Homo sapiens
ttgaaccttggtaa

SEQ ID NO: 2011318 - DNA, 16 bp, Homo sapiens
ttgaactcctggcctc

SEQ ID NO: 2011319 - DNA, 18 bp, Homo sapiens
ttgaacttaaataaatgt

SEQ ID NO: 2011320 - DNA, 18 bp, Homo sapiens
ttgaactttccaaaacct

SEQ ID NO: 2011321 - DNA, 14 bp, Homo sapiens
ttgaagaaacagat

SEQ ID NO: 2011322 - DNA, 19 bp, Homo sapiens
ttgaagaaacagataccat

SEQ ID NO: 2011323 - DNA, 21 bp, Homo sapiens
ttgaagagagatatatctgaa

SEQ ID NO: 2011324 - DNA, 17 bp, Homo sapiens
ttgaagaggggaggggc

SEQ ID NO: 2011325 - DNA, 20 bp, Homo sapiens
ttgaagcctttttttagtaa

SEQ ID NO: 2011326 - DNA, 18 bp, Homo sapiens
ttgaaggagaaaatgcat

SEQ ID NO: 2011327 - DNA, 13 bp, Homo sapiens
ttgaaggcagtct

SEQ ID NO: 2011328 - DNA, 18 bp, Homo sapiens
ttgaagtggccagatgag

SEQ ID NO: 2011329 - DNA, 21 bp, Homo sapiens
ttgaataaagcctgcttttta

SEQ ID NO: 2011330 - DNA, 13 bp, Homo sapiens
ttgaataaagtct

SEQ ID NO: 2011331 - DNA, 15 bp, Homo sapiens
ttgaataaagtctga

SEQ ID NO: 2011332 - DNA, 19 bp, Homo sapiens
ttgaataaagtctgagtgg

SEQ ID NO: 2011333 - DNA, 21 bp, Homo sapiens
ttgaatacccccagagacctt

SEQ ID NO: 2011334 - DNA, 18 bp, Homo sapiens
ttgaatataaacactata

SEQ ID NO: 2011335 - DNA, 11 bp, Homo sapiens
ttgaatatatc

SEQ ID NO: 2011336 - DNA, 19 bp, Homo sapiens
ttgaatatattataatctt

SEQ ID NO: 2011337 - DNA, 14 bp, Homo sapiens
ttgaatatcattaa

SEQ ID NO: 2011338 - DNA, 23 bp, Homo sapiens
ttgaatctgattggacattttct

SEQ ID NO: 2011339 - DNA, 18 bp, Homo sapiens
ttgaatctgttactgaaa

SEQ ID NO: 2011340 - DNA, 21 bp, Homo sapiens
ttgaatctgttactgaaatga

SEQ ID NO: 2011341 - DNA, 17 bp, Homo sapiens
ttgaatgacaacagaag

SEQ ID NO: 2011342 - DNA, 18 bp, Homo sapiens
ttgaatgacaacagaagc

SEQ ID NO: 2011343 - DNA, 16 bp, Homo sapiens
ttgaatgcaaaccata

SEQ ID NO: 2011344 - DNA, 23 bp, Homo sapiens
ttgaatgctttttgaatgttatt

SEQ ID NO: 2011345 - DNA, 23 bp, Homo sapiens
ttgaatgttatttgttattttca

SEQ ID NO: 2011346 - DNA, 16 bp, Homo sapiens
ttgaatgtttatgttc

SEQ ID NO: 2011347 - DNA, 13 bp, Homo sapiens
ttgaattctggag

SEQ ID NO: 2011348 - DNA, 16 bp, Homo sapiens
ttgaatttcctatctg

SEQ ID NO: 2011349 - DNA, 14 bp, Homo sapiens
ttgacaacagactg

SEQ ID NO: 2011350 - DNA, 18 bp, Homo sapiens
ttgacaaggtagacatgg

SEQ ID NO: 2011351 - DNA, 14 bp, Homo sapiens
ttgacacacagcac

SEQ ID NO: 2011352 - DNA, 16 bp, Homo sapiens
ttgacacacagcactc

SEQ ID NO: 2011353 - DNA, 14 bp, Homo sapiens
ttgacagaacactg

SEQ ID NO: 2011354 - DNA, 16 bp, Homo sapiens
ttgacagaacactgtc

SEQ ID NO: 2011355 - DNA, 12 bp, Homo sapiens
ttgacagggcac

SEQ ID NO: 2011356 - DNA, 15 bp, Homo sapiens
ttgacataaagttga

SEQ ID NO: 2011357 - DNA, 11 bp, Homo sapiens
ttgacattcct

SEQ ID NO: 2011358 - DNA, 13 bp, Homo sapiens
ttgaccactccag

SEQ ID NO: 2011359 - DNA, 23 bp, Homo sapiens
ttgaccagacctagacctgggcc

SEQ ID NO: 2011360 - DNA, 14 bp, Homo sapiens
ttgacccactcaca

SEQ ID NO: 2011361 - DNA, 20 bp, Homo sapiens
ttgacccactcacacttgga

SEQ ID NO: 2011362 - DNA, 19 bp, Homo sapiens
ttgacccctttcccccacc

SEQ ID NO: 2011363 - DNA, 15 bp, Homo sapiens
ttgacctcaggtgat

SEQ ID NO: 2011364 - DNA, 17 bp, Homo sapiens
ttgaccttcccaaggtt

SEQ ID NO: 2011365 - DNA, 15 bp, Homo sapiens
ttgacgcatcctgca

SEQ ID NO: 2011366 - DNA, 15 bp, Homo sapiens
ttgacgccaccataa

SEQ ID NO: 2011367 - DNA, 19 bp, Homo sapiens
ttgacgggaggcctcagtt

SEQ ID NO: 2011368 - DNA, 13 bp, Homo sapiens
ttgactatcacat

SEQ ID NO: 2011369 - DNA, 14 bp, Homo sapiens
ttgactatcacata

SEQ ID NO: 2011370 - DNA, 19 bp, Homo sapiens
ttgactatcacatacaatt

SEQ ID NO: 2011371 - DNA, 20 bp, Homo sapiens
ttgactatcacatacaattt

SEQ ID NO: 2011372 - DNA, 20 bp, Homo sapiens
ttgactcttttatctgagtt

SEQ ID NO: 2011373 - DNA, 21 bp, Homo sapiens
ttgactcttttgccattaaac

SEQ ID NO: 2011374 - DNA, 20 bp, Homo sapiens
ttgacttgacagaacactgt

SEQ ID NO: 2011375 - DNA, 23 bp, Homo sapiens
ttgagaaaccttattgtacctct

SEQ ID NO: 2011376 - DNA, 19 bp, Homo sapiens
ttgagaaggaaaattttag

SEQ ID NO: 2011377 - DNA, 19 bp, Homo sapiens
ttgagaagttttgtacaga

SEQ ID NO: 2011378 - DNA, 11 bp, Homo sapiens
ttgagacagag

SEQ ID NO: 2011379 - DNA, 13 bp, Homo sapiens
ttgagaccagcct

SEQ ID NO: 2011380 - DNA, 16 bp, Homo sapiens
ttgagaccagcctggc

SEQ ID NO: 2011381 - DNA, 22 bp, Homo sapiens
ttgagacggcgcacctatcacc

SEQ ID NO: 2011382 - DNA, 19 bp, Homo sapiens
ttgagaggccctggggttc

SEQ ID NO: 2011383 - DNA, 13 bp, Homo sapiens
ttgagagtgtgac

SEQ ID NO: 2011384 - DNA, 18 bp, Homo sapiens
ttgagataatatctgtga

SEQ ID NO: 2011385 - DNA, 15 bp, Homo sapiens
ttgagcaattcattt

SEQ ID NO: 2011386 - DNA, 16 bp, Homo sapiens
ttgagcaattcatttc

SEQ ID NO: 2011387 - DNA, 20 bp, Homo sapiens
ttgagcaattcatttcactt

SEQ ID NO: 2011388 - DNA, 22 bp, Homo sapiens
ttgagcaattcatttcacttta

SEQ ID NO: 2011389 - DNA, 19 bp, Homo sapiens
ttgagcatgcacagctgct

SEQ ID NO: 2011390 - DNA, 22 bp, Homo sapiens
ttgagccaagcttcaaccctca

SEQ ID NO: 2011391 - DNA, 12 bp, Homo sapiens
ttgagctgtttt

SEQ ID NO: 2011392 - DNA, 18 bp, Homo sapiens
ttgagctgttttccctga

SEQ ID NO: 2011393 - DNA, 13 bp, Homo sapiens
ttgaggagtgtga

SEQ ID NO: 2011394 - DNA, 21 bp, Homo sapiens
ttgaggcaaaggccagcagca

SEQ ID NO: 2011395 - DNA, 14 bp, Homo sapiens
ttgaggctgcagcg

SEQ ID NO: 2011396 - DNA, 15 bp, Homo sapiens
ttgaggggctcctgg

SEQ ID NO: 2011397 - DNA, 19 bp, Homo sapiens
ttgaggtggtgccttctca

SEQ ID NO: 2011398 - DNA, 20 bp, Homo sapiens
ttgagtgcaacaagagcaaa

SEQ ID NO: 2011399 - DNA, 18 bp, Homo sapiens
ttgagttggacacactgt

SEQ ID NO: 2011400 - DNA, 17 bp, Homo sapiens
ttgagtttaagtctctg

SEQ ID NO: 2011401 - DNA, 23 bp, Homo sapiens
ttgagtttaagtctctgactctt

SEQ ID NO: 2011402 - DNA, 17 bp, Homo sapiens
ttgataaagatttttta

SEQ ID NO: 2011403 - DNA, 22 bp, Homo sapiens
ttgataaagattttttaataat

SEQ ID NO: 2011404 - DNA, 18 bp, Homo sapiens
ttgataaattccactgga

SEQ ID NO: 2011405 - DNA, 14 bp, Homo sapiens
ttgatagctttatt

SEQ ID NO: 2011406 - DNA, 20 bp, Homo sapiens
ttgatatacttttttcttat

SEQ ID NO: 2011407 - DNA, 21 bp, Homo sapiens
ttgatatatttcattctctta

SEQ ID NO: 2011408 - DNA, 16 bp, Homo sapiens
ttgatatgaaaaatat

SEQ ID NO: 2011409 - DNA, 16 bp, Homo sapiens
ttgatatgagtataca

SEQ ID NO: 2011410 - DNA, 22 bp, Homo sapiens
ttgatccacttcttaatgcttt

SEQ ID NO: 2011411 - DNA, 18 bp, Homo sapiens
ttgatgaaattcttgaag

SEQ ID NO: 2011412 - DNA, 14 bp, Homo sapiens
ttgatgaagcccgt

SEQ ID NO: 2011413 - DNA, 22 bp, Homo sapiens
ttgatgaagcccgtgtcctgcc

SEQ ID NO: 2011414 - DNA, 14 bp, Homo sapiens
ttgatggagatatt

SEQ ID NO: 2011415 - DNA, 21 bp, Homo sapiens
ttgatgtcatgtacttcctgt

SEQ ID NO: 2011416 - DNA, 14 bp, Homo sapiens
ttgatgtttccaga

SEQ ID NO: 2011417 - DNA, 14 bp, Homo sapiens
ttgattaatttgag

SEQ ID NO: 2011418 - DNA, 11 bp, Homo sapiens
ttgattacata

SEQ ID NO: 2011419 - DNA, 13 bp, Homo sapiens
ttgattatgcata

SEQ ID NO: 2011420 - DNA, 12 bp, Homo sapiens
ttgattattctg

SEQ ID NO: 2011421 - DNA, 13 bp, Homo sapiens
ttgattatttcct

SEQ ID NO: 2011422 - DNA, 17 bp, Homo sapiens
ttgattgtaaaaacaaa

SEQ ID NO: 2011423 - DNA, 18 bp, Homo sapiens
ttgatttatatgtgtaat

SEQ ID NO: 2011424 - DNA, 22 bp, Homo sapiens
tttaagggtttgtggaaaatga

SEQ ID NO: 2011425 - DNA, 13 bp, Homo sapiens
tttaagtatttat

SEQ ID NO: 2011426 - DNA, 20 bp, Homo sapiens
tttaagtatttatatattta

SEQ ID NO: 2011427 - DNA, 16 bp, Homo sapiens
tttaagttattttaaa

SEQ ID NO: 2011428 - DNA, 18 bp, Homo sapiens
tttaatagcaaagaattg

SEQ ID NO: 2011429 - DNA, 21 bp, Homo sapiens
tttaatatctgagaagtgtat

SEQ ID NO: 2011430 - DNA, 18 bp, Homo sapiens
tttaatatttaaacagca

SEQ ID NO: 2011431 - DNA, 20 bp, Homo sapiens
tttaatgactttttataatg

SEQ ID NO: 2011432 - DNA, 17 bp, Homo sapiens
tttaatgtgtattgaag

SEQ ID NO: 2011433 - DNA, 16 bp, Homo sapiens
tttaatgtttgattta

SEQ ID NO: 2011434 - DNA, 14 bp, Homo sapiens
tttaatgttttctg

SEQ ID NO: 2011435 - DNA, 23 bp, Homo sapiens
tttaattaatatgttcattaaat

SEQ ID NO: 2011436 - DNA, 23 bp, Homo sapiens
tttaattattatttatatatgta

SEQ ID NO: 2011437 - DNA, 14 bp, Homo sapiens
tttaattgattatt

SEQ ID NO: 2011438 - DNA, 16 bp, Homo sapiens
tttaattgcatttaaa

SEQ ID NO: 2011439 - DNA, 23 bp, Homo sapiens
tttaatttatatttgaaatttta

SEQ ID NO: 2011440 - DNA, 19 bp, Homo sapiens
tttacaaatttaattttgc

SEQ ID NO: 2011441 - DNA, 19 bp, Homo sapiens
tttacaaatttttcctgca

SEQ ID NO: 2011442 - DNA, 15 bp, Homo sapiens
tttacaagtgtatat

SEQ ID NO: 2011443 - DNA, 19 bp, Homo sapiens
tttacaataaatattctgc

SEQ ID NO: 2011444 - DNA, 20 bp, Homo sapiens
tttacagtaaataaattgtt

SEQ ID NO: 2011445 - DNA, 14 bp, Homo sapiens
tttacatgaacaca

SEQ ID NO: 2011446 - DNA, 18 bp, Homo sapiens
tttacatgaattgcattt

SEQ ID NO: 2011447 - DNA, 18 bp, Homo sapiens
tttaccagggatgtagat

SEQ ID NO: 2011448 - DNA, 18 bp, Homo sapiens
tttacccaaaaactaaat

SEQ ID NO: 2011449 - DNA, 18 bp, Homo sapiens
tttacccctgcacagttt

SEQ ID NO: 2011450 - DNA, 16 bp, Homo sapiens
tttacctgagaccagt

SEQ ID NO: 2011451 - DNA, 16 bp, Homo sapiens
tttacctgcaaaaaat

SEQ ID NO: 2011452 - DNA, 21 bp, Homo sapiens
tttacctgtgcgttactaatt

SEQ ID NO: 2011453 - DNA, 17 bp, Homo sapiens
tttaccttttctgttgt

SEQ ID NO: 2011454 - DNA, 20 bp, Homo sapiens
tttactaaagagacatattt

SEQ ID NO: 2011455 - DNA, 20 bp, Homo sapiens
tttactaaagatatcagagc

SEQ ID NO: 2011456 - DNA, 20 bp, Homo sapiens
tttactaagccacaagaaat

SEQ ID NO: 2011457 - DNA, 15 bp, Homo sapiens
tttactaagtaaaag

SEQ ID NO: 2011458 - DNA, 16 bp, Homo sapiens
tttactactattctgt

SEQ ID NO: 2011459 - DNA, 14 bp, Homo sapiens
tttactacttgtta

SEQ ID NO: 2011460 - DNA, 21 bp, Homo sapiens
tttactctatgccccaaatat

SEQ ID NO: 2011461 - DNA, 22 bp, Homo sapiens
tttactctatgccccaaatata

SEQ ID NO: 2011462 - DNA, 17 bp, Homo sapiens
tttactgagcttctctg

SEQ ID NO: 2011463 - DNA, 22 bp, Homo sapiens
tttactgctgtcattgtccatg

SEQ ID NO: 2011464 - DNA, 14 bp, Homo sapiens
tttactgtctgtaa

SEQ ID NO: 2011465 - DNA, 16 bp, Homo sapiens
tttactgtgcatacat

SEQ ID NO: 2011466 - DNA, 15 bp, Homo sapiens
tttacttgtagaaat

SEQ ID NO: 2011467 - DNA, 21 bp, Homo sapiens
tttactttatccaatcctcag

SEQ ID NO: 2011468 - DNA, 18 bp, Homo sapiens
tttacttttaaacagtga

SEQ ID NO: 2011469 - DNA, 12 bp, Homo sapiens
tttagaaaactt

SEQ ID NO: 2011470 - DNA, 16 bp, Homo sapiens
tttagaaatcattttg

SEQ ID NO: 2011471 - DNA, 13 bp, Homo sapiens
tttagaacagagg

SEQ ID NO: 2011472 - DNA, 14 bp, Homo sapiens
tttagaatatatta

SEQ ID NO: 2011473 - DNA, 21 bp, Homo sapiens
tttagagatgaattaaattta

SEQ ID NO: 2011474 - DNA, 18 bp, Homo sapiens
tttagagattaatttgtg

SEQ ID NO: 2011475 - DNA, 14 bp, Homo sapiens
tttagattccagga

SEQ ID NO: 2011476 - DNA, 12 bp, Homo sapiens
tttagatttcaa

SEQ ID NO: 2011477 - DNA, 23 bp, Homo sapiens
tttagcagtccaaagaacaagaa

SEQ ID NO: 2011478 - DNA, 13 bp, Homo sapiens
tttagccagtgac

SEQ ID NO: 2011479 - DNA, 14 bp, Homo sapiens
tttagctatgtgga

SEQ ID NO: 2011480 - DNA, 16 bp, Homo sapiens
tttagcttctctgcca

SEQ ID NO: 2011481 - DNA, 18 bp, Homo sapiens
tttaggaagcaagcttaa

SEQ ID NO: 2011482 - DNA, 14 bp, Homo sapiens
tttaggagacagtc

SEQ ID NO: 2011483 - DNA, 23 bp, Homo sapiens
tttaggatgtaactttataaata

SEQ ID NO: 2011484 - DNA, 11 bp, Homo sapiens
tttaggcagcc

SEQ ID NO: 2011485 - DNA, 17 bp, Homo sapiens
tttaggcagcctgccgc

SEQ ID NO: 2011486 - DNA, 19 bp, Homo sapiens
tttaggcagggatttgagg

SEQ ID NO: 2011487 - DNA, 19 bp, Homo sapiens
tttaggctcaggacggaag

SEQ ID NO: 2011488 - DNA, 13 bp, Homo sapiens
tttagggaagcag

SEQ ID NO: 2011489 - DNA, 15 bp, Homo sapiens
tttagggctgtagac

SEQ ID NO: 2011490 - DNA, 17 bp, Homo sapiens
tttaggggaagtatgtg

SEQ ID NO: 2011491 - DNA, 18 bp, Homo sapiens
tttaggggaagtatgtgt

SEQ ID NO: 2011492 - DNA, 20 bp, Homo sapiens
tttaggtgcctcctgtctta

SEQ ID NO: 2011493 - DNA, 15 bp, Homo sapiens
tttagtagagacagg

SEQ ID NO: 2011494 - DNA, 22 bp, Homo sapiens
tttagtagcagtgattgtctta

SEQ ID NO: 2011495 - DNA, 15 bp, Homo sapiens
tttagtcttttactc

SEQ ID NO: 2011496 - DNA, 17 bp, Homo sapiens
tttagtgttctgtattt

SEQ ID NO: 2011497 - DNA, 11 bp, Homo sapiens
tttagttcttt

SEQ ID NO: 2011498 - DNA, 13 bp, Homo sapiens
tttagttttatgg

SEQ ID NO: 2011499 - DNA, 23 bp, Homo sapiens
tttataaaagaataaaattgcac

SEQ ID NO: 2011500 - DNA, 14 bp, Homo sapiens
tttataaacttaat

SEQ ID NO: 2011501 - DNA, 13 bp, Homo sapiens
tttataaatgtgt

SEQ ID NO: 2011502 - DNA, 16 bp, Homo sapiens
tttataagcaaatttc

SEQ ID NO: 2011503 - DNA, 15 bp, Homo sapiens
tttatacaaaataat

SEQ ID NO: 2011504 - DNA, 23 bp, Homo sapiens
tttatacagaactgaattaagtt

SEQ ID NO: 2011505 - DNA, 20 bp, Homo sapiens
tttatacatagtcacaaaaa

SEQ ID NO: 2011506 - DNA, 21 bp, Homo sapiens
tttatacatagtcacaaaaat

SEQ ID NO: 2011507 - DNA, 19 bp, Homo sapiens
tttatactccatacataac

SEQ ID NO: 2011508 - DNA, 20 bp, Homo sapiens
tttatagctattactgtctg

SEQ ID NO: 2011509 - DNA, 15 bp, Homo sapiens
tttatatatatatgt

SEQ ID NO: 2011510 - DNA, 19 bp, Homo sapiens
tttatatatgaagtaagtt

SEQ ID NO: 2011511 - DNA, 22 bp, Homo sapiens
tttatatgaaatgtttcactat

SEQ ID NO: 2011512 - DNA, 16 bp, Homo sapiens
tttatattagaagtgt

SEQ ID NO: 2011513 - DNA, 22 bp, Homo sapiens
tttatattcagagatgtaccat

SEQ ID NO: 2011514 - DNA, 14 bp, Homo sapiens
tttatattgtaaat

SEQ ID NO: 2011515 - DNA, 16 bp, Homo sapiens
tttatatttggaaaga

SEQ ID NO: 2011516 - DNA, 18 bp, Homo sapiens
tttatatttggaaagaga

SEQ ID NO: 2011517 - DNA, 13 bp, Homo sapiens
tttatattttccc

SEQ ID NO: 2011518 - DNA, 14 bp, Homo sapiens
tttatcatgacatg

SEQ ID NO: 2011519 - DNA, 15 bp, Homo sapiens
tttatccaatcctca

SEQ ID NO: 2011520 - DNA, 18 bp, Homo sapiens
tttatcgtttattgctta

SEQ ID NO: 2011521 - DNA, 15 bp, Homo sapiens
tttatctgtcacaca

SEQ ID NO: 2011522 - DNA, 21 bp, Homo sapiens
tttatgaaatggttaagaatt

SEQ ID NO: 2011523 - DNA, 18 bp, Homo sapiens
tttatgaagaaaaaatac

SEQ ID NO: 2011524 - DNA, 22 bp, Homo sapiens
tttatgaagaaaaaatacattt

SEQ ID NO: 2011525 - DNA, 21 bp, Homo sapiens
tttatgactgtaaacatagat

SEQ ID NO: 2011526 - DNA, 19 bp, Homo sapiens
tttatgatttaaaaaataa

SEQ ID NO: 2011527 - DNA, 18 bp, Homo sapiens
tttatgcaaggaaggaaa

SEQ ID NO: 2011528 - DNA, 18 bp, Homo sapiens
tttatgcttaaaatatgt

SEQ ID NO: 2011529 - DNA, 19 bp, Homo sapiens
tttatgcttaaaatatgta

SEQ ID NO: 2011530 - DNA, 20 bp, Homo sapiens
tttatggatcccaattcatt

SEQ ID NO: 2011531 - DNA, 18 bp, Homo sapiens
tttatggcttataaatgt

SEQ ID NO: 2011532 - DNA, 18 bp, Homo sapiens
tttatgtctatttaagcc

SEQ ID NO: 2011533 - DNA, 14 bp, Homo sapiens
tttattaaaatgat

SEQ ID NO: 2011534 - DNA, 13 bp, Homo sapiens
tttattaaagcaa

SEQ ID NO: 2011535 - DNA, 14 bp, Homo sapiens
tttattaaagcaac

SEQ ID NO: 2011536 - DNA, 14 bp, Homo sapiens
tttattaagtctgg

SEQ ID NO: 2011537 - DNA, 20 bp, Homo sapiens
tttattacctctgatacctc

SEQ ID NO: 2011538 - DNA, 13 bp, Homo sapiens
tttattagctgta

SEQ ID NO: 2011539 - DNA, 19 bp, Homo sapiens
tttgtacagaatttttaat

SEQ ID NO: 2011540 - DNA, 21 bp, Homo sapiens
tttgtacagaatttttaatga

SEQ ID NO: 2011541 - DNA, 16 bp, Homo sapiens
tttgtacattcctgat

SEQ ID NO: 2011542 - DNA, 14 bp, Homo sapiens
tttgtaccatggtg

SEQ ID NO: 2011543 - DNA, 14 bp, Homo sapiens
tttgtactgaaaaa

SEQ ID NO: 2011544 - DNA, 15 bp, Homo sapiens
tttgtactgaaaaat

SEQ ID NO: 2011545 - DNA, 19 bp, Homo sapiens
tttgtaggggtcaaagaaa

SEQ ID NO: 2011546 - DNA, 20 bp, Homo sapiens
tttgtaggggtcaaagaaat

SEQ ID NO: 2011547 - DNA, 21 bp, Homo sapiens
tttgtaggggtcaaagaaatg

SEQ ID NO: 2011548 - DNA, 23 bp, Homo sapiens
tttgtaggggtcaaagaaatgct

SEQ ID NO: 2011549 - DNA, 17 bp, Homo sapiens
tttgtagtagttgatga

SEQ ID NO: 2011550 - DNA, 14 bp, Homo sapiens
tttgtataaataat

SEQ ID NO: 2011551 - DNA, 23 bp, Homo sapiens
tttgtatatcatgaaacacttct

SEQ ID NO: 2011552 - DNA, 12 bp, Homo sapiens
tttgtatattgt

SEQ ID NO: 2011553 - DNA, 13 bp, Homo sapiens
tttgtatctgaag

SEQ ID NO: 2011554 - DNA, 17 bp, Homo sapiens
tttgtattacatctaat

SEQ ID NO: 2011555 - DNA, 21 bp, Homo sapiens
tttgtattcatgaacttggct

SEQ ID NO: 2011556 - DNA, 22 bp, Homo sapiens
tttgtattcccttttatttcca

SEQ ID NO: 2011557 - DNA, 17 bp, Homo sapiens
tttgtatttaaaacctt

SEQ ID NO: 2011558 - DNA, 13 bp, Homo sapiens
tttgtattttcaa

SEQ ID NO: 2011559 - DNA, 17 bp, Homo sapiens
tttgtcatatattcatg

SEQ ID NO: 2011560 - DNA, 20 bp, Homo sapiens
tttgtcatatattcatgtaa

SEQ ID NO: 2011561 - DNA, 19 bp, Homo sapiens
tttgtccattttaaaaacc

SEQ ID NO: 2011562 - DNA, 20 bp, Homo sapiens
tttgtcccatttccttggag

SEQ ID NO: 2011563 - DNA, 21 bp, Homo sapiens
tttgtcctttgagaaagaaat

SEQ ID NO: 2011564 - DNA, 23 bp, Homo sapiens
tttgtgagtgactcggtgtaaaa

SEQ ID NO: 2011565 - DNA, 23 bp, Homo sapiens
tttgtgccttaaaaggagagaag

SEQ ID NO: 2011566 - DNA, 14 bp, Homo sapiens
tttgtgctgtgggc

SEQ ID NO: 2011567 - DNA, 17 bp, Homo sapiens
tttgtggcaccttttct

SEQ ID NO: 2011568 - DNA, 12 bp, Homo sapiens
tttgtgtaataa

SEQ ID NO: 2011569 - DNA, 17 bp, Homo sapiens
tttgtgtaataaaaatt

SEQ ID NO: 2011570 - DNA, 12 bp, Homo sapiens
tttgtgtgagag

SEQ ID NO: 2011571 - DNA, 13 bp, Homo sapiens
tttgtgtgattga

SEQ ID NO: 2011572 - DNA, 12 bp, Homo sapiens
tttgtgtttcta

SEQ ID NO: 2011573 - DNA, 17 bp, Homo sapiens
tttgttaaatatttaca

SEQ ID NO: 2011574 - DNA, 14 bp, Homo sapiens
tttgttcaaagttg

SEQ ID NO: 2011575 - DNA, 14 bp, Homo sapiens
tttgttctgtattt

SEQ ID NO: 2011576 - DNA, 15 bp, Homo sapiens
tttgttctttatttg

SEQ ID NO: 2011577 - DNA, 20 bp, Homo sapiens
tttgttgccttatcttgaaa

SEQ ID NO: 2011578 - DNA, 14 bp, Homo sapiens
tttgttgctgtcaa

SEQ ID NO: 2011579 - DNA, 14 bp, Homo sapiens
tttgttgctgtttt

SEQ ID NO: 2011580 - DNA, 15 bp, Homo sapiens
tttgtttcctttgtt

SEQ ID NO: 2011581 - DNA, 13 bp, Homo sapiens
tttgtttgtaatc

SEQ ID NO: 2011582 - DNA, 14 bp, Homo sapiens
tttgttttcatggt

SEQ ID NO: 2011583 - DNA, 19 bp, Homo sapiens
tttgtttttcttatccaag

SEQ ID NO: 2011584 - DNA, 16 bp, Homo sapiens
tttgtttttttccaac

SEQ ID NO: 2011585 - DNA, 22 bp, Homo sapiens
tttgtttttttccaactgtgtt

SEQ ID NO: 2011586 - DNA, 17 bp, Homo sapiens
ttttaaaaaagcttaaa

SEQ ID NO: 2011587 - DNA, 22 bp, Homo sapiens
ttttaaaaaagcttaaaacttt

SEQ ID NO: 2011588 - DNA, 14 bp, Homo sapiens
ttttaaaaaatgaa

SEQ ID NO: 2011589 - DNA, 15 bp, Homo sapiens
ttttaaaaaggcagt

SEQ ID NO: 2011590 - DNA, 15 bp, Homo sapiens
ttttaaaaatcataa

SEQ ID NO: 2011591 - DNA, 22 bp, Homo sapiens
ttttaaaaatcataaactgtgt

SEQ ID NO: 2011592 - DNA, 17 bp, Homo sapiens
ttttaaaaccatgcagc

SEQ ID NO: 2011593 - DNA, 12 bp, Homo sapiens
ttttaaaagaaa

SEQ ID NO: 2011594 - DNA, 13 bp, Homo sapiens
ttttaaaagaaat

SEQ ID NO: 2011595 - DNA, 12 bp, Homo sapiens
ttttaaaagttt

SEQ ID NO: 2011596 - DNA, 13 bp, Homo sapiens
ttttaaaagtttc

SEQ ID NO: 2011597 - DNA, 15 bp, Homo sapiens
ttttaaaagtttcaa

SEQ ID NO: 2011598 - DNA, 18 bp, Homo sapiens
ttttaaaagtttcaatgt

SEQ ID NO: 2011599 - DNA, 19 bp, Homo sapiens
ttttaaaatctgatttaat

SEQ ID NO: 2011600 - DNA, 20 bp, Homo sapiens
ttttaaacaaaatagaagct

SEQ ID NO: 2011601 - DNA, 23 bp, Homo sapiens
ttttaaacaaaatagaagctgta

SEQ ID NO: 2011602 - DNA, 19 bp, Homo sapiens
ttttaaacatgagaataaa

SEQ ID NO: 2011603 - DNA, 14 bp, Homo sapiens
ttttaaactagtaa

SEQ ID NO: 2011604 - DNA, 20 bp, Homo sapiens
ttttaaaggtagagatgtgt

SEQ ID NO: 2011605 - DNA, 21 bp, Homo sapiens
ttttaaaggtagagatgtgtg

SEQ ID NO: 2011606 - DNA, 22 bp, Homo sapiens
ttttaaagtatgttattgcata

SEQ ID NO: 2011607 - DNA, 17 bp, Homo sapiens
ttttaaataaaagcagc

SEQ ID NO: 2011608 - DNA, 14 bp, Homo sapiens
ttttaaatatgaac

SEQ ID NO: 2011609 - DNA, 18 bp, Homo sapiens
ttttaaatgaaaatgtaa

SEQ ID NO: 2011610 - DNA, 15 bp, Homo sapiens
ttttaaatgacattt

SEQ ID NO: 2011611 - DNA, 20 bp, Homo sapiens
ttttaaattataagatgtca

SEQ ID NO: 2011612 - DNA, 23 bp, Homo sapiens
ttttaacacataactagaaacct

SEQ ID NO: 2011613 - DNA, 22 bp, Homo sapiens
ttttaaccagtacttctaagag

SEQ ID NO: 2011614 - DNA, 12 bp, Homo sapiens
ttttaactagaa

SEQ ID NO: 2011615 - DNA, 17 bp, Homo sapiens
ttttaagcattcttaga

SEQ ID NO: 2011616 - DNA, 22 bp, Homo sapiens
ttttaagctgtaaaaagagaga

SEQ ID NO: 2011617 - DNA, 12 bp, Homo sapiens
ttttaagctgtt

SEQ ID NO: 2011618 - DNA, 20 bp, Homo sapiens
ttttaagggtttgtggaaaa

SEQ ID NO: 2011619 - DNA, 23 bp, Homo sapiens
ttttaagggtttgtggaaaatga

SEQ ID NO: 2011620 - DNA, 17 bp, Homo sapiens
ttttaagtatttatata

SEQ ID NO: 2011621 - DNA, 13 bp, Homo sapiens
ttttaataaaagt

SEQ ID NO: 2011622 - DNA, 21 bp, Homo sapiens
ttttaataaaattgacaacat

SEQ ID NO: 2011623 - DNA, 15 bp, Homo sapiens
ttttaataatttcat

SEQ ID NO: 2011624 - DNA, 16 bp, Homo sapiens
ttttaataatttcatc

SEQ ID NO: 2011625 - DNA, 12 bp, Homo sapiens
ttttaatacagg

SEQ ID NO: 2011626 - DNA, 22 bp, Homo sapiens
ttttaatcagacaaagtaattc

SEQ ID NO: 2011627 - DNA, 19 bp, Homo sapiens
ttttaattccaatatgatg

SEQ ID NO: 2011628 - DNA, 21 bp, Homo sapiens
ttttaatttatatttgaaatt

SEQ ID NO: 2011629 - DNA, 21 bp, Homo sapiens
ttttaatttatttcatccagt

SEQ ID NO: 2011630 - DNA, 14 bp, Homo sapiens
ttttaatttctaca

SEQ ID NO: 2011631 - DNA, 17 bp, Homo sapiens
ttttacaataaaatctt

SEQ ID NO: 2011632 - DNA, 17 bp, Homo sapiens
ttttacagagaatctga

SEQ ID NO: 2011633 - DNA, 13 bp, Homo sapiens
ttttacatgacca

SEQ ID NO: 2011634 - DNA, 18 bp, Homo sapiens
ttttacctaccacagtgt

SEQ ID NO: 2011635 - DNA, 15 bp, Homo sapiens
ttttactccagtggt

SEQ ID NO: 2011636 - DNA, 13 bp, Homo sapiens
ttttactgtctgt

SEQ ID NO: 2011637 - DNA, 14 bp, Homo sapiens
ttttagaaaacagc

SEQ ID NO: 2011638 - DNA, 22 bp, Homo sapiens
ttttagagccccccgtgtggct

SEQ ID NO: 2011639 - DNA, 19 bp, Homo sapiens
ttttagatgagattgtttt

SEQ ID NO: 2011640 - DNA, 16 bp, Homo sapiens
ttttagctctgttctt

SEQ ID NO: 2011641 - DNA, 18 bp, Homo sapiens
ttttaggaagcaagctta

SEQ ID NO: 2011642 - DNA, 15 bp, Homo sapiens
ttttagtaaatcctt

SEQ ID NO: 2011643 - DNA, 20 bp, Homo sapiens
ttttataactagtcctttac

SEQ ID NO: 2011644 - DNA, 14 bp, Homo sapiens
ttttatacatagtc

SEQ ID NO: 2011645 - DNA, 20 bp, Homo sapiens
ttttatacatatcagaaaag

SEQ ID NO: 2011646 - DNA, 12 bp, Homo sapiens
ttttatactgta

SEQ ID NO: 2011647 - DNA, 15 bp, Homo sapiens
ttttatagaaaagat

SEQ ID NO: 2011648 - DNA, 13 bp, Homo sapiens
ttttatatttagt

SEQ ID NO: 2011649 - DNA, 15 bp, Homo sapiens
ttttatcatgacatg

SEQ ID NO: 2011650 - DNA, 19 bp, Homo sapiens
ttttatcatgacatgttat

SEQ ID NO: 2011651 - DNA, 19 bp, Homo sapiens
ttttatcattttcaaaatg

SEQ ID NO: 2011652 - DNA, 12 bp, Homo sapiens
ttttatctttga

SEQ ID NO: 2011653 - DNA, 19 bp, Homo sapiens
ttttatgactgtaaacata

SEQ ID NO: 2011654 - DNA, 22 bp, Homo sapiens
gagctgttggcctcgcctgggc

SEQ ID NO: 2011655 - DNA, 20 bp, Homo sapiens
gagcttagccttgtgccctg

SEQ ID NO: 2011656 - DNA, 19 bp, Homo sapiens
gagcttattggccactggg

SEQ ID NO: 2011657 - DNA, 17 bp, Homo sapiens
gagcttccagtgcatgt

SEQ ID NO: 2011658 - DNA, 18 bp, Homo sapiens
gagcttccagtgcatgtt

SEQ ID NO: 2011659 - DNA, 14 bp, Homo sapiens
gagcttcccaggat

SEQ ID NO: 2011660 - DNA, 15 bp, Homo sapiens
gagcttcccaggatc

SEQ ID NO: 2011661 - DNA, 20 bp, Homo sapiens
gagcttctacagattttaga

SEQ ID NO: 2011662 - DNA, 17 bp, Homo sapiens
gagcttggtggctgagc

SEQ ID NO: 2011663 - DNA, 23 bp, Homo sapiens
gagctttctgtccttttggcact

SEQ ID NO: 2011664 - DNA, 21 bp, Homo sapiens
gaggaaaaacgatcgctgtga

SEQ ID NO: 2011665 - DNA, 21 bp, Homo sapiens
gagtgaacaactatttataaa

SEQ ID NO: 2011666 - DNA, 20 bp, Homo sapiens
gagtgacacccaagagggct

SEQ ID NO: 2011667 - DNA, 15 bp, Homo sapiens
gagtgacagaggcag

SEQ ID NO: 2011668 - DNA, 22 bp, Homo sapiens
gagtgacatgggtgtgccaggc

SEQ ID NO: 2011669 - DNA, 20 bp, Homo sapiens
gagtgacggtcccacactgg

SEQ ID NO: 2011670 - DNA, 16 bp, Homo sapiens
gagtgactcggtgtaa

SEQ ID NO: 2011671 - DNA, 21 bp, Homo sapiens
gagtgactcggtgtaaaacca

SEQ ID NO: 2011672 - DNA, 23 bp, Homo sapiens
gagtgagcagtagaagcctgcag

SEQ ID NO: 2011673 - DNA, 13 bp, Homo sapiens
gagtgagccacag

SEQ ID NO: 2011674 - DNA, 21 bp, Homo sapiens
gagtgagccacagaccacctg

SEQ ID NO: 2011675 - DNA, 23 bp, Homo sapiens
gagtgagccacagaccacctgct

SEQ ID NO: 2011676 - DNA, 15 bp, Homo sapiens
gagtgaggcttccag

SEQ ID NO: 2011677 - DNA, 18 bp, Homo sapiens
gagtgaggcttccaggct

SEQ ID NO: 2011678 - DNA, 22 bp, Homo sapiens
gagtgatacaacttcaagtgca

SEQ ID NO: 2011679 - DNA, 23 bp, Homo sapiens
gagtgcagtagtaattgatttga

SEQ ID NO: 2011680 - DNA, 12 bp, Homo sapiens
gagtgcagtgag

SEQ ID NO: 2011681 - DNA, 18 bp, Homo sapiens
gagtgcagtgagccgaga

SEQ ID NO: 2011682 - DNA, 22 bp, Homo sapiens
gagtgccaggactccccaggcc

SEQ ID NO: 2011683 - DNA, 22 bp, Homo sapiens
gagtgcccttaaaataatgatt

SEQ ID NO: 2011684 - DNA, 21 bp, Homo sapiens
gagtgcgctcttggtccctgg

SEQ ID NO: 2011685 - DNA, 23 bp, Homo sapiens
gagtgcgctcttggtccctggtc

SEQ ID NO: 2011686 - DNA, 17 bp, Homo sapiens
gagtggaggaggcctgg

SEQ ID NO: 2011687 - DNA, 22 bp, Homo sapiens
gagtggatctccaaggaccagg

SEQ ID NO: 2011688 - DNA, 13 bp, Homo sapiens
gagtggatggatg

SEQ ID NO: 2011689 - DNA, 11 bp, Homo sapiens
gagtggcagcc

SEQ ID NO: 2011690 - DNA, 17 bp, Homo sapiens
gagtggccggggaagct

SEQ ID NO: 2011691 - DNA, 21 bp, Homo sapiens
gagtggccggggaagctggca

SEQ ID NO: 2011692 - DNA, 14 bp, Homo sapiens
ctcagagcaggctc

SEQ ID NO: 2011693 - DNA, 22 bp, Homo sapiens
ctcagagcaggctcagactctg

SEQ ID NO: 2011694 - DNA, 19 bp, Homo sapiens
ctcagagcccctccctgct

SEQ ID NO: 2011695 - DNA, 16 bp, Homo sapiens
ctcagaggcccaggaa

SEQ ID NO: 2011696 - DNA, 15 bp, Homo sapiens
ctcagaggggccccg

SEQ ID NO: 2011697 - DNA, 16 bp, Homo sapiens
ctcagatcttgacagt

SEQ ID NO: 2011698 - DNA, 15 bp, Homo sapiens
ctcagcaaatcctct

SEQ ID NO: 2011699 - DNA, 16 bp, Homo sapiens
ctcagcaaatcctctt

SEQ ID NO: 2011700 - DNA, 13 bp, Homo sapiens
ctcagcacagact

SEQ ID NO: 2011701 - DNA, 18 bp, Homo sapiens
ctcagcagcagagagccc

SEQ ID NO: 2011702 - DNA, 18 bp, Homo sapiens
ctcagcagccccctgccc

SEQ ID NO: 2011703 - DNA, 12 bp, Homo sapiens
ctcagcagccct

SEQ ID NO: 2011704 - DNA, 15 bp, Homo sapiens
ctcagcagccctcct

SEQ ID NO: 2011705 - DNA, 21 bp, Homo sapiens
ctcagcatcctggcacccggc

SEQ ID NO: 2011706 - DNA, 14 bp, Homo sapiens
ctcagccacacccc

SEQ ID NO: 2011707 - DNA, 17 bp, Homo sapiens
ctcagccccgggcctgc

SEQ ID NO: 2011708 - DNA, 19 bp, Homo sapiens
ctcagccccgggcctgcct

SEQ ID NO: 2011709 - DNA, 23 bp, Homo sapiens
ctcagccccgggcctgcctctga

SEQ ID NO: 2011710 - DNA, 13 bp, Homo sapiens
ctcagccctcaga

SEQ ID NO: 2011711 - DNA, 14 bp, Homo sapiens
ctcagccctccctg

SEQ ID NO: 2011712 - DNA, 20 bp, Homo sapiens
ctcagccctccctgcccctc

SEQ ID NO: 2011713 - DNA, 13 bp, Homo sapiens
ctcagccctgact

SEQ ID NO: 2011714 - DNA, 19 bp, Homo sapiens
ctcagccctgactggtgct

SEQ ID NO: 2011715 - DNA, 11 bp, Homo sapiens
ctcagccctgg

SEQ ID NO: 2011716 - DNA, 12 bp, Homo sapiens
ctcagccctggg

SEQ ID NO: 2011717 - DNA, 15 bp, Homo sapiens
ctcagccctgggccc

SEQ ID NO: 2011718 - DNA, 21 bp, Homo sapiens
ctcagccctgggccccaccac

SEQ ID NO: 2011719 - DNA, 13 bp, Homo sapiens
ctcagcccttgcc

SEQ ID NO: 2011720 - DNA, 14 bp, Homo sapiens
ctcagcccttgccc

SEQ ID NO: 2011721 - DNA, 23 bp, Homo sapiens
ctcagccggcgtggcaaatataa

SEQ ID NO: 2011722 - DNA, 13 bp, Homo sapiens
ctcagcctcccaa

SEQ ID NO: 2011723 - DNA, 22 bp, Homo sapiens
ctcagcctcccaaagtgctggg

SEQ ID NO: 2011724 - DNA, 14 bp, Homo sapiens
ctcagcctcccaga

SEQ ID NO: 2011725 - DNA, 17 bp, Homo sapiens
ctcagcctcccagagtg

SEQ ID NO: 2011726 - DNA, 16 bp, Homo sapiens
ctcagcctccccctgc

SEQ ID NO: 2011727 - DNA, 18 bp, Homo sapiens
ctcagcctccccctgctg

SEQ ID NO: 2011728 - DNA, 21 bp, Homo sapiens
ctcagcctccccctgctgctc

SEQ ID NO: 2011729 - DNA, 18 bp, Homo sapiens
ctcagcctggtgggcctc

SEQ ID NO: 2011730 - DNA, 20 bp, Homo sapiens
ctcagcctggtgggcctcct

SEQ ID NO: 2011731 - DNA, 22 bp, Homo sapiens
ctcagccttccccttgcccagg

SEQ ID NO: 2011732 - DNA, 14 bp, Homo sapiens
ctcagcgaggtgta

SEQ ID NO: 2011733 - DNA, 19 bp, Homo sapiens
ctcagcggggacagctcct

SEQ ID NO: 2011734 - DNA, 13 bp, Homo sapiens
ctcagctcagcct

SEQ ID NO: 2011735 - DNA, 13 bp, Homo sapiens
ctcagctccagaa

SEQ ID NO: 2011736 - DNA, 22 bp, Homo sapiens
ctcagctccagaataccttctt

SEQ ID NO: 2011737 - DNA, 18 bp, Homo sapiens
ctcagctccgtcatctgc

SEQ ID NO: 2011738 - DNA, 23 bp, Homo sapiens
ctcagctctgacattctgattcg

SEQ ID NO: 2011739 - DNA, 14 bp, Homo sapiens
ctcagctgacacat

SEQ ID NO: 2011740 - DNA, 13 bp, Homo sapiens
ctcagctgcacat

SEQ ID NO: 2011741 - DNA, 14 bp, Homo sapiens
ctcagctgccaagc

SEQ ID NO: 2011742 - DNA, 14 bp, Homo sapiens
ctcagctgctcgca

SEQ ID NO: 2011743 - DNA, 14 bp, Homo sapiens
ctcagtcctggaag

SEQ ID NO: 2011744 - DNA, 16 bp, Homo sapiens
ctcagtctcaggagca

SEQ ID NO: 2011745 - DNA, 18 bp, Homo sapiens
ctcagtgaagaatacttc

SEQ ID NO: 2011746 - DNA, 22 bp, Homo sapiens
ctcagtgaggccgcccggcaca

SEQ ID NO: 2011747 - DNA, 20 bp, Homo sapiens
ctcagtgccacttgacattc

SEQ ID NO: 2011748 - DNA, 16 bp, Homo sapiens
ctcagtgctcggcagt

SEQ ID NO: 2011749 - DNA, 18 bp, Homo sapiens
ctcagtgctcggcagtca

SEQ ID NO: 2011750 - DNA, 20 bp, Homo sapiens
ctcagtgggacaaaccagag

SEQ ID NO: 2011751 - DNA, 20 bp, Homo sapiens
ctcagtgtcctcaggggcct

SEQ ID NO: 2011752 - DNA, 18 bp, Homo sapiens
ctcagtgttttagctgtt

SEQ ID NO: 2011753 - DNA, 13 bp, Homo sapiens
ctcagttattcag

SEQ ID NO: 2011754 - DNA, 18 bp, Homo sapiens
ctcagttcaacctggtgg

SEQ ID NO: 2011755 - DNA, 23 bp, Homo sapiens
ctcagttcaacctggtggcacca

SEQ ID NO: 2011756 - DNA, 10 bp, Homo sapiens
ctcagtttcc

SEQ ID NO: 2011757 - DNA, 11 bp, Homo sapiens
ctcagtttccc

SEQ ID NO: 2011758 - DNA, 16 bp, Homo sapiens
ctcagtttccccattg

SEQ ID NO: 2011759 - DNA, 11 bp, Homo sapiens
ctcagtttcct

SEQ ID NO: 2011760 - DNA, 21 bp, Homo sapiens
ctcagtttcctcatctgcaga

SEQ ID NO: 2011761 - DNA, 16 bp, Homo sapiens
ctcagtttctccatca

SEQ ID NO: 2011762 - DNA, 18 bp, Homo sapiens
ctcagtttctccatcagc

SEQ ID NO: 2011763 - DNA, 19 bp, Homo sapiens
ctcagtttctccatcagct

SEQ ID NO: 2011764 - DNA, 17 bp, Homo sapiens
ctcagttttatcatttt

SEQ ID NO: 2011765 - DNA, 21 bp, Homo sapiens
ctcagtttttcggtgggacag

SEQ ID NO: 2011766 - DNA, 22 bp, Homo sapiens
ctcagtttttcggtgggacagc

SEQ ID NO: 2011767 - DNA, 13 bp, Homo sapiens
ctcataacatctt

SEQ ID NO: 2011768 - DNA, 17 bp, Homo sapiens
ctcataaggcatataca

SEQ ID NO: 2011769 - DNA, 20 bp, Homo sapiens
ctcataaggttctttagctg

SEQ ID NO: 2011770 - DNA, 17 bp, Homo sapiens
ctcataagttggaccag

SEQ ID NO: 2011771 - DNA, 18 bp, Homo sapiens
ctcataagttggaccaga

SEQ ID NO: 2011772 - DNA, 12 bp, Homo sapiens
ctcataccatct

SEQ ID NO: 2011773 - DNA, 22 bp, Homo sapiens
ctcataccatctgctgccccgc

SEQ ID NO: 2011774 - DNA, 23 bp, Homo sapiens
ctcataggaaaagtacatttaat

SEQ ID NO: 2011775 - DNA, 18 bp, Homo sapiens
ctcatagtatggtggctg

SEQ ID NO: 2011776 - DNA, 21 bp, Homo sapiens
ctcatagtatggtggctgggt

SEQ ID NO: 2011777 - DNA, 13 bp, Homo sapiens
ctcatatatttaa

SEQ ID NO: 2011778 - DNA, 16 bp, Homo sapiens
ctcatatgtagccctc

SEQ ID NO: 2011779 - DNA, 14 bp, Homo sapiens
ctcatcacccagtc

SEQ ID NO: 2011780 - DNA, 19 bp, Homo sapiens
ctcatcacccagtcctggc

SEQ ID NO: 2011781 - DNA, 22 bp, Homo sapiens
ctcatcacccagtcctggccat

SEQ ID NO: 2011782 - DNA, 13 bp, Homo sapiens
ctcatcagtagat

SEQ ID NO: 2011783 - DNA, 12 bp, Homo sapiens
ctcatcataaaa

SEQ ID NO: 2011784 - DNA, 14 bp, Homo sapiens
ctcatcataaaata

SEQ ID NO: 2011785 - DNA, 14 bp, Homo sapiens
ctcatcatattgta

SEQ ID NO: 2011786 - DNA, 17 bp, Homo sapiens
ctcatcatattgtatgt

SEQ ID NO: 2011787 - DNA, 17 bp, Homo sapiens
ctcatcccctcgtcctg

SEQ ID NO: 2011788 - DNA, 15 bp, Homo sapiens
ctcatccctcggaag

SEQ ID NO: 2011789 - DNA, 13 bp, Homo sapiens
ctcatcctccttc

SEQ ID NO: 2011790 - DNA, 13 bp, Homo sapiens
ctcatcctgtgtg

SEQ ID NO: 2011791 - DNA, 18 bp, Homo sapiens
ctcatctaaaatttttct

SEQ ID NO: 2011792 - DNA, 18 bp, Homo sapiens
ctcatctcactgcccagt

SEQ ID NO: 2011793 - DNA, 12 bp, Homo sapiens
ctcatctcttct

SEQ ID NO: 2011794 - DNA, 15 bp, Homo sapiens
ctcatctcttctttt

SEQ ID NO: 2011795 - DNA, 15 bp, Homo sapiens
ctcatcttgccccct

SEQ ID NO: 2011796 - DNA, 21 bp, Homo sapiens
ctcatgaacctcaagctgcat

SEQ ID NO: 2011797 - DNA, 12 bp, Homo sapiens
ctcatgacagcc

SEQ ID NO: 2011798 - DNA, 19 bp, Homo sapiens
ctcatgacagccagagcct

SEQ ID NO: 2011799 - DNA, 20 bp, Homo sapiens
ctcatgacagccagagcctg

SEQ ID NO: 2011800 - DNA, 16 bp, Homo sapiens
ctcatgaccctcctgt

SEQ ID NO: 2011801 - DNA, 18 bp, Homo sapiens
ctcatgaccctcctgtcc

SEQ ID NO: 2011802 - DNA, 15 bp, Homo sapiens
ctcatgataatctgg

SEQ ID NO: 2011803 - DNA, 16 bp, Homo sapiens
atagaggtaccagcaa

SEQ ID NO: 2011804 - DNA, 17 bp, Homo sapiens
atagagtatactaaaaa

SEQ ID NO: 2011805 - DNA, 17 bp, Homo sapiens
atagatcctaggtgctg

SEQ ID NO: 2011806 - DNA, 19 bp, Homo sapiens
atagatgcaagatatttat

SEQ ID NO: 2011807 - DNA, 21 bp, Homo sapiens
atagatgcaagatatttatat

SEQ ID NO: 2011808 - DNA, 13 bp, Homo sapiens
atagatgggtctg

SEQ ID NO: 2011809 - DNA, 23 bp, Homo sapiens
atagatgggtctggctgagctga

SEQ ID NO: 2011810 - DNA, 13 bp, Homo sapiens
atagatgtgcaag

SEQ ID NO: 2011811 - DNA, 17 bp, Homo sapiens
atagattaatggcactg

SEQ ID NO: 2011812 - DNA, 19 bp, Homo sapiens
atagattaatggcactgat

SEQ ID NO: 2011813 - DNA, 19 bp, Homo sapiens
atagattataaaattattt

SEQ ID NO: 2011814 - DNA, 18 bp, Homo sapiens
atagatttgtattttaaa

SEQ ID NO: 2011815 - DNA, 16 bp, Homo sapiens
atagcaaaagaagaag

SEQ ID NO: 2011816 - DNA, 19 bp, Homo sapiens
atagcaaaagaagaagttt

SEQ ID NO: 2011817 - DNA, 15 bp, Homo sapiens
atagcaaagaattga

SEQ ID NO: 2011818 - DNA, 23 bp, Homo sapiens
ctgctctattgtagcatttcttg

SEQ ID NO: 2011819 - DNA, 15 bp, Homo sapiens
ctgctctcagcctcc

SEQ ID NO: 2011820 - DNA, 15 bp, Homo sapiens
ctgctctccgaccag

SEQ ID NO: 2011821 - DNA, 14 bp, Homo sapiens
ctgctctcctcttg

SEQ ID NO: 2011822 - DNA, 15 bp, Homo sapiens
ctgctctcttcagga

SEQ ID NO: 2011823 - DNA, 16 bp, Homo sapiens
ctgctctcttcaggag

SEQ ID NO: 2011824 - DNA, 18 bp, Homo sapiens
ctgctctgaggcttccag

SEQ ID NO: 2011825 - DNA, 21 bp, Homo sapiens
ctgctctgaggcttccagaga

SEQ ID NO: 2011826 - DNA, 12 bp, Homo sapiens
ctgctctgatgc

SEQ ID NO: 2011827 - DNA, 13 bp, Homo sapiens
ctgctctgatgca

SEQ ID NO: 2011828 - DNA, 11 bp, Homo sapiens
ctgctctgccc

SEQ ID NO: 2011829 - DNA, 12 bp, Homo sapiens
ctgctctgcccc

SEQ ID NO: 2011830 - DNA, 14 bp, Homo sapiens
ctgctctgcccctt

SEQ ID NO: 2011831 - DNA, 23 bp, Homo sapiens
ctgctctgccccttgggcatcca

SEQ ID NO: 2011832 - DNA, 16 bp, Homo sapiens
ctgctcttgcctgcac

SEQ ID NO: 2011833 - DNA, 17 bp, Homo sapiens
ctgctcttgcctgcacc

SEQ ID NO: 2011834 - DNA, 18 bp, Homo sapiens
ctgctcttgcctgcaccc

SEQ ID NO: 2011835 - DNA, 17 bp, Homo sapiens
ctgctgaaacacctccc

SEQ ID NO: 2011836 - DNA, 19 bp, Homo sapiens
ctgctgaaacacctcccag

SEQ ID NO: 2011837 - DNA, 11 bp, Homo sapiens
ctgctgaagag

SEQ ID NO: 2011838 - DNA, 18 bp, Homo sapiens
ctgctgaaggaataaatt

SEQ ID NO: 2011839 - DNA, 23 bp, Homo sapiens
ctgctgaatgatttccaaagaga

SEQ ID NO: 2011840 - DNA, 18 bp, Homo sapiens
ctgctgacagacacaggc

SEQ ID NO: 2011841 - DNA, 13 bp, Homo sapiens
ctgctgacaggat

SEQ ID NO: 2011842 - DNA, 19 bp, Homo sapiens
ctgctgacaggatgtggca

SEQ ID NO: 2011843 - DNA, 23 bp, Homo sapiens
ctgctgacaggatgtggcactgc

SEQ ID NO: 2011844 - DNA, 15 bp, Homo sapiens
ctgctgacagtgttg

SEQ ID NO: 2011845 - DNA, 13 bp, Homo sapiens
ctgctgacctgtt

SEQ ID NO: 2011846 - DNA, 12 bp, Homo sapiens
ctgctgagaacc

SEQ ID NO: 2011847 - DNA, 13 bp, Homo sapiens
ctgctgagaacct

SEQ ID NO: 2011848 - DNA, 19 bp, Homo sapiens
ctgctgagaacctggcctt

SEQ ID NO: 2011849 - DNA, 11 bp, Homo sapiens
ctgctgagcca

SEQ ID NO: 2011850 - DNA, 14 bp, Homo sapiens
ctgctgagccactc

SEQ ID NO: 2011851 - DNA, 17 bp, Homo sapiens
ctgctgagccactcgca

SEQ ID NO: 2011852 - DNA, 19 bp, Homo sapiens
ctgctgagctctgagaggc

SEQ ID NO: 2011853 - DNA, 23 bp, Homo sapiens
ctgctgagctctgagaggccctg

SEQ ID NO: 2011854 - DNA, 16 bp, Homo sapiens
ctgctgcaaagtgcaa

SEQ ID NO: 2011855 - DNA, 14 bp, Homo sapiens
ctgctgcaccagag

SEQ ID NO: 2011856 - DNA, 15 bp, Homo sapiens
tatttaacaagatct

SEQ ID NO: 2011857 - DNA, 14 bp, Homo sapiens
tatttaacataggt

SEQ ID NO: 2011858 - DNA, 23 bp, Homo sapiens
tatttaactctctttatgtctgt

SEQ ID NO: 2011859 - DNA, 18 bp, Homo sapiens
tatttaagcctcatattt

SEQ ID NO: 2011860 - DNA, 21 bp, Homo sapiens
tatttaagcctcatatttaaa

SEQ ID NO: 2011861 - DNA, 16 bp, Homo sapiens
tatttaagtatatagt

SEQ ID NO: 2011862 - DNA, 15 bp, Homo sapiens
tatttaatacctttg

SEQ ID NO: 2011863 - DNA, 13 bp, Homo sapiens
tatttaatagcaa

SEQ ID NO: 2011864 - DNA, 22 bp, Homo sapiens
tatttaatagcaaagaattgac

SEQ ID NO: 2011865 - DNA, 15 bp, Homo sapiens
tatttaatgttatgt

SEQ ID NO: 2011866 - DNA, 12 bp, Homo sapiens
tatttaattgtg

SEQ ID NO: 2011867 - DNA, 13 bp, Homo sapiens
tatttaattgtgt

SEQ ID NO: 2011868 - DNA, 23 bp, Homo sapiens
tatttaatttttttgagacagag

SEQ ID NO: 2011869 - DNA, 13 bp, Homo sapiens
tatttacaatgca

SEQ ID NO: 2011870 - DNA, 17 bp, Homo sapiens
tatttacatatgaaatt

SEQ ID NO: 2011871 - DNA, 21 bp, Homo sapiens
tatttacatatgaaatttaat

SEQ ID NO: 2011872 - DNA, 16 bp, Homo sapiens
tatttactgagcttct

SEQ ID NO: 2011873 - DNA, 19 bp, Homo sapiens
tatttactgagcttctctg

SEQ ID NO: 2011874 - DNA, 15 bp, Homo sapiens
tatttagttatagtt

SEQ ID NO: 2011875 - DNA, 17 bp, Homo sapiens
tatttagttatagtttc

SEQ ID NO: 2011876 - DNA, 13 bp, Homo sapiens
tatttataactca

SEQ ID NO: 2011877 - DNA, 22 bp, Homo sapiens
tatttataactcatcataaaat

SEQ ID NO: 2011878 - DNA, 11 bp, Homo sapiens
tatttatactc

SEQ ID NO: 2011879 - DNA, 13 bp, Homo sapiens
tatttatatattt

SEQ ID NO: 2011880 - DNA, 14 bp, Homo sapiens
tatttatatatttg

SEQ ID NO: 2011881 - DNA, 23 bp, Homo sapiens
tatttatattcagagatgtacca

SEQ ID NO: 2011882 - DNA, 13 bp, Homo sapiens
tatttatattgta

SEQ ID NO: 2011883 - DNA, 18 bp, Homo sapiens
tatttatcagtgacagag

SEQ ID NO: 2011884 - DNA, 22 bp, Homo sapiens
tatttatctccgcaggctattt

SEQ ID NO: 2011885 - DNA, 15 bp, Homo sapiens
tatttatgaatgtgc

SEQ ID NO: 2011886 - DNA, 17 bp, Homo sapiens
tatttatgaatgtgcat

SEQ ID NO: 2011887 - DNA, 12 bp, Homo sapiens
tatttatggctt

SEQ ID NO: 2011888 - DNA, 17 bp, Homo sapiens
tatttatggcttataaa

SEQ ID NO: 2011889 - DNA, 21 bp, Homo sapiens
tatttatggcttataaatgtg

SEQ ID NO: 2011890 - DNA, 12 bp, Homo sapiens
tatttattgggg

SEQ ID NO: 2011891 - DNA, 22 bp, Homo sapiens
tatttattgtttatttatcagt

SEQ ID NO: 2011892 - DNA, 17 bp, Homo sapiens
tatttatttactgagct

SEQ ID NO: 2011893 - DNA, 16 bp, Homo sapiens
tatttatttgaaagtc

SEQ ID NO: 2011894 - DNA, 15 bp, Homo sapiens
tatttcaatgttagc

SEQ ID NO: 2011895 - DNA, 15 bp, Homo sapiens
tatttcacaacagcc

SEQ ID NO: 2011896 - DNA, 19 bp, Homo sapiens
tatttcatacaaaactgtt

SEQ ID NO: 2011897 - DNA, 23 bp, Homo sapiens
tatttcatgattcacaactagga

SEQ ID NO: 2011898 - DNA, 18 bp, Homo sapiens
tatttcctcccccagtta

SEQ ID NO: 2011899 - DNA, 14 bp, Homo sapiens
tatttctagcagag

SEQ ID NO: 2011900 - DNA, 21 bp, Homo sapiens
tatttctcaacaaagcacagt

SEQ ID NO: 2011901 - DNA, 19 bp, Homo sapiens
tatttctcgggtgcatttg

SEQ ID NO: 2011902 - DNA, 20 bp, Homo sapiens
tatttctgtaaaatttgttt

SEQ ID NO: 2011903 - DNA, 20 bp, Homo sapiens
tatttctgtcattcaaatgg

SEQ ID NO: 2011904 - DNA, 13 bp, Homo sapiens
tatttctgtgtta

SEQ ID NO: 2011905 - DNA, 19 bp, Homo sapiens
tatttctttgtgataacaa

SEQ ID NO: 2011906 - DNA, 23 bp, Homo sapiens
tatttgagcatgcacagctgctt

SEQ ID NO: 2011907 - DNA, 16 bp, Homo sapiens
tatttgcactgtagcc

SEQ ID NO: 2011908 - DNA, 15 bp, Homo sapiens
tatttgcatgttacc

SEQ ID NO: 2011909 - DNA, 16 bp, Homo sapiens
tatttgcatgttacct

SEQ ID NO: 2011910 - DNA, 15 bp, Homo sapiens
tatttgctaattaaa

SEQ ID NO: 2011911 - DNA, 14 bp, Homo sapiens
tatttgcttattta

SEQ ID NO: 2011912 - DNA, 23 bp, Homo sapiens
tatttgtaaaagaacagtaaaca

SEQ ID NO: 2011913 - DNA, 15 bp, Homo sapiens
tatttgtaatagatg

SEQ ID NO: 2011914 - DNA, 20 bp, Homo sapiens
tatttgtaatagatgtttga

SEQ ID NO: 2011915 - DNA, 17 bp, Homo sapiens
tatttgtgtaatagaaa

SEQ ID NO: 2011916 - DNA, 17 bp, Homo sapiens
tatttgttaaatattta

SEQ ID NO: 2011917 - DNA, 14 bp, Homo sapiens
tatttgttattttc

SEQ ID NO: 2011918 - DNA, 18 bp, Homo sapiens
tatttgttattttcagta

SEQ ID NO: 2011919 - DNA, 14 bp, Homo sapiens
tatttgttcagaga

SEQ ID NO: 2011920 - DNA, 17 bp, Homo sapiens
tatttgttcccaagagc

SEQ ID NO: 2011921 - DNA, 14 bp, Homo sapiens
tatttgttttcatg

SEQ ID NO: 2011922 - DNA, 15 bp, Homo sapiens
tattttaaaaccatg

SEQ ID NO: 2011923 - DNA, 14 bp, Homo sapiens
tattttaaaagcca

SEQ ID NO: 2011924 - DNA, 23 bp, Homo sapiens
tattttaaaagccacatagagtg

SEQ ID NO: 2011925 - DNA, 16 bp, Homo sapiens
tattttaaagaattgt

SEQ ID NO: 2011926 - DNA, 20 bp, Homo sapiens
tattttaaagctgactttgt

SEQ ID NO: 2011927 - DNA, 22 bp, Homo sapiens
tattttaaagctgactttgttg

SEQ ID NO: 2011928 - DNA, 19 bp, Homo sapiens
tattttaatattttgtatt

SEQ ID NO: 2011929 - DNA, 21 bp, Homo sapiens
tattttacagagcttgaaaac

SEQ ID NO: 2011930 - DNA, 16 bp, Homo sapiens
tattttactactgtgg

SEQ ID NO: 2011931 - DNA, 15 bp, Homo sapiens
tattttagagaatgg

SEQ ID NO: 2011932 - DNA, 15 bp, Homo sapiens
tattttagatgcaat

SEQ ID NO: 2011933 - DNA, 15 bp, Homo sapiens
tattttatctgtgtt

SEQ ID NO: 2011934 - DNA, 13 bp, Homo sapiens
tattttatgattt

SEQ ID NO: 2011935 - DNA, 13 bp, Homo sapiens
tattttcaagaaa

SEQ ID NO: 2011936 - DNA, 13 bp, Homo sapiens
tattttcattaca

SEQ ID NO: 2011937 - DNA, 21 bp, Homo sapiens
tattttcattacaatggaaac

SEQ ID NO: 2011938 - DNA, 18 bp, Homo sapiens
tattttccaataaaattt

SEQ ID NO: 2011939 - DNA, 21 bp, Homo sapiens
tattttccctctcttgccttt

SEQ ID NO: 2011940 - DNA, 18 bp, Homo sapiens
tattttcgtgcatttgtg

SEQ ID NO: 2011941 - DNA, 19 bp, Homo sapiens
tattttcttcccatttgta

SEQ ID NO: 2011942 - DNA, 17 bp, Homo sapiens
tattttgacataaagtt

SEQ ID NO: 2011943 - DNA, 20 bp, Homo sapiens
tattttgtaaactcaaaata

SEQ ID NO: 2011944 - DNA, 16 bp, Homo sapiens
tattttgtaataaact

SEQ ID NO: 2011945 - DNA, 20 bp, Homo sapiens
tatttttatacaccattgtt

SEQ ID NO: 2011946 - DNA, 19 bp, Homo sapiens
tatttttattaaataaata

SEQ ID NO: 2011947 - DNA, 13 bp, Homo sapiens
tatttttatttgt

SEQ ID NO: 2011948 - DNA, 17 bp, Homo sapiens
tatttttatttgtttgt

SEQ ID NO: 2011949 - DNA, 14 bp, Homo sapiens
tatttttctaaggt

SEQ ID NO: 2011950 - DNA, 22 bp, Homo sapiens
tatttttgaaaggcatgttcct

SEQ ID NO: 2011951 - DNA, 19 bp, Homo sapiens
tatttttgaacccctgtgt

SEQ ID NO: 2011952 - DNA, 13 bp, Homo sapiens
tatttttgaataa

SEQ ID NO: 2011953 - DNA, 16 bp, Homo sapiens
tatttttgtacgttat

SEQ ID NO: 2011954 - DNA, 15 bp, Homo sapiens
tatttttgtgtttct

SEQ ID NO: 2011955 - DNA, 16 bp, Homo sapiens
tatttttgtgtttcta

SEQ ID NO: 2011956 - DNA, 18 bp, Homo sapiens
tattttttaaaataattt

SEQ ID NO: 2011957 - DNA, 15 bp, Homo sapiens
tattttttaagtatt

SEQ ID NO: 2011958 - DNA, 13 bp, Homo sapiens
tattttttaataa

SEQ ID NO: 2011959 - DNA, 15 bp, Homo sapiens
tattttttaataaaa

SEQ ID NO: 2011960 - DNA, 16 bp, Homo sapiens
tattttttaatcattt

SEQ ID NO: 2011961 - DNA, 17 bp, Homo sapiens
tattttttttaagtatt

SEQ ID NO: 2011962 - DNA, 19 bp, Homo sapiens
tcaaaaagtgtttattttt

SEQ ID NO: 2011963 - DNA, 23 bp, Homo sapiens
tcaaaaagtgtttatttttcata

SEQ ID NO: 2011964 - DNA, 17 bp, Homo sapiens
tcaaaaattacactaca

SEQ ID NO: 2011965 - DNA, 21 bp, Homo sapiens
tcaaaaattgaagagagatat

SEQ ID NO: 2011966 - DNA, 15 bp, Homo sapiens
tcaaaacagagatgt

SEQ ID NO: 2011967 - DNA, 16 bp, Homo sapiens
tcaaaacatatcaatt

SEQ ID NO: 2011968 - DNA, 17 bp, Homo sapiens
tcaaaacatatcaattc

SEQ ID NO: 2011969 - DNA, 18 bp, Homo sapiens
tcaaaacatatcaattca

SEQ ID NO: 2011970 - DNA, 19 bp, Homo sapiens
tcaaaacatatcaattcaa

SEQ ID NO: 2011971 - DNA, 22 bp, Homo sapiens
ctttgcactgagggccacacta

SEQ ID NO: 2011972 - DNA, 23 bp, Homo sapiens
ctttgcactgagggccacactat

SEQ ID NO: 2011973 - DNA, 14 bp, Homo sapiens
ctttgcagacaggc

SEQ ID NO: 2011974 - DNA, 13 bp, Homo sapiens
ctttgcaggctct

SEQ ID NO: 2011975 - DNA, 15 bp, Homo sapiens
ctttgcaggctctgg

SEQ ID NO: 2011976 - DNA, 21 bp, Homo sapiens
ctttgcatggaatttgtaagt

SEQ ID NO: 2011977 - DNA, 19 bp, Homo sapiens
ctttgccccaaggctgctc

SEQ ID NO: 2011978 - DNA, 12 bp, Homo sapiens
ctttgcctcaaa

SEQ ID NO: 2011979 - DNA, 11 bp, Homo sapiens
ctttgcctgct

SEQ ID NO: 2011980 - DNA, 12 bp, Homo sapiens
ctttgcctgctt

SEQ ID NO: 2011981 - DNA, 11 bp, Homo sapiens
ctttgcctggt

SEQ ID NO: 2011982 - DNA, 12 bp, Homo sapiens
ctttgcctgtgt

SEQ ID NO: 2011983 - DNA, 17 bp, Homo sapiens
ctttgcctgtgtgagca

SEQ ID NO: 2011984 - DNA, 18 bp, Homo sapiens
ctttgcctgtgtgagcat

SEQ ID NO: 2011985 - DNA, 17 bp, Homo sapiens
ctttgctacaataaatg

SEQ ID NO: 2011986 - DNA, 14 bp, Homo sapiens
ctttgctctttctt

SEQ ID NO: 2011987 - DNA, 13 bp, Homo sapiens
ctttgctgtctgg

SEQ ID NO: 2011988 - DNA, 16 bp, Homo sapiens
ctttggaaaaatcttg

SEQ ID NO: 2011989 - DNA, 19 bp, Homo sapiens
ctttggaaaaatcttgggc

SEQ ID NO: 2011990 - DNA, 17 bp, Homo sapiens
ctttggaagaaaaaatc

SEQ ID NO: 2011991 - DNA, 17 bp, Homo sapiens
ctttggaaggagtgaga

SEQ ID NO: 2011992 - DNA, 18 bp, Homo sapiens
ctttggaggaacagctcc

SEQ ID NO: 2011993 - DNA, 15 bp, Homo sapiens
ctttggcccaatgcc

SEQ ID NO: 2011994 - DNA, 19 bp, Homo sapiens
ctttggctattagagatca

SEQ ID NO: 2011995 - DNA, 15 bp, Homo sapiens
ctttggcttctcctg

SEQ ID NO: 2011996 - DNA, 16 bp, Homo sapiens
ctttggcttctcctgt

SEQ ID NO: 2011997 - DNA, 19 bp, Homo sapiens
ctttgggaggccaaggcag

SEQ ID NO: 2011998 - DNA, 14 bp, Homo sapiens
ctttgggaggctga

SEQ ID NO: 2011999 - DNA, 17 bp, Homo sapiens
ctttgggctttgcaggc

SEQ ID NO: 2012000 - DNA, 19 bp, Homo sapiens
ctttgggctttgcaggctc

SEQ ID NO: 2012001 - DNA, 17 bp, Homo sapiens
ctttggggaagggggag

SEQ ID NO: 2012002 - DNA, 24 bp, Homo sapiens
ctttggggacagttggcagagaag

SEQ ID NO: 2012003 - DNA, 20 bp, Homo sapiens
ctttggggcttttacaccag

SEQ ID NO: 2012004 - DNA, 14 bp, Homo sapiens
ctttggtagaaaag

SEQ ID NO: 2012005 - DNA, 22 bp, Homo sapiens
ctttggtgcagaggtttcttga

SEQ ID NO: 2012006 - DNA, 19 bp, Homo sapiens
ctttggttctctccaggaa

SEQ ID NO: 2012007 - DNA, 20 bp, Homo sapiens
ctttggttctctccaggaag

SEQ ID NO: 2012008 - DNA, 21 bp, Homo sapiens
ctttggttctctccaggaagg

SEQ ID NO: 2012009 - DNA, 21 bp, Homo sapiens
ctttggttgcttaactggctg

SEQ ID NO: 2012010 - DNA, 14 bp, Homo sapiens
ctttgtaaaggtca

SEQ ID NO: 2012011 - DNA, 15 bp, Homo sapiens
ctttgtaaaggtcag

SEQ ID NO: 2012012 - DNA, 16 bp, Homo sapiens
ctttgtaaaggtcaga

SEQ ID NO: 2012013 - DNA, 19 bp, Homo sapiens
ctttgtaatcgttatgtgt

SEQ ID NO: 2012014 - DNA, 17 bp, Homo sapiens
ctttgtaatgtcaccac

SEQ ID NO: 2012015 - DNA, 21 bp, Homo sapiens
ctttgtaatgtcaccaccttc

SEQ ID NO: 2012016 - DNA, 16 bp, Homo sapiens
ctttgtaccatctgtc

SEQ ID NO: 2012017 - DNA, 14 bp, Homo sapiens
ctttgtgacaggaa

SEQ ID NO: 2012018 - DNA, 22 bp, Homo sapiens
ctttgtgacaggaaagccctcc

SEQ ID NO: 2012019 - DNA, 23 bp, Homo sapiens
ctttgtgacaggaaagccctccc

SEQ ID NO: 2012020 - DNA, 21 bp, Homo sapiens
ctttgtgggagggtaagacaa

SEQ ID NO: 2012021 - DNA, 19 bp, Homo sapiens
ctttgttaaaaatattttc

SEQ ID NO: 2012022 - DNA, 19 bp, Homo sapiens
ctttgttattatcctgcat

SEQ ID NO: 2012023 - DNA, 22 bp, Homo sapiens
ctttgttatttttgtttcttcc

SEQ ID NO: 2012024 - DNA, 17 bp, Homo sapiens
ctttgttctttatttgt

SEQ ID NO: 2012025 - DNA, 22 bp, Homo sapiens
ctttgtttgggccactgccagc

SEQ ID NO: 2012026 - DNA, 14 bp, Homo sapiens
ctttgttttctaaa

SEQ ID NO: 2012027 - DNA, 14 bp, Homo sapiens
ctttgttttgcact

SEQ ID NO: 2012028 - DNA, 15 bp, Homo sapiens
ctttgttttgcactg

SEQ ID NO: 2012029 - DNA, 18 bp, Homo sapiens
cttttaaaacacttccat

SEQ ID NO: 2012030 - DNA, 13 bp, Homo sapiens
cttttaagaaaca

SEQ ID NO: 2012031 - DNA, 12 bp, Homo sapiens
cttttactcctt

SEQ ID NO: 2012032 - DNA, 14 bp, Homo sapiens
cttttactcctttg

SEQ ID NO: 2012033 - DNA, 17 bp, Homo sapiens
cttttactcctttgcat

SEQ ID NO: 2012034 - DNA, 20 bp, Homo sapiens
cttttactcctttgcattcc

SEQ ID NO: 2012035 - DNA, 22 bp, Homo sapiens
cttttaggaatatgttcaatgc

SEQ ID NO: 2012036 - DNA, 18 bp, Homo sapiens
cttttagttgtatctctt

SEQ ID NO: 2012037 - DNA, 22 bp, Homo sapiens
cttttagttttagttgcagaaa

SEQ ID NO: 2012038 - DNA, 17 bp, Homo sapiens
cttttatagctattact

SEQ ID NO: 2012039 - DNA, 18 bp, Homo sapiens
cttttatgttatttatat

SEQ ID NO: 2012040 - DNA, 19 bp, Homo sapiens
cttttattgtataaactat

SEQ ID NO: 2012041 - DNA, 12 bp, Homo sapiens
cttttatttcca

SEQ ID NO: 2012042 - DNA, 13 bp, Homo sapiens
cttttatttggaa

SEQ ID NO: 2012043 - DNA, 17 bp, Homo sapiens
cttttcaattatttcaa

SEQ ID NO: 2012044 - DNA, 18 bp, Homo sapiens
cttttcaattatttcaat

SEQ ID NO: 2012045 - DNA, 12 bp, Homo sapiens
cttttcacggga

SEQ ID NO: 2012046 - DNA, 19 bp, Homo sapiens
cttttcacgggaactctcc

SEQ ID NO: 2012047 - DNA, 16 bp, Homo sapiens
cttttcactgctggct

SEQ ID NO: 2012048 - DNA, 20 bp, Homo sapiens
cttttcactgctggctgcct

SEQ ID NO: 2012049 - DNA, 20 bp, Homo sapiens
cttttcataacctagcctta

SEQ ID NO: 2012050 - DNA, 18 bp, Homo sapiens
cttttccaggagttctga

SEQ ID NO: 2012051 - DNA, 22 bp, Homo sapiens
cttttccaggagttctgaagct

SEQ ID NO: 2012052 - DNA, 14 bp, Homo sapiens
cttttccccggtcc

SEQ ID NO: 2012053 - DNA, 13 bp, Homo sapiens
cttttcctccaga

SEQ ID NO: 2012054 - DNA, 17 bp, Homo sapiens
cttttctaatctctttt

SEQ ID NO: 2012055 - DNA, 15 bp, Homo sapiens
cttttctgcagaggg

SEQ ID NO: 2012056 - DNA, 19 bp, Homo sapiens
cttttctggaatgtaatca

SEQ ID NO: 2012057 - DNA, 13 bp, Homo sapiens
cttttctttttcc

SEQ ID NO: 2012058 - DNA, 19 bp, Homo sapiens
cttttctttttcccttgaa

SEQ ID NO: 2012059 - DNA, 14 bp, Homo sapiens
cttttctttttctc

SEQ ID NO: 2012060 - DNA, 21 bp, Homo sapiens
cttttgaatccatgcttgggt

SEQ ID NO: 2012061 - DNA, 23 bp, Homo sapiens
cttttgaatccatgcttgggtgt

SEQ ID NO: 2012062 - DNA, 18 bp, Homo sapiens
cttttgacttaaagcaga

SEQ ID NO: 2012063 - DNA, 14 bp, Homo sapiens
cttttgagaggggt

SEQ ID NO: 2012064 - DNA, 16 bp, Homo sapiens
cttttgatggggagaa

SEQ ID NO: 2012065 - DNA, 19 bp, Homo sapiens
cttttgccactttggcttc

SEQ ID NO: 2012066 - DNA, 20 bp, Homo sapiens
cttttgccactttggcttct

SEQ ID NO: 2012067 - DNA, 21 bp, Homo sapiens
cttttgcccttcacagtgttt

SEQ ID NO: 2012068 - DNA, 22 bp, Homo sapiens
cttttgctcttagctgtctgct

SEQ ID NO: 2012069 - DNA, 15 bp, Homo sapiens
cttttgctgtctttc

SEQ ID NO: 2012070 - DNA, 23 bp, Homo sapiens
cttttgctgtttggatgtttcca

SEQ ID NO: 2012071 - DNA, 13 bp, Homo sapiens
cttttggccttgt

SEQ ID NO: 2012072 - DNA, 14 bp, Homo sapiens
cttttggccttgtg

SEQ ID NO: 2012073 - DNA, 13 bp, Homo sapiens
cttttgtaaatgt

SEQ ID NO: 2012074 - DNA, 17 bp, Homo sapiens
cttttgtaccagtgtga

SEQ ID NO: 2012075 - DNA, 19 bp, Homo sapiens
cttttgtaccagtgtgaat

SEQ ID NO: 2012076 - DNA, 19 bp, Homo sapiens
cttttgtatttaaaacctt

SEQ ID NO: 2012077 - DNA, 18 bp, Homo sapiens
cttttgtccccagggccc

SEQ ID NO: 2012078 - DNA, 17 bp, Homo sapiens
cttttgtcctgttattt

SEQ ID NO: 2012079 - DNA, 20 bp, Homo sapiens
cttttgtccttcctgtgccc

SEQ ID NO: 2012080 - DNA, 12 bp, Homo sapiens
cttttgtggatt

SEQ ID NO: 2012081 - DNA, 16 bp, Homo sapiens
cttttgtggattgaca

SEQ ID NO: 2012082 - DNA, 14 bp, Homo sapiens
cttttgttgtgact

SEQ ID NO: 2012083 - DNA, 21 bp, Homo sapiens
ctttttaaaaagttgcacatt

SEQ ID NO: 2012084 - DNA, 19 bp, Homo sapiens
ctttttaagcttatttaat

SEQ ID NO: 2012085 - DNA, 19 bp, Homo sapiens
ctttttagggccaggcagg

SEQ ID NO: 2012086 - DNA, 13 bp, Homo sapiens
gaaattcacactg

SEQ ID NO: 2012087 - DNA, 13 bp, Homo sapiens
gaaattcccccac

SEQ ID NO: 2012088 - DNA, 21 bp, Homo sapiens
gaaattcccccacttgggagc

SEQ ID NO: 2012089 - DNA, 22 bp, Homo sapiens
gaaattgcctccttatttatca

SEQ ID NO: 2012090 - DNA, 15 bp, Homo sapiens
gaaattgttcctgat

SEQ ID NO: 2012091 - DNA, 22 bp, Homo sapiens
gaaattgtttaagtgttgtaaa

SEQ ID NO: 2012092 - DNA, 18 bp, Homo sapiens
gaaatttaaaaataaagc

SEQ ID NO: 2012093 - DNA, 20 bp, Homo sapiens
gaaatttaaactataagcaa

SEQ ID NO: 2012094 - DNA, 16 bp, Homo sapiens
gaaatttactgtgaga

SEQ ID NO: 2012095 - DNA, 19 bp, Homo sapiens
gaaatttcccacaccccag

SEQ ID NO: 2012096 - DNA, 15 bp, Homo sapiens
gaaatttgatttcta

SEQ ID NO: 2012097 - DNA, 22 bp, Homo sapiens
gaaattttactgacagaaatgc

SEQ ID NO: 2012098 - DNA, 20 bp, Homo sapiens
gaaattttctagactttctg

SEQ ID NO: 2012099 - DNA, 13 bp, Homo sapiens
gaaattttgtcca

SEQ ID NO: 2012100 - DNA, 18 bp, Homo sapiens
gaaattttgtccatttta

SEQ ID NO: 2012101 - DNA, 18 bp, Homo sapiens
gaacaaactgatgcgaaa

SEQ ID NO: 2012102 - DNA, 17 bp, Homo sapiens
gaacaaagaaaaaaata

SEQ ID NO: 2012103 - DNA, 19 bp, Homo sapiens
gaacaaagaaaaaaatata

SEQ ID NO: 2012104 - DNA, 22 bp, Homo sapiens
gaacaaagaacggcatgtgaat

SEQ ID NO: 2012105 - DNA, 19 bp, Homo sapiens
gaacaactaggcttcagca

SEQ ID NO: 2012106 - DNA, 16 bp, Homo sapiens
gaacaagcattctcct

SEQ ID NO: 2012107 - DNA, 14 bp, Homo sapiens
gaacaagtcacagc

SEQ ID NO: 2012108 - DNA, 16 bp, Homo sapiens
gaacaagtcacagctg

SEQ ID NO: 2012109 - DNA, 15 bp, Homo sapiens
gaacaatgtcagaaa

SEQ ID NO: 2012110 - DNA, 15 bp, Homo sapiens
gaacacactcagcag

SEQ ID NO: 2012111 - DNA, 17 bp, Homo sapiens
gaacacactcagcagcc

SEQ ID NO: 2012112 - DNA, 20 bp, Homo sapiens
gaacacactcagcagccccc

SEQ ID NO: 2012113 - DNA, 20 bp, Homo sapiens
gaacacagcagttctgcaga

SEQ ID NO: 2012114 - DNA, 22 bp, Homo sapiens
gaacacagcctgggaccagggc

SEQ ID NO: 2012115 - DNA, 17 bp, Homo sapiens
gaacacaggcaaaatcc

SEQ ID NO: 2012116 - DNA, 20 bp, Homo sapiens
gaacaccactttgtctctga

SEQ ID NO: 2012117 - DNA, 12 bp, Homo sapiens
gaacacccactg

SEQ ID NO: 2012118 - DNA, 14 bp, Homo sapiens
gaacacccctgtgc

SEQ ID NO: 2012119 - DNA, 15 bp, Homo sapiens
gaacacccctgtgca

SEQ ID NO: 2012120 - DNA, 22 bp, Homo sapiens
gaacacctttgttttgcactga

SEQ ID NO: 2012121 - DNA, 16 bp, Homo sapiens
gaacactgggggaggg

SEQ ID NO: 2012122 - DNA, 20 bp, Homo sapiens
gaacagactggaagcacagc

SEQ ID NO: 2012123 - DNA, 15 bp, Homo sapiens
gaacagagactctgg

SEQ ID NO: 2012124 - DNA, 16 bp, Homo sapiens
gaacagagcgggcctc

SEQ ID NO: 2012125 - DNA, 14 bp, Homo sapiens
gaacagaggcattt

SEQ ID NO: 2012126 - DNA, 19 bp, Homo sapiens
gaacaggcaagtgaagaaa

SEQ ID NO: 2012127 - DNA, 21 bp, Homo sapiens
gaacagtcacccttctgggca

SEQ ID NO: 2012128 - DNA, 18 bp, Homo sapiens
gaacagtgtttcccataa

SEQ ID NO: 2012129 - DNA, 21 bp, Homo sapiens
gaacatctcactttgccccag

SEQ ID NO: 2012130 - DNA, 17 bp, Homo sapiens
gaacatctgtcctgtga

SEQ ID NO: 2012131 - DNA, 19 bp, Homo sapiens
gaacatgcacatttatata

SEQ ID NO: 2012132 - DNA, 20 bp, Homo sapiens
gaacatgccctcagctaagc

SEQ ID NO: 2012133 - DNA, 15 bp, Homo sapiens
gaacatgcctgattt

SEQ ID NO: 2012134 - DNA, 19 bp, Homo sapiens
gaacatgtcggagtagaaa

SEQ ID NO: 2012135 - DNA, 19 bp, Homo sapiens
gaacattcgaggtgtcacc

SEQ ID NO: 2012136 - DNA, 15 bp, Homo sapiens
gaacatttacacatt

SEQ ID NO: 2012137 - DNA, 20 bp, Homo sapiens
gaacatttcttatgattttt

SEQ ID NO: 2012138 - DNA, 22 bp, Homo sapiens
gaacatttcttatgatttttaa

SEQ ID NO: 2012139 - DNA, 13 bp, Homo sapiens
gaacatttgcttt

SEQ ID NO: 2012140 - DNA, 20 bp, Homo sapiens
gaaccacatcttgctctgct

SEQ ID NO: 2012141 - DNA, 16 bp, Homo sapiens
gaaccaccacacccag

SEQ ID NO: 2012142 - DNA, 17 bp, Homo sapiens
gaaccaccacacccagc

SEQ ID NO: 2012143 - DNA, 20 bp, Homo sapiens
gaaccaccacacccagccca

SEQ ID NO: 2012144 - DNA, 16 bp, Homo sapiens
gaaccatccttcccat

SEQ ID NO: 2012145 - DNA, 17 bp, Homo sapiens
gaaccatccttcccatg

SEQ ID NO: 2012146 - DNA, 17 bp, Homo sapiens
gaacccaagtccaagca

SEQ ID NO: 2012147 - DNA, 14 bp, Homo sapiens
gaacccacctgctg

SEQ ID NO: 2012148 - DNA, 17 bp, Homo sapiens
gaacccagccctggggt

SEQ ID NO: 2012149 - DNA, 16 bp, Homo sapiens
gaacccaggaggtgga

SEQ ID NO: 2012150 - DNA, 16 bp, Homo sapiens
gaaccccatgggcttg

SEQ ID NO: 2012151 - DNA, 21 bp, Homo sapiens
gaacccctacatgaaacagaa

SEQ ID NO: 2012152 - DNA, 13 bp, Homo sapiens
gaacccctgtgtc

SEQ ID NO: 2012153 - DNA, 19 bp, Homo sapiens
gaacccctgtgtccctttt

SEQ ID NO: 2012154 - DNA, 15 bp, Homo sapiens
gaacccttgtgcttg

SEQ ID NO: 2012155 - DNA, 22 bp, Homo sapiens
gaaccgacttttctaaagctct

SEQ ID NO: 2012156 - DNA, 17 bp, Homo sapiens
gaaccgtgtccagcaca

SEQ ID NO: 2012157 - DNA, 18 bp, Homo sapiens
gaaccgtgtccagcacag

SEQ ID NO: 2012158 - DNA, 19 bp, Homo sapiens
gaacctaattcaattcaaa

SEQ ID NO: 2012159 - DNA, 20 bp, Homo sapiens
gaacctagtactctctgctc

SEQ ID NO: 2012160 - DNA, 22 bp, Homo sapiens
gaacctcaagtctagaaaccag

SEQ ID NO: 2012161 - DNA, 14 bp, Homo sapiens
gaacctcagtttcc

SEQ ID NO: 2012162 - DNA, 16 bp, Homo sapiens
gaacctggagggctag

SEQ ID NO: 2012163 - DNA, 12 bp, Homo sapiens
gaacctggcctt

SEQ ID NO: 2012164 - DNA, 10 bp, Homo sapiens
gaaccttccc

SEQ ID NO: 2012165 - DNA, 17 bp, Homo sapiens
gaacgagcactggccag

SEQ ID NO: 2012166 - DNA, 23 bp, Homo sapiens
gaacggagccccaggcctctgtg

SEQ ID NO: 2012167 - DNA, 23 bp, Homo sapiens
gaactcatcctgtgtggggaggc

SEQ ID NO: 2012168 - DNA, 18 bp, Homo sapiens
gaactccactctccttcg

SEQ ID NO: 2012169 - DNA, 11 bp, Homo sapiens
gaactcccagc

SEQ ID NO: 2012170 - DNA, 13 bp, Homo sapiens
gaactcctggcct

SEQ ID NO: 2012171 - DNA, 14 bp, Homo sapiens
gaactcctggcctc

SEQ ID NO: 2012172 - DNA, 15 bp, Homo sapiens
gaactccttgatttt

SEQ ID NO: 2012173 - DNA, 21 bp, Homo sapiens
gaactctaccctggtaggaaa

SEQ ID NO: 2012174 - DNA, 14 bp, Homo sapiens
gaactctgacaagg

SEQ ID NO: 2012175 - DNA, 15 bp, Homo sapiens
gaactctgacaaggg

SEQ ID NO: 2012176 - DNA, 19 bp, Homo sapiens
gaactgaagggggcggcct

SEQ ID NO: 2012177 - DNA, 16 bp, Homo sapiens
gaactgagccaaacac

SEQ ID NO: 2012178 - DNA, 19 bp, Homo sapiens
gaactgagcctagctacct

SEQ ID NO: 2012179 - DNA, 14 bp, Homo sapiens
gaactgccaagaaa

SEQ ID NO: 2012180 - DNA, 15 bp, Homo sapiens
gaactgccaagaaaa

SEQ ID NO: 2012181 - DNA, 12 bp, Homo sapiens
gaactggctgca

SEQ ID NO: 2012182 - DNA, 20 bp, Homo sapiens
gaactggttcaagagacact

SEQ ID NO: 2012183 - DNA, 19 bp, Homo sapiens
gaactgtcagcccacagca

SEQ ID NO: 2012184 - DNA, 12 bp, Homo sapiens
gaactgtgacag

SEQ ID NO: 2012185 - DNA, 14 bp, Homo sapiens
gaactgtgcctagt

SEQ ID NO: 2012186 - DNA, 19 bp, Homo sapiens
gaactgttgtttacttgtt

SEQ ID NO: 2012187 - DNA, 18 bp, Homo sapiens
gaacttacacttggagcc

SEQ ID NO: 2012188 - DNA, 23 bp, Homo sapiens
gaacttacacttggagcccgtgc

SEQ ID NO: 2012189 - DNA, 14 bp, Homo sapiens
gaacttcaaaatgt

SEQ ID NO: 2012190 - DNA, 14 bp, Homo sapiens
gaacttcaatcact

SEQ ID NO: 2012191 - DNA, 21 bp, Homo sapiens
gaacttcgaccctttctctga

SEQ ID NO: 2012192 - DNA, 14 bp, Homo sapiens
gaacttgaggacac

SEQ ID NO: 2012193 - DNA, 15 bp, Homo sapiens
gaacttgaggacaca

SEQ ID NO: 2012194 - DNA, 19 bp, Homo sapiens
gaacttgaggacacatgtc

SEQ ID NO: 2012195 - DNA, 21 bp, Homo sapiens
gaacttgaggacacatgtcca

SEQ ID NO: 2012196 - DNA, 22 bp, Homo sapiens
gaacttgctgctgagtgcacca

SEQ ID NO: 2012197 - DNA, 21 bp, Homo sapiens
gaactttctcttcatactttt

SEQ ID NO: 2012198 - DNA, 13 bp, Homo sapiens
gaagaaaaagaag

SEQ ID NO: 2012199 - DNA, 14 bp, Homo sapiens
gaagaaaaagaagc

SEQ ID NO: 2012200 - DNA, 14 bp, Homo sapiens
gaagaaaactatcc

SEQ ID NO: 2012201 - DNA, 17 bp, Homo sapiens
gaatatttattacctct

SEQ ID NO: 2012202 - DNA, 20 bp, Homo sapiens
gaatattttcattaaaagct

SEQ ID NO: 2012203 - DNA, 14 bp, Homo sapiens
gaatcaaaactctc

SEQ ID NO: 2012204 - DNA, 14 bp, Homo sapiens
gaatcaaggaatcc

SEQ ID NO: 2012205 - DNA, 17 bp, Homo sapiens
gaatcaatttcccagaa

SEQ ID NO: 2012206 - DNA, 22 bp, Homo sapiens
gaatcaatttcccagaagggag

SEQ ID NO: 2012207 - DNA, 16 bp, Homo sapiens
gaatcacacaagtttg

SEQ ID NO: 2012208 - DNA, 14 bp, Homo sapiens
gaatcacctggagg

SEQ ID NO: 2012209 - DNA, 19 bp, Homo sapiens
gaatcacctggagggcttg

SEQ ID NO: 2012210 - DNA, 23 bp, Homo sapiens
gaatcactgtattttcattttaa

SEQ ID NO: 2012211 - DNA, 19 bp, Homo sapiens
gaatcagacttcacactgc

SEQ ID NO: 2012212 - DNA, 13 bp, Homo sapiens
gaatcataatttt

SEQ ID NO: 2012213 - DNA, 15 bp, Homo sapiens
gaatcataattttca

SEQ ID NO: 2012214 - DNA, 17 bp, Homo sapiens
gaatcataattttcaag

SEQ ID NO: 2012215 - DNA, 20 bp, Homo sapiens
gaatcatgtcaggcctgtgt

SEQ ID NO: 2012216 - DNA, 21 bp, Homo sapiens
gaatcatgtcaggcctgtgtg

SEQ ID NO: 2012217 - DNA, 22 bp, Homo sapiens
gaatcatgttggatagtcagct

SEQ ID NO: 2012218 - DNA, 18 bp, Homo sapiens
gaatccagacccggctgc

SEQ ID NO: 2012219 - DNA, 19 bp, Homo sapiens
gaatccatcaggacttggg

SEQ ID NO: 2012220 - DNA, 18 bp, Homo sapiens
gaatcccacccacatgtg

SEQ ID NO: 2012221 - DNA, 15 bp, Homo sapiens
gaatccgcctgcaga

SEQ ID NO: 2012222 - DNA, 14 bp, Homo sapiens
gaatcctgcctctc

SEQ ID NO: 2012223 - DNA, 15 bp, Homo sapiens
gaatcgtttcaaatg

SEQ ID NO: 2012224 - DNA, 13 bp, Homo sapiens
gaatctacagaac

SEQ ID NO: 2012225 - DNA, 18 bp, Homo sapiens
gaatctagggagggggaa

SEQ ID NO: 2012226 - DNA, 12 bp, Homo sapiens
gaatctcccctc

SEQ ID NO: 2012227 - DNA, 14 bp, Homo sapiens
gaatctcccctcct

SEQ ID NO: 2012228 - DNA, 20 bp, Homo sapiens
gaatctgataggaaaagaag

SEQ ID NO: 2012229 - DNA, 19 bp, Homo sapiens
gaatctgcagggagcaact

SEQ ID NO: 2012230 - DNA, 15 bp, Homo sapiens
gaatctgtgcagatg

SEQ ID NO: 2012231 - DNA, 12 bp, Homo sapiens
gaatctgttact

SEQ ID NO: 2012232 - DNA, 15 bp, Homo sapiens
gaatctgttactgaa

SEQ ID NO: 2012233 - DNA, 21 bp, Homo sapiens
gaatgaaagggcccagagagg

SEQ ID NO: 2012234 - DNA, 18 bp, Homo sapiens
gaatgaaccacatcttgc

SEQ ID NO: 2012235 - DNA, 22 bp, Homo sapiens
gaatgaaccacatcttgctctg

SEQ ID NO: 2012236 - DNA, 18 bp, Homo sapiens
gaatgaagacctaaatga

SEQ ID NO: 2012237 - DNA, 16 bp, Homo sapiens
gaatgaagcatgtagc

SEQ ID NO: 2012238 - DNA, 16 bp, Homo sapiens
gaatgaattaaataaa

SEQ ID NO: 2012239 - DNA, 12 bp, Homo sapiens
gaatgacactgt

SEQ ID NO: 2012240 - DNA, 19 bp, Homo sapiens
gaatgaccacgggcctcag

SEQ ID NO: 2012241 - DNA, 17 bp, Homo sapiens
gaatgactataaacatt

SEQ ID NO: 2012242 - DNA, 11 bp, Homo sapiens
gaatgagcctc

SEQ ID NO: 2012243 - DNA, 22 bp, Homo sapiens
gaatgatttccaaagagaaaaa

SEQ ID NO: 2012244 - DNA, 16 bp, Homo sapiens
gaatgcagattcctgg

SEQ ID NO: 2012245 - DNA, 21 bp, Homo sapiens
gaatgcagattcctgggcctg

SEQ ID NO: 2012246 - DNA, 14 bp, Homo sapiens
gaatgcatgtaagg

SEQ ID NO: 2012247 - DNA, 19 bp, Homo sapiens
gaatgccttccgggccggg

SEQ ID NO: 2012248 - DNA, 13 bp, Homo sapiens
gaatgctgagacc

SEQ ID NO: 2012249 - DNA, 15 bp, Homo sapiens
gaatgctgtatatgt

SEQ ID NO: 2012250 - DNA, 18 bp, Homo sapiens
gaatgctttttgaatgtt

SEQ ID NO: 2012251 - DNA, 22 bp, Homo sapiens
gaatggcacagcccaaagaagg

SEQ ID NO: 2012252 - DNA, 18 bp, Homo sapiens
gaatggccctagaactgt

SEQ ID NO: 2012253 - DNA, 17 bp, Homo sapiens
gaatggcctgccttgaa

SEQ ID NO: 2012254 - DNA, 15 bp, Homo sapiens
gaatgggtttactct

SEQ ID NO: 2012255 - DNA, 22 bp, Homo sapiens
gaatggtgtgaacccgggaagc

SEQ ID NO: 2012256 - DNA, 19 bp, Homo sapiens
gaatggttccatgcctgag

SEQ ID NO: 2012257 - DNA, 15 bp, Homo sapiens
gaatgtatctcctcc

SEQ ID NO: 2012258 - DNA, 17 bp, Homo sapiens
gaatgtcaccagtcctg

SEQ ID NO: 2012259 - DNA, 17 bp, Homo sapiens
gaatgtcccttttccta

SEQ ID NO: 2012260 - DNA, 22 bp, Homo sapiens
gaatgtctttgttggaaaagaa

SEQ ID NO: 2012261 - DNA, 20 bp, Homo sapiens
gaatgttaagacttgacagt

SEQ ID NO: 2012262 - DNA, 16 bp, Homo sapiens
gaatgttccctgcacc

SEQ ID NO: 2012263 - DNA, 20 bp, Homo sapiens
gaatgttccctgcaccctgg

SEQ ID NO: 2012264 - DNA, 16 bp, Homo sapiens
gaatgtttgaactgcc

SEQ ID NO: 2012265 - DNA, 17 bp, Homo sapiens
gaatgtttgcctctgcc

SEQ ID NO: 2012266 - DNA, 18 bp, Homo sapiens
gaatgtttgcctctgcct

SEQ ID NO: 2012267 - DNA, 12 bp, Homo sapiens
gaattaaataaa

SEQ ID NO: 2012268 - DNA, 14 bp, Homo sapiens
gaattaagttattg

SEQ ID NO: 2012269 - DNA, 15 bp, Homo sapiens
gaattaatagctttt

SEQ ID NO: 2012270 - DNA, 20 bp, Homo sapiens
gaattaattggctatatgga

SEQ ID NO: 2012271 - DNA, 18 bp, Homo sapiens
gaattatatctaatttat

SEQ ID NO: 2012272 - DNA, 23 bp, Homo sapiens
gaattatatctaatttatacaaa

SEQ ID NO: 2012273 - DNA, 18 bp, Homo sapiens
gaattcagcaccctgggt

SEQ ID NO: 2012274 - DNA, 18 bp, Homo sapiens
gaattcatgtgaaaataa

SEQ ID NO: 2012275 - DNA, 13 bp, Homo sapiens
gaattccaaggag

SEQ ID NO: 2012276 - DNA, 17 bp, Homo sapiens
gaattcctgaagccaga

SEQ ID NO: 2012277 - DNA, 20 bp, Homo sapiens
gaattctaagattgtacata

SEQ ID NO: 2012278 - DNA, 19 bp, Homo sapiens
gaattctgctacctcactg

SEQ ID NO: 2012279 - DNA, 14 bp, Homo sapiens
gaattctggaggaa

SEQ ID NO: 2012280 - DNA, 17 bp, Homo sapiens
gaattctggaggaagaa

SEQ ID NO: 2012281 - DNA, 17 bp, Homo sapiens
gaattctgtgaagaatg

SEQ ID NO: 2012282 - DNA, 19 bp, Homo sapiens
gaattctttacaataaaca

SEQ ID NO: 2012283 - DNA, 20 bp, Homo sapiens
gaattgaaggagaaaatgca

SEQ ID NO: 2012284 - DNA, 14 bp, Homo sapiens
gaattgagctgcag

SEQ ID NO: 2012285 - DNA, 19 bp, Homo sapiens
gaattgagtgtttaaagtt

SEQ ID NO: 2012286 - DNA, 22 bp, Homo sapiens
gaattgcctgcagagagaagcc

SEQ ID NO: 2012287 - DNA, 14 bp, Homo sapiens
gaattgctgctctc

SEQ ID NO: 2012288 - DNA, 17 bp, Homo sapiens
gaattgggagcttggga

SEQ ID NO: 2012289 - DNA, 17 bp, Homo sapiens
gaattgtccatgtgctt

SEQ ID NO: 2012290 - DNA, 12 bp, Homo sapiens
gaattgtgcaaa

SEQ ID NO: 2012291 - DNA, 21 bp, Homo sapiens
gaatttcttggtaagaagccg

SEQ ID NO: 2012292 - DNA, 15 bp, Homo sapiens
gaattttaagtgctt

SEQ ID NO: 2012293 - DNA, 15 bp, Homo sapiens
gaattttagaagaga

SEQ ID NO: 2012294 - DNA, 14 bp, Homo sapiens
gaattttcagaccc

SEQ ID NO: 2012295 - DNA, 21 bp, Homo sapiens
gaattttctttgtgtagcttt

SEQ ID NO: 2012296 - DNA, 15 bp, Homo sapiens
gaatttttaatgact

SEQ ID NO: 2012297 - DNA, 16 bp, Homo sapiens
gaattttttgagtaat

SEQ ID NO: 2012298 - DNA, 22 bp, Homo sapiens
gaatttttttttcctagccctc

SEQ ID NO: 2012299 - DNA, 18 bp, Homo sapiens
gacaaaaacagcctcaca

SEQ ID NO: 2012300 - DNA, 15 bp, Homo sapiens
gacaaaactagagac

SEQ ID NO: 2012301 - DNA, 20 bp, Homo sapiens
gacaaaattggccagagagt

SEQ ID NO: 2012302 - DNA, 17 bp, Homo sapiens
gacaaacacctcccagg

SEQ ID NO: 2012303 - DNA, 22 bp, Homo sapiens
gacaaacacctcccaggagaca

SEQ ID NO: 2012304 - DNA, 18 bp, Homo sapiens
gacaaaccactgtacata

SEQ ID NO: 2012305 - DNA, 18 bp, Homo sapiens
gacaaagcatcattgtaa

SEQ ID NO: 2012306 - DNA, 18 bp, Homo sapiens
gacaaagggaaggctgct

SEQ ID NO: 2012307 - DNA, 18 bp, Homo sapiens
gacaaagttccaaaatgc

SEQ ID NO: 2012308 - DNA, 22 bp, Homo sapiens
gacaacagaagtcatgaagccc

SEQ ID NO: 2012309 - DNA, 21 bp, Homo sapiens
gacaacaggttttcaccatag

SEQ ID NO: 2012310 - DNA, 23 bp, Homo sapiens
gacaacaggttttcaccatagcc

SEQ ID NO: 2012311 - DNA, 16 bp, Homo sapiens
gacaacatcccacagt

SEQ ID NO: 2012312 - DNA, 13 bp, Homo sapiens
gacaacctttgtg

SEQ ID NO: 2012313 - DNA, 16 bp, Homo sapiens
gacaacctttgtgtaa

SEQ ID NO: 2012314 - DNA, 15 bp, Homo sapiens
gacaagaaatccctg

SEQ ID NO: 2012315 - DNA, 14 bp, Homo sapiens
gacaagaagctgct

SEQ ID NO: 2012316 - DNA, 21 bp, Homo sapiens
attgtataaactatcagtttg

SEQ ID NO: 2012317 - DNA, 11 bp, Homo sapiens
attgtatatat

SEQ ID NO: 2012318 - DNA, 15 bp, Homo sapiens
attgtatatatgtgt

SEQ ID NO: 2012319 - DNA, 12 bp, Homo sapiens
attgtatgatgt

SEQ ID NO: 2012320 - DNA, 21 bp, Homo sapiens
attgtatgatgtgttgtgata

SEQ ID NO: 2012321 - DNA, 22 bp, Homo sapiens
attgtattttagcagggtacat

SEQ ID NO: 2012322 - DNA, 14 bp, Homo sapiens
attgtcagatattt

SEQ ID NO: 2012323 - DNA, 21 bp, Homo sapiens
attgtccatatcagacctctg

SEQ ID NO: 2012324 - DNA, 19 bp, Homo sapiens
attgtccatgcctacagat

SEQ ID NO: 2012325 - DNA, 23 bp, Homo sapiens
attgtccatgcctacagataatt

SEQ ID NO: 2012326 - DNA, 23 bp, Homo sapiens
attgtcctcccctattttaagac

SEQ ID NO: 2012327 - DNA, 13 bp, Homo sapiens
attgtccttcaga

SEQ ID NO: 2012328 - DNA, 16 bp, Homo sapiens
attgtccttcagagct

SEQ ID NO: 2012329 - DNA, 17 bp, Homo sapiens
attgtccttcagagctc

SEQ ID NO: 2012330 - DNA, 18 bp, Homo sapiens
attgtcttttgtcatgtg

SEQ ID NO: 2012331 - DNA, 20 bp, Homo sapiens
attgtcttttgtcatgtggc

SEQ ID NO: 2012332 - DNA, 17 bp, Homo sapiens
attgtgaccaagttata

SEQ ID NO: 2012333 - DNA, 17 bp, Homo sapiens
attgtgacgattattta

SEQ ID NO: 2012334 - DNA, 23 bp, Homo sapiens
attgtgatcagaccataatgtta

SEQ ID NO: 2012335 - DNA, 21 bp, Homo sapiens
attgtgatctatcaatagtca

SEQ ID NO: 2012336 - DNA, 19 bp, Homo sapiens
attgtgatgttttgttcaa

SEQ ID NO: 2012337 - DNA, 16 bp, Homo sapiens
attgtgccaatatgta

SEQ ID NO: 2012338 - DNA, 17 bp, Homo sapiens
attgtgccaatatgtat

SEQ ID NO: 2012339 - DNA, 17 bp, Homo sapiens
attgtgcttaaattatt

SEQ ID NO: 2012340 - DNA, 24 bp, Homo sapiens
attgtgtaaattcctgttgtctga

SEQ ID NO: 2012341 - DNA, 23 bp, Homo sapiens
attgtgtaacaattttaatgcta

SEQ ID NO: 2012342 - DNA, 14 bp, Homo sapiens
attgtgtctgcatt

SEQ ID NO: 2012343 - DNA, 15 bp, Homo sapiens
attgtgtgagcttct

SEQ ID NO: 2012344 - DNA, 16 bp, Homo sapiens
attgtgtgttatttaa

SEQ ID NO: 2012345 - DNA, 18 bp, Homo sapiens
attgtgtgttatttaaat

SEQ ID NO: 2012346 - DNA, 19 bp, Homo sapiens
attgtgttgccttagcact

SEQ ID NO: 2012347 - DNA, 21 bp, Homo sapiens
attgtgttgccttagcacttc

SEQ ID NO: 2012348 - DNA, 19 bp, Homo sapiens
attgttacaggtgtactat

SEQ ID NO: 2012349 - DNA, 13 bp, Homo sapiens
attgttcctgtca

SEQ ID NO: 2012350 - DNA, 14 bp, Homo sapiens
attgttgattaatt

SEQ ID NO: 2012351 - DNA, 16 bp, Homo sapiens
attgttgctccctgtg

SEQ ID NO: 2012352 - DNA, 15 bp, Homo sapiens
attgttgtgggcttt

SEQ ID NO: 2012353 - DNA, 15 bp, Homo sapiens
attgtttatttatca

SEQ ID NO: 2012354 - DNA, 17 bp, Homo sapiens
attgtttatttatcagt

SEQ ID NO: 2012355 - DNA, 21 bp, Homo sapiens
attgtttatttatcagtgaca

SEQ ID NO: 2012356 - DNA, 15 bp, Homo sapiens
attgttttagagact

SEQ ID NO: 2012357 - DNA, 13 bp, Homo sapiens
attgttttatcat

SEQ ID NO: 2012358 - DNA, 19 bp, Homo sapiens
attgttttatctgaatttt

SEQ ID NO: 2012359 - DNA, 13 bp, Homo sapiens
atttaaaaaataa

SEQ ID NO: 2012360 - DNA, 20 bp, Homo sapiens
atttaaaaaataaaaaaata

SEQ ID NO: 2012361 - DNA, 23 bp, Homo sapiens
atttaaaaaataaaaaaatacag

SEQ ID NO: 2012362 - DNA, 22 bp, Homo sapiens
atttaaaaaataaatataattg

SEQ ID NO: 2012363 - DNA, 15 bp, Homo sapiens
atttaaaaaataact

SEQ ID NO: 2012364 - DNA, 15 bp, Homo sapiens
atttaaaaataaagc

SEQ ID NO: 2012365 - DNA, 16 bp, Homo sapiens
atttaaaaataaagct

SEQ ID NO: 2012366 - DNA, 17 bp, Homo sapiens
atttaaaaataaagcta

SEQ ID NO: 2012367 - DNA, 19 bp, Homo sapiens
atttaaaaataaagctact

SEQ ID NO: 2012368 - DNA, 15 bp, Homo sapiens
atttaaaatagcaaa

SEQ ID NO: 2012369 - DNA, 18 bp, Homo sapiens
atttaaaatagcaaaaga

SEQ ID NO: 2012370 - DNA, 22 bp, Homo sapiens
atttaaaatagcaaaagaagaa

SEQ ID NO: 2012371 - DNA, 13 bp, Homo sapiens
atttaaaatgatt

SEQ ID NO: 2012372 - DNA, 16 bp, Homo sapiens
atttaaaatgattaga

SEQ ID NO: 2012373 - DNA, 12 bp, Homo sapiens
atttaaaccagc

SEQ ID NO: 2012374 - DNA, 14 bp, Homo sapiens
atttaaaccagcag

SEQ ID NO: 2012375 - DNA, 17 bp, Homo sapiens
atttaaaccagcagaaa

SEQ ID NO: 2012376 - DNA, 19 bp, Homo sapiens
atttaaaccagcagaaaag

SEQ ID NO: 2012377 - DNA, 19 bp, Homo sapiens
atttaaactataagcaaga

SEQ ID NO: 2012378 - DNA, 14 bp, Homo sapiens
atttaaaggggaga

SEQ ID NO: 2012379 - DNA, 16 bp, Homo sapiens
atttaaatattaaata

SEQ ID NO: 2012380 - DNA, 13 bp, Homo sapiens
atttaaatctgtt

SEQ ID NO: 2012381 - DNA, 23 bp, Homo sapiens
acattatgtgtgcatgtgtgtat

SEQ ID NO: 2012382 - DNA, 20 bp, Homo sapiens
acattcacacagggctcttt

SEQ ID NO: 2012383 - DNA, 19 bp, Homo sapiens
acattccctatcaaaacat

SEQ ID NO: 2012384 - DNA, 22 bp, Homo sapiens
acattccctatcaaaacatatc

SEQ ID NO: 2012385 - DNA, 14 bp, Homo sapiens
acattccctggcct

SEQ ID NO: 2012386 - DNA, 15 bp, Homo sapiens
acattccctggcctg

SEQ ID NO: 2012387 - DNA, 12 bp, Homo sapiens
acattcctcagc

SEQ ID NO: 2012388 - DNA, 13 bp, Homo sapiens
acattcctggccc

SEQ ID NO: 2012389 - DNA, 21 bp, Homo sapiens
acattctcacaattgtaaagt

SEQ ID NO: 2012390 - DNA, 23 bp, Homo sapiens
acattctgattcgaatgacactg

SEQ ID NO: 2012391 - DNA, 23 bp, Homo sapiens
acattcttaaaggaaaagtcaac

SEQ ID NO: 2012392 - DNA, 12 bp, Homo sapiens
acattgaaagag

SEQ ID NO: 2012393 - DNA, 16 bp, Homo sapiens
acattgatttattttt

SEQ ID NO: 2012394 - DNA, 15 bp, Homo sapiens
acattgcctccacct

SEQ ID NO: 2012395 - DNA, 22 bp, Homo sapiens
acattgcggacagccacggcca

SEQ ID NO: 2012396 - DNA, 14 bp, Homo sapiens
acattggacttcct

SEQ ID NO: 2012397 - DNA, 12 bp, Homo sapiens
acattgtctgcg

SEQ ID NO: 2012398 - DNA, 16 bp, Homo sapiens
acattgttaaaataaa

SEQ ID NO: 2012399 - DNA, 16 bp, Homo sapiens
acatttacaataaata

SEQ ID NO: 2012400 - DNA, 17 bp, Homo sapiens
acatttacaataaatat

SEQ ID NO: 2012401 - DNA, 13 bp, Homo sapiens
acatttacacatt

SEQ ID NO: 2012402 - DNA, 20 bp, Homo sapiens
acatttataatgtttgctat

SEQ ID NO: 2012403 - DNA, 13 bp, Homo sapiens
acatttatacatc

SEQ ID NO: 2012404 - DNA, 17 bp, Homo sapiens
acatttatatatatatg

SEQ ID NO: 2012405 - DNA, 15 bp, Homo sapiens
acatttatctaaaag

SEQ ID NO: 2012406 - DNA, 15 bp, Homo sapiens
acatttattctgctc

SEQ ID NO: 2012407 - DNA, 16 bp, Homo sapiens
acatttcaaagctgag

SEQ ID NO: 2012408 - DNA, 12 bp, Homo sapiens
acatttccctgt

SEQ ID NO: 2012409 - DNA, 15 bp, Homo sapiens
acatttccctgtgct

SEQ ID NO: 2012410 - DNA, 14 bp, Homo sapiens
acatttctaacata

SEQ ID NO: 2012411 - DNA, 20 bp, Homo sapiens
acatttcttatgatttttaa

SEQ ID NO: 2012412 - DNA, 13 bp, Homo sapiens
acatttgatgtac

SEQ ID NO: 2012413 - DNA, 18 bp, Homo sapiens
acatttgatgtacatgtg

SEQ ID NO: 2012414 - DNA, 15 bp, Homo sapiens
acatttgccttgctg

SEQ ID NO: 2012415 - DNA, 13 bp, Homo sapiens
acatttgtacatt

SEQ ID NO: 2012416 - DNA, 19 bp, Homo sapiens
acatttgtacattcctgat

SEQ ID NO: 2012417 - DNA, 20 bp, Homo sapiens
acatttgttcatgagtggat

SEQ ID NO: 2012418 - DNA, 17 bp, Homo sapiens
acattttaaaaaacaaa

SEQ ID NO: 2012419 - DNA, 20 bp, Homo sapiens
acattttaaataaaagaaaa

SEQ ID NO: 2012420 - DNA, 16 bp, Homo sapiens
acattttatttattag

SEQ ID NO: 2012421 - DNA, 22 bp, Homo sapiens
acattttatttattagctgtaa

SEQ ID NO: 2012422 - DNA, 17 bp, Homo sapiens
acattttctctttaaaa

SEQ ID NO: 2012423 - DNA, 13 bp, Homo sapiens
acattttgccttt

SEQ ID NO: 2012424 - DNA, 19 bp, Homo sapiens
acattttgttatagaatac

SEQ ID NO: 2012425 - DNA, 21 bp, Homo sapiens
acattttgttatagaatactt

SEQ ID NO: 2012426 - DNA, 14 bp, Homo sapiens
acatttttacaata

SEQ ID NO: 2012427 - DNA, 21 bp, Homo sapiens
accaaaaaggctagtttattt

SEQ ID NO: 2012428 - DNA, 13 bp, Homo sapiens
accaaaagaagta

SEQ ID NO: 2012429 - DNA, 21 bp, Homo sapiens
accaaaagaagtaaaagcaaa

SEQ ID NO: 2012430 - DNA, 21 bp, Homo sapiens
accaaaagttacatgtttgca

SEQ ID NO: 2012431 - DNA, 23 bp, Homo sapiens
accaaaatttctttttttaaatt

SEQ ID NO: 2012432 - DNA, 21 bp, Homo sapiens
accaaagagactggagcatct

SEQ ID NO: 2012433 - DNA, 20 bp, Homo sapiens
accaaagcaccttagctggc

SEQ ID NO: 2012434 - DNA, 21 bp, Homo sapiens
accaaaggaatcgtttcaaat

SEQ ID NO: 2012435 - DNA, 12 bp, Homo sapiens
accaaatataaa

SEQ ID NO: 2012436 - DNA, 21 bp, Homo sapiens
accaaatgagcattagctact

SEQ ID NO: 2012437 - DNA, 15 bp, Homo sapiens
accaaatgatgccac

SEQ ID NO: 2012438 - DNA, 14 bp, Homo sapiens
accaaattgcttct

SEQ ID NO: 2012439 - DNA, 19 bp, Homo sapiens
accaacacgagcaggctac

SEQ ID NO: 2012440 - DNA, 22 bp, Homo sapiens
accaacaggctgttctgcactg

SEQ ID NO: 2012441 - DNA, 23 bp, Homo sapiens
accaacaggctgttctgcactga

SEQ ID NO: 2012442 - DNA, 14 bp, Homo sapiens
accaacataaaaat

SEQ ID NO: 2012443 - DNA, 24 bp, Homo sapiens
accaacatggagaaaccctgtctc

SEQ ID NO: 2012444 - DNA, 18 bp, Homo sapiens
accagctgctactcataa

SEQ ID NO: 2012445 - DNA, 14 bp, Homo sapiens
accaggacaggacc

SEQ ID NO: 2012446 - DNA, 15 bp, Homo sapiens
accaggacaggacca

SEQ ID NO: 2012447 - DNA, 20 bp, Homo sapiens
accaggcacgaacccacctg

SEQ ID NO: 2012448 - DNA, 22 bp, Homo sapiens
accaggcacgaacccacctgct

SEQ ID NO: 2012449 - DNA, 20 bp, Homo sapiens
accagggagcccctttgatg

SEQ ID NO: 2012450 - DNA, 21 bp, Homo sapiens
accagggcactgtctgcgtga

SEQ ID NO: 2012451 - DNA, 16 bp, Homo sapiens
accagggcgcaagcct

SEQ ID NO: 2012452 - DNA, 24 bp, Homo sapiens
accaggggtgatttcagagagggc

SEQ ID NO: 2012453 - DNA, 14 bp, Homo sapiens
accagtacttctaa

SEQ ID NO: 2012454 - DNA, 16 bp, Homo sapiens
accagtacttctaaga

SEQ ID NO: 2012455 - DNA, 17 bp, Homo sapiens
accagtacttctaagag

SEQ ID NO: 2012456 - DNA, 18 bp, Homo sapiens
accagtatggaagggagg

SEQ ID NO: 2012457 - DNA, 22 bp, Homo sapiens
accagtgcccaaagtctgtgtg

SEQ ID NO: 2012458 - DNA, 14 bp, Homo sapiens
accagtgccgcctg

SEQ ID NO: 2012459 - DNA, 16 bp, Homo sapiens
accagtgccgcctgtg

SEQ ID NO: 2012460 - DNA, 12 bp, Homo sapiens
accagtgtactg

SEQ ID NO: 2012461 - DNA, 16 bp, Homo sapiens
accagtgtactgcttt

SEQ ID NO: 2012462 - DNA, 13 bp, Homo sapiens
accagtgtagcct

SEQ ID NO: 2012463 - DNA, 20 bp, Homo sapiens
accagtgtcccctccactgt

SEQ ID NO: 2012464 - DNA, 23 bp, Homo sapiens
accagttctggccaggagctgga

SEQ ID NO: 2012465 - DNA, 19 bp, Homo sapiens
accagttgggagcactgga

SEQ ID NO: 2012466 - DNA, 21 bp, Homo sapiens
accataagggactgtgccaga

SEQ ID NO: 2012467 - DNA, 20 bp, Homo sapiens
accatatgtctgcttctgtc

SEQ ID NO: 2012468 - DNA, 13 bp, Homo sapiens
accatcaaatgct

SEQ ID NO: 2012469 - DNA, 12 bp, Homo sapiens
accatcaataaa

SEQ ID NO: 2012470 - DNA, 13 bp, Homo sapiens
accatcaataaag

SEQ ID NO: 2012471 - DNA, 15 bp, Homo sapiens
accatcaatggaaac

SEQ ID NO: 2012472 - DNA, 14 bp, Homo sapiens
accatcacacatgc

SEQ ID NO: 2012473 - DNA, 13 bp, Homo sapiens
accatcctattta

SEQ ID NO: 2012474 - DNA, 17 bp, Homo sapiens
accatcctgcagcctcc

SEQ ID NO: 2012475 - DNA, 17 bp, Homo sapiens
accatcctggcccctcc

SEQ ID NO: 2012476 - DNA, 19 bp, Homo sapiens
accatcctggcccctccag

SEQ ID NO: 2012477 - DNA, 18 bp, Homo sapiens
accatcttaaatgacagt

SEQ ID NO: 2012478 - DNA, 23 bp, Homo sapiens
accatgagaataagagaaagaaa

SEQ ID NO: 2012479 - DNA, 18 bp, Homo sapiens
accatgagcaattctcct

SEQ ID NO: 2012480 - DNA, 16 bp, Homo sapiens
accatgcaaatgctat

SEQ ID NO: 2012481 - DNA, 19 bp, Homo sapiens
accatgcagcttcatcaat

SEQ ID NO: 2012482 - DNA, 14 bp, Homo sapiens
accatgccaggcta

SEQ ID NO: 2012483 - DNA, 14 bp, Homo sapiens
accatgctggcggc

SEQ ID NO: 2012484 - DNA, 20 bp, Homo sapiens
accatgctggcggcgcagag

SEQ ID NO: 2012485 - DNA, 22 bp, Homo sapiens
accatggaggcaggctccccct

SEQ ID NO: 2012486 - DNA, 17 bp, Homo sapiens
accatgtaacaaccaga

SEQ ID NO: 2012487 - DNA, 11 bp, Homo sapiens
accatgtacat

SEQ ID NO: 2012488 - DNA, 17 bp, Homo sapiens
accatgtacatgaagaa

SEQ ID NO: 2012489 - DNA, 19 bp, Homo sapiens
accatgtctctaagccaac

SEQ ID NO: 2012490 - DNA, 21 bp, Homo sapiens
accatgtgtagattgcgtgga

SEQ ID NO: 2012491 - DNA, 20 bp, Homo sapiens
accatgtttgagctcagacc

SEQ ID NO: 2012492 - DNA, 14 bp, Homo sapiens
accattcacatttg

SEQ ID NO: 2012493 - DNA, 19 bp, Homo sapiens
accattcacatttgatgta

SEQ ID NO: 2012494 - DNA, 12 bp, Homo sapiens
accattccccat

SEQ ID NO: 2012495 - DNA, 22 bp, Homo sapiens
accattgacctcagctgcacat

SEQ ID NO: 2012496 - DNA, 17 bp, Homo sapiens
accattggctgcgctaa

SEQ ID NO: 2012497 - DNA, 12 bp, Homo sapiens
accattgtcttc

SEQ ID NO: 2012498 - DNA, 14 bp, Homo sapiens
accattgtcttcca

SEQ ID NO: 2012499 - DNA, 20 bp, Homo sapiens
accattgtcttccaacccca

SEQ ID NO: 2012500 - DNA, 14 bp, Homo sapiens
accatttaattcat

SEQ ID NO: 2012501 - DNA, 13 bp, Homo sapiens
acctggagggcta

SEQ ID NO: 2012502 - DNA, 20 bp, Homo sapiens
acctggagggctagaacctg

SEQ ID NO: 2012503 - DNA, 22 bp, Homo sapiens
acctggagggctagaacctggc

SEQ ID NO: 2012504 - DNA, 18 bp, Homo sapiens
acctggccgcctccagga

SEQ ID NO: 2012505 - DNA, 13 bp, Homo sapiens
acctggcctgctg

SEQ ID NO: 2012506 - DNA, 15 bp, Homo sapiens
acctggcctgctggg

SEQ ID NO: 2012507 - DNA, 17 bp, Homo sapiens
acctggcctgctgggaa

SEQ ID NO: 2012508 - DNA, 11 bp, Homo sapiens
acctggccttc

SEQ ID NO: 2012509 - DNA, 18 bp, Homo sapiens
acctgggaaaacagagga

SEQ ID NO: 2012510 - DNA, 20 bp, Homo sapiens
acctgggaaaacagaggaat

SEQ ID NO: 2012511 - DNA, 17 bp, Homo sapiens
acctgggaaaggaccca

SEQ ID NO: 2012512 - DNA, 23 bp, Homo sapiens
acctgggaaaggacccacccatc

SEQ ID NO: 2012513 - DNA, 24 bp, Homo sapiens
acctgggaaaggacccacccatct

SEQ ID NO: 2012514 - DNA, 16 bp, Homo sapiens
acctgggaaccatgaa

SEQ ID NO: 2012515 - DNA, 20 bp, Homo sapiens
acctgggaaccatgaagctg

SEQ ID NO: 2012516 - DNA, 15 bp, Homo sapiens
acctgggatatgaca

SEQ ID NO: 2012517 - DNA, 23 bp, Homo sapiens
acctgggccaaaagggcagccag

SEQ ID NO: 2012518 - DNA, 20 bp, Homo sapiens
acctgggcctttcctgtgcc

SEQ ID NO: 2012519 - DNA, 21 bp, Homo sapiens
acctggtcacaggactctgcc

SEQ ID NO: 2012520 - DNA, 22 bp, Homo sapiens
acctggtcacaggactctgcct

SEQ ID NO: 2012521 - DNA, 14 bp, Homo sapiens
acctggtctctcct

SEQ ID NO: 2012522 - DNA, 19 bp, Homo sapiens
acctgtaatcccagctact

SEQ ID NO: 2012523 - DNA, 18 bp, Homo sapiens
acctgtcagcccaagcag

SEQ ID NO: 2012524 - DNA, 14 bp, Homo sapiens
acctgtctccctgg

SEQ ID NO: 2012525 - DNA, 11 bp, Homo sapiens
acctgtctgtc

SEQ ID NO: 2012526 - DNA, 12 bp, Homo sapiens
acctgtctgtct

SEQ ID NO: 2012527 - DNA, 18 bp, Homo sapiens
acctgtctgtctgtctgt

SEQ ID NO: 2012528 - DNA, 18 bp, Homo sapiens
acctgtgcagtcccgtgg

SEQ ID NO: 2012529 - DNA, 16 bp, Homo sapiens
acctgtgttcattctt

SEQ ID NO: 2012530 - DNA, 20 bp, Homo sapiens
acctgtgtttcttgcctcat

SEQ ID NO: 2012531 - DNA, 14 bp, Homo sapiens
acctgttcaggagc

SEQ ID NO: 2012532 - DNA, 15 bp, Homo sapiens
acctgttgcacctca

SEQ ID NO: 2012533 - DNA, 17 bp, Homo sapiens
acctgtttatataattt

SEQ ID NO: 2012534 - DNA, 14 bp, Homo sapiens
acctgttttcttca

SEQ ID NO: 2012535 - DNA, 23 bp, Homo sapiens
accttaaatctgcctttgtttct

SEQ ID NO: 2012536 - DNA, 19 bp, Homo sapiens
accttaatattattggggt

SEQ ID NO: 2012537 - DNA, 14 bp, Homo sapiens
accttacattccta

SEQ ID NO: 2012538 - DNA, 15 bp, Homo sapiens
accttaccaactttc

SEQ ID NO: 2012539 - DNA, 18 bp, Homo sapiens
accttaccaactttctgt

SEQ ID NO: 2012540 - DNA, 19 bp, Homo sapiens
accttaccaactttctgta

SEQ ID NO: 2012541 - DNA, 18 bp, Homo sapiens
accttagaaatcattgta

SEQ ID NO: 2012542 - DNA, 18 bp, Homo sapiens
accttagcagctcttccc

SEQ ID NO: 2012543 - DNA, 13 bp, Homo sapiens
accttcaataaag

SEQ ID NO: 2012544 - DNA, 14 bp, Homo sapiens
acccccgccacggc

SEQ ID NO: 2012545 - DNA, 21 bp, Homo sapiens
acccccgccacggccaccctc

SEQ ID NO: 2012546 - DNA, 15 bp, Homo sapiens
acccccgctccagat

SEQ ID NO: 2012547 - DNA, 15 bp, Homo sapiens
acccccgtggtcttt

SEQ ID NO: 2012548 - DNA, 17 bp, Homo sapiens
acccccgtggtctttga

SEQ ID NO: 2012549 - DNA, 18 bp, Homo sapiens
acccccgtggtctttgaa

SEQ ID NO: 2012550 - DNA, 21 bp, Homo sapiens
acccccgtggtctttgaataa

SEQ ID NO: 2012551 - DNA, 11 bp, Homo sapiens
accccctcatt

SEQ ID NO: 2012552 - DNA, 14 bp, Homo sapiens
accccctccagctc

SEQ ID NO: 2012553 - DNA, 19 bp, Homo sapiens
accccctcccacccccagc

SEQ ID NO: 2012554 - DNA, 12 bp, Homo sapiens
accccctcccca

SEQ ID NO: 2012555 - DNA, 14 bp, Homo sapiens
accccctccccagg

SEQ ID NO: 2012556 - DNA, 16 bp, Homo sapiens
accccctccccagggg

SEQ ID NO: 2012557 - DNA, 22 bp, Homo sapiens
accccctgagtcaactggagca

SEQ ID NO: 2012558 - DNA, 13 bp, Homo sapiens
accccctgcagct

SEQ ID NO: 2012559 - DNA, 12 bp, Homo sapiens
accccctggaga

SEQ ID NO: 2012560 - DNA, 18 bp, Homo sapiens
acccccttctactgagcc

SEQ ID NO: 2012561 - DNA, 15 bp, Homo sapiens
accccgcagcccgtg

SEQ ID NO: 2012562 - DNA, 15 bp, Homo sapiens
accccgcggtgctct

SEQ ID NO: 2012563 - DNA, 18 bp, Homo sapiens
accccgcggtgctctggc

SEQ ID NO: 2012564 - DNA, 21 bp, Homo sapiens
accccgcggtgctctggcggc

SEQ ID NO: 2012565 - DNA, 14 bp, Homo sapiens
accccggatcgagg

SEQ ID NO: 2012566 - DNA, 15 bp, Homo sapiens
accccggcctccact

SEQ ID NO: 2012567 - DNA, 21 bp, Homo sapiens
accccggcctccactccccca

SEQ ID NO: 2012568 - DNA, 22 bp, Homo sapiens
accccgtctggggttcagcccc

SEQ ID NO: 2012569 - DNA, 16 bp, Homo sapiens
acccctaacctggctt

SEQ ID NO: 2012570 - DNA, 18 bp, Homo sapiens
acccctaacctggcttat

SEQ ID NO: 2012571 - DNA, 15 bp, Homo sapiens
acccctcactctggc

SEQ ID NO: 2012572 - DNA, 17 bp, Homo sapiens
acccctcactctggcct

SEQ ID NO: 2012573 - DNA, 18 bp, Homo sapiens
acccctcactctggcctc

SEQ ID NO: 2012574 - DNA, 14 bp, Homo sapiens
acccctcccaacct

SEQ ID NO: 2012575 - DNA, 20 bp, Homo sapiens
acccctccccattcacagag

SEQ ID NO: 2012576 - DNA, 20 bp, Homo sapiens
acccctgcaccagcccttcc

SEQ ID NO: 2012577 - DNA, 19 bp, Homo sapiens
acccctgcctgggttttct

SEQ ID NO: 2012578 - DNA, 20 bp, Homo sapiens
acccctgcctgggttttcta

SEQ ID NO: 2012579 - DNA, 20 bp, Homo sapiens
acccctggcttttcactgct

SEQ ID NO: 2012580 - DNA, 21 bp, Homo sapiens
acccctgttaagcaattcctt

SEQ ID NO: 2012581 - DNA, 17 bp, Homo sapiens
accccttatccaggact

SEQ ID NO: 2012582 - DNA, 15 bp, Homo sapiens
accccttcctttcct

SEQ ID NO: 2012583 - DNA, 18 bp, Homo sapiens
accccttcctttcctctg

SEQ ID NO: 2012584 - DNA, 15 bp, Homo sapiens
accccttcgctcctg

SEQ ID NO: 2012585 - DNA, 15 bp, Homo sapiens
acccctttcccccac

SEQ ID NO: 2012586 - DNA, 12 bp, Homo sapiens
acccctttcctg

SEQ ID NO: 2012587 - DNA, 19 bp, Homo sapiens
acccgagcccagctacatt

SEQ ID NO: 2012588 - DNA, 15 bp, Homo sapiens
acccgaggctgccca

SEQ ID NO: 2012589 - DNA, 12 bp, Homo sapiens
acccggaaagac

SEQ ID NO: 2012590 - DNA, 15 bp, Homo sapiens
acccggaggggcctg

SEQ ID NO: 2012591 - DNA, 21 bp, Homo sapiens
acccggaggggcctggcagcc

SEQ ID NO: 2012592 - DNA, 16 bp, Homo sapiens
acccggcaccccctgc

SEQ ID NO: 2012593 - DNA, 12 bp, Homo sapiens
acccggctcccc

SEQ ID NO: 2012594 - DNA, 21 bp, Homo sapiens
acccggctccccctgcttctc

SEQ ID NO: 2012595 - DNA, 23 bp, Homo sapiens
acccgtgccaagtccaggtcctg

SEQ ID NO: 2012596 - DNA, 21 bp, Homo sapiens
acccgttcaacttttcctttg

SEQ ID NO: 2012597 - DNA, 23 bp, Homo sapiens
acccgttctgctggcctggatct

SEQ ID NO: 2012598 - DNA, 18 bp, Homo sapiens
acctaaatgacctcagca

SEQ ID NO: 2012599 - DNA, 22 bp, Homo sapiens
acctaaatgacctcagcaaatc

SEQ ID NO: 2012600 - DNA, 16 bp, Homo sapiens
acctaccacagtgtct

SEQ ID NO: 2012601 - DNA, 19 bp, Homo sapiens
acctaccacagtgtctgta

SEQ ID NO: 2012602 - DNA, 21 bp, Homo sapiens
acctaccaccccttcctgtcc

SEQ ID NO: 2012603 - DNA, 20 bp, Homo sapiens
acctacttgtgactgaaggg

SEQ ID NO: 2012604 - DNA, 13 bp, Homo sapiens
acctagcaattcc

SEQ ID NO: 2012605 - DNA, 19 bp, Homo sapiens
acctagcatcttacaaaaa

SEQ ID NO: 2012606 - DNA, 23 bp, Homo sapiens
acctagtactctctgctctagcc

SEQ ID NO: 2012607 - DNA, 15 bp, Homo sapiens
acctatacctgtgtt

SEQ ID NO: 2012608 - DNA, 15 bp, Homo sapiens
acctatagtcccagc

SEQ ID NO: 2012609 - DNA, 17 bp, Homo sapiens
acctatatgatttatag

SEQ ID NO: 2012610 - DNA, 18 bp, Homo sapiens
acctatgtcatttcattt

SEQ ID NO: 2012611 - DNA, 22 bp, Homo sapiens
acctatgtcatttcatttccta

SEQ ID NO: 2012612 - DNA, 15 bp, Homo sapiens
acctatgtgacagac

SEQ ID NO: 2012613 - DNA, 14 bp, Homo sapiens
acctattttttaaa

SEQ ID NO: 2012614 - DNA, 12 bp, Homo sapiens
acctcaaactgg

SEQ ID NO: 2012615 - DNA, 21 bp, Homo sapiens
acctcaacccccatttctatt

SEQ ID NO: 2012616 - DNA, 15 bp, Homo sapiens
acctcaactaaccct

SEQ ID NO: 2012617 - DNA, 19 bp, Homo sapiens
acctcaatcagtctcagaa

SEQ ID NO: 2012618 - DNA, 21 bp, Homo sapiens
acctcaatcagtctcagaatg

SEQ ID NO: 2012619 - DNA, 15 bp, Homo sapiens
acctcaatgccctgc

SEQ ID NO: 2012620 - DNA, 17 bp, Homo sapiens
acctcaatgccctgcca

SEQ ID NO: 2012621 - DNA, 15 bp, Homo sapiens
acctcacagaaatgt

SEQ ID NO: 2012622 - DNA, 19 bp, Homo sapiens
acctcacagtgacccttcc

SEQ ID NO: 2012623 - DNA, 20 bp, Homo sapiens
acctcacagtgacccttccc

SEQ ID NO: 2012624 - DNA, 19 bp, Homo sapiens
acctcacccgaggctgccc

SEQ ID NO: 2012625 - DNA, 17 bp, Homo sapiens
acctcaccggcatgctg

SEQ ID NO: 2012626 - DNA, 19 bp, Homo sapiens
acctcaccggcatgctggc

SEQ ID NO: 2012627 - DNA, 14 bp, Homo sapiens
acctcacgctctgg

SEQ ID NO: 2012628 - DNA, 16 bp, Homo sapiens
acctcactatggtatg

SEQ ID NO: 2012629 - DNA, 15 bp, Homo sapiens
acctcactgaggaag

SEQ ID NO: 2012630 - DNA, 21 bp, Homo sapiens
acctcactggggtcctggggc

SEQ ID NO: 2012631 - DNA, 18 bp, Homo sapiens
acctcagacaatccactc

SEQ ID NO: 2012632 - DNA, 12 bp, Homo sapiens
acctcagcaaat

SEQ ID NO: 2012633 - DNA, 20 bp, Homo sapiens
acctcagcaaatcctcttct

SEQ ID NO: 2012634 - DNA, 17 bp, Homo sapiens
acctcagccaaacacag

SEQ ID NO: 2012635 - DNA, 22 bp, Homo sapiens
acctcagccatgaggagttgct

SEQ ID NO: 2012636 - DNA, 13 bp, Homo sapiens
acctcagcctaga

SEQ ID NO: 2012637 - DNA, 12 bp, Homo sapiens
acctcagcctcc

SEQ ID NO: 2012638 - DNA, 16 bp, Homo sapiens
acctcagcctcccaga

SEQ ID NO: 2012639 - DNA, 18 bp, Homo sapiens
acctcagcctcccagagt

SEQ ID NO: 2012640 - DNA, 23 bp, Homo sapiens
acctcagcctcccagagtgctag

SEQ ID NO: 2012641 - DNA, 17 bp, Homo sapiens
acctcagcctgtgctgc

SEQ ID NO: 2012642 - DNA, 20 bp, Homo sapiens
acctcagccttccccttgcc

SEQ ID NO: 2012643 - DNA, 12 bp, Homo sapiens
acctcagctgca

SEQ ID NO: 2012644 - DNA, 16 bp, Homo sapiens
acctcagctgcacatt

SEQ ID NO: 2012645 - DNA, 18 bp, Homo sapiens
acctcagctgcacattcc

SEQ ID NO: 2012646 - DNA, 19 bp, Homo sapiens
acctcagctgcacattcct

SEQ ID NO: 2012647 - DNA, 20 bp, Homo sapiens
acctcagctgcacattcctg

SEQ ID NO: 2012648 - DNA, 23 bp, Homo sapiens
acctcagctgcacattcctggcc

SEQ ID NO: 2012649 - DNA, 20 bp, Homo sapiens
acctcaggccaggtgcagtg

SEQ ID NO: 2012650 - DNA, 19 bp, Homo sapiens
acctcaggcttccttggca

SEQ ID NO: 2012651 - DNA, 20 bp, Homo sapiens
acctcaggtgatccacccac

SEQ ID NO: 2012652 - DNA, 21 bp, Homo sapiens
acctcaggtgatccacccacc

SEQ ID NO: 2012653 - DNA, 15 bp, Homo sapiens
acctcagtaatttag

SEQ ID NO: 2012654 - DNA, 16 bp, Homo sapiens
acctcagtgtcattta

SEQ ID NO: 2012655 - DNA, 21 bp, Homo sapiens
acctcagtgtcatttatgaaa

SEQ ID NO: 2012656 - DNA, 13 bp, Homo sapiens
acctcagtttcct

SEQ ID NO: 2012657 - DNA, 16 bp, Homo sapiens
acctcagtttcctcat

SEQ ID NO: 2012658 - DNA, 13 bp, Homo sapiens
acctcagtttctc

SEQ ID NO: 2012659 - DNA, 19 bp, Homo sapiens
acctcatatcttcctcatc

SEQ ID NO: 2012660 - DNA, 14 bp, Homo sapiens
acctcatatgctat

SEQ ID NO: 2012661 - DNA, 14 bp, Homo sapiens
acctcatgacagcc

SEQ ID NO: 2012662 - DNA, 18 bp, Homo sapiens
acctcatgcctggccccc

SEQ ID NO: 2012663 - DNA, 19 bp, Homo sapiens
acctcatggtcatggacag

SEQ ID NO: 2012664 - DNA, 14 bp, Homo sapiens
acccaggctgcact

SEQ ID NO: 2012665 - DNA, 15 bp, Homo sapiens
acccaggctgcactg

SEQ ID NO: 2012666 - DNA, 22 bp, Homo sapiens
acccagtcccagaaccacactg

SEQ ID NO: 2012667 - DNA, 14 bp, Homo sapiens
acccagtcctggcc

SEQ ID NO: 2012668 - DNA, 16 bp, Homo sapiens
acccagtcctggccat

SEQ ID NO: 2012669 - DNA, 21 bp, Homo sapiens
acccagtgctgccatgccact

SEQ ID NO: 2012670 - DNA, 15 bp, Homo sapiens
acccagtgggacaga

SEQ ID NO: 2012671 - DNA, 21 bp, Homo sapiens
acccagtgtaaagaataaatg

SEQ ID NO: 2012672 - DNA, 14 bp, Homo sapiens
acccatcagaagga

SEQ ID NO: 2012673 - DNA, 20 bp, Homo sapiens
acccatcctaccaatgcatg

SEQ ID NO: 2012674 - DNA, 13 bp, Homo sapiens
acccatctccccc

SEQ ID NO: 2012675 - DNA, 17 bp, Homo sapiens
acccatcttcctgctgc

SEQ ID NO: 2012676 - DNA, 14 bp, Homo sapiens
acccatgaatcaaa

SEQ ID NO: 2012677 - DNA, 18 bp, Homo sapiens
acccatgatgagctcctc

SEQ ID NO: 2012678 - DNA, 13 bp, Homo sapiens
acccatgccatag

SEQ ID NO: 2012679 - DNA, 17 bp, Homo sapiens
acccatgtgccaaggtg

SEQ ID NO: 2012680 - DNA, 16 bp, Homo sapiens
acccattaggcatgcc

SEQ ID NO: 2012681 - DNA, 19 bp, Homo sapiens
acccattcccccatgtggc

SEQ ID NO: 2012682 - DNA, 23 bp, Homo sapiens
acccattcccccatgtggctgaa

SEQ ID NO: 2012683 - DNA, 22 bp, Homo sapiens
acccattcgtggtgatcaatta

SEQ ID NO: 2012684 - DNA, 14 bp, Homo sapiens
accccaaagagcct

SEQ ID NO: 2012685 - DNA, 18 bp, Homo sapiens
accccaaagccccttgct

SEQ ID NO: 2012686 - DNA, 16 bp, Homo sapiens
accccaacgcacagga

SEQ ID NO: 2012687 - DNA, 15 bp, Homo sapiens
accccaagtccacct

SEQ ID NO: 2012688 - DNA, 12 bp, Homo sapiens
accccaccccct

SEQ ID NO: 2012689 - DNA, 19 bp, Homo sapiens
accccacctcatgcctggc

SEQ ID NO: 2012690 - DNA, 18 bp, Homo sapiens
accccaccttgccaagct

SEQ ID NO: 2012691 - DNA, 22 bp, Homo sapiens
accccaccttgccaagctttct

SEQ ID NO: 2012692 - DNA, 20 bp, Homo sapiens
accccactccagccctgtcc

SEQ ID NO: 2012693 - DNA, 10 bp, Homo sapiens
accccagagt

SEQ ID NO: 2012694 - DNA, 11 bp, Homo sapiens
accccagagtt

SEQ ID NO: 2012695 - DNA, 14 bp, Homo sapiens
accccagagttggg

SEQ ID NO: 2012696 - DNA, 13 bp, Homo sapiens
accccagcatcct

SEQ ID NO: 2012697 - DNA, 12 bp, Homo sapiens
accccagctggc

SEQ ID NO: 2012698 - DNA, 13 bp, Homo sapiens
accccagctggcc

SEQ ID NO: 2012699 - DNA, 16 bp, Homo sapiens
accccagctggcctct

SEQ ID NO: 2012700 - DNA, 16 bp, Homo sapiens
accccaggcatcccat

SEQ ID NO: 2012701 - DNA, 10 bp, Homo sapiens
accccagggc

SEQ ID NO: 2012702 - DNA, 11 bp, Homo sapiens
accccagggca

SEQ ID NO: 2012703 - DNA, 19 bp, Homo sapiens
accccagggcccccacagg

SEQ ID NO: 2012704 - DNA, 19 bp, Homo sapiens
accccagttctgctcctct

SEQ ID NO: 2012705 - DNA, 22 bp, Homo sapiens
accccagttctgctcctctcca

SEQ ID NO: 2012706 - DNA, 17 bp, Homo sapiens
accccatgggcttggac

SEQ ID NO: 2012707 - DNA, 18 bp, Homo sapiens
accccatttgctttcttt

SEQ ID NO: 2012708 - DNA, 15 bp, Homo sapiens
acccccaccgaagag

SEQ ID NO: 2012709 - DNA, 13 bp, Homo sapiens
acccccactctca

SEQ ID NO: 2012710 - DNA, 13 bp, Homo sapiens
acccccagagacc

SEQ ID NO: 2012711 - DNA, 14 bp, Homo sapiens
acccccagagacct

SEQ ID NO: 2012712 - DNA, 18 bp, Homo sapiens
acccccagcccacagagc

SEQ ID NO: 2012713 - DNA, 12 bp, Homo sapiens
acccccagcccc

SEQ ID NO: 2012714 - DNA, 21 bp, Homo sapiens
acccccagccccgactccagc

SEQ ID NO: 2012715 - DNA, 14 bp, Homo sapiens
acccccagcctgct

SEQ ID NO: 2012716 - DNA, 15 bp, Homo sapiens
acccccagcctgcta

SEQ ID NO: 2012717 - DNA, 14 bp, Homo sapiens
acccccagcctggg

SEQ ID NO: 2012718 - DNA, 15 bp, Homo sapiens
acccccagcctgggc

SEQ ID NO: 2012719 - DNA, 16 bp, Homo sapiens
acccccagcctgggcc

SEQ ID NO: 2012720 - DNA, 16 bp, Homo sapiens
acccccagctttgcta

SEQ ID NO: 2012721 - DNA, 18 bp, Homo sapiens
acccccagtgccacagag

SEQ ID NO: 2012722 - DNA, 17 bp, Homo sapiens
acccccatttctattta

SEQ ID NO: 2012723 - DNA, 14 bp, Homo sapiens
accccccaagctgt

SEQ ID NO: 2012724 - DNA, 20 bp, Homo sapiens
accccccagtcgagccctgc

SEQ ID NO: 2012725 - DNA, 22 bp, Homo sapiens
acgcagaggcggaaaccttgca

SEQ ID NO: 2012726 - DNA, 22 bp, Homo sapiens
acgcagcagctgggacccctcc

SEQ ID NO: 2012727 - DNA, 19 bp, Homo sapiens
acgcagccctgggggccag

SEQ ID NO: 2012728 - DNA, 21 bp, Homo sapiens
acgcagccctgggggccagct

SEQ ID NO: 2012729 - DNA, 22 bp, Homo sapiens
acgcaggcccccaggtgccagt

SEQ ID NO: 2012730 - DNA, 12 bp, Homo sapiens
acgcccagcctc

SEQ ID NO: 2012731 - DNA, 19 bp, Homo sapiens
acgcccagcctcctcccac

SEQ ID NO: 2012732 - DNA, 19 bp, Homo sapiens
acgcccagctgaggctggg

SEQ ID NO: 2012733 - DNA, 23 bp, Homo sapiens
acgcccctccctcctctggccca

SEQ ID NO: 2012734 - DNA, 16 bp, Homo sapiens
acgcctatgatcccag

SEQ ID NO: 2012735 - DNA, 17 bp, Homo sapiens
acgcctatgatcccagc

SEQ ID NO: 2012736 - DNA, 13 bp, Homo sapiens
acgcctcctggcc

SEQ ID NO: 2012737 - DNA, 15 bp, Homo sapiens
acgcctcctggccag

SEQ ID NO: 2012738 - DNA, 19 bp, Homo sapiens
acgcctgagcccagggagg

SEQ ID NO: 2012739 - DNA, 21 bp, Homo sapiens
acgcctgagcccagggaggcc

SEQ ID NO: 2012740 - DNA, 12 bp, Homo sapiens
acgcctgcccag

SEQ ID NO: 2012741 - DNA, 15 bp, Homo sapiens
acgcctgcccagcct

SEQ ID NO: 2012742 - DNA, 16 bp, Homo sapiens
acgcctgcccagcctc

SEQ ID NO: 2012743 - DNA, 17 bp, Homo sapiens
acgcctgcttgtccctg

SEQ ID NO: 2012744 - DNA, 21 bp, Homo sapiens
acgcctgcttgtccctgccca

SEQ ID NO: 2012745 - DNA, 12 bp, Homo sapiens
acgcgcacacac

SEQ ID NO: 2012746 - DNA, 17 bp, Homo sapiens
acgcgggctgtgcctta

SEQ ID NO: 2012747 - DNA, 14 bp, Homo sapiens
acgctcccccgcag

SEQ ID NO: 2012748 - DNA, 13 bp, Homo sapiens
acgctctctgtct

SEQ ID NO: 2012749 - DNA, 13 bp, Homo sapiens
acgctggaccttg

SEQ ID NO: 2012750 - DNA, 15 bp, Homo sapiens
acgctggagtgcagt

SEQ ID NO: 2012751 - DNA, 17 bp, Homo sapiens
acgctggagtgcagtga

SEQ ID NO: 2012752 - DNA, 14 bp, Homo sapiens
acgctgtcctctcg

SEQ ID NO: 2012753 - DNA, 11 bp, Homo sapiens
acgcttccaga

SEQ ID NO: 2012754 - DNA, 17 bp, Homo sapiens
acgcttccagaccacct

SEQ ID NO: 2012755 - DNA, 18 bp, Homo sapiens
acgcttccagaccacctg

SEQ ID NO: 2012756 - DNA, 22 bp, Homo sapiens
acgcttccagaccacctgccag

SEQ ID NO: 2012757 - DNA, 23 bp, Homo sapiens
acgcttccagaccacctgccagc

SEQ ID NO: 2012758 - DNA, 19 bp, Homo sapiens
acggaatagttggctagga

SEQ ID NO: 2012759 - DNA, 21 bp, Homo sapiens
acggagccccaggcctctgtg

SEQ ID NO: 2012760 - DNA, 19 bp, Homo sapiens
acggagtcccaccttggct

SEQ ID NO: 2012761 - DNA, 21 bp, Homo sapiens
acggagtcccaccttggctgc

SEQ ID NO: 2012762 - DNA, 23 bp, Homo sapiens
acggagtcccaccttggctgcag

SEQ ID NO: 2012763 - DNA, 16 bp, Homo sapiens
acggatgcacacacag

SEQ ID NO: 2012764 - DNA, 20 bp, Homo sapiens
actactgctgcaaagtgcaa

SEQ ID NO: 2012765 - DNA, 21 bp, Homo sapiens
actactgtaattaagtgcaat

SEQ ID NO: 2012766 - DNA, 20 bp, Homo sapiens
actactgtggaaaaatattt

SEQ ID NO: 2012767 - DNA, 17 bp, Homo sapiens
actacttcttggaaaaa

SEQ ID NO: 2012768 - DNA, 17 bp, Homo sapiens
actacttgttacctttc

SEQ ID NO: 2012769 - DNA, 15 bp, Homo sapiens
actactttttatact

SEQ ID NO: 2012770 - DNA, 23 bp, Homo sapiens
actactttttatactccatacat

SEQ ID NO: 2012771 - DNA, 15 bp, Homo sapiens
actagaaatctgcca

SEQ ID NO: 2012772 - DNA, 16 bp, Homo sapiens
actagaactctccatc

SEQ ID NO: 2012773 - DNA, 17 bp, Homo sapiens
actagaatttgtatttt

SEQ ID NO: 2012774 - DNA, 23 bp, Homo sapiens
actagagctgggaaacagggagc

SEQ ID NO: 2012775 - DNA, 15 bp, Homo sapiens
actagagctttcttt

SEQ ID NO: 2012776 - DNA, 14 bp, Homo sapiens
actagaggcaggga

SEQ ID NO: 2012777 - DNA, 16 bp, Homo sapiens
actagaggcagggagg

SEQ ID NO: 2012778 - DNA, 22 bp, Homo sapiens
actagatctcctatttttcaga

SEQ ID NO: 2012779 - DNA, 18 bp, Homo sapiens
actagatcttacatctgc

SEQ ID NO: 2012780 - DNA, 15 bp, Homo sapiens
actagatggcgagca

SEQ ID NO: 2012781 - DNA, 12 bp, Homo sapiens
actaggccattt

SEQ ID NO: 2012782 - DNA, 21 bp, Homo sapiens
actaggttctaggtcctggct

SEQ ID NO: 2012783 - DNA, 18 bp, Homo sapiens
actagtaatgggccaatt

SEQ ID NO: 2012784 - DNA, 19 bp, Homo sapiens
actagtattgtccatatca

SEQ ID NO: 2012785 - DNA, 15 bp, Homo sapiens
actagtgttgcttgg

SEQ ID NO: 2012786 - DNA, 18 bp, Homo sapiens
actagtttaattaactat

SEQ ID NO: 2012787 - DNA, 13 bp, Homo sapiens
actagtttccagt

SEQ ID NO: 2012788 - DNA, 17 bp, Homo sapiens
actagttttgtgccagc

SEQ ID NO: 2012789 - DNA, 13 bp, Homo sapiens
actataaacatta

SEQ ID NO: 2012790 - DNA, 18 bp, Homo sapiens
actataaaggttgacaat

SEQ ID NO: 2012791 - DNA, 20 bp, Homo sapiens
actataagcaagaaggcaaa

SEQ ID NO: 2012792 - DNA, 14 bp, Homo sapiens
actatagcccaggt

SEQ ID NO: 2012793 - DNA, 18 bp, Homo sapiens
actatagcctaggtgaca

SEQ ID NO: 2012794 - DNA, 15 bp, Homo sapiens
actatatacatgtgt

SEQ ID NO: 2012795 - DNA, 17 bp, Homo sapiens
actatatacatgtgtgt

SEQ ID NO: 2012796 - DNA, 21 bp, Homo sapiens
actatatacatgtgtgtatat

SEQ ID NO: 2012797 - DNA, 17 bp, Homo sapiens
actatcaatatttaagt

SEQ ID NO: 2012798 - DNA, 22 bp, Homo sapiens
actatcacatacaatttgcact

SEQ ID NO: 2012799 - DNA, 23 bp, Homo sapiens
actatcacatacaatttgcactg

SEQ ID NO: 2012800 - DNA, 23 bp, Homo sapiens
actatctctagagtgagaatctg

SEQ ID NO: 2012801 - DNA, 23 bp, Homo sapiens
actatctttctgataacagaatt

SEQ ID NO: 2012802 - DNA, 16 bp, Homo sapiens
actatgaaaagctaga

SEQ ID NO: 2012803 - DNA, 20 bp, Homo sapiens
actatgaaaagctagaattg

SEQ ID NO: 2012804 - DNA, 12 bp, Homo sapiens
actatgacactg

SEQ ID NO: 2012805 - DNA, 15 bp, Homo sapiens
actatgatcacagtg

SEQ ID NO: 2012806 - DNA, 17 bp, Homo sapiens
actatgatcacagtgac

SEQ ID NO: 2012807 - DNA, 13 bp, Homo sapiens
actatgctgaaga

SEQ ID NO: 2012808 - DNA, 19 bp, Homo sapiens
actatggtatgctggccag

SEQ ID NO: 2012809 - DNA, 15 bp, Homo sapiens
actatggtatttgag

SEQ ID NO: 2012810 - DNA, 15 bp, Homo sapiens
actatggttcccaat

SEQ ID NO: 2012811 - DNA, 17 bp, Homo sapiens
actatggttcccaataa

SEQ ID NO: 2012812 - DNA, 15 bp, Homo sapiens
actatgtgtcatgat

SEQ ID NO: 2012813 - DNA, 14 bp, Homo sapiens
actatgttgcccag

SEQ ID NO: 2012814 - DNA, 16 bp, Homo sapiens
actatgttgcccaggc

SEQ ID NO: 2012815 - DNA, 20 bp, Homo sapiens
actatgttgcccaggcaggt

SEQ ID NO: 2012816 - DNA, 15 bp, Homo sapiens
actattaaagtgcca

SEQ ID NO: 2012817 - DNA, 13 bp, Homo sapiens
actattacttgaa

SEQ ID NO: 2012818 - DNA, 16 bp, Homo sapiens
actattattaataaat

SEQ ID NO: 2012819 - DNA, 22 bp, Homo sapiens
actattctcggggccctgtgta

SEQ ID NO: 2012820 - DNA, 17 bp, Homo sapiens
actattctgttaaaatc

SEQ ID NO: 2012821 - DNA, 21 bp, Homo sapiens
actattctgttaaaatcagga

SEQ ID NO: 2012822 - DNA, 18 bp, Homo sapiens
actattgaagttgcagat

SEQ ID NO: 2012823 - DNA, 19 bp, Homo sapiens
actattggagggtgggaga

SEQ ID NO: 2012824 - DNA, 13 bp, Homo sapiens
actattgtttaaa

SEQ ID NO: 2012825 - DNA, 22 bp, Homo sapiens
actatttctacacagtgggaac

SEQ ID NO: 2012826 - DNA, 18 bp, Homo sapiens
actatttgtctttcagga

SEQ ID NO: 2012827 - DNA, 13 bp, Homo sapiens
actattttttaat

SEQ ID NO: 2012828 - DNA, 19 bp, Homo sapiens
actcaaattaatctttctt

SEQ ID NO: 2012829 - DNA, 18 bp, Homo sapiens
actcaagaggctgaggca

SEQ ID NO: 2012830 - DNA, 15 bp, Homo sapiens
actcaataaaatcat

SEQ ID NO: 2012831 - DNA, 22 bp, Homo sapiens
actcaatatgtgatttttgtga

SEQ ID NO: 2012832 - DNA, 12 bp, Homo sapiens
actcaatatttt

SEQ ID NO: 2012833 - DNA, 16 bp, Homo sapiens
actcaatgcactgaca

SEQ ID NO: 2012834 - DNA, 23 bp, Homo sapiens
actcaatgtgcaagttgtactgt

SEQ ID NO: 2012835 - DNA, 18 bp, Homo sapiens
actcacaagaagaccaga

SEQ ID NO: 2012836 - DNA, 16 bp, Homo sapiens
actcacatggctatgt

SEQ ID NO: 2012837 - DNA, 19 bp, Homo sapiens
actcacatggctatgtttt

SEQ ID NO: 2012838 - DNA, 19 bp, Homo sapiens
actcacatttattctgctc

SEQ ID NO: 2012839 - DNA, 20 bp, Homo sapiens
actcacatttattctgctca

SEQ ID NO: 2012840 - DNA, 21 bp, Homo sapiens
actcacatttattctgctcac

SEQ ID NO: 2012841 - DNA, 13 bp, Homo sapiens
actcaccagggtc

SEQ ID NO: 2012842 - DNA, 15 bp, Homo sapiens
actcacctcctccca

SEQ ID NO: 2012843 - DNA, 13 bp, Homo sapiens
actcacctctgcc

SEQ ID NO: 2012844 - DNA, 19 bp, Homo sapiens
actgatcaaaaataaacta

SEQ ID NO: 2012845 - DNA, 20 bp, Homo sapiens
actgatcaaaaataaactag

SEQ ID NO: 2012846 - DNA, 19 bp, Homo sapiens
actgatcaatccttcttat

SEQ ID NO: 2012847 - DNA, 19 bp, Homo sapiens
actgatgcgaaaacttgaa

SEQ ID NO: 2012848 - DNA, 21 bp, Homo sapiens
actgatggaccgggtgggcct

SEQ ID NO: 2012849 - DNA, 23 bp, Homo sapiens
actgatggaccgggtgggcctgg

SEQ ID NO: 2012850 - DNA, 22 bp, Homo sapiens
actgatgggcaacccccagcct

SEQ ID NO: 2012851 - DNA, 22 bp, Homo sapiens
actgatgttacatcacagtgtt

SEQ ID NO: 2012852 - DNA, 20 bp, Homo sapiens
actgattctgggatgctcct

SEQ ID NO: 2012853 - DNA, 20 bp, Homo sapiens
actgattgggtgccatgtgg

SEQ ID NO: 2012854 - DNA, 22 bp, Homo sapiens
actgattgggtgccatgtggag

SEQ ID NO: 2012855 - DNA, 13 bp, Homo sapiens
actgatttctcac

SEQ ID NO: 2012856 - DNA, 22 bp, Homo sapiens
actgattttgttatttttatat

SEQ ID NO: 2012857 - DNA, 22 bp, Homo sapiens
actgcaacctccacctcctgag

SEQ ID NO: 2012858 - DNA, 14 bp, Homo sapiens
actgcaacctccgc

SEQ ID NO: 2012859 - DNA, 17 bp, Homo sapiens
actgcaagacttaaata

SEQ ID NO: 2012860 - DNA, 15 bp, Homo sapiens
actgcacacacagct

SEQ ID NO: 2012861 - DNA, 17 bp, Homo sapiens
actgcacacacagctcc

SEQ ID NO: 2012862 - DNA, 14 bp, Homo sapiens
actgcaccgggcca

SEQ ID NO: 2012863 - DNA, 18 bp, Homo sapiens
actgcactccagcctggg

SEQ ID NO: 2012864 - DNA, 21 bp, Homo sapiens
actgcagaatacagtaagctg

SEQ ID NO: 2012865 - DNA, 18 bp, Homo sapiens
actgcagatagccagaca

SEQ ID NO: 2012866 - DNA, 16 bp, Homo sapiens
actgcagggactgcca

SEQ ID NO: 2012867 - DNA, 12 bp, Homo sapiens
actgcatgcact

SEQ ID NO: 2012868 - DNA, 14 bp, Homo sapiens
actgcatgcacttc

SEQ ID NO: 2012869 - DNA, 16 bp, Homo sapiens
actgccaaaacaatgc

SEQ ID NO: 2012870 - DNA, 12 bp, Homo sapiens
actgccaggagg

SEQ ID NO: 2012871 - DNA, 13 bp, Homo sapiens
actgccaggaggg

SEQ ID NO: 2012872 - DNA, 15 bp, Homo sapiens
actgccaggagggac

SEQ ID NO: 2012873 - DNA, 18 bp, Homo sapiens
actgccaggcacctggcc

SEQ ID NO: 2012874 - DNA, 20 bp, Homo sapiens
actgccaggcacctggcctg

SEQ ID NO: 2012875 - DNA, 22 bp, Homo sapiens
actgccaggcacctggcctgct

SEQ ID NO: 2012876 - DNA, 19 bp, Homo sapiens
actgccagtccccctgccc

SEQ ID NO: 2012877 - DNA, 20 bp, Homo sapiens
actgccatgcctcaagaaca

SEQ ID NO: 2012878 - DNA, 15 bp, Homo sapiens
actgccccaactcct

SEQ ID NO: 2012879 - DNA, 17 bp, Homo sapiens
actgccccaactcctgg

SEQ ID NO: 2012880 - DNA, 18 bp, Homo sapiens
actgccccaactcctgga

SEQ ID NO: 2012881 - DNA, 12 bp, Homo sapiens
actgccccacca

SEQ ID NO: 2012882 - DNA, 15 bp, Homo sapiens
actgccccaccagcc

SEQ ID NO: 2012883 - DNA, 11 bp, Homo sapiens
actgccctgcc

SEQ ID NO: 2012884 - DNA, 15 bp, Homo sapiens
actgccctgcctgcc

SEQ ID NO: 2012885 - DNA, 17 bp, Homo sapiens
actgccctgcctgccca

SEQ ID NO: 2012886 - DNA, 20 bp, Homo sapiens
actgccggtcacccaggctc

SEQ ID NO: 2012887 - DNA, 9 bp, Homo sapiens
actgcctgc

SEQ ID NO: 2012888 - DNA, 22 bp, Homo sapiens
actgcctggatgtgtttgattt

SEQ ID NO: 2012889 - DNA, 23 bp, Homo sapiens
actgccttaatgagaacatttac

SEQ ID NO: 2012890 - DNA, 11 bp, Homo sapiens
actgccttcca

SEQ ID NO: 2012891 - DNA, 21 bp, Homo sapiens
actgcgggatggtcctggggc

SEQ ID NO: 2012892 - DNA, 23 bp, Homo sapiens
actgctacaaatactcttaggaa

SEQ ID NO: 2012893 - DNA, 19 bp, Homo sapiens
actgctaggcgagtgccag

SEQ ID NO: 2012894 - DNA, 22 bp, Homo sapiens
actgctaggcgagtgccaggac

SEQ ID NO: 2012895 - DNA, 12 bp, Homo sapiens
actgctccaagt

SEQ ID NO: 2012896 - DNA, 18 bp, Homo sapiens
actgctccccagccctgg

SEQ ID NO: 2012897 - DNA, 16 bp, Homo sapiens
actgctctcagcctcc

SEQ ID NO: 2012898 - DNA, 14 bp, Homo sapiens
actgctgagccact

SEQ ID NO: 2012899 - DNA, 20 bp, Homo sapiens
actgctgatcaatgaaatgc

SEQ ID NO: 2012900 - DNA, 19 bp, Homo sapiens
actgctgcaaagtgcaaat

SEQ ID NO: 2012901 - DNA, 15 bp, Homo sapiens
actgctgcaccagag

SEQ ID NO: 2012902 - DNA, 16 bp, Homo sapiens
actgctgcccagcctc

SEQ ID NO: 2012903 - DNA, 21 bp, Homo sapiens
actgctgcccagcctccaagc

SEQ ID NO: 2012904 - DNA, 15 bp, Homo sapiens
actgctgccttaccc

SEQ ID NO: 2012905 - DNA, 18 bp, Homo sapiens
actgctgggactggccag

SEQ ID NO: 2012906 - DNA, 13 bp, Homo sapiens
actgctgtcattg

SEQ ID NO: 2012907 - DNA, 22 bp, Homo sapiens
actgctgtcattgtccatgcct

SEQ ID NO: 2012908 - DNA, 24 bp, Homo sapiens
actgcttgaggaggggcacctgcc

SEQ ID NO: 2012909 - DNA, 16 bp, Homo sapiens
actgctttcaacttaa

SEQ ID NO: 2012910 - DNA, 16 bp, Homo sapiens
actgcttttggtctgt

SEQ ID NO: 2012911 - DNA, 17 bp, Homo sapiens
actggaacttgaactga

SEQ ID NO: 2012912 - DNA, 17 bp, Homo sapiens
actggaagcacagcttc

SEQ ID NO: 2012913 - DNA, 19 bp, Homo sapiens
actggaagcacagcttcat

SEQ ID NO: 2012914 - DNA, 19 bp, Homo sapiens
actggaagcatgtaggaga

SEQ ID NO: 2012915 - DNA, 20 bp, Homo sapiens
actggaagcatgtaggagaa

SEQ ID NO: 2012916 - DNA, 16 bp, Homo sapiens
actggaatcctttcag

SEQ ID NO: 2012917 - DNA, 18 bp, Homo sapiens
actggaatcgatctgtac

SEQ ID NO: 2012918 - DNA, 19 bp, Homo sapiens
actggaatcgatctgtact

SEQ ID NO: 2012919 - DNA, 21 bp, Homo sapiens
actggaatcgatctgtactgt

SEQ ID NO: 2012920 - DNA, 13 bp, Homo sapiens
actggacatcaca

SEQ ID NO: 2012921 - DNA, 20 bp, Homo sapiens
actggaccactgggcaatga

SEQ ID NO: 2012922 - DNA, 21 bp, Homo sapiens
actggactgggttttgtctct

SEQ ID NO: 2012923 - DNA, 12 bp, Homo sapiens
actggagcccag

SEQ ID NO: 2012924 - DNA, 14 bp, Homo sapiens
actggagcccagga

SEQ ID NO: 2012925 - DNA, 19 bp, Homo sapiens
actggaggtcacattcagg

SEQ ID NO: 2012926 - DNA, 18 bp, Homo sapiens
actggagtgcagggagga

SEQ ID NO: 2012927 - DNA, 17 bp, Homo sapiens
actggagttacattaat

SEQ ID NO: 2012928 - DNA, 19 bp, Homo sapiens
actggatcttcagaaggct

SEQ ID NO: 2012929 - DNA, 14 bp, Homo sapiens
actggatgaagatt

SEQ ID NO: 2012930 - DNA, 18 bp, Homo sapiens
actggcaatatttgttct

SEQ ID NO: 2012931 - DNA, 20 bp, Homo sapiens
actggcacagttttctgaga

SEQ ID NO: 2012932 - DNA, 22 bp, Homo sapiens
actggcacagttttctgagaaa

SEQ ID NO: 2012933 - DNA, 17 bp, Homo sapiens
actggcacgtttgtgag

SEQ ID NO: 2012934 - DNA, 23 bp, Homo sapiens
actggcacgtttgtgagaagaaa

SEQ ID NO: 2012935 - DNA, 11 bp, Homo sapiens
actggcagctc

SEQ ID NO: 2012936 - DNA, 14 bp, Homo sapiens
actggcaggtgcag

SEQ ID NO: 2012937 - DNA, 17 bp, Homo sapiens
actggcattaattatta

SEQ ID NO: 2012938 - DNA, 16 bp, Homo sapiens
actggccaagctgagg

SEQ ID NO: 2012939 - DNA, 17 bp, Homo sapiens
actggccaagctgaggt

SEQ ID NO: 2012940 - DNA, 19 bp, Homo sapiens
actggccaagctgaggtgc

SEQ ID NO: 2012941 - DNA, 21 bp, Homo sapiens
actggccaagctgaggtgccc

SEQ ID NO: 2012942 - DNA, 15 bp, Homo sapiens
actggccacccaaca

SEQ ID NO: 2012943 - DNA, 17 bp, Homo sapiens
actggccagagagggcc

SEQ ID NO: 2012944 - DNA, 22 bp, Homo sapiens
actggccagagagggcccagct

SEQ ID NO: 2012945 - DNA, 20 bp, Homo sapiens
actggccagtcctagagctc

SEQ ID NO: 2012946 - DNA, 23 bp, Homo sapiens
actggccagtcctagagctcctg

SEQ ID NO: 2012947 - DNA, 12 bp, Homo sapiens
actggccccacc

SEQ ID NO: 2012948 - DNA, 13 bp, Homo sapiens
actggccccaccc

SEQ ID NO: 2012949 - DNA, 21 bp, Homo sapiens
actggctggccagtctgggtc

SEQ ID NO: 2012950 - DNA, 17 bp, Homo sapiens
actggctggctgcagtg

SEQ ID NO: 2012951 - DNA, 15 bp, Homo sapiens
actggctggggcaga

SEQ ID NO: 2012952 - DNA, 17 bp, Homo sapiens
actggctggggcagagg

SEQ ID NO: 2012953 - DNA, 22 bp, Homo sapiens
actggcttctgtgcactagcct

SEQ ID NO: 2012954 - DNA, 11 bp, Homo sapiens
actgggaaggc

SEQ ID NO: 2012955 - DNA, 15 bp, Homo sapiens
actgggatcgcacct

SEQ ID NO: 2012956 - DNA, 16 bp, Homo sapiens
actgggatgagccgct

SEQ ID NO: 2012957 - DNA, 13 bp, Homo sapiens
actgggcaatgat

SEQ ID NO: 2012958 - DNA, 18 bp, Homo sapiens
actggggagaaataattg

SEQ ID NO: 2012959 - DNA, 20 bp, Homo sapiens
actggggagttataaaaata

SEQ ID NO: 2012960 - DNA, 17 bp, Homo sapiens
actcacctctgcctcaa

SEQ ID NO: 2012961 - DNA, 15 bp, Homo sapiens
actcacctgttactt

SEQ ID NO: 2012962 - DNA, 13 bp, Homo sapiens
actcactcattcc

SEQ ID NO: 2012963 - DNA, 16 bp, Homo sapiens
actcactccagcccaa

SEQ ID NO: 2012964 - DNA, 22 bp, Homo sapiens
actcacttttctttattgctgt

SEQ ID NO: 2012965 - DNA, 16 bp, Homo sapiens
actcagaagacactga

SEQ ID NO: 2012966 - DNA, 15 bp, Homo sapiens
actcagaagcctgag

SEQ ID NO: 2012967 - DNA, 14 bp, Homo sapiens
actcagaagcctgg

SEQ ID NO: 2012968 - DNA, 21 bp, Homo sapiens
actcagaagcctgggggcctg

SEQ ID NO: 2012969 - DNA, 22 bp, Homo sapiens
actcagaagcctgggggcctgg

SEQ ID NO: 2012970 - DNA, 23 bp, Homo sapiens
actcagaagcctgggggcctggc

SEQ ID NO: 2012971 - DNA, 15 bp, Homo sapiens
actcagacattccaa

SEQ ID NO: 2012972 - DNA, 12 bp, Homo sapiens
actcagagcaga

SEQ ID NO: 2012973 - DNA, 14 bp, Homo sapiens
actcagagcagagc

SEQ ID NO: 2012974 - DNA, 17 bp, Homo sapiens
actcagcagcagagagc

SEQ ID NO: 2012975 - DNA, 19 bp, Homo sapiens
actcagcagcagagagccc

SEQ ID NO: 2012976 - DNA, 21 bp, Homo sapiens
actcagcagcagagagccctg

SEQ ID NO: 2012977 - DNA, 17 bp, Homo sapiens
actcagcagccctcctc

SEQ ID NO: 2012978 - DNA, 19 bp, Homo sapiens
actcagcagccctcctcac

SEQ ID NO: 2012979 - DNA, 22 bp, Homo sapiens
actcagcagccctcctcacccc

SEQ ID NO: 2012980 - DNA, 19 bp, Homo sapiens
actcagctctcctgctgca

SEQ ID NO: 2012981 - DNA, 20 bp, Homo sapiens
actcagctctcctgctgcag

SEQ ID NO: 2012982 - DNA, 11 bp, Homo sapiens
actcagctctg

SEQ ID NO: 2012983 - DNA, 19 bp, Homo sapiens
actcagctctgacattctg

SEQ ID NO: 2012984 - DNA, 18 bp, Homo sapiens
actcagctgtctgtggct

SEQ ID NO: 2012985 - DNA, 13 bp, Homo sapiens
actcaggaggctg

SEQ ID NO: 2012986 - DNA, 22 bp, Homo sapiens
agcaaagcctgttcatggcaga

SEQ ID NO: 2012987 - DNA, 14 bp, Homo sapiens
agcaaatcctcttc

SEQ ID NO: 2012988 - DNA, 18 bp, Homo sapiens
agcaaatcctcttctaac

SEQ ID NO: 2012989 - DNA, 15 bp, Homo sapiens
agcaaatcgaatgaa

SEQ ID NO: 2012990 - DNA, 22 bp, Homo sapiens
agcaaatcgaatgaaattaact

SEQ ID NO: 2012991 - DNA, 18 bp, Homo sapiens
agcaaatgcttaaaacaa

SEQ ID NO: 2012992 - DNA, 19 bp, Homo sapiens
agcaaatgcttaaaacaag

SEQ ID NO: 2012993 - DNA, 16 bp, Homo sapiens
agcaaatgtttctgca

SEQ ID NO: 2012994 - DNA, 17 bp, Homo sapiens
agcaaatgtttctgcag

SEQ ID NO: 2012995 - DNA, 19 bp, Homo sapiens
agcaaatttcaaaagacat

SEQ ID NO: 2012996 - DNA, 14 bp, Homo sapiens
agcaacacaagctg

SEQ ID NO: 2012997 - DNA, 16 bp, Homo sapiens
agcaacagaaaaatgg

SEQ ID NO: 2012998 - DNA, 22 bp, Homo sapiens
agcaacagagtgagaccctgtc

SEQ ID NO: 2012999 - DNA, 22 bp, Homo sapiens
agcaacaggaatctcagagaca

SEQ ID NO: 2013000 - DNA, 17 bp, Homo sapiens
agcaacagtagcaggga

SEQ ID NO: 2013001 - DNA, 14 bp, Homo sapiens
agcaacattttatt

SEQ ID NO: 2013002 - DNA, 21 bp, Homo sapiens
agcaacccctgtacccagctc

SEQ ID NO: 2013003 - DNA, 22 bp, Homo sapiens
agcaacccctgtacccagctcc

SEQ ID NO: 2013004 - DNA, 23 bp, Homo sapiens
agcaacccctgtacccagctcct

SEQ ID NO: 2013005 - DNA, 15 bp, Homo sapiens
agcaaccgtggccct

SEQ ID NO: 2013006 - DNA, 16 bp, Homo sapiens
agcaaccgtggccctt

SEQ ID NO: 2013007 - DNA, 13 bp, Homo sapiens
agcaacctcccaa

SEQ ID NO: 2013008 - DNA, 15 bp, Homo sapiens
agcaaccttcatttt

SEQ ID NO: 2013009 - DNA, 17 bp, Homo sapiens
agcaaccttcattttac

SEQ ID NO: 2013010 - DNA, 23 bp, Homo sapiens
agcaacgcaggcccccaggtgcc

SEQ ID NO: 2013011 - DNA, 21 bp, Homo sapiens
agcaactctccactccatatt

SEQ ID NO: 2013012 - DNA, 12 bp, Homo sapiens
agcaactgttgg

SEQ ID NO: 2013013 - DNA, 14 bp, Homo sapiens
agcaacttgcttct

SEQ ID NO: 2013014 - DNA, 18 bp, Homo sapiens
agcaagacctgttggtta

SEQ ID NO: 2013015 - DNA, 19 bp, Homo sapiens
agcaagacgtcctggaatg

SEQ ID NO: 2013016 - DNA, 17 bp, Homo sapiens
agcaagactgttagccc

SEQ ID NO: 2013017 - DNA, 23 bp, Homo sapiens
agcaagacttctctttgcctcaa

SEQ ID NO: 2013018 - DNA, 23 bp, Homo sapiens
agcaagagagagctcgctcttgg

SEQ ID NO: 2013019 - DNA, 20 bp, Homo sapiens
agcaaggacaacctgcccct

SEQ ID NO: 2013020 - DNA, 15 bp, Homo sapiens
agcaaggatatcaga

SEQ ID NO: 2013021 - DNA, 17 bp, Homo sapiens
agcaaggcccgagcagc

SEQ ID NO: 2013022 - DNA, 14 bp, Homo sapiens
agcaagggctccag

SEQ ID NO: 2013023 - DNA, 21 bp, Homo sapiens
agcaaggtttaaatttgttat

SEQ ID NO: 2013024 - DNA, 14 bp, Homo sapiens
agcaaggtttctgg

SEQ ID NO: 2013025 - DNA, 17 bp, Homo sapiens
agcaagtgagagctggg

SEQ ID NO: 2013026 - DNA, 17 bp, Homo sapiens
agcaagttctagagaag

SEQ ID NO: 2013027 - DNA, 13 bp, Homo sapiens
agcaataattagg

SEQ ID NO: 2013028 - DNA, 21 bp, Homo sapiens
agcaataattaggatctatgc

SEQ ID NO: 2013029 - DNA, 15 bp, Homo sapiens
agcaatatgtaaata

SEQ ID NO: 2013030 - DNA, 21 bp, Homo sapiens
agcaatgcccgtaatgcttag

SEQ ID NO: 2013031 - DNA, 21 bp, Homo sapiens
agcaatggacctttggggaag

SEQ ID NO: 2013032 - DNA, 23 bp, Homo sapiens
agcaatgggagggggctccatgg

SEQ ID NO: 2013033 - DNA, 16 bp, Homo sapiens
agcaattcatttcact

SEQ ID NO: 2013034 - DNA, 18 bp, Homo sapiens
agcaattcatttcacttt

SEQ ID NO: 2013035 - DNA, 19 bp, Homo sapiens
agcaattcatttcacttta

SEQ ID NO: 2013036 - DNA, 17 bp, Homo sapiens
agcacaagttatttaaa

SEQ ID NO: 2013037 - DNA, 14 bp, Homo sapiens
agcacaatttatat

SEQ ID NO: 2013038 - DNA, 20 bp, Homo sapiens
agcacacaggtacagcaaca

SEQ ID NO: 2013039 - DNA, 15 bp, Homo sapiens
agcacaccccaaggg

SEQ ID NO: 2013040 - DNA, 17 bp, Homo sapiens
agcacaccccaagggac

SEQ ID NO: 2013041 - DNA, 14 bp, Homo sapiens
agcacacggccctg

SEQ ID NO: 2013042 - DNA, 21 bp, Homo sapiens
agcacagcagcccctgcacaa

SEQ ID NO: 2013043 - DNA, 22 bp, Homo sapiens
agcacagcagtggagagtgttc

SEQ ID NO: 2013044 - DNA, 13 bp, Homo sapiens
agcacagccctgg

SEQ ID NO: 2013045 - DNA, 17 bp, Homo sapiens
agcacagccctgggagg

SEQ ID NO: 2013046 - DNA, 12 bp, Homo sapiens
agcacaggggcc

SEQ ID NO: 2013047 - DNA, 15 bp, Homo sapiens
agcacaggggcccca

SEQ ID NO: 2013048 - DNA, 14 bp, Homo sapiens
agatcgtattaatt

SEQ ID NO: 2013049 - DNA, 19 bp, Homo sapiens
agatcgtattaattatctg

SEQ ID NO: 2013050 - DNA, 22 bp, Homo sapiens
agatcgtattaattatctgatc

SEQ ID NO: 2013051 - DNA, 17 bp, Homo sapiens
agatcgttagtatctaa

SEQ ID NO: 2013052 - DNA, 18 bp, Homo sapiens
agatctccacggtcagat

SEQ ID NO: 2013053 - DNA, 16 bp, Homo sapiens
agatctccctccaggg

SEQ ID NO: 2013054 - DNA, 17 bp, Homo sapiens
agatctccctccaggga

SEQ ID NO: 2013055 - DNA, 16 bp, Homo sapiens
agatctcctgtaattt

SEQ ID NO: 2013056 - DNA, 15 bp, Homo sapiens
agatctgaaaggcac

SEQ ID NO: 2013057 - DNA, 20 bp, Homo sapiens
agatctgatggtgagctggg

SEQ ID NO: 2013058 - DNA, 16 bp, Homo sapiens
agatctgcactgggtg

SEQ ID NO: 2013059 - DNA, 21 bp, Homo sapiens
agatctgcagggggtgtgtct

SEQ ID NO: 2013060 - DNA, 18 bp, Homo sapiens
agatctgcctgggcctgt

SEQ ID NO: 2013061 - DNA, 22 bp, Homo sapiens
agatctgcctgggcctgtgcag

SEQ ID NO: 2013062 - DNA, 23 bp, Homo sapiens
agatctgcctgggcctgtgcagc

SEQ ID NO: 2013063 - DNA, 13 bp, Homo sapiens
agatctgcttctt

SEQ ID NO: 2013064 - DNA, 17 bp, Homo sapiens
agatcttctgaaatgaa

SEQ ID NO: 2013065 - DNA, 20 bp, Homo sapiens
agatctttttgtgaaattca

SEQ ID NO: 2013066 - DNA, 13 bp, Homo sapiens
agatgaaagagga

SEQ ID NO: 2013067 - DNA, 19 bp, Homo sapiens
agatgaagagaagctgaga

SEQ ID NO: 2013068 - DNA, 14 bp, Homo sapiens
agatgacagctctt

SEQ ID NO: 2013069 - DNA, 14 bp, Homo sapiens
agatgactgagtcc

SEQ ID NO: 2013070 - DNA, 14 bp, Homo sapiens
agatgacttgaggc

SEQ ID NO: 2013071 - DNA, 17 bp, Homo sapiens
agatgagatttgccagc

SEQ ID NO: 2013072 - DNA, 15 bp, Homo sapiens
agatgagcagtcaca

SEQ ID NO: 2013073 - DNA, 16 bp, Homo sapiens
agatgagggtgactgt

SEQ ID NO: 2013074 - DNA, 13 bp, Homo sapiens
agatgataatgga

SEQ ID NO: 2013075 - DNA, 16 bp, Homo sapiens
agatgatctactcaga

SEQ ID NO: 2013076 - DNA, 14 bp, Homo sapiens
agatgatctctcca

SEQ ID NO: 2013077 - DNA, 12 bp, Homo sapiens
agatgatgatga

SEQ ID NO: 2013078 - DNA, 21 bp, Homo sapiens
agatgattcggatttgacaaa

SEQ ID NO: 2013079 - DNA, 12 bp, Homo sapiens
agatgattctgg

SEQ ID NO: 2013080 - DNA, 19 bp, Homo sapiens
agatgcaacctcactatgg

SEQ ID NO: 2013081 - DNA, 17 bp, Homo sapiens
agatgcacacacagatg

SEQ ID NO: 2013082 - DNA, 22 bp, Homo sapiens
agatgcacacacagatgcacac

SEQ ID NO: 2013083 - DNA, 18 bp, Homo sapiens
agatgcatgcgcaggctc

SEQ ID NO: 2013084 - DNA, 16 bp, Homo sapiens
agatgccacacctgct

SEQ ID NO: 2013085 - DNA, 18 bp, Homo sapiens
agatgccattcatagaga

SEQ ID NO: 2013086 - DNA, 22 bp, Homo sapiens
agatgcccagagggcccaggca

SEQ ID NO: 2013087 - DNA, 14 bp, Homo sapiens
agatgcctccaccg

SEQ ID NO: 2013088 - DNA, 15 bp, Homo sapiens
agatgcctccaccgc

SEQ ID NO: 2013089 - DNA, 21 bp, Homo sapiens
agatgccttcctgtctttctg

SEQ ID NO: 2013090 - DNA, 23 bp, Homo sapiens
agatgctgactgtactcctccca

SEQ ID NO: 2013091 - DNA, 17 bp, Homo sapiens
agatggaaagaaagcac

SEQ ID NO: 2013092 - DNA, 22 bp, Homo sapiens
agatggaagttgcagtgagctg

SEQ ID NO: 2013093 - DNA, 19 bp, Homo sapiens
agatggaccagtagacaac

SEQ ID NO: 2013094 - DNA, 18 bp, Homo sapiens
agatggacccctcccttg

SEQ ID NO: 2013095 - DNA, 15 bp, Homo sapiens
agatggaggccgagc

SEQ ID NO: 2013096 - DNA, 18 bp, Homo sapiens
agatggctgtgcctctgc

SEQ ID NO: 2013097 - DNA, 21 bp, Homo sapiens
agatgggcacatgaggagggt

SEQ ID NO: 2013098 - DNA, 18 bp, Homo sapiens
agatgggcttgttttctt

SEQ ID NO: 2013099 - DNA, 16 bp, Homo sapiens
agatgggtattaaact

SEQ ID NO: 2013100 - DNA, 19 bp, Homo sapiens
agatgggtctggctgagct

SEQ ID NO: 2013101 - DNA, 20 bp, Homo sapiens
agatggtaatctacagctca

SEQ ID NO: 2013102 - DNA, 22 bp, Homo sapiens
agatggttagtggggtaattct

SEQ ID NO: 2013103 - DNA, 14 bp, Homo sapiens
agatgtatcattaa

SEQ ID NO: 2013104 - DNA, 13 bp, Homo sapiens
agatgtcaaatat

SEQ ID NO: 2013105 - DNA, 21 bp, Homo sapiens
agatgtcaataggaattgcat

SEQ ID NO: 2013106 - DNA, 20 bp, Homo sapiens
agatgtcagccgagccgggc

SEQ ID NO: 2013107 - DNA, 13 bp, Homo sapiens
agatgtctttagg

SEQ ID NO: 2013108 - DNA, 23 bp, Homo sapiens
agatgtctttaggcagcagcttt

SEQ ID NO: 2013109 - DNA, 19 bp, Homo sapiens
agatgtgattcctgcattt

SEQ ID NO: 2013110 - DNA, 23 bp, Homo sapiens
agatgtggcaaagtgctgtaccc

SEQ ID NO: 2013111 - DNA, 14 bp, Homo sapiens
agatgtttcacgaa

SEQ ID NO: 2013112 - DNA, 15 bp, Homo sapiens
agatgtttgtcagat

SEQ ID NO: 2013113 - DNA, 14 bp, Homo sapiens
agatgttttacaaa

SEQ ID NO: 2013114 - DNA, 15 bp, Homo sapiens
agatacactcctgct

SEQ ID NO: 2013115 - DNA, 18 bp, Homo sapiens
agatacatagatggacca

SEQ ID NO: 2013116 - DNA, 16 bp, Homo sapiens
agataccatactcatt

SEQ ID NO: 2013117 - DNA, 22 bp, Homo sapiens
agatacggttgcttcaccttgg

SEQ ID NO: 2013118 - DNA, 20 bp, Homo sapiens
agatactggaagttttgcat

SEQ ID NO: 2013119 - DNA, 16 bp, Homo sapiens
agatacttaagtgctg

SEQ ID NO: 2013120 - DNA, 17 bp, Homo sapiens
agatagaaagcaataaa

SEQ ID NO: 2013121 - DNA, 19 bp, Homo sapiens
agatagaaagcaataaaaa

SEQ ID NO: 2013122 - DNA, 16 bp, Homo sapiens
agatagaatttccaat

SEQ ID NO: 2013123 - DNA, 15 bp, Homo sapiens
agatagccagacaca

SEQ ID NO: 2013124 - DNA, 15 bp, Homo sapiens
agataggtaaatacc

SEQ ID NO: 2013125 - DNA, 17 bp, Homo sapiens
agatagtagcatacatt

SEQ ID NO: 2013126 - DNA, 17 bp, Homo sapiens
agatataaatggctggt

SEQ ID NO: 2013127 - DNA, 15 bp, Homo sapiens
agatatacaaaaaca

SEQ ID NO: 2013128 - DNA, 14 bp, Homo sapiens
agatatatttttca

SEQ ID NO: 2013129 - DNA, 16 bp, Homo sapiens
agatatcagagctctt

SEQ ID NO: 2013130 - DNA, 19 bp, Homo sapiens
agatatcagagctcttaat

SEQ ID NO: 2013131 - DNA, 16 bp, Homo sapiens
agatatgatatgtaaa

SEQ ID NO: 2013132 - DNA, 17 bp, Homo sapiens
agatatggcagcgaaag

SEQ ID NO: 2013133 - DNA, 16 bp, Homo sapiens
agatattatttaaatg

SEQ ID NO: 2013134 - DNA, 14 bp, Homo sapiens
agatatttatatat

SEQ ID NO: 2013135 - DNA, 14 bp, Homo sapiens
agatatttttgtac

SEQ ID NO: 2013136 - DNA, 22 bp, Homo sapiens
agatattttttcagaaatatgt

SEQ ID NO: 2013137 - DNA, 14 bp, Homo sapiens
agatcaaatttcac

SEQ ID NO: 2013138 - DNA, 14 bp, Homo sapiens
agatcaaccccttc

SEQ ID NO: 2013139 - DNA, 21 bp, Homo sapiens
agatcaaccccttcgctcctg

SEQ ID NO: 2013140 - DNA, 14 bp, Homo sapiens
agatcaattaattc

SEQ ID NO: 2013141 - DNA, 21 bp, Homo sapiens
agatcaatttgtaattgctta

SEQ ID NO: 2013142 - DNA, 17 bp, Homo sapiens
agatcacatattctagt

SEQ ID NO: 2013143 - DNA, 14 bp, Homo sapiens
agatcaccagcccg

SEQ ID NO: 2013144 - DNA, 21 bp, Homo sapiens
agatcaccagcccggcctgct

SEQ ID NO: 2013145 - DNA, 18 bp, Homo sapiens
agatcacgccactgcact

SEQ ID NO: 2013146 - DNA, 14 bp, Homo sapiens
agatcagccacgga

SEQ ID NO: 2013147 - DNA, 13 bp, Homo sapiens
agatcaggaagag

SEQ ID NO: 2013148 - DNA, 19 bp, Homo sapiens
agatcaggaagagaaggag

SEQ ID NO: 2013149 - DNA, 22 bp, Homo sapiens
agatcatctggggacctggttt

SEQ ID NO: 2013150 - DNA, 20 bp, Homo sapiens
agatccatttggacaaaatg

SEQ ID NO: 2013151 - DNA, 20 bp, Homo sapiens
agatcccatccatcagctcc

SEQ ID NO: 2013152 - DNA, 14 bp, Homo sapiens
agatcccatgtcac

SEQ ID NO: 2013153 - DNA, 23 bp, Homo sapiens
agatcccatgtcacctcagctga

SEQ ID NO: 2013154 - DNA, 17 bp, Homo sapiens
agatcctaggtgctgga

SEQ ID NO: 2013155 - DNA, 17 bp, Homo sapiens
agatcctctgctgactc

SEQ ID NO: 2013156 - DNA, 20 bp, Homo sapiens
agatcgagaccatcctggct

SEQ ID NO: 2013157 - DNA, 20 bp, Homo sapiens
agatcgcgccactgcactcc

SEQ ID NO: 2013158 - DNA, 19 bp, Homo sapiens
agatcgcttgagcccagga

SEQ ID NO: 2013159 - DNA, 12 bp, Homo sapiens
agatcgtattaa

SEQ ID NO: 2013160 - DNA, 16 bp, Homo sapiens
agaggagcacctgaac

SEQ ID NO: 2013161 - DNA, 19 bp, Homo sapiens
agaggagccagaagtaaag

SEQ ID NO: 2013162 - DNA, 16 bp, Homo sapiens
agaggagttgccaggg

SEQ ID NO: 2013163 - DNA, 16 bp, Homo sapiens
agaggatgatttcaga

SEQ ID NO: 2013164 - DNA, 18 bp, Homo sapiens
agaggatgatttcagaag

SEQ ID NO: 2013165 - DNA, 13 bp, Homo sapiens
agaggatgttctg

SEQ ID NO: 2013166 - DNA, 14 bp, Homo sapiens
agaggatgttctgg

SEQ ID NO: 2013167 - DNA, 19 bp, Homo sapiens
agaggcagaagtcagcccg

SEQ ID NO: 2013168 - DNA, 14 bp, Homo sapiens
agaggcagagaaag

SEQ ID NO: 2013169 - DNA, 21 bp, Homo sapiens
agaggcagagaaagaagagac

SEQ ID NO: 2013170 - DNA, 13 bp, Homo sapiens
agaggcagcccca

SEQ ID NO: 2013171 - DNA, 19 bp, Homo sapiens
agaggcagccccattctgc

SEQ ID NO: 2013172 - DNA, 21 bp, Homo sapiens
agaggcagccccattctgcct

SEQ ID NO: 2013173 - DNA, 10 bp, Homo sapiens
agaggcaggg

SEQ ID NO: 2013174 - DNA, 13 bp, Homo sapiens
agaggcagggagg

SEQ ID NO: 2013175 - DNA, 13 bp, Homo sapiens
agaggccctggat

SEQ ID NO: 2013176 - DNA, 21 bp, Homo sapiens
agaggccctggatcagcgtgg

SEQ ID NO: 2013177 - DNA, 24 bp, Homo sapiens
agaggccctggatcagcgtggcct

SEQ ID NO: 2013178 - DNA, 12 bp, Homo sapiens
agaggcctcagt

SEQ ID NO: 2013179 - DNA, 21 bp, Homo sapiens
agaggcgcgtctgccccaccc

SEQ ID NO: 2013180 - DNA, 21 bp, Homo sapiens
agaggcggaaaccttgcagca

SEQ ID NO: 2013181 - DNA, 16 bp, Homo sapiens
agaggcggcctcgtgc

SEQ ID NO: 2013182 - DNA, 22 bp, Homo sapiens
agaggcgtctcacatttttact

SEQ ID NO: 2013183 - DNA, 13 bp, Homo sapiens
agaggctgcagaa

SEQ ID NO: 2013184 - DNA, 17 bp, Homo sapiens
agaggctggaggcaggg

SEQ ID NO: 2013185 - DNA, 14 bp, Homo sapiens
agaggctgggggag

SEQ ID NO: 2013186 - DNA, 17 bp, Homo sapiens
agaggctgtggtggctg

SEQ ID NO: 2013187 - DNA, 23 bp, Homo sapiens
agaggctgtggtggctgtctctg

SEQ ID NO: 2013188 - DNA, 16 bp, Homo sapiens
agaggctttggcccaa

SEQ ID NO: 2013189 - DNA, 17 bp, Homo sapiens
agagggaatggatgggg

SEQ ID NO: 2013190 - DNA, 13 bp, Homo sapiens
agagggacagggt

SEQ ID NO: 2013191 - DNA, 20 bp, Homo sapiens
agagggaccaaattgcttct

SEQ ID NO: 2013192 - DNA, 24 bp, Homo sapiens
agagggaggagaatgagcctcggc

SEQ ID NO: 2013193 - DNA, 17 bp, Homo sapiens
agagggcagtacctggg

SEQ ID NO: 2013194 - DNA, 18 bp, Homo sapiens
agagggcagtacctggga

SEQ ID NO: 2013195 - DNA, 16 bp, Homo sapiens
agagggccaagagaga

SEQ ID NO: 2013196 - DNA, 18 bp, Homo sapiens
agagggccaagagagaca

SEQ ID NO: 2013197 - DNA, 14 bp, Homo sapiens
agagggcccagctg

SEQ ID NO: 2013198 - DNA, 21 bp, Homo sapiens
agagggcccaggcaggccacc

SEQ ID NO: 2013199 - DNA, 21 bp, Homo sapiens
agagggctgcgagcatttccc

SEQ ID NO: 2013200 - DNA, 16 bp, Homo sapiens
agaggggaagggccag

SEQ ID NO: 2013201 - DNA, 16 bp, Homo sapiens
agaggggacatttccc

SEQ ID NO: 2013202 - DNA, 12 bp, Homo sapiens
agagcagcctga

SEQ ID NO: 2013203 - DNA, 18 bp, Homo sapiens
agagcagcctgatggcca

SEQ ID NO: 2013204 - DNA, 21 bp, Homo sapiens
agagcagcctgatggccaagg

SEQ ID NO: 2013205 - DNA, 11 bp, Homo sapiens
agagcagctgg

SEQ ID NO: 2013206 - DNA, 13 bp, Homo sapiens
agagcagctggct

SEQ ID NO: 2013207 - DNA, 18 bp, Homo sapiens
agagcaggcacatggagg

SEQ ID NO: 2013208 - DNA, 19 bp, Homo sapiens
agagcaggcacatggagga

SEQ ID NO: 2013209 - DNA, 17 bp, Homo sapiens
agagcaggctcagactc

SEQ ID NO: 2013210 - DNA, 22 bp, Homo sapiens
agagcaggggtccttggtgtga

SEQ ID NO: 2013211 - DNA, 17 bp, Homo sapiens
agagcaggtgagatggg

SEQ ID NO: 2013212 - DNA, 14 bp, Homo sapiens
agagcatcatgcct

SEQ ID NO: 2013213 - DNA, 15 bp, Homo sapiens
agagcatcatgcctc

SEQ ID NO: 2013214 - DNA, 22 bp, Homo sapiens
agagcatcatgcctctgaggcc

SEQ ID NO: 2013215 - DNA, 22 bp, Homo sapiens
agagcattacgtgagccaggta

SEQ ID NO: 2013216 - DNA, 22 bp, Homo sapiens
agagccagaacctggagggcta

SEQ ID NO: 2013217 - DNA, 12 bp, Homo sapiens
agagccagccct

SEQ ID NO: 2013218 - DNA, 17 bp, Homo sapiens
agagccagccctccctg

SEQ ID NO: 2013219 - DNA, 18 bp, Homo sapiens
agagccagcctgggactc

SEQ ID NO: 2013220 - DNA, 16 bp, Homo sapiens
agagccaggctctgcc

SEQ ID NO: 2013221 - DNA, 13 bp, Homo sapiens
agagccagggtct

SEQ ID NO: 2013222 - DNA, 13 bp, Homo sapiens
agagccatgggcc

SEQ ID NO: 2013223 - DNA, 16 bp, Homo sapiens
agagccatgggcctgg

SEQ ID NO: 2013224 - DNA, 17 bp, Homo sapiens
agagccatgggcctggg

SEQ ID NO: 2013225 - DNA, 19 bp, Homo sapiens
agagccatgggcctgggcc

SEQ ID NO: 2013226 - DNA, 20 bp, Homo sapiens
agagccatgggcctgggcct

SEQ ID NO: 2013227 - DNA, 22 bp, Homo sapiens
agagccatgggcctgggcctgc

SEQ ID NO: 2013228 - DNA, 14 bp, Homo sapiens
agagcccaagtgcc

SEQ ID NO: 2013229 - DNA, 18 bp, Homo sapiens
agagcccaagtgccatcc

SEQ ID NO: 2013230 - DNA, 21 bp, Homo sapiens
agagcccagcagggcctcaaa

SEQ ID NO: 2013231 - DNA, 14 bp, Homo sapiens
agagcccagccatt

SEQ ID NO: 2013232 - DNA, 14 bp, Homo sapiens
agagcccatgctca

SEQ ID NO: 2013233 - DNA, 15 bp, Homo sapiens
agagcccatgctcaa

SEQ ID NO: 2013234 - DNA, 15 bp, Homo sapiens
agagccccacacgga

SEQ ID NO: 2013235 - DNA, 17 bp, Homo sapiens
agagccccacacggagg

SEQ ID NO: 2013236 - DNA, 14 bp, Homo sapiens
agagccccactccc

SEQ ID NO: 2013237 - DNA, 15 bp, Homo sapiens
agagcccccaagcct

SEQ ID NO: 2013238 - DNA, 16 bp, Homo sapiens
agagcccccaagcctc

SEQ ID NO: 2013239 - DNA, 20 bp, Homo sapiens
agagcccccaagcctctgcc

SEQ ID NO: 2013240 - DNA, 13 bp, Homo sapiens
agagcccccaagg

SEQ ID NO: 2013241 - DNA, 16 bp, Homo sapiens
actcctgtgggagcct

SEQ ID NO: 2013242 - DNA, 19 bp, Homo sapiens
actcctgtgggagcctcgc

SEQ ID NO: 2013243 - DNA, 17 bp, Homo sapiens
actcctgttacttacct

SEQ ID NO: 2013244 - DNA, 11 bp, Homo sapiens
actccttcctg

SEQ ID NO: 2013245 - DNA, 15 bp, Homo sapiens
actccttcctgcccc

SEQ ID NO: 2013246 - DNA, 21 bp, Homo sapiens
actccttgtggtttatgtcat

SEQ ID NO: 2013247 - DNA, 16 bp, Homo sapiens
actcgcagtcgcagga

SEQ ID NO: 2013248 - DNA, 16 bp, Homo sapiens
actcggagagggctgc

SEQ ID NO: 2013249 - DNA, 21 bp, Homo sapiens
actcgggaggctgaggcagga

SEQ ID NO: 2013250 - DNA, 17 bp, Homo sapiens
actcggtgtaaaaccat

SEQ ID NO: 2013251 - DNA, 18 bp, Homo sapiens
actctaaatatttcatga

SEQ ID NO: 2013252 - DNA, 19 bp, Homo sapiens
actctacccatattacaga

SEQ ID NO: 2013253 - DNA, 22 bp, Homo sapiens
actctaccctggtaggaaagca

SEQ ID NO: 2013254 - DNA, 17 bp, Homo sapiens
actctacgccaaagtgc

SEQ ID NO: 2013255 - DNA, 22 bp, Homo sapiens
actctacgccaaagtgcagccc

SEQ ID NO: 2013256 - DNA, 20 bp, Homo sapiens
actctactgcaagacttaaa

SEQ ID NO: 2013257 - DNA, 18 bp, Homo sapiens
actctagaacatgcacat

SEQ ID NO: 2013258 - DNA, 13 bp, Homo sapiens
actctagcctggg

SEQ ID NO: 2013259 - DNA, 20 bp, Homo sapiens
actctagtgacttcctggtg

SEQ ID NO: 2013260 - DNA, 14 bp, Homo sapiens
actctatagacttt

SEQ ID NO: 2013261 - DNA, 20 bp, Homo sapiens
actctatagttattgtttta

SEQ ID NO: 2013262 - DNA, 22 bp, Homo sapiens
actctcaatgcattttcaagat

SEQ ID NO: 2013263 - DNA, 24 bp, Homo sapiens
actctcaggaggcgcagcccgaag

SEQ ID NO: 2013264 - DNA, 13 bp, Homo sapiens
actgggggagggg

SEQ ID NO: 2013265 - DNA, 14 bp, Homo sapiens
actgggtaatgaaa

SEQ ID NO: 2013266 - DNA, 20 bp, Homo sapiens
actgggtaatgaaacaaaga

SEQ ID NO: 2013267 - DNA, 15 bp, Homo sapiens
actgggtacttgtgg

SEQ ID NO: 2013268 - DNA, 17 bp, Homo sapiens
actgggtacttgtggac

SEQ ID NO: 2013269 - DNA, 20 bp, Homo sapiens
actgggtacttgtggacaca

SEQ ID NO: 2013270 - DNA, 23 bp, Homo sapiens
actgggtacttgtggacacagct

SEQ ID NO: 2013271 - DNA, 21 bp, Homo sapiens
actgggttatttttgtccctg

SEQ ID NO: 2013272 - DNA, 23 bp, Homo sapiens
actgggttatttttgtccctgct

SEQ ID NO: 2013273 - DNA, 13 bp, Homo sapiens
actgggttgactt

SEQ ID NO: 2013274 - DNA, 20 bp, Homo sapiens
actgggttgactttcaggta

SEQ ID NO: 2013275 - DNA, 20 bp, Homo sapiens
actgggtttctctgtatagt

SEQ ID NO: 2013276 - DNA, 18 bp, Homo sapiens
actgggtttgtttttcaa

SEQ ID NO: 2013277 - DNA, 19 bp, Homo sapiens
actgggttttgtctctgca

SEQ ID NO: 2013278 - DNA, 22 bp, Homo sapiens
actgggttttgtctctgcatct

SEQ ID NO: 2013279 - DNA, 17 bp, Homo sapiens
actggtccactcagggc

SEQ ID NO: 2013280 - DNA, 18 bp, Homo sapiens
actggtccactcagggct

SEQ ID NO: 2013281 - DNA, 23 bp, Homo sapiens
actggtgctataggctggagaag

SEQ ID NO: 2013282 - DNA, 18 bp, Homo sapiens
actggtgttaagatatat

SEQ ID NO: 2013283 - DNA, 16 bp, Homo sapiens
actggttgtgaataat

SEQ ID NO: 2013284 - DNA, 20 bp, Homo sapiens
actggtttatccacccacaa

SEQ ID NO: 2013285 - DNA, 22 bp, Homo sapiens
actggtttgttgcagccaaaga

SEQ ID NO: 2013286 - DNA, 19 bp, Homo sapiens
actgtaaatatgtttgtgc

SEQ ID NO: 2013287 - DNA, 11 bp, Homo sapiens
actgtaaatca

SEQ ID NO: 2013288 - DNA, 13 bp, Homo sapiens
actgtaaatcact

SEQ ID NO: 2013289 - DNA, 16 bp, Homo sapiens
actgtaaatcacttgt

SEQ ID NO: 2013290 - DNA, 17 bp, Homo sapiens
actgtaaatcacttgta

SEQ ID NO: 2013291 - DNA, 19 bp, Homo sapiens
actgtaaatcacttgtaaa

SEQ ID NO: 2013292 - DNA, 23 bp, Homo sapiens
actgtaaatcacttgtaaataaa

SEQ ID NO: 2013293 - DNA, 13 bp, Homo sapiens
actgtaaatgtat

SEQ ID NO: 2013294 - DNA, 14 bp, Homo sapiens
actgtaagtttatt

SEQ ID NO: 2013295 - DNA, 14 bp, Homo sapiens
actgtaattttgtt

SEQ ID NO: 2013296 - DNA, 22 bp, Homo sapiens
actgtaattttgtttgtaatcc

SEQ ID NO: 2013297 - DNA, 12 bp, Homo sapiens
actgtacataga

SEQ ID NO: 2013298 - DNA, 13 bp, Homo sapiens
actgtactcctcc

SEQ ID NO: 2013299 - DNA, 22 bp, Homo sapiens
actgtactgagacattacagtt

SEQ ID NO: 2013300 - DNA, 17 bp, Homo sapiens
actgtacttaataaatt

SEQ ID NO: 2013301 - DNA, 23 bp, Homo sapiens
actgtacttattttccaataaaa

SEQ ID NO: 2013302 - DNA, 18 bp, Homo sapiens
actgtagaatgatttcat

SEQ ID NO: 2013303 - DNA, 16 bp, Homo sapiens
actgtatcaaatctgt

SEQ ID NO: 2013304 - DNA, 22 bp, Homo sapiens
actgtatctctaatacagtgtg

SEQ ID NO: 2013305 - DNA, 13 bp, Homo sapiens
actgtatgctgga

SEQ ID NO: 2013306 - DNA, 15 bp, Homo sapiens
actgtcaagtcatga

SEQ ID NO: 2013307 - DNA, 22 bp, Homo sapiens
actgtccgcctctgcccgcaga

SEQ ID NO: 2013308 - DNA, 23 bp, Homo sapiens
actgtcctacccaccctcctttc

SEQ ID NO: 2013309 - DNA, 18 bp, Homo sapiens
actgtcgtgtttacaaaa

SEQ ID NO: 2013310 - DNA, 23 bp, Homo sapiens
actgtctcaagagggcactggtg

SEQ ID NO: 2013311 - DNA, 15 bp, Homo sapiens
actgtctctcatgaa

SEQ ID NO: 2013312 - DNA, 17 bp, Homo sapiens
actgtctctcatgaacc

SEQ ID NO: 2013313 - DNA, 17 bp, Homo sapiens
actgtctggttttaaca

SEQ ID NO: 2013314 - DNA, 18 bp, Homo sapiens
actgtctggttttaacaa

SEQ ID NO: 2013315 - DNA, 17 bp, Homo sapiens
actgtctgtaagagaat

SEQ ID NO: 2013316 - DNA, 14 bp, Homo sapiens
actgtcttcacaac

SEQ ID NO: 2013317 - DNA, 22 bp, Homo sapiens
actgtcttgcctgccagggccc

SEQ ID NO: 2013318 - DNA, 21 bp, Homo sapiens
actgtgaagacccagcaggaa

SEQ ID NO: 2013319 - DNA, 22 bp, Homo sapiens
actgtgacaccagaataatgag

SEQ ID NO: 2013320 - DNA, 11 bp, Homo sapiens
actgtgacagg

SEQ ID NO: 2013321 - DNA, 12 bp, Homo sapiens
actgtgagactg

SEQ ID NO: 2013322 - DNA, 15 bp, Homo sapiens
actgtgagactgtat

SEQ ID NO: 2013323 - DNA, 23 bp, Homo sapiens
actgtgatcaggctatgtatgga

SEQ ID NO: 2013324 - DNA, 23 bp, Homo sapiens
actgtgatggggtgggcagggct

SEQ ID NO: 2013325 - DNA, 13 bp, Homo sapiens
actgtgcaggagt

SEQ ID NO: 2013326 - DNA, 17 bp, Homo sapiens
actgtgcatacatgttc

SEQ ID NO: 2013327 - DNA, 17 bp, Homo sapiens
actgtgccctgccttca

SEQ ID NO: 2013328 - DNA, 18 bp, Homo sapiens
actgtgccctgccttcag

SEQ ID NO: 2013329 - DNA, 18 bp, Homo sapiens
actgtgcgttttagagta

SEQ ID NO: 2013330 - DNA, 14 bp, Homo sapiens
actgtgcttacagt

SEQ ID NO: 2013331 - DNA, 23 bp, Homo sapiens
actgtgcttacagtgactgtcgt

SEQ ID NO: 2013332 - DNA, 14 bp, Homo sapiens
actgtggaaaaata

SEQ ID NO: 2013333 - DNA, 15 bp, Homo sapiens
actgtggaaaaatat

SEQ ID NO: 2013334 - DNA, 15 bp, Homo sapiens
actgtggccagagct

SEQ ID NO: 2013335 - DNA, 17 bp, Homo sapiens
actgtggccagagctgg

SEQ ID NO: 2013336 - DNA, 14 bp, Homo sapiens
actgtggctgcaga

SEQ ID NO: 2013337 - DNA, 19 bp, Homo sapiens
actgtggctgctagcactt

SEQ ID NO: 2013338 - DNA, 20 bp, Homo sapiens
actgtgttcagtgccttgga

SEQ ID NO: 2013339 - DNA, 19 bp, Homo sapiens
actgtgttggccaggctgg

SEQ ID NO: 2013340 - DNA, 20 bp, Homo sapiens
actgtgttggccaggctggt

SEQ ID NO: 2013341 - DNA, 14 bp, Homo sapiens
actgttactccaca

SEQ ID NO: 2013342 - DNA, 21 bp, Homo sapiens
actgttactttttagtctttt

SEQ ID NO: 2013343 - DNA, 22 bp, Homo sapiens
actgttactttttagtctttta

SEQ ID NO: 2013344 - DNA, 18 bp, Homo sapiens
actgttcacgttgggtgg

SEQ ID NO: 2013345 - DNA, 20 bp, Homo sapiens
actgttctgtgtgggtctgg

SEQ ID NO: 2013346 - DNA, 13 bp, Homo sapiens
actgttgaaaatt

SEQ ID NO: 2013347 - DNA, 14 bp, Homo sapiens
actgttgcccaggc

SEQ ID NO: 2013348 - DNA, 21 bp, Homo sapiens
actgttgctcaaatctattca

SEQ ID NO: 2013349 - DNA, 15 bp, Homo sapiens
actgttgtacaagct

SEQ ID NO: 2013350 - DNA, 14 bp, Homo sapiens
actgtttcttacct

SEQ ID NO: 2013351 - DNA, 21 bp, Homo sapiens
actgtttgccttctactttta

SEQ ID NO: 2013352 - DNA, 14 bp, Homo sapiens
actgtttttgaaga

SEQ ID NO: 2013353 - DNA, 16 bp, Homo sapiens
actgtttttgaagaag

SEQ ID NO: 2013354 - DNA, 14 bp, Homo sapiens
acttaaaaaaatga

SEQ ID NO: 2013355 - DNA, 16 bp, Homo sapiens
acttaaaaaaatgaca

SEQ ID NO: 2013356 - DNA, 17 bp, Homo sapiens
acttaaaagattcacta

SEQ ID NO: 2013357 - DNA, 13 bp, Homo sapiens
acttaaaatattt

SEQ ID NO: 2013358 - DNA, 16 bp, Homo sapiens
acttaaagcttgtttg

SEQ ID NO: 2013359 - DNA, 16 bp, Homo sapiens
acttaacattgattta

SEQ ID NO: 2013360 - DNA, 19 bp, Homo sapiens
acttaacggctccaggatt

SEQ ID NO: 2013361 - DNA, 13 bp, Homo sapiens
acttaactgtgtg

SEQ ID NO: 2013362 - DNA, 21 bp, Homo sapiens
acttaactgtgtgaagaaatg

SEQ ID NO: 2013363 - DNA, 22 bp, Homo sapiens
acttaactgtgtgaagaaatgg

SEQ ID NO: 2013364 - DNA, 15 bp, Homo sapiens
actttgatctctgct

SEQ ID NO: 2013365 - DNA, 16 bp, Homo sapiens
actttgatctctgctt

SEQ ID NO: 2013366 - DNA, 17 bp, Homo sapiens
actttgatgcatttcca

SEQ ID NO: 2013367 - DNA, 21 bp, Homo sapiens
actttgccccagttacaaaaa

SEQ ID NO: 2013368 - DNA, 17 bp, Homo sapiens
actttgctctttcttga

SEQ ID NO: 2013369 - DNA, 18 bp, Homo sapiens
actttggccaagcaagag

SEQ ID NO: 2013370 - DNA, 17 bp, Homo sapiens
actttggcttctcctgt

SEQ ID NO: 2013371 - DNA, 14 bp, Homo sapiens
actttgggaggcca

SEQ ID NO: 2013372 - DNA, 15 bp, Homo sapiens
actttgggaggccaa

SEQ ID NO: 2013373 - DNA, 14 bp, Homo sapiens
actttgggcccaga

SEQ ID NO: 2013374 - DNA, 19 bp, Homo sapiens
actttggtacatggccagt

SEQ ID NO: 2013375 - DNA, 13 bp, Homo sapiens
actttgtcccgct

SEQ ID NO: 2013376 - DNA, 18 bp, Homo sapiens
actttgtgttcaccttgt

SEQ ID NO: 2013377 - DNA, 18 bp, Homo sapiens
actttgttgccttatctt

SEQ ID NO: 2013378 - DNA, 15 bp, Homo sapiens
acttttaaacagtga

SEQ ID NO: 2013379 - DNA, 21 bp, Homo sapiens
acttttccatgtatctacctc

SEQ ID NO: 2013380 - DNA, 21 bp, Homo sapiens
acttttctttattgctgtgaa

SEQ ID NO: 2013381 - DNA, 20 bp, Homo sapiens
acttttggataatatccact

SEQ ID NO: 2013382 - DNA, 12 bp, Homo sapiens
acttttgtaaga

SEQ ID NO: 2013383 - DNA, 17 bp, Homo sapiens
acttttgtaccagtgtg

SEQ ID NO: 2013384 - DNA, 18 bp, Homo sapiens
acttttgttctgtatttt

SEQ ID NO: 2013385 - DNA, 13 bp, Homo sapiens
acttttgtttcag

SEQ ID NO: 2013386 - DNA, 10 bp, Homo sapiens
actttttagc

SEQ ID NO: 2013387 - DNA, 17 bp, Homo sapiens
actttttagtcttttac

SEQ ID NO: 2013388 - DNA, 19 bp, Homo sapiens
actttttataatgtggatt

SEQ ID NO: 2013389 - DNA, 14 bp, Homo sapiens
actttttattcaat

SEQ ID NO: 2013390 - DNA, 22 bp, Homo sapiens
actttttattcaattctgtata

SEQ ID NO: 2013391 - DNA, 23 bp, Homo sapiens
acttttttatttaaaaaactaaa

SEQ ID NO: 2013392 - DNA, 15 bp, Homo sapiens
agaaaaaaaaaaaga

SEQ ID NO: 2013393 - DNA, 16 bp, Homo sapiens
agaaaaaaaaaaagaa

SEQ ID NO: 2013394 - DNA, 21 bp, Homo sapiens
agaaaaaaagtttgccagaag

SEQ ID NO: 2013395 - DNA, 15 bp, Homo sapiens
agaaaaaaatatatt

SEQ ID NO: 2013396 - DNA, 15 bp, Homo sapiens
agaaaaaataaatgg

SEQ ID NO: 2013397 - DNA, 23 bp, Homo sapiens
agaaaaaccaatgattcataaca

SEQ ID NO: 2013398 - DNA, 21 bp, Homo sapiens
agaaaaagttgcagtctcaga

SEQ ID NO: 2013399 - DNA, 23 bp, Homo sapiens
agaaaaatatatatgtgcagtat

SEQ ID NO: 2013400 - DNA, 16 bp, Homo sapiens
agaaaacctttcttca

SEQ ID NO: 2013401 - DNA, 19 bp, Homo sapiens
agaaaacgcacctccatcc

SEQ ID NO: 2013402 - DNA, 20 bp, Homo sapiens
agaaaacggagagtgcttgg

SEQ ID NO: 2013403 - DNA, 15 bp, Homo sapiens
agaaaactgaaaatc

SEQ ID NO: 2013404 - DNA, 14 bp, Homo sapiens
agaaaactggaaat

SEQ ID NO: 2013405 - DNA, 16 bp, Homo sapiens
agaaaagaaaaccatt

SEQ ID NO: 2013406 - DNA, 20 bp, Homo sapiens
agaaaagaacgtattttaaa

SEQ ID NO: 2013407 - DNA, 21 bp, Homo sapiens
agaaaagattaaaattagtga

SEQ ID NO: 2013408 - DNA, 18 bp, Homo sapiens
agaaaagatttaagtaat

SEQ ID NO: 2013409 - DNA, 15 bp, Homo sapiens
agaaaagcacctgcc

SEQ ID NO: 2013410 - DNA, 16 bp, Homo sapiens
agaaaagcacctgccg

SEQ ID NO: 2013411 - DNA, 14 bp, Homo sapiens
agaaaagctttgaa

SEQ ID NO: 2013412 - DNA, 15 bp, Homo sapiens
agaaaagtagaatta

SEQ ID NO: 2013413 - DNA, 17 bp, Homo sapiens
agaaaagtagaattata

SEQ ID NO: 2013414 - DNA, 22 bp, Homo sapiens
agaaaagtagaattatatctaa

SEQ ID NO: 2013415 - DNA, 19 bp, Homo sapiens
agaaaagtgcttagaaagt

SEQ ID NO: 2013416 - DNA, 11 bp, Homo sapiens
agaaaatgaag

SEQ ID NO: 2013417 - DNA, 23 bp, Homo sapiens
agaaacacaaatgtaaaataagt

SEQ ID NO: 2013418 - DNA, 14 bp, Homo sapiens
agaaacacaatatt

SEQ ID NO: 2013419 - DNA, 14 bp, Homo sapiens
agaaacagagacag

SEQ ID NO: 2013420 - DNA, 19 bp, Homo sapiens
agaaacagagacaggccca

SEQ ID NO: 2013421 - DNA, 17 bp, Homo sapiens
agaaacagagagagaca

SEQ ID NO: 2013422 - DNA, 15 bp, Homo sapiens
agaaacagataccat

SEQ ID NO: 2013423 - DNA, 21 bp, Homo sapiens
agaaacagggacaaagaaatc

SEQ ID NO: 2013424 - DNA, 13 bp, Homo sapiens
agaaacagttaac

SEQ ID NO: 2013425 - DNA, 17 bp, Homo sapiens
agaaacatgaattattt

SEQ ID NO: 2013426 - DNA, 17 bp, Homo sapiens
agaaacatgacactgac

SEQ ID NO: 2013427 - DNA, 15 bp, Homo sapiens
agaaaccagtatgga

SEQ ID NO: 2013428 - DNA, 17 bp, Homo sapiens
agaaacccaccagccta

SEQ ID NO: 2013429 - DNA, 18 bp, Homo sapiens
agaaacccaccagcctaa

SEQ ID NO: 2013430 - DNA, 13 bp, Homo sapiens
agaaaccccaagc

SEQ ID NO: 2013431 - DNA, 18 bp, Homo sapiens
agaaaccttattgtacct

SEQ ID NO: 2013432 - DNA, 20 bp, Homo sapiens
agaaacgaagccatctttct

SEQ ID NO: 2013433 - DNA, 20 bp, Homo sapiens
agaaactcacgatgaaattg

SEQ ID NO: 2013434 - DNA, 21 bp, Homo sapiens
agaaactccttttgctgtctt

SEQ ID NO: 2013435 - DNA, 19 bp, Homo sapiens
agaaactcgatgaatgtgt

SEQ ID NO: 2013436 - DNA, 19 bp, Homo sapiens
agaaactgaaaactgtaaa

SEQ ID NO: 2013437 - DNA, 12 bp, Homo sapiens
agaaactgagga

SEQ ID NO: 2013438 - DNA, 13 bp, Homo sapiens
agaaactgaggag

SEQ ID NO: 2013439 - DNA, 16 bp, Homo sapiens
agaaactgaggagtag

SEQ ID NO: 2013440 - DNA, 21 bp, Homo sapiens
agaaactgaggagtagctgag

SEQ ID NO: 2013441 - DNA, 15 bp, Homo sapiens
agaaactttctttct

SEQ ID NO: 2013442 - DNA, 19 bp, Homo sapiens
agaaactttgatctctgct

SEQ ID NO: 2013443 - DNA, 22 bp, Homo sapiens
agaaactttgatctctgcttac

SEQ ID NO: 2013444 - DNA, 19 bp, Homo sapiens
agaaacttttttatttaaa

SEQ ID NO: 2013445 - DNA, 22 bp, Homo sapiens
agaaagaaaattagtaattgta

SEQ ID NO: 2013446 - DNA, 20 bp, Homo sapiens
agaaagaacggaagaagaga

SEQ ID NO: 2013447 - DNA, 12 bp, Homo sapiens
agaaagaagaga

SEQ ID NO: 2013448 - DNA, 13 bp, Homo sapiens
agaaagaagagac

SEQ ID NO: 2013449 - DNA, 12 bp, Homo sapiens
agaaagaagccc

SEQ ID NO: 2013450 - DNA, 18 bp, Homo sapiens
agaaagaaggaagtgaag

SEQ ID NO: 2013451 - DNA, 19 bp, Homo sapiens
agaaagactattcaaacag

SEQ ID NO: 2013452 - DNA, 23 bp, Homo sapiens
agaaagagagagaattctttcaa

SEQ ID NO: 2013453 - DNA, 20 bp, Homo sapiens
agaaagaggtgaccccaggg

SEQ ID NO: 2013454 - DNA, 21 bp, Homo sapiens
agaaagaggtgaccccagggc

SEQ ID NO: 2013455 - DNA, 23 bp, Homo sapiens
agaaagaggtgaccccagggcac

SEQ ID NO: 2013456 - DNA, 19 bp, Homo sapiens
agaaagatggatgtgcttt

SEQ ID NO: 2013457 - DNA, 21 bp, Homo sapiens
agaaagcaagccaatttggaa

SEQ ID NO: 2013458 - DNA, 13 bp, Homo sapiens
agaagcagtgagc

SEQ ID NO: 2013459 - DNA, 23 bp, Homo sapiens
agaagcagtgagccgcatcttct

SEQ ID NO: 2013460 - DNA, 17 bp, Homo sapiens
agaagcagtgtttctac

SEQ ID NO: 2013461 - DNA, 14 bp, Homo sapiens
agaagccaaatttt

SEQ ID NO: 2013462 - DNA, 14 bp, Homo sapiens
agaagccaggagca

SEQ ID NO: 2013463 - DNA, 15 bp, Homo sapiens
agaagccgcagggac

SEQ ID NO: 2013464 - DNA, 14 bp, Homo sapiens
agaagccgggaaca

SEQ ID NO: 2013465 - DNA, 16 bp, Homo sapiens
agaagccgggaacaga

SEQ ID NO: 2013466 - DNA, 16 bp, Homo sapiens
agaagcctctgcctcc

SEQ ID NO: 2013467 - DNA, 13 bp, Homo sapiens
agaagcctggggg

SEQ ID NO: 2013468 - DNA, 17 bp, Homo sapiens
agaagcctgggggcctg

SEQ ID NO: 2013469 - DNA, 19 bp, Homo sapiens
agaagcggtttccaggcca

SEQ ID NO: 2013470 - DNA, 21 bp, Homo sapiens
agaagctcatttagttagaaa

SEQ ID NO: 2013471 - DNA, 13 bp, Homo sapiens
agaagctcccaga

SEQ ID NO: 2013472 - DNA, 21 bp, Homo sapiens
agaagctcccagatgctgggg

SEQ ID NO: 2013473 - DNA, 15 bp, Homo sapiens
agaagctgagaagaa

SEQ ID NO: 2013474 - DNA, 16 bp, Homo sapiens
agaagctgagaagaag

SEQ ID NO: 2013475 - DNA, 12 bp, Homo sapiens
agaagctgagga

SEQ ID NO: 2013476 - DNA, 15 bp, Homo sapiens
agaagctgaggatcc

SEQ ID NO: 2013477 - DNA, 16 bp, Homo sapiens
agaagcttcagaagtt

SEQ ID NO: 2013478 - DNA, 17 bp, Homo sapiens
agaaggaaaaagaaagt

SEQ ID NO: 2013479 - DNA, 16 bp, Homo sapiens
agaaggaaaaggcagg

SEQ ID NO: 2013480 - DNA, 22 bp, Homo sapiens
agaaggaaggagactcacctct

SEQ ID NO: 2013481 - DNA, 19 bp, Homo sapiens
agaaggaaggaggcagact

SEQ ID NO: 2013482 - DNA, 11 bp, Homo sapiens
agaaggaaggc

SEQ ID NO: 2013483 - DNA, 19 bp, Homo sapiens
agaaggaaggcagggagga

SEQ ID NO: 2013484 - DNA, 20 bp, Homo sapiens
acttataagtgggagctaaa

SEQ ID NO: 2013485 - DNA, 18 bp, Homo sapiens
acttatatggaaattctg

SEQ ID NO: 2013486 - DNA, 20 bp, Homo sapiens
acttatcagctacttaagag

SEQ ID NO: 2013487 - DNA, 16 bp, Homo sapiens
acttatgctagtttat

SEQ ID NO: 2013488 - DNA, 12 bp, Homo sapiens
acttatttgagt

SEQ ID NO: 2013489 - DNA, 22 bp, Homo sapiens
acttatttgagtgattatttgt

SEQ ID NO: 2013490 - DNA, 21 bp, Homo sapiens
acttattttctggatctatct

SEQ ID NO: 2013491 - DNA, 15 bp, Homo sapiens
acttcaaatatagag

SEQ ID NO: 2013492 - DNA, 23 bp, Homo sapiens
acttcaagcatggctattttata

SEQ ID NO: 2013493 - DNA, 16 bp, Homo sapiens
acttcaagttaaagtg

SEQ ID NO: 2013494 - DNA, 16 bp, Homo sapiens
acttcacacacaggca

SEQ ID NO: 2013495 - DNA, 19 bp, Homo sapiens
acttcacactgcaagagcc

SEQ ID NO: 2013496 - DNA, 21 bp, Homo sapiens
acttcactgtgaggggaaggc

SEQ ID NO: 2013497 - DNA, 20 bp, Homo sapiens
acttcagaacatgctggata

SEQ ID NO: 2013498 - DNA, 13 bp, Homo sapiens
acttcagcccagc

SEQ ID NO: 2013499 - DNA, 13 bp, Homo sapiens
acttcagctctgt

SEQ ID NO: 2013500 - DNA, 22 bp, Homo sapiens
acttcaggtggagagcactaga

SEQ ID NO: 2013501 - DNA, 23 bp, Homo sapiens
acttcatggcctttgataaatgt

SEQ ID NO: 2013502 - DNA, 15 bp, Homo sapiens
acttcattcttgaaa

SEQ ID NO: 2013503 - DNA, 17 bp, Homo sapiens
acttcattttcagagtg

SEQ ID NO: 2013504 - DNA, 22 bp, Homo sapiens
acttccagtgttggctgtgtga

SEQ ID NO: 2013505 - DNA, 17 bp, Homo sapiens
acttccataatctggac

SEQ ID NO: 2013506 - DNA, 16 bp, Homo sapiens
acttcctgtgtactct

SEQ ID NO: 2013507 - DNA, 13 bp, Homo sapiens
acttctaaatgtt

SEQ ID NO: 2013508 - DNA, 14 bp, Homo sapiens
acttctaaatgttg

SEQ ID NO: 2013509 - DNA, 13 bp, Homo sapiens
acttctaagtaaa

SEQ ID NO: 2013510 - DNA, 17 bp, Homo sapiens
acttctcaggacacagg

SEQ ID NO: 2013511 - DNA, 18 bp, Homo sapiens
acttctcaggacacaggc

SEQ ID NO: 2013512 - DNA, 20 bp, Homo sapiens
acttctcaggacacaggcct

SEQ ID NO: 2013513 - DNA, 21 bp, Homo sapiens
acttctcaggacacaggcctg

SEQ ID NO: 2013514 - DNA, 22 bp, Homo sapiens
acttctcatcatattgtatgta

SEQ ID NO: 2013515 - DNA, 23 bp, Homo sapiens
acttctcatcatattgtatgtaa

SEQ ID NO: 2013516 - DNA, 19 bp, Homo sapiens
acttctcattttttaaaaa

SEQ ID NO: 2013517 - DNA, 15 bp, Homo sapiens
acttctccaccctgc

SEQ ID NO: 2013518 - DNA, 18 bp, Homo sapiens
acttctccaccctgctct

SEQ ID NO: 2013519 - DNA, 14 bp, Homo sapiens
acttctctttctta

SEQ ID NO: 2013520 - DNA, 17 bp, Homo sapiens
acttctctttgcctcaa

SEQ ID NO: 2013521 - DNA, 21 bp, Homo sapiens
acttctctttgcctcaaataa

SEQ ID NO: 2013522 - DNA, 17 bp, Homo sapiens
acttctgccccagcttt

SEQ ID NO: 2013523 - DNA, 16 bp, Homo sapiens
acttctggaaggctgg

SEQ ID NO: 2013524 - DNA, 19 bp, Homo sapiens
acttctggaaggctggctg

SEQ ID NO: 2013525 - DNA, 20 bp, Homo sapiens
acttctggaaggctggctga

SEQ ID NO: 2013526 - DNA, 21 bp, Homo sapiens
acttctggaaggctggctgag

SEQ ID NO: 2013527 - DNA, 22 bp, Homo sapiens
acttctgtcttcacaacagatt

SEQ ID NO: 2013528 - DNA, 16 bp, Homo sapiens
acttcttaaaagttgt

SEQ ID NO: 2013529 - DNA, 15 bp, Homo sapiens
acttcttggaaaaaa

SEQ ID NO: 2013530 - DNA, 21 bp, Homo sapiens
acttcttggaaaaaaattaca

SEQ ID NO: 2013531 - DNA, 19 bp, Homo sapiens
acttcttggtttggggaga

SEQ ID NO: 2013532 - DNA, 22 bp, Homo sapiens
acttcttggtttggggagaaat

SEQ ID NO: 2013533 - DNA, 22 bp, Homo sapiens
acttctttcctctccaattgta

SEQ ID NO: 2013534 - DNA, 15 bp, Homo sapiens
acttcttttataact

SEQ ID NO: 2013535 - DNA, 16 bp, Homo sapiens
acttgaaattatatct

SEQ ID NO: 2013536 - DNA, 21 bp, Homo sapiens
acttgaactgattcacatctc

SEQ ID NO: 2013537 - DNA, 19 bp, Homo sapiens
acttgaatactctcacaag

SEQ ID NO: 2013538 - DNA, 14 bp, Homo sapiens
acttgaatctgtta

SEQ ID NO: 2013539 - DNA, 19 bp, Homo sapiens
acttgaatctgttactgaa

SEQ ID NO: 2013540 - DNA, 19 bp, Homo sapiens
acttgacaacatcccacag

SEQ ID NO: 2013541 - DNA, 13 bp, Homo sapiens
acttgacattcct

SEQ ID NO: 2013542 - DNA, 22 bp, Homo sapiens
acttgagcctccatttctggct

SEQ ID NO: 2013543 - DNA, 14 bp, Homo sapiens
acttgagctgtata

SEQ ID NO: 2013544 - DNA, 16 bp, Homo sapiens
acttgagctgtatata

SEQ ID NO: 2013545 - DNA, 14 bp, Homo sapiens
acttgaggacacat

SEQ ID NO: 2013546 - DNA, 15 bp, Homo sapiens
acttgaggacacatg

SEQ ID NO: 2013547 - DNA, 19 bp, Homo sapiens
acttgaggctggcactccc

SEQ ID NO: 2013548 - DNA, 15 bp, Homo sapiens
acttgagggtaataa

SEQ ID NO: 2013549 - DNA, 17 bp, Homo sapiens
acttgagggtaataaac

SEQ ID NO: 2013550 - DNA, 18 bp, Homo sapiens
acttgagggtaataaact

SEQ ID NO: 2013551 - DNA, 19 bp, Homo sapiens
acttgatatagaaagctgt

SEQ ID NO: 2013552 - DNA, 22 bp, Homo sapiens
acttgcagactctacagaggcc

SEQ ID NO: 2013553 - DNA, 19 bp, Homo sapiens
acttgcattgaatatatta

SEQ ID NO: 2013554 - DNA, 20 bp, Homo sapiens
acttgccttcttcacccagc

SEQ ID NO: 2013555 - DNA, 20 bp, Homo sapiens
acttgcgtcctgcagaggac

SEQ ID NO: 2013556 - DNA, 23 bp, Homo sapiens
acttgctctctggccttttccta

SEQ ID NO: 2013557 - DNA, 23 bp, Homo sapiens
acttgctgcctgaagaacagtaa

SEQ ID NO: 2013558 - DNA, 14 bp, Homo sapiens
acttggaaaaagaa

SEQ ID NO: 2013559 - DNA, 18 bp, Homo sapiens
acttggaaaaagaaagaa

SEQ ID NO: 2013560 - DNA, 21 bp, Homo sapiens
acttggaaaaatccagaaaga

SEQ ID NO: 2013561 - DNA, 21 bp, Homo sapiens
acttgggaggctgaggcagga

SEQ ID NO: 2013562 - DNA, 21 bp, Homo sapiens
acttgggcacccccagcctgg

SEQ ID NO: 2013563 - DNA, 16 bp, Homo sapiens
acttgggcgctctgcc

SEQ ID NO: 2013564 - DNA, 15 bp, Homo sapiens
acttgggtcttccct

SEQ ID NO: 2013565 - DNA, 19 bp, Homo sapiens
acttggtttttggctcttt

SEQ ID NO: 2013566 - DNA, 16 bp, Homo sapiens
acttgtaaataaatag

SEQ ID NO: 2013567 - DNA, 19 bp, Homo sapiens
acttgtaaataaatagatt

SEQ ID NO: 2013568 - DNA, 18 bp, Homo sapiens
acttgtactatgttaata

SEQ ID NO: 2013569 - DNA, 18 bp, Homo sapiens
acttgtagaaatctgtaa

SEQ ID NO: 2013570 - DNA, 19 bp, Homo sapiens
acttgtagaaatctgtaat

SEQ ID NO: 2013571 - DNA, 19 bp, Homo sapiens
acttgtataaatgtatata

SEQ ID NO: 2013572 - DNA, 16 bp, Homo sapiens
acttgtctattacctg

SEQ ID NO: 2013573 - DNA, 12 bp, Homo sapiens
acttgtctgagg

SEQ ID NO: 2013574 - DNA, 22 bp, Homo sapiens
acttgtctgaggcctcatccct

SEQ ID NO: 2013575 - DNA, 23 bp, Homo sapiens
acttgtgtatgatccaagtattt

SEQ ID NO: 2013576 - DNA, 16 bp, Homo sapiens
acttgtgtctctgtgc

SEQ ID NO: 2013577 - DNA, 15 bp, Homo sapiens
acttgttcacaggtt

SEQ ID NO: 2013578 - DNA, 20 bp, Homo sapiens
acttgttccttctgcttctc

SEQ ID NO: 2013579 - DNA, 16 bp, Homo sapiens
acttgtttgtaagatt

SEQ ID NO: 2013580 - DNA, 15 bp, Homo sapiens
actttaaaagatgaa

SEQ ID NO: 2013581 - DNA, 19 bp, Homo sapiens
aggcggtcatgtgtgcatg

SEQ ID NO: 2013582 - DNA, 22 bp, Homo sapiens
aggcggtcatgtgtgcatgtga

SEQ ID NO: 2013583 - DNA, 16 bp, Homo sapiens
aggcggtttccaggaa

SEQ ID NO: 2013584 - DNA, 14 bp, Homo sapiens
aggcgttggtgcca

SEQ ID NO: 2013585 - DNA, 15 bp, Homo sapiens
aggcgttggtgccac

SEQ ID NO: 2013586 - DNA, 18 bp, Homo sapiens
aggctaagttcagttctg

SEQ ID NO: 2013587 - DNA, 22 bp, Homo sapiens
aggctaatttttttgtatttta

SEQ ID NO: 2013588 - DNA, 23 bp, Homo sapiens
aggctaatttttttgtattttag

SEQ ID NO: 2013589 - DNA, 20 bp, Homo sapiens
aggctacttcggggctggga

SEQ ID NO: 2013590 - DNA, 20 bp, Homo sapiens
aggctagagtgcagtggcat

SEQ ID NO: 2013591 - DNA, 22 bp, Homo sapiens
aggatgtaaacagtgcctgctg

SEQ ID NO: 2013592 - DNA, 19 bp, Homo sapiens
aggatgtccgttccaggag

SEQ ID NO: 2013593 - DNA, 20 bp, Homo sapiens
aggatgtccgttccaggagc

SEQ ID NO: 2013594 - DNA, 16 bp, Homo sapiens
aggatgtggcactgct

SEQ ID NO: 2013595 - DNA, 15 bp, Homo sapiens
aggatgttctgggac

SEQ ID NO: 2013596 - DNA, 16 bp, Homo sapiens
aggatgttctgggaca

SEQ ID NO: 2013597 - DNA, 22 bp, Homo sapiens
aggatgttttgtcccatttcct

SEQ ID NO: 2013598 - DNA, 14 bp, Homo sapiens
aggatgtttttcat

SEQ ID NO: 2013599 - DNA, 14 bp, Homo sapiens
aggattccaaagtt

SEQ ID NO: 2013600 - DNA, 18 bp, Homo sapiens
aggattcctctctcaggt

SEQ ID NO: 2013601 - DNA, 14 bp, Homo sapiens
aggattgaagagca

SEQ ID NO: 2013602 - DNA, 22 bp, Homo sapiens
aggattgaagagcattgcatgg

SEQ ID NO: 2013603 - DNA, 22 bp, Homo sapiens
aggattgctactgtcctaccca

SEQ ID NO: 2013604 - DNA, 17 bp, Homo sapiens
aggattgcttgagccca

SEQ ID NO: 2013605 - DNA, 21 bp, Homo sapiens
aggattgcttgagcccaggag

SEQ ID NO: 2013606 - DNA, 21 bp, Homo sapiens
aggatttaacagtcatttaaa

SEQ ID NO: 2013607 - DNA, 17 bp, Homo sapiens
aggatttatttaaaata

SEQ ID NO: 2013608 - DNA, 16 bp, Homo sapiens
aggatttcaagcctgc

SEQ ID NO: 2013609 - DNA, 19 bp, Homo sapiens
aggatttcatgatttcatt

SEQ ID NO: 2013610 - DNA, 21 bp, Homo sapiens
aggatttcattgactgaactg

SEQ ID NO: 2013611 - DNA, 19 bp, Homo sapiens
aggattttaacaaaagcaa

SEQ ID NO: 2013612 - DNA, 23 bp, Homo sapiens
aggattttaacaaaagcaagact

SEQ ID NO: 2013613 - DNA, 17 bp, Homo sapiens
aggcaaaatccttgctt

SEQ ID NO: 2013614 - DNA, 15 bp, Homo sapiens
aggcaaacatttctt

SEQ ID NO: 2013615 - DNA, 16 bp, Homo sapiens
aggcaaagcccctgga

SEQ ID NO: 2013616 - DNA, 19 bp, Homo sapiens
aggcaaatataagctggga

SEQ ID NO: 2013617 - DNA, 15 bp, Homo sapiens
aggcaaatgcagttt

SEQ ID NO: 2013618 - DNA, 15 bp, Homo sapiens
aggcaactgaggcag

SEQ ID NO: 2013619 - DNA, 12 bp, Homo sapiens
aggcaagagaaa

SEQ ID NO: 2013620 - DNA, 12 bp, Homo sapiens
aggcaagagaat

SEQ ID NO: 2013621 - DNA, 17 bp, Homo sapiens
aggcaagcacctcctgc

SEQ ID NO: 2013622 - DNA, 20 bp, Homo sapiens
aggcaagcacctcctgcctc

SEQ ID NO: 2013623 - DNA, 13 bp, Homo sapiens
aggcaagcccctc

SEQ ID NO: 2013624 - DNA, 16 bp, Homo sapiens
aggcaagcccctcagc

SEQ ID NO: 2013625 - DNA, 20 bp, Homo sapiens
aggcaagcccctcagccctt

SEQ ID NO: 2013626 - DNA, 21 bp, Homo sapiens
aggcaagcccctcagcccttg

SEQ ID NO: 2013627 - DNA, 17 bp, Homo sapiens
aggcaagtgaagaaaag

SEQ ID NO: 2013628 - DNA, 18 bp, Homo sapiens
aggcaagtttctagctag

SEQ ID NO: 2013629 - DNA, 14 bp, Homo sapiens
aggcaatgctggct

SEQ ID NO: 2013630 - DNA, 15 bp, Homo sapiens
aggcaatgctggctg

SEQ ID NO: 2013631 - DNA, 16 bp, Homo sapiens
aggcaatgctggctgt

SEQ ID NO: 2013632 - DNA, 19 bp, Homo sapiens
aggcaatgtcaggaacaga

SEQ ID NO: 2013633 - DNA, 23 bp, Homo sapiens
aggcaatgtcaggaacagaagga

SEQ ID NO: 2013634 - DNA, 14 bp, Homo sapiens
aggcacacagcagc

SEQ ID NO: 2013635 - DNA, 18 bp, Homo sapiens
aggcacacagcagccccc

SEQ ID NO: 2013636 - DNA, 20 bp, Homo sapiens
aggcacacttcttcttggtc

SEQ ID NO: 2013637 - DNA, 18 bp, Homo sapiens
aggcacaggacacctggc

SEQ ID NO: 2013638 - DNA, 13 bp, Homo sapiens
aggcacaggcagg

SEQ ID NO: 2013639 - DNA, 19 bp, Homo sapiens
aggcacaggcaggaagaga

SEQ ID NO: 2013640 - DNA, 21 bp, Homo sapiens
aggcacaggcaggaagagaga

SEQ ID NO: 2013641 - DNA, 20 bp, Homo sapiens
aggcaccaaaagaagtaaaa

SEQ ID NO: 2013642 - DNA, 14 bp, Homo sapiens
aggcaccatctccc

SEQ ID NO: 2013643 - DNA, 16 bp, Homo sapiens
aggcaccccctggaga

SEQ ID NO: 2013644 - DNA, 13 bp, Homo sapiens
aggcaccggcgct

SEQ ID NO: 2013645 - DNA, 14 bp, Homo sapiens
aggcaccggcgctg

SEQ ID NO: 2013646 - DNA, 17 bp, Homo sapiens
aggcaccggcgctgcag

SEQ ID NO: 2013647 - DNA, 13 bp, Homo sapiens
aggcacctgctgg

SEQ ID NO: 2013648 - DNA, 14 bp, Homo sapiens
aggcacctgctgga

SEQ ID NO: 2013649 - DNA, 13 bp, Homo sapiens
aggcacctggcct

SEQ ID NO: 2013650 - DNA, 14 bp, Homo sapiens
aggcacctggcctg

SEQ ID NO: 2013651 - DNA, 21 bp, Homo sapiens
aggcacctggcctgctgggaa

SEQ ID NO: 2013652 - DNA, 19 bp, Homo sapiens
aggcaccttagtggctttt

SEQ ID NO: 2013653 - DNA, 17 bp, Homo sapiens
aggcacgaacccacctg

SEQ ID NO: 2013654 - DNA, 19 bp, Homo sapiens
aggcacgaacccacctgct

SEQ ID NO: 2013655 - DNA, 15 bp, Homo sapiens
aggcactggtggcat

SEQ ID NO: 2013656 - DNA, 18 bp, Homo sapiens
aggcagaataagaaaaca

SEQ ID NO: 2013657 - DNA, 16 bp, Homo sapiens
aggcagacaagagctg

SEQ ID NO: 2013658 - DNA, 19 bp, Homo sapiens
aggcagacaagagctgctg

SEQ ID NO: 2013659 - DNA, 19 bp, Homo sapiens
aggcagacgtggggagggt

SEQ ID NO: 2013660 - DNA, 22 bp, Homo sapiens
aggcagacttccctgaatgtat

SEQ ID NO: 2013661 - DNA, 13 bp, Homo sapiens
aggcagagaaaga

SEQ ID NO: 2013662 - DNA, 15 bp, Homo sapiens
aggcagagaaagaag

SEQ ID NO: 2013663 - DNA, 19 bp, Homo sapiens
aggcagagaaagaagagac

SEQ ID NO: 2013664 - DNA, 22 bp, Homo sapiens
aggcagagaaagaagagacagg

SEQ ID NO: 2013665 - DNA, 14 bp, Homo sapiens
aggcagagaatcat

SEQ ID NO: 2013666 - DNA, 21 bp, Homo sapiens
aggcagagacaataaaacatt

SEQ ID NO: 2013667 - DNA, 20 bp, Homo sapiens
aggcagagcggggaggtgcc

SEQ ID NO: 2013668 - DNA, 17 bp, Homo sapiens
aggcagaggatgttctg

SEQ ID NO: 2013669 - DNA, 13 bp, Homo sapiens
aggcagcctccag

SEQ ID NO: 2013670 - DNA, 17 bp, Homo sapiens
aggcagcctccagagcc

SEQ ID NO: 2013671 - DNA, 20 bp, Homo sapiens
aggcagcctccagagccagc

SEQ ID NO: 2013672 - DNA, 11 bp, Homo sapiens
aggcagcctgc

SEQ ID NO: 2013673 - DNA, 13 bp, Homo sapiens
aggcaggaagaga

SEQ ID NO: 2013674 - DNA, 14 bp, Homo sapiens
aggcaggaagagag

SEQ ID NO: 2013675 - DNA, 17 bp, Homo sapiens
aggcaggaagagagaga

SEQ ID NO: 2013676 - DNA, 23 bp, Homo sapiens
aggcaggaagagagagagagagg

SEQ ID NO: 2013677 - DNA, 18 bp, Homo sapiens
aggcagggacagagatgg

SEQ ID NO: 2013678 - DNA, 18 bp, Homo sapiens
aggcagggcaaatgacat

SEQ ID NO: 2013679 - DNA, 14 bp, Homo sapiens
aggcagggcagagg

SEQ ID NO: 2013680 - DNA, 23 bp, Homo sapiens
aggcagggccttgcccagagatg

SEQ ID NO: 2013681 - DNA, 13 bp, Homo sapiens
aggcagggctctc

SEQ ID NO: 2013682 - DNA, 22 bp, Homo sapiens
aggcagggctctcctggcttcc

SEQ ID NO: 2013683 - DNA, 15 bp, Homo sapiens
aggcaggggtgggag

SEQ ID NO: 2013684 - DNA, 22 bp, Homo sapiens
aggcagggtctcactctgtcgc

SEQ ID NO: 2013685 - DNA, 21 bp, Homo sapiens
aggcaggtcttgaactcctgg

SEQ ID NO: 2013686 - DNA, 13 bp, Homo sapiens
aggcaggtgcctg

SEQ ID NO: 2013687 - DNA, 16 bp, Homo sapiens
aggcagtctgaaccct

SEQ ID NO: 2013688 - DNA, 18 bp, Homo sapiens
aggcagttcaaagcagga

SEQ ID NO: 2013689 - DNA, 13 bp, Homo sapiens
aggcatcccaggg

SEQ ID NO: 2013690 - DNA, 17 bp, Homo sapiens
aggcatcccaggggacc

SEQ ID NO: 2013691 - DNA, 18 bp, Homo sapiens
aggcatctacacagcctg

SEQ ID NO: 2013692 - DNA, 14 bp, Homo sapiens
aggcatctgcaccc

SEQ ID NO: 2013693 - DNA, 19 bp, Homo sapiens
aggcatgaacacacatgga

SEQ ID NO: 2013694 - DNA, 22 bp, Homo sapiens
aggcatgcaccagtgccgcctg

SEQ ID NO: 2013695 - DNA, 14 bp, Homo sapiens
aggcatgctggcct

SEQ ID NO: 2013696 - DNA, 13 bp, Homo sapiens
aggcatggccctg

SEQ ID NO: 2013697 - DNA, 20 bp, Homo sapiens
aggcatggtggcacacgcct

SEQ ID NO: 2013698 - DNA, 19 bp, Homo sapiens
aggcatgttctctgaggac

SEQ ID NO: 2013699 - DNA, 14 bp, Homo sapiens
aggcattaaatttt

SEQ ID NO: 2013700 - DNA, 22 bp, Homo sapiens
aggcattaaattttagcaaaga

SEQ ID NO: 2013701 - DNA, 14 bp, Homo sapiens
aggcattatttaat

SEQ ID NO: 2013702 - DNA, 14 bp, Homo sapiens
aggcatttcctggg

SEQ ID NO: 2013703 - DNA, 23 bp, Homo sapiens
aggccaaaattaccaaaaatctt

SEQ ID NO: 2013704 - DNA, 16 bp, Homo sapiens
aggccaaatgcacaag

SEQ ID NO: 2013705 - DNA, 22 bp, Homo sapiens
aggccaaatgcacaagctcaga

SEQ ID NO: 2013706 - DNA, 14 bp, Homo sapiens
aggccaagaatcaa

SEQ ID NO: 2013707 - DNA, 18 bp, Homo sapiens
aggccaagagcagaggca

SEQ ID NO: 2013708 - DNA, 17 bp, Homo sapiens
aggagccccgaggcctt

SEQ ID NO: 2013709 - DNA, 22 bp, Homo sapiens
aggagccccgaggccttctctg

SEQ ID NO: 2013710 - DNA, 19 bp, Homo sapiens
aggagccggaccaagatgg

SEQ ID NO: 2013711 - DNA, 20 bp, Homo sapiens
aggagcctgtgaacccagga

SEQ ID NO: 2013712 - DNA, 22 bp, Homo sapiens
aggagcctgtgaacccaggaca

SEQ ID NO: 2013713 - DNA, 12 bp, Homo sapiens
aggagctacctg

SEQ ID NO: 2013714 - DNA, 16 bp, Homo sapiens
aggagctacctgtgtg

SEQ ID NO: 2013715 - DNA, 23 bp, Homo sapiens
aggagctctgaatctgataggaa

SEQ ID NO: 2013716 - DNA, 16 bp, Homo sapiens
aggagctgagtcacct

SEQ ID NO: 2013717 - DNA, 14 bp, Homo sapiens
aggagcttccagtg

SEQ ID NO: 2013718 - DNA, 19 bp, Homo sapiens
aggagcttccagtgcatgt

SEQ ID NO: 2013719 - DNA, 20 bp, Homo sapiens
aggagcttccagtgcatgtt

SEQ ID NO: 2013720 - DNA, 21 bp, Homo sapiens
aggagcttccagtgcatgttg

SEQ ID NO: 2013721 - DNA, 23 bp, Homo sapiens
aggagcttccagtgcatgttgcc

SEQ ID NO: 2013722 - DNA, 13 bp, Homo sapiens
aggagcttctctg

SEQ ID NO: 2013723 - DNA, 13 bp, Homo sapiens
aggaggaaggcaa

SEQ ID NO: 2013724 - DNA, 15 bp, Homo sapiens
aggaggaaggcaaag

SEQ ID NO: 2013725 - DNA, 21 bp, Homo sapiens
aggaggaataagctcccaggg

SEQ ID NO: 2013726 - DNA, 22 bp, Homo sapiens
aggaggaatcatgtcaggcctg

SEQ ID NO: 2013727 - DNA, 23 bp, Homo sapiens
aggaggaatcatgtcaggcctgt

SEQ ID NO: 2013728 - DNA, 15 bp, Homo sapiens
aggaggacttgcagg

SEQ ID NO: 2013729 - DNA, 18 bp, Homo sapiens
aggaggagctgccgcaag

SEQ ID NO: 2013730 - DNA, 14 bp, Homo sapiens
aggaggaggaggaa

SEQ ID NO: 2013731 - DNA, 15 bp, Homo sapiens
aggaggaggaggaag

SEQ ID NO: 2013732 - DNA, 13 bp, Homo sapiens
aggaggattgctt

SEQ ID NO: 2013733 - DNA, 20 bp, Homo sapiens
aggaggattgcttcttgtga

SEQ ID NO: 2013734 - DNA, 21 bp, Homo sapiens
aggaggattgcttgagcccag

SEQ ID NO: 2013735 - DNA, 17 bp, Homo sapiens
aggaggcgcagcccgaa

SEQ ID NO: 2013736 - DNA, 23 bp, Homo sapiens
aggaggcgcagcccgaagcccag

SEQ ID NO: 2013737 - DNA, 16 bp, Homo sapiens
aggaggctagcaaagc

SEQ ID NO: 2013738 - DNA, 20 bp, Homo sapiens
aggaggctcaacaataaaac

SEQ ID NO: 2013739 - DNA, 17 bp, Homo sapiens
aggaggctgaggcagga

SEQ ID NO: 2013740 - DNA, 19 bp, Homo sapiens
aggaggctgaggcaggagg

SEQ ID NO: 2013741 - DNA, 21 bp, Homo sapiens
aggaggctgcatgctctggaa

SEQ ID NO: 2013742 - DNA, 18 bp, Homo sapiens
aggagggacaaaggagcc

SEQ ID NO: 2013743 - DNA, 20 bp, Homo sapiens
aggagggcaagggccatgct

SEQ ID NO: 2013744 - DNA, 14 bp, Homo sapiens
aggagggcagagcc

SEQ ID NO: 2013745 - DNA, 17 bp, Homo sapiens
aggagggcagagccatg

SEQ ID NO: 2013746 - DNA, 16 bp, Homo sapiens
aggagggcatgggagg

SEQ ID NO: 2013747 - DNA, 15 bp, Homo sapiens
aggaggggcacctgc

SEQ ID NO: 2013748 - DNA, 12 bp, Homo sapiens
aggaggggcctc

SEQ ID NO: 2013749 - DNA, 14 bp, Homo sapiens
aggaggggcctctg

SEQ ID NO: 2013750 - DNA, 21 bp, Homo sapiens
aggagggggtcgtggagagct

SEQ ID NO: 2013751 - DNA, 21 bp, Homo sapiens
aggagggtggaggaaggtgct

SEQ ID NO: 2013752 - DNA, 23 bp, Homo sapiens
aggagggttgggcgtgctacctg

SEQ ID NO: 2013753 - DNA, 14 bp, Homo sapiens
aggaggtggcagcc

SEQ ID NO: 2013754 - DNA, 18 bp, Homo sapiens
aggaggtggcagccctgt

SEQ ID NO: 2013755 - DNA, 14 bp, Homo sapiens
aggaggtgtcccaa

SEQ ID NO: 2013756 - DNA, 16 bp, Homo sapiens
aggaggttggtgactg

SEQ ID NO: 2013757 - DNA, 23 bp, Homo sapiens
aggaggttgtggatgctccaggg

SEQ ID NO: 2013758 - DNA, 18 bp, Homo sapiens
aggagtagctgagaggaa

SEQ ID NO: 2013759 - DNA, 20 bp, Homo sapiens
aggagtagctgagaggaaga

SEQ ID NO: 2013760 - DNA, 18 bp, Homo sapiens
aggagtatgcagggagct

SEQ ID NO: 2013761 - DNA, 16 bp, Homo sapiens
aggagtcaactggctg

SEQ ID NO: 2013762 - DNA, 21 bp, Homo sapiens
aggagtcaactggctggccag

SEQ ID NO: 2013763 - DNA, 14 bp, Homo sapiens
aggagtccagggcg

SEQ ID NO: 2013764 - DNA, 14 bp, Homo sapiens
aggagtcccaagga

SEQ ID NO: 2013765 - DNA, 16 bp, Homo sapiens
aggagtctgaggtcct

SEQ ID NO: 2013766 - DNA, 20 bp, Homo sapiens
aggagtctgaggtcctgagc

SEQ ID NO: 2013767 - DNA, 23 bp, Homo sapiens
aggagtctgaggtcctgagcact

SEQ ID NO: 2013768 - DNA, 14 bp, Homo sapiens
aggagtctgtgctc

SEQ ID NO: 2013769 - DNA, 16 bp, Homo sapiens
aggagtctgtgctctt

SEQ ID NO: 2013770 - DNA, 18 bp, Homo sapiens
aggagtggaggaggcctg

SEQ ID NO: 2013771 - DNA, 16 bp, Homo sapiens
aggagttaagagtagc

SEQ ID NO: 2013772 - DNA, 17 bp, Homo sapiens
aggagttaagagtagca

SEQ ID NO: 2013773 - DNA, 16 bp, Homo sapiens
aggagttcgagaccag

SEQ ID NO: 2013774 - DNA, 22 bp, Homo sapiens
aggagttcgagaccagcctggc

SEQ ID NO: 2013775 - DNA, 17 bp, Homo sapiens
aggagttcgaggctgca

SEQ ID NO: 2013776 - DNA, 20 bp, Homo sapiens
aggagttctgaagctgacag

SEQ ID NO: 2013777 - DNA, 21 bp, Homo sapiens
aggagttgctgtttgtttgac

SEQ ID NO: 2013778 - DNA, 21 bp, Homo sapiens
aggagtttgagacaagccctg

SEQ ID NO: 2013779 - DNA, 24 bp, Homo sapiens
aggagtttgagacaagccctggca

SEQ ID NO: 2013780 - DNA, 20 bp, Homo sapiens
aggagtttgaggctgcagcg

SEQ ID NO: 2013781 - DNA, 24 bp, Homo sapiens
aggagtttgaggctgcagcgagct

SEQ ID NO: 2013782 - DNA, 17 bp, Homo sapiens
aggagttttttttaacc

SEQ ID NO: 2013783 - DNA, 18 bp, Homo sapiens
aggatatcagagctggga

SEQ ID NO: 2013784 - DNA, 16 bp, Homo sapiens
aggatcactggagccc

SEQ ID NO: 2013785 - DNA, 22 bp, Homo sapiens
aggatcagaatggaaagaaact

SEQ ID NO: 2013786 - DNA, 12 bp, Homo sapiens
aggatcagtctg

SEQ ID NO: 2013787 - DNA, 15 bp, Homo sapiens
aggatccgctgccac

SEQ ID NO: 2013788 - DNA, 16 bp, Homo sapiens
aggatccgctgccacc

SEQ ID NO: 2013789 - DNA, 17 bp, Homo sapiens
aggatccgctgccacca

SEQ ID NO: 2013790 - DNA, 22 bp, Homo sapiens
aggatcctattctcaccaggaa

SEQ ID NO: 2013791 - DNA, 16 bp, Homo sapiens
aggatcctcacaggag

SEQ ID NO: 2013792 - DNA, 17 bp, Homo sapiens
aggatcctcacaggagc

SEQ ID NO: 2013793 - DNA, 21 bp, Homo sapiens
aggatcctcacaggagcagac

SEQ ID NO: 2013794 - DNA, 12 bp, Homo sapiens
aggatcctgcag

SEQ ID NO: 2013795 - DNA, 13 bp, Homo sapiens
aggatcctgcagg

SEQ ID NO: 2013796 - DNA, 19 bp, Homo sapiens
aggatctctcaggagcaca

SEQ ID NO: 2013797 - DNA, 20 bp, Homo sapiens
aggatctctcaggagcacag

SEQ ID NO: 2013798 - DNA, 20 bp, Homo sapiens
aggatctgtttttaaaaatc

SEQ ID NO: 2013799 - DNA, 22 bp, Homo sapiens
aggatgaaggcgtgcaaggggc

SEQ ID NO: 2013800 - DNA, 18 bp, Homo sapiens
aggatgaagggcccgaga

SEQ ID NO: 2013801 - DNA, 21 bp, Homo sapiens
aggatgaatgaggtcccaggc

SEQ ID NO: 2013802 - DNA, 19 bp, Homo sapiens
aggatgactttttttctga

SEQ ID NO: 2013803 - DNA, 22 bp, Homo sapiens
aggatgaggaacctcaaactgg

SEQ ID NO: 2013804 - DNA, 13 bp, Homo sapiens
aggatgccacagc

SEQ ID NO: 2013805 - DNA, 15 bp, Homo sapiens
aggatgccacagccc

SEQ ID NO: 2013806 - DNA, 20 bp, Homo sapiens
aggatgccacagccccacag

SEQ ID NO: 2013807 - DNA, 20 bp, Homo sapiens
aggatggacgaacaggggcc

SEQ ID NO: 2013808 - DNA, 15 bp, Homo sapiens
aggatggtgcaggat

SEQ ID NO: 2013809 - DNA, 21 bp, Homo sapiens
aggatggtgcaggatggcttt

SEQ ID NO: 2013810 - DNA, 19 bp, Homo sapiens
aggatgtaaacagtgcctg

SEQ ID NO: 2013811 - DNA, 14 bp, Homo sapiens
aggctagttccttt

SEQ ID NO: 2013812 - DNA, 18 bp, Homo sapiens
aggctattattttcactg

SEQ ID NO: 2013813 - DNA, 19 bp, Homo sapiens
aggctattattttcactgt

SEQ ID NO: 2013814 - DNA, 19 bp, Homo sapiens
aggctatttgttcagagag

SEQ ID NO: 2013815 - DNA, 18 bp, Homo sapiens
aggctcaagaggcccagg

SEQ ID NO: 2013816 - DNA, 21 bp, Homo sapiens
aggctcaagaggcccagggag

SEQ ID NO: 2013817 - DNA, 23 bp, Homo sapiens
aggctcacaactgtttttgaaga

SEQ ID NO: 2013818 - DNA, 16 bp, Homo sapiens
aggctcagtctcagga

SEQ ID NO: 2013819 - DNA, 17 bp, Homo sapiens
aggctcagtctcaggag

SEQ ID NO: 2013820 - DNA, 19 bp, Homo sapiens
aggctcagtctcaggagca

SEQ ID NO: 2013821 - DNA, 22 bp, Homo sapiens
aggctccaccccatccagttca

SEQ ID NO: 2013822 - DNA, 16 bp, Homo sapiens
aggctccatggggaag

SEQ ID NO: 2013823 - DNA, 14 bp, Homo sapiens
aggctccattagga

SEQ ID NO: 2013824 - DNA, 13 bp, Homo sapiens
aggctcctgtgct

SEQ ID NO: 2013825 - DNA, 18 bp, Homo sapiens
aggctctgaaagccagct

SEQ ID NO: 2013826 - DNA, 16 bp, Homo sapiens
aggctctgcctggagg

SEQ ID NO: 2013827 - DNA, 11 bp, Homo sapiens
aggctctggga

SEQ ID NO: 2013828 - DNA, 12 bp, Homo sapiens
aggctctgggaa

SEQ ID NO: 2013829 - DNA, 14 bp, Homo sapiens
aggctctgggctca

SEQ ID NO: 2013830 - DNA, 19 bp, Homo sapiens
aggctctgggctcagggct

SEQ ID NO: 2013831 - DNA, 20 bp, Homo sapiens
aggctctgggctcagggctg

SEQ ID NO: 2013832 - DNA, 21 bp, Homo sapiens
aggctctgggctcagggctgg

SEQ ID NO: 2013833 - DNA, 18 bp, Homo sapiens
aggctcttcctggacctg

SEQ ID NO: 2013834 - DNA, 22 bp, Homo sapiens
aggctcttcctggacctgagtc

SEQ ID NO: 2013835 - DNA, 13 bp, Homo sapiens
aggctcttctcct

SEQ ID NO: 2013836 - DNA, 14 bp, Homo sapiens
aggctcttctcctt

SEQ ID NO: 2013837 - DNA, 21 bp, Homo sapiens
aggctcttctccttggaggac

SEQ ID NO: 2013838 - DNA, 21 bp, Homo sapiens
aggctctttggggtcagccag

SEQ ID NO: 2013839 - DNA, 22 bp, Homo sapiens
aggctctttggggtcagccagg

SEQ ID NO: 2013840 - DNA, 14 bp, Homo sapiens
aggctgaccaagag

SEQ ID NO: 2013841 - DNA, 18 bp, Homo sapiens
aggctgaccaagagagaa

SEQ ID NO: 2013842 - DNA, 19 bp, Homo sapiens
aggctgaccaagagagaaa

SEQ ID NO: 2013843 - DNA, 14 bp, Homo sapiens
aggctgagacagga

SEQ ID NO: 2013844 - DNA, 17 bp, Homo sapiens
aggctgagcccagccac

SEQ ID NO: 2013845 - DNA, 15 bp, Homo sapiens
aggctgaggcagaag

SEQ ID NO: 2013846 - DNA, 17 bp, Homo sapiens
aggctgaggcagaagaa

SEQ ID NO: 2013847 - DNA, 15 bp, Homo sapiens
aggctgaggcaggag

SEQ ID NO: 2013848 - DNA, 19 bp, Homo sapiens
aggctgagtgagccacaga

SEQ ID NO: 2013849 - DNA, 15 bp, Homo sapiens
aggctgcactgcagt

SEQ ID NO: 2013850 - DNA, 19 bp, Homo sapiens
aggctgcactgcagtgatg

SEQ ID NO: 2013851 - DNA, 17 bp, Homo sapiens
aggctgcagaaggccaa

SEQ ID NO: 2013852 - DNA, 20 bp, Homo sapiens
aggctgctcggggtgcacag

SEQ ID NO: 2013853 - DNA, 21 bp, Homo sapiens
aggctgctcggggtgcacagg

SEQ ID NO: 2013854 - DNA, 22 bp, Homo sapiens
aggctgctcggggtgcacagga

SEQ ID NO: 2013855 - DNA, 20 bp, Homo sapiens
aggctgctgtgtagctctgt

SEQ ID NO: 2013856 - DNA, 20 bp, Homo sapiens
aggctggagaagctcaccca

SEQ ID NO: 2013857 - DNA, 13 bp, Homo sapiens
aggctggaggcag

SEQ ID NO: 2013858 - DNA, 14 bp, Homo sapiens
aggctggaggcagg

SEQ ID NO: 2013859 - DNA, 17 bp, Homo sapiens
aggctggaggcagggcc

SEQ ID NO: 2013860 - DNA, 18 bp, Homo sapiens
aggctggaggcagggcct

SEQ ID NO: 2013861 - DNA, 19 bp, Homo sapiens
aggctggaggcagggcctt

SEQ ID NO: 2013862 - DNA, 13 bp, Homo sapiens
aggctggcgtgca

SEQ ID NO: 2013863 - DNA, 11 bp, Homo sapiens
aggctggctga

SEQ ID NO: 2013864 - DNA, 15 bp, Homo sapiens
aggctggctgaaaat

SEQ ID NO: 2013865 - DNA, 15 bp, Homo sapiens
aggctgggccagcct

SEQ ID NO: 2013866 - DNA, 16 bp, Homo sapiens
aggctgggccagcctc

SEQ ID NO: 2013867 - DNA, 20 bp, Homo sapiens
aggctgggccagcctcagct

SEQ ID NO: 2013868 - DNA, 21 bp, Homo sapiens
aggctgggccagcctcagctc

SEQ ID NO: 2013869 - DNA, 15 bp, Homo sapiens
aggctgggcccctgg

SEQ ID NO: 2013870 - DNA, 19 bp, Homo sapiens
aggctggtctcgaactcct

SEQ ID NO: 2013871 - DNA, 13 bp, Homo sapiens
aggctggtcttga

SEQ ID NO: 2013872 - DNA, 22 bp, Homo sapiens
aggctgtaagcattctgagctg

SEQ ID NO: 2013873 - DNA, 19 bp, Homo sapiens
aggctgtggtgagggaaga

SEQ ID NO: 2013874 - DNA, 17 bp, Homo sapiens
aggcttaggtgccaggc

SEQ ID NO: 2013875 - DNA, 16 bp, Homo sapiens
aggcttatcaaaatct

SEQ ID NO: 2013876 - DNA, 17 bp, Homo sapiens
aggcttatcaaaatctt

SEQ ID NO: 2013877 - DNA, 13 bp, Homo sapiens
aggcttccaggct

SEQ ID NO: 2013878 - DNA, 14 bp, Homo sapiens
aggcttccaggctc

SEQ ID NO: 2013879 - DNA, 22 bp, Homo sapiens
aggcttcctgactgacacaggc

SEQ ID NO: 2013880 - DNA, 19 bp, Homo sapiens
aggcttccttcatttcctc

SEQ ID NO: 2013881 - DNA, 13 bp, Homo sapiens
aggcttccttggc

SEQ ID NO: 2013882 - DNA, 23 bp, Homo sapiens
aggcttcttcagatcagtgcttg

SEQ ID NO: 2013883 - DNA, 22 bp, Homo sapiens
aggcttgtcactagcagctgca

SEQ ID NO: 2013884 - DNA, 19 bp, Homo sapiens
aggctttcaattgtatttt

SEQ ID NO: 2013885 - DNA, 22 bp, Homo sapiens
aggctttcaattgtattttata

SEQ ID NO: 2013886 - DNA, 18 bp, Homo sapiens
aggctttgccatgggcct

SEQ ID NO: 2013887 - DNA, 23 bp, Homo sapiens
aggctttgccatgggcctgctgc

SEQ ID NO: 2013888 - DNA, 13 bp, Homo sapiens
aggctttggccca

SEQ ID NO: 2013889 - DNA, 13 bp, Homo sapiens
agggaaaaatata

SEQ ID NO: 2013890 - DNA, 23 bp, Homo sapiens
agggaaaccaatagtccccatca

SEQ ID NO: 2013891 - DNA, 16 bp, Homo sapiens
agggaaactattgtcc

SEQ ID NO: 2013892 - DNA, 23 bp, Homo sapiens
agggaaactgccagcaacgcagg

SEQ ID NO: 2013893 - DNA, 15 bp, Homo sapiens
agggaaactggctga

SEQ ID NO: 2013894 - DNA, 18 bp, Homo sapiens
agggaaaggatattttct

SEQ ID NO: 2013895 - DNA, 19 bp, Homo sapiens
agggaaatgctgttggtga

SEQ ID NO: 2013896 - DNA, 14 bp, Homo sapiens
agggaaatggaggg

SEQ ID NO: 2013897 - DNA, 15 bp, Homo sapiens
agggaaatggagggt

SEQ ID NO: 2013898 - DNA, 16 bp, Homo sapiens
agggaaatggagggtg

SEQ ID NO: 2013899 - DNA, 17 bp, Homo sapiens
agggaaattcacactgt

SEQ ID NO: 2013900 - DNA, 23 bp, Homo sapiens
agggaaattcacactgtgcgttt

SEQ ID NO: 2013901 - DNA, 13 bp, Homo sapiens
agggaacagacag

SEQ ID NO: 2013902 - DNA, 18 bp, Homo sapiens
agggaacagacaggagaa

SEQ ID NO: 2013903 - DNA, 19 bp, Homo sapiens
agggaacggggtccttcaa

SEQ ID NO: 2013904 - DNA, 15 bp, Homo sapiens
agggaagacaggtct

SEQ ID NO: 2013905 - DNA, 13 bp, Homo sapiens
agggaagagggca

SEQ ID NO: 2013906 - DNA, 14 bp, Homo sapiens
agggaagagggcag

SEQ ID NO: 2013907 - DNA, 15 bp, Homo sapiens
agggaagcctcttca

SEQ ID NO: 2013908 - DNA, 17 bp, Homo sapiens
agggaagtgatatcata

SEQ ID NO: 2013909 - DNA, 13 bp, Homo sapiens
agggacaaagagg

SEQ ID NO: 2013910 - DNA, 17 bp, Homo sapiens
agggacaaaggagcctg

SEQ ID NO: 2013911 - DNA, 20 bp, Homo sapiens
agggacaaaggagcctgtga

SEQ ID NO: 2013912 - DNA, 14 bp, Homo sapiens
agggacagggcttg

SEQ ID NO: 2013913 - DNA, 16 bp, Homo sapiens
agggacagggcttggg

SEQ ID NO: 2013914 - DNA, 16 bp, Homo sapiens
agggacagtattctca

SEQ ID NO: 2013915 - DNA, 18 bp, Homo sapiens
agggaccaaattgcttct

SEQ ID NO: 2013916 - DNA, 17 bp, Homo sapiens
agggacccgaagcccag

SEQ ID NO: 2013917 - DNA, 14 bp, Homo sapiens
agggacgaagaaag

SEQ ID NO: 2013918 - DNA, 15 bp, Homo sapiens
agggacgaagaaagg

SEQ ID NO: 2013919 - DNA, 15 bp, Homo sapiens
agggactggaaccag

SEQ ID NO: 2013920 - DNA, 18 bp, Homo sapiens
agggactggaaccaggga

SEQ ID NO: 2013921 - DNA, 13 bp, Homo sapiens
agggacttaaaaa

SEQ ID NO: 2013922 - DNA, 17 bp, Homo sapiens
agggacttaaaaaactt

SEQ ID NO: 2013923 - DNA, 16 bp, Homo sapiens
agggagaagaaatcca

SEQ ID NO: 2013924 - DNA, 17 bp, Homo sapiens
agggagaagaaatccat

SEQ ID NO: 2013925 - DNA, 15 bp, Homo sapiens
agggagaaggatcta

SEQ ID NO: 2013926 - DNA, 18 bp, Homo sapiens
agggagactgcatctcaa

SEQ ID NO: 2013927 - DNA, 14 bp, Homo sapiens
agggagagaagata

SEQ ID NO: 2013928 - DNA, 20 bp, Homo sapiens
agttcagttcctctttgcat

SEQ ID NO: 2013929 - DNA, 23 bp, Homo sapiens
agttcagttcctctttgcatgga

SEQ ID NO: 2013930 - DNA, 20 bp, Homo sapiens
agttcatagggtctcttcag

SEQ ID NO: 2013931 - DNA, 22 bp, Homo sapiens
agttcatatgtaccatgtacat

SEQ ID NO: 2013932 - DNA, 18 bp, Homo sapiens
agttcatcccagccccaa

SEQ ID NO: 2013933 - DNA, 20 bp, Homo sapiens
agttcatctatggcagtcca

SEQ ID NO: 2013934 - DNA, 13 bp, Homo sapiens
agttcatgagaat

SEQ ID NO: 2013935 - DNA, 21 bp, Homo sapiens
agttcatgagaatctatattt

SEQ ID NO: 2013936 - DNA, 17 bp, Homo sapiens
agttcatggtgatcagt

SEQ ID NO: 2013937 - DNA, 22 bp, Homo sapiens
agttcatgtatgttcagaagaa

SEQ ID NO: 2013938 - DNA, 15 bp, Homo sapiens
agttcatgtttgtaa

SEQ ID NO: 2013939 - DNA, 22 bp, Homo sapiens
agttcccggagcacagccctgg

SEQ ID NO: 2013940 - DNA, 23 bp, Homo sapiens
agttcccggagcacagccctggg

SEQ ID NO: 2013941 - DNA, 21 bp, Homo sapiens
agttccctgaaaacccagaga

SEQ ID NO: 2013942 - DNA, 13 bp, Homo sapiens
agttcctcgccct

SEQ ID NO: 2013943 - DNA, 17 bp, Homo sapiens
agttcctcgccctgggt

SEQ ID NO: 2013944 - DNA, 18 bp, Homo sapiens
agttcctctagtgccctc

SEQ ID NO: 2013945 - DNA, 16 bp, Homo sapiens
agttcctctttgcatg

SEQ ID NO: 2013946 - DNA, 14 bp, Homo sapiens
agttcctgcactcc

SEQ ID NO: 2013947 - DNA, 19 bp, Homo sapiens
agttcctgttcaccttatg

SEQ ID NO: 2013948 - DNA, 16 bp, Homo sapiens
agttccttataagaat

SEQ ID NO: 2013949 - DNA, 13 bp, Homo sapiens
agttcgcagccac

SEQ ID NO: 2013950 - DNA, 21 bp, Homo sapiens
agttctacaagcatatttgag

SEQ ID NO: 2013951 - DNA, 13 bp, Homo sapiens
agttctagagaag

SEQ ID NO: 2013952 - DNA, 17 bp, Homo sapiens
agttctagagaagaggc

SEQ ID NO: 2013953 - DNA, 22 bp, Homo sapiens
agttctagtccttggtctgctg

SEQ ID NO: 2013954 - DNA, 23 bp, Homo sapiens
agttctagtccttggtctgctgg

SEQ ID NO: 2013955 - DNA, 19 bp, Homo sapiens
agttctcctatcttctcca

SEQ ID NO: 2013956 - DNA, 17 bp, Homo sapiens
agttctctcgtaactgg

SEQ ID NO: 2013957 - DNA, 17 bp, Homo sapiens
agttctgaaaactgttt

SEQ ID NO: 2013958 - DNA, 19 bp, Homo sapiens
agttctgaaaactgtttat

SEQ ID NO: 2013959 - DNA, 16 bp, Homo sapiens
agttctgctcctctcc

SEQ ID NO: 2013960 - DNA, 18 bp, Homo sapiens
agttctgctcctctccag

SEQ ID NO: 2013961 - DNA, 16 bp, Homo sapiens
agttcttgtgcatgtt

SEQ ID NO: 2013962 - DNA, 20 bp, Homo sapiens
agttctttaggtgcctcctg

SEQ ID NO: 2013963 - DNA, 22 bp, Homo sapiens
agttctttaggtgcctcctgtc

SEQ ID NO: 2013964 - DNA, 16 bp, Homo sapiens
agttgaaaataaagtg

SEQ ID NO: 2013965 - DNA, 20 bp, Homo sapiens
agttgaaaatggatttttaa

SEQ ID NO: 2013966 - DNA, 13 bp, Homo sapiens
agttgacagcagg

SEQ ID NO: 2013967 - DNA, 16 bp, Homo sapiens
agttgaccgttttcat

SEQ ID NO: 2013968 - DNA, 23 bp, Homo sapiens
agttgaccgttttcatcctggcc

SEQ ID NO: 2013969 - DNA, 14 bp, Homo sapiens
agttgatgaccaat

SEQ ID NO: 2013970 - DNA, 22 bp, Homo sapiens
agttgatgaccaatctctgtga

SEQ ID NO: 2013971 - DNA, 16 bp, Homo sapiens
agttgcaataaaatag

SEQ ID NO: 2013972 - DNA, 20 bp, Homo sapiens
agttgccatgtagacccctt

SEQ ID NO: 2013973 - DNA, 16 bp, Homo sapiens
agttgctcactcagga

SEQ ID NO: 2013974 - DNA, 21 bp, Homo sapiens
agttggaaccgtgtccagcac

SEQ ID NO: 2013975 - DNA, 22 bp, Homo sapiens
agttggaaccgtgtccagcaca

SEQ ID NO: 2013976 - DNA, 17 bp, Homo sapiens
agttggacacactgtaa

SEQ ID NO: 2013977 - DNA, 18 bp, Homo sapiens
agttggaccagaggaagc

SEQ ID NO: 2013978 - DNA, 20 bp, Homo sapiens
agttggccatgatgtctttt

SEQ ID NO: 2013979 - DNA, 15 bp, Homo sapiens
agttggctcaggcag

SEQ ID NO: 2013980 - DNA, 17 bp, Homo sapiens
agttgtatctcttttga

SEQ ID NO: 2013981 - DNA, 22 bp, Homo sapiens
agttgtatctcttttgaatcca

SEQ ID NO: 2013982 - DNA, 18 bp, Homo sapiens
agttgtgccttttatagc

SEQ ID NO: 2013983 - DNA, 19 bp, Homo sapiens
agttgtgccttttatagct

SEQ ID NO: 2013984 - DNA, 21 bp, Homo sapiens
agttgtgccttttatagctat

SEQ ID NO: 2013985 - DNA, 23 bp, Homo sapiens
agttgtgccttttatagctatta

SEQ ID NO: 2013986 - DNA, 21 bp, Homo sapiens
agttgtgtctggcagtttata

SEQ ID NO: 2013987 - DNA, 15 bp, Homo sapiens
agttgttgccctggg

SEQ ID NO: 2013988 - DNA, 13 bp, Homo sapiens
agttgtttcattg

SEQ ID NO: 2013989 - DNA, 16 bp, Homo sapiens
agttgtttcattgact

SEQ ID NO: 2013990 - DNA, 21 bp, Homo sapiens
agttgttttggtgcctgcctc

SEQ ID NO: 2013991 - DNA, 22 bp, Homo sapiens
agttgttttggtgcctgcctct

SEQ ID NO: 2013992 - DNA, 12 bp, Homo sapiens
agtttaaaaaat

SEQ ID NO: 2013993 - DNA, 14 bp, Homo sapiens
agtttaaaaaatac

SEQ ID NO: 2013994 - DNA, 17 bp, Homo sapiens
agtttaataaatttatt

SEQ ID NO: 2013995 - DNA, 22 bp, Homo sapiens
agtttaatggtgccttcatttg

SEQ ID NO: 2013996 - DNA, 15 bp, Homo sapiens
agtttacaagtgtat

SEQ ID NO: 2013997 - DNA, 17 bp, Homo sapiens
agtttacaagtgtatat

SEQ ID NO: 2013998 - DNA, 23 bp, Homo sapiens
agtttacaagtgtatatcagaaa

SEQ ID NO: 2013999 - DNA, 18 bp, Homo sapiens
agtttacagtaaataaat

SEQ ID NO: 2014000 - DNA, 20 bp, Homo sapiens
agtttagaagcgctcatctg

SEQ ID NO: 2014001 - DNA, 23 bp, Homo sapiens
agtttagatcccatgtcacctca

SEQ ID NO: 2014002 - DNA, 16 bp, Homo sapiens
agtttaggcctatcaa

SEQ ID NO: 2014003 - DNA, 15 bp, Homo sapiens
agtttatgtctaaag

SEQ ID NO: 2014004 - DNA, 16 bp, Homo sapiens
agtttatgtctaaaga

SEQ ID NO: 2014005 - DNA, 20 bp, Homo sapiens
agtttatttgttgagagtgt

SEQ ID NO: 2014006 - DNA, 16 bp, Homo sapiens
agtttattttttctac

SEQ ID NO: 2014007 - DNA, 12 bp, Homo sapiens
agtttcaatgtg

SEQ ID NO: 2014008 - DNA, 15 bp, Homo sapiens
agtttcaatgtgatt

SEQ ID NO: 2014009 - DNA, 16 bp, Homo sapiens
agtttcaatgtgattc

SEQ ID NO: 2014010 - DNA, 16 bp, Homo sapiens
agtttcaattcagtgc

SEQ ID NO: 2014011 - DNA, 15 bp, Homo sapiens
agtttcagatatata

SEQ ID NO: 2014012 - DNA, 17 bp, Homo sapiens
agtttcattctcctgcc

SEQ ID NO: 2014013 - DNA, 22 bp, Homo sapiens
agtttccaaagggcagtaaagt

SEQ ID NO: 2014014 - DNA, 20 bp, Homo sapiens
agtttcccaaattccctgga

SEQ ID NO: 2014015 - DNA, 17 bp, Homo sapiens
agtttctagaggcctca

SEQ ID NO: 2014016 - DNA, 18 bp, Homo sapiens
agtttctagaggcctcag

SEQ ID NO: 2014017 - DNA, 13 bp, Homo sapiens
agtttctcagctc

SEQ ID NO: 2014018 - DNA, 16 bp, Homo sapiens
agtttctcagctccca

SEQ ID NO: 2014019 - DNA, 21 bp, Homo sapiens
agtttctcctttattgctcct

SEQ ID NO: 2014020 - DNA, 16 bp, Homo sapiens
agtttctggagcaaga

SEQ ID NO: 2014021 - DNA, 23 bp, Homo sapiens
agtttctggagcaagagagagct

SEQ ID NO: 2014022 - DNA, 17 bp, Homo sapiens
agtttctgggacctcag

SEQ ID NO: 2014023 - DNA, 22 bp, Homo sapiens
agtttcttactgttttgtatca

SEQ ID NO: 2014024 - DNA, 16 bp, Homo sapiens
agtttcttggtctcag

SEQ ID NO: 2014025 - DNA, 20 bp, Homo sapiens
agtttcttggtctcagcttc

SEQ ID NO: 2014026 - DNA, 15 bp, Homo sapiens
agtttgaacttcata

SEQ ID NO: 2014027 - DNA, 17 bp, Homo sapiens
agtttgagacaagccct

SEQ ID NO: 2014028 - DNA, 21 bp, Homo sapiens
agtttgagacaagccctggca

SEQ ID NO: 2014029 - DNA, 12 bp, Homo sapiens
agtttgagacca

SEQ ID NO: 2014030 - DNA, 17 bp, Homo sapiens
agtttgagaccagcctg

SEQ ID NO: 2014031 - DNA, 14 bp, Homo sapiens
agtttgaggctgca

SEQ ID NO: 2014032 - DNA, 17 bp, Homo sapiens
agtttgaggctgcagcg

SEQ ID NO: 2014033 - DNA, 17 bp, Homo sapiens
agtttgatcaaatctaa

SEQ ID NO: 2014034 - DNA, 20 bp, Homo sapiens
agtttgatgtcattaatgtg

SEQ ID NO: 2014035 - DNA, 19 bp, Homo sapiens
agtttgatttaatatctga

SEQ ID NO: 2014036 - DNA, 23 bp, Homo sapiens
agtttgcagaaaagcacctgccg

SEQ ID NO: 2014037 - DNA, 16 bp, Homo sapiens
agtttggatatgtaaa

SEQ ID NO: 2014038 - DNA, 22 bp, Homo sapiens
agtttggccgggtgcggtggct

SEQ ID NO: 2014039 - DNA, 18 bp, Homo sapiens
agtttgggccactgcact

SEQ ID NO: 2014040 - DNA, 16 bp, Homo sapiens
agtttggtgttttata

SEQ ID NO: 2014041 - DNA, 14 bp, Homo sapiens
agtttgtataactt

SEQ ID NO: 2014042 - DNA, 21 bp, Homo sapiens
agtttgtatagagttcatccc

SEQ ID NO: 2014043 - DNA, 17 bp, Homo sapiens
agtggggtaattctgct

SEQ ID NO: 2014044 - DNA, 19 bp, Homo sapiens
agtggggtctccctctcct

SEQ ID NO: 2014045 - DNA, 22 bp, Homo sapiens
agtggggttgcaaccactgcaa

SEQ ID NO: 2014046 - DNA, 17 bp, Homo sapiens
agtgggtgaatgtgtga

SEQ ID NO: 2014047 - DNA, 15 bp, Homo sapiens
agtgggtggcacctc

SEQ ID NO: 2014048 - DNA, 16 bp, Homo sapiens
agtggtaagctctggc

SEQ ID NO: 2014049 - DNA, 19 bp, Homo sapiens
agtggtaagctctggcttt

SEQ ID NO: 2014050 - DNA, 14 bp, Homo sapiens
agtggtaccagctc

SEQ ID NO: 2014051 - DNA, 21 bp, Homo sapiens
agtggtaccagctcactccct

SEQ ID NO: 2014052 - DNA, 23 bp, Homo sapiens
agtggtcaaaccgcactcaccca

SEQ ID NO: 2014053 - DNA, 13 bp, Homo sapiens
agtgtaaaataga

SEQ ID NO: 2014054 - DNA, 22 bp, Homo sapiens
agtgtaaagaataaatgaatct

SEQ ID NO: 2014055 - DNA, 14 bp, Homo sapiens
agtgtaaatccttt

SEQ ID NO: 2014056 - DNA, 21 bp, Homo sapiens
agtgtaaggcatagggaatat

SEQ ID NO: 2014057 - DNA, 14 bp, Homo sapiens
agtgtaattgagaa

SEQ ID NO: 2014058 - DNA, 13 bp, Homo sapiens
agtgtactgcttt

SEQ ID NO: 2014059 - DNA, 15 bp, Homo sapiens
agtgtagccttgccc

SEQ ID NO: 2014060 - DNA, 17 bp, Homo sapiens
agtgtagccttgcccgg

SEQ ID NO: 2014061 - DNA, 16 bp, Homo sapiens
agtgtatggaaataaa

SEQ ID NO: 2014062 - DNA, 20 bp, Homo sapiens
agtgtatggaaataaatgta

SEQ ID NO: 2014063 - DNA, 21 bp, Homo sapiens
agtgtatggaaataaatgtat

SEQ ID NO: 2014064 - DNA, 20 bp, Homo sapiens
agtgtcaccagctgccaaaa

SEQ ID NO: 2014065 - DNA, 21 bp, Homo sapiens
agtgtcacttacctagattta

SEQ ID NO: 2014066 - DNA, 20 bp, Homo sapiens
agtgtcatatgtaggtgtct

SEQ ID NO: 2014067 - DNA, 19 bp, Homo sapiens
agtgtcatttatgaaaaga

SEQ ID NO: 2014068 - DNA, 21 bp, Homo sapiens
agtgtccagaccattgtcttc

SEQ ID NO: 2014069 - DNA, 21 bp, Homo sapiens
agtgtcccctccactgtcaca

SEQ ID NO: 2014070 - DNA, 22 bp, Homo sapiens
agtgtccttggcaggctgattt

SEQ ID NO: 2014071 - DNA, 18 bp, Homo sapiens
agtgtcttaattaaaaga

SEQ ID NO: 2014072 - DNA, 14 bp, Homo sapiens
agtgtcttccataa

SEQ ID NO: 2014073 - DNA, 15 bp, Homo sapiens
agtgtgaaatagaca

SEQ ID NO: 2014074 - DNA, 20 bp, Homo sapiens
agtgtgaatatatggtctgt

SEQ ID NO: 2014075 - DNA, 22 bp, Homo sapiens
agtgtgagtggcagccatgcct

SEQ ID NO: 2014076 - DNA, 14 bp, Homo sapiens
agtgtgcagactga

SEQ ID NO: 2014077 - DNA, 15 bp, Homo sapiens
agtgtgcagactgat

SEQ ID NO: 2014078 - DNA, 15 bp, Homo sapiens
agtgtgcgtgtgtgc

SEQ ID NO: 2014079 - DNA, 22 bp, Homo sapiens
agtgtgcttctgttatcaaaca

SEQ ID NO: 2014080 - DNA, 18 bp, Homo sapiens
agtgtgcttgtcatctgc

SEQ ID NO: 2014081 - DNA, 19 bp, Homo sapiens
agtgtgcttgtcatctgcc

SEQ ID NO: 2014082 - DNA, 15 bp, Homo sapiens
agtgtgggaagggag

SEQ ID NO: 2014083 - DNA, 17 bp, Homo sapiens
agtgtgggaagggagag

SEQ ID NO: 2014084 - DNA, 18 bp, Homo sapiens
agtgtgggagtgcagaga

SEQ ID NO: 2014085 - DNA, 22 bp, Homo sapiens
agtgtgggtgatcagaaggctg

SEQ ID NO: 2014086 - DNA, 20 bp, Homo sapiens
agtgtgtcaagattgcaaag

SEQ ID NO: 2014087 - DNA, 23 bp, Homo sapiens
agtgtgtgtgatgggatctgtaa

SEQ ID NO: 2014088 - DNA, 16 bp, Homo sapiens
agtgtgtgtgcatgtg

SEQ ID NO: 2014089 - DNA, 18 bp, Homo sapiens
agtgttccctttcctact

SEQ ID NO: 2014090 - DNA, 16 bp, Homo sapiens
agtgttcctatttggg

SEQ ID NO: 2014091 - DNA, 20 bp, Homo sapiens
agtgttcctatttggggctt

SEQ ID NO: 2014092 - DNA, 13 bp, Homo sapiens
agtgttctgtatt

SEQ ID NO: 2014093 - DNA, 22 bp, Homo sapiens
agtgttctgtgggcttggcctt

SEQ ID NO: 2014094 - DNA, 21 bp, Homo sapiens
agtgtttatttttcatattgt

SEQ ID NO: 2014095 - DNA, 19 bp, Homo sapiens
agtgttttctcagaacagc

SEQ ID NO: 2014096 - DNA, 22 bp, Homo sapiens
agtgttttctcagaacagctga

SEQ ID NO: 2014097 - DNA, 14 bp, Homo sapiens
agttaaactgatta

SEQ ID NO: 2014098 - DNA, 18 bp, Homo sapiens
agttaaagggcagaaggg

SEQ ID NO: 2014099 - DNA, 16 bp, Homo sapiens
agttaaagtgaataac

SEQ ID NO: 2014100 - DNA, 19 bp, Homo sapiens
agttaacattaacatctat

SEQ ID NO: 2014101 - DNA, 18 bp, Homo sapiens
agttaactttaagactga

SEQ ID NO: 2014102 - DNA, 19 bp, Homo sapiens
agttaagcagcctttctgt

SEQ ID NO: 2014103 - DNA, 20 bp, Homo sapiens
agttaagcagcctttctgtg

SEQ ID NO: 2014104 - DNA, 15 bp, Homo sapiens
agttaagtatttaca

SEQ ID NO: 2014105 - DNA, 14 bp, Homo sapiens
agttaagtcatcca

SEQ ID NO: 2014106 - DNA, 20 bp, Homo sapiens
agttaatatatcccagaaat

SEQ ID NO: 2014107 - DNA, 14 bp, Homo sapiens
agttaatttaaagt

SEQ ID NO: 2014108 - DNA, 16 bp, Homo sapiens
agttacaaaaatagta

SEQ ID NO: 2014109 - DNA, 19 bp, Homo sapiens
agttacacaattaattgtc

SEQ ID NO: 2014110 - DNA, 22 bp, Homo sapiens
agttacagcgagaggcagagaa

SEQ ID NO: 2014111 - DNA, 15 bp, Homo sapiens
agttacatgtttgca

SEQ ID NO: 2014112 - DNA, 16 bp, Homo sapiens
agttacattaatgtta

SEQ ID NO: 2014113 - DNA, 13 bp, Homo sapiens
agttacggaggga

SEQ ID NO: 2014114 - DNA, 22 bp, Homo sapiens
agttacggagggaggacatcat

SEQ ID NO: 2014115 - DNA, 12 bp, Homo sapiens
agttactcagcc

SEQ ID NO: 2014116 - DNA, 19 bp, Homo sapiens
agttactcagccctgggcc

SEQ ID NO: 2014117 - DNA, 23 bp, Homo sapiens
agttactcagccctgggccccac

SEQ ID NO: 2014118 - DNA, 17 bp, Homo sapiens
agttacttgtctgaggc

SEQ ID NO: 2014119 - DNA, 18 bp, Homo sapiens
agttacttgtctgaggcc

SEQ ID NO: 2014120 - DNA, 17 bp, Homo sapiens
agttagcaggaaatagt

SEQ ID NO: 2014121 - DNA, 18 bp, Homo sapiens
agttagcaggaaatagtg

SEQ ID NO: 2014122 - DNA, 14 bp, Homo sapiens
agttagccctcagt

SEQ ID NO: 2014123 - DNA, 16 bp, Homo sapiens
agttagctcaggaggc

SEQ ID NO: 2014124 - DNA, 22 bp, Homo sapiens
agttagctcaggaggcttggaa

SEQ ID NO: 2014125 - DNA, 20 bp, Homo sapiens
agttagctttaacttaaata

SEQ ID NO: 2014126 - DNA, 14 bp, Homo sapiens
agttaggaaataaa

SEQ ID NO: 2014127 - DNA, 15 bp, Homo sapiens
agttaggaaataaaa

SEQ ID NO: 2014128 - DNA, 16 bp, Homo sapiens
agttaggatagcattt

SEQ ID NO: 2014129 - DNA, 17 bp, Homo sapiens
agttagggaatggcaca

SEQ ID NO: 2014130 - DNA, 16 bp, Homo sapiens
agttaggttataagaa

SEQ ID NO: 2014131 - DNA, 19 bp, Homo sapiens
agttatagtatatctggac

SEQ ID NO: 2014132 - DNA, 19 bp, Homo sapiens
agttatattgaatatatca

SEQ ID NO: 2014133 - DNA, 15 bp, Homo sapiens
agttatgtgaatgat

SEQ ID NO: 2014134 - DNA, 17 bp, Homo sapiens
agttattcaaatgaagg

SEQ ID NO: 2014135 - DNA, 13 bp, Homo sapiens
agttattctatca

SEQ ID NO: 2014136 - DNA, 17 bp, Homo sapiens
agttattgaatcttaat

SEQ ID NO: 2014137 - DNA, 19 bp, Homo sapiens
agttattgaatcttaattt

SEQ ID NO: 2014138 - DNA, 21 bp, Homo sapiens
agttattgaatcttaattttt

SEQ ID NO: 2014139 - DNA, 12 bp, Homo sapiens
agttattgtaca

SEQ ID NO: 2014140 - DNA, 18 bp, Homo sapiens
agttattgtacagctgtt

SEQ ID NO: 2014141 - DNA, 19 bp, Homo sapiens
agttattgtacagctgttt

SEQ ID NO: 2014142 - DNA, 19 bp, Homo sapiens
agttattgttttatgttct

SEQ ID NO: 2014143 - DNA, 21 bp, Homo sapiens
agttattgttttatgttctag

SEQ ID NO: 2014144 - DNA, 20 bp, Homo sapiens
agttattttaggagacagtc

SEQ ID NO: 2014145 - DNA, 16 bp, Homo sapiens
agttcaaatcctcacc

SEQ ID NO: 2014146 - DNA, 14 bp, Homo sapiens
agttcaaattttgc

SEQ ID NO: 2014147 - DNA, 21 bp, Homo sapiens
agttcaagcgattcttgtgcc

SEQ ID NO: 2014148 - DNA, 18 bp, Homo sapiens
agttcaataaatgtctgt

SEQ ID NO: 2014149 - DNA, 19 bp, Homo sapiens
agttcaataaatgtctgtt

SEQ ID NO: 2014150 - DNA, 21 bp, Homo sapiens
agttcaataaatgtctgttga

SEQ ID NO: 2014151 - DNA, 16 bp, Homo sapiens
agttcaattctcattt

SEQ ID NO: 2014152 - DNA, 23 bp, Homo sapiens
agttcacagggtattaatatgct

SEQ ID NO: 2014153 - DNA, 15 bp, Homo sapiens
agttcagccaccctg

SEQ ID NO: 2014154 - DNA, 16 bp, Homo sapiens
agttcagccaccctga

SEQ ID NO: 2014155 - DNA, 15 bp, Homo sapiens
agttcagccagaatc

SEQ ID NO: 2014156 - DNA, 16 bp, Homo sapiens
agttcaggagtcccaa

SEQ ID NO: 2014157 - DNA, 16 bp, Homo sapiens
agttcagggaagcagg

SEQ ID NO: 2014158 - DNA, 16 bp, Homo sapiens
agttcagttcctcttt

SEQ ID NO: 2014159 - DNA, 20 bp, Homo sapiens
agtcctagagctcctgtccc

SEQ ID NO: 2014160 - DNA, 16 bp, Homo sapiens
agtcctattctattgc

SEQ ID NO: 2014161 - DNA, 19 bp, Homo sapiens
agtcctcacagcctctccc

SEQ ID NO: 2014162 - DNA, 17 bp, Homo sapiens
agtcctcgtagccatct

SEQ ID NO: 2014163 - DNA, 21 bp, Homo sapiens
agtcctcgtagccatctctct

SEQ ID NO: 2014164 - DNA, 12 bp, Homo sapiens
agtcctctcttc

SEQ ID NO: 2014165 - DNA, 18 bp, Homo sapiens
agtcctgcagaggattta

SEQ ID NO: 2014166 - DNA, 10 bp, Homo sapiens
agtcctggcc

SEQ ID NO: 2014167 - DNA, 12 bp, Homo sapiens
agtcctggtctg

SEQ ID NO: 2014168 - DNA, 16 bp, Homo sapiens
agtcctgtctctgcct

SEQ ID NO: 2014169 - DNA, 21 bp, Homo sapiens
agtcctgtctctgcctgcggc

SEQ ID NO: 2014170 - DNA, 23 bp, Homo sapiens
agtcctgtgaatttcttcactgt

SEQ ID NO: 2014171 - DNA, 21 bp, Homo sapiens
agtccttggtctgctggtgtc

SEQ ID NO: 2014172 - DNA, 15 bp, Homo sapiens
agtcctttgattcca

SEQ ID NO: 2014173 - DNA, 12 bp, Homo sapiens
agtctaaagttt

SEQ ID NO: 2014174 - DNA, 14 bp, Homo sapiens
agtctaaagtttac

SEQ ID NO: 2014175 - DNA, 15 bp, Homo sapiens
agtctacctcttcag

SEQ ID NO: 2014176 - DNA, 18 bp, Homo sapiens
agtctacctgagcattca

SEQ ID NO: 2014177 - DNA, 20 bp, Homo sapiens
agtctacgctctcctttctt

SEQ ID NO: 2014178 - DNA, 23 bp, Homo sapiens
agtctagaaaccagtatggaagg

SEQ ID NO: 2014179 - DNA, 18 bp, Homo sapiens
agtctagtgaagatgttg

SEQ ID NO: 2014180 - DNA, 22 bp, Homo sapiens
agtctatcaaccccagacactg

SEQ ID NO: 2014181 - DNA, 14 bp, Homo sapiens
agtctatggtcagt

SEQ ID NO: 2014182 - DNA, 20 bp, Homo sapiens
agtctcaagcactaaaaagt

SEQ ID NO: 2014183 - DNA, 21 bp, Homo sapiens
agtctcactgttgcccaggct

SEQ ID NO: 2014184 - DNA, 18 bp, Homo sapiens
agtctcagaaagccttcc

SEQ ID NO: 2014185 - DNA, 19 bp, Homo sapiens
agtctcagaatgtcatttt

SEQ ID NO: 2014186 - DNA, 22 bp, Homo sapiens
agtctcaggaaatcaaatatgc

SEQ ID NO: 2014187 - DNA, 13 bp, Homo sapiens
agtctcaggagca

SEQ ID NO: 2014188 - DNA, 14 bp, Homo sapiens
agtctcaggccctg

SEQ ID NO: 2014189 - DNA, 16 bp, Homo sapiens
agtctcagtccagatg

SEQ ID NO: 2014190 - DNA, 20 bp, Homo sapiens
agtctcattctgttgcccag

SEQ ID NO: 2014191 - DNA, 19 bp, Homo sapiens
agtctccagtggttgctgt

SEQ ID NO: 2014192 - DNA, 13 bp, Homo sapiens
agtctcccattct

SEQ ID NO: 2014193 - DNA, 14 bp, Homo sapiens
agtctccttcccct

SEQ ID NO: 2014194 - DNA, 23 bp, Homo sapiens
agtctctcaatgggtaaccatta

SEQ ID NO: 2014195 - DNA, 13 bp, Homo sapiens
agtctctgggaga

SEQ ID NO: 2014196 - DNA, 16 bp, Homo sapiens
agtctctgtgctttga

SEQ ID NO: 2014197 - DNA, 17 bp, Homo sapiens
agtctcttctccactgg

SEQ ID NO: 2014198 - DNA, 18 bp, Homo sapiens
agtctcttctccactgga

SEQ ID NO: 2014199 - DNA, 17 bp, Homo sapiens
agtctctttaatcttca

SEQ ID NO: 2014200 - DNA, 19 bp, Homo sapiens
agtctcttttttattctgt

SEQ ID NO: 2014201 - DNA, 22 bp, Homo sapiens
agtctgaggccccaggccctag

SEQ ID NO: 2014202 - DNA, 19 bp, Homo sapiens
agtctgaggtcctgagcac

SEQ ID NO: 2014203 - DNA, 20 bp, Homo sapiens
agtctgaggtcctgagcact

SEQ ID NO: 2014204 - DNA, 13 bp, Homo sapiens
agtctgagtcctg

SEQ ID NO: 2014205 - DNA, 20 bp, Homo sapiens
agtctgagtcctgtctctgc

SEQ ID NO: 2014206 - DNA, 18 bp, Homo sapiens
agtctgattcccaagctc

SEQ ID NO: 2014207 - DNA, 17 bp, Homo sapiens
agtctggatctgggacc

SEQ ID NO: 2014208 - DNA, 15 bp, Homo sapiens
agtctggcctgggcg

SEQ ID NO: 2014209 - DNA, 14 bp, Homo sapiens
agtctgggctgccg

SEQ ID NO: 2014210 - DNA, 21 bp, Homo sapiens
agtctgggtctgggtttggat

SEQ ID NO: 2014211 - DNA, 22 bp, Homo sapiens
agtctgtgtgatgaactttctc

SEQ ID NO: 2014212 - DNA, 15 bp, Homo sapiens
agtgctgcttctctt

SEQ ID NO: 2014213 - DNA, 19 bp, Homo sapiens
agtgctgcttctcttggga

SEQ ID NO: 2014214 - DNA, 22 bp, Homo sapiens
agtgctgggattacaggcatga

SEQ ID NO: 2014215 - DNA, 17 bp, Homo sapiens
agtgctgtggcctgggc

SEQ ID NO: 2014216 - DNA, 18 bp, Homo sapiens
agtgctgtggcctgggca

SEQ ID NO: 2014217 - DNA, 14 bp, Homo sapiens
agtgctgttctgga

SEQ ID NO: 2014218 - DNA, 22 bp, Homo sapiens
agtgctgttttgtcctttgaga

SEQ ID NO: 2014219 - DNA, 20 bp, Homo sapiens
agtgcttagaaagttattgt

SEQ ID NO: 2014220 - DNA, 16 bp, Homo sapiens
agtgcttcagcctgag

SEQ ID NO: 2014221 - DNA, 18 bp, Homo sapiens
agtgcttcagcctgaggc

SEQ ID NO: 2014222 - DNA, 20 bp, Homo sapiens
agtgcttcagcctgaggctg

SEQ ID NO: 2014223 - DNA, 14 bp, Homo sapiens
agtgcttctctaca

SEQ ID NO: 2014224 - DNA, 15 bp, Homo sapiens
agtggaaaaaagaga

SEQ ID NO: 2014225 - DNA, 19 bp, Homo sapiens
agtggaaaaaagagaaaaa

SEQ ID NO: 2014226 - DNA, 13 bp, Homo sapiens
agtggaagagcag

SEQ ID NO: 2014227 - DNA, 23 bp, Homo sapiens
agtggaagagcagcctgatggcc

SEQ ID NO: 2014228 - DNA, 24 bp, Homo sapiens
agtggaagagcagcctgatggcca

SEQ ID NO: 2014229 - DNA, 19 bp, Homo sapiens
agtggaatcactgtatttt

SEQ ID NO: 2014230 - DNA, 17 bp, Homo sapiens
agtggaatgcagggaag

SEQ ID NO: 2014231 - DNA, 19 bp, Homo sapiens
agtggaatgcagggaagag

SEQ ID NO: 2014232 - DNA, 21 bp, Homo sapiens
agtggaatgcagggaagaggg

SEQ ID NO: 2014233 - DNA, 20 bp, Homo sapiens
agtggacaccaggagtccct

SEQ ID NO: 2014234 - DNA, 22 bp, Homo sapiens
agtggacaccaggagtccctgg

SEQ ID NO: 2014235 - DNA, 12 bp, Homo sapiens
agtggagaaata

SEQ ID NO: 2014236 - DNA, 16 bp, Homo sapiens
agtggagaattatata

SEQ ID NO: 2014237 - DNA, 15 bp, Homo sapiens
agtggagagtgttcc

SEQ ID NO: 2014238 - DNA, 19 bp, Homo sapiens
agtggaggaaaatccatgg

SEQ ID NO: 2014239 - DNA, 23 bp, Homo sapiens
agtggagggggtgtctggaagct

SEQ ID NO: 2014240 - DNA, 13 bp, Homo sapiens
agtggatggatgg

SEQ ID NO: 2014241 - DNA, 15 bp, Homo sapiens
agtggatggatggac

SEQ ID NO: 2014242 - DNA, 17 bp, Homo sapiens
agtggatggatggacag

SEQ ID NO: 2014243 - DNA, 13 bp, Homo sapiens
agtggcagccatg

SEQ ID NO: 2014244 - DNA, 14 bp, Homo sapiens
agtggcagccatgc

SEQ ID NO: 2014245 - DNA, 16 bp, Homo sapiens
agtggcagccatgcct

SEQ ID NO: 2014246 - DNA, 17 bp, Homo sapiens
agtggcagccatgcctc

SEQ ID NO: 2014247 - DNA, 22 bp, Homo sapiens
agtggcagccatgcctcatgcc

SEQ ID NO: 2014248 - DNA, 11 bp, Homo sapiens
agtggcagctg

SEQ ID NO: 2014249 - DNA, 14 bp, Homo sapiens
agtggcagctgctt

SEQ ID NO: 2014250 - DNA, 20 bp, Homo sapiens
agtggcagctgcttttgtct

SEQ ID NO: 2014251 - DNA, 22 bp, Homo sapiens
agtggcagctgtcccctctccc

SEQ ID NO: 2014252 - DNA, 20 bp, Homo sapiens
agtggcagtgaaaaatatgt

SEQ ID NO: 2014253 - DNA, 21 bp, Homo sapiens
agtggcccctcacctgggcct

SEQ ID NO: 2014254 - DNA, 21 bp, Homo sapiens
agtggcccctgcccccaaagg

SEQ ID NO: 2014255 - DNA, 19 bp, Homo sapiens
agtggccgcaagcgcaggg

SEQ ID NO: 2014256 - DNA, 23 bp, Homo sapiens
agtggccgcaagcgcagggagga

SEQ ID NO: 2014257 - DNA, 16 bp, Homo sapiens
agtggccggggaagct

SEQ ID NO: 2014258 - DNA, 17 bp, Homo sapiens
agtggccggggaagctg

SEQ ID NO: 2014259 - DNA, 15 bp, Homo sapiens
agtggcgagaggaga

SEQ ID NO: 2014260 - DNA, 17 bp, Homo sapiens
agtggcgagaggagagg

SEQ ID NO: 2014261 - DNA, 17 bp, Homo sapiens
agtggctcacgcctgta

SEQ ID NO: 2014262 - DNA, 21 bp, Homo sapiens
agtggctcctcccggtgccca

SEQ ID NO: 2014263 - DNA, 16 bp, Homo sapiens
agtggctcgctccctg

SEQ ID NO: 2014264 - DNA, 23 bp, Homo sapiens
agtggctcttctaacctcagcca

SEQ ID NO: 2014265 - DNA, 19 bp, Homo sapiens
agtggctgaaataaaagcc

SEQ ID NO: 2014266 - DNA, 11 bp, Homo sapiens
agtggctgctg

SEQ ID NO: 2014267 - DNA, 15 bp, Homo sapiens
agtggcttcaaaata

SEQ ID NO: 2014268 - DNA, 22 bp, Homo sapiens
agtggcttgtgattctgggatg

SEQ ID NO: 2014269 - DNA, 20 bp, Homo sapiens
agtgggaacgtgactgcccc

SEQ ID NO: 2014270 - DNA, 15 bp, Homo sapiens
agtgggaagtgaagc

SEQ ID NO: 2014271 - DNA, 18 bp, Homo sapiens
agtgggaagtgaagcccc

SEQ ID NO: 2014272 - DNA, 15 bp, Homo sapiens
agtgggaagtgaatc

SEQ ID NO: 2014273 - DNA, 15 bp, Homo sapiens
agtgggacattagta

SEQ ID NO: 2014274 - DNA, 22 bp, Homo sapiens
agtgggacccatagatcttctg

SEQ ID NO: 2014275 - DNA, 17 bp, Homo sapiens
agtgggagaaaacactt

SEQ ID NO: 2014276 - DNA, 20 bp, Homo sapiens
agtgggccaggacaggcccg

SEQ ID NO: 2014277 - DNA, 17 bp, Homo sapiens
agtgggctgcatctggg

SEQ ID NO: 2014278 - DNA, 14 bp, Homo sapiens
agtgggggccgctg

SEQ ID NO: 2014279 - DNA, 15 bp, Homo sapiens
agtggggtaattctg

SEQ ID NO: 2014280 - DNA, 16 bp, Homo sapiens
agtaggaccaatgttg

SEQ ID NO: 2014281 - DNA, 13 bp, Homo sapiens
agtaggtccaagg

SEQ ID NO: 2014282 - DNA, 17 bp, Homo sapiens
agtagtcaattagtaca

SEQ ID NO: 2014283 - DNA, 20 bp, Homo sapiens
agtagtcagaagcaggttct

SEQ ID NO: 2014284 - DNA, 13 bp, Homo sapiens
agtagtgcattta

SEQ ID NO: 2014285 - DNA, 23 bp, Homo sapiens
agtagttgatgaccaatctctgt

SEQ ID NO: 2014286 - DNA, 15 bp, Homo sapiens
agtataaaactgctt

SEQ ID NO: 2014287 - DNA, 23 bp, Homo sapiens
agtatacaatatataaaaatata

SEQ ID NO: 2014288 - DNA, 17 bp, Homo sapiens
agtatatagtatattta

SEQ ID NO: 2014289 - DNA, 14 bp, Homo sapiens
agtatatatgtaca

SEQ ID NO: 2014290 - DNA, 15 bp, Homo sapiens
agtatatattctaca

SEQ ID NO: 2014291 - DNA, 21 bp, Homo sapiens
agtatatattctacacatata

SEQ ID NO: 2014292 - DNA, 13 bp, Homo sapiens
agtatatctggac

SEQ ID NO: 2014293 - DNA, 15 bp, Homo sapiens
agtatatctggacaa

SEQ ID NO: 2014294 - DNA, 22 bp, Homo sapiens
agtatatctggacaagccaact

SEQ ID NO: 2014295 - DNA, 23 bp, Homo sapiens
agtatatgtcagacatgaaaact

SEQ ID NO: 2014296 - DNA, 19 bp, Homo sapiens
agtatattagtttgattta

SEQ ID NO: 2014297 - DNA, 14 bp, Homo sapiens
agtatattatgtat

SEQ ID NO: 2014298 - DNA, 15 bp, Homo sapiens
agtatattatgtatt

SEQ ID NO: 2014299 - DNA, 13 bp, Homo sapiens
agtatatttctga

SEQ ID NO: 2014300 - DNA, 19 bp, Homo sapiens
agtatattttcttttcctc

SEQ ID NO: 2014301 - DNA, 19 bp, Homo sapiens
agtatcaatccttgttcag

SEQ ID NO: 2014302 - DNA, 21 bp, Homo sapiens
agtatcttacctgtaaagtct

SEQ ID NO: 2014303 - DNA, 15 bp, Homo sapiens
agtatggaagggagg

SEQ ID NO: 2014304 - DNA, 14 bp, Homo sapiens
agtatggtggctgg

SEQ ID NO: 2014305 - DNA, 16 bp, Homo sapiens
agtatggtggctgggt

SEQ ID NO: 2014306 - DNA, 15 bp, Homo sapiens
agtatggttctcaga

SEQ ID NO: 2014307 - DNA, 15 bp, Homo sapiens
agtatgtaaagtatg

SEQ ID NO: 2014308 - DNA, 16 bp, Homo sapiens
agtatgtaaagtatgt

SEQ ID NO: 2014309 - DNA, 12 bp, Homo sapiens
agtatgtgtggg

SEQ ID NO: 2014310 - DNA, 16 bp, Homo sapiens
agtatgttaagctctt

SEQ ID NO: 2014311 - DNA, 19 bp, Homo sapiens
agtatgttaagctctttat

SEQ ID NO: 2014312 - DNA, 17 bp, Homo sapiens
agtattcaggcactgag

SEQ ID NO: 2014313 - DNA, 18 bp, Homo sapiens
agtattcaggcactgaga

SEQ ID NO: 2014314 - DNA, 20 bp, Homo sapiens
agtattccatttttactaaa

SEQ ID NO: 2014315 - DNA, 16 bp, Homo sapiens
agtattctcagtgctc

SEQ ID NO: 2014316 - DNA, 15 bp, Homo sapiens
agtattcttgtcaaa

SEQ ID NO: 2014317 - DNA, 18 bp, Homo sapiens
agtattcttgtcaaaaaa

SEQ ID NO: 2014318 - DNA, 22 bp, Homo sapiens
agtattgccacaatgcctctcc

SEQ ID NO: 2014319 - DNA, 22 bp, Homo sapiens
agtattgtccatatcagacctc

SEQ ID NO: 2014320 - DNA, 15 bp, Homo sapiens
agtatttacagatgt

SEQ ID NO: 2014321 - DNA, 16 bp, Homo sapiens
agtatttatatattta

SEQ ID NO: 2014322 - DNA, 19 bp, Homo sapiens
agtatttatatatttataa

SEQ ID NO: 2014323 - DNA, 14 bp, Homo sapiens
agtatttgttaatt

SEQ ID NO: 2014324 - DNA, 18 bp, Homo sapiens
agtatttgttaatttaga

SEQ ID NO: 2014325 - DNA, 19 bp, Homo sapiens
agtatttttttaagttaga

SEQ ID NO: 2014326 - DNA, 23 bp, Homo sapiens
agtatttttttaagttagagaat

SEQ ID NO: 2014327 - DNA, 17 bp, Homo sapiens
agtcaaaccataaactt

SEQ ID NO: 2014328 - DNA, 18 bp, Homo sapiens
agtcaaaccataaacttc

SEQ ID NO: 2014329 - DNA, 12 bp, Homo sapiens
agtcaaagtaaa

SEQ ID NO: 2014330 - DNA, 21 bp, Homo sapiens
agtcaacactcttcttgagca

SEQ ID NO: 2014331 - DNA, 15 bp, Homo sapiens
agtcaacagttcaaa

SEQ ID NO: 2014332 - DNA, 21 bp, Homo sapiens
agtcaacagttcaaagaagtc

SEQ ID NO: 2014333 - DNA, 13 bp, Homo sapiens
agtcaacatcttc

SEQ ID NO: 2014334 - DNA, 14 bp, Homo sapiens
agtcaactggagca

SEQ ID NO: 2014335 - DNA, 19 bp, Homo sapiens
agtcaagaaaaattattgt

SEQ ID NO: 2014336 - DNA, 21 bp, Homo sapiens
agtcaagagcaatcaaagcag

SEQ ID NO: 2014337 - DNA, 18 bp, Homo sapiens
agtcacacagacacacaa

SEQ ID NO: 2014338 - DNA, 15 bp, Homo sapiens
aggggacatttccct

SEQ ID NO: 2014339 - DNA, 18 bp, Homo sapiens
aggggaccatgaagagac

SEQ ID NO: 2014340 - DNA, 17 bp, Homo sapiens
aggggacgcgggctgtg

SEQ ID NO: 2014341 - DNA, 21 bp, Homo sapiens
aggggactaattcactggcga

SEQ ID NO: 2014342 - DNA, 16 bp, Homo sapiens
aggggacttgtgccag

SEQ ID NO: 2014343 - DNA, 18 bp, Homo sapiens
aggggacttgtgccagca

SEQ ID NO: 2014344 - DNA, 20 bp, Homo sapiens
aggggagaagggccagccct

SEQ ID NO: 2014345 - DNA, 23 bp, Homo sapiens
aggggagaagggccagccctaca

SEQ ID NO: 2014346 - DNA, 10 bp, Homo sapiens
aggggagagg

SEQ ID NO: 2014347 - DNA, 17 bp, Homo sapiens
aggggaggcatcagtgt

SEQ ID NO: 2014348 - DNA, 12 bp, Homo sapiens
aggggaggggcc

SEQ ID NO: 2014349 - DNA, 21 bp, Homo sapiens
aggggaggggcctagggagcc

SEQ ID NO: 2014350 - DNA, 15 bp, Homo sapiens
aggggagtgtgggtg

SEQ ID NO: 2014351 - DNA, 19 bp, Homo sapiens
aggggatgaggggcttcct

SEQ ID NO: 2014352 - DNA, 22 bp, Homo sapiens
aggggcacaccactgccctgcc

SEQ ID NO: 2014353 - DNA, 14 bp, Homo sapiens
aggggcacctgcca

SEQ ID NO: 2014354 - DNA, 15 bp, Homo sapiens
aggggcacctgccac

SEQ ID NO: 2014355 - DNA, 21 bp, Homo sapiens
aggggcacctgccaccgccag

SEQ ID NO: 2014356 - DNA, 22 bp, Homo sapiens
aggggcacctgccaccgccaga

SEQ ID NO: 2014357 - DNA, 14 bp, Homo sapiens
aggggcacctggga

SEQ ID NO: 2014358 - DNA, 16 bp, Homo sapiens
aggggcacgcctgccc

SEQ ID NO: 2014359 - DNA, 22 bp, Homo sapiens
aggggcacgcctgcccagcctc

SEQ ID NO: 2014360 - DNA, 14 bp, Homo sapiens
aggggcagaacagc

SEQ ID NO: 2014361 - DNA, 16 bp, Homo sapiens
aggggcaggcctggga

SEQ ID NO: 2014362 - DNA, 17 bp, Homo sapiens
aggggcaggcctgggac

SEQ ID NO: 2014363 - DNA, 21 bp, Homo sapiens
aggggcaggcctgggacccag

SEQ ID NO: 2014364 - DNA, 22 bp, Homo sapiens
aggggcaggcctgggacccagc

SEQ ID NO: 2014365 - DNA, 17 bp, Homo sapiens
aggggccagtgagggct

SEQ ID NO: 2014366 - DNA, 24 bp, Homo sapiens
aggggccagtgagggctgggccca

SEQ ID NO: 2014367 - DNA, 19 bp, Homo sapiens
aggggcccacagggaaccc

SEQ ID NO: 2014368 - DNA, 21 bp, Homo sapiens
aggggcccacagggaaccctg

SEQ ID NO: 2014369 - DNA, 15 bp, Homo sapiens
aggggccccagatct

SEQ ID NO: 2014370 - DNA, 19 bp, Homo sapiens
aggggccccagatctgcct

SEQ ID NO: 2014371 - DNA, 21 bp, Homo sapiens
aggggccccagatctgcctgg

SEQ ID NO: 2014372 - DNA, 20 bp, Homo sapiens
aggggccccggggctggcaa

SEQ ID NO: 2014373 - DNA, 12 bp, Homo sapiens
aggggccctggt

SEQ ID NO: 2014374 - DNA, 17 bp, Homo sapiens
aggggcctagggagccg

SEQ ID NO: 2014375 - DNA, 20 bp, Homo sapiens
aggggcctctgaaatttccc

SEQ ID NO: 2014376 - DNA, 17 bp, Homo sapiens
aggggcctgggaaagga

SEQ ID NO: 2014377 - DNA, 18 bp, Homo sapiens
aggggcctgggaaaggaa

SEQ ID NO: 2014378 - DNA, 21 bp, Homo sapiens
aggggcctgggaaaggaaaac

SEQ ID NO: 2014379 - DNA, 13 bp, Homo sapiens
aggggcgagcacc

SEQ ID NO: 2014380 - DNA, 18 bp, Homo sapiens
aggggctaggggctggtc

SEQ ID NO: 2014381 - DNA, 14 bp, Homo sapiens
aggggctcagcaag

SEQ ID NO: 2014382 - DNA, 15 bp, Homo sapiens
aggggctcagcaagg

SEQ ID NO: 2014383 - DNA, 20 bp, Homo sapiens
aggggctcagcaaggtgtga

SEQ ID NO: 2014384 - DNA, 20 bp, Homo sapiens
aggggctgctcatcacccag

SEQ ID NO: 2014385 - DNA, 21 bp, Homo sapiens
aggggctgctcatcacccagt

SEQ ID NO: 2014386 - DNA, 13 bp, Homo sapiens
aggggctgctggg

SEQ ID NO: 2014387 - DNA, 16 bp, Homo sapiens
agggggagactatgtg

SEQ ID NO: 2014388 - DNA, 15 bp, Homo sapiens
agggggcggggcggg

SEQ ID NO: 2014389 - DNA, 12 bp, Homo sapiens
agggggctccat

SEQ ID NO: 2014390 - DNA, 14 bp, Homo sapiens
agggggctccatgg

SEQ ID NO: 2014391 - DNA, 20 bp, Homo sapiens
agggggctccatggaggagg

SEQ ID NO: 2014392 - DNA, 21 bp, Homo sapiens
agggggctctccaaaggggct

SEQ ID NO: 2014393 - DNA, 15 bp, Homo sapiens
agggggtcgtggaga

SEQ ID NO: 2014394 - DNA, 19 bp, Homo sapiens
agggggtcgtggagagcta

SEQ ID NO: 2014395 - DNA, 23 bp, Homo sapiens
agggggtcgtggagagctaggag

SEQ ID NO: 2014396 - DNA, 22 bp, Homo sapiens
agggggtgtctggaagctgagc

SEQ ID NO: 2014397 - DNA, 19 bp, Homo sapiens
aggggtaggcagagccttt

SEQ ID NO: 2014398 - DNA, 20 bp, Homo sapiens
aggggtatatttagaccctg

SEQ ID NO: 2014399 - DNA, 13 bp, Homo sapiens
aggggtcaggctc

SEQ ID NO: 2014400 - DNA, 15 bp, Homo sapiens
aggggtcaggctcca

SEQ ID NO: 2014401 - DNA, 13 bp, Homo sapiens
aggggtctccctg

SEQ ID NO: 2014402 - DNA, 16 bp, Homo sapiens
aggggtctccctggag

SEQ ID NO: 2014403 - DNA, 14 bp, Homo sapiens
aggggtctgagcca

SEQ ID NO: 2014404 - DNA, 21 bp, Homo sapiens
aggggtctgtatatacatttc

SEQ ID NO: 2014405 - DNA, 14 bp, Homo sapiens
agggagagcggggc

SEQ ID NO: 2014406 - DNA, 16 bp, Homo sapiens
agggagagcggggcag

SEQ ID NO: 2014407 - DNA, 15 bp, Homo sapiens
agggagagggaggga

SEQ ID NO: 2014408 - DNA, 17 bp, Homo sapiens
agggagcaatgggaggg

SEQ ID NO: 2014409 - DNA, 13 bp, Homo sapiens
agggagcactggg

SEQ ID NO: 2014410 - DNA, 14 bp, Homo sapiens
agggagcagacagg

SEQ ID NO: 2014411 - DNA, 18 bp, Homo sapiens
agggagccatcccttccc

SEQ ID NO: 2014412 - DNA, 19 bp, Homo sapiens
agggagcccctaggaaagc

SEQ ID NO: 2014413 - DNA, 20 bp, Homo sapiens
agggaggaggcagagaagaa

SEQ ID NO: 2014414 - DNA, 16 bp, Homo sapiens
agggaggatgccacag

SEQ ID NO: 2014415 - DNA, 12 bp, Homo sapiens
agggagggctct

SEQ ID NO: 2014416 - DNA, 18 bp, Homo sapiens
agggagggctctgaggcg

SEQ ID NO: 2014417 - DNA, 20 bp, Homo sapiens
agggagggctctgaggcgcc

SEQ ID NO: 2014418 - DNA, 19 bp, Homo sapiens
agggagggggcgctcagga

SEQ ID NO: 2014419 - DNA, 23 bp, Homo sapiens
agggagggggcgctcaggaccca

SEQ ID NO: 2014420 - DNA, 24 bp, Homo sapiens
agggagggggcgctcaggacccag

SEQ ID NO: 2014421 - DNA, 21 bp, Homo sapiens
agggagttgctcactcaggac

SEQ ID NO: 2014422 - DNA, 22 bp, Homo sapiens
agggagttgctcactcaggact

SEQ ID NO: 2014423 - DNA, 14 bp, Homo sapiens
agggataattcaaa

SEQ ID NO: 2014424 - DNA, 14 bp, Homo sapiens
agggatacactgaa

SEQ ID NO: 2014425 - DNA, 19 bp, Homo sapiens
agggatcttgcattcccag

SEQ ID NO: 2014426 - DNA, 22 bp, Homo sapiens
agggatgactaaaatatttatt

SEQ ID NO: 2014427 - DNA, 18 bp, Homo sapiens
agggatggagaggcggcc

SEQ ID NO: 2014428 - DNA, 17 bp, Homo sapiens
agggatgggatttcatg

SEQ ID NO: 2014429 - DNA, 16 bp, Homo sapiens
agggatgggggatggg

SEQ ID NO: 2014430 - DNA, 15 bp, Homo sapiens
agggattagggagag

SEQ ID NO: 2014431 - DNA, 19 bp, Homo sapiens
agggcaaacccaaaacctc

SEQ ID NO: 2014432 - DNA, 18 bp, Homo sapiens
agggcaaatgacatgcac

SEQ ID NO: 2014433 - DNA, 21 bp, Homo sapiens
agggcaaatgacatgcactga

SEQ ID NO: 2014434 - DNA, 22 bp, Homo sapiens
agggcaaatgacatgcactgac

SEQ ID NO: 2014435 - DNA, 17 bp, Homo sapiens
agggcaaattattttaa

SEQ ID NO: 2014436 - DNA, 14 bp, Homo sapiens
agggcaagggccat

SEQ ID NO: 2014437 - DNA, 21 bp, Homo sapiens
agggcacaccgggcactcaga

SEQ ID NO: 2014438 - DNA, 15 bp, Homo sapiens
agggcacaggagcta

SEQ ID NO: 2014439 - DNA, 18 bp, Homo sapiens
agggcacaggagctacct

SEQ ID NO: 2014440 - DNA, 22 bp, Homo sapiens
agggcacaggagctacctgtgt

SEQ ID NO: 2014441 - DNA, 13 bp, Homo sapiens
agggcactcacat

SEQ ID NO: 2014442 - DNA, 18 bp, Homo sapiens
agggcactgtctgcgtga

SEQ ID NO: 2014443 - DNA, 19 bp, Homo sapiens
agggcagagtgggctgcct

SEQ ID NO: 2014444 - DNA, 15 bp, Homo sapiens
agggcagcagccagc

SEQ ID NO: 2014445 - DNA, 19 bp, Homo sapiens
agggcagcagccagccctg

SEQ ID NO: 2014446 - DNA, 20 bp, Homo sapiens
agggcagcagccagccctgc

SEQ ID NO: 2014447 - DNA, 14 bp, Homo sapiens
agggcagccagggg

SEQ ID NO: 2014448 - DNA, 17 bp, Homo sapiens
agggcagggacaggata

SEQ ID NO: 2014449 - DNA, 16 bp, Homo sapiens
agggcaggtgcttcag

SEQ ID NO: 2014450 - DNA, 15 bp, Homo sapiens
agggcagtacctggg

SEQ ID NO: 2014451 - DNA, 16 bp, Homo sapiens
agggcagtacctggga

SEQ ID NO: 2014452 - DNA, 17 bp, Homo sapiens
agggcagtacctgggaa

SEQ ID NO: 2014453 - DNA, 18 bp, Homo sapiens
agggcagtacctgggaaa

SEQ ID NO: 2014454 - DNA, 20 bp, Homo sapiens
agggcagtgacaagtggagg

SEQ ID NO: 2014455 - DNA, 16 bp, Homo sapiens
agggcagttcgcagcc

SEQ ID NO: 2014456 - DNA, 21 bp, Homo sapiens
agggcagttcgcagccaccct

SEQ ID NO: 2014457 - DNA, 14 bp, Homo sapiens
agggcatcaggcac

SEQ ID NO: 2014458 - DNA, 17 bp, Homo sapiens
agggcatcaggcactgg

SEQ ID NO: 2014459 - DNA, 17 bp, Homo sapiens
agggcatggccaggtgg

SEQ ID NO: 2014460 - DNA, 17 bp, Homo sapiens
agggcatgggagggagg

SEQ ID NO: 2014461 - DNA, 13 bp, Homo sapiens
agggcattttaaa

SEQ ID NO: 2014462 - DNA, 18 bp, Homo sapiens
agggccacactattacca

SEQ ID NO: 2014463 - DNA, 19 bp, Homo sapiens
agggccacatcccactgcc

SEQ ID NO: 2014464 - DNA, 18 bp, Homo sapiens
agggccacgtgccaggcc

SEQ ID NO: 2014465 - DNA, 19 bp, Homo sapiens
agggccacgtgccaggccc

SEQ ID NO: 2014466 - DNA, 21 bp, Homo sapiens
agggccagccctacatcttca

SEQ ID NO: 2014467 - DNA, 22 bp, Homo sapiens
agggccagctcacaagcccagg

SEQ ID NO: 2014468 - DNA, 16 bp, Homo sapiens
agggccaggagagaga

SEQ ID NO: 2014469 - DNA, 17 bp, Homo sapiens
agggccaggagagagat

SEQ ID NO: 2014470 - DNA, 21 bp, Homo sapiens
agggccaggcaggtgcctgga

SEQ ID NO: 2014471 - DNA, 14 bp, Homo sapiens
agggccagggccct

SEQ ID NO: 2014472 - DNA, 15 bp, Homo sapiens
agggccagggccctg

SEQ ID NO: 2014473 - DNA, 18 bp, Homo sapiens
agggccatgctgaaggga

SEQ ID NO: 2014474 - DNA, 14 bp, Homo sapiens
agggcccagagagg

SEQ ID NO: 2014475 - DNA, 23 bp, Homo sapiens
agggcccagagagggtggtgacc

SEQ ID NO: 2014476 - DNA, 23 bp, Homo sapiens
ccagagcctgtctttcagcattc

SEQ ID NO: 2014477 - DNA, 18 bp, Homo sapiens
ccagagccttctcctgcc

SEQ ID NO: 2014478 - DNA, 23 bp, Homo sapiens
ccagagccttctcctgcctacat

SEQ ID NO: 2014479 - DNA, 17 bp, Homo sapiens
ccagagctggaaggcag

SEQ ID NO: 2014480 - DNA, 18 bp, Homo sapiens
ccagagctggaaggcagg

SEQ ID NO: 2014481 - DNA, 23 bp, Homo sapiens
ccagagctggaaggcagggcaga

SEQ ID NO: 2014482 - DNA, 21 bp, Homo sapiens
ccagagcttattggccactgg

SEQ ID NO: 2014483 - DNA, 16 bp, Homo sapiens
ccagagcttcccagga

SEQ ID NO: 2014484 - DNA, 15 bp, Homo sapiens
ccagaggaagcccct

SEQ ID NO: 2014485 - DNA, 13 bp, Homo sapiens
ccagaggacaagg

SEQ ID NO: 2014486 - DNA, 22 bp, Homo sapiens
ccagaggccaggaatctgccat

SEQ ID NO: 2014487 - DNA, 16 bp, Homo sapiens
ccagagggagtgacag

SEQ ID NO: 2014488 - DNA, 17 bp, Homo sapiens
ccagagggagtgacaga

SEQ ID NO: 2014489 - DNA, 22 bp, Homo sapiens
ccagagggagtgacagaggcag

SEQ ID NO: 2014490 - DNA, 20 bp, Homo sapiens
ccagagggccaagagagaca

SEQ ID NO: 2014491 - DNA, 18 bp, Homo sapiens
ccagagggcccaggcagg

SEQ ID NO: 2014492 - DNA, 16 bp, Homo sapiens
ccagagggtagggcag

SEQ ID NO: 2014493 - DNA, 19 bp, Homo sapiens
ccagagggtagggcagcag

SEQ ID NO: 2014494 - DNA, 23 bp, Homo sapiens
ccagaggttatctgcctggcctg

SEQ ID NO: 2014495 - DNA, 15 bp, Homo sapiens
ccactgtggccagag

SEQ ID NO: 2014496 - DNA, 16 bp, Homo sapiens
ccactgtggcgttctg

SEQ ID NO: 2014497 - DNA, 16 bp, Homo sapiens
ccacttaaaaaatgtc

SEQ ID NO: 2014498 - DNA, 13 bp, Homo sapiens
ccacttaccttca

SEQ ID NO: 2014499 - DNA, 14 bp, Homo sapiens
ccacttaccttcaa

SEQ ID NO: 2014500 - DNA, 14 bp, Homo sapiens
ccacttcagcccag

SEQ ID NO: 2014501 - DNA, 15 bp, Homo sapiens
ccacttcagcccagc

SEQ ID NO: 2014502 - DNA, 21 bp, Homo sapiens
ccacttcattcttgaaagctg

SEQ ID NO: 2014503 - DNA, 20 bp, Homo sapiens
ccacttccaggagcccagag

SEQ ID NO: 2014504 - DNA, 11 bp, Homo sapiens
ccacttctctc

SEQ ID NO: 2014505 - DNA, 13 bp, Homo sapiens
ccacttctctcca

SEQ ID NO: 2014506 - DNA, 18 bp, Homo sapiens
ccacttcttaaaggcctg

SEQ ID NO: 2014507 - DNA, 16 bp, Homo sapiens
ccacttcttttataac

SEQ ID NO: 2014508 - DNA, 21 bp, Homo sapiens
ccacttgacattccttgtcac

SEQ ID NO: 2014509 - DNA, 16 bp, Homo sapiens
ccacttgaggctggca

SEQ ID NO: 2014510 - DNA, 14 bp, Homo sapiens
ccacttgtcatcca

SEQ ID NO: 2014511 - DNA, 19 bp, Homo sapiens
ccagaaaaaaaaaaactta

SEQ ID NO: 2014512 - DNA, 17 bp, Homo sapiens
ccagaaaacctccagta

SEQ ID NO: 2014513 - DNA, 22 bp, Homo sapiens
ccagaaaatataaatgcatgat

SEQ ID NO: 2014514 - DNA, 22 bp, Homo sapiens
ccagaaagaaggacacttgtat

SEQ ID NO: 2014515 - DNA, 13 bp, Homo sapiens
ccagaaattagaa

SEQ ID NO: 2014516 - DNA, 16 bp, Homo sapiens
ccagaaattccttccc

SEQ ID NO: 2014517 - DNA, 17 bp, Homo sapiens
ccagaaattccttccca

SEQ ID NO: 2014518 - DNA, 22 bp, Homo sapiens
ccagaacaaggttccctctgag

SEQ ID NO: 2014519 - DNA, 13 bp, Homo sapiens
ccagaaccacact

SEQ ID NO: 2014520 - DNA, 15 bp, Homo sapiens
ccagaaccacactgt

SEQ ID NO: 2014521 - DNA, 22 bp, Homo sapiens
ccagaactgaggtcactgggtt

SEQ ID NO: 2014522 - DNA, 22 bp, Homo sapiens
ccagaaggagggcagagccatg

SEQ ID NO: 2014523 - DNA, 20 bp, Homo sapiens
ccagaagggagttgctcact

SEQ ID NO: 2014524 - DNA, 18 bp, Homo sapiens
ccagaaggggcacgcctg

SEQ ID NO: 2014525 - DNA, 20 bp, Homo sapiens
ccagaaggggcacgcctgcc

SEQ ID NO: 2014526 - DNA, 17 bp, Homo sapiens
ccagaagtggggctctg

SEQ ID NO: 2014527 - DNA, 14 bp, Homo sapiens
ccagaatctgctgt

SEQ ID NO: 2014528 - DNA, 19 bp, Homo sapiens
ccagaatcttcgtcctgcc

SEQ ID NO: 2014529 - DNA, 23 bp, Homo sapiens
ccagaatggtctttctaatgtgt

SEQ ID NO: 2014530 - DNA, 21 bp, Homo sapiens
ccagaattcccagctgtctgt

SEQ ID NO: 2014531 - DNA, 22 bp, Homo sapiens
ccagaattgcattctgaatgaa

SEQ ID NO: 2014532 - DNA, 14 bp, Homo sapiens
ccagacacaccccc

SEQ ID NO: 2014533 - DNA, 11 bp, Homo sapiens
ccagacacatt

SEQ ID NO: 2014534 - DNA, 17 bp, Homo sapiens
ccagacaccttgacagg

SEQ ID NO: 2014535 - DNA, 20 bp, Homo sapiens
ccagacaccttgacagggca

SEQ ID NO: 2014536 - DNA, 13 bp, Homo sapiens
ccagacagataca

SEQ ID NO: 2014537 - DNA, 19 bp, Homo sapiens
ccagacatgtggtgggaca

SEQ ID NO: 2014538 - DNA, 22 bp, Homo sapiens
ccagaccacctgccagccatca

SEQ ID NO: 2014539 - DNA, 14 bp, Homo sapiens
ccagaccattgtct

SEQ ID NO: 2014540 - DNA, 19 bp, Homo sapiens
ccagaccattgtcttccaa

SEQ ID NO: 2014541 - DNA, 15 bp, Homo sapiens
ccagacccctgtggc

SEQ ID NO: 2014542 - DNA, 15 bp, Homo sapiens
ccagacccggctgcg

SEQ ID NO: 2014543 - DNA, 16 bp, Homo sapiens
ccagacccggctgcgt

SEQ ID NO: 2014544 - DNA, 13 bp, Homo sapiens
ccagaccctgaag

SEQ ID NO: 2014545 - DNA, 13 bp, Homo sapiens
ccagaccctgcct

SEQ ID NO: 2014546 - DNA, 18 bp, Homo sapiens
ccagacctagacctgggc

SEQ ID NO: 2014547 - DNA, 24 bp, Homo sapiens
ccagacgctgccgctgccgctgca

SEQ ID NO: 2014548 - DNA, 13 bp, Homo sapiens
ccagactcagctc

SEQ ID NO: 2014549 - DNA, 14 bp, Homo sapiens
ccagactcagctcc

SEQ ID NO: 2014550 - DNA, 18 bp, Homo sapiens
ccagactcctttcctctg

SEQ ID NO: 2014551 - DNA, 22 bp, Homo sapiens
ccagactgcttccaattttctg

SEQ ID NO: 2014552 - DNA, 16 bp, Homo sapiens
ccagactgtggagaaa

SEQ ID NO: 2014553 - DNA, 18 bp, Homo sapiens
ccagactgtggagaaata

SEQ ID NO: 2014554 - DNA, 19 bp, Homo sapiens
ccagacttctctttcttat

SEQ ID NO: 2014555 - DNA, 16 bp, Homo sapiens
ccagactttctacacc

SEQ ID NO: 2014556 - DNA, 13 bp, Homo sapiens
ccagagacaggaa

SEQ ID NO: 2014557 - DNA, 14 bp, Homo sapiens
ccagagacaggaaa

SEQ ID NO: 2014558 - DNA, 15 bp, Homo sapiens
ccagagacaggaaaa

SEQ ID NO: 2014559 - DNA, 16 bp, Homo sapiens
ccagagacaggaaaga

SEQ ID NO: 2014560 - DNA, 21 bp, Homo sapiens
ccagagaccttttctctccca

SEQ ID NO: 2014561 - DNA, 19 bp, Homo sapiens
ccagagacggaagcctttt

SEQ ID NO: 2014562 - DNA, 14 bp, Homo sapiens
ccagagaggagcac

SEQ ID NO: 2014563 - DNA, 17 bp, Homo sapiens
ccagagaggagcacctg

SEQ ID NO: 2014564 - DNA, 20 bp, Homo sapiens
ccagagaggagcacctgaac

SEQ ID NO: 2014565 - DNA, 18 bp, Homo sapiens
ccagagagggcccagctg

SEQ ID NO: 2014566 - DNA, 23 bp, Homo sapiens
ccagagagggcccagctgtagcc

SEQ ID NO: 2014567 - DNA, 21 bp, Homo sapiens
ccagagaggggacatttccct

SEQ ID NO: 2014568 - DNA, 22 bp, Homo sapiens
ccagagaggggacatttccctc

SEQ ID NO: 2014569 - DNA, 21 bp, Homo sapiens
ccagagagggtggtgacctct

SEQ ID NO: 2014570 - DNA, 15 bp, Homo sapiens
ccagagagtcctctg

SEQ ID NO: 2014571 - DNA, 15 bp, Homo sapiens
ccagagagtggctcc

SEQ ID NO: 2014572 - DNA, 17 bp, Homo sapiens
ccagagatgcctccacc

SEQ ID NO: 2014573 - DNA, 21 bp, Homo sapiens
ccagagcacaagttccagctg

SEQ ID NO: 2014574 - DNA, 23 bp, Homo sapiens
ccagagcattacgtgagccaggt

SEQ ID NO: 2014575 - DNA, 13 bp, Homo sapiens
ccagagccagcct

SEQ ID NO: 2014576 - DNA, 15 bp, Homo sapiens
ccagagccagcctgg

SEQ ID NO: 2014577 - DNA, 17 bp, Homo sapiens
ccagagccagcctggga

SEQ ID NO: 2014578 - DNA, 20 bp, Homo sapiens
ccagagccagcctgggactc

SEQ ID NO: 2014579 - DNA, 20 bp, Homo sapiens
ccagagcccaagtgccatcc

SEQ ID NO: 2014580 - DNA, 14 bp, Homo sapiens
ccagagcccagggc

SEQ ID NO: 2014581 - DNA, 10 bp, Homo sapiens
ccagagcccc

SEQ ID NO: 2014582 - DNA, 20 bp, Homo sapiens
ccagagccggggcactttca

SEQ ID NO: 2014583 - DNA, 11 bp, Homo sapiens
ccagagcctgg

SEQ ID NO: 2014584 - DNA, 12 bp, Homo sapiens
ccagagcctggg

SEQ ID NO: 2014585 - DNA, 19 bp, Homo sapiens
ccagagcctgtctttcagc

SEQ ID NO: 2014586 - DNA, 17 bp, Homo sapiens
ccaccgggagcctcccc

SEQ ID NO: 2014587 - DNA, 22 bp, Homo sapiens
ccaccgggagcctccccctcag

SEQ ID NO: 2014588 - DNA, 18 bp, Homo sapiens
ccaccgggccactccttc

SEQ ID NO: 2014589 - DNA, 19 bp, Homo sapiens
ccaccgggccactccttcc

SEQ ID NO: 2014590 - DNA, 19 bp, Homo sapiens
ccaccgggctgggagctct

SEQ ID NO: 2014591 - DNA, 18 bp, Homo sapiens
ccaccggggaacccagcc

SEQ ID NO: 2014592 - DNA, 17 bp, Homo sapiens
ccacctaatcaggctga

SEQ ID NO: 2014593 - DNA, 15 bp, Homo sapiens
ccacctcactcctgt

SEQ ID NO: 2014594 - DNA, 12 bp, Homo sapiens
ccacctcagcct

SEQ ID NO: 2014595 - DNA, 15 bp, Homo sapiens
ccacctcagcctccc

SEQ ID NO: 2014596 - DNA, 23 bp, Homo sapiens
ccacctccacccccgccacggcc

SEQ ID NO: 2014597 - DNA, 16 bp, Homo sapiens
ccacctcccaaggact

SEQ ID NO: 2014598 - DNA, 20 bp, Homo sapiens
ccacctcccaaggactttcc

SEQ ID NO: 2014599 - DNA, 19 bp, Homo sapiens
ccacctcccaccccactcc

SEQ ID NO: 2014600 - DNA, 22 bp, Homo sapiens
ccacctcccaccccactccagc

SEQ ID NO: 2014601 - DNA, 19 bp, Homo sapiens
ccacctcccctatccaccc

SEQ ID NO: 2014602 - DNA, 12 bp, Homo sapiens
ccacctccctgc

SEQ ID NO: 2014603 - DNA, 19 bp, Homo sapiens
ccacctccgccccagacac

SEQ ID NO: 2014604 - DNA, 18 bp, Homo sapiens
ccacctcctagaggtggg

SEQ ID NO: 2014605 - DNA, 14 bp, Homo sapiens
ccacctctcaatat

SEQ ID NO: 2014606 - DNA, 18 bp, Homo sapiens
ccacctcttctcttcctg

SEQ ID NO: 2014607 - DNA, 23 bp, Homo sapiens
ccacctcttctcttcctgtaaca

SEQ ID NO: 2014608 - DNA, 20 bp, Homo sapiens
ccacctcttgggcatgctca

SEQ ID NO: 2014609 - DNA, 19 bp, Homo sapiens
ccacctgcaagtgcccgcc

SEQ ID NO: 2014610 - DNA, 20 bp, Homo sapiens
ccacctgcaagtgcccgccc

SEQ ID NO: 2014611 - DNA, 15 bp, Homo sapiens
ccacctgccagccat

SEQ ID NO: 2014612 - DNA, 14 bp, Homo sapiens
ccacctgcccaacc

SEQ ID NO: 2014613 - DNA, 14 bp, Homo sapiens
ccacctgcctatcc

SEQ ID NO: 2014614 - DNA, 20 bp, Homo sapiens
ccacctgcctatccatcctg

SEQ ID NO: 2014615 - DNA, 14 bp, Homo sapiens
ccacctgtctgtct

SEQ ID NO: 2014616 - DNA, 16 bp, Homo sapiens
ccacctgtctgtctgt

SEQ ID NO: 2014617 - DNA, 20 bp, Homo sapiens
ccaagcactcgagaccatcc

SEQ ID NO: 2014618 - DNA, 16 bp, Homo sapiens
ccaagcagccagccag

SEQ ID NO: 2014619 - DNA, 18 bp, Homo sapiens
ccaagcagccagccagtc

SEQ ID NO: 2014620 - DNA, 22 bp, Homo sapiens
ccaagcataccaacacgagcag

SEQ ID NO: 2014621 - DNA, 21 bp, Homo sapiens
ccaagccccttggccctctcc

SEQ ID NO: 2014622 - DNA, 11 bp, Homo sapiens
ccaagcccttt

SEQ ID NO: 2014623 - DNA, 13 bp, Homo sapiens
ccaagccgtggct

SEQ ID NO: 2014624 - DNA, 15 bp, Homo sapiens
ccaagccgtggcttc

SEQ ID NO: 2014625 - DNA, 16 bp, Homo sapiens
ccaagccgtggcttcc

SEQ ID NO: 2014626 - DNA, 17 bp, Homo sapiens
ccaagccgtggcttccc

SEQ ID NO: 2014627 - DNA, 16 bp, Homo sapiens
ccaagcctctgcccca

SEQ ID NO: 2014628 - DNA, 22 bp, Homo sapiens
ccaagcctctgccccaaggggc

SEQ ID NO: 2014629 - DNA, 15 bp, Homo sapiens
ccaagcctggtctcc

SEQ ID NO: 2014630 - DNA, 20 bp, Homo sapiens
ccaagcgaggtcaacagaga

SEQ ID NO: 2014631 - DNA, 21 bp, Homo sapiens
ccaagcgaggtcaacagagaa

SEQ ID NO: 2014632 - DNA, 15 bp, Homo sapiens
ccaagcgtcccgtcc

SEQ ID NO: 2014633 - DNA, 12 bp, Homo sapiens
ccaagctgaggt

SEQ ID NO: 2014634 - DNA, 17 bp, Homo sapiens
ccaagctgaggtgccca

SEQ ID NO: 2014635 - DNA, 19 bp, Homo sapiens
ccaagctgaggtgcccagg

SEQ ID NO: 2014636 - DNA, 20 bp, Homo sapiens
ccaagctgaggtgcccagga

SEQ ID NO: 2014637 - DNA, 21 bp, Homo sapiens
ccaagctgaggtgcccaggag

SEQ ID NO: 2014638 - DNA, 22 bp, Homo sapiens
ccaagctggcagctgtcattca

SEQ ID NO: 2014639 - DNA, 12 bp, Homo sapiens
ccaagctggtcc

SEQ ID NO: 2014640 - DNA, 21 bp, Homo sapiens
ccaagctgttccacttctcta

SEQ ID NO: 2014641 - DNA, 14 bp, Homo sapiens
ccaagctgttttct

SEQ ID NO: 2014642 - DNA, 19 bp, Homo sapiens
ccaagcttcaaccctcagc

SEQ ID NO: 2014643 - DNA, 23 bp, Homo sapiens
ccaagcttcaaccctcagccttg

SEQ ID NO: 2014644 - DNA, 15 bp, Homo sapiens
ccaagcttcaagtga

SEQ ID NO: 2014645 - DNA, 19 bp, Homo sapiens
ccaagcttcaagtgatata

SEQ ID NO: 2014646 - DNA, 12 bp, Homo sapiens
ccaagcttcaga

SEQ ID NO: 2014647 - DNA, 14 bp, Homo sapiens
ccaagcttcagagc

SEQ ID NO: 2014648 - DNA, 18 bp, Homo sapiens
ccaagcttcagagcctag

SEQ ID NO: 2014649 - DNA, 18 bp, Homo sapiens
ccaagcttgtgagagctg

SEQ ID NO: 2014650 - DNA, 11 bp, Homo sapiens
ccaaggaacct

SEQ ID NO: 2014651 - DNA, 18 bp, Homo sapiens
ccaaggaacctaattgaa

SEQ ID NO: 2014652 - DNA, 13 bp, Homo sapiens
ccaaggaccaggt

SEQ ID NO: 2014653 - DNA, 16 bp, Homo sapiens
ccaaggactctggcct

SEQ ID NO: 2014654 - DNA, 17 bp, Homo sapiens
ccaaggactctggcctc

SEQ ID NO: 2014655 - DNA, 18 bp, Homo sapiens
ccacaggggcaggcctgg

SEQ ID NO: 2014656 - DNA, 23 bp, Homo sapiens
ccacaggtgtttatacagctcag

SEQ ID NO: 2014657 - DNA, 13 bp, Homo sapiens
ccacagtctccca

SEQ ID NO: 2014658 - DNA, 13 bp, Homo sapiens
ccacagtgctgct

SEQ ID NO: 2014659 - DNA, 20 bp, Homo sapiens
ccacagttgctgctcctttg

SEQ ID NO: 2014660 - DNA, 19 bp, Homo sapiens
ccacatacaacacaaagag

SEQ ID NO: 2014661 - DNA, 20 bp, Homo sapiens
ccacatacaacacaaagaga

SEQ ID NO: 2014662 - DNA, 15 bp, Homo sapiens
ccacatcccaggctt

SEQ ID NO: 2014663 - DNA, 18 bp, Homo sapiens
ccacatcccaggcttcac

SEQ ID NO: 2014664 - DNA, 15 bp, Homo sapiens
ccacatccctgggcc

SEQ ID NO: 2014665 - DNA, 17 bp, Homo sapiens
ccacatccctttgaaac

SEQ ID NO: 2014666 - DNA, 19 bp, Homo sapiens
ccacatcttgctctgctga

SEQ ID NO: 2014667 - DNA, 21 bp, Homo sapiens
ccacatgatcttgagatttct

SEQ ID NO: 2014668 - DNA, 15 bp, Homo sapiens
ccacatgtgacacat

SEQ ID NO: 2014669 - DNA, 21 bp, Homo sapiens
ccacattcggaccctgcccat

SEQ ID NO: 2014670 - DNA, 16 bp, Homo sapiens
ccacattggacttcct

SEQ ID NO: 2014671 - DNA, 18 bp, Homo sapiens
ccacattggacttccttg

SEQ ID NO: 2014672 - DNA, 21 bp, Homo sapiens
ccaccaacccatcagaaggag

SEQ ID NO: 2014673 - DNA, 15 bp, Homo sapiens
ccaccaaccctcaga

SEQ ID NO: 2014674 - DNA, 11 bp, Homo sapiens
ccaccaaggtc

SEQ ID NO: 2014675 - DNA, 17 bp, Homo sapiens
ccaccaaggtcttcagc

SEQ ID NO: 2014676 - DNA, 12 bp, Homo sapiens
ccaccaataaaa

SEQ ID NO: 2014677 - DNA, 12 bp, Homo sapiens
ccaccacctagg

SEQ ID NO: 2014678 - DNA, 22 bp, Homo sapiens
ccaccaccttggactcctccca

SEQ ID NO: 2014679 - DNA, 19 bp, Homo sapiens
ccaccacgatgtggccctg

SEQ ID NO: 2014680 - DNA, 16 bp, Homo sapiens
ccaccacgtctgccag

SEQ ID NO: 2014681 - DNA, 19 bp, Homo sapiens
ccaccacgtctgccaggcc

SEQ ID NO: 2014682 - DNA, 21 bp, Homo sapiens
ccaccacgtctgccaggccca

SEQ ID NO: 2014683 - DNA, 13 bp, Homo sapiens
ccaccagccacct

SEQ ID NO: 2014684 - DNA, 17 bp, Homo sapiens
ccaccagggcactgtct

SEQ ID NO: 2014685 - DNA, 22 bp, Homo sapiens
ccaccatattcagtgctgtggc

SEQ ID NO: 2014686 - DNA, 18 bp, Homo sapiens
ccaccatgcgctgctcaa

SEQ ID NO: 2014687 - DNA, 15 bp, Homo sapiens
ccacccaacagcacc

SEQ ID NO: 2014688 - DNA, 17 bp, Homo sapiens
ccacccaacagcaccaa

SEQ ID NO: 2014689 - DNA, 14 bp, Homo sapiens
ccacccaagtatac

SEQ ID NO: 2014690 - DNA, 14 bp, Homo sapiens
ccacccacctcagc

SEQ ID NO: 2014691 - DNA, 15 bp, Homo sapiens
ccacccactgtccgc

SEQ ID NO: 2014692 - DNA, 12 bp, Homo sapiens
ccacccaggctg

SEQ ID NO: 2014693 - DNA, 21 bp, Homo sapiens
ccacccaggctgcactgcagt

SEQ ID NO: 2014694 - DNA, 15 bp, Homo sapiens
ccacccagggctccc

SEQ ID NO: 2014695 - DNA, 23 bp, Homo sapiens
ccacccagggctccctcctggag

SEQ ID NO: 2014696 - DNA, 23 bp, Homo sapiens
ccacccaggggaatgatctctga

SEQ ID NO: 2014697 - DNA, 12 bp, Homo sapiens
ccacccagtgct

SEQ ID NO: 2014698 - DNA, 13 bp, Homo sapiens
ccacccagtgctg

SEQ ID NO: 2014699 - DNA, 15 bp, Homo sapiens
ccacccagtgctgcc

SEQ ID NO: 2014700 - DNA, 19 bp, Homo sapiens
ccacccagtgctgccatgc

SEQ ID NO: 2014701 - DNA, 21 bp, Homo sapiens
ccacccagtgctgccatgcca

SEQ ID NO: 2014702 - DNA, 18 bp, Homo sapiens
ccacccatcttcctgctg

SEQ ID NO: 2014703 - DNA, 19 bp, Homo sapiens
ccacccatcttcctgctgc

SEQ ID NO: 2014704 - DNA, 12 bp, Homo sapiens
ccaccccacgga

SEQ ID NO: 2014705 - DNA, 19 bp, Homo sapiens
ccaccccactccagccctg

SEQ ID NO: 2014706 - DNA, 13 bp, Homo sapiens
ccaccccaggacg

SEQ ID NO: 2014707 - DNA, 22 bp, Homo sapiens
ccaccccataatctcattcaaa

SEQ ID NO: 2014708 - DNA, 16 bp, Homo sapiens
ccacccccagccccga

SEQ ID NO: 2014709 - DNA, 14 bp, Homo sapiens
ccacccccgctggg

SEQ ID NO: 2014710 - DNA, 15 bp, Homo sapiens
ccacccccgctgggg

SEQ ID NO: 2014711 - DNA, 20 bp, Homo sapiens
ccacccccgctgggggtggg

SEQ ID NO: 2014712 - DNA, 19 bp, Homo sapiens
ccaccccctccccagggga

SEQ ID NO: 2014713 - DNA, 20 bp, Homo sapiens
ccacccccttcagtgcccac

SEQ ID NO: 2014714 - DNA, 22 bp, Homo sapiens
ccacccccttcagtgcccacca

SEQ ID NO: 2014715 - DNA, 17 bp, Homo sapiens
ccaccccggcctccact

SEQ ID NO: 2014716 - DNA, 13 bp, Homo sapiens
ccaccccttcctg

SEQ ID NO: 2014717 - DNA, 15 bp, Homo sapiens
ccaccccttcctgtc

SEQ ID NO: 2014718 - DNA, 16 bp, Homo sapiens
ccacccgtaggcagcc

SEQ ID NO: 2014719 - DNA, 20 bp, Homo sapiens
ccacccgtaggcagcctctc

SEQ ID NO: 2014720 - DNA, 23 bp, Homo sapiens
ccacccgtaggcagcctctctgc

SEQ ID NO: 2014721 - DNA, 18 bp, Homo sapiens
ccaccctaaaatgacagc

SEQ ID NO: 2014722 - DNA, 20 bp, Homo sapiens
ccaccctcgtggacacctgc

SEQ ID NO: 2014723 - DNA, 13 bp, Homo sapiens
ccaccctgctctc

SEQ ID NO: 2014724 - DNA, 11 bp, Homo sapiens
ccaccctggaa

SEQ ID NO: 2014725 - DNA, 16 bp, Homo sapiens
ccaccgaagagccctg

SEQ ID NO: 2014726 - DNA, 21 bp, Homo sapiens
ccaccgcaccgggccctcctt

SEQ ID NO: 2014727 - DNA, 15 bp, Homo sapiens
ccaccgcagaaggaa

SEQ ID NO: 2014728 - DNA, 13 bp, Homo sapiens
ccaccgccagagg

SEQ ID NO: 2014729 - DNA, 15 bp, Homo sapiens
ccaccgccagaggac

SEQ ID NO: 2014730 - DNA, 22 bp, Homo sapiens
ccaccgccagaggacaaggaag

SEQ ID NO: 2014731 - DNA, 13 bp, Homo sapiens
ccaccgctgccta

SEQ ID NO: 2014732 - DNA, 15 bp, Homo sapiens
ccaccgctgcctaag

SEQ ID NO: 2014733 - DNA, 21 bp, Homo sapiens
ccaccgctgcctaagtggctg

SEQ ID NO: 2014734 - DNA, 22 bp, Homo sapiens
ccaccgggacagacctggacac

SEQ ID NO: 2014735 - DNA, 16 bp, Homo sapiens
ccaccgggagcctccc

SEQ ID NO: 2014736 - DNA, 22 bp, Homo sapiens
cattttatctttgaatggtctt

SEQ ID NO: 2014737 - DNA, 12 bp, Homo sapiens
cattttcagagt

SEQ ID NO: 2014738 - DNA, 12 bp, Homo sapiens
cattttcccaga

SEQ ID NO: 2014739 - DNA, 21 bp, Homo sapiens
cattttcgctttcctctggtt

SEQ ID NO: 2014740 - DNA, 15 bp, Homo sapiens
cattttctctagctg

SEQ ID NO: 2014741 - DNA, 22 bp, Homo sapiens
cattttcttcagagagctaaat

SEQ ID NO: 2014742 - DNA, 19 bp, Homo sapiens
cattttctttctttttctg

SEQ ID NO: 2014743 - DNA, 20 bp, Homo sapiens
cattttgagtgactcgaggg

SEQ ID NO: 2014744 - DNA, 16 bp, Homo sapiens
cattttgcagcagtga

SEQ ID NO: 2014745 - DNA, 19 bp, Homo sapiens
cattttgcattagacagat

SEQ ID NO: 2014746 - DNA, 18 bp, Homo sapiens
cattttggaagttttcag

SEQ ID NO: 2014747 - DNA, 20 bp, Homo sapiens
cattttgggggtttttaatc

SEQ ID NO: 2014748 - DNA, 22 bp, Homo sapiens
cattttggggtacccactgctc

SEQ ID NO: 2014749 - DNA, 14 bp, Homo sapiens
cattttggtacttt

SEQ ID NO: 2014750 - DNA, 19 bp, Homo sapiens
cattttgtaacaaatgaac

SEQ ID NO: 2014751 - DNA, 23 bp, Homo sapiens
cattttgtacaaagatatgctaa

SEQ ID NO: 2014752 - DNA, 22 bp, Homo sapiens
cattttgtggtcattaagcatt

SEQ ID NO: 2014753 - DNA, 17 bp, Homo sapiens
catttttactaaagcag

SEQ ID NO: 2014754 - DNA, 19 bp, Homo sapiens
catttttactaaagcagtg

SEQ ID NO: 2014755 - DNA, 18 bp, Homo sapiens
catttttagtagagacag

SEQ ID NO: 2014756 - DNA, 19 bp, Homo sapiens
catttttagtagagacagg

SEQ ID NO: 2014757 - DNA, 17 bp, Homo sapiens
catttttgatttatgca

SEQ ID NO: 2014758 - DNA, 12 bp, Homo sapiens
ccaaaaatagct

SEQ ID NO: 2014759 - DNA, 13 bp, Homo sapiens
ccaaaagggcagc

SEQ ID NO: 2014760 - DNA, 17 bp, Homo sapiens
ccaaaagggcagccagg

SEQ ID NO: 2014761 - DNA, 20 bp, Homo sapiens
ccaaaagggcagccaggggc

SEQ ID NO: 2014762 - DNA, 17 bp, Homo sapiens
ccaaaagttacatgttt

SEQ ID NO: 2014763 - DNA, 16 bp, Homo sapiens
ccaaacacactgtaaa

SEQ ID NO: 2014764 - DNA, 14 bp, Homo sapiens
ccaaacaccggcag

SEQ ID NO: 2014765 - DNA, 12 bp, Homo sapiens
ccaaacactcca

SEQ ID NO: 2014766 - DNA, 13 bp, Homo sapiens
ccaaacactccac

SEQ ID NO: 2014767 - DNA, 13 bp, Homo sapiens
ccaaacatctggc

SEQ ID NO: 2014768 - DNA, 22 bp, Homo sapiens
ccaaacattaatcaccaaagta

SEQ ID NO: 2014769 - DNA, 13 bp, Homo sapiens
ccaaactcctgcc

SEQ ID NO: 2014770 - DNA, 14 bp, Homo sapiens
ccaaactcctgcct

SEQ ID NO: 2014771 - DNA, 19 bp, Homo sapiens
ccaaactgcacacacagct

SEQ ID NO: 2014772 - DNA, 15 bp, Homo sapiens
ccaaactgtgccctg

SEQ ID NO: 2014773 - DNA, 18 bp, Homo sapiens
ccaaactgtgccctgcct

SEQ ID NO: 2014774 - DNA, 19 bp, Homo sapiens
ccaaactgtgccctgcctt

SEQ ID NO: 2014775 - DNA, 16 bp, Homo sapiens
ccaaactgttcaagaa

SEQ ID NO: 2014776 - DNA, 22 bp, Homo sapiens
ccaaagaaaaagggctgccggg

SEQ ID NO: 2014777 - DNA, 17 bp, Homo sapiens
ccaaagaaatgtaaggg

SEQ ID NO: 2014778 - DNA, 13 bp, Homo sapiens
ccaaagagaaaag

SEQ ID NO: 2014779 - DNA, 13 bp, Homo sapiens
ccaaagcatggac

SEQ ID NO: 2014780 - DNA, 15 bp, Homo sapiens
ccaaagctaggcctg

SEQ ID NO: 2014781 - DNA, 21 bp, Homo sapiens
ccaaagctgttggtctgtccc

SEQ ID NO: 2014782 - DNA, 18 bp, Homo sapiens
ccaaaggaagtctaggag

SEQ ID NO: 2014783 - DNA, 22 bp, Homo sapiens
ccaaaggccctaccagagggaa

SEQ ID NO: 2014784 - DNA, 19 bp, Homo sapiens
ccaaaggggctgctggggc

SEQ ID NO: 2014785 - DNA, 14 bp, Homo sapiens
ccaaagtgcagccc

SEQ ID NO: 2014786 - DNA, 17 bp, Homo sapiens
ccaaataaatgtgtaaa

SEQ ID NO: 2014787 - DNA, 18 bp, Homo sapiens
ccaaataaatgtgtaaat

SEQ ID NO: 2014788 - DNA, 20 bp, Homo sapiens
ccaaataaatgtgtaaatgt

SEQ ID NO: 2014789 - DNA, 14 bp, Homo sapiens
ccaaatataaactt

SEQ ID NO: 2014790 - DNA, 20 bp, Homo sapiens
ccaaatattattcaagtgcc

SEQ ID NO: 2014791 - DNA, 16 bp, Homo sapiens
ccaaatgaatgacctt

SEQ ID NO: 2014792 - DNA, 17 bp, Homo sapiens
ccaaatgcatggtgcag

SEQ ID NO: 2014793 - DNA, 22 bp, Homo sapiens
ccaaatgctgtctccataatgc

SEQ ID NO: 2014794 - DNA, 16 bp, Homo sapiens
ccaaattccctggacc

SEQ ID NO: 2014795 - DNA, 20 bp, Homo sapiens
ccaaattgctgggattacag

SEQ ID NO: 2014796 - DNA, 14 bp, Homo sapiens
ccaaattgcttcta

SEQ ID NO: 2014797 - DNA, 16 bp, Homo sapiens
ccaaattggtgtttct

SEQ ID NO: 2014798 - DNA, 19 bp, Homo sapiens
ccaaatttatatgccaccg

SEQ ID NO: 2014799 - DNA, 16 bp, Homo sapiens
ccaacaaacctgcttg

SEQ ID NO: 2014800 - DNA, 21 bp, Homo sapiens
ccaacacgagcaggctactgt

SEQ ID NO: 2014801 - DNA, 16 bp, Homo sapiens
ccaacagcccccccct

SEQ ID NO: 2014802 - DNA, 17 bp, Homo sapiens
ccaacagctcagagatg

SEQ ID NO: 2014803 - DNA, 22 bp, Homo sapiens
ccaacagcttgaccagacctag

SEQ ID NO: 2014804 - DNA, 19 bp, Homo sapiens
ccaacaggtggcaggacca

SEQ ID NO: 2014805 - DNA, 23 bp, Homo sapiens
ccaacaggtggcaggaccaggac

SEQ ID NO: 2014806 - DNA, 12 bp, Homo sapiens
ccaacagttcct

SEQ ID NO: 2014807 - DNA, 15 bp, Homo sapiens
ccaacataaaaatga

SEQ ID NO: 2014808 - DNA, 19 bp, Homo sapiens
ccaacatacccttctttaa

SEQ ID NO: 2014809 - DNA, 17 bp, Homo sapiens
ccaacatcccattgccc

SEQ ID NO: 2014810 - DNA, 15 bp, Homo sapiens
ccaacatggtgaaac

SEQ ID NO: 2014811 - DNA, 21 bp, Homo sapiens
ccaacccaattcaggactggc

SEQ ID NO: 2014812 - DNA, 14 bp, Homo sapiens
ccaacccatcagaa

SEQ ID NO: 2014813 - DNA, 13 bp, Homo sapiens
ccaaccccagctg

SEQ ID NO: 2014814 - DNA, 14 bp, Homo sapiens
ccaaccccagctgg

SEQ ID NO: 2014815 - DNA, 15 bp, Homo sapiens
ccaaccccagctggc

SEQ ID NO: 2014816 - DNA, 23 bp, Homo sapiens
ccaaccccagggcccccacaggc

SEQ ID NO: 2014817 - DNA, 19 bp, Homo sapiens
ccaacccccgacttcatcc

SEQ ID NO: 2014818 - DNA, 14 bp, Homo sapiens
ccaacccgtggagg

SEQ ID NO: 2014819 - DNA, 20 bp, Homo sapiens
ccaacccgtggaggctgctc

SEQ ID NO: 2014820 - DNA, 16 bp, Homo sapiens
ccaaccctgtttcctg

SEQ ID NO: 2014821 - DNA, 18 bp, Homo sapiens
ccaaccctgtttcctgag

SEQ ID NO: 2014822 - DNA, 21 bp, Homo sapiens
ccaacctcaatgccctgccat

SEQ ID NO: 2014823 - DNA, 22 bp, Homo sapiens
ccaacctcaatgccctgccatt

SEQ ID NO: 2014824 - DNA, 19 bp, Homo sapiens
ccaacctgatgccccttcc

SEQ ID NO: 2014825 - DNA, 15 bp, Homo sapiens
ccaacctttccctca

SEQ ID NO: 2014826 - DNA, 19 bp, Homo sapiens
ccaacctttccctcacccc

SEQ ID NO: 2014827 - DNA, 15 bp, Homo sapiens
ccaactaagccctcg

SEQ ID NO: 2014828 - DNA, 18 bp, Homo sapiens
ccaactcctggagatttc

SEQ ID NO: 2014829 - DNA, 12 bp, Homo sapiens
ccaactccttcc

SEQ ID NO: 2014830 - DNA, 14 bp, Homo sapiens
ccaactccttccag

SEQ ID NO: 2014831 - DNA, 15 bp, Homo sapiens
ccaactccttccagc

SEQ ID NO: 2014832 - DNA, 14 bp, Homo sapiens
ccaactctgcactc

SEQ ID NO: 2014833 - DNA, 16 bp, Homo sapiens
ccaactctgcactcca

SEQ ID NO: 2014834 - DNA, 19 bp, Homo sapiens
ccaactcttcattttgagt

SEQ ID NO: 2014835 - DNA, 14 bp, Homo sapiens
ccaacttggctttc

SEQ ID NO: 2014836 - DNA, 17 bp, Homo sapiens
ccaacttgtaaatacac

SEQ ID NO: 2014837 - DNA, 14 bp, Homo sapiens
ccaactttctgtaa

SEQ ID NO: 2014838 - DNA, 17 bp, Homo sapiens
ccaactttctgtaaact

SEQ ID NO: 2014839 - DNA, 19 bp, Homo sapiens
ccaagaaaaggcatggaga

SEQ ID NO: 2014840 - DNA, 14 bp, Homo sapiens
ccaagaaagatcca

SEQ ID NO: 2014841 - DNA, 16 bp, Homo sapiens
ccaagaccccagcttc

SEQ ID NO: 2014842 - DNA, 20 bp, Homo sapiens
ccaagacttggcaacagaag

SEQ ID NO: 2014843 - DNA, 20 bp, Homo sapiens
ccaagagagggccatgcaat

SEQ ID NO: 2014844 - DNA, 16 bp, Homo sapiens
ccaagagcatcatgcc

SEQ ID NO: 2014845 - DNA, 18 bp, Homo sapiens
ccaagagcatcatgcctc

SEQ ID NO: 2014846 - DNA, 19 bp, Homo sapiens
ccaagagcatcatgcctct

SEQ ID NO: 2014847 - DNA, 17 bp, Homo sapiens
ccaagaggtctgagccc

SEQ ID NO: 2014848 - DNA, 17 bp, Homo sapiens
ccaagagtattccattt

SEQ ID NO: 2014849 - DNA, 16 bp, Homo sapiens
ccaagatcgcgccact

SEQ ID NO: 2014850 - DNA, 20 bp, Homo sapiens
ccaagatgatcacatggaag

SEQ ID NO: 2014851 - DNA, 20 bp, Homo sapiens
ccaagatgggcacatgagga

SEQ ID NO: 2014852 - DNA, 17 bp, Homo sapiens
ccaagattcaaagagac

SEQ ID NO: 2014853 - DNA, 20 bp, Homo sapiens
cattctcatatgtagccctc

SEQ ID NO: 2014854 - DNA, 16 bp, Homo sapiens
cattctcatctactca

SEQ ID NO: 2014855 - DNA, 13 bp, Homo sapiens
cattctcctgcct

SEQ ID NO: 2014856 - DNA, 20 bp, Homo sapiens
cattctctctcctgtccaac

SEQ ID NO: 2014857 - DNA, 16 bp, Homo sapiens
cattctcttatatagt

SEQ ID NO: 2014858 - DNA, 17 bp, Homo sapiens
cattctgaccatttcag

SEQ ID NO: 2014859 - DNA, 13 bp, Homo sapiens
cattctgagctgg

SEQ ID NO: 2014860 - DNA, 23 bp, Homo sapiens
cattctgattcgaatgacactgt

SEQ ID NO: 2014861 - DNA, 23 bp, Homo sapiens
cattcttaaaggaaaagtcaaca

SEQ ID NO: 2014862 - DNA, 21 bp, Homo sapiens
cattcttaagatttctcctga

SEQ ID NO: 2014863 - DNA, 20 bp, Homo sapiens
cattcttaccgagaaaagga

SEQ ID NO: 2014864 - DNA, 23 bp, Homo sapiens
cattcttaccgagaaaaggagaa

SEQ ID NO: 2014865 - DNA, 17 bp, Homo sapiens
cattcttcagtgcctag

SEQ ID NO: 2014866 - DNA, 13 bp, Homo sapiens
cattcttcctagt

SEQ ID NO: 2014867 - DNA, 21 bp, Homo sapiens
cattcttcctagttttctcct

SEQ ID NO: 2014868 - DNA, 23 bp, Homo sapiens
cattcttctgtacgtctgacagg

SEQ ID NO: 2014869 - DNA, 14 bp, Homo sapiens
cattcttgtcctgg

SEQ ID NO: 2014870 - DNA, 21 bp, Homo sapiens
cattgaacatttcttatgatt

SEQ ID NO: 2014871 - DNA, 22 bp, Homo sapiens
cattgaatggctatgtttttaa

SEQ ID NO: 2014872 - DNA, 21 bp, Homo sapiens
cattgaccaagatgatcacat

SEQ ID NO: 2014873 - DNA, 13 bp, Homo sapiens
cattgacctcagc

SEQ ID NO: 2014874 - DNA, 15 bp, Homo sapiens
cattgacctcagctg

SEQ ID NO: 2014875 - DNA, 22 bp, Homo sapiens
cattgagggaaaacataatatc

SEQ ID NO: 2014876 - DNA, 13 bp, Homo sapiens
cattgcctccacc

SEQ ID NO: 2014877 - DNA, 13 bp, Homo sapiens
cattgctgttgtt

SEQ ID NO: 2014878 - DNA, 18 bp, Homo sapiens
cattgcttattcttgagc

SEQ ID NO: 2014879 - DNA, 18 bp, Homo sapiens
cattgctttgaagcagtt

SEQ ID NO: 2014880 - DNA, 18 bp, Homo sapiens
cattggacccacatgagg

SEQ ID NO: 2014881 - DNA, 13 bp, Homo sapiens
cattgggagaagc

SEQ ID NO: 2014882 - DNA, 22 bp, Homo sapiens
cattgggctgacacctaccatg

SEQ ID NO: 2014883 - DNA, 18 bp, Homo sapiens
cattgggtgggtaaattc

SEQ ID NO: 2014884 - DNA, 16 bp, Homo sapiens
cattgggttttatcag

SEQ ID NO: 2014885 - DNA, 14 bp, Homo sapiens
cattggtctgctga

SEQ ID NO: 2014886 - DNA, 21 bp, Homo sapiens
cattgtaaatgtgcttttaaa

SEQ ID NO: 2014887 - DNA, 21 bp, Homo sapiens
cattgtagaaacacagttttg

SEQ ID NO: 2014888 - DNA, 19 bp, Homo sapiens
cattgtagagcttctggca

SEQ ID NO: 2014889 - DNA, 19 bp, Homo sapiens
cattgtagagcttggtggc

SEQ ID NO: 2014890 - DNA, 23 bp, Homo sapiens
cattgtagagcttggtggctgag

SEQ ID NO: 2014891 - DNA, 16 bp, Homo sapiens
cattgtatatatgtgt

SEQ ID NO: 2014892 - DNA, 17 bp, Homo sapiens
cattgtatatatgtgtg

SEQ ID NO: 2014893 - DNA, 22 bp, Homo sapiens
cattgtatatatgtgtgtttaa

SEQ ID NO: 2014894 - DNA, 18 bp, Homo sapiens
cattgtatgatgtgttgt

SEQ ID NO: 2014895 - DNA, 22 bp, Homo sapiens
cattgtatgatgtgttgtgata

SEQ ID NO: 2014896 - DNA, 17 bp, Homo sapiens
cattgtcttccaacccc

SEQ ID NO: 2014897 - DNA, 20 bp, Homo sapiens
cattgtcttccaaccccagc

SEQ ID NO: 2014898 - DNA, 22 bp, Homo sapiens
cattgtcttccaaccccagctg

SEQ ID NO: 2014899 - DNA, 17 bp, Homo sapiens
cattgtgtgagcttcta

SEQ ID NO: 2014900 - DNA, 18 bp, Homo sapiens
cattgttccttaccttta

SEQ ID NO: 2014901 - DNA, 17 bp, Homo sapiens
cattgttgctccctgtg

SEQ ID NO: 2014902 - DNA, 19 bp, Homo sapiens
catgcgtatatgtgcgtct

SEQ ID NO: 2014903 - DNA, 23 bp, Homo sapiens
catgctcagccctgactggtgct

SEQ ID NO: 2014904 - DNA, 20 bp, Homo sapiens
catgctctctgcagccagcc

SEQ ID NO: 2014905 - DNA, 21 bp, Homo sapiens
catgctctctgcagccagccc

SEQ ID NO: 2014906 - DNA, 13 bp, Homo sapiens
catgctctgcccc

SEQ ID NO: 2014907 - DNA, 18 bp, Homo sapiens
catgctctgccccaagcc

SEQ ID NO: 2014908 - DNA, 19 bp, Homo sapiens
catgctctgccccaagccc

SEQ ID NO: 2014909 - DNA, 13 bp, Homo sapiens
catgctctggaag

SEQ ID NO: 2014910 - DNA, 18 bp, Homo sapiens
catgctgaagggaccttg

SEQ ID NO: 2014911 - DNA, 15 bp, Homo sapiens
catgctgacttgcag

SEQ ID NO: 2014912 - DNA, 16 bp, Homo sapiens
catgctgacttgcaga

SEQ ID NO: 2014913 - DNA, 19 bp, Homo sapiens
catgctgctttttggcaca

SEQ ID NO: 2014914 - DNA, 21 bp, Homo sapiens
catgctgctttttggcacagt

SEQ ID NO: 2014915 - DNA, 16 bp, Homo sapiens
catgctggcctcccaa

SEQ ID NO: 2014916 - DNA, 20 bp, Homo sapiens
catgctggcctcccaataaa

SEQ ID NO: 2014917 - DNA, 23 bp, Homo sapiens
catgctggcggcgcagagggaag

SEQ ID NO: 2014918 - DNA, 15 bp, Homo sapiens
catgctgtgctcttt

SEQ ID NO: 2014919 - DNA, 15 bp, Homo sapiens
catgctttaaagtgt

SEQ ID NO: 2014920 - DNA, 23 bp, Homo sapiens
catgctttaaagtgtaataatat

SEQ ID NO: 2014921 - DNA, 21 bp, Homo sapiens
catgctttcccaccagcatgt

SEQ ID NO: 2014922 - DNA, 23 bp, Homo sapiens
catgctttccttttcttccttct

SEQ ID NO: 2014923 - DNA, 14 bp, Homo sapiens
catgctttctcctt

SEQ ID NO: 2014924 - DNA, 12 bp, Homo sapiens
catgctttggca

SEQ ID NO: 2014925 - DNA, 14 bp, Homo sapiens
catggaaaagccca

SEQ ID NO: 2014926 - DNA, 16 bp, Homo sapiens
catggaaaatgtcctg

SEQ ID NO: 2014927 - DNA, 18 bp, Homo sapiens
catggaaaatgtcctgtg

SEQ ID NO: 2014928 - DNA, 15 bp, Homo sapiens
catggaaggcggcac

SEQ ID NO: 2014929 - DNA, 19 bp, Homo sapiens
catggaatttgtaagttta

SEQ ID NO: 2014930 - DNA, 21 bp, Homo sapiens
catggacaatataaactgaaa

SEQ ID NO: 2014931 - DNA, 13 bp, Homo sapiens
catggacacagac

SEQ ID NO: 2014932 - DNA, 19 bp, Homo sapiens
catggacacagacccacac

SEQ ID NO: 2014933 - DNA, 14 bp, Homo sapiens
catggacacccctt

SEQ ID NO: 2014934 - DNA, 22 bp, Homo sapiens
catggacaccccttatccagga

SEQ ID NO: 2014935 - DNA, 22 bp, Homo sapiens
catggactctgggtttcatatc

SEQ ID NO: 2014936 - DNA, 12 bp, Homo sapiens
catggagaaaca

SEQ ID NO: 2014937 - DNA, 22 bp, Homo sapiens
catggagaagttgccaagagtt

SEQ ID NO: 2014938 - DNA, 21 bp, Homo sapiens
catggaggaggtgtcccaagc

SEQ ID NO: 2014939 - DNA, 20 bp, Homo sapiens
catggatatccacgcagcag

SEQ ID NO: 2014940 - DNA, 13 bp, Homo sapiens
catggatgcacac

SEQ ID NO: 2014941 - DNA, 21 bp, Homo sapiens
catggcagaataatctttggg

SEQ ID NO: 2014942 - DNA, 20 bp, Homo sapiens
catggcagcatggagagcct

SEQ ID NO: 2014943 - DNA, 18 bp, Homo sapiens
catggcccaaatccagtg

SEQ ID NO: 2014944 - DNA, 16 bp, Homo sapiens
catggcctatgcacat

SEQ ID NO: 2014945 - DNA, 18 bp, Homo sapiens
catggcctctggccaggc

SEQ ID NO: 2014946 - DNA, 13 bp, Homo sapiens
catggccttccct

SEQ ID NO: 2014947 - DNA, 14 bp, Homo sapiens
catggccttccctc

SEQ ID NO: 2014948 - DNA, 17 bp, Homo sapiens
catggcgtaatgggcct

SEQ ID NO: 2014949 - DNA, 18 bp, Homo sapiens
catggcgtaatgggcctg

SEQ ID NO: 2014950 - DNA, 21 bp, Homo sapiens
catggcgtaatgggcctgccc

SEQ ID NO: 2014951 - DNA, 23 bp, Homo sapiens
catggcgtaatgggcctgcccaa

SEQ ID NO: 2014952 - DNA, 19 bp, Homo sapiens
catggcgtgtccctctcgg

SEQ ID NO: 2014953 - DNA, 14 bp, Homo sapiens
catggctgtgagga

SEQ ID NO: 2014954 - DNA, 23 bp, Homo sapiens
catggctgtggttcctaagcctg

SEQ ID NO: 2014955 - DNA, 15 bp, Homo sapiens
catggcttaatgttt

SEQ ID NO: 2014956 - DNA, 20 bp, Homo sapiens
catggcttaatgtttattcc

SEQ ID NO: 2014957 - DNA, 11 bp, Homo sapiens
cattacatgtt

SEQ ID NO: 2014958 - DNA, 23 bp, Homo sapiens
cattacatgtttaaattgtaaat

SEQ ID NO: 2014959 - DNA, 16 bp, Homo sapiens
cattacgtgagccagg

SEQ ID NO: 2014960 - DNA, 13 bp, Homo sapiens
cattactgcatgc

SEQ ID NO: 2014961 - DNA, 17 bp, Homo sapiens
cattactgcctttggaa

SEQ ID NO: 2014962 - DNA, 14 bp, Homo sapiens
cattacttgcacaa

SEQ ID NO: 2014963 - DNA, 20 bp, Homo sapiens
cattacttgcacaagcttgt

SEQ ID NO: 2014964 - DNA, 22 bp, Homo sapiens
cattacttgcacaagcttgtat

SEQ ID NO: 2014965 - DNA, 23 bp, Homo sapiens
cattacttgcacaagcttgtata

SEQ ID NO: 2014966 - DNA, 18 bp, Homo sapiens
cattagaaattagctgtg

SEQ ID NO: 2014967 - DNA, 16 bp, Homo sapiens
cattagactggaactt

SEQ ID NO: 2014968 - DNA, 19 bp, Homo sapiens
cattagagcccatttcaat

SEQ ID NO: 2014969 - DNA, 18 bp, Homo sapiens
cattagcagtttgctttg

SEQ ID NO: 2014970 - DNA, 22 bp, Homo sapiens
cattaggaacagagtatatatg

SEQ ID NO: 2014971 - DNA, 18 bp, Homo sapiens
cattataactgaaggaga

SEQ ID NO: 2014972 - DNA, 18 bp, Homo sapiens
cattatcgggagcagtgt

SEQ ID NO: 2014973 - DNA, 22 bp, Homo sapiens
cattatgatgtgggtcaaggaa

SEQ ID NO: 2014974 - DNA, 15 bp, Homo sapiens
cattatgtagaaata

SEQ ID NO: 2014975 - DNA, 19 bp, Homo sapiens
cattatgtgtgcatgtgtg

SEQ ID NO: 2014976 - DNA, 14 bp, Homo sapiens
cattattcctccag

SEQ ID NO: 2014977 - DNA, 14 bp, Homo sapiens
cattatttaatgtt

SEQ ID NO: 2014978 - DNA, 15 bp, Homo sapiens
cattatttaatgttt

SEQ ID NO: 2014979 - DNA, 16 bp, Homo sapiens
cattatttaatgtttg

SEQ ID NO: 2014980 - DNA, 23 bp, Homo sapiens
cattatttcaaccgcttgccata

SEQ ID NO: 2014981 - DNA, 19 bp, Homo sapiens
cattatttgcatgttacct

SEQ ID NO: 2014982 - DNA, 23 bp, Homo sapiens
cattcaactttagtatttttact

SEQ ID NO: 2014983 - DNA, 18 bp, Homo sapiens
cattcaatatctgacagt

SEQ ID NO: 2014984 - DNA, 13 bp, Homo sapiens
cattcacagagcc

SEQ ID NO: 2014985 - DNA, 19 bp, Homo sapiens
cattcacatttgatgtaca

SEQ ID NO: 2014986 - DNA, 18 bp, Homo sapiens
cattcagaagaaaaagaa

SEQ ID NO: 2014987 - DNA, 16 bp, Homo sapiens
cattcagcacacccca

SEQ ID NO: 2014988 - DNA, 23 bp, Homo sapiens
cattcaggaaaactgacagagga

SEQ ID NO: 2014989 - DNA, 14 bp, Homo sapiens
cattcaggcagcac

SEQ ID NO: 2014990 - DNA, 19 bp, Homo sapiens
cattcaggtgttctcttct

SEQ ID NO: 2014991 - DNA, 18 bp, Homo sapiens
cattcagtatataaaata

SEQ ID NO: 2014992 - DNA, 23 bp, Homo sapiens
cattcagtccgcctggccggctc

SEQ ID NO: 2014993 - DNA, 14 bp, Homo sapiens
cattcagtgagaca

SEQ ID NO: 2014994 - DNA, 19 bp, Homo sapiens
cattcatccagttgcaata

SEQ ID NO: 2014995 - DNA, 18 bp, Homo sapiens
cattccaacaatggggtg

SEQ ID NO: 2014996 - DNA, 22 bp, Homo sapiens
cattccaccttcccatgccctg

SEQ ID NO: 2014997 - DNA, 11 bp, Homo sapiens
cattccatgat

SEQ ID NO: 2014998 - DNA, 14 bp, Homo sapiens
cattccatgatttt

SEQ ID NO: 2014999 - DNA, 20 bp, Homo sapiens
cattcccattggttctccta

SEQ ID NO: 2015000 - DNA, 18 bp, Homo sapiens
cattcccccatgtggctg

SEQ ID NO: 2015001 - DNA, 15 bp, Homo sapiens
cattccctatcaaaa

SEQ ID NO: 2015002 - DNA, 17 bp, Homo sapiens
cattccctatcaaaaca

SEQ ID NO: 2015003 - DNA, 23 bp, Homo sapiens
cattccctatcaaaacatatcaa

SEQ ID NO: 2015004 - DNA, 17 bp, Homo sapiens
cattccctgagtcacca

SEQ ID NO: 2015005 - DNA, 20 bp, Homo sapiens
cattccctgagtcaccagga

SEQ ID NO: 2015006 - DNA, 20 bp, Homo sapiens
cattcccttggatgtagtct

SEQ ID NO: 2015007 - DNA, 23 bp, Homo sapiens
cattcccttggatgtagtctgag

SEQ ID NO: 2015008 - DNA, 20 bp, Homo sapiens
cattcctagagagcagaaat

SEQ ID NO: 2015009 - DNA, 15 bp, Homo sapiens
cattcctcagctgcc

SEQ ID NO: 2015010 - DNA, 23 bp, Homo sapiens
cattcctcagggacagagacacc

SEQ ID NO: 2015011 - DNA, 19 bp, Homo sapiens
cattcctgaaagaaacagt

SEQ ID NO: 2015012 - DNA, 12 bp, Homo sapiens
cattcctggccc

SEQ ID NO: 2015013 - DNA, 13 bp, Homo sapiens
cattcctggcccc

SEQ ID NO: 2015014 - DNA, 18 bp, Homo sapiens
cattcgaggtgtcaccct

SEQ ID NO: 2015015 - DNA, 20 bp, Homo sapiens
cattcgaggtgtcaccctgc

SEQ ID NO: 2015016 - DNA, 19 bp, Homo sapiens
cattcggaccctgcccata

SEQ ID NO: 2015017 - DNA, 20 bp, Homo sapiens
cattcgtctgtcccagagct

SEQ ID NO: 2015018 - DNA, 13 bp, Homo sapiens
cattctagatgct

SEQ ID NO: 2015019 - DNA, 16 bp, Homo sapiens
cattctcactcctacc

SEQ ID NO: 2015020 - DNA, 19 bp, Homo sapiens
catatgtagactatataca

SEQ ID NO: 2015021 - DNA, 20 bp, Homo sapiens
catatgtagactatatacat

SEQ ID NO: 2015022 - DNA, 17 bp, Homo sapiens
catatgtgaatatggac

SEQ ID NO: 2015023 - DNA, 15 bp, Homo sapiens
catatgttacactaa

SEQ ID NO: 2015024 - DNA, 13 bp, Homo sapiens
catattaaaggct

SEQ ID NO: 2015025 - DNA, 16 bp, Homo sapiens
catattataaataaat

SEQ ID NO: 2015026 - DNA, 19 bp, Homo sapiens
catattataaataaatgcc

SEQ ID NO: 2015027 - DNA, 14 bp, Homo sapiens
catattcacacctc

SEQ ID NO: 2015028 - DNA, 21 bp, Homo sapiens
catattctagtgtaacactgc

SEQ ID NO: 2015029 - DNA, 18 bp, Homo sapiens
catattctgttggccagt

SEQ ID NO: 2015030 - DNA, 17 bp, Homo sapiens
catattcttggagaact

SEQ ID NO: 2015031 - DNA, 16 bp, Homo sapiens
catattgaatgtttcc

SEQ ID NO: 2015032 - DNA, 14 bp, Homo sapiens
catattggtattca

SEQ ID NO: 2015033 - DNA, 13 bp, Homo sapiens
catattgtatgta

SEQ ID NO: 2015034 - DNA, 14 bp, Homo sapiens
catattgtatgtaa

SEQ ID NO: 2015035 - DNA, 22 bp, Homo sapiens
catatttatagcaatccatgtt

SEQ ID NO: 2015036 - DNA, 23 bp, Homo sapiens
catatttatattgtatattctgg

SEQ ID NO: 2015037 - DNA, 21 bp, Homo sapiens
catatttgttaaatatttaca

SEQ ID NO: 2015038 - DNA, 13 bp, Homo sapiens
catattttgtata

SEQ ID NO: 2015039 - DNA, 20 bp, Homo sapiens
catcaaatgctgtagaatgc

SEQ ID NO: 2015040 - DNA, 19 bp, Homo sapiens
catcaagaaggtagcttga

SEQ ID NO: 2015041 - DNA, 12 bp, Homo sapiens
catcaatttaaa

SEQ ID NO: 2015042 - DNA, 18 bp, Homo sapiens
catcaattttcacttgct

SEQ ID NO: 2015043 - DNA, 17 bp, Homo sapiens
catcaatttttatacat

SEQ ID NO: 2015044 - DNA, 23 bp, Homo sapiens
catcaatttttatacatatcaga

SEQ ID NO: 2015045 - DNA, 17 bp, Homo sapiens
catcacagcagaatgaa

SEQ ID NO: 2015046 - DNA, 22 bp, Homo sapiens
catcacaggacacggggcagtg

SEQ ID NO: 2015047 - DNA, 13 bp, Homo sapiens
catcacagggcag

SEQ ID NO: 2015048 - DNA, 15 bp, Homo sapiens
catcacagggcagag

SEQ ID NO: 2015049 - DNA, 20 bp, Homo sapiens
catcacagggcagagccggg

SEQ ID NO: 2015050 - DNA, 14 bp, Homo sapiens
catcacccagtcct

SEQ ID NO: 2015051 - DNA, 13 bp, Homo sapiens
catcacctcaggc

SEQ ID NO: 2015052 - DNA, 13 bp, Homo sapiens
catcacctctgta

SEQ ID NO: 2015053 - DNA, 19 bp, Homo sapiens
catcacttgtacaaaataa

SEQ ID NO: 2015054 - DNA, 21 bp, Homo sapiens
catcagaaagggagggctctg

SEQ ID NO: 2015055 - DNA, 13 bp, Homo sapiens
catcagaagataa

SEQ ID NO: 2015056 - DNA, 15 bp, Homo sapiens
catcagaaggagaag

SEQ ID NO: 2015057 - DNA, 23 bp, Homo sapiens
catcagaaggagaaggaaggaga

SEQ ID NO: 2015058 - DNA, 20 bp, Homo sapiens
catcagcatacctttattgt

SEQ ID NO: 2015059 - DNA, 14 bp, Homo sapiens
catcagctcccttt

SEQ ID NO: 2015060 - DNA, 15 bp, Homo sapiens
catcagctgctgaaa

SEQ ID NO: 2015061 - DNA, 17 bp, Homo sapiens
catcagctgctgaaaca

SEQ ID NO: 2015062 - DNA, 14 bp, Homo sapiens
catcaggcactggt

SEQ ID NO: 2015063 - DNA, 16 bp, Homo sapiens
catcaggttccatccc

SEQ ID NO: 2015064 - DNA, 21 bp, Homo sapiens
catcatacgcatggtcctgga

SEQ ID NO: 2015065 - DNA, 15 bp, Homo sapiens
catcatatgaatgtt

SEQ ID NO: 2015066 - DNA, 13 bp, Homo sapiens
catcatcccagct

SEQ ID NO: 2015067 - DNA, 17 bp, Homo sapiens
catcatgaccagcaaat

SEQ ID NO: 2015068 - DNA, 15 bp, Homo sapiens
catcatgcctctgag

SEQ ID NO: 2015069 - DNA, 16 bp, Homo sapiens
catcatgcctctgagg

SEQ ID NO: 2015070 - DNA, 18 bp, Homo sapiens
catcatgcctctgaggcc

SEQ ID NO: 2015071 - DNA, 20 bp, Homo sapiens
catcatgcctctgaggccag

SEQ ID NO: 2015072 - DNA, 17 bp, Homo sapiens
catcattccttgagaaa

SEQ ID NO: 2015073 - DNA, 14 bp, Homo sapiens
catcattgtatata

SEQ ID NO: 2015074 - DNA, 15 bp, Homo sapiens
catcattgtatatat

SEQ ID NO: 2015075 - DNA, 19 bp, Homo sapiens
catcattgtatatatgtgt

SEQ ID NO: 2015076 - DNA, 19 bp, Homo sapiens
catccaaccccccacctgc

SEQ ID NO: 2015077 - DNA, 21 bp, Homo sapiens
catccaaccccccacctgcca

SEQ ID NO: 2015078 - DNA, 15 bp, Homo sapiens
catccaaggaaccta

SEQ ID NO: 2015079 - DNA, 14 bp, Homo sapiens
catccaaggagaaa

SEQ ID NO: 2015080 - DNA, 21 bp, Homo sapiens
catccaaggagaaacagagac

SEQ ID NO: 2015081 - DNA, 23 bp, Homo sapiens
catccaaggagaaacagagacag

SEQ ID NO: 2015082 - DNA, 15 bp, Homo sapiens
catccaatgcatagt

SEQ ID NO: 2015083 - DNA, 16 bp, Homo sapiens
catccacccagtgctg

SEQ ID NO: 2015084 - DNA, 20 bp, Homo sapiens
catccacccagtgctgccat

SEQ ID NO: 2015085 - DNA, 21 bp, Homo sapiens
catccacccagtgctgccatg

SEQ ID NO: 2015086 - DNA, 22 bp, Homo sapiens
catccacccagtgctgccatgc

SEQ ID NO: 2015087 - DNA, 17 bp, Homo sapiens
catccactgtgccatgt

SEQ ID NO: 2015088 - DNA, 14 bp, Homo sapiens
catccagtttgttc

SEQ ID NO: 2015089 - DNA, 16 bp, Homo sapiens
catccataaagcaagc

SEQ ID NO: 2015090 - DNA, 20 bp, Homo sapiens
catccatgtcctatgtgtga

SEQ ID NO: 2015091 - DNA, 15 bp, Homo sapiens
catccatgtttgtaa

SEQ ID NO: 2015092 - DNA, 19 bp, Homo sapiens
catccatgtttgtaaaact

SEQ ID NO: 2015093 - DNA, 18 bp, Homo sapiens
catccattcccaagaaat

SEQ ID NO: 2015094 - DNA, 16 bp, Homo sapiens
catccattcctcaggg

SEQ ID NO: 2015095 - DNA, 17 bp, Homo sapiens
catccattcctcaggga

SEQ ID NO: 2015096 - DNA, 18 bp, Homo sapiens
catccattcctcagggac

SEQ ID NO: 2015097 - DNA, 12 bp, Homo sapiens
catcccacatga

SEQ ID NO: 2015098 - DNA, 20 bp, Homo sapiens
catcccagccccaattttct

SEQ ID NO: 2015099 - DNA, 22 bp, Homo sapiens
catcccaggaggggcctctgaa

SEQ ID NO: 2015100 - DNA, 12 bp, Homo sapiens
catcccatccct

SEQ ID NO: 2015101 - DNA, 17 bp, Homo sapiens
catcccattgccctggt

SEQ ID NO: 2015102 - DNA, 12 bp, Homo sapiens
catccccacctt

SEQ ID NO: 2015103 - DNA, 14 bp, Homo sapiens
catccccaggtctc

SEQ ID NO: 2015104 - DNA, 17 bp, Homo sapiens
catcccccactgccaca

SEQ ID NO: 2015105 - DNA, 19 bp, Homo sapiens
catcccccactgccacacc

SEQ ID NO: 2015106 - DNA, 16 bp, Homo sapiens
catcccccagcactga

SEQ ID NO: 2015107 - DNA, 17 bp, Homo sapiens
catcccctcgtcctgtc

SEQ ID NO: 2015108 - DNA, 18 bp, Homo sapiens
catcccctcgtcctgtcc

SEQ ID NO: 2015109 - DNA, 19 bp, Homo sapiens
catcccctcgtcctgtccc

SEQ ID NO: 2015110 - DNA, 20 bp, Homo sapiens
catcccctcgtcctgtccca

SEQ ID NO: 2015111 - DNA, 13 bp, Homo sapiens
catcccctttcct

SEQ ID NO: 2015112 - DNA, 15 bp, Homo sapiens
catcccctttcctcc

SEQ ID NO: 2015113 - DNA, 15 bp, Homo sapiens
catcccgctcctgct

SEQ ID NO: 2015114 - DNA, 14 bp, Homo sapiens
catcccggcctctt

SEQ ID NO: 2015115 - DNA, 21 bp, Homo sapiens
catcccggcctcttccaccca

SEQ ID NO: 2015116 - DNA, 19 bp, Homo sapiens
catccctgggcccctccac

SEQ ID NO: 2015117 - DNA, 15 bp, Homo sapiens
catccctgggcctgc

SEQ ID NO: 2015118 - DNA, 17 bp, Homo sapiens
catccctgggcctgctg

SEQ ID NO: 2015119 - DNA, 18 bp, Homo sapiens
catccctgggcctgctgc

SEQ ID NO: 2015120 - DNA, 19 bp, Homo sapiens
catccctgggcctgctgct

SEQ ID NO: 2015121 - DNA, 17 bp, Homo sapiens
catcccttcctccccag

SEQ ID NO: 2015122 - DNA, 13 bp, Homo sapiens
catccctttccag

SEQ ID NO: 2015123 - DNA, 22 bp, Homo sapiens
catccgaggcagggtcaggaga

SEQ ID NO: 2015124 - DNA, 23 bp, Homo sapiens
catccgaggcagggtcaggagag

SEQ ID NO: 2015125 - DNA, 15 bp, Homo sapiens
catccgggacgcttc

SEQ ID NO: 2015126 - DNA, 16 bp, Homo sapiens
catcctgccttcatgg

SEQ ID NO: 2015127 - DNA, 15 bp, Homo sapiens
catcctggcacccgg

SEQ ID NO: 2015128 - DNA, 22 bp, Homo sapiens
catcctggcacccggcccctgc

SEQ ID NO: 2015129 - DNA, 16 bp, Homo sapiens
catcctggcctccttt

SEQ ID NO: 2015130 - DNA, 17 bp, Homo sapiens
catcctggcctcctttt

SEQ ID NO: 2015131 - DNA, 13 bp, Homo sapiens
catcctgggcctt

SEQ ID NO: 2015132 - DNA, 17 bp, Homo sapiens
catcctgtgtggggagg

SEQ ID NO: 2015133 - DNA, 22 bp, Homo sapiens
catccttcaagaactctgggct

SEQ ID NO: 2015134 - DNA, 21 bp, Homo sapiens
catccttcaccagagcccatg

SEQ ID NO: 2015135 - DNA, 18 bp, Homo sapiens
catgatctccctgccgcc

SEQ ID NO: 2015136 - DNA, 20 bp, Homo sapiens
catgatctgactttaattgt

SEQ ID NO: 2015137 - DNA, 15 bp, Homo sapiens
catgatgagctcctc

SEQ ID NO: 2015138 - DNA, 19 bp, Homo sapiens
catgatgagctcctcttcc

SEQ ID NO: 2015139 - DNA, 13 bp, Homo sapiens
catgattcatttt

SEQ ID NO: 2015140 - DNA, 21 bp, Homo sapiens
catgattggtttctaggcagt

SEQ ID NO: 2015141 - DNA, 19 bp, Homo sapiens
catgatttagggaagcagg

SEQ ID NO: 2015142 - DNA, 20 bp, Homo sapiens
catgatttatatatggcata

SEQ ID NO: 2015143 - DNA, 18 bp, Homo sapiens
catgattttaagaggctt

SEQ ID NO: 2015144 - DNA, 13 bp, Homo sapiens
catgattttacag

SEQ ID NO: 2015145 - DNA, 14 bp, Homo sapiens
catgattttataca

SEQ ID NO: 2015146 - DNA, 16 bp, Homo sapiens
catgattttatacata

SEQ ID NO: 2015147 - DNA, 12 bp, Homo sapiens
catgcaataatg

SEQ ID NO: 2015148 - DNA, 17 bp, Homo sapiens
catgcaataatgtgcaa

SEQ ID NO: 2015149 - DNA, 19 bp, Homo sapiens
catgcaataatgtgcaaat

SEQ ID NO: 2015150 - DNA, 19 bp, Homo sapiens
catgcacacaaacacctcc

SEQ ID NO: 2015151 - DNA, 20 bp, Homo sapiens
catgcacacaaacacctcct

SEQ ID NO: 2015152 - DNA, 12 bp, Homo sapiens
catgcacagctg

SEQ ID NO: 2015153 - DNA, 13 bp, Homo sapiens
catgcacagctgc

SEQ ID NO: 2015154 - DNA, 23 bp, Homo sapiens
catgcacagctgcttgtcctgct

SEQ ID NO: 2015155 - DNA, 13 bp, Homo sapiens
catgcacatttat

SEQ ID NO: 2015156 - DNA, 17 bp, Homo sapiens
catgcacatttatatat

SEQ ID NO: 2015157 - DNA, 12 bp, Homo sapiens
catgcactgacc

SEQ ID NO: 2015158 - DNA, 20 bp, Homo sapiens
catgcactgacccttccaga

SEQ ID NO: 2015159 - DNA, 17 bp, Homo sapiens
catgcagactcctcaga

SEQ ID NO: 2015160 - DNA, 17 bp, Homo sapiens
catgcagccactgtgct

SEQ ID NO: 2015161 - DNA, 22 bp, Homo sapiens
catgcagcctaaggctgtatga

SEQ ID NO: 2015162 - DNA, 18 bp, Homo sapiens
catgcagcttcatcaatt

SEQ ID NO: 2015163 - DNA, 23 bp, Homo sapiens
catgcagcttcatcaatttttat

SEQ ID NO: 2015164 - DNA, 21 bp, Homo sapiens
catgcatcacggatcaataga

SEQ ID NO: 2015165 - DNA, 17 bp, Homo sapiens
catgcattactgcatgc

SEQ ID NO: 2015166 - DNA, 20 bp, Homo sapiens
catgcattactgcatgcact

SEQ ID NO: 2015167 - DNA, 14 bp, Homo sapiens
catgccactgccag

SEQ ID NO: 2015168 - DNA, 19 bp, Homo sapiens
catgccactgccaggcacc

SEQ ID NO: 2015169 - DNA, 20 bp, Homo sapiens
catgccactgccaggcacct

SEQ ID NO: 2015170 - DNA, 23 bp, Homo sapiens
catgccactgccaggcacctggc

SEQ ID NO: 2015171 - DNA, 19 bp, Homo sapiens
catgccagagcctggggca

SEQ ID NO: 2015172 - DNA, 18 bp, Homo sapiens
catgccagcttcctgtgg

SEQ ID NO: 2015173 - DNA, 16 bp, Homo sapiens
catgccaggctaattt

SEQ ID NO: 2015174 - DNA, 18 bp, Homo sapiens
catgccaggctaattttt

SEQ ID NO: 2015175 - DNA, 22 bp, Homo sapiens
catgccagggattgaggaggac

SEQ ID NO: 2015176 - DNA, 21 bp, Homo sapiens
catgccaggttaggaaggcag

SEQ ID NO: 2015177 - DNA, 10 bp, Homo sapiens
catgccatct

SEQ ID NO: 2015178 - DNA, 23 bp, Homo sapiens
catgccatctccaccctgagcct

SEQ ID NO: 2015179 - DNA, 18 bp, Homo sapiens
catgccatttgtactgac

SEQ ID NO: 2015180 - DNA, 13 bp, Homo sapiens
catgcccaaccta

SEQ ID NO: 2015181 - DNA, 20 bp, Homo sapiens
catgccgcggtaggtaaggg

SEQ ID NO: 2015182 - DNA, 17 bp, Homo sapiens
catgcctcagtttcccc

SEQ ID NO: 2015183 - DNA, 15 bp, Homo sapiens
catgcctcatgccac

SEQ ID NO: 2015184 - DNA, 15 bp, Homo sapiens
catgcctctgaggcc

SEQ ID NO: 2015185 - DNA, 16 bp, Homo sapiens
catgcctctgaggcca

SEQ ID NO: 2015186 - DNA, 20 bp, Homo sapiens
catgcctctgaggccagcct

SEQ ID NO: 2015187 - DNA, 23 bp, Homo sapiens
catgcctctgaggccagcctggc

SEQ ID NO: 2015188 - DNA, 13 bp, Homo sapiens
catgcctgagggt

SEQ ID NO: 2015189 - DNA, 15 bp, Homo sapiens
catgcctgagggtgg

SEQ ID NO: 2015190 - DNA, 13 bp, Homo sapiens
catgcctgcctga

SEQ ID NO: 2015191 - DNA, 23 bp, Homo sapiens
catgcctggcccccctccaggca

SEQ ID NO: 2015192 - DNA, 19 bp, Homo sapiens
cagctcacctctgaaggca

SEQ ID NO: 2015193 - DNA, 14 bp, Homo sapiens
cagctcactccctg

SEQ ID NO: 2015194 - DNA, 15 bp, Homo sapiens
cagctcactccctgg

SEQ ID NO: 2015195 - DNA, 16 bp, Homo sapiens
cagctcactccctggg

SEQ ID NO: 2015196 - DNA, 18 bp, Homo sapiens
cagctcagaggcccagga

SEQ ID NO: 2015197 - DNA, 15 bp, Homo sapiens
cagctcagcctcccc

SEQ ID NO: 2015198 - DNA, 23 bp, Homo sapiens
cagctcaggcacacttcttcttg

SEQ ID NO: 2015199 - DNA, 16 bp, Homo sapiens
cagctccaacagcttg

SEQ ID NO: 2015200 - DNA, 23 bp, Homo sapiens
cagctccaacagcttgaccagac

SEQ ID NO: 2015201 - DNA, 16 bp, Homo sapiens
cagctccagaatacct

SEQ ID NO: 2015202 - DNA, 13 bp, Homo sapiens
cagctccagctca

SEQ ID NO: 2015203 - DNA, 10 bp, Homo sapiens
cagctccagt

SEQ ID NO: 2015204 - DNA, 23 bp, Homo sapiens
cagctcccaccccacccccttca

SEQ ID NO: 2015205 - DNA, 14 bp, Homo sapiens
cagctccccaggac

SEQ ID NO: 2015206 - DNA, 23 bp, Homo sapiens
cagctccccaggactcaccctca

SEQ ID NO: 2015207 - DNA, 18 bp, Homo sapiens
cagctcccctcggagaag

SEQ ID NO: 2015208 - DNA, 15 bp, Homo sapiens
cagctccctaggaga

SEQ ID NO: 2015209 - DNA, 20 bp, Homo sapiens
cagctccctagtggcttcct

SEQ ID NO: 2015210 - DNA, 20 bp, Homo sapiens
cagctcccttcccctgcctg

SEQ ID NO: 2015211 - DNA, 14 bp, Homo sapiens
cagctcctctcctt

SEQ ID NO: 2015212 - DNA, 17 bp, Homo sapiens
cagctcctctccttggg

SEQ ID NO: 2015213 - DNA, 19 bp, Homo sapiens
cagctcctctccttgggct

SEQ ID NO: 2015214 - DNA, 14 bp, Homo sapiens
cagctcctctgtct

SEQ ID NO: 2015215 - DNA, 15 bp, Homo sapiens
cagctcctctgtctc

SEQ ID NO: 2015216 - DNA, 20 bp, Homo sapiens
cagctctagacactgccaca

SEQ ID NO: 2015217 - DNA, 20 bp, Homo sapiens
cagctctgacattctgattc

SEQ ID NO: 2015218 - DNA, 16 bp, Homo sapiens
cagctctgctttttcc

SEQ ID NO: 2015219 - DNA, 12 bp, Homo sapiens
cagctctgtcct

SEQ ID NO: 2015220 - DNA, 16 bp, Homo sapiens
cagctctgtcctggga

SEQ ID NO: 2015221 - DNA, 18 bp, Homo sapiens
cagctctgtcctgggagt

SEQ ID NO: 2015222 - DNA, 13 bp, Homo sapiens
cagctctgtggcc

SEQ ID NO: 2015223 - DNA, 17 bp, Homo sapiens
cagctctgtggcctgtg

SEQ ID NO: 2015224 - DNA, 16 bp, Homo sapiens
cagctcttcactcagc

SEQ ID NO: 2015225 - DNA, 17 bp, Homo sapiens
cagctcttcactcagcc

SEQ ID NO: 2015226 - DNA, 20 bp, Homo sapiens
cagctcttcactcagccaca

SEQ ID NO: 2015227 - DNA, 18 bp, Homo sapiens
cagctcttcccctttcct

SEQ ID NO: 2015228 - DNA, 13 bp, Homo sapiens
cagctcttctcca

SEQ ID NO: 2015229 - DNA, 15 bp, Homo sapiens
cagctcttctccagg

SEQ ID NO: 2015230 - DNA, 15 bp, Homo sapiens
cagctgaacagccaa

SEQ ID NO: 2015231 - DNA, 21 bp, Homo sapiens
cagctgacacataatttgaat

SEQ ID NO: 2015232 - DNA, 22 bp, Homo sapiens
cagctgacagatacatagatgg

SEQ ID NO: 2015233 - DNA, 16 bp, Homo sapiens
cagctgacctttgtca

SEQ ID NO: 2015234 - DNA, 16 bp, Homo sapiens
cagctgagagccctgc

SEQ ID NO: 2015235 - DNA, 21 bp, Homo sapiens
cagctgagagccctgctgtgg

SEQ ID NO: 2015236 - DNA, 23 bp, Homo sapiens
cagctgagtgaaaaatctgtgga

SEQ ID NO: 2015237 - DNA, 21 bp, Homo sapiens
cagctgatattatggcaagtg

SEQ ID NO: 2015238 - DNA, 15 bp, Homo sapiens
cagctgattttgtca

SEQ ID NO: 2015239 - DNA, 21 bp, Homo sapiens
cagctgattttgtcactgtct

SEQ ID NO: 2015240 - DNA, 15 bp, Homo sapiens
cagctgcacattcct

SEQ ID NO: 2015241 - DNA, 20 bp, Homo sapiens
cagctgcacattcctggccc

SEQ ID NO: 2015242 - DNA, 17 bp, Homo sapiens
cagctgcacctgccagc

SEQ ID NO: 2015243 - DNA, 22 bp, Homo sapiens
cagctgcacctgccagcctggc

SEQ ID NO: 2015244 - DNA, 13 bp, Homo sapiens
cagctgcagctgg

SEQ ID NO: 2015245 - DNA, 14 bp, Homo sapiens
cagctgcagctggg

SEQ ID NO: 2015246 - DNA, 15 bp, Homo sapiens
cagctgcagctgggc

SEQ ID NO: 2015247 - DNA, 15 bp, Homo sapiens
cagctgcaggaatca

SEQ ID NO: 2015248 - DNA, 16 bp, Homo sapiens
cagctgcatctactca

SEQ ID NO: 2015249 - DNA, 12 bp, Homo sapiens
cagctgccaagc

SEQ ID NO: 2015250 - DNA, 19 bp, Homo sapiens
cagctgccgaccagagccc

SEQ ID NO: 2015251 - DNA, 23 bp, Homo sapiens
cagctgcggtccacccaggagcc

SEQ ID NO: 2015252 - DNA, 16 bp, Homo sapiens
cagctgctcgcacaga

SEQ ID NO: 2015253 - DNA, 21 bp, Homo sapiens
cagctgctctgccccttgggc

SEQ ID NO: 2015254 - DNA, 20 bp, Homo sapiens
cagctgctcttagtgcccgc

SEQ ID NO: 2015255 - DNA, 15 bp, Homo sapiens
cagctgctgaagagg

SEQ ID NO: 2015256 - DNA, 16 bp, Homo sapiens
cagctgcttgtgggcc

SEQ ID NO: 2015257 - DNA, 21 bp, Homo sapiens
cagctgcttgtgggcccggag

SEQ ID NO: 2015258 - DNA, 19 bp, Homo sapiens
cagctgcttgttgtcaagt

SEQ ID NO: 2015259 - DNA, 19 bp, Homo sapiens
cagctggaattgctgctct

SEQ ID NO: 2015260 - DNA, 19 bp, Homo sapiens
cagctggcctctagaacac

SEQ ID NO: 2015261 - DNA, 18 bp, Homo sapiens
cagctggctctccacctt

SEQ ID NO: 2015262 - DNA, 16 bp, Homo sapiens
cagctggctgctgaca

SEQ ID NO: 2015263 - DNA, 17 bp, Homo sapiens
cagctggctgctgacag

SEQ ID NO: 2015264 - DNA, 18 bp, Homo sapiens
cagctgggactacaggcg

SEQ ID NO: 2015265 - DNA, 19 bp, Homo sapiens
cagctgggccccacctact

SEQ ID NO: 2015266 - DNA, 21 bp, Homo sapiens
cagctgggccccatgctctgc

SEQ ID NO: 2015267 - DNA, 13 bp, Homo sapiens
cagctgggccggc

SEQ ID NO: 2015268 - DNA, 13 bp, Homo sapiens
cagctggtgctgc

SEQ ID NO: 2015269 - DNA, 18 bp, Homo sapiens
cagctggtgctgcaagga

SEQ ID NO: 2015270 - DNA, 19 bp, Homo sapiens
cagctggtggtatctgagt

SEQ ID NO: 2015271 - DNA, 20 bp, Homo sapiens
cagctgtaacacagctgaga

SEQ ID NO: 2015272 - DNA, 16 bp, Homo sapiens
cagctgtagccatggc

SEQ ID NO: 2015273 - DNA, 17 bp, Homo sapiens
cagctgtagccatggct

SEQ ID NO: 2015274 - DNA, 18 bp, Homo sapiens
cagctgtagccatggctc

SEQ ID NO: 2015275 - DNA, 21 bp, Homo sapiens
cagctgtagccatggctcagg

SEQ ID NO: 2015276 - DNA, 22 bp, Homo sapiens
cagctgtagccatggctcaggc

SEQ ID NO: 2015277 - DNA, 18 bp, Homo sapiens
cagctgtagctcccgagc

SEQ ID NO: 2015278 - DNA, 16 bp, Homo sapiens
cagctgtcattcagga

SEQ ID NO: 2015279 - DNA, 14 bp, Homo sapiens
cagctgtccctgtc

SEQ ID NO: 2015280 - DNA, 22 bp, Homo sapiens
cagctgtccctgtcaccaagct

SEQ ID NO: 2015281 - DNA, 20 bp, Homo sapiens
cagctgtctgtgtcagcctg

SEQ ID NO: 2015282 - DNA, 12 bp, Homo sapiens
cagctgtgcctc

SEQ ID NO: 2015283 - DNA, 18 bp, Homo sapiens
cagctgtgctctggacag

SEQ ID NO: 2015284 - DNA, 20 bp, Homo sapiens
cagctgtgctctggacaggc

SEQ ID NO: 2015285 - DNA, 17 bp, Homo sapiens
cagctgtgtgggctgca

SEQ ID NO: 2015286 - DNA, 18 bp, Homo sapiens
cagctgtgtgggctgcag

SEQ ID NO: 2015287 - DNA, 18 bp, Homo sapiens
cagcttaacattgacttc

SEQ ID NO: 2015288 - DNA, 21 bp, Homo sapiens
cagcttatgggatccttgtct

SEQ ID NO: 2015289 - DNA, 19 bp, Homo sapiens
cagcttcatcaatttttat

SEQ ID NO: 2015290 - DNA, 10 bp, Homo sapiens
cagcttcatt

SEQ ID NO: 2015291 - DNA, 22 bp, Homo sapiens
cagcttcattatgcagctgagg

SEQ ID NO: 2015292 - DNA, 19 bp, Homo sapiens
caggcatgttctctgagga

SEQ ID NO: 2015293 - DNA, 17 bp, Homo sapiens
caggcatttcctgggtg

SEQ ID NO: 2015294 - DNA, 19 bp, Homo sapiens
caggcatttcctgggtggc

SEQ ID NO: 2015295 - DNA, 23 bp, Homo sapiens
caggccaagagcagaggcagcga

SEQ ID NO: 2015296 - DNA, 23 bp, Homo sapiens
caggccaccatattcagtgctgt

SEQ ID NO: 2015297 - DNA, 17 bp, Homo sapiens
caggccacgctcaggcc

SEQ ID NO: 2015298 - DNA, 12 bp, Homo sapiens
caggccactgtg

SEQ ID NO: 2015299 - DNA, 16 bp, Homo sapiens
caggccactgtggcca

SEQ ID NO: 2015300 - DNA, 18 bp, Homo sapiens
caggccactgtggccaga

SEQ ID NO: 2015301 - DNA, 19 bp, Homo sapiens
caggccactgtggccagag

SEQ ID NO: 2015302 - DNA, 16 bp, Homo sapiens
caggccagagggagtg

SEQ ID NO: 2015303 - DNA, 21 bp, Homo sapiens
caggccagagggagtgacaga

SEQ ID NO: 2015304 - DNA, 13 bp, Homo sapiens
caggccagcccca

SEQ ID NO: 2015305 - DNA, 14 bp, Homo sapiens
caggccagccccat

SEQ ID NO: 2015306 - DNA, 14 bp, Homo sapiens
caggccaggccacc

SEQ ID NO: 2015307 - DNA, 19 bp, Homo sapiens
caggccaggttatgcctca

SEQ ID NO: 2015308 - DNA, 18 bp, Homo sapiens
caggccagtgccaggaca

SEQ ID NO: 2015309 - DNA, 18 bp, Homo sapiens
caggcccaagagatgaag

SEQ ID NO: 2015310 - DNA, 19 bp, Homo sapiens
caggcccaagagatgaaga

SEQ ID NO: 2015311 - DNA, 17 bp, Homo sapiens
caggcccactgcagaga

SEQ ID NO: 2015312 - DNA, 22 bp, Homo sapiens
caggccccatgacctccagctt

SEQ ID NO: 2015313 - DNA, 14 bp, Homo sapiens
caggcccccaggtg

SEQ ID NO: 2015314 - DNA, 19 bp, Homo sapiens
caggcccccaggtgccagt

SEQ ID NO: 2015315 - DNA, 23 bp, Homo sapiens
caggcccccgctggctcctccag

SEQ ID NO: 2015316 - DNA, 23 bp, Homo sapiens
caggccccgcttgtccagcgcct

SEQ ID NO: 2015317 - DNA, 13 bp, Homo sapiens
caggcccctgagg

SEQ ID NO: 2015318 - DNA, 15 bp, Homo sapiens
caggcccctgaggac

SEQ ID NO: 2015319 - DNA, 20 bp, Homo sapiens
caggcccctgaggactggag

SEQ ID NO: 2015320 - DNA, 15 bp, Homo sapiens
caggcccctgccacc

SEQ ID NO: 2015321 - DNA, 17 bp, Homo sapiens
caggcccctgccaccct

SEQ ID NO: 2015322 - DNA, 17 bp, Homo sapiens
caggcccgacagagaga

SEQ ID NO: 2015323 - DNA, 18 bp, Homo sapiens
caggcccgacagagagat

SEQ ID NO: 2015324 - DNA, 20 bp, Homo sapiens
caggcccggcatgcgggcca

SEQ ID NO: 2015325 - DNA, 19 bp, Homo sapiens
caggcccggcgcggtggct

SEQ ID NO: 2015326 - DNA, 14 bp, Homo sapiens
caggcccggctcca

SEQ ID NO: 2015327 - DNA, 15 bp, Homo sapiens
caggcccggctccag

SEQ ID NO: 2015328 - DNA, 18 bp, Homo sapiens
caggcccggctccaggct

SEQ ID NO: 2015329 - DNA, 22 bp, Homo sapiens
caggcccggctccaggctcctt

SEQ ID NO: 2015330 - DNA, 16 bp, Homo sapiens
caggcccggggctggc

SEQ ID NO: 2015331 - DNA, 17 bp, Homo sapiens
caggccctccatgggct

SEQ ID NO: 2015332 - DNA, 18 bp, Homo sapiens
caggccctccatgggcta

SEQ ID NO: 2015333 - DNA, 20 bp, Homo sapiens
caggccctccatgggctagt

SEQ ID NO: 2015334 - DNA, 21 bp, Homo sapiens
caggccctccatgggctagtg

SEQ ID NO: 2015335 - DNA, 19 bp, Homo sapiens
caggccctccctgactccc

SEQ ID NO: 2015336 - DNA, 16 bp, Homo sapiens
caggcccttcctctcc

SEQ ID NO: 2015337 - DNA, 17 bp, Homo sapiens
caggcccttcctctcca

SEQ ID NO: 2015338 - DNA, 15 bp, Homo sapiens
caggcccttggggtt

SEQ ID NO: 2015339 - DNA, 18 bp, Homo sapiens
caggccgggcttgggccc

SEQ ID NO: 2015340 - DNA, 22 bp, Homo sapiens
caggccgggcttgggccctgca

SEQ ID NO: 2015341 - DNA, 11 bp, Homo sapiens
caggcctagga

SEQ ID NO: 2015342 - DNA, 18 bp, Homo sapiens
caggcctaggacctcagg

SEQ ID NO: 2015343 - DNA, 14 bp, Homo sapiens
caggcctccagcct

SEQ ID NO: 2015344 - DNA, 15 bp, Homo sapiens
caggcctctgtgtcc

SEQ ID NO: 2015345 - DNA, 17 bp, Homo sapiens
caggcctggcaagtggg

SEQ ID NO: 2015346 - DNA, 20 bp, Homo sapiens
caggcctggcaagtgggtga

SEQ ID NO: 2015347 - DNA, 12 bp, Homo sapiens
caggcctgggac

SEQ ID NO: 2015348 - DNA, 21 bp, Homo sapiens
caggcctgggacccagctact

SEQ ID NO: 2015349 - DNA, 20 bp, Homo sapiens
caggcctgtgtagctgtgac

SEQ ID NO: 2015350 - DNA, 21 bp, Homo sapiens
caggcctgtgtagctgtgacc

SEQ ID NO: 2015351 - DNA, 23 bp, Homo sapiens
caggcctgtgtagctgtgacctg

SEQ ID NO: 2015352 - DNA, 12 bp, Homo sapiens
caggcctgtgtg

SEQ ID NO: 2015353 - DNA, 18 bp, Homo sapiens
caggcctttgagaaaggg

SEQ ID NO: 2015354 - DNA, 21 bp, Homo sapiens
caggcgcggtggctcacgcct

SEQ ID NO: 2015355 - DNA, 17 bp, Homo sapiens
caggcgctggacagagg

SEQ ID NO: 2015356 - DNA, 23 bp, Homo sapiens
caggcgctggacagaggggcagg

SEQ ID NO: 2015357 - DNA, 16 bp, Homo sapiens
caggcggggaggagga

SEQ ID NO: 2015358 - DNA, 13 bp, Homo sapiens
caggctaattttt

SEQ ID NO: 2015359 - DNA, 15 bp, Homo sapiens
caggctaccccttca

SEQ ID NO: 2015360 - DNA, 15 bp, Homo sapiens
caggctactctcctc

SEQ ID NO: 2015361 - DNA, 11 bp, Homo sapiens
caggctactgt

SEQ ID NO: 2015362 - DNA, 16 bp, Homo sapiens
caggctagagtgcagt

SEQ ID NO: 2015363 - DNA, 15 bp, Homo sapiens
caggctcacaactgt

SEQ ID NO: 2015364 - DNA, 14 bp, Homo sapiens
caggctcagactct

SEQ ID NO: 2015365 - DNA, 16 bp, Homo sapiens
caggctcagactctgg

SEQ ID NO: 2015366 - DNA, 14 bp, Homo sapiens
caggctccatgggg

SEQ ID NO: 2015367 - DNA, 19 bp, Homo sapiens
caggctccatggggaagtg

SEQ ID NO: 2015368 - DNA, 14 bp, Homo sapiens
caggctcctttagc

SEQ ID NO: 2015369 - DNA, 20 bp, Homo sapiens
caggctcctttagcgcccag

SEQ ID NO: 2015370 - DNA, 21 bp, Homo sapiens
caggctcctttagcgcccagt

SEQ ID NO: 2015371 - DNA, 17 bp, Homo sapiens
caggctctggagccaga

SEQ ID NO: 2015372 - DNA, 12 bp, Homo sapiens
caggctctgggc

SEQ ID NO: 2015373 - DNA, 18 bp, Homo sapiens
caggctctgggctcaggg

SEQ ID NO: 2015374 - DNA, 21 bp, Homo sapiens
caggctctgggctcagggctg

SEQ ID NO: 2015375 - DNA, 22 bp, Homo sapiens
caggctctgggctcagggctgg

SEQ ID NO: 2015376 - DNA, 18 bp, Homo sapiens
caggctcttcctggacct

SEQ ID NO: 2015377 - DNA, 23 bp, Homo sapiens
caggctcttcctggacctgagtc

SEQ ID NO: 2015378 - DNA, 12 bp, Homo sapiens
caggctcttctc

SEQ ID NO: 2015379 - DNA, 15 bp, Homo sapiens
caggctcttctcctt

SEQ ID NO: 2015380 - DNA, 22 bp, Homo sapiens
caggctctttggggtcagccag

SEQ ID NO: 2015381 - DNA, 12 bp, Homo sapiens
caggctgaagag

SEQ ID NO: 2015382 - DNA, 16 bp, Homo sapiens
caggctgagcccagcc

SEQ ID NO: 2015383 - DNA, 17 bp, Homo sapiens
caggctgagcccagcca

SEQ ID NO: 2015384 - DNA, 11 bp, Homo sapiens
caggctgaggt

SEQ ID NO: 2015385 - DNA, 22 bp, Homo sapiens
caggctgaggtcctgatcagct

SEQ ID NO: 2015386 - DNA, 16 bp, Homo sapiens
caggctgagtgagcca

SEQ ID NO: 2015387 - DNA, 13 bp, Homo sapiens
caggctgcactgc

SEQ ID NO: 2015388 - DNA, 17 bp, Homo sapiens
caggctggcgtgcagtg

SEQ ID NO: 2015389 - DNA, 18 bp, Homo sapiens
caggctggcgtgcagtgg

SEQ ID NO: 2015390 - DNA, 19 bp, Homo sapiens
caggctggcgtgcagtggt

SEQ ID NO: 2015391 - DNA, 15 bp, Homo sapiens
caggctgggcttcag

SEQ ID NO: 2015392 - DNA, 16 bp, Homo sapiens
caggctgggcttcagt

SEQ ID NO: 2015393 - DNA, 17 bp, Homo sapiens
caggctgggcttcagtg

SEQ ID NO: 2015394 - DNA, 19 bp, Homo sapiens
caggctgggcttcagtggc

SEQ ID NO: 2015395 - DNA, 20 bp, Homo sapiens
caggctgggcttcagtggca

SEQ ID NO: 2015396 - DNA, 19 bp, Homo sapiens
caggctggtctcaaactct

SEQ ID NO: 2015397 - DNA, 18 bp, Homo sapiens
caggctgttctgcactga

SEQ ID NO: 2015398 - DNA, 19 bp, Homo sapiens
caggctgttctgcactgaa

SEQ ID NO: 2015399 - DNA, 15 bp, Homo sapiens
caggctgtttctttt

SEQ ID NO: 2015400 - DNA, 21 bp, Homo sapiens
caggcttcggacagtgcccat

SEQ ID NO: 2015401 - DNA, 21 bp, Homo sapiens
caggcttggaatgaattctct

SEQ ID NO: 2015402 - DNA, 15 bp, Homo sapiens
cagggaaagctccac

SEQ ID NO: 2015403 - DNA, 23 bp, Homo sapiens
caggtaaatgggcagtgcctcct

SEQ ID NO: 2015404 - DNA, 21 bp, Homo sapiens
caggtaacaggcagatacagg

SEQ ID NO: 2015405 - DNA, 15 bp, Homo sapiens
caggtaatgagggac

SEQ ID NO: 2015406 - DNA, 20 bp, Homo sapiens
caggtaatgagggactggaa

SEQ ID NO: 2015407 - DNA, 14 bp, Homo sapiens
caggtacagcaaca

SEQ ID NO: 2015408 - DNA, 16 bp, Homo sapiens
caggtacttcctcctg

SEQ ID NO: 2015409 - DNA, 17 bp, Homo sapiens
caggtacttcctcctga

SEQ ID NO: 2015410 - DNA, 23 bp, Homo sapiens
caggtacttcctcctgatggcca

SEQ ID NO: 2015411 - DNA, 18 bp, Homo sapiens
caggtagatcgcttgagc

SEQ ID NO: 2015412 - DNA, 23 bp, Homo sapiens
caggtagatcgcttgagcccagg

SEQ ID NO: 2015413 - DNA, 23 bp, Homo sapiens
caggtaggaggcaaatatcttga

SEQ ID NO: 2015414 - DNA, 20 bp, Homo sapiens
caggtaggcccttgtcctgc

SEQ ID NO: 2015415 - DNA, 23 bp, Homo sapiens
caggtaggcccttgtcctgccag

SEQ ID NO: 2015416 - DNA, 13 bp, Homo sapiens
caggtagtactgg

SEQ ID NO: 2015417 - DNA, 22 bp, Homo sapiens
caggtatctccaggattgaaga

SEQ ID NO: 2015418 - DNA, 17 bp, Homo sapiens
caggtccggaggggttg

SEQ ID NO: 2015419 - DNA, 15 bp, Homo sapiens
caggtcctcagagaa

SEQ ID NO: 2015420 - DNA, 22 bp, Homo sapiens
caggtcctcccgggagcacaga

SEQ ID NO: 2015421 - DNA, 22 bp, Homo sapiens
caggtcctctgatacccagagc

SEQ ID NO: 2015422 - DNA, 22 bp, Homo sapiens
caggtcctgcccatgtgtcccc

SEQ ID NO: 2015423 - DNA, 19 bp, Homo sapiens
caggtcctggtggggcagc

SEQ ID NO: 2015424 - DNA, 21 bp, Homo sapiens
caggtcctggtggggcagctc

SEQ ID NO: 2015425 - DNA, 12 bp, Homo sapiens
caggtctcccac

SEQ ID NO: 2015426 - DNA, 13 bp, Homo sapiens
caggtctcccacg

SEQ ID NO: 2015427 - DNA, 17 bp, Homo sapiens
caggtctcctcttaaaa

SEQ ID NO: 2015428 - DNA, 17 bp, Homo sapiens
caggtctctccactgct

SEQ ID NO: 2015429 - DNA, 19 bp, Homo sapiens
caggtctctccactgctct

SEQ ID NO: 2015430 - DNA, 22 bp, Homo sapiens
caggtctctccactgctctcag

SEQ ID NO: 2015431 - DNA, 23 bp, Homo sapiens
caggtctctccactgctctcagc

SEQ ID NO: 2015432 - DNA, 21 bp, Homo sapiens
caggtctctggcagagaagga

SEQ ID NO: 2015433 - DNA, 18 bp, Homo sapiens
caggtcttgaactcctgg

SEQ ID NO: 2015434 - DNA, 22 bp, Homo sapiens
caggtcttgaactcctggcctc

SEQ ID NO: 2015435 - DNA, 23 bp, Homo sapiens
caggtcttgaactcctggcctca

SEQ ID NO: 2015436 - DNA, 14 bp, Homo sapiens
caggtgactggagc

SEQ ID NO: 2015437 - DNA, 17 bp, Homo sapiens
caggtgatccacccacc

SEQ ID NO: 2015438 - DNA, 20 bp, Homo sapiens
caggtgatccacccacctca

SEQ ID NO: 2015439 - DNA, 14 bp, Homo sapiens
caggtgcaagagac

SEQ ID NO: 2015440 - DNA, 16 bp, Homo sapiens
caggtgcaagagacag

SEQ ID NO: 2015441 - DNA, 23 bp, Homo sapiens
caggtgcaagagacagagccccc

SEQ ID NO: 2015442 - DNA, 17 bp, Homo sapiens
caggtgcagatgggctg

SEQ ID NO: 2015443 - DNA, 18 bp, Homo sapiens
caggtgcagatgggctgt

SEQ ID NO: 2015444 - DNA, 12 bp, Homo sapiens
caggtgcagtgg

SEQ ID NO: 2015445 - DNA, 17 bp, Homo sapiens
caggtgccaccaataaa

SEQ ID NO: 2015446 - DNA, 18 bp, Homo sapiens
caggtgccaccaataaaa

SEQ ID NO: 2015447 - DNA, 13 bp, Homo sapiens
caggtgccactcc

SEQ ID NO: 2015448 - DNA, 14 bp, Homo sapiens
caggtgccactccc

SEQ ID NO: 2015449 - DNA, 13 bp, Homo sapiens
caggtgctgccat

SEQ ID NO: 2015450 - DNA, 20 bp, Homo sapiens
caggtgcttttgatgtgaaa

SEQ ID NO: 2015451 - DNA, 24 bp, Homo sapiens
caggtggattttgtggaggtgaga

SEQ ID NO: 2015452 - DNA, 15 bp, Homo sapiens
caggtggcaggacca

SEQ ID NO: 2015453 - DNA, 18 bp, Homo sapiens
caggtggcctagcaggca

SEQ ID NO: 2015454 - DNA, 22 bp, Homo sapiens
caggtggctagcaaattagaaa

SEQ ID NO: 2015455 - DNA, 16 bp, Homo sapiens
caggtggctgacccag

SEQ ID NO: 2015456 - DNA, 15 bp, Homo sapiens
caggtgggagagaca

SEQ ID NO: 2015457 - DNA, 14 bp, Homo sapiens
caggtggggcagct

SEQ ID NO: 2015458 - DNA, 16 bp, Homo sapiens
caggtggggcagcttg

SEQ ID NO: 2015459 - DNA, 16 bp, Homo sapiens
caggtggtcctgagac

SEQ ID NO: 2015460 - DNA, 20 bp, Homo sapiens
caggtggtcctgagacctga

SEQ ID NO: 2015461 - DNA, 14 bp, Homo sapiens
caggtgtaaatata

SEQ ID NO: 2015462 - DNA, 21 bp, Homo sapiens
caggtgtaaatatagtagcag

SEQ ID NO: 2015463 - DNA, 14 bp, Homo sapiens
caggtgtccctgca

SEQ ID NO: 2015464 - DNA, 18 bp, Homo sapiens
caggtgtccctgcacttg

SEQ ID NO: 2015465 - DNA, 15 bp, Homo sapiens
caggtgtctatccac

SEQ ID NO: 2015466 - DNA, 19 bp, Homo sapiens
caggtgtgaaccaccacac

SEQ ID NO: 2015467 - DNA, 22 bp, Homo sapiens
caggtgtgagtcaccaagccca

SEQ ID NO: 2015468 - DNA, 23 bp, Homo sapiens
caggtgtgagtcaccaagcccag

SEQ ID NO: 2015469 - DNA, 13 bp, Homo sapiens
caggtgtggtggc

SEQ ID NO: 2015470 - DNA, 14 bp, Homo sapiens
caggtgttgccatt

SEQ ID NO: 2015471 - DNA, 20 bp, Homo sapiens
caggttagcctttgccctgt

SEQ ID NO: 2015472 - DNA, 18 bp, Homo sapiens
caggttaggaaggcagca

SEQ ID NO: 2015473 - DNA, 17 bp, Homo sapiens
caggttatgcctcatgc

SEQ ID NO: 2015474 - DNA, 12 bp, Homo sapiens
caggttcagctt

SEQ ID NO: 2015475 - DNA, 14 bp, Homo sapiens
caggttccatcccg

SEQ ID NO: 2015476 - DNA, 18 bp, Homo sapiens
caggttcccagcagctgg

SEQ ID NO: 2015477 - DNA, 20 bp, Homo sapiens
caggttcccagcagctgggc

SEQ ID NO: 2015478 - DNA, 21 bp, Homo sapiens
caggttcccagcagctgggcc

SEQ ID NO: 2015479 - DNA, 19 bp, Homo sapiens
caggttgttctgtataaaa

SEQ ID NO: 2015480 - DNA, 18 bp, Homo sapiens
cagtaaaaacttgtacta

SEQ ID NO: 2015481 - DNA, 22 bp, Homo sapiens
cagtaaaaacttgtactatgtt

SEQ ID NO: 2015482 - DNA, 14 bp, Homo sapiens
cagtaaataaattg

SEQ ID NO: 2015483 - DNA, 17 bp, Homo sapiens
cagtaaataaattgttt

SEQ ID NO: 2015484 - DNA, 14 bp, Homo sapiens
cagtaacacatctt

SEQ ID NO: 2015485 - DNA, 18 bp, Homo sapiens
cagtaacacatctttaat

SEQ ID NO: 2015486 - DNA, 16 bp, Homo sapiens
cagtaactcatctgtc

SEQ ID NO: 2015487 - DNA, 19 bp, Homo sapiens
cagtaagctgctctattgt

SEQ ID NO: 2015488 - DNA, 13 bp, Homo sapiens
cagtacctgggaa

SEQ ID NO: 2015489 - DNA, 14 bp, Homo sapiens
cagtacctgggaaa

SEQ ID NO: 2015490 - DNA, 15 bp, Homo sapiens
cagtacctttgtcac

SEQ ID NO: 2015491 - DNA, 16 bp, Homo sapiens
cagtacctttgtcaca

SEQ ID NO: 2015492 - DNA, 17 bp, Homo sapiens
cagtacctttgtcacaa

SEQ ID NO: 2015493 - DNA, 17 bp, Homo sapiens
cagtactatgtaaattt

SEQ ID NO: 2015494 - DNA, 12 bp, Homo sapiens
cagtacttctaa

SEQ ID NO: 2015495 - DNA, 23 bp, Homo sapiens
cagtagcacaagttatttaaatc

SEQ ID NO: 2015496 - DNA, 19 bp, Homo sapiens
cagtagccaagttatattg

SEQ ID NO: 2015497 - DNA, 17 bp, Homo sapiens
cagtagcttaaataaat

SEQ ID NO: 2015498 - DNA, 17 bp, Homo sapiens
cagtaggtccaagggcc

SEQ ID NO: 2015499 - DNA, 19 bp, Homo sapiens
cagtaggtccaagggccat

SEQ ID NO: 2015500 - DNA, 15 bp, Homo sapiens
cagtagtcagaagca

SEQ ID NO: 2015501 - DNA, 17 bp, Homo sapiens
cagtagtttgagaccag

SEQ ID NO: 2015502 - DNA, 14 bp, Homo sapiens
cagtataaaagaca

SEQ ID NO: 2015503 - DNA, 15 bp, Homo sapiens
cagtataaaagacaa

SEQ ID NO: 2015504 - DNA, 22 bp, Homo sapiens
cagtatagcattgaacatttct

SEQ ID NO: 2015505 - DNA, 13 bp, Homo sapiens
cagtatatttata

SEQ ID NO: 2015506 - DNA, 21 bp, Homo sapiens
cagtatgaatgatgttttaga

SEQ ID NO: 2015507 - DNA, 21 bp, Homo sapiens
cagtatgctgttttaataatt

SEQ ID NO: 2015508 - DNA, 15 bp, Homo sapiens
cagtatggaagggag

SEQ ID NO: 2015509 - DNA, 18 bp, Homo sapiens
cagtattattgagctcta

SEQ ID NO: 2015510 - DNA, 15 bp, Homo sapiens
cagtatttgtacaaa

SEQ ID NO: 2015511 - DNA, 11 bp, Homo sapiens
cagtattttat

SEQ ID NO: 2015512 - DNA, 19 bp, Homo sapiens
cagtattttggagaaatta

SEQ ID NO: 2015513 - DNA, 20 bp, Homo sapiens
cagtattttggagaaattat

SEQ ID NO: 2015514 - DNA, 15 bp, Homo sapiens
cagtcaaaacagaga

SEQ ID NO: 2015515 - DNA, 19 bp, Homo sapiens
cagtcaaaacagagatgtg

SEQ ID NO: 2015516 - DNA, 15 bp, Homo sapiens
cagtcaacagttcaa

SEQ ID NO: 2015517 - DNA, 23 bp, Homo sapiens
cagtcaacagttcaaagaagtca

SEQ ID NO: 2015518 - DNA, 15 bp, Homo sapiens
cagtcaattttacaa

SEQ ID NO: 2015519 - DNA, 12 bp, Homo sapiens
cagtcacactgt

SEQ ID NO: 2015520 - DNA, 13 bp, Homo sapiens
cagtcacactgtt

SEQ ID NO: 2015521 - DNA, 20 bp, Homo sapiens
cagtcacactgttactccac

SEQ ID NO: 2015522 - DNA, 22 bp, Homo sapiens
cagtcacactgttactccacag

SEQ ID NO: 2015523 - DNA, 23 bp, Homo sapiens
cagtcacactgttactccacagc

SEQ ID NO: 2015524 - DNA, 17 bp, Homo sapiens
cagtcacccttctgggc

SEQ ID NO: 2015525 - DNA, 22 bp, Homo sapiens
cagtcactgtccctcaaatgac

SEQ ID NO: 2015526 - DNA, 16 bp, Homo sapiens
cagtcagtaattgcca

SEQ ID NO: 2015527 - DNA, 15 bp, Homo sapiens
cagtcagttcccgga

SEQ ID NO: 2015528 - DNA, 22 bp, Homo sapiens
cagtcagttcccggagcacagc

SEQ ID NO: 2015529 - DNA, 15 bp, Homo sapiens
cagtcataactaaat

SEQ ID NO: 2015530 - DNA, 21 bp, Homo sapiens
cagtcattgggttttatcagt

SEQ ID NO: 2015531 - DNA, 16 bp, Homo sapiens
cagtccagaataagtg

SEQ ID NO: 2015532 - DNA, 20 bp, Homo sapiens
cagtccagaataagtgctgt

SEQ ID NO: 2015533 - DNA, 16 bp, Homo sapiens
cagtccagatgccttc

SEQ ID NO: 2015534 - DNA, 14 bp, Homo sapiens
cagtccagccagct

SEQ ID NO: 2015535 - DNA, 15 bp, Homo sapiens
cagtccagccagctc

SEQ ID NO: 2015536 - DNA, 16 bp, Homo sapiens
cagtcccaatgcacat

SEQ ID NO: 2015537 - DNA, 21 bp, Homo sapiens
cagtcccagaaccacactgtt

SEQ ID NO: 2015538 - DNA, 14 bp, Homo sapiens
cagtcccagagcag

SEQ ID NO: 2015539 - DNA, 16 bp, Homo sapiens
cagtccccctgcccca

SEQ ID NO: 2015540 - DNA, 18 bp, Homo sapiens
cagtccccgtgccccgcc

SEQ ID NO: 2015541 - DNA, 21 bp, Homo sapiens
cagtccctgggggaagccctg

SEQ ID NO: 2015542 - DNA, 16 bp, Homo sapiens
cagtcccttgctgaca

SEQ ID NO: 2015543 - DNA, 22 bp, Homo sapiens
cagtccgccaaacactccaccc

SEQ ID NO: 2015544 - DNA, 15 bp, Homo sapiens
cagtccgcctggccg

SEQ ID NO: 2015545 - DNA, 22 bp, Homo sapiens
cagtccgcctggccggctccag

SEQ ID NO: 2015546 - DNA, 19 bp, Homo sapiens
cagtccgtcaaaacagatt

SEQ ID NO: 2015547 - DNA, 14 bp, Homo sapiens
cagtcctagagctc

SEQ ID NO: 2015548 - DNA, 15 bp, Homo sapiens
cagtcctagagctcc

SEQ ID NO: 2015549 - DNA, 16 bp, Homo sapiens
cagtcctagagctcct

SEQ ID NO: 2015550 - DNA, 22 bp, Homo sapiens
cagtcctagagctcctgtccct

SEQ ID NO: 2015551 - DNA, 23 bp, Homo sapiens
cagtcctagagctcctgtcccta

SEQ ID NO: 2015552 - DNA, 17 bp, Homo sapiens
cagtcctcttattccta

SEQ ID NO: 2015553 - DNA, 12 bp, Homo sapiens
cagtcctggaag

SEQ ID NO: 2015554 - DNA, 23 bp, Homo sapiens
cagtcctggccattttcttgcct

SEQ ID NO: 2015555 - DNA, 12 bp, Homo sapiens
cagtcctgggag

SEQ ID NO: 2015556 - DNA, 13 bp, Homo sapiens
cagtcctgggaga

SEQ ID NO: 2015557 - DNA, 15 bp, Homo sapiens
cagcacaccccaagg

SEQ ID NO: 2015558 - DNA, 22 bp, Homo sapiens
cagcacaccccaagggacaacc

SEQ ID NO: 2015559 - DNA, 14 bp, Homo sapiens
cagcacaggggccc

SEQ ID NO: 2015560 - DNA, 22 bp, Homo sapiens
cagcacaggggccccagatctg

SEQ ID NO: 2015561 - DNA, 22 bp, Homo sapiens
cagcaccaattgtacattccct

SEQ ID NO: 2015562 - DNA, 23 bp, Homo sapiens
cagcaccaattgtacattccctg

SEQ ID NO: 2015563 - DNA, 14 bp, Homo sapiens
cagcaccagaatgt

SEQ ID NO: 2015564 - DNA, 13 bp, Homo sapiens
cagcaccatggag

SEQ ID NO: 2015565 - DNA, 11 bp, Homo sapiens
cagcacccagg

SEQ ID NO: 2015566 - DNA, 20 bp, Homo sapiens
cagcacccaggctccatggg

SEQ ID NO: 2015567 - DNA, 16 bp, Homo sapiens
cagcacccctgtctct

SEQ ID NO: 2015568 - DNA, 19 bp, Homo sapiens
cagcaccctcccccgcagc

SEQ ID NO: 2015569 - DNA, 14 bp, Homo sapiens
cagcaccctctcct

SEQ ID NO: 2015570 - DNA, 14 bp, Homo sapiens
cagcaccctgcaga

SEQ ID NO: 2015571 - DNA, 16 bp, Homo sapiens
cagcaccctgcagagc

SEQ ID NO: 2015572 - DNA, 22 bp, Homo sapiens
cagcaccctgcagagcacacag

SEQ ID NO: 2015573 - DNA, 20 bp, Homo sapiens
cagcaccctgggtgccattc

SEQ ID NO: 2015574 - DNA, 19 bp, Homo sapiens
cagcactaaggccgtgtct

SEQ ID NO: 2015575 - DNA, 21 bp, Homo sapiens
cagcactaaggccgtgtctct

SEQ ID NO: 2015576 - DNA, 22 bp, Homo sapiens
cagcactaaggccgtgtctctg

SEQ ID NO: 2015577 - DNA, 13 bp, Homo sapiens
cagcactcagtga

SEQ ID NO: 2015578 - DNA, 21 bp, Homo sapiens
cagcactctctaaatcttcct

SEQ ID NO: 2015579 - DNA, 22 bp, Homo sapiens
cagcactctctaaatcttcctt

SEQ ID NO: 2015580 - DNA, 11 bp, Homo sapiens
cagcactgaaa

SEQ ID NO: 2015581 - DNA, 14 bp, Homo sapiens
cagcactgaaaata

SEQ ID NO: 2015582 - DNA, 12 bp, Homo sapiens
cagcactgtgaa

SEQ ID NO: 2015583 - DNA, 17 bp, Homo sapiens
cagcactttaaccctct

SEQ ID NO: 2015584 - DNA, 24 bp, Homo sapiens
cagcactttaaccctctcttccct

SEQ ID NO: 2015585 - DNA, 18 bp, Homo sapiens
cagcactttgggaggctg

SEQ ID NO: 2015586 - DNA, 19 bp, Homo sapiens
cagcactttgggaggctga

SEQ ID NO: 2015587 - DNA, 20 bp, Homo sapiens
cagcactttgggaggctgag

SEQ ID NO: 2015588 - DNA, 22 bp, Homo sapiens
cagcactttgggaggctgaggc

SEQ ID NO: 2015589 - DNA, 15 bp, Homo sapiens
cagcagaaaagtgct

SEQ ID NO: 2015590 - DNA, 17 bp, Homo sapiens
cagcagaatgaagacct

SEQ ID NO: 2015591 - DNA, 18 bp, Homo sapiens
cagcagactcagctctga

SEQ ID NO: 2015592 - DNA, 17 bp, Homo sapiens
cagcagatggaaagaaa

SEQ ID NO: 2015593 - DNA, 15 bp, Homo sapiens
cagcagcactgcaga

SEQ ID NO: 2015594 - DNA, 14 bp, Homo sapiens
cagcagcagagagc

SEQ ID NO: 2015595 - DNA, 18 bp, Homo sapiens
cagcagcagagagccctg

SEQ ID NO: 2015596 - DNA, 10 bp, Homo sapiens
cagcagccag

SEQ ID NO: 2015597 - DNA, 15 bp, Homo sapiens
cagcagccagccctg

SEQ ID NO: 2015598 - DNA, 16 bp, Homo sapiens
cagcagccagccctgc

SEQ ID NO: 2015599 - DNA, 17 bp, Homo sapiens
cagcagccagccctgcc

SEQ ID NO: 2015600 - DNA, 20 bp, Homo sapiens
cagcagccagccctgcctgg

SEQ ID NO: 2015601 - DNA, 12 bp, Homo sapiens
cagcagcccagc

SEQ ID NO: 2015602 - DNA, 13 bp, Homo sapiens
cagcagcccagct

SEQ ID NO: 2015603 - DNA, 13 bp, Homo sapiens
cagcagcccccca

SEQ ID NO: 2015604 - DNA, 16 bp, Homo sapiens
cagcagccccccagca

SEQ ID NO: 2015605 - DNA, 17 bp, Homo sapiens
cagcagccccccagcac

SEQ ID NO: 2015606 - DNA, 21 bp, Homo sapiens
cagcagccccccagcactaag

SEQ ID NO: 2015607 - DNA, 17 bp, Homo sapiens
cagcagccccctgcccg

SEQ ID NO: 2015608 - DNA, 23 bp, Homo sapiens
cagcagccctaaggatctctcag

SEQ ID NO: 2015609 - DNA, 24 bp, Homo sapiens
cagcagccctaaggatctctcagg

SEQ ID NO: 2015610 - DNA, 11 bp, Homo sapiens
cagcagccctc

SEQ ID NO: 2015611 - DNA, 12 bp, Homo sapiens
cagcagccctcc

SEQ ID NO: 2015612 - DNA, 14 bp, Homo sapiens
cagcagccctcctc

SEQ ID NO: 2015613 - DNA, 19 bp, Homo sapiens
cagcagccctggcctgtgg

SEQ ID NO: 2015614 - DNA, 16 bp, Homo sapiens
cagcagctaggactga

SEQ ID NO: 2015615 - DNA, 23 bp, Homo sapiens
cagcagctaggactgaggagtgg

SEQ ID NO: 2015616 - DNA, 13 bp, Homo sapiens
cagcagctcagcc

SEQ ID NO: 2015617 - DNA, 17 bp, Homo sapiens
cagcagctcagcctccc

SEQ ID NO: 2015618 - DNA, 14 bp, Homo sapiens
cagcagctcaggca

SEQ ID NO: 2015619 - DNA, 18 bp, Homo sapiens
cagcagctgaacagccaa

SEQ ID NO: 2015620 - DNA, 22 bp, Homo sapiens
cagcagctgcgggtctgaagga

SEQ ID NO: 2015621 - DNA, 14 bp, Homo sapiens
cagcagctgggacc

SEQ ID NO: 2015622 - DNA, 19 bp, Homo sapiens
cagcagctgggacccctcc

SEQ ID NO: 2015623 - DNA, 21 bp, Homo sapiens
cagcagctgggccggccagcc

SEQ ID NO: 2015624 - DNA, 22 bp, Homo sapiens
cagcagctgggccggccagcct

SEQ ID NO: 2015625 - DNA, 17 bp, Homo sapiens
cagcaggaacctgtact

SEQ ID NO: 2015626 - DNA, 14 bp, Homo sapiens
cagcaggaagccag

SEQ ID NO: 2015627 - DNA, 22 bp, Homo sapiens
cagcaggtagtgggtgaatgtg

SEQ ID NO: 2015628 - DNA, 14 bp, Homo sapiens
cagcaggtgcaaga

SEQ ID NO: 2015629 - DNA, 19 bp, Homo sapiens
cagcaggtgcaagagacag

SEQ ID NO: 2015630 - DNA, 20 bp, Homo sapiens
cagcaggtgcaagagacaga

SEQ ID NO: 2015631 - DNA, 12 bp, Homo sapiens
cagcagtcttct

SEQ ID NO: 2015632 - DNA, 17 bp, Homo sapiens
cagcagttccatgaaga

SEQ ID NO: 2015633 - DNA, 17 bp, Homo sapiens
cagcagttgaaaagact

SEQ ID NO: 2015634 - DNA, 14 bp, Homo sapiens
cagcataccttgga

SEQ ID NO: 2015635 - DNA, 19 bp, Homo sapiens
cagcatacctttattgtga

SEQ ID NO: 2015636 - DNA, 14 bp, Homo sapiens
cagcatcctggcac

SEQ ID NO: 2015637 - DNA, 17 bp, Homo sapiens
cagcatcctggcacccg

SEQ ID NO: 2015638 - DNA, 12 bp, Homo sapiens
cagcatgtcact

SEQ ID NO: 2015639 - DNA, 18 bp, Homo sapiens
cagcatgtcactcccaga

SEQ ID NO: 2015640 - DNA, 13 bp, Homo sapiens
cagcattcagcac

SEQ ID NO: 2015641 - DNA, 19 bp, Homo sapiens
cagcattcagcacacccca

SEQ ID NO: 2015642 - DNA, 13 bp, Homo sapiens
cagcattcatgcc

SEQ ID NO: 2015643 - DNA, 15 bp, Homo sapiens
cagcattctcactcc

SEQ ID NO: 2015644 - DNA, 13 bp, Homo sapiens
cagcattttacta

SEQ ID NO: 2015645 - DNA, 12 bp, Homo sapiens
cagccaaacaca

SEQ ID NO: 2015646 - DNA, 19 bp, Homo sapiens
cagccaaacccatgaggca

SEQ ID NO: 2015647 - DNA, 22 bp, Homo sapiens
cagccaacaggtggcaggacca

SEQ ID NO: 2015648 - DNA, 23 bp, Homo sapiens
cagccaataaatcaactccagct

SEQ ID NO: 2015649 - DNA, 12 bp, Homo sapiens
cagccacacaga

SEQ ID NO: 2015650 - DNA, 13 bp, Homo sapiens
cagccacacagag

SEQ ID NO: 2015651 - DNA, 15 bp, Homo sapiens
cagccaccccctccc

SEQ ID NO: 2015652 - DNA, 12 bp, Homo sapiens
cagccaccctga

SEQ ID NO: 2015653 - DNA, 14 bp, Homo sapiens
cagccaccctgagg

SEQ ID NO: 2015654 - DNA, 20 bp, Homo sapiens
cagccaccctgaggagtctg

SEQ ID NO: 2015655 - DNA, 17 bp, Homo sapiens
cagccacctaaaaacat

SEQ ID NO: 2015656 - DNA, 15 bp, Homo sapiens
cagccacctcccaag

SEQ ID NO: 2015657 - DNA, 16 bp, Homo sapiens
cagccacctcccaagg

SEQ ID NO: 2015658 - DNA, 14 bp, Homo sapiens
cagccactcgggag

SEQ ID NO: 2015659 - DNA, 21 bp, Homo sapiens
cagccactcgggaggctgaga

SEQ ID NO: 2015660 - DNA, 23 bp, Homo sapiens
cagccactcgggaggctgagaca

SEQ ID NO: 2015661 - DNA, 17 bp, Homo sapiens
cagccagaagcctctgc

SEQ ID NO: 2015662 - DNA, 14 bp, Homo sapiens
cagccagactggca

SEQ ID NO: 2015663 - DNA, 15 bp, Homo sapiens
cagccagactggcac

SEQ ID NO: 2015664 - DNA, 13 bp, Homo sapiens
cagccagcaatga

SEQ ID NO: 2015665 - DNA, 22 bp, Homo sapiens
cagccagcaatgatgtccagaa

SEQ ID NO: 2015666 - DNA, 23 bp, Homo sapiens
cagccagcaatgatgtccagaag

SEQ ID NO: 2015667 - DNA, 14 bp, Homo sapiens
cagccagcagccag

SEQ ID NO: 2015668 - DNA, 17 bp, Homo sapiens
cagccagcagccagctc

SEQ ID NO: 2015669 - DNA, 19 bp, Homo sapiens
cagccagcagccagctctc

SEQ ID NO: 2015670 - DNA, 15 bp, Homo sapiens
cagccagcccagccc

SEQ ID NO: 2015671 - DNA, 12 bp, Homo sapiens
cagccagccctg

SEQ ID NO: 2015672 - DNA, 21 bp, Homo sapiens
cagccagccctgcctggagga

SEQ ID NO: 2015673 - DNA, 22 bp, Homo sapiens
cagccagccctgcctggaggac

SEQ ID NO: 2015674 - DNA, 21 bp, Homo sapiens
cagagaaggcctcttgtgctc

SEQ ID NO: 2015675 - DNA, 16 bp, Homo sapiens
cagagaaggcttcctc

SEQ ID NO: 2015676 - DNA, 12 bp, Homo sapiens
cagagaagtcag

SEQ ID NO: 2015677 - DNA, 23 bp, Homo sapiens
cagagaatttctaccatttcaga

SEQ ID NO: 2015678 - DNA, 14 bp, Homo sapiens
cagagacacctgca

SEQ ID NO: 2015679 - DNA, 17 bp, Homo sapiens
cagagacacctgcacct

SEQ ID NO: 2015680 - DNA, 19 bp, Homo sapiens
cagagacagaaacagagag

SEQ ID NO: 2015681 - DNA, 21 bp, Homo sapiens
cagagacagaaacagagagag

SEQ ID NO: 2015682 - DNA, 13 bp, Homo sapiens
cagagacagagag

SEQ ID NO: 2015683 - DNA, 15 bp, Homo sapiens
cagagacagagagag

SEQ ID NO: 2015684 - DNA, 13 bp, Homo sapiens
cagagacaggaaa

SEQ ID NO: 2015685 - DNA, 21 bp, Homo sapiens
cagagacaggaaaatcctctg

SEQ ID NO: 2015686 - DNA, 22 bp, Homo sapiens
cagaggcggaaaccttgcagca

SEQ ID NO: 2015687 - DNA, 16 bp, Homo sapiens
cagaggctaagatgag

SEQ ID NO: 2015688 - DNA, 12 bp, Homo sapiens
cagaggctgcag

SEQ ID NO: 2015689 - DNA, 22 bp, Homo sapiens
cagaggctgggggaggcggcac

SEQ ID NO: 2015690 - DNA, 17 bp, Homo sapiens
cagagggaatgttccct

SEQ ID NO: 2015691 - DNA, 19 bp, Homo sapiens
cagagggaatgttccctgc

SEQ ID NO: 2015692 - DNA, 21 bp, Homo sapiens
cagagggaatgttccctgcac

SEQ ID NO: 2015693 - DNA, 21 bp, Homo sapiens
cagagggaccaaattgcttct

SEQ ID NO: 2015694 - DNA, 20 bp, Homo sapiens
cagagggagtgacagaggca

SEQ ID NO: 2015695 - DNA, 22 bp, Homo sapiens
cagagggagtgacagaggcagc

SEQ ID NO: 2015696 - DNA, 13 bp, Homo sapiens
cagagggcccagg

SEQ ID NO: 2015697 - DNA, 16 bp, Homo sapiens
cagagggcccaggcag

SEQ ID NO: 2015698 - DNA, 23 bp, Homo sapiens
cagaggggaaaccagtgtagcct

SEQ ID NO: 2015699 - DNA, 18 bp, Homo sapiens
cagaggggcaggggagtg

SEQ ID NO: 2015700 - DNA, 18 bp, Homo sapiens
cagaggggctttctggag

SEQ ID NO: 2015701 - DNA, 17 bp, Homo sapiens
cagagggttgtgatttt

SEQ ID NO: 2015702 - DNA, 20 bp, Homo sapiens
cagaggtaaaagtgtgagca

SEQ ID NO: 2015703 - DNA, 21 bp, Homo sapiens
cagaggtgacccaatgctcct

SEQ ID NO: 2015704 - DNA, 22 bp, Homo sapiens
cagaggtgagcagaggagtcca

SEQ ID NO: 2015705 - DNA, 16 bp, Homo sapiens
cagagtatatatgtac

SEQ ID NO: 2015706 - DNA, 18 bp, Homo sapiens
cagagtatatatgtacag

SEQ ID NO: 2015707 - DNA, 17 bp, Homo sapiens
cagagtcagaggagaag

SEQ ID NO: 2015708 - DNA, 23 bp, Homo sapiens
cagagtcagaggagaagagacat

SEQ ID NO: 2015709 - DNA, 14 bp, Homo sapiens
cagagtcattgtta

SEQ ID NO: 2015710 - DNA, 19 bp, Homo sapiens
cagagtctcactgttgccc

SEQ ID NO: 2015711 - DNA, 22 bp, Homo sapiens
cagagtctcactgttgcccagg

SEQ ID NO: 2015712 - DNA, 20 bp, Homo sapiens
cagagtgaaagggctatggc

SEQ ID NO: 2015713 - DNA, 19 bp, Homo sapiens
cagagtgagaccctgtctc

SEQ ID NO: 2015714 - DNA, 20 bp, Homo sapiens
cagagtgagactctgtctca

SEQ ID NO: 2015715 - DNA, 15 bp, Homo sapiens
cagagtggagtctga

SEQ ID NO: 2015716 - DNA, 15 bp, Homo sapiens
cagagtgggctgcct

SEQ ID NO: 2015717 - DNA, 16 bp, Homo sapiens
cagagtgggctgcctg

SEQ ID NO: 2015718 - DNA, 17 bp, Homo sapiens
cagagtgtgcagactga

SEQ ID NO: 2015719 - DNA, 14 bp, Homo sapiens
cagagttcactata

SEQ ID NO: 2015720 - DNA, 20 bp, Homo sapiens
cagagttccacaaatctata

SEQ ID NO: 2015721 - DNA, 22 bp, Homo sapiens
cagagttccacaaatctatatt

SEQ ID NO: 2015722 - DNA, 17 bp, Homo sapiens
cagataaagacagctga

SEQ ID NO: 2015723 - DNA, 18 bp, Homo sapiens
cagataatcagcctctta

SEQ ID NO: 2015724 - DNA, 23 bp, Homo sapiens
cagatacagccccaaaccagggt

SEQ ID NO: 2015725 - DNA, 20 bp, Homo sapiens
cagatacaggaaaagctgct

SEQ ID NO: 2015726 - DNA, 16 bp, Homo sapiens
cagatacatggggaac

SEQ ID NO: 2015727 - DNA, 17 bp, Homo sapiens
cagatacattcatgagg

SEQ ID NO: 2015728 - DNA, 18 bp, Homo sapiens
cagatactggaagttttg

SEQ ID NO: 2015729 - DNA, 21 bp, Homo sapiens
cagatactggaagttttgcat

SEQ ID NO: 2015730 - DNA, 17 bp, Homo sapiens
cagatagacagtgctgc

SEQ ID NO: 2015731 - DNA, 18 bp, Homo sapiens
cagatagccagacacatg

SEQ ID NO: 2015732 - DNA, 19 bp, Homo sapiens
cagatagccagacacatgg

SEQ ID NO: 2015733 - DNA, 18 bp, Homo sapiens
cagatataaatggctggt

SEQ ID NO: 2015734 - DNA, 20 bp, Homo sapiens
cagatataaatggctggttt

SEQ ID NO: 2015735 - DNA, 14 bp, Homo sapiens
cagatatacacatg

SEQ ID NO: 2015736 - DNA, 18 bp, Homo sapiens
cagatatgatatgtaaac

SEQ ID NO: 2015737 - DNA, 18 bp, Homo sapiens
cagatatttccatttctt

SEQ ID NO: 2015738 - DNA, 21 bp, Homo sapiens
cagatcaccagcccggcctgc

SEQ ID NO: 2015739 - DNA, 15 bp, Homo sapiens
cagatcgatcctgga

SEQ ID NO: 2015740 - DNA, 22 bp, Homo sapiens
cagatcgtattaattatctgat

SEQ ID NO: 2015741 - DNA, 22 bp, Homo sapiens
cagatctcatggaaactggcca

SEQ ID NO: 2015742 - DNA, 14 bp, Homo sapiens
cagatctgaacaca

SEQ ID NO: 2015743 - DNA, 16 bp, Homo sapiens
cagatctgcctgggcc

SEQ ID NO: 2015744 - DNA, 20 bp, Homo sapiens
cagatctgcctgggcctgtg

SEQ ID NO: 2015745 - DNA, 18 bp, Homo sapiens
cagatgagattccctctc

SEQ ID NO: 2015746 - DNA, 20 bp, Homo sapiens
cagatgagattccctctcct

SEQ ID NO: 2015747 - DNA, 18 bp, Homo sapiens
cagatgagcagtcacact

SEQ ID NO: 2015748 - DNA, 15 bp, Homo sapiens
cagatgataaatatt

SEQ ID NO: 2015749 - DNA, 17 bp, Homo sapiens
cagatgataaatattta

SEQ ID NO: 2015750 - DNA, 18 bp, Homo sapiens
cagatgatctctccacgg

SEQ ID NO: 2015751 - DNA, 13 bp, Homo sapiens
cagatgcaacctc

SEQ ID NO: 2015752 - DNA, 19 bp, Homo sapiens
cagatgcaacctcactatg

SEQ ID NO: 2015753 - DNA, 16 bp, Homo sapiens
cagatgcaccagccct

SEQ ID NO: 2015754 - DNA, 19 bp, Homo sapiens
cagatgcccagagggccca

SEQ ID NO: 2015755 - DNA, 20 bp, Homo sapiens
cagatgcccagagggcccag

SEQ ID NO: 2015756 - DNA, 14 bp, Homo sapiens
cagatggaaagaaa

SEQ ID NO: 2015757 - DNA, 16 bp, Homo sapiens
cagatggaggtgccat

SEQ ID NO: 2015758 - DNA, 15 bp, Homo sapiens
cagatggtcacacag

SEQ ID NO: 2015759 - DNA, 23 bp, Homo sapiens
cagattattttagtctgtcatcc

SEQ ID NO: 2015760 - DNA, 15 bp, Homo sapiens
cagattcatttttct

SEQ ID NO: 2015761 - DNA, 18 bp, Homo sapiens
cagattcccagagcaaaa

SEQ ID NO: 2015762 - DNA, 21 bp, Homo sapiens
cagattcccagagcaaaataa

SEQ ID NO: 2015763 - DNA, 16 bp, Homo sapiens
cagattcctgggcctg

SEQ ID NO: 2015764 - DNA, 19 bp, Homo sapiens
cagattcctgggcctgtcc

SEQ ID NO: 2015765 - DNA, 23 bp, Homo sapiens
cagattctgatttttttgttgtt

SEQ ID NO: 2015766 - DNA, 13 bp, Homo sapiens
cagattgtttgca

SEQ ID NO: 2015767 - DNA, 17 bp, Homo sapiens
cagatttagtgaaagct

SEQ ID NO: 2015768 - DNA, 20 bp, Homo sapiens
cagatttagtgaaagctaga

SEQ ID NO: 2015769 - DNA, 22 bp, Homo sapiens
cagatttagtgaaagctagaga

SEQ ID NO: 2015770 - DNA, 16 bp, Homo sapiens
cagatttcctgtgtgg

SEQ ID NO: 2015771 - DNA, 17 bp, Homo sapiens
cagatttcctgtgtggg

SEQ ID NO: 2015772 - DNA, 12 bp, Homo sapiens
cagattttagac

SEQ ID NO: 2015773 - DNA, 16 bp, Homo sapiens
cagatttttacacatg

SEQ ID NO: 2015774 - DNA, 19 bp, Homo sapiens
cagatttttgggctccact

SEQ ID NO: 2015775 - DNA, 20 bp, Homo sapiens
cagattttttttggactgtt

SEQ ID NO: 2015776 - DNA, 12 bp, Homo sapiens
cagcaaatcctc

SEQ ID NO: 2015777 - DNA, 13 bp, Homo sapiens
cagcaaatcctct

SEQ ID NO: 2015778 - DNA, 21 bp, Homo sapiens
cagcaacacaagctggaagca

SEQ ID NO: 2015779 - DNA, 19 bp, Homo sapiens
cagcaacaggaatctcaga

SEQ ID NO: 2015780 - DNA, 22 bp, Homo sapiens
cagcaacaggaatctcagagac

SEQ ID NO: 2015781 - DNA, 14 bp, Homo sapiens
cagcaactcccacg

SEQ ID NO: 2015782 - DNA, 20 bp, Homo sapiens
cagcaagacttctctttgcc

SEQ ID NO: 2015783 - DNA, 23 bp, Homo sapiens
cagcaagacttctctttgcctca

SEQ ID NO: 2015784 - DNA, 19 bp, Homo sapiens
cagcaaggcccgagcagct

SEQ ID NO: 2015785 - DNA, 23 bp, Homo sapiens
cagcaaggcccgagcagctgagc

SEQ ID NO: 2015786 - DNA, 19 bp, Homo sapiens
cagcaagggtgatgggaaa

SEQ ID NO: 2015787 - DNA, 22 bp, Homo sapiens
cagcaagggtgatgggaaagca

SEQ ID NO: 2015788 - DNA, 23 bp, Homo sapiens
cagcaagggtgatgggaaagcat

SEQ ID NO: 2015789 - DNA, 16 bp, Homo sapiens
cagcaaggtgtgaatg

SEQ ID NO: 2015790 - DNA, 21 bp, Homo sapiens
cagcaaggtgtgaatgacctt

SEQ ID NO: 2015791 - DNA, 17 bp, Homo sapiens
cagcaatagggtgcagt

SEQ ID NO: 2015792 - DNA, 21 bp, Homo sapiens
cagcaatagggtgcagttttc

SEQ ID NO: 2015793 - DNA, 15 bp, Homo sapiens
cagcaatatgtaaat

SEQ ID NO: 2015794 - DNA, 13 bp, Homo sapiens
cagcacaccccaa

SEQ ID NO: 2015795 - DNA, 17 bp, Homo sapiens
atggagagaggggaata

SEQ ID NO: 2015796 - DNA, 20 bp, Homo sapiens
atggagagctagaacccggc

SEQ ID NO: 2015797 - DNA, 11 bp, Homo sapiens
atggagctgag

SEQ ID NO: 2015798 - DNA, 13 bp, Homo sapiens
atggagcttgtac

SEQ ID NO: 2015799 - DNA, 22 bp, Homo sapiens
atggaggaaaaccaagccgtgg

SEQ ID NO: 2015800 - DNA, 11 bp, Homo sapiens
atggaggagaa

SEQ ID NO: 2015801 - DNA, 13 bp, Homo sapiens
atggaggagaaat

SEQ ID NO: 2015802 - DNA, 16 bp, Homo sapiens
atggaggagaaataaa

SEQ ID NO: 2015803 - DNA, 18 bp, Homo sapiens
atggaggatggagagagg

SEQ ID NO: 2015804 - DNA, 12 bp, Homo sapiens
atggaggcaggc

SEQ ID NO: 2015805 - DNA, 14 bp, Homo sapiens
atggagggcagagt

SEQ ID NO: 2015806 - DNA, 24 bp, Homo sapiens
atggagggcagagtgggctgcctg

SEQ ID NO: 2015807 - DNA, 12 bp, Homo sapiens
atggagggtggg

SEQ ID NO: 2015808 - DNA, 17 bp, Homo sapiens
atggagtaatggtcacg

SEQ ID NO: 2015809 - DNA, 21 bp, Homo sapiens
atggagtgggagatcagccac

SEQ ID NO: 2015810 - DNA, 21 bp, Homo sapiens
atggagtgtcaccagctgcca

SEQ ID NO: 2015811 - DNA, 15 bp, Homo sapiens
atggagttcttgtgc

SEQ ID NO: 2015812 - DNA, 14 bp, Homo sapiens
atggatgctgggga

SEQ ID NO: 2015813 - DNA, 12 bp, Homo sapiens
atggatgtgctt

SEQ ID NO: 2015814 - DNA, 14 bp, Homo sapiens
atggcaaaaatggc

SEQ ID NO: 2015815 - DNA, 23 bp, Homo sapiens
atggcaagaaagctggtaaacta

SEQ ID NO: 2015816 - DNA, 16 bp, Homo sapiens
atggcaattttgtaac

SEQ ID NO: 2015817 - DNA, 20 bp, Homo sapiens
atggcacttagctatcagaa

SEQ ID NO: 2015818 - DNA, 22 bp, Homo sapiens
atggcacttagctatcagaaga

SEQ ID NO: 2015819 - DNA, 16 bp, Homo sapiens
atggcagtccagccag

SEQ ID NO: 2015820 - DNA, 21 bp, Homo sapiens
atggcagtccagccagctcct

SEQ ID NO: 2015821 - DNA, 18 bp, Homo sapiens
atggcagtgttcctattt

SEQ ID NO: 2015822 - DNA, 15 bp, Homo sapiens
atggcatgatttata

SEQ ID NO: 2015823 - DNA, 16 bp, Homo sapiens
atggccaggtggccac

SEQ ID NO: 2015824 - DNA, 11 bp, Homo sapiens
atggccctggg

SEQ ID NO: 2015825 - DNA, 21 bp, Homo sapiens
atggcctattatattaaaata

SEQ ID NO: 2015826 - DNA, 17 bp, Homo sapiens
atggcctctggccaggc

SEQ ID NO: 2015827 - DNA, 20 bp, Homo sapiens
atggcctgccttgaagccac

SEQ ID NO: 2015828 - DNA, 17 bp, Homo sapiens
atggcgcgggaggcacc

SEQ ID NO: 2015829 - DNA, 18 bp, Homo sapiens
atggcgcgggaggcacca

SEQ ID NO: 2015830 - DNA, 18 bp, Homo sapiens
atggcgtaatgggcctgc

SEQ ID NO: 2015831 - DNA, 20 bp, Homo sapiens
atggcgtaatgggcctgccc

SEQ ID NO: 2015832 - DNA, 16 bp, Homo sapiens
atggctaattcccaga

SEQ ID NO: 2015833 - DNA, 13 bp, Homo sapiens
atggctataaata

SEQ ID NO: 2015834 - DNA, 14 bp, Homo sapiens
atggctataaatat

SEQ ID NO: 2015835 - DNA, 16 bp, Homo sapiens
atggctataggtgcta

SEQ ID NO: 2015836 - DNA, 23 bp, Homo sapiens
atggctataggtgctacaaaaac

SEQ ID NO: 2015837 - DNA, 20 bp, Homo sapiens
atggctcaggcaagcccctc

SEQ ID NO: 2015838 - DNA, 22 bp, Homo sapiens
atggctcaggcaagcccctcag

SEQ ID NO: 2015839 - DNA, 15 bp, Homo sapiens
atggctctgtgaaat

SEQ ID NO: 2015840 - DNA, 18 bp, Homo sapiens
atggctgactttgctctt

SEQ ID NO: 2015841 - DNA, 11 bp, Homo sapiens
atggctgcctg

SEQ ID NO: 2015842 - DNA, 14 bp, Homo sapiens
atggctgtaaacta

SEQ ID NO: 2015843 - DNA, 20 bp, Homo sapiens
atggctgtaaactataaact

SEQ ID NO: 2015844 - DNA, 16 bp, Homo sapiens
atggctgtatttttag

SEQ ID NO: 2015845 - DNA, 19 bp, Homo sapiens
atggctgtatttttagaga

SEQ ID NO: 2015846 - DNA, 13 bp, Homo sapiens
atggctgtgagga

SEQ ID NO: 2015847 - DNA, 14 bp, Homo sapiens
atggctgtgaggat

SEQ ID NO: 2015848 - DNA, 15 bp, Homo sapiens
atggctgtgcctctg

SEQ ID NO: 2015849 - DNA, 14 bp, Homo sapiens
ataaaatatcctca

SEQ ID NO: 2015850 - DNA, 20 bp, Homo sapiens
ataaaatcatgtacatttct

SEQ ID NO: 2015851 - DNA, 11 bp, Homo sapiens
ataaaatctgt

SEQ ID NO: 2015852 - DNA, 17 bp, Homo sapiens
ataaaatgaaatgtctt

SEQ ID NO: 2015853 - DNA, 12 bp, Homo sapiens
ataaaatgatgt

SEQ ID NO: 2015854 - DNA, 16 bp, Homo sapiens
ataaaattagaaagca

SEQ ID NO: 2015855 - DNA, 13 bp, Homo sapiens
ataaaattatgcc

SEQ ID NO: 2015856 - DNA, 14 bp, Homo sapiens
ataaaattgtgatg

SEQ ID NO: 2015857 - DNA, 14 bp, Homo sapiens
ataaacagcattta

SEQ ID NO: 2015858 - DNA, 12 bp, Homo sapiens
ataaacattaaa

SEQ ID NO: 2015859 - DNA, 16 bp, Homo sapiens
ataaacattaaaagaa

SEQ ID NO: 2015860 - DNA, 20 bp, Homo sapiens
ataaacattaaaagaagact

SEQ ID NO: 2015861 - DNA, 15 bp, Homo sapiens
ataaacattaaatgt

SEQ ID NO: 2015862 - DNA, 23 bp, Homo sapiens
ataaacattaagattgaggcctg

SEQ ID NO: 2015863 - DNA, 15 bp, Homo sapiens
ataaactagatctcc

SEQ ID NO: 2015864 - DNA, 18 bp, Homo sapiens
ataaactagtttccagtg

SEQ ID NO: 2015865 - DNA, 19 bp, Homo sapiens
ataaactagtttccagtgg

SEQ ID NO: 2015866 - DNA, 19 bp, Homo sapiens
ataaactgaaaaatgtcag

SEQ ID NO: 2015867 - DNA, 14 bp, Homo sapiens
ataaactgagcctc

SEQ ID NO: 2015868 - DNA, 15 bp, Homo sapiens
ataaacttaattttg

SEQ ID NO: 2015869 - DNA, 12 bp, Homo sapiens
ataaacttcagc

SEQ ID NO: 2015870 - DNA, 13 bp, Homo sapiens
ataaacttgtgta

SEQ ID NO: 2015871 - DNA, 22 bp, Homo sapiens
ataaagaactccttattttgta

SEQ ID NO: 2015872 - DNA, 12 bp, Homo sapiens
ataaagacacct

SEQ ID NO: 2015873 - DNA, 16 bp, Homo sapiens
ataaagacttcatgtt

SEQ ID NO: 2015874 - DNA, 15 bp, Homo sapiens
ataaagataaaatat

SEQ ID NO: 2015875 - DNA, 17 bp, Homo sapiens
ataaagatggctattat

SEQ ID NO: 2015876 - DNA, 21 bp, Homo sapiens
ataaagattttttaataattt

SEQ ID NO: 2015877 - DNA, 14 bp, Homo sapiens
ataaagctactgaa

SEQ ID NO: 2015878 - DNA, 15 bp, Homo sapiens
ataaagctactgaat

SEQ ID NO: 2015879 - DNA, 16 bp, Homo sapiens
ataaagctactgaatt

SEQ ID NO: 2015880 - DNA, 17 bp, Homo sapiens
ataaagctactgaattt

SEQ ID NO: 2015881 - DNA, 11 bp, Homo sapiens
ataaagctgga

SEQ ID NO: 2015882 - DNA, 20 bp, Homo sapiens
ataaagctggacaagaagct

SEQ ID NO: 2015883 - DNA, 21 bp, Homo sapiens
ataaagctggacaagaagctg

SEQ ID NO: 2015884 - DNA, 13 bp, Homo sapiens
ataaaggtattta

SEQ ID NO: 2015885 - DNA, 21 bp, Homo sapiens
ataaaggtatttagaatatat

SEQ ID NO: 2015886 - DNA, 22 bp, Homo sapiens
ataaaggtctttgcacatgtga

SEQ ID NO: 2015887 - DNA, 20 bp, Homo sapiens
ataaaggtggtatgtgtgtg

SEQ ID NO: 2015888 - DNA, 21 bp, Homo sapiens
ataaaggttgacaataaatgt

SEQ ID NO: 2015889 - DNA, 22 bp, Homo sapiens
ataaaggttgacaataaatgtg

SEQ ID NO: 2015890 - DNA, 15 bp, Homo sapiens
ataaagtatcatcag

SEQ ID NO: 2015891 - DNA, 15 bp, Homo sapiens
ataaagtatcatgca

SEQ ID NO: 2015892 - DNA, 15 bp, Homo sapiens
ataaagtatgccttc

SEQ ID NO: 2015893 - DNA, 19 bp, Homo sapiens
ataaagtcaggacctggct

SEQ ID NO: 2015894 - DNA, 15 bp, Homo sapiens
ataaagtctgagtgg

SEQ ID NO: 2015895 - DNA, 21 bp, Homo sapiens
ataaagttctgagtgttttta

SEQ ID NO: 2015896 - DNA, 22 bp, Homo sapiens
ataaagttgaagctaagattta

SEQ ID NO: 2015897 - DNA, 21 bp, Homo sapiens
ataaagttgataaagattttt

SEQ ID NO: 2015898 - DNA, 17 bp, Homo sapiens
ataaataaaaatattct

SEQ ID NO: 2015899 - DNA, 18 bp, Homo sapiens
ataaataaaaatattctc

SEQ ID NO: 2015900 - DNA, 14 bp, Homo sapiens
ataaataaatgcca

SEQ ID NO: 2015901 - DNA, 22 bp, Homo sapiens
ataaatagatttgattatttcc

SEQ ID NO: 2015902 - DNA, 23 bp, Homo sapiens
ataaatatataaaaagaaaagat

SEQ ID NO: 2015903 - DNA, 20 bp, Homo sapiens
ataaatatatatttttcaac

SEQ ID NO: 2015904 - DNA, 14 bp, Homo sapiens
ataaatattttaca

SEQ ID NO: 2015905 - DNA, 18 bp, Homo sapiens
ataaatattttacagtat

SEQ ID NO: 2015906 - DNA, 15 bp, Homo sapiens
ataaatcaatgtcac

SEQ ID NO: 2015907 - DNA, 15 bp, Homo sapiens
ataaatccaaagtaa

SEQ ID NO: 2015908 - DNA, 20 bp, Homo sapiens
ataaatctgagcctaaatct

SEQ ID NO: 2015909 - DNA, 17 bp, Homo sapiens
ataaatgcaatatgtat

SEQ ID NO: 2015910 - DNA, 17 bp, Homo sapiens
ataaatgccctctctga

SEQ ID NO: 2015911 - DNA, 16 bp, Homo sapiens
ataaatggctggtttt

SEQ ID NO: 2015912 - DNA, 13 bp, Homo sapiens
ataaatgtatata

SEQ ID NO: 2015913 - DNA, 14 bp, Homo sapiens
ataaatgtatatac

SEQ ID NO: 2015914 - DNA, 17 bp, Homo sapiens
ataaatgtatcatagaa

SEQ ID NO: 2015915 - DNA, 17 bp, Homo sapiens
ataaatgtcattaaaat

SEQ ID NO: 2015916 - DNA, 21 bp, Homo sapiens
ataaatgtcattaaaataaat

SEQ ID NO: 2015917 - DNA, 19 bp, Homo sapiens
ataaatgtgccttcatttt

SEQ ID NO: 2015918 - DNA, 19 bp, Homo sapiens
ataaatgtgtaaatgtgga

SEQ ID NO: 2015919 - DNA, 14 bp, Homo sapiens
ataaatgtgtattc

SEQ ID NO: 2015920 - DNA, 21 bp, Homo sapiens
ataaatgtgtggtgctaactg

SEQ ID NO: 2015921 - DNA, 12 bp, Homo sapiens
ataaatgttcaa

SEQ ID NO: 2015922 - DNA, 17 bp, Homo sapiens
ataaatgttcaaactgt

SEQ ID NO: 2015923 - DNA, 20 bp, Homo sapiens
ataaatgtttaaatataaat

SEQ ID NO: 2015924 - DNA, 15 bp, Homo sapiens
ataaatgtttttatt

SEQ ID NO: 2015925 - DNA, 17 bp, Homo sapiens
ataaatgtttttattaa

SEQ ID NO: 2015926 - DNA, 14 bp, Homo sapiens
ataaattcaaacca

SEQ ID NO: 2015927 - DNA, 16 bp, Homo sapiens
ataaattcaaaccatt

SEQ ID NO: 2015928 - DNA, 14 bp, Homo sapiens
atggcttaatgttt

SEQ ID NO: 2015929 - DNA, 15 bp, Homo sapiens
atggcttataaatgt

SEQ ID NO: 2015930 - DNA, 17 bp, Homo sapiens
atggcttggggagcaga

SEQ ID NO: 2015931 - DNA, 19 bp, Homo sapiens
atggcttggggagcagagt

SEQ ID NO: 2015932 - DNA, 16 bp, Homo sapiens
atggctttgctttgtg

SEQ ID NO: 2015933 - DNA, 19 bp, Homo sapiens
atggctttgctttgtgtaa

SEQ ID NO: 2015934 - DNA, 14 bp, Homo sapiens
atgggaagacatga

SEQ ID NO: 2015935 - DNA, 21 bp, Homo sapiens
atgggaagatggtagcagata

SEQ ID NO: 2015936 - DNA, 23 bp, Homo sapiens
atgggagagtagatggtgaaatt

SEQ ID NO: 2015937 - DNA, 15 bp, Homo sapiens
atgggagcctgaggc

SEQ ID NO: 2015938 - DNA, 21 bp, Homo sapiens
atgggagctggttagaaatgc

SEQ ID NO: 2015939 - DNA, 19 bp, Homo sapiens
atgggagggagggagaggt

SEQ ID NO: 2015940 - DNA, 22 bp, Homo sapiens
atgggattagattcatctatgg

SEQ ID NO: 2015941 - DNA, 23 bp, Homo sapiens
atgggattagattcatctatgga

SEQ ID NO: 2015942 - DNA, 18 bp, Homo sapiens
atgggcaacccccagcct

SEQ ID NO: 2015943 - DNA, 22 bp, Homo sapiens
atgggcaattctgacttctccc

SEQ ID NO: 2015944 - DNA, 16 bp, Homo sapiens
atgggcacatgaggag

SEQ ID NO: 2015945 - DNA, 18 bp, Homo sapiens
atgggcagtgcctcctgg

SEQ ID NO: 2015946 - DNA, 20 bp, Homo sapiens
atgggcagtgcctcctggga

SEQ ID NO: 2015947 - DNA, 20 bp, Homo sapiens
atgggccaattaaaatatat

SEQ ID NO: 2015948 - DNA, 22 bp, Homo sapiens
atgggccaattaaaatatatat

SEQ ID NO: 2015949 - DNA, 15 bp, Homo sapiens
atgggcctcctgtgt

SEQ ID NO: 2015950 - DNA, 17 bp, Homo sapiens
atgggcctcctgtgtgt

SEQ ID NO: 2015951 - DNA, 13 bp, Homo sapiens
atgggcctgggcc

SEQ ID NO: 2015952 - DNA, 16 bp, Homo sapiens
atgggcctgggcctgc

SEQ ID NO: 2015953 - DNA, 18 bp, Homo sapiens
atgggcttggacttcctg

SEQ ID NO: 2015954 - DNA, 19 bp, Homo sapiens
atgggcttggacttcctgg

SEQ ID NO: 2015955 - DNA, 23 bp, Homo sapiens
atgggcttgttttcttgccaatg

SEQ ID NO: 2015956 - DNA, 15 bp, Homo sapiens
atggggaagtgctcc

SEQ ID NO: 2015957 - DNA, 12 bp, Homo sapiens
atggggagaaag

SEQ ID NO: 2015958 - DNA, 13 bp, Homo sapiens
atggggagaaagg

SEQ ID NO: 2015959 - DNA, 12 bp, Homo sapiens
atggggatgcag

SEQ ID NO: 2015960 - DNA, 15 bp, Homo sapiens
atggggcggcaattg

SEQ ID NO: 2015961 - DNA, 13 bp, Homo sapiens
atgggggactgag

SEQ ID NO: 2015962 - DNA, 19 bp, Homo sapiens
atgggtctggctgagctga

SEQ ID NO: 2015963 - DNA, 15 bp, Homo sapiens
atgggtgatatcctg

SEQ ID NO: 2015964 - DNA, 15 bp, Homo sapiens
atgggtgctggcaga

SEQ ID NO: 2015965 - DNA, 17 bp, Homo sapiens
atggtaatctacagctc

SEQ ID NO: 2015966 - DNA, 16 bp, Homo sapiens
atggtatgctggccag

SEQ ID NO: 2015967 - DNA, 17 bp, Homo sapiens
atggtatgctggccagc

SEQ ID NO: 2015968 - DNA, 16 bp, Homo sapiens
atggtcagctcacacc

SEQ ID NO: 2015969 - DNA, 20 bp, Homo sapiens
atggtcagtgtggagagggg

SEQ ID NO: 2015970 - DNA, 22 bp, Homo sapiens
atggtcatctttttctctaaaa

SEQ ID NO: 2015971 - DNA, 15 bp, Homo sapiens
atggtccggtgtcct

SEQ ID NO: 2015972 - DNA, 15 bp, Homo sapiens
atggtcgcccaggag

SEQ ID NO: 2015973 - DNA, 14 bp, Homo sapiens
atggtgaaaatgta

SEQ ID NO: 2015974 - DNA, 16 bp, Homo sapiens
atggtgaaaatgtact

SEQ ID NO: 2015975 - DNA, 17 bp, Homo sapiens
atggtgaaaatgtactg

SEQ ID NO: 2015976 - DNA, 14 bp, Homo sapiens
atggtgagctggga

SEQ ID NO: 2015977 - DNA, 20 bp, Homo sapiens
atggtgcagttgacagcagg

SEQ ID NO: 2015978 - DNA, 14 bp, Homo sapiens
atggtgccttcatt

SEQ ID NO: 2015979 - DNA, 14 bp, Homo sapiens
atggtgctgacctc

SEQ ID NO: 2015980 - DNA, 18 bp, Homo sapiens
atggtgtaatgcacaatt

SEQ ID NO: 2015981 - DNA, 20 bp, Homo sapiens
atggtgtaatgcacaattta

SEQ ID NO: 2015982 - DNA, 18 bp, Homo sapiens
atggtgtgaaagtcagat

SEQ ID NO: 2015983 - DNA, 22 bp, Homo sapiens
atggtgtgaaagtcagatgccc

SEQ ID NO: 2015984 - DNA, 16 bp, Homo sapiens
atgtctgccacagaga

SEQ ID NO: 2015985 - DNA, 24 bp, Homo sapiens
atgtctgtgtgtgtgtgtgtatgt

SEQ ID NO: 2015986 - DNA, 19 bp, Homo sapiens
atgtcttcatttcattgta

SEQ ID NO: 2015987 - DNA, 20 bp, Homo sapiens
atgtcttcatttcattgtat

SEQ ID NO: 2015988 - DNA, 18 bp, Homo sapiens
atgtctttctccaaagtt

SEQ ID NO: 2015989 - DNA, 20 bp, Homo sapiens
atgtctttgttggaaaagaa

SEQ ID NO: 2015990 - DNA, 16 bp, Homo sapiens
atgtctttttaagctt

SEQ ID NO: 2015991 - DNA, 23 bp, Homo sapiens
atgtctttttaagcttatttaat

SEQ ID NO: 2015992 - DNA, 15 bp, Homo sapiens
atgtgaacacatcag

SEQ ID NO: 2015993 - DNA, 20 bp, Homo sapiens
atgtgacaacctttgtgtaa

SEQ ID NO: 2015994 - DNA, 14 bp, Homo sapiens
atgtgacacattct

SEQ ID NO: 2015995 - DNA, 16 bp, Homo sapiens
atgtgacaggtaaact

SEQ ID NO: 2015996 - DNA, 21 bp, Homo sapiens
atgtgatacccatagcttcca

SEQ ID NO: 2015997 - DNA, 17 bp, Homo sapiens
atgtgatccttttatgt

SEQ ID NO: 2015998 - DNA, 23 bp, Homo sapiens
atgtgatccttttatgttattta

SEQ ID NO: 2015999 - DNA, 14 bp, Homo sapiens
atgtgatgttaact

SEQ ID NO: 2016000 - DNA, 15 bp, Homo sapiens
atgtgattcaaaaga

SEQ ID NO: 2016001 - DNA, 16 bp, Homo sapiens
atgtgattccttttga

SEQ ID NO: 2016002 - DNA, 20 bp, Homo sapiens
atgtgatttttgtgaagtta

SEQ ID NO: 2016003 - DNA, 19 bp, Homo sapiens
atgtgcaaattttgcattt

SEQ ID NO: 2016004 - DNA, 15 bp, Homo sapiens
atgtgcacatgtgtc

SEQ ID NO: 2016005 - DNA, 17 bp, Homo sapiens
atgtgcacatgtgtctg

SEQ ID NO: 2016006 - DNA, 18 bp, Homo sapiens
atgtgcacatgtgtctgt

SEQ ID NO: 2016007 - DNA, 15 bp, Homo sapiens
atgtgcacggcagct

SEQ ID NO: 2016008 - DNA, 22 bp, Homo sapiens
atgtgcacggcagcttgagcct

SEQ ID NO: 2016009 - DNA, 18 bp, Homo sapiens
atgtgcagtattttatta

SEQ ID NO: 2016010 - DNA, 17 bp, Homo sapiens
atgtgcattctccagcc

SEQ ID NO: 2016011 - DNA, 11 bp, Homo sapiens
atgtgcatttc

SEQ ID NO: 2016012 - DNA, 15 bp, Homo sapiens
atgtgccaaggtggg

SEQ ID NO: 2016013 - DNA, 21 bp, Homo sapiens
atgtgccattttaataaaatg

SEQ ID NO: 2016014 - DNA, 15 bp, Homo sapiens
atgtgcccacaggga

SEQ ID NO: 2016015 - DNA, 16 bp, Homo sapiens
atgtgcccacagggac

SEQ ID NO: 2016016 - DNA, 20 bp, Homo sapiens
atgtgcgtctctctttctcc

SEQ ID NO: 2016017 - DNA, 18 bp, Homo sapiens
atgtgctattgaactgag

SEQ ID NO: 2016018 - DNA, 21 bp, Homo sapiens
atgtgcttccctaggctgagc

SEQ ID NO: 2016019 - DNA, 22 bp, Homo sapiens
atgtgcttccctaggctgagct

SEQ ID NO: 2016020 - DNA, 14 bp, Homo sapiens
atgtggagtggaca

SEQ ID NO: 2016021 - DNA, 15 bp, Homo sapiens
atgtggatttcctat

SEQ ID NO: 2016022 - DNA, 20 bp, Homo sapiens
atgtggatttcctattttaa

SEQ ID NO: 2016023 - DNA, 22 bp, Homo sapiens
atgtggatttcctattttaaaa

SEQ ID NO: 2016024 - DNA, 17 bp, Homo sapiens
atgtggccccaggtgcc

SEQ ID NO: 2016025 - DNA, 18 bp, Homo sapiens
atgtggcccctgaacaag

SEQ ID NO: 2016026 - DNA, 14 bp, Homo sapiens
atgtggccctggcc

SEQ ID NO: 2016027 - DNA, 11 bp, Homo sapiens
atgtgggatgg

SEQ ID NO: 2016028 - DNA, 18 bp, Homo sapiens
atgtgggcagtgatgtca

SEQ ID NO: 2016029 - DNA, 20 bp, Homo sapiens
atgtgggctagttgggcttc

SEQ ID NO: 2016030 - DNA, 21 bp, Homo sapiens
atgtggggtccccatcatccc

SEQ ID NO: 2016031 - DNA, 20 bp, Homo sapiens
atgtggttgcaaggccgctg

SEQ ID NO: 2016032 - DNA, 13 bp, Homo sapiens
atgtggtttatag

SEQ ID NO: 2016033 - DNA, 11 bp, Homo sapiens
atgtgtaaatg

SEQ ID NO: 2016034 - DNA, 13 bp, Homo sapiens
atgtgtaaatgga

SEQ ID NO: 2016035 - DNA, 20 bp, Homo sapiens
atgtgtaaatggagcttgta

SEQ ID NO: 2016036 - DNA, 16 bp, Homo sapiens
atgtgtaagcattgta

SEQ ID NO: 2016037 - DNA, 20 bp, Homo sapiens
atgtgtagggaaagttaaaa

SEQ ID NO: 2016038 - DNA, 16 bp, Homo sapiens
atgtgtatatatacat

SEQ ID NO: 2016039 - DNA, 17 bp, Homo sapiens
atgtgtatatatacata

SEQ ID NO: 2016040 - DNA, 18 bp, Homo sapiens
atgtgtatttgtatgtac

SEQ ID NO: 2016041 - DNA, 16 bp, Homo sapiens
atgtgtcacagctctg

SEQ ID NO: 2016042 - DNA, 21 bp, Homo sapiens
atgtgtcactactcacagtct

SEQ ID NO: 2016043 - DNA, 11 bp, Homo sapiens
atgtgtcccct

SEQ ID NO: 2016044 - DNA, 18 bp, Homo sapiens
atgtgtcccctcactctg

SEQ ID NO: 2016045 - DNA, 18 bp, Homo sapiens
atgtgtgccatagagttt

SEQ ID NO: 2016046 - DNA, 22 bp, Homo sapiens
atgtgtgccatagagtttaaca

SEQ ID NO: 2016047 - DNA, 17 bp, Homo sapiens
atgtgtgcctgtggcag

SEQ ID NO: 2016048 - DNA, 21 bp, Homo sapiens
attgacctcagctgcacattc

SEQ ID NO: 2016049 - DNA, 20 bp, Homo sapiens
attgaccttctccctcactc

SEQ ID NO: 2016050 - DNA, 16 bp, Homo sapiens
attgactgaactgcac

SEQ ID NO: 2016051 - DNA, 23 bp, Homo sapiens
attgacttcttggtttggggaga

SEQ ID NO: 2016052 - DNA, 13 bp, Homo sapiens
attgagaatttta

SEQ ID NO: 2016053 - DNA, 19 bp, Homo sapiens
attgagataatatctgtga

SEQ ID NO: 2016054 - DNA, 20 bp, Homo sapiens
attgagataatatctgtgag

SEQ ID NO: 2016055 - DNA, 21 bp, Homo sapiens
attgagatgtgtttttaatgt

SEQ ID NO: 2016056 - DNA, 21 bp, Homo sapiens
attgaggcctgccctcaggga

SEQ ID NO: 2016057 - DNA, 22 bp, Homo sapiens
attgagggaaaacataatatct

SEQ ID NO: 2016058 - DNA, 22 bp, Homo sapiens
attgagtttaagtctctgactc

SEQ ID NO: 2016059 - DNA, 21 bp, Homo sapiens
attgatacttcaggtgctttt

SEQ ID NO: 2016060 - DNA, 18 bp, Homo sapiens
attgatagagtgttatca

SEQ ID NO: 2016061 - DNA, 15 bp, Homo sapiens
attgatatgaaaaat

SEQ ID NO: 2016062 - DNA, 17 bp, Homo sapiens
attgatatgaaaaatat

SEQ ID NO: 2016063 - DNA, 23 bp, Homo sapiens
attgatcactttgttaaaaatat

SEQ ID NO: 2016064 - DNA, 13 bp, Homo sapiens
attgatgtttcca

SEQ ID NO: 2016065 - DNA, 18 bp, Homo sapiens
attgatgtttccagaaaa

SEQ ID NO: 2016066 - DNA, 19 bp, Homo sapiens
attgatgtttccagaaaat

SEQ ID NO: 2016067 - DNA, 22 bp, Homo sapiens
attgattattctgattccactt

SEQ ID NO: 2016068 - DNA, 18 bp, Homo sapiens
attgcaaagtgcgctcat

SEQ ID NO: 2016069 - DNA, 18 bp, Homo sapiens
attgcaacaggctgggct

SEQ ID NO: 2016070 - DNA, 11 bp, Homo sapiens
attgcacaatt

SEQ ID NO: 2016071 - DNA, 18 bp, Homo sapiens
attgcactatgaaaatca

SEQ ID NO: 2016072 - DNA, 17 bp, Homo sapiens
attgcaggacacaagca

SEQ ID NO: 2016073 - DNA, 15 bp, Homo sapiens
attgcatgtaaaatg

SEQ ID NO: 2016074 - DNA, 16 bp, Homo sapiens
attgcatgtaaaatgc

SEQ ID NO: 2016075 - DNA, 21 bp, Homo sapiens
attgccacaatgcctctccca

SEQ ID NO: 2016076 - DNA, 17 bp, Homo sapiens
attgcccacgctggagt

SEQ ID NO: 2016077 - DNA, 14 bp, Homo sapiens
attgccccagagcc

SEQ ID NO: 2016078 - DNA, 19 bp, Homo sapiens
attgccccagagccccact

SEQ ID NO: 2016079 - DNA, 11 bp, Homo sapiens
attgccctggt

SEQ ID NO: 2016080 - DNA, 22 bp, Homo sapiens
attgcctccacctctccttgga

SEQ ID NO: 2016081 - DNA, 19 bp, Homo sapiens
attgcctcttgcaggctga

SEQ ID NO: 2016082 - DNA, 16 bp, Homo sapiens
attgcctgcagagaga

SEQ ID NO: 2016083 - DNA, 23 bp, Homo sapiens
attgcgaaacaacttgtgttcta

SEQ ID NO: 2016084 - DNA, 16 bp, Homo sapiens
attgcggacagccacg

SEQ ID NO: 2016085 - DNA, 18 bp, Homo sapiens
attgcggacagccacggc

SEQ ID NO: 2016086 - DNA, 14 bp, Homo sapiens
attgctactgtcct

SEQ ID NO: 2016087 - DNA, 20 bp, Homo sapiens
attgctactgtcctacccac

SEQ ID NO: 2016088 - DNA, 22 bp, Homo sapiens
attgctactgtcctacccaccc

SEQ ID NO: 2016089 - DNA, 21 bp, Homo sapiens
attgctattttatttgtattc

SEQ ID NO: 2016090 - DNA, 12 bp, Homo sapiens
attgctccttga

SEQ ID NO: 2016091 - DNA, 12 bp, Homo sapiens
attgctgttgtt

SEQ ID NO: 2016092 - DNA, 13 bp, Homo sapiens
attgctgttgttg

SEQ ID NO: 2016093 - DNA, 14 bp, Homo sapiens
attgctgttgttgc

SEQ ID NO: 2016094 - DNA, 13 bp, Homo sapiens
attgcttaatccc

SEQ ID NO: 2016095 - DNA, 19 bp, Homo sapiens
attgcttacatttttacaa

SEQ ID NO: 2016096 - DNA, 10 bp, Homo sapiens
attgcttcta

SEQ ID NO: 2016097 - DNA, 23 bp, Homo sapiens
attgcttcttgtgaaaccacagg

SEQ ID NO: 2016098 - DNA, 19 bp, Homo sapiens
attgcttgaaccggggaga

SEQ ID NO: 2016099 - DNA, 18 bp, Homo sapiens
attgcttgagcccaggag

SEQ ID NO: 2016100 - DNA, 19 bp, Homo sapiens
attgcttttgttgtgactt

SEQ ID NO: 2016101 - DNA, 21 bp, Homo sapiens
attgcttttgttgtgactttt

SEQ ID NO: 2016102 - DNA, 18 bp, Homo sapiens
attggaagaaattcctgt

SEQ ID NO: 2016103 - DNA, 16 bp, Homo sapiens
attggacatggtctcc

SEQ ID NO: 2016104 - DNA, 14 bp, Homo sapiens
attggacttccttg

SEQ ID NO: 2016105 - DNA, 18 bp, Homo sapiens
attggagagtaaaaactg

SEQ ID NO: 2016106 - DNA, 23 bp, Homo sapiens
attggagggtgggagagcccagc

SEQ ID NO: 2016107 - DNA, 18 bp, Homo sapiens
attggattattcatttaa

SEQ ID NO: 2016108 - DNA, 17 bp, Homo sapiens
attggcagtgtgtcaca

SEQ ID NO: 2016109 - DNA, 18 bp, Homo sapiens
attggcatggatttctgt

SEQ ID NO: 2016110 - DNA, 20 bp, Homo sapiens
attggccactgggtctcact

SEQ ID NO: 2016111 - DNA, 16 bp, Homo sapiens
attggctatatggaat

SEQ ID NO: 2016112 - DNA, 13 bp, Homo sapiens
attgggaaatctt

SEQ ID NO: 2016113 - DNA, 16 bp, Homo sapiens
attgggagggacaggg

SEQ ID NO: 2016114 - DNA, 14 bp, Homo sapiens
attgggagggatga

SEQ ID NO: 2016115 - DNA, 15 bp, Homo sapiens
attgggagggatgag

SEQ ID NO: 2016116 - DNA, 13 bp, Homo sapiens
attggggccctct

SEQ ID NO: 2016117 - DNA, 20 bp, Homo sapiens
attggggttggttggggtgg

SEQ ID NO: 2016118 - DNA, 17 bp, Homo sapiens
attgggtgccatgtgga

SEQ ID NO: 2016119 - DNA, 15 bp, Homo sapiens
attggtaacatcctt

SEQ ID NO: 2016120 - DNA, 17 bp, Homo sapiens
attggtaggatttatat

SEQ ID NO: 2016121 - DNA, 19 bp, Homo sapiens
attggtaggatttatatct

SEQ ID NO: 2016122 - DNA, 14 bp, Homo sapiens
attggtccagcttg

SEQ ID NO: 2016123 - DNA, 18 bp, Homo sapiens
attggtgataagtggaaa

SEQ ID NO: 2016124 - DNA, 11 bp, Homo sapiens
attgtaaaaaa

SEQ ID NO: 2016125 - DNA, 21 bp, Homo sapiens
attgtaaaacctgtcaatgat

SEQ ID NO: 2016126 - DNA, 15 bp, Homo sapiens
attgtaaaatagctt

SEQ ID NO: 2016127 - DNA, 21 bp, Homo sapiens
attgtaaaatagcttgtatag

SEQ ID NO: 2016128 - DNA, 15 bp, Homo sapiens
attgtaaaattgtat

SEQ ID NO: 2016129 - DNA, 15 bp, Homo sapiens
attgtaaacagaagg

SEQ ID NO: 2016130 - DNA, 15 bp, Homo sapiens
attgtaaatgtgctt

SEQ ID NO: 2016131 - DNA, 17 bp, Homo sapiens
attgtaaatgtgctttt

SEQ ID NO: 2016132 - DNA, 13 bp, Homo sapiens
attgtaaattatt

SEQ ID NO: 2016133 - DNA, 21 bp, Homo sapiens
attgtaatgaatatctgcttt

SEQ ID NO: 2016134 - DNA, 19 bp, Homo sapiens
attgtacacaccttatatt

SEQ ID NO: 2016135 - DNA, 14 bp, Homo sapiens
attgtacagctgtt

SEQ ID NO: 2016136 - DNA, 16 bp, Homo sapiens
attgtacagctgttta

SEQ ID NO: 2016137 - DNA, 16 bp, Homo sapiens
attgtaccagaactat

SEQ ID NO: 2016138 - DNA, 19 bp, Homo sapiens
attgtacctctcttataga

SEQ ID NO: 2016139 - DNA, 17 bp, Homo sapiens
attgtagatggaaatca

SEQ ID NO: 2016140 - DNA, 16 bp, Homo sapiens
attgtagcatttcttg

SEQ ID NO: 2016141 - DNA, 13 bp, Homo sapiens
attgtagtaatct

SEQ ID NO: 2016142 - DNA, 14 bp, Homo sapiens
attgtataaaaata

SEQ ID NO: 2016143 - DNA, 21 bp, Homo sapiens
attgtataaaaatagaagaat

SEQ ID NO: 2016144 - DNA, 15 bp, Homo sapiens
attgtatacattttg

SEQ ID NO: 2016145 - DNA, 13 bp, Homo sapiens
attgtatattctg

SEQ ID NO: 2016146 - DNA, 14 bp, Homo sapiens
attgtatattctgg

SEQ ID NO: 2016147 - DNA, 16 bp, Homo sapiens
attgtatattctggaa

SEQ ID NO: 2016148 - DNA, 14 bp, Homo sapiens
attgtatcctgagg

SEQ ID NO: 2016149 - DNA, 14 bp, Homo sapiens
attgtcaaatgtca

SEQ ID NO: 2016150 - DNA, 19 bp, Homo sapiens
attgtcagagttctgctct

SEQ ID NO: 2016151 - DNA, 23 bp, Homo sapiens
attgtcagatattttttcagaaa

SEQ ID NO: 2016152 - DNA, 20 bp, Homo sapiens
attgtccatatcagacctct

SEQ ID NO: 2016153 - DNA, 22 bp, Homo sapiens
attgtccatatcagacctctga

SEQ ID NO: 2016154 - DNA, 23 bp, Homo sapiens
attgtccatatcagacctctgat

SEQ ID NO: 2016155 - DNA, 15 bp, Homo sapiens
attgtccatgtgctt

SEQ ID NO: 2016156 - DNA, 17 bp, Homo sapiens
attgtccatgtgcttcc

SEQ ID NO: 2016157 - DNA, 14 bp, Homo sapiens
attgtccttcagag

SEQ ID NO: 2016158 - DNA, 18 bp, Homo sapiens
attgtccttcagagctct

SEQ ID NO: 2016159 - DNA, 15 bp, Homo sapiens
attgtctccttgagt

SEQ ID NO: 2016160 - DNA, 11 bp, Homo sapiens
attgtcttcca

SEQ ID NO: 2016161 - DNA, 18 bp, Homo sapiens
attgtcttccaaccccag

SEQ ID NO: 2016162 - DNA, 20 bp, Homo sapiens
attgtcttccaaccccagct

SEQ ID NO: 2016163 - DNA, 22 bp, Homo sapiens
attgtcttccaaccccagctgg

SEQ ID NO: 2016164 - DNA, 14 bp, Homo sapiens
attgtgatgttttg

SEQ ID NO: 2016165 - DNA, 22 bp, Homo sapiens
attctattgcagttatagaaaa

SEQ ID NO: 2016166 - DNA, 20 bp, Homo sapiens
attctattgtgcctatgata

SEQ ID NO: 2016167 - DNA, 21 bp, Homo sapiens
attctcaacctaccacccctt

SEQ ID NO: 2016168 - DNA, 14 bp, Homo sapiens
attctcactccacc

SEQ ID NO: 2016169 - DNA, 23 bp, Homo sapiens
attctcatgtctcagcctcctca

SEQ ID NO: 2016170 - DNA, 15 bp, Homo sapiens
attctcatgtgatcc

SEQ ID NO: 2016171 - DNA, 14 bp, Homo sapiens
attctccaaatgat

SEQ ID NO: 2016172 - DNA, 20 bp, Homo sapiens
attctccctaaggaatctga

SEQ ID NO: 2016173 - DNA, 12 bp, Homo sapiens
attctcctcctc

SEQ ID NO: 2016174 - DNA, 17 bp, Homo sapiens
attctcctcctccctcc

SEQ ID NO: 2016175 - DNA, 13 bp, Homo sapiens
attctcctgcctc

SEQ ID NO: 2016176 - DNA, 15 bp, Homo sapiens
attctcctgcctcag

SEQ ID NO: 2016177 - DNA, 13 bp, Homo sapiens
attctcctgtgct

SEQ ID NO: 2016178 - DNA, 16 bp, Homo sapiens
attctctcctcagact

SEQ ID NO: 2016179 - DNA, 19 bp, Homo sapiens
attctctcctcagactgct

SEQ ID NO: 2016180 - DNA, 17 bp, Homo sapiens
attctctctaaaaataa

SEQ ID NO: 2016181 - DNA, 22 bp, Homo sapiens
attctctttctttttctgtctc

SEQ ID NO: 2016182 - DNA, 16 bp, Homo sapiens
attctgaacaattctc

SEQ ID NO: 2016183 - DNA, 16 bp, Homo sapiens
attctgacttctccca

SEQ ID NO: 2016184 - DNA, 16 bp, Homo sapiens
attctgagctggccct

SEQ ID NO: 2016185 - DNA, 12 bp, Homo sapiens
attctgattcag

SEQ ID NO: 2016186 - DNA, 16 bp, Homo sapiens
attctgcaactagcca

SEQ ID NO: 2016187 - DNA, 14 bp, Homo sapiens
attctgcctgccca

SEQ ID NO: 2016188 - DNA, 17 bp, Homo sapiens
attctgcctgcccaggc

SEQ ID NO: 2016189 - DNA, 20 bp, Homo sapiens
attctgcctgcccaggcccc

SEQ ID NO: 2016190 - DNA, 15 bp, Homo sapiens
attctgctacctcac

SEQ ID NO: 2016191 - DNA, 19 bp, Homo sapiens
attctgctacctcactggg

SEQ ID NO: 2016192 - DNA, 20 bp, Homo sapiens
attctgctcacatatctgtc

SEQ ID NO: 2016193 - DNA, 18 bp, Homo sapiens
attctggaaaaaaaatat

SEQ ID NO: 2016194 - DNA, 22 bp, Homo sapiens
attctggaaaaaaaatatatat

SEQ ID NO: 2016195 - DNA, 12 bp, Homo sapiens
attctggaaatg

SEQ ID NO: 2016196 - DNA, 20 bp, Homo sapiens
attctggaaatgtctttcta

SEQ ID NO: 2016197 - DNA, 18 bp, Homo sapiens
attctggaggaagaagac

SEQ ID NO: 2016198 - DNA, 14 bp, Homo sapiens
attctggctgaaaa

SEQ ID NO: 2016199 - DNA, 19 bp, Homo sapiens
attctgggctcctggaacc

SEQ ID NO: 2016200 - DNA, 20 bp, Homo sapiens
attctgtaaaatgtctgtta

SEQ ID NO: 2016201 - DNA, 12 bp, Homo sapiens
attctgtaagaa

SEQ ID NO: 2016202 - DNA, 14 bp, Homo sapiens
attctgtcttgaag

SEQ ID NO: 2016203 - DNA, 14 bp, Homo sapiens
attctgtgaagaat

SEQ ID NO: 2016204 - DNA, 17 bp, Homo sapiens
attctgtggtgggaaca

SEQ ID NO: 2016205 - DNA, 11 bp, Homo sapiens
attctgtgttg

SEQ ID NO: 2016206 - DNA, 14 bp, Homo sapiens
attctgtgttgaac

SEQ ID NO: 2016207 - DNA, 13 bp, Homo sapiens
attctgttttctt

SEQ ID NO: 2016208 - DNA, 23 bp, Homo sapiens
attcttaaaatatatttcagata

SEQ ID NO: 2016209 - DNA, 20 bp, Homo sapiens
attcttaagatttctcctga

SEQ ID NO: 2016210 - DNA, 21 bp, Homo sapiens
attcttacaaacatgtggtta

SEQ ID NO: 2016211 - DNA, 12 bp, Homo sapiens
attcttatttct

SEQ ID NO: 2016212 - DNA, 17 bp, Homo sapiens
attcttatttctgtgtt

SEQ ID NO: 2016213 - DNA, 22 bp, Homo sapiens
attcttcatcagcatttaataa

SEQ ID NO: 2016214 - DNA, 13 bp, Homo sapiens
attcttccatctg

SEQ ID NO: 2016215 - DNA, 20 bp, Homo sapiens
attcttctgcttcagcctcc

SEQ ID NO: 2016216 - DNA, 14 bp, Homo sapiens
attcttggagaact

SEQ ID NO: 2016217 - DNA, 12 bp, Homo sapiens
attctttaaatt

SEQ ID NO: 2016218 - DNA, 17 bp, Homo sapiens
attctttatttctgtca

SEQ ID NO: 2016219 - DNA, 19 bp, Homo sapiens
attctttcaagtgaatcta

SEQ ID NO: 2016220 - DNA, 20 bp, Homo sapiens
attctttcccctcagagctc

SEQ ID NO: 2016221 - DNA, 22 bp, Homo sapiens
attctttgtaccatctgtcttg

SEQ ID NO: 2016222 - DNA, 15 bp, Homo sapiens
attgaaaatatattt

SEQ ID NO: 2016223 - DNA, 15 bp, Homo sapiens
attgaaagagaacca

SEQ ID NO: 2016224 - DNA, 18 bp, Homo sapiens
attgaaagagaaccagtt

SEQ ID NO: 2016225 - DNA, 20 bp, Homo sapiens
attgaaatataatgcaaacc

SEQ ID NO: 2016226 - DNA, 14 bp, Homo sapiens
attgaacccaggag

SEQ ID NO: 2016227 - DNA, 14 bp, Homo sapiens
attgaactgagcca

SEQ ID NO: 2016228 - DNA, 14 bp, Homo sapiens
attgaagaaacaga

SEQ ID NO: 2016229 - DNA, 21 bp, Homo sapiens
attgaagagatttcaacatat

SEQ ID NO: 2016230 - DNA, 23 bp, Homo sapiens
attgaagagatttcaacatatca

SEQ ID NO: 2016231 - DNA, 17 bp, Homo sapiens
attgaaggagaaaatgc

SEQ ID NO: 2016232 - DNA, 13 bp, Homo sapiens
attgaatatatca

SEQ ID NO: 2016233 - DNA, 21 bp, Homo sapiens
attgaatatatcagaatctgt

SEQ ID NO: 2016234 - DNA, 22 bp, Homo sapiens
attgaatatatcagaatctgtg

SEQ ID NO: 2016235 - DNA, 21 bp, Homo sapiens
attgaatggctatgtttttaa

SEQ ID NO: 2016236 - DNA, 22 bp, Homo sapiens
attgaatggctatgtttttaat

SEQ ID NO: 2016237 - DNA, 15 bp, Homo sapiens
attgacaacatttta

SEQ ID NO: 2016238 - DNA, 19 bp, Homo sapiens
attgacaaggtagacatgg

SEQ ID NO: 2016239 - DNA, 13 bp, Homo sapiens
attgacacacagc

SEQ ID NO: 2016240 - DNA, 22 bp, Homo sapiens
attgacacacagcactctctaa

SEQ ID NO: 2016241 - DNA, 13 bp, Homo sapiens
attgacagaagct

SEQ ID NO: 2016242 - DNA, 16 bp, Homo sapiens
attgacctcagctgca

SEQ ID NO: 2016243 - DNA, 19 bp, Homo sapiens
attgacctcagctgcacat

SEQ ID NO: 2016244 - DNA, 20 bp, Homo sapiens
attgacctcagctgcacatt

SEQ ID NO: 2016245 - DNA, 15 bp, Homo sapiens
attgtgcaatgtaaa

SEQ ID NO: 2016246 - DNA, 18 bp, Homo sapiens
attgtgcaatgtaaatat

SEQ ID NO: 2016247 - DNA, 16 bp, Homo sapiens
attgtgggtgttaatt

SEQ ID NO: 2016248 - DNA, 18 bp, Homo sapiens
attgtggtacaatctcaa

SEQ ID NO: 2016249 - DNA, 19 bp, Homo sapiens
attgtggtacaatctcaaa

SEQ ID NO: 2016250 - DNA, 14 bp, Homo sapiens
attgtgtacaaagt

SEQ ID NO: 2016251 - DNA, 20 bp, Homo sapiens
attgtgtacaaagtagagaa

SEQ ID NO: 2016252 - DNA, 20 bp, Homo sapiens
attgtgttgccttagcactt

SEQ ID NO: 2016253 - DNA, 23 bp, Homo sapiens
attgtgttgccttagcacttctt

SEQ ID NO: 2016254 - DNA, 13 bp, Homo sapiens
attgttaaaataa

SEQ ID NO: 2016255 - DNA, 15 bp, Homo sapiens
attgttaaaataact

SEQ ID NO: 2016256 - DNA, 22 bp, Homo sapiens
attgttattgtggaagatttac

SEQ ID NO: 2016257 - DNA, 18 bp, Homo sapiens
attgttccaaatgaatgt

SEQ ID NO: 2016258 - DNA, 15 bp, Homo sapiens
attgtttaaaaacag

SEQ ID NO: 2016259 - DNA, 22 bp, Homo sapiens
attgtttaaaaacaggaaaaaa

SEQ ID NO: 2016260 - DNA, 15 bp, Homo sapiens
attgtttaattgtag

SEQ ID NO: 2016261 - DNA, 14 bp, Homo sapiens
attgtttattcttt

SEQ ID NO: 2016262 - DNA, 18 bp, Homo sapiens
attgtttatttatcagtg

SEQ ID NO: 2016263 - DNA, 19 bp, Homo sapiens
attgtttatttatcagtga

SEQ ID NO: 2016264 - DNA, 20 bp, Homo sapiens
attgtttggcttcctcctga

SEQ ID NO: 2016265 - DNA, 21 bp, Homo sapiens
attgtttggggatgagaaagg

SEQ ID NO: 2016266 - DNA, 19 bp, Homo sapiens
attgttttagagactatgg

SEQ ID NO: 2016267 - DNA, 10 bp, Homo sapiens
attgttttca

SEQ ID NO: 2016268 - DNA, 13 bp, Homo sapiens
atttaaaaaacta

SEQ ID NO: 2016269 - DNA, 17 bp, Homo sapiens
atttaaaaaactaaaaa

SEQ ID NO: 2016270 - DNA, 19 bp, Homo sapiens
atttaaaaaataaatataa

SEQ ID NO: 2016271 - DNA, 21 bp, Homo sapiens
atttaaaaaataaatataatt

SEQ ID NO: 2016272 - DNA, 21 bp, Homo sapiens
atttaaaaataaagctactga

SEQ ID NO: 2016273 - DNA, 16 bp, Homo sapiens
atttaaaaataagaaa

SEQ ID NO: 2016274 - DNA, 14 bp, Homo sapiens
atttattagctgta

SEQ ID NO: 2016275 - DNA, 16 bp, Homo sapiens
atttattagctgtaaa

SEQ ID NO: 2016276 - DNA, 18 bp, Homo sapiens
atttattagctgtaaata

SEQ ID NO: 2016277 - DNA, 12 bp, Homo sapiens
atttattattga

SEQ ID NO: 2016278 - DNA, 19 bp, Homo sapiens
atttattcaattcctctgg

SEQ ID NO: 2016279 - DNA, 18 bp, Homo sapiens
atttattcagcttcattt

SEQ ID NO: 2016280 - DNA, 14 bp, Homo sapiens
atttattcattcag

SEQ ID NO: 2016281 - DNA, 14 bp, Homo sapiens
atttattctgctca

SEQ ID NO: 2016282 - DNA, 12 bp, Homo sapiens
atttattggggt

SEQ ID NO: 2016283 - DNA, 16 bp, Homo sapiens
atttatttaaaatagc

SEQ ID NO: 2016284 - DNA, 12 bp, Homo sapiens
atttatttaata

SEQ ID NO: 2016285 - DNA, 13 bp, Homo sapiens
atttatttaataa

SEQ ID NO: 2016286 - DNA, 15 bp, Homo sapiens
atttatttaatgtta

SEQ ID NO: 2016287 - DNA, 17 bp, Homo sapiens
atttatttaatgttatg

SEQ ID NO: 2016288 - DNA, 14 bp, Homo sapiens
atttatttcaaaaa

SEQ ID NO: 2016289 - DNA, 12 bp, Homo sapiens
atttattttgac

SEQ ID NO: 2016290 - DNA, 21 bp, Homo sapiens
atttattttgacataaagttg

SEQ ID NO: 2016291 - DNA, 23 bp, Homo sapiens
atttattttgtatttttgaataa

SEQ ID NO: 2016292 - DNA, 13 bp, Homo sapiens
atttcaaaagaca

SEQ ID NO: 2016293 - DNA, 16 bp, Homo sapiens
atttcaaaagacatgt

SEQ ID NO: 2016294 - DNA, 17 bp, Homo sapiens
atttcaaaagacatgtt

SEQ ID NO: 2016295 - DNA, 17 bp, Homo sapiens
atttcaaaataaactgg

SEQ ID NO: 2016296 - DNA, 11 bp, Homo sapiens
atttcaaatgg

SEQ ID NO: 2016297 - DNA, 18 bp, Homo sapiens
atttcaaccgcttgccat

SEQ ID NO: 2016298 - DNA, 13 bp, Homo sapiens
atttcaagaaaaa

SEQ ID NO: 2016299 - DNA, 18 bp, Homo sapiens
atttcaatgattgtttaa

SEQ ID NO: 2016300 - DNA, 14 bp, Homo sapiens
atttcaattctcaa

SEQ ID NO: 2016301 - DNA, 20 bp, Homo sapiens
atttcacatcagctttagga

SEQ ID NO: 2016302 - DNA, 16 bp, Homo sapiens
atttcacattaatggt

SEQ ID NO: 2016303 - DNA, 20 bp, Homo sapiens
atttcacgtcgtcttctgta

SEQ ID NO: 2016304 - DNA, 16 bp, Homo sapiens
atttcagagaggcctt

SEQ ID NO: 2016305 - DNA, 19 bp, Homo sapiens
atttcaggatactctgtca

SEQ ID NO: 2016306 - DNA, 16 bp, Homo sapiens
atttcagttacttacc

SEQ ID NO: 2016307 - DNA, 18 bp, Homo sapiens
atttcagtttgtttactt

SEQ ID NO: 2016308 - DNA, 21 bp, Homo sapiens
atttcataaggcctgccctcc

SEQ ID NO: 2016309 - DNA, 17 bp, Homo sapiens
atttcatacaaaactgt

SEQ ID NO: 2016310 - DNA, 20 bp, Homo sapiens
atttcatacctatcatctta

SEQ ID NO: 2016311 - DNA, 15 bp, Homo sapiens
atttcatctactaca

SEQ ID NO: 2016312 - DNA, 15 bp, Homo sapiens
atttcatctatttct

SEQ ID NO: 2016313 - DNA, 19 bp, Homo sapiens
atttcatctatttctgaga

SEQ ID NO: 2016314 - DNA, 17 bp, Homo sapiens
atttcatggattattta

SEQ ID NO: 2016315 - DNA, 19 bp, Homo sapiens
atttcatggattatttatg

SEQ ID NO: 2016316 - DNA, 20 bp, Homo sapiens
atttcatggattatttatga

SEQ ID NO: 2016317 - DNA, 19 bp, Homo sapiens
atttcattgagggaaaaca

SEQ ID NO: 2016318 - DNA, 15 bp, Homo sapiens
atttcattgtatgat

SEQ ID NO: 2016319 - DNA, 16 bp, Homo sapiens
atttcattttttgcat

SEQ ID NO: 2016320 - DNA, 22 bp, Homo sapiens
atttcattttttgcatcagtat

SEQ ID NO: 2016321 - DNA, 21 bp, Homo sapiens
atttccacataaaggtattta

SEQ ID NO: 2016322 - DNA, 11 bp, Homo sapiens
atttccaggcc

SEQ ID NO: 2016323 - DNA, 12 bp, Homo sapiens
atttccaggccc

SEQ ID NO: 2016324 - DNA, 14 bp, Homo sapiens
atttccaggcccct

SEQ ID NO: 2016325 - DNA, 23 bp, Homo sapiens
atttccaggcccctgaggactgg

SEQ ID NO: 2016326 - DNA, 13 bp, Homo sapiens
atttccatttctt

SEQ ID NO: 2016327 - DNA, 17 bp, Homo sapiens
atttccatttcttcctc

SEQ ID NO: 2016328 - DNA, 13 bp, Homo sapiens
atttcccacaccc

SEQ ID NO: 2016329 - DNA, 15 bp, Homo sapiens
atttccccaccccac

SEQ ID NO: 2016330 - DNA, 14 bp, Homo sapiens
atttcccccaggga

SEQ ID NO: 2016331 - DNA, 22 bp, Homo sapiens
atttcccctctgtgtcctctcc

SEQ ID NO: 2016332 - DNA, 22 bp, Homo sapiens
atttccgaagaccttctgaaga

SEQ ID NO: 2016333 - DNA, 15 bp, Homo sapiens
atttcctacagaaat

SEQ ID NO: 2016334 - DNA, 20 bp, Homo sapiens
atttcctattttaaaaccat

SEQ ID NO: 2016335 - DNA, 23 bp, Homo sapiens
atttcctattttaaaaccatgca

SEQ ID NO: 2016336 - DNA, 19 bp, Homo sapiens
atttcctatttttggaaga

SEQ ID NO: 2016337 - DNA, 23 bp, Homo sapiens
atttcctccatggtggaaggggg

SEQ ID NO: 2016338 - DNA, 12 bp, Homo sapiens
atttccttggag

SEQ ID NO: 2016339 - DNA, 21 bp, Homo sapiens
atttcgccgttgaagaggaag

SEQ ID NO: 2016340 - DNA, 17 bp, Homo sapiens
atttctaacatatgtat

SEQ ID NO: 2016341 - DNA, 18 bp, Homo sapiens
atttctaacatatgtatt

SEQ ID NO: 2016342 - DNA, 15 bp, Homo sapiens
atttctactgtgact

SEQ ID NO: 2016343 - DNA, 17 bp, Homo sapiens
atttctactgtgactga

SEQ ID NO: 2016344 - DNA, 16 bp, Homo sapiens
atttctagcagagtga

SEQ ID NO: 2016345 - DNA, 20 bp, Homo sapiens
atttctaggtaggaaatgtg

SEQ ID NO: 2016346 - DNA, 18 bp, Homo sapiens
atttctcaatcagtgcag

SEQ ID NO: 2016347 - DNA, 17 bp, Homo sapiens
atttctcctactttaca

SEQ ID NO: 2016348 - DNA, 17 bp, Homo sapiens
atttctgagaaggtcct

SEQ ID NO: 2016349 - DNA, 23 bp, Homo sapiens
atttctgagaaggtccttaatga

SEQ ID NO: 2016350 - DNA, 15 bp, Homo sapiens
atttctggcctcagc

SEQ ID NO: 2016351 - DNA, 21 bp, Homo sapiens
atttcttaaacaaatgtatga

SEQ ID NO: 2016352 - DNA, 22 bp, Homo sapiens
atttcttatttgtttggtcact

SEQ ID NO: 2016353 - DNA, 16 bp, Homo sapiens
atttcttcgctgctct

SEQ ID NO: 2016354 - DNA, 16 bp, Homo sapiens
atttctttgtgataac

SEQ ID NO: 2016355 - DNA, 18 bp, Homo sapiens
atttcttttttaaatgaa

SEQ ID NO: 2016356 - DNA, 18 bp, Homo sapiens
atttctttttttaaattg

SEQ ID NO: 2016357 - DNA, 20 bp, Homo sapiens
atttctttttttaaattgta

SEQ ID NO: 2016358 - DNA, 22 bp, Homo sapiens
atttgaaaacataatctgcaaa

SEQ ID NO: 2016359 - DNA, 21 bp, Homo sapiens
atttgaaattttatttagttc

SEQ ID NO: 2016360 - DNA, 16 bp, Homo sapiens
atttgaagtaaaggat

SEQ ID NO: 2016361 - DNA, 22 bp, Homo sapiens
atttgaatatcattaaattgga

SEQ ID NO: 2016362 - DNA, 14 bp, Homo sapiens
atttgaatggtgca

SEQ ID NO: 2016363 - DNA, 21 bp, Homo sapiens
atttgaatggtgcagaaaaaa

SEQ ID NO: 2016364 - DNA, 20 bp, Homo sapiens
atttgacaaaataacatttg

SEQ ID NO: 2016365 - DNA, 20 bp, Homo sapiens
atttgacccactcacacttg

SEQ ID NO: 2016366 - DNA, 15 bp, Homo sapiens
atttgagagaagcca

SEQ ID NO: 2016367 - DNA, 17 bp, Homo sapiens
atttgagcaattcattt

SEQ ID NO: 2016368 - DNA, 15 bp, Homo sapiens
atttgagcagggctc

SEQ ID NO: 2016369 - DNA, 17 bp, Homo sapiens
atttgagcagggctcag

SEQ ID NO: 2016370 - DNA, 15 bp, Homo sapiens
atttgagcatgcaca

SEQ ID NO: 2016371 - DNA, 18 bp, Homo sapiens
atttgagtgattatttgt

SEQ ID NO: 2016372 - DNA, 14 bp, Homo sapiens
atttgatacaaaat

SEQ ID NO: 2016373 - DNA, 15 bp, Homo sapiens
atttgatacaaaatg

SEQ ID NO: 2016374 - DNA, 20 bp, Homo sapiens
atttgatgtttacaggtgga

SEQ ID NO: 2016375 - DNA, 17 bp, Homo sapiens
atttgatttctattcaa

SEQ ID NO: 2016376 - DNA, 17 bp, Homo sapiens
atttgcacaggttttca

SEQ ID NO: 2016377 - DNA, 14 bp, Homo sapiens
atttgccagcacag

SEQ ID NO: 2016378 - DNA, 14 bp, Homo sapiens
atttgccctgtgga

SEQ ID NO: 2016379 - DNA, 16 bp, Homo sapiens
atttgcctgtaacaag

SEQ ID NO: 2016380 - DNA, 16 bp, Homo sapiens
atttgccttctccctg

SEQ ID NO: 2016381 - DNA, 13 bp, Homo sapiens
atttgctggggaa

SEQ ID NO: 2016382 - DNA, 13 bp, Homo sapiens
atttgcttattta

SEQ ID NO: 2016383 - DNA, 16 bp, Homo sapiens
atttggaaagagacca

SEQ ID NO: 2016384 - DNA, 21 bp, Homo sapiens
atttggaagagaggcacctgc

SEQ ID NO: 2016385 - DNA, 11 bp, Homo sapiens
atttggagact

SEQ ID NO: 2016386 - DNA, 14 bp, Homo sapiens
atttggagtgtgta

SEQ ID NO: 2016387 - DNA, 14 bp, Homo sapiens
atttggatttacga

SEQ ID NO: 2016388 - DNA, 18 bp, Homo sapiens
atttggcatgcttaaata

SEQ ID NO: 2016389 - DNA, 19 bp, Homo sapiens
atttggcatgcttaaatat

SEQ ID NO: 2016390 - DNA, 16 bp, Homo sapiens
atttgggccaaggtgt

SEQ ID NO: 2016391 - DNA, 21 bp, Homo sapiens
atttggggcttgcatgccaaa

SEQ ID NO: 2016392 - DNA, 21 bp, Homo sapiens
atttggtaaattagtatttat

SEQ ID NO: 2016393 - DNA, 22 bp, Homo sapiens
atttggtgtggctgtattcaga

SEQ ID NO: 2016394 - DNA, 23 bp, Homo sapiens
atttgtaaaagaacagtaaacat

SEQ ID NO: 2016395 - DNA, 19 bp, Homo sapiens
atttgtaagcaacttgctt

SEQ ID NO: 2016396 - DNA, 22 bp, Homo sapiens
atttgtaagcaacttgcttcta

SEQ ID NO: 2016397 - DNA, 23 bp, Homo sapiens
atttgtaagtttatgtctaaaga

SEQ ID NO: 2016398 - DNA, 17 bp, Homo sapiens
atttgtaatagatgttt

SEQ ID NO: 2016399 - DNA, 22 bp, Homo sapiens
atttgtaatgtatcttatttat

SEQ ID NO: 2016400 - DNA, 21 bp, Homo sapiens
atttgtacatatgtaaaataa

SEQ ID NO: 2016401 - DNA, 21 bp, Homo sapiens
atttgtatctctgaagcatgt

SEQ ID NO: 2016402 - DNA, 23 bp, Homo sapiens
atttgtatctctgaagcatgttt

SEQ ID NO: 2016403 - DNA, 21 bp, Homo sapiens
atttgtatctgaaggagattt

SEQ ID NO: 2016404 - DNA, 20 bp, Homo sapiens
atttgtatttatattagagt

SEQ ID NO: 2016405 - DNA, 22 bp, Homo sapiens
atttgtattttgcttaaaattt

SEQ ID NO: 2016406 - DNA, 21 bp, Homo sapiens
atttgtccaatggctgtaaac

SEQ ID NO: 2016407 - DNA, 22 bp, Homo sapiens
atttgtccaatggctgtaaact

SEQ ID NO: 2016408 - DNA, 20 bp, Homo sapiens
atttgtcctctttacatgaa

SEQ ID NO: 2016409 - DNA, 13 bp, Homo sapiens
atttgtggtcaca

SEQ ID NO: 2016410 - DNA, 21 bp, Homo sapiens
atttgtgtaatagaaaactga

SEQ ID NO: 2016411 - DNA, 21 bp, Homo sapiens
atttgtgtagattgtgtaaat

SEQ ID NO: 2016412 - DNA, 18 bp, Homo sapiens
atttgttaaatatttaca

SEQ ID NO: 2016413 - DNA, 17 bp, Homo sapiens
atttgttatttgtacag

SEQ ID NO: 2016414 - DNA, 20 bp, Homo sapiens
atttgttgaaattatgtatg

SEQ ID NO: 2016415 - DNA, 22 bp, Homo sapiens
atttgttgagagtgtgaccaaa

SEQ ID NO: 2016416 - DNA, 13 bp, Homo sapiens
atttgttggaatg

SEQ ID NO: 2016417 - DNA, 16 bp, Homo sapiens
atttgtttacatgcag

SEQ ID NO: 2016418 - DNA, 15 bp, Homo sapiens
atttgtttagaagta

SEQ ID NO: 2016419 - DNA, 17 bp, Homo sapiens
atttgtttatatttaat

SEQ ID NO: 2016420 - DNA, 13 bp, Homo sapiens
atttgtttctact

SEQ ID NO: 2016421 - DNA, 15 bp, Homo sapiens
atttgtttttcttat

SEQ ID NO: 2016422 - DNA, 19 bp, Homo sapiens
attttaaaaaatgaaaata

SEQ ID NO: 2016423 - DNA, 21 bp, Homo sapiens
attttaaaaacatgagaaatg

SEQ ID NO: 2016424 - DNA, 13 bp, Homo sapiens
attttaaaaccat

SEQ ID NO: 2016425 - DNA, 23 bp, Homo sapiens
attttaaaaccatgcagcttcat

SEQ ID NO: 2016426 - DNA, 20 bp, Homo sapiens
attttaaaagcaattatatt

SEQ ID NO: 2016427 - DNA, 22 bp, Homo sapiens
attttaaaagcaattatattgt

SEQ ID NO: 2016428 - DNA, 19 bp, Homo sapiens
attttaaaagccacataga

SEQ ID NO: 2016429 - DNA, 12 bp, Homo sapiens
attttaaaagtt

SEQ ID NO: 2016430 - DNA, 19 bp, Homo sapiens
attttaaaatctgatttaa

SEQ ID NO: 2016431 - DNA, 12 bp, Homo sapiens
attttaaagaat

SEQ ID NO: 2016432 - DNA, 13 bp, Homo sapiens
attttaacaaaag

SEQ ID NO: 2016433 - DNA, 19 bp, Homo sapiens
attttaacaaaagaagatt

SEQ ID NO: 2016434 - DNA, 15 bp, Homo sapiens
attttaactttatca

SEQ ID NO: 2016435 - DNA, 19 bp, Homo sapiens
attttaactttatcacatt

SEQ ID NO: 2016436 - DNA, 19 bp, Homo sapiens
attttaagaagacatgaca

SEQ ID NO: 2016437 - DNA, 20 bp, Homo sapiens
attttaagcattcttagact

SEQ ID NO: 2016438 - DNA, 21 bp, Homo sapiens
attttaagcattcttagacta

SEQ ID NO: 2016439 - DNA, 23 bp, Homo sapiens
attttaaggtgtacgtatcattt

SEQ ID NO: 2016440 - DNA, 12 bp, Homo sapiens
attttaagtgct

SEQ ID NO: 2016441 - DNA, 14 bp, Homo sapiens
attttaagtgcttt

SEQ ID NO: 2016442 - DNA, 16 bp, Homo sapiens
attttaagtgctttgt

SEQ ID NO: 2016443 - DNA, 17 bp, Homo sapiens
attttaagtgctttgta

SEQ ID NO: 2016444 - DNA, 17 bp, Homo sapiens
attttaatattttgtat

SEQ ID NO: 2016445 - DNA, 23 bp, Homo sapiens
attttaattattattcttcataa

SEQ ID NO: 2016446 - DNA, 12 bp, Homo sapiens
attttacagaga

SEQ ID NO: 2016447 - DNA, 18 bp, Homo sapiens
attttacagagaatctga

SEQ ID NO: 2016448 - DNA, 16 bp, Homo sapiens
attttacattctgtct

SEQ ID NO: 2016449 - DNA, 21 bp, Homo sapiens
attttacctgggatatgacaa

SEQ ID NO: 2016450 - DNA, 17 bp, Homo sapiens
attttactactgtggaa

SEQ ID NO: 2016451 - DNA, 18 bp, Homo sapiens
attttacttctagagata

SEQ ID NO: 2016452 - DNA, 23 bp, Homo sapiens
attttagagcataccagtactca

SEQ ID NO: 2016453 - DNA, 16 bp, Homo sapiens
attttagctgcagaac

SEQ ID NO: 2016454 - DNA, 16 bp, Homo sapiens
attttaggagacagtc

SEQ ID NO: 2016455 - DNA, 21 bp, Homo sapiens
attttaggcagggatttgagg

SEQ ID NO: 2016456 - DNA, 14 bp, Homo sapiens
attttaggcctcct

SEQ ID NO: 2016457 - DNA, 17 bp, Homo sapiens
attttaggcctcctctc

SEQ ID NO: 2016458 - DNA, 20 bp, Homo sapiens
attttagtctgtcatccaga

SEQ ID NO: 2016459 - DNA, 17 bp, Homo sapiens
attttatacatagtcac

SEQ ID NO: 2016460 - DNA, 23 bp, Homo sapiens
attttatacatagtcacaaaaat

SEQ ID NO: 2016461 - DNA, 22 bp, Homo sapiens
attttatagctcagtttatcca

SEQ ID NO: 2016462 - DNA, 19 bp, Homo sapiens
attttatatgaaatgtttc

SEQ ID NO: 2016463 - DNA, 18 bp, Homo sapiens
attttatattacactaca

SEQ ID NO: 2016464 - DNA, 19 bp, Homo sapiens
attttatattagaagtgtt

SEQ ID NO: 2016465 - DNA, 20 bp, Homo sapiens
attttatgatttaaaaaata

SEQ ID NO: 2016466 - DNA, 16 bp, Homo sapiens
attttattaaagcaac

SEQ ID NO: 2016467 - DNA, 12 bp, Homo sapiens
attttatttgta

SEQ ID NO: 2016468 - DNA, 15 bp, Homo sapiens
attttatttgtattc

SEQ ID NO: 2016469 - DNA, 17 bp, Homo sapiens
attttcaagaaactgag

SEQ ID NO: 2016470 - DNA, 21 bp, Homo sapiens
attttcaagatacatttcatc

SEQ ID NO: 2016471 - DNA, 21 bp, Homo sapiens
attttcacctgtttttaagct

SEQ ID NO: 2016472 - DNA, 12 bp, Homo sapiens
attttcacttgc

SEQ ID NO: 2016473 - DNA, 11 bp, Homo sapiens
attttcagtat

SEQ ID NO: 2016474 - DNA, 19 bp, Homo sapiens
attttcagtataatttaac

SEQ ID NO: 2016475 - DNA, 14 bp, Homo sapiens
attttcatcaattt

SEQ ID NO: 2016476 - DNA, 20 bp, Homo sapiens
attttcatgacttttccatg

SEQ ID NO: 2016477 - DNA, 19 bp, Homo sapiens
attttcattttaatttata

SEQ ID NO: 2016478 - DNA, 23 bp, Homo sapiens
attttccacaagattcccagaga

SEQ ID NO: 2016479 - DNA, 15 bp, Homo sapiens
attttccatgaaaat

SEQ ID NO: 2016480 - DNA, 16 bp, Homo sapiens
attttcccctgaagac

SEQ ID NO: 2016481 - DNA, 21 bp, Homo sapiens
attttcctgaatattaatccc

SEQ ID NO: 2016482 - DNA, 15 bp, Homo sapiens
attttcgtgcatttg

SEQ ID NO: 2016483 - DNA, 16 bp, Homo sapiens
attttcgtgcatttgt

SEQ ID NO: 2016484 - DNA, 18 bp, Homo sapiens
attttcgtgcatttgtga

SEQ ID NO: 2016485 - DNA, 21 bp, Homo sapiens
caagagaagaaaaaattaaga

SEQ ID NO: 2016486 - DNA, 15 bp, Homo sapiens
caagagaattcactt

SEQ ID NO: 2016487 - DNA, 22 bp, Homo sapiens
caagagaattgcttgaacccag

SEQ ID NO: 2016488 - DNA, 14 bp, Homo sapiens
caagagacagagcc

SEQ ID NO: 2016489 - DNA, 19 bp, Homo sapiens
caagagacagagcccccaa

SEQ ID NO: 2016490 - DNA, 12 bp, Homo sapiens
caagagactctg

SEQ ID NO: 2016491 - DNA, 14 bp, Homo sapiens
caagagagaaagaa

SEQ ID NO: 2016492 - DNA, 23 bp, Homo sapiens
caagagagagctcgctcttggga

SEQ ID NO: 2016493 - DNA, 23 bp, Homo sapiens
caagagatgaagagtgagagggc

SEQ ID NO: 2016494 - DNA, 20 bp, Homo sapiens
caagagcatcatgcctctga

SEQ ID NO: 2016495 - DNA, 21 bp, Homo sapiens
caagagcatcatgcctctgag

SEQ ID NO: 2016496 - DNA, 23 bp, Homo sapiens
caagagcatcatgcctctgaggc

SEQ ID NO: 2016497 - DNA, 22 bp, Homo sapiens
caagagccatgtaccagtgtac

SEQ ID NO: 2016498 - DNA, 19 bp, Homo sapiens
caagagcccagcagggcct

SEQ ID NO: 2016499 - DNA, 23 bp, Homo sapiens
caagagccttggtgtccacctgg

SEQ ID NO: 2016500 - DNA, 12 bp, Homo sapiens
caagagctgagg

SEQ ID NO: 2016501 - DNA, 13 bp, Homo sapiens
caagagctgctgt

SEQ ID NO: 2016502 - DNA, 15 bp, Homo sapiens
caagagctgctgtcc

SEQ ID NO: 2016503 - DNA, 17 bp, Homo sapiens
caagaggcccagggagc

SEQ ID NO: 2016504 - DNA, 19 bp, Homo sapiens
caagagggcactggtggcc

SEQ ID NO: 2016505 - DNA, 20 bp, Homo sapiens
caagagggcactggtggccc

SEQ ID NO: 2016506 - DNA, 17 bp, Homo sapiens
caagagggctgcttccc

SEQ ID NO: 2016507 - DNA, 18 bp, Homo sapiens
caagaggtctgagccctg

SEQ ID NO: 2016508 - DNA, 11 bp, Homo sapiens
caagaggtggg

SEQ ID NO: 2016509 - DNA, 17 bp, Homo sapiens
caagaggtggggaccaa

SEQ ID NO: 2016510 - DNA, 22 bp, Homo sapiens
caagagttctttaggtgcctcc

SEQ ID NO: 2016511 - DNA, 22 bp, Homo sapiens
caagataaaggaagtcaccaaa

SEQ ID NO: 2016512 - DNA, 16 bp, Homo sapiens
caagatatttatatat

SEQ ID NO: 2016513 - DNA, 19 bp, Homo sapiens
caagatcctgtctttaagg

SEQ ID NO: 2016514 - DNA, 21 bp, Homo sapiens
caagatcttgtctccactaaa

SEQ ID NO: 2016515 - DNA, 14 bp, Homo sapiens
caagatctttcagg

SEQ ID NO: 2016516 - DNA, 13 bp, Homo sapiens
caagatgacagct

SEQ ID NO: 2016517 - DNA, 17 bp, Homo sapiens
caagatgacagctcttc

SEQ ID NO: 2016518 - DNA, 21 bp, Homo sapiens
caagatgtcctccttgttcta

SEQ ID NO: 2016519 - DNA, 21 bp, Homo sapiens
caagattatattataataatg

SEQ ID NO: 2016520 - DNA, 15 bp, Homo sapiens
caagattcaaagaga

SEQ ID NO: 2016521 - DNA, 18 bp, Homo sapiens
caagattcaaagagacta

SEQ ID NO: 2016522 - DNA, 13 bp, Homo sapiens
caagattcccaga

SEQ ID NO: 2016523 - DNA, 15 bp, Homo sapiens
caagattcccagaga

SEQ ID NO: 2016524 - DNA, 16 bp, Homo sapiens
caagattcccagagac

SEQ ID NO: 2016525 - DNA, 17 bp, Homo sapiens
caagattcccagagaca

SEQ ID NO: 2016526 - DNA, 21 bp, Homo sapiens
caagattgcttaaaatagcaa

SEQ ID NO: 2016527 - DNA, 23 bp, Homo sapiens
caagatttaacactaaaaaggtt

SEQ ID NO: 2016528 - DNA, 18 bp, Homo sapiens
caagatttcacatcagct

SEQ ID NO: 2016529 - DNA, 20 bp, Homo sapiens
caagattttttttgtaactt

SEQ ID NO: 2016530 - DNA, 19 bp, Homo sapiens
caagcaaaggtgaagagac

SEQ ID NO: 2016531 - DNA, 22 bp, Homo sapiens
caagcaagaggtggtagaacca

SEQ ID NO: 2016532 - DNA, 12 bp, Homo sapiens
caagcaataatt

SEQ ID NO: 2016533 - DNA, 13 bp, Homo sapiens
caagcacctcctg

SEQ ID NO: 2016534 - DNA, 16 bp, Homo sapiens
caagcacctcctgcct

SEQ ID NO: 2016535 - DNA, 12 bp, Homo sapiens
caagcacctgca

SEQ ID NO: 2016536 - DNA, 16 bp, Homo sapiens
caagcactaaaaagtg

SEQ ID NO: 2016537 - DNA, 20 bp, Homo sapiens
caagcactcgagaccatcct

SEQ ID NO: 2016538 - DNA, 20 bp, Homo sapiens
caagcagaggtggccagagc

SEQ ID NO: 2016539 - DNA, 19 bp, Homo sapiens
caagcagagtgattcaggg

SEQ ID NO: 2016540 - DNA, 11 bp, Homo sapiens
caagcagccag

SEQ ID NO: 2016541 - DNA, 12 bp, Homo sapiens
caagcagccagc

SEQ ID NO: 2016542 - DNA, 17 bp, Homo sapiens
caagcagccagccagtc

SEQ ID NO: 2016543 - DNA, 18 bp, Homo sapiens
caagcagccagccagtct

SEQ ID NO: 2016544 - DNA, 14 bp, Homo sapiens
caagcagcctcctg

SEQ ID NO: 2016545 - DNA, 16 bp, Homo sapiens
caagcaggaagttcaa

SEQ ID NO: 2016546 - DNA, 19 bp, Homo sapiens
caagcagggaaagctccac

SEQ ID NO: 2016547 - DNA, 23 bp, Homo sapiens
caagcagggaaagctccacggtg

SEQ ID NO: 2016548 - DNA, 21 bp, Homo sapiens
caagcatggctattttatatt

SEQ ID NO: 2016549 - DNA, 18 bp, Homo sapiens
caagccaacgacaaagcc

SEQ ID NO: 2016550 - DNA, 18 bp, Homo sapiens
caagccaacttgtaaata

SEQ ID NO: 2016551 - DNA, 13 bp, Homo sapiens
caagccacagaag

SEQ ID NO: 2016552 - DNA, 22 bp, Homo sapiens
caagccagcaacacagagcact

SEQ ID NO: 2016553 - DNA, 13 bp, Homo sapiens
caagccatggtga

SEQ ID NO: 2016554 - DNA, 19 bp, Homo sapiens
caagccatggtgacacaca

SEQ ID NO: 2016555 - DNA, 20 bp, Homo sapiens
caagccattttttgaggaga

SEQ ID NO: 2016556 - DNA, 16 bp, Homo sapiens
caagcccaggctggag

SEQ ID NO: 2016557 - DNA, 21 bp, Homo sapiens
caagccccagggcctgggggc

SEQ ID NO: 2016558 - DNA, 19 bp, Homo sapiens
caagcccctcagcccttgc

SEQ ID NO: 2016559 - DNA, 12 bp, Homo sapiens
caagccctggca

SEQ ID NO: 2016560 - DNA, 15 bp, Homo sapiens
caagcctggtctcct

SEQ ID NO: 2016561 - DNA, 16 bp, Homo sapiens
caagcctgtgaataaa

SEQ ID NO: 2016562 - DNA, 16 bp, Homo sapiens
caagccttactcacct

SEQ ID NO: 2016563 - DNA, 18 bp, Homo sapiens
caagccttactcacctct

SEQ ID NO: 2016564 - DNA, 19 bp, Homo sapiens
caagccttactcacctctc

SEQ ID NO: 2016565 - DNA, 20 bp, Homo sapiens
caagccttactcacctctct

SEQ ID NO: 2016566 - DNA, 20 bp, Homo sapiens
caagcgattcttctgcttca

SEQ ID NO: 2016567 - DNA, 13 bp, Homo sapiens
caagcgcagggag

SEQ ID NO: 2016568 - DNA, 14 bp, Homo sapiens
caagcgcagggagg

SEQ ID NO: 2016569 - DNA, 23 bp, Homo sapiens
caagcgcagggaggatgccacag

SEQ ID NO: 2016570 - DNA, 16 bp, Homo sapiens
caagctagaacctgga

SEQ ID NO: 2016571 - DNA, 22 bp, Homo sapiens
caagctagccagagggtgggag

SEQ ID NO: 2016572 - DNA, 21 bp, Homo sapiens
caagctcacagttcctcgccc

SEQ ID NO: 2016573 - DNA, 17 bp, Homo sapiens
caagctccatctccact

SEQ ID NO: 2016574 - DNA, 13 bp, Homo sapiens
caagctctgctcc

SEQ ID NO: 2016575 - DNA, 16 bp, Homo sapiens
caagctctgctcctct

SEQ ID NO: 2016576 - DNA, 17 bp, Homo sapiens
caagctgaggtgcccag

SEQ ID NO: 2016577 - DNA, 21 bp, Homo sapiens
caagctgaggtgcccaggaga

SEQ ID NO: 2016578 - DNA, 19 bp, Homo sapiens
caagctggtcccactcagt

SEQ ID NO: 2016579 - DNA, 16 bp, Homo sapiens
caagctgtcccctctg

SEQ ID NO: 2016580 - DNA, 17 bp, Homo sapiens
caagcttcaaccctcag

SEQ ID NO: 2016581 - DNA, 20 bp, Homo sapiens
caagcttcaaccctcagcct

SEQ ID NO: 2016582 - DNA, 13 bp, Homo sapiens
caagcttctttta

SEQ ID NO: 2016583 - DNA, 17 bp, Homo sapiens
caagcttgtatatacat

SEQ ID NO: 2016584 - DNA, 12 bp, Homo sapiens
caagctttcttc

SEQ ID NO: 2016585 - DNA, 20 bp, Homo sapiens
caaggaaagccccagcacta

SEQ ID NO: 2016586 - DNA, 12 bp, Homo sapiens
caaggaacaaga

SEQ ID NO: 2016587 - DNA, 18 bp, Homo sapiens
caaggaacctaattgaaa

SEQ ID NO: 2016588 - DNA, 20 bp, Homo sapiens
caaggaacctaattgaaatt

SEQ ID NO: 2016589 - DNA, 12 bp, Homo sapiens
caaggaaggaaa

SEQ ID NO: 2016590 - DNA, 13 bp, Homo sapiens
caaggaaggaaag

SEQ ID NO: 2016591 - DNA, 17 bp, Homo sapiens
caaggaaggaaagaaag

SEQ ID NO: 2016592 - DNA, 19 bp, Homo sapiens
caaggaagtgggggccgct

SEQ ID NO: 2016593 - DNA, 18 bp, Homo sapiens
caaggaccgtttttacta

SEQ ID NO: 2016594 - DNA, 19 bp, Homo sapiens
caaggactcctgtctgtcc

SEQ ID NO: 2016595 - DNA, 22 bp, Homo sapiens
caaggactgcagggactgccag

SEQ ID NO: 2016596 - DNA, 19 bp, Homo sapiens
caaggactttccagtgagg

SEQ ID NO: 2016597 - DNA, 23 bp, Homo sapiens
caaggagatataaaatctagatc

SEQ ID NO: 2016598 - DNA, 22 bp, Homo sapiens
caaggagctgatttccaggccc

SEQ ID NO: 2016599 - DNA, 19 bp, Homo sapiens
caaggagttccatgaagac

SEQ ID NO: 2016600 - DNA, 23 bp, Homo sapiens
caaggagttccatgaagaccaca

SEQ ID NO: 2016601 - DNA, 21 bp, Homo sapiens
caaggagttcgtggctgcaaa

SEQ ID NO: 2016602 - DNA, 19 bp, Homo sapiens
caaggattgctactgtcct

SEQ ID NO: 2016603 - DNA, 22 bp, Homo sapiens
caaggcacgtttggcatttctc

SEQ ID NO: 2016604 - DNA, 16 bp, Homo sapiens
caaggcagcaaggccc

SEQ ID NO: 2016605 - DNA, 16 bp, Homo sapiens
caaggcagcctccaga

SEQ ID NO: 2016606 - DNA, 18 bp, Homo sapiens
caaggcagcctccagagc

SEQ ID NO: 2016607 - DNA, 19 bp, Homo sapiens
caaggcagcctccagagcc

SEQ ID NO: 2016608 - DNA, 23 bp, Homo sapiens
caaggcaggtagatcgcttgagc

SEQ ID NO: 2016609 - DNA, 16 bp, Homo sapiens
caaggcccgagcagct

SEQ ID NO: 2016610 - DNA, 18 bp, Homo sapiens
caaggcccgagcagctga

SEQ ID NO: 2016611 - DNA, 19 bp, Homo sapiens
caaggccgctgttcaccca

SEQ ID NO: 2016612 - DNA, 20 bp, Homo sapiens
caaggccgctgttcacccac

SEQ ID NO: 2016613 - DNA, 22 bp, Homo sapiens
caaggccgctgttcacccacag

SEQ ID NO: 2016614 - DNA, 15 bp, Homo sapiens
caaggctctgagcaa

SEQ ID NO: 2016615 - DNA, 18 bp, Homo sapiens
caaggctgaccaagagag

SEQ ID NO: 2016616 - DNA, 10 bp, Homo sapiens
caaggctgct

SEQ ID NO: 2016617 - DNA, 12 bp, Homo sapiens
caaggctgctca

SEQ ID NO: 2016618 - DNA, 17 bp, Homo sapiens
caagggaagaaacactc

SEQ ID NO: 2016619 - DNA, 23 bp, Homo sapiens
caagggaaggaagggacacacac

SEQ ID NO: 2016620 - DNA, 18 bp, Homo sapiens
caagggagaagaaatcca

SEQ ID NO: 2016621 - DNA, 19 bp, Homo sapiens
caagggagaagaaatccat

SEQ ID NO: 2016622 - DNA, 17 bp, Homo sapiens
caagggcatcaggcact

SEQ ID NO: 2016623 - DNA, 21 bp, Homo sapiens
caagggccatgctgaagggac

SEQ ID NO: 2016624 - DNA, 14 bp, Homo sapiens
caagggcctgatgg

SEQ ID NO: 2016625 - DNA, 18 bp, Homo sapiens
caagggcggggctatgcc

SEQ ID NO: 2016626 - DNA, 13 bp, Homo sapiens
caagggctccagc

SEQ ID NO: 2016627 - DNA, 19 bp, Homo sapiens
caagggctccagcatccag

SEQ ID NO: 2016628 - DNA, 20 bp, Homo sapiens
caagggctccagcatccagc

SEQ ID NO: 2016629 - DNA, 22 bp, Homo sapiens
caagggggtgtcatctgaggag

SEQ ID NO: 2016630 - DNA, 17 bp, Homo sapiens
caaggggtttctgtttc

SEQ ID NO: 2016631 - DNA, 16 bp, Homo sapiens
caagggtctagggaga

SEQ ID NO: 2016632 - DNA, 21 bp, Homo sapiens
caagggtgatgggaaagcatt

SEQ ID NO: 2016633 - DNA, 23 bp, Homo sapiens
caagggtgatgggaaagcattgt

SEQ ID NO: 2016634 - DNA, 23 bp, Homo sapiens
caaggtctccttactctgagccc

SEQ ID NO: 2016635 - DNA, 16 bp, Homo sapiens
caaggtcttcagccat

SEQ ID NO: 2016636 - DNA, 15 bp, Homo sapiens
caaggtgcaaatcaa

SEQ ID NO: 2016637 - DNA, 12 bp, Homo sapiens
caaggtgggctg

SEQ ID NO: 2016638 - DNA, 18 bp, Homo sapiens
caaggtgggctgagccct

SEQ ID NO: 2016639 - DNA, 22 bp, Homo sapiens
caaggttactcagcagcagaga

SEQ ID NO: 2016640 - DNA, 21 bp, Homo sapiens
caaggttatatgcactttctc

SEQ ID NO: 2016641 - DNA, 16 bp, Homo sapiens
caaggttttggagtca

SEQ ID NO: 2016642 - DNA, 13 bp, Homo sapiens
caagtaaacattc

SEQ ID NO: 2016643 - DNA, 23 bp, Homo sapiens
caagtaatataatggaagagaaa

SEQ ID NO: 2016644 - DNA, 20 bp, Homo sapiens
caagtacatggctagctttt

SEQ ID NO: 2016645 - DNA, 13 bp, Homo sapiens
caagtactgctgt

SEQ ID NO: 2016646 - DNA, 20 bp, Homo sapiens
caagtagaatggcagctgga

SEQ ID NO: 2016647 - DNA, 17 bp, Homo sapiens
caagtagtagtgtcttc

SEQ ID NO: 2016648 - DNA, 13 bp, Homo sapiens
caagtataaagtc

SEQ ID NO: 2016649 - DNA, 20 bp, Homo sapiens
caagtattaggggtaatata

SEQ ID NO: 2016650 - DNA, 16 bp, Homo sapiens
caagtatttgttaatt

SEQ ID NO: 2016651 - DNA, 19 bp, Homo sapiens
caagtatttgttaatttag

SEQ ID NO: 2016652 - DNA, 22 bp, Homo sapiens
caagtatttgttaatttagaaa

SEQ ID NO: 2016653 - DNA, 18 bp, Homo sapiens
caagtattttatctgtgt

SEQ ID NO: 2016654 - DNA, 17 bp, Homo sapiens
caagtcaacactcttct

SEQ ID NO: 2016655 - DNA, 20 bp, Homo sapiens
caagtcaacactcttcttga

SEQ ID NO: 2016656 - DNA, 12 bp, Homo sapiens
caagtcacagct

SEQ ID NO: 2016657 - DNA, 13 bp, Homo sapiens
caagtcacagctg

SEQ ID NO: 2016658 - DNA, 20 bp, Homo sapiens
caagtcacagctgcagctgg

SEQ ID NO: 2016659 - DNA, 22 bp, Homo sapiens
caagtcacagctgcagctgggc

SEQ ID NO: 2016660 - DNA, 16 bp, Homo sapiens
caagtccacctgccta

SEQ ID NO: 2016661 - DNA, 15 bp, Homo sapiens
caagtccaggtcctg

SEQ ID NO: 2016662 - DNA, 20 bp, Homo sapiens
caagtccctgactctctgtg

SEQ ID NO: 2016663 - DNA, 21 bp, Homo sapiens
caagtccctgactctctgtga

SEQ ID NO: 2016664 - DNA, 23 bp, Homo sapiens
caagtccctgactctctgtgacc

SEQ ID NO: 2016665 - DNA, 17 bp, Homo sapiens
caagtcctgtgaatttc

SEQ ID NO: 2016666 - DNA, 17 bp, Homo sapiens
caagtctccttcccctt

SEQ ID NO: 2016667 - DNA, 15 bp, Homo sapiens
caagtcttccctgat

SEQ ID NO: 2016668 - DNA, 14 bp, Homo sapiens
caagtgaagaaaag

SEQ ID NO: 2016669 - DNA, 16 bp, Homo sapiens
caagtgacatctcttt

SEQ ID NO: 2016670 - DNA, 21 bp, Homo sapiens
caagtgacctatacctgtgtt

SEQ ID NO: 2016671 - DNA, 14 bp, Homo sapiens
caagtgagagagca

SEQ ID NO: 2016672 - DNA, 16 bp, Homo sapiens
caagtgagagagcaag

SEQ ID NO: 2016673 - DNA, 15 bp, Homo sapiens
caagtgagagctggg

SEQ ID NO: 2016674 - DNA, 14 bp, Homo sapiens
caagtgatatatgt

SEQ ID NO: 2016675 - DNA, 17 bp, Homo sapiens
caagtgatatcacctct

SEQ ID NO: 2016676 - DNA, 18 bp, Homo sapiens
caagtgattctcctgcct

SEQ ID NO: 2016677 - DNA, 19 bp, Homo sapiens
caagtgattctcctgcctc

SEQ ID NO: 2016678 - DNA, 15 bp, Homo sapiens
caagtgattgaaaat

SEQ ID NO: 2016679 - DNA, 19 bp, Homo sapiens
caagtgattgaaaatagta

SEQ ID NO: 2016680 - DNA, 21 bp, Homo sapiens
caagtgcccgccctgcccctg

SEQ ID NO: 2016681 - DNA, 22 bp, Homo sapiens
caagtgcccgccctgcccctgc

SEQ ID NO: 2016682 - DNA, 20 bp, Homo sapiens
caagtgggggcagagggcag

SEQ ID NO: 2016683 - DNA, 18 bp, Homo sapiens
caagttaaagtgaataac

SEQ ID NO: 2016684 - DNA, 19 bp, Homo sapiens
caagttatattgaatatat

SEQ ID NO: 2016685 - DNA, 15 bp, Homo sapiens
caagttcagggaagc

SEQ ID NO: 2016686 - DNA, 19 bp, Homo sapiens
caagttcagggaagcaggc

SEQ ID NO: 2016687 - DNA, 22 bp, Homo sapiens
caagttcagggaagcaggcaga

SEQ ID NO: 2016688 - DNA, 20 bp, Homo sapiens
caagttcctgcactccagaa

SEQ ID NO: 2016689 - DNA, 13 bp, Homo sapiens
caagttctagaga

SEQ ID NO: 2016690 - DNA, 23 bp, Homo sapiens
caagttctagagaagaggctggt

SEQ ID NO: 2016691 - DNA, 18 bp, Homo sapiens
caagttgaaatcagaagc

SEQ ID NO: 2016692 - DNA, 20 bp, Homo sapiens
caagttgtactgtatgcagt

SEQ ID NO: 2016693 - DNA, 13 bp, Homo sapiens
caagtttataagc

SEQ ID NO: 2016694 - DNA, 23 bp, Homo sapiens
caagtttctagctagaaatatga

SEQ ID NO: 2016695 - DNA, 13 bp, Homo sapiens
caagttttgtata

SEQ ID NO: 2016696 - DNA, 17 bp, Homo sapiens
caagtttttctaacagt

SEQ ID NO: 2016697 - DNA, 13 bp, Homo sapiens
caataaaaaaaag

SEQ ID NO: 2016698 - DNA, 22 bp, Homo sapiens
caataaaaatctttgattcaga

SEQ ID NO: 2016699 - DNA, 13 bp, Homo sapiens
caataaaacattc

SEQ ID NO: 2016700 - DNA, 11 bp, Homo sapiens
caataaaagtg

SEQ ID NO: 2016701 - DNA, 13 bp, Homo sapiens
caataaaagtgac

SEQ ID NO: 2016702 - DNA, 13 bp, Homo sapiens
caataaaatagta

SEQ ID NO: 2016703 - DNA, 21 bp, Homo sapiens
caataaaatagtattgaaagt

SEQ ID NO: 2016704 - DNA, 14 bp, Homo sapiens
caataaaatcatgt

SEQ ID NO: 2016705 - DNA, 22 bp, Homo sapiens
caataaagagttagaatgaaaa

SEQ ID NO: 2016706 - DNA, 23 bp, Homo sapiens
caataaagctgctgagaatctag

SEQ ID NO: 2016707 - DNA, 12 bp, Homo sapiens
caataaagctgg

SEQ ID NO: 2016708 - DNA, 14 bp, Homo sapiens
caataaagctggac

SEQ ID NO: 2016709 - DNA, 22 bp, Homo sapiens
caataaagctggacaagaagct

SEQ ID NO: 2016710 - DNA, 23 bp, Homo sapiens
caataaagctggacaagaagctg

SEQ ID NO: 2016711 - DNA, 13 bp, Homo sapiens
caataaatattct

SEQ ID NO: 2016712 - DNA, 19 bp, Homo sapiens
caataaatgccctctctga

SEQ ID NO: 2016713 - DNA, 17 bp, Homo sapiens
caataaatgctgaatga

SEQ ID NO: 2016714 - DNA, 15 bp, Homo sapiens
caataaatgtctgtt

SEQ ID NO: 2016715 - DNA, 17 bp, Homo sapiens
caataaatgtgcttatg

SEQ ID NO: 2016716 - DNA, 10 bp, Homo sapiens
caataacaac

SEQ ID NO: 2016717 - DNA, 12 bp, Homo sapiens
caataacaacaa

SEQ ID NO: 2016718 - DNA, 22 bp, Homo sapiens
caataatgtgcaaattttgcat

SEQ ID NO: 2016719 - DNA, 17 bp, Homo sapiens
caataattaggatctat

SEQ ID NO: 2016720 - DNA, 15 bp, Homo sapiens
caatacatgctgcta

SEQ ID NO: 2016721 - DNA, 13 bp, Homo sapiens
caataccactggt

SEQ ID NO: 2016722 - DNA, 18 bp, Homo sapiens
caatactaattgagaaac

SEQ ID NO: 2016723 - DNA, 13 bp, Homo sapiens
caatactactgta

SEQ ID NO: 2016724 - DNA, 23 bp, Homo sapiens
caatagactgtacttattttcca

SEQ ID NO: 2016725 - DNA, 15 bp, Homo sapiens
caatagctattgcat

SEQ ID NO: 2016726 - DNA, 17 bp, Homo sapiens
caatagctattgcatgt

SEQ ID NO: 2016727 - DNA, 21 bp, Homo sapiens
caatagctattgcatgtaaaa

SEQ ID NO: 2016728 - DNA, 15 bp, Homo sapiens
caatagggtgcagtt

SEQ ID NO: 2016729 - DNA, 16 bp, Homo sapiens
caatagtcaagaaaaa

SEQ ID NO: 2016730 - DNA, 22 bp, Homo sapiens
caatagtccccatcagcaccat

SEQ ID NO: 2016731 - DNA, 12 bp, Homo sapiens
caatatctttaa

SEQ ID NO: 2016732 - DNA, 22 bp, Homo sapiens
caatatgtattaatattcattg

SEQ ID NO: 2016733 - DNA, 13 bp, Homo sapiens
caatatgtattgt

SEQ ID NO: 2016734 - DNA, 15 bp, Homo sapiens
caatatgtattgtaa

SEQ ID NO: 2016735 - DNA, 23 bp, Homo sapiens
caatatgtattgtaaacatgtgt

SEQ ID NO: 2016736 - DNA, 12 bp, Homo sapiens
caatattaaata

SEQ ID NO: 2016737 - DNA, 21 bp, Homo sapiens
caatattaaatacagacacta

SEQ ID NO: 2016738 - DNA, 22 bp, Homo sapiens
caatattataatttttttcaat

SEQ ID NO: 2016739 - DNA, 13 bp, Homo sapiens
caatattcaaatg

SEQ ID NO: 2016740 - DNA, 21 bp, Homo sapiens
caatattcctgaatgaaatat

SEQ ID NO: 2016741 - DNA, 12 bp, Homo sapiens
caatatttatta

SEQ ID NO: 2016742 - DNA, 13 bp, Homo sapiens
caatatttattat

SEQ ID NO: 2016743 - DNA, 14 bp, Homo sapiens
caatatttgtagaa

SEQ ID NO: 2016744 - DNA, 15 bp, Homo sapiens
caatatttgtagaag

SEQ ID NO: 2016745 - DNA, 20 bp, Homo sapiens
caatattttccatgaaaatg

SEQ ID NO: 2016746 - DNA, 22 bp, Homo sapiens
caatattttccatgaaaatgca

SEQ ID NO: 2016747 - DNA, 12 bp, Homo sapiens
caatcagcactg

SEQ ID NO: 2016748 - DNA, 16 bp, Homo sapiens
caatcagcactgaaaa

SEQ ID NO: 2016749 - DNA, 20 bp, Homo sapiens
caatcatctgtgtgaaaatg

SEQ ID NO: 2016750 - DNA, 20 bp, Homo sapiens
caatccaggtgggagagaca

SEQ ID NO: 2016751 - DNA, 23 bp, Homo sapiens
caatccatgttagtttttacttt

SEQ ID NO: 2016752 - DNA, 16 bp, Homo sapiens
caatcccaccaaccct

SEQ ID NO: 2016753 - DNA, 15 bp, Homo sapiens
caatcccctcattca

SEQ ID NO: 2016754 - DNA, 21 bp, Homo sapiens
caatcctagaaccaagcttca

SEQ ID NO: 2016755 - DNA, 11 bp, Homo sapiens
caatcctcagg

SEQ ID NO: 2016756 - DNA, 13 bp, Homo sapiens
caatcctctaagc

SEQ ID NO: 2016757 - DNA, 16 bp, Homo sapiens
caatcctgtccctcac

SEQ ID NO: 2016758 - DNA, 12 bp, Homo sapiens
caatcctttcca

SEQ ID NO: 2016759 - DNA, 20 bp, Homo sapiens
caatctcaaattctcaacct

SEQ ID NO: 2016760 - DNA, 19 bp, Homo sapiens
caatctccagggctgcccc

SEQ ID NO: 2016761 - DNA, 20 bp, Homo sapiens
caatctgctcagcaggccct

SEQ ID NO: 2016762 - DNA, 18 bp, Homo sapiens
caatctttccttgtctct

SEQ ID NO: 2016763 - DNA, 14 bp, Homo sapiens
caatctttgctgta

SEQ ID NO: 2016764 - DNA, 16 bp, Homo sapiens
caatcttttttactct

SEQ ID NO: 2016765 - DNA, 22 bp, Homo sapiens
caatgaaacagatgataaatat

SEQ ID NO: 2016766 - DNA, 17 bp, Homo sapiens
caatgaaatatttgctt

SEQ ID NO: 2016767 - DNA, 15 bp, Homo sapiens
caatgaaatgcttgt

SEQ ID NO: 2016768 - DNA, 22 bp, Homo sapiens
caatgaacaaagggattctcca

SEQ ID NO: 2016769 - DNA, 20 bp, Homo sapiens
caatgaaggaaaacctcact

SEQ ID NO: 2016770 - DNA, 15 bp, Homo sapiens
caatgacatcttcaa

SEQ ID NO: 2016771 - DNA, 15 bp, Homo sapiens
caatgacctgtattt

SEQ ID NO: 2016772 - DNA, 18 bp, Homo sapiens
caatgatgattaaacacc

SEQ ID NO: 2016773 - DNA, 22 bp, Homo sapiens
caatgatgattaaacacctgac

SEQ ID NO: 2016774 - DNA, 21 bp, Homo sapiens
caatgatggcaattttgtaac

SEQ ID NO: 2016775 - DNA, 20 bp, Homo sapiens
caatgatgtgagtacccagg

SEQ ID NO: 2016776 - DNA, 15 bp, Homo sapiens
caatgattcataaca

SEQ ID NO: 2016777 - DNA, 19 bp, Homo sapiens
caatgattgtttaattgta

SEQ ID NO: 2016778 - DNA, 16 bp, Homo sapiens
caatgcaatgaaacag

SEQ ID NO: 2016779 - DNA, 17 bp, Homo sapiens
caatgcacacacacaga

SEQ ID NO: 2016780 - DNA, 18 bp, Homo sapiens
caatgcacacacacagag

SEQ ID NO: 2016781 - DNA, 13 bp, Homo sapiens
caatgcacatcca

SEQ ID NO: 2016782 - DNA, 18 bp, Homo sapiens
caatgcacctaaagaaaa

SEQ ID NO: 2016783 - DNA, 16 bp, Homo sapiens
caatgcatgcagccac

SEQ ID NO: 2016784 - DNA, 13 bp, Homo sapiens
caatgccctgcca

SEQ ID NO: 2016785 - DNA, 15 bp, Homo sapiens
caatgccctgccatt

SEQ ID NO: 2016786 - DNA, 16 bp, Homo sapiens
caatgccctgccatta

SEQ ID NO: 2016787 - DNA, 17 bp, Homo sapiens
caatgccttgggagaga

SEQ ID NO: 2016788 - DNA, 23 bp, Homo sapiens
caatgctggctgttggctggggg

SEQ ID NO: 2016789 - DNA, 18 bp, Homo sapiens
caatgctttgggaggcca

SEQ ID NO: 2016790 - DNA, 17 bp, Homo sapiens
caatggaaacagggcag

SEQ ID NO: 2016791 - DNA, 17 bp, Homo sapiens
caatggacttcaaattg

SEQ ID NO: 2016792 - DNA, 20 bp, Homo sapiens
caatggagactgtctcaaga

SEQ ID NO: 2016793 - DNA, 17 bp, Homo sapiens
caatggcagctagactg

SEQ ID NO: 2016794 - DNA, 20 bp, Homo sapiens
caatggcagctagactggag

SEQ ID NO: 2016795 - DNA, 17 bp, Homo sapiens
caatggctaattcccag

SEQ ID NO: 2016796 - DNA, 18 bp, Homo sapiens
caatggctaattcccaga

SEQ ID NO: 2016797 - DNA, 14 bp, Homo sapiens
caatggctgtaaac

SEQ ID NO: 2016798 - DNA, 24 bp, Homo sapiens
caatgggagggggctccatggagg

SEQ ID NO: 2016799 - DNA, 18 bp, Homo sapiens
caatgggcactgggatga

SEQ ID NO: 2016800 - DNA, 19 bp, Homo sapiens
caatgggcactgggatgag

SEQ ID NO: 2016801 - DNA, 15 bp, Homo sapiens
caatggggagaggca

SEQ ID NO: 2016802 - DNA, 16 bp, Homo sapiens
caatggggagaggcaa

SEQ ID NO: 2016803 - DNA, 17 bp, Homo sapiens
caatggggagaggcaaa

SEQ ID NO: 2016804 - DNA, 16 bp, Homo sapiens
caatggggtgggccca

SEQ ID NO: 2016805 - DNA, 22 bp, Homo sapiens
caatggtgttgccctgagtgga

SEQ ID NO: 2016806 - DNA, 22 bp, Homo sapiens
cacaatttgagcaattcatttc

SEQ ID NO: 2016807 - DNA, 14 bp, Homo sapiens
cacacaaaatgtca

SEQ ID NO: 2016808 - DNA, 11 bp, Homo sapiens
cacacacacac

SEQ ID NO: 2016809 - DNA, 12 bp, Homo sapiens
cacacacacaca

SEQ ID NO: 2016810 - DNA, 15 bp, Homo sapiens
cacacacacacacac

SEQ ID NO: 2016811 - DNA, 15 bp, Homo sapiens
cacacacacacatac

SEQ ID NO: 2016812 - DNA, 14 bp, Homo sapiens
cacacacagaggaa

SEQ ID NO: 2016813 - DNA, 14 bp, Homo sapiens
cacacacagatatg

SEQ ID NO: 2016814 - DNA, 13 bp, Homo sapiens
cacacacaggagc

SEQ ID NO: 2016815 - DNA, 15 bp, Homo sapiens
cacacacaggagcat

SEQ ID NO: 2016816 - DNA, 16 bp, Homo sapiens
cacacaccagagccca

SEQ ID NO: 2016817 - DNA, 20 bp, Homo sapiens
cacacaccagagcccacctt

SEQ ID NO: 2016818 - DNA, 17 bp, Homo sapiens
cacacacgcgtgcacac

SEQ ID NO: 2016819 - DNA, 14 bp, Homo sapiens
cacacactttggct

SEQ ID NO: 2016820 - DNA, 16 bp, Homo sapiens
cacacagaaatatata

SEQ ID NO: 2016821 - DNA, 21 bp, Homo sapiens
cacacagactacagccagaag

SEQ ID NO: 2016822 - DNA, 14 bp, Homo sapiens
cacacagagcctgc

SEQ ID NO: 2016823 - DNA, 15 bp, Homo sapiens
cacacagagcctgcc

SEQ ID NO: 2016824 - DNA, 22 bp, Homo sapiens
cacacagaggaagagcaggcac

SEQ ID NO: 2016825 - DNA, 18 bp, Homo sapiens
cacacagatgcacacaca

SEQ ID NO: 2016826 - DNA, 18 bp, Homo sapiens
cacacagatggtcacaca

SEQ ID NO: 2016827 - DNA, 14 bp, Homo sapiens
cacacagcactctc

SEQ ID NO: 2016828 - DNA, 13 bp, Homo sapiens
cacacagctcctc

SEQ ID NO: 2016829 - DNA, 15 bp, Homo sapiens
cacacagctctgtcc

SEQ ID NO: 2016830 - DNA, 20 bp, Homo sapiens
cacacaggcatttcctgggt

SEQ ID NO: 2016831 - DNA, 18 bp, Homo sapiens
cacacagtgagtcgagga

SEQ ID NO: 2016832 - DNA, 17 bp, Homo sapiens
cacacatggatgagcac

SEQ ID NO: 2016833 - DNA, 14 bp, Homo sapiens
cacacatggatgca

SEQ ID NO: 2016834 - DNA, 18 bp, Homo sapiens
cacacatggctaattttt

SEQ ID NO: 2016835 - DNA, 15 bp, Homo sapiens
cacaccaatgcgcac

SEQ ID NO: 2016836 - DNA, 14 bp, Homo sapiens
cacaccactgccct

SEQ ID NO: 2016837 - DNA, 12 bp, Homo sapiens
cacaccagagcc

SEQ ID NO: 2016838 - DNA, 13 bp, Homo sapiens
cacaccagagccc

SEQ ID NO: 2016839 - DNA, 21 bp, Homo sapiens
cacacccagagggtagggcag

SEQ ID NO: 2016840 - DNA, 22 bp, Homo sapiens
cacacccagagggtagggcagc

SEQ ID NO: 2016841 - DNA, 14 bp, Homo sapiens
cacacccagcccac

SEQ ID NO: 2016842 - DNA, 15 bp, Homo sapiens
cacaccgatgcacac

SEQ ID NO: 2016843 - DNA, 15 bp, Homo sapiens
cacaccgatgtgcgc

SEQ ID NO: 2016844 - DNA, 17 bp, Homo sapiens
cacaccggtcaccgaga

SEQ ID NO: 2016845 - DNA, 16 bp, Homo sapiens
cacacctccctgaacc

SEQ ID NO: 2016846 - DNA, 16 bp, Homo sapiens
cacacctctgggcttc

SEQ ID NO: 2016847 - DNA, 11 bp, Homo sapiens
cacacctgagc

SEQ ID NO: 2016848 - DNA, 20 bp, Homo sapiens
cacacctgtaatcccagcac

SEQ ID NO: 2016849 - DNA, 21 bp, Homo sapiens
cacacctgtaatcccagcact

SEQ ID NO: 2016850 - DNA, 20 bp, Homo sapiens
cacacgcaggaactcccagc

SEQ ID NO: 2016851 - DNA, 21 bp, Homo sapiens
cacacgcaggaactcccagca

SEQ ID NO: 2016852 - DNA, 18 bp, Homo sapiens
cacacgcctgtaatccca

SEQ ID NO: 2016853 - DNA, 14 bp, Homo sapiens
cacacgctgtctct

SEQ ID NO: 2016854 - DNA, 20 bp, Homo sapiens
cacacggaggcatctgcacc

SEQ ID NO: 2016855 - DNA, 21 bp, Homo sapiens
cacacggaggcatctgcaccc

SEQ ID NO: 2016856 - DNA, 15 bp, Homo sapiens
cacacggatgcacag

SEQ ID NO: 2016857 - DNA, 22 bp, Homo sapiens
cacacggccctgccccatcctg

SEQ ID NO: 2016858 - DNA, 16 bp, Homo sapiens
cacacgtgctcgcagc

SEQ ID NO: 2016859 - DNA, 18 bp, Homo sapiens
cacactagcctctccagg

SEQ ID NO: 2016860 - DNA, 12 bp, Homo sapiens
cacactcagcag

SEQ ID NO: 2016861 - DNA, 20 bp, Homo sapiens
cacactcagtcccccaccac

SEQ ID NO: 2016862 - DNA, 14 bp, Homo sapiens
cacactgagctggg

SEQ ID NO: 2016863 - DNA, 17 bp, Homo sapiens
cacactgcaagagcctt

SEQ ID NO: 2016864 - DNA, 18 bp, Homo sapiens
cacactgcaagagccttg

SEQ ID NO: 2016865 - DNA, 21 bp, Homo sapiens
cacactgcaagagccttggtg

SEQ ID NO: 2016866 - DNA, 15 bp, Homo sapiens
cacactggtgactgc

SEQ ID NO: 2016867 - DNA, 13 bp, Homo sapiens
cacactgtaaata

SEQ ID NO: 2016868 - DNA, 20 bp, Homo sapiens
cacactgtgcgttttagagt

SEQ ID NO: 2016869 - DNA, 20 bp, Homo sapiens
cacacttgggcgctctgccc

SEQ ID NO: 2016870 - DNA, 12 bp, Homo sapiens
cacacttgtttc

SEQ ID NO: 2016871 - DNA, 17 bp, Homo sapiens
cacactttgagaacctg

SEQ ID NO: 2016872 - DNA, 12 bp, Homo sapiens
cacagaaatata

SEQ ID NO: 2016873 - DNA, 23 bp, Homo sapiens
cacagaaatatatatacatatgt

SEQ ID NO: 2016874 - DNA, 13 bp, Homo sapiens
cacagaacccttg

SEQ ID NO: 2016875 - DNA, 21 bp, Homo sapiens
cacagaactgcttactagccc

SEQ ID NO: 2016876 - DNA, 18 bp, Homo sapiens
cacagaagccaggagcaa

SEQ ID NO: 2016877 - DNA, 23 bp, Homo sapiens
cacagaagccaggagcaaatgtt

SEQ ID NO: 2016878 - DNA, 20 bp, Homo sapiens
cacagaaggaatctgtgcag

SEQ ID NO: 2016879 - DNA, 12 bp, Homo sapiens
cacagacacaca

SEQ ID NO: 2016880 - DNA, 14 bp, Homo sapiens
cacagacagatccc

SEQ ID NO: 2016881 - DNA, 14 bp, Homo sapiens
cacagaccacctgc

SEQ ID NO: 2016882 - DNA, 15 bp, Homo sapiens
cacagactacagcca

SEQ ID NO: 2016883 - DNA, 12 bp, Homo sapiens
cacagactccct

SEQ ID NO: 2016884 - DNA, 13 bp, Homo sapiens
cacagactccctc

SEQ ID NO: 2016885 - DNA, 13 bp, Homo sapiens
cacagactctttc

SEQ ID NO: 2016886 - DNA, 16 bp, Homo sapiens
cacagacttctggaag

SEQ ID NO: 2016887 - DNA, 23 bp, Homo sapiens
cacagacttctggaaggctggct

SEQ ID NO: 2016888 - DNA, 12 bp, Homo sapiens
cacagagaaagt

SEQ ID NO: 2016889 - DNA, 19 bp, Homo sapiens
cacagagaaagtacttctc

SEQ ID NO: 2016890 - DNA, 13 bp, Homo sapiens
cacagagatgcat

SEQ ID NO: 2016891 - DNA, 12 bp, Homo sapiens
cacagagcctgc

SEQ ID NO: 2016892 - DNA, 13 bp, Homo sapiens
cacagagcctgcc

SEQ ID NO: 2016893 - DNA, 15 bp, Homo sapiens
cacagagcctgcctc

SEQ ID NO: 2016894 - DNA, 21 bp, Homo sapiens
cacagagcctgcctcagctgc

SEQ ID NO: 2016895 - DNA, 19 bp, Homo sapiens
cacagaggcagctgtgtgg

SEQ ID NO: 2016896 - DNA, 18 bp, Homo sapiens
cacagaggcttcttcaga

SEQ ID NO: 2016897 - DNA, 22 bp, Homo sapiens
cacagagtggagccctcagttt

SEQ ID NO: 2016898 - DNA, 20 bp, Homo sapiens
cacagatatacacatggatg

SEQ ID NO: 2016899 - DNA, 18 bp, Homo sapiens
cacagatatgcacacaca

SEQ ID NO: 2016900 - DNA, 19 bp, Homo sapiens
cacagatgggtattaaact

SEQ ID NO: 2016901 - DNA, 22 bp, Homo sapiens
cacagatgggtattaaacttgt

SEQ ID NO: 2016902 - DNA, 16 bp, Homo sapiens
cacagatggtcacaca

SEQ ID NO: 2016903 - DNA, 14 bp, Homo sapiens
cacagcacccaggc

SEQ ID NO: 2016904 - DNA, 17 bp, Homo sapiens
cacagcacccaggctcc

SEQ ID NO: 2016905 - DNA, 20 bp, Homo sapiens
cacagcacccaggctccatg

SEQ ID NO: 2016906 - DNA, 21 bp, Homo sapiens
cacagcacccaggctccatgg

SEQ ID NO: 2016907 - DNA, 16 bp, Homo sapiens
cacagcactctctaaa

SEQ ID NO: 2016908 - DNA, 16 bp, Homo sapiens
cacagcagaatgaaga

SEQ ID NO: 2016909 - DNA, 12 bp, Homo sapiens
cacagcagcact

SEQ ID NO: 2016910 - DNA, 13 bp, Homo sapiens
cacagcagcactg

SEQ ID NO: 2016911 - DNA, 15 bp, Homo sapiens
cacagcagcccccca

SEQ ID NO: 2016912 - DNA, 18 bp, Homo sapiens
cacagcagccccccagca

SEQ ID NO: 2016913 - DNA, 19 bp, Homo sapiens
cacagcagctgaacagcca

SEQ ID NO: 2016914 - DNA, 19 bp, Homo sapiens
cacagcagtatgaatgatg

SEQ ID NO: 2016915 - DNA, 21 bp, Homo sapiens
cacagcagttctgcagaggac

SEQ ID NO: 2016916 - DNA, 14 bp, Homo sapiens
cacagccaaggact

SEQ ID NO: 2016917 - DNA, 18 bp, Homo sapiens
cacagccagactggcaca

SEQ ID NO: 2016918 - DNA, 13 bp, Homo sapiens
cacagccccacag

SEQ ID NO: 2016919 - DNA, 15 bp, Homo sapiens
cacagccccacagca

SEQ ID NO: 2016920 - DNA, 23 bp, Homo sapiens
cacagccccacagcacccaggct

SEQ ID NO: 2016921 - DNA, 18 bp, Homo sapiens
caccaataacttcagaga

SEQ ID NO: 2016922 - DNA, 22 bp, Homo sapiens
caccaataacttcagagaagtc

SEQ ID NO: 2016923 - DNA, 23 bp, Homo sapiens
caccaataacttcagagaagtca

SEQ ID NO: 2016924 - DNA, 18 bp, Homo sapiens
caccaccagatgagaagt

SEQ ID NO: 2016925 - DNA, 22 bp, Homo sapiens
caccaccctcccctgtcttctc

SEQ ID NO: 2016926 - DNA, 16 bp, Homo sapiens
caccaccttcccagct

SEQ ID NO: 2016927 - DNA, 19 bp, Homo sapiens
caccacgtctgccaggccc

SEQ ID NO: 2016928 - DNA, 20 bp, Homo sapiens
caccacgtctgccaggccca

SEQ ID NO: 2016929 - DNA, 21 bp, Homo sapiens
caccacgtctgccaggcccat

SEQ ID NO: 2016930 - DNA, 21 bp, Homo sapiens
caccactagggtcctggccct

SEQ ID NO: 2016931 - DNA, 15 bp, Homo sapiens
caccactccattccc

SEQ ID NO: 2016932 - DNA, 16 bp, Homo sapiens
caccactccattccca

SEQ ID NO: 2016933 - DNA, 12 bp, Homo sapiens
caccactctggc

SEQ ID NO: 2016934 - DNA, 18 bp, Homo sapiens
caccactgcactccagcc

SEQ ID NO: 2016935 - DNA, 14 bp, Homo sapiens
caccactgccctgc

SEQ ID NO: 2016936 - DNA, 15 bp, Homo sapiens
caccactgccctgcc

SEQ ID NO: 2016937 - DNA, 16 bp, Homo sapiens
caccacttcttttata

SEQ ID NO: 2016938 - DNA, 14 bp, Homo sapiens
caccagaataatga

SEQ ID NO: 2016939 - DNA, 18 bp, Homo sapiens
caccagaattgtgcaaat

SEQ ID NO: 2016940 - DNA, 20 bp, Homo sapiens
caccagagcccaccttggct

SEQ ID NO: 2016941 - DNA, 13 bp, Homo sapiens
caccagagcccat

SEQ ID NO: 2016942 - DNA, 12 bp, Homo sapiens
caccagagtgaa

SEQ ID NO: 2016943 - DNA, 16 bp, Homo sapiens
caccagcatgtcactc

SEQ ID NO: 2016944 - DNA, 21 bp, Homo sapiens
caccagcatgtcactcccaga

SEQ ID NO: 2016945 - DNA, 16 bp, Homo sapiens
caccagccacctcttg

SEQ ID NO: 2016946 - DNA, 13 bp, Homo sapiens
caccagccccagt

SEQ ID NO: 2016947 - DNA, 21 bp, Homo sapiens
caccagccccagtgcccacag

SEQ ID NO: 2016948 - DNA, 22 bp, Homo sapiens
caccagccccagtgcccacagg

SEQ ID NO: 2016949 - DNA, 20 bp, Homo sapiens
caccagccccctggatgggc

SEQ ID NO: 2016950 - DNA, 16 bp, Homo sapiens
caccagcccggcctgc

SEQ ID NO: 2016951 - DNA, 19 bp, Homo sapiens
caccagcccttagcaggga

SEQ ID NO: 2016952 - DNA, 14 bp, Homo sapiens
caccagcctaagaa

SEQ ID NO: 2016953 - DNA, 20 bp, Homo sapiens
caccagcctaagaagctctg

SEQ ID NO: 2016954 - DNA, 15 bp, Homo sapiens
caccagctctgtggc

SEQ ID NO: 2016955 - DNA, 16 bp, Homo sapiens
caccagctctgtggcc

SEQ ID NO: 2016956 - DNA, 13 bp, Homo sapiens
caccagctgctct

SEQ ID NO: 2016957 - DNA, 15 bp, Homo sapiens
caccagctgctctgc

SEQ ID NO: 2016958 - DNA, 17 bp, Homo sapiens
caccagctgctctgccc

SEQ ID NO: 2016959 - DNA, 16 bp, Homo sapiens
caccagcttctccagg

SEQ ID NO: 2016960 - DNA, 12 bp, Homo sapiens
caccaggaatgt

SEQ ID NO: 2016961 - DNA, 17 bp, Homo sapiens
caccaggaatgttaaag

SEQ ID NO: 2016962 - DNA, 11 bp, Homo sapiens
caccaggatga

SEQ ID NO: 2016963 - DNA, 21 bp, Homo sapiens
caccaggatggcccttcccac

SEQ ID NO: 2016964 - DNA, 19 bp, Homo sapiens
caccaggcacgaacccacc

SEQ ID NO: 2016965 - DNA, 23 bp, Homo sapiens
caccaggcacgaacccacctgct

SEQ ID NO: 2016966 - DNA, 13 bp, Homo sapiens
caccaggccgggc

SEQ ID NO: 2016967 - DNA, 14 bp, Homo sapiens
caccaggccgggct

SEQ ID NO: 2016968 - DNA, 23 bp, Homo sapiens
caccaggccgggcttgggccctg

SEQ ID NO: 2016969 - DNA, 17 bp, Homo sapiens
caccagggcactgtctg

SEQ ID NO: 2016970 - DNA, 20 bp, Homo sapiens
caccagggtccgcaccagct

SEQ ID NO: 2016971 - DNA, 21 bp, Homo sapiens
caccagggtccgcaccagctg

SEQ ID NO: 2016972 - DNA, 16 bp, Homo sapiens
caccaggtagaacaca

SEQ ID NO: 2016973 - DNA, 13 bp, Homo sapiens
caccagtgccgcc

SEQ ID NO: 2016974 - DNA, 15 bp, Homo sapiens
caccagtgccgcctg

SEQ ID NO: 2016975 - DNA, 18 bp, Homo sapiens
caccagtgccgcctgtgc

SEQ ID NO: 2016976 - DNA, 18 bp, Homo sapiens
caccagtgtcccctccac

SEQ ID NO: 2016977 - DNA, 17 bp, Homo sapiens
caccataggtagaatgt

SEQ ID NO: 2016978 - DNA, 12 bp, Homo sapiens
caccatatgcaa

SEQ ID NO: 2016979 - DNA, 16 bp, Homo sapiens
caccatattcagtgct

SEQ ID NO: 2016980 - DNA, 21 bp, Homo sapiens
caccatattcagtgctgtggc

SEQ ID NO: 2016981 - DNA, 19 bp, Homo sapiens
caccatcaccctctgggca

SEQ ID NO: 2016982 - DNA, 18 bp, Homo sapiens
caccatcatgtctggcta

SEQ ID NO: 2016983 - DNA, 15 bp, Homo sapiens
caccatcctgcagcc

SEQ ID NO: 2016984 - DNA, 21 bp, Homo sapiens
caccatcctgcagcctcctcc

SEQ ID NO: 2016985 - DNA, 19 bp, Homo sapiens
caccatcctttactattaa

SEQ ID NO: 2016986 - DNA, 12 bp, Homo sapiens
caccatctgctt

SEQ ID NO: 2016987 - DNA, 16 bp, Homo sapiens
caccatgcgctgctca

SEQ ID NO: 2016988 - DNA, 20 bp, Homo sapiens
taaggaactggaacacacat

SEQ ID NO: 2016989 - DNA, 17 bp, Homo sapiens
taaggaattgaagatag

SEQ ID NO: 2016990 - DNA, 15 bp, Homo sapiens
taaggacacactaat

SEQ ID NO: 2016991 - DNA, 23 bp, Homo sapiens
taaggaccgtggccctgccctct

SEQ ID NO: 2016992 - DNA, 18 bp, Homo sapiens
taaggacttagctggcca

SEQ ID NO: 2016993 - DNA, 22 bp, Homo sapiens
taaggagagttcaagcctgtgg

SEQ ID NO: 2016994 - DNA, 15 bp, Homo sapiens
taaggagcatgattt

SEQ ID NO: 2016995 - DNA, 16 bp, Homo sapiens
taaggatgactttttt

SEQ ID NO: 2016996 - DNA, 15 bp, Homo sapiens
taaggattgtgatat

SEQ ID NO: 2016997 - DNA, 16 bp, Homo sapiens
taaggcatatacaaat

SEQ ID NO: 2016998 - DNA, 20 bp, Homo sapiens
taaggccagaaactcctttt

SEQ ID NO: 2016999 - DNA, 16 bp, Homo sapiens
taaggcctgccctccc

SEQ ID NO: 2017000 - DNA, 13 bp, Homo sapiens
taagggcatttta

SEQ ID NO: 2017001 - DNA, 17 bp, Homo sapiens
taaggggcacctgggaa

SEQ ID NO: 2017002 - DNA, 15 bp, Homo sapiens
taagggtctgttgta

SEQ ID NO: 2017003 - DNA, 16 bp, Homo sapiens
taagggttgaaggcag

SEQ ID NO: 2017004 - DNA, 13 bp, Homo sapiens
taagggttttaga

SEQ ID NO: 2017005 - DNA, 18 bp, Homo sapiens
taaggtagaacctcacct

SEQ ID NO: 2017006 - DNA, 21 bp, Homo sapiens
taaggtctgggagtgttctgt

SEQ ID NO: 2017007 - DNA, 18 bp, Homo sapiens
taaggttacctttgttcc

SEQ ID NO: 2017008 - DNA, 18 bp, Homo sapiens
taagtaaaaccacagcag

SEQ ID NO: 2017009 - DNA, 19 bp, Homo sapiens
taagtaaaaccacagcagt

SEQ ID NO: 2017010 - DNA, 23 bp, Homo sapiens
taagtaattatcgggaacagtgt

SEQ ID NO: 2017011 - DNA, 18 bp, Homo sapiens
taagtaattgcatttctg

SEQ ID NO: 2017012 - DNA, 21 bp, Homo sapiens
taagtaattgcatttctgctc

SEQ ID NO: 2017013 - DNA, 20 bp, Homo sapiens
taagtatttaggtttttgtt

SEQ ID NO: 2017014 - DNA, 13 bp, Homo sapiens
taagtatttatat

SEQ ID NO: 2017015 - DNA, 18 bp, Homo sapiens
taagtatttatatattta

SEQ ID NO: 2017016 - DNA, 18 bp, Homo sapiens
taagtcatccacagccca

SEQ ID NO: 2017017 - DNA, 22 bp, Homo sapiens
taagtcattgaaatttactgtg

SEQ ID NO: 2017018 - DNA, 16 bp, Homo sapiens
taagtctccaagaata

SEQ ID NO: 2017019 - DNA, 17 bp, Homo sapiens
taagtgcacacagaaat

SEQ ID NO: 2017020 - DNA, 22 bp, Homo sapiens
taagtgcacacagaaatatata

SEQ ID NO: 2017021 - DNA, 15 bp, Homo sapiens
taagtgctgtttgag

SEQ ID NO: 2017022 - DNA, 22 bp, Homo sapiens
taagtgctgtttgagatgtgat

SEQ ID NO: 2017023 - DNA, 12 bp, Homo sapiens
taagtggaaaaa

SEQ ID NO: 2017024 - DNA, 19 bp, Homo sapiens
taagtgggaagtgaagccc

SEQ ID NO: 2017025 - DNA, 20 bp, Homo sapiens
taagtggggttgcaaccact

SEQ ID NO: 2017026 - DNA, 21 bp, Homo sapiens
taagtggggttgcaaccactg

SEQ ID NO: 2017027 - DNA, 18 bp, Homo sapiens
taagttctaagttcatgt

SEQ ID NO: 2017028 - DNA, 20 bp, Homo sapiens
taagttttttacttccacag

SEQ ID NO: 2017029 - DNA, 15 bp, Homo sapiens
taataaaaaatggaa

SEQ ID NO: 2017030 - DNA, 16 bp, Homo sapiens
taggggagggtggggc

SEQ ID NO: 2017031 - DNA, 17 bp, Homo sapiens
taggggagggtggggca

SEQ ID NO: 2017032 - DNA, 14 bp, Homo sapiens
taggggtcaaagaa

SEQ ID NO: 2017033 - DNA, 15 bp, Homo sapiens
tagggtaaggtgcct

SEQ ID NO: 2017034 - DNA, 12 bp, Homo sapiens
taggtaagggcc

SEQ ID NO: 2017035 - DNA, 14 bp, Homo sapiens
taggtacacagctc

SEQ ID NO: 2017036 - DNA, 15 bp, Homo sapiens
taggtatgaataagt

SEQ ID NO: 2017037 - DNA, 18 bp, Homo sapiens
taggtattaaagatgtgt

SEQ ID NO: 2017038 - DNA, 22 bp, Homo sapiens
taggtcacatatgtctgtatct

SEQ ID NO: 2017039 - DNA, 15 bp, Homo sapiens
taggtcctggcttct

SEQ ID NO: 2017040 - DNA, 23 bp, Homo sapiens
taggtgaaaacagcccaggtcct

SEQ ID NO: 2017041 - DNA, 14 bp, Homo sapiens
taggtgcctcctgt

SEQ ID NO: 2017042 - DNA, 18 bp, Homo sapiens
taggtgcctcctgtctta

SEQ ID NO: 2017043 - DNA, 23 bp, Homo sapiens
taggtgctacaaaaacacagcaa

SEQ ID NO: 2017044 - DNA, 16 bp, Homo sapiens
taggtgctggatgctt

SEQ ID NO: 2017045 - DNA, 20 bp, Homo sapiens
taggtggtgttgagaaagaa

SEQ ID NO: 2017046 - DNA, 23 bp, Homo sapiens
taggtttccttttattctgtacc

SEQ ID NO: 2017047 - DNA, 17 bp, Homo sapiens
tagtaaagtcaaggaga

SEQ ID NO: 2017048 - DNA, 18 bp, Homo sapiens
tagtaaatcacgcttttt

SEQ ID NO: 2017049 - DNA, 22 bp, Homo sapiens
tagtaaatcacgctttttgaaa

SEQ ID NO: 2017050 - DNA, 17 bp, Homo sapiens
tagtaatagtccaatat

SEQ ID NO: 2017051 - DNA, 22 bp, Homo sapiens
tagtaatagtccaatatttggc

SEQ ID NO: 2017052 - DNA, 14 bp, Homo sapiens
tagtaatctgcatt

SEQ ID NO: 2017053 - DNA, 22 bp, Homo sapiens
tagtaatgggccaattaaaata

SEQ ID NO: 2017054 - DNA, 23 bp, Homo sapiens
tagtaatgggccaattaaaatat

SEQ ID NO: 2017055 - DNA, 20 bp, Homo sapiens
tagtacagtagcttaaataa

SEQ ID NO: 2017056 - DNA, 12 bp, Homo sapiens
tagtacataaag

SEQ ID NO: 2017057 - DNA, 17 bp, Homo sapiens
tagtactctctgctcta

SEQ ID NO: 2017058 - DNA, 20 bp, Homo sapiens
tagtagcagtgattgtctta

SEQ ID NO: 2017059 - DNA, 19 bp, Homo sapiens
tagtagcggatctcactca

SEQ ID NO: 2017060 - DNA, 18 bp, Homo sapiens
tagtagctaatgaaattg

SEQ ID NO: 2017061 - DNA, 16 bp, Homo sapiens
tagtataaagaaaagt

SEQ ID NO: 2017062 - DNA, 21 bp, Homo sapiens
tagtatatgtcagacatgaaa

SEQ ID NO: 2017063 - DNA, 13 bp, Homo sapiens
tagtatatttata

SEQ ID NO: 2017064 - DNA, 14 bp, Homo sapiens
tagtatctaacatg

SEQ ID NO: 2017065 - DNA, 15 bp, Homo sapiens
tagtatctaacatgt

SEQ ID NO: 2017066 - DNA, 21 bp, Homo sapiens
tagtatgtggcgtatcatgca

SEQ ID NO: 2017067 - DNA, 16 bp, Homo sapiens
tagtcaattagtacag

SEQ ID NO: 2017068 - DNA, 19 bp, Homo sapiens
tagtcaattagtacagtag

SEQ ID NO: 2017069 - DNA, 23 bp, Homo sapiens
tagtcacatggcctatgcacata

SEQ ID NO: 2017070 - DNA, 17 bp, Homo sapiens
tagtcacttatttcata

SEQ ID NO: 2017071 - DNA, 15 bp, Homo sapiens
tagtcagaagcaggt

SEQ ID NO: 2017072 - DNA, 21 bp, Homo sapiens
tagtcatagaaatacctcatt

SEQ ID NO: 2017073 - DNA, 22 bp, Homo sapiens
tagtcatagaaatacctcattc

SEQ ID NO: 2017074 - DNA, 19 bp, Homo sapiens
tagtccccatcagcaccat

SEQ ID NO: 2017075 - DNA, 14 bp, Homo sapiens
tagtcctattctat

SEQ ID NO: 2017076 - DNA, 21 bp, Homo sapiens
tagtctcctttgcactgaggg

SEQ ID NO: 2017077 - DNA, 20 bp, Homo sapiens
tagtctgaggccccttaact

SEQ ID NO: 2017078 - DNA, 23 bp, Homo sapiens
tagtctggtgttctgagtacttg

SEQ ID NO: 2017079 - DNA, 12 bp, Homo sapiens
tagtctggtttc

SEQ ID NO: 2017080 - DNA, 13 bp, Homo sapiens
tagtctggtttct

SEQ ID NO: 2017081 - DNA, 12 bp, Homo sapiens
tagtctgtcatc

SEQ ID NO: 2017082 - DNA, 18 bp, Homo sapiens
tagtctgtcatccagaaa

SEQ ID NO: 2017083 - DNA, 17 bp, Homo sapiens
tagtcttgctttgctgt

SEQ ID NO: 2017084 - DNA, 21 bp, Homo sapiens
tagtcttgctttgctgtctgg

SEQ ID NO: 2017085 - DNA, 15 bp, Homo sapiens
tagtcttttactcct

SEQ ID NO: 2017086 - DNA, 15 bp, Homo sapiens
tagtgaagatgttgt

SEQ ID NO: 2017087 - DNA, 17 bp, Homo sapiens
tagtgagatttgtattt

SEQ ID NO: 2017088 - DNA, 13 bp, Homo sapiens
tagtgcacacttg

SEQ ID NO: 2017089 - DNA, 14 bp, Homo sapiens
tagtgcccgcctag

SEQ ID NO: 2017090 - DNA, 17 bp, Homo sapiens
tagtgcggacaagtttt

SEQ ID NO: 2017091 - DNA, 19 bp, Homo sapiens
tagtgcggacaagttttaa

SEQ ID NO: 2017092 - DNA, 21 bp, Homo sapiens
tagtgctatatatataaatat

SEQ ID NO: 2017093 - DNA, 23 bp, Homo sapiens
tagtggaaatgagcgaaatcatg

SEQ ID NO: 2017094 - DNA, 14 bp, Homo sapiens
tagtggaagagcag

SEQ ID NO: 2017095 - DNA, 19 bp, Homo sapiens
tagtggaagagcagcctga

SEQ ID NO: 2017096 - DNA, 14 bp, Homo sapiens
tagtggcttcaaaa

SEQ ID NO: 2017097 - DNA, 18 bp, Homo sapiens
tagtggggtctccctctc

SEQ ID NO: 2017098 - DNA, 22 bp, Homo sapiens
tagtggggtctccctctcctgc

SEQ ID NO: 2017099 - DNA, 11 bp, Homo sapiens
tagtgtaaaat

SEQ ID NO: 2017100 - DNA, 13 bp, Homo sapiens
tatgatttaaaaa

SEQ ID NO: 2017101 - DNA, 20 bp, Homo sapiens
tatgatttaaaaaataaata

SEQ ID NO: 2017102 - DNA, 21 bp, Homo sapiens
tatgatttaaaaaataaatat

SEQ ID NO: 2017103 - DNA, 22 bp, Homo sapiens
tatgatttaaaaaataaatata

SEQ ID NO: 2017104 - DNA, 14 bp, Homo sapiens
tatgatttatagtt

SEQ ID NO: 2017105 - DNA, 21 bp, Homo sapiens
tatgattttctatttttcttc

SEQ ID NO: 2017106 - DNA, 16 bp, Homo sapiens
tatgattttttaaaag

SEQ ID NO: 2017107 - DNA, 20 bp, Homo sapiens
tatgattttttaaaagaaat

SEQ ID NO: 2017108 - DNA, 21 bp, Homo sapiens
tatgcaaacagttcttggacc

SEQ ID NO: 2017109 - DNA, 14 bp, Homo sapiens
tatgcaaagcactg

SEQ ID NO: 2017110 - DNA, 17 bp, Homo sapiens
tatgcaaggaaggaaag

SEQ ID NO: 2017111 - DNA, 20 bp, Homo sapiens
tatgcaaggaaggaaagaaa

SEQ ID NO: 2017112 - DNA, 18 bp, Homo sapiens
tatgcaatttttaaacta

SEQ ID NO: 2017113 - DNA, 19 bp, Homo sapiens
tatgcaatttttaaactag

SEQ ID NO: 2017114 - DNA, 15 bp, Homo sapiens
tatgcacacacatgg

SEQ ID NO: 2017115 - DNA, 20 bp, Homo sapiens
tatgcaccttgtgtctgtac

SEQ ID NO: 2017116 - DNA, 13 bp, Homo sapiens
tatgcagctgagg

SEQ ID NO: 2017117 - DNA, 22 bp, Homo sapiens
tatgcatggtgtagatgccctg

SEQ ID NO: 2017118 - DNA, 20 bp, Homo sapiens
tatgccctcagatggagaca

SEQ ID NO: 2017119 - DNA, 14 bp, Homo sapiens
tatgcctcatgctg

SEQ ID NO: 2017120 - DNA, 23 bp, Homo sapiens
tatgccttatgtaattattttct

SEQ ID NO: 2017121 - DNA, 16 bp, Homo sapiens
tatgctactacaaaaa

SEQ ID NO: 2017122 - DNA, 14 bp, Homo sapiens
tatgctatttctgg

SEQ ID NO: 2017123 - DNA, 22 bp, Homo sapiens
tatgctatttctggcctcagca

SEQ ID NO: 2017124 - DNA, 16 bp, Homo sapiens
tatgctgccaaatttt

SEQ ID NO: 2017125 - DNA, 13 bp, Homo sapiens
tatgcttatttta

SEQ ID NO: 2017126 - DNA, 14 bp, Homo sapiens
tatgcttattttaa

SEQ ID NO: 2017127 - DNA, 17 bp, Homo sapiens
tatgcttattttaaaat

SEQ ID NO: 2017128 - DNA, 17 bp, Homo sapiens
tatggaacttctaatat

SEQ ID NO: 2017129 - DNA, 14 bp, Homo sapiens
tatggaatacagtg

SEQ ID NO: 2017130 - DNA, 20 bp, Homo sapiens
tatggaatttttcattgata

SEQ ID NO: 2017131 - DNA, 15 bp, Homo sapiens
tatggactctgcaca

SEQ ID NO: 2017132 - DNA, 15 bp, Homo sapiens
tatggaggatggaga

SEQ ID NO: 2017133 - DNA, 18 bp, Homo sapiens
tatggcagtccagccagc

SEQ ID NO: 2017134 - DNA, 14 bp, Homo sapiens
tatggcctgtgtca

SEQ ID NO: 2017135 - DNA, 23 bp, Homo sapiens
tatgggactcaatgcactgacat

SEQ ID NO: 2017136 - DNA, 16 bp, Homo sapiens
tatgggattagattca

SEQ ID NO: 2017137 - DNA, 23 bp, Homo sapiens
tatggggggaggggggagggctg

SEQ ID NO: 2017138 - DNA, 22 bp, Homo sapiens
tatgggtgtgtgtttgtgtgag

SEQ ID NO: 2017139 - DNA, 19 bp, Homo sapiens
tatggtatgctggccagca

SEQ ID NO: 2017140 - DNA, 22 bp, Homo sapiens
tatggtatgctggccagcaccc

SEQ ID NO: 2017141 - DNA, 13 bp, Homo sapiens
tatggtattttcg

SEQ ID NO: 2017142 - DNA, 20 bp, Homo sapiens
tatggtattttcgtgcattt

SEQ ID NO: 2017143 - DNA, 16 bp, Homo sapiens
tatggtgtaatgcaca

SEQ ID NO: 2017144 - DNA, 17 bp, Homo sapiens
tatggtgtaatgcacaa

SEQ ID NO: 2017145 - DNA, 20 bp, Homo sapiens
tatggtgtaatgcacaattt

SEQ ID NO: 2017146 - DNA, 16 bp, Homo sapiens
tatggtgtgttcctaa

SEQ ID NO: 2017147 - DNA, 23 bp, Homo sapiens
tatggttctcagatcttgacagt

SEQ ID NO: 2017148 - DNA, 19 bp, Homo sapiens
tatggtttctgcgtgcttt

SEQ ID NO: 2017149 - DNA, 12 bp, Homo sapiens
tatgtaaaataa

SEQ ID NO: 2017150 - DNA, 23 bp, Homo sapiens
tatgtaaactgcattagaaatta

SEQ ID NO: 2017151 - DNA, 17 bp, Homo sapiens
tatgtaacatccagaag

SEQ ID NO: 2017152 - DNA, 21 bp, Homo sapiens
tatgtaattattttctttttg

SEQ ID NO: 2017153 - DNA, 18 bp, Homo sapiens
tatgtagaaatattataa

SEQ ID NO: 2017154 - DNA, 19 bp, Homo sapiens
tatgtagactatatacatg

SEQ ID NO: 2017155 - DNA, 17 bp, Homo sapiens
tatgtatatagatgtgc

SEQ ID NO: 2017156 - DNA, 14 bp, Homo sapiens
tatgtatatatata

SEQ ID NO: 2017157 - DNA, 17 bp, Homo sapiens
tatgtatatgtatatat

SEQ ID NO: 2017158 - DNA, 19 bp, Homo sapiens
tatgtatatgtatatctat

SEQ ID NO: 2017159 - DNA, 13 bp, Homo sapiens
tatgtatgtgtgt

SEQ ID NO: 2017160 - DNA, 16 bp, Homo sapiens
tatgtatgtttacata

SEQ ID NO: 2017161 - DNA, 17 bp, Homo sapiens
tatgtatgtttacatat

SEQ ID NO: 2017162 - DNA, 19 bp, Homo sapiens
tatgtattaatattcattg

SEQ ID NO: 2017163 - DNA, 17 bp, Homo sapiens
tatgtcatttattttgt

SEQ ID NO: 2017164 - DNA, 16 bp, Homo sapiens
tatgtcatttcatttc

SEQ ID NO: 2017165 - DNA, 14 bp, Homo sapiens
tatgtctaattgag

SEQ ID NO: 2017166 - DNA, 12 bp, Homo sapiens
tatgtctattta

SEQ ID NO: 2017167 - DNA, 15 bp, Homo sapiens
tatgtctatttaagc

SEQ ID NO: 2017168 - DNA, 19 bp, Homo sapiens
tatgtcttggacactgtac

SEQ ID NO: 2017169 - DNA, 16 bp, Homo sapiens
tatgtgaaagtgtaaa

SEQ ID NO: 2017170 - DNA, 15 bp, Homo sapiens
tatgtgacaaccttt

SEQ ID NO: 2017171 - DNA, 20 bp, Homo sapiens
tatgtgacaacctttgtgta

SEQ ID NO: 2017172 - DNA, 19 bp, Homo sapiens
tatgtgcacatgtgtctgt

SEQ ID NO: 2017173 - DNA, 15 bp, Homo sapiens
tatgtgcctttttgt

SEQ ID NO: 2017174 - DNA, 23 bp, Homo sapiens
tatgtggattagctagaatgcac

SEQ ID NO: 2017175 - DNA, 21 bp, Homo sapiens
tatgtggcgtatcatgcaagt

SEQ ID NO: 2017176 - DNA, 16 bp, Homo sapiens
tatgtgtcatgatttc

SEQ ID NO: 2017177 - DNA, 12 bp, Homo sapiens
tatgtgtgtata

SEQ ID NO: 2017178 - DNA, 12 bp, Homo sapiens
tatgtgtgtgta

SEQ ID NO: 2017179 - DNA, 20 bp, Homo sapiens
tatgtgtgtttaaataaagt

SEQ ID NO: 2017180 - DNA, 20 bp, Homo sapiens
tatgttaacctcagtgtcat

SEQ ID NO: 2017181 - DNA, 18 bp, Homo sapiens
tatgttaagctctttatg

SEQ ID NO: 2017182 - DNA, 15 bp, Homo sapiens
tatgttaagttactt

SEQ ID NO: 2017183 - DNA, 22 bp, Homo sapiens
tatgttacatctgttttaaatt

SEQ ID NO: 2017184 - DNA, 18 bp, Homo sapiens
tatgttactacatgcact

SEQ ID NO: 2017185 - DNA, 23 bp, Homo sapiens
tatgttctagtgatttcctgtat

SEQ ID NO: 2017186 - DNA, 17 bp, Homo sapiens
tatgttgagtgttcatt

SEQ ID NO: 2017187 - DNA, 20 bp, Homo sapiens
tatgttgtaataaaacttat

SEQ ID NO: 2017188 - DNA, 14 bp, Homo sapiens
tatgtttaaaaaca

SEQ ID NO: 2017189 - DNA, 17 bp, Homo sapiens
tatgttttaagaggcag

SEQ ID NO: 2017190 - DNA, 13 bp, Homo sapiens
tattaaaaaacaa

SEQ ID NO: 2017191 - DNA, 12 bp, Homo sapiens
tattaaaaatat

SEQ ID NO: 2017192 - DNA, 18 bp, Homo sapiens
tattaaaatgattgtaaa

SEQ ID NO: 2017193 - DNA, 18 bp, Homo sapiens
tattaaacttgtcagaat

SEQ ID NO: 2017194 - DNA, 14 bp, Homo sapiens
tattaaagatgtgt

SEQ ID NO: 2017195 - DNA, 21 bp, Homo sapiens
tattaaatacagacactaagt

SEQ ID NO: 2017196 - DNA, 15 bp, Homo sapiens
tattaagatttccaa

SEQ ID NO: 2017197 - DNA, 17 bp, Homo sapiens
tattaagatttccaagt

SEQ ID NO: 2017198 - DNA, 14 bp, Homo sapiens
tattaagggaaagg

SEQ ID NO: 2017199 - DNA, 15 bp, Homo sapiens
tattaagggcatttt

SEQ ID NO: 2017200 - DNA, 16 bp, Homo sapiens
tattaaggtgtggctt

SEQ ID NO: 2017201 - DNA, 22 bp, Homo sapiens
tattaagtctgggatgtagaac

SEQ ID NO: 2017202 - DNA, 17 bp, Homo sapiens
tattaataccaaatatt

SEQ ID NO: 2017203 - DNA, 18 bp, Homo sapiens
tattaatgaactgtgaca

SEQ ID NO: 2017204 - DNA, 19 bp, Homo sapiens
tattaatgaactgtgacag

SEQ ID NO: 2017205 - DNA, 15 bp, Homo sapiens
tattaattatctgat

SEQ ID NO: 2017206 - DNA, 13 bp, Homo sapiens
tattaatttgttt

SEQ ID NO: 2017207 - DNA, 14 bp, Homo sapiens
tattacatctaatg

SEQ ID NO: 2017208 - DNA, 11 bp, Homo sapiens
tattacctctg

SEQ ID NO: 2017209 - DNA, 13 bp, Homo sapiens
tattacctctgat

SEQ ID NO: 2017210 - DNA, 14 bp, Homo sapiens
tattacctctgata

SEQ ID NO: 2017211 - DNA, 13 bp, Homo sapiens
tattacttctgct

SEQ ID NO: 2017212 - DNA, 18 bp, Homo sapiens
tattagatgttttacaaa

SEQ ID NO: 2017213 - DNA, 20 bp, Homo sapiens
tattagatgttttacaaatt

SEQ ID NO: 2017214 - DNA, 12 bp, Homo sapiens
tattataaataa

SEQ ID NO: 2017215 - DNA, 13 bp, Homo sapiens
tatttatcagtga

SEQ ID NO: 2017216 - DNA, 15 bp, Homo sapiens
tatttatcagtgaca

SEQ ID NO: 2017217 - DNA, 16 bp, Homo sapiens
tatttatctctattta

SEQ ID NO: 2017218 - DNA, 20 bp, Homo sapiens
tatttatctgtgcaaatcct

SEQ ID NO: 2017219 - DNA, 21 bp, Homo sapiens
tatttatgcttaaaatatgta

SEQ ID NO: 2017220 - DNA, 13 bp, Homo sapiens
tatttattacctc

SEQ ID NO: 2017221 - DNA, 15 bp, Homo sapiens
tatttattacctctg

SEQ ID NO: 2017222 - DNA, 13 bp, Homo sapiens
tatttattcattc

SEQ ID NO: 2017223 - DNA, 16 bp, Homo sapiens
tatttattgtttattt

SEQ ID NO: 2017224 - DNA, 16 bp, Homo sapiens
tatttatttaagctta

SEQ ID NO: 2017225 - DNA, 21 bp, Homo sapiens
tatttatttaataacaattgt

SEQ ID NO: 2017226 - DNA, 13 bp, Homo sapiens
tatttatttatgg

SEQ ID NO: 2017227 - DNA, 14 bp, Homo sapiens
tatttatttatgga

SEQ ID NO: 2017228 - DNA, 20 bp, Homo sapiens
tatttattttttttaagtat

SEQ ID NO: 2017229 - DNA, 13 bp, Homo sapiens
tatttcaaaataa

SEQ ID NO: 2017230 - DNA, 17 bp, Homo sapiens
tatttcaaaataaactg

SEQ ID NO: 2017231 - DNA, 15 bp, Homo sapiens
tatttcaaatgaaca

SEQ ID NO: 2017232 - DNA, 20 bp, Homo sapiens
tatttcagttttaaatgtac

SEQ ID NO: 2017233 - DNA, 18 bp, Homo sapiens
tatttccacataaaggta

SEQ ID NO: 2017234 - DNA, 19 bp, Homo sapiens
tatttccacataaaggtat

SEQ ID NO: 2017235 - DNA, 23 bp, Homo sapiens
tatttccaccatcaaatgctgta

SEQ ID NO: 2017236 - DNA, 21 bp, Homo sapiens
tatttccccaggggaaaatga

SEQ ID NO: 2017237 - DNA, 19 bp, Homo sapiens
tatttcccccttactactt

SEQ ID NO: 2017238 - DNA, 15 bp, Homo sapiens
tatttctagcagagt

SEQ ID NO: 2017239 - DNA, 13 bp, Homo sapiens
tatttctctcccc

SEQ ID NO: 2017240 - DNA, 20 bp, Homo sapiens
tatttcttaaacaaatgtat

SEQ ID NO: 2017241 - DNA, 12 bp, Homo sapiens
tatttgaaattt

SEQ ID NO: 2017242 - DNA, 22 bp, Homo sapiens
tatttgaaattttatttagttc

SEQ ID NO: 2017243 - DNA, 15 bp, Homo sapiens
tatttgaatatcatt

SEQ ID NO: 2017244 - DNA, 22 bp, Homo sapiens
tatttgagcatgcacagctgct

SEQ ID NO: 2017245 - DNA, 9 bp, Homo sapiens
tatttgcaa

SEQ ID NO: 2017246 - DNA, 13 bp, Homo sapiens
tatttgcttattt

SEQ ID NO: 2017247 - DNA, 12 bp, Homo sapiens
tatttggaaaga

SEQ ID NO: 2017248 - DNA, 16 bp, Homo sapiens
tatttggaaagagacc

SEQ ID NO: 2017249 - DNA, 19 bp, Homo sapiens
tatttgtacagttcagttc

SEQ ID NO: 2017250 - DNA, 23 bp, Homo sapiens
tatttgtatctctgaagcatgtt

SEQ ID NO: 2017251 - DNA, 15 bp, Homo sapiens
tatttgtattcatga

SEQ ID NO: 2017252 - DNA, 15 bp, Homo sapiens
tatttgtgctctgtg

SEQ ID NO: 2017253 - DNA, 13 bp, Homo sapiens
tatttgtgtaata

SEQ ID NO: 2017254 - DNA, 14 bp, Homo sapiens
tatttgtgtaatag

SEQ ID NO: 2017255 - DNA, 13 bp, Homo sapiens
tatttgtgtatgt

SEQ ID NO: 2017256 - DNA, 16 bp, Homo sapiens
tatttgtgtatgtgta

SEQ ID NO: 2017257 - DNA, 20 bp, Homo sapiens
tatttgttctggtttagtgt

SEQ ID NO: 2017258 - DNA, 19 bp, Homo sapiens
tatttgttgtttttaacaa

SEQ ID NO: 2017259 - DNA, 20 bp, Homo sapiens
tattttaaaaaaattcatca

SEQ ID NO: 2017260 - DNA, 12 bp, Homo sapiens
tattttaaaagc

SEQ ID NO: 2017261 - DNA, 12 bp, Homo sapiens
tattttaaacaa

SEQ ID NO: 2017262 - DNA, 13 bp, Homo sapiens
tattttaaagaat

SEQ ID NO: 2017263 - DNA, 13 bp, Homo sapiens
tattttaaatgtt

SEQ ID NO: 2017264 - DNA, 16 bp, Homo sapiens
tattttaggagacagt

SEQ ID NO: 2017265 - DNA, 22 bp, Homo sapiens
tattttaggcagggatttgagg

SEQ ID NO: 2017266 - DNA, 15 bp, Homo sapiens
tattttatatgagag

SEQ ID NO: 2017267 - DNA, 20 bp, Homo sapiens
tattttatatgagagaatca

SEQ ID NO: 2017268 - DNA, 19 bp, Homo sapiens
tattttattccctttcaca

SEQ ID NO: 2017269 - DNA, 21 bp, Homo sapiens
tattttcaacgcagccctgct

SEQ ID NO: 2017270 - DNA, 16 bp, Homo sapiens
tattttcaagaaactg

SEQ ID NO: 2017271 - DNA, 20 bp, Homo sapiens
tattttcatttaactacaaa

SEQ ID NO: 2017272 - DNA, 14 bp, Homo sapiens
tattttccaataaa

SEQ ID NO: 2017273 - DNA, 16 bp, Homo sapiens
tattttccatgaaaat

SEQ ID NO: 2017274 - DNA, 20 bp, Homo sapiens
tattttccatgaaaatgcaa

SEQ ID NO: 2017275 - DNA, 14 bp, Homo sapiens
tattttctttgaaa

SEQ ID NO: 2017276 - DNA, 12 bp, Homo sapiens
tattttgtaata

SEQ ID NO: 2017277 - DNA, 19 bp, Homo sapiens
tattttgtaataaactctc

SEQ ID NO: 2017278 - DNA, 22 bp, Homo sapiens
tattttgtaataaactctctag

SEQ ID NO: 2017279 - DNA, 10 bp, Homo sapiens
tattttgtat

SEQ ID NO: 2017280 - DNA, 17 bp, Homo sapiens
tattttgttacactaaa

SEQ ID NO: 2017281 - DNA, 22 bp, Homo sapiens
tattttgttgtgattttgtaca

SEQ ID NO: 2017282 - DNA, 12 bp, Homo sapiens
tatttttagaga

SEQ ID NO: 2017283 - DNA, 23 bp, Homo sapiens
tatttttagagattaatttgtgt

SEQ ID NO: 2017284 - DNA, 18 bp, Homo sapiens
tatttttagcagagatgg

SEQ ID NO: 2017285 - DNA, 18 bp, Homo sapiens
tatttttcaaccagcatt

SEQ ID NO: 2017286 - DNA, 13 bp, Homo sapiens
tatttttcatatt

SEQ ID NO: 2017287 - DNA, 15 bp, Homo sapiens
tatttttcatattgt

SEQ ID NO: 2017288 - DNA, 19 bp, Homo sapiens
tatttttcatattgtgcca

SEQ ID NO: 2017289 - DNA, 15 bp, Homo sapiens
tatttttccacattt

SEQ ID NO: 2017290 - DNA, 20 bp, Homo sapiens
tatttttgaacccctgtgtc

SEQ ID NO: 2017291 - DNA, 17 bp, Homo sapiens
tattttttattgttttc

SEQ ID NO: 2017292 - DNA, 21 bp, Homo sapiens
tattttttcaatttaaaggtt

SEQ ID NO: 2017293 - DNA, 15 bp, Homo sapiens
tattttttctacaca

SEQ ID NO: 2017294 - DNA, 18 bp, Homo sapiens
tattttttctacacagta

SEQ ID NO: 2017295 - DNA, 16 bp, Homo sapiens
tcaaaaaaacactagt

SEQ ID NO: 2017296 - DNA, 15 bp, Homo sapiens
tcaaaaagtgtttat

SEQ ID NO: 2017297 - DNA, 12 bp, Homo sapiens
tcaaaaataaac

SEQ ID NO: 2017298 - DNA, 17 bp, Homo sapiens
tcaaaaataaactagtt

SEQ ID NO: 2017299 - DNA, 18 bp, Homo sapiens
tcaaaaataaactagttt

SEQ ID NO: 2017300 - DNA, 19 bp, Homo sapiens
tcaaaaataaactagtttc

SEQ ID NO: 2017301 - DNA, 22 bp, Homo sapiens
tcaaaaataaactagtttccag

SEQ ID NO: 2017302 - DNA, 19 bp, Homo sapiens
tcaaaaattacactacaag

SEQ ID NO: 2017303 - DNA, 18 bp, Homo sapiens
tcaaaaattgaagagaga

SEQ ID NO: 2017304 - DNA, 16 bp, Homo sapiens
tcaaaacagattgttt

SEQ ID NO: 2017305 - DNA, 13 bp, Homo sapiens
tcaaaacatatca

SEQ ID NO: 2017306 - DNA, 14 bp, Homo sapiens
tcaaaacatatcaa

SEQ ID NO: 2017307 - DNA, 21 bp, Homo sapiens
tcaaaacatatcaattcaaca

SEQ ID NO: 2017308 - DNA, 20 bp, Homo sapiens
tcatattgtgccaatatgta

SEQ ID NO: 2017309 - DNA, 12 bp, Homo sapiens
tcatatttaaag

SEQ ID NO: 2017310 - DNA, 15 bp, Homo sapiens
tcatattttgtatat

SEQ ID NO: 2017311 - DNA, 12 bp, Homo sapiens
tcatcaattccc

SEQ ID NO: 2017312 - DNA, 21 bp, Homo sapiens
tcatcaatttttatacatatc

SEQ ID NO: 2017313 - DNA, 20 bp, Homo sapiens
tcatcacacccttttaacat

SEQ ID NO: 2017314 - DNA, 16 bp, Homo sapiens
tcatcacccagtcctg

SEQ ID NO: 2017315 - DNA, 22 bp, Homo sapiens
tcatcactggatgaagattctc

SEQ ID NO: 2017316 - DNA, 15 bp, Homo sapiens
tcatcagaagataac

SEQ ID NO: 2017317 - DNA, 13 bp, Homo sapiens
tcatcagaagtgg

SEQ ID NO: 2017318 - DNA, 21 bp, Homo sapiens
tcatcagcatttaataaatgt

SEQ ID NO: 2017319 - DNA, 23 bp, Homo sapiens
tcatcaggcttggaatgaattct

SEQ ID NO: 2017320 - DNA, 15 bp, Homo sapiens
tcatcataaaataaa

SEQ ID NO: 2017321 - DNA, 22 bp, Homo sapiens
tcatccaaggaacctaattgaa

SEQ ID NO: 2017322 - DNA, 24 bp, Homo sapiens
tcatccaaggaacctaattgaaat

SEQ ID NO: 2017323 - DNA, 21 bp, Homo sapiens
tcatccactgtgccatgtgcc

SEQ ID NO: 2017324 - DNA, 23 bp, Homo sapiens
tcatccactgtgccatgtgccag

SEQ ID NO: 2017325 - DNA, 20 bp, Homo sapiens
tcatccagttgcaataaaat

SEQ ID NO: 2017326 - DNA, 13 bp, Homo sapiens
tcatcccagctgc

SEQ ID NO: 2017327 - DNA, 22 bp, Homo sapiens
tcatcccatctaagctgcagct

SEQ ID NO: 2017328 - DNA, 14 bp, Homo sapiens
tcatccccaccttg

SEQ ID NO: 2017329 - DNA, 14 bp, Homo sapiens
tcatcccctacact

SEQ ID NO: 2017330 - DNA, 15 bp, Homo sapiens
tcatcccctcgtcct

SEQ ID NO: 2017331 - DNA, 14 bp, Homo sapiens
tcatccctttccag

SEQ ID NO: 2017332 - DNA, 15 bp, Homo sapiens
tcatccgaggcaggg

SEQ ID NO: 2017333 - DNA, 22 bp, Homo sapiens
tcatcctccttataagcccagc

SEQ ID NO: 2017334 - DNA, 23 bp, Homo sapiens
tcatcctgccttcatggaactca

SEQ ID NO: 2017335 - DNA, 16 bp, Homo sapiens
tcatcctggcctcctt

SEQ ID NO: 2017336 - DNA, 17 bp, Homo sapiens
tcatcctgtgtggggag

SEQ ID NO: 2017337 - DNA, 18 bp, Homo sapiens
tcatcctgtgtggggagg

SEQ ID NO: 2017338 - DNA, 17 bp, Homo sapiens
tcatcgaacaaactgat

SEQ ID NO: 2017339 - DNA, 20 bp, Homo sapiens
tcatcgattcaaactgctcc

SEQ ID NO: 2017340 - DNA, 19 bp, Homo sapiens
tcatctacaagcatttgcc

SEQ ID NO: 2017341 - DNA, 14 bp, Homo sapiens
tcatctagcccctt

SEQ ID NO: 2017342 - DNA, 15 bp, Homo sapiens
tcatctagccccttc

SEQ ID NO: 2017343 - DNA, 14 bp, Homo sapiens
tcatctatggaggg

SEQ ID NO: 2017344 - DNA, 16 bp, Homo sapiens
tcatctatttctgaga

SEQ ID NO: 2017345 - DNA, 18 bp, Homo sapiens
tcatctatttctgagaag

SEQ ID NO: 2017346 - DNA, 20 bp, Homo sapiens
tcatctcaggcctccctcaa

SEQ ID NO: 2017347 - DNA, 14 bp, Homo sapiens
tcatctcatttaag

SEQ ID NO: 2017348 - DNA, 22 bp, Homo sapiens
tcatctcatttaagggaaaaat

SEQ ID NO: 2017349 - DNA, 13 bp, Homo sapiens
tcatctccagtgt

SEQ ID NO: 2017350 - DNA, 18 bp, Homo sapiens
tcatctcctttattgcag

SEQ ID NO: 2017351 - DNA, 19 bp, Homo sapiens
tcatctgcggggcttctgg

SEQ ID NO: 2017352 - DNA, 18 bp, Homo sapiens
tcatctggggacctggtt

SEQ ID NO: 2017353 - DNA, 14 bp, Homo sapiens
tcatctgtgtgaaa

SEQ ID NO: 2017354 - DNA, 17 bp, Homo sapiens
tcatctgtttttctttt

SEQ ID NO: 2017355 - DNA, 14 bp, Homo sapiens
tcatgaaaagagga

SEQ ID NO: 2017356 - DNA, 16 bp, Homo sapiens
tcatgaacacagcctg

SEQ ID NO: 2017357 - DNA, 18 bp, Homo sapiens
tcatgaacttggctgtaa

SEQ ID NO: 2017358 - DNA, 12 bp, Homo sapiens
tcatgaagccca

SEQ ID NO: 2017359 - DNA, 20 bp, Homo sapiens
tcatgaattcttatgcttat

SEQ ID NO: 2017360 - DNA, 23 bp, Homo sapiens
tcatgacaaagttacaaattcaa

SEQ ID NO: 2017361 - DNA, 15 bp, Homo sapiens
tcatgaccagcaaat

SEQ ID NO: 2017362 - DNA, 18 bp, Homo sapiens
tcatgaccctcctgtcca

SEQ ID NO: 2017363 - DNA, 23 bp, Homo sapiens
tcatgagtctacctgagcattca

SEQ ID NO: 2017364 - DNA, 21 bp, Homo sapiens
tcatgataatgaacagaacat

SEQ ID NO: 2017365 - DNA, 24 bp, Homo sapiens
tcatgatggatggaaatatgttct

SEQ ID NO: 2017366 - DNA, 16 bp, Homo sapiens
tcatgccatctgtttt

SEQ ID NO: 2017367 - DNA, 16 bp, Homo sapiens
tcatgcctcagtttcc

SEQ ID NO: 2017368 - DNA, 17 bp, Homo sapiens
tcatgcctcagtttccc

SEQ ID NO: 2017369 - DNA, 18 bp, Homo sapiens
tcatgcctcagtttcccc

SEQ ID NO: 2017370 - DNA, 13 bp, Homo sapiens
tcatgcctgcctg

SEQ ID NO: 2017371 - DNA, 15 bp, Homo sapiens
tcatgcctggccccc

SEQ ID NO: 2017372 - DNA, 19 bp, Homo sapiens
tcatgcctggcccccctcc

SEQ ID NO: 2017373 - DNA, 21 bp, Homo sapiens
tcatgcctggcccccctccag

SEQ ID NO: 2017374 - DNA, 18 bp, Homo sapiens
tcatgctgacttgcagag

SEQ ID NO: 2017375 - DNA, 19 bp, Homo sapiens
tcatgcttcagttgtactt

SEQ ID NO: 2017376 - DNA, 17 bp, Homo sapiens
tcatgcttcttccttac

SEQ ID NO: 2017377 - DNA, 13 bp, Homo sapiens
tcatgctttaaag

SEQ ID NO: 2017378 - DNA, 20 bp, Homo sapiens
tcatgctttaaagtgtaata

SEQ ID NO: 2017379 - DNA, 15 bp, Homo sapiens
tcatgctttctcctt

SEQ ID NO: 2017380 - DNA, 17 bp, Homo sapiens
tcatgcttttgccactt

SEQ ID NO: 2017381 - DNA, 17 bp, Homo sapiens
tcatggaaaagcccagt

SEQ ID NO: 2017382 - DNA, 14 bp, Homo sapiens
tcatggagctgagg

SEQ ID NO: 2017383 - DNA, 20 bp, Homo sapiens
tcatggcctattatattaaa

SEQ ID NO: 2017384 - DNA, 20 bp, Homo sapiens
tcatggcgtaatgggcctgc

SEQ ID NO: 2017385 - DNA, 18 bp, Homo sapiens
tcatggcttaatgtttat

SEQ ID NO: 2017386 - DNA, 17 bp, Homo sapiens
tcatggtcagctcacac

SEQ ID NO: 2017387 - DNA, 19 bp, Homo sapiens
tcatggtgatcagtgcaat

SEQ ID NO: 2017388 - DNA, 20 bp, Homo sapiens
tcatgtaaacctaagcacgt

SEQ ID NO: 2017389 - DNA, 16 bp, Homo sapiens
tcatgtaaatgattat

SEQ ID NO: 2017390 - DNA, 15 bp, Homo sapiens
tcatgtacagcatgc

SEQ ID NO: 2017391 - DNA, 16 bp, Homo sapiens
tcatgtaccatcaata

SEQ ID NO: 2017392 - DNA, 18 bp, Homo sapiens
tcatgtacttcctgtgta

SEQ ID NO: 2017393 - DNA, 22 bp, Homo sapiens
tcatgtacttcctgtgtactct

SEQ ID NO: 2017394 - DNA, 11 bp, Homo sapiens
tcatgtagatt

SEQ ID NO: 2017395 - DNA, 22 bp, Homo sapiens
tcatgtatgttcagaagaaatt

SEQ ID NO: 2017396 - DNA, 17 bp, Homo sapiens
tcatgtcaggcctgtgt

SEQ ID NO: 2017397 - DNA, 19 bp, Homo sapiens
tcatgtcaggcctgtgtgt

SEQ ID NO: 2017398 - DNA, 13 bp, Homo sapiens
tcatgtctggcta

SEQ ID NO: 2017399 - DNA, 15 bp, Homo sapiens
tcatgtgatcctttt

SEQ ID NO: 2017400 - DNA, 13 bp, Homo sapiens
tcatgtgcctgga

SEQ ID NO: 2017401 - DNA, 15 bp, Homo sapiens
tcatgtgcctggaaa

SEQ ID NO: 2017402 - DNA, 18 bp, Homo sapiens
tcatgtggaatataaaga

SEQ ID NO: 2017403 - DNA, 15 bp, Homo sapiens
tcatgtgtgctgtgc

SEQ ID NO: 2017404 - DNA, 13 bp, Homo sapiens
tcatgtttgtaaa

SEQ ID NO: 2017405 - DNA, 14 bp, Homo sapiens
tcattaatgtgttg

SEQ ID NO: 2017406 - DNA, 12 bp, Homo sapiens
tcattactaacc

SEQ ID NO: 2017407 - DNA, 16 bp, Homo sapiens
tcattactgcctttgg

SEQ ID NO: 2017408 - DNA, 18 bp, Homo sapiens
tcattactgcctttggaa

SEQ ID NO: 2017409 - DNA, 20 bp, Homo sapiens
tcattagactggaacttgaa

SEQ ID NO: 2017410 - DNA, 13 bp, Homo sapiens
tcattataaacgt

SEQ ID NO: 2017411 - DNA, 19 bp, Homo sapiens
tcattatctcaaaactgca

SEQ ID NO: 2017412 - DNA, 22 bp, Homo sapiens
tcattcaccaaatgatgccact

SEQ ID NO: 2017413 - DNA, 16 bp, Homo sapiens
tcattcaggtgttctc

SEQ ID NO: 2017414 - DNA, 19 bp, Homo sapiens
tcattcaggtgttctcttc

SEQ ID NO: 2017415 - DNA, 16 bp, Homo sapiens
tcattcatttattcat

SEQ ID NO: 2017416 - DNA, 14 bp, Homo sapiens
tcattcatttttgt

SEQ ID NO: 2017417 - DNA, 17 bp, Homo sapiens
tcattccaacagtgagt

SEQ ID NO: 2017418 - DNA, 13 bp, Homo sapiens
tcattcccagagt

SEQ ID NO: 2017419 - DNA, 13 bp, Homo sapiens
tcattcccctcgt

SEQ ID NO: 2017420 - DNA, 21 bp, Homo sapiens
tcattcctgaaagaaacagtt

SEQ ID NO: 2017421 - DNA, 23 bp, Homo sapiens
tcattccttgagaaaaacaatga

SEQ ID NO: 2017422 - DNA, 12 bp, Homo sapiens
tcattctcctgc

SEQ ID NO: 2017423 - DNA, 14 bp, Homo sapiens
tcattctcctgcct

SEQ ID NO: 2017424 - DNA, 13 bp, Homo sapiens
tcattctctttct

SEQ ID NO: 2017425 - DNA, 17 bp, Homo sapiens
tcattctgttgcccagg

SEQ ID NO: 2017426 - DNA, 20 bp, Homo sapiens
tcattctgttgcccaggctg

SEQ ID NO: 2017427 - DNA, 22 bp, Homo sapiens
tcattcttaagatttctcctga

SEQ ID NO: 2017428 - DNA, 22 bp, Homo sapiens
tcattctttcccctcagagctc

SEQ ID NO: 2017429 - DNA, 17 bp, Homo sapiens
tcattgatatgaaaaat

SEQ ID NO: 2017430 - DNA, 19 bp, Homo sapiens
tcattgatatgaaaaatat

SEQ ID NO: 2017431 - DNA, 21 bp, Homo sapiens
tcattgctttgaagcagttgt

SEQ ID NO: 2017432 - DNA, 19 bp, Homo sapiens
tcattgggttttatcagtg

SEQ ID NO: 2017433 - DNA, 14 bp, Homo sapiens
tcattgtagaaaag

SEQ ID NO: 2017434 - DNA, 17 bp, Homo sapiens
tcattgtagaaacacag

SEQ ID NO: 2017435 - DNA, 14 bp, Homo sapiens
tcattgtagagctt

SEQ ID NO: 2017436 - DNA, 23 bp, Homo sapiens
tcattgtagagcttggtggctga

SEQ ID NO: 2017437 - DNA, 14 bp, Homo sapiens
tcattgtataaaaa

SEQ ID NO: 2017438 - DNA, 17 bp, Homo sapiens
tcattgtataaaaatag

SEQ ID NO: 2017439 - DNA, 23 bp, Homo sapiens
tcattgtatgatgtgttgtgata

SEQ ID NO: 2017440 - DNA, 16 bp, Homo sapiens
tcattgtccatgccta

SEQ ID NO: 2017441 - DNA, 20 bp, Homo sapiens
tcattgtccatgcctacaga

SEQ ID NO: 2017442 - DNA, 13 bp, Homo sapiens
tcattgtggctat

SEQ ID NO: 2017443 - DNA, 13 bp, Homo sapiens
tcatttaaaatga

SEQ ID NO: 2017444 - DNA, 16 bp, Homo sapiens
tcatttaaaatgatta

SEQ ID NO: 2017445 - DNA, 15 bp, Homo sapiens
tcatttaactacaaa

SEQ ID NO: 2017446 - DNA, 23 bp, Homo sapiens
tcatttaagggaaaaatatatat

SEQ ID NO: 2017447 - DNA, 22 bp, Homo sapiens
tcatttaccataaaaatccttc

SEQ ID NO: 2017448 - DNA, 20 bp, Homo sapiens
tcatttattttaaaaaatga

SEQ ID NO: 2017449 - DNA, 13 bp, Homo sapiens
tcatttattttgt

SEQ ID NO: 2017450 - DNA, 14 bp, Homo sapiens
tcatttcactttaa

SEQ ID NO: 2017451 - DNA, 17 bp, Homo sapiens
tcatttcatctactaca

SEQ ID NO: 2017452 - DNA, 17 bp, Homo sapiens
tcatttcatctcattta

SEQ ID NO: 2017453 - DNA, 18 bp, Homo sapiens
tcatttcatctcatttaa

SEQ ID NO: 2017454 - DNA, 19 bp, Homo sapiens
tcatttcattgtatgatgt

SEQ ID NO: 2017455 - DNA, 16 bp, Homo sapiens
tcatttcctgtgtctt

SEQ ID NO: 2017456 - DNA, 15 bp, Homo sapiens
tcatttctaaaagaa

SEQ ID NO: 2017457 - DNA, 17 bp, Homo sapiens
tcatttctaaaagaata

SEQ ID NO: 2017458 - DNA, 15 bp, Homo sapiens
tcatttctactgtga

SEQ ID NO: 2017459 - DNA, 19 bp, Homo sapiens
tcatttctactgtgactga

SEQ ID NO: 2017460 - DNA, 16 bp, Homo sapiens
tcatttctgcatcagc

SEQ ID NO: 2017461 - DNA, 14 bp, Homo sapiens
tcatttctttgagt

SEQ ID NO: 2017462 - DNA, 16 bp, Homo sapiens
tcatttgaacaactag

SEQ ID NO: 2017463 - DNA, 12 bp, Homo sapiens
tcatttgtgtca

SEQ ID NO: 2017464 - DNA, 15 bp, Homo sapiens
tcatttgtgtcaatg

SEQ ID NO: 2017465 - DNA, 15 bp, Homo sapiens
tcattttaaaatctg

SEQ ID NO: 2017466 - DNA, 22 bp, Homo sapiens
tcattttaggcctcctctctgc

SEQ ID NO: 2017467 - DNA, 17 bp, Homo sapiens
tcattttagtgactgta

SEQ ID NO: 2017468 - DNA, 13 bp, Homo sapiens
tcattttcagagt

SEQ ID NO: 2017469 - DNA, 21 bp, Homo sapiens
tcattttcttatcttctgcaa

SEQ ID NO: 2017470 - DNA, 22 bp, Homo sapiens
tcattttggtaaaatacttctt

SEQ ID NO: 2017471 - DNA, 15 bp, Homo sapiens
tcatttttccgtaaa

SEQ ID NO: 2017472 - DNA, 16 bp, Homo sapiens
tcattttttaaaaaag

SEQ ID NO: 2017473 - DNA, 15 bp, Homo sapiens
tcatttttttccttg

SEQ ID NO: 2017474 - DNA, 21 bp, Homo sapiens
tccaaaaaggaacactggaaa

SEQ ID NO: 2017475 - DNA, 12 bp, Homo sapiens
tccaaactcctg

SEQ ID NO: 2017476 - DNA, 14 bp, Homo sapiens
tccaaagaaatgta

SEQ ID NO: 2017477 - DNA, 13 bp, Homo sapiens
tccaaagagaaaa

SEQ ID NO: 2017478 - DNA, 19 bp, Homo sapiens
tccaaagcacattgaaaga

SEQ ID NO: 2017479 - DNA, 23 bp, Homo sapiens
tccaaaggaatctccagttttca

SEQ ID NO: 2017480 - DNA, 19 bp, Homo sapiens
tccaaatgaatgaccttgt

SEQ ID NO: 2017481 - DNA, 21 bp, Homo sapiens
tccaaatgattttcatcaatt

SEQ ID NO: 2017482 - DNA, 22 bp, Homo sapiens
tccaaatgattttcatcaattt

SEQ ID NO: 2017483 - DNA, 17 bp, Homo sapiens
tccaacaataaagagct

SEQ ID NO: 2017484 - DNA, 19 bp, Homo sapiens
tccaacaataaagagctca

SEQ ID NO: 2017485 - DNA, 18 bp, Homo sapiens
tccaacagcttgaccaga

SEQ ID NO: 2017486 - DNA, 17 bp, Homo sapiens
tccaaccccagctggcc

SEQ ID NO: 2017487 - DNA, 18 bp, Homo sapiens
tccaaccccagctggcct

SEQ ID NO: 2017488 - DNA, 14 bp, Homo sapiens
tccaacctggacaa

SEQ ID NO: 2017489 - DNA, 19 bp, Homo sapiens
tccaactgtgttcattaga

SEQ ID NO: 2017490 - DNA, 19 bp, Homo sapiens
tccaagagaattcacttta

SEQ ID NO: 2017491 - DNA, 21 bp, Homo sapiens
tccaagagctacataatttag

SEQ ID NO: 2017492 - DNA, 22 bp, Homo sapiens
tccaagcgaggtcaacagagaa

SEQ ID NO: 2017493 - DNA, 11 bp, Homo sapiens
tccaagctggt

SEQ ID NO: 2017494 - DNA, 21 bp, Homo sapiens
tccaaggaacctaattgaaat

SEQ ID NO: 2017495 - DNA, 23 bp, Homo sapiens
tccaaggagaaacagagacaggc

SEQ ID NO: 2017496 - DNA, 20 bp, Homo sapiens
tccaagggtatgggaagcca

SEQ ID NO: 2017497 - DNA, 17 bp, Homo sapiens
tccaagtattttatctg

SEQ ID NO: 2017498 - DNA, 20 bp, Homo sapiens
tccaagtccaacctgcctgt

SEQ ID NO: 2017499 - DNA, 22 bp, Homo sapiens
tccaagtccaacctgcctgtgc

SEQ ID NO: 2017500 - DNA, 22 bp, Homo sapiens
tccaagtcttcagcgagaccct

SEQ ID NO: 2017501 - DNA, 14 bp, Homo sapiens
tccaagttcctgca

SEQ ID NO: 2017502 - DNA, 20 bp, Homo sapiens
tccaagttcctgcactccag

SEQ ID NO: 2017503 - DNA, 21 bp, Homo sapiens
tccaagttcctgcactccaga

SEQ ID NO: 2017504 - DNA, 19 bp, Homo sapiens
tccaatctgctcagcaggc

SEQ ID NO: 2017505 - DNA, 22 bp, Homo sapiens
tccaatctgctcagcaggccct

SEQ ID NO: 2017506 - DNA, 16 bp, Homo sapiens
tccaatggctgtaaac

SEQ ID NO: 2017507 - DNA, 20 bp, Homo sapiens
tccaattatgcactggccac

SEQ ID NO: 2017508 - DNA, 19 bp, Homo sapiens
tccaattatgtgacaacct

SEQ ID NO: 2017509 - DNA, 20 bp, Homo sapiens
tccaattccacagtctctgg

SEQ ID NO: 2017510 - DNA, 12 bp, Homo sapiens
tccaattgtaaa

SEQ ID NO: 2017511 - DNA, 15 bp, Homo sapiens
tccaattgtaaaaaa

SEQ ID NO: 2017512 - DNA, 16 bp, Homo sapiens
tccacaaagccgtgcc

SEQ ID NO: 2017513 - DNA, 19 bp, Homo sapiens
tccacaaagccgtgccttt

SEQ ID NO: 2017514 - DNA, 18 bp, Homo sapiens
tccacaagattcccagag

SEQ ID NO: 2017515 - DNA, 21 bp, Homo sapiens
tccacaagattcccagagaca

SEQ ID NO: 2017516 - DNA, 12 bp, Homo sapiens
tccacacaaaat

SEQ ID NO: 2017517 - DNA, 14 bp, Homo sapiens
tccacacaaaatgt

SEQ ID NO: 2017518 - DNA, 13 bp, Homo sapiens
tccacacacagag

SEQ ID NO: 2017519 - DNA, 14 bp, Homo sapiens
tccacacacagagg

SEQ ID NO: 2017520 - DNA, 15 bp, Homo sapiens
tccacacacagagga

SEQ ID NO: 2017521 - DNA, 14 bp, Homo sapiens
tccacacacgcagg

SEQ ID NO: 2017522 - DNA, 21 bp, Homo sapiens
tccacactgtcagagctgttg

SEQ ID NO: 2017523 - DNA, 11 bp, Homo sapiens
tccacagccaa

SEQ ID NO: 2017524 - DNA, 19 bp, Homo sapiens
tccacagcggaggagacca

SEQ ID NO: 2017525 - DNA, 23 bp, Homo sapiens
tccacagcggaggagaccagctc

SEQ ID NO: 2017526 - DNA, 22 bp, Homo sapiens
tccacaggagggagagaactta

SEQ ID NO: 2017527 - DNA, 15 bp, Homo sapiens
tccacagtgctgctt

SEQ ID NO: 2017528 - DNA, 22 bp, Homo sapiens
tccacagtgctgcttctcttgg

SEQ ID NO: 2017529 - DNA, 14 bp, Homo sapiens
tccacataaaggta

SEQ ID NO: 2017530 - DNA, 14 bp, Homo sapiens
tccacatcttctca

SEQ ID NO: 2017531 - DNA, 13 bp, Homo sapiens
tccaccacccaaa

SEQ ID NO: 2017532 - DNA, 19 bp, Homo sapiens
tcactggtagaccaaaata

SEQ ID NO: 2017533 - DNA, 16 bp, Homo sapiens
tcactgtaagtttatt

SEQ ID NO: 2017534 - DNA, 14 bp, Homo sapiens
tcactgtcaatgat

SEQ ID NO: 2017535 - DNA, 23 bp, Homo sapiens
tcactgtcaatgattattttcat

SEQ ID NO: 2017536 - DNA, 15 bp, Homo sapiens
tcactgtctcctggt

SEQ ID NO: 2017537 - DNA, 14 bp, Homo sapiens
tcactgtgagggga

SEQ ID NO: 2017538 - DNA, 15 bp, Homo sapiens
tcactgttgcccagg

SEQ ID NO: 2017539 - DNA, 16 bp, Homo sapiens
tcactgttgcccaggc

SEQ ID NO: 2017540 - DNA, 17 bp, Homo sapiens
tcactgttgcccaggct

SEQ ID NO: 2017541 - DNA, 17 bp, Homo sapiens
tcacttacctagattta

SEQ ID NO: 2017542 - DNA, 12 bp, Homo sapiens
tcacttatacca

SEQ ID NO: 2017543 - DNA, 20 bp, Homo sapiens
tcacttataccaaagggaaa

SEQ ID NO: 2017544 - DNA, 14 bp, Homo sapiens
tcacttcaatgaac

SEQ ID NO: 2017545 - DNA, 16 bp, Homo sapiens
tcacttcattgaccaa

SEQ ID NO: 2017546 - DNA, 13 bp, Homo sapiens
tcacttccagtgt

SEQ ID NO: 2017547 - DNA, 15 bp, Homo sapiens
tcacttccagtgttg

SEQ ID NO: 2017548 - DNA, 14 bp, Homo sapiens
tcacttccctggga

SEQ ID NO: 2017549 - DNA, 23 bp, Homo sapiens
tcacttggggtcaccaccctccc

SEQ ID NO: 2017550 - DNA, 15 bp, Homo sapiens
tcacttgtaaataaa

SEQ ID NO: 2017551 - DNA, 13 bp, Homo sapiens
tcacttgtacaaa

SEQ ID NO: 2017552 - DNA, 14 bp, Homo sapiens
tcacttgtacaaaa

SEQ ID NO: 2017553 - DNA, 21 bp, Homo sapiens
tcacttttaatgaacaaatgg

SEQ ID NO: 2017554 - DNA, 13 bp, Homo sapiens
tcacttttctgta

SEQ ID NO: 2017555 - DNA, 21 bp, Homo sapiens
tcacttttctgtaacgcctgc

SEQ ID NO: 2017556 - DNA, 22 bp, Homo sapiens
tcagaaaacataatataagaat

SEQ ID NO: 2017557 - DNA, 13 bp, Homo sapiens
tcagaaaagtaga

SEQ ID NO: 2017558 - DNA, 18 bp, Homo sapiens
tcagaaaagtagaattat

SEQ ID NO: 2017559 - DNA, 20 bp, Homo sapiens
tcagaaaagtagaattatat

SEQ ID NO: 2017560 - DNA, 21 bp, Homo sapiens
tcagaaaagtagaattatatc

SEQ ID NO: 2017561 - DNA, 23 bp, Homo sapiens
tcagaaaagtagaattatatcta

SEQ ID NO: 2017562 - DNA, 13 bp, Homo sapiens
tcagaaaccagtt

SEQ ID NO: 2017563 - DNA, 23 bp, Homo sapiens
tcagaaagagcaagtctggatct

SEQ ID NO: 2017564 - DNA, 14 bp, Homo sapiens
tcagaaagggaggg

SEQ ID NO: 2017565 - DNA, 20 bp, Homo sapiens
tcagaaagggagggctctga

SEQ ID NO: 2017566 - DNA, 21 bp, Homo sapiens
tcagaaagggagggctctgag

SEQ ID NO: 2017567 - DNA, 20 bp, Homo sapiens
tcagaaataaaatgaaatgt

SEQ ID NO: 2017568 - DNA, 23 bp, Homo sapiens
tcagaaataaaatgaaatgtctt

SEQ ID NO: 2017569 - DNA, 16 bp, Homo sapiens
tcagaacaatccgatt

SEQ ID NO: 2017570 - DNA, 15 bp, Homo sapiens
tcagaacagaggcat

SEQ ID NO: 2017571 - DNA, 23 bp, Homo sapiens
tcagaacagcagactcagctctg

SEQ ID NO: 2017572 - DNA, 15 bp, Homo sapiens
tcagaacatcctcca

SEQ ID NO: 2017573 - DNA, 14 bp, Homo sapiens
tcagaagataactt

SEQ ID NO: 2017574 - DNA, 18 bp, Homo sapiens
tcagaagcaggttcttga

SEQ ID NO: 2017575 - DNA, 20 bp, Homo sapiens
tcagaagccccatttgcaca

SEQ ID NO: 2017576 - DNA, 15 bp, Homo sapiens
tcagaagcctgaggc

SEQ ID NO: 2017577 - DNA, 13 bp, Homo sapiens
tcagaagcctggg

SEQ ID NO: 2017578 - DNA, 12 bp, Homo sapiens
tcagaaggagaa

SEQ ID NO: 2017579 - DNA, 14 bp, Homo sapiens
tcagaaggagaagg

SEQ ID NO: 2017580 - DNA, 22 bp, Homo sapiens
tcagaatcaggttgacagtccc

SEQ ID NO: 2017581 - DNA, 14 bp, Homo sapiens
tcagaatctgtgtg

SEQ ID NO: 2017582 - DNA, 17 bp, Homo sapiens
tcagaatgctctacttc

SEQ ID NO: 2017583 - DNA, 15 bp, Homo sapiens
tcagaatggaaagaa

SEQ ID NO: 2017584 - DNA, 23 bp, Homo sapiens
tcagaatttctttgtcattcaag

SEQ ID NO: 2017585 - DNA, 20 bp, Homo sapiens
tcagacaataccactggtta

SEQ ID NO: 2017586 - DNA, 13 bp, Homo sapiens
tcagacaatccac

SEQ ID NO: 2017587 - DNA, 22 bp, Homo sapiens
tcagacaattcagaagcatcac

SEQ ID NO: 2017588 - DNA, 19 bp, Homo sapiens
tcagacacttcatggacca

SEQ ID NO: 2017589 - DNA, 22 bp, Homo sapiens
tcagacatccatgtttgtaaaa

SEQ ID NO: 2017590 - DNA, 19 bp, Homo sapiens
tcagacatgaaaactattt

SEQ ID NO: 2017591 - DNA, 20 bp, Homo sapiens
tcagacatgaaaactatttt

SEQ ID NO: 2017592 - DNA, 20 bp, Homo sapiens
tcagaccaactctctcctgt

SEQ ID NO: 2017593 - DNA, 18 bp, Homo sapiens
tcagaccagtactgggaa

SEQ ID NO: 2017594 - DNA, 15 bp, Homo sapiens
tcagaccataatgtt

SEQ ID NO: 2017595 - DNA, 23 bp, Homo sapiens
tcagaccataatgttacattatt

SEQ ID NO: 2017596 - DNA, 13 bp, Homo sapiens
tcagaccccagcg

SEQ ID NO: 2017597 - DNA, 17 bp, Homo sapiens
tcagaccccagcggctg

SEQ ID NO: 2017598 - DNA, 18 bp, Homo sapiens
tcagacccccactctcat

SEQ ID NO: 2017599 - DNA, 13 bp, Homo sapiens
tcagaccctaccc

SEQ ID NO: 2017600 - DNA, 16 bp, Homo sapiens
tcagacctctgatccc

SEQ ID NO: 2017601 - DNA, 17 bp, Homo sapiens
tcagacctctgatccct

SEQ ID NO: 2017602 - DNA, 22 bp, Homo sapiens
tcagacctgacaccgtccctca

SEQ ID NO: 2017603 - DNA, 14 bp, Homo sapiens
tcagactagtgaca

SEQ ID NO: 2017604 - DNA, 20 bp, Homo sapiens
tcagactggctggctgcagt

SEQ ID NO: 2017605 - DNA, 17 bp, Homo sapiens
tcagactttaaagaata

SEQ ID NO: 2017606 - DNA, 12 bp, Homo sapiens
tcagagaagtca

SEQ ID NO: 2017607 - DNA, 13 bp, Homo sapiens
tcagagaagtcag

SEQ ID NO: 2017608 - DNA, 22 bp, Homo sapiens
tcagagaagtcagttggagaaa

SEQ ID NO: 2017609 - DNA, 23 bp, Homo sapiens
tcagagaatttctaccatttcag

SEQ ID NO: 2017610 - DNA, 20 bp, Homo sapiens
tcagagacaggtggcctagc

SEQ ID NO: 2017611 - DNA, 14 bp, Homo sapiens
tcagagactcaggg

SEQ ID NO: 2017612 - DNA, 22 bp, Homo sapiens
tcagagaggcatgtgatgtgca

SEQ ID NO: 2017613 - DNA, 16 bp, Homo sapiens
tcagagaggccttttg

SEQ ID NO: 2017614 - DNA, 22 bp, Homo sapiens
tcagagaggccttttggaatgt

SEQ ID NO: 2017615 - DNA, 18 bp, Homo sapiens
tcagagatgtaccatgtt

SEQ ID NO: 2017616 - DNA, 14 bp, Homo sapiens
tcagagccaggctc

SEQ ID NO: 2017617 - DNA, 21 bp, Homo sapiens
tcagagccaggctctgcctgg

SEQ ID NO: 2017618 - DNA, 16 bp, Homo sapiens
tcagagcccctccctg

SEQ ID NO: 2017619 - DNA, 12 bp, Homo sapiens
tcagagcctagc

SEQ ID NO: 2017620 - DNA, 13 bp, Homo sapiens
tcagagcctgcag

SEQ ID NO: 2017621 - DNA, 14 bp, Homo sapiens
tcagagcctgcagt

SEQ ID NO: 2017622 - DNA, 21 bp, Homo sapiens
tcagagctcttcaagctgtcc

SEQ ID NO: 2017623 - DNA, 22 bp, Homo sapiens
tcagagctgttggcctcgcctg

SEQ ID NO: 2017624 - DNA, 17 bp, Homo sapiens
tcagagttgctttaaag

SEQ ID NO: 2017625 - DNA, 17 bp, Homo sapiens
tcagagttgcttttcta

SEQ ID NO: 2017626 - DNA, 16 bp, Homo sapiens
tcagatatatttttca

SEQ ID NO: 2017627 - DNA, 18 bp, Homo sapiens
tcagatatatttttcaca

SEQ ID NO: 2017628 - DNA, 16 bp, Homo sapiens
tcagatcgtattaatt

SEQ ID NO: 2017629 - DNA, 14 bp, Homo sapiens
tcagatctgaacac

SEQ ID NO: 2017630 - DNA, 14 bp, Homo sapiens
tcagcaaatcctct

SEQ ID NO: 2017631 - DNA, 18 bp, Homo sapiens
tcagcaatagggtgcagt

SEQ ID NO: 2017632 - DNA, 12 bp, Homo sapiens
tcagcaccctgg

SEQ ID NO: 2017633 - DNA, 19 bp, Homo sapiens
tcagcaccctgggtgccat

SEQ ID NO: 2017634 - DNA, 13 bp, Homo sapiens
tcagcactgaaaa

SEQ ID NO: 2017635 - DNA, 17 bp, Homo sapiens
tcagcactgatttcaca

SEQ ID NO: 2017636 - DNA, 22 bp, Homo sapiens
tcagcagagttattgaatctta

SEQ ID NO: 2017637 - DNA, 14 bp, Homo sapiens
tcagcagccccctg

SEQ ID NO: 2017638 - DNA, 20 bp, Homo sapiens
tcaatatttattattttcac

SEQ ID NO: 2017639 - DNA, 17 bp, Homo sapiens
tcaatattttccatgaa

SEQ ID NO: 2017640 - DNA, 15 bp, Homo sapiens
tcaatcactgctccc

SEQ ID NO: 2017641 - DNA, 15 bp, Homo sapiens
tcaatcagtgcagtg

SEQ ID NO: 2017642 - DNA, 16 bp, Homo sapiens
tcaatcatctgtgtga

SEQ ID NO: 2017643 - DNA, 20 bp, Homo sapiens
tcaatcatctgtgtgaaaat

SEQ ID NO: 2017644 - DNA, 13 bp, Homo sapiens
tcaatcccaaaag

SEQ ID NO: 2017645 - DNA, 16 bp, Homo sapiens
tcaatcccaaaagtca

SEQ ID NO: 2017646 - DNA, 19 bp, Homo sapiens
tcaatcccaaaagtcacca

SEQ ID NO: 2017647 - DNA, 16 bp, Homo sapiens
tcaatctgtttttcat

SEQ ID NO: 2017648 - DNA, 16 bp, Homo sapiens
tcaatgaaatatttgc

SEQ ID NO: 2017649 - DNA, 19 bp, Homo sapiens
tcaatgaaatatttgctta

SEQ ID NO: 2017650 - DNA, 14 bp, Homo sapiens
tcaatgcactgaca

SEQ ID NO: 2017651 - DNA, 18 bp, Homo sapiens
tcaatgcactgacattgt

SEQ ID NO: 2017652 - DNA, 21 bp, Homo sapiens
tcaatgcattgtcttgtggag

SEQ ID NO: 2017653 - DNA, 12 bp, Homo sapiens
tcaatgccctgc

SEQ ID NO: 2017654 - DNA, 14 bp, Homo sapiens
tcaatgccctgcca

SEQ ID NO: 2017655 - DNA, 13 bp, Homo sapiens
tcaatgcttttct

SEQ ID NO: 2017656 - DNA, 18 bp, Homo sapiens
tcaatggaaacagggcag

SEQ ID NO: 2017657 - DNA, 20 bp, Homo sapiens
tcaatgggacaggaactagg

SEQ ID NO: 2017658 - DNA, 19 bp, Homo sapiens
tcaatggtttgcaaggaag

SEQ ID NO: 2017659 - DNA, 12 bp, Homo sapiens
tcaatgtgaaaa

SEQ ID NO: 2017660 - DNA, 12 bp, Homo sapiens
tcaattaaatgt

SEQ ID NO: 2017661 - DNA, 13 bp, Homo sapiens
tcaattaaatgta

SEQ ID NO: 2017662 - DNA, 16 bp, Homo sapiens
tcaattaaatgtaggt

SEQ ID NO: 2017663 - DNA, 11 bp, Homo sapiens
tcaattaataa

SEQ ID NO: 2017664 - DNA, 13 bp, Homo sapiens
tcaattagtacag

SEQ ID NO: 2017665 - DNA, 13 bp, Homo sapiens
tcaattatttcaa

SEQ ID NO: 2017666 - DNA, 23 bp, Homo sapiens
tcaattcaacacattacttgcac

SEQ ID NO: 2017667 - DNA, 15 bp, Homo sapiens
tcaattcctctggga

SEQ ID NO: 2017668 - DNA, 13 bp, Homo sapiens
tcaattcctgggc

SEQ ID NO: 2017669 - DNA, 17 bp, Homo sapiens
tcaattcctgggcccca

SEQ ID NO: 2017670 - DNA, 12 bp, Homo sapiens
tcaattctcaaa

SEQ ID NO: 2017671 - DNA, 17 bp, Homo sapiens
tcaattgtattttatat

SEQ ID NO: 2017672 - DNA, 23 bp, Homo sapiens
tcaatttaattcttatttctgtg

SEQ ID NO: 2017673 - DNA, 20 bp, Homo sapiens
tcaatttccaagagctgagg

SEQ ID NO: 2017674 - DNA, 14 bp, Homo sapiens
tcaatttcccagaa

SEQ ID NO: 2017675 - DNA, 18 bp, Homo sapiens
tcaatttccctgactcct

SEQ ID NO: 2017676 - DNA, 21 bp, Homo sapiens
tcaatttccctgactcctcta

SEQ ID NO: 2017677 - DNA, 20 bp, Homo sapiens
tcaatttttcttatttcatt

SEQ ID NO: 2017678 - DNA, 13 bp, Homo sapiens
tcaattttttgct

SEQ ID NO: 2017679 - DNA, 21 bp, Homo sapiens
tcacaaaacctggcacaatgg

SEQ ID NO: 2017680 - DNA, 16 bp, Homo sapiens
tcacaacaacctggtc

SEQ ID NO: 2017681 - DNA, 21 bp, Homo sapiens
tcacaacagattattacctta

SEQ ID NO: 2017682 - DNA, 19 bp, Homo sapiens
tcacaaccagccacacaga

SEQ ID NO: 2017683 - DNA, 21 bp, Homo sapiens
tcacaaccagccacacagagc

SEQ ID NO: 2017684 - DNA, 13 bp, Homo sapiens
tcacaacctccgt

SEQ ID NO: 2017685 - DNA, 17 bp, Homo sapiens
tcacaactaggacctca

SEQ ID NO: 2017686 - DNA, 13 bp, Homo sapiens
tcacaactgtttt

SEQ ID NO: 2017687 - DNA, 20 bp, Homo sapiens
tcacaactgtttttgaagaa

SEQ ID NO: 2017688 - DNA, 14 bp, Homo sapiens
tcacaagaagacca

SEQ ID NO: 2017689 - DNA, 17 bp, Homo sapiens
tcacaagagcccagcag

SEQ ID NO: 2017690 - DNA, 15 bp, Homo sapiens
tcacaagcaataatt

SEQ ID NO: 2017691 - DNA, 16 bp, Homo sapiens
tcacaagcaataatta

SEQ ID NO: 2017692 - DNA, 19 bp, Homo sapiens
tcacaagcaataattagga

SEQ ID NO: 2017693 - DNA, 18 bp, Homo sapiens
tcacaagggacgctttgg

SEQ ID NO: 2017694 - DNA, 20 bp, Homo sapiens
tcacaagggacgctttggga

SEQ ID NO: 2017695 - DNA, 18 bp, Homo sapiens
tcacaatcctgtccctca

SEQ ID NO: 2017696 - DNA, 22 bp, Homo sapiens
tcacaatgaaatgctctccttt

SEQ ID NO: 2017697 - DNA, 19 bp, Homo sapiens
tcacaattccatttccagt

SEQ ID NO: 2017698 - DNA, 22 bp, Homo sapiens
tcacaattccatttccagttca

SEQ ID NO: 2017699 - DNA, 15 bp, Homo sapiens
tcacacaaggctggg

SEQ ID NO: 2017700 - DNA, 16 bp, Homo sapiens
tcacacaaggctgggc

SEQ ID NO: 2017701 - DNA, 17 bp, Homo sapiens
tcacacaaggctgggca

SEQ ID NO: 2017702 - DNA, 15 bp, Homo sapiens
tcacacagacacaca

SEQ ID NO: 2017703 - DNA, 12 bp, Homo sapiens
tcacacaggcat

SEQ ID NO: 2017704 - DNA, 20 bp, Homo sapiens
tcacacaggcatttcctggg

SEQ ID NO: 2017705 - DNA, 21 bp, Homo sapiens
tcacacaggcatttcctgggt

SEQ ID NO: 2017706 - DNA, 23 bp, Homo sapiens
tcacacaggcatttcctgggtgg

SEQ ID NO: 2017707 - DNA, 22 bp, Homo sapiens
tcacacagtattacttctgcta

SEQ ID NO: 2017708 - DNA, 13 bp, Homo sapiens
tcacacctctggg

SEQ ID NO: 2017709 - DNA, 22 bp, Homo sapiens
tcacacctctgggcttcagggt

SEQ ID NO: 2017710 - DNA, 20 bp, Homo sapiens
tcacacctgtaatcccagca

SEQ ID NO: 2017711 - DNA, 17 bp, Homo sapiens
tcacacggggtatttta

SEQ ID NO: 2017712 - DNA, 11 bp, Homo sapiens
tcacactgtgc

SEQ ID NO: 2017713 - DNA, 21 bp, Homo sapiens
tcacactgttactccacagcg

SEQ ID NO: 2017714 - DNA, 23 bp, Homo sapiens
tcacactgttactccacagcgga

SEQ ID NO: 2017715 - DNA, 13 bp, Homo sapiens
tcacacttgtttc

SEQ ID NO: 2017716 - DNA, 12 bp, Homo sapiens
tcacagaagaat

SEQ ID NO: 2017717 - DNA, 21 bp, Homo sapiens
tcacagatgggtattaaactt

SEQ ID NO: 2017718 - DNA, 14 bp, Homo sapiens
tcacagcagaatga

SEQ ID NO: 2017719 - DNA, 14 bp, Homo sapiens
tcacagcagccact

SEQ ID NO: 2017720 - DNA, 18 bp, Homo sapiens
tcacagctgcagctgggc

SEQ ID NO: 2017721 - DNA, 22 bp, Homo sapiens
tcacaggagcagacagagaaat

SEQ ID NO: 2017722 - DNA, 17 bp, Homo sapiens
tcacaggcaggtccagg

SEQ ID NO: 2017723 - DNA, 19 bp, Homo sapiens
tcacaggcaggtccagggt

SEQ ID NO: 2017724 - DNA, 17 bp, Homo sapiens
tcacaggggcggggcag

SEQ ID NO: 2017725 - DNA, 19 bp, Homo sapiens
tcacaggggcggggcagga

SEQ ID NO: 2017726 - DNA, 18 bp, Homo sapiens
tcacaggtgtggtgtaat

SEQ ID NO: 2017727 - DNA, 19 bp, Homo sapiens
tcacagtctctttaatctt

SEQ ID NO: 2017728 - DNA, 23 bp, Homo sapiens
tcacagtctctttaatcttcagt

SEQ ID NO: 2017729 - DNA, 16 bp, Homo sapiens
tcacagtgacccttcc

SEQ ID NO: 2017730 - DNA, 22 bp, Homo sapiens
tcacagtggcgagaggagagga

SEQ ID NO: 2017731 - DNA, 14 bp, Homo sapiens
tcacagtgtttcga

SEQ ID NO: 2017732 - DNA, 23 bp, Homo sapiens
tcacagtgtttgcaatggtgttg

SEQ ID NO: 2017733 - DNA, 19 bp, Homo sapiens
tcacagttcctcgccctgg

SEQ ID NO: 2017734 - DNA, 22 bp, Homo sapiens
tcacagttcctcgccctgggtc

SEQ ID NO: 2017735 - DNA, 22 bp, Homo sapiens
tcacagttgccatgtagacccc

SEQ ID NO: 2017736 - DNA, 12 bp, Homo sapiens
tagactttctgt

SEQ ID NO: 2017737 - DNA, 15 bp, Homo sapiens
tagagaagtatccaa

SEQ ID NO: 2017738 - DNA, 20 bp, Homo sapiens
tagagaagtatccaattatg

SEQ ID NO: 2017739 - DNA, 11 bp, Homo sapiens
tagagagcaga

SEQ ID NO: 2017740 - DNA, 15 bp, Homo sapiens
tagagagcagaaata

SEQ ID NO: 2017741 - DNA, 16 bp, Homo sapiens
tagagagcagaaataa

SEQ ID NO: 2017742 - DNA, 18 bp, Homo sapiens
tagagagcagaaataaaa

SEQ ID NO: 2017743 - DNA, 14 bp, Homo sapiens
tagagaggctggca

SEQ ID NO: 2017744 - DNA, 17 bp, Homo sapiens
tagagaggtagcgagct

SEQ ID NO: 2017745 - DNA, 17 bp, Homo sapiens
tagagatatttttgtac

SEQ ID NO: 2017746 - DNA, 19 bp, Homo sapiens
tagagatgtttttaaaagt

SEQ ID NO: 2017747 - DNA, 23 bp, Homo sapiens
tagagatgtttttaaaagtttca

SEQ ID NO: 2017748 - DNA, 17 bp, Homo sapiens
tagagcacactgtagca

SEQ ID NO: 2017749 - DNA, 14 bp, Homo sapiens
tagagcagcccaaa

SEQ ID NO: 2017750 - DNA, 22 bp, Homo sapiens
tagagccccccgtgtggcttac

SEQ ID NO: 2017751 - DNA, 13 bp, Homo sapiens
tagagcctggaag

SEQ ID NO: 2017752 - DNA, 18 bp, Homo sapiens
tagagctcctgtccctac

SEQ ID NO: 2017753 - DNA, 20 bp, Homo sapiens
tagagctcctgtccctaccc

SEQ ID NO: 2017754 - DNA, 15 bp, Homo sapiens
tagagcttggacagt

SEQ ID NO: 2017755 - DNA, 22 bp, Homo sapiens
tagaggaaaaaaatgactaaaa

SEQ ID NO: 2017756 - DNA, 22 bp, Homo sapiens
tagaggagggcatgggagggag

SEQ ID NO: 2017757 - DNA, 17 bp, Homo sapiens
tagaggcaaacatttct

SEQ ID NO: 2017758 - DNA, 23 bp, Homo sapiens
tagagggaggagaatgagcctcg

SEQ ID NO: 2017759 - DNA, 16 bp, Homo sapiens
tagaggtgagaaattt

SEQ ID NO: 2017760 - DNA, 17 bp, Homo sapiens
tagaggtgagaaattta

SEQ ID NO: 2017761 - DNA, 14 bp, Homo sapiens
tagaggtgggcagc

SEQ ID NO: 2017762 - DNA, 17 bp, Homo sapiens
tagagtagaagtctctt

SEQ ID NO: 2017763 - DNA, 14 bp, Homo sapiens
tagagtcagccttc

SEQ ID NO: 2017764 - DNA, 20 bp, Homo sapiens
tagagtggcccagaattgca

SEQ ID NO: 2017765 - DNA, 14 bp, Homo sapiens
tagagttcatccca

SEQ ID NO: 2017766 - DNA, 22 bp, Homo sapiens
tagataggtgcttttaactggg

SEQ ID NO: 2017767 - DNA, 19 bp, Homo sapiens
tagatagttaaaagactgc

SEQ ID NO: 2017768 - DNA, 23 bp, Homo sapiens
tagatatataactttagaaataa

SEQ ID NO: 2017769 - DNA, 23 bp, Homo sapiens
tagatccatttggacaaaatgga

SEQ ID NO: 2017770 - DNA, 18 bp, Homo sapiens
tagatcctaggtgctgga

SEQ ID NO: 2017771 - DNA, 18 bp, Homo sapiens
tagatcgcttgagcccag

SEQ ID NO: 2017772 - DNA, 12 bp, Homo sapiens
tagatctcctgt

SEQ ID NO: 2017773 - DNA, 16 bp, Homo sapiens
tagatcttctgaaatg

SEQ ID NO: 2017774 - DNA, 16 bp, Homo sapiens
tagatgagggtgactg

SEQ ID NO: 2017775 - DNA, 19 bp, Homo sapiens
tagatgcaagatatttata

SEQ ID NO: 2017776 - DNA, 20 bp, Homo sapiens
tagatgggtctggctgagct

SEQ ID NO: 2017777 - DNA, 15 bp, Homo sapiens
tagatgtatcattaa

SEQ ID NO: 2017778 - DNA, 21 bp, Homo sapiens
tagatgtctttaggcagcagc

SEQ ID NO: 2017779 - DNA, 16 bp, Homo sapiens
tagatgtgcaagtctt

SEQ ID NO: 2017780 - DNA, 20 bp, Homo sapiens
tagatgtgcaagtcttgtca

SEQ ID NO: 2017781 - DNA, 15 bp, Homo sapiens
tagatgttttacaaa

SEQ ID NO: 2017782 - DNA, 15 bp, Homo sapiens
tagattaatggcact

SEQ ID NO: 2017783 - DNA, 16 bp, Homo sapiens
tagattaatggcactg

SEQ ID NO: 2017784 - DNA, 14 bp, Homo sapiens
tagattacctgcca

SEQ ID NO: 2017785 - DNA, 14 bp, Homo sapiens
tagattagctctgg

SEQ ID NO: 2017786 - DNA, 22 bp, Homo sapiens
tagattcctcttgcctctctca

SEQ ID NO: 2017787 - DNA, 19 bp, Homo sapiens
tagattctccaaatgattt

SEQ ID NO: 2017788 - DNA, 19 bp, Homo sapiens
tagatttatgtaatgcttt

SEQ ID NO: 2017789 - DNA, 18 bp, Homo sapiens
tagatttgattatttcct

SEQ ID NO: 2017790 - DNA, 18 bp, Homo sapiens
tagatttgtattttaaaa

SEQ ID NO: 2017791 - DNA, 14 bp, Homo sapiens
tagattttcatgtt

SEQ ID NO: 2017792 - DNA, 12 bp, Homo sapiens
tagcaaagaatt

SEQ ID NO: 2017793 - DNA, 16 bp, Homo sapiens
tagcaaagatatctca

SEQ ID NO: 2017794 - DNA, 22 bp, Homo sapiens
tagcaactacagtctaaagctg

SEQ ID NO: 2017795 - DNA, 12 bp, Homo sapiens
tagcaactgtgc

SEQ ID NO: 2017796 - DNA, 18 bp, Homo sapiens
tagcaagacacatcccta

SEQ ID NO: 2017797 - DNA, 19 bp, Homo sapiens
tagcaagacctgttggtta

SEQ ID NO: 2017798 - DNA, 24 bp, Homo sapiens
tagcaagattgcttaaaatagcaa

SEQ ID NO: 2017799 - DNA, 19 bp, Homo sapiens
tagcaagttctagagaaga

SEQ ID NO: 2017800 - DNA, 18 bp, Homo sapiens
taaatacaaaataaaatt

SEQ ID NO: 2017801 - DNA, 23 bp, Homo sapiens
taaatacaaaataaaattatggt

SEQ ID NO: 2017802 - DNA, 12 bp, Homo sapiens
taaatacatgtg

SEQ ID NO: 2017803 - DNA, 14 bp, Homo sapiens
taaatactgtacat

SEQ ID NO: 2017804 - DNA, 16 bp, Homo sapiens
taaatactgtacatag

SEQ ID NO: 2017805 - DNA, 17 bp, Homo sapiens
taaatactgtacataga

SEQ ID NO: 2017806 - DNA, 18 bp, Homo sapiens
taaatagttttaaatatg

SEQ ID NO: 2017807 - DNA, 19 bp, Homo sapiens
taaatagttttaaatatga

SEQ ID NO: 2017808 - DNA, 17 bp, Homo sapiens
taaatataaatgtttaa

SEQ ID NO: 2017809 - DNA, 15 bp, Homo sapiens
taaatataattggga

SEQ ID NO: 2017810 - DNA, 14 bp, Homo sapiens
taaatatataaaaa

SEQ ID NO: 2017811 - DNA, 21 bp, Homo sapiens
taaatatatctatattattgt

SEQ ID NO: 2017812 - DNA, 14 bp, Homo sapiens
taaatatccacaga

SEQ ID NO: 2017813 - DNA, 22 bp, Homo sapiens
taaatatccacagactccctcc

SEQ ID NO: 2017814 - DNA, 15 bp, Homo sapiens
taaatatgaacaaag

SEQ ID NO: 2017815 - DNA, 18 bp, Homo sapiens
taaatatgttagcaaaga

SEQ ID NO: 2017816 - DNA, 13 bp, Homo sapiens
taaatatttaaca

SEQ ID NO: 2017817 - DNA, 18 bp, Homo sapiens
taaatatttacatatgaa

SEQ ID NO: 2017818 - DNA, 14 bp, Homo sapiens
taaatattttaaag

SEQ ID NO: 2017819 - DNA, 15 bp, Homo sapiens
taaatattttaaaga

SEQ ID NO: 2017820 - DNA, 15 bp, Homo sapiens
taaatattttacagt

SEQ ID NO: 2017821 - DNA, 20 bp, Homo sapiens
taaatcaaaagctgcttgac

SEQ ID NO: 2017822 - DNA, 16 bp, Homo sapiens
taaatcaactccagct

SEQ ID NO: 2017823 - DNA, 21 bp, Homo sapiens
taaatcacgctttttgaaaaa

SEQ ID NO: 2017824 - DNA, 13 bp, Homo sapiens
taaatcacttgta

SEQ ID NO: 2017825 - DNA, 15 bp, Homo sapiens
taaatcacttgtaaa

SEQ ID NO: 2017826 - DNA, 16 bp, Homo sapiens
taaatcacttgtaaat

SEQ ID NO: 2017827 - DNA, 17 bp, Homo sapiens
taaatcacttgtaaata

SEQ ID NO: 2017828 - DNA, 18 bp, Homo sapiens
taaatcacttgtaaataa

SEQ ID NO: 2017829 - DNA, 22 bp, Homo sapiens
taaatcacttgtaaataaatag

SEQ ID NO: 2017830 - DNA, 19 bp, Homo sapiens
taaatcctttttctttata

SEQ ID NO: 2017831 - DNA, 14 bp, Homo sapiens
taaatctaatcagg

SEQ ID NO: 2017832 - DNA, 23 bp, Homo sapiens
gtctcattctgttgcccaggctg

SEQ ID NO: 2017833 - DNA, 17 bp, Homo sapiens
gtctccactgaggatgt

SEQ ID NO: 2017834 - DNA, 21 bp, Homo sapiens
gtctccagtatccactttgca

SEQ ID NO: 2017835 - DNA, 18 bp, Homo sapiens
gtctccagtggttgctgt

SEQ ID NO: 2017836 - DNA, 15 bp, Homo sapiens
gtctccctaaaataa

SEQ ID NO: 2017837 - DNA, 15 bp, Homo sapiens
gtctccctctcctgc

SEQ ID NO: 2017838 - DNA, 19 bp, Homo sapiens
gtctccctctcctgcctac

SEQ ID NO: 2017839 - DNA, 20 bp, Homo sapiens
gtctccctctcctgcctact

SEQ ID NO: 2017840 - DNA, 20 bp, Homo sapiens
gtctccctggatcagaacag

SEQ ID NO: 2017841 - DNA, 17 bp, Homo sapiens
gtctccgcacttggaaa

SEQ ID NO: 2017842 - DNA, 17 bp, Homo sapiens
gtctcctacctgctgct

SEQ ID NO: 2017843 - DNA, 20 bp, Homo sapiens
gtctcctctgattatcaggt

SEQ ID NO: 2017844 - DNA, 23 bp, Homo sapiens
gtctcctcttaaaaaataaaaac

SEQ ID NO: 2017845 - DNA, 17 bp, Homo sapiens
gtctcctggtctgtgct

SEQ ID NO: 2017846 - DNA, 21 bp, Homo sapiens
gtctcctgtgcccacatccca

SEQ ID NO: 2017847 - DNA, 22 bp, Homo sapiens
gtctcctgtgcccacatcccag

SEQ ID NO: 2017848 - DNA, 21 bp, Homo sapiens
gtctccttactctgagcccag

SEQ ID NO: 2017849 - DNA, 23 bp, Homo sapiens
gtctccttactctgagcccaggc

SEQ ID NO: 2017850 - DNA, 14 bp, Homo sapiens
gtctccttgcactt

SEQ ID NO: 2017851 - DNA, 21 bp, Homo sapiens
gtctcctttctcagccacaaa

SEQ ID NO: 2017852 - DNA, 16 bp, Homo sapiens
gtctcctttgcactga

SEQ ID NO: 2017853 - DNA, 18 bp, Homo sapiens
gtctcctttgcactgagg

SEQ ID NO: 2017854 - DNA, 20 bp, Homo sapiens
gtctcctttgcactgagggc

SEQ ID NO: 2017855 - DNA, 14 bp, Homo sapiens
gtctcgagcgccct

SEQ ID NO: 2017856 - DNA, 18 bp, Homo sapiens
gtctcgagcgccctgcag

SEQ ID NO: 2017857 - DNA, 19 bp, Homo sapiens
gtctcgagcgccctgcaga

SEQ ID NO: 2017858 - DNA, 21 bp, Homo sapiens
gtctcgagcgccctgcagacc

SEQ ID NO: 2017859 - DNA, 23 bp, Homo sapiens
gtctcgggtggctagtcagagag

SEQ ID NO: 2017860 - DNA, 17 bp, Homo sapiens
gtctctatgccagctca

SEQ ID NO: 2017861 - DNA, 12 bp, Homo sapiens
gtctctcagaat

SEQ ID NO: 2017862 - DNA, 19 bp, Homo sapiens
gtctctcattctctttctt

SEQ ID NO: 2017863 - DNA, 13 bp, Homo sapiens
gtctctccactgc

SEQ ID NO: 2017864 - DNA, 13 bp, Homo sapiens
gtctctcccaccc

SEQ ID NO: 2017865 - DNA, 16 bp, Homo sapiens
gtctctcccaccccgg

SEQ ID NO: 2017866 - DNA, 14 bp, Homo sapiens
gtctctgctgcatt

SEQ ID NO: 2017867 - DNA, 16 bp, Homo sapiens
gtctctggaacccagg

SEQ ID NO: 2017868 - DNA, 23 bp, Homo sapiens
gtctctgtcccggttcaccttgc

SEQ ID NO: 2017869 - DNA, 13 bp, Homo sapiens
gtctcttcctctg

SEQ ID NO: 2017870 - DNA, 14 bp, Homo sapiens
gtctcttcctctgt

SEQ ID NO: 2017871 - DNA, 17 bp, Homo sapiens
gtctcttcctctgttct

SEQ ID NO: 2017872 - DNA, 23 bp, Homo sapiens
gtctcttcctctgttctatccca

SEQ ID NO: 2017873 - DNA, 15 bp, Homo sapiens
gtctcttctccactg

SEQ ID NO: 2017874 - DNA, 17 bp, Homo sapiens
gtctcttctccactgga

SEQ ID NO: 2017875 - DNA, 22 bp, Homo sapiens
gtctcttttgttcctggctttg

SEQ ID NO: 2017876 - DNA, 13 bp, Homo sapiens
gtctgaacccttg

SEQ ID NO: 2017877 - DNA, 18 bp, Homo sapiens
gtctgaacccttgtgctt

SEQ ID NO: 2017878 - DNA, 17 bp, Homo sapiens
gtctgaagtcactgcac

SEQ ID NO: 2017879 - DNA, 19 bp, Homo sapiens
gtctgaagtcactgcacag

SEQ ID NO: 2017880 - DNA, 16 bp, Homo sapiens
gtctgaagtggttgtt

SEQ ID NO: 2017881 - DNA, 13 bp, Homo sapiens
gtctgacaggcaa

SEQ ID NO: 2017882 - DNA, 20 bp, Homo sapiens
gtctgacaggcaatgctggc

SEQ ID NO: 2017883 - DNA, 23 bp, Homo sapiens
gtctgacaggcaatgctggctgt

SEQ ID NO: 2017884 - DNA, 15 bp, Homo sapiens
gtctgacccactgct

SEQ ID NO: 2017885 - DNA, 18 bp, Homo sapiens
gtctgactccagagtctg

SEQ ID NO: 2017886 - DNA, 21 bp, Homo sapiens
gtctgactccagagtctgagc

SEQ ID NO: 2017887 - DNA, 22 bp, Homo sapiens
gtctgagcaccccctcattccc

SEQ ID NO: 2017888 - DNA, 12 bp, Homo sapiens
gtctgagccccc

SEQ ID NO: 2017889 - DNA, 16 bp, Homo sapiens
gtctgagcccccggct

SEQ ID NO: 2017890 - DNA, 12 bp, Homo sapiens
gtctgagccctg

SEQ ID NO: 2017891 - DNA, 13 bp, Homo sapiens
gtctgaggcctca

SEQ ID NO: 2017892 - DNA, 19 bp, Homo sapiens
gtctgaggcctcatccctc

SEQ ID NO: 2017893 - DNA, 22 bp, Homo sapiens
gtctgaggcctcatccctcgga

SEQ ID NO: 2017894 - DNA, 15 bp, Homo sapiens
gtctgaggtcctgag

SEQ ID NO: 2017895 - DNA, 16 bp, Homo sapiens
gtctgaggtcctgagc

SEQ ID NO: 2017896 - DNA, 21 bp, Homo sapiens
gtctgagtcctgtctctgcct

SEQ ID NO: 2017897 - DNA, 13 bp, Homo sapiens
gtctgagtgggcg

SEQ ID NO: 2017898 - DNA, 14 bp, Homo sapiens
gtctgatgtttgtt

SEQ ID NO: 2017899 - DNA, 22 bp, Homo sapiens
gtctgatttcaggatactctgt

SEQ ID NO: 2017900 - DNA, 17 bp, Homo sapiens
gtctgcacccaggggtg

SEQ ID NO: 2017901 - DNA, 18 bp, Homo sapiens
gtctgcagcccggcgcca

SEQ ID NO: 2017902 - DNA, 17 bp, Homo sapiens
gtctgccagccagcagc

SEQ ID NO: 2017903 - DNA, 13 bp, Homo sapiens
gtctgccaggccc

SEQ ID NO: 2017904 - DNA, 14 bp, Homo sapiens
gtctgccaggccca

SEQ ID NO: 2017905 - DNA, 21 bp, Homo sapiens
gtctgcccccgtcttctctcc

SEQ ID NO: 2017906 - DNA, 15 bp, Homo sapiens
gtctgcgtgactatt

SEQ ID NO: 2017907 - DNA, 23 bp, Homo sapiens
gtctgctcagacagaacccctac

SEQ ID NO: 2017908 - DNA, 12 bp, Homo sapiens
gtctgctcagga

SEQ ID NO: 2017909 - DNA, 20 bp, Homo sapiens
gtctgctggtgtcattgctg

SEQ ID NO: 2017910 - DNA, 19 bp, Homo sapiens
gtctggagaagcagtgagc

SEQ ID NO: 2017911 - DNA, 15 bp, Homo sapiens
gtctggctgagctga

SEQ ID NO: 2017912 - DNA, 16 bp, Homo sapiens
gtctgggatgtagaac

SEQ ID NO: 2017913 - DNA, 13 bp, Homo sapiens
gtctgggtgtctc

SEQ ID NO: 2017914 - DNA, 23 bp, Homo sapiens
gtctggtgtagctcctctgctgc

SEQ ID NO: 2017915 - DNA, 20 bp, Homo sapiens
gtctgtacacgtgtcctgta

SEQ ID NO: 2017916 - DNA, 15 bp, Homo sapiens
gtctgtatatacatt

SEQ ID NO: 2017917 - DNA, 20 bp, Homo sapiens
gtctgtatcggagacagtga

SEQ ID NO: 2017918 - DNA, 11 bp, Homo sapiens
gtctgtcatcc

SEQ ID NO: 2017919 - DNA, 15 bp, Homo sapiens
gtctgtcccaccagc

SEQ ID NO: 2017920 - DNA, 18 bp, Homo sapiens
gtctgtcctttgccccct

SEQ ID NO: 2017921 - DNA, 14 bp, Homo sapiens
gtctgtctgtctgt

SEQ ID NO: 2017922 - DNA, 15 bp, Homo sapiens
gtctgtctttgtggg

SEQ ID NO: 2017923 - DNA, 21 bp, Homo sapiens
gtctgtgaattggaccatcct

SEQ ID NO: 2017924 - DNA, 11 bp, Homo sapiens
gtctgtgcagc

SEQ ID NO: 2017925 - DNA, 13 bp, Homo sapiens
gtctgtgcagctg

SEQ ID NO: 2017926 - DNA, 19 bp, Homo sapiens
gtctgtgctgtgcctgcta

SEQ ID NO: 2017927 - DNA, 20 bp, Homo sapiens
gtctgtgtgatgaactttct

SEQ ID NO: 2017928 - DNA, 20 bp, Homo sapiens
gtttttgaagaagggaaatt

SEQ ID NO: 2017929 - DNA, 18 bp, Homo sapiens
gtttttgatagctttatt

SEQ ID NO: 2017930 - DNA, 12 bp, Homo sapiens
gtttttgtgctg

SEQ ID NO: 2017931 - DNA, 17 bp, Homo sapiens
gtttttgtgctgtgggc

SEQ ID NO: 2017932 - DNA, 15 bp, Homo sapiens
gttttttatgctaat

SEQ ID NO: 2017933 - DNA, 15 bp, Homo sapiens
gtttttttcttgtgc

SEQ ID NO: 2017934 - DNA, 16 bp, Homo sapiens
taaaaaaaagaaatga

SEQ ID NO: 2017935 - DNA, 15 bp, Homo sapiens
taaaaaaaagaagag

SEQ ID NO: 2017936 - DNA, 12 bp, Homo sapiens
taaaaaaaagcc

SEQ ID NO: 2017937 - DNA, 15 bp, Homo sapiens
taaaaaaataagaag

SEQ ID NO: 2017938 - DNA, 13 bp, Homo sapiens
taaaaaaatacag

SEQ ID NO: 2017939 - DNA, 14 bp, Homo sapiens
taaaaaacatttgt

SEQ ID NO: 2017940 - DNA, 16 bp, Homo sapiens
taaaaaacatttgtac

SEQ ID NO: 2017941 - DNA, 17 bp, Homo sapiens
taaaaaacatttgtaca

SEQ ID NO: 2017942 - DNA, 19 bp, Homo sapiens
taaaaaactaaaaactaga

SEQ ID NO: 2017943 - DNA, 21 bp, Homo sapiens
taaaaaactatctttttgctt

SEQ ID NO: 2017944 - DNA, 20 bp, Homo sapiens
taaaaaagcttaaaactttg

SEQ ID NO: 2017945 - DNA, 15 bp, Homo sapiens
taaaaaataaatata

SEQ ID NO: 2017946 - DNA, 17 bp, Homo sapiens
taaaaaataaatataat

SEQ ID NO: 2017947 - DNA, 12 bp, Homo sapiens
taaaaaatacac

SEQ ID NO: 2017948 - DNA, 13 bp, Homo sapiens
taaaaaatacacc

SEQ ID NO: 2017949 - DNA, 22 bp, Homo sapiens
taaaaaatacaccacgaatttg

SEQ ID NO: 2017950 - DNA, 15 bp, Homo sapiens
taaaaacataaaata

SEQ ID NO: 2017951 - DNA, 18 bp, Homo sapiens
taaaaaccagaatcataa

SEQ ID NO: 2017952 - DNA, 20 bp, Homo sapiens
gtttattggaagtgttcaag

SEQ ID NO: 2017953 - DNA, 16 bp, Homo sapiens
gtttatttttcatatt

SEQ ID NO: 2017954 - DNA, 12 bp, Homo sapiens
gtttcaaaagtg

SEQ ID NO: 2017955 - DNA, 23 bp, Homo sapiens
gtttcaaatggactcatggctta

SEQ ID NO: 2017956 - DNA, 21 bp, Homo sapiens
gtttcaatgtgattctaatgt

SEQ ID NO: 2017957 - DNA, 19 bp, Homo sapiens
gtttcactatgattttcta

SEQ ID NO: 2017958 - DNA, 19 bp, Homo sapiens
gtttcactgtgttggccag

SEQ ID NO: 2017959 - DNA, 16 bp, Homo sapiens
gtttcagaattttgta

SEQ ID NO: 2017960 - DNA, 17 bp, Homo sapiens
gtttcaggacatggggc

SEQ ID NO: 2017961 - DNA, 23 bp, Homo sapiens
gtttccaagttcctgcactccag

SEQ ID NO: 2017962 - DNA, 22 bp, Homo sapiens
gtttccacgatgaaaaacttcc

SEQ ID NO: 2017963 - DNA, 22 bp, Homo sapiens
gtttccactgtcttgcctgcca

SEQ ID NO: 2017964 - DNA, 17 bp, Homo sapiens
gtttccagaaaatataa

SEQ ID NO: 2017965 - DNA, 22 bp, Homo sapiens
gtttccaggccaccgctctcct

SEQ ID NO: 2017966 - DNA, 23 bp, Homo sapiens
gtttccagtacacctttcagcca

SEQ ID NO: 2017967 - DNA, 21 bp, Homo sapiens
gtttcccataattttcttcat

SEQ ID NO: 2017968 - DNA, 20 bp, Homo sapiens
gtttcctcattcctgaaaga

SEQ ID NO: 2017969 - DNA, 17 bp, Homo sapiens
ggggagccaacagcagc

SEQ ID NO: 2017970 - DNA, 22 bp, Homo sapiens
ggggaggaagggccaggagaga

SEQ ID NO: 2017971 - DNA, 21 bp, Homo sapiens
ggggaggggcctagggagccg

SEQ ID NO: 2017972 - DNA, 15 bp, Homo sapiens
ggggagtccctgcca

SEQ ID NO: 2017973 - DNA, 17 bp, Homo sapiens
ggggataccataaaaag

SEQ ID NO: 2017974 - DNA, 13 bp, Homo sapiens
ggggatgggccag

SEQ ID NO: 2017975 - DNA, 20 bp, Homo sapiens
ggggattcttccatctgatt

SEQ ID NO: 2017976 - DNA, 18 bp, Homo sapiens
ggggattggagggaagac

SEQ ID NO: 2017977 - DNA, 20 bp, Homo sapiens
ggggattggagggaagacag

SEQ ID NO: 2017978 - DNA, 18 bp, Homo sapiens
ggggattgggagggacag

SEQ ID NO: 2017979 - DNA, 23 bp, Homo sapiens
ggggattgggagggacagggctt

SEQ ID NO: 2017980 - DNA, 14 bp, Homo sapiens
ggggcaaggtctcc

SEQ ID NO: 2017981 - DNA, 18 bp, Homo sapiens
ggggcaaggtctccttac

SEQ ID NO: 2017982 - DNA, 15 bp, Homo sapiens
ggggcaatggggaga

SEQ ID NO: 2017983 - DNA, 13 bp, Homo sapiens
ggggcacagtcat

SEQ ID NO: 2017984 - DNA, 16 bp, Homo sapiens
ggggcacctgccaccg

SEQ ID NO: 2017985 - DNA, 16 bp, Homo sapiens
ggggcacgcctgccca

SEQ ID NO: 2017986 - DNA, 18 bp, Homo sapiens
ggggcacgcctgcccagc

SEQ ID NO: 2017987 - DNA, 16 bp, Homo sapiens
ggggcagagggcagag

SEQ ID NO: 2017988 - DNA, 18 bp, Homo sapiens
ggggcagagggcagaggc

SEQ ID NO: 2017989 - DNA, 11 bp, Homo sapiens
ggggcaggagg

SEQ ID NO: 2017990 - DNA, 20 bp, Homo sapiens
ggggcaggaggcctggcctt

SEQ ID NO: 2017991 - DNA, 19 bp, Homo sapiens
ggggcaggagtagctgagc

SEQ ID NO: 2017992 - DNA, 21 bp, Homo sapiens
ggggcaggggagtgccaaggt

SEQ ID NO: 2017993 - DNA, 21 bp, Homo sapiens
ggggcatggttccttccctgg

SEQ ID NO: 2017994 - DNA, 12 bp, Homo sapiens
ggggccagctgg

SEQ ID NO: 2017995 - DNA, 19 bp, Homo sapiens
ggggccagctggtgctgca

SEQ ID NO: 2017996 - DNA, 11 bp, Homo sapiens
ggggcccacaa

SEQ ID NO: 2017997 - DNA, 15 bp, Homo sapiens
ggggccccagatctg

SEQ ID NO: 2017998 - DNA, 22 bp, Homo sapiens
ggggccccagatctgcctgggc

SEQ ID NO: 2017999 - DNA, 11 bp, Homo sapiens
ggggccctggg

SEQ ID NO: 2018000 - DNA, 13 bp, Homo sapiens
ggggccctgggcc

SEQ ID NO: 2018001 - DNA, 18 bp, Homo sapiens
ggggccctgggcctcagt

SEQ ID NO: 2018002 - DNA, 11 bp, Homo sapiens
ggggccctgtg

SEQ ID NO: 2018003 - DNA, 20 bp, Homo sapiens
ggggcccttggggcctggct

SEQ ID NO: 2018004 - DNA, 18 bp, Homo sapiens
ggggccgtgggggttgag

SEQ ID NO: 2018005 - DNA, 17 bp, Homo sapiens
ggggcctagggagccgc

SEQ ID NO: 2018006 - DNA, 12 bp, Homo sapiens
ggggcctccctg

SEQ ID NO: 2018007 - DNA, 15 bp, Homo sapiens
ggggcctggagaggg

SEQ ID NO: 2018008 - DNA, 21 bp, Homo sapiens
ggggcctggagaggggcctgg

SEQ ID NO: 2018009 - DNA, 19 bp, Homo sapiens
ggggcctggctggctgagg

SEQ ID NO: 2018010 - DNA, 17 bp, Homo sapiens
ggggcctgggaaaggaa

SEQ ID NO: 2018011 - DNA, 21 bp, Homo sapiens
ggggctagaacctagagaagc

SEQ ID NO: 2018012 - DNA, 17 bp, Homo sapiens
ggggctaggggctggtc

SEQ ID NO: 2018013 - DNA, 16 bp, Homo sapiens
ggggctcagcaaggtg

SEQ ID NO: 2018014 - DNA, 18 bp, Homo sapiens
ggggctccatggaggagg

SEQ ID NO: 2018015 - DNA, 13 bp, Homo sapiens
ggggctcctggaa

SEQ ID NO: 2018016 - DNA, 17 bp, Homo sapiens
ggggctctaacgcctga

SEQ ID NO: 2018017 - DNA, 21 bp, Homo sapiens
ggggctctaacgcctgagccc

SEQ ID NO: 2018018 - DNA, 22 bp, Homo sapiens
ggggctctaacgcctgagccca

SEQ ID NO: 2018019 - DNA, 23 bp, Homo sapiens
ggggctctaacgcctgagcccag

SEQ ID NO: 2018020 - DNA, 18 bp, Homo sapiens
ggggctctccaaaggggc

SEQ ID NO: 2018021 - DNA, 20 bp, Homo sapiens
ggggctgctcatcacccagt

SEQ ID NO: 2018022 - DNA, 14 bp, Homo sapiens
ggggctgctcctcc

SEQ ID NO: 2018023 - DNA, 20 bp, Homo sapiens
ggggctgctcctccagggcc

SEQ ID NO: 2018024 - DNA, 11 bp, Homo sapiens
ggggctgctgg

SEQ ID NO: 2018025 - DNA, 19 bp, Homo sapiens
ggggctggcggctactcag

SEQ ID NO: 2018026 - DNA, 14 bp, Homo sapiens
ggggcttctgggtg

SEQ ID NO: 2018027 - DNA, 15 bp, Homo sapiens
ggggcttctgggtgg

SEQ ID NO: 2018028 - DNA, 19 bp, Homo sapiens
ggggcttctgggtggctcc

SEQ ID NO: 2018029 - DNA, 20 bp, Homo sapiens
ggggcttctgggtggctcct

SEQ ID NO: 2018030 - DNA, 16 bp, Homo sapiens
gggggccagacacaga

SEQ ID NO: 2018031 - DNA, 20 bp, Homo sapiens
gggggccagctggtgctgca

SEQ ID NO: 2018032 - DNA, 16 bp, Homo sapiens
gggggccgctggccca

SEQ ID NO: 2018033 - DNA, 17 bp, Homo sapiens
gggggcctcagtgccac

SEQ ID NO: 2018034 - DNA, 11 bp, Homo sapiens
gggggcctggc

SEQ ID NO: 2018035 - DNA, 14 bp, Homo sapiens
gggggcctggctgg

SEQ ID NO: 2018036 - DNA, 20 bp, Homo sapiens
gggggcctggctggctgagg

SEQ ID NO: 2018037 - DNA, 22 bp, Homo sapiens
gggggcgctcaggacccaggcc

SEQ ID NO: 2018038 - DNA, 16 bp, Homo sapiens
gggggctggtcctgag

SEQ ID NO: 2018039 - DNA, 22 bp, Homo sapiens
gggggtgatgagggcagcagcc

SEQ ID NO: 2018040 - DNA, 18 bp, Homo sapiens
gggggtgcggcaggagca

SEQ ID NO: 2018041 - DNA, 19 bp, Homo sapiens
ggggtacaggtttggggag

SEQ ID NO: 2018042 - DNA, 20 bp, Homo sapiens
ggggtacatttctctgagca

SEQ ID NO: 2018043 - DNA, 17 bp, Homo sapiens
ggggtaggcagagcctt

SEQ ID NO: 2018044 - DNA, 22 bp, Homo sapiens
ggggtatttaccacagcagctg

SEQ ID NO: 2018045 - DNA, 18 bp, Homo sapiens
ggggtattttaggcaggg

SEQ ID NO: 2018046 - DNA, 18 bp, Homo sapiens
ggggtccacccagcaaag

SEQ ID NO: 2018047 - DNA, 14 bp, Homo sapiens
ggggtcctagccca

SEQ ID NO: 2018048 - DNA, 22 bp, Homo sapiens
ggggtccttcaagttagctcag

SEQ ID NO: 2018049 - DNA, 17 bp, Homo sapiens
ggggtctgtgctgtgcc

SEQ ID NO: 2018050 - DNA, 18 bp, Homo sapiens
ggggtctgtgctgtgcct

SEQ ID NO: 2018051 - DNA, 22 bp, Homo sapiens
ggggtctttgtgagagtgagct

SEQ ID NO: 2018052 - DNA, 21 bp, Homo sapiens
ggggtgatgatgaccaagaat

SEQ ID NO: 2018053 - DNA, 22 bp, Homo sapiens
ggggtgcatcccccagcactga

SEQ ID NO: 2018054 - DNA, 17 bp, Homo sapiens
ggggtggggagacctgg

SEQ ID NO: 2018055 - DNA, 14 bp, Homo sapiens
ggggtgtctggaag

SEQ ID NO: 2018056 - DNA, 13 bp, Homo sapiens
ggggttcccccag

SEQ ID NO: 2018057 - DNA, 20 bp, Homo sapiens
ggggttggatgggaagatgg

SEQ ID NO: 2018058 - DNA, 14 bp, Homo sapiens
gggtaagccagagc

SEQ ID NO: 2018059 - DNA, 19 bp, Homo sapiens
gggtaagccagagcctggg

SEQ ID NO: 2018060 - DNA, 22 bp, Homo sapiens
gggtaatcagcattattcttca

SEQ ID NO: 2018061 - DNA, 17 bp, Homo sapiens
gggtacatttctctgag

SEQ ID NO: 2018062 - DNA, 18 bp, Homo sapiens
gggtaccaatcctggcag

SEQ ID NO: 2018063 - DNA, 13 bp, Homo sapiens
gggtacctcagtt

SEQ ID NO: 2018064 - DNA, 14 bp, Homo sapiens
gggtacctcagttt

SEQ ID NO: 2018065 - DNA, 23 bp, Homo sapiens
gggtaccttgaacactgggggag

SEQ ID NO: 2018066 - DNA, 15 bp, Homo sapiens
gggtagaggagggca

SEQ ID NO: 2018067 - DNA, 16 bp, Homo sapiens
gggtaggggagtgtgg

SEQ ID NO: 2018068 - DNA, 14 bp, Homo sapiens
gggtatttcctgct

SEQ ID NO: 2018069 - DNA, 17 bp, Homo sapiens
gggtcagccagggccag

SEQ ID NO: 2018070 - DNA, 19 bp, Homo sapiens
gggtcagccagggccaggg

SEQ ID NO: 2018071 - DNA, 22 bp, Homo sapiens
gggtccaggaaggcagctgctc

SEQ ID NO: 2018072 - DNA, 14 bp, Homo sapiens
gggtccccagctcc

SEQ ID NO: 2018073 - DNA, 15 bp, Homo sapiens
gggtccccagctccc

SEQ ID NO: 2018074 - DNA, 17 bp, Homo sapiens
gggtccccatcatccca

SEQ ID NO: 2018075 - DNA, 16 bp, Homo sapiens
gggtccgcaccagctg

SEQ ID NO: 2018076 - DNA, 17 bp, Homo sapiens
gggtccgcaccagctgc

SEQ ID NO: 2018077 - DNA, 18 bp, Homo sapiens
gggtccgcaccagctgct

SEQ ID NO: 2018078 - DNA, 23 bp, Homo sapiens
gggtccgcaccagctgctctgcc

SEQ ID NO: 2018079 - DNA, 14 bp, Homo sapiens
gggtcctgagtggc

SEQ ID NO: 2018080 - DNA, 16 bp, Homo sapiens
gggtctccctctcctg

SEQ ID NO: 2018081 - DNA, 15 bp, Homo sapiens
gggtctccctggagt

SEQ ID NO: 2018082 - DNA, 12 bp, Homo sapiens
gggtctgaggaa

SEQ ID NO: 2018083 - DNA, 20 bp, Homo sapiens
gggtctgccaccatcctgct

SEQ ID NO: 2018084 - DNA, 22 bp, Homo sapiens
gggtctgtgctgtgcctgctag

SEQ ID NO: 2018085 - DNA, 19 bp, Homo sapiens
gggtgagaatcctgcctct

SEQ ID NO: 2018086 - DNA, 15 bp, Homo sapiens
ggctgccctggtgct

SEQ ID NO: 2018087 - DNA, 22 bp, Homo sapiens
ggctgccctggtgctgccacac

SEQ ID NO: 2018088 - DNA, 21 bp, Homo sapiens
ggctgcccttcgctgccagga

SEQ ID NO: 2018089 - DNA, 13 bp, Homo sapiens
ggctgcctgccgc

SEQ ID NO: 2018090 - DNA, 13 bp, Homo sapiens
ggctgcctgggga

SEQ ID NO: 2018091 - DNA, 23 bp, Homo sapiens
ggctgcgagcatttccctcccgg

SEQ ID NO: 2018092 - DNA, 15 bp, Homo sapiens
ggctgcgctaacccc

SEQ ID NO: 2018093 - DNA, 22 bp, Homo sapiens
ggctgcggaatgaaccacatct

SEQ ID NO: 2018094 - DNA, 16 bp, Homo sapiens
ggctgctacccagaaa

SEQ ID NO: 2018095 - DNA, 13 bp, Homo sapiens
ggctgctcagagg

SEQ ID NO: 2018096 - DNA, 12 bp, Homo sapiens
ggctgctcatca

SEQ ID NO: 2018097 - DNA, 17 bp, Homo sapiens
ggctgctcatcacccag

SEQ ID NO: 2018098 - DNA, 24 bp, Homo sapiens
ggctgctcattccttctggaggac

SEQ ID NO: 2018099 - DNA, 12 bp, Homo sapiens
ggctgctcctcc

SEQ ID NO: 2018100 - DNA, 13 bp, Homo sapiens
ggctgctcctcca

SEQ ID NO: 2018101 - DNA, 15 bp, Homo sapiens
ggctgctcctccagg

SEQ ID NO: 2018102 - DNA, 18 bp, Homo sapiens
ggctgctcctccagggcc

SEQ ID NO: 2018103 - DNA, 23 bp, Homo sapiens
ggctgctcctccagggccacgtg

SEQ ID NO: 2018104 - DNA, 17 bp, Homo sapiens
ggctgctctcatgcctg

SEQ ID NO: 2018105 - DNA, 19 bp, Homo sapiens
ggctgctgacaggatgtgg

SEQ ID NO: 2018106 - DNA, 16 bp, Homo sapiens
ggctgctggggcatgt

SEQ ID NO: 2018107 - DNA, 21 bp, Homo sapiens
ggctgctggggcatgtgtgcc

SEQ ID NO: 2018108 - DNA, 17 bp, Homo sapiens
ggctgctgtgtgccttc

SEQ ID NO: 2018109 - DNA, 18 bp, Homo sapiens
ggctgcttattggaccag

SEQ ID NO: 2018110 - DNA, 22 bp, Homo sapiens
ggctgcttccttctgcacccag

SEQ ID NO: 2018111 - DNA, 20 bp, Homo sapiens
ggctggaaaagtcacacaga

SEQ ID NO: 2018112 - DNA, 19 bp, Homo sapiens
ggctggaatctggagagct

SEQ ID NO: 2018113 - DNA, 13 bp, Homo sapiens
ggctggacctgca

SEQ ID NO: 2018114 - DNA, 13 bp, Homo sapiens
ggctggaggcagg

SEQ ID NO: 2018115 - DNA, 17 bp, Homo sapiens
ggctggaggcagggcct

SEQ ID NO: 2018116 - DNA, 19 bp, Homo sapiens
ggctggaggcagggccttg

SEQ ID NO: 2018117 - DNA, 15 bp, Homo sapiens
ggctggatgaaattt

SEQ ID NO: 2018118 - DNA, 19 bp, Homo sapiens
ggctggatgtggtggcata

SEQ ID NO: 2018119 - DNA, 15 bp, Homo sapiens
ggctggcaagcaggg

SEQ ID NO: 2018120 - DNA, 17 bp, Homo sapiens
ggctggcagctgagagc

SEQ ID NO: 2018121 - DNA, 14 bp, Homo sapiens
ggctggcgtgcagt

SEQ ID NO: 2018122 - DNA, 16 bp, Homo sapiens
ggctggcgtgcagtgg

SEQ ID NO: 2018123 - DNA, 13 bp, Homo sapiens
ggctggctgggca

SEQ ID NO: 2018124 - DNA, 13 bp, Homo sapiens
ggctgggcccaca

SEQ ID NO: 2018125 - DNA, 23 bp, Homo sapiens
ggctgggcccacagagatgcatg

SEQ ID NO: 2018126 - DNA, 13 bp, Homo sapiens
ggctgggcccctg

SEQ ID NO: 2018127 - DNA, 17 bp, Homo sapiens
ggctgggcccctgggat

SEQ ID NO: 2018128 - DNA, 18 bp, Homo sapiens
ggctgggcttcagtggca

SEQ ID NO: 2018129 - DNA, 21 bp, Homo sapiens
ggctgggcttcagtggcagct

SEQ ID NO: 2018130 - DNA, 22 bp, Homo sapiens
ggctgggcttcagtggcagctg

SEQ ID NO: 2018131 - DNA, 15 bp, Homo sapiens
ggctggggcagaggg

SEQ ID NO: 2018132 - DNA, 22 bp, Homo sapiens
ggctggggcagaggggcagccg

SEQ ID NO: 2018133 - DNA, 13 bp, Homo sapiens
ggctggggccagt

SEQ ID NO: 2018134 - DNA, 15 bp, Homo sapiens
ggctgggggcctcag

SEQ ID NO: 2018135 - DNA, 17 bp, Homo sapiens
ggctgggggcctcagtg

SEQ ID NO: 2018136 - DNA, 16 bp, Homo sapiens
ggctggtgtcacctga

SEQ ID NO: 2018137 - DNA, 19 bp, Homo sapiens
ggctgtaaacagctctgtg

SEQ ID NO: 2018138 - DNA, 17 bp, Homo sapiens
ggctgtatttttagaga

SEQ ID NO: 2018139 - DNA, 12 bp, Homo sapiens
ggctgtgcctta

SEQ ID NO: 2018140 - DNA, 13 bp, Homo sapiens
ggctgtggcacag

SEQ ID NO: 2018141 - DNA, 20 bp, Homo sapiens
ggctgtggtggctgtctctg

SEQ ID NO: 2018142 - DNA, 12 bp, Homo sapiens
ggctgtggttcc

SEQ ID NO: 2018143 - DNA, 17 bp, Homo sapiens
ggctgttctgcactgaa

SEQ ID NO: 2018144 - DNA, 18 bp, Homo sapiens
ggctgttctgcactgaaa

SEQ ID NO: 2018145 - DNA, 16 bp, Homo sapiens
ggctgttggctggggg

SEQ ID NO: 2018146 - DNA, 11 bp, Homo sapiens
ggctgtttctt

SEQ ID NO: 2018147 - DNA, 15 bp, Homo sapiens
ggcttaaggagagga

SEQ ID NO: 2018148 - DNA, 12 bp, Homo sapiens
ggcttaatgttt

SEQ ID NO: 2018149 - DNA, 16 bp, Homo sapiens
ggcttaatgtttattc

SEQ ID NO: 2018150 - DNA, 20 bp, Homo sapiens
ggcttattttttaaaataat

SEQ ID NO: 2018151 - DNA, 22 bp, Homo sapiens
ggcttcaaccactcgccgagga

SEQ ID NO: 2018152 - DNA, 17 bp, Homo sapiens
ggcttcagcatatttat

SEQ ID NO: 2018153 - DNA, 17 bp, Homo sapiens
ggcttcagtggcagctg

SEQ ID NO: 2018154 - DNA, 14 bp, Homo sapiens
ggcttccagagagt

SEQ ID NO: 2018155 - DNA, 15 bp, Homo sapiens
ggcttcccgctcagc

SEQ ID NO: 2018156 - DNA, 19 bp, Homo sapiens
ggcttcccgctcagccctc

SEQ ID NO: 2018157 - DNA, 21 bp, Homo sapiens
ggcttcccgctcagccctccc

SEQ ID NO: 2018158 - DNA, 21 bp, Homo sapiens
ggcttcctccgtccacccagg

SEQ ID NO: 2018159 - DNA, 17 bp, Homo sapiens
ggcttcctgactgacac

SEQ ID NO: 2018160 - DNA, 19 bp, Homo sapiens
ggcttcctgactgacacag

SEQ ID NO: 2018161 - DNA, 18 bp, Homo sapiens
ggcttcctgtccactctc

SEQ ID NO: 2018162 - DNA, 13 bp, Homo sapiens
ggcttctggagcc

SEQ ID NO: 2018163 - DNA, 19 bp, Homo sapiens
ggcttctgggtggctcctg

SEQ ID NO: 2018164 - DNA, 13 bp, Homo sapiens
ggcttctgtgcac

SEQ ID NO: 2018165 - DNA, 17 bp, Homo sapiens
ggcttctgttgcgccac

SEQ ID NO: 2018166 - DNA, 19 bp, Homo sapiens
ggcttctgttgcgccactg

SEQ ID NO: 2018167 - DNA, 13 bp, Homo sapiens
ggcttgctccagg

SEQ ID NO: 2018168 - DNA, 18 bp, Homo sapiens
ggcttgcttgccgagcct

SEQ ID NO: 2018169 - DNA, 16 bp, Homo sapiens
ggcttgggccctgcac

SEQ ID NO: 2018170 - DNA, 17 bp, Homo sapiens
ggcttggggagcagagt

SEQ ID NO: 2018171 - DNA, 17 bp, Homo sapiens
ggcttgggggaaaagag

SEQ ID NO: 2018172 - DNA, 17 bp, Homo sapiens
ggcttgtgattctggga

SEQ ID NO: 2018173 - DNA, 21 bp, Homo sapiens
ggctttaaactaccctccaga

SEQ ID NO: 2018174 - DNA, 16 bp, Homo sapiens
ggctttacattttatt

SEQ ID NO: 2018175 - DNA, 13 bp, Homo sapiens
ggctttgcaggct

SEQ ID NO: 2018176 - DNA, 14 bp, Homo sapiens
ggctttgcaggctc

SEQ ID NO: 2018177 - DNA, 16 bp, Homo sapiens
ggctttgcaggctctg

SEQ ID NO: 2018178 - DNA, 20 bp, Homo sapiens
ggctttgcaggctctgggct

SEQ ID NO: 2018179 - DNA, 12 bp, Homo sapiens
ggctttggccca

SEQ ID NO: 2018180 - DNA, 15 bp, Homo sapiens
ggctttggggtccta

SEQ ID NO: 2018181 - DNA, 13 bp, Homo sapiens
ggcttttaagaaa

SEQ ID NO: 2018182 - DNA, 22 bp, Homo sapiens
ggcttttcactgctggctgcct

SEQ ID NO: 2018183 - DNA, 19 bp, Homo sapiens
ggcttttgcttggcagaga

SEQ ID NO: 2018184 - DNA, 16 bp, Homo sapiens
ggcttttggtggtccc

SEQ ID NO: 2018185 - DNA, 15 bp, Homo sapiens
gggaaaactcttcat

SEQ ID NO: 2018186 - DNA, 14 bp, Homo sapiens
gggaaacagggagc

SEQ ID NO: 2018187 - DNA, 19 bp, Homo sapiens
gggaaaggaaaaccaggga

SEQ ID NO: 2018188 - DNA, 23 bp, Homo sapiens
gggaaaggaggcatgcctctgat

SEQ ID NO: 2018189 - DNA, 22 bp, Homo sapiens
gggaaagggacccgaagcccag

SEQ ID NO: 2018190 - DNA, 23 bp, Homo sapiens
gggaaagtcagctttcagagcca

SEQ ID NO: 2018191 - DNA, 21 bp, Homo sapiens
gggaacaaatcacacctctgg

SEQ ID NO: 2018192 - DNA, 19 bp, Homo sapiens
gggaacagacaacagaagt

SEQ ID NO: 2018193 - DNA, 19 bp, Homo sapiens
gggaacagagcgggcctct

SEQ ID NO: 2018194 - DNA, 20 bp, Homo sapiens
gggaacccaagtccaagcat

SEQ ID NO: 2018195 - DNA, 16 bp, Homo sapiens
gggaacccagccctgg

SEQ ID NO: 2018196 - DNA, 16 bp, Homo sapiens
gggaaccccgcagccc

SEQ ID NO: 2018197 - DNA, 17 bp, Homo sapiens
gggaaccccgcagcccg

SEQ ID NO: 2018198 - DNA, 20 bp, Homo sapiens
gggaacctagtactctctgc

SEQ ID NO: 2018199 - DNA, 21 bp, Homo sapiens
gggaacctagtactctctgct

SEQ ID NO: 2018200 - DNA, 17 bp, Homo sapiens
gggaacgtgactgcccc

SEQ ID NO: 2018201 - DNA, 19 bp, Homo sapiens
ggtcacccttaatatttat

SEQ ID NO: 2018202 - DNA, 22 bp, Homo sapiens
ggtcactcttcctgcaaggact

SEQ ID NO: 2018203 - DNA, 12 bp, Homo sapiens
ggtcagagcctg

SEQ ID NO: 2018204 - DNA, 15 bp, Homo sapiens
ggtcagagcctgcag

SEQ ID NO: 2018205 - DNA, 19 bp, Homo sapiens
ggtcaggcggggtgctgtg

SEQ ID NO: 2018206 - DNA, 21 bp, Homo sapiens
ggtcaggcggggtgctgtggt

SEQ ID NO: 2018207 - DNA, 19 bp, Homo sapiens
ggtcaggtgttcaagacca

SEQ ID NO: 2018208 - DNA, 19 bp, Homo sapiens
ggtcagtgtggagaggggt

SEQ ID NO: 2018209 - DNA, 17 bp, Homo sapiens
ggtcatcgattcaaact

SEQ ID NO: 2018210 - DNA, 12 bp, Homo sapiens
ggtccacccagg

SEQ ID NO: 2018211 - DNA, 15 bp, Homo sapiens
ggtccacccaggagc

SEQ ID NO: 2018212 - DNA, 20 bp, Homo sapiens
ggtccacccaggagccccga

SEQ ID NO: 2018213 - DNA, 16 bp, Homo sapiens
ggtccagaagtccctc

SEQ ID NO: 2018214 - DNA, 19 bp, Homo sapiens
ggtccagctcttggcccct

SEQ ID NO: 2018215 - DNA, 18 bp, Homo sapiens
ggtccaggaaggcagctg

SEQ ID NO: 2018216 - DNA, 19 bp, Homo sapiens
ggtccaggaaggcagctgc

SEQ ID NO: 2018217 - DNA, 22 bp, Homo sapiens
ggtcccaagtagtagtgtcttc

SEQ ID NO: 2018218 - DNA, 16 bp, Homo sapiens
ggtcccacatccctgg

SEQ ID NO: 2018219 - DNA, 20 bp, Homo sapiens
ggtcccacatccctgggcct

SEQ ID NO: 2018220 - DNA, 21 bp, Homo sapiens
ggtcccacatccctgggcctg

SEQ ID NO: 2018221 - DNA, 12 bp, Homo sapiens
ggtcccactcag

SEQ ID NO: 2018222 - DNA, 22 bp, Homo sapiens
ggtcccactcagtccatagcag

SEQ ID NO: 2018223 - DNA, 14 bp, Homo sapiens
ggtcccaggcagag

SEQ ID NO: 2018224 - DNA, 16 bp, Homo sapiens
ggtccccatcatccca

SEQ ID NO: 2018225 - DNA, 21 bp, Homo sapiens
ggtcccgtgcagcttctgtcc

SEQ ID NO: 2018226 - DNA, 22 bp, Homo sapiens
ggtccctcgtccacaggggcag

SEQ ID NO: 2018227 - DNA, 20 bp, Homo sapiens
ggtccctgataacaacctgg

SEQ ID NO: 2018228 - DNA, 19 bp, Homo sapiens
ggtccctggtccctcgtcc

SEQ ID NO: 2018229 - DNA, 17 bp, Homo sapiens
ggtccgcaccagctgct

SEQ ID NO: 2018230 - DNA, 19 bp, Homo sapiens
ggtccgcaccagctgctct

SEQ ID NO: 2018231 - DNA, 20 bp, Homo sapiens
ggtccgcaccagctgctctg

SEQ ID NO: 2018232 - DNA, 20 bp, Homo sapiens
ggtccgccttaatctggaag

SEQ ID NO: 2018233 - DNA, 20 bp, Homo sapiens
ggtcctccatttcaactcca

SEQ ID NO: 2018234 - DNA, 23 bp, Homo sapiens
ggtcctccatttcaactccagaa

SEQ ID NO: 2018235 - DNA, 20 bp, Homo sapiens
ggtcctgaaagtctgtgtcc

SEQ ID NO: 2018236 - DNA, 19 bp, Homo sapiens
ggtcctgagcactgccagg

SEQ ID NO: 2018237 - DNA, 21 bp, Homo sapiens
ggtcctgagcactgccaggag

SEQ ID NO: 2018238 - DNA, 18 bp, Homo sapiens
ggtcctgcaatctccagg

SEQ ID NO: 2018239 - DNA, 22 bp, Homo sapiens
ggtcctgcccatgtgtcccctc

SEQ ID NO: 2018240 - DNA, 13 bp, Homo sapiens
ggtcctggcccca

SEQ ID NO: 2018241 - DNA, 15 bp, Homo sapiens
ggtcctggccccagc

SEQ ID NO: 2018242 - DNA, 23 bp, Homo sapiens
ggtcctggggctctgtgcaggga

SEQ ID NO: 2018243 - DNA, 21 bp, Homo sapiens
ggtcctggtggggcagctcct

SEQ ID NO: 2018244 - DNA, 21 bp, Homo sapiens
ggtcctgtcaccctggcccca

SEQ ID NO: 2018245 - DNA, 22 bp, Homo sapiens
ggtccttcctttaggtctggtt

SEQ ID NO: 2018246 - DNA, 13 bp, Homo sapiens
ggtcgcccaggag

SEQ ID NO: 2018247 - DNA, 15 bp, Homo sapiens
ggtcgtggagagcta

SEQ ID NO: 2018248 - DNA, 20 bp, Homo sapiens
ggtcgtggagagctaggagc

SEQ ID NO: 2018249 - DNA, 14 bp, Homo sapiens
ggtctagggagaga

SEQ ID NO: 2018250 - DNA, 21 bp, Homo sapiens
ggtctcactatgttgcccagg

SEQ ID NO: 2018251 - DNA, 12 bp, Homo sapiens
ggtctcactctg

SEQ ID NO: 2018252 - DNA, 18 bp, Homo sapiens
ggtctcagcccgggacag

SEQ ID NO: 2018253 - DNA, 14 bp, Homo sapiens
ggtctctatttcat

SEQ ID NO: 2018254 - DNA, 14 bp, Homo sapiens
ggtctctccactgc

SEQ ID NO: 2018255 - DNA, 16 bp, Homo sapiens
ggtctctccactgctc

SEQ ID NO: 2018256 - DNA, 19 bp, Homo sapiens
ggtctctctctctctacaa

SEQ ID NO: 2018257 - DNA, 11 bp, Homo sapiens
ggtctctggca

SEQ ID NO: 2018258 - DNA, 15 bp, Homo sapiens
ggtctctggcagaga

SEQ ID NO: 2018259 - DNA, 21 bp, Homo sapiens
ggtctgaaggaatagccagag

SEQ ID NO: 2018260 - DNA, 14 bp, Homo sapiens
ggtctgacccactg

SEQ ID NO: 2018261 - DNA, 16 bp, Homo sapiens
ggtctgagcaccccct

SEQ ID NO: 2018262 - DNA, 12 bp, Homo sapiens
ggtctgagccct

SEQ ID NO: 2018263 - DNA, 14 bp, Homo sapiens
ggtctgagccctgg

SEQ ID NO: 2018264 - DNA, 22 bp, Homo sapiens
ggtctgaggggcaactgagtct

SEQ ID NO: 2018265 - DNA, 15 bp, Homo sapiens
ggtctgccctgggct

SEQ ID NO: 2018266 - DNA, 21 bp, Homo sapiens
ggtctgtgctgtgcctgctag

SEQ ID NO: 2018267 - DNA, 16 bp, Homo sapiens
ggtcttcttgtgtcct

SEQ ID NO: 2018268 - DNA, 20 bp, Homo sapiens
ggtcttggccgactcaggga

SEQ ID NO: 2018269 - DNA, 20 bp, Homo sapiens
ggtcttgggctactggcagc

SEQ ID NO: 2018270 - DNA, 11 bp, Homo sapiens
ggtctttgaat

SEQ ID NO: 2018271 - DNA, 12 bp, Homo sapiens
ggtctttgaata

SEQ ID NO: 2018272 - DNA, 14 bp, Homo sapiens
ggtctttgaataaa

SEQ ID NO: 2018273 - DNA, 17 bp, Homo sapiens
ggtctttgaataaagtc

SEQ ID NO: 2018274 - DNA, 20 bp, Homo sapiens
ggtgaaaatgccagtctgtg

SEQ ID NO: 2018275 - DNA, 14 bp, Homo sapiens
ggtgaaatccaggt

SEQ ID NO: 2018276 - DNA, 13 bp, Homo sapiens
ggtgaagtccctg

SEQ ID NO: 2018277 - DNA, 23 bp, Homo sapiens
ggtgaagtccctgttctcagctc

SEQ ID NO: 2018278 - DNA, 12 bp, Homo sapiens
ggtgacacacag

SEQ ID NO: 2018279 - DNA, 17 bp, Homo sapiens
ggtgacatgtgcctgta

SEQ ID NO: 2018280 - DNA, 22 bp, Homo sapiens
ggtgaccaatactactgtaaat

SEQ ID NO: 2018281 - DNA, 16 bp, Homo sapiens
ggtgaccccagggcac

SEQ ID NO: 2018282 - DNA, 21 bp, Homo sapiens
ggtgacccggcaccccctgca

SEQ ID NO: 2018283 - DNA, 13 bp, Homo sapiens
ggtgactggagcc

SEQ ID NO: 2018284 - DNA, 12 bp, Homo sapiens
ggtgactgtccc

SEQ ID NO: 2018285 - DNA, 18 bp, Homo sapiens
ggtgagaatcctgcctct

SEQ ID NO: 2018286 - DNA, 14 bp, Homo sapiens
ggtgagaccacctc

SEQ ID NO: 2018287 - DNA, 17 bp, Homo sapiens
ggtgagcacatctggga

SEQ ID NO: 2018288 - DNA, 15 bp, Homo sapiens
ggtgaggcccagcct

SEQ ID NO: 2018289 - DNA, 12 bp, Homo sapiens
ggtgagggatgt

SEQ ID NO: 2018290 - DNA, 12 bp, Homo sapiens
ggtgatcagaag

SEQ ID NO: 2018291 - DNA, 13 bp, Homo sapiens
ggtgatcagaagg

SEQ ID NO: 2018292 - DNA, 16 bp, Homo sapiens
ggtgatcagaaggctg

SEQ ID NO: 2018293 - DNA, 16 bp, Homo sapiens
ggtgatgagggcagca

SEQ ID NO: 2018294 - DNA, 19 bp, Homo sapiens
ggtgatgagggcagcagcc

SEQ ID NO: 2018295 - DNA, 22 bp, Homo sapiens
ggtgcaagagacagagccccca

SEQ ID NO: 2018296 - DNA, 12 bp, Homo sapiens
ggtgcacaggag

SEQ ID NO: 2018297 - DNA, 21 bp, Homo sapiens
ggtgcatggcttggggagcag

SEQ ID NO: 2018298 - DNA, 22 bp, Homo sapiens
ggtgcatggcttggggagcaga

SEQ ID NO: 2018299 - DNA, 16 bp, Homo sapiens
ggtgccaccaataaaa

SEQ ID NO: 2018300 - DNA, 13 bp, Homo sapiens
ggtgccactccct

SEQ ID NO: 2018301 - DNA, 17 bp, Homo sapiens
ggtgccactccctgagc

SEQ ID NO: 2018302 - DNA, 21 bp, Homo sapiens
ggtgcccacaaaatagagatt

SEQ ID NO: 2018303 - DNA, 23 bp, Homo sapiens
ggtgccctctggatcctgctgtg

SEQ ID NO: 2018304 - DNA, 17 bp, Homo sapiens
ggtgcctatttattggg

SEQ ID NO: 2018305 - DNA, 18 bp, Homo sapiens
ggtgcctatttattgggg

SEQ ID NO: 2018306 - DNA, 12 bp, Homo sapiens
ggtgcctcctgt

SEQ ID NO: 2018307 - DNA, 15 bp, Homo sapiens
ggtgcctgagctggg

SEQ ID NO: 2018308 - DNA, 10 bp, Homo sapiens
ggtgcctggc

SEQ ID NO: 2018309 - DNA, 17 bp, Homo sapiens
ggtgcctgtgaggcagg

SEQ ID NO: 2018310 - DNA, 11 bp, Homo sapiens
ggtgcctgtgg

SEQ ID NO: 2018311 - DNA, 23 bp, Homo sapiens
ggtgccttcttattctcactcca

SEQ ID NO: 2018312 - DNA, 13 bp, Homo sapiens
ggtgcggcaggag

SEQ ID NO: 2018313 - DNA, 14 bp, Homo sapiens
ggtgcggcaggagc

SEQ ID NO: 2018314 - DNA, 18 bp, Homo sapiens
ggtgcgtggctgtggcac

SEQ ID NO: 2018315 - DNA, 20 bp, Homo sapiens
ggtgcgtggctgtggcacag

SEQ ID NO: 2018316 - DNA, 20 bp, Homo sapiens
ggtgctaaatggtcgcccag

SEQ ID NO: 2018317 - DNA, 20 bp, Homo sapiens
ggtgctaagggtaagggaga

SEQ ID NO: 2018318 - DNA, 22 bp, Homo sapiens
gtattgccacaatgcctctccc

SEQ ID NO: 2018319 - DNA, 23 bp, Homo sapiens
gtattgccacaatgcctctccca

SEQ ID NO: 2018320 - DNA, 21 bp, Homo sapiens
gtatttaaaaccttgatttaa

SEQ ID NO: 2018321 - DNA, 13 bp, Homo sapiens
gtatttataaata

SEQ ID NO: 2018322 - DNA, 19 bp, Homo sapiens
gtatttatatttggaaaga

SEQ ID NO: 2018323 - DNA, 20 bp, Homo sapiens
gtatttatatttggaaagag

SEQ ID NO: 2018324 - DNA, 14 bp, Homo sapiens
gtatttgaaactga

SEQ ID NO: 2018325 - DNA, 18 bp, Homo sapiens
gtatttgtacaaatactg

SEQ ID NO: 2018326 - DNA, 17 bp, Homo sapiens
gtatttgtatgtactgt

SEQ ID NO: 2018327 - DNA, 17 bp, Homo sapiens
gtatttgttaatttaga

SEQ ID NO: 2018328 - DNA, 23 bp, Homo sapiens
gtatttgttaatttagaaaactt

SEQ ID NO: 2018329 - DNA, 16 bp, Homo sapiens
gtatttgttcccaaga

SEQ ID NO: 2018330 - DNA, 22 bp, Homo sapiens
gtattttattaaagcaacattt

SEQ ID NO: 2018331 - DNA, 17 bp, Homo sapiens
gtattttcatttaacta

SEQ ID NO: 2018332 - DNA, 16 bp, Homo sapiens
gtattttcattttaat

SEQ ID NO: 2018333 - DNA, 16 bp, Homo sapiens
gtattttcttcccatt

SEQ ID NO: 2018334 - DNA, 22 bp, Homo sapiens
gtattttcttcccatttgtaat

SEQ ID NO: 2018335 - DNA, 14 bp, Homo sapiens
gtattttgagataa

SEQ ID NO: 2018336 - DNA, 13 bp, Homo sapiens
gtatttttagaga

SEQ ID NO: 2018337 - DNA, 14 bp, Homo sapiens
gtatttttagagat

SEQ ID NO: 2018338 - DNA, 22 bp, Homo sapiens
gtatttttagagattaatttgt

SEQ ID NO: 2018339 - DNA, 14 bp, Homo sapiens
gtatttttgaataa

SEQ ID NO: 2018340 - DNA, 15 bp, Homo sapiens
gtattttttaaagct

SEQ ID NO: 2018341 - DNA, 18 bp, Homo sapiens
gtcaaagcattgagatct

SEQ ID NO: 2018342 - DNA, 22 bp, Homo sapiens
gtcaaatcatggccaaatcgca

SEQ ID NO: 2018343 - DNA, 19 bp, Homo sapiens
gtcaaatgtcattatgtag

SEQ ID NO: 2018344 - DNA, 19 bp, Homo sapiens
gtcaacactcttcttgagc

SEQ ID NO: 2018345 - DNA, 22 bp, Homo sapiens
gtcaacacttaagggttttaga

SEQ ID NO: 2018346 - DNA, 20 bp, Homo sapiens
gtcccttgtttccagctaga

SEQ ID NO: 2018347 - DNA, 22 bp, Homo sapiens
gtccgaaagggacttggaagct

SEQ ID NO: 2018348 - DNA, 23 bp, Homo sapiens
gtccgcaccagctgctctgcccc

SEQ ID NO: 2018349 - DNA, 22 bp, Homo sapiens
gtccgcctctgcccgcagagcc

SEQ ID NO: 2018350 - DNA, 19 bp, Homo sapiens
gtccgccttaatctggaag

SEQ ID NO: 2018351 - DNA, 17 bp, Homo sapiens
gtccggtgtccttttca

SEQ ID NO: 2018352 - DNA, 15 bp, Homo sapiens
gtccgtccaccacct

SEQ ID NO: 2018353 - DNA, 19 bp, Homo sapiens
gtccgttccaggagcacac

SEQ ID NO: 2018354 - DNA, 17 bp, Homo sapiens
gtcctacagtggctgtc

SEQ ID NO: 2018355 - DNA, 13 bp, Homo sapiens
gtcctacccaccc

SEQ ID NO: 2018356 - DNA, 16 bp, Homo sapiens
gtcctacccaccctcc

SEQ ID NO: 2018357 - DNA, 13 bp, Homo sapiens
gtcctactctgtg

SEQ ID NO: 2018358 - DNA, 15 bp, Homo sapiens
gtcctactctgtgtc

SEQ ID NO: 2018359 - DNA, 23 bp, Homo sapiens
gtcctactctgtgtcaggtgggg

SEQ ID NO: 2018360 - DNA, 22 bp, Homo sapiens
gtcctagagctcctgtccctac

SEQ ID NO: 2018361 - DNA, 20 bp, Homo sapiens
gtcctagcccagtgcttctc

SEQ ID NO: 2018362 - DNA, 19 bp, Homo sapiens
gtcctatccaaaggaatca

SEQ ID NO: 2018363 - DNA, 20 bp, Homo sapiens
gtcctatccaaaggaatcag

SEQ ID NO: 2018364 - DNA, 13 bp, Homo sapiens
gtcctcacagcct

SEQ ID NO: 2018365 - DNA, 15 bp, Homo sapiens
gtcctcacagcctct

SEQ ID NO: 2018366 - DNA, 20 bp, Homo sapiens
gtcctcacagcctctccctt

SEQ ID NO: 2018367 - DNA, 19 bp, Homo sapiens
gtcctcacctggttgaccc

SEQ ID NO: 2018368 - DNA, 21 bp, Homo sapiens
gtcctccaacaataaagagct

SEQ ID NO: 2018369 - DNA, 14 bp, Homo sapiens
gtcctccacaataa

SEQ ID NO: 2018370 - DNA, 13 bp, Homo sapiens
gtcctccatttca

SEQ ID NO: 2018371 - DNA, 22 bp, Homo sapiens
gtcctccatttcaactccagaa

SEQ ID NO: 2018372 - DNA, 14 bp, Homo sapiens
gtcctcccacccta

SEQ ID NO: 2018373 - DNA, 17 bp, Homo sapiens
gtcctcccatcccctgg

SEQ ID NO: 2018374 - DNA, 15 bp, Homo sapiens
gtcctcccctatttt

SEQ ID NO: 2018375 - DNA, 22 bp, Homo sapiens
gtcctcctcggatcaccgagag

SEQ ID NO: 2018376 - DNA, 11 bp, Homo sapiens
gtcctctcccc

SEQ ID NO: 2018377 - DNA, 17 bp, Homo sapiens
gtcctctcgagcccaga

SEQ ID NO: 2018378 - DNA, 19 bp, Homo sapiens
gtcctctgatacccagagc

SEQ ID NO: 2018379 - DNA, 21 bp, Homo sapiens
gtcctctttactcccttcctg

SEQ ID NO: 2018380 - DNA, 14 bp, Homo sapiens
gtcctgacgccctg

SEQ ID NO: 2018381 - DNA, 13 bp, Homo sapiens
gtcctgagacctg

SEQ ID NO: 2018382 - DNA, 14 bp, Homo sapiens
gtcctgagcactgc

SEQ ID NO: 2018383 - DNA, 13 bp, Homo sapiens
gtcctgcagagga

SEQ ID NO: 2018384 - DNA, 21 bp, Homo sapiens
gtcctgcagaggaccacagtg

SEQ ID NO: 2018385 - DNA, 11 bp, Homo sapiens
gtcctgccagc

SEQ ID NO: 2018386 - DNA, 22 bp, Homo sapiens
gtcctgccagctgccttcctca

SEQ ID NO: 2018387 - DNA, 13 bp, Homo sapiens
gtcctgcccatgt

SEQ ID NO: 2018388 - DNA, 16 bp, Homo sapiens
gtcctgcccatgtgtc

SEQ ID NO: 2018389 - DNA, 17 bp, Homo sapiens
gtcctgcccatgtgtcc

SEQ ID NO: 2018390 - DNA, 23 bp, Homo sapiens
gtcctgcccccgacagcccagcc

SEQ ID NO: 2018391 - DNA, 16 bp, Homo sapiens
gtcctgcctctctgct

SEQ ID NO: 2018392 - DNA, 19 bp, Homo sapiens
gtcctgcctctctgctcca

SEQ ID NO: 2018393 - DNA, 23 bp, Homo sapiens
gtcctgccttgatgaagcctgtg

SEQ ID NO: 2018394 - DNA, 20 bp, Homo sapiens
gtcctgctctcttcaggagg

SEQ ID NO: 2018395 - DNA, 17 bp, Homo sapiens
gtcctgctggcacctca

SEQ ID NO: 2018396 - DNA, 14 bp, Homo sapiens
gtcctggctgctct

SEQ ID NO: 2018397 - DNA, 20 bp, Homo sapiens
gtcctggcttctagatctgg

SEQ ID NO: 2018398 - DNA, 19 bp, Homo sapiens
gtcctgggagaacctcagg

SEQ ID NO: 2018399 - DNA, 16 bp, Homo sapiens
gtcctgggagtgagct

SEQ ID NO: 2018400 - DNA, 17 bp, Homo sapiens
gtcctgggagtgagctg

SEQ ID NO: 2018401 - DNA, 18 bp, Homo sapiens
gtcctgggagtgagctgg

SEQ ID NO: 2018402 - DNA, 16 bp, Homo sapiens
gtcctggggctctgtg

SEQ ID NO: 2018403 - DNA, 18 bp, Homo sapiens
gtcctggtacagcagggt

SEQ ID NO: 2018404 - DNA, 21 bp, Homo sapiens
gtcctggtctgctcaggaatt

SEQ ID NO: 2018405 - DNA, 16 bp, Homo sapiens
gtcctggtggggcagc

SEQ ID NO: 2018406 - DNA, 18 bp, Homo sapiens
gtcctggtggggcagctc

SEQ ID NO: 2018407 - DNA, 15 bp, Homo sapiens
gtcctgtcaccctgg

SEQ ID NO: 2018408 - DNA, 16 bp, Homo sapiens
gtcctgtcaccctggc

SEQ ID NO: 2018409 - DNA, 17 bp, Homo sapiens
gtcctgtcaccctggcc

SEQ ID NO: 2018410 - DNA, 18 bp, Homo sapiens
gtcctgtcaccctggccc

SEQ ID NO: 2018411 - DNA, 16 bp, Homo sapiens
gtcctgtctctgcctg

SEQ ID NO: 2018412 - DNA, 23 bp, Homo sapiens
gtcctgttaacgtcatctcaggg

SEQ ID NO: 2018413 - DNA, 22 bp, Homo sapiens
gtccttccaggcccccaccact

SEQ ID NO: 2018414 - DNA, 16 bp, Homo sapiens
gtccttgcacccctca

SEQ ID NO: 2018415 - DNA, 18 bp, Homo sapiens
gtccttgcacctgcatcc

SEQ ID NO: 2018416 - DNA, 16 bp, Homo sapiens
gtcctttaggcagcct

SEQ ID NO: 2018417 - DNA, 19 bp, Homo sapiens
gtcctttaggcagcctgcc

SEQ ID NO: 2018418 - DNA, 21 bp, Homo sapiens
gtcctttaggcagcctgccgc

SEQ ID NO: 2018419 - DNA, 15 bp, Homo sapiens
gtccttttcactaca

SEQ ID NO: 2018420 - DNA, 12 bp, Homo sapiens
gtcgagacactt

SEQ ID NO: 2018421 - DNA, 14 bp, Homo sapiens
gtcgaggacaggga

SEQ ID NO: 2018422 - DNA, 16 bp, Homo sapiens
gtcgaggacagggagg

SEQ ID NO: 2018423 - DNA, 22 bp, Homo sapiens
gtcgcaggatccgctgccacca

SEQ ID NO: 2018424 - DNA, 19 bp, Homo sapiens
gtcgccacacccggctccc

SEQ ID NO: 2018425 - DNA, 14 bp, Homo sapiens
gtcgcccagtctgg

SEQ ID NO: 2018426 - DNA, 18 bp, Homo sapiens
gtcgccccaggccctccc

SEQ ID NO: 2018427 - DNA, 17 bp, Homo sapiens
gtcgctggacaacccag

SEQ ID NO: 2018428 - DNA, 18 bp, Homo sapiens
gtcgctggacaacccaga

SEQ ID NO: 2018429 - DNA, 19 bp, Homo sapiens
gtcgctggacaacccagaa

SEQ ID NO: 2018430 - DNA, 14 bp, Homo sapiens
gtcgggacagagag

SEQ ID NO: 2018431 - DNA, 17 bp, Homo sapiens
gtcgtccttactcctgt

SEQ ID NO: 2018432 - DNA, 20 bp, Homo sapiens
gtcgtggagagctaggagca

SEQ ID NO: 2018433 - DNA, 21 bp, Homo sapiens
gtcgtggagagctaggagcaa

SEQ ID NO: 2018434 - DNA, 22 bp, Homo sapiens
gtcgtggcagataatcagcctc

SEQ ID NO: 2018435 - DNA, 19 bp, Homo sapiens
gtcgttttcataacttgct

SEQ ID NO: 2018436 - DNA, 14 bp, Homo sapiens
gtctaaagagcttt

SEQ ID NO: 2018437 - DNA, 21 bp, Homo sapiens
gtctaaagctggtttaatgtt

SEQ ID NO: 2018438 - DNA, 19 bp, Homo sapiens
gtagctgtgacctgctgag

SEQ ID NO: 2018439 - DNA, 18 bp, Homo sapiens
gtagctgtggtgaggtgg

SEQ ID NO: 2018440 - DNA, 17 bp, Homo sapiens
gtagctttcccaaataa

SEQ ID NO: 2018441 - DNA, 22 bp, Homo sapiens
gtaggaactcttaagcaatggt

SEQ ID NO: 2018442 - DNA, 19 bp, Homo sapiens
gtaggactttcctaaatgt

SEQ ID NO: 2018443 - DNA, 22 bp, Homo sapiens
gtaggcatgagggatcacaggg

SEQ ID NO: 2018444 - DNA, 16 bp, Homo sapiens
gtaggccaagctgaag

SEQ ID NO: 2018445 - DNA, 21 bp, Homo sapiens
gtaggcccctggtctgccctg

SEQ ID NO: 2018446 - DNA, 19 bp, Homo sapiens
gtaggcccttgtcctgcca

SEQ ID NO: 2018447 - DNA, 20 bp, Homo sapiens
gtaggcccttgtcctgccag

SEQ ID NO: 2018448 - DNA, 16 bp, Homo sapiens
gtaggctttatgctgt

SEQ ID NO: 2018449 - DNA, 21 bp, Homo sapiens
gtagggcgggaggatgttctg

SEQ ID NO: 2018450 - DNA, 20 bp, Homo sapiens
gtaggggtcaaagaaatgct

SEQ ID NO: 2018451 - DNA, 15 bp, Homo sapiens
gtaggtattaaagat

SEQ ID NO: 2018452 - DNA, 14 bp, Homo sapiens
gtaggtccaagggc

SEQ ID NO: 2018453 - DNA, 17 bp, Homo sapiens
gtagtagccctttctgt

SEQ ID NO: 2018454 - DNA, 21 bp, Homo sapiens
gtagtagccctttctgtgtgc

SEQ ID NO: 2018455 - DNA, 23 bp, Homo sapiens
gtagtagttgatgaccaatctct

SEQ ID NO: 2018456 - DNA, 13 bp, Homo sapiens
gtagtatgatggg

SEQ ID NO: 2018457 - DNA, 17 bp, Homo sapiens
gtagtatggcctgtgtc

SEQ ID NO: 2018458 - DNA, 19 bp, Homo sapiens
gtagtgatgttgtttggga

SEQ ID NO: 2018459 - DNA, 22 bp, Homo sapiens
gtagtgcccacttgaggctggc

SEQ ID NO: 2018460 - DNA, 14 bp, Homo sapiens
gtagtggaagagca

SEQ ID NO: 2018461 - DNA, 20 bp, Homo sapiens
gtagtggaagagcagcctga

SEQ ID NO: 2018462 - DNA, 21 bp, Homo sapiens
gtagtggaagagcagcctgat

SEQ ID NO: 2018463 - DNA, 11 bp, Homo sapiens
gtagtgtcttc

SEQ ID NO: 2018464 - DNA, 22 bp, Homo sapiens
gtagtgtcttcctagtatatta

SEQ ID NO: 2018465 - DNA, 15 bp, Homo sapiens
gtagttaggaaataa

SEQ ID NO: 2018466 - DNA, 23 bp, Homo sapiens
gtagttccctgaaaacccagaga

SEQ ID NO: 2018467 - DNA, 18 bp, Homo sapiens
gtagttgatgaccaatct

SEQ ID NO: 2018468 - DNA, 24 bp, Homo sapiens
gtagttgatgaccaatctctgtga

SEQ ID NO: 2018469 - DNA, 12 bp, Homo sapiens
gtataaaaacaa

SEQ ID NO: 2018470 - DNA, 20 bp, Homo sapiens
gtataacacaatatgaatac

SEQ ID NO: 2018471 - DNA, 12 bp, Homo sapiens
gtataatatttt

SEQ ID NO: 2018472 - DNA, 19 bp, Homo sapiens
gtataatggttgactgggt

SEQ ID NO: 2018473 - DNA, 21 bp, Homo sapiens
gtataatggttgactgggttt

SEQ ID NO: 2018474 - DNA, 14 bp, Homo sapiens
gtatacaatatata

SEQ ID NO: 2018475 - DNA, 17 bp, Homo sapiens
gtatacaatatataaaa

SEQ ID NO: 2018476 - DNA, 14 bp, Homo sapiens
gtatacacacatat

SEQ ID NO: 2018477 - DNA, 15 bp, Homo sapiens
gtatagagatatgca

SEQ ID NO: 2018478 - DNA, 18 bp, Homo sapiens
gtatagatgcaagatatt

SEQ ID NO: 2018479 - DNA, 14 bp, Homo sapiens
gtatagtgtaaaat

SEQ ID NO: 2018480 - DNA, 19 bp, Homo sapiens
gtatagttaggatagcatt

SEQ ID NO: 2018481 - DNA, 14 bp, Homo sapiens
gtatatacacatat

SEQ ID NO: 2018482 - DNA, 16 bp, Homo sapiens
gtatatacacatatac

SEQ ID NO: 2018483 - DNA, 14 bp, Homo sapiens
gtatatacatatta

SEQ ID NO: 2018484 - DNA, 23 bp, Homo sapiens
gtatatacatattataaataaat

SEQ ID NO: 2018485 - DNA, 20 bp, Homo sapiens
gtatatagtatatttatact

SEQ ID NO: 2018486 - DNA, 21 bp, Homo sapiens
gtatatagtatatttatactc

SEQ ID NO: 2018487 - DNA, 15 bp, Homo sapiens
gtatatatatatagt

SEQ ID NO: 2018488 - DNA, 17 bp, Homo sapiens
gtatatatatatgtgtg

SEQ ID NO: 2018489 - DNA, 20 bp, Homo sapiens
gtatatatatatgtgtgtgt

SEQ ID NO: 2018490 - DNA, 22 bp, Homo sapiens
gtatatatctgcttcagtggag

SEQ ID NO: 2018491 - DNA, 12 bp, Homo sapiens
gtatatatgtac

SEQ ID NO: 2018492 - DNA, 13 bp, Homo sapiens
gtatatatgtaca

SEQ ID NO: 2018493 - DNA, 13 bp, Homo sapiens
gtatatatgtgta

SEQ ID NO: 2018494 - DNA, 16 bp, Homo sapiens
gtatatatgtgtatat

SEQ ID NO: 2018495 - DNA, 18 bp, Homo sapiens
gtatatatgtgtgtttaa

SEQ ID NO: 2018496 - DNA, 19 bp, Homo sapiens
gtatatcagaaaagggaag

SEQ ID NO: 2018497 - DNA, 18 bp, Homo sapiens
gtatatctatatctctaa

SEQ ID NO: 2018498 - DNA, 15 bp, Homo sapiens
gtatatgtatatcta

SEQ ID NO: 2018499 - DNA, 16 bp, Homo sapiens
gtatatgtatatctat

SEQ ID NO: 2018500 - DNA, 14 bp, Homo sapiens
gtatatgtcattta

SEQ ID NO: 2018501 - DNA, 21 bp, Homo sapiens
gtatatgtctcaggtccctgc

SEQ ID NO: 2018502 - DNA, 15 bp, Homo sapiens
gtatattatggtgta

SEQ ID NO: 2018503 - DNA, 21 bp, Homo sapiens
gtatattatggtgtaatgcac

SEQ ID NO: 2018504 - DNA, 21 bp, Homo sapiens
gtatattatgtatttatattt

SEQ ID NO: 2018505 - DNA, 14 bp, Homo sapiens
gtatattctggaaa

SEQ ID NO: 2018506 - DNA, 15 bp, Homo sapiens
gtatattctggaaaa

SEQ ID NO: 2018507 - DNA, 13 bp, Homo sapiens
gtatatttatact

SEQ ID NO: 2018508 - DNA, 16 bp, Homo sapiens
gtatatttgtgtatgt

SEQ ID NO: 2018509 - DNA, 17 bp, Homo sapiens
gtatatttgtgtatgtg

SEQ ID NO: 2018510 - DNA, 21 bp, Homo sapiens
gtatcagagttgcttttctaa

SEQ ID NO: 2018511 - DNA, 22 bp, Homo sapiens
gtatcagagttgcttttctaat

SEQ ID NO: 2018512 - DNA, 18 bp, Homo sapiens
gtatcaggcacaggcagg

SEQ ID NO: 2018513 - DNA, 19 bp, Homo sapiens
gtatcaggcacaggcagga

SEQ ID NO: 2018514 - DNA, 22 bp, Homo sapiens
gtatcaggcacaggcaggaaga

SEQ ID NO: 2018515 - DNA, 18 bp, Homo sapiens
gtatcaggtgctgccatc

SEQ ID NO: 2018516 - DNA, 12 bp, Homo sapiens
gtatcatagaaa

SEQ ID NO: 2018517 - DNA, 15 bp, Homo sapiens
gtatcatagaaatgt

SEQ ID NO: 2018518 - DNA, 19 bp, Homo sapiens
gtatcatttctaattttaa

SEQ ID NO: 2018519 - DNA, 20 bp, Homo sapiens
gtatcatttctaattttaag

SEQ ID NO: 2018520 - DNA, 17 bp, Homo sapiens
gtatccaattatgtgac

SEQ ID NO: 2018521 - DNA, 17 bp, Homo sapiens
gtatcccagacccctct

SEQ ID NO: 2018522 - DNA, 18 bp, Homo sapiens
gtatcccagacccctctc

SEQ ID NO: 2018523 - DNA, 17 bp, Homo sapiens
gtatctatgcattttct

SEQ ID NO: 2018524 - DNA, 13 bp, Homo sapiens
gtatctctctgcc

SEQ ID NO: 2018525 - DNA, 20 bp, Homo sapiens
gtatctctgaagcatgtttc

SEQ ID NO: 2018526 - DNA, 12 bp, Homo sapiens
gtatctgaagac

SEQ ID NO: 2018527 - DNA, 21 bp, Homo sapiens
gtatctttaaaaagcagtcct

SEQ ID NO: 2018528 - DNA, 16 bp, Homo sapiens
gtatgaacttgaggac

SEQ ID NO: 2018529 - DNA, 15 bp, Homo sapiens
gtatggaagggaggg

SEQ ID NO: 2018530 - DNA, 17 bp, Homo sapiens
gtatggaatacagtgtt

SEQ ID NO: 2018531 - DNA, 18 bp, Homo sapiens
gtatggaatacagtgtta

SEQ ID NO: 2018532 - DNA, 14 bp, Homo sapiens
gtatggcctgtgtc

SEQ ID NO: 2018533 - DNA, 13 bp, Homo sapiens
gtatggtggctgg

SEQ ID NO: 2018534 - DNA, 14 bp, Homo sapiens
gtatggtggctggg

SEQ ID NO: 2018535 - DNA, 14 bp, Homo sapiens
gtatgtaaacagga

SEQ ID NO: 2018536 - DNA, 15 bp, Homo sapiens
gtatgtatacacaca

SEQ ID NO: 2018537 - DNA, 13 bp, Homo sapiens
gtatgtctccagt

SEQ ID NO: 2018538 - DNA, 17 bp, Homo sapiens
gtatgtgcacatgtgtc

SEQ ID NO: 2018539 - DNA, 13 bp, Homo sapiens
gtatgtgtgggta

SEQ ID NO: 2018540 - DNA, 12 bp, Homo sapiens
gtatgtgtgtgg

SEQ ID NO: 2018541 - DNA, 22 bp, Homo sapiens
gtatgtgtgtggtgtgtgtgct

SEQ ID NO: 2018542 - DNA, 22 bp, Homo sapiens
gtatgttttaattgcatttaaa

SEQ ID NO: 2018543 - DNA, 14 bp, Homo sapiens
gtattaaagatgtg

SEQ ID NO: 2018544 - DNA, 19 bp, Homo sapiens
gtattaacttttttagaat

SEQ ID NO: 2018545 - DNA, 13 bp, Homo sapiens
gtattacactgta

SEQ ID NO: 2018546 - DNA, 14 bp, Homo sapiens
gtattacttctgct

SEQ ID NO: 2018547 - DNA, 18 bp, Homo sapiens
gtattatcacatcaagca

SEQ ID NO: 2018548 - DNA, 20 bp, Homo sapiens
gtattcaacagaaggactgt

SEQ ID NO: 2018549 - DNA, 19 bp, Homo sapiens
gtattcagatcgtattaat

SEQ ID NO: 2018550 - DNA, 21 bp, Homo sapiens
gtattcagatcgtattaatta

SEQ ID NO: 2018551 - DNA, 22 bp, Homo sapiens
gtattcagatcgtattaattat

SEQ ID NO: 2018552 - DNA, 18 bp, Homo sapiens
gtattccatgggatgtta

SEQ ID NO: 2018553 - DNA, 18 bp, Homo sapiens
gtattcccttttatttcc

SEQ ID NO: 2018554 - DNA, 18 bp, Homo sapiens
gtattctaaagctttctg

SEQ ID NO: 2018555 - DNA, 18 bp, Homo sapiens
gggcaatggggagaggca

SEQ ID NO: 2018556 - DNA, 22 bp, Homo sapiens
gggcacaccactgccctgcctg

SEQ ID NO: 2018557 - DNA, 23 bp, Homo sapiens
gggcacaccactgccctgcctgc

SEQ ID NO: 2018558 - DNA, 12 bp, Homo sapiens
gggcacaggagc

SEQ ID NO: 2018559 - DNA, 14 bp, Homo sapiens
gggcacaggagcta

SEQ ID NO: 2018560 - DNA, 17 bp, Homo sapiens
gggcacaggagctacct

SEQ ID NO: 2018561 - DNA, 14 bp, Homo sapiens
gggcacatgaggag

SEQ ID NO: 2018562 - DNA, 20 bp, Homo sapiens
gggcacatgaggagggtgcc

SEQ ID NO: 2018563 - DNA, 17 bp, Homo sapiens
gggcacccccagcctgg

SEQ ID NO: 2018564 - DNA, 18 bp, Homo sapiens
gggcacccccagcctggg

SEQ ID NO: 2018565 - DNA, 19 bp, Homo sapiens
gggcacctatagtcccagc

SEQ ID NO: 2018566 - DNA, 15 bp, Homo sapiens
gggcacctctagtgc

SEQ ID NO: 2018567 - DNA, 16 bp, Homo sapiens
gggcacctgccaccgc

SEQ ID NO: 2018568 - DNA, 12 bp, Homo sapiens
gggcacctggga

SEQ ID NO: 2018569 - DNA, 18 bp, Homo sapiens
gggcacgcctgcccagcc

SEQ ID NO: 2018570 - DNA, 17 bp, Homo sapiens
gggcagaaggggaagat

SEQ ID NO: 2018571 - DNA, 13 bp, Homo sapiens
gggcagagccacc

SEQ ID NO: 2018572 - DNA, 18 bp, Homo sapiens
gggcagagccaccagggc

SEQ ID NO: 2018573 - DNA, 15 bp, Homo sapiens
gggcagagccatggg

SEQ ID NO: 2018574 - DNA, 23 bp, Homo sapiens
gggcagaggctggaggcagggcc

SEQ ID NO: 2018575 - DNA, 13 bp, Homo sapiens
gggcagaggggca

SEQ ID NO: 2018576 - DNA, 12 bp, Homo sapiens
gggcagagtggg

SEQ ID NO: 2018577 - DNA, 18 bp, Homo sapiens
gggcagagtgggctgcct

SEQ ID NO: 2018578 - DNA, 19 bp, Homo sapiens
gggcagagtgggctgcctg

SEQ ID NO: 2018579 - DNA, 12 bp, Homo sapiens
gggcagcaccct

SEQ ID NO: 2018580 - DNA, 13 bp, Homo sapiens
gggcagcaccctc

SEQ ID NO: 2018581 - DNA, 15 bp, Homo sapiens
gggcagcaccctccc

SEQ ID NO: 2018582 - DNA, 18 bp, Homo sapiens
gggcagcaccctcccccg

SEQ ID NO: 2018583 - DNA, 17 bp, Homo sapiens
gggcagcagccagccct

SEQ ID NO: 2018584 - DNA, 16 bp, Homo sapiens
gggcagccaggggctg

SEQ ID NO: 2018585 - DNA, 23 bp, Homo sapiens
gggcagccgctaggagagactga

SEQ ID NO: 2018586 - DNA, 22 bp, Homo sapiens
gggcagcctccaccttgctctt

SEQ ID NO: 2018587 - DNA, 13 bp, Homo sapiens
gggcagctgggcc

SEQ ID NO: 2018588 - DNA, 20 bp, Homo sapiens
gggcaggagtagctgagctc

SEQ ID NO: 2018589 - DNA, 11 bp, Homo sapiens
gggcagggctg

SEQ ID NO: 2018590 - DNA, 12 bp, Homo sapiens
gggcagggctgg

SEQ ID NO: 2018591 - DNA, 14 bp, Homo sapiens
gggcagggctggga

SEQ ID NO: 2018592 - DNA, 20 bp, Homo sapiens
gggcagtgacaagtggaggg

SEQ ID NO: 2018593 - DNA, 12 bp, Homo sapiens
gggcagtgactg

SEQ ID NO: 2018594 - DNA, 15 bp, Homo sapiens
gggcagtgactggca

SEQ ID NO: 2018595 - DNA, 17 bp, Homo sapiens
gggcagtgactggcagg

SEQ ID NO: 2018596 - DNA, 21 bp, Homo sapiens
gggcagtgggacccatagatc

SEQ ID NO: 2018597 - DNA, 21 bp, Homo sapiens
gggcagttcgcagccaccctg

SEQ ID NO: 2018598 - DNA, 22 bp, Homo sapiens
gggcagttcgcagccaccctga

SEQ ID NO: 2018599 - DNA, 21 bp, Homo sapiens
gggcatcaggcactggtggca

SEQ ID NO: 2018600 - DNA, 17 bp, Homo sapiens
gggcatccacccagtgc

SEQ ID NO: 2018601 - DNA, 22 bp, Homo sapiens
gggcatccacccagtgctgcca

SEQ ID NO: 2018602 - DNA, 21 bp, Homo sapiens
gggcatctcgtgccagggcag

SEQ ID NO: 2018603 - DNA, 24 bp, Homo sapiens
gggcatctcgtgccagggcaggct

SEQ ID NO: 2018604 - DNA, 17 bp, Homo sapiens
gggcatcttctggcttg

SEQ ID NO: 2018605 - DNA, 15 bp, Homo sapiens
gggcatgctcagccc

SEQ ID NO: 2018606 - DNA, 22 bp, Homo sapiens
gggcatggacgttcggggcatg

SEQ ID NO: 2018607 - DNA, 17 bp, Homo sapiens
gggcatggccaggtggc

SEQ ID NO: 2018608 - DNA, 23 bp, Homo sapiens
gggcattgggctgacacctacca

SEQ ID NO: 2018609 - DNA, 19 bp, Homo sapiens
gggccaaaagggcagccag

SEQ ID NO: 2018610 - DNA, 23 bp, Homo sapiens
gggccaaaagggcagccaggggc

SEQ ID NO: 2018611 - DNA, 18 bp, Homo sapiens
gggccaattaaaatatat

SEQ ID NO: 2018612 - DNA, 16 bp, Homo sapiens
gggccacagagaaagt

SEQ ID NO: 2018613 - DNA, 14 bp, Homo sapiens
gggccacgtgccag

SEQ ID NO: 2018614 - DNA, 19 bp, Homo sapiens
gggccacgtgccaggcccg

SEQ ID NO: 2018615 - DNA, 12 bp, Homo sapiens
gggccactcctt

SEQ ID NO: 2018616 - DNA, 21 bp, Homo sapiens
gggccactccttcctgcccca

SEQ ID NO: 2018617 - DNA, 12 bp, Homo sapiens
gggccactgcca

SEQ ID NO: 2018618 - DNA, 19 bp, Homo sapiens
gggccagaaggagggcaga

SEQ ID NO: 2018619 - DNA, 21 bp, Homo sapiens
gggccagaaggagggcagagc

SEQ ID NO: 2018620 - DNA, 22 bp, Homo sapiens
gggccagaaggagggcagagcc

SEQ ID NO: 2018621 - DNA, 12 bp, Homo sapiens
gggccagacaca

SEQ ID NO: 2018622 - DNA, 19 bp, Homo sapiens
gggccagccctacatcttc

SEQ ID NO: 2018623 - DNA, 22 bp, Homo sapiens
gggccagccctacatcttcagc

SEQ ID NO: 2018624 - DNA, 22 bp, Homo sapiens
gggccagcctcagctcagcctc

SEQ ID NO: 2018625 - DNA, 15 bp, Homo sapiens
gggccaggagagaga

SEQ ID NO: 2018626 - DNA, 15 bp, Homo sapiens
gggccaggagctcag

SEQ ID NO: 2018627 - DNA, 11 bp, Homo sapiens
gggccaggcag

SEQ ID NO: 2018628 - DNA, 20 bp, Homo sapiens
gggccaggcaggtgcctgga

SEQ ID NO: 2018629 - DNA, 18 bp, Homo sapiens
gggcccaaagcccagctc

SEQ ID NO: 2018630 - DNA, 21 bp, Homo sapiens
gggcccacaaaggggagaagg

SEQ ID NO: 2018631 - DNA, 12 bp, Homo sapiens
gtacaaaaacaa

SEQ ID NO: 2018632 - DNA, 14 bp, Homo sapiens
gtacaaaataaaca

SEQ ID NO: 2018633 - DNA, 12 bp, Homo sapiens
gtacaaatactg

SEQ ID NO: 2018634 - DNA, 15 bp, Homo sapiens
gtacaagaagcattt

SEQ ID NO: 2018635 - DNA, 21 bp, Homo sapiens
gtacaagaagcattttgtaag

SEQ ID NO: 2018636 - DNA, 15 bp, Homo sapiens
gtacaagctcaggag

SEQ ID NO: 2018637 - DNA, 12 bp, Homo sapiens
gtacaatattta

SEQ ID NO: 2018638 - DNA, 14 bp, Homo sapiens
gtacaatatttaaa

SEQ ID NO: 2018639 - DNA, 18 bp, Homo sapiens
gtacaatatttaaaattt

SEQ ID NO: 2018640 - DNA, 17 bp, Homo sapiens
gtacaatcctttgagtt

SEQ ID NO: 2018641 - DNA, 17 bp, Homo sapiens
gtacaatgtttcagaag

SEQ ID NO: 2018642 - DNA, 15 bp, Homo sapiens
gtacaattactaaat

SEQ ID NO: 2018643 - DNA, 21 bp, Homo sapiens
gtacaattactaaattgtata

SEQ ID NO: 2018644 - DNA, 13 bp, Homo sapiens
gtacacacacaga

SEQ ID NO: 2018645 - DNA, 15 bp, Homo sapiens
gtacacgtgtcctgt

SEQ ID NO: 2018646 - DNA, 20 bp, Homo sapiens
gtacagaattctgctacctc

SEQ ID NO: 2018647 - DNA, 16 bp, Homo sapiens
gtacagaatttttaat

SEQ ID NO: 2018648 - DNA, 21 bp, Homo sapiens
gtacagaatttttaatgactt

SEQ ID NO: 2018649 - DNA, 20 bp, Homo sapiens
gtacagagtggcccctcacc

SEQ ID NO: 2018650 - DNA, 22 bp, Homo sapiens
gtacagagtggcccctcacctg

SEQ ID NO: 2018651 - DNA, 18 bp, Homo sapiens
gtacagtagcttaaataa

SEQ ID NO: 2018652 - DNA, 20 bp, Homo sapiens
gtacagtagcttaaataaat

SEQ ID NO: 2018653 - DNA, 16 bp, Homo sapiens
gtacagtggagaaata

SEQ ID NO: 2018654 - DNA, 20 bp, Homo sapiens
gtacagttatctaagttaat

SEQ ID NO: 2018655 - DNA, 22 bp, Homo sapiens
gtacataaaggtggtatgtgtg

SEQ ID NO: 2018656 - DNA, 17 bp, Homo sapiens
gtacatagttatttatt

SEQ ID NO: 2018657 - DNA, 19 bp, Homo sapiens
gtacatatggaaatcctgt

SEQ ID NO: 2018658 - DNA, 22 bp, Homo sapiens
gtacatgaagagcagctggtca

SEQ ID NO: 2018659 - DNA, 20 bp, Homo sapiens
gtacatgtgtagcctgtgca

SEQ ID NO: 2018660 - DNA, 18 bp, Homo sapiens
gtacattcaatgtttatg

SEQ ID NO: 2018661 - DNA, 17 bp, Homo sapiens
gtacatttctctgagca

SEQ ID NO: 2018662 - DNA, 13 bp, Homo sapiens
gtaccaagcccct

SEQ ID NO: 2018663 - DNA, 12 bp, Homo sapiens
gtaccagctcac

SEQ ID NO: 2018664 - DNA, 16 bp, Homo sapiens
gtaccaggtcattctt

SEQ ID NO: 2018665 - DNA, 13 bp, Homo sapiens
gtacccactgctc

SEQ ID NO: 2018666 - DNA, 12 bp, Homo sapiens
gtacccagctcc

SEQ ID NO: 2018667 - DNA, 13 bp, Homo sapiens
gtacccagctcct

SEQ ID NO: 2018668 - DNA, 17 bp, Homo sapiens
gtacccaggatgatttc

SEQ ID NO: 2018669 - DNA, 15 bp, Homo sapiens
gtaccccatcccttc

SEQ ID NO: 2018670 - DNA, 21 bp, Homo sapiens
gtaccccatcccttcctcccc

SEQ ID NO: 2018671 - DNA, 16 bp, Homo sapiens
gtacccccgtggtctt

SEQ ID NO: 2018672 - DNA, 17 bp, Homo sapiens
gtacccccgtggtcttt

SEQ ID NO: 2018673 - DNA, 20 bp, Homo sapiens
gtacccccgtggtctttgaa

SEQ ID NO: 2018674 - DNA, 14 bp, Homo sapiens
gtacccttccacct

SEQ ID NO: 2018675 - DNA, 20 bp, Homo sapiens
gtaccgcgtctaccctggga

SEQ ID NO: 2018676 - DNA, 14 bp, Homo sapiens
gtacctatggctgc

SEQ ID NO: 2018677 - DNA, 12 bp, Homo sapiens
gtacctcagttt

SEQ ID NO: 2018678 - DNA, 12 bp, Homo sapiens
gtacctgggaaa

SEQ ID NO: 2018679 - DNA, 19 bp, Homo sapiens
gtacgaacccctcccctcc

SEQ ID NO: 2018680 - DNA, 12 bp, Homo sapiens
gtacgtaatgta

SEQ ID NO: 2018681 - DNA, 14 bp, Homo sapiens
gtacgtctgacagg

SEQ ID NO: 2018682 - DNA, 20 bp, Homo sapiens
gtactactagatgtctttag

SEQ ID NO: 2018683 - DNA, 18 bp, Homo sapiens
gtactactgctgcaaagt

SEQ ID NO: 2018684 - DNA, 22 bp, Homo sapiens
gtactactgctgcaaagtgcaa

SEQ ID NO: 2018685 - DNA, 13 bp, Homo sapiens
gtactatgttaat

SEQ ID NO: 2018686 - DNA, 13 bp, Homo sapiens
gtactcagagcag

SEQ ID NO: 2018687 - DNA, 16 bp, Homo sapiens
gtactcagagcagagc

SEQ ID NO: 2018688 - DNA, 17 bp, Homo sapiens
gtactcaggaggctgag

SEQ ID NO: 2018689 - DNA, 18 bp, Homo sapiens
gtactctacgccaaagtg

SEQ ID NO: 2018690 - DNA, 15 bp, Homo sapiens
gtactctctgctcta

SEQ ID NO: 2018691 - DNA, 17 bp, Homo sapiens
gtactctctgctctagc

SEQ ID NO: 2018692 - DNA, 18 bp, Homo sapiens
gtactcttgctttttcaa

SEQ ID NO: 2018693 - DNA, 15 bp, Homo sapiens
gtactctttatttct

SEQ ID NO: 2018694 - DNA, 19 bp, Homo sapiens
gtactgaccccatcaccta

SEQ ID NO: 2018695 - DNA, 12 bp, Homo sapiens
gtactgagattt

SEQ ID NO: 2018696 - DNA, 16 bp, Homo sapiens
gtactgcctgcttggg

SEQ ID NO: 2018697 - DNA, 19 bp, Homo sapiens
gtactggggagaaataatt

SEQ ID NO: 2018698 - DNA, 19 bp, Homo sapiens
gtacttaaatgaaagcatg

SEQ ID NO: 2018699 - DNA, 15 bp, Homo sapiens
gtacttaataaattc

SEQ ID NO: 2018700 - DNA, 20 bp, Homo sapiens
gtacttattttccaataaaa

SEQ ID NO: 2018701 - DNA, 17 bp, Homo sapiens
gtacttcagtcttggag

SEQ ID NO: 2018702 - DNA, 14 bp, Homo sapiens
gtacttcctcctga

SEQ ID NO: 2018703 - DNA, 15 bp, Homo sapiens
gtacttcctcctgat

SEQ ID NO: 2018704 - DNA, 21 bp, Homo sapiens
gtacttcctcctgatggccaa

SEQ ID NO: 2018705 - DNA, 19 bp, Homo sapiens
gtacttctccaccctgctc

SEQ ID NO: 2018706 - DNA, 19 bp, Homo sapiens
gtactttatttgtatttgc

SEQ ID NO: 2018707 - DNA, 16 bp, Homo sapiens
gtactttttattcaat

SEQ ID NO: 2018708 - DNA, 18 bp, Homo sapiens
gtagaaacacagttttga

SEQ ID NO: 2018709 - DNA, 22 bp, Homo sapiens
gtagaaccacttggctgctcat

SEQ ID NO: 2018710 - DNA, 14 bp, Homo sapiens
gtagaacctcacct

SEQ ID NO: 2018711 - DNA, 18 bp, Homo sapiens
gtagaacgtaaccacgga

SEQ ID NO: 2018712 - DNA, 19 bp, Homo sapiens
gtagaagggttatatttta

SEQ ID NO: 2018713 - DNA, 17 bp, Homo sapiens
gtagaatggcagctgga

SEQ ID NO: 2018714 - DNA, 19 bp, Homo sapiens
gtagaatgtaaagcttgtc

SEQ ID NO: 2018715 - DNA, 21 bp, Homo sapiens
gtagaatgtaaagcttgtctg

SEQ ID NO: 2018716 - DNA, 15 bp, Homo sapiens
gtagaattatatcta

SEQ ID NO: 2018717 - DNA, 17 bp, Homo sapiens
gtagaattatatctaat

SEQ ID NO: 2018718 - DNA, 16 bp, Homo sapiens
gtagaccaaaataaaa

SEQ ID NO: 2018719 - DNA, 15 bp, Homo sapiens
gtagactatatacat

SEQ ID NO: 2018720 - DNA, 16 bp, Homo sapiens
gtagactcctgcttct

SEQ ID NO: 2018721 - DNA, 23 bp, Homo sapiens
gtagaggcatgaacacacatgga

SEQ ID NO: 2018722 - DNA, 17 bp, Homo sapiens
gtagatagaaagcaata

SEQ ID NO: 2018723 - DNA, 15 bp, Homo sapiens
gtagatcatcttgaa

SEQ ID NO: 2018724 - DNA, 19 bp, Homo sapiens
gtagatcgcttgagcccag

SEQ ID NO: 2018725 - DNA, 23 bp, Homo sapiens
gtagatggaaatcagttgtgttt

SEQ ID NO: 2018726 - DNA, 19 bp, Homo sapiens
gtagattacctgccacttc

SEQ ID NO: 2018727 - DNA, 20 bp, Homo sapiens
gtagattacctgccacttcc

SEQ ID NO: 2018728 - DNA, 14 bp, Homo sapiens
gtagattgcgtgga

SEQ ID NO: 2018729 - DNA, 21 bp, Homo sapiens
gtagattgtgtaaattcctgt

SEQ ID NO: 2018730 - DNA, 15 bp, Homo sapiens
gtagcaaccttcatt

SEQ ID NO: 2018731 - DNA, 18 bp, Homo sapiens
gtagcaaccttcatttta

SEQ ID NO: 2018732 - DNA, 21 bp, Homo sapiens
gtagcaagttctagagaagag

SEQ ID NO: 2018733 - DNA, 17 bp, Homo sapiens
gtagcaattctacccag

SEQ ID NO: 2018734 - DNA, 16 bp, Homo sapiens
gtagcatcttctggag

SEQ ID NO: 2018735 - DNA, 18 bp, Homo sapiens
gtagcatggactctgggt

SEQ ID NO: 2018736 - DNA, 13 bp, Homo sapiens
gtagcccagcact

SEQ ID NO: 2018737 - DNA, 15 bp, Homo sapiens
gtagcccagcactgt

SEQ ID NO: 2018738 - DNA, 17 bp, Homo sapiens
gtagcccagcactgtga

SEQ ID NO: 2018739 - DNA, 17 bp, Homo sapiens
gtagcccatcaaaatgt

SEQ ID NO: 2018740 - DNA, 19 bp, Homo sapiens
gtagccccagtgacagcta

SEQ ID NO: 2018741 - DNA, 15 bp, Homo sapiens
gtagcccggccaggg

SEQ ID NO: 2018742 - DNA, 19 bp, Homo sapiens
gtagcctccgtttatgggc

SEQ ID NO: 2018743 - DNA, 22 bp, Homo sapiens
gtagctatttgtttacatgcag

SEQ ID NO: 2018744 - DNA, 12 bp, Homo sapiens
gtagctctgcct

SEQ ID NO: 2018745 - DNA, 11 bp, Homo sapiens
gtagctgagct

SEQ ID NO: 2018746 - DNA, 17 bp, Homo sapiens
gtagctgggactacagg

SEQ ID NO: 2018747 - DNA, 16 bp, Homo sapiens
gtagctgtgacctgct

SEQ ID NO: 2018748 - DNA, 19 bp, Homo sapiens
gccctgcccctgccccaac

SEQ ID NO: 2018749 - DNA, 21 bp, Homo sapiens
gccctgcccctgccccaaccc

SEQ ID NO: 2018750 - DNA, 12 bp, Homo sapiens
gccctgcctccc

SEQ ID NO: 2018751 - DNA, 14 bp, Homo sapiens
gccctgcctccctt

SEQ ID NO: 2018752 - DNA, 20 bp, Homo sapiens
gccctgcctccctttctggg

SEQ ID NO: 2018753 - DNA, 14 bp, Homo sapiens
gccctgcctgccca

SEQ ID NO: 2018754 - DNA, 17 bp, Homo sapiens
gccctgcctgcccactt

SEQ ID NO: 2018755 - DNA, 11 bp, Homo sapiens
gccctgcctgg

SEQ ID NO: 2018756 - DNA, 13 bp, Homo sapiens
gccctgcctggag

SEQ ID NO: 2018757 - DNA, 15 bp, Homo sapiens
gccctgcctggagga

SEQ ID NO: 2018758 - DNA, 22 bp, Homo sapiens
gccctgcctggaggacctgagc

SEQ ID NO: 2018759 - DNA, 18 bp, Homo sapiens
gccctgcggagccggcac

SEQ ID NO: 2018760 - DNA, 18 bp, Homo sapiens
gccctgcgttggagccac

SEQ ID NO: 2018761 - DNA, 19 bp, Homo sapiens
gccctgcgttggagccact

SEQ ID NO: 2018762 - DNA, 20 bp, Homo sapiens
gccctgcgttggagccactc

SEQ ID NO: 2018763 - DNA, 16 bp, Homo sapiens
gccctgctctggggat

SEQ ID NO: 2018764 - DNA, 21 bp, Homo sapiens
gccctgctgccgcctcccagc

SEQ ID NO: 2018765 - DNA, 17 bp, Homo sapiens
gccctgctgtgggagag

SEQ ID NO: 2018766 - DNA, 22 bp, Homo sapiens
gccctgctgtgggagagcgaag

SEQ ID NO: 2018767 - DNA, 19 bp, Homo sapiens
gccctgctttgggctgccc

SEQ ID NO: 2018768 - DNA, 20 bp, Homo sapiens
gccctgctttgggctgccct

SEQ ID NO: 2018769 - DNA, 14 bp, Homo sapiens
gccctggagggagg

SEQ ID NO: 2018770 - DNA, 17 bp, Homo sapiens
gccctggatcagcgtgg

SEQ ID NO: 2018771 - DNA, 20 bp, Homo sapiens
gccctggatcagcgtggcct

SEQ ID NO: 2018772 - DNA, 22 bp, Homo sapiens
gccctggatcagcgtggccttg

SEQ ID NO: 2018773 - DNA, 23 bp, Homo sapiens
gccctggatcagcgtggccttgt

SEQ ID NO: 2018774 - DNA, 18 bp, Homo sapiens
gccctggatgtgcccaca

SEQ ID NO: 2018775 - DNA, 18 bp, Homo sapiens
gccctggatttcagaaag

SEQ ID NO: 2018776 - DNA, 19 bp, Homo sapiens
gccctggcaggatgaccct

SEQ ID NO: 2018777 - DNA, 12 bp, Homo sapiens
gccctggcctgc

SEQ ID NO: 2018778 - DNA, 14 bp, Homo sapiens
gccctggcctgctg

SEQ ID NO: 2018779 - DNA, 20 bp, Homo sapiens
gccctggctcccacaggccc

SEQ ID NO: 2018780 - DNA, 22 bp, Homo sapiens
gccctgggcacccacctccacc

SEQ ID NO: 2018781 - DNA, 20 bp, Homo sapiens
gccctgggccccaccaccta

SEQ ID NO: 2018782 - DNA, 22 bp, Homo sapiens
gccctgggccccaccacctagg

SEQ ID NO: 2018783 - DNA, 14 bp, Homo sapiens
gccctgggcctcag

SEQ ID NO: 2018784 - DNA, 23 bp, Homo sapiens
gccctgggcctcagttcaacctg

SEQ ID NO: 2018785 - DNA, 20 bp, Homo sapiens
gccctgggctgtctgtcacc

SEQ ID NO: 2018786 - DNA, 21 bp, Homo sapiens
gccctggggcctgtactgcct

SEQ ID NO: 2018787 - DNA, 14 bp, Homo sapiens
gccctgggggccag

SEQ ID NO: 2018788 - DNA, 19 bp, Homo sapiens
gccctgggggccagctggt

SEQ ID NO: 2018789 - DNA, 20 bp, Homo sapiens
gccctgggggccagctggtg

SEQ ID NO: 2018790 - DNA, 11 bp, Homo sapiens
gccctggggta

SEQ ID NO: 2018791 - DNA, 15 bp, Homo sapiens
gccctggtccttcca

SEQ ID NO: 2018792 - DNA, 21 bp, Homo sapiens
gccctggtgctgccacacttc

SEQ ID NO: 2018793 - DNA, 14 bp, Homo sapiens
gccctggtggcagt

SEQ ID NO: 2018794 - DNA, 18 bp, Homo sapiens
gccctggtggcagtggga

SEQ ID NO: 2018795 - DNA, 16 bp, Homo sapiens
gccctgtcccagcaga

SEQ ID NO: 2018796 - DNA, 14 bp, Homo sapiens
gccctgtcccctga

SEQ ID NO: 2018797 - DNA, 17 bp, Homo sapiens
gccctgttgtgtataga

SEQ ID NO: 2018798 - DNA, 20 bp, Homo sapiens
gcccttaaaataatgattta

SEQ ID NO: 2018799 - DNA, 18 bp, Homo sapiens
gcccttattttcaagaaa

SEQ ID NO: 2018800 - DNA, 16 bp, Homo sapiens
gcccttcccactggag

SEQ ID NO: 2018801 - DNA, 12 bp, Homo sapiens
gcccttccctgc

SEQ ID NO: 2018802 - DNA, 13 bp, Homo sapiens
gcccttccctgct

SEQ ID NO: 2018803 - DNA, 14 bp, Homo sapiens
gcccttccctgctt

SEQ ID NO: 2018804 - DNA, 13 bp, Homo sapiens
gcccttcctagaa

SEQ ID NO: 2018805 - DNA, 14 bp, Homo sapiens
gcccttcctctcca

SEQ ID NO: 2018806 - DNA, 18 bp, Homo sapiens
gcccttcctctccactgc

SEQ ID NO: 2018807 - DNA, 13 bp, Homo sapiens
gcccttcctggac

SEQ ID NO: 2018808 - DNA, 15 bp, Homo sapiens
gcccttcctggacag

SEQ ID NO: 2018809 - DNA, 20 bp, Homo sapiens
gcccttcctggacagctgtg

SEQ ID NO: 2018810 - DNA, 22 bp, Homo sapiens
gcccttcctggacagctgtgcc

SEQ ID NO: 2018811 - DNA, 14 bp, Homo sapiens
gcccttcgctgcca

SEQ ID NO: 2018812 - DNA, 16 bp, Homo sapiens
gcccttctttctaccc

SEQ ID NO: 2018813 - DNA, 18 bp, Homo sapiens
gcccttgagctccccaaa

SEQ ID NO: 2018814 - DNA, 22 bp, Homo sapiens
gcccttgagctccccaaaaacc

SEQ ID NO: 2018815 - DNA, 13 bp, Homo sapiens
gcccttgccccca

SEQ ID NO: 2018816 - DNA, 19 bp, Homo sapiens
gcccttgcccccatccctc

SEQ ID NO: 2018817 - DNA, 15 bp, Homo sapiens
gcccttgccctgacc

SEQ ID NO: 2018818 - DNA, 16 bp, Homo sapiens
gcccttgccctgacct

SEQ ID NO: 2018819 - DNA, 13 bp, Homo sapiens
gcccttggggcct

SEQ ID NO: 2018820 - DNA, 15 bp, Homo sapiens
gcccttggggcctgg

SEQ ID NO: 2018821 - DNA, 20 bp, Homo sapiens
gcccttggggttcccccaga

SEQ ID NO: 2018822 - DNA, 15 bp, Homo sapiens
gcccttgtcctgcca

SEQ ID NO: 2018823 - DNA, 17 bp, Homo sapiens
gcccttgtcctgccagc

SEQ ID NO: 2018824 - DNA, 21 bp, Homo sapiens
gcccttgtcctgccagctgcc

SEQ ID NO: 2018825 - DNA, 19 bp, Homo sapiens
gcccttgtttggggcagga

SEQ ID NO: 2018826 - DNA, 21 bp, Homo sapiens
gcccttgtttggggcaggagt

SEQ ID NO: 2018827 - DNA, 22 bp, Homo sapiens
gcccttgtttggggcaggagta

SEQ ID NO: 2018828 - DNA, 12 bp, Homo sapiens
gccctttctgtg

SEQ ID NO: 2018829 - DNA, 21 bp, Homo sapiens
gccctttgggaggctgaggcg

SEQ ID NO: 2018830 - DNA, 21 bp, Homo sapiens
gccctttgggtactactgctg

SEQ ID NO: 2018831 - DNA, 14 bp, Homo sapiens
gccgacctcagcct

SEQ ID NO: 2018832 - DNA, 15 bp, Homo sapiens
gccgacctcagcctt

SEQ ID NO: 2018833 - DNA, 13 bp, Homo sapiens
gccgacctcgtcc

SEQ ID NO: 2018834 - DNA, 21 bp, Homo sapiens
gccgacctcgtcctccccctg

SEQ ID NO: 2018835 - DNA, 16 bp, Homo sapiens
gccgactcagggacct

SEQ ID NO: 2018836 - DNA, 22 bp, Homo sapiens
gccgactgcacagcggcccctg

SEQ ID NO: 2018837 - DNA, 15 bp, Homo sapiens
gccgagagcctgctc

SEQ ID NO: 2018838 - DNA, 19 bp, Homo sapiens
gccgagagcctgctccccc

SEQ ID NO: 2018839 - DNA, 18 bp, Homo sapiens
gccgagatcacgccactg

SEQ ID NO: 2018840 - DNA, 19 bp, Homo sapiens
gccgagatcacgccactgc

SEQ ID NO: 2018841 - DNA, 21 bp, Homo sapiens
gccgagatcacgccactgcac

SEQ ID NO: 2018842 - DNA, 13 bp, Homo sapiens
gccgagggaaatg

SEQ ID NO: 2018843 - DNA, 19 bp, Homo sapiens
gccgagggaaatgctgttg

SEQ ID NO: 2018844 - DNA, 19 bp, Homo sapiens
gccgcaaatcaaccccaga

SEQ ID NO: 2018845 - DNA, 14 bp, Homo sapiens
gccgcaagcgcagg

SEQ ID NO: 2018846 - DNA, 17 bp, Homo sapiens
gccgcaaggccctgtcc

SEQ ID NO: 2018847 - DNA, 19 bp, Homo sapiens
gccgcaaggccctgtccca

SEQ ID NO: 2018848 - DNA, 23 bp, Homo sapiens
gccgcaccccagagtgtgggaag

SEQ ID NO: 2018849 - DNA, 17 bp, Homo sapiens
gccgcagggacggggac

SEQ ID NO: 2018850 - DNA, 18 bp, Homo sapiens
gccgcatcttctccatct

SEQ ID NO: 2018851 - DNA, 20 bp, Homo sapiens
gccgcatcttctccatctgg

SEQ ID NO: 2018852 - DNA, 15 bp, Homo sapiens
gccgccatccgggac

SEQ ID NO: 2018853 - DNA, 17 bp, Homo sapiens
gccgctgctttgcgctg

SEQ ID NO: 2018854 - DNA, 14 bp, Homo sapiens
gccgctggcccagg

SEQ ID NO: 2018855 - DNA, 15 bp, Homo sapiens
gccgctggcccaggg

SEQ ID NO: 2018856 - DNA, 11 bp, Homo sapiens
gccggcaaccc

SEQ ID NO: 2018857 - DNA, 20 bp, Homo sapiens
gccggcaaccccagttctgc

SEQ ID NO: 2018858 - DNA, 13 bp, Homo sapiens
gccggccagcctt

SEQ ID NO: 2018859 - DNA, 14 bp, Homo sapiens
gccggccggctggg

SEQ ID NO: 2018860 - DNA, 20 bp, Homo sapiens
gccgggaacagacaacagaa

SEQ ID NO: 2018861 - DNA, 14 bp, Homo sapiens
gccgggcaggtcct

SEQ ID NO: 2018862 - DNA, 23 bp, Homo sapiens
gccgggcatggtggcgcaagcct

SEQ ID NO: 2018863 - DNA, 12 bp, Homo sapiens
gccgggcctggg

SEQ ID NO: 2018864 - DNA, 19 bp, Homo sapiens
gccgggcgtggtggcgggc

SEQ ID NO: 2018865 - DNA, 22 bp, Homo sapiens
gccgggcgtggtggcgggcacc

SEQ ID NO: 2018866 - DNA, 17 bp, Homo sapiens
gccgggcttgggccctg

SEQ ID NO: 2018867 - DNA, 17 bp, Homo sapiens
gccggggaactggccaa

SEQ ID NO: 2018868 - DNA, 17 bp, Homo sapiens
gccggggaagctggcag

SEQ ID NO: 2018869 - DNA, 17 bp, Homo sapiens
gccggggcgagtggcac

SEQ ID NO: 2018870 - DNA, 18 bp, Homo sapiens
gccgtcagccaaatgtaa

SEQ ID NO: 2018871 - DNA, 18 bp, Homo sapiens
gccgtccatggcaccagc

SEQ ID NO: 2018872 - DNA, 22 bp, Homo sapiens
gccgtccatggcaccagccccc

SEQ ID NO: 2018873 - DNA, 17 bp, Homo sapiens
gccgtctgactccagag

SEQ ID NO: 2018874 - DNA, 12 bp, Homo sapiens
gccgtgcccagg

SEQ ID NO: 2018875 - DNA, 14 bp, Homo sapiens
gccgtgccttcagc

SEQ ID NO: 2018876 - DNA, 19 bp, Homo sapiens
gccgtgccttcagctctac

SEQ ID NO: 2018877 - DNA, 23 bp, Homo sapiens
gccgtgcctttctctggctccag

SEQ ID NO: 2018878 - DNA, 20 bp, Homo sapiens
gccgtggccatcagggtggg

SEQ ID NO: 2018879 - DNA, 11 bp, Homo sapiens
gccgtggcttc

SEQ ID NO: 2018880 - DNA, 13 bp, Homo sapiens
gccgtggcttccc

SEQ ID NO: 2018881 - DNA, 22 bp, Homo sapiens
gccgtggcttcccgctcagccc

SEQ ID NO: 2018882 - DNA, 18 bp, Homo sapiens
gccgtgggggttgaggca

SEQ ID NO: 2018883 - DNA, 15 bp, Homo sapiens
gccgtgtctctgagg

SEQ ID NO: 2018884 - DNA, 16 bp, Homo sapiens
gccgtgttactgttgc

SEQ ID NO: 2018885 - DNA, 14 bp, Homo sapiens
gccgttactctcca

SEQ ID NO: 2018886 - DNA, 15 bp, Homo sapiens
gccgttactctccaa

SEQ ID NO: 2018887 - DNA, 18 bp, Homo sapiens
gccgttactctccaacct

SEQ ID NO: 2018888 - DNA, 16 bp, Homo sapiens
gcctaaatccaaagaa

SEQ ID NO: 2018889 - DNA, 17 bp, Homo sapiens
gcctaagtggctgctga

SEQ ID NO: 2018890 - DNA, 12 bp, Homo sapiens
gcctaataaaga

SEQ ID NO: 2018891 - DNA, 15 bp, Homo sapiens
gcctaatggagaaga

SEQ ID NO: 2018892 - DNA, 16 bp, Homo sapiens
gcctaatggagaagac

SEQ ID NO: 2018893 - DNA, 15 bp, Homo sapiens
gcctaattcctggca

SEQ ID NO: 2018894 - DNA, 16 bp, Homo sapiens
gcctacattccctggc

SEQ ID NO: 2018895 - DNA, 18 bp, Homo sapiens
gcctacattccctggcct

SEQ ID NO: 2018896 - DNA, 21 bp, Homo sapiens
gcctacccttgtaccccatcc

SEQ ID NO: 2018897 - DNA, 12 bp, Homo sapiens
gcctactcacga

SEQ ID NO: 2018898 - DNA, 17 bp, Homo sapiens
gcctagatccacacaca

SEQ ID NO: 2018899 - DNA, 23 bp, Homo sapiens
gcctagatccacacacagaggaa

SEQ ID NO: 2018900 - DNA, 13 bp, Homo sapiens
gcctagcaggcac

SEQ ID NO: 2018901 - DNA, 18 bp, Homo sapiens
gcctagccacctcccacc

SEQ ID NO: 2018902 - DNA, 21 bp, Homo sapiens
gcctagccacctcccacccca

SEQ ID NO: 2018903 - DNA, 15 bp, Homo sapiens
gcctagccgacctca

SEQ ID NO: 2018904 - DNA, 19 bp, Homo sapiens
gcctaggccaaatgcacaa

SEQ ID NO: 2018905 - DNA, 11 bp, Homo sapiens
gcctagggagc

SEQ ID NO: 2018906 - DNA, 15 bp, Homo sapiens
gcctaggtgacagag

SEQ ID NO: 2018907 - DNA, 22 bp, Homo sapiens
gcctagtggggtctccctctcc

SEQ ID NO: 2018908 - DNA, 13 bp, Homo sapiens
gcctataatccca

SEQ ID NO: 2018909 - DNA, 18 bp, Homo sapiens
gcctatgatcccagcact

SEQ ID NO: 2018910 - DNA, 14 bp, Homo sapiens
gcctatgcacatat

SEQ ID NO: 2018911 - DNA, 22 bp, Homo sapiens
gcctatgcacatatggactctg

SEQ ID NO: 2018912 - DNA, 19 bp, Homo sapiens
gcctatggagagccctggg

SEQ ID NO: 2018913 - DNA, 20 bp, Homo sapiens
gcctatggagagccctggga

SEQ ID NO: 2018914 - DNA, 17 bp, Homo sapiens
gcctatttattcattca

SEQ ID NO: 2018915 - DNA, 14 bp, Homo sapiens
gcctatttattggg

SEQ ID NO: 2018916 - DNA, 15 bp, Homo sapiens
gcctatttattgggg

SEQ ID NO: 2018917 - DNA, 16 bp, Homo sapiens
gcctatttatttgaaa

SEQ ID NO: 2018918 - DNA, 16 bp, Homo sapiens
gcctcaacctcctggg

SEQ ID NO: 2018919 - DNA, 18 bp, Homo sapiens
gcctcaacctcctgggct

SEQ ID NO: 2018920 - DNA, 19 bp, Homo sapiens
gcctcaacctcctgggcta

SEQ ID NO: 2018921 - DNA, 19 bp, Homo sapiens
gcctcaagtgattctcctg

SEQ ID NO: 2018922 - DNA, 20 bp, Homo sapiens
gcctcaagtgattctcctgc

SEQ ID NO: 2018923 - DNA, 21 bp, Homo sapiens
gcctcaatgtgaatcagaccc

SEQ ID NO: 2018924 - DNA, 22 bp, Homo sapiens
gcctcaatttctgaacaccata

SEQ ID NO: 2018925 - DNA, 15 bp, Homo sapiens
gcctcacagaagaat

SEQ ID NO: 2018926 - DNA, 16 bp, Homo sapiens
gcctcacgcccagcct

SEQ ID NO: 2018927 - DNA, 22 bp, Homo sapiens
gcctcactgatatattttccag

SEQ ID NO: 2018928 - DNA, 14 bp, Homo sapiens
gcctcactggctgg

SEQ ID NO: 2018929 - DNA, 22 bp, Homo sapiens
gcctcactggctggggcagagg

SEQ ID NO: 2018930 - DNA, 16 bp, Homo sapiens
gcctcagaccaactct

SEQ ID NO: 2018931 - DNA, 17 bp, Homo sapiens
gcctcagcaggaacctg

SEQ ID NO: 2018932 - DNA, 21 bp, Homo sapiens
gcctcagcatcctggcacccg

SEQ ID NO: 2018933 - DNA, 19 bp, Homo sapiens
gcctcagctcagcctcccc

SEQ ID NO: 2018934 - DNA, 16 bp, Homo sapiens
gcctcagctgctcgca

SEQ ID NO: 2018935 - DNA, 22 bp, Homo sapiens
gcctcagtaagtatctggagga

SEQ ID NO: 2018936 - DNA, 15 bp, Homo sapiens
gcctcagtgccacta

SEQ ID NO: 2018937 - DNA, 16 bp, Homo sapiens
gcctcagtgccacttg

SEQ ID NO: 2018938 - DNA, 14 bp, Homo sapiens
gcctcagtttcccc

SEQ ID NO: 2018939 - DNA, 17 bp, Homo sapiens
gcctcagtttccccatt

SEQ ID NO: 2018940 - DNA, 15 bp, Homo sapiens
gcctcatatttaaag

SEQ ID NO: 2018941 - DNA, 13 bp, Homo sapiens
gcctcatccctcg

SEQ ID NO: 2018942 - DNA, 24 bp, Homo sapiens
gcctcatccctcggaagccgtctg

SEQ ID NO: 2018943 - DNA, 16 bp, Homo sapiens
gcctcatccgaggcag

SEQ ID NO: 2018944 - DNA, 17 bp, Homo sapiens
gcctcatccgaggcagg

SEQ ID NO: 2018945 - DNA, 22 bp, Homo sapiens
gcctcatccgaggcagggtcag

SEQ ID NO: 2018946 - DNA, 15 bp, Homo sapiens
gcctcatctccttta

SEQ ID NO: 2018947 - DNA, 19 bp, Homo sapiens
gcctcatgaccctcctgtc

SEQ ID NO: 2018948 - DNA, 15 bp, Homo sapiens
gcctgagtctcctgt

SEQ ID NO: 2018949 - DNA, 20 bp, Homo sapiens
gcctgataagcttcaaagct

SEQ ID NO: 2018950 - DNA, 15 bp, Homo sapiens
gcctgataccctgct

SEQ ID NO: 2018951 - DNA, 14 bp, Homo sapiens
gcctgatggccaag

SEQ ID NO: 2018952 - DNA, 12 bp, Homo sapiens
gcctgcagagag

SEQ ID NO: 2018953 - DNA, 13 bp, Homo sapiens
gcctgccagggcc

SEQ ID NO: 2018954 - DNA, 20 bp, Homo sapiens
gcctgccataccgctgggga

SEQ ID NO: 2018955 - DNA, 17 bp, Homo sapiens
gcctgcccaatgctttg

SEQ ID NO: 2018956 - DNA, 13 bp, Homo sapiens
gcctgcccagcct

SEQ ID NO: 2018957 - DNA, 22 bp, Homo sapiens
gcctgcccagcctcgcatgcca

SEQ ID NO: 2018958 - DNA, 18 bp, Homo sapiens
gcctgcccaggcccctgc

SEQ ID NO: 2018959 - DNA, 15 bp, Homo sapiens
gcctgccctcccatg

SEQ ID NO: 2018960 - DNA, 17 bp, Homo sapiens
gcctgccctccctgggg

SEQ ID NO: 2018961 - DNA, 17 bp, Homo sapiens
gcctgccgcccaaagag

SEQ ID NO: 2018962 - DNA, 20 bp, Homo sapiens
gcctgccgccgtctctgtcc

SEQ ID NO: 2018963 - DNA, 24 bp, Homo sapiens
gcctgcctcccagccctgccagga

SEQ ID NO: 2018964 - DNA, 16 bp, Homo sapiens
gcctgcctctgactca

SEQ ID NO: 2018965 - DNA, 14 bp, Homo sapiens
gcctgcctctgcca

SEQ ID NO: 2018966 - DNA, 16 bp, Homo sapiens
gcctgccttgaagcca

SEQ ID NO: 2018967 - DNA, 19 bp, Homo sapiens
gcctgctaatagctgctag

SEQ ID NO: 2018968 - DNA, 17 bp, Homo sapiens
gcctgctagagcaaccc

SEQ ID NO: 2018969 - DNA, 20 bp, Homo sapiens
gcctgctatttgaagtgtaa

SEQ ID NO: 2018970 - DNA, 13 bp, Homo sapiens
gcctgctcccagc

SEQ ID NO: 2018971 - DNA, 20 bp, Homo sapiens
gcctgctcccagcagcccta

SEQ ID NO: 2018972 - DNA, 11 bp, Homo sapiens
gcctgctcccc

SEQ ID NO: 2018973 - DNA, 13 bp, Homo sapiens
gcctgctccccca

SEQ ID NO: 2018974 - DNA, 15 bp, Homo sapiens
gcctgctcccccacc

SEQ ID NO: 2018975 - DNA, 17 bp, Homo sapiens
gcctgctgcgtcagacc

SEQ ID NO: 2018976 - DNA, 19 bp, Homo sapiens
gcctgctgcgtcagaccag

SEQ ID NO: 2018977 - DNA, 12 bp, Homo sapiens
gcctgctgctga

SEQ ID NO: 2018978 - DNA, 15 bp, Homo sapiens
gcctgctgctgagaa

SEQ ID NO: 2018979 - DNA, 17 bp, Homo sapiens
gcctgctgctgagaacc

SEQ ID NO: 2018980 - DNA, 18 bp, Homo sapiens
gcctgctgctgagaacct

SEQ ID NO: 2018981 - DNA, 20 bp, Homo sapiens
gcctgctgggaaccccgcag

SEQ ID NO: 2018982 - DNA, 21 bp, Homo sapiens
gcctgctgggaaccccgcagc

SEQ ID NO: 2018983 - DNA, 13 bp, Homo sapiens
gcctgctgggctc

SEQ ID NO: 2018984 - DNA, 16 bp, Homo sapiens
gcctgctgggctctcc

SEQ ID NO: 2018985 - DNA, 19 bp, Homo sapiens
gcctgctgggctctccacc

SEQ ID NO: 2018986 - DNA, 22 bp, Homo sapiens
gcctgctgggctctccacctca

SEQ ID NO: 2018987 - DNA, 23 bp, Homo sapiens
gcctgctgggctctccacctcag

SEQ ID NO: 2018988 - DNA, 18 bp, Homo sapiens
gcctgcttttccaggatc

SEQ ID NO: 2018989 - DNA, 19 bp, Homo sapiens
gcctggaaccagggaggag

SEQ ID NO: 2018990 - DNA, 19 bp, Homo sapiens
gcctggaccgcttcccaga

SEQ ID NO: 2018991 - DNA, 22 bp, Homo sapiens
gcctggaccgcttcccagaggc

SEQ ID NO: 2018992 - DNA, 15 bp, Homo sapiens
gcctggagaagctga

SEQ ID NO: 2018993 - DNA, 20 bp, Homo sapiens
gcctggagaggggcctggga

SEQ ID NO: 2018994 - DNA, 15 bp, Homo sapiens
gcctggaggacctga

SEQ ID NO: 2018995 - DNA, 16 bp, Homo sapiens
gcctggaggacctgag

SEQ ID NO: 2018996 - DNA, 19 bp, Homo sapiens
gcctggaggacctgagcct

SEQ ID NO: 2018997 - DNA, 20 bp, Homo sapiens
gcctggaggacctgagcctg

SEQ ID NO: 2018998 - DNA, 13 bp, Homo sapiens
gcctggcacacat

SEQ ID NO: 2018999 - DNA, 15 bp, Homo sapiens
gcctggcacaggact

SEQ ID NO: 2019000 - DNA, 20 bp, Homo sapiens
gcctggcagccgtgccttca

SEQ ID NO: 2019001 - DNA, 21 bp, Homo sapiens
gcctggcagccgtgccttcag

SEQ ID NO: 2019002 - DNA, 14 bp, Homo sapiens
gcctggccagatgc

SEQ ID NO: 2019003 - DNA, 15 bp, Homo sapiens
gcctggccagatgca

SEQ ID NO: 2019004 - DNA, 16 bp, Homo sapiens
gcctggccagatgcac

SEQ ID NO: 2019005 - DNA, 20 bp, Homo sapiens
gcctggccagatgcaccagc

SEQ ID NO: 2019006 - DNA, 22 bp, Homo sapiens
gcctggccagatgcaccagccc

SEQ ID NO: 2019007 - DNA, 15 bp, Homo sapiens
gcctggccatcccca

SEQ ID NO: 2019008 - DNA, 14 bp, Homo sapiens
gcctggcccataga

SEQ ID NO: 2019009 - DNA, 15 bp, Homo sapiens
gcctggcccccctcc

SEQ ID NO: 2019010 - DNA, 20 bp, Homo sapiens
gcctggcccccctccaggca

SEQ ID NO: 2019011 - DNA, 18 bp, Homo sapiens
gcctggccggcaacccca

SEQ ID NO: 2019012 - DNA, 14 bp, Homo sapiens
gcctggcctcctgc

SEQ ID NO: 2019013 - DNA, 15 bp, Homo sapiens
gcctggcctcctgcc

SEQ ID NO: 2019014 - DNA, 16 bp, Homo sapiens
gcctggcctcctgcct

SEQ ID NO: 2019015 - DNA, 13 bp, Homo sapiens
gcctggcctgagc

SEQ ID NO: 2019016 - DNA, 16 bp, Homo sapiens
gcctggcctggcacac

SEQ ID NO: 2019017 - DNA, 13 bp, Homo sapiens
gcctggcctggct

SEQ ID NO: 2019018 - DNA, 18 bp, Homo sapiens
gcctggccttgtcaggac

SEQ ID NO: 2019019 - DNA, 20 bp, Homo sapiens
gcctggccttgtcaggaccc

SEQ ID NO: 2019020 - DNA, 22 bp, Homo sapiens
gcctggccttgtcaggacccag

SEQ ID NO: 2019021 - DNA, 16 bp, Homo sapiens
gcctggcggggcagga

SEQ ID NO: 2019022 - DNA, 21 bp, Homo sapiens
gcctggcggggcaggaggcct

SEQ ID NO: 2019023 - DNA, 16 bp, Homo sapiens
gcctggctccgtccag

SEQ ID NO: 2019024 - DNA, 15 bp, Homo sapiens
gcctggctctcctgt

SEQ ID NO: 2019025 - DNA, 14 bp, Homo sapiens
gcctggctggctga

SEQ ID NO: 2019026 - DNA, 18 bp, Homo sapiens
gcctggctggctgagggc

SEQ ID NO: 2019027 - DNA, 10 bp, Homo sapiens
gcctggctgt

SEQ ID NO: 2019028 - DNA, 13 bp, Homo sapiens
gcctggctgtgga

SEQ ID NO: 2019029 - DNA, 14 bp, Homo sapiens
gcctggctgtggag

SEQ ID NO: 2019030 - DNA, 17 bp, Homo sapiens
gcctggctgtggaggcc

SEQ ID NO: 2019031 - DNA, 18 bp, Homo sapiens
gcctggctgtggaggcct

SEQ ID NO: 2019032 - DNA, 19 bp, Homo sapiens
gcctggctgtggaggcctg

SEQ ID NO: 2019033 - DNA, 21 bp, Homo sapiens
gcctggctgtggaggcctgat

SEQ ID NO: 2019034 - DNA, 13 bp, Homo sapiens
gcctggcttctgg

SEQ ID NO: 2019035 - DNA, 17 bp, Homo sapiens
gcctggcttctggagcc

SEQ ID NO: 2019036 - DNA, 14 bp, Homo sapiens
gcctggcttgctcc

SEQ ID NO: 2019037 - DNA, 14 bp, Homo sapiens
gcctgggaaaggaa

SEQ ID NO: 2019038 - DNA, 16 bp, Homo sapiens
gcctgggaaaggaaaa

SEQ ID NO: 2019039 - DNA, 16 bp, Homo sapiens
gcctgggacccagcta

SEQ ID NO: 2019040 - DNA, 18 bp, Homo sapiens
gcctgggacccagctact

SEQ ID NO: 2019041 - DNA, 16 bp, Homo sapiens
gcctgggccagagaag

SEQ ID NO: 2019042 - DNA, 14 bp, Homo sapiens
gcctgggcccaggc

SEQ ID NO: 2019043 - DNA, 16 bp, Homo sapiens
gcctgggcccaggctc

SEQ ID NO: 2019044 - DNA, 20 bp, Homo sapiens
gcctgggcccaggctctggg

SEQ ID NO: 2019045 - DNA, 23 bp, Homo sapiens
gcctgggcccaggctctgggaag

SEQ ID NO: 2019046 - DNA, 18 bp, Homo sapiens
gcctgggcctatggagag

SEQ ID NO: 2019047 - DNA, 13 bp, Homo sapiens
gctatttctctcc

SEQ ID NO: 2019048 - DNA, 17 bp, Homo sapiens
gctatttctggcctcag

SEQ ID NO: 2019049 - DNA, 13 bp, Homo sapiens
gctatttgttcag

SEQ ID NO: 2019050 - DNA, 17 bp, Homo sapiens
gctatttgttcagagag

SEQ ID NO: 2019051 - DNA, 18 bp, Homo sapiens
gctattttatattacact

SEQ ID NO: 2019052 - DNA, 21 bp, Homo sapiens
gctattttcttacagtggagt

SEQ ID NO: 2019053 - DNA, 22 bp, Homo sapiens
gctatttttatttgtttgtgca

SEQ ID NO: 2019054 - DNA, 15 bp, Homo sapiens
gctcaagaggcccag

SEQ ID NO: 2019055 - DNA, 21 bp, Homo sapiens
gctcaagaggcccagggagca

SEQ ID NO: 2019056 - DNA, 16 bp, Homo sapiens
gctcaagcagtcctcc

SEQ ID NO: 2019057 - DNA, 21 bp, Homo sapiens
gctcaatattcctgaatgaaa

SEQ ID NO: 2019058 - DNA, 22 bp, Homo sapiens
gctcaatattcctgaatgaaat

SEQ ID NO: 2019059 - DNA, 14 bp, Homo sapiens
gctcacaagcccag

SEQ ID NO: 2019060 - DNA, 19 bp, Homo sapiens
gctcacaaggcagcaaggc

SEQ ID NO: 2019061 - DNA, 20 bp, Homo sapiens
gctcacaaggcagcaaggcc

SEQ ID NO: 2019062 - DNA, 22 bp, Homo sapiens
gctcacaaggcagcaaggcccg

SEQ ID NO: 2019063 - DNA, 17 bp, Homo sapiens
gctcacagttcctcgcc

SEQ ID NO: 2019064 - DNA, 21 bp, Homo sapiens
gctcacagttcctcgccctgg

SEQ ID NO: 2019065 - DNA, 22 bp, Homo sapiens
gctcacagttcctcgccctggg

SEQ ID NO: 2019066 - DNA, 14 bp, Homo sapiens
gctcaccagcccca

SEQ ID NO: 2019067 - DNA, 15 bp, Homo sapiens
gctcaccagccccag

SEQ ID NO: 2019068 - DNA, 19 bp, Homo sapiens
gctcaccagccccagtgcc

SEQ ID NO: 2019069 - DNA, 20 bp, Homo sapiens
gctcacccaataaacattaa

SEQ ID NO: 2019070 - DNA, 14 bp, Homo sapiens
gctcacctctgaag

SEQ ID NO: 2019071 - DNA, 13 bp, Homo sapiens
gctcacctttgtt

SEQ ID NO: 2019072 - DNA, 16 bp, Homo sapiens
gctcacgactcttcct

SEQ ID NO: 2019073 - DNA, 23 bp, Homo sapiens
gctcacgcctataatcccagcac

SEQ ID NO: 2019074 - DNA, 23 bp, Homo sapiens
gctcacgcctgtaatcccagcac

SEQ ID NO: 2019075 - DNA, 12 bp, Homo sapiens
gctcactccctg

SEQ ID NO: 2019076 - DNA, 11 bp, Homo sapiens
gctcactgcag

SEQ ID NO: 2019077 - DNA, 14 bp, Homo sapiens
gctcactgcagcct

SEQ ID NO: 2019078 - DNA, 16 bp, Homo sapiens
gctcactgcagcctca

SEQ ID NO: 2019079 - DNA, 20 bp, Homo sapiens
gctcagaatagatctgatgg

SEQ ID NO: 2019080 - DNA, 21 bp, Homo sapiens
gctcagaatagatctgatggt

SEQ ID NO: 2019081 - DNA, 23 bp, Homo sapiens
gctcagacccccactctcattcc

SEQ ID NO: 2019082 - DNA, 12 bp, Homo sapiens
gctcagaggccc

SEQ ID NO: 2019083 - DNA, 16 bp, Homo sapiens
gctcagaggcccagga

SEQ ID NO: 2019084 - DNA, 15 bp, Homo sapiens
gctcagatagaatga

SEQ ID NO: 2019085 - DNA, 14 bp, Homo sapiens
gctcagcaggccct

SEQ ID NO: 2019086 - DNA, 15 bp, Homo sapiens
gctcagcaggcccta

SEQ ID NO: 2019087 - DNA, 21 bp, Homo sapiens
gctcagccctgactggtgcta

SEQ ID NO: 2019088 - DNA, 14 bp, Homo sapiens
gctcagcccttcct

SEQ ID NO: 2019089 - DNA, 21 bp, Homo sapiens
gctcagcctccccctgctgct

SEQ ID NO: 2019090 - DNA, 14 bp, Homo sapiens
gctcagcctggtgg

SEQ ID NO: 2019091 - DNA, 15 bp, Homo sapiens
gctcagcctggtggg

SEQ ID NO: 2019092 - DNA, 19 bp, Homo sapiens
gctcagcctggtgggcctc

SEQ ID NO: 2019093 - DNA, 20 bp, Homo sapiens
gctcagcctggtgggcctcc

SEQ ID NO: 2019094 - DNA, 15 bp, Homo sapiens
gctcagcggggacag

SEQ ID NO: 2019095 - DNA, 18 bp, Homo sapiens
gctcagcggggacagctc

SEQ ID NO: 2019096 - DNA, 20 bp, Homo sapiens
gctcagcggggacagctcct

SEQ ID NO: 2019097 - DNA, 22 bp, Homo sapiens
gctcagcggggacagctccttc

SEQ ID NO: 2019098 - DNA, 19 bp, Homo sapiens
gctcaggaagaaaccccaa

SEQ ID NO: 2019099 - DNA, 21 bp, Homo sapiens
gctcaggaagaaaccccaagc

SEQ ID NO: 2019100 - DNA, 21 bp, Homo sapiens
gctcaggacccaggccctcca

SEQ ID NO: 2019101 - DNA, 20 bp, Homo sapiens
gctcaggaggcgaataaatg

SEQ ID NO: 2019102 - DNA, 16 bp, Homo sapiens
gctcaggaggcttgga

SEQ ID NO: 2019103 - DNA, 11 bp, Homo sapiens
gctcaggcaga

SEQ ID NO: 2019104 - DNA, 15 bp, Homo sapiens
gctcaggctgagccc

SEQ ID NO: 2019105 - DNA, 21 bp, Homo sapiens
gctcaggctgagcccagccac

SEQ ID NO: 2019106 - DNA, 19 bp, Homo sapiens
gctcaggtgactggagccc

SEQ ID NO: 2019107 - DNA, 13 bp, Homo sapiens
gcgtgactcaccc

SEQ ID NO: 2019108 - DNA, 14 bp, Homo sapiens
gcgtgactcaccca

SEQ ID NO: 2019109 - DNA, 14 bp, Homo sapiens
gcgtgagccactgc

SEQ ID NO: 2019110 - DNA, 23 bp, Homo sapiens
gcgtgagccactgcaccgggcca

SEQ ID NO: 2019111 - DNA, 17 bp, Homo sapiens
gcgtgcaaggggctcag

SEQ ID NO: 2019112 - DNA, 19 bp, Homo sapiens
gcgtgcacacaccagagcc

SEQ ID NO: 2019113 - DNA, 20 bp, Homo sapiens
gcgtgcacacaccagagccc

SEQ ID NO: 2019114 - DNA, 18 bp, Homo sapiens
gcgtgcagggacaaagag

SEQ ID NO: 2019115 - DNA, 19 bp, Homo sapiens
gcgtgcagggacaaagagg

SEQ ID NO: 2019116 - DNA, 14 bp, Homo sapiens
gcgtggactctgca

SEQ ID NO: 2019117 - DNA, 15 bp, Homo sapiens
gcgtggttcctttct

SEQ ID NO: 2019118 - DNA, 19 bp, Homo sapiens
gcgtgtcgtgggtgtgtgt

SEQ ID NO: 2019119 - DNA, 22 bp, Homo sapiens
gcgtgttagtgtgtgtgcatgt

SEQ ID NO: 2019120 - DNA, 18 bp, Homo sapiens
gcgttctgctgcccctgc

SEQ ID NO: 2019121 - DNA, 19 bp, Homo sapiens
gcgttctgctgcccctgca

SEQ ID NO: 2019122 - DNA, 21 bp, Homo sapiens
gcgttggagccactcctgtcc

SEQ ID NO: 2019123 - DNA, 23 bp, Homo sapiens
gcgttggtgccacttcttaaagg

SEQ ID NO: 2019124 - DNA, 16 bp, Homo sapiens
gctaaaacctgagcta

SEQ ID NO: 2019125 - DNA, 15 bp, Homo sapiens
gctaaaagaaacttt

SEQ ID NO: 2019126 - DNA, 12 bp, Homo sapiens
gctaaatgcaaa

SEQ ID NO: 2019127 - DNA, 13 bp, Homo sapiens
gctaaatgcaaac

SEQ ID NO: 2019128 - DNA, 18 bp, Homo sapiens
gctaaatgcctaataaac

SEQ ID NO: 2019129 - DNA, 14 bp, Homo sapiens
gctaacattttaaa

SEQ ID NO: 2019130 - DNA, 21 bp, Homo sapiens
gctaacattttaaataaaaga

SEQ ID NO: 2019131 - DNA, 21 bp, Homo sapiens
gctaacccccttctactgagc

SEQ ID NO: 2019132 - DNA, 15 bp, Homo sapiens
gctaagaaatgctga

SEQ ID NO: 2019133 - DNA, 18 bp, Homo sapiens
gctaagacctccccaccc

SEQ ID NO: 2019134 - DNA, 20 bp, Homo sapiens
gctaagagctagcgctgccg

SEQ ID NO: 2019135 - DNA, 18 bp, Homo sapiens
gctaagtgaaaaggtcat

SEQ ID NO: 2019136 - DNA, 23 bp, Homo sapiens
gctaagtgatcctcccacctcag

SEQ ID NO: 2019137 - DNA, 22 bp, Homo sapiens
gctaagttctaagttcatgttt

SEQ ID NO: 2019138 - DNA, 21 bp, Homo sapiens
gctaatgaagggaaaggatat

SEQ ID NO: 2019139 - DNA, 22 bp, Homo sapiens
gctaatttttatatttttagaa

SEQ ID NO: 2019140 - DNA, 21 bp, Homo sapiens
gctaatttttttgtattttag

SEQ ID NO: 2019141 - DNA, 18 bp, Homo sapiens
gctacaaaaacacagcaa

SEQ ID NO: 2019142 - DNA, 19 bp, Homo sapiens
gctacaaaaacacagcaag

SEQ ID NO: 2019143 - DNA, 13 bp, Homo sapiens
gctacaataaatg

SEQ ID NO: 2019144 - DNA, 15 bp, Homo sapiens
gctacaataaatgct

SEQ ID NO: 2019145 - DNA, 17 bp, Homo sapiens
gctacaccactctggca

SEQ ID NO: 2019146 - DNA, 21 bp, Homo sapiens
gctacactattgcattgttca

SEQ ID NO: 2019147 - DNA, 20 bp, Homo sapiens
gctacagtactatgtaaatt

SEQ ID NO: 2019148 - DNA, 11 bp, Homo sapiens
gctacattcct

SEQ ID NO: 2019149 - DNA, 16 bp, Homo sapiens
gctacattcctcagct

SEQ ID NO: 2019150 - DNA, 23 bp, Homo sapiens
gctacccaaaagagaaaaaaaat

SEQ ID NO: 2019151 - DNA, 17 bp, Homo sapiens
gctacccacttctaaat

SEQ ID NO: 2019152 - DNA, 21 bp, Homo sapiens
gctacctctctcttccctagg

SEQ ID NO: 2019153 - DNA, 18 bp, Homo sapiens
gctacctgtgtggacagg

SEQ ID NO: 2019154 - DNA, 19 bp, Homo sapiens
gctacctgtgtggacagga

SEQ ID NO: 2019155 - DNA, 22 bp, Homo sapiens
gctacctgtgtggacaggacta

SEQ ID NO: 2019156 - DNA, 18 bp, Homo sapiens
gctacgtacatgtgaggc

SEQ ID NO: 2019157 - DNA, 14 bp, Homo sapiens
gctacgtatttaat

SEQ ID NO: 2019158 - DNA, 16 bp, Homo sapiens
gctactcaagaggctg

SEQ ID NO: 2019159 - DNA, 17 bp, Homo sapiens
gctactcaagaggctga

SEQ ID NO: 2019160 - DNA, 17 bp, Homo sapiens
gctactcagaagcctga

SEQ ID NO: 2019161 - DNA, 16 bp, Homo sapiens
gctactcagcagccct

SEQ ID NO: 2019162 - DNA, 14 bp, Homo sapiens
gctgctcaaatcat

SEQ ID NO: 2019163 - DNA, 19 bp, Homo sapiens
gctgctcaacctctctcct

SEQ ID NO: 2019164 - DNA, 14 bp, Homo sapiens
gctgctcatcaccc

SEQ ID NO: 2019165 - DNA, 14 bp, Homo sapiens
gctgctcctccagg

SEQ ID NO: 2019166 - DNA, 23 bp, Homo sapiens
gctgctcctccagggccacgtgc

SEQ ID NO: 2019167 - DNA, 18 bp, Homo sapiens
gctgctcggggtgcacag

SEQ ID NO: 2019168 - DNA, 20 bp, Homo sapiens
gctgctcggggtgcacagga

SEQ ID NO: 2019169 - DNA, 13 bp, Homo sapiens
gctgctctagctg

SEQ ID NO: 2019170 - DNA, 17 bp, Homo sapiens
gctgctctagctggcag

SEQ ID NO: 2019171 - DNA, 22 bp, Homo sapiens
gctgctctagctggcaggacac

SEQ ID NO: 2019172 - DNA, 17 bp, Homo sapiens
gctgctctcatgcctgc

SEQ ID NO: 2019173 - DNA, 15 bp, Homo sapiens
gctgctctctgaggg

SEQ ID NO: 2019174 - DNA, 13 bp, Homo sapiens
gctgctctgcccc

SEQ ID NO: 2019175 - DNA, 20 bp, Homo sapiens
gctgctctgccccttgggca

SEQ ID NO: 2019176 - DNA, 22 bp, Homo sapiens
gctgctctgccccttgggcatc

SEQ ID NO: 2019177 - DNA, 21 bp, Homo sapiens
gctgctctgctatatgcctta

SEQ ID NO: 2019178 - DNA, 12 bp, Homo sapiens
gctgctctggaa

SEQ ID NO: 2019179 - DNA, 22 bp, Homo sapiens
gctgctgaagaggcaagagaca

SEQ ID NO: 2019180 - DNA, 12 bp, Homo sapiens
gctgctgacagt

SEQ ID NO: 2019181 - DNA, 16 bp, Homo sapiens
gctgctgactgatgtt

SEQ ID NO: 2019182 - DNA, 13 bp, Homo sapiens
gctgctgagaacc

SEQ ID NO: 2019183 - DNA, 14 bp, Homo sapiens
gctgctgagaacct

SEQ ID NO: 2019184 - DNA, 18 bp, Homo sapiens
gctgctgagaacctggcc

SEQ ID NO: 2019185 - DNA, 12 bp, Homo sapiens
gctgctggggca

SEQ ID NO: 2019186 - DNA, 19 bp, Homo sapiens
gctgctgtaactgctgagc

SEQ ID NO: 2019187 - DNA, 21 bp, Homo sapiens
gctgctgtaactgctgagcca

SEQ ID NO: 2019188 - DNA, 16 bp, Homo sapiens
gctgctgtgtagctct

SEQ ID NO: 2019189 - DNA, 19 bp, Homo sapiens
gctgctgtgtagctctgtc

SEQ ID NO: 2019190 - DNA, 11 bp, Homo sapiens
gctgcttccca

SEQ ID NO: 2019191 - DNA, 17 bp, Homo sapiens
gctgcttgtcctgctct

SEQ ID NO: 2019192 - DNA, 14 bp, Homo sapiens
gctgcttgtgggcc

SEQ ID NO: 2019193 - DNA, 20 bp, Homo sapiens
gctgctttgcgctggtggac

SEQ ID NO: 2019194 - DNA, 22 bp, Homo sapiens
gctgcttttgtctatgggactc

SEQ ID NO: 2019195 - DNA, 19 bp, Homo sapiens
gctggaaaagtcacacaga

SEQ ID NO: 2019196 - DNA, 20 bp, Homo sapiens
gctggaaaagtcacacagac

SEQ ID NO: 2019197 - DNA, 23 bp, Homo sapiens
gctggaaaagtcacacagacaca

SEQ ID NO: 2019198 - DNA, 23 bp, Homo sapiens
gctggaaataaacctggagatga

SEQ ID NO: 2019199 - DNA, 21 bp, Homo sapiens
gctggaagacgcaagggcctg

SEQ ID NO: 2019200 - DNA, 20 bp, Homo sapiens
gctgtctctgtccctcactg

SEQ ID NO: 2019201 - DNA, 23 bp, Homo sapiens
gctgtctctgtccctcactgcct

SEQ ID NO: 2019202 - DNA, 13 bp, Homo sapiens
gctgtctgtcacc

SEQ ID NO: 2019203 - DNA, 16 bp, Homo sapiens
gctgtctgtcaccagc

SEQ ID NO: 2019204 - DNA, 15 bp, Homo sapiens
gctgtctgtggcttc

SEQ ID NO: 2019205 - DNA, 19 bp, Homo sapiens
gctgtgaaaatgaggagga

SEQ ID NO: 2019206 - DNA, 13 bp, Homo sapiens
gctgtgaactcag

SEQ ID NO: 2019207 - DNA, 16 bp, Homo sapiens
gctgtgaactcagagc

SEQ ID NO: 2019208 - DNA, 20 bp, Homo sapiens
gctgtgaatttgtgtaagga

SEQ ID NO: 2019209 - DNA, 16 bp, Homo sapiens
gctgtgacctgctgag

SEQ ID NO: 2019210 - DNA, 17 bp, Homo sapiens
gctgtgacctgctgagc

SEQ ID NO: 2019211 - DNA, 12 bp, Homo sapiens
gctgtgagcccc

SEQ ID NO: 2019212 - DNA, 16 bp, Homo sapiens
gctgtgagcccctggt

SEQ ID NO: 2019213 - DNA, 18 bp, Homo sapiens
gctgtgcctcgctcccca

SEQ ID NO: 2019214 - DNA, 23 bp, Homo sapiens
gctgtgcctcgctccccactctg

SEQ ID NO: 2019215 - DNA, 12 bp, Homo sapiens
gctgtgcctctg

SEQ ID NO: 2019216 - DNA, 14 bp, Homo sapiens
gctgtgcctctgcc

SEQ ID NO: 2019217 - DNA, 15 bp, Homo sapiens
gctgtgcctgctaga

SEQ ID NO: 2019218 - DNA, 15 bp, Homo sapiens
gctgtggaggcctga

SEQ ID NO: 2019219 - DNA, 15 bp, Homo sapiens
gctgtggcacagact

SEQ ID NO: 2019220 - DNA, 14 bp, Homo sapiens
gctgtggccagggt

SEQ ID NO: 2019221 - DNA, 16 bp, Homo sapiens
gctgtggccagggtga

SEQ ID NO: 2019222 - DNA, 16 bp, Homo sapiens
gctgtggctcctgcct

SEQ ID NO: 2019223 - DNA, 18 bp, Homo sapiens
gctgtggctcctgccttg

SEQ ID NO: 2019224 - DNA, 19 bp, Homo sapiens
gctgtggctcctgccttga

SEQ ID NO: 2019225 - DNA, 14 bp, Homo sapiens
gctgtgggcagcac

SEQ ID NO: 2019226 - DNA, 18 bp, Homo sapiens
gctgtgggcagcaccctc

SEQ ID NO: 2019227 - DNA, 17 bp, Homo sapiens
gctgtggtggctgtctc

SEQ ID NO: 2019228 - DNA, 19 bp, Homo sapiens
gctgtggtggctgtctctg

SEQ ID NO: 2019229 - DNA, 14 bp, Homo sapiens
gctgtgtccttgca

SEQ ID NO: 2019230 - DNA, 18 bp, Homo sapiens
gctgtgtccttgcacctg

SEQ ID NO: 2019231 - DNA, 22 bp, Homo sapiens
gctgtgtgacagaatcttgtat

SEQ ID NO: 2019232 - DNA, 15 bp, Homo sapiens
gctgttcacagccag

SEQ ID NO: 2019233 - DNA, 23 bp, Homo sapiens
gctgttcacagccagactggcac

SEQ ID NO: 2019234 - DNA, 22 bp, Homo sapiens
gctgttccaacagacagggcct

SEQ ID NO: 2019235 - DNA, 13 bp, Homo sapiens
gctgttctgcact

SEQ ID NO: 2019236 - DNA, 14 bp, Homo sapiens
gctgttctgcactg

SEQ ID NO: 2019237 - DNA, 16 bp, Homo sapiens
gctgttctgcactgaa

SEQ ID NO: 2019238 - DNA, 12 bp, Homo sapiens
gctgttgagctg

SEQ ID NO: 2019239 - DNA, 18 bp, Homo sapiens
gctgttgagctgttttcc

SEQ ID NO: 2019240 - DNA, 17 bp, Homo sapiens
gctgttgccatagcccc

SEQ ID NO: 2019241 - DNA, 15 bp, Homo sapiens
gctgttgcctcatct

SEQ ID NO: 2019242 - DNA, 17 bp, Homo sapiens
gctgttgctggactgag

SEQ ID NO: 2019243 - DNA, 21 bp, Homo sapiens
gctgttggacagctgcttgtg

SEQ ID NO: 2019244 - DNA, 13 bp, Homo sapiens
gctgttggcctcg

SEQ ID NO: 2019245 - DNA, 14 bp, Homo sapiens
gctgttggcctggg

SEQ ID NO: 2019246 - DNA, 12 bp, Homo sapiens
gctgtttgtcat

SEQ ID NO: 2019247 - DNA, 21 bp, Homo sapiens
gctgtttgtgtgtctgggttg

SEQ ID NO: 2019248 - DNA, 21 bp, Homo sapiens
gctgtttgtttgacaaagaaa

SEQ ID NO: 2019249 - DNA, 13 bp, Homo sapiens
gcttaaaagagta

SEQ ID NO: 2019250 - DNA, 17 bp, Homo sapiens
gcttaaaattggtaatt

SEQ ID NO: 2019251 - DNA, 20 bp, Homo sapiens
gcttaaaattggtaattgaa

SEQ ID NO: 2019252 - DNA, 18 bp, Homo sapiens
gcttaaataaattcaaac

SEQ ID NO: 2019253 - DNA, 22 bp, Homo sapiens
gcttaaattgcttttgttgtga

SEQ ID NO: 2019254 - DNA, 14 bp, Homo sapiens
gcttaactggctgt

SEQ ID NO: 2019255 - DNA, 20 bp, Homo sapiens
gcttaatggctgataatttt

SEQ ID NO: 2019256 - DNA, 23 bp, Homo sapiens
gcttaatgtttattcctgataat

SEQ ID NO: 2019257 - DNA, 23 bp, Homo sapiens
gcttaattctgagctggcccttt

SEQ ID NO: 2019258 - DNA, 14 bp, Homo sapiens
gcttacatttttac

SEQ ID NO: 2019259 - DNA, 16 bp, Homo sapiens
gcttacctgacacaag

SEQ ID NO: 2019260 - DNA, 12 bp, Homo sapiens
gcttacctgacg

SEQ ID NO: 2019261 - DNA, 14 bp, Homo sapiens
gcttagacctcagc

SEQ ID NO: 2019262 - DNA, 15 bp, Homo sapiens
gcttagacctcagcc

SEQ ID NO: 2019263 - DNA, 23 bp, Homo sapiens
gcttagacctcagcctgtgctgc

SEQ ID NO: 2019264 - DNA, 16 bp, Homo sapiens
gcttagagaatgttct

SEQ ID NO: 2019265 - DNA, 23 bp, Homo sapiens
gcttagcagggtgctaacgtatc

SEQ ID NO: 2019266 - DNA, 13 bp, Homo sapiens
gcttagccttgtg

SEQ ID NO: 2019267 - DNA, 21 bp, Homo sapiens
gcttagctgaaacctaaggca

SEQ ID NO: 2019268 - DNA, 14 bp, Homo sapiens
gcttagtatctcat

SEQ ID NO: 2019269 - DNA, 22 bp, Homo sapiens
gcttagttaagtcatccacagc

SEQ ID NO: 2019270 - DNA, 17 bp, Homo sapiens
gcttatcaataaacctg

SEQ ID NO: 2019271 - DNA, 22 bp, Homo sapiens
gcttattcccaactgctctgcc

SEQ ID NO: 2019272 - DNA, 15 bp, Homo sapiens
gcttattggccactg

SEQ ID NO: 2019273 - DNA, 11 bp, Homo sapiens
gcttatttaat

SEQ ID NO: 2019274 - DNA, 15 bp, Homo sapiens
gcttatttccctcat

SEQ ID NO: 2019275 - DNA, 12 bp, Homo sapiens
gcttcaagtgat

SEQ ID NO: 2019276 - DNA, 23 bp, Homo sapiens
gcttcaagtgatatatgtattta

SEQ ID NO: 2019277 - DNA, 15 bp, Homo sapiens
gcttcaattaataaa

SEQ ID NO: 2019278 - DNA, 19 bp, Homo sapiens
gcttcaccttggagcctga

SEQ ID NO: 2019279 - DNA, 17 bp, Homo sapiens
gcttcagaattaaaact

SEQ ID NO: 2019280 - DNA, 18 bp, Homo sapiens
gcttcagagcctagccac

SEQ ID NO: 2019281 - DNA, 19 bp, Homo sapiens
gcttcagagcctagccacc

SEQ ID NO: 2019282 - DNA, 21 bp, Homo sapiens
gcttcagagcctagccacctc

SEQ ID NO: 2019283 - DNA, 14 bp, Homo sapiens
gcttcagcctgagg

SEQ ID NO: 2019284 - DNA, 15 bp, Homo sapiens
gcttcagcctgaggc

SEQ ID NO: 2019285 - DNA, 15 bp, Homo sapiens
gcttcagtggcagct

SEQ ID NO: 2019286 - DNA, 16 bp, Homo sapiens
gcttcatcaattttta

SEQ ID NO: 2019287 - DNA, 22 bp, Homo sapiens
gcttcatcaatttttatacata

SEQ ID NO: 2019288 - DNA, 23 bp, Homo sapiens
gcttcatcaatttttatacatat

SEQ ID NO: 2019289 - DNA, 23 bp, Homo sapiens
gcttcatgcctcagtttccccat

SEQ ID NO: 2019290 - DNA, 12 bp, Homo sapiens
gcttccaatttt

SEQ ID NO: 2019291 - DNA, 19 bp, Homo sapiens
gcttccagaaaaccccagc

SEQ ID NO: 2019292 - DNA, 13 bp, Homo sapiens
gcttccagaccac

SEQ ID NO: 2019293 - DNA, 23 bp, Homo sapiens
gcttccagaccacctgccagcca

SEQ ID NO: 2019294 - DNA, 21 bp, Homo sapiens
gcttccaggctcttcctggac

SEQ ID NO: 2019295 - DNA, 20 bp, Homo sapiens
gcttccaggtatctccagga

SEQ ID NO: 2019296 - DNA, 13 bp, Homo sapiens
gcttcccagaggc

SEQ ID NO: 2019297 - DNA, 20 bp, Homo sapiens
gcttcccaggatccctccca

SEQ ID NO: 2019298 - DNA, 24 bp, Homo sapiens
gcttccccacagaactgcttacta

SEQ ID NO: 2019299 - DNA, 16 bp, Homo sapiens
gcttcccgctcagccc

SEQ ID NO: 2019300 - DNA, 23 bp, Homo sapiens
gcttcccgctcagccctccctgc

SEQ ID NO: 2019301 - DNA, 18 bp, Homo sapiens
gcttccctaggctgagct

SEQ ID NO: 2019302 - DNA, 16 bp, Homo sapiens
gcttcctccgtctgca

SEQ ID NO: 2019303 - DNA, 18 bp, Homo sapiens
gcttcctgactgacacag

SEQ ID NO: 2019304 - DNA, 22 bp, Homo sapiens
gcttcctgactgacacaggcca

SEQ ID NO: 2019305 - DNA, 13 bp, Homo sapiens
gcttcctgtccac

SEQ ID NO: 2019306 - DNA, 23 bp, Homo sapiens
gcttcctgtccactctcggggcc

SEQ ID NO: 2019307 - DNA, 19 bp, Homo sapiens
gcttcctgtgggccaggag

SEQ ID NO: 2019308 - DNA, 20 bp, Homo sapiens
gcttcctgtgggccaggagc

SEQ ID NO: 2019309 - DNA, 22 bp, Homo sapiens
gcttccttggcatcacagggca

SEQ ID NO: 2019310 - DNA, 16 bp, Homo sapiens
gcttctaaatgcccag

SEQ ID NO: 2019311 - DNA, 15 bp, Homo sapiens
gcttctaggagtcaa

SEQ ID NO: 2019312 - DNA, 23 bp, Homo sapiens
gcttctaggagtcaactggctgg

SEQ ID NO: 2019313 - DNA, 12 bp, Homo sapiens
gcttctatccca

SEQ ID NO: 2019314 - DNA, 14 bp, Homo sapiens
gcttctcagccccg

SEQ ID NO: 2019315 - DNA, 22 bp, Homo sapiens
gcttctcagccccgggcctgcc

SEQ ID NO: 2019316 - DNA, 13 bp, Homo sapiens
gcttctcctccag

SEQ ID NO: 2019317 - DNA, 13 bp, Homo sapiens
gcttctcctctcc

SEQ ID NO: 2019318 - DNA, 13 bp, Homo sapiens
gcttctcctgtga

SEQ ID NO: 2019319 - DNA, 15 bp, Homo sapiens
gcttctcctgtgacc

SEQ ID NO: 2019320 - DNA, 16 bp, Homo sapiens
gcttctcctgtgaccc

SEQ ID NO: 2019321 - DNA, 14 bp, Homo sapiens
gcttctctacagac

SEQ ID NO: 2019322 - DNA, 22 bp, Homo sapiens
gcttctctgtgcccctgtaaat

SEQ ID NO: 2019323 - DNA, 13 bp, Homo sapiens
gcttctgaactca

SEQ ID NO: 2019324 - DNA, 18 bp, Homo sapiens
gcttctgaactcaagctg

SEQ ID NO: 2019325 - DNA, 17 bp, Homo sapiens
gcttctgcagcaactcc

SEQ ID NO: 2019326 - DNA, 20 bp, Homo sapiens
gcttctgcagcaactcccac

SEQ ID NO: 2019327 - DNA, 23 bp, Homo sapiens
gcttctgcagcaactcccacgac

SEQ ID NO: 2019328 - DNA, 16 bp, Homo sapiens
gcttctgggtggctcc

SEQ ID NO: 2019329 - DNA, 17 bp, Homo sapiens
gcttctgggtggctcct

SEQ ID NO: 2019330 - DNA, 22 bp, Homo sapiens
gcttctgggtggctcctgccac

SEQ ID NO: 2019331 - DNA, 14 bp, Homo sapiens
gcttctgtccagga

SEQ ID NO: 2019332 - DNA, 19 bp, Homo sapiens
gcttcttcaagcacctgca

SEQ ID NO: 2019333 - DNA, 19 bp, Homo sapiens
gcttcttcatcttgacatg

SEQ ID NO: 2019334 - DNA, 17 bp, Homo sapiens
gcttcttgccccttggg

SEQ ID NO: 2019335 - DNA, 23 bp, Homo sapiens
gcttcttttagttgtatctcttt

SEQ ID NO: 2019336 - DNA, 13 bp, Homo sapiens
gcttgaacccagg

SEQ ID NO: 2019337 - DNA, 22 bp, Homo sapiens
gcttgaagatcgttagtatcta

SEQ ID NO: 2019338 - DNA, 19 bp, Homo sapiens
gcttgaccagacctagacc

SEQ ID NO: 2019339 - DNA, 23 bp, Homo sapiens
gcttgaccagacctagacctggg

SEQ ID NO: 2019340 - DNA, 22 bp, Homo sapiens
gcttgactatcacatacaattt

SEQ ID NO: 2019341 - DNA, 21 bp, Homo sapiens
gcttgactggatggaaggaga

SEQ ID NO: 2019342 - DNA, 21 bp, Homo sapiens
gcttgagagggcaaacccaaa

SEQ ID NO: 2019343 - DNA, 12 bp, Homo sapiens
gcttgagcccag

SEQ ID NO: 2019344 - DNA, 14 bp, Homo sapiens
gcttgagcccagga

SEQ ID NO: 2019345 - DNA, 16 bp, Homo sapiens
gcttgagggttgggct

SEQ ID NO: 2019346 - DNA, 18 bp, Homo sapiens
gcttgccctgttaaaaga

SEQ ID NO: 2019347 - DNA, 14 bp, Homo sapiens
gcttgctcattttt

SEQ ID NO: 2019348 - DNA, 14 bp, Homo sapiens
gcttgctccagggt

SEQ ID NO: 2019349 - DNA, 23 bp, Homo sapiens
gcttgctcttcagtgggagaaaa

SEQ ID NO: 2019350 - DNA, 16 bp, Homo sapiens
gcttgcttctgcagca

SEQ ID NO: 2019351 - DNA, 21 bp, Homo sapiens
gcttgcttctgcagcaactcc

SEQ ID NO: 2019352 - DNA, 17 bp, Homo sapiens
gcttgcttgccgagcct

SEQ ID NO: 2019353 - DNA, 14 bp, Homo sapiens
gcttgcttgtcttt

SEQ ID NO: 2019354 - DNA, 21 bp, Homo sapiens
gcttggaaagcatcacctcag

SEQ ID NO: 2019355 - DNA, 17 bp, Homo sapiens
gcttggacttcctgggg

SEQ ID NO: 2019356 - DNA, 22 bp, Homo sapiens
gcttggacttcctggggccccg

SEQ ID NO: 2019357 - DNA, 13 bp, Homo sapiens
gcttggcagctga

SEQ ID NO: 2019358 - DNA, 15 bp, Homo sapiens
gcttggccgccatcc

SEQ ID NO: 2019359 - DNA, 20 bp, Homo sapiens
gcttggccgccatccgggac

SEQ ID NO: 2019360 - DNA, 11 bp, Homo sapiens
gcttggccttg

SEQ ID NO: 2019361 - DNA, 22 bp, Homo sapiens
gcttggggagcagagtatagga

SEQ ID NO: 2019362 - DNA, 22 bp, Homo sapiens
gcttggggggtgatgagggcag

SEQ ID NO: 2019363 - DNA, 19 bp, Homo sapiens
gcttgggtgtaacaggtct

SEQ ID NO: 2019364 - DNA, 22 bp, Homo sapiens
gcttgggtgtaacaggtctcct

SEQ ID NO: 2019365 - DNA, 18 bp, Homo sapiens
gcttggtcaaatccccgg

SEQ ID NO: 2019366 - DNA, 16 bp, Homo sapiens
gcttggtggctgagct

SEQ ID NO: 2019367 - DNA, 18 bp, Homo sapiens
gcttggtggggctcgtgg

SEQ ID NO: 2019368 - DNA, 15 bp, Homo sapiens
gcttggttggctggc

SEQ ID NO: 2019369 - DNA, 19 bp, Homo sapiens
gcttgtaaatagctcaggt

SEQ ID NO: 2019370 - DNA, 13 bp, Homo sapiens
gcttgtacatatt

SEQ ID NO: 2019371 - DNA, 17 bp, Homo sapiens
gcttgtagaccactgtc

SEQ ID NO: 2019372 - DNA, 16 bp, Homo sapiens
gcttgtagccagccgg

SEQ ID NO: 2019373 - DNA, 14 bp, Homo sapiens
gcttgtatagtgta

SEQ ID NO: 2019374 - DNA, 16 bp, Homo sapiens
gcttgtatatacatat

SEQ ID NO: 2019375 - DNA, 20 bp, Homo sapiens
gcttgtcactagcagctgca

SEQ ID NO: 2019376 - DNA, 16 bp, Homo sapiens
gcttgtccctgcccag

SEQ ID NO: 2019377 - DNA, 23 bp, Homo sapiens
gcttgtggattgagggtaggagg

SEQ ID NO: 2019378 - DNA, 15 bp, Homo sapiens
gcttgttatttataa

SEQ ID NO: 2019379 - DNA, 15 bp, Homo sapiens
gctttaaagtgtaat

SEQ ID NO: 2019380 - DNA, 17 bp, Homo sapiens
gctttaaatctatctat

SEQ ID NO: 2019381 - DNA, 14 bp, Homo sapiens
gctttaacaaaaca

SEQ ID NO: 2019382 - DNA, 23 bp, Homo sapiens
gctttaacaaaacaagaaagaaa

SEQ ID NO: 2019383 - DNA, 19 bp, Homo sapiens
gctttaaccgtttttcaag

SEQ ID NO: 2019384 - DNA, 16 bp, Homo sapiens
gctttacacacacaga

SEQ ID NO: 2019385 - DNA, 20 bp, Homo sapiens
gctttacatgctgtgctctt

SEQ ID NO: 2019386 - DNA, 14 bp, Homo sapiens
gctttacattttat

SEQ ID NO: 2019387 - DNA, 20 bp, Homo sapiens
gctttacctttattaatgaa

SEQ ID NO: 2019388 - DNA, 23 bp, Homo sapiens
gctttacctttattaatgaactg

SEQ ID NO: 2019389 - DNA, 22 bp, Homo sapiens
gctttaggactgacatttctat

SEQ ID NO: 2019390 - DNA, 14 bp, Homo sapiens
gctttatgctgtgt

SEQ ID NO: 2019391 - DNA, 21 bp, Homo sapiens
gctttatttatggcttataaa

SEQ ID NO: 2019392 - DNA, 21 bp, Homo sapiens
gctttcaacttaaatcactga

SEQ ID NO: 2019393 - DNA, 21 bp, Homo sapiens
gctttcatcacacccttttaa

SEQ ID NO: 2019394 - DNA, 13 bp, Homo sapiens
gctttcctccctg

SEQ ID NO: 2019395 - DNA, 19 bp, Homo sapiens
gctttctacccagcgagcc

SEQ ID NO: 2019396 - DNA, 23 bp, Homo sapiens
gctttctacccagcgagccctgg

SEQ ID NO: 2019397 - DNA, 15 bp, Homo sapiens
gctttctccggggtc

SEQ ID NO: 2019398 - DNA, 18 bp, Homo sapiens
gctttctccggggtctgt

SEQ ID NO: 2019399 - DNA, 23 bp, Homo sapiens
gctttctccggggtctgtgctgt

SEQ ID NO: 2019400 - DNA, 22 bp, Homo sapiens
gctttctggaaaagaggagttt

SEQ ID NO: 2019401 - DNA, 18 bp, Homo sapiens
gctttcttctacaaccag

SEQ ID NO: 2019402 - DNA, 18 bp, Homo sapiens
gctttgaatacccccaga

SEQ ID NO: 2019403 - DNA, 22 bp, Homo sapiens
gctttgaatacccccagagacc

SEQ ID NO: 2019404 - DNA, 17 bp, Homo sapiens
gctttgacatgaaaaga

SEQ ID NO: 2019405 - DNA, 21 bp, Homo sapiens
gctttgacatgaaaagatagg

SEQ ID NO: 2019406 - DNA, 21 bp, Homo sapiens
gctttgcaggctctgggctca

SEQ ID NO: 2019407 - DNA, 19 bp, Homo sapiens
gctttgccatgggcctgct

SEQ ID NO: 2019408 - DNA, 17 bp, Homo sapiens
gctttgcccttctttct

SEQ ID NO: 2019409 - DNA, 16 bp, Homo sapiens
gctttggcccaatgcc

SEQ ID NO: 2019410 - DNA, 19 bp, Homo sapiens
gctttgggaggccaaggca

SEQ ID NO: 2019411 - DNA, 14 bp, Homo sapiens
gctttgggctgccc

SEQ ID NO: 2019412 - DNA, 15 bp, Homo sapiens
gctttgggctgccct

SEQ ID NO: 2019413 - DNA, 16 bp, Homo sapiens
gctttgggctgccctg

SEQ ID NO: 2019414 - DNA, 18 bp, Homo sapiens
gctttgggctgccctggt

SEQ ID NO: 2019415 - DNA, 19 bp, Homo sapiens
gctttgggctgccctggtg

SEQ ID NO: 2019416 - DNA, 18 bp, Homo sapiens
gctttgtctctagccggg

SEQ ID NO: 2019417 - DNA, 14 bp, Homo sapiens
gctttgttttatat

SEQ ID NO: 2019418 - DNA, 15 bp, Homo sapiens
gcttttaagaaacac

SEQ ID NO: 2019419 - DNA, 14 bp, Homo sapiens
gcttttaataaaat

SEQ ID NO: 2019420 - DNA, 15 bp, Homo sapiens
gcttttaataaaatt

SEQ ID NO: 2019421 - DNA, 15 bp, Homo sapiens
gcttttattgtataa

SEQ ID NO: 2019422 - DNA, 15 bp, Homo sapiens
gcttttccaggatcc

SEQ ID NO: 2019423 - DNA, 21 bp, Homo sapiens
gcttttccaggatcctgcagg

SEQ ID NO: 2019424 - DNA, 22 bp, Homo sapiens
gcttttccccggtcccttgaga

SEQ ID NO: 2019425 - DNA, 20 bp, Homo sapiens
gcttttcgcttgcttctgca

SEQ ID NO: 2019426 - DNA, 23 bp, Homo sapiens
gcttttgcggttcaggaaaattg

SEQ ID NO: 2019427 - DNA, 20 bp, Homo sapiens
gcttttgttgtgacttttta

SEQ ID NO: 2019428 - DNA, 19 bp, Homo sapiens
gctttttccagattcttcc

SEQ ID NO: 2019429 - DNA, 12 bp, Homo sapiens
ggaaggctggct

SEQ ID NO: 2019430 - DNA, 13 bp, Homo sapiens
ggaagggaggggt

SEQ ID NO: 2019431 - DNA, 14 bp, Homo sapiens
ggaagggcaaaacc

SEQ ID NO: 2019432 - DNA, 15 bp, Homo sapiens
ggaagggccaggaga

SEQ ID NO: 2019433 - DNA, 16 bp, Homo sapiens
ggaaggggtgccctct

SEQ ID NO: 2019434 - DNA, 17 bp, Homo sapiens
ggaaggtagcccagcac

SEQ ID NO: 2019435 - DNA, 21 bp, Homo sapiens
ggaaggtagcccagcactgtg

SEQ ID NO: 2019436 - DNA, 23 bp, Homo sapiens
ggaaggtagcccagcactgtgaa

SEQ ID NO: 2019437 - DNA, 21 bp, Homo sapiens
ggaaggtcagttgccatggtt

SEQ ID NO: 2019438 - DNA, 18 bp, Homo sapiens
ggaaggtttgtatattgt

SEQ ID NO: 2019439 - DNA, 17 bp, Homo sapiens
ggaagtctaggagctgg

SEQ ID NO: 2019440 - DNA, 13 bp, Homo sapiens
ggaagtgaagccc

SEQ ID NO: 2019441 - DNA, 14 bp, Homo sapiens
ggaagtgctcccca

SEQ ID NO: 2019442 - DNA, 21 bp, Homo sapiens
ggaagtgggggccgctggccc

SEQ ID NO: 2019443 - DNA, 16 bp, Homo sapiens
ggaagtgttcaagaaa

SEQ ID NO: 2019444 - DNA, 18 bp, Homo sapiens
ggaagtgttcaagaaata

SEQ ID NO: 2019445 - DNA, 18 bp, Homo sapiens
ggaagttttgcatttatg

SEQ ID NO: 2019446 - DNA, 19 bp, Homo sapiens
ggaataaggtacaagaagc

SEQ ID NO: 2019447 - DNA, 14 bp, Homo sapiens
ggaatagccagaga

SEQ ID NO: 2019448 - DNA, 17 bp, Homo sapiens
ggaatagccagagagga

SEQ ID NO: 2019449 - DNA, 21 bp, Homo sapiens
ggaatagccagagaggagcac

SEQ ID NO: 2019450 - DNA, 15 bp, Homo sapiens
ggaatataattgttt

SEQ ID NO: 2019451 - DNA, 14 bp, Homo sapiens
ggaatcaaaaattg

SEQ ID NO: 2019452 - DNA, 22 bp, Homo sapiens
ggaatcaagatgtcagactggc

SEQ ID NO: 2019453 - DNA, 18 bp, Homo sapiens
ggaatcaatttcccagaa

SEQ ID NO: 2019454 - DNA, 19 bp, Homo sapiens
ggaatcaatttcccagaag

SEQ ID NO: 2019455 - DNA, 18 bp, Homo sapiens
ggaatcacctggagggct

SEQ ID NO: 2019456 - DNA, 23 bp, Homo sapiens
ggaatcagacttcacactgcaag

SEQ ID NO: 2019457 - DNA, 15 bp, Homo sapiens
ggaatcatgtcaggc

SEQ ID NO: 2019458 - DNA, 21 bp, Homo sapiens
ggaatcatgtcaggcctgtgt

SEQ ID NO: 2019459 - DNA, 16 bp, Homo sapiens
ggaatccagacccggc

SEQ ID NO: 2019460 - DNA, 20 bp, Homo sapiens
ggaatccgcctgcagaggac

SEQ ID NO: 2019461 - DNA, 18 bp, Homo sapiens
ggaatcgatctgtactgt

SEQ ID NO: 2019462 - DNA, 17 bp, Homo sapiens
ggaatctacctgtggtg

SEQ ID NO: 2019463 - DNA, 13 bp, Homo sapiens
ggaatctggagag

SEQ ID NO: 2019464 - DNA, 13 bp, Homo sapiens
ggaatgaagcatg

SEQ ID NO: 2019465 - DNA, 14 bp, Homo sapiens
ggaatgaagcatgt

SEQ ID NO: 2019466 - DNA, 15 bp, Homo sapiens
ggaatgaagcatgta

SEQ ID NO: 2019467 - DNA, 20 bp, Homo sapiens
ggaatgaccacgggcctcag

SEQ ID NO: 2019468 - DNA, 20 bp, Homo sapiens
ggaatgcagggaagagggca

SEQ ID NO: 2019469 - DNA, 12 bp, Homo sapiens
ggaatgcagtgg

SEQ ID NO: 2019470 - DNA, 17 bp, Homo sapiens
ggaatgttccctgcacc

SEQ ID NO: 2019471 - DNA, 20 bp, Homo sapiens
ggaatgttccctgcaccctg

SEQ ID NO: 2019472 - DNA, 17 bp, Homo sapiens
ggaattcagcaccctgg

SEQ ID NO: 2019473 - DNA, 21 bp, Homo sapiens
ggaattcagcaccctgggtgc

SEQ ID NO: 2019474 - DNA, 22 bp, Homo sapiens
ggaattcagcaccctgggtgcc

SEQ ID NO: 2019475 - DNA, 20 bp, Homo sapiens
ggaattcatctctctttaat

SEQ ID NO: 2019476 - DNA, 17 bp, Homo sapiens
ggaattgattcaagatt

SEQ ID NO: 2019477 - DNA, 21 bp, Homo sapiens
ggaatttaaggagggacaaga

SEQ ID NO: 2019478 - DNA, 23 bp, Homo sapiens
ggaatttctcccagtcatttaat

SEQ ID NO: 2019479 - DNA, 19 bp, Homo sapiens
ggaatttgtaagtttatgt

SEQ ID NO: 2019480 - DNA, 15 bp, Homo sapiens
ggaattttcaaaaat

SEQ ID NO: 2019481 - DNA, 13 bp, Homo sapiens
ggacaaaggagcc

SEQ ID NO: 2019482 - DNA, 12 bp, Homo sapiens
ggacaacatttt

SEQ ID NO: 2019483 - DNA, 13 bp, Homo sapiens
ggacaacccagaa

SEQ ID NO: 2019484 - DNA, 13 bp, Homo sapiens
ggacaagcagagg

SEQ ID NO: 2019485 - DNA, 20 bp, Homo sapiens
ggacaagcagaggtggccag

SEQ ID NO: 2019486 - DNA, 16 bp, Homo sapiens
ggacaagcaggtaaga

SEQ ID NO: 2019487 - DNA, 20 bp, Homo sapiens
ggacaagccaacttgtaaat

SEQ ID NO: 2019488 - DNA, 21 bp, Homo sapiens
ggacaagccaacttgtaaata

SEQ ID NO: 2019489 - DNA, 16 bp, Homo sapiens
ggacaatgccttggga

SEQ ID NO: 2019490 - DNA, 21 bp, Homo sapiens
ggacacacaaggtgcaaatca

SEQ ID NO: 2019491 - DNA, 19 bp, Homo sapiens
ggacacactgtaaacccct

SEQ ID NO: 2019492 - DNA, 15 bp, Homo sapiens
ggacacagacccaca

SEQ ID NO: 2019493 - DNA, 13 bp, Homo sapiens
ggacacagctctt

SEQ ID NO: 2019494 - DNA, 18 bp, Homo sapiens
ggacacagctcttctcca

SEQ ID NO: 2019495 - DNA, 11 bp, Homo sapiens
ggacacaggcc

SEQ ID NO: 2019496 - DNA, 13 bp, Homo sapiens
ggacacaggcctg

SEQ ID NO: 2019497 - DNA, 14 bp, Homo sapiens
ggacacatcccggc

SEQ ID NO: 2019498 - DNA, 17 bp, Homo sapiens
ggacacatcccggcctc

SEQ ID NO: 2019499 - DNA, 22 bp, Homo sapiens
ggacacatcccggcctcttcca

SEQ ID NO: 2019500 - DNA, 21 bp, Homo sapiens
ggacacctcaaatacatacct

SEQ ID NO: 2019501 - DNA, 13 bp, Homo sapiens
ggacacctgcccc

SEQ ID NO: 2019502 - DNA, 15 bp, Homo sapiens
ggacacctgccccag

SEQ ID NO: 2019503 - DNA, 17 bp, Homo sapiens
ggacacctgccccagcg

SEQ ID NO: 2019504 - DNA, 13 bp, Homo sapiens
ggacacctgccct

SEQ ID NO: 2019505 - DNA, 15 bp, Homo sapiens
ggacacctgccctgc

SEQ ID NO: 2019506 - DNA, 16 bp, Homo sapiens
ggacacctgccctgcc

SEQ ID NO: 2019507 - DNA, 13 bp, Homo sapiens
ggacacctggccg

SEQ ID NO: 2019508 - DNA, 16 bp, Homo sapiens
ggacacttatggggac

SEQ ID NO: 2019509 - DNA, 23 bp, Homo sapiens
ggacagaactgaacgtcctgcag

SEQ ID NO: 2019510 - DNA, 16 bp, Homo sapiens
ggacagaatgatggac

SEQ ID NO: 2019511 - DNA, 14 bp, Homo sapiens
ggacagagacacct

SEQ ID NO: 2019512 - DNA, 20 bp, Homo sapiens
ggacagaggagcaaggttta

SEQ ID NO: 2019513 - DNA, 19 bp, Homo sapiens
ggacagatagacagtgctg

SEQ ID NO: 2019514 - DNA, 19 bp, Homo sapiens
ggacagccacggccaggcc

SEQ ID NO: 2019515 - DNA, 22 bp, Homo sapiens
ggacagccacggccaggccaga

SEQ ID NO: 2019516 - DNA, 16 bp, Homo sapiens
ggacagccccagggcc

SEQ ID NO: 2019517 - DNA, 18 bp, Homo sapiens
ggacagccccagggccct

SEQ ID NO: 2019518 - DNA, 21 bp, Homo sapiens
ggacagcctgtggcggtgcct

SEQ ID NO: 2019519 - DNA, 12 bp, Homo sapiens
ggacagctgctt

SEQ ID NO: 2019520 - DNA, 17 bp, Homo sapiens
ggagaggcggcctcgtg

SEQ ID NO: 2019521 - DNA, 21 bp, Homo sapiens
ggagaggcggcctcgtgccat

SEQ ID NO: 2019522 - DNA, 22 bp, Homo sapiens
ggagaggggaagggccagtctg

SEQ ID NO: 2019523 - DNA, 17 bp, Homo sapiens
ggagaggggtgcaccca

SEQ ID NO: 2019524 - DNA, 19 bp, Homo sapiens
ggagaggggtgcacccact

SEQ ID NO: 2019525 - DNA, 17 bp, Homo sapiens
ggagagggtctggagaa

SEQ ID NO: 2019526 - DNA, 23 bp, Homo sapiens
ggagagggtctggagaagcagtg

SEQ ID NO: 2019527 - DNA, 17 bp, Homo sapiens
ggagagtacagtgagcc

SEQ ID NO: 2019528 - DNA, 20 bp, Homo sapiens
ggagagtacagtgagccaag

SEQ ID NO: 2019529 - DNA, 21 bp, Homo sapiens
ggagagttcaagcctgtggga

SEQ ID NO: 2019530 - DNA, 22 bp, Homo sapiens
ggagagttcaagcctgtgggag

SEQ ID NO: 2019531 - DNA, 21 bp, Homo sapiens
ggagatcagggcgacctgcac

SEQ ID NO: 2019532 - DNA, 18 bp, Homo sapiens
ggagatcgagaccatcct

SEQ ID NO: 2019533 - DNA, 12 bp, Homo sapiens
ggagatgatgat

SEQ ID NO: 2019534 - DNA, 20 bp, Homo sapiens
ggagatggaagttgcagtga

SEQ ID NO: 2019535 - DNA, 18 bp, Homo sapiens
ggagatggacccctccct

SEQ ID NO: 2019536 - DNA, 20 bp, Homo sapiens
ggagcaaatgtttctgcagt

SEQ ID NO: 2019537 - DNA, 18 bp, Homo sapiens
ggagcacacggccctgcc

SEQ ID NO: 2019538 - DNA, 21 bp, Homo sapiens
ggagcacacggccctgcccca

SEQ ID NO: 2019539 - DNA, 23 bp, Homo sapiens
ggagcacacggccctgccccatc

SEQ ID NO: 2019540 - DNA, 14 bp, Homo sapiens
ggagcacagccctg

SEQ ID NO: 2019541 - DNA, 15 bp, Homo sapiens
ggagcacaggcagct

SEQ ID NO: 2019542 - DNA, 13 bp, Homo sapiens
ggagcactggagt

SEQ ID NO: 2019543 - DNA, 18 bp, Homo sapiens
ggagcactggagtgcagg

SEQ ID NO: 2019544 - DNA, 18 bp, Homo sapiens
ggagcagacagagaaatg

SEQ ID NO: 2019545 - DNA, 20 bp, Homo sapiens
ggagcagacaggaggaatca

SEQ ID NO: 2019546 - DNA, 17 bp, Homo sapiens
ggagcagagctctgccg

SEQ ID NO: 2019547 - DNA, 21 bp, Homo sapiens
ggagcagagtataggatggat

SEQ ID NO: 2019548 - DNA, 17 bp, Homo sapiens
ggagcaggtctctggca

SEQ ID NO: 2019549 - DNA, 21 bp, Homo sapiens
ggagcaggtctctggcagaga

SEQ ID NO: 2019550 - DNA, 13 bp, Homo sapiens
ggagcagtgtctt

SEQ ID NO: 2019551 - DNA, 18 bp, Homo sapiens
ggagcagtgtcttccata

SEQ ID NO: 2019552 - DNA, 15 bp, Homo sapiens
ggagcatcccaggcg

SEQ ID NO: 2019553 - DNA, 17 bp, Homo sapiens
ggagcatgattttaaga

SEQ ID NO: 2019554 - DNA, 17 bp, Homo sapiens
ggagcatggctgtgagg

SEQ ID NO: 2019555 - DNA, 15 bp, Homo sapiens
ggagcatttggagag

SEQ ID NO: 2019556 - DNA, 15 bp, Homo sapiens
ggagccaacagcagc

SEQ ID NO: 2019557 - DNA, 17 bp, Homo sapiens
ggagccactcctgtccc

SEQ ID NO: 2019558 - DNA, 20 bp, Homo sapiens
ggagccactcctgtcccgcc

SEQ ID NO: 2019559 - DNA, 14 bp, Homo sapiens
ggagccccaggcct

SEQ ID NO: 2019560 - DNA, 20 bp, Homo sapiens
ggagccccaggcctctgtgt

SEQ ID NO: 2019561 - DNA, 13 bp, Homo sapiens
ggagcccccaccc

SEQ ID NO: 2019562 - DNA, 18 bp, Homo sapiens
ggagcccctaggaaagca

SEQ ID NO: 2019563 - DNA, 15 bp, Homo sapiens
ggagcccgtgcagta

SEQ ID NO: 2019564 - DNA, 14 bp, Homo sapiens
ggagccggaccaag

SEQ ID NO: 2019565 - DNA, 18 bp, Homo sapiens
ggagccggaccaagatgg

SEQ ID NO: 2019566 - DNA, 20 bp, Homo sapiens
ggagcctcatccgaggcagg

SEQ ID NO: 2019567 - DNA, 14 bp, Homo sapiens
ggagcctccccctc

SEQ ID NO: 2019568 - DNA, 18 bp, Homo sapiens
ggagcctcgcaacccgtg

SEQ ID NO: 2019569 - DNA, 20 bp, Homo sapiens
ggagcctggcacaggactga

SEQ ID NO: 2019570 - DNA, 18 bp, Homo sapiens
ggagcctgtgaacccagg

SEQ ID NO: 2019571 - DNA, 22 bp, Homo sapiens
ggagcctgtgaacccaggacaa

SEQ ID NO: 2019572 - DNA, 15 bp, Homo sapiens
ggagcgaaagtttct

SEQ ID NO: 2019573 - DNA, 21 bp, Homo sapiens
ggagcgcacctgccccctggt

SEQ ID NO: 2019574 - DNA, 13 bp, Homo sapiens
ggagcggctctcc

SEQ ID NO: 2019575 - DNA, 14 bp, Homo sapiens
ggagctacctgtgt

SEQ ID NO: 2019576 - DNA, 14 bp, Homo sapiens
ggagctcttggaag

SEQ ID NO: 2019577 - DNA, 18 bp, Homo sapiens
ggagctgatttccaggcc

SEQ ID NO: 2019578 - DNA, 19 bp, Homo sapiens
ggagctgatttccaggccc

SEQ ID NO: 2019579 - DNA, 20 bp, Homo sapiens
ggagctgatttccaggcccc

SEQ ID NO: 2019580 - DNA, 16 bp, Homo sapiens
ggagctgccgcaaggc

SEQ ID NO: 2019581 - DNA, 21 bp, Homo sapiens
ggagctgcctgttcagctcca

SEQ ID NO: 2019582 - DNA, 13 bp, Homo sapiens
ggagctggaaata

SEQ ID NO: 2019583 - DNA, 12 bp, Homo sapiens
ggagctggcttt

SEQ ID NO: 2019584 - DNA, 16 bp, Homo sapiens
ggagcttccagtgcat

SEQ ID NO: 2019585 - DNA, 20 bp, Homo sapiens
ggagctttcaaagaaggaat

SEQ ID NO: 2019586 - DNA, 22 bp, Homo sapiens
ggaggaaaaccaagccgtggct

SEQ ID NO: 2019587 - DNA, 14 bp, Homo sapiens
ggaggaagaagaca

SEQ ID NO: 2019588 - DNA, 14 bp, Homo sapiens
ggaggaaggcaaag

SEQ ID NO: 2019589 - DNA, 15 bp, Homo sapiens
ggaggaagggccagg

SEQ ID NO: 2019590 - DNA, 18 bp, Homo sapiens
ggaggaaggtgctgagct

SEQ ID NO: 2019591 - DNA, 13 bp, Homo sapiens
ggaggacctgagc

SEQ ID NO: 2019592 - DNA, 19 bp, Homo sapiens
ggaggactagaacctggag

SEQ ID NO: 2019593 - DNA, 22 bp, Homo sapiens
ggaggactagaacctggagggc

SEQ ID NO: 2019594 - DNA, 23 bp, Homo sapiens
ggaggagctgccgcaaggccctg

SEQ ID NO: 2019595 - DNA, 13 bp, Homo sapiens
ggaggaggaggaa

SEQ ID NO: 2019596 - DNA, 17 bp, Homo sapiens
ggaggaggcagagaaga

SEQ ID NO: 2019597 - DNA, 21 bp, Homo sapiens
ggaggatcactggagcccagg

SEQ ID NO: 2019598 - DNA, 15 bp, Homo sapiens
ggaggatgccacagc

SEQ ID NO: 2019599 - DNA, 12 bp, Homo sapiens
ggaggatggaga

SEQ ID NO: 2019600 - DNA, 18 bp, Homo sapiens
ggaggatgttctgggaca

SEQ ID NO: 2019601 - DNA, 21 bp, Homo sapiens
ggaggatgttctgggacacag

SEQ ID NO: 2019602 - DNA, 16 bp, Homo sapiens
ggaggcaccagctctg

SEQ ID NO: 2019603 - DNA, 21 bp, Homo sapiens
ggaggcaccagctctgtggcc

SEQ ID NO: 2019604 - DNA, 14 bp, Homo sapiens
ggaggcagagaaga

SEQ ID NO: 2019605 - DNA, 19 bp, Homo sapiens
ggaggcagctccaacagct

SEQ ID NO: 2019606 - DNA, 21 bp, Homo sapiens
ggaggcagggccttgcccaga

SEQ ID NO: 2019607 - DNA, 14 bp, Homo sapiens
ggaggcatctgcac

SEQ ID NO: 2019608 - DNA, 15 bp, Homo sapiens
ggaggcatggccctg

SEQ ID NO: 2019609 - DNA, 13 bp, Homo sapiens
ggaggccaaggca

SEQ ID NO: 2019610 - DNA, 15 bp, Homo sapiens
ggaggccaaggcagg

SEQ ID NO: 2019611 - DNA, 20 bp, Homo sapiens
ggaggcctcgtaccagccag

SEQ ID NO: 2019612 - DNA, 14 bp, Homo sapiens
ggaggcctggcctt

SEQ ID NO: 2019613 - DNA, 18 bp, Homo sapiens
ggaggcctgggggcaggg

SEQ ID NO: 2019614 - DNA, 18 bp, Homo sapiens
ggaggcgaataaatgttc

SEQ ID NO: 2019615 - DNA, 13 bp, Homo sapiens
ggaggcgcagccc

SEQ ID NO: 2019616 - DNA, 20 bp, Homo sapiens
ggaggcggagagtacagtga

SEQ ID NO: 2019617 - DNA, 20 bp, Homo sapiens
ggaggcggaggttgcagtga

SEQ ID NO: 2019618 - DNA, 21 bp, Homo sapiens
ggaggcggcacattggcagtg

SEQ ID NO: 2019619 - DNA, 15 bp, Homo sapiens
ggaggcggctccagg

SEQ ID NO: 2019620 - DNA, 17 bp, Homo sapiens
ggaggcggctccaggtc

SEQ ID NO: 2019621 - DNA, 22 bp, Homo sapiens
ggaggcggctccaggtccggag

SEQ ID NO: 2019622 - DNA, 22 bp, Homo sapiens
ggaggctgaagtgggtggatca

SEQ ID NO: 2019623 - DNA, 14 bp, Homo sapiens
ggaggctgagacag

SEQ ID NO: 2019624 - DNA, 15 bp, Homo sapiens
ggaggctgagacagg

SEQ ID NO: 2019625 - DNA, 18 bp, Homo sapiens
ggaggctgaggcagaaga

SEQ ID NO: 2019626 - DNA, 13 bp, Homo sapiens
ggaggctgaggcg

SEQ ID NO: 2019627 - DNA, 14 bp, Homo sapiens
ggaggctgcagagc

SEQ ID NO: 2019628 - DNA, 21 bp, Homo sapiens
ggaggctgcagagctgaccca

SEQ ID NO: 2019629 - DNA, 23 bp, Homo sapiens
ggaggctgcatgctctggaagcc

SEQ ID NO: 2019630 - DNA, 22 bp, Homo sapiens
ggaggctgctcggggtgcacag

SEQ ID NO: 2019631 - DNA, 23 bp, Homo sapiens
ggaggctgctcggggtgcacagg

SEQ ID NO: 2019632 - DNA, 12 bp, Homo sapiens
ggaggctgggcc

SEQ ID NO: 2019633 - DNA, 19 bp, Homo sapiens
ggaggctgggcccctggga

SEQ ID NO: 2019634 - DNA, 22 bp, Homo sapiens
ggaggctggtctccctccagct

SEQ ID NO: 2019635 - DNA, 15 bp, Homo sapiens
ggaggcttcctgact

SEQ ID NO: 2019636 - DNA, 21 bp, Homo sapiens
ggagggaatgaacctggaggg

SEQ ID NO: 2019637 - DNA, 21 bp, Homo sapiens
ggagggacaaaggagcctgtg

SEQ ID NO: 2019638 - DNA, 22 bp, Homo sapiens
ggagggacaaaggagcctgtga

SEQ ID NO: 2019639 - DNA, 12 bp, Homo sapiens
ggagggacaggg

SEQ ID NO: 2019640 - DNA, 21 bp, Homo sapiens
ggagggatgctgcctgagtca

SEQ ID NO: 2019641 - DNA, 16 bp, Homo sapiens
ggagggatggagaggc

SEQ ID NO: 2019642 - DNA, 22 bp, Homo sapiens
ggagggatggagaggcggcctc

SEQ ID NO: 2019643 - DNA, 11 bp, Homo sapiens
ggagggcagag

SEQ ID NO: 2019644 - DNA, 23 bp, Homo sapiens
ggagggcagagccatgggcctgg

SEQ ID NO: 2019645 - DNA, 16 bp, Homo sapiens
ggagggctagaacctg

SEQ ID NO: 2019646 - DNA, 20 bp, Homo sapiens
ggagggctagaacctggaga

SEQ ID NO: 2019647 - DNA, 22 bp, Homo sapiens
ggagggctagaacctggagagc

SEQ ID NO: 2019648 - DNA, 23 bp, Homo sapiens
ggagggctagaacctggcaggtt

SEQ ID NO: 2019649 - DNA, 16 bp, Homo sapiens
ggagggctctgaggcg

SEQ ID NO: 2019650 - DNA, 18 bp, Homo sapiens
ggagggctctgaggcgcc

SEQ ID NO: 2019651 - DNA, 18 bp, Homo sapiens
ggaggggcctagggagcc

SEQ ID NO: 2019652 - DNA, 21 bp, Homo sapiens
ggagggggcgctcaggaccca

SEQ ID NO: 2019653 - DNA, 12 bp, Homo sapiens
ggagggtggggc

SEQ ID NO: 2019654 - DNA, 13 bp, Homo sapiens
ggagggtggggcc

SEQ ID NO: 2019655 - DNA, 19 bp, Homo sapiens
ggagggtggggccgggtga

SEQ ID NO: 2019656 - DNA, 16 bp, Homo sapiens
ggaggtgaagtccctg

SEQ ID NO: 2019657 - DNA, 13 bp, Homo sapiens
ggaggtgagggat

SEQ ID NO: 2019658 - DNA, 17 bp, Homo sapiens
ggaggtgcctgagctgg

SEQ ID NO: 2019659 - DNA, 20 bp, Homo sapiens
ggaggtgcctgagctggggc

SEQ ID NO: 2019660 - DNA, 20 bp, Homo sapiens
ggaggtggaggttgcagtga

SEQ ID NO: 2019661 - DNA, 14 bp, Homo sapiens
ggaggtggtggagg

SEQ ID NO: 2019662 - DNA, 19 bp, Homo sapiens
ggaggttccggtgtctgga

SEQ ID NO: 2019663 - DNA, 17 bp, Homo sapiens
ggaggttgcagggagcc

SEQ ID NO: 2019664 - DNA, 16 bp, Homo sapiens
ggaggttggtgactga

SEQ ID NO: 2019665 - DNA, 13 bp, Homo sapiens
ggaggttgtggat

SEQ ID NO: 2019666 - DNA, 14 bp, Homo sapiens
ggaggttgtggatg

SEQ ID NO: 2019667 - DNA, 16 bp, Homo sapiens
ggagtaatcaggcagc

SEQ ID NO: 2019668 - DNA, 17 bp, Homo sapiens
ggagtagctgagctcac

SEQ ID NO: 2019669 - DNA, 17 bp, Homo sapiens
ggagtcccaaggaaagc

SEQ ID NO: 2019670 - DNA, 20 bp, Homo sapiens
ggagtcccaccttggctgca

SEQ ID NO: 2019671 - DNA, 21 bp, Homo sapiens
ggagtcccaccttggctgcag

SEQ ID NO: 2019672 - DNA, 23 bp, Homo sapiens
ggagtcccaccttggctgcaggg

SEQ ID NO: 2019673 - DNA, 16 bp, Homo sapiens
ggagtctgaggtcctg

SEQ ID NO: 2019674 - DNA, 23 bp, Homo sapiens
ggagtctgaggtcctgagcactg

SEQ ID NO: 2019675 - DNA, 14 bp, Homo sapiens
ggagtctgagtctg

SEQ ID NO: 2019676 - DNA, 19 bp, Homo sapiens
ggagtctgagtctgagtcc

SEQ ID NO: 2019677 - DNA, 22 bp, Homo sapiens
ggagtctgagtctgagtcctgt

SEQ ID NO: 2019678 - DNA, 16 bp, Homo sapiens
ggagtgacagaggcag

SEQ ID NO: 2019679 - DNA, 17 bp, Homo sapiens
ggagtgacagaggcagc

SEQ ID NO: 2019680 - DNA, 18 bp, Homo sapiens
ggagtgacagaggcagcc

SEQ ID NO: 2019681 - DNA, 12 bp, Homo sapiens
ggagtgagctgg

SEQ ID NO: 2019682 - DNA, 15 bp, Homo sapiens
ggagtgcagggagga

SEQ ID NO: 2019683 - DNA, 12 bp, Homo sapiens
ggagtgcagtga

SEQ ID NO: 2019684 - DNA, 21 bp, Homo sapiens
ggagtgcgctcttggtccctg

SEQ ID NO: 2019685 - DNA, 22 bp, Homo sapiens
ggagtgcttatcccttcttttt

SEQ ID NO: 2019686 - DNA, 13 bp, Homo sapiens
ggagtgggggctg

SEQ ID NO: 2019687 - DNA, 20 bp, Homo sapiens
ggagttcgagaccagcctgg

SEQ ID NO: 2019688 - DNA, 21 bp, Homo sapiens
ggagttcgaggctgcagtcag

SEQ ID NO: 2019689 - DNA, 15 bp, Homo sapiens
ggagttgctcactca

SEQ ID NO: 2019690 - DNA, 23 bp, Homo sapiens
ggagttgctcactcaggactttg

SEQ ID NO: 2019691 - DNA, 17 bp, Homo sapiens
ggagtttgagacaagcc

SEQ ID NO: 2019692 - DNA, 14 bp, Homo sapiens
ggataaaatgaggt

SEQ ID NO: 2019693 - DNA, 16 bp, Homo sapiens
ggataacaaaatcaca

SEQ ID NO: 2019694 - DNA, 18 bp, Homo sapiens
ggataacaaaatcacaag

SEQ ID NO: 2019695 - DNA, 21 bp, Homo sapiens
ggataagcgtgggtggaggaa

SEQ ID NO: 2019696 - DNA, 18 bp, Homo sapiens
ggatactctgtcagatgg

SEQ ID NO: 2019697 - DNA, 13 bp, Homo sapiens
ggatagcattttt

SEQ ID NO: 2019698 - DNA, 16 bp, Homo sapiens
ggatatgtaaaacatt

SEQ ID NO: 2019699 - DNA, 13 bp, Homo sapiens
ggatcacagggcc

SEQ ID NO: 2019700 - DNA, 17 bp, Homo sapiens
ggatcacagggccccag

SEQ ID NO: 2019701 - DNA, 13 bp, Homo sapiens
ggatcactggagc

SEQ ID NO: 2019702 - DNA, 14 bp, Homo sapiens
ggatcactggagcc

SEQ ID NO: 2019703 - DNA, 18 bp, Homo sapiens
ggatcagcgtggccttgt

SEQ ID NO: 2019704 - DNA, 15 bp, Homo sapiens
ggatccactgtgcag

SEQ ID NO: 2019705 - DNA, 18 bp, Homo sapiens
ggatccctccatccggct

SEQ ID NO: 2019706 - DNA, 16 bp, Homo sapiens
ggatccgctgccacca

SEQ ID NO: 2019707 - DNA, 17 bp, Homo sapiens
ggatccgctgccaccac

SEQ ID NO: 2019708 - DNA, 14 bp, Homo sapiens
ggatcctattctca

SEQ ID NO: 2019709 - DNA, 20 bp, Homo sapiens
ggatcctattctcaccagga

SEQ ID NO: 2019710 - DNA, 21 bp, Homo sapiens
ggatcctattctcaccaggaa

SEQ ID NO: 2019711 - DNA, 23 bp, Homo sapiens
ggatcctattctcaccaggaagg

SEQ ID NO: 2019712 - DNA, 12 bp, Homo sapiens
ggatcctgcagg

SEQ ID NO: 2019713 - DNA, 13 bp, Homo sapiens
ggatcctgcagga

SEQ ID NO: 2019714 - DNA, 18 bp, Homo sapiens
ggatcctgctgtggcctc

SEQ ID NO: 2019715 - DNA, 19 bp, Homo sapiens
ggatcctgctgtggcctca

SEQ ID NO: 2019716 - DNA, 21 bp, Homo sapiens
ggatctagcttcatgcctcag

SEQ ID NO: 2019717 - DNA, 14 bp, Homo sapiens
ggatctatgcaatt

SEQ ID NO: 2019718 - DNA, 19 bp, Homo sapiens
ggatctatgcaatttttaa

SEQ ID NO: 2019719 - DNA, 13 bp, Homo sapiens
ggatctccaagga

SEQ ID NO: 2019720 - DNA, 22 bp, Homo sapiens
ggatctctcaggagcacaggca

SEQ ID NO: 2019721 - DNA, 18 bp, Homo sapiens
ggatctgcattccccgct

SEQ ID NO: 2019722 - DNA, 23 bp, Homo sapiens
ggatctgggaccctttccttcct

SEQ ID NO: 2019723 - DNA, 18 bp, Homo sapiens
ggatctggggctctggga

SEQ ID NO: 2019724 - DNA, 16 bp, Homo sapiens
ggatctgtccaaggaa

SEQ ID NO: 2019725 - DNA, 22 bp, Homo sapiens
ggatcttgcattcccagtggtc

SEQ ID NO: 2019726 - DNA, 17 bp, Homo sapiens
ggatgaaattttctaga

SEQ ID NO: 2019727 - DNA, 14 bp, Homo sapiens
ggatgaatgaggtc

SEQ ID NO: 2019728 - DNA, 17 bp, Homo sapiens
ggatgattggattattc

SEQ ID NO: 2019729 - DNA, 12 bp, Homo sapiens
ggatgcagaggg

SEQ ID NO: 2019730 - DNA, 13 bp, Homo sapiens
ggatgccacagcc

SEQ ID NO: 2019731 - DNA, 19 bp, Homo sapiens
ggatgccacagccccacag

SEQ ID NO: 2019732 - DNA, 22 bp, Homo sapiens
ggatgccacagccccacagcac

SEQ ID NO: 2019733 - DNA, 13 bp, Homo sapiens
ggatgcctggtgg

SEQ ID NO: 2019734 - DNA, 11 bp, Homo sapiens
ggaccaggact

SEQ ID NO: 2019735 - DNA, 18 bp, Homo sapiens
ggaccaggcaccaggcag

SEQ ID NO: 2019736 - DNA, 16 bp, Homo sapiens
ggaccagggatggggg

SEQ ID NO: 2019737 - DNA, 15 bp, Homo sapiens
ggaccatgaagagac

SEQ ID NO: 2019738 - DNA, 18 bp, Homo sapiens
ggaccattgacctcagct

SEQ ID NO: 2019739 - DNA, 19 bp, Homo sapiens
ggaccattgacctcagctg

SEQ ID NO: 2019740 - DNA, 21 bp, Homo sapiens
ggaccattgacctcagctgca

SEQ ID NO: 2019741 - DNA, 22 bp, Homo sapiens
ggaccattgacctcagctgcac

SEQ ID NO: 2019742 - DNA, 22 bp, Homo sapiens
ggacccacccatcttcctgctg

SEQ ID NO: 2019743 - DNA, 23 bp, Homo sapiens
ggacccacccatcttcctgctgc

SEQ ID NO: 2019744 - DNA, 14 bp, Homo sapiens
ggacccaggccctc

SEQ ID NO: 2019745 - DNA, 22 bp, Homo sapiens
ggacccaggccctccatgggct

SEQ ID NO: 2019746 - DNA, 20 bp, Homo sapiens
ggacccaggccgcctgccat

SEQ ID NO: 2019747 - DNA, 22 bp, Homo sapiens
ggaccccctgagtcaactggag

SEQ ID NO: 2019748 - DNA, 15 bp, Homo sapiens
ggacccctcccaacc

SEQ ID NO: 2019749 - DNA, 17 bp, Homo sapiens
ggacccgctctggacca

SEQ ID NO: 2019750 - DNA, 20 bp, Homo sapiens
ggacccggaggggcctggca

SEQ ID NO: 2019751 - DNA, 21 bp, Homo sapiens
ggacccggaggggcctggcag

SEQ ID NO: 2019752 - DNA, 17 bp, Homo sapiens
ggaccctcgcagcaggt

SEQ ID NO: 2019753 - DNA, 18 bp, Homo sapiens
ggaccctcgcagcaggtg

SEQ ID NO: 2019754 - DNA, 23 bp, Homo sapiens
ggacccttgagagtatcaggtct

SEQ ID NO: 2019755 - DNA, 12 bp, Homo sapiens
ggaccctttcct

SEQ ID NO: 2019756 - DNA, 17 bp, Homo sapiens
ggaccgcgtagagagcc

SEQ ID NO: 2019757 - DNA, 18 bp, Homo sapiens
ggaccgcttcccagaggc

SEQ ID NO: 2019758 - DNA, 16 bp, Homo sapiens
ggaccgggtgggcctg

SEQ ID NO: 2019759 - DNA, 17 bp, Homo sapiens
ggaccgggtgggcctgg

SEQ ID NO: 2019760 - DNA, 17 bp, Homo sapiens
ggaccggtacagaaagg

SEQ ID NO: 2019761 - DNA, 21 bp, Homo sapiens
ggacctatgtcctaaggacac

SEQ ID NO: 2019762 - DNA, 21 bp, Homo sapiens
ggacctcaggcggggaggagg

SEQ ID NO: 2019763 - DNA, 19 bp, Homo sapiens
ggacctccggggagagcag

SEQ ID NO: 2019764 - DNA, 14 bp, Homo sapiens
ggacctgaaggacg

SEQ ID NO: 2019765 - DNA, 23 bp, Homo sapiens
ggacctgaagggtgacatcccag

SEQ ID NO: 2019766 - DNA, 13 bp, Homo sapiens
ggacctgagcctg

SEQ ID NO: 2019767 - DNA, 23 bp, Homo sapiens
ggacctgagcctgccgagcaacc

SEQ ID NO: 2019768 - DNA, 21 bp, Homo sapiens
ggacctgcacgccaccgctgc

SEQ ID NO: 2019769 - DNA, 18 bp, Homo sapiens
ggacctgtggggccccag

SEQ ID NO: 2019770 - DNA, 21 bp, Homo sapiens
ggacctgtggggccccagaga

SEQ ID NO: 2019771 - DNA, 18 bp, Homo sapiens
ggacctgtgttcttgctg

SEQ ID NO: 2019772 - DNA, 15 bp, Homo sapiens
ggaccttcctgccac

SEQ ID NO: 2019773 - DNA, 17 bp, Homo sapiens
ggaccttgaactgggta

SEQ ID NO: 2019774 - DNA, 15 bp, Homo sapiens
ggacctttcagctgt

SEQ ID NO: 2019775 - DNA, 20 bp, Homo sapiens
ggacgcccagctgaggctgg

SEQ ID NO: 2019776 - DNA, 14 bp, Homo sapiens
ggacgcttccagac

SEQ ID NO: 2019777 - DNA, 16 bp, Homo sapiens
ggacgcttccagacca

SEQ ID NO: 2019778 - DNA, 17 bp, Homo sapiens
ggacgcttccagaccac

SEQ ID NO: 2019779 - DNA, 21 bp, Homo sapiens
ggacgcttccagaccacctgc

SEQ ID NO: 2019780 - DNA, 22 bp, Homo sapiens
ggacgcttccagaccacctgcc

SEQ ID NO: 2019781 - DNA, 22 bp, Homo sapiens
ggacgtcatcggaggctgggcc

SEQ ID NO: 2019782 - DNA, 19 bp, Homo sapiens
ggactaacactcagaagcc

SEQ ID NO: 2019783 - DNA, 20 bp, Homo sapiens
ggactaacactcagaagcct

SEQ ID NO: 2019784 - DNA, 14 bp, Homo sapiens
ggactacaggtgtg

SEQ ID NO: 2019785 - DNA, 18 bp, Homo sapiens
ggactagaaaaacttggg

SEQ ID NO: 2019786 - DNA, 15 bp, Homo sapiens
ggactatagcccagg

SEQ ID NO: 2019787 - DNA, 18 bp, Homo sapiens
ggactcaagccccggact

SEQ ID NO: 2019788 - DNA, 13 bp, Homo sapiens
ggactcaccctca

SEQ ID NO: 2019789 - DNA, 14 bp, Homo sapiens
ggactcatggctta

SEQ ID NO: 2019790 - DNA, 19 bp, Homo sapiens
ggactccccaggccaggcc

SEQ ID NO: 2019791 - DNA, 15 bp, Homo sapiens
ggactcctcccacaa

SEQ ID NO: 2019792 - DNA, 14 bp, Homo sapiens
ggactcctctgtcc

SEQ ID NO: 2019793 - DNA, 11 bp, Homo sapiens
ggactctgagg

SEQ ID NO: 2019794 - DNA, 13 bp, Homo sapiens
ggactctgaggct

SEQ ID NO: 2019795 - DNA, 21 bp, Homo sapiens
ggactctgaggctctttctgg

SEQ ID NO: 2019796 - DNA, 20 bp, Homo sapiens
ggactctgcacatgtcttgt

SEQ ID NO: 2019797 - DNA, 15 bp, Homo sapiens
ggactctggcctctc

SEQ ID NO: 2019798 - DNA, 23 bp, Homo sapiens
ggactgagactggcacttagccc

SEQ ID NO: 2019799 - DNA, 11 bp, Homo sapiens
ggactgaggac

SEQ ID NO: 2019800 - DNA, 13 bp, Homo sapiens
ggactgaggagtg

SEQ ID NO: 2019801 - DNA, 21 bp, Homo sapiens
ggactgccagtccccctgccc

SEQ ID NO: 2019802 - DNA, 15 bp, Homo sapiens
ggactggaaccaggg

SEQ ID NO: 2019803 - DNA, 17 bp, Homo sapiens
ggacttaacggctccag

SEQ ID NO: 2019804 - DNA, 15 bp, Homo sapiens
ggacttgaacccagg

SEQ ID NO: 2019805 - DNA, 15 bp, Homo sapiens
ggacttggaagctcc

SEQ ID NO: 2019806 - DNA, 17 bp, Homo sapiens
ggacttggaagctccgc

SEQ ID NO: 2019807 - DNA, 17 bp, Homo sapiens
ggactttccagtgagga

SEQ ID NO: 2019808 - DNA, 21 bp, Homo sapiens
ggactttggttctctccagga

SEQ ID NO: 2019809 - DNA, 14 bp, Homo sapiens
ggagaaacagagac

SEQ ID NO: 2019810 - DNA, 13 bp, Homo sapiens
ggagaaataaact

SEQ ID NO: 2019811 - DNA, 23 bp, Homo sapiens
ggagaaatgcatccattcctcag

SEQ ID NO: 2019812 - DNA, 15 bp, Homo sapiens
ggagaacctcaggct

SEQ ID NO: 2019813 - DNA, 17 bp, Homo sapiens
ggagaactttccatctg

SEQ ID NO: 2019814 - DNA, 23 bp, Homo sapiens
ggagaagaaagaggtgaccccag

SEQ ID NO: 2019815 - DNA, 13 bp, Homo sapiens
ggagaagctgatg

SEQ ID NO: 2019816 - DNA, 12 bp, Homo sapiens
ggagaaggatct

SEQ ID NO: 2019817 - DNA, 14 bp, Homo sapiens
ggagaaggatctag

SEQ ID NO: 2019818 - DNA, 18 bp, Homo sapiens
ggagaagggccagcccta

SEQ ID NO: 2019819 - DNA, 16 bp, Homo sapiens
ggagaagttgccaaga

SEQ ID NO: 2019820 - DNA, 14 bp, Homo sapiens
ggagaattgcctct

SEQ ID NO: 2019821 - DNA, 14 bp, Homo sapiens
ggagaccagctcag

SEQ ID NO: 2019822 - DNA, 20 bp, Homo sapiens
ggagaccgcttcacccctgc

SEQ ID NO: 2019823 - DNA, 22 bp, Homo sapiens
ggagaccgcttcacccctgcac

SEQ ID NO: 2019824 - DNA, 18 bp, Homo sapiens
ggagactcacctctgcct

SEQ ID NO: 2019825 - DNA, 19 bp, Homo sapiens
ggagactcacctctgcctc

SEQ ID NO: 2019826 - DNA, 16 bp, Homo sapiens
ggagactctgtggggc

SEQ ID NO: 2019827 - DNA, 20 bp, Homo sapiens
ggagactctgtggggccttg

SEQ ID NO: 2019828 - DNA, 14 bp, Homo sapiens
gctcccttcttccc

SEQ ID NO: 2019829 - DNA, 13 bp, Homo sapiens
gctccctttctct

SEQ ID NO: 2019830 - DNA, 19 bp, Homo sapiens
gctccgtcatctgcggggc

SEQ ID NO: 2019831 - DNA, 20 bp, Homo sapiens
gctcctaaacccccgctcca

SEQ ID NO: 2019832 - DNA, 22 bp, Homo sapiens
gctcctccagggccacgtgcca

SEQ ID NO: 2019833 - DNA, 23 bp, Homo sapiens
gctcctccagggccacgtgccag

SEQ ID NO: 2019834 - DNA, 15 bp, Homo sapiens
gctcctcccattccc

SEQ ID NO: 2019835 - DNA, 15 bp, Homo sapiens
gctcctcccctcttg

SEQ ID NO: 2019836 - DNA, 21 bp, Homo sapiens
gctcctcgctgcgtctccatc

SEQ ID NO: 2019837 - DNA, 12 bp, Homo sapiens
gctcctctccag

SEQ ID NO: 2019838 - DNA, 14 bp, Homo sapiens
gctcctctccaggc

SEQ ID NO: 2019839 - DNA, 15 bp, Homo sapiens
gctcctctccaggca

SEQ ID NO: 2019840 - DNA, 21 bp, Homo sapiens
gctcctctccttgggctcctg

SEQ ID NO: 2019841 - DNA, 15 bp, Homo sapiens
gctcctctgctgctc

SEQ ID NO: 2019842 - DNA, 18 bp, Homo sapiens
gctcctcttaccgtagcc

SEQ ID NO: 2019843 - DNA, 22 bp, Homo sapiens
gctcctcttaccgtagcctccg

SEQ ID NO: 2019844 - DNA, 23 bp, Homo sapiens
gctcctcttaccgtagcctccgt

SEQ ID NO: 2019845 - DNA, 12 bp, Homo sapiens
gctcctgccact

SEQ ID NO: 2019846 - DNA, 17 bp, Homo sapiens
gctcctgccactgacct

SEQ ID NO: 2019847 - DNA, 22 bp, Homo sapiens
gctcctgctgaaacacctccca

SEQ ID NO: 2019848 - DNA, 23 bp, Homo sapiens
gctcctgctgaaacacctcccag

SEQ ID NO: 2019849 - DNA, 13 bp, Homo sapiens
gctcctggctgcc

SEQ ID NO: 2019850 - DNA, 17 bp, Homo sapiens
gctcctggctgccaggc

SEQ ID NO: 2019851 - DNA, 18 bp, Homo sapiens
gctcctggctgccaggcg

SEQ ID NO: 2019852 - DNA, 14 bp, Homo sapiens
gctcctgggcagct

SEQ ID NO: 2019853 - DNA, 17 bp, Homo sapiens
gctcctgggcagcttga

SEQ ID NO: 2019854 - DNA, 14 bp, Homo sapiens
gctcctgtccctac

SEQ ID NO: 2019855 - DNA, 19 bp, Homo sapiens
gctcctgtccctacccact

SEQ ID NO: 2019856 - DNA, 17 bp, Homo sapiens
gctcctgtctgccagcc

SEQ ID NO: 2019857 - DNA, 18 bp, Homo sapiens
gctcctgtctgccagcca

SEQ ID NO: 2019858 - DNA, 19 bp, Homo sapiens
gctcctgtctgccagccag

SEQ ID NO: 2019859 - DNA, 19 bp, Homo sapiens
gctcctttctccagccagc

SEQ ID NO: 2019860 - DNA, 20 bp, Homo sapiens
gctcctttctccagccagca

SEQ ID NO: 2019861 - DNA, 18 bp, Homo sapiens
gctccttttgtccccagg

SEQ ID NO: 2019862 - DNA, 21 bp, Homo sapiens
gctccttttgtccccagggcc

SEQ ID NO: 2019863 - DNA, 12 bp, Homo sapiens
gctcgcagcctg

SEQ ID NO: 2019864 - DNA, 21 bp, Homo sapiens
gctcgcagcctggcggggcag

SEQ ID NO: 2019865 - DNA, 17 bp, Homo sapiens
gctcgccccacccaggg

SEQ ID NO: 2019866 - DNA, 18 bp, Homo sapiens
gctcgccccacccagggc

SEQ ID NO: 2019867 - DNA, 16 bp, Homo sapiens
gctcgctccctgtagc

SEQ ID NO: 2019868 - DNA, 19 bp, Homo sapiens
gctcgcttctcctccaggt

SEQ ID NO: 2019869 - DNA, 20 bp, Homo sapiens
gctcggggtgcacaggaggg

SEQ ID NO: 2019870 - DNA, 21 bp, Homo sapiens
gctcggggtgcacaggagggg

SEQ ID NO: 2019871 - DNA, 12 bp, Homo sapiens
gctcggtggacc

SEQ ID NO: 2019872 - DNA, 14 bp, Homo sapiens
gctcggtggaccca

SEQ ID NO: 2019873 - DNA, 20 bp, Homo sapiens
gctctaacgcctgagcccag

SEQ ID NO: 2019874 - DNA, 21 bp, Homo sapiens
gctctaacgcctgagcccagg

SEQ ID NO: 2019875 - DNA, 22 bp, Homo sapiens
gctctaacgcctgagcccaggg

SEQ ID NO: 2019876 - DNA, 21 bp, Homo sapiens
gctctactggtcttgtggaat

SEQ ID NO: 2019877 - DNA, 23 bp, Homo sapiens
gctctagattgagagaagagaca

SEQ ID NO: 2019878 - DNA, 15 bp, Homo sapiens
gctctagccaggagt

SEQ ID NO: 2019879 - DNA, 19 bp, Homo sapiens
gctctagccaggagtctgt

SEQ ID NO: 2019880 - DNA, 22 bp, Homo sapiens
gctctagccaggagtctgtgct

SEQ ID NO: 2019881 - DNA, 14 bp, Homo sapiens
gctctaggctgccc

SEQ ID NO: 2019882 - DNA, 23 bp, Homo sapiens
gctctagtcttgctttgctgtct

SEQ ID NO: 2019883 - DNA, 14 bp, Homo sapiens
gctctagtgggaag

SEQ ID NO: 2019884 - DNA, 13 bp, Homo sapiens
gctctagttcaaa

SEQ ID NO: 2019885 - DNA, 19 bp, Homo sapiens
gctctatttccccacccca

SEQ ID NO: 2019886 - DNA, 10 bp, Homo sapiens
gctctcagcc

SEQ ID NO: 2019887 - DNA, 14 bp, Homo sapiens
gctctcagcctccc

SEQ ID NO: 2019888 - DNA, 22 bp, Homo sapiens
gctctccaaaggggctgctggg

SEQ ID NO: 2019889 - DNA, 16 bp, Homo sapiens
gctctccacctcagcc

SEQ ID NO: 2019890 - DNA, 18 bp, Homo sapiens
gctctccacctcagcctt

SEQ ID NO: 2019891 - DNA, 19 bp, Homo sapiens
gctctccacctcagccttg

SEQ ID NO: 2019892 - DNA, 14 bp, Homo sapiens
ggcagacaagagct

SEQ ID NO: 2019893 - DNA, 19 bp, Homo sapiens
ggcagacaagagctgctgt

SEQ ID NO: 2019894 - DNA, 13 bp, Homo sapiens
ggcagacagcagc

SEQ ID NO: 2019895 - DNA, 14 bp, Homo sapiens
ggcagacagcagct

SEQ ID NO: 2019896 - DNA, 17 bp, Homo sapiens
ggcagacagcagctcag

SEQ ID NO: 2019897 - DNA, 19 bp, Homo sapiens
ggcagaccgggggccagac

SEQ ID NO: 2019898 - DNA, 20 bp, Homo sapiens
ggcagaccgggggccagaca

SEQ ID NO: 2019899 - DNA, 16 bp, Homo sapiens
ggcagagaaggcctct

SEQ ID NO: 2019900 - DNA, 22 bp, Homo sapiens
ggcagagaaggcttcctccagc

SEQ ID NO: 2019901 - DNA, 18 bp, Homo sapiens
ggcagagacaataaaaca

SEQ ID NO: 2019902 - DNA, 14 bp, Homo sapiens
ggcagagccatggg

SEQ ID NO: 2019903 - DNA, 19 bp, Homo sapiens
ggcagagcggggaggtgcc

SEQ ID NO: 2019904 - DNA, 13 bp, Homo sapiens
ggcagaggctgga

SEQ ID NO: 2019905 - DNA, 21 bp, Homo sapiens
ggcagaggctggaggcagggc

SEQ ID NO: 2019906 - DNA, 22 bp, Homo sapiens
ggcagaggctggaggcagggcc

SEQ ID NO: 2019907 - DNA, 22 bp, Homo sapiens
ggcagagggaatgttccctgca

SEQ ID NO: 2019908 - DNA, 14 bp, Homo sapiens
ggcagagggcagag

SEQ ID NO: 2019909 - DNA, 19 bp, Homo sapiens
ggcagagggcagaggctgg

SEQ ID NO: 2019910 - DNA, 20 bp, Homo sapiens
ggcagagggcagaggctgga

SEQ ID NO: 2019911 - DNA, 23 bp, Homo sapiens
ggcagatacaggaaaagctgctg

SEQ ID NO: 2019912 - DNA, 22 bp, Homo sapiens
ggcagcaaggcccgagcagctg

SEQ ID NO: 2019913 - DNA, 13 bp, Homo sapiens
ggcagcaccctcc

SEQ ID NO: 2019914 - DNA, 12 bp, Homo sapiens
ggcagcagccag

SEQ ID NO: 2019915 - DNA, 14 bp, Homo sapiens
ggcagcagccagcc

SEQ ID NO: 2019916 - DNA, 16 bp, Homo sapiens
ggcagcagccagccct

SEQ ID NO: 2019917 - DNA, 18 bp, Homo sapiens
ggcagcagccagccctgc

SEQ ID NO: 2019918 - DNA, 16 bp, Homo sapiens
ggcagcagctcagcct

SEQ ID NO: 2019919 - DNA, 22 bp, Homo sapiens
ggcagcagctcagcctcccccc

SEQ ID NO: 2019920 - DNA, 17 bp, Homo sapiens
ggcagcatagcaagaca

SEQ ID NO: 2019921 - DNA, 17 bp, Homo sapiens
ggcagcatggagagcct

SEQ ID NO: 2019922 - DNA, 19 bp, Homo sapiens
ggcagccaaacccatgagg

SEQ ID NO: 2019923 - DNA, 22 bp, Homo sapiens
ggcagcccagcctctgtccctc

SEQ ID NO: 2019924 - DNA, 21 bp, Homo sapiens
ggcagccccattctgcctgcc

SEQ ID NO: 2019925 - DNA, 17 bp, Homo sapiens
ggcagccgctaggagag

SEQ ID NO: 2019926 - DNA, 23 bp, Homo sapiens
ggcagccgctaggagagactgaa

SEQ ID NO: 2019927 - DNA, 18 bp, Homo sapiens
ggcagccgtgccttcagc

SEQ ID NO: 2019928 - DNA, 22 bp, Homo sapiens
ggcagccgtgccttcagctcta

SEQ ID NO: 2019929 - DNA, 20 bp, Homo sapiens
ggcagcctcaggggcctcag

SEQ ID NO: 2019930 - DNA, 22 bp, Homo sapiens
ggcagcctccaccttgctcttc

SEQ ID NO: 2019931 - DNA, 15 bp, Homo sapiens
ggcagcctccagagc

SEQ ID NO: 2019932 - DNA, 17 bp, Homo sapiens
ggcagcctccagagcca

SEQ ID NO: 2019933 - DNA, 19 bp, Homo sapiens
ggcagcctccagagccagc

SEQ ID NO: 2019934 - DNA, 20 bp, Homo sapiens
ggcagcctccagagccagcc

SEQ ID NO: 2019935 - DNA, 21 bp, Homo sapiens
ggcagcctccagagccagcct

SEQ ID NO: 2019936 - DNA, 22 bp, Homo sapiens
ggcagcctccagagccagcctg

SEQ ID NO: 2019937 - DNA, 24 bp, Homo sapiens
ggcagcctccagagccagcctggg

SEQ ID NO: 2019938 - DNA, 12 bp, Homo sapiens
ggcagcctgccg

SEQ ID NO: 2019939 - DNA, 22 bp, Homo sapiens
ggcagcctgccgccgtctctgt

SEQ ID NO: 2019940 - DNA, 14 bp, Homo sapiens
ggcagctagactgg

SEQ ID NO: 2019941 - DNA, 18 bp, Homo sapiens
ggcagctccaacagcttg

SEQ ID NO: 2019942 - DNA, 21 bp, Homo sapiens
ggcagctcctctgtctcgagc

SEQ ID NO: 2019943 - DNA, 19 bp, Homo sapiens
ggcagctgcggtccaccca

SEQ ID NO: 2019944 - DNA, 23 bp, Homo sapiens
ggcagctgcggtccacccaggag

SEQ ID NO: 2019945 - DNA, 24 bp, Homo sapiens
ggcagctgcggtccacccaggagc

SEQ ID NO: 2019946 - DNA, 22 bp, Homo sapiens
ggcagctgctcttagtgcccgc

SEQ ID NO: 2019947 - DNA, 23 bp, Homo sapiens
ggcagctgctcttagtgcccgcc

SEQ ID NO: 2019948 - DNA, 22 bp, Homo sapiens
ggcagctgcttttgtctatggg

SEQ ID NO: 2019949 - DNA, 20 bp, Homo sapiens
ggcagctgggccccacctac

SEQ ID NO: 2019950 - DNA, 21 bp, Homo sapiens
ggcagctgtcatggaaaagcc

SEQ ID NO: 2019951 - DNA, 22 bp, Homo sapiens
ggcagctgtcccctctccctgg

SEQ ID NO: 2019952 - DNA, 14 bp, Homo sapiens
ggcagcttgagcct

SEQ ID NO: 2019953 - DNA, 16 bp, Homo sapiens
ggcagcttgagcctgt

SEQ ID NO: 2019954 - DNA, 17 bp, Homo sapiens
ggcagcttgagcctgtc

SEQ ID NO: 2019955 - DNA, 19 bp, Homo sapiens
ggcagcttgagcctgtcac

SEQ ID NO: 2019956 - DNA, 20 bp, Homo sapiens
ggcagcttgagcctgtcacg

SEQ ID NO: 2019957 - DNA, 17 bp, Homo sapiens
ggcagcttgagggttgg

SEQ ID NO: 2019958 - DNA, 22 bp, Homo sapiens
ggcaggaagagagagagagagg

SEQ ID NO: 2019959 - DNA, 12 bp, Homo sapiens
ggcaggacacat

SEQ ID NO: 2019960 - DNA, 21 bp, Homo sapiens
ggcaggacacatcccggcctc

SEQ ID NO: 2019961 - DNA, 15 bp, Homo sapiens
ggcaggaccaggact

SEQ ID NO: 2019962 - DNA, 13 bp, Homo sapiens
ggcaggagcagga

SEQ ID NO: 2019963 - DNA, 24 bp, Homo sapiens
ggcaggaggattgcttgagcccag

SEQ ID NO: 2019964 - DNA, 14 bp, Homo sapiens
ggcaggaggcctgg

SEQ ID NO: 2019965 - DNA, 18 bp, Homo sapiens
ggcaggaggcctggcctt

SEQ ID NO: 2019966 - DNA, 14 bp, Homo sapiens
ggcaggagtagctg

SEQ ID NO: 2019967 - DNA, 17 bp, Homo sapiens
ggcaggagtagctgagc

SEQ ID NO: 2019968 - DNA, 19 bp, Homo sapiens
ggcaggagtagctgagctc

SEQ ID NO: 2019969 - DNA, 19 bp, Homo sapiens
ggcaggcacacagcagccc

SEQ ID NO: 2019970 - DNA, 20 bp, Homo sapiens
ggcaggcagatcacaaggtc

SEQ ID NO: 2019971 - DNA, 14 bp, Homo sapiens
ggcaggcagggctc

SEQ ID NO: 2019972 - DNA, 22 bp, Homo sapiens
ggcaggcagggctctcctggct

SEQ ID NO: 2019973 - DNA, 13 bp, Homo sapiens
ggcaggcctggga

SEQ ID NO: 2019974 - DNA, 14 bp, Homo sapiens
ggcaggcctgggac

SEQ ID NO: 2019975 - DNA, 16 bp, Homo sapiens
ggcaggctggctggcc

SEQ ID NO: 2019976 - DNA, 15 bp, Homo sapiens
ggcagggatttgagg

SEQ ID NO: 2019977 - DNA, 14 bp, Homo sapiens
ggcagggcagaggg

SEQ ID NO: 2019978 - DNA, 16 bp, Homo sapiens
ggcagggccttgccca

SEQ ID NO: 2019979 - DNA, 18 bp, Homo sapiens
ggcagggccttgcccaga

SEQ ID NO: 2019980 - DNA, 21 bp, Homo sapiens
ggcagggccttgcccagagat

SEQ ID NO: 2019981 - DNA, 16 bp, Homo sapiens
ggcagggctctcctgg

SEQ ID NO: 2019982 - DNA, 18 bp, Homo sapiens
ggcagggctctcctggct

SEQ ID NO: 2019983 - DNA, 19 bp, Homo sapiens
ggcagggctctcctggctt

SEQ ID NO: 2019984 - DNA, 18 bp, Homo sapiens
ggcaggggtgggagagcc

SEQ ID NO: 2019985 - DNA, 15 bp, Homo sapiens
ggcagggtcaggaga

SEQ ID NO: 2019986 - DNA, 17 bp, Homo sapiens
ggcagggtctcactctg

SEQ ID NO: 2019987 - DNA, 21 bp, Homo sapiens
ggcaggtagatcgcttgagcc

SEQ ID NO: 2019988 - DNA, 13 bp, Homo sapiens
ggcaggtccaggg

SEQ ID NO: 2019989 - DNA, 23 bp, Homo sapiens
ggcaggtcttgaactcctggcct

SEQ ID NO: 2019990 - DNA, 23 bp, Homo sapiens
ggcagtacctgggaaaggaccca

SEQ ID NO: 2019991 - DNA, 17 bp, Homo sapiens
ggcagtcatactggggt

SEQ ID NO: 2019992 - DNA, 22 bp, Homo sapiens
ggcagtcattcagcaccagagc

SEQ ID NO: 2019993 - DNA, 17 bp, Homo sapiens
ggcagtccagccagctc

SEQ ID NO: 2019994 - DNA, 23 bp, Homo sapiens
ggcagtgaacacactcagcagcc

SEQ ID NO: 2019995 - DNA, 24 bp, Homo sapiens
ggcagtgaacacactcagcagccc

SEQ ID NO: 2019996 - DNA, 13 bp, Homo sapiens
ggcagtgacaagt

SEQ ID NO: 2019997 - DNA, 19 bp, Homo sapiens
ggcagtgacaagtggaggg

SEQ ID NO: 2019998 - DNA, 14 bp, Homo sapiens
ggcagtgactggca

SEQ ID NO: 2019999 - DNA, 22 bp, Homo sapiens
ggcccataccttctggttgctt

SEQ ID NO: 2020000 - DNA, 22 bp, Homo sapiens
ggcccatctcaggtgccactcc

SEQ ID NO: 2020001 - DNA, 21 bp, Homo sapiens
ggccccagatctgcctgggcc

SEQ ID NO: 2020002 - DNA, 13 bp, Homo sapiens
ggccccaggccct

SEQ ID NO: 2020003 - DNA, 13 bp, Homo sapiens
ggccccagggttg

SEQ ID NO: 2020004 - DNA, 20 bp, Homo sapiens
ggccccaggtgccaccaata

SEQ ID NO: 2020005 - DNA, 22 bp, Homo sapiens
ggccccaggtgccaccaataaa

SEQ ID NO: 2020006 - DNA, 17 bp, Homo sapiens
ggccccatgctctgccc

SEQ ID NO: 2020007 - DNA, 18 bp, Homo sapiens
ggccccatgctctgcccc

SEQ ID NO: 2020008 - DNA, 21 bp, Homo sapiens
ggccccatgctctgccccaag

SEQ ID NO: 2020009 - DNA, 20 bp, Homo sapiens
ggccccccacacgcgtgtgt

SEQ ID NO: 2020010 - DNA, 14 bp, Homo sapiens
ggcccccccagctg

SEQ ID NO: 2020011 - DNA, 19 bp, Homo sapiens
ggcccccgctggctcctcc

SEQ ID NO: 2020012 - DNA, 20 bp, Homo sapiens
ggccccctgtgccagctcag

SEQ ID NO: 2020013 - DNA, 21 bp, Homo sapiens
ggccccctgtgccagctcagg

SEQ ID NO: 2020014 - DNA, 19 bp, Homo sapiens
ggccccgcttgtccagcgc

SEQ ID NO: 2020015 - DNA, 23 bp, Homo sapiens
ggccccgggctctggccaccctg

SEQ ID NO: 2020016 - DNA, 19 bp, Homo sapiens
ggccccggggctggcaagc

SEQ ID NO: 2020017 - DNA, 12 bp, Homo sapiens
ggcccctccacg

SEQ ID NO: 2020018 - DNA, 14 bp, Homo sapiens
ggcccctccagacc

SEQ ID NO: 2020019 - DNA, 18 bp, Homo sapiens
ggcccctccctctgcccc

SEQ ID NO: 2020020 - DNA, 21 bp, Homo sapiens
ggcccctccctctgccccaag

SEQ ID NO: 2020021 - DNA, 15 bp, Homo sapiens
ggcccctgaggactg

SEQ ID NO: 2020022 - DNA, 16 bp, Homo sapiens
ggcccctgaggactgg

SEQ ID NO: 2020023 - DNA, 13 bp, Homo sapiens
ggcccctgctggt

SEQ ID NO: 2020024 - DNA, 12 bp, Homo sapiens
ggcccctgggat

SEQ ID NO: 2020025 - DNA, 13 bp, Homo sapiens
ggcccctgggatg

SEQ ID NO: 2020026 - DNA, 20 bp, Homo sapiens
ggcccctgggatgggaccag

SEQ ID NO: 2020027 - DNA, 15 bp, Homo sapiens
ggcccgacagcctgg

SEQ ID NO: 2020028 - DNA, 20 bp, Homo sapiens
ggcccgagcagctgagcagg

SEQ ID NO: 2020029 - DNA, 14 bp, Homo sapiens
ggcccgcccctcgc

SEQ ID NO: 2020030 - DNA, 15 bp, Homo sapiens
ggcccggctccaggc

SEQ ID NO: 2020031 - DNA, 22 bp, Homo sapiens
ggccctaacgggggtgcggcag

SEQ ID NO: 2020032 - DNA, 15 bp, Homo sapiens
ggccctaagatgcct

SEQ ID NO: 2020033 - DNA, 16 bp, Homo sapiens
ggccctccatgggcta

SEQ ID NO: 2020034 - DNA, 11 bp, Homo sapiens
ggccctccctg

SEQ ID NO: 2020035 - DNA, 13 bp, Homo sapiens
ggccctccctgac

SEQ ID NO: 2020036 - DNA, 16 bp, Homo sapiens
ggccctgccccatcct

SEQ ID NO: 2020037 - DNA, 18 bp, Homo sapiens
ggccctgccccatcctgg

SEQ ID NO: 2020038 - DNA, 18 bp, Homo sapiens
ggccctggatcagcgtgg

SEQ ID NO: 2020039 - DNA, 19 bp, Homo sapiens
ggccctggatgtgcccaca

SEQ ID NO: 2020040 - DNA, 14 bp, Homo sapiens
ggccctggcctgct

SEQ ID NO: 2020041 - DNA, 15 bp, Homo sapiens
ggccctggcctgctg

SEQ ID NO: 2020042 - DNA, 17 bp, Homo sapiens
ggccctggcctgctggg

SEQ ID NO: 2020043 - DNA, 13 bp, Homo sapiens
ggccctgggcctc

SEQ ID NO: 2020044 - DNA, 16 bp, Homo sapiens
ggccctgggcctcagt

SEQ ID NO: 2020045 - DNA, 16 bp, Homo sapiens
ggccctggggcctgta

SEQ ID NO: 2020046 - DNA, 17 bp, Homo sapiens
ggccctggtccttccag

SEQ ID NO: 2020047 - DNA, 19 bp, Homo sapiens
ggccctgtcccagcagaag

SEQ ID NO: 2020048 - DNA, 15 bp, Homo sapiens
ggcccttcctctcca

SEQ ID NO: 2020049 - DNA, 18 bp, Homo sapiens
ggcccttcctctccactg

SEQ ID NO: 2020050 - DNA, 19 bp, Homo sapiens
ggcccttcctctccactgc

SEQ ID NO: 2020051 - DNA, 14 bp, Homo sapiens
ggcccttcctggac

SEQ ID NO: 2020052 - DNA, 21 bp, Homo sapiens
ggcccttcctggacagctgtg

SEQ ID NO: 2020053 - DNA, 16 bp, Homo sapiens
ggcccttggggcctgg

SEQ ID NO: 2020054 - DNA, 19 bp, Homo sapiens
ggcccttggggcctggctt

SEQ ID NO: 2020055 - DNA, 20 bp, Homo sapiens
ggcccttggggcctggcttg

SEQ ID NO: 2020056 - DNA, 18 bp, Homo sapiens
ggcccttgtcctgccagc

SEQ ID NO: 2020057 - DNA, 21 bp, Homo sapiens
ggcccttgtcctgccagctgc

SEQ ID NO: 2020058 - DNA, 18 bp, Homo sapiens
ggccgaagctaacaggga

SEQ ID NO: 2020059 - DNA, 17 bp, Homo sapiens
ggccgactcagggacct

SEQ ID NO: 2020060 - DNA, 18 bp, Homo sapiens
ggccgcaagcgcagggag

SEQ ID NO: 2020061 - DNA, 16 bp, Homo sapiens
ggccgcattccctgag

SEQ ID NO: 2020062 - DNA, 15 bp, Homo sapiens
ggccgccatccggga

SEQ ID NO: 2020063 - DNA, 15 bp, Homo sapiens
ggccgcctccaggag

SEQ ID NO: 2020064 - DNA, 16 bp, Homo sapiens
ggccgctgccccagcc

SEQ ID NO: 2020065 - DNA, 21 bp, Homo sapiens
ggccgctggcccagggtaggg

SEQ ID NO: 2020066 - DNA, 16 bp, Homo sapiens
ggccgctgttcaccca

SEQ ID NO: 2020067 - DNA, 17 bp, Homo sapiens
ggccggcccaggcctcc

SEQ ID NO: 2020068 - DNA, 18 bp, Homo sapiens
ggccggggaactggccaa

SEQ ID NO: 2020069 - DNA, 19 bp, Homo sapiens
ggccggggaactggccaag

SEQ ID NO: 2020070 - DNA, 22 bp, Homo sapiens
ggccgtggccatcagggtgggc

SEQ ID NO: 2020071 - DNA, 16 bp, Homo sapiens
ggccgttccccttggc

SEQ ID NO: 2020072 - DNA, 22 bp, Homo sapiens
ggccgttccccttggcttcctc

SEQ ID NO: 2020073 - DNA, 17 bp, Homo sapiens
ggcctaggacctcaggc

SEQ ID NO: 2020074 - DNA, 21 bp, Homo sapiens
ggcctatgcacatatggactc

SEQ ID NO: 2020075 - DNA, 22 bp, Homo sapiens
ggcctatggagagccctgggac

SEQ ID NO: 2020076 - DNA, 22 bp, Homo sapiens
ggcctcaagtgattctcctgcc

SEQ ID NO: 2020077 - DNA, 23 bp, Homo sapiens
ggcctcaagtgattctcctgcct

SEQ ID NO: 2020078 - DNA, 14 bp, Homo sapiens
ggcctcacacccag

SEQ ID NO: 2020079 - DNA, 14 bp, Homo sapiens
ggcctcacttccct

SEQ ID NO: 2020080 - DNA, 18 bp, Homo sapiens
ggcctcacttccctggga

SEQ ID NO: 2020081 - DNA, 19 bp, Homo sapiens
ggcctcacttccctgggaa

SEQ ID NO: 2020082 - DNA, 23 bp, Homo sapiens
ggcctcagaccaactctctcctg

SEQ ID NO: 2020083 - DNA, 17 bp, Homo sapiens
ggcctcagcacccctgt

SEQ ID NO: 2020084 - DNA, 14 bp, Homo sapiens
ggcctcagccctca

SEQ ID NO: 2020085 - DNA, 19 bp, Homo sapiens
ggcctcaggggagccccca

SEQ ID NO: 2020086 - DNA, 13 bp, Homo sapiens
ggcctcagtgcca

SEQ ID NO: 2020087 - DNA, 13 bp, Homo sapiens
ggcctcagtttcc

SEQ ID NO: 2020088 - DNA, 19 bp, Homo sapiens
ggcctcagtttctccatca

SEQ ID NO: 2020089 - DNA, 13 bp, Homo sapiens
ggcctcatccctc

SEQ ID NO: 2020090 - DNA, 14 bp, Homo sapiens
ggcctccactcccc

SEQ ID NO: 2020091 - DNA, 16 bp, Homo sapiens
ggcctccactccccca

SEQ ID NO: 2020092 - DNA, 14 bp, Homo sapiens
ggcctccagcctct

SEQ ID NO: 2020093 - DNA, 23 bp, Homo sapiens
ggcctccagcctctcccggctgc

SEQ ID NO: 2020094 - DNA, 20 bp, Homo sapiens
ggcctcccaaggtgctagga

SEQ ID NO: 2020095 - DNA, 19 bp, Homo sapiens
ggcctcccaataaagctgg

SEQ ID NO: 2020096 - DNA, 16 bp, Homo sapiens
ggcctccccccagccc

SEQ ID NO: 2020097 - DNA, 19 bp, Homo sapiens
ggcctccccccagcccctc

SEQ ID NO: 2020098 - DNA, 23 bp, Homo sapiens
ggcctccccccagcccctcctcc

SEQ ID NO: 2020099 - DNA, 22 bp, Homo sapiens
ggcctccgtcatgaatgccttc

SEQ ID NO: 2020100 - DNA, 19 bp, Homo sapiens
ggcctcctctgtccagggc

SEQ ID NO: 2020101 - DNA, 13 bp, Homo sapiens
ggcctcctgcctc

SEQ ID NO: 2020102 - DNA, 15 bp, Homo sapiens
ggcctcctgcctcta

SEQ ID NO: 2020103 - DNA, 14 bp, Homo sapiens
ggcctcctgtgtgt

SEQ ID NO: 2020104 - DNA, 22 bp, Homo sapiens
ggcctcggagcctcatccgagg

SEQ ID NO: 2020105 - DNA, 16 bp, Homo sapiens
ggcctcgggacacctg

SEQ ID NO: 2020106 - DNA, 22 bp, Homo sapiens
ggcctcttggacctctgctctg

SEQ ID NO: 2020107 - DNA, 16 bp, Homo sapiens
ggcctcttgtgctcac

SEQ ID NO: 2020108 - DNA, 20 bp, Homo sapiens
ggcctctttctgtgcttctc

SEQ ID NO: 2020109 - DNA, 21 bp, Homo sapiens
ggcctgaaccacagcggagga

SEQ ID NO: 2020110 - DNA, 12 bp, Homo sapiens
ggcctgagctgg

SEQ ID NO: 2020111 - DNA, 13 bp, Homo sapiens
ggcctgagctggg

SEQ ID NO: 2020112 - DNA, 16 bp, Homo sapiens
ggcctgagctggggcc

SEQ ID NO: 2020113 - DNA, 13 bp, Homo sapiens
ggcctgatgctgc

SEQ ID NO: 2020114 - DNA, 15 bp, Homo sapiens
ggcctgatgctgccc

SEQ ID NO: 2020115 - DNA, 17 bp, Homo sapiens
ggcagtgcctcctggga

SEQ ID NO: 2020116 - DNA, 18 bp, Homo sapiens
ggcagtgcctcctgggac

SEQ ID NO: 2020117 - DNA, 17 bp, Homo sapiens
ggcagtgggagctgcct

SEQ ID NO: 2020118 - DNA, 18 bp, Homo sapiens
ggcagtgggagctgcctg

SEQ ID NO: 2020119 - DNA, 20 bp, Homo sapiens
ggcagtggtaagctctggct

SEQ ID NO: 2020120 - DNA, 21 bp, Homo sapiens
ggcagttcgcagccaccctga

SEQ ID NO: 2020121 - DNA, 19 bp, Homo sapiens
ggcatacaacctgagcctt

SEQ ID NO: 2020122 - DNA, 14 bp, Homo sapiens
ggcatcacagggca

SEQ ID NO: 2020123 - DNA, 16 bp, Homo sapiens
ggcatcacagggcaga

SEQ ID NO: 2020124 - DNA, 15 bp, Homo sapiens
ggcatcaggcactgg

SEQ ID NO: 2020125 - DNA, 19 bp, Homo sapiens
ggcatccacccagtgctgc

SEQ ID NO: 2020126 - DNA, 20 bp, Homo sapiens
ggcatccacccagtgctgcc

SEQ ID NO: 2020127 - DNA, 15 bp, Homo sapiens
ggcatcccaggggac

SEQ ID NO: 2020128 - DNA, 24 bp, Homo sapiens
ggcatcccatgggggtgctgcagc

SEQ ID NO: 2020129 - DNA, 13 bp, Homo sapiens
ggcatcctgcccc

SEQ ID NO: 2020130 - DNA, 18 bp, Homo sapiens
ggcatctacacagcctgg

SEQ ID NO: 2020131 - DNA, 22 bp, Homo sapiens
ggcatctacacagcctggactt

SEQ ID NO: 2020132 - DNA, 15 bp, Homo sapiens
ggcatctctaattgg

SEQ ID NO: 2020133 - DNA, 18 bp, Homo sapiens
ggcatctctaattggaag

SEQ ID NO: 2020134 - DNA, 23 bp, Homo sapiens
ggcatgacactctagtgacttcc

SEQ ID NO: 2020135 - DNA, 15 bp, Homo sapiens
ggcatgaccatcctg

SEQ ID NO: 2020136 - DNA, 21 bp, Homo sapiens
ggcatgatttatatatggcat

SEQ ID NO: 2020137 - DNA, 23 bp, Homo sapiens
ggcatgcctctgatatgggactg

SEQ ID NO: 2020138 - DNA, 10 bp, Homo sapiens
ggcatgctgg

SEQ ID NO: 2020139 - DNA, 17 bp, Homo sapiens
ggcatgctggcctgtgg

SEQ ID NO: 2020140 - DNA, 21 bp, Homo sapiens
ggcatgctggcctgtggcagg

SEQ ID NO: 2020141 - DNA, 17 bp, Homo sapiens
ggcatggccaggtggcc

SEQ ID NO: 2020142 - DNA, 12 bp, Homo sapiens
ggcatggccctg

SEQ ID NO: 2020143 - DNA, 17 bp, Homo sapiens
ggcatggcgaggctgag

SEQ ID NO: 2020144 - DNA, 14 bp, Homo sapiens
ggcatggctgggaa

SEQ ID NO: 2020145 - DNA, 19 bp, Homo sapiens
ggcatggtggcgcaagcct

SEQ ID NO: 2020146 - DNA, 21 bp, Homo sapiens
ggcatggttccttccctggga

SEQ ID NO: 2020147 - DNA, 22 bp, Homo sapiens
ggcatggttccttccctgggaa

SEQ ID NO: 2020148 - DNA, 19 bp, Homo sapiens
ggcatgtcagagccaggct

SEQ ID NO: 2020149 - DNA, 23 bp, Homo sapiens
ggcatgtgaattctgtgaagaat

SEQ ID NO: 2020150 - DNA, 15 bp, Homo sapiens
ggcatgtgtgcctgt

SEQ ID NO: 2020151 - DNA, 18 bp, Homo sapiens
ggccaaaagggcagccag

SEQ ID NO: 2020152 - DNA, 19 bp, Homo sapiens
ggccaaatgcacaagctca

SEQ ID NO: 2020153 - DNA, 21 bp, Homo sapiens
ggccaaattatttgtgtaata

SEQ ID NO: 2020154 - DNA, 23 bp, Homo sapiens
ggccaacatggtgaaaccctgta

SEQ ID NO: 2020155 - DNA, 15 bp, Homo sapiens
ggccaagcaagaggt

SEQ ID NO: 2020156 - DNA, 22 bp, Homo sapiens
ggccaagctgaagtgaaggaga

SEQ ID NO: 2020157 - DNA, 13 bp, Homo sapiens
ggccaaggcaggt

SEQ ID NO: 2020158 - DNA, 19 bp, Homo sapiens
ggccaattaaaatatatat

SEQ ID NO: 2020159 - DNA, 22 bp, Homo sapiens
ggccacaaatcaaagcaagggc

SEQ ID NO: 2020160 - DNA, 20 bp, Homo sapiens
ggccaccccgtgccacccgt

SEQ ID NO: 2020161 - DNA, 21 bp, Homo sapiens
ggccacccgttctgctggcct

SEQ ID NO: 2020162 - DNA, 23 bp, Homo sapiens
ggccacccgttctgctggcctgg

SEQ ID NO: 2020163 - DNA, 10 bp, Homo sapiens
ggccaccctc

SEQ ID NO: 2020164 - DNA, 15 bp, Homo sapiens
ggccaccctccttcc

SEQ ID NO: 2020165 - DNA, 16 bp, Homo sapiens
ggccaccctccttccc

SEQ ID NO: 2020166 - DNA, 19 bp, Homo sapiens
ggccaccctccttcccgcc

SEQ ID NO: 2020167 - DNA, 13 bp, Homo sapiens
ggccaccctggcc

SEQ ID NO: 2020168 - DNA, 19 bp, Homo sapiens
ggccaccgggacagacctg

SEQ ID NO: 2020169 - DNA, 18 bp, Homo sapiens
ggccacgtgccaggcccg

SEQ ID NO: 2020170 - DNA, 19 bp, Homo sapiens
ggccactccttcctgcccc

SEQ ID NO: 2020171 - DNA, 21 bp, Homo sapiens
ggccactctcccctccctctt

SEQ ID NO: 2020172 - DNA, 14 bp, Homo sapiens
ggccactgtggcca

SEQ ID NO: 2020173 - DNA, 23 bp, Homo sapiens
ggccagaaactccttttgctgtc

SEQ ID NO: 2020174 - DNA, 14 bp, Homo sapiens
ggccagaaggaggg

SEQ ID NO: 2020175 - DNA, 15 bp, Homo sapiens
ggccagaaggagggc

SEQ ID NO: 2020176 - DNA, 13 bp, Homo sapiens
ggccagacacaga

SEQ ID NO: 2020177 - DNA, 16 bp, Homo sapiens
ggccagacgctgccgc

SEQ ID NO: 2020178 - DNA, 17 bp, Homo sapiens
ggccagacgctgccgct

SEQ ID NO: 2020179 - DNA, 18 bp, Homo sapiens
ggccagagagggcccagc

SEQ ID NO: 2020180 - DNA, 21 bp, Homo sapiens
ggccagagagggcccagctgt

SEQ ID NO: 2020181 - DNA, 16 bp, Homo sapiens
ggccagagctggaagg

SEQ ID NO: 2020182 - DNA, 17 bp, Homo sapiens
ggccagagctggaaggc

SEQ ID NO: 2020183 - DNA, 23 bp, Homo sapiens
ggccagagctggaaggcagggca

SEQ ID NO: 2020184 - DNA, 23 bp, Homo sapiens
ggccagagggagtgacagaggca

SEQ ID NO: 2020185 - DNA, 19 bp, Homo sapiens
ggccagatgcaccagccct

SEQ ID NO: 2020186 - DNA, 12 bp, Homo sapiens
ggccagcaccct

SEQ ID NO: 2020187 - DNA, 17 bp, Homo sapiens
ggccagcaccctctcct

SEQ ID NO: 2020188 - DNA, 19 bp, Homo sapiens
ggccagcaccctctcctgg

SEQ ID NO: 2020189 - DNA, 22 bp, Homo sapiens
ggccagccccatcttggtcctg

SEQ ID NO: 2020190 - DNA, 20 bp, Homo sapiens
ggccagcctcagctcagcct

SEQ ID NO: 2020191 - DNA, 13 bp, Homo sapiens
ggccagcctggcc

SEQ ID NO: 2020192 - DNA, 17 bp, Homo sapiens
ggccagcctggcctcct

SEQ ID NO: 2020193 - DNA, 20 bp, Homo sapiens
ggccagctgcatctactcag

SEQ ID NO: 2020194 - DNA, 15 bp, Homo sapiens
ggccaggacaggccc

SEQ ID NO: 2020195 - DNA, 11 bp, Homo sapiens
ggccaggagag

SEQ ID NO: 2020196 - DNA, 15 bp, Homo sapiens
ggccaggagctcagc

SEQ ID NO: 2020197 - DNA, 18 bp, Homo sapiens
ggccagggaaagcccgtg

SEQ ID NO: 2020198 - DNA, 13 bp, Homo sapiens
ggccagggccctg

SEQ ID NO: 2020199 - DNA, 18 bp, Homo sapiens
ggccagtcctagagctcc

SEQ ID NO: 2020200 - DNA, 20 bp, Homo sapiens
ggccagtcctagagctcctg

SEQ ID NO: 2020201 - DNA, 16 bp, Homo sapiens
ggccagtctgggctgc

SEQ ID NO: 2020202 - DNA, 13 bp, Homo sapiens
ggccagtgagggc

SEQ ID NO: 2020203 - DNA, 16 bp, Homo sapiens
ggccagtgagggctgg

SEQ ID NO: 2020204 - DNA, 18 bp, Homo sapiens
ggccagtgagggctgggc

SEQ ID NO: 2020205 - DNA, 13 bp, Homo sapiens
ggccagtgccagg

SEQ ID NO: 2020206 - DNA, 20 bp, Homo sapiens
ggccagtgccaggacagctg

SEQ ID NO: 2020207 - DNA, 19 bp, Homo sapiens
ggccatacttttgagaggg

SEQ ID NO: 2020208 - DNA, 13 bp, Homo sapiens
ggccatccctggg

SEQ ID NO: 2020209 - DNA, 19 bp, Homo sapiens
ggccatccctgggcccctc

SEQ ID NO: 2020210 - DNA, 20 bp, Homo sapiens
ggccatccctgggcccctcc

SEQ ID NO: 2020211 - DNA, 20 bp, Homo sapiens
ggccatgctttccttttctt

SEQ ID NO: 2020212 - DNA, 13 bp, Homo sapiens
ggcccacagctcc

SEQ ID NO: 2020213 - DNA, 15 bp, Homo sapiens
ggcccacagctccca

SEQ ID NO: 2020214 - DNA, 19 bp, Homo sapiens
ggcccacagctcccacccc

SEQ ID NO: 2020215 - DNA, 20 bp, Homo sapiens
ggcccacagctcccacccca

SEQ ID NO: 2020216 - DNA, 20 bp, Homo sapiens
ggcccacagggaaccctgct

SEQ ID NO: 2020217 - DNA, 12 bp, Homo sapiens
ggcccagaaact

SEQ ID NO: 2020218 - DNA, 23 bp, Homo sapiens
ggcccagagaccccttcctttcc

SEQ ID NO: 2020219 - DNA, 22 bp, Homo sapiens
ggcccagagctggaacactctc

SEQ ID NO: 2020220 - DNA, 15 bp, Homo sapiens
ggcccagcctgtcct

SEQ ID NO: 2020221 - DNA, 16 bp, Homo sapiens
ggcccagcctgtcctg

SEQ ID NO: 2020222 - DNA, 22 bp, Homo sapiens
ggcccagcctgtcctggtacag

SEQ ID NO: 2020223 - DNA, 14 bp, Homo sapiens
ggcccaggctctgg

SEQ ID NO: 2020224 - DNA, 17 bp, Homo sapiens
ggcccaggctctgggaa

SEQ ID NO: 2020225 - DNA, 20 bp, Homo sapiens
ggcccaggctctgggaaggg

SEQ ID NO: 2020226 - DNA, 23 bp, Homo sapiens
ggcccataatagttagccctcag

SEQ ID NO: 2020227 - DNA, 16 bp, Homo sapiens
gggacaaaggagcctg

SEQ ID NO: 2020228 - DNA, 11 bp, Homo sapiens
gggacacacac

SEQ ID NO: 2020229 - DNA, 15 bp, Homo sapiens
gggacacacacacac

SEQ ID NO: 2020230 - DNA, 16 bp, Homo sapiens
gggacaccccccgccc

SEQ ID NO: 2020231 - DNA, 17 bp, Homo sapiens
gggacacctgccctgcc

SEQ ID NO: 2020232 - DNA, 15 bp, Homo sapiens
gggacagacctggac

SEQ ID NO: 2020233 - DNA, 18 bp, Homo sapiens
gggacagagacacctgca

SEQ ID NO: 2020234 - DNA, 23 bp, Homo sapiens
gggacagagaggagttgccaggg

SEQ ID NO: 2020235 - DNA, 17 bp, Homo sapiens
gggacagccccagggcc

SEQ ID NO: 2020236 - DNA, 19 bp, Homo sapiens
gggacagccccagggccct

SEQ ID NO: 2020237 - DNA, 15 bp, Homo sapiens
gggacagggcttggg

SEQ ID NO: 2020238 - DNA, 20 bp, Homo sapiens
gggacattccaaagaacagc

SEQ ID NO: 2020239 - DNA, 19 bp, Homo sapiens
gggaccaaattgcttctag

SEQ ID NO: 2020240 - DNA, 15 bp, Homo sapiens
gggaccagggcatat

SEQ ID NO: 2020241 - DNA, 17 bp, Homo sapiens
gggaccatggacacatt

SEQ ID NO: 2020242 - DNA, 16 bp, Homo sapiens
gggaccattgacctca

SEQ ID NO: 2020243 - DNA, 21 bp, Homo sapiens
gggaccccagctagggctgga

SEQ ID NO: 2020244 - DNA, 19 bp, Homo sapiens
gggacccctcccaacctca

SEQ ID NO: 2020245 - DNA, 16 bp, Homo sapiens
gggaccctttccttcc

SEQ ID NO: 2020246 - DNA, 22 bp, Homo sapiens
gggaccgctacaccactctggc

SEQ ID NO: 2020247 - DNA, 18 bp, Homo sapiens
gggaccggtacagaaagg

SEQ ID NO: 2020248 - DNA, 14 bp, Homo sapiens
gggacgcttccaga

SEQ ID NO: 2020249 - DNA, 15 bp, Homo sapiens
gggacgcttccagac

SEQ ID NO: 2020250 - DNA, 18 bp, Homo sapiens
gggacgcttccagaccac

SEQ ID NO: 2020251 - DNA, 19 bp, Homo sapiens
gggacgcttccagaccacc

SEQ ID NO: 2020252 - DNA, 21 bp, Homo sapiens
gggacgcttccagaccacctg

SEQ ID NO: 2020253 - DNA, 16 bp, Homo sapiens
gggactcaatgcactg

SEQ ID NO: 2020254 - DNA, 23 bp, Homo sapiens
gggactcaatgcactgacattgt

SEQ ID NO: 2020255 - DNA, 18 bp, Homo sapiens
gggactcagcgtcccctg

SEQ ID NO: 2020256 - DNA, 23 bp, Homo sapiens
gggactgccagtccccctgcccc

SEQ ID NO: 2020257 - DNA, 20 bp, Homo sapiens
gggactggggatgtgggagg

SEQ ID NO: 2020258 - DNA, 15 bp, Homo sapiens
gggactgtgcctttg

SEQ ID NO: 2020259 - DNA, 18 bp, Homo sapiens
gggacttggaagctccgc

SEQ ID NO: 2020260 - DNA, 23 bp, Homo sapiens
gggacttggaagctccgctttct

SEQ ID NO: 2020261 - DNA, 10 bp, Homo sapiens
gggagaaaac

SEQ ID NO: 2020262 - DNA, 15 bp, Homo sapiens
gggagaaagggcaaa

SEQ ID NO: 2020263 - DNA, 16 bp, Homo sapiens
gggagaagaaatccat

SEQ ID NO: 2020264 - DNA, 18 bp, Homo sapiens
gggagaagggccagccct

SEQ ID NO: 2020265 - DNA, 20 bp, Homo sapiens
gggagagacactcccaggga

SEQ ID NO: 2020266 - DNA, 12 bp, Homo sapiens
gggagagactct

SEQ ID NO: 2020267 - DNA, 14 bp, Homo sapiens
gggagaggggagac

SEQ ID NO: 2020268 - DNA, 19 bp, Homo sapiens
gggagatggagttcttgtg

SEQ ID NO: 2020269 - DNA, 15 bp, Homo sapiens
gggagcaactctcca

SEQ ID NO: 2020270 - DNA, 23 bp, Homo sapiens
gggagcacttgcgtcctgcagag

SEQ ID NO: 2020271 - DNA, 16 bp, Homo sapiens
gggagcagagtatagg

SEQ ID NO: 2020272 - DNA, 21 bp, Homo sapiens
gggagcaggtctctggcagag

SEQ ID NO: 2020273 - DNA, 22 bp, Homo sapiens
gggagcaggtctctggcagaga

SEQ ID NO: 2020274 - DNA, 20 bp, Homo sapiens
gggagcagtgtcttccataa

SEQ ID NO: 2020275 - DNA, 16 bp, Homo sapiens
gggagcatggctgtga

SEQ ID NO: 2020276 - DNA, 17 bp, Homo sapiens
gggagcccctaggaaag

SEQ ID NO: 2020277 - DNA, 19 bp, Homo sapiens
gggagcccctaggaaagca

SEQ ID NO: 2020278 - DNA, 13 bp, Homo sapiens
gggagcctccccc

SEQ ID NO: 2020279 - DNA, 13 bp, Homo sapiens
gggagctgcctgt

SEQ ID NO: 2020280 - DNA, 21 bp, Homo sapiens
gggagctgcctgttcagctcc

SEQ ID NO: 2020281 - DNA, 12 bp, Homo sapiens
gggagctggaaa

SEQ ID NO: 2020282 - DNA, 13 bp, Homo sapiens
gggagctggaaat

SEQ ID NO: 2020283 - DNA, 14 bp, Homo sapiens
gggagctgggcttc

SEQ ID NO: 2020284 - DNA, 16 bp, Homo sapiens
gggaggaaaagaaaag

SEQ ID NO: 2020285 - DNA, 23 bp, Homo sapiens
gggaggaagcaggttgaggggct

SEQ ID NO: 2020286 - DNA, 19 bp, Homo sapiens
gggaggaagggccaggaga

SEQ ID NO: 2020287 - DNA, 21 bp, Homo sapiens
gggaggaagggccaggagaga

SEQ ID NO: 2020288 - DNA, 12 bp, Homo sapiens
gggaggactccg

SEQ ID NO: 2020289 - DNA, 15 bp, Homo sapiens
gggaggaggagctgc

SEQ ID NO: 2020290 - DNA, 18 bp, Homo sapiens
gggaggaggagctgccgc

SEQ ID NO: 2020291 - DNA, 19 bp, Homo sapiens
gggaggatgccacagcccc

SEQ ID NO: 2020292 - DNA, 21 bp, Homo sapiens
gggaggatgccacagccccac

SEQ ID NO: 2020293 - DNA, 14 bp, Homo sapiens
gggaggcaccagct

SEQ ID NO: 2020294 - DNA, 23 bp, Homo sapiens
gggaggcaccagctctgtggcct

SEQ ID NO: 2020295 - DNA, 17 bp, Homo sapiens
gggaggcatggccctgg

SEQ ID NO: 2020296 - DNA, 13 bp, Homo sapiens
gggaggcctcagt

SEQ ID NO: 2020297 - DNA, 23 bp, Homo sapiens
gggaggcctcgtaccagccagga

SEQ ID NO: 2020298 - DNA, 18 bp, Homo sapiens
gggaggcggagagtacag

SEQ ID NO: 2020299 - DNA, 20 bp, Homo sapiens
gggaggcggagagtacagtg

SEQ ID NO: 2020300 - DNA, 20 bp, Homo sapiens
gggaggcttttggtggtccc

SEQ ID NO: 2020301 - DNA, 24 bp, Homo sapiens
gggagggacagggcttggggagca

SEQ ID NO: 2020302 - DNA, 12 bp, Homo sapiens
gggagggctctg

SEQ ID NO: 2020303 - DNA, 15 bp, Homo sapiens
gggagggctctgagg

SEQ ID NO: 2020304 - DNA, 16 bp, Homo sapiens
gggagggctctgaggc

SEQ ID NO: 2020305 - DNA, 18 bp, Homo sapiens
gggagggctctgaggcgc

SEQ ID NO: 2020306 - DNA, 22 bp, Homo sapiens
gggaggggtaaaattccttagc

SEQ ID NO: 2020307 - DNA, 15 bp, Homo sapiens
gggaggtcgaggtag

SEQ ID NO: 2020308 - DNA, 17 bp, Homo sapiens
gcaggctcagactctgg

SEQ ID NO: 2020309 - DNA, 15 bp, Homo sapiens
gcaggctctgggctc

SEQ ID NO: 2020310 - DNA, 19 bp, Homo sapiens
gcaggctctgggctcaggg

SEQ ID NO: 2020311 - DNA, 14 bp, Homo sapiens
gcagggacaaagag

SEQ ID NO: 2020312 - DNA, 15 bp, Homo sapiens
gcagggacaaagagg

SEQ ID NO: 2020313 - DNA, 22 bp, Homo sapiens
gcagggacaccccccgcccccc

SEQ ID NO: 2020314 - DNA, 17 bp, Homo sapiens
gcagggacggggactgg

SEQ ID NO: 2020315 - DNA, 19 bp, Homo sapiens
gcagggagcaactctccac

SEQ ID NO: 2020316 - DNA, 22 bp, Homo sapiens
gcagggagccgagatcacgcca

SEQ ID NO: 2020317 - DNA, 20 bp, Homo sapiens
gcagggaggatgccacagcc

SEQ ID NO: 2020318 - DNA, 21 bp, Homo sapiens
gcagggaggatgccacagccc

SEQ ID NO: 2020319 - DNA, 15 bp, Homo sapiens
gcagggatttgagga

SEQ ID NO: 2020320 - DNA, 22 bp, Homo sapiens
gcagggcaaatgacatgcactg

SEQ ID NO: 2020321 - DNA, 23 bp, Homo sapiens
gcagggcaaatgacatgcactga

SEQ ID NO: 2020322 - DNA, 14 bp, Homo sapiens
gcagggcagaggga

SEQ ID NO: 2020323 - DNA, 20 bp, Homo sapiens
gcagggccggggaactggcc

SEQ ID NO: 2020324 - DNA, 19 bp, Homo sapiens
gcagggccttgcccagaga

SEQ ID NO: 2020325 - DNA, 19 bp, Homo sapiens
gcagggctcagcggggaca

SEQ ID NO: 2020326 - DNA, 22 bp, Homo sapiens
gcagggctcagcggggacagct

SEQ ID NO: 2020327 - DNA, 14 bp, Homo sapiens
gcagggctctcctg

SEQ ID NO: 2020328 - DNA, 14 bp, Homo sapiens
gcaggggtctgagc

SEQ ID NO: 2020329 - DNA, 18 bp, Homo sapiens
gcaggggtgggagagcca

SEQ ID NO: 2020330 - DNA, 13 bp, Homo sapiens
gcaggggttccca

SEQ ID NO: 2020331 - DNA, 13 bp, Homo sapiens
gcagggtcttgct

SEQ ID NO: 2020332 - DNA, 15 bp, Homo sapiens
gcagggtgggatgga

SEQ ID NO: 2020333 - DNA, 14 bp, Homo sapiens
gcaggtaccactga

SEQ ID NO: 2020334 - DNA, 22 bp, Homo sapiens
gcaggtacttcctcctgatggc

SEQ ID NO: 2020335 - DNA, 21 bp, Homo sapiens
gcaggtattttaactgtgtga

SEQ ID NO: 2020336 - DNA, 15 bp, Homo sapiens
gcaggtcctgcccat

SEQ ID NO: 2020337 - DNA, 21 bp, Homo sapiens
gcaggtctcagcccgggacag

SEQ ID NO: 2020338 - DNA, 13 bp, Homo sapiens
gcaggtctctggc

SEQ ID NO: 2020339 - DNA, 20 bp, Homo sapiens
gcaggtcttgaactcctggc

SEQ ID NO: 2020340 - DNA, 19 bp, Homo sapiens
gcaggtgtggtggctcatg

SEQ ID NO: 2020341 - DNA, 16 bp, Homo sapiens
gcaggttcttgatgtc

SEQ ID NO: 2020342 - DNA, 23 bp, Homo sapiens
gcaggttcttgatgtcatgtact

SEQ ID NO: 2020343 - DNA, 16 bp, Homo sapiens
gcagtaaactttctct

SEQ ID NO: 2020344 - DNA, 18 bp, Homo sapiens
gcagtacctgggaaagga

SEQ ID NO: 2020345 - DNA, 13 bp, Homo sapiens
gcagtagccagca

SEQ ID NO: 2020346 - DNA, 16 bp, Homo sapiens
gcagtattttattaaa

SEQ ID NO: 2020347 - DNA, 19 bp, Homo sapiens
gcagtcaacagttcaaaga

SEQ ID NO: 2020348 - DNA, 21 bp, Homo sapiens
gcagtcaacagttcaaagaag

SEQ ID NO: 2020349 - DNA, 14 bp, Homo sapiens
gcagtcatcagaag

SEQ ID NO: 2020350 - DNA, 15 bp, Homo sapiens
gcagtccagaataag

SEQ ID NO: 2020351 - DNA, 17 bp, Homo sapiens
gcagtccagccagctcc

SEQ ID NO: 2020352 - DNA, 16 bp, Homo sapiens
gcagtccccagccctt

SEQ ID NO: 2020353 - DNA, 17 bp, Homo sapiens
gcagtccccagcccttc

SEQ ID NO: 2020354 - DNA, 16 bp, Homo sapiens
gcagtccccagtcacc

SEQ ID NO: 2020355 - DNA, 15 bp, Homo sapiens
gcagtcccgtggagg

SEQ ID NO: 2020356 - DNA, 23 bp, Homo sapiens
gcagtcccgtggagggtagggga

SEQ ID NO: 2020357 - DNA, 15 bp, Homo sapiens
gcagtcgcaggatcc

SEQ ID NO: 2020358 - DNA, 21 bp, Homo sapiens
gcagtcgcaggatccgctgcc

SEQ ID NO: 2020359 - DNA, 22 bp, Homo sapiens
gcagtcgcaggatccgctgcca

SEQ ID NO: 2020360 - DNA, 23 bp, Homo sapiens
gcagtcgcaggatccgctgccac

SEQ ID NO: 2020361 - DNA, 17 bp, Homo sapiens
gcagtcgtaagggttgc

SEQ ID NO: 2020362 - DNA, 12 bp, Homo sapiens
gcagtctcagaa

SEQ ID NO: 2020363 - DNA, 21 bp, Homo sapiens
gcagtctcagaaagccttcca

SEQ ID NO: 2020364 - DNA, 18 bp, Homo sapiens
gcagtctgaacccttgtg

SEQ ID NO: 2020365 - DNA, 21 bp, Homo sapiens
gcagtgaacacactcagcagc

SEQ ID NO: 2020366 - DNA, 18 bp, Homo sapiens
gcagtgacgtgcacctgt

SEQ ID NO: 2020367 - DNA, 15 bp, Homo sapiens
gcagtgactggcagg

SEQ ID NO: 2020368 - DNA, 20 bp, Homo sapiens
gcagtgagaaaaagctcctg

SEQ ID NO: 2020369 - DNA, 21 bp, Homo sapiens
gcagtgagaaaaagctcctgt

SEQ ID NO: 2020370 - DNA, 23 bp, Homo sapiens
gcagtgagaaaaagctcctgtcc

SEQ ID NO: 2020371 - DNA, 21 bp, Homo sapiens
gcagtgagccgcatcttctcc

SEQ ID NO: 2020372 - DNA, 18 bp, Homo sapiens
gcagtgagtctcttcaga

SEQ ID NO: 2020373 - DNA, 19 bp, Homo sapiens
gcagtgagttacagcgaga

SEQ ID NO: 2020374 - DNA, 14 bp, Homo sapiens
gcagtgatggcgcg

SEQ ID NO: 2020375 - DNA, 21 bp, Homo sapiens
gcagtgatggttgccaggacg

SEQ ID NO: 2020376 - DNA, 13 bp, Homo sapiens
gcagtgatgtcac

SEQ ID NO: 2020377 - DNA, 15 bp, Homo sapiens
gcagtgcctgataag

SEQ ID NO: 2020378 - DNA, 19 bp, Homo sapiens
gcagtgctgattcagcctg

SEQ ID NO: 2020379 - DNA, 16 bp, Homo sapiens
gcagtgcttctctaca

SEQ ID NO: 2020380 - DNA, 15 bp, Homo sapiens
gcagtggacaccagg

SEQ ID NO: 2020381 - DNA, 22 bp, Homo sapiens
gcagtggccgcaagcgcaggga

SEQ ID NO: 2020382 - DNA, 12 bp, Homo sapiens
gcagtgggagct

SEQ ID NO: 2020383 - DNA, 14 bp, Homo sapiens
gcagtgggagctgc

SEQ ID NO: 2020384 - DNA, 17 bp, Homo sapiens
gcagtgggagctgcctg

SEQ ID NO: 2020385 - DNA, 20 bp, Homo sapiens
gcagtggtgcgatctgggtt

SEQ ID NO: 2020386 - DNA, 18 bp, Homo sapiens
gcagtgtcatcagaagat

SEQ ID NO: 2020387 - DNA, 14 bp, Homo sapiens
gcagtgtcttccat

SEQ ID NO: 2020388 - DNA, 15 bp, Homo sapiens
gcagtgtcttccata

SEQ ID NO: 2020389 - DNA, 23 bp, Homo sapiens
gcagtgtgtccttggggcacagt

SEQ ID NO: 2020390 - DNA, 21 bp, Homo sapiens
gcagtgttccccatctgggtc

SEQ ID NO: 2020391 - DNA, 23 bp, Homo sapiens
gcagtgttcctcaccaataactt

SEQ ID NO: 2020392 - DNA, 17 bp, Homo sapiens
gcagttccatgaagaca

SEQ ID NO: 2020393 - DNA, 15 bp, Homo sapiens
gcagttcgcagccac

SEQ ID NO: 2020394 - DNA, 19 bp, Homo sapiens
gcagttcgcagccaccctg

SEQ ID NO: 2020395 - DNA, 16 bp, Homo sapiens
gcagttgaaaagactc

SEQ ID NO: 2020396 - DNA, 21 bp, Homo sapiens
gcagttgaaaagactccaaag

SEQ ID NO: 2020397 - DNA, 22 bp, Homo sapiens
gcagttgaaaagactccaaaga

SEQ ID NO: 2020398 - DNA, 15 bp, Homo sapiens
gcagtttatatttaa

SEQ ID NO: 2020399 - DNA, 18 bp, Homo sapiens
gcagtttatatttaactc

SEQ ID NO: 2020400 - DNA, 14 bp, Homo sapiens
gcagtttgggaggt

SEQ ID NO: 2020401 - DNA, 16 bp, Homo sapiens
gcataagattaaagga

SEQ ID NO: 2020402 - DNA, 23 bp, Homo sapiens
gcataagattaaaggaaggaaaa

SEQ ID NO: 2020403 - DNA, 17 bp, Homo sapiens
gcatacatttataatgt

SEQ ID NO: 2020404 - DNA, 13 bp, Homo sapiens
gcatacctttatt

SEQ ID NO: 2020405 - DNA, 20 bp, Homo sapiens
gcatacctttattgtgatct

SEQ ID NO: 2020406 - DNA, 15 bp, Homo sapiens
gcatagaaactgagg

SEQ ID NO: 2020407 - DNA, 16 bp, Homo sapiens
gcatagcaagacacat

SEQ ID NO: 2020408 - DNA, 15 bp, Homo sapiens
gcatagggaatatgt

SEQ ID NO: 2020409 - DNA, 17 bp, Homo sapiens
gcatagtcactgtctca

SEQ ID NO: 2020410 - DNA, 18 bp, Homo sapiens
gcatagttcccatgttaa

SEQ ID NO: 2020411 - DNA, 16 bp, Homo sapiens
gcatcaagggctttat

SEQ ID NO: 2020412 - DNA, 16 bp, Homo sapiens
gcatcaccatgcatgg

SEQ ID NO: 2020413 - DNA, 15 bp, Homo sapiens
gcatcacttggggtc

SEQ ID NO: 2020414 - DNA, 16 bp, Homo sapiens
gcatcagaaagggagg

SEQ ID NO: 2020415 - DNA, 19 bp, Homo sapiens
gcatcagaaagggagggct

SEQ ID NO: 2020416 - DNA, 22 bp, Homo sapiens
gcatcagaaagggagggctctg

SEQ ID NO: 2020417 - DNA, 12 bp, Homo sapiens
gcatcaggcact

SEQ ID NO: 2020418 - DNA, 13 bp, Homo sapiens
gcatcaggcactg

SEQ ID NO: 2020419 - DNA, 15 bp, Homo sapiens
gcatcaggcactggt

SEQ ID NO: 2020420 - DNA, 17 bp, Homo sapiens
gcatcaggcactggtgg

SEQ ID NO: 2020421 - DNA, 14 bp, Homo sapiens
gcatcatgcctctg

SEQ ID NO: 2020422 - DNA, 13 bp, Homo sapiens
gcatcatggctat

SEQ ID NO: 2020423 - DNA, 22 bp, Homo sapiens
gcatcattatttgcagagacag

SEQ ID NO: 2020424 - DNA, 13 bp, Homo sapiens
gcatcattgtaaa

SEQ ID NO: 2020425 - DNA, 16 bp, Homo sapiens
gcatccacccagtgct

SEQ ID NO: 2020426 - DNA, 24 bp, Homo sapiens
gcatccacccagtgctgccatgcc

SEQ ID NO: 2020427 - DNA, 12 bp, Homo sapiens
gcatccagcctg

SEQ ID NO: 2020428 - DNA, 14 bp, Homo sapiens
gcatccagcctgtg

SEQ ID NO: 2020429 - DNA, 15 bp, Homo sapiens
gcatccagcctgtgt

SEQ ID NO: 2020430 - DNA, 12 bp, Homo sapiens
gcatcccatccc

SEQ ID NO: 2020431 - DNA, 15 bp, Homo sapiens
gcatcccatcccttg

SEQ ID NO: 2020432 - DNA, 13 bp, Homo sapiens
gcatcccatgggg

SEQ ID NO: 2020433 - DNA, 16 bp, Homo sapiens
gcatcccctttattaa

SEQ ID NO: 2020434 - DNA, 19 bp, Homo sapiens
gcatcctaaagataaagcc

SEQ ID NO: 2020435 - DNA, 20 bp, Homo sapiens
gcatcctaaagataaagcca

SEQ ID NO: 2020436 - DNA, 13 bp, Homo sapiens
gcatcctgcttcc

SEQ ID NO: 2020437 - DNA, 17 bp, Homo sapiens
gcatcctggcacccggc

SEQ ID NO: 2020438 - DNA, 22 bp, Homo sapiens
gcatcctggcacccggcccctg

SEQ ID NO: 2020439 - DNA, 23 bp, Homo sapiens
gcatcctggcacccggcccctgc

SEQ ID NO: 2020440 - DNA, 15 bp, Homo sapiens
gcatcgtagaagaga

SEQ ID NO: 2020441 - DNA, 17 bp, Homo sapiens
gcatctacacagcctgg

SEQ ID NO: 2020442 - DNA, 13 bp, Homo sapiens
gcatctcagccca

SEQ ID NO: 2020443 - DNA, 14 bp, Homo sapiens
gcatctcagcccac

SEQ ID NO: 2020444 - DNA, 13 bp, Homo sapiens
gcatctcattgta

SEQ ID NO: 2020445 - DNA, 19 bp, Homo sapiens
gcatctcattgtagagctt

SEQ ID NO: 2020446 - DNA, 14 bp, Homo sapiens
gcatctcttgaggc

SEQ ID NO: 2020447 - DNA, 21 bp, Homo sapiens
gcatctcttgaggccaggagt

SEQ ID NO: 2020448 - DNA, 19 bp, Homo sapiens
gcatctgactcacaagaag

SEQ ID NO: 2020449 - DNA, 12 bp, Homo sapiens
gcatctgcaccc

SEQ ID NO: 2020450 - DNA, 16 bp, Homo sapiens
gcatctgggattccca

SEQ ID NO: 2020451 - DNA, 19 bp, Homo sapiens
gcatgagggatcacagggc

SEQ ID NO: 2020452 - DNA, 21 bp, Homo sapiens
gcatgagggatcacagggccc

SEQ ID NO: 2020453 - DNA, 14 bp, Homo sapiens
gcatgatcttgtta

SEQ ID NO: 2020454 - DNA, 21 bp, Homo sapiens
gcatgatttatatatggcata

SEQ ID NO: 2020455 - DNA, 15 bp, Homo sapiens
gcatgattttataca

SEQ ID NO: 2020456 - DNA, 19 bp, Homo sapiens
gcatgattttatacatagt

SEQ ID NO: 2020457 - DNA, 17 bp, Homo sapiens
gcatgcacagctgcttg

SEQ ID NO: 2020458 - DNA, 20 bp, Homo sapiens
gcatgcaccagtgccgcctg

SEQ ID NO: 2020459 - DNA, 20 bp, Homo sapiens
gcatgccagagcctggggca

SEQ ID NO: 2020460 - DNA, 13 bp, Homo sapiens
gcatgcgcaggct

SEQ ID NO: 2020461 - DNA, 14 bp, Homo sapiens
gcatgcgcaggctc

SEQ ID NO: 2020462 - DNA, 16 bp, Homo sapiens
gcatgctcagcccttc

SEQ ID NO: 2020463 - DNA, 15 bp, Homo sapiens
gcatgctctctgcag

SEQ ID NO: 2020464 - DNA, 13 bp, Homo sapiens
gcatgctctggaa

SEQ ID NO: 2020465 - DNA, 16 bp, Homo sapiens
gcatgctggcctgtgg

SEQ ID NO: 2020466 - DNA, 15 bp, Homo sapiens
gcatgctggggcaag

SEQ ID NO: 2020467 - DNA, 16 bp, Homo sapiens
gcatgctggggcaagt

SEQ ID NO: 2020468 - DNA, 13 bp, Homo sapiens
gcatggaatttgt

SEQ ID NO: 2020469 - DNA, 15 bp, Homo sapiens
gcatggagaataaac

SEQ ID NO: 2020470 - DNA, 15 bp, Homo sapiens
gcatggatttctgtc

SEQ ID NO: 2020471 - DNA, 12 bp, Homo sapiens
gcatggccctgg

SEQ ID NO: 2020472 - DNA, 15 bp, Homo sapiens
gcatggctattttat

SEQ ID NO: 2020473 - DNA, 19 bp, Homo sapiens
gcatggcttggggagcaga

SEQ ID NO: 2020474 - DNA, 14 bp, Homo sapiens
gcatgggagggagg

SEQ ID NO: 2020475 - DNA, 20 bp, Homo sapiens
gcatggtcacaagcacaaag

SEQ ID NO: 2020476 - DNA, 20 bp, Homo sapiens
gcatggtcccacatccctgg

SEQ ID NO: 2020477 - DNA, 23 bp, Homo sapiens
gcatggtcccacatccctgggcc

SEQ ID NO: 2020478 - DNA, 13 bp, Homo sapiens
gcatggtgcagtt

SEQ ID NO: 2020479 - DNA, 14 bp, Homo sapiens
gcatggtgctttca

SEQ ID NO: 2020480 - DNA, 22 bp, Homo sapiens
gcatggttccttccctgggaag

SEQ ID NO: 2020481 - DNA, 17 bp, Homo sapiens
gcatgtaatcccagcta

SEQ ID NO: 2020482 - DNA, 14 bp, Homo sapiens
gcatgtatgtcttg

SEQ ID NO: 2020483 - DNA, 15 bp, Homo sapiens
gcatgtatgtcttgg

SEQ ID NO: 2020484 - DNA, 21 bp, Homo sapiens
gcatgtatgtgcacatgtgtc

SEQ ID NO: 2020485 - DNA, 12 bp, Homo sapiens
gcatgtatgtgt

SEQ ID NO: 2020486 - DNA, 23 bp, Homo sapiens
gcatgtcactcccagaccacctc

SEQ ID NO: 2020487 - DNA, 18 bp, Homo sapiens
gcatgtgtgcctgtggca

SEQ ID NO: 2020488 - DNA, 19 bp, Homo sapiens
gcatgtgtgcctgtggcag

SEQ ID NO: 2020489 - DNA, 20 bp, Homo sapiens
gcatgtgtgcctgtggcaga

SEQ ID NO: 2020490 - DNA, 15 bp, Homo sapiens
gcatgtgtgtataag

SEQ ID NO: 2020491 - DNA, 18 bp, Homo sapiens
gcatgtgtgtgtctgtct

SEQ ID NO: 2020492 - DNA, 16 bp, Homo sapiens
gcatgtgttgtacaat

SEQ ID NO: 2020493 - DNA, 14 bp, Homo sapiens
gcatgttctctgag

SEQ ID NO: 2020494 - DNA, 23 bp, Homo sapiens
gcattaaattttagcaaagatat

SEQ ID NO: 2020495 - DNA, 16 bp, Homo sapiens
gcattacatttccaaa

SEQ ID NO: 2020496 - DNA, 15 bp, Homo sapiens
gcattacgtgagcca

SEQ ID NO: 2020497 - DNA, 16 bp, Homo sapiens
gcattagaaatagaca

SEQ ID NO: 2020498 - DNA, 15 bp, Homo sapiens
gcattatttaatgtt

SEQ ID NO: 2020499 - DNA, 23 bp, Homo sapiens
gcattatttaatgtttgatttag

SEQ ID NO: 2020500 - DNA, 15 bp, Homo sapiens
gcattcaataaatat

SEQ ID NO: 2020501 - DNA, 16 bp, Homo sapiens
gcattcagaagaaaaa

SEQ ID NO: 2020502 - DNA, 16 bp, Homo sapiens
gcattcagcacacccc

SEQ ID NO: 2020503 - DNA, 21 bp, Homo sapiens
gcattcagcacaccccaaggg

SEQ ID NO: 2020504 - DNA, 18 bp, Homo sapiens
gcattcaggcagcactga

SEQ ID NO: 2020505 - DNA, 23 bp, Homo sapiens
gcattcaggcagcactgacaata

SEQ ID NO: 2020506 - DNA, 14 bp, Homo sapiens
gcattccatgattt

SEQ ID NO: 2020507 - DNA, 16 bp, Homo sapiens
gcattccatgatttta

SEQ ID NO: 2020508 - DNA, 13 bp, Homo sapiens
gcattccccgctg

SEQ ID NO: 2020509 - DNA, 16 bp, Homo sapiens
gcattccccgctgccc

SEQ ID NO: 2020510 - DNA, 22 bp, Homo sapiens
gcattccctgagtcaccaggaa

SEQ ID NO: 2020511 - DNA, 21 bp, Homo sapiens
gcattcctaagaagtccccag

SEQ ID NO: 2020512 - DNA, 13 bp, Homo sapiens
gcattctagtact

SEQ ID NO: 2020513 - DNA, 16 bp, Homo sapiens
gcattgaatatattat

SEQ ID NO: 2020514 - DNA, 21 bp, Homo sapiens
gcattgaatggctatgttttt

SEQ ID NO: 2020515 - DNA, 20 bp, Homo sapiens
gcattgggctgacacctacc

SEQ ID NO: 2020516 - DNA, 19 bp, Homo sapiens
gcattggggggccgggcag

SEQ ID NO: 2020517 - DNA, 16 bp, Homo sapiens
gcattgtaaatgtgct

SEQ ID NO: 2020518 - DNA, 14 bp, Homo sapiens
gcattgtcttgtgg

SEQ ID NO: 2020519 - DNA, 17 bp, Homo sapiens
gcattgttattgtggaa

SEQ ID NO: 2020520 - DNA, 17 bp, Homo sapiens
gcatttactttgaattt

SEQ ID NO: 2020521 - DNA, 19 bp, Homo sapiens
gcatttataaatgtgtggt

SEQ ID NO: 2020522 - DNA, 19 bp, Homo sapiens
gcatttatggtcaacactt

SEQ ID NO: 2020523 - DNA, 13 bp, Homo sapiens
gcatttccacact

SEQ ID NO: 2020524 - DNA, 19 bp, Homo sapiens
gcatttccacactgtcaga

SEQ ID NO: 2020525 - DNA, 21 bp, Homo sapiens
gcatttcctgggtggctactc

SEQ ID NO: 2020526 - DNA, 21 bp, Homo sapiens
gcatttcttatttgtttggtc

SEQ ID NO: 2020527 - DNA, 20 bp, Homo sapiens
gcatttcttgatgttgctta

SEQ ID NO: 2020528 - DNA, 15 bp, Homo sapiens
gcatttgtgagccaa

SEQ ID NO: 2020529 - DNA, 15 bp, Homo sapiens
gcatttgtgtcatct

SEQ ID NO: 2020530 - DNA, 22 bp, Homo sapiens
gcattttaaaagcaattatatt

SEQ ID NO: 2020531 - DNA, 12 bp, Homo sapiens
gcattttattct

SEQ ID NO: 2020532 - DNA, 16 bp, Homo sapiens
gcattttcctcgccta

SEQ ID NO: 2020533 - DNA, 22 bp, Homo sapiens
gcattttgggggtttttaatct

SEQ ID NO: 2020534 - DNA, 23 bp, Homo sapiens
gccaaaacaatgtttaaaccttt

SEQ ID NO: 2020535 - DNA, 18 bp, Homo sapiens
gccaaaagggcagccagg

SEQ ID NO: 2020536 - DNA, 13 bp, Homo sapiens
gccaaacacagag

SEQ ID NO: 2020537 - DNA, 14 bp, Homo sapiens
gccaaacagagcct

SEQ ID NO: 2020538 - DNA, 22 bp, Homo sapiens
gccaaagctaggcctggccaga

SEQ ID NO: 2020539 - DNA, 22 bp, Homo sapiens
gccaaataaaacctcagggaca

SEQ ID NO: 2020540 - DNA, 15 bp, Homo sapiens
gccaaattatttgtg

SEQ ID NO: 2020541 - DNA, 17 bp, Homo sapiens
gagcccagggcatccca

SEQ ID NO: 2020542 - DNA, 22 bp, Homo sapiens
gagcccatgctcaaccactgtg

SEQ ID NO: 2020543 - DNA, 17 bp, Homo sapiens
gagccccaggcctctgt

SEQ ID NO: 2020544 - DNA, 13 bp, Homo sapiens
gagcccccaagcc

SEQ ID NO: 2020545 - DNA, 12 bp, Homo sapiens
gagcccccaagg

SEQ ID NO: 2020546 - DNA, 13 bp, Homo sapiens
gagccccccacaa

SEQ ID NO: 2020547 - DNA, 12 bp, Homo sapiens
gagccccctgga

SEQ ID NO: 2020548 - DNA, 17 bp, Homo sapiens
gagccccgaggccttct

SEQ ID NO: 2020549 - DNA, 13 bp, Homo sapiens
gagcccctaggaa

SEQ ID NO: 2020550 - DNA, 21 bp, Homo sapiens
gagcccgtgcagtacaggcaa

SEQ ID NO: 2020551 - DNA, 10 bp, Homo sapiens
gagccctgag

SEQ ID NO: 2020552 - DNA, 12 bp, Homo sapiens
gagccctgagct

SEQ ID NO: 2020553 - DNA, 15 bp, Homo sapiens
gagccctgagctcag

SEQ ID NO: 2020554 - DNA, 17 bp, Homo sapiens
gagccctgagctcaggc

SEQ ID NO: 2020555 - DNA, 23 bp, Homo sapiens
gagccctgcagccaaacagagcc

SEQ ID NO: 2020556 - DNA, 23 bp, Homo sapiens
gagccctggcaggatgaccctgc

SEQ ID NO: 2020557 - DNA, 12 bp, Homo sapiens
gagccctgggac

SEQ ID NO: 2020558 - DNA, 13 bp, Homo sapiens
gagccctgggtga

SEQ ID NO: 2020559 - DNA, 15 bp, Homo sapiens
gagccctggtggcag

SEQ ID NO: 2020560 - DNA, 16 bp, Homo sapiens
gagccctggtggcagt

SEQ ID NO: 2020561 - DNA, 20 bp, Homo sapiens
gagccgagatcacgccactg

SEQ ID NO: 2020562 - DNA, 22 bp, Homo sapiens
gagccgagatcacgccactgca

SEQ ID NO: 2020563 - DNA, 20 bp, Homo sapiens
gagccgctgtgagcccctgg

SEQ ID NO: 2020564 - DNA, 22 bp, Homo sapiens
gagccggaccaagatgggcaca

SEQ ID NO: 2020565 - DNA, 15 bp, Homo sapiens
gagccgggccccgga

SEQ ID NO: 2020566 - DNA, 20 bp, Homo sapiens
gagccgggcctggggctcct

SEQ ID NO: 2020567 - DNA, 16 bp, Homo sapiens
gagccgtagagggtgg

SEQ ID NO: 2020568 - DNA, 13 bp, Homo sapiens
gagcctagccacc

SEQ ID NO: 2020569 - DNA, 17 bp, Homo sapiens
gagcctagccacctccc

SEQ ID NO: 2020570 - DNA, 13 bp, Homo sapiens
gagcctcagcatc

SEQ ID NO: 2020571 - DNA, 14 bp, Homo sapiens
gagcctcagcatcc

SEQ ID NO: 2020572 - DNA, 19 bp, Homo sapiens
gagcctcagcatcctggca

SEQ ID NO: 2020573 - DNA, 17 bp, Homo sapiens
gagcctcatccgaggca

SEQ ID NO: 2020574 - DNA, 18 bp, Homo sapiens
gagcctcatccgaggcag

SEQ ID NO: 2020575 - DNA, 19 bp, Homo sapiens
gagcctcatccgaggcagg

SEQ ID NO: 2020576 - DNA, 15 bp, Homo sapiens
gagcctccatttctg

SEQ ID NO: 2020577 - DNA, 12 bp, Homo sapiens
gagcctccccct

SEQ ID NO: 2020578 - DNA, 16 bp, Homo sapiens
gagcctccccctcaga

SEQ ID NO: 2020579 - DNA, 20 bp, Homo sapiens
gagcctcgcaacccgtgcca

SEQ ID NO: 2020580 - DNA, 20 bp, Homo sapiens
gagcctgactgtgttcagtg

SEQ ID NO: 2020581 - DNA, 12 bp, Homo sapiens
gagcctgcagtt

SEQ ID NO: 2020582 - DNA, 16 bp, Homo sapiens
gagcctgccgagcaac

SEQ ID NO: 2020583 - DNA, 13 bp, Homo sapiens
gagcctgctcccc

SEQ ID NO: 2020584 - DNA, 19 bp, Homo sapiens
gagcctgctcccccacccc

SEQ ID NO: 2020585 - DNA, 13 bp, Homo sapiens
gagcctggagaag

SEQ ID NO: 2020586 - DNA, 13 bp, Homo sapiens
gagcctggggctc

SEQ ID NO: 2020587 - DNA, 17 bp, Homo sapiens
gagcctgtgaacccagg

SEQ ID NO: 2020588 - DNA, 20 bp, Homo sapiens
gagcctgtgaacccaggaca

SEQ ID NO: 2020589 - DNA, 18 bp, Homo sapiens
gagccttctcctgcctac

SEQ ID NO: 2020590 - DNA, 17 bp, Homo sapiens
gagcctttggatgacca

SEQ ID NO: 2020591 - DNA, 18 bp, Homo sapiens
gagcgcacctgccccctg

SEQ ID NO: 2020592 - DNA, 13 bp, Homo sapiens
gagcgccctgcag

SEQ ID NO: 2020593 - DNA, 14 bp, Homo sapiens
gagcgccctgcaga

SEQ ID NO: 2020594 - DNA, 14 bp, Homo sapiens
gagcggggaggtgc

SEQ ID NO: 2020595 - DNA, 16 bp, Homo sapiens
gagcggggaggtgcct

SEQ ID NO: 2020596 - DNA, 19 bp, Homo sapiens
gagctaaattacaattgtc

SEQ ID NO: 2020597 - DNA, 21 bp, Homo sapiens
gagctaaattacaattgtcat

SEQ ID NO: 2020598 - DNA, 22 bp, Homo sapiens
gagctacctgtgtggacaggac

SEQ ID NO: 2020599 - DNA, 20 bp, Homo sapiens
gagctacgtatttaatagca

SEQ ID NO: 2020600 - DNA, 20 bp, Homo sapiens
gagctactctcttgccagca

SEQ ID NO: 2020601 - DNA, 22 bp, Homo sapiens
gagctagaacctagaagggcta

SEQ ID NO: 2020602 - DNA, 14 bp, Homo sapiens
gagctagaacctgg

SEQ ID NO: 2020603 - DNA, 21 bp, Homo sapiens
gagctagaacctggagggcta

SEQ ID NO: 2020604 - DNA, 18 bp, Homo sapiens
gagctagcgctgccgcac

SEQ ID NO: 2020605 - DNA, 12 bp, Homo sapiens
gagctaggagca

SEQ ID NO: 2020606 - DNA, 21 bp, Homo sapiens
gagctaggagcaaagcctgtt

SEQ ID NO: 2020607 - DNA, 16 bp, Homo sapiens
gagctcacaaggcagc

SEQ ID NO: 2020608 - DNA, 21 bp, Homo sapiens
gagctcacaaggcagcaaggc

SEQ ID NO: 2020609 - DNA, 14 bp, Homo sapiens
gagctcagaccccc

SEQ ID NO: 2020610 - DNA, 12 bp, Homo sapiens
gagctcaggctg

SEQ ID NO: 2020611 - DNA, 16 bp, Homo sapiens
gagctcaggctgagcc

SEQ ID NO: 2020612 - DNA, 18 bp, Homo sapiens
gagctcaggctgagccca

SEQ ID NO: 2020613 - DNA, 20 bp, Homo sapiens
gagctcaggctgagcccagc

SEQ ID NO: 2020614 - DNA, 11 bp, Homo sapiens
gagctcctgcg

SEQ ID NO: 2020615 - DNA, 14 bp, Homo sapiens
gagctcctgtccct

SEQ ID NO: 2020616 - DNA, 16 bp, Homo sapiens
gagctcctgtccctac

SEQ ID NO: 2020617 - DNA, 18 bp, Homo sapiens
gagctcctgtccctaccc

SEQ ID NO: 2020618 - DNA, 15 bp, Homo sapiens
gagctcggtggaccc

SEQ ID NO: 2020619 - DNA, 22 bp, Homo sapiens
gagctctgagaggccctggatc

SEQ ID NO: 2020620 - DNA, 16 bp, Homo sapiens
gagctctgcagagcag

SEQ ID NO: 2020621 - DNA, 15 bp, Homo sapiens
gagctcttaatgttg

SEQ ID NO: 2020622 - DNA, 20 bp, Homo sapiens
gagctcttcaagctgtcccc

SEQ ID NO: 2020623 - DNA, 21 bp, Homo sapiens
gagctcttcaagctgtcccct

SEQ ID NO: 2020624 - DNA, 22 bp, Homo sapiens
gagctcttcggtttctgagcat

SEQ ID NO: 2020625 - DNA, 13 bp, Homo sapiens
gagctcttggaag

SEQ ID NO: 2020626 - DNA, 17 bp, Homo sapiens
gagctcttggaagagct

SEQ ID NO: 2020627 - DNA, 23 bp, Homo sapiens
gagctgaacccattttgagtgac

SEQ ID NO: 2020628 - DNA, 14 bp, Homo sapiens
gagctgagtcacct

SEQ ID NO: 2020629 - DNA, 15 bp, Homo sapiens
gagctgatggagaag

SEQ ID NO: 2020630 - DNA, 18 bp, Homo sapiens
gagctgatggagaaggaa

SEQ ID NO: 2020631 - DNA, 20 bp, Homo sapiens
gagctgatgtgagtgtgtgt

SEQ ID NO: 2020632 - DNA, 16 bp, Homo sapiens
gagctgccgcaaggcc

SEQ ID NO: 2020633 - DNA, 20 bp, Homo sapiens
gagctgcctgttcagctcca

SEQ ID NO: 2020634 - DNA, 17 bp, Homo sapiens
gagctgctattaaatta

SEQ ID NO: 2020635 - DNA, 12 bp, Homo sapiens
gagctgctgtcc

SEQ ID NO: 2020636 - DNA, 11 bp, Homo sapiens
gagctggaaat

SEQ ID NO: 2020637 - DNA, 13 bp, Homo sapiens
gagctggaaataa

SEQ ID NO: 2020638 - DNA, 15 bp, Homo sapiens
gagctggaaggcagg

SEQ ID NO: 2020639 - DNA, 20 bp, Homo sapiens
gagctggcattggtctgctg

SEQ ID NO: 2020640 - DNA, 21 bp, Homo sapiens
gagctggcgactgcagctgca

SEQ ID NO: 2020641 - DNA, 14 bp, Homo sapiens
gagctgggaggaaa

SEQ ID NO: 2020642 - DNA, 17 bp, Homo sapiens
gagctgggaggaaaaga

SEQ ID NO: 2020643 - DNA, 17 bp, Homo sapiens
gagctgggaggcatggc

SEQ ID NO: 2020644 - DNA, 22 bp, Homo sapiens
gagctgggcttctgtccaaggc

SEQ ID NO: 2020645 - DNA, 14 bp, Homo sapiens
gagctggggcctgg

SEQ ID NO: 2020646 - DNA, 22 bp, Homo sapiens
gagctggggcctggagaggggc

SEQ ID NO: 2020647 - DNA, 21 bp, Homo sapiens
gagctgttggcctcgcctggg

SEQ ID NO: 2020648 - DNA, 17 bp, Homo sapiens
gagctgttggcctgggt

SEQ ID NO: 2020649 - DNA, 14 bp, Homo sapiens
gagcttagccttgt

SEQ ID NO: 2020650 - DNA, 17 bp, Homo sapiens
gagcttagccttgtgcc

SEQ ID NO: 2020651 - DNA, 18 bp, Homo sapiens
gagcttagccttgtgccc

SEQ ID NO: 2020652 - DNA, 19 bp, Homo sapiens
gagcttagccttgtgccct

SEQ ID NO: 2020653 - DNA, 21 bp, Homo sapiens
gagcttagccttgtgccctgc

SEQ ID NO: 2020654 - DNA, 22 bp, Homo sapiens
gagcttagccttgtgccctgcc

SEQ ID NO: 2020655 - DNA, 15 bp, Homo sapiens
gagcttattggccac

SEQ ID NO: 2020656 - DNA, 14 bp, Homo sapiens
gcacaccactgccc

SEQ ID NO: 2020657 - DNA, 21 bp, Homo sapiens
gcacaccactgccctgcctgc

SEQ ID NO: 2020658 - DNA, 23 bp, Homo sapiens
gcacaccccaagggacaacccca

SEQ ID NO: 2020659 - DNA, 13 bp, Homo sapiens
gcacacctgtggt

SEQ ID NO: 2020660 - DNA, 17 bp, Homo sapiens
gcacacctgtggtgcct

SEQ ID NO: 2020661 - DNA, 13 bp, Homo sapiens
gcacacggccctg

SEQ ID NO: 2020662 - DNA, 19 bp, Homo sapiens
gcacacggccctgccccat

SEQ ID NO: 2020663 - DNA, 12 bp, Homo sapiens
gcacactgtagc

SEQ ID NO: 2020664 - DNA, 15 bp, Homo sapiens
gcacagacttctgga

SEQ ID NO: 2020665 - DNA, 21 bp, Homo sapiens
gcacagacttctggaaggctg

SEQ ID NO: 2020666 - DNA, 22 bp, Homo sapiens
gcacagacttctggaaggctgg

SEQ ID NO: 2020667 - DNA, 16 bp, Homo sapiens
gcacagatatttccat

SEQ ID NO: 2020668 - DNA, 17 bp, Homo sapiens
gcacagatatttccatt

SEQ ID NO: 2020669 - DNA, 12 bp, Homo sapiens
gcacagccctgg

SEQ ID NO: 2020670 - DNA, 13 bp, Homo sapiens
gcacagccctggg

SEQ ID NO: 2020671 - DNA, 18 bp, Homo sapiens
gcacagcgcgggcggagg

SEQ ID NO: 2020672 - DNA, 22 bp, Homo sapiens
gcacagcgcgggcggaggcggc

SEQ ID NO: 2020673 - DNA, 14 bp, Homo sapiens
gcacagctgcttgt

SEQ ID NO: 2020674 - DNA, 16 bp, Homo sapiens
gcacagcttcatttcc

SEQ ID NO: 2020675 - DNA, 23 bp, Homo sapiens
gcacagcttcatttcctgtgtct

SEQ ID NO: 2020676 - DNA, 15 bp, Homo sapiens
gcacaggaaaaggta

SEQ ID NO: 2020677 - DNA, 18 bp, Homo sapiens
gcacaggaaaaggtagct

SEQ ID NO: 2020678 - DNA, 19 bp, Homo sapiens
gcacaggacacctggccgc

SEQ ID NO: 2020679 - DNA, 15 bp, Homo sapiens
gcacaggagctacct

SEQ ID NO: 2020680 - DNA, 20 bp, Homo sapiens
gcacaggagctacctgtgtg

SEQ ID NO: 2020681 - DNA, 21 bp, Homo sapiens
gcacaggagggggtcgtggag

SEQ ID NO: 2020682 - DNA, 16 bp, Homo sapiens
gcacaggcaggaagag

SEQ ID NO: 2020683 - DNA, 16 bp, Homo sapiens
gcacagggcagtggga

SEQ ID NO: 2020684 - DNA, 16 bp, Homo sapiens
gcacaggggccccaga

SEQ ID NO: 2020685 - DNA, 15 bp, Homo sapiens
gcacaggtgtaaata

SEQ ID NO: 2020686 - DNA, 20 bp, Homo sapiens
gcacagtgcatctcagccca

SEQ ID NO: 2020687 - DNA, 21 bp, Homo sapiens
gcacagtgcatctcagcccac

SEQ ID NO: 2020688 - DNA, 20 bp, Homo sapiens
gcacagtgttaaatgaaatt

SEQ ID NO: 2020689 - DNA, 22 bp, Homo sapiens
gcacagtttagaacagagggac

SEQ ID NO: 2020690 - DNA, 14 bp, Homo sapiens
gcacagttttctga

SEQ ID NO: 2020691 - DNA, 23 bp, Homo sapiens
gcacagttttctgagaaagacta

SEQ ID NO: 2020692 - DNA, 20 bp, Homo sapiens
gcacatagagatatgcacac

SEQ ID NO: 2020693 - DNA, 14 bp, Homo sapiens
gcacatgaggaggg

SEQ ID NO: 2020694 - DNA, 16 bp, Homo sapiens
gcacatgaggagggtg

SEQ ID NO: 2020695 - DNA, 22 bp, Homo sapiens
gcacatggaggagcttggggga

SEQ ID NO: 2020696 - DNA, 18 bp, Homo sapiens
gcacatgtgtctgtgtgg

SEQ ID NO: 2020697 - DNA, 18 bp, Homo sapiens
gcacattcctggccccgg

SEQ ID NO: 2020698 - DNA, 19 bp, Homo sapiens
gcacattcttaaaggaaaa

SEQ ID NO: 2020699 - DNA, 20 bp, Homo sapiens
gcacattcttaaaggaaaag

SEQ ID NO: 2020700 - DNA, 20 bp, Homo sapiens
gcacatttatatatatatgt

SEQ ID NO: 2020701 - DNA, 15 bp, Homo sapiens
gcaccaaaagaagta

SEQ ID NO: 2020702 - DNA, 20 bp, Homo sapiens
gcaccaattgtacattccct

SEQ ID NO: 2020703 - DNA, 22 bp, Homo sapiens
gcaccaattgtacattccctgc

SEQ ID NO: 2020704 - DNA, 13 bp, Homo sapiens
gcaccacaggctg

SEQ ID NO: 2020705 - DNA, 15 bp, Homo sapiens
gcaccacaggctgcc

SEQ ID NO: 2020706 - DNA, 23 bp, Homo sapiens
gcaccactgcactccagcctggg

SEQ ID NO: 2020707 - DNA, 22 bp, Homo sapiens
gcaccagagtgaaagggctatg

SEQ ID NO: 2020708 - DNA, 16 bp, Homo sapiens
gcaccagcccttccct

SEQ ID NO: 2020709 - DNA, 22 bp, Homo sapiens
gcaccagcccttccctgctttg

SEQ ID NO: 2020710 - DNA, 17 bp, Homo sapiens
gcaccagctctgtggcc

SEQ ID NO: 2020711 - DNA, 19 bp, Homo sapiens
gcaccagctctgtggcctg

SEQ ID NO: 2020712 - DNA, 22 bp, Homo sapiens
gcaccagctctgtggcctgtgt

SEQ ID NO: 2020713 - DNA, 17 bp, Homo sapiens
gcaccagctgctctgcc

SEQ ID NO: 2020714 - DNA, 16 bp, Homo sapiens
gcaccagcttctccag

SEQ ID NO: 2020715 - DNA, 20 bp, Homo sapiens
gcaccaggcacgaacccacc

SEQ ID NO: 2020716 - DNA, 20 bp, Homo sapiens
gcaccaggccgggcttgggc

SEQ ID NO: 2020717 - DNA, 18 bp, Homo sapiens
gcaccagtgccgcctgtg

SEQ ID NO: 2020718 - DNA, 21 bp, Homo sapiens
gcaccagtgccgcctgtgccc

SEQ ID NO: 2020719 - DNA, 16 bp, Homo sapiens
gcaccatcacacatgc

SEQ ID NO: 2020720 - DNA, 20 bp, Homo sapiens
gcaccatctctgattttcaa

SEQ ID NO: 2020721 - DNA, 19 bp, Homo sapiens
gcaccatggaggcaggctc

SEQ ID NO: 2020722 - DNA, 17 bp, Homo sapiens
gcacccactcaccaggg

SEQ ID NO: 2020723 - DNA, 18 bp, Homo sapiens
gcacccactcaccagggt

SEQ ID NO: 2020724 - DNA, 16 bp, Homo sapiens
gcacccaggctccatg

SEQ ID NO: 2020725 - DNA, 18 bp, Homo sapiens
gcacccaggctccatggg

SEQ ID NO: 2020726 - DNA, 13 bp, Homo sapiens
gcacccccagcct

SEQ ID NO: 2020727 - DNA, 14 bp, Homo sapiens
gcacccccagcctg

SEQ ID NO: 2020728 - DNA, 16 bp, Homo sapiens
gcacccccagcctggg

SEQ ID NO: 2020729 - DNA, 14 bp, Homo sapiens
gcaccccccaagct

SEQ ID NO: 2020730 - DNA, 19 bp, Homo sapiens
gcaccccctgcagcttgta

SEQ ID NO: 2020731 - DNA, 19 bp, Homo sapiens
gcaccccggatcgaggaca

SEQ ID NO: 2020732 - DNA, 22 bp, Homo sapiens
gcacccctccccattcacagag

SEQ ID NO: 2020733 - DNA, 14 bp, Homo sapiens
gcacccggcccctg

SEQ ID NO: 2020734 - DNA, 15 bp, Homo sapiens
gcacccggcccctgc

SEQ ID NO: 2020735 - DNA, 19 bp, Homo sapiens
gcacccggcccctgctggt

SEQ ID NO: 2020736 - DNA, 18 bp, Homo sapiens
gcacccgttcaccttctt

SEQ ID NO: 2020737 - DNA, 19 bp, Homo sapiens
gcaccctcgatgaagccca

SEQ ID NO: 2020738 - DNA, 17 bp, Homo sapiens
gcaccctctcctggggg

SEQ ID NO: 2020739 - DNA, 21 bp, Homo sapiens
gcaccctgcagagcacacagg

SEQ ID NO: 2020740 - DNA, 22 bp, Homo sapiens
gcaccctggaaaggggagttga

SEQ ID NO: 2020741 - DNA, 15 bp, Homo sapiens
gcacccttctgctgt

SEQ ID NO: 2020742 - DNA, 17 bp, Homo sapiens
gcacccttctttcctct

SEQ ID NO: 2020743 - DNA, 21 bp, Homo sapiens
gcacccttctttcctcttccc

SEQ ID NO: 2020744 - DNA, 17 bp, Homo sapiens
gcaccggcgctgcaggt

SEQ ID NO: 2020745 - DNA, 18 bp, Homo sapiens
gcaccggcgctgcaggta

SEQ ID NO: 2020746 - DNA, 14 bp, Homo sapiens
gcaccgggccacag

SEQ ID NO: 2020747 - DNA, 23 bp, Homo sapiens
gcaccgggccacagagaaagtac

SEQ ID NO: 2020748 - DNA, 17 bp, Homo sapiens
gcaccgtcatggcttaa

SEQ ID NO: 2020749 - DNA, 21 bp, Homo sapiens
gcaccgtcatggcttaatgtt

SEQ ID NO: 2020750 - DNA, 19 bp, Homo sapiens
gcacctaaaccaccagtgc

SEQ ID NO: 2020751 - DNA, 17 bp, Homo sapiens
gcacctacatccccagg

SEQ ID NO: 2020752 - DNA, 17 bp, Homo sapiens
gcacctatagtcccagc

SEQ ID NO: 2020753 - DNA, 18 bp, Homo sapiens
gcacctatagtcccagct

SEQ ID NO: 2020754 - DNA, 16 bp, Homo sapiens
gcacctcagacaatcc

SEQ ID NO: 2020755 - DNA, 21 bp, Homo sapiens
gcacctccccccactgcaggc

SEQ ID NO: 2020756 - DNA, 13 bp, Homo sapiens
gcacctcctgaga

SEQ ID NO: 2020757 - DNA, 15 bp, Homo sapiens
gcacctcctgagaag

SEQ ID NO: 2020758 - DNA, 15 bp, Homo sapiens
gcacctcctgcctcg

SEQ ID NO: 2020759 - DNA, 16 bp, Homo sapiens
gcacctgaaccccatg

SEQ ID NO: 2020760 - DNA, 18 bp, Homo sapiens
gcacctgaaccccatggg

SEQ ID NO: 2020761 - DNA, 19 bp, Homo sapiens
gcacctgaaccccatgggc

SEQ ID NO: 2020762 - DNA, 24 bp, Homo sapiens
gcacctgaaccccatgggcttgga

SEQ ID NO: 2020763 - DNA, 17 bp, Homo sapiens
gcacctgcagattctga

SEQ ID NO: 2020764 - DNA, 22 bp, Homo sapiens
gcacctgccaccgccagaggac

SEQ ID NO: 2020765 - DNA, 19 bp, Homo sapiens
gcacctgccgacctcgtcc

SEQ ID NO: 2020766 - DNA, 21 bp, Homo sapiens
gcacctgccgacctcgtcctc

SEQ ID NO: 2020767 - DNA, 21 bp, Homo sapiens
gcacctgcgagaggtccctgc

SEQ ID NO: 2020768 - DNA, 22 bp, Homo sapiens
gcacctgcgagaggtccctgct

SEQ ID NO: 2020769 - DNA, 12 bp, Homo sapiens
gcacctgctgga

SEQ ID NO: 2020770 - DNA, 17 bp, Homo sapiens
gccaacagaagcttcca

SEQ ID NO: 2020771 - DNA, 19 bp, Homo sapiens
gccaacagaagcttccatt

SEQ ID NO: 2020772 - DNA, 16 bp, Homo sapiens
gccaacaggtggcagg

SEQ ID NO: 2020773 - DNA, 23 bp, Homo sapiens
gccaacaggtggcaggaccagga

SEQ ID NO: 2020774 - DNA, 14 bp, Homo sapiens
gccaacatggtgaa

SEQ ID NO: 2020775 - DNA, 15 bp, Homo sapiens
gccaaccaagagcac

SEQ ID NO: 2020776 - DNA, 14 bp, Homo sapiens
gccaacctgatgcc

SEQ ID NO: 2020777 - DNA, 20 bp, Homo sapiens
gccaactcactcttatgaaa

SEQ ID NO: 2020778 - DNA, 21 bp, Homo sapiens
gccaactcactcttatgaaat

SEQ ID NO: 2020779 - DNA, 16 bp, Homo sapiens
gccaactcctccttgc

SEQ ID NO: 2020780 - DNA, 14 bp, Homo sapiens
gccaacttggcttt

SEQ ID NO: 2020781 - DNA, 18 bp, Homo sapiens
gccaacttgtaaatacac

SEQ ID NO: 2020782 - DNA, 17 bp, Homo sapiens
gccaagaccccagcttc

SEQ ID NO: 2020783 - DNA, 13 bp, Homo sapiens
gccaagagagaca

SEQ ID NO: 2020784 - DNA, 18 bp, Homo sapiens
gccaagctgaggtgccca

SEQ ID NO: 2020785 - DNA, 23 bp, Homo sapiens
gccaagctgaggtgcccaggaga

SEQ ID NO: 2020786 - DNA, 16 bp, Homo sapiens
gccaagctttcttcta

SEQ ID NO: 2020787 - DNA, 22 bp, Homo sapiens
gccaaggtgggctgagccctgg

SEQ ID NO: 2020788 - DNA, 20 bp, Homo sapiens
gccaaggtgtggcctgcact

SEQ ID NO: 2020789 - DNA, 16 bp, Homo sapiens
gccaagtccaggtcct

SEQ ID NO: 2020790 - DNA, 13 bp, Homo sapiens
gccaatatgtatt

SEQ ID NO: 2020791 - DNA, 23 bp, Homo sapiens
gccaatatgtattgtaaacatgt

SEQ ID NO: 2020792 - DNA, 18 bp, Homo sapiens
gccaatccaggtgggaga

SEQ ID NO: 2020793 - DNA, 22 bp, Homo sapiens
gccaatccaggtgggagagaca

SEQ ID NO: 2020794 - DNA, 19 bp, Homo sapiens
gccaatggagactgtctca

SEQ ID NO: 2020795 - DNA, 18 bp, Homo sapiens
gccaattaaaatatatat

SEQ ID NO: 2020796 - DNA, 19 bp, Homo sapiens
gccaattaaaatatatata

SEQ ID NO: 2020797 - DNA, 17 bp, Homo sapiens
gccacaatgcctctccc

SEQ ID NO: 2020798 - DNA, 12 bp, Homo sapiens
gccacacagagc

SEQ ID NO: 2020799 - DNA, 14 bp, Homo sapiens
gccacacagagcct

SEQ ID NO: 2020800 - DNA, 21 bp, Homo sapiens
gccacacagagcctgcctcag

SEQ ID NO: 2020801 - DNA, 17 bp, Homo sapiens
gccacacattgtgcttg

SEQ ID NO: 2020802 - DNA, 19 bp, Homo sapiens
gccacaccatctcctttca

SEQ ID NO: 2020803 - DNA, 15 bp, Homo sapiens
gccacacccggctcc

SEQ ID NO: 2020804 - DNA, 14 bp, Homo sapiens
gccacacctgagcc

SEQ ID NO: 2020805 - DNA, 17 bp, Homo sapiens
gccacacttctcaggac

SEQ ID NO: 2020806 - DNA, 14 bp, Homo sapiens
gccacagaccacct

SEQ ID NO: 2020807 - DNA, 15 bp, Homo sapiens
gccacagaccacctg

SEQ ID NO: 2020808 - DNA, 20 bp, Homo sapiens
gccacagaccacctgcttct

SEQ ID NO: 2020809 - DNA, 23 bp, Homo sapiens
gccacagagaaagtacttctcca

SEQ ID NO: 2020810 - DNA, 12 bp, Homo sapiens
gccacagcccca

SEQ ID NO: 2020811 - DNA, 14 bp, Homo sapiens
gccacagccccaca

SEQ ID NO: 2020812 - DNA, 22 bp, Homo sapiens
gccacagtgagctgatgtgccc

SEQ ID NO: 2020813 - DNA, 15 bp, Homo sapiens
gccacatctgtgtct

SEQ ID NO: 2020814 - DNA, 13 bp, Homo sapiens
gccaccaataaaa

SEQ ID NO: 2020815 - DNA, 15 bp, Homo sapiens
gccaccacgtctgcc

SEQ ID NO: 2020816 - DNA, 19 bp, Homo sapiens
gccaccacgtctgccaggc

SEQ ID NO: 2020817 - DNA, 20 bp, Homo sapiens
gccaccacgtctgccaggcc

SEQ ID NO: 2020818 - DNA, 21 bp, Homo sapiens
gccaccacgtctgccaggccc

SEQ ID NO: 2020819 - DNA, 21 bp, Homo sapiens
gccaccagggcactgtctgcg

SEQ ID NO: 2020820 - DNA, 23 bp, Homo sapiens
gccaccatattcagtgctgtggc

SEQ ID NO: 2020821 - DNA, 14 bp, Homo sapiens
gccaccatcctgct

SEQ ID NO: 2020822 - DNA, 17 bp, Homo sapiens
gccacccaacagcacca

SEQ ID NO: 2020823 - DNA, 15 bp, Homo sapiens
gccaccccgtgccac

SEQ ID NO: 2020824 - DNA, 16 bp, Homo sapiens
gccaccccgtgccacc

SEQ ID NO: 2020825 - DNA, 22 bp, Homo sapiens
gccacccgttctgctggcctgg

SEQ ID NO: 2020826 - DNA, 13 bp, Homo sapiens
gccaccctctcca

SEQ ID NO: 2020827 - DNA, 14 bp, Homo sapiens
gccaccctctccat

SEQ ID NO: 2020828 - DNA, 17 bp, Homo sapiens
gccaccctctccatgcc

SEQ ID NO: 2020829 - DNA, 12 bp, Homo sapiens
gccaccctgagg

SEQ ID NO: 2020830 - DNA, 18 bp, Homo sapiens
gccaccctgaggcctctg

SEQ ID NO: 2020831 - DNA, 13 bp, Homo sapiens
gccaccctggccc

SEQ ID NO: 2020832 - DNA, 14 bp, Homo sapiens
gccaccctggcccg

SEQ ID NO: 2020833 - DNA, 15 bp, Homo sapiens
gccaccgccagagga

SEQ ID NO: 2020834 - DNA, 19 bp, Homo sapiens
gccaccgggacagacctgg

SEQ ID NO: 2020835 - DNA, 22 bp, Homo sapiens
gccaccgggacagacctggaca

SEQ ID NO: 2020836 - DNA, 18 bp, Homo sapiens
gccaccggggaacccagc

SEQ ID NO: 2020837 - DNA, 17 bp, Homo sapiens
gccacctcccaaggact

SEQ ID NO: 2020838 - DNA, 12 bp, Homo sapiens
gccacctcccac

SEQ ID NO: 2020839 - DNA, 19 bp, Homo sapiens
gccacctcccaccccactc

SEQ ID NO: 2020840 - DNA, 20 bp, Homo sapiens
gccacctcccaccccactcc

SEQ ID NO: 2020841 - DNA, 21 bp, Homo sapiens
gccacctcccaccccactcca

SEQ ID NO: 2020842 - DNA, 22 bp, Homo sapiens
gccacctcccaccccactccag

SEQ ID NO: 2020843 - DNA, 11 bp, Homo sapiens
gccacctcccc

SEQ ID NO: 2020844 - DNA, 20 bp, Homo sapiens
gccacctcccctatccaccc

SEQ ID NO: 2020845 - DNA, 13 bp, Homo sapiens
gccacctgtctgt

SEQ ID NO: 2020846 - DNA, 13 bp, Homo sapiens
gccacgctcaggc

SEQ ID NO: 2020847 - DNA, 21 bp, Homo sapiens
gccacgctgtcctctcgagcc

SEQ ID NO: 2020848 - DNA, 22 bp, Homo sapiens
gccacgctgtcctctcgagccc

SEQ ID NO: 2020849 - DNA, 14 bp, Homo sapiens
gccacggccaccct

SEQ ID NO: 2020850 - DNA, 15 bp, Homo sapiens
gccacggccaggcca

SEQ ID NO: 2020851 - DNA, 18 bp, Homo sapiens
gccacggccaggccagag

SEQ ID NO: 2020852 - DNA, 14 bp, Homo sapiens
gccacgtgaatggc

SEQ ID NO: 2020853 - DNA, 14 bp, Homo sapiens
gccacgtgccaggc

SEQ ID NO: 2020854 - DNA, 17 bp, Homo sapiens
gccacgtgccaggcccg

SEQ ID NO: 2020855 - DNA, 22 bp, Homo sapiens
gccacgttccttactgcagaat

SEQ ID NO: 2020856 - DNA, 17 bp, Homo sapiens
gccactacactccagcc

SEQ ID NO: 2020857 - DNA, 18 bp, Homo sapiens
gccactacactccagcct

SEQ ID NO: 2020858 - DNA, 19 bp, Homo sapiens
gccactacactccagcctg

SEQ ID NO: 2020859 - DNA, 20 bp, Homo sapiens
gccactacactccagcctga

SEQ ID NO: 2020860 - DNA, 17 bp, Homo sapiens
gccactatgtccagcta

SEQ ID NO: 2020861 - DNA, 21 bp, Homo sapiens
gccactcaggaggctgaggca

SEQ ID NO: 2020862 - DNA, 14 bp, Homo sapiens
gccactcatttcat

SEQ ID NO: 2020863 - DNA, 18 bp, Homo sapiens
gccactcatttcatctca

SEQ ID NO: 2020864 - DNA, 20 bp, Homo sapiens
gccactcatttcatctcatt

SEQ ID NO: 2020865 - DNA, 16 bp, Homo sapiens
gccactccagacccct

SEQ ID NO: 2020866 - DNA, 20 bp, Homo sapiens
gccactccctgagctttggg

SEQ ID NO: 2020867 - DNA, 17 bp, Homo sapiens
gccactcctgtcccgcc

SEQ ID NO: 2020868 - DNA, 18 bp, Homo sapiens
gccactccttcctgcccc

SEQ ID NO: 2020869 - DNA, 22 bp, Homo sapiens
gccactctcccctccctcttcc

SEQ ID NO: 2020870 - DNA, 18 bp, Homo sapiens
gccactgacctcaccggc

SEQ ID NO: 2020871 - DNA, 19 bp, Homo sapiens
gccactgacctcaccggca

SEQ ID NO: 2020872 - DNA, 20 bp, Homo sapiens
gccactgcaccgggccacag

SEQ ID NO: 2020873 - DNA, 23 bp, Homo sapiens
gccactgcaccgggccacagaga

SEQ ID NO: 2020874 - DNA, 22 bp, Homo sapiens
gccactgcactccagcctgggc

SEQ ID NO: 2020875 - DNA, 15 bp, Homo sapiens
gccactgccagcagc

SEQ ID NO: 2020876 - DNA, 17 bp, Homo sapiens
gccactgccagcagctg

SEQ ID NO: 2020877 - DNA, 12 bp, Homo sapiens
gccactgccagg

SEQ ID NO: 2020878 - DNA, 13 bp, Homo sapiens
gccactgccaggc

SEQ ID NO: 2020879 - DNA, 14 bp, Homo sapiens
gccactgccaggca

SEQ ID NO: 2020880 - DNA, 24 bp, Homo sapiens
gccactgccaggcacctggcctgc

SEQ ID NO: 2020881 - DNA, 17 bp, Homo sapiens
gccactgcctcttcctc

SEQ ID NO: 2020882 - DNA, 20 bp, Homo sapiens
gccactgctttccagcctgg

SEQ ID NO: 2020883 - DNA, 17 bp, Homo sapiens
gccactgggtctcactc

SEQ ID NO: 2020884 - DNA, 20 bp, Homo sapiens
gccactggtttctcagaatc

SEQ ID NO: 2020885 - DNA, 14 bp, Homo sapiens
gccactgtggccag

SEQ ID NO: 2020886 - DNA, 18 bp, Homo sapiens
gcactgctgcccagcctc

SEQ ID NO: 2020887 - DNA, 16 bp, Homo sapiens
gcactgcttgaggagg

SEQ ID NO: 2020888 - DNA, 14 bp, Homo sapiens
gcactggagtgcag

SEQ ID NO: 2020889 - DNA, 15 bp, Homo sapiens
gcactggagtgcagg

SEQ ID NO: 2020890 - DNA, 16 bp, Homo sapiens
gcactggccagagagg

SEQ ID NO: 2020891 - DNA, 21 bp, Homo sapiens
gcactggccagagagggccca

SEQ ID NO: 2020892 - DNA, 19 bp, Homo sapiens
gcactggtggcccgacagc

SEQ ID NO: 2020893 - DNA, 22 bp, Homo sapiens
gcactggtggcccgacagcctg

SEQ ID NO: 2020894 - DNA, 16 bp, Homo sapiens
gcactgtatgctggac

SEQ ID NO: 2020895 - DNA, 16 bp, Homo sapiens
gcactgtcttaaggca

SEQ ID NO: 2020896 - DNA, 19 bp, Homo sapiens
gcactgtgaagacccagca

SEQ ID NO: 2020897 - DNA, 21 bp, Homo sapiens
gcactgtgaagacccagcagg

SEQ ID NO: 2020898 - DNA, 14 bp, Homo sapiens
gcacttgcagactc

SEQ ID NO: 2020899 - DNA, 19 bp, Homo sapiens
gcacttgttccttctgctt

SEQ ID NO: 2020900 - DNA, 22 bp, Homo sapiens
gcacttgttccttctgcttctc

SEQ ID NO: 2020901 - DNA, 18 bp, Homo sapiens
gcactttaaccctctctt

SEQ ID NO: 2020902 - DNA, 18 bp, Homo sapiens
gcagaaaagcacctgccg

SEQ ID NO: 2020903 - DNA, 21 bp, Homo sapiens
gcagaaaagcacctgccgacc

SEQ ID NO: 2020904 - DNA, 13 bp, Homo sapiens
gcagaaaagtgct

SEQ ID NO: 2020905 - DNA, 15 bp, Homo sapiens
gcagaaaagtgctta

SEQ ID NO: 2020906 - DNA, 12 bp, Homo sapiens
gcagaaataaaa

SEQ ID NO: 2020907 - DNA, 23 bp, Homo sapiens
gcagaacagccgctcctgtctgc

SEQ ID NO: 2020908 - DNA, 22 bp, Homo sapiens
gcagaacatgtgggaggaagaa

SEQ ID NO: 2020909 - DNA, 13 bp, Homo sapiens
gcagaacggagcc

SEQ ID NO: 2020910 - DNA, 21 bp, Homo sapiens
gcagaagaattgaacccagga

SEQ ID NO: 2020911 - DNA, 23 bp, Homo sapiens
gcagaagaattgaacccaggagg

SEQ ID NO: 2020912 - DNA, 16 bp, Homo sapiens
gcagaaggggaagata

SEQ ID NO: 2020913 - DNA, 13 bp, Homo sapiens
gcagaatgaagac

SEQ ID NO: 2020914 - DNA, 16 bp, Homo sapiens
gcagaatgaagaccta

SEQ ID NO: 2020915 - DNA, 13 bp, Homo sapiens
gcagaatgttttt

SEQ ID NO: 2020916 - DNA, 13 bp, Homo sapiens
gcagacaagagct

SEQ ID NO: 2020917 - DNA, 18 bp, Homo sapiens
gcagacaagagctgctgt

SEQ ID NO: 2020918 - DNA, 13 bp, Homo sapiens
gcagacagagaaa

SEQ ID NO: 2020919 - DNA, 16 bp, Homo sapiens
gcagacagcagctcag

SEQ ID NO: 2020920 - DNA, 20 bp, Homo sapiens
gcagacagcagctcaggcac

SEQ ID NO: 2020921 - DNA, 14 bp, Homo sapiens
gcagacaggaggaa

SEQ ID NO: 2020922 - DNA, 19 bp, Homo sapiens
gcagacaggcaagcacctc

SEQ ID NO: 2020923 - DNA, 16 bp, Homo sapiens
gcagaccgggggccag

SEQ ID NO: 2020924 - DNA, 17 bp, Homo sapiens
gcagaccgggggccaga

SEQ ID NO: 2020925 - DNA, 19 bp, Homo sapiens
gcagaccgggggccagaca

SEQ ID NO: 2020926 - DNA, 17 bp, Homo sapiens
gcagaccgtgatttgga

SEQ ID NO: 2020927 - DNA, 21 bp, Homo sapiens
gcagacgcagcagctgggacc

SEQ ID NO: 2020928 - DNA, 16 bp, Homo sapiens
gcagactcagctctga

SEQ ID NO: 2020929 - DNA, 18 bp, Homo sapiens
gcagactcagtttgtcag

SEQ ID NO: 2020930 - DNA, 15 bp, Homo sapiens
gcagactctacagag

SEQ ID NO: 2020931 - DNA, 23 bp, Homo sapiens
gcagactgtggctgcagagacct

SEQ ID NO: 2020932 - DNA, 13 bp, Homo sapiens
gcagagaaagaaa

SEQ ID NO: 2020933 - DNA, 16 bp, Homo sapiens
gcagagaaagaagaga

SEQ ID NO: 2020934 - DNA, 12 bp, Homo sapiens
gcagagaaggct

SEQ ID NO: 2020935 - DNA, 12 bp, Homo sapiens
gcagcagcccag

SEQ ID NO: 2020936 - DNA, 14 bp, Homo sapiens
gcagcagcccagct

SEQ ID NO: 2020937 - DNA, 15 bp, Homo sapiens
gcagcagcccagctt

SEQ ID NO: 2020938 - DNA, 16 bp, Homo sapiens
gcagcagctcagcctc

SEQ ID NO: 2020939 - DNA, 17 bp, Homo sapiens
gcagcaggtgcaagaga

SEQ ID NO: 2020940 - DNA, 18 bp, Homo sapiens
gcagcaggtgcaagagac

SEQ ID NO: 2020941 - DNA, 17 bp, Homo sapiens
gcagcagtgagtctctt

SEQ ID NO: 2020942 - DNA, 15 bp, Homo sapiens
gcagcagttccatga

SEQ ID NO: 2020943 - DNA, 15 bp, Homo sapiens
gcagcatcttcaaac

SEQ ID NO: 2020944 - DNA, 16 bp, Homo sapiens
gcagcattcagcacac

SEQ ID NO: 2020945 - DNA, 19 bp, Homo sapiens
gcagcattccatgaccaga

SEQ ID NO: 2020946 - DNA, 16 bp, Homo sapiens
gcagccaaacagagcc

SEQ ID NO: 2020947 - DNA, 18 bp, Homo sapiens
gcagccaaacagagcctt

SEQ ID NO: 2020948 - DNA, 18 bp, Homo sapiens
gcagccacacttctcagg

SEQ ID NO: 2020949 - DNA, 22 bp, Homo sapiens
gcagccacacttctcaggacac

SEQ ID NO: 2020950 - DNA, 14 bp, Homo sapiens
gcagccaccctgag

SEQ ID NO: 2020951 - DNA, 17 bp, Homo sapiens
gcagccagccctgcctg

SEQ ID NO: 2020952 - DNA, 20 bp, Homo sapiens
gcagccagccggtgcctggc

SEQ ID NO: 2020953 - DNA, 17 bp, Homo sapiens
gcagccagctctcagcc

SEQ ID NO: 2020954 - DNA, 17 bp, Homo sapiens
gcagccaggaggagagg

SEQ ID NO: 2020955 - DNA, 21 bp, Homo sapiens
gcagccaggggctgctcatca

SEQ ID NO: 2020956 - DNA, 13 bp, Homo sapiens
gcagccatgcctc

SEQ ID NO: 2020957 - DNA, 18 bp, Homo sapiens
gcagccatgcctcatgcc

SEQ ID NO: 2020958 - DNA, 20 bp, Homo sapiens
gcagccatgcctcatgccac

SEQ ID NO: 2020959 - DNA, 23 bp, Homo sapiens
gcagccatgcctcatgccacacc

SEQ ID NO: 2020960 - DNA, 19 bp, Homo sapiens
gcagcccagcttcctggtg

SEQ ID NO: 2020961 - DNA, 20 bp, Homo sapiens
gcagcccagggtagggagaa

SEQ ID NO: 2020962 - DNA, 15 bp, Homo sapiens
gcagcccccactttc

SEQ ID NO: 2020963 - DNA, 15 bp, Homo sapiens
gcagccccccagcac

SEQ ID NO: 2020964 - DNA, 17 bp, Homo sapiens
gcagccccgccctctgc

SEQ ID NO: 2020965 - DNA, 23 bp, Homo sapiens
gcagccccgcgcctccttccttg

SEQ ID NO: 2020966 - DNA, 17 bp, Homo sapiens
gcagcccgaagcccagt

SEQ ID NO: 2020967 - DNA, 18 bp, Homo sapiens
gcagcccgaagcccagtt

SEQ ID NO: 2020968 - DNA, 15 bp, Homo sapiens
gcagcccgtgaagca

SEQ ID NO: 2020969 - DNA, 22 bp, Homo sapiens
gcagcccgtgaagcagtgcctc

SEQ ID NO: 2020970 - DNA, 22 bp, Homo sapiens
gcagccctaaggatctctcagg

SEQ ID NO: 2020971 - DNA, 23 bp, Homo sapiens
gcagccctaaggatctctcagga

SEQ ID NO: 2020972 - DNA, 24 bp, Homo sapiens
gcagccctaaggatctctcaggag

SEQ ID NO: 2020973 - DNA, 13 bp, Homo sapiens
gcagccctgcttt

SEQ ID NO: 2020974 - DNA, 14 bp, Homo sapiens
gcagccctgctttg

SEQ ID NO: 2020975 - DNA, 20 bp, Homo sapiens
gcagccctgggggccagctg

SEQ ID NO: 2020976 - DNA, 19 bp, Homo sapiens
gcagccgctaggagagact

SEQ ID NO: 2020977 - DNA, 21 bp, Homo sapiens
gcagccgctaggagagactga

SEQ ID NO: 2020978 - DNA, 13 bp, Homo sapiens
gcagcctccagag

SEQ ID NO: 2020979 - DNA, 15 bp, Homo sapiens
gcagcctcctgggca

SEQ ID NO: 2020980 - DNA, 16 bp, Homo sapiens
gcagcctcctgggcag

SEQ ID NO: 2020981 - DNA, 15 bp, Homo sapiens
gcagcctgatggcca

SEQ ID NO: 2020982 - DNA, 21 bp, Homo sapiens
gcagcctgatggccaaggggg

SEQ ID NO: 2020983 - DNA, 11 bp, Homo sapiens
gcagcctggcg

SEQ ID NO: 2020984 - DNA, 16 bp, Homo sapiens
gcagccttcttttcaa

SEQ ID NO: 2020985 - DNA, 13 bp, Homo sapiens
gcagcctttctgt

SEQ ID NO: 2020986 - DNA, 22 bp, Homo sapiens
gcagcgagctatgatcgcgcca

SEQ ID NO: 2020987 - DNA, 22 bp, Homo sapiens
gcagcgcagccgccgggcaggc

SEQ ID NO: 2020988 - DNA, 14 bp, Homo sapiens
gcagctagactgga

SEQ ID NO: 2020989 - DNA, 19 bp, Homo sapiens
gcagctagactggagtgag

SEQ ID NO: 2020990 - DNA, 21 bp, Homo sapiens
gcagctagactggagtgaggc

SEQ ID NO: 2020991 - DNA, 18 bp, Homo sapiens
gcagctaggactgaggag

SEQ ID NO: 2020992 - DNA, 20 bp, Homo sapiens
gcagctaggactgaggagtg

SEQ ID NO: 2020993 - DNA, 21 bp, Homo sapiens
gcagctaggactgaggagtgg

SEQ ID NO: 2020994 - DNA, 22 bp, Homo sapiens
gcagctatgcgcaatgtggcat

SEQ ID NO: 2020995 - DNA, 19 bp, Homo sapiens
gcagctcctctccttgggc

SEQ ID NO: 2020996 - DNA, 13 bp, Homo sapiens
gcagctcctctgt

SEQ ID NO: 2020997 - DNA, 16 bp, Homo sapiens
gcagctgagagccctg

SEQ ID NO: 2020998 - DNA, 17 bp, Homo sapiens
gcagctgagagccctgc

SEQ ID NO: 2020999 - DNA, 16 bp, Homo sapiens
gcagctgagcagggcc

SEQ ID NO: 2021000 - DNA, 21 bp, Homo sapiens
gcagctgagcagggccgggga

SEQ ID NO: 2021001 - DNA, 16 bp, Homo sapiens
gcagctgcaccatcac

SEQ ID NO: 2021002 - DNA, 11 bp, Homo sapiens
gcagctgctct

SEQ ID NO: 2021003 - DNA, 13 bp, Homo sapiens
gcagctgctctta

SEQ ID NO: 2021004 - DNA, 20 bp, Homo sapiens
gcagctgcttttgtctatgg

SEQ ID NO: 2021005 - DNA, 16 bp, Homo sapiens
gcagctgggacccctc

SEQ ID NO: 2021006 - DNA, 22 bp, Homo sapiens
gcagctgggacccctcccaacc

SEQ ID NO: 2021007 - DNA, 18 bp, Homo sapiens
gcagctgggccccaccta

SEQ ID NO: 2021008 - DNA, 16 bp, Homo sapiens
gcagctgggccccatg

SEQ ID NO: 2021009 - DNA, 17 bp, Homo sapiens
gcagctgggccccatgc

SEQ ID NO: 2021010 - DNA, 19 bp, Homo sapiens
gcagctgggccggccagcc

SEQ ID NO: 2021011 - DNA, 22 bp, Homo sapiens
gcagctgtcatggaaaagccca

SEQ ID NO: 2021012 - DNA, 19 bp, Homo sapiens
gcagcttcatcaattttta

SEQ ID NO: 2021013 - DNA, 13 bp, Homo sapiens
gcagcttcctgtc

SEQ ID NO: 2021014 - DNA, 15 bp, Homo sapiens
gcagcttgagagggc

SEQ ID NO: 2021015 - DNA, 19 bp, Homo sapiens
gcagcttgagggttgggct

SEQ ID NO: 2021016 - DNA, 20 bp, Homo sapiens
gcagcttgtagccagccggg

SEQ ID NO: 2021017 - DNA, 14 bp, Homo sapiens
gcaggaacagagac

SEQ ID NO: 2021018 - DNA, 15 bp, Homo sapiens
gcaggaacagagact

SEQ ID NO: 2021019 - DNA, 19 bp, Homo sapiens
gcaggaacagagactctgg

SEQ ID NO: 2021020 - DNA, 14 bp, Homo sapiens
gcaggaacgagcac

SEQ ID NO: 2021021 - DNA, 18 bp, Homo sapiens
gcaggaacgagcactggc

SEQ ID NO: 2021022 - DNA, 21 bp, Homo sapiens
gcaggaacgagcactggccag

SEQ ID NO: 2021023 - DNA, 15 bp, Homo sapiens
gcaggaagagagaga

SEQ ID NO: 2021024 - DNA, 16 bp, Homo sapiens
gcaggaagccaggctg

SEQ ID NO: 2021025 - DNA, 13 bp, Homo sapiens
gcaggaagtctct

SEQ ID NO: 2021026 - DNA, 18 bp, Homo sapiens
gcaggaagtctctcccga

SEQ ID NO: 2021027 - DNA, 19 bp, Homo sapiens
gcaggaatcaaaaattgaa

SEQ ID NO: 2021028 - DNA, 13 bp, Homo sapiens
gcaggaccaggac

SEQ ID NO: 2021029 - DNA, 14 bp, Homo sapiens
gcaggaccaggact

SEQ ID NO: 2021030 - DNA, 15 bp, Homo sapiens
gcaggaccaggacta

SEQ ID NO: 2021031 - DNA, 16 bp, Homo sapiens
gcaggagcaggaacag

SEQ ID NO: 2021032 - DNA, 14 bp, Homo sapiens
gcaggaggattgct

SEQ ID NO: 2021033 - DNA, 18 bp, Homo sapiens
gcaggaggctagcaaagc

SEQ ID NO: 2021034 - DNA, 16 bp, Homo sapiens
gcaggagtagctgagc

SEQ ID NO: 2021035 - DNA, 18 bp, Homo sapiens
gcaggagtagctgagctc

SEQ ID NO: 2021036 - DNA, 19 bp, Homo sapiens
gcaggatccgctgccacca

SEQ ID NO: 2021037 - DNA, 16 bp, Homo sapiens
gcaggcacacagcagc

SEQ ID NO: 2021038 - DNA, 19 bp, Homo sapiens
gcaggcagggctctcctgg

SEQ ID NO: 2021039 - DNA, 20 bp, Homo sapiens
gcaggcagggctctcctggc

SEQ ID NO: 2021040 - DNA, 22 bp, Homo sapiens
gcaggcagggctctcctggctt

SEQ ID NO: 2021041 - DNA, 22 bp, Homo sapiens
gcaggccaagagcagaggcagc

SEQ ID NO: 2021042 - DNA, 15 bp, Homo sapiens
gcaggcccgacagag

SEQ ID NO: 2021043 - DNA, 18 bp, Homo sapiens
gcaggcccgacagagaga

SEQ ID NO: 2021044 - DNA, 22 bp, Homo sapiens
gcaggcccgacagagagatgaa

SEQ ID NO: 2021045 - DNA, 12 bp, Homo sapiens
gcaggcctagga

SEQ ID NO: 2021046 - DNA, 18 bp, Homo sapiens
gcaggcctgggacccagc

SEQ ID NO: 2021047 - DNA, 20 bp, Homo sapiens
gcaggcctgggacccagcta

SEQ ID NO: 2021048 - DNA, 22 bp, Homo sapiens
gcaggcctgggacccagctact

SEQ ID NO: 2021049 - DNA, 15 bp, Homo sapiens
gcaggctactgtcag

SEQ ID NO: 2021050 - DNA, 16 bp, Homo sapiens
gcaggctagaacctgg

SEQ ID NO: 2021051 - DNA, 18 bp, Homo sapiens
cttttgatggggagaaag

SEQ ID NO: 2021052 - DNA, 13 bp, Homo sapiens
cttttgcctggct

SEQ ID NO: 2021053 - DNA, 15 bp, Homo sapiens
cttttgcctggctgt

SEQ ID NO: 2021054 - DNA, 14 bp, Homo sapiens
cttttgctgtcttt

SEQ ID NO: 2021055 - DNA, 17 bp, Homo sapiens
cttttgctgtctttctc

SEQ ID NO: 2021056 - DNA, 19 bp, Homo sapiens
cttttgctgtctttctcta

SEQ ID NO: 2021057 - DNA, 16 bp, Homo sapiens
cttttgcttggcagag

SEQ ID NO: 2021058 - DNA, 15 bp, Homo sapiens
cttttggcactgaga

SEQ ID NO: 2021059 - DNA, 12 bp, Homo sapiens
cttttggccttg

SEQ ID NO: 2021060 - DNA, 12 bp, Homo sapiens
cttttgggggtt

SEQ ID NO: 2021061 - DNA, 15 bp, Homo sapiens
cttttggtctgtgtg

SEQ ID NO: 2021062 - DNA, 17 bp, Homo sapiens
cttttgtcatgtggcta

SEQ ID NO: 2021063 - DNA, 16 bp, Homo sapiens
cttttgtccccagggc

SEQ ID NO: 2021064 - DNA, 17 bp, Homo sapiens
cttttgtccccagggcc

SEQ ID NO: 2021065 - DNA, 17 bp, Homo sapiens
cttttgtctatgggact

SEQ ID NO: 2021066 - DNA, 23 bp, Homo sapiens
cttttgtgtacagtgtgtaaagt

SEQ ID NO: 2021067 - DNA, 22 bp, Homo sapiens
ctttttaaaaagtactctttaa

SEQ ID NO: 2021068 - DNA, 14 bp, Homo sapiens
ctttttagccagtg

SEQ ID NO: 2021069 - DNA, 18 bp, Homo sapiens
ctttttataatgtggatt

SEQ ID NO: 2021070 - DNA, 18 bp, Homo sapiens
ctttttatactccataca

SEQ ID NO: 2021071 - DNA, 23 bp, Homo sapiens
ctttttcaacttggaaaaagaaa

SEQ ID NO: 2021072 - DNA, 21 bp, Homo sapiens
ctttttcagagttgctttaaa

SEQ ID NO: 2021073 - DNA, 13 bp, Homo sapiens
ctttttccagagg

SEQ ID NO: 2021074 - DNA, 17 bp, Homo sapiens
ctttttccccaaagtct

SEQ ID NO: 2021075 - DNA, 16 bp, Homo sapiens
ctttttctgtctctct

SEQ ID NO: 2021076 - DNA, 18 bp, Homo sapiens
ctttttctttataaactt

SEQ ID NO: 2021077 - DNA, 21 bp, Homo sapiens
cttttttattctgttttcttg

SEQ ID NO: 2021078 - DNA, 21 bp, Homo sapiens
cttttttcaactggctgggac

SEQ ID NO: 2021079 - DNA, 20 bp, Homo sapiens
cttttttgtgtttttaaaag

SEQ ID NO: 2021080 - DNA, 15 bp, Homo sapiens
ctttttttctttggt

SEQ ID NO: 2021081 - DNA, 13 bp, Homo sapiens
gaaaaaaatgact

SEQ ID NO: 2021082 - DNA, 19 bp, Homo sapiens
gaaaaaaattacaaaatga

SEQ ID NO: 2021083 - DNA, 14 bp, Homo sapiens
gaaaaaatacattt

SEQ ID NO: 2021084 - DNA, 17 bp, Homo sapiens
gaaaaaatacattttat

SEQ ID NO: 2021085 - DNA, 14 bp, Homo sapiens
gaaaaaatgttcta

SEQ ID NO: 2021086 - DNA, 18 bp, Homo sapiens
gaaaaacacggcagctgt

SEQ ID NO: 2021087 - DNA, 23 bp, Homo sapiens
gaaaaacacggcagctgtagctc

SEQ ID NO: 2021088 - DNA, 18 bp, Homo sapiens
gaaaaacatctgaaagcc

SEQ ID NO: 2021089 - DNA, 15 bp, Homo sapiens
gaaaaaccaatgatt

SEQ ID NO: 2021090 - DNA, 18 bp, Homo sapiens
gaaaaaccaatgattcat

SEQ ID NO: 2021091 - DNA, 23 bp, Homo sapiens
gaaaaactctgggaaataagaga

SEQ ID NO: 2021092 - DNA, 19 bp, Homo sapiens
gaaaaagaaaaaaaaagca

SEQ ID NO: 2021093 - DNA, 11 bp, Homo sapiens
gaaaaatatga

SEQ ID NO: 2021094 - DNA, 21 bp, Homo sapiens
gaaaaatatgttgagtgttca

SEQ ID NO: 2021095 - DNA, 17 bp, Homo sapiens
gaaaaatccagaaagaa

SEQ ID NO: 2021096 - DNA, 18 bp, Homo sapiens
gaaaaatccagaaagaaa

SEQ ID NO: 2021097 - DNA, 22 bp, Homo sapiens
gaaaacaggacttaaaatgaca

SEQ ID NO: 2021098 - DNA, 21 bp, Homo sapiens
gaaaacataatatcttgaaga

SEQ ID NO: 2021099 - DNA, 18 bp, Homo sapiens
gaaaacatttcaaagctg

SEQ ID NO: 2021100 - DNA, 18 bp, Homo sapiens
gaaaaccaagccgtggct

SEQ ID NO: 2021101 - DNA, 21 bp, Homo sapiens
gaaaaccaagccgtggcttcc

SEQ ID NO: 2021102 - DNA, 14 bp, Homo sapiens
gaaaaccccagcat

SEQ ID NO: 2021103 - DNA, 17 bp, Homo sapiens
gaaaacgggaaagaata

SEQ ID NO: 2021104 - DNA, 15 bp, Homo sapiens
gaaaactattttaaa

SEQ ID NO: 2021105 - DNA, 19 bp, Homo sapiens
gaaaacttagaaataagaa

SEQ ID NO: 2021106 - DNA, 14 bp, Homo sapiens
gaaaacttgaatct

SEQ ID NO: 2021107 - DNA, 21 bp, Homo sapiens
gaaaagaatccctgcagcctg

SEQ ID NO: 2021108 - DNA, 16 bp, Homo sapiens
gaaaagaccagggctt

SEQ ID NO: 2021109 - DNA, 14 bp, Homo sapiens
gaaaagaccctgag

SEQ ID NO: 2021110 - DNA, 16 bp, Homo sapiens
gaaaagaccctgagac

SEQ ID NO: 2021111 - DNA, 22 bp, Homo sapiens
gaaaagaccctgagactccaga

SEQ ID NO: 2021112 - DNA, 18 bp, Homo sapiens
gaaaagaggaaaaaaagc

SEQ ID NO: 2021113 - DNA, 12 bp, Homo sapiens
gaaaagaggagt

SEQ ID NO: 2021114 - DNA, 18 bp, Homo sapiens
gaaaagatgagaggcaga

SEQ ID NO: 2021115 - DNA, 16 bp, Homo sapiens
gaaaagcacctgccga

SEQ ID NO: 2021116 - DNA, 17 bp, Homo sapiens
gaaaagcacctgccgac

SEQ ID NO: 2021117 - DNA, 21 bp, Homo sapiens
gaaaagcccagtgacctgacc

SEQ ID NO: 2021118 - DNA, 19 bp, Homo sapiens
gaaaagctgctgacagtgt

SEQ ID NO: 2021119 - DNA, 19 bp, Homo sapiens
gaaaaggagaaaggagctc

SEQ ID NO: 2021120 - DNA, 12 bp, Homo sapiens
gaaaaggcctgg

SEQ ID NO: 2021121 - DNA, 16 bp, Homo sapiens
gaaaaggcctggggtg

SEQ ID NO: 2021122 - DNA, 14 bp, Homo sapiens
gaaaagggtcttct

SEQ ID NO: 2021123 - DNA, 23 bp, Homo sapiens
gaaaaggtagcttacctgacaca

SEQ ID NO: 2021124 - DNA, 23 bp, Homo sapiens
gaaaaggttcttcatccctttcc

SEQ ID NO: 2021125 - DNA, 14 bp, Homo sapiens
gaaaagtacattta

SEQ ID NO: 2021126 - DNA, 16 bp, Homo sapiens
gaaaagtacatttaat

SEQ ID NO: 2021127 - DNA, 20 bp, Homo sapiens
gaaaagtagaattatatcta

SEQ ID NO: 2021128 - DNA, 20 bp, Homo sapiens
gaaaagtgcttagaaagtta

SEQ ID NO: 2021129 - DNA, 21 bp, Homo sapiens
gaaaagtgcttagaaagttat

SEQ ID NO: 2021130 - DNA, 13 bp, Homo sapiens
gaaaagtgttatt

SEQ ID NO: 2021131 - DNA, 19 bp, Homo sapiens
gaaaataaattttgaatgt

SEQ ID NO: 2021132 - DNA, 19 bp, Homo sapiens
gaaaataagtgaataataa

SEQ ID NO: 2021133 - DNA, 13 bp, Homo sapiens
gaaaataattgtt

SEQ ID NO: 2021134 - DNA, 19 bp, Homo sapiens
gaaaatagctctttcaggg

SEQ ID NO: 2021135 - DNA, 15 bp, Homo sapiens
gaaaatataaatgca

SEQ ID NO: 2021136 - DNA, 16 bp, Homo sapiens
gaaaatataaatgcat

SEQ ID NO: 2021137 - DNA, 18 bp, Homo sapiens
gaaaatataaatgcatga

SEQ ID NO: 2021138 - DNA, 14 bp, Homo sapiens
gaaaatcaaagtaa

SEQ ID NO: 2021139 - DNA, 20 bp, Homo sapiens
gaaaatcagttatattcttt

SEQ ID NO: 2021140 - DNA, 23 bp, Homo sapiens
gaaaatgagtttttatggggctg

SEQ ID NO: 2021141 - DNA, 23 bp, Homo sapiens
gaaaatgtaacttttcttacagc

SEQ ID NO: 2021142 - DNA, 21 bp, Homo sapiens
gaaaatgtcagaaaccagtta

SEQ ID NO: 2021143 - DNA, 22 bp, Homo sapiens
gaaaatgtcagaaaccagttat

SEQ ID NO: 2021144 - DNA, 23 bp, Homo sapiens
gaaaatgtcagaaaccagttatg

SEQ ID NO: 2021145 - DNA, 15 bp, Homo sapiens
gaaaatgtcctgtgg

SEQ ID NO: 2021146 - DNA, 18 bp, Homo sapiens
gaaaatgtgtcagcatgc

SEQ ID NO: 2021147 - DNA, 14 bp, Homo sapiens
gaaaatgttcatca

SEQ ID NO: 2021148 - DNA, 22 bp, Homo sapiens
gaaaattaggatttcatgattt

SEQ ID NO: 2021149 - DNA, 17 bp, Homo sapiens
gaaacaaatttttttct

SEQ ID NO: 2021150 - DNA, 22 bp, Homo sapiens
gaaacaagttattctcttcact

SEQ ID NO: 2021151 - DNA, 14 bp, Homo sapiens
gaaacacaatattt

SEQ ID NO: 2021152 - DNA, 15 bp, Homo sapiens
gaaacacaatatttt

SEQ ID NO: 2021153 - DNA, 13 bp, Homo sapiens
gaaacaccattca

SEQ ID NO: 2021154 - DNA, 15 bp, Homo sapiens
gaaacacctcccagg

SEQ ID NO: 2021155 - DNA, 22 bp, Homo sapiens
gaaacagaaacaaaaacactaa

SEQ ID NO: 2021156 - DNA, 15 bp, Homo sapiens
gaaacagaagtagaa

SEQ ID NO: 2021157 - DNA, 16 bp, Homo sapiens
gaaacagagacaggcc

SEQ ID NO: 2021158 - DNA, 17 bp, Homo sapiens
gaaacagatgataaata

SEQ ID NO: 2021159 - DNA, 21 bp, Homo sapiens
gaaacagatgataaatattta

SEQ ID NO: 2021160 - DNA, 15 bp, Homo sapiens
gaaacatggttttga

SEQ ID NO: 2021161 - DNA, 15 bp, Homo sapiens
gaaacatttatggaa

SEQ ID NO: 2021162 - DNA, 13 bp, Homo sapiens
gaaacattttcat

SEQ ID NO: 2021163 - DNA, 13 bp, Homo sapiens
gaaacattttctt

SEQ ID NO: 2021164 - DNA, 15 bp, Homo sapiens
gaaaccaaagccagg

SEQ ID NO: 2021165 - DNA, 21 bp, Homo sapiens
gaaaccacacttcttgaaaca

SEQ ID NO: 2021166 - DNA, 18 bp, Homo sapiens
gaaaccacaggcccttgg

SEQ ID NO: 2021167 - DNA, 13 bp, Homo sapiens
ctgccttccagga

SEQ ID NO: 2021168 - DNA, 12 bp, Homo sapiens
ctgccttcctca

SEQ ID NO: 2021169 - DNA, 16 bp, Homo sapiens
ctgccttgaagccact

SEQ ID NO: 2021170 - DNA, 21 bp, Homo sapiens
ctgccttgatgaagcctgtgc

SEQ ID NO: 2021171 - DNA, 17 bp, Homo sapiens
ctgcctttggaagaaac

SEQ ID NO: 2021172 - DNA, 18 bp, Homo sapiens
ctgccttttttcacagcc

SEQ ID NO: 2021173 - DNA, 19 bp, Homo sapiens
ctgcgaaaacgttgacccc

SEQ ID NO: 2021174 - DNA, 21 bp, Homo sapiens
ctgcgaaaacgttgacccctt

SEQ ID NO: 2021175 - DNA, 17 bp, Homo sapiens
ctgcgatcttcagagca

SEQ ID NO: 2021176 - DNA, 20 bp, Homo sapiens
ctgcgatcttcagagcaggg

SEQ ID NO: 2021177 - DNA, 17 bp, Homo sapiens
ctgcgattttgcctgtg

SEQ ID NO: 2021178 - DNA, 21 bp, Homo sapiens
ctgcggaatgaaccacatctt

SEQ ID NO: 2021179 - DNA, 17 bp, Homo sapiens
ctgcggagccggcacct

SEQ ID NO: 2021180 - DNA, 14 bp, Homo sapiens
ctgcggccgggctg

SEQ ID NO: 2021181 - DNA, 16 bp, Homo sapiens
ctgcggctgctgtgtg

SEQ ID NO: 2021182 - DNA, 18 bp, Homo sapiens
ctgcgggacagaggacca

SEQ ID NO: 2021183 - DNA, 17 bp, Homo sapiens
ctgcgggatggtcctgg

SEQ ID NO: 2021184 - DNA, 16 bp, Homo sapiens
ctgcgggtctgaagga

SEQ ID NO: 2021185 - DNA, 19 bp, Homo sapiens
ctgcggtccacccaggagc

SEQ ID NO: 2021186 - DNA, 19 bp, Homo sapiens
ctgcggtggtgccagaggt

SEQ ID NO: 2021187 - DNA, 19 bp, Homo sapiens
ctgcgtagagcctggaagg

SEQ ID NO: 2021188 - DNA, 15 bp, Homo sapiens
ctgcgtcccccagcc

SEQ ID NO: 2021189 - DNA, 18 bp, Homo sapiens
ctgcgtcctgacgccctg

SEQ ID NO: 2021190 - DNA, 19 bp, Homo sapiens
ctgcgtcctgacgccctgc

SEQ ID NO: 2021191 - DNA, 14 bp, Homo sapiens
ctgcgtctccatca

SEQ ID NO: 2021192 - DNA, 13 bp, Homo sapiens
ctgcgtctgtgtt

SEQ ID NO: 2021193 - DNA, 20 bp, Homo sapiens
ctgcgtgcagggacaaagag

SEQ ID NO: 2021194 - DNA, 21 bp, Homo sapiens
ctgcgttggagccactcctgt

SEQ ID NO: 2021195 - DNA, 22 bp, Homo sapiens
ctgcgttggagccactcctgtc

SEQ ID NO: 2021196 - DNA, 17 bp, Homo sapiens
ctgctaaatactgtaca

SEQ ID NO: 2021197 - DNA, 14 bp, Homo sapiens
ctgctaaatgaaga

SEQ ID NO: 2021198 - DNA, 14 bp, Homo sapiens
ctgctaagtagggg

SEQ ID NO: 2021199 - DNA, 16 bp, Homo sapiens
ctgctaataaaaccca

SEQ ID NO: 2021200 - DNA, 22 bp, Homo sapiens
ctgctacaagaatgcaaaaaat

SEQ ID NO: 2021201 - DNA, 17 bp, Homo sapiens
ctgctacccagaaatca

SEQ ID NO: 2021202 - DNA, 17 bp, Homo sapiens
ctgctactacccgagcc

SEQ ID NO: 2021203 - DNA, 19 bp, Homo sapiens
ctgctactacccgagccca

SEQ ID NO: 2021204 - DNA, 21 bp, Homo sapiens
ctgctactacccgagcccagc

SEQ ID NO: 2021205 - DNA, 23 bp, Homo sapiens
ctgctactacccgagcccagcta

SEQ ID NO: 2021206 - DNA, 22 bp, Homo sapiens
ctgctactcataagttggacca

SEQ ID NO: 2021207 - DNA, 17 bp, Homo sapiens
ctgctactcctgtgctc

SEQ ID NO: 2021208 - DNA, 13 bp, Homo sapiens
ctgctagagcaac

SEQ ID NO: 2021209 - DNA, 14 bp, Homo sapiens
ctgctagagcaacc

SEQ ID NO: 2021210 - DNA, 16 bp, Homo sapiens
ctgctagagcaacccc

SEQ ID NO: 2021211 - DNA, 19 bp, Homo sapiens
ctgctagagcaacccctgt

SEQ ID NO: 2021212 - DNA, 21 bp, Homo sapiens
ctgctagcacttggagccaag

SEQ ID NO: 2021213 - DNA, 15 bp, Homo sapiens
ctgctagctgtagaa

SEQ ID NO: 2021214 - DNA, 20 bp, Homo sapiens
ctgctatatgccttaagcca

SEQ ID NO: 2021215 - DNA, 19 bp, Homo sapiens
ctgctatattttcatgact

SEQ ID NO: 2021216 - DNA, 15 bp, Homo sapiens
ctgctcaacctctct

SEQ ID NO: 2021217 - DNA, 18 bp, Homo sapiens
ctgctcaacctctctcct

SEQ ID NO: 2021218 - DNA, 14 bp, Homo sapiens
ctgctcagaggggc

SEQ ID NO: 2021219 - DNA, 16 bp, Homo sapiens
ctgctcagcaggccct

SEQ ID NO: 2021220 - DNA, 15 bp, Homo sapiens
ctgctcataacatct

SEQ ID NO: 2021221 - DNA, 16 bp, Homo sapiens
ctgctcatcacccagt

SEQ ID NO: 2021222 - DNA, 18 bp, Homo sapiens
ctgctcatcacccagtcc

SEQ ID NO: 2021223 - DNA, 19 bp, Homo sapiens
ctgctcatcacccagtcct

SEQ ID NO: 2021224 - DNA, 20 bp, Homo sapiens
ctgctcatcacccagtcctg

SEQ ID NO: 2021225 - DNA, 12 bp, Homo sapiens
ctgctcatcatt

SEQ ID NO: 2021226 - DNA, 15 bp, Homo sapiens
ctgctcattccttct

SEQ ID NO: 2021227 - DNA, 15 bp, Homo sapiens
ctgctcccatctgca

SEQ ID NO: 2021228 - DNA, 18 bp, Homo sapiens
ctgctccccagccctggc

SEQ ID NO: 2021229 - DNA, 21 bp, Homo sapiens
ctgctcccccaccccctcccc

SEQ ID NO: 2021230 - DNA, 14 bp, Homo sapiens
ctgctcctccaggg

SEQ ID NO: 2021231 - DNA, 16 bp, Homo sapiens
ctgctcctccagggcc

SEQ ID NO: 2021232 - DNA, 17 bp, Homo sapiens
ctgctcctccagggcca

SEQ ID NO: 2021233 - DNA, 24 bp, Homo sapiens
ctgctcctccagggccacgtgcca

SEQ ID NO: 2021234 - DNA, 13 bp, Homo sapiens
ctgctcctcccat

SEQ ID NO: 2021235 - DNA, 15 bp, Homo sapiens
ctgctcctctccagg

SEQ ID NO: 2021236 - DNA, 18 bp, Homo sapiens
ctgctcctctccccagca

SEQ ID NO: 2021237 - DNA, 14 bp, Homo sapiens
ctgctcgcacagat

SEQ ID NO: 2021238 - DNA, 18 bp, Homo sapiens
ctgctcgtccccaagtga

SEQ ID NO: 2021239 - DNA, 14 bp, Homo sapiens
ctgctctagccagg

SEQ ID NO: 2021240 - DNA, 14 bp, Homo sapiens
ctgctctagctggc

SEQ ID NO: 2021241 - DNA, 18 bp, Homo sapiens
ctgctctagctggcagga

SEQ ID NO: 2021242 - DNA, 17 bp, Homo sapiens
ctgctctcagcctccca

SEQ ID NO: 2021243 - DNA, 16 bp, Homo sapiens
ctgctctcatgcctgc

SEQ ID NO: 2021244 - DNA, 21 bp, Homo sapiens
ctgctctcctcttgccactgc

SEQ ID NO: 2021245 - DNA, 13 bp, Homo sapiens
ctgctctgaggct

SEQ ID NO: 2021246 - DNA, 22 bp, Homo sapiens
ctgctctgaggcttccagagag

SEQ ID NO: 2021247 - DNA, 11 bp, Homo sapiens
ctgctctgcca

SEQ ID NO: 2021248 - DNA, 11 bp, Homo sapiens
ctgctctgcta

SEQ ID NO: 2021249 - DNA, 13 bp, Homo sapiens
ctgctctggaaaa

SEQ ID NO: 2021250 - DNA, 13 bp, Homo sapiens
ctgctctggggat

SEQ ID NO: 2021251 - DNA, 15 bp, Homo sapiens
ctgctcttagtgccc

SEQ ID NO: 2021252 - DNA, 17 bp, Homo sapiens
ctgctcttagtgcccgc

SEQ ID NO: 2021253 - DNA, 19 bp, Homo sapiens
ctgctcttagtgcccgcct

SEQ ID NO: 2021254 - DNA, 17 bp, Homo sapiens
ctgctcttccaaagctc

SEQ ID NO: 2021255 - DNA, 14 bp, Homo sapiens
ctgctcttgcctgc

SEQ ID NO: 2021256 - DNA, 15 bp, Homo sapiens
ctgctcttgcctgca

SEQ ID NO: 2021257 - DNA, 18 bp, Homo sapiens
ctgctgaaacaacaaata

SEQ ID NO: 2021258 - DNA, 16 bp, Homo sapiens
ctgctgaaacacctcc

SEQ ID NO: 2021259 - DNA, 20 bp, Homo sapiens
ctgctgaaacacctcccagg

SEQ ID NO: 2021260 - DNA, 17 bp, Homo sapiens
ctgctgaaggaataaat

SEQ ID NO: 2021261 - DNA, 17 bp, Homo sapiens
ctgctgaagttctgagc

SEQ ID NO: 2021262 - DNA, 12 bp, Homo sapiens
ctgctgacagtg

SEQ ID NO: 2021263 - DNA, 13 bp, Homo sapiens
ctgctgacagtgt

SEQ ID NO: 2021264 - DNA, 14 bp, Homo sapiens
ctgctgagaacctg

SEQ ID NO: 2021265 - DNA, 15 bp, Homo sapiens
ctgctgagaacctgg

SEQ ID NO: 2021266 - DNA, 20 bp, Homo sapiens
ctgcaggaacgagcactggc

SEQ ID NO: 2021267 - DNA, 22 bp, Homo sapiens
ctgcaggaacgagcactggcca

SEQ ID NO: 2021268 - DNA, 24 bp, Homo sapiens
ctgcaggaacgagcactggccaga

SEQ ID NO: 2021269 - DNA, 19 bp, Homo sapiens
ctgcaggacttctgcctga

SEQ ID NO: 2021270 - DNA, 19 bp, Homo sapiens
ctgcaggccaagagcagag

SEQ ID NO: 2021271 - DNA, 22 bp, Homo sapiens
ctgcaggccaagagcagaggca

SEQ ID NO: 2021272 - DNA, 20 bp, Homo sapiens
ctgcaggccccgcttgtcca

SEQ ID NO: 2021273 - DNA, 20 bp, Homo sapiens
ctgcagggagcaactctcca

SEQ ID NO: 2021274 - DNA, 22 bp, Homo sapiens
ctgcagggagtccgaaagggac

SEQ ID NO: 2021275 - DNA, 20 bp, Homo sapiens
ctgcagggggtgtgtctgct

SEQ ID NO: 2021276 - DNA, 19 bp, Homo sapiens
ctgcaggtacttcctcctg

SEQ ID NO: 2021277 - DNA, 20 bp, Homo sapiens
ctgcagtatggccatgggct

SEQ ID NO: 2021278 - DNA, 23 bp, Homo sapiens
ctgcagtcaacagttcaaagaag

SEQ ID NO: 2021279 - DNA, 21 bp, Homo sapiens
ctgcagtcagtcatgatggca

SEQ ID NO: 2021280 - DNA, 14 bp, Homo sapiens
ctgcagtccgcagt

SEQ ID NO: 2021281 - DNA, 16 bp, Homo sapiens
ctgcagtgaggctgtg

SEQ ID NO: 2021282 - DNA, 14 bp, Homo sapiens
ctgcagttcctgag

SEQ ID NO: 2021283 - DNA, 18 bp, Homo sapiens
ctgcagttggcagaaagg

SEQ ID NO: 2021284 - DNA, 22 bp, Homo sapiens
ctgcatatcggaggtggtggag

SEQ ID NO: 2021285 - DNA, 23 bp, Homo sapiens
ctgcatatcggaggtggtggagg

SEQ ID NO: 2021286 - DNA, 20 bp, Homo sapiens
ctgcatcagctgctgaaaca

SEQ ID NO: 2021287 - DNA, 16 bp, Homo sapiens
ctgcatccccttggct

SEQ ID NO: 2021288 - DNA, 22 bp, Homo sapiens
ctgcatctattctttgtaccat

SEQ ID NO: 2021289 - DNA, 16 bp, Homo sapiens
ctgcatctcaaaaaaa

SEQ ID NO: 2021290 - DNA, 21 bp, Homo sapiens
ctgcatctgggattcccacca

SEQ ID NO: 2021291 - DNA, 12 bp, Homo sapiens
ctgcatgctctg

SEQ ID NO: 2021292 - DNA, 13 bp, Homo sapiens
ctgcatgctctgg

SEQ ID NO: 2021293 - DNA, 19 bp, Homo sapiens
ctgcatgtgttgtacaata

SEQ ID NO: 2021294 - DNA, 15 bp, Homo sapiens
ctgcattagaaatta

SEQ ID NO: 2021295 - DNA, 19 bp, Homo sapiens
ctgcattgttattgtggaa

SEQ ID NO: 2021296 - DNA, 20 bp, Homo sapiens
ctgcatttataaatgtgtgg

SEQ ID NO: 2021297 - DNA, 14 bp, Homo sapiens
ctgcatttctgagt

SEQ ID NO: 2021298 - DNA, 15 bp, Homo sapiens
ctgcatttgtgaaat

SEQ ID NO: 2021299 - DNA, 17 bp, Homo sapiens
ctgcatttgtgaaatga

SEQ ID NO: 2021300 - DNA, 22 bp, Homo sapiens
ctgcatttgtgaaatgatggtg

SEQ ID NO: 2021301 - DNA, 23 bp, Homo sapiens
ctgcattttacgtctttggagga

SEQ ID NO: 2021302 - DNA, 18 bp, Homo sapiens
ctgcatttttttacctta

SEQ ID NO: 2021303 - DNA, 20 bp, Homo sapiens
ctgccaaattttggccaaag

SEQ ID NO: 2021304 - DNA, 11 bp, Homo sapiens
ctgccaagaaa

SEQ ID NO: 2021305 - DNA, 12 bp, Homo sapiens
ctgccaagagag

SEQ ID NO: 2021306 - DNA, 14 bp, Homo sapiens
ctgccaagccacct

SEQ ID NO: 2021307 - DNA, 22 bp, Homo sapiens
ctgccaagcctattgtgcctct

SEQ ID NO: 2021308 - DNA, 18 bp, Homo sapiens
ctgccacaccctccccat

SEQ ID NO: 2021309 - DNA, 23 bp, Homo sapiens
ctgccacactcagtcccccacca

SEQ ID NO: 2021310 - DNA, 22 bp, Homo sapiens
ctgccacacttcaggctcttct

SEQ ID NO: 2021311 - DNA, 13 bp, Homo sapiens
ctgccacagagag

SEQ ID NO: 2021312 - DNA, 16 bp, Homo sapiens
ctgccaccacgtctgc

SEQ ID NO: 2021313 - DNA, 14 bp, Homo sapiens
ctgccaccatcctg

SEQ ID NO: 2021314 - DNA, 19 bp, Homo sapiens
ctgccaccatcctgctgct

SEQ ID NO: 2021315 - DNA, 22 bp, Homo sapiens
ctgccacccaggcaggccctgc

SEQ ID NO: 2021316 - DNA, 21 bp, Homo sapiens
ctgccaccctggggagaaagt

SEQ ID NO: 2021317 - DNA, 11 bp, Homo sapiens
ctgccacctcc

SEQ ID NO: 2021318 - DNA, 13 bp, Homo sapiens
ctgccacctcccc

SEQ ID NO: 2021319 - DNA, 19 bp, Homo sapiens
ctgccactaacctgtagaa

SEQ ID NO: 2021320 - DNA, 23 bp, Homo sapiens
ctgccactttggtacatggccag

SEQ ID NO: 2021321 - DNA, 23 bp, Homo sapiens
ctgccagagcccaagtgccatcc

SEQ ID NO: 2021322 - DNA, 24 bp, Homo sapiens
ctgccagagcccaagtgccatccc

SEQ ID NO: 2021323 - DNA, 13 bp, Homo sapiens
ctgccagccagca

SEQ ID NO: 2021324 - DNA, 14 bp, Homo sapiens
ctgccagccagcag

SEQ ID NO: 2021325 - DNA, 15 bp, Homo sapiens
ctgccagccagcagc

SEQ ID NO: 2021326 - DNA, 18 bp, Homo sapiens
ctgccagccagcagccag

SEQ ID NO: 2021327 - DNA, 14 bp, Homo sapiens
ctgccagcctggct

SEQ ID NO: 2021328 - DNA, 16 bp, Homo sapiens
ctgccagcctggcttc

SEQ ID NO: 2021329 - DNA, 20 bp, Homo sapiens
ctgccagcctggcttctgga

SEQ ID NO: 2021330 - DNA, 13 bp, Homo sapiens
ctgccaggacacc

SEQ ID NO: 2021331 - DNA, 20 bp, Homo sapiens
ctgccaggacacctgcccca

SEQ ID NO: 2021332 - DNA, 19 bp, Homo sapiens
ctgccaggaggctgcggcc

SEQ ID NO: 2021333 - DNA, 20 bp, Homo sapiens
ctgccaggagggacaaagga

SEQ ID NO: 2021334 - DNA, 13 bp, Homo sapiens
ctgccaggcacct

SEQ ID NO: 2021335 - DNA, 14 bp, Homo sapiens
ctgccaggcacctg

SEQ ID NO: 2021336 - DNA, 17 bp, Homo sapiens
ctgccaggcacctggcc

SEQ ID NO: 2021337 - DNA, 22 bp, Homo sapiens
ctgccaggcacctggcctgctg

SEQ ID NO: 2021338 - DNA, 23 bp, Homo sapiens
ctgccaggcacctggcctgctgg

SEQ ID NO: 2021339 - DNA, 16 bp, Homo sapiens
ctgccaggcccatctc

SEQ ID NO: 2021340 - DNA, 18 bp, Homo sapiens
ctgccaggcccatctcag

SEQ ID NO: 2021341 - DNA, 22 bp, Homo sapiens
ctgccaggcccatctcaggtgc

SEQ ID NO: 2021342 - DNA, 21 bp, Homo sapiens
ctgccaggcgttggtgccact

SEQ ID NO: 2021343 - DNA, 19 bp, Homo sapiens
ctgccagggcccctgttcc

SEQ ID NO: 2021344 - DNA, 12 bp, Homo sapiens
ctgccagggctc

SEQ ID NO: 2021345 - DNA, 12 bp, Homo sapiens
ctgccagtgcct

SEQ ID NO: 2021346 - DNA, 13 bp, Homo sapiens
ctgccagtgcctt

SEQ ID NO: 2021347 - DNA, 18 bp, Homo sapiens
ctgccagtgccttacctc

SEQ ID NO: 2021348 - DNA, 12 bp, Homo sapiens
ctgccagtgttt

SEQ ID NO: 2021349 - DNA, 22 bp, Homo sapiens
ctgccagtgtttagaagagcct

SEQ ID NO: 2021350 - DNA, 15 bp, Homo sapiens
ctgccataaagccat

SEQ ID NO: 2021351 - DNA, 19 bp, Homo sapiens
ctgccataccgctggggaa

SEQ ID NO: 2021352 - DNA, 22 bp, Homo sapiens
ctgccataccgctggggaacag

SEQ ID NO: 2021353 - DNA, 13 bp, Homo sapiens
ctgccatgccact

SEQ ID NO: 2021354 - DNA, 19 bp, Homo sapiens
ctgccatgccactgccagg

SEQ ID NO: 2021355 - DNA, 16 bp, Homo sapiens
ctgccatgcccagaga

SEQ ID NO: 2021356 - DNA, 13 bp, Homo sapiens
ctgccatgcctca

SEQ ID NO: 2021357 - DNA, 21 bp, Homo sapiens
ctgccatgcctcaagaacacc

SEQ ID NO: 2021358 - DNA, 22 bp, Homo sapiens
ctgccatggcgtgtccctctcg

SEQ ID NO: 2021359 - DNA, 20 bp, Homo sapiens
ctgccatttgcaccctccgc

SEQ ID NO: 2021360 - DNA, 17 bp, Homo sapiens
ctgcccaacctgctctc

SEQ ID NO: 2021361 - DNA, 16 bp, Homo sapiens
ctgcccaatgctttgg

SEQ ID NO: 2021362 - DNA, 19 bp, Homo sapiens
ctgcccacttcagcccagc

SEQ ID NO: 2021363 - DNA, 23 bp, Homo sapiens
ctgcccagaacccttcctgagac

SEQ ID NO: 2021364 - DNA, 20 bp, Homo sapiens
ctgcccagaattcccagctg

SEQ ID NO: 2021365 - DNA, 21 bp, Homo sapiens
ctgcccagaattcccagctgt

SEQ ID NO: 2021366 - DNA, 17 bp, Homo sapiens
ctgcccagcctcgcatg

SEQ ID NO: 2021367 - DNA, 18 bp, Homo sapiens
ctgcccaggcccctgcca

SEQ ID NO: 2021368 - DNA, 19 bp, Homo sapiens
ctgcccaggcccctgccac

SEQ ID NO: 2021369 - DNA, 19 bp, Homo sapiens
ctgcccatacccctgcctg

SEQ ID NO: 2021370 - DNA, 22 bp, Homo sapiens
ctgcccatacccctgcctgggt

SEQ ID NO: 2021371 - DNA, 17 bp, Homo sapiens
ctgccccaactcctgga

SEQ ID NO: 2021372 - DNA, 18 bp, Homo sapiens
ctgccccaactcctggaa

SEQ ID NO: 2021373 - DNA, 22 bp, Homo sapiens
gaagaaaactatcctgcgggtt

SEQ ID NO: 2021374 - DNA, 20 bp, Homo sapiens
gaagaaacaaggttttcagt

SEQ ID NO: 2021375 - DNA, 16 bp, Homo sapiens
gaagaaacaggggatc

SEQ ID NO: 2021376 - DNA, 14 bp, Homo sapiens
gaagaaaccccaag

SEQ ID NO: 2021377 - DNA, 16 bp, Homo sapiens
gaagaaagaacggaag

SEQ ID NO: 2021378 - DNA, 19 bp, Homo sapiens
gaagaaagaacggaagaag

SEQ ID NO: 2021379 - DNA, 20 bp, Homo sapiens
gaagaaagaacggaagaaga

SEQ ID NO: 2021380 - DNA, 23 bp, Homo sapiens
gaagaaagaggtgaccccagggc

SEQ ID NO: 2021381 - DNA, 23 bp, Homo sapiens
gaagaaagggtctgataaacaca

SEQ ID NO: 2021382 - DNA, 21 bp, Homo sapiens
gaagaaatccataacaccccc

SEQ ID NO: 2021383 - DNA, 16 bp, Homo sapiens
gaagaacatccaagga

SEQ ID NO: 2021384 - DNA, 20 bp, Homo sapiens
gaagaacatccaaggagaaa

SEQ ID NO: 2021385 - DNA, 18 bp, Homo sapiens
gaagaagacacattccta

SEQ ID NO: 2021386 - DNA, 23 bp, Homo sapiens
gaagaatacttctcattttttaa

SEQ ID NO: 2021387 - DNA, 13 bp, Homo sapiens
gaagaatataaat

SEQ ID NO: 2021388 - DNA, 14 bp, Homo sapiens
gaagaatattcagg

SEQ ID NO: 2021389 - DNA, 14 bp, Homo sapiens
gaaggcaggcaggg

SEQ ID NO: 2021390 - DNA, 21 bp, Homo sapiens
gaaggcaggcagggctctcct

SEQ ID NO: 2021391 - DNA, 21 bp, Homo sapiens
gaaggcagggacagagatgga

SEQ ID NO: 2021392 - DNA, 13 bp, Homo sapiens
gaaggcagggcag

SEQ ID NO: 2021393 - DNA, 14 bp, Homo sapiens
gaaggcagggcaga

SEQ ID NO: 2021394 - DNA, 15 bp, Homo sapiens
gaaggcagggcagag

SEQ ID NO: 2021395 - DNA, 13 bp, Homo sapiens
gaaggcatggcgg

SEQ ID NO: 2021396 - DNA, 21 bp, Homo sapiens
gaaggccgctgccccagcccc

SEQ ID NO: 2021397 - DNA, 18 bp, Homo sapiens
gaaggcctcttgtgctca

SEQ ID NO: 2021398 - DNA, 14 bp, Homo sapiens
gaaggcgaggagag

SEQ ID NO: 2021399 - DNA, 17 bp, Homo sapiens
gaaggctactggcatta

SEQ ID NO: 2021400 - DNA, 16 bp, Homo sapiens
gaaggcttcctccagc

SEQ ID NO: 2021401 - DNA, 23 bp, Homo sapiens
gaaggctttgccatgggcctgct

SEQ ID NO: 2021402 - DNA, 14 bp, Homo sapiens
gaagggaaatctta

SEQ ID NO: 2021403 - DNA, 17 bp, Homo sapiens
gaagggaagcctcttca

SEQ ID NO: 2021404 - DNA, 20 bp, Homo sapiens
gaagggaccttgaagggtaa

SEQ ID NO: 2021405 - DNA, 18 bp, Homo sapiens
gaagggagttgctcactc

SEQ ID NO: 2021406 - DNA, 20 bp, Homo sapiens
gaagggagttgctcactcag

SEQ ID NO: 2021407 - DNA, 22 bp, Homo sapiens
gaagggagttgctcactcagga

SEQ ID NO: 2021408 - DNA, 23 bp, Homo sapiens
gaagggagttgctcactcaggac

SEQ ID NO: 2021409 - DNA, 11 bp, Homo sapiens
gaagggcaccg

SEQ ID NO: 2021410 - DNA, 15 bp, Homo sapiens
gaagggccagcccta

SEQ ID NO: 2021411 - DNA, 14 bp, Homo sapiens
gaagggccaggaga

SEQ ID NO: 2021412 - DNA, 11 bp, Homo sapiens
gaagggccagt

SEQ ID NO: 2021413 - DNA, 20 bp, Homo sapiens
gaagggccagtctgggctgc

SEQ ID NO: 2021414 - DNA, 19 bp, Homo sapiens
gaagggctagaacctggag

SEQ ID NO: 2021415 - DNA, 19 bp, Homo sapiens
gaaggggacagcgccacct

SEQ ID NO: 2021416 - DNA, 19 bp, Homo sapiens
gaaggggacgcgggctgtg

SEQ ID NO: 2021417 - DNA, 20 bp, Homo sapiens
gaaggggacgcgggctgtgc

SEQ ID NO: 2021418 - DNA, 22 bp, Homo sapiens
gaaggggcacgcctgcccagcc

SEQ ID NO: 2021419 - DNA, 21 bp, Homo sapiens
gaaggggccccggggctggca

SEQ ID NO: 2021420 - DNA, 23 bp, Homo sapiens
gaaggggccctggtccttccagg

SEQ ID NO: 2021421 - DNA, 16 bp, Homo sapiens
gaagggggtgtgcgtg

SEQ ID NO: 2021422 - DNA, 12 bp, Homo sapiens
gaagggtggggt

SEQ ID NO: 2021423 - DNA, 19 bp, Homo sapiens
gaagggttggtgggctggc

SEQ ID NO: 2021424 - DNA, 21 bp, Homo sapiens
gaagggttggtgggctggccc

SEQ ID NO: 2021425 - DNA, 22 bp, Homo sapiens
gaagggttggtgggctggccca

SEQ ID NO: 2021426 - DNA, 23 bp, Homo sapiens
gaagggttggtgggctggcccag

SEQ ID NO: 2021427 - DNA, 19 bp, Homo sapiens
gaaggtagcccagcactgt

SEQ ID NO: 2021428 - DNA, 23 bp, Homo sapiens
gaaggtcactcttcctgcaagga

SEQ ID NO: 2021429 - DNA, 20 bp, Homo sapiens
gaaggttaggatttaacagt

SEQ ID NO: 2021430 - DNA, 15 bp, Homo sapiens
gaaggtttgtatatt

SEQ ID NO: 2021431 - DNA, 11 bp, Homo sapiens
gaagtaaattt

SEQ ID NO: 2021432 - DNA, 16 bp, Homo sapiens
gaagtaacttttacaa

SEQ ID NO: 2021433 - DNA, 17 bp, Homo sapiens
gaagtaagtggggttgc

SEQ ID NO: 2021434 - DNA, 17 bp, Homo sapiens
gaagtaagttctgaaaa

SEQ ID NO: 2021435 - DNA, 15 bp, Homo sapiens
gaagtacgtttttgc

SEQ ID NO: 2021436 - DNA, 23 bp, Homo sapiens
gaagtaggaagtgaaaataggta

SEQ ID NO: 2021437 - DNA, 19 bp, Homo sapiens
gaagtagtttgtataactt

SEQ ID NO: 2021438 - DNA, 13 bp, Homo sapiens
gaagtatccaatt

SEQ ID NO: 2021439 - DNA, 20 bp, Homo sapiens
gaagtatccaattatgtgac

SEQ ID NO: 2021440 - DNA, 23 bp, Homo sapiens
gaagtatccaattatgtgacaac

SEQ ID NO: 2021441 - DNA, 13 bp, Homo sapiens
gaagtatgtgtgg

SEQ ID NO: 2021442 - DNA, 14 bp, Homo sapiens
gaagtatgtgtggg

SEQ ID NO: 2021443 - DNA, 18 bp, Homo sapiens
gaagtcataaacagcatt

SEQ ID NO: 2021444 - DNA, 15 bp, Homo sapiens
gaagtcatgaagccc

SEQ ID NO: 2021445 - DNA, 20 bp, Homo sapiens
gaagtcattgtcgctcagca

SEQ ID NO: 2021446 - DNA, 18 bp, Homo sapiens
gaagtccctgttctcagc

SEQ ID NO: 2021447 - DNA, 22 bp, Homo sapiens
gaagtccctgttctcagctccg

SEQ ID NO: 2021448 - DNA, 22 bp, Homo sapiens
gaagtcgtccttactcctgtgg

SEQ ID NO: 2021449 - DNA, 19 bp, Homo sapiens
gaagtcgtttcaggacatg

SEQ ID NO: 2021450 - DNA, 16 bp, Homo sapiens
gaagtctaggagctgg

SEQ ID NO: 2021451 - DNA, 20 bp, Homo sapiens
gaagtctaggagctgggagg

SEQ ID NO: 2021452 - DNA, 22 bp, Homo sapiens
gaagtctaggagctgggaggaa

SEQ ID NO: 2021453 - DNA, 18 bp, Homo sapiens
gaagtgaaggagaaagga

SEQ ID NO: 2021454 - DNA, 16 bp, Homo sapiens
gaagtgagggctgggc

SEQ ID NO: 2021455 - DNA, 14 bp, Homo sapiens
gaagtgctccccac

SEQ ID NO: 2021456 - DNA, 16 bp, Homo sapiens
gaagtgctccccacac

SEQ ID NO: 2021457 - DNA, 18 bp, Homo sapiens
gaagtgctccccacacgt

SEQ ID NO: 2021458 - DNA, 16 bp, Homo sapiens
gaagtggaccaggaca

SEQ ID NO: 2021459 - DNA, 18 bp, Homo sapiens
gaagtggaccaggacagg

SEQ ID NO: 2021460 - DNA, 18 bp, Homo sapiens
gaagtgggccaggacagg

SEQ ID NO: 2021461 - DNA, 17 bp, Homo sapiens
gaagtgggggccgctgg

SEQ ID NO: 2021462 - DNA, 18 bp, Homo sapiens
gaagtgggggccgctggc

SEQ ID NO: 2021463 - DNA, 21 bp, Homo sapiens
gaagtgggggccgctggccca

SEQ ID NO: 2021464 - DNA, 20 bp, Homo sapiens
gaagtggtttcctgataaca

SEQ ID NO: 2021465 - DNA, 17 bp, Homo sapiens
gaagtgtgtggaaggca

SEQ ID NO: 2021466 - DNA, 21 bp, Homo sapiens
gaagttaagcagcctttctgt

SEQ ID NO: 2021467 - DNA, 19 bp, Homo sapiens
gaagttacacaattaattg

SEQ ID NO: 2021468 - DNA, 13 bp, Homo sapiens
gaagttctgagcc

SEQ ID NO: 2021469 - DNA, 16 bp, Homo sapiens
gaagttgccaagagtt

SEQ ID NO: 2021470 - DNA, 11 bp, Homo sapiens
gaagtttcatc

SEQ ID NO: 2021471 - DNA, 19 bp, Homo sapiens
gaagtttgatattaaagga

SEQ ID NO: 2021472 - DNA, 16 bp, Homo sapiens
gaataaaaaacatttg

SEQ ID NO: 2021473 - DNA, 17 bp, Homo sapiens
gaataaaaaacatttgt

SEQ ID NO: 2021474 - DNA, 21 bp, Homo sapiens
gaataaaaaacatttgtacat

SEQ ID NO: 2021475 - DNA, 11 bp, Homo sapiens
gaataaacttc

SEQ ID NO: 2021476 - DNA, 17 bp, Homo sapiens
gaataaacttcagcacc

SEQ ID NO: 2021477 - DNA, 14 bp, Homo sapiens
gaataaagaaaaac

SEQ ID NO: 2021478 - DNA, 14 bp, Homo sapiens
gaataaagacacct

SEQ ID NO: 2021479 - DNA, 19 bp, Homo sapiens
gaataaagtctgagtgggc

SEQ ID NO: 2021480 - DNA, 13 bp, Homo sapiens
gaataaagttctg

SEQ ID NO: 2021481 - DNA, 20 bp, Homo sapiens
gaataaagttctgagtgttt

SEQ ID NO: 2021482 - DNA, 22 bp, Homo sapiens
gaataaataaatgtatcttatt

SEQ ID NO: 2021483 - DNA, 12 bp, Homo sapiens
gaataaatgaag

SEQ ID NO: 2021484 - DNA, 12 bp, Homo sapiens
gaataaggcctt

SEQ ID NO: 2021485 - DNA, 19 bp, Homo sapiens
gaataaggtacaagaagca

SEQ ID NO: 2021486 - DNA, 20 bp, Homo sapiens
gaataaggtacaagaagcat

SEQ ID NO: 2021487 - DNA, 18 bp, Homo sapiens
gaataagtgctgtttgag

SEQ ID NO: 2021488 - DNA, 21 bp, Homo sapiens
gaataagtgctgtttgagatg

SEQ ID NO: 2021489 - DNA, 22 bp, Homo sapiens
gaataataattatccagagttt

SEQ ID NO: 2021490 - DNA, 12 bp, Homo sapiens
gaataatagaag

SEQ ID NO: 2021491 - DNA, 15 bp, Homo sapiens
gaataatagaagaac

SEQ ID NO: 2021492 - DNA, 15 bp, Homo sapiens
gaataatctttgggt

SEQ ID NO: 2021493 - DNA, 22 bp, Homo sapiens
gaataatctttgggtaacttca

SEQ ID NO: 2021494 - DNA, 14 bp, Homo sapiens
gaatacccccagag

SEQ ID NO: 2021495 - DNA, 18 bp, Homo sapiens
gaatacccccagagacct

SEQ ID NO: 2021496 - DNA, 19 bp, Homo sapiens
gaatacccccagagacctt

SEQ ID NO: 2021497 - DNA, 15 bp, Homo sapiens
gaatagccagagagg

SEQ ID NO: 2021498 - DNA, 23 bp, Homo sapiens
gaatagctgggactacaggtgtg

SEQ ID NO: 2021499 - DNA, 14 bp, Homo sapiens
gaatataaacacta

SEQ ID NO: 2021500 - DNA, 12 bp, Homo sapiens
gaatataattat

SEQ ID NO: 2021501 - DNA, 13 bp, Homo sapiens
gaatataattatc

SEQ ID NO: 2021502 - DNA, 17 bp, Homo sapiens
gaatatgactgttttta

SEQ ID NO: 2021503 - DNA, 13 bp, Homo sapiens
gaatatggacaaa

SEQ ID NO: 2021504 - DNA, 17 bp, Homo sapiens
gaatatgtaagtcagga

SEQ ID NO: 2021505 - DNA, 15 bp, Homo sapiens
gaatatgttcaatgc

SEQ ID NO: 2021506 - DNA, 13 bp, Homo sapiens
gaatattaatccc

SEQ ID NO: 2021507 - DNA, 20 bp, Homo sapiens
gaatattcagagaatatcaa

SEQ ID NO: 2021508 - DNA, 20 bp, Homo sapiens
gaatatttacaataaagagt

SEQ ID NO: 2021509 - DNA, 10 bp, Homo sapiens
gaatatttat

SEQ ID NO: 2021510 - DNA, 18 bp, Homo sapiens
gaatatttattacctctg

SEQ ID NO: 2021511 - DNA, 19 bp, Homo sapiens
gaatatttattacctctga

SEQ ID NO: 2021512 - DNA, 18 bp, Homo sapiens
gaatatttcaaatgaaca

SEQ ID NO: 2021513 - DNA, 21 bp, Homo sapiens
gaatattttcattaaaagcta

SEQ ID NO: 2021514 - DNA, 15 bp, Homo sapiens
gaatcaaaaattgaa

SEQ ID NO: 2021515 - DNA, 21 bp, Homo sapiens
gaatcaaaaattgaagagaga

SEQ ID NO: 2021516 - DNA, 17 bp, Homo sapiens
gaatcaaagacatggaa

SEQ ID NO: 2021517 - DNA, 20 bp, Homo sapiens
gaatcaagatgtcagactgg

SEQ ID NO: 2021518 - DNA, 15 bp, Homo sapiens
gaatcacctggaggg

SEQ ID NO: 2021519 - DNA, 20 bp, Homo sapiens
gaatcacttgaacccgggag

SEQ ID NO: 2021520 - DNA, 13 bp, Homo sapiens
gaatcagaaacag

SEQ ID NO: 2021521 - DNA, 22 bp, Homo sapiens
gaatcagaccctaccccaccac

SEQ ID NO: 2021522 - DNA, 20 bp, Homo sapiens
gaatcagctgctacaagaat

SEQ ID NO: 2021523 - DNA, 20 bp, Homo sapiens
gaatcagtattgggagccgg

SEQ ID NO: 2021524 - DNA, 23 bp, Homo sapiens
gaatcataattttcaagagaaga

SEQ ID NO: 2021525 - DNA, 16 bp, Homo sapiens
gaatccaagcgaggtc

SEQ ID NO: 2021526 - DNA, 24 bp, Homo sapiens
gaatccacccatcctaccaatgca

SEQ ID NO: 2021527 - DNA, 20 bp, Homo sapiens
gaatccagacccggctgcgt

SEQ ID NO: 2021528 - DNA, 12 bp, Homo sapiens
gaatccctgcag

SEQ ID NO: 2021529 - DNA, 22 bp, Homo sapiens
gaatccgcctgcagaggacaga

SEQ ID NO: 2021530 - DNA, 20 bp, Homo sapiens
gaatcctaggctccacccca

SEQ ID NO: 2021531 - DNA, 12 bp, Homo sapiens
gaatcctttcag

SEQ ID NO: 2021532 - DNA, 13 bp, Homo sapiens
gaatcctttgaga

SEQ ID NO: 2021533 - DNA, 18 bp, Homo sapiens
gaatcgacctcactgtca

SEQ ID NO: 2021534 - DNA, 18 bp, Homo sapiens
gaatcgatctgtactgta

SEQ ID NO: 2021535 - DNA, 17 bp, Homo sapiens
gaatcgtttcaaatgga

SEQ ID NO: 2021536 - DNA, 20 bp, Homo sapiens
gaatcgtttcaaatggactc

SEQ ID NO: 2021537 - DNA, 17 bp, Homo sapiens
gaatctatatttaacaa

SEQ ID NO: 2021538 - DNA, 20 bp, Homo sapiens
gaatctgaaagtatattttc

SEQ ID NO: 2021539 - DNA, 17 bp, Homo sapiens
gaatctgataggaaaag

SEQ ID NO: 2021540 - DNA, 15 bp, Homo sapiens
gaatctgctgttgcc

SEQ ID NO: 2021541 - DNA, 23 bp, Homo sapiens
gaatctgtgcagatgagcagtca

SEQ ID NO: 2021542 - DNA, 16 bp, Homo sapiens
gaatctgttactgaaa

SEQ ID NO: 2021543 - DNA, 18 bp, Homo sapiens
gaatctgttactgaaatg

SEQ ID NO: 2021544 - DNA, 15 bp, Homo sapiens
gaatgaaaactcatt

SEQ ID NO: 2021545 - DNA, 19 bp, Homo sapiens
gaatgaaagggcccagaga

SEQ ID NO: 2021546 - DNA, 16 bp, Homo sapiens
gaatgacaacagaagc

SEQ ID NO: 2021547 - DNA, 22 bp, Homo sapiens
gaatgacatcaacattccccca

SEQ ID NO: 2021548 - DNA, 20 bp, Homo sapiens
gaatgaccacgggcctcagt

SEQ ID NO: 2021549 - DNA, 21 bp, Homo sapiens
gaatgaccacgggcctcagtt

SEQ ID NO: 2021550 - DNA, 22 bp, Homo sapiens
gaatgaccacgggcctcagttt

SEQ ID NO: 2021551 - DNA, 13 bp, Homo sapiens
gaatgagcctcgg

SEQ ID NO: 2021552 - DNA, 23 bp, Homo sapiens
gaatgaggaataataagttaaac

SEQ ID NO: 2021553 - DNA, 15 bp, Homo sapiens
gaatgaggtcccagg

SEQ ID NO: 2021554 - DNA, 16 bp, Homo sapiens
gaatgaggtcccaggc

SEQ ID NO: 2021555 - DNA, 17 bp, Homo sapiens
gaatgaggtcccaggca

SEQ ID NO: 2021556 - DNA, 22 bp, Homo sapiens
gaatgattccctcttgctattg

SEQ ID NO: 2021557 - DNA, 20 bp, Homo sapiens
gaatgatttccaaagagaaa

SEQ ID NO: 2021558 - DNA, 16 bp, Homo sapiens
gaatgatttttagatg

SEQ ID NO: 2021559 - DNA, 12 bp, Homo sapiens
gaatgcaagagt

SEQ ID NO: 2021560 - DNA, 18 bp, Homo sapiens
gaatgcagattcctgggc

SEQ ID NO: 2021561 - DNA, 21 bp, Homo sapiens
gaatgcagggaagagggcagt

SEQ ID NO: 2021562 - DNA, 11 bp, Homo sapiens
gaatgcagtgg

SEQ ID NO: 2021563 - DNA, 21 bp, Homo sapiens
gaatgcctcaatgtgaccagg

SEQ ID NO: 2021564 - DNA, 21 bp, Homo sapiens
gaatgcggccgcattccctga

SEQ ID NO: 2021565 - DNA, 22 bp, Homo sapiens
gaatgctggttttcctaaatgc

SEQ ID NO: 2021566 - DNA, 15 bp, Homo sapiens
gaatggatggggaga

SEQ ID NO: 2021567 - DNA, 20 bp, Homo sapiens
gaatggatggggagaatggt

SEQ ID NO: 2021568 - DNA, 22 bp, Homo sapiens
gaatggcaaagcggttgcttct

SEQ ID NO: 2021569 - DNA, 17 bp, Homo sapiens
gaatggcacagcccaaa

SEQ ID NO: 2021570 - DNA, 15 bp, Homo sapiens
gaatggcagctggaa

SEQ ID NO: 2021571 - DNA, 24 bp, Homo sapiens
gaatggccctagaactgtgcctag

SEQ ID NO: 2021572 - DNA, 21 bp, Homo sapiens
gaatggcctgccttgaagcca

SEQ ID NO: 2021573 - DNA, 15 bp, Homo sapiens
gaatggtccagggtt

SEQ ID NO: 2021574 - DNA, 16 bp, Homo sapiens
gaatggttccatgcct

SEQ ID NO: 2021575 - DNA, 20 bp, Homo sapiens
gaatggttccatgcctgagg

SEQ ID NO: 2021576 - DNA, 15 bp, Homo sapiens
gaatgtaaagcttgt

SEQ ID NO: 2021577 - DNA, 16 bp, Homo sapiens
gaatgtaatcaatgtt

SEQ ID NO: 2021578 - DNA, 19 bp, Homo sapiens
gaatgtaatcaatgtttct

SEQ ID NO: 2021579 - DNA, 20 bp, Homo sapiens
gaatgtagctggtttcctca

SEQ ID NO: 2021580 - DNA, 12 bp, Homo sapiens
gaatgtctcagc

SEQ ID NO: 2021581 - DNA, 22 bp, Homo sapiens
gaatgtggcccctgaacaagaa

SEQ ID NO: 2021582 - DNA, 17 bp, Homo sapiens
gaatgttacattgtttg

SEQ ID NO: 2021583 - DNA, 21 bp, Homo sapiens
gaatgtttacactctttgtaa

SEQ ID NO: 2021584 - DNA, 17 bp, Homo sapiens
gaatgtttatgttctca

SEQ ID NO: 2021585 - DNA, 20 bp, Homo sapiens
gaattaaataaacccttcct

SEQ ID NO: 2021586 - DNA, 13 bp, Homo sapiens
gaattaagttatt

SEQ ID NO: 2021587 - DNA, 13 bp, Homo sapiens
gaattaatcttaa

SEQ ID NO: 2021588 - DNA, 22 bp, Homo sapiens
gaattaccttagattagctctg

SEQ ID NO: 2021589 - DNA, 17 bp, Homo sapiens
gaattatatctaattta

SEQ ID NO: 2021590 - DNA, 19 bp, Homo sapiens
gaattatatctaatttata

SEQ ID NO: 2021591 - DNA, 14 bp, Homo sapiens
gaattatttttgtg

SEQ ID NO: 2021592 - DNA, 22 bp, Homo sapiens
gaattatttttgtgtttctaaa

SEQ ID NO: 2021593 - DNA, 17 bp, Homo sapiens
gaattcagcaccctggg

SEQ ID NO: 2021594 - DNA, 12 bp, Homo sapiens
gaattcccaggt

SEQ ID NO: 2021595 - DNA, 18 bp, Homo sapiens
gaattcctgaagccagat

SEQ ID NO: 2021596 - DNA, 18 bp, Homo sapiens
gaattctaagattgtaca

SEQ ID NO: 2021597 - DNA, 14 bp, Homo sapiens
gaattctagaaaat

SEQ ID NO: 2021598 - DNA, 16 bp, Homo sapiens
gaattctagaaaattt

SEQ ID NO: 2021599 - DNA, 16 bp, Homo sapiens
gaattctgtgaagaat

SEQ ID NO: 2021600 - DNA, 16 bp, Homo sapiens
gaattgcattagtcca

SEQ ID NO: 2021601 - DNA, 20 bp, Homo sapiens
gaattgcctgcagagagaag

SEQ ID NO: 2021602 - DNA, 21 bp, Homo sapiens
gaattgcctgcagagagaagc

SEQ ID NO: 2021603 - DNA, 15 bp, Homo sapiens
gaattgctgctctct

SEQ ID NO: 2021604 - DNA, 22 bp, Homo sapiens
ctgctgcctaataaagagactg

SEQ ID NO: 2021605 - DNA, 15 bp, Homo sapiens
ctgctgcctccctct

SEQ ID NO: 2021606 - DNA, 22 bp, Homo sapiens
ctgctgcggccagcctgactag

SEQ ID NO: 2021607 - DNA, 13 bp, Homo sapiens
ctgctgctaaggc

SEQ ID NO: 2021608 - DNA, 13 bp, Homo sapiens
ctgctgctgagaa

SEQ ID NO: 2021609 - DNA, 22 bp, Homo sapiens
ctgctgctgagaacctggcctt

SEQ ID NO: 2021610 - DNA, 23 bp, Homo sapiens
ctgctgctgtaactgctgagcca

SEQ ID NO: 2021611 - DNA, 15 bp, Homo sapiens
ctgctggcacctcag

SEQ ID NO: 2021612 - DNA, 14 bp, Homo sapiens
ctgctggcctggat

SEQ ID NO: 2021613 - DNA, 16 bp, Homo sapiens
ctgctggcctggatct

SEQ ID NO: 2021614 - DNA, 20 bp, Homo sapiens
ctgctggcctggccggcaac

SEQ ID NO: 2021615 - DNA, 15 bp, Homo sapiens
ctgctggctgcctta

SEQ ID NO: 2021616 - DNA, 19 bp, Homo sapiens
ctgctgggaccccagctag

SEQ ID NO: 2021617 - DNA, 22 bp, Homo sapiens
ctgctgggaccccagctagggc

SEQ ID NO: 2021618 - DNA, 23 bp, Homo sapiens
ctgctgggaccccagctagggct

SEQ ID NO: 2021619 - DNA, 17 bp, Homo sapiens
ctgctgggactggccag

SEQ ID NO: 2021620 - DNA, 19 bp, Homo sapiens
ctgctgggactggccaggt

SEQ ID NO: 2021621 - DNA, 14 bp, Homo sapiens
ctgctgggctctcc

SEQ ID NO: 2021622 - DNA, 17 bp, Homo sapiens
ctgctgggctctccacc

SEQ ID NO: 2021623 - DNA, 22 bp, Homo sapiens
ctgctgggctctccacctcagc

SEQ ID NO: 2021624 - DNA, 12 bp, Homo sapiens
ctgctggggagt

SEQ ID NO: 2021625 - DNA, 14 bp, Homo sapiens
ctgctggggagtcc

SEQ ID NO: 2021626 - DNA, 14 bp, Homo sapiens
ctgctggggcatgt

SEQ ID NO: 2021627 - DNA, 20 bp, Homo sapiens
ctgctggggcatgtgtgcct

SEQ ID NO: 2021628 - DNA, 22 bp, Homo sapiens
ctgctggggcatgtgtgcctgt

SEQ ID NO: 2021629 - DNA, 18 bp, Homo sapiens
ctgctggtgcagagctga

SEQ ID NO: 2021630 - DNA, 22 bp, Homo sapiens
ctgctggtgcagagctgaagat

SEQ ID NO: 2021631 - DNA, 21 bp, Homo sapiens
ctgctggttttaacaactgtg

SEQ ID NO: 2021632 - DNA, 18 bp, Homo sapiens
ctgctgtaactgctgagc

SEQ ID NO: 2021633 - DNA, 21 bp, Homo sapiens
ctgctgtcattgtccatgcct

SEQ ID NO: 2021634 - DNA, 22 bp, Homo sapiens
ctgctgtcattgtccatgccta

SEQ ID NO: 2021635 - DNA, 14 bp, Homo sapiens
ctgctgtcctttta

SEQ ID NO: 2021636 - DNA, 12 bp, Homo sapiens
ctgctgtggcct

SEQ ID NO: 2021637 - DNA, 14 bp, Homo sapiens
ctgctgtggcctca

SEQ ID NO: 2021638 - DNA, 22 bp, Homo sapiens
ctgctgtgtagctctgtccact

SEQ ID NO: 2021639 - DNA, 23 bp, Homo sapiens
ctgctgttaattgattaaaatct

SEQ ID NO: 2021640 - DNA, 22 bp, Homo sapiens
ctgctgttccaacagacagggc

SEQ ID NO: 2021641 - DNA, 18 bp, Homo sapiens
ctgctgttgccatagccc

SEQ ID NO: 2021642 - DNA, 12 bp, Homo sapiens
ctgctgtttaag

SEQ ID NO: 2021643 - DNA, 18 bp, Homo sapiens
ctgcttaaacttgaccca

SEQ ID NO: 2021644 - DNA, 19 bp, Homo sapiens
ctgcttaaacttgacccag

SEQ ID NO: 2021645 - DNA, 15 bp, Homo sapiens
ctgcttacccttcac

SEQ ID NO: 2021646 - DNA, 19 bp, Homo sapiens
ctgcttcagtgtatggaaa

SEQ ID NO: 2021647 - DNA, 17 bp, Homo sapiens
ctgcttcccatgcctgc

SEQ ID NO: 2021648 - DNA, 19 bp, Homo sapiens
ctgcttcctaggccccaga

SEQ ID NO: 2021649 - DNA, 13 bp, Homo sapiens
ctgcttccttctg

SEQ ID NO: 2021650 - DNA, 17 bp, Homo sapiens
ctgcttctgtccaggac

SEQ ID NO: 2021651 - DNA, 23 bp, Homo sapiens
ctgcttcttcaagcacctgcaga

SEQ ID NO: 2021652 - DNA, 19 bp, Homo sapiens
ctgcttcttcatcttgaca

SEQ ID NO: 2021653 - DNA, 20 bp, Homo sapiens
ctgcttgaaggaacagtgct

SEQ ID NO: 2021654 - DNA, 23 bp, Homo sapiens
ctgcttgaaggaacagtgctgtt

SEQ ID NO: 2021655 - DNA, 18 bp, Homo sapiens
ctgcttgaggaggggcac

SEQ ID NO: 2021656 - DNA, 21 bp, Homo sapiens
ctgcttggggggtgatgaggg

SEQ ID NO: 2021657 - DNA, 22 bp, Homo sapiens
ctgcttggggggtgatgagggc

SEQ ID NO: 2021658 - DNA, 21 bp, Homo sapiens
ctgcttgtccctgcccagaat

SEQ ID NO: 2021659 - DNA, 13 bp, Homo sapiens
ctgcttgtcctgc

SEQ ID NO: 2021660 - DNA, 16 bp, Homo sapiens
ctgcttgtcctgctct

SEQ ID NO: 2021661 - DNA, 17 bp, Homo sapiens
ctgctttaaatctatct

SEQ ID NO: 2021662 - DNA, 18 bp, Homo sapiens
ctgctttaaatctatcta

SEQ ID NO: 2021663 - DNA, 21 bp, Homo sapiens
ctgctttcaacttaaatcact

SEQ ID NO: 2021664 - DNA, 22 bp, Homo sapiens
ctgctttcaacttaaatcactg

SEQ ID NO: 2021665 - DNA, 16 bp, Homo sapiens
ctgctttccctcccca

SEQ ID NO: 2021666 - DNA, 17 bp, Homo sapiens
ctgcttttccaggatcc

SEQ ID NO: 2021667 - DNA, 20 bp, Homo sapiens
ctggaaaaaaaatatatata

SEQ ID NO: 2021668 - DNA, 15 bp, Homo sapiens
ctggaaaagaggagt

SEQ ID NO: 2021669 - DNA, 17 bp, Homo sapiens
ctggaaaggctcagtct

SEQ ID NO: 2021670 - DNA, 21 bp, Homo sapiens
ctggaaaggctcagtctcagg

SEQ ID NO: 2021671 - DNA, 21 bp, Homo sapiens
ctggaaataaacctggagatg

SEQ ID NO: 2021672 - DNA, 18 bp, Homo sapiens
ctggaaattctggaactg

SEQ ID NO: 2021673 - DNA, 12 bp, Homo sapiens
ctggaaattttg

SEQ ID NO: 2021674 - DNA, 16 bp, Homo sapiens
ctggaaattttgtcca

SEQ ID NO: 2021675 - DNA, 23 bp, Homo sapiens
ctggaacatgggcattgggttct

SEQ ID NO: 2021676 - DNA, 22 bp, Homo sapiens
ctggaaccaatcccgtgaaaga

SEQ ID NO: 2021677 - DNA, 17 bp, Homo sapiens
ctggaaccagggaggag

SEQ ID NO: 2021678 - DNA, 20 bp, Homo sapiens
ctggaaccagggaggagagg

SEQ ID NO: 2021679 - DNA, 23 bp, Homo sapiens
ctggaaccagggaggagaggaaa

SEQ ID NO: 2021680 - DNA, 18 bp, Homo sapiens
ctggaactgtctctcatg

SEQ ID NO: 2021681 - DNA, 20 bp, Homo sapiens
ctggaacttgaactgattca

SEQ ID NO: 2021682 - DNA, 17 bp, Homo sapiens
ctggaagacatgataca

SEQ ID NO: 2021683 - DNA, 12 bp, Homo sapiens
ctggaagagagg

SEQ ID NO: 2021684 - DNA, 14 bp, Homo sapiens
ctggaagcacagct

SEQ ID NO: 2021685 - DNA, 18 bp, Homo sapiens
ctggaagcacagcttcat

SEQ ID NO: 2021686 - DNA, 12 bp, Homo sapiens
ctggaagcacat

SEQ ID NO: 2021687 - DNA, 16 bp, Homo sapiens
ctggaagcactgctgt

SEQ ID NO: 2021688 - DNA, 16 bp, Homo sapiens
ctggaagcctggactc

SEQ ID NO: 2021689 - DNA, 11 bp, Homo sapiens
ctggaagctga

SEQ ID NO: 2021690 - DNA, 16 bp, Homo sapiens
ctggaagctgagcagg

SEQ ID NO: 2021691 - DNA, 18 bp, Homo sapiens
ctggaagctgagcaggcc

SEQ ID NO: 2021692 - DNA, 20 bp, Homo sapiens
ctggaagctgggaggtcagg

SEQ ID NO: 2021693 - DNA, 12 bp, Homo sapiens
ctggaagctgtg

SEQ ID NO: 2021694 - DNA, 22 bp, Homo sapiens
ctggaagctgtgtccttgcacc

SEQ ID NO: 2021695 - DNA, 17 bp, Homo sapiens
gactcaatgcactgaca

SEQ ID NO: 2021696 - DNA, 13 bp, Homo sapiens
gactcacctctgc

SEQ ID NO: 2021697 - DNA, 15 bp, Homo sapiens
gactcacctctgcct

SEQ ID NO: 2021698 - DNA, 12 bp, Homo sapiens
gactcagctctg

SEQ ID NO: 2021699 - DNA, 22 bp, Homo sapiens
gactcaggcccccacctggctc

SEQ ID NO: 2021700 - DNA, 19 bp, Homo sapiens
gactcagggacctaagcca

SEQ ID NO: 2021701 - DNA, 15 bp, Homo sapiens
gactcagggccccag

SEQ ID NO: 2021702 - DNA, 15 bp, Homo sapiens
gactcattcttctgt

SEQ ID NO: 2021703 - DNA, 21 bp, Homo sapiens
gactcattttaaaaaatggaa

SEQ ID NO: 2021704 - DNA, 12 bp, Homo sapiens
gactccaaagaa

SEQ ID NO: 2021705 - DNA, 12 bp, Homo sapiens
gactccagagtc

SEQ ID NO: 2021706 - DNA, 17 bp, Homo sapiens
gactccagagtctgagc

SEQ ID NO: 2021707 - DNA, 10 bp, Homo sapiens
gactccagcc

SEQ ID NO: 2021708 - DNA, 13 bp, Homo sapiens
gactccagccagc

SEQ ID NO: 2021709 - DNA, 15 bp, Homo sapiens
gactccagccagcgc

SEQ ID NO: 2021710 - DNA, 19 bp, Homo sapiens
gactccagccagcgcctcc

SEQ ID NO: 2021711 - DNA, 22 bp, Homo sapiens
gactccagccagcgcctccctc

SEQ ID NO: 2021712 - DNA, 23 bp, Homo sapiens
gactccagcgcctgccctccctg

SEQ ID NO: 2021713 - DNA, 16 bp, Homo sapiens
gactccccaggccagg

SEQ ID NO: 2021714 - DNA, 13 bp, Homo sapiens
gactccctgtggg

SEQ ID NO: 2021715 - DNA, 19 bp, Homo sapiens
gactccgggaccattgacc

SEQ ID NO: 2021716 - DNA, 11 bp, Homo sapiens
gactcctccca

SEQ ID NO: 2021717 - DNA, 11 bp, Homo sapiens
gactcctctgt

SEQ ID NO: 2021718 - DNA, 13 bp, Homo sapiens
gactcctgccctg

SEQ ID NO: 2021719 - DNA, 22 bp, Homo sapiens
gactcctggtctgaaaatgttg

SEQ ID NO: 2021720 - DNA, 18 bp, Homo sapiens
gactctaaatatttcatg

SEQ ID NO: 2021721 - DNA, 16 bp, Homo sapiens
gactctaagctggagc

SEQ ID NO: 2021722 - DNA, 21 bp, Homo sapiens
gactctacctgcaagatttca

SEQ ID NO: 2021723 - DNA, 12 bp, Homo sapiens
gactctctgtga

SEQ ID NO: 2021724 - DNA, 14 bp, Homo sapiens
gactctctgtgacc

SEQ ID NO: 2021725 - DNA, 20 bp, Homo sapiens
gactctgcacatgtcttgta

SEQ ID NO: 2021726 - DNA, 23 bp, Homo sapiens
gactctgccccttctgtttccat

SEQ ID NO: 2021727 - DNA, 13 bp, Homo sapiens
gactctggcctcc

SEQ ID NO: 2021728 - DNA, 15 bp, Homo sapiens
gactctggcctccac

SEQ ID NO: 2021729 - DNA, 13 bp, Homo sapiens
gactctggcctct

SEQ ID NO: 2021730 - DNA, 19 bp, Homo sapiens
gactctgtctcaaaaaaac

SEQ ID NO: 2021731 - DNA, 12 bp, Homo sapiens
gactcttcctgc

SEQ ID NO: 2021732 - DNA, 13 bp, Homo sapiens
gactcttcctgca

SEQ ID NO: 2021733 - DNA, 12 bp, Homo sapiens
gactcttgcctt

SEQ ID NO: 2021734 - DNA, 19 bp, Homo sapiens
gactcttgttttcagtttc

SEQ ID NO: 2021735 - DNA, 20 bp, Homo sapiens
gactcttttatctgagtttt

SEQ ID NO: 2021736 - DNA, 17 bp, Homo sapiens
gactcttttgccattaa

SEQ ID NO: 2021737 - DNA, 19 bp, Homo sapiens
gactctttttagggccagg

SEQ ID NO: 2021738 - DNA, 22 bp, Homo sapiens
gactctttttagggccaggcag

SEQ ID NO: 2021739 - DNA, 12 bp, Homo sapiens
gactgaaagcag

SEQ ID NO: 2021740 - DNA, 16 bp, Homo sapiens
gactgaaagcagcagc

SEQ ID NO: 2021741 - DNA, 21 bp, Homo sapiens
gactgaaagcagcagctagga

SEQ ID NO: 2021742 - DNA, 13 bp, Homo sapiens
gactgaactgcac

SEQ ID NO: 2021743 - DNA, 17 bp, Homo sapiens
gactgacacaggccagc

SEQ ID NO: 2021744 - DNA, 18 bp, Homo sapiens
gactgacacaggccagcc

SEQ ID NO: 2021745 - DNA, 22 bp, Homo sapiens
gactgacacaggccagccccat

SEQ ID NO: 2021746 - DNA, 17 bp, Homo sapiens
gactgacacctcactga

SEQ ID NO: 2021747 - DNA, 15 bp, Homo sapiens
gactgagacccgttc

SEQ ID NO: 2021748 - DNA, 22 bp, Homo sapiens
gactgagactggcacttagccc

SEQ ID NO: 2021749 - DNA, 15 bp, Homo sapiens
gactgagggagagac

SEQ ID NO: 2021750 - DNA, 18 bp, Homo sapiens
gactgccccaactcctgg

SEQ ID NO: 2021751 - DNA, 21 bp, Homo sapiens
gactgcgggatggtcctgggg

SEQ ID NO: 2021752 - DNA, 16 bp, Homo sapiens
gactggaagcacagct

SEQ ID NO: 2021753 - DNA, 13 bp, Homo sapiens
gactggacagctt

SEQ ID NO: 2021754 - DNA, 14 bp, Homo sapiens
gactggacagcttg

SEQ ID NO: 2021755 - DNA, 20 bp, Homo sapiens
gactggagaccgcttcaccc

SEQ ID NO: 2021756 - DNA, 13 bp, Homo sapiens
gactggagcccga

SEQ ID NO: 2021757 - DNA, 14 bp, Homo sapiens
gactggcacagttt

SEQ ID NO: 2021758 - DNA, 18 bp, Homo sapiens
gactggcacagttttctg

SEQ ID NO: 2021759 - DNA, 22 bp, Homo sapiens
gactggcacagttttctgagaa

SEQ ID NO: 2021760 - DNA, 16 bp, Homo sapiens
gactggcacttagccc

SEQ ID NO: 2021761 - DNA, 20 bp, Homo sapiens
gactggcacttagcccaaga

SEQ ID NO: 2021762 - DNA, 14 bp, Homo sapiens
gactggctggctgc

SEQ ID NO: 2021763 - DNA, 13 bp, Homo sapiens
gactgggaggtag

SEQ ID NO: 2021764 - DNA, 15 bp, Homo sapiens
gactgggctagggag

SEQ ID NO: 2021765 - DNA, 16 bp, Homo sapiens
gactggggatgtggga

SEQ ID NO: 2021766 - DNA, 17 bp, Homo sapiens
gactggggatgtgggag

SEQ ID NO: 2021767 - DNA, 20 bp, Homo sapiens
gactggggatgtgggaggga

SEQ ID NO: 2021768 - DNA, 16 bp, Homo sapiens
gactggtaagtaactg

SEQ ID NO: 2021769 - DNA, 23 bp, Homo sapiens
gactggtgctataggctggagaa

SEQ ID NO: 2021770 - DNA, 17 bp, Homo sapiens
gactgtactcctcccag

SEQ ID NO: 2021771 - DNA, 18 bp, Homo sapiens
gactgtactcctcccagg

SEQ ID NO: 2021772 - DNA, 23 bp, Homo sapiens
gactgtactcctcccaggcgccc

SEQ ID NO: 2021773 - DNA, 15 bp, Homo sapiens
gactgtcatagaaat

SEQ ID NO: 2021774 - DNA, 18 bp, Homo sapiens
gactgtcgtgtttacaaa

SEQ ID NO: 2021775 - DNA, 19 bp, Homo sapiens
gactgtcgtgtttacaaaa

SEQ ID NO: 2021776 - DNA, 21 bp, Homo sapiens
gactgtctcaagagggcactg

SEQ ID NO: 2021777 - DNA, 22 bp, Homo sapiens
gactgtctcaagagggcactgg

SEQ ID NO: 2021778 - DNA, 23 bp, Homo sapiens
gactgtctcaagagggcactggt

SEQ ID NO: 2021779 - DNA, 15 bp, Homo sapiens
gactgtggctgcaga

SEQ ID NO: 2021780 - DNA, 14 bp, Homo sapiens
gactgttcctgtct

SEQ ID NO: 2021781 - DNA, 19 bp, Homo sapiens
gactgtttttatatgcaca

SEQ ID NO: 2021782 - DNA, 19 bp, Homo sapiens
gacttaaaatattcctgca

SEQ ID NO: 2021783 - DNA, 19 bp, Homo sapiens
gacttaacggctccaggat

SEQ ID NO: 2021784 - DNA, 14 bp, Homo sapiens
gacttaagattaaa

SEQ ID NO: 2021785 - DNA, 15 bp, Homo sapiens
gacttacatgattca

SEQ ID NO: 2021786 - DNA, 14 bp, Homo sapiens
gacttcacactgca

SEQ ID NO: 2021787 - DNA, 13 bp, Homo sapiens
gacttcacagcag

SEQ ID NO: 2021788 - DNA, 15 bp, Homo sapiens
gacttcacagcagcc

SEQ ID NO: 2021789 - DNA, 18 bp, Homo sapiens
gacttcagaacatgctgg

SEQ ID NO: 2021790 - DNA, 14 bp, Homo sapiens
gacttcagctctgt

SEQ ID NO: 2021791 - DNA, 18 bp, Homo sapiens
gacttcaggttgttctgt

SEQ ID NO: 2021792 - DNA, 18 bp, Homo sapiens
gacttcagtcctggtctg

SEQ ID NO: 2021793 - DNA, 19 bp, Homo sapiens
gacttcagtcctggtctgc

SEQ ID NO: 2021794 - DNA, 22 bp, Homo sapiens
gacttcagtcctggtctgctca

SEQ ID NO: 2021795 - DNA, 13 bp, Homo sapiens
gacttcatgttca

SEQ ID NO: 2021796 - DNA, 18 bp, Homo sapiens
gacttcctcgcctctccc

SEQ ID NO: 2021797 - DNA, 15 bp, Homo sapiens
gacttcctggggccc

SEQ ID NO: 2021798 - DNA, 22 bp, Homo sapiens
gacttcctggtgaggcccagcc

SEQ ID NO: 2021799 - DNA, 16 bp, Homo sapiens
gacttcgactcaggat

SEQ ID NO: 2021800 - DNA, 17 bp, Homo sapiens
gacttctctttcttatt

SEQ ID NO: 2021801 - DNA, 23 bp, Homo sapiens
gacttctctttcttattttgtaa

SEQ ID NO: 2021802 - DNA, 13 bp, Homo sapiens
gacttctgcagct

SEQ ID NO: 2021803 - DNA, 13 bp, Homo sapiens
gacttctggaagg

SEQ ID NO: 2021804 - DNA, 14 bp, Homo sapiens
gacttctggaaggc

SEQ ID NO: 2021805 - DNA, 16 bp, Homo sapiens
gacttctggaaggctg

SEQ ID NO: 2021806 - DNA, 21 bp, Homo sapiens
gacttctggaaggctggctga

SEQ ID NO: 2021807 - DNA, 23 bp, Homo sapiens
gacttcttggtttggggagaaat

SEQ ID NO: 2021808 - DNA, 16 bp, Homo sapiens
gacttgacagaacact

SEQ ID NO: 2021809 - DNA, 23 bp, Homo sapiens
gacttgaggattttgagtatctc

SEQ ID NO: 2021810 - DNA, 20 bp, Homo sapiens
gacttgcacatctctgcagt

SEQ ID NO: 2021811 - DNA, 18 bp, Homo sapiens
gacttgggcacccccagc

SEQ ID NO: 2021812 - DNA, 20 bp, Homo sapiens
gacttgggcacccccagcct

SEQ ID NO: 2021813 - DNA, 21 bp, Homo sapiens
gacttgggcacccccagcctg

SEQ ID NO: 2021814 - DNA, 14 bp, Homo sapiens
gactttaattgtgt

SEQ ID NO: 2021815 - DNA, 15 bp, Homo sapiens
gactttatacagaac

SEQ ID NO: 2021816 - DNA, 21 bp, Homo sapiens
gactttatctaatacctctgt

SEQ ID NO: 2021817 - DNA, 19 bp, Homo sapiens
gactttctacacctgttgc

SEQ ID NO: 2021818 - DNA, 18 bp, Homo sapiens
gactttggttctctccag

SEQ ID NO: 2021819 - DNA, 15 bp, Homo sapiens
gacttttccaagccc

SEQ ID NO: 2021820 - DNA, 18 bp, Homo sapiens
gacttttccatgtatcta

SEQ ID NO: 2021821 - DNA, 22 bp, Homo sapiens
gacttttgggggttggatggga

SEQ ID NO: 2021822 - DNA, 16 bp, Homo sapiens
gactttttataatgtg

SEQ ID NO: 2021823 - DNA, 14 bp, Homo sapiens
gagaaaaaccaatg

SEQ ID NO: 2021824 - DNA, 15 bp, Homo sapiens
gagaaaaagaaatgc

SEQ ID NO: 2021825 - DNA, 19 bp, Homo sapiens
gagaaaaagctcctgtcct

SEQ ID NO: 2021826 - DNA, 18 bp, Homo sapiens
gagaaaacttatttgagt

SEQ ID NO: 2021827 - DNA, 22 bp, Homo sapiens
gagaaaacttatttgagtgatt

SEQ ID NO: 2021828 - DNA, 11 bp, Homo sapiens
gagaaactgag

SEQ ID NO: 2021829 - DNA, 22 bp, Homo sapiens
gagaaactgagaaatgaatgct

SEQ ID NO: 2021830 - DNA, 18 bp, Homo sapiens
gagaaagaagtaggcatg

SEQ ID NO: 2021831 - DNA, 13 bp, Homo sapiens
gagaaagactatt

SEQ ID NO: 2021832 - DNA, 17 bp, Homo sapiens
gagaaaggattaagata

SEQ ID NO: 2021833 - DNA, 22 bp, Homo sapiens
gagaaagtacttctccaccctg

SEQ ID NO: 2021834 - DNA, 17 bp, Homo sapiens
gagaaatcacaggggcg

SEQ ID NO: 2021835 - DNA, 18 bp, Homo sapiens
gagaaatgtgaagggtgg

SEQ ID NO: 2021836 - DNA, 21 bp, Homo sapiens
gagaaatgtgaagggtggggt

SEQ ID NO: 2021837 - DNA, 12 bp, Homo sapiens
gagaacctggcc

SEQ ID NO: 2021838 - DNA, 15 bp, Homo sapiens
gagaacctggccttc

SEQ ID NO: 2021839 - DNA, 16 bp, Homo sapiens
gagaacctggccttca

SEQ ID NO: 2021840 - DNA, 19 bp, Homo sapiens
gagaactagaacctggagg

SEQ ID NO: 2021841 - DNA, 16 bp, Homo sapiens
gagaagaaagaacgga

SEQ ID NO: 2021842 - DNA, 21 bp, Homo sapiens
gagaagaaagaacggaagaag

SEQ ID NO: 2021843 - DNA, 13 bp, Homo sapiens
gagaagaagctga

SEQ ID NO: 2021844 - DNA, 21 bp, Homo sapiens
gagaagaattttcagacccca

SEQ ID NO: 2021845 - DNA, 19 bp, Homo sapiens
gagaagagagaaatagcct

SEQ ID NO: 2021846 - DNA, 19 bp, Homo sapiens
gagaagagggcctgtggga

SEQ ID NO: 2021847 - DNA, 15 bp, Homo sapiens
gagaagcagcctcct

SEQ ID NO: 2021848 - DNA, 16 bp, Homo sapiens
gagaagcagcctccta

SEQ ID NO: 2021849 - DNA, 20 bp, Homo sapiens
gagaagctaaaacctgagct

SEQ ID NO: 2021850 - DNA, 14 bp, Homo sapiens
gagaagctcattta

SEQ ID NO: 2021851 - DNA, 12 bp, Homo sapiens
gagaagctgaga

SEQ ID NO: 2021852 - DNA, 13 bp, Homo sapiens
gagaagctgagaa

SEQ ID NO: 2021853 - DNA, 14 bp, Homo sapiens
gagaagctgagaag

SEQ ID NO: 2021854 - DNA, 15 bp, Homo sapiens
gagaagctgagaaga

SEQ ID NO: 2021855 - DNA, 16 bp, Homo sapiens
gagaaggaaaaagaaa

SEQ ID NO: 2021856 - DNA, 14 bp, Homo sapiens
gagaaggaaggaga

SEQ ID NO: 2021857 - DNA, 15 bp, Homo sapiens
gagaaggcgaggaga

SEQ ID NO: 2021858 - DNA, 14 bp, Homo sapiens
gagaagggccagcc

SEQ ID NO: 2021859 - DNA, 15 bp, Homo sapiens
gagaagggccagccc

SEQ ID NO: 2021860 - DNA, 19 bp, Homo sapiens
gagaagggggattggaggg

SEQ ID NO: 2021861 - DNA, 19 bp, Homo sapiens
gagaagtcagttggagaaa

SEQ ID NO: 2021862 - DNA, 21 bp, Homo sapiens
gagaagtcagttggagaaaat

SEQ ID NO: 2021863 - DNA, 21 bp, Homo sapiens
gagaagtttcgaggggtcctc

SEQ ID NO: 2021864 - DNA, 18 bp, Homo sapiens
gagaataattgtgtacaa

SEQ ID NO: 2021865 - DNA, 19 bp, Homo sapiens
gagaataattgtgtacaaa

SEQ ID NO: 2021866 - DNA, 12 bp, Homo sapiens
gagaatatatac

SEQ ID NO: 2021867 - DNA, 22 bp, Homo sapiens
gagaatatttcaaatgaacacg

SEQ ID NO: 2021868 - DNA, 15 bp, Homo sapiens
gagaatctatattta

SEQ ID NO: 2021869 - DNA, 22 bp, Homo sapiens
gagaatctatatttaacaagat

SEQ ID NO: 2021870 - DNA, 16 bp, Homo sapiens
gagaatctgaagctat

SEQ ID NO: 2021871 - DNA, 19 bp, Homo sapiens
gagaatgcccaactcttca

SEQ ID NO: 2021872 - DNA, 18 bp, Homo sapiens
gagaattgcttgaaccca

SEQ ID NO: 2021873 - DNA, 15 bp, Homo sapiens
gagaattgtatcatt

SEQ ID NO: 2021874 - DNA, 22 bp, Homo sapiens
gagacaaacacctcccaggaga

SEQ ID NO: 2021875 - DNA, 13 bp, Homo sapiens
gagacaagccctg

SEQ ID NO: 2021876 - DNA, 15 bp, Homo sapiens
gagacaagccctggc

SEQ ID NO: 2021877 - DNA, 22 bp, Homo sapiens
gagacaataaaaaccaaagcat

SEQ ID NO: 2021878 - DNA, 14 bp, Homo sapiens
gagacaataaaaca

SEQ ID NO: 2021879 - DNA, 17 bp, Homo sapiens
gagacacctgcacctcc

SEQ ID NO: 2021880 - DNA, 19 bp, Homo sapiens
gagacacctgcacctcccc

SEQ ID NO: 2021881 - DNA, 21 bp, Homo sapiens
gagacacctgcacctcccccc

SEQ ID NO: 2021882 - DNA, 17 bp, Homo sapiens
gagacactcccagggac

SEQ ID NO: 2021883 - DNA, 18 bp, Homo sapiens
gagacagaaacagagaga

SEQ ID NO: 2021884 - DNA, 20 bp, Homo sapiens
gagacagaaacagagagaga

SEQ ID NO: 2021885 - DNA, 23 bp, Homo sapiens
gagacagagcccccaagcctctg

SEQ ID NO: 2021886 - DNA, 21 bp, Homo sapiens
gagacaggaaaatcctctggc

SEQ ID NO: 2021887 - DNA, 15 bp, Homo sapiens
gagacaggaaagaat

SEQ ID NO: 2021888 - DNA, 12 bp, Homo sapiens
gagacaggaagg

SEQ ID NO: 2021889 - DNA, 22 bp, Homo sapiens
gagacagggttttgccatgttg

SEQ ID NO: 2021890 - DNA, 17 bp, Homo sapiens
gagacaggtggcctagc

SEQ ID NO: 2021891 - DNA, 18 bp, Homo sapiens
gagacagtagaggcatga

SEQ ID NO: 2021892 - DNA, 13 bp, Homo sapiens
gagacatgtacct

SEQ ID NO: 2021893 - DNA, 22 bp, Homo sapiens
gagacattaactcattagactg

SEQ ID NO: 2021894 - DNA, 14 bp, Homo sapiens
gagacattgcctcc

SEQ ID NO: 2021895 - DNA, 15 bp, Homo sapiens
gagacattgcctcca

SEQ ID NO: 2021896 - DNA, 16 bp, Homo sapiens
gagaccaacctgacca

SEQ ID NO: 2021897 - DNA, 21 bp, Homo sapiens
gagaccacagcaattggctcc

SEQ ID NO: 2021898 - DNA, 11 bp, Homo sapiens
gagaccagcac

SEQ ID NO: 2021899 - DNA, 19 bp, Homo sapiens
gagaccagcctgggcagca

SEQ ID NO: 2021900 - DNA, 19 bp, Homo sapiens
gagaccagctcagaggccc

SEQ ID NO: 2021901 - DNA, 15 bp, Homo sapiens
gagaccatcctggcc

SEQ ID NO: 2021902 - DNA, 23 bp, Homo sapiens
gagaccatcctggcccctccaga

SEQ ID NO: 2021903 - DNA, 18 bp, Homo sapiens
cgactttgagctggaaag

SEQ ID NO: 2021904 - DNA, 13 bp, Homo sapiens
cgagaccagcctg

SEQ ID NO: 2021905 - DNA, 17 bp, Homo sapiens
cgagaccatcctggccc

SEQ ID NO: 2021906 - DNA, 19 bp, Homo sapiens
cgagaccatcctggcccct

SEQ ID NO: 2021907 - DNA, 20 bp, Homo sapiens
cgagaccatcctggcccctc

SEQ ID NO: 2021908 - DNA, 21 bp, Homo sapiens
cgagaccatcctggcccctcc

SEQ ID NO: 2021909 - DNA, 17 bp, Homo sapiens
cgagactgagaggcaga

SEQ ID NO: 2021910 - DNA, 22 bp, Homo sapiens
cgagagaggcgcgtctgcccca

SEQ ID NO: 2021911 - DNA, 17 bp, Homo sapiens
cgagagaggtgggcagc

SEQ ID NO: 2021912 - DNA, 19 bp, Homo sapiens
cgagagaggtgggcagcag

SEQ ID NO: 2021913 - DNA, 15 bp, Homo sapiens
cgagagcctgctccc

SEQ ID NO: 2021914 - DNA, 21 bp, Homo sapiens
cgagagcctgctcccccaccc

SEQ ID NO: 2021915 - DNA, 18 bp, Homo sapiens
cgagaggtccctgcttac

SEQ ID NO: 2021916 - DNA, 20 bp, Homo sapiens
cgagagtagccgagagcctg

SEQ ID NO: 2021917 - DNA, 14 bp, Homo sapiens
cgagagtctgtctc

SEQ ID NO: 2021918 - DNA, 16 bp, Homo sapiens
cgagatcgctggcaga

SEQ ID NO: 2021919 - DNA, 19 bp, Homo sapiens
cgagatcgctggcagagaa

SEQ ID NO: 2021920 - DNA, 16 bp, Homo sapiens
cgagattgcgccactg

SEQ ID NO: 2021921 - DNA, 19 bp, Homo sapiens
cgagcaaagtctaaagttt

SEQ ID NO: 2021922 - DNA, 23 bp, Homo sapiens
cgagcaaccgtggcccttcctgg

SEQ ID NO: 2021923 - DNA, 13 bp, Homo sapiens
cgagcagctgagc

SEQ ID NO: 2021924 - DNA, 14 bp, Homo sapiens
cgagcagctgagca

SEQ ID NO: 2021925 - DNA, 16 bp, Homo sapiens
cgagcagctgagcagg

SEQ ID NO: 2021926 - DNA, 18 bp, Homo sapiens
cgagcagggtgctgtggg

SEQ ID NO: 2021927 - DNA, 12 bp, Homo sapiens
cgagcatttccc

SEQ ID NO: 2021928 - DNA, 13 bp, Homo sapiens
cgagcccagctac

SEQ ID NO: 2021929 - DNA, 19 bp, Homo sapiens
cgagcccagctacattcct

SEQ ID NO: 2021930 - DNA, 19 bp, Homo sapiens
cgagccctggtggcagtgg

SEQ ID NO: 2021931 - DNA, 20 bp, Homo sapiens
cgagcgccctgcagaccctg

SEQ ID NO: 2021932 - DNA, 21 bp, Homo sapiens
cgagcgccctgcagaccctgc

SEQ ID NO: 2021933 - DNA, 21 bp, Homo sapiens
cgagctactctcttgccagca

SEQ ID NO: 2021934 - DNA, 14 bp, Homo sapiens
cgagctgctctgct

SEQ ID NO: 2021935 - DNA, 15 bp, Homo sapiens
cgagctgctctgcta

SEQ ID NO: 2021936 - DNA, 14 bp, Homo sapiens
cgaggacagggagg

SEQ ID NO: 2021937 - DNA, 21 bp, Homo sapiens
cgaggagcttccagtgcatgt

SEQ ID NO: 2021938 - DNA, 23 bp, Homo sapiens
cgaggagcttccagtgcatgttg

SEQ ID NO: 2021939 - DNA, 17 bp, Homo sapiens
cgaggcaccggcgctgc

SEQ ID NO: 2021940 - DNA, 22 bp, Homo sapiens
cgaggcagggtcaggagagggg

SEQ ID NO: 2021941 - DNA, 19 bp, Homo sapiens
cgaggccttctctgaagga

SEQ ID NO: 2021942 - DNA, 19 bp, Homo sapiens
cgaggcggtttccaggaag

SEQ ID NO: 2021943 - DNA, 20 bp, Homo sapiens
cgaggcggtttccaggaaga

SEQ ID NO: 2021944 - DNA, 17 bp, Homo sapiens
cgaggtcaacagagaag

SEQ ID NO: 2021945 - DNA, 14 bp, Homo sapiens
cgaggtccagaccc

SEQ ID NO: 2021946 - DNA, 18 bp, Homo sapiens
cgaggtgtcaccctgcag

SEQ ID NO: 2021947 - DNA, 22 bp, Homo sapiens
cgagtaagatattatttaaatg

SEQ ID NO: 2021948 - DNA, 13 bp, Homo sapiens
cgagtagctggga

SEQ ID NO: 2021949 - DNA, 14 bp, Homo sapiens
cgagtagctgggac

SEQ ID NO: 2021950 - DNA, 16 bp, Homo sapiens
cgagtcaatcccctca

SEQ ID NO: 2021951 - DNA, 17 bp, Homo sapiens
cgagtctacctcttcag

SEQ ID NO: 2021952 - DNA, 16 bp, Homo sapiens
cgagtctcttctccac

SEQ ID NO: 2021953 - DNA, 18 bp, Homo sapiens
cgagtctcttctccactg

SEQ ID NO: 2021954 - DNA, 21 bp, Homo sapiens
cgagtttgggccactgcactc

SEQ ID NO: 2021955 - DNA, 16 bp, Homo sapiens
cgagtttggtccctgg

SEQ ID NO: 2021956 - DNA, 17 bp, Homo sapiens
cgagtttggtccctggg

SEQ ID NO: 2021957 - DNA, 20 bp, Homo sapiens
cgataaaactaaatatatgt

SEQ ID NO: 2021958 - DNA, 20 bp, Homo sapiens
cgatacaccgggcctggaga

SEQ ID NO: 2021959 - DNA, 21 bp, Homo sapiens
cgatacaccgggcctggagaa

SEQ ID NO: 2021960 - DNA, 19 bp, Homo sapiens
cgatctgggttcactgcaa

SEQ ID NO: 2021961 - DNA, 16 bp, Homo sapiens
cgatctgtactgtaat

SEQ ID NO: 2021962 - DNA, 16 bp, Homo sapiens
cgatgtacacacacag

SEQ ID NO: 2021963 - DNA, 19 bp, Homo sapiens
cgatgtacacacacagatg

SEQ ID NO: 2021964 - DNA, 11 bp, Homo sapiens
cgatgtggccc

SEQ ID NO: 2021965 - DNA, 18 bp, Homo sapiens
cgattaatttatggtttc

SEQ ID NO: 2021966 - DNA, 17 bp, Homo sapiens
cgattcaaactgctcca

SEQ ID NO: 2021967 - DNA, 19 bp, Homo sapiens
cgattccctctcccaggcc

SEQ ID NO: 2021968 - DNA, 21 bp, Homo sapiens
cgattcttctgcttcagcctc

SEQ ID NO: 2021969 - DNA, 15 bp, Homo sapiens
cgattggctttaaac

SEQ ID NO: 2021970 - DNA, 21 bp, Homo sapiens
cgatttccctggttttagtct

SEQ ID NO: 2021971 - DNA, 14 bp, Homo sapiens
cgatttgtcccagg

SEQ ID NO: 2021972 - DNA, 13 bp, Homo sapiens
cgattttgcctgt

SEQ ID NO: 2021973 - DNA, 13 bp, Homo sapiens
cgcaacccgtgcc

SEQ ID NO: 2021974 - DNA, 14 bp, Homo sapiens
cgcaacccgtgcca

SEQ ID NO: 2021975 - DNA, 22 bp, Homo sapiens
cgcaacccgtgccaagtccagg

SEQ ID NO: 2021976 - DNA, 17 bp, Homo sapiens
cgcaacccttgctgctg

SEQ ID NO: 2021977 - DNA, 20 bp, Homo sapiens
cgcaagcctgtaatcccagc

SEQ ID NO: 2021978 - DNA, 21 bp, Homo sapiens
cgcaagcctgtaatcccagct

SEQ ID NO: 2021979 - DNA, 17 bp, Homo sapiens
cgcaagcgcagggagga

SEQ ID NO: 2021980 - DNA, 21 bp, Homo sapiens
cgcaagcgcagggaggatgcc

SEQ ID NO: 2021981 - DNA, 14 bp, Homo sapiens
cgcaagtctgcagc

SEQ ID NO: 2021982 - DNA, 13 bp, Homo sapiens
cgcaatgtggcat

SEQ ID NO: 2021983 - DNA, 10 bp, Homo sapiens
cgcacacaca

SEQ ID NO: 2021984 - DNA, 12 bp, Homo sapiens
cgcacacacacc

SEQ ID NO: 2021985 - DNA, 22 bp, Homo sapiens
cgcacacacaccggtcaccgag

SEQ ID NO: 2021986 - DNA, 19 bp, Homo sapiens
cgcacacatggacacagac

SEQ ID NO: 2021987 - DNA, 22 bp, Homo sapiens
cgcacagattacttcagggctg

SEQ ID NO: 2021988 - DNA, 17 bp, Homo sapiens
cgcaccagctgctctgc

SEQ ID NO: 2021989 - DNA, 20 bp, Homo sapiens
cgcaccagctgctctgcccc

SEQ ID NO: 2021990 - DNA, 13 bp, Homo sapiens
cgcagagctccct

SEQ ID NO: 2021991 - DNA, 14 bp, Homo sapiens
cgcagagctccctt

SEQ ID NO: 2021992 - DNA, 11 bp, Homo sapiens
cgcagaggcgg

SEQ ID NO: 2021993 - DNA, 23 bp, Homo sapiens
cgcagaggcggaaaccttgcagc

SEQ ID NO: 2021994 - DNA, 14 bp, Homo sapiens
cgcagcaccctgca

SEQ ID NO: 2021995 - DNA, 18 bp, Homo sapiens
cgcagcaccctgcagagc

SEQ ID NO: 2021996 - DNA, 10 bp, Homo sapiens
cgcagcagct

SEQ ID NO: 2021997 - DNA, 14 bp, Homo sapiens
cgcagccaccctga

SEQ ID NO: 2021998 - DNA, 21 bp, Homo sapiens
cgcagccagccggtgcctggc

SEQ ID NO: 2021999 - DNA, 12 bp, Homo sapiens
cgcagcccgtga

SEQ ID NO: 2022000 - DNA, 24 bp, Homo sapiens
cgcagccctgctttgggctgccct

SEQ ID NO: 2022001 - DNA, 18 bp, Homo sapiens
cgcagccctgggggccag

SEQ ID NO: 2022002 - DNA, 20 bp, Homo sapiens
cgcagccctgggggccagct

SEQ ID NO: 2022003 - DNA, 22 bp, Homo sapiens
cgcagccctgggggccagctgg

SEQ ID NO: 2022004 - DNA, 16 bp, Homo sapiens
cgcagcctccctctga

SEQ ID NO: 2022005 - DNA, 16 bp, Homo sapiens
cgctttctacccagcg

SEQ ID NO: 2022006 - DNA, 22 bp, Homo sapiens
cgctttctagctgttgagctgt

SEQ ID NO: 2022007 - DNA, 12 bp, Homo sapiens
cgctttgcctgc

SEQ ID NO: 2022008 - DNA, 11 bp, Homo sapiens
cgctttttgaa

SEQ ID NO: 2022009 - DNA, 16 bp, Homo sapiens
cgctttttgaaaaagc

SEQ ID NO: 2022010 - DNA, 12 bp, Homo sapiens
cggaaaccttgc

SEQ ID NO: 2022011 - DNA, 18 bp, Homo sapiens
cggaaaccttgcagcatt

SEQ ID NO: 2022012 - DNA, 21 bp, Homo sapiens
cggaatcactctgtccttgga

SEQ ID NO: 2022013 - DNA, 20 bp, Homo sapiens
cggaatgaaccacatcttgc

SEQ ID NO: 2022014 - DNA, 21 bp, Homo sapiens
cggaattctcgggaaattatt

SEQ ID NO: 2022015 - DNA, 15 bp, Homo sapiens
cggacagccacggcc

SEQ ID NO: 2022016 - DNA, 18 bp, Homo sapiens
cggacagccacggccagg

SEQ ID NO: 2022017 - DNA, 20 bp, Homo sapiens
cggacccaccaaactgcaca

SEQ ID NO: 2022018 - DNA, 17 bp, Homo sapiens
cggaccgcgtagagagc

SEQ ID NO: 2022019 - DNA, 20 bp, Homo sapiens
cggacctgtggggccccaga

SEQ ID NO: 2022020 - DNA, 22 bp, Homo sapiens
cggacctgtggggccccagaga

SEQ ID NO: 2022021 - DNA, 18 bp, Homo sapiens
cggacgtttccatcaggt

SEQ ID NO: 2022022 - DNA, 15 bp, Homo sapiens
cggagacggagtccc

SEQ ID NO: 2022023 - DNA, 19 bp, Homo sapiens
cggagagtacagtgagcca

SEQ ID NO: 2022024 - DNA, 17 bp, Homo sapiens
cggagcacagccctggg

SEQ ID NO: 2022025 - DNA, 19 bp, Homo sapiens
cggagcacagccctgggag

SEQ ID NO: 2022026 - DNA, 12 bp, Homo sapiens
cggagccccagg

SEQ ID NO: 2022027 - DNA, 14 bp, Homo sapiens
cggagccggcacct

SEQ ID NO: 2022028 - DNA, 21 bp, Homo sapiens
cggagcctcatccgaggcagg

SEQ ID NO: 2022029 - DNA, 15 bp, Homo sapiens
cggagcttgcagtga

SEQ ID NO: 2022030 - DNA, 20 bp, Homo sapiens
cggaggagaccagctcagag

SEQ ID NO: 2022031 - DNA, 22 bp, Homo sapiens
cggaggcaccacgaagctgtga

SEQ ID NO: 2022032 - DNA, 18 bp, Homo sapiens
cggaggcggctccaggtc

SEQ ID NO: 2022033 - DNA, 13 bp, Homo sapiens
cggaggctgggcc

SEQ ID NO: 2022034 - DNA, 18 bp, Homo sapiens
cggaggctgggcccctgg

SEQ ID NO: 2022035 - DNA, 15 bp, Homo sapiens
cggaggggcctggca

SEQ ID NO: 2022036 - DNA, 23 bp, Homo sapiens
cggaggggttgcgggggagctgg

SEQ ID NO: 2022037 - DNA, 15 bp, Homo sapiens
cggaggtggtggagg

SEQ ID NO: 2022038 - DNA, 18 bp, Homo sapiens
cggaggtggtggaggagg

SEQ ID NO: 2022039 - DNA, 19 bp, Homo sapiens
cggaggttccagtgagccg

SEQ ID NO: 2022040 - DNA, 23 bp, Homo sapiens
cggatcaccgagagtagccgaga

SEQ ID NO: 2022041 - DNA, 20 bp, Homo sapiens
cggatcgaggacaagtgaga

SEQ ID NO: 2022042 - DNA, 19 bp, Homo sapiens
cggatgtcccatctgctcc

SEQ ID NO: 2022043 - DNA, 22 bp, Homo sapiens
cggatgtcccatctgctcctcc

SEQ ID NO: 2022044 - DNA, 19 bp, Homo sapiens
cggcaaccccagttctgct

SEQ ID NO: 2022045 - DNA, 22 bp, Homo sapiens
cggcaaccccagttctgctcct

SEQ ID NO: 2022046 - DNA, 19 bp, Homo sapiens
cggcaccccctgcagcttg

SEQ ID NO: 2022047 - DNA, 18 bp, Homo sapiens
cggcacctacatccccag

SEQ ID NO: 2022048 - DNA, 19 bp, Homo sapiens
cggcacctacatccccagg

SEQ ID NO: 2022049 - DNA, 23 bp, Homo sapiens
cggcacctacatccccaggtctc

SEQ ID NO: 2022050 - DNA, 17 bp, Homo sapiens
cggcacctgggccctgg

SEQ ID NO: 2022051 - DNA, 23 bp, Homo sapiens
cggcacctgggccctggggcctg

SEQ ID NO: 2022052 - DNA, 15 bp, Homo sapiens
cggcacgtcccatgt

SEQ ID NO: 2022053 - DNA, 14 bp, Homo sapiens
cggcaggagcagga

SEQ ID NO: 2022054 - DNA, 15 bp, Homo sapiens
cggcaggagcaggaa

SEQ ID NO: 2022055 - DNA, 18 bp, Homo sapiens
cggcaggagcaggaacag

SEQ ID NO: 2022056 - DNA, 16 bp, Homo sapiens
cggcagggtgggggag

SEQ ID NO: 2022057 - DNA, 17 bp, Homo sapiens
cggcatgctggcctgtg

SEQ ID NO: 2022058 - DNA, 10 bp, Homo sapiens
cggccaccct

SEQ ID NO: 2022059 - DNA, 12 bp, Homo sapiens
cggccaggccag

SEQ ID NO: 2022060 - DNA, 13 bp, Homo sapiens
cggccagggcctg

SEQ ID NO: 2022061 - DNA, 17 bp, Homo sapiens
cggcccagagacccctt

SEQ ID NO: 2022062 - DNA, 19 bp, Homo sapiens
cggcccagagaccccttcc

SEQ ID NO: 2022063 - DNA, 13 bp, Homo sapiens
cggccccatcaga

SEQ ID NO: 2022064 - DNA, 17 bp, Homo sapiens
cggccccctccatcggg

SEQ ID NO: 2022065 - DNA, 18 bp, Homo sapiens
cggcccctgctggttcag

SEQ ID NO: 2022066 - DNA, 13 bp, Homo sapiens
cggccctgcccca

SEQ ID NO: 2022067 - DNA, 23 bp, Homo sapiens
cggccctgccccatcctgggcct

SEQ ID NO: 2022068 - DNA, 24 bp, Homo sapiens
cggccctgccccatcctgggcctt

SEQ ID NO: 2022069 - DNA, 13 bp, Homo sapiens
cggccgggctgcc

SEQ ID NO: 2022070 - DNA, 15 bp, Homo sapiens
cggccgggctgccct

SEQ ID NO: 2022071 - DNA, 19 bp, Homo sapiens
cggccgggctgcccttcgc

SEQ ID NO: 2022072 - DNA, 17 bp, Homo sapiens
cggcctatgacttgggc

SEQ ID NO: 2022073 - DNA, 14 bp, Homo sapiens
cggcctcagcaccc

SEQ ID NO: 2022074 - DNA, 10 bp, Homo sapiens
cggcctccac

SEQ ID NO: 2022075 - DNA, 22 bp, Homo sapiens
cggcctccactcccccacctga

SEQ ID NO: 2022076 - DNA, 19 bp, Homo sapiens
cggcctcgtgccatgatct

SEQ ID NO: 2022077 - DNA, 19 bp, Homo sapiens
cggcctctctcttcccagc

SEQ ID NO: 2022078 - DNA, 15 bp, Homo sapiens
cggcctgctcccagc

SEQ ID NO: 2022079 - DNA, 19 bp, Homo sapiens
cggccttcaactgaaaaga

SEQ ID NO: 2022080 - DNA, 13 bp, Homo sapiens
cggcgccaccatc

SEQ ID NO: 2022081 - DNA, 17 bp, Homo sapiens
cggcgccaccatcctgc

SEQ ID NO: 2022082 - DNA, 13 bp, Homo sapiens
cggcgcggtggct

SEQ ID NO: 2022083 - DNA, 16 bp, Homo sapiens
cggctaactctggcac

SEQ ID NO: 2022084 - DNA, 16 bp, Homo sapiens
cggctacatcaaatca

SEQ ID NO: 2022085 - DNA, 17 bp, Homo sapiens
cggctcactgcagcctc

SEQ ID NO: 2022086 - DNA, 12 bp, Homo sapiens
cggctccaggct

SEQ ID NO: 2022087 - DNA, 12 bp, Homo sapiens
cggctccaggtc

SEQ ID NO: 2022088 - DNA, 18 bp, Homo sapiens
cggctccccctgcttctc

SEQ ID NO: 2022089 - DNA, 16 bp, Homo sapiens
cggctctcctgagagg

SEQ ID NO: 2022090 - DNA, 20 bp, Homo sapiens
cggctgagtcatgatctccc

SEQ ID NO: 2022091 - DNA, 11 bp, Homo sapiens
cggctgcctgc

SEQ ID NO: 2022092 - DNA, 14 bp, Homo sapiens
cggctgcctgccgc

SEQ ID NO: 2022093 - DNA, 23 bp, Homo sapiens
cggctgtgggggaggtccctgcc

SEQ ID NO: 2022094 - DNA, 14 bp, Homo sapiens
cggcttggccgcca

SEQ ID NO: 2022095 - DNA, 18 bp, Homo sapiens
cggcttggccgccatccg

SEQ ID NO: 2022096 - DNA, 22 bp, Homo sapiens
cgggaagcctccgtcaggagag

SEQ ID NO: 2022097 - DNA, 13 bp, Homo sapiens
cgggacagacctg

SEQ ID NO: 2022098 - DNA, 19 bp, Homo sapiens
cgggaccattgacctcagc

SEQ ID NO: 2022099 - DNA, 12 bp, Homo sapiens
cgggacgcttcc

SEQ ID NO: 2022100 - DNA, 15 bp, Homo sapiens
cgggagcagtgtctt

SEQ ID NO: 2022101 - DNA, 20 bp, Homo sapiens
cgggagcagtgtcttccata

SEQ ID NO: 2022102 - DNA, 23 bp, Homo sapiens
cgggagcagtgtcttccataatg

SEQ ID NO: 2022103 - DNA, 22 bp, Homo sapiens
cgggagcatctcttgaggccag

SEQ ID NO: 2022104 - DNA, 19 bp, Homo sapiens
cgggagcctccccctcaga

SEQ ID NO: 2022105 - DNA, 15 bp, Homo sapiens
cgggagcctctcctt

SEQ ID NO: 2022106 - DNA, 24 bp, Homo sapiens
cgggagcctctccttgcctggtga

SEQ ID NO: 2022107 - DNA, 21 bp, Homo sapiens
cgggaggactccgggaccatt

SEQ ID NO: 2022108 - DNA, 13 bp, Homo sapiens
cgggaggcaccag

SEQ ID NO: 2022109 - DNA, 16 bp, Homo sapiens
cgggaggcaccagctc

SEQ ID NO: 2022110 - DNA, 17 bp, Homo sapiens
cgggaggcaccagctct

SEQ ID NO: 2022111 - DNA, 19 bp, Homo sapiens
cgggaggcaccagctctgt

SEQ ID NO: 2022112 - DNA, 21 bp, Homo sapiens
cgggaggcaccagctctgtgg

SEQ ID NO: 2022113 - DNA, 23 bp, Homo sapiens
cgggaggcaccagctctgtggcc

SEQ ID NO: 2022114 - DNA, 13 bp, Homo sapiens
cgggaggcctcag

SEQ ID NO: 2022115 - DNA, 13 bp, Homo sapiens
cgggaggctgaga

SEQ ID NO: 2022116 - DNA, 18 bp, Homo sapiens
cgggaggctgagacagga

SEQ ID NO: 2022117 - DNA, 20 bp, Homo sapiens
cgggaggctgagacaggaga

SEQ ID NO: 2022118 - DNA, 18 bp, Homo sapiens
cgggatggtcctggggct

SEQ ID NO: 2022119 - DNA, 22 bp, Homo sapiens
cgggcactcagaagacactgat

SEQ ID NO: 2022120 - DNA, 12 bp, Homo sapiens
ctaaagacagaa

SEQ ID NO: 2022121 - DNA, 23 bp, Homo sapiens
ctaaagagttattcaaatgaagg

SEQ ID NO: 2022122 - DNA, 19 bp, Homo sapiens
ctaaagatatcagagctct

SEQ ID NO: 2022123 - DNA, 17 bp, Homo sapiens
ctaaagcagtgttttca

SEQ ID NO: 2022124 - DNA, 22 bp, Homo sapiens
ctaattggaagaaattcctgta

SEQ ID NO: 2022125 - DNA, 19 bp, Homo sapiens
ctaattggcctctttaaga

SEQ ID NO: 2022126 - DNA, 17 bp, Homo sapiens
ctaatttaaaccagcag

SEQ ID NO: 2022127 - DNA, 13 bp, Homo sapiens
ctaatttatacaa

SEQ ID NO: 2022128 - DNA, 19 bp, Homo sapiens
ctaatttatacaaaataat

SEQ ID NO: 2022129 - DNA, 22 bp, Homo sapiens
ctaatttatacaaaataattta

SEQ ID NO: 2022130 - DNA, 21 bp, Homo sapiens
ctaatttatcctgaaatttca

SEQ ID NO: 2022131 - DNA, 21 bp, Homo sapiens
ctaatttatcttgtctctggg

SEQ ID NO: 2022132 - DNA, 20 bp, Homo sapiens
ctaatttttgtatttttcgt

SEQ ID NO: 2022133 - DNA, 21 bp, Homo sapiens
ctaatttttttgtattttagc

SEQ ID NO: 2022134 - DNA, 16 bp, Homo sapiens
ctacaaaaacacagca

SEQ ID NO: 2022135 - DNA, 17 bp, Homo sapiens
ctacaaaaacacagcaa

SEQ ID NO: 2022136 - DNA, 12 bp, Homo sapiens
ctacaaaatgga

SEQ ID NO: 2022137 - DNA, 15 bp, Homo sapiens
ctacaaccagagccc

SEQ ID NO: 2022138 - DNA, 19 bp, Homo sapiens
ctacaaccagagcccccca

SEQ ID NO: 2022139 - DNA, 19 bp, Homo sapiens
ctacaagcatatttgagaa

SEQ ID NO: 2022140 - DNA, 22 bp, Homo sapiens
ctacaagcatttgccctgtgga

SEQ ID NO: 2022141 - DNA, 15 bp, Homo sapiens
ctacaaggacaatgc

SEQ ID NO: 2022142 - DNA, 13 bp, Homo sapiens
ctacaataaatgc

SEQ ID NO: 2022143 - DNA, 17 bp, Homo sapiens
ctacaataaatgctgaa

SEQ ID NO: 2022144 - DNA, 13 bp, Homo sapiens
ctacacagcctgg

SEQ ID NO: 2022145 - DNA, 22 bp, Homo sapiens
ctacacagtgggaactctgaca

SEQ ID NO: 2022146 - DNA, 14 bp, Homo sapiens
ctacacatatatgt

SEQ ID NO: 2022147 - DNA, 18 bp, Homo sapiens
ctacacatatatgtatat

SEQ ID NO: 2022148 - DNA, 13 bp, Homo sapiens
ctacaccactctg

SEQ ID NO: 2022149 - DNA, 16 bp, Homo sapiens
ctacaccactctggca

SEQ ID NO: 2022150 - DNA, 16 bp, Homo sapiens
ctacacccttggactt

SEQ ID NO: 2022151 - DNA, 13 bp, Homo sapiens
ctacagattttag

SEQ ID NO: 2022152 - DNA, 18 bp, Homo sapiens
ctacagctaatcagcatt

SEQ ID NO: 2022153 - DNA, 19 bp, Homo sapiens
ctacagctaatcagcattc

SEQ ID NO: 2022154 - DNA, 22 bp, Homo sapiens
ctacagctaatcagcattctca

SEQ ID NO: 2022155 - DNA, 19 bp, Homo sapiens
ctacagctcacctctgaag

SEQ ID NO: 2022156 - DNA, 14 bp, Homo sapiens
ctacaggagtgagc

SEQ ID NO: 2022157 - DNA, 15 bp, Homo sapiens
ctacaggagtgagca

SEQ ID NO: 2022158 - DNA, 17 bp, Homo sapiens
ctacaggtgcaagccac

SEQ ID NO: 2022159 - DNA, 16 bp, Homo sapiens
ctacaggtgtgagtca

SEQ ID NO: 2022160 - DNA, 16 bp, Homo sapiens
ctacagtactatgtaa

SEQ ID NO: 2022161 - DNA, 20 bp, Homo sapiens
ctacagttgttttttgaaaa

SEQ ID NO: 2022162 - DNA, 16 bp, Homo sapiens
ctacatccccaggtct

SEQ ID NO: 2022163 - DNA, 13 bp, Homo sapiens
ctacatcttcagc

SEQ ID NO: 2022164 - DNA, 10 bp, Homo sapiens
ctacatgaaa

SEQ ID NO: 2022165 - DNA, 14 bp, Homo sapiens
ctacatgaaacaga

SEQ ID NO: 2022166 - DNA, 15 bp, Homo sapiens
ctacatgaaacagaa

SEQ ID NO: 2022167 - DNA, 18 bp, Homo sapiens
ctacatgaaacagaaaca

SEQ ID NO: 2022168 - DNA, 21 bp, Homo sapiens
ctacatggtattgtaatgaat

SEQ ID NO: 2022169 - DNA, 14 bp, Homo sapiens
ctacattccctggc

SEQ ID NO: 2022170 - DNA, 16 bp, Homo sapiens
ctacattcctcagctg

SEQ ID NO: 2022171 - DNA, 14 bp, Homo sapiens
ctacattctcatct

SEQ ID NO: 2022172 - DNA, 14 bp, Homo sapiens
ctaccaaagcacct

SEQ ID NO: 2022173 - DNA, 15 bp, Homo sapiens
ctaccaaagcacctt

SEQ ID NO: 2022174 - DNA, 14 bp, Homo sapiens
ctaccaatgcatgc

SEQ ID NO: 2022175 - DNA, 14 bp, Homo sapiens
ctaccacagtgtct

SEQ ID NO: 2022176 - DNA, 17 bp, Homo sapiens
ctaccaccccttcctgt

SEQ ID NO: 2022177 - DNA, 22 bp, Homo sapiens
ctaccaccccttcctgtcccac

SEQ ID NO: 2022178 - DNA, 16 bp, Homo sapiens
ctaccaccttccctct

SEQ ID NO: 2022179 - DNA, 13 bp, Homo sapiens
ctaccatgctgct

SEQ ID NO: 2022180 - DNA, 13 bp, Homo sapiens
ctaccatttcaga

SEQ ID NO: 2022181 - DNA, 13 bp, Homo sapiens
ctacccaccctcc

SEQ ID NO: 2022182 - DNA, 17 bp, Homo sapiens
ctacccaccctcctttc

SEQ ID NO: 2022183 - DNA, 22 bp, Homo sapiens
ctacccacttctaaatagcaat

SEQ ID NO: 2022184 - DNA, 19 bp, Homo sapiens
ctacccgagcccagctaca

SEQ ID NO: 2022185 - DNA, 17 bp, Homo sapiens
ctacccttgtaccccat

SEQ ID NO: 2022186 - DNA, 16 bp, Homo sapiens
ctacctgagcattcag

SEQ ID NO: 2022187 - DNA, 13 bp, Homo sapiens
ctacctgaggcct

SEQ ID NO: 2022188 - DNA, 17 bp, Homo sapiens
ctacctgccctctctca

SEQ ID NO: 2022189 - DNA, 18 bp, Homo sapiens
ctacctgccctctctcag

SEQ ID NO: 2022190 - DNA, 19 bp, Homo sapiens
ctacctgccctctctcagt

SEQ ID NO: 2022191 - DNA, 22 bp, Homo sapiens
ctacctgccctctctcagttat

SEQ ID NO: 2022192 - DNA, 12 bp, Homo sapiens
ctacctgtgcct

SEQ ID NO: 2022193 - DNA, 17 bp, Homo sapiens
ctacctgtgtggacagg

SEQ ID NO: 2022194 - DNA, 17 bp, Homo sapiens
ctaccttctctacccat

SEQ ID NO: 2022195 - DNA, 15 bp, Homo sapiens
ctaccttctgacctc

SEQ ID NO: 2022196 - DNA, 14 bp, Homo sapiens
ctacctttttttct

SEQ ID NO: 2022197 - DNA, 13 bp, Homo sapiens
ctacgccaaagtg

SEQ ID NO: 2022198 - DNA, 14 bp, Homo sapiens
ctacgtataaatat

SEQ ID NO: 2022199 - DNA, 14 bp, Homo sapiens
ctacgtatttaata

SEQ ID NO: 2022200 - DNA, 17 bp, Homo sapiens
ctacgttctccagccca

SEQ ID NO: 2022201 - DNA, 20 bp, Homo sapiens
ctacgttctccagcccacac

SEQ ID NO: 2022202 - DNA, 21 bp, Homo sapiens
ctacgttctccagcccacacc

SEQ ID NO: 2022203 - DNA, 20 bp, Homo sapiens
ctactaaaaatacaaaaaat

SEQ ID NO: 2022204 - DNA, 19 bp, Homo sapiens
ctactaaaaatacaaaaat

SEQ ID NO: 2022205 - DNA, 14 bp, Homo sapiens
ctactaaagtgcct

SEQ ID NO: 2022206 - DNA, 20 bp, Homo sapiens
ctactaattatatagtatac

SEQ ID NO: 2022207 - DNA, 18 bp, Homo sapiens
ctactacccgagcccagc

SEQ ID NO: 2022208 - DNA, 15 bp, Homo sapiens
ctactactcaattgt

SEQ ID NO: 2022209 - DNA, 18 bp, Homo sapiens
ctactatgccagatgcct

SEQ ID NO: 2022210 - DNA, 14 bp, Homo sapiens
ctactattctgtta

SEQ ID NO: 2022211 - DNA, 13 bp, Homo sapiens
ctactcacacagg

SEQ ID NO: 2022212 - DNA, 22 bp, Homo sapiens
ctactcacacaggcatttcctg

SEQ ID NO: 2022213 - DNA, 18 bp, Homo sapiens
ctactcacagtctcttta

SEQ ID NO: 2022214 - DNA, 21 bp, Homo sapiens
ctactcagaagcctgaggctg

SEQ ID NO: 2022215 - DNA, 15 bp, Homo sapiens
ctactcaggaggctg

SEQ ID NO: 2022216 - DNA, 16 bp, Homo sapiens
ctactcaggaggctga

SEQ ID NO: 2022217 - DNA, 15 bp, Homo sapiens
ctactcctacctcag

SEQ ID NO: 2022218 - DNA, 18 bp, Homo sapiens
ctactcctacctcagcct

SEQ ID NO: 2022219 - DNA, 23 bp, Homo sapiens
ctactcgggaggctgaggcagga

SEQ ID NO: 2022220 - DNA, 18 bp, Homo sapiens
ctactctcttgccagcat

SEQ ID NO: 2022221 - DNA, 23 bp, Homo sapiens
ctactctggaagtccccgggagc

SEQ ID NO: 2022222 - DNA, 18 bp, Homo sapiens
ctactctgtccaggccac

SEQ ID NO: 2022223 - DNA, 21 bp, Homo sapiens
ctactctgtgccagagcctgg

SEQ ID NO: 2022224 - DNA, 22 bp, Homo sapiens
ctactctgtgccagagcctggg

SEQ ID NO: 2022225 - DNA, 12 bp, Homo sapiens
ctactctgtgtc

SEQ ID NO: 2022226 - DNA, 19 bp, Homo sapiens
ctactcttcctttctaaat

SEQ ID NO: 2022227 - DNA, 22 bp, Homo sapiens
ctactgagcggacagaatgatg

SEQ ID NO: 2022228 - DNA, 17 bp, Homo sapiens
ctactgagtaaacccta

SEQ ID NO: 2022229 - DNA, 14 bp, Homo sapiens
ctactgctgcaaag

SEQ ID NO: 2022230 - DNA, 17 bp, Homo sapiens
ctactgctgcaaagtgc

SEQ ID NO: 2022231 - DNA, 18 bp, Homo sapiens
ctactgctgcaaagtgca

SEQ ID NO: 2022232 - DNA, 16 bp, Homo sapiens
ctactgggaaattact

SEQ ID NO: 2022233 - DNA, 22 bp, Homo sapiens
ctactgtaattaagtgcaattt

SEQ ID NO: 2022234 - DNA, 13 bp, Homo sapiens
ctactgtgactga

SEQ ID NO: 2022235 - DNA, 22 bp, Homo sapiens
ctacttagcatgtccctaccga

SEQ ID NO: 2022236 - DNA, 15 bp, Homo sapiens
ctacttcttggaaaa

SEQ ID NO: 2022237 - DNA, 23 bp, Homo sapiens
ctacttgggaggctgaggcagga

SEQ ID NO: 2022238 - DNA, 17 bp, Homo sapiens
ctactttgatatgactg

SEQ ID NO: 2022239 - DNA, 18 bp, Homo sapiens
ctacttttgcatgaaaat

SEQ ID NO: 2022240 - DNA, 14 bp, Homo sapiens
ctactttttatact

SEQ ID NO: 2022241 - DNA, 21 bp, Homo sapiens
ctcatgcctggcccccctcca

SEQ ID NO: 2022242 - DNA, 22 bp, Homo sapiens
ctcatgcctggcccccctccag

SEQ ID NO: 2022243 - DNA, 17 bp, Homo sapiens
ctcatggaaactggcca

SEQ ID NO: 2022244 - DNA, 19 bp, Homo sapiens
ctcatggcgtaatgggcct

SEQ ID NO: 2022245 - DNA, 23 bp, Homo sapiens
ctcatggcgtaatgggcctgccc

SEQ ID NO: 2022246 - DNA, 18 bp, Homo sapiens
ctcatggcttagaaatct

SEQ ID NO: 2022247 - DNA, 12 bp, Homo sapiens
ctcatgggtacc

SEQ ID NO: 2022248 - DNA, 12 bp, Homo sapiens
ctcatgtgatcc

SEQ ID NO: 2022249 - DNA, 19 bp, Homo sapiens
ctcatgttgttcccacaca

SEQ ID NO: 2022250 - DNA, 13 bp, Homo sapiens
ctcattacccagg

SEQ ID NO: 2022251 - DNA, 17 bp, Homo sapiens
ctcattccaacagtgag

SEQ ID NO: 2022252 - DNA, 18 bp, Homo sapiens
ctcattccaccttcccat

SEQ ID NO: 2022253 - DNA, 21 bp, Homo sapiens
ctcattccaccttcccatgcc

SEQ ID NO: 2022254 - DNA, 13 bp, Homo sapiens
ctcattccccagg

SEQ ID NO: 2022255 - DNA, 13 bp, Homo sapiens
ctcattcccctcg

SEQ ID NO: 2022256 - DNA, 17 bp, Homo sapiens
ctcatttaagggaaaaa

SEQ ID NO: 2022257 - DNA, 22 bp, Homo sapiens
ctcatttaagggaaaaatatat

SEQ ID NO: 2022258 - DNA, 19 bp, Homo sapiens
ctcatttaatcctcccttc

SEQ ID NO: 2022259 - DNA, 15 bp, Homo sapiens
ctcatttcatctcat

SEQ ID NO: 2022260 - DNA, 16 bp, Homo sapiens
ctcatttcatctcatt

SEQ ID NO: 2022261 - DNA, 18 bp, Homo sapiens
ctcatttcatctcattta

SEQ ID NO: 2022262 - DNA, 17 bp, Homo sapiens
ctcatttgtcacacact

SEQ ID NO: 2022263 - DNA, 24 bp, Homo sapiens
ctcattttaggcctcctctctgcc

SEQ ID NO: 2022264 - DNA, 18 bp, Homo sapiens
ctcattttcaatgcacat

SEQ ID NO: 2022265 - DNA, 16 bp, Homo sapiens
ctccaaacaccggcag

SEQ ID NO: 2022266 - DNA, 13 bp, Homo sapiens
ctccaaactcctg

SEQ ID NO: 2022267 - DNA, 14 bp, Homo sapiens
ctccaaactcctgc

SEQ ID NO: 2022268 - DNA, 12 bp, Homo sapiens
ctccaaagaaat

SEQ ID NO: 2022269 - DNA, 20 bp, Homo sapiens
ctccaaaggccctaccagag

SEQ ID NO: 2022270 - DNA, 19 bp, Homo sapiens
ctccaaaggggctgctggg

SEQ ID NO: 2022271 - DNA, 22 bp, Homo sapiens
ctccaaaggggctgctggggca

SEQ ID NO: 2022272 - DNA, 16 bp, Homo sapiens
ctccaaagttatccag

SEQ ID NO: 2022273 - DNA, 21 bp, Homo sapiens
ctccaaatattattcaagtgc

SEQ ID NO: 2022274 - DNA, 20 bp, Homo sapiens
ctccaaatgagacacattaa

SEQ ID NO: 2022275 - DNA, 14 bp, Homo sapiens
ctccaacctggaca

SEQ ID NO: 2022276 - DNA, 14 bp, Homo sapiens
ctccaagagctaca

SEQ ID NO: 2022277 - DNA, 17 bp, Homo sapiens
ctccaagcttcaagtga

SEQ ID NO: 2022278 - DNA, 21 bp, Homo sapiens
ctccaaggggctttgtcctgg

SEQ ID NO: 2022279 - DNA, 15 bp, Homo sapiens
ctccaatcctttcca

SEQ ID NO: 2022280 - DNA, 13 bp, Homo sapiens
ctccaattgtaaa

SEQ ID NO: 2022281 - DNA, 15 bp, Homo sapiens
ctccaattgtaaaaa

SEQ ID NO: 2022282 - DNA, 15 bp, Homo sapiens
ctccacagcggagga

SEQ ID NO: 2022283 - DNA, 14 bp, Homo sapiens
ctccacagtagcat

SEQ ID NO: 2022284 - DNA, 14 bp, Homo sapiens
ctccaccacccaaa

SEQ ID NO: 2022285 - DNA, 16 bp, Homo sapiens
ctccacccactgtccg

SEQ ID NO: 2022286 - DNA, 14 bp, Homo sapiens
ctccaccccaggac

SEQ ID NO: 2022287 - DNA, 20 bp, Homo sapiens
ctccacccccgccacggcca

SEQ ID NO: 2022288 - DNA, 15 bp, Homo sapiens
ctccaccccctccag

SEQ ID NO: 2022289 - DNA, 16 bp, Homo sapiens
ctccaccccctccagc

SEQ ID NO: 2022290 - DNA, 22 bp, Homo sapiens
ctccaccccctccagctccagt

SEQ ID NO: 2022291 - DNA, 16 bp, Homo sapiens
ctactttttatactcc

SEQ ID NO: 2022292 - DNA, 21 bp, Homo sapiens
ctagaaaccagtatggaaggg

SEQ ID NO: 2022293 - DNA, 22 bp, Homo sapiens
ctagaaagctctgcatgtgtgt

SEQ ID NO: 2022294 - DNA, 19 bp, Homo sapiens
ctagaacacaggcaaaatc

SEQ ID NO: 2022295 - DNA, 14 bp, Homo sapiens
ctagaacacccact

SEQ ID NO: 2022296 - DNA, 22 bp, Homo sapiens
ctagaacacccactggccagtc

SEQ ID NO: 2022297 - DNA, 20 bp, Homo sapiens
ctagaacatgcacatttata

SEQ ID NO: 2022298 - DNA, 22 bp, Homo sapiens
ctagaacatgcacatttatata

SEQ ID NO: 2022299 - DNA, 20 bp, Homo sapiens
ctagaaccaagcttcagagc

SEQ ID NO: 2022300 - DNA, 21 bp, Homo sapiens
ctagaaccaagcttcagagcc

SEQ ID NO: 2022301 - DNA, 22 bp, Homo sapiens
ctagaaccaagcttcagagcct

SEQ ID NO: 2022302 - DNA, 15 bp, Homo sapiens
ctagaacctggagag

SEQ ID NO: 2022303 - DNA, 18 bp, Homo sapiens
ctagaactctccatctta

SEQ ID NO: 2022304 - DNA, 14 bp, Homo sapiens
ctagaacttcaaaa

SEQ ID NO: 2022305 - DNA, 14 bp, Homo sapiens
ctagaaggccacat

SEQ ID NO: 2022306 - DNA, 22 bp, Homo sapiens
ctagaagggctagaacctggag

SEQ ID NO: 2022307 - DNA, 19 bp, Homo sapiens
ctagaagtgggccaggaca

SEQ ID NO: 2022308 - DNA, 16 bp, Homo sapiens
ctagaatagccatgta

SEQ ID NO: 2022309 - DNA, 20 bp, Homo sapiens
ctagaatctggagagctaga

SEQ ID NO: 2022310 - DNA, 19 bp, Homo sapiens
ctagaattgagtgtttaaa

SEQ ID NO: 2022311 - DNA, 21 bp, Homo sapiens
ctagaattgagtgtttaaagt

SEQ ID NO: 2022312 - DNA, 23 bp, Homo sapiens
ctagaatttattcaattcctctg

SEQ ID NO: 2022313 - DNA, 13 bp, Homo sapiens
ctagacactgcca

SEQ ID NO: 2022314 - DNA, 14 bp, Homo sapiens
ctagacctgggcca

SEQ ID NO: 2022315 - DNA, 20 bp, Homo sapiens
ctagactaattaaaatctgg

SEQ ID NO: 2022316 - DNA, 23 bp, Homo sapiens
ctagactaattaaaatctggaaa

SEQ ID NO: 2022317 - DNA, 22 bp, Homo sapiens
ctagactagtgctttaccttta

SEQ ID NO: 2022318 - DNA, 16 bp, Homo sapiens
ctagactggagtgagg

SEQ ID NO: 2022319 - DNA, 23 bp, Homo sapiens
ctagactggagtgaggcttccag

SEQ ID NO: 2022320 - DNA, 24 bp, Homo sapiens
ctagactggagtgaggcttccagg

SEQ ID NO: 2022321 - DNA, 22 bp, Homo sapiens
ctagagcagcccaaatttttct

SEQ ID NO: 2022322 - DNA, 17 bp, Homo sapiens
ctagagctcctgtccct

SEQ ID NO: 2022323 - DNA, 19 bp, Homo sapiens
ctagagctcctgtccctac

SEQ ID NO: 2022324 - DNA, 24 bp, Homo sapiens
ctagagctcctgtccctacccact

SEQ ID NO: 2022325 - DNA, 21 bp, Homo sapiens
ctagagctgggaaacagggag

SEQ ID NO: 2022326 - DNA, 11 bp, Homo sapiens
ctagaggcctc

SEQ ID NO: 2022327 - DNA, 15 bp, Homo sapiens
ctagaggcctcagtt

SEQ ID NO: 2022328 - DNA, 21 bp, Homo sapiens
ctagaggcttccttcatttcc

SEQ ID NO: 2022329 - DNA, 19 bp, Homo sapiens
ctagagggcgactctggtg

SEQ ID NO: 2022330 - DNA, 17 bp, Homo sapiens
ctagaggtgggcagctg

SEQ ID NO: 2022331 - DNA, 19 bp, Homo sapiens
ctagaggtgggcagctggg

SEQ ID NO: 2022332 - DNA, 21 bp, Homo sapiens
ctagaggtgggcagctgggcc

SEQ ID NO: 2022333 - DNA, 22 bp, Homo sapiens
ctagaggtgggcagctgggccc

SEQ ID NO: 2022334 - DNA, 18 bp, Homo sapiens
ctagataggtgcttttaa

SEQ ID NO: 2022335 - DNA, 15 bp, Homo sapiens
ctagatcaaggagcc

SEQ ID NO: 2022336 - DNA, 20 bp, Homo sapiens
ctagatcaaggagcccagaa

SEQ ID NO: 2022337 - DNA, 13 bp, Homo sapiens
ctagatccacaca

SEQ ID NO: 2022338 - DNA, 17 bp, Homo sapiens
ctagatccacacacaga

SEQ ID NO: 2022339 - DNA, 19 bp, Homo sapiens
ctagatccacacacagagg

SEQ ID NO: 2022340 - DNA, 21 bp, Homo sapiens
ctagatctcctatttttcaga

SEQ ID NO: 2022341 - DNA, 21 bp, Homo sapiens
ctagattaccccctcattgtt

SEQ ID NO: 2022342 - DNA, 18 bp, Homo sapiens
ctagcaagacctgttggt

SEQ ID NO: 2022343 - DNA, 11 bp, Homo sapiens
ctagcagaagt

SEQ ID NO: 2022344 - DNA, 23 bp, Homo sapiens
ctagcagagcaggggcagggtga

SEQ ID NO: 2022345 - DNA, 18 bp, Homo sapiens
ctagcaggcacaggacac

SEQ ID NO: 2022346 - DNA, 23 bp, Homo sapiens
ctagcaggcacaggacacctggc

SEQ ID NO: 2022347 - DNA, 15 bp, Homo sapiens
ctagcaggcatgccg

SEQ ID NO: 2022348 - DNA, 19 bp, Homo sapiens
ctagccaactcctccttgc

SEQ ID NO: 2022349 - DNA, 20 bp, Homo sapiens
ctagccacctcccaccccac

SEQ ID NO: 2022350 - DNA, 21 bp, Homo sapiens
ctagccacctcccaccccact

SEQ ID NO: 2022351 - DNA, 22 bp, Homo sapiens
ctagccacctcccaccccactc

SEQ ID NO: 2022352 - DNA, 13 bp, Homo sapiens
ctagccaggagtc

SEQ ID NO: 2022353 - DNA, 20 bp, Homo sapiens
ctagcccacttgtcatccat

SEQ ID NO: 2022354 - DNA, 15 bp, Homo sapiens
ctagcccagtgcttc

SEQ ID NO: 2022355 - DNA, 21 bp, Homo sapiens
ctagccctgcggagccggcac

SEQ ID NO: 2022356 - DNA, 18 bp, Homo sapiens
ctagccgacctcagcctt

SEQ ID NO: 2022357 - DNA, 17 bp, Homo sapiens
ctagcctgggccagaga

SEQ ID NO: 2022358 - DNA, 17 bp, Homo sapiens
ctagctagaaatatgat

SEQ ID NO: 2022359 - DNA, 23 bp, Homo sapiens
ctagctagaagtgggccaggaca

SEQ ID NO: 2022360 - DNA, 19 bp, Homo sapiens
ctagctgatcagaatttta

SEQ ID NO: 2022361 - DNA, 18 bp, Homo sapiens
ctagctgggcaaaccctt

SEQ ID NO: 2022362 - DNA, 14 bp, Homo sapiens
ctaggaaacccaag

SEQ ID NO: 2022363 - DNA, 17 bp, Homo sapiens
ctaggaatgaaatcctg

SEQ ID NO: 2022364 - DNA, 22 bp, Homo sapiens
ctaggacccctccatgtgggct

SEQ ID NO: 2022365 - DNA, 14 bp, Homo sapiens
ctaggacctcaggc

SEQ ID NO: 2022366 - DNA, 15 bp, Homo sapiens
ctaggacctcaggcg

SEQ ID NO: 2022367 - DNA, 16 bp, Homo sapiens
ctaggactctgaggct

SEQ ID NO: 2022368 - DNA, 22 bp, Homo sapiens
ctaggactctgaggctctttct

SEQ ID NO: 2022369 - DNA, 15 bp, Homo sapiens
ctaggactgaggagt

SEQ ID NO: 2022370 - DNA, 18 bp, Homo sapiens
ctaggacttgagcctcca

SEQ ID NO: 2022371 - DNA, 16 bp, Homo sapiens
ctaggagcaaagcctg

SEQ ID NO: 2022372 - DNA, 15 bp, Homo sapiens
ctaggagctgggagg

SEQ ID NO: 2022373 - DNA, 20 bp, Homo sapiens
ctaggcagttcaaagcagga

SEQ ID NO: 2022374 - DNA, 18 bp, Homo sapiens
ctaggcatcccaggggac

SEQ ID NO: 2022375 - DNA, 16 bp, Homo sapiens
ctaggccactcctcca

SEQ ID NO: 2022376 - DNA, 15 bp, Homo sapiens
ctaggcgagtgccag

SEQ ID NO: 2022377 - DNA, 16 bp, Homo sapiens
ctaggcgagtgccagg

SEQ ID NO: 2022378 - DNA, 18 bp, Homo sapiens
ctaggcgagtgccaggac

SEQ ID NO: 2022379 - DNA, 19 bp, Homo sapiens
ctaggcgagtgccaggact

SEQ ID NO: 2022380 - DNA, 14 bp, Homo sapiens
ctcctcccacaatc

SEQ ID NO: 2022381 - DNA, 16 bp, Homo sapiens
ctcctcccaccaccct

SEQ ID NO: 2022382 - DNA, 16 bp, Homo sapiens
ctcctcccatggcctt

SEQ ID NO: 2022383 - DNA, 14 bp, Homo sapiens
ctcctcccattccc

SEQ ID NO: 2022384 - DNA, 15 bp, Homo sapiens
ctcctccccttcctg

SEQ ID NO: 2022385 - DNA, 14 bp, Homo sapiens
ctcctcctccccca

SEQ ID NO: 2022386 - DNA, 13 bp, Homo sapiens
ctcctcctgccct

SEQ ID NO: 2022387 - DNA, 14 bp, Homo sapiens
ctcctccttcccct

SEQ ID NO: 2022388 - DNA, 22 bp, Homo sapiens
ctcctccttgcctgcttttctt

SEQ ID NO: 2022389 - DNA, 19 bp, Homo sapiens
ctcctcggccccctccatc

SEQ ID NO: 2022390 - DNA, 15 bp, Homo sapiens
ctcctctccaggcac

SEQ ID NO: 2022391 - DNA, 20 bp, Homo sapiens
ctcctctccttgggctcctg

SEQ ID NO: 2022392 - DNA, 21 bp, Homo sapiens
ctcctctccttgggctcctgg

SEQ ID NO: 2022393 - DNA, 22 bp, Homo sapiens
ctcctctccttgggctcctggc

SEQ ID NO: 2022394 - DNA, 23 bp, Homo sapiens
ctcctctccttgggctcctggct

SEQ ID NO: 2022395 - DNA, 11 bp, Homo sapiens
ctcctctctga

SEQ ID NO: 2022396 - DNA, 14 bp, Homo sapiens
ctcctctctgagac

SEQ ID NO: 2022397 - DNA, 17 bp, Homo sapiens
ctcctctgattatcagg

SEQ ID NO: 2022398 - DNA, 14 bp, Homo sapiens
ctcctctgccacct

SEQ ID NO: 2022399 - DNA, 15 bp, Homo sapiens
ctcctctgccacctc

SEQ ID NO: 2022400 - DNA, 12 bp, Homo sapiens
ctcctctgcttg

SEQ ID NO: 2022401 - DNA, 13 bp, Homo sapiens
ctcctctggccca

SEQ ID NO: 2022402 - DNA, 22 bp, Homo sapiens
ctcctctggcccagcctaccct

SEQ ID NO: 2022403 - DNA, 15 bp, Homo sapiens
ctcctctgtccaggc

SEQ ID NO: 2022404 - DNA, 16 bp, Homo sapiens
ctcctctgtccagggc

SEQ ID NO: 2022405 - DNA, 23 bp, Homo sapiens
ctcctcttaaaaaataaaaactg

SEQ ID NO: 2022406 - DNA, 15 bp, Homo sapiens
ctcctcttgccactg

SEQ ID NO: 2022407 - DNA, 22 bp, Homo sapiens
ctcctgaaaaggtttatgaaaa

SEQ ID NO: 2022408 - DNA, 20 bp, Homo sapiens
ctcctgaagcctctgccctg

SEQ ID NO: 2022409 - DNA, 22 bp, Homo sapiens
ctcctgacattaagacacacct

SEQ ID NO: 2022410 - DNA, 18 bp, Homo sapiens
ctcctgagaaggcgagga

SEQ ID NO: 2022411 - DNA, 21 bp, Homo sapiens
ctcctgagaaggcgaggagag

SEQ ID NO: 2022412 - DNA, 17 bp, Homo sapiens
ctcctgatggccaagag

SEQ ID NO: 2022413 - DNA, 18 bp, Homo sapiens
ctcctgatttctctgaac

SEQ ID NO: 2022414 - DNA, 14 bp, Homo sapiens
ctcctgcccaggag

SEQ ID NO: 2022415 - DNA, 22 bp, Homo sapiens
ctcctgcccaggagagccagcc

SEQ ID NO: 2022416 - DNA, 12 bp, Homo sapiens
ctcctgccctgt

SEQ ID NO: 2022417 - DNA, 22 bp, Homo sapiens
ctcctgcctacattccctggcc

SEQ ID NO: 2022418 - DNA, 16 bp, Homo sapiens
ctcctgcctactcacg

SEQ ID NO: 2022419 - DNA, 14 bp, Homo sapiens
ctcctgcctcagcc

SEQ ID NO: 2022420 - DNA, 18 bp, Homo sapiens
ctcctgcctcgaactggc

SEQ ID NO: 2022421 - DNA, 21 bp, Homo sapiens
ctcctgcctcgaactggctgc

SEQ ID NO: 2022422 - DNA, 15 bp, Homo sapiens
ctcctgcctctactg

SEQ ID NO: 2022423 - DNA, 22 bp, Homo sapiens
ctcctgcctctactgggaaggc

SEQ ID NO: 2022424 - DNA, 16 bp, Homo sapiens
ctcctgcctgtagcag

SEQ ID NO: 2022425 - DNA, 18 bp, Homo sapiens
ctcctgcctgtagcagtg

SEQ ID NO: 2022426 - DNA, 14 bp, Homo sapiens
ctcctgcctgtgtt

SEQ ID NO: 2022427 - DNA, 12 bp, Homo sapiens
ctcctgccttga

SEQ ID NO: 2022428 - DNA, 19 bp, Homo sapiens
ctcctgcgtctgtttttaa

SEQ ID NO: 2022429 - DNA, 19 bp, Homo sapiens
ctcctggaaaggctcagtc

SEQ ID NO: 2022430 - DNA, 22 bp, Homo sapiens
ctcctggaaaggctcagtctca

SEQ ID NO: 2022431 - DNA, 23 bp, Homo sapiens
ctcctggaaaggctcagtctcag

SEQ ID NO: 2022432 - DNA, 11 bp, Homo sapiens
ctcctggaaat

SEQ ID NO: 2022433 - DNA, 20 bp, Homo sapiens
ctcctggaagctgtgtcctt

SEQ ID NO: 2022434 - DNA, 23 bp, Homo sapiens
ctcctggaagctgtgtccttgca

SEQ ID NO: 2022435 - DNA, 18 bp, Homo sapiens
ctcctggagatttcagtt

SEQ ID NO: 2022436 - DNA, 13 bp, Homo sapiens
ctcctggctgcca

SEQ ID NO: 2022437 - DNA, 15 bp, Homo sapiens
ctcctggctgccagg

SEQ ID NO: 2022438 - DNA, 16 bp, Homo sapiens
ctcctggctgccaggc

SEQ ID NO: 2022439 - DNA, 17 bp, Homo sapiens
ctcctggctgccaggcg

SEQ ID NO: 2022440 - DNA, 19 bp, Homo sapiens
ctcctggctgccaggcgtt

SEQ ID NO: 2022441 - DNA, 21 bp, Homo sapiens
ctcctggcttcccatccccag

SEQ ID NO: 2022442 - DNA, 16 bp, Homo sapiens
ctcctgggcagcttga

SEQ ID NO: 2022443 - DNA, 23 bp, Homo sapiens
ctcctgggcccgctttgcctgct

SEQ ID NO: 2022444 - DNA, 19 bp, Homo sapiens
ctcctgggggtggcaggca

SEQ ID NO: 2022445 - DNA, 21 bp, Homo sapiens
ctcctgggggtggcaggcaca

SEQ ID NO: 2022446 - DNA, 14 bp, Homo sapiens
ctcctgggggttct

SEQ ID NO: 2022447 - DNA, 20 bp, Homo sapiens
ctcctgggggttctttcttc

SEQ ID NO: 2022448 - DNA, 23 bp, Homo sapiens
ctcctgggggttctttcttcctc

SEQ ID NO: 2022449 - DNA, 18 bp, Homo sapiens
ctcctgtacgaacccctc

SEQ ID NO: 2022450 - DNA, 15 bp, Homo sapiens
ctcctgtccagcagg

SEQ ID NO: 2022451 - DNA, 15 bp, Homo sapiens
ctcctgtccctaccc

SEQ ID NO: 2022452 - DNA, 16 bp, Homo sapiens
ctcctgtccctaccca

SEQ ID NO: 2022453 - DNA, 19 bp, Homo sapiens
ctcctgtccctacccactc

SEQ ID NO: 2022454 - DNA, 12 bp, Homo sapiens
ctcctgtcctcc

SEQ ID NO: 2022455 - DNA, 15 bp, Homo sapiens
ctcctgtcctcccat

SEQ ID NO: 2022456 - DNA, 20 bp, Homo sapiens
ctcctgtcctcccatcccct

SEQ ID NO: 2022457 - DNA, 21 bp, Homo sapiens
ctcctgtcctcccatcccctg

SEQ ID NO: 2022458 - DNA, 13 bp, Homo sapiens
ctcctgtctgcca

SEQ ID NO: 2022459 - DNA, 22 bp, Homo sapiens
ctcctgtctgccagccagcagc

SEQ ID NO: 2022460 - DNA, 17 bp, Homo sapiens
ctcctgtgcaactttcc

SEQ ID NO: 2022461 - DNA, 22 bp, Homo sapiens
ctcctgtgcccctcagagaggc

SEQ ID NO: 2022462 - DNA, 14 bp, Homo sapiens
ctcctgtgctctgg

SEQ ID NO: 2022463 - DNA, 22 bp, Homo sapiens
ctcctgtgctggactgtttcct

SEQ ID NO: 2022464 - DNA, 15 bp, Homo sapiens
ctcctgtgggagcct

SEQ ID NO: 2022465 - DNA, 19 bp, Homo sapiens
ctcctgtgggagcctcgca

SEQ ID NO: 2022466 - DNA, 17 bp, Homo sapiens
ctcctgtgtggaagaag

SEQ ID NO: 2022467 - DNA, 19 bp, Homo sapiens
ctcctgtgtgtgcgcctac

SEQ ID NO: 2022468 - DNA, 12 bp, Homo sapiens
ctcctgtttcca

SEQ ID NO: 2022469 - DNA, 21 bp, Homo sapiens
ctccttactctgagcccaggc

SEQ ID NO: 2022470 - DNA, 23 bp, Homo sapiens
ctccttactctgagcccaggccg

SEQ ID NO: 2022471 - DNA, 21 bp, Homo sapiens
ctccttagagacatcaaaatc

SEQ ID NO: 2022472 - DNA, 16 bp, Homo sapiens
ctccttattttgtatt

SEQ ID NO: 2022473 - DNA, 21 bp, Homo sapiens
ctccttcaacaattctaaaat

SEQ ID NO: 2022474 - DNA, 16 bp, Homo sapiens
ctccttccagctagtg

SEQ ID NO: 2022475 - DNA, 13 bp, Homo sapiens
ctccttcccctgt

SEQ ID NO: 2022476 - DNA, 11 bp, Homo sapiens
ctccttcctgc

SEQ ID NO: 2022477 - DNA, 21 bp, Homo sapiens
ctccttcctgccccaactcct

SEQ ID NO: 2022478 - DNA, 22 bp, Homo sapiens
ctccttccttgctgtcctaggc

SEQ ID NO: 2022479 - DNA, 15 bp, Homo sapiens
ctccttcgtgtctct

SEQ ID NO: 2022480 - DNA, 21 bp, Homo sapiens
ctccttgattttagccttctc

SEQ ID NO: 2022481 - DNA, 19 bp, Homo sapiens
ctccttggaggacagtggg

SEQ ID NO: 2022482 - DNA, 13 bp, Homo sapiens
ctccttgggctcc

SEQ ID NO: 2022483 - DNA, 15 bp, Homo sapiens
ctccttgggctcctg

SEQ ID NO: 2022484 - DNA, 17 bp, Homo sapiens
ctccttgggctcctggc

SEQ ID NO: 2022485 - DNA, 18 bp, Homo sapiens
ctccttgggctcctggct

SEQ ID NO: 2022486 - DNA, 20 bp, Homo sapiens
ctccttgggctcctggctgc

SEQ ID NO: 2022487 - DNA, 21 bp, Homo sapiens
ctccttgggctcctggctgcc

SEQ ID NO: 2022488 - DNA, 22 bp, Homo sapiens
ctccttgggctcctggctgcca

SEQ ID NO: 2022489 - DNA, 14 bp, Homo sapiens
ctcctttagcaggt

SEQ ID NO: 2022490 - DNA, 17 bp, Homo sapiens
ctcctttagcgcccagt

SEQ ID NO: 2022491 - DNA, 22 bp, Homo sapiens
ctcctttagcgcccagttgggt

SEQ ID NO: 2022492 - DNA, 15 bp, Homo sapiens
ctcctttcaccacat

SEQ ID NO: 2022493 - DNA, 14 bp, Homo sapiens
ctcctttcctctga

SEQ ID NO: 2022494 - DNA, 14 bp, Homo sapiens
ctcctttctttcta

SEQ ID NO: 2022495 - DNA, 14 bp, Homo sapiens
ctcctttgcactga

SEQ ID NO: 2022496 - DNA, 16 bp, Homo sapiens
ctcctttgcactgagg

SEQ ID NO: 2022497 - DNA, 18 bp, Homo sapiens
ctcctttgcactgagggc

SEQ ID NO: 2022498 - DNA, 21 bp, Homo sapiens
ctcctttgcactgagggccac

SEQ ID NO: 2022499 - DNA, 16 bp, Homo sapiens
ctcctttggaccctgt

SEQ ID NO: 2022500 - DNA, 13 bp, Homo sapiens
ctccttttgctgt

SEQ ID NO: 2022501 - DNA, 15 bp, Homo sapiens
ctcgaaccaaggcag

SEQ ID NO: 2022502 - DNA, 13 bp, Homo sapiens
ctcgaactggctg

SEQ ID NO: 2022503 - DNA, 17 bp, Homo sapiens
ctcgaagcccttccagt

SEQ ID NO: 2022504 - DNA, 21 bp, Homo sapiens
ctcgagaccatcctggcccct

SEQ ID NO: 2022505 - DNA, 15 bp, Homo sapiens
ctcgagccccctgga

SEQ ID NO: 2022506 - DNA, 19 bp, Homo sapiens
ctcgagcgccctgcagacc

SEQ ID NO: 2022507 - DNA, 21 bp, Homo sapiens
ctcgagcgccctgcagaccct

SEQ ID NO: 2022508 - DNA, 14 bp, Homo sapiens
ctcgaggcaccggc

SEQ ID NO: 2022509 - DNA, 21 bp, Homo sapiens
ctcgaggcaccggcgctgcag

SEQ ID NO: 2022510 - DNA, 22 bp, Homo sapiens
ctcgcaacccgtgccaagtcca

SEQ ID NO: 2022511 - DNA, 22 bp, Homo sapiens
ctcgcagcaggtgcaagagaca

SEQ ID NO: 2022512 - DNA, 13 bp, Homo sapiens
ctcgcagcctggc

SEQ ID NO: 2022513 - DNA, 14 bp, Homo sapiens
ctcgcagcctggcg

SEQ ID NO: 2022514 - DNA, 15 bp, Homo sapiens
ctcgcagcctggcgg

SEQ ID NO: 2022515 - DNA, 16 bp, Homo sapiens
ctcgccacggggaggg

SEQ ID NO: 2022516 - DNA, 16 bp, Homo sapiens
ctcgccggccttgttt

SEQ ID NO: 2022517 - DNA, 16 bp, Homo sapiens
ctcgccgtctgtgaat

SEQ ID NO: 2022518 - DNA, 18 bp, Homo sapiens
ctcgcctgggcccaggct

SEQ ID NO: 2022519 - DNA, 22 bp, Homo sapiens
ctcgcctgggcccaggctctgg

SEQ ID NO: 2022520 - DNA, 19 bp, Homo sapiens
ctcgccttttaggctcagg

SEQ ID NO: 2022521 - DNA, 15 bp, Homo sapiens
ctcgctccccactct

SEQ ID NO: 2022522 - DNA, 17 bp, Homo sapiens
ctcgctccccactctgc

SEQ ID NO: 2022523 - DNA, 23 bp, Homo sapiens
ctcgctccccactctgctctgat

SEQ ID NO: 2022524 - DNA, 16 bp, Homo sapiens
ctcgctgtcctgctgt

SEQ ID NO: 2022525 - DNA, 17 bp, Homo sapiens
ctcggaagccgtctgac

SEQ ID NO: 2022526 - DNA, 23 bp, Homo sapiens
ctcggacccaccaaactgcacac

SEQ ID NO: 2022527 - DNA, 12 bp, Homo sapiens
ctcggagaagag

SEQ ID NO: 2022528 - DNA, 12 bp, Homo sapiens
ctcggagcctca

SEQ ID NO: 2022529 - DNA, 16 bp, Homo sapiens
ctcggagcctcatccg

SEQ ID NO: 2022530 - DNA, 16 bp, Homo sapiens
ctcggccccctccatc

SEQ ID NO: 2022531 - DNA, 20 bp, Homo sapiens
ctcggctgtaaacagctctg

SEQ ID NO: 2022532 - DNA, 15 bp, Homo sapiens
ctcgggacacctgcc

SEQ ID NO: 2022533 - DNA, 20 bp, Homo sapiens
ctcgggacacctgccctgcc

SEQ ID NO: 2022534 - DNA, 21 bp, Homo sapiens
ctcgggacctcgtttgggagt

SEQ ID NO: 2022535 - DNA, 15 bp, Homo sapiens
ctcgggaggctgaga

SEQ ID NO: 2022536 - DNA, 19 bp, Homo sapiens
ctcgggaggctgagacagg

SEQ ID NO: 2022537 - DNA, 21 bp, Homo sapiens
ctcgggaggctgagacaggag

SEQ ID NO: 2022538 - DNA, 20 bp, Homo sapiens
ctcgggaggctgaggcagga

SEQ ID NO: 2022539 - DNA, 20 bp, Homo sapiens
ctcgggcgctgtggctcctg

SEQ ID NO: 2022540 - DNA, 21 bp, Homo sapiens
ctcgggcgctgtggctcctgc

SEQ ID NO: 2022541 - DNA, 24 bp, Homo sapiens
ctcggggcccttggggcctggctt

SEQ ID NO: 2022542 - DNA, 16 bp, Homo sapiens
ctcggggtgcacagga

SEQ ID NO: 2022543 - DNA, 15 bp, Homo sapiens
ctcggtggccatgct

SEQ ID NO: 2022544 - DNA, 19 bp, Homo sapiens
ctcggtggccatgcttctt

SEQ ID NO: 2022545 - DNA, 10 bp, Homo sapiens
ctcggtgtaa

SEQ ID NO: 2022546 - DNA, 14 bp, Homo sapiens
ctcgtaccagccag

SEQ ID NO: 2022547 - DNA, 16 bp, Homo sapiens
ctcgtaccagccagga

SEQ ID NO: 2022548 - DNA, 14 bp, Homo sapiens
ctcgtagccatctc

SEQ ID NO: 2022549 - DNA, 17 bp, Homo sapiens
ctcgtccacaggggcag

SEQ ID NO: 2022550 - DNA, 21 bp, Homo sapiens
ctcgtccacaggggcaggcct

SEQ ID NO: 2022551 - DNA, 17 bp, Homo sapiens
ctcgtcctccccctgcc

SEQ ID NO: 2022552 - DNA, 22 bp, Homo sapiens
ctcgtcctccccctgccagtgc

SEQ ID NO: 2022553 - DNA, 15 bp, Homo sapiens
ctcgtcctgtcccag

SEQ ID NO: 2022554 - DNA, 17 bp, Homo sapiens
ctcgtcctgtcccagag

SEQ ID NO: 2022555 - DNA, 17 bp, Homo sapiens
ctcgtgccatgatctgt

SEQ ID NO: 2022556 - DNA, 12 bp, Homo sapiens
ctcgtggacacc

SEQ ID NO: 2022557 - DNA, 14 bp, Homo sapiens
ctcgtggacacctg

SEQ ID NO: 2022558 - DNA, 15 bp, Homo sapiens
ctcgtggacacctgc

SEQ ID NO: 2022559 - DNA, 16 bp, Homo sapiens
ctcgtggacacctgcc

SEQ ID NO: 2022560 - DNA, 19 bp, Homo sapiens
ctcgtggacacctgccctg

SEQ ID NO: 2022561 - DNA, 17 bp, Homo sapiens
ctcgtggtagaagccag

SEQ ID NO: 2022562 - DNA, 20 bp, Homo sapiens
ctcgtggtagaagccagtac

SEQ ID NO: 2022563 - DNA, 16 bp, Homo sapiens
ctctaaaaataaaatg

SEQ ID NO: 2022564 - DNA, 19 bp, Homo sapiens
ctctaaaaataaaatgatg

SEQ ID NO: 2022565 - DNA, 17 bp, Homo sapiens
ctctaaaatagccactt

SEQ ID NO: 2022566 - DNA, 15 bp, Homo sapiens
ctctaaatcttcctt

SEQ ID NO: 2022567 - DNA, 20 bp, Homo sapiens
ctctaacccccagtgccaca

SEQ ID NO: 2022568 - DNA, 21 bp, Homo sapiens
ctctaacccccagtgccacag

SEQ ID NO: 2022569 - DNA, 13 bp, Homo sapiens
ctctaacgcctga

SEQ ID NO: 2022570 - DNA, 21 bp, Homo sapiens
ctctaacgcctgagcccaggg

SEQ ID NO: 2022571 - DNA, 13 bp, Homo sapiens
ctctaagccactc

SEQ ID NO: 2022572 - DNA, 13 bp, Homo sapiens
ctctacagaggcc

SEQ ID NO: 2022573 - DNA, 16 bp, Homo sapiens
ctctacagaggccatg

SEQ ID NO: 2022574 - DNA, 19 bp, Homo sapiens
ctctacagaggccatgggc

SEQ ID NO: 2022575 - DNA, 14 bp, Homo sapiens
ctctacccatctcc

SEQ ID NO: 2022576 - DNA, 22 bp, Homo sapiens
ctctaccccaaagaattcctga

SEQ ID NO: 2022577 - DNA, 17 bp, Homo sapiens
ctctacccggcccagag

SEQ ID NO: 2022578 - DNA, 19 bp, Homo sapiens
ctctacccggcccagagac

SEQ ID NO: 2022579 - DNA, 21 bp, Homo sapiens
ctctacccggcccagagaccc

SEQ ID NO: 2022580 - DNA, 23 bp, Homo sapiens
ctctaccctggtaggaaagcacc

SEQ ID NO: 2022581 - DNA, 22 bp, Homo sapiens
ctctacgccaaagtgcagccct

SEQ ID NO: 2022582 - DNA, 23 bp, Homo sapiens
ctctacgccaaagtgcagccctt

SEQ ID NO: 2022583 - DNA, 19 bp, Homo sapiens
ctctactcctacctcagcc

SEQ ID NO: 2022584 - DNA, 12 bp, Homo sapiens
ctctactgggaa

SEQ ID NO: 2022585 - DNA, 20 bp, Homo sapiens
ctctacttagcatgtcccta

SEQ ID NO: 2022586 - DNA, 18 bp, Homo sapiens
ctctagaacacccactgg

SEQ ID NO: 2022587 - DNA, 20 bp, Homo sapiens
ctctagaattttaagtgctt

SEQ ID NO: 2022588 - DNA, 13 bp, Homo sapiens
ctctagagaacat

SEQ ID NO: 2022589 - DNA, 21 bp, Homo sapiens
ctctagcctgggccagagaag

SEQ ID NO: 2022590 - DNA, 13 bp, Homo sapiens
ctctagctggcag

SEQ ID NO: 2022591 - DNA, 15 bp, Homo sapiens
ctctagctggcagga

SEQ ID NO: 2022592 - DNA, 20 bp, Homo sapiens
ctctagtcttgctttgctgt

SEQ ID NO: 2022593 - DNA, 22 bp, Homo sapiens
ctctagtcttgctttgctgtct

SEQ ID NO: 2022594 - DNA, 22 bp, Homo sapiens
ctctagtgacttcctggtgagg

SEQ ID NO: 2022595 - DNA, 21 bp, Homo sapiens
ctctagtttctttctgttatt

SEQ ID NO: 2022596 - DNA, 21 bp, Homo sapiens
ctctagttttcagccttggga

SEQ ID NO: 2022597 - DNA, 21 bp, Homo sapiens
ctctatatatacatgtatagt

SEQ ID NO: 2022598 - DNA, 16 bp, Homo sapiens
ctctatgccccaaata

SEQ ID NO: 2022599 - DNA, 23 bp, Homo sapiens
ctctattcctgaccctccctacc

SEQ ID NO: 2022600 - DNA, 14 bp, Homo sapiens
ctctatttaatatt

SEQ ID NO: 2022601 - DNA, 15 bp, Homo sapiens
ctctatttcattttt

SEQ ID NO: 2022602 - DNA, 16 bp, Homo sapiens
ctctcaatatgcttac

SEQ ID NO: 2022603 - DNA, 14 bp, Homo sapiens
ctctcacacacata

SEQ ID NO: 2022604 - DNA, 17 bp, Homo sapiens
ctctcagaattcttcag

SEQ ID NO: 2022605 - DNA, 11 bp, Homo sapiens
ctctcagccaa

SEQ ID NO: 2022606 - DNA, 22 bp, Homo sapiens
ctctcagcctcccaaccccagg

SEQ ID NO: 2022607 - DNA, 13 bp, Homo sapiens
ctctcaggagcac

SEQ ID NO: 2022608 - DNA, 15 bp, Homo sapiens
ctctcaggagcacag

SEQ ID NO: 2022609 - DNA, 16 bp, Homo sapiens
ctctcaggagcacagg

SEQ ID NO: 2022610 - DNA, 17 bp, Homo sapiens
ctctcaggagcacaggc

SEQ ID NO: 2022611 - DNA, 20 bp, Homo sapiens
ctctcaggagcacaggcagc

SEQ ID NO: 2022612 - DNA, 14 bp, Homo sapiens
ctccctaaactgta

SEQ ID NO: 2022613 - DNA, 14 bp, Homo sapiens
ctccctactcccct

SEQ ID NO: 2022614 - DNA, 16 bp, Homo sapiens
ctccctccaccccagg

SEQ ID NO: 2022615 - DNA, 17 bp, Homo sapiens
ctccctccaccccagga

SEQ ID NO: 2022616 - DNA, 12 bp, Homo sapiens
ctccctccaggg

SEQ ID NO: 2022617 - DNA, 16 bp, Homo sapiens
ctccctccatgtggcc

SEQ ID NO: 2022618 - DNA, 12 bp, Homo sapiens
ctccctcccaca

SEQ ID NO: 2022619 - DNA, 22 bp, Homo sapiens
ctccctccccacacctccctac

SEQ ID NO: 2022620 - DNA, 19 bp, Homo sapiens
ctccctcctaacctagaga

SEQ ID NO: 2022621 - DNA, 16 bp, Homo sapiens
ctccctcctctggccc

SEQ ID NO: 2022622 - DNA, 12 bp, Homo sapiens
ctccctcctgga

SEQ ID NO: 2022623 - DNA, 12 bp, Homo sapiens
ctccctctcctg

SEQ ID NO: 2022624 - DNA, 13 bp, Homo sapiens
ctccctctcctgc

SEQ ID NO: 2022625 - DNA, 14 bp, Homo sapiens
ctccctctcctgcc

SEQ ID NO: 2022626 - DNA, 13 bp, Homo sapiens
ctccctctgacct

SEQ ID NO: 2022627 - DNA, 14 bp, Homo sapiens
ctccctctgacctg

SEQ ID NO: 2022628 - DNA, 13 bp, Homo sapiens
ctccctctgcccc

SEQ ID NO: 2022629 - DNA, 20 bp, Homo sapiens
ctccctctgccccaagcagc

SEQ ID NO: 2022630 - DNA, 21 bp, Homo sapiens
ctccctctgccccaagcagcc

SEQ ID NO: 2022631 - DNA, 14 bp, Homo sapiens
ctccctctggccct

SEQ ID NO: 2022632 - DNA, 19 bp, Homo sapiens
ctccctctggccctgcctt

SEQ ID NO: 2022633 - DNA, 20 bp, Homo sapiens
ctccctctggccctgccttc

SEQ ID NO: 2022634 - DNA, 19 bp, Homo sapiens
ctccctcttccttccccca

SEQ ID NO: 2022635 - DNA, 16 bp, Homo sapiens
ctccctgaacctcagt

SEQ ID NO: 2022636 - DNA, 17 bp, Homo sapiens
ctccctgactccctgtg

SEQ ID NO: 2022637 - DNA, 12 bp, Homo sapiens
ctccctgagctt

SEQ ID NO: 2022638 - DNA, 16 bp, Homo sapiens
ctccctgagctttggg

SEQ ID NO: 2022639 - DNA, 14 bp, Homo sapiens
ctccctgcccctcc

SEQ ID NO: 2022640 - DNA, 15 bp, Homo sapiens
ctccctgccctgtcc

SEQ ID NO: 2022641 - DNA, 21 bp, Homo sapiens
ctccctgccctgtcctccagc

SEQ ID NO: 2022642 - DNA, 15 bp, Homo sapiens
ctccctgccgcctca

SEQ ID NO: 2022643 - DNA, 19 bp, Homo sapiens
ctccctgccgcctcaatgt

SEQ ID NO: 2022644 - DNA, 15 bp, Homo sapiens
ctccctgctaccaag

SEQ ID NO: 2022645 - DNA, 22 bp, Homo sapiens
ctccctggagtgcagtttccaa

SEQ ID NO: 2022646 - DNA, 19 bp, Homo sapiens
ctccctggatgtgtggggc

SEQ ID NO: 2022647 - DNA, 18 bp, Homo sapiens
ctccctggcctcacgccc

SEQ ID NO: 2022648 - DNA, 15 bp, Homo sapiens
ctccctggctctcag

SEQ ID NO: 2022649 - DNA, 18 bp, Homo sapiens
ctccctggctctcagaag

SEQ ID NO: 2022650 - DNA, 13 bp, Homo sapiens
ctccctgtcctcc

SEQ ID NO: 2022651 - DNA, 15 bp, Homo sapiens
ctccctgtcctcctc

SEQ ID NO: 2022652 - DNA, 19 bp, Homo sapiens
ctccctgttatctgctaga

SEQ ID NO: 2022653 - DNA, 22 bp, Homo sapiens
ctcccttaggcattatttaatg

SEQ ID NO: 2022654 - DNA, 23 bp, Homo sapiens
ctcccttcaaccattccccatgg

SEQ ID NO: 2022655 - DNA, 12 bp, Homo sapiens
ctcccttcctga

SEQ ID NO: 2022656 - DNA, 18 bp, Homo sapiens
ctcccttcctggcctcac

SEQ ID NO: 2022657 - DNA, 16 bp, Homo sapiens
ctcccttctacagcct

SEQ ID NO: 2022658 - DNA, 24 bp, Homo sapiens
ctcccttgctcagtgcctcctggc

SEQ ID NO: 2022659 - DNA, 16 bp, Homo sapiens
ctccctttctcttctt

SEQ ID NO: 2022660 - DNA, 13 bp, Homo sapiens
ctccgagaacaac

SEQ ID NO: 2022661 - DNA, 18 bp, Homo sapiens
ctccgccttcactccggt

SEQ ID NO: 2022662 - DNA, 23 bp, Homo sapiens
ctccgctgggaggaacctgaacc

SEQ ID NO: 2022663 - DNA, 19 bp, Homo sapiens
ctccgctttctacccagcg

SEQ ID NO: 2022664 - DNA, 20 bp, Homo sapiens
ctccgctttctacccagcga

SEQ ID NO: 2022665 - DNA, 16 bp, Homo sapiens
ctccggaatgaccagc

SEQ ID NO: 2022666 - DNA, 15 bp, Homo sapiens
ctccggggagagcag

SEQ ID NO: 2022667 - DNA, 21 bp, Homo sapiens
ctccggggtctgtgctgtgcc

SEQ ID NO: 2022668 - DNA, 19 bp, Homo sapiens
ctccggtgtgcctgcagcc

SEQ ID NO: 2022669 - DNA, 12 bp, Homo sapiens
ctccgtcaggag

SEQ ID NO: 2022670 - DNA, 14 bp, Homo sapiens
ctccgtcaggagag

SEQ ID NO: 2022671 - DNA, 19 bp, Homo sapiens
ctccgtcatgaatgccttc

SEQ ID NO: 2022672 - DNA, 22 bp, Homo sapiens
ctccgtccacccaggctgcact

SEQ ID NO: 2022673 - DNA, 22 bp, Homo sapiens
ctccgtccaggagcctgtgcct

SEQ ID NO: 2022674 - DNA, 19 bp, Homo sapiens
ctccgtttatgggccttgc

SEQ ID NO: 2022675 - DNA, 14 bp, Homo sapiens
ctcctaagcagctg

SEQ ID NO: 2022676 - DNA, 15 bp, Homo sapiens
ctcctacctcagcct

SEQ ID NO: 2022677 - DNA, 15 bp, Homo sapiens
ctcctacctgctgct

SEQ ID NO: 2022678 - DNA, 18 bp, Homo sapiens
ctcctagaggtgggcagc

SEQ ID NO: 2022679 - DNA, 20 bp, Homo sapiens
ctcctagggaaaagttcata

SEQ ID NO: 2022680 - DNA, 19 bp, Homo sapiens
ctcctagtttgacctcaca

SEQ ID NO: 2022681 - DNA, 17 bp, Homo sapiens
ctcctatttttcagaat

SEQ ID NO: 2022682 - DNA, 14 bp, Homo sapiens
ctcctcacccccag

SEQ ID NO: 2022683 - DNA, 15 bp, Homo sapiens
ctcctcaccccgtct

SEQ ID NO: 2022684 - DNA, 18 bp, Homo sapiens
ctcctcaccccgtctggg

SEQ ID NO: 2022685 - DNA, 11 bp, Homo sapiens
ctcctcagact

SEQ ID NO: 2022686 - DNA, 23 bp, Homo sapiens
ctcctccaaaggaagtctaggag

SEQ ID NO: 2022687 - DNA, 14 bp, Homo sapiens
ctcctccacagtgc

SEQ ID NO: 2022688 - DNA, 15 bp, Homo sapiens
ctcctccacagtgct

SEQ ID NO: 2022689 - DNA, 17 bp, Homo sapiens
ctcctccacagtgctgc

SEQ ID NO: 2022690 - DNA, 18 bp, Homo sapiens
ctcctccacagtgctgct

SEQ ID NO: 2022691 - DNA, 13 bp, Homo sapiens
ctcctccactcac

SEQ ID NO: 2022692 - DNA, 19 bp, Homo sapiens
ctcctccactcactccagc

SEQ ID NO: 2022693 - DNA, 15 bp, Homo sapiens
ctcctccactccacc

SEQ ID NO: 2022694 - DNA, 11 bp, Homo sapiens
ctcctccaggg

SEQ ID NO: 2022695 - DNA, 20 bp, Homo sapiens
ctcttcactcagccacaccc

SEQ ID NO: 2022696 - DNA, 19 bp, Homo sapiens
ctcttcaggaggccctggt

SEQ ID NO: 2022697 - DNA, 14 bp, Homo sapiens
ctcttcaggttctt

SEQ ID NO: 2022698 - DNA, 22 bp, Homo sapiens
ctcttcaggttcttagtgtcac

SEQ ID NO: 2022699 - DNA, 13 bp, Homo sapiens
ctcttcatacttt

SEQ ID NO: 2022700 - DNA, 17 bp, Homo sapiens
ctcttcattctttgaag

SEQ ID NO: 2022701 - DNA, 14 bp, Homo sapiens
ctcttcattttgag

SEQ ID NO: 2022702 - DNA, 21 bp, Homo sapiens
ctcttcattttgagtctcagg

SEQ ID NO: 2022703 - DNA, 14 bp, Homo sapiens
ctcttccaaagctc

SEQ ID NO: 2022704 - DNA, 20 bp, Homo sapiens
ctcttccagaagatgccctc

SEQ ID NO: 2022705 - DNA, 15 bp, Homo sapiens
ctcttccccttgccc

SEQ ID NO: 2022706 - DNA, 16 bp, Homo sapiens
ctcttccccttgccct

SEQ ID NO: 2022707 - DNA, 19 bp, Homo sapiens
ctcttccccttgcccttgc

SEQ ID NO: 2022708 - DNA, 23 bp, Homo sapiens
ctcttccccttgcccttgccctg

SEQ ID NO: 2022709 - DNA, 14 bp, Homo sapiens
ctcttcccctttcc

SEQ ID NO: 2022710 - DNA, 13 bp, Homo sapiens
ctcttccctcagt

SEQ ID NO: 2022711 - DNA, 16 bp, Homo sapiens
ctcttccctccttccc

SEQ ID NO: 2022712 - DNA, 12 bp, Homo sapiens
ctcttcctaccc

SEQ ID NO: 2022713 - DNA, 22 bp, Homo sapiens
ctcttcctacccaaccactcaa

SEQ ID NO: 2022714 - DNA, 15 bp, Homo sapiens
ctcttcctctgttct

SEQ ID NO: 2022715 - DNA, 12 bp, Homo sapiens
ctcttcctgatt

SEQ ID NO: 2022716 - DNA, 13 bp, Homo sapiens
ctcttcctggacc

SEQ ID NO: 2022717 - DNA, 10 bp, Homo sapiens
ctcttcctgt

SEQ ID NO: 2022718 - DNA, 16 bp, Homo sapiens
ctcttcggtttctgag

SEQ ID NO: 2022719 - DNA, 18 bp, Homo sapiens
ctcttcggtttctgagca

SEQ ID NO: 2022720 - DNA, 17 bp, Homo sapiens
ctcttctattttgtaaa

SEQ ID NO: 2022721 - DNA, 15 bp, Homo sapiens
ctcttctccactgga

SEQ ID NO: 2022722 - DNA, 19 bp, Homo sapiens
ctcttctccactggatgga

SEQ ID NO: 2022723 - DNA, 13 bp, Homo sapiens
ctcttctcctttc

SEQ ID NO: 2022724 - DNA, 15 bp, Homo sapiens
ctcttctcctttcac

SEQ ID NO: 2022725 - DNA, 16 bp, Homo sapiens
ctcttctcttcctgta

SEQ ID NO: 2022726 - DNA, 18 bp, Homo sapiens
ctcttctgccagcctccc

SEQ ID NO: 2022727 - DNA, 15 bp, Homo sapiens
ctcttctgttctcaa

SEQ ID NO: 2022728 - DNA, 17 bp, Homo sapiens
ctcttcttcttcagaag

SEQ ID NO: 2022729 - DNA, 17 bp, Homo sapiens
ctcttcttgagcagacc

SEQ ID NO: 2022730 - DNA, 13 bp, Homo sapiens
ctcttctttctga

SEQ ID NO: 2022731 - DNA, 14 bp, Homo sapiens
ctcttctttctgag

SEQ ID NO: 2022732 - DNA, 15 bp, Homo sapiens
ctcttctttctgaga

SEQ ID NO: 2022733 - DNA, 15 bp, Homo sapiens
ctcttgacctcaggt

SEQ ID NO: 2022734 - DNA, 14 bp, Homo sapiens
ctcttgaggccagg

SEQ ID NO: 2022735 - DNA, 17 bp, Homo sapiens
ctcttgaggccaggagt

SEQ ID NO: 2022736 - DNA, 18 bp, Homo sapiens
ctcttgccactgcctctt

SEQ ID NO: 2022737 - DNA, 20 bp, Homo sapiens
ctcttgccactgcctcttcc

SEQ ID NO: 2022738 - DNA, 13 bp, Homo sapiens
ctcttgcctctct

SEQ ID NO: 2022739 - DNA, 12 bp, Homo sapiens
ctcttgcctgca

SEQ ID NO: 2022740 - DNA, 14 bp, Homo sapiens
ctcttgcctgcacc

SEQ ID NO: 2022741 - DNA, 10 bp, Homo sapiens
ctcttgcctt

SEQ ID NO: 2022742 - DNA, 15 bp, Homo sapiens
ctcttgcctttctta

SEQ ID NO: 2022743 - DNA, 18 bp, Homo sapiens
ctcttggacctctgctct

SEQ ID NO: 2022744 - DNA, 20 bp, Homo sapiens
ctcttggacctctgctctga

SEQ ID NO: 2022745 - DNA, 20 bp, Homo sapiens
ctcttgggcatgctcagccc

SEQ ID NO: 2022746 - DNA, 22 bp, Homo sapiens
ctcttgggcatgctcagccctt

SEQ ID NO: 2022747 - DNA, 21 bp, Homo sapiens
ctcttgggttcaagcgattct

SEQ ID NO: 2022748 - DNA, 23 bp, Homo sapiens
ctcttgtacagttaactctccca

SEQ ID NO: 2022749 - DNA, 12 bp, Homo sapiens
ctcttgtagaag

SEQ ID NO: 2022750 - DNA, 16 bp, Homo sapiens
ctcttgtcatataaac

SEQ ID NO: 2022751 - DNA, 23 bp, Homo sapiens
ctctttaatgtcacaggcaggtc

SEQ ID NO: 2022752 - DNA, 20 bp, Homo sapiens
ctctttactcccttcctggc

SEQ ID NO: 2022753 - DNA, 22 bp, Homo sapiens
ctctttactcccttcctggcct

SEQ ID NO: 2022754 - DNA, 17 bp, Homo sapiens
ctctttcagagaggtct

SEQ ID NO: 2022755 - DNA, 22 bp, Homo sapiens
ctctttcagagaggtctcaggt

SEQ ID NO: 2022756 - DNA, 15 bp, Homo sapiens
ctctttccccacctc

SEQ ID NO: 2022757 - DNA, 20 bp, Homo sapiens
ctctttccccacctcttcct

SEQ ID NO: 2022758 - DNA, 22 bp, Homo sapiens
ctctttctttttctgtctctct

SEQ ID NO: 2022759 - DNA, 22 bp, Homo sapiens
ctctttgacgggaggcctcagt

SEQ ID NO: 2022760 - DNA, 17 bp, Homo sapiens
ctctttgctacaataaa

SEQ ID NO: 2022761 - DNA, 20 bp, Homo sapiens
ctctttgctacaataaatgc

SEQ ID NO: 2022762 - DNA, 14 bp, Homo sapiens
ctctttggaatgaa

SEQ ID NO: 2022763 - DNA, 20 bp, Homo sapiens
ctctttggggtcagccaggg

SEQ ID NO: 2022764 - DNA, 15 bp, Homo sapiens
ctcttttccctctct

SEQ ID NO: 2022765 - DNA, 17 bp, Homo sapiens
ctcttttccctctctag

SEQ ID NO: 2022766 - DNA, 14 bp, Homo sapiens
ctcttttctctgtg

SEQ ID NO: 2022767 - DNA, 15 bp, Homo sapiens
ctcttttggccttgt

SEQ ID NO: 2022768 - DNA, 16 bp, Homo sapiens
ctcttttttattctgt

SEQ ID NO: 2022769 - DNA, 17 bp, Homo sapiens
ctcttttttattctgtt

SEQ ID NO: 2022770 - DNA, 19 bp, Homo sapiens
ctcttttttattctgtttt

SEQ ID NO: 2022771 - DNA, 21 bp, Homo sapiens
ctcttttttattctgttttct

SEQ ID NO: 2022772 - DNA, 13 bp, Homo sapiens
ctgaaaaatgtca

SEQ ID NO: 2022773 - DNA, 14 bp, Homo sapiens
ctgaaaaatgtcag

SEQ ID NO: 2022774 - DNA, 14 bp, Homo sapiens
ctgaaaacccagag

SEQ ID NO: 2022775 - DNA, 13 bp, Homo sapiens
ctgaaaactggaa

SEQ ID NO: 2022776 - DNA, 15 bp, Homo sapiens
ctgaaaactggaata

SEQ ID NO: 2022777 - DNA, 22 bp, Homo sapiens
ctgaaaactggaataagaagca

SEQ ID NO: 2022778 - DNA, 14 bp, Homo sapiens
ctgaaaactgttta

SEQ ID NO: 2022779 - DNA, 21 bp, Homo sapiens
ctgaaaagcaattgccctgta

SEQ ID NO: 2022780 - DNA, 13 bp, Homo sapiens
ctgaaaatcacta

SEQ ID NO: 2022781 - DNA, 15 bp, Homo sapiens
ctgaaaatctaatat

SEQ ID NO: 2022782 - DNA, 20 bp, Homo sapiens
ctgaaaatctaatattaaaa

SEQ ID NO: 2022783 - DNA, 17 bp, Homo sapiens
ctgaaaattaacactgc

SEQ ID NO: 2022784 - DNA, 15 bp, Homo sapiens
ctgaaacaacaaata

SEQ ID NO: 2022785 - DNA, 17 bp, Homo sapiens
ctgaaacacctcccagg

SEQ ID NO: 2022786 - DNA, 21 bp, Homo sapiens
ctgaaacattcacacagggct

SEQ ID NO: 2022787 - DNA, 15 bp, Homo sapiens
ctgaaagaaacagtt

SEQ ID NO: 2022788 - DNA, 20 bp, Homo sapiens
ctgaaagaaacagttaactt

SEQ ID NO: 2022789 - DNA, 16 bp, Homo sapiens
ctgaaagcacaggaga

SEQ ID NO: 2022790 - DNA, 14 bp, Homo sapiens
ctgaaagcagcagc

SEQ ID NO: 2022791 - DNA, 15 bp, Homo sapiens
ctgaaagcagcagct

SEQ ID NO: 2022792 - DNA, 19 bp, Homo sapiens
ctgaaagcagcagctagga

SEQ ID NO: 2022793 - DNA, 14 bp, Homo sapiens
ctgaaagccagctg

SEQ ID NO: 2022794 - DNA, 23 bp, Homo sapiens
ctgaaagccatttgttggggcag

SEQ ID NO: 2022795 - DNA, 17 bp, Homo sapiens
ctgaaagtgacagagac

SEQ ID NO: 2022796 - DNA, 18 bp, Homo sapiens
ctgaaataaaagcctctg

SEQ ID NO: 2022797 - DNA, 22 bp, Homo sapiens
ctgaaatcggaagggacttcct

SEQ ID NO: 2022798 - DNA, 23 bp, Homo sapiens
ctgaaatcttgggcaaaatgaca

SEQ ID NO: 2022799 - DNA, 22 bp, Homo sapiens
ctgaaatgaaacaaataatcac

SEQ ID NO: 2022800 - DNA, 22 bp, Homo sapiens
ctgaacaaacactgaatcatgt

SEQ ID NO: 2022801 - DNA, 12 bp, Homo sapiens
ctgaacaagaat

SEQ ID NO: 2022802 - DNA, 13 bp, Homo sapiens
ctgaacaagaatt

SEQ ID NO: 2022803 - DNA, 18 bp, Homo sapiens
ctgaacacatactagaaa

SEQ ID NO: 2022804 - DNA, 22 bp, Homo sapiens
ctgaacaccataggtagaatgt

SEQ ID NO: 2022805 - DNA, 16 bp, Homo sapiens
ctgaacatctgtgtgt

SEQ ID NO: 2022806 - DNA, 17 bp, Homo sapiens
ctgaacatgacatttct

SEQ ID NO: 2022807 - DNA, 17 bp, Homo sapiens
ctgaaccccatgggctt

SEQ ID NO: 2022808 - DNA, 20 bp, Homo sapiens
ctgaaccccatgggcttgga

SEQ ID NO: 2022809 - DNA, 13 bp, Homo sapiens
ctgaacggggaga

SEQ ID NO: 2022810 - DNA, 14 bp, Homo sapiens
ctctcaggatcaag

SEQ ID NO: 2022811 - DNA, 20 bp, Homo sapiens
ctctcaggggccagtgaggg

SEQ ID NO: 2022812 - DNA, 15 bp, Homo sapiens
ctctcaggtcactcc

SEQ ID NO: 2022813 - DNA, 16 bp, Homo sapiens
ctctcaggtcactcca

SEQ ID NO: 2022814 - DNA, 14 bp, Homo sapiens
ctctcagttattca

SEQ ID NO: 2022815 - DNA, 20 bp, Homo sapiens
ctctcagttattcagattga

SEQ ID NO: 2022816 - DNA, 18 bp, Homo sapiens
ctctcatcgccagacaac

SEQ ID NO: 2022817 - DNA, 11 bp, Homo sapiens
ctctcattccc

SEQ ID NO: 2022818 - DNA, 20 bp, Homo sapiens
ctctcattccccaggtggct

SEQ ID NO: 2022819 - DNA, 15 bp, Homo sapiens
ctctcattctctttc

SEQ ID NO: 2022820 - DNA, 22 bp, Homo sapiens
ctctcattctctttctttttct

SEQ ID NO: 2022821 - DNA, 19 bp, Homo sapiens
ctctccaaaggccctacca

SEQ ID NO: 2022822 - DNA, 16 bp, Homo sapiens
ctctccaaaggggctg

SEQ ID NO: 2022823 - DNA, 18 bp, Homo sapiens
ctctccaaaggggctgct

SEQ ID NO: 2022824 - DNA, 20 bp, Homo sapiens
ctctccaaaggggctgctgg

SEQ ID NO: 2022825 - DNA, 23 bp, Homo sapiens
ctctccaaaggggctgctggggc

SEQ ID NO: 2022826 - DNA, 13 bp, Homo sapiens
ctctccaacctgg

SEQ ID NO: 2022827 - DNA, 14 bp, Homo sapiens
ctctccaacctgga

SEQ ID NO: 2022828 - DNA, 10 bp, Homo sapiens
ctctccacct

SEQ ID NO: 2022829 - DNA, 13 bp, Homo sapiens
ctctccacctcag

SEQ ID NO: 2022830 - DNA, 13 bp, Homo sapiens
ctctccacggtag

SEQ ID NO: 2022831 - DNA, 23 bp, Homo sapiens
ctctccacggtagcacttgacct

SEQ ID NO: 2022832 - DNA, 12 bp, Homo sapiens
ctctccactgct

SEQ ID NO: 2022833 - DNA, 18 bp, Homo sapiens
ctctccactgctctcagc

SEQ ID NO: 2022834 - DNA, 14 bp, Homo sapiens
ctctccagcctgac

SEQ ID NO: 2022835 - DNA, 21 bp, Homo sapiens
ctctccagccttctctctctg

SEQ ID NO: 2022836 - DNA, 22 bp, Homo sapiens
ctctccagccttctctctctgg

SEQ ID NO: 2022837 - DNA, 21 bp, Homo sapiens
ctctcccaccccggcctccac

SEQ ID NO: 2022838 - DNA, 19 bp, Homo sapiens
ctctcccaggccccatgac

SEQ ID NO: 2022839 - DNA, 24 bp, Homo sapiens
ctctcccaggccccatgacctcca

SEQ ID NO: 2022840 - DNA, 18 bp, Homo sapiens
ctctcccataccatcact

SEQ ID NO: 2022841 - DNA, 14 bp, Homo sapiens
ctctcccatttcct

SEQ ID NO: 2022842 - DNA, 22 bp, Homo sapiens
ctctccccagcaagtgagagct

SEQ ID NO: 2022843 - DNA, 22 bp, Homo sapiens
ctctcccccgcccaaggctgca

SEQ ID NO: 2022844 - DNA, 14 bp, Homo sapiens
ctctccccctttca

SEQ ID NO: 2022845 - DNA, 18 bp, Homo sapiens
ctctcccctcatggagaa

SEQ ID NO: 2022846 - DNA, 19 bp, Homo sapiens
ctctcccctccctcttcct

SEQ ID NO: 2022847 - DNA, 19 bp, Homo sapiens
ctctcccctctgccctgta

SEQ ID NO: 2022848 - DNA, 17 bp, Homo sapiens
ctctcccgcaccaggcc

SEQ ID NO: 2022849 - DNA, 19 bp, Homo sapiens
ctctcccggctgcctgccg

SEQ ID NO: 2022850 - DNA, 14 bp, Homo sapiens
ctctcccttttaaa

SEQ ID NO: 2022851 - DNA, 15 bp, Homo sapiens
ctctccggtctctct

SEQ ID NO: 2022852 - DNA, 20 bp, Homo sapiens
ctctcctaccccacctcatg

SEQ ID NO: 2022853 - DNA, 13 bp, Homo sapiens
ctctcctcagact

SEQ ID NO: 2022854 - DNA, 15 bp, Homo sapiens
ctctcctctgcctca

SEQ ID NO: 2022855 - DNA, 17 bp, Homo sapiens
ctctcctcttgccactg

SEQ ID NO: 2022856 - DNA, 22 bp, Homo sapiens
ctctcctcttgccactgcctct

SEQ ID NO: 2022857 - DNA, 12 bp, Homo sapiens
ctctcctggctt

SEQ ID NO: 2022858 - DNA, 19 bp, Homo sapiens
ctctcctgggggtggcagg

SEQ ID NO: 2022859 - DNA, 22 bp, Homo sapiens
ctctcctgtataaccccacctt

SEQ ID NO: 2022860 - DNA, 21 bp, Homo sapiens
ctctcctgtccaacctaaccc

SEQ ID NO: 2022861 - DNA, 12 bp, Homo sapiens
ctctccttcctt

SEQ ID NO: 2022862 - DNA, 16 bp, Homo sapiens
ctctccttcgtgtctc

SEQ ID NO: 2022863 - DNA, 17 bp, Homo sapiens
ctctccttcgtgtctct

SEQ ID NO: 2022864 - DNA, 22 bp, Homo sapiens
ctctccttcgtgtctctcccac

SEQ ID NO: 2022865 - DNA, 14 bp, Homo sapiens
ctctccttgcctgg

SEQ ID NO: 2022866 - DNA, 16 bp, Homo sapiens
ctctccttgcctggtg

SEQ ID NO: 2022867 - DNA, 17 bp, Homo sapiens
ctctccttgcctggtga

SEQ ID NO: 2022868 - DNA, 12 bp, Homo sapiens
ctctccttggaa

SEQ ID NO: 2022869 - DNA, 13 bp, Homo sapiens
ctctccttgggct

SEQ ID NO: 2022870 - DNA, 16 bp, Homo sapiens
ctctccttgggctcct

SEQ ID NO: 2022871 - DNA, 18 bp, Homo sapiens
ctctccttgggctcctgg

SEQ ID NO: 2022872 - DNA, 23 bp, Homo sapiens
ctctccttgggctcctggctgcc

SEQ ID NO: 2022873 - DNA, 12 bp, Homo sapiens
ctctcgagccca

SEQ ID NO: 2022874 - DNA, 22 bp, Homo sapiens
ctctcggaaggctggctgggca

SEQ ID NO: 2022875 - DNA, 21 bp, Homo sapiens
ctctcggttccacgtccccct

SEQ ID NO: 2022876 - DNA, 21 bp, Homo sapiens
ctctctaaatcttccttgtga

SEQ ID NO: 2022877 - DNA, 14 bp, Homo sapiens
ctctctaagccaca

SEQ ID NO: 2022878 - DNA, 19 bp, Homo sapiens
ctctctacaaactcccact

SEQ ID NO: 2022879 - DNA, 20 bp, Homo sapiens
ctctctacccggcccagaga

SEQ ID NO: 2022880 - DNA, 20 bp, Homo sapiens
ctctctactcctacctcagc

SEQ ID NO: 2022881 - DNA, 16 bp, Homo sapiens
ctctctatatatacat

SEQ ID NO: 2022882 - DNA, 12 bp, Homo sapiens
ctctctcctgta

SEQ ID NO: 2022883 - DNA, 14 bp, Homo sapiens
ctctctcctgtcca

SEQ ID NO: 2022884 - DNA, 22 bp, Homo sapiens
ctctctctacccggcccagaga

SEQ ID NO: 2022885 - DNA, 20 bp, Homo sapiens
ctctctctatatatacatgt

SEQ ID NO: 2022886 - DNA, 15 bp, Homo sapiens
ctctctcttcccagc

SEQ ID NO: 2022887 - DNA, 17 bp, Homo sapiens
ctctctgcagccagccc

SEQ ID NO: 2022888 - DNA, 14 bp, Homo sapiens
ctctctgctccaga

SEQ ID NO: 2022889 - DNA, 17 bp, Homo sapiens
ctctctggccttttcct

SEQ ID NO: 2022890 - DNA, 19 bp, Homo sapiens
ctctctggccttttcctat

SEQ ID NO: 2022891 - DNA, 23 bp, Homo sapiens
ctctctggggcagggttattcct

SEQ ID NO: 2022892 - DNA, 19 bp, Homo sapiens
ctctctggggccctgggcc

SEQ ID NO: 2022893 - DNA, 23 bp, Homo sapiens
ctctctggggccctgggcctcag

SEQ ID NO: 2022894 - DNA, 19 bp, Homo sapiens
ctctctgtacaaaaacaaa

SEQ ID NO: 2022895 - DNA, 13 bp, Homo sapiens
ctctctgtataaa

SEQ ID NO: 2022896 - DNA, 18 bp, Homo sapiens
ctctctgtataaacatta

SEQ ID NO: 2022897 - DNA, 20 bp, Homo sapiens
ctctctgtataaacattaaa

SEQ ID NO: 2022898 - DNA, 19 bp, Homo sapiens
ctctcttatagaatattta

SEQ ID NO: 2022899 - DNA, 23 bp, Homo sapiens
ctctcttatagaatatttattac

SEQ ID NO: 2022900 - DNA, 24 bp, Homo sapiens
ctctcttcaggaggccctggtgtc

SEQ ID NO: 2022901 - DNA, 13 bp, Homo sapiens
ctctcttccctat

SEQ ID NO: 2022902 - DNA, 10 bp, Homo sapiens
ctctcttgcc

SEQ ID NO: 2022903 - DNA, 13 bp, Homo sapiens
ctctcttgccagc

SEQ ID NO: 2022904 - DNA, 18 bp, Homo sapiens
ctctctttggaatgaaca

SEQ ID NO: 2022905 - DNA, 17 bp, Homo sapiens
ctctcttttttttttct

SEQ ID NO: 2022906 - DNA, 21 bp, Homo sapiens
ctctgaaaagcaattgccctg

SEQ ID NO: 2022907 - DNA, 22 bp, Homo sapiens
ctctgaaaagcaattgccctgt

SEQ ID NO: 2022908 - DNA, 20 bp, Homo sapiens
ctctgaaatttcccacaccc

SEQ ID NO: 2022909 - DNA, 17 bp, Homo sapiens
ctctgaagcatgtttca

SEQ ID NO: 2022910 - DNA, 20 bp, Homo sapiens
ctctgaagcatgtttcatgt

SEQ ID NO: 2022911 - DNA, 23 bp, Homo sapiens
ctctgaagtcacatcacaggaca

SEQ ID NO: 2022912 - DNA, 22 bp, Homo sapiens
ctctgaatctgataggaaaaga

SEQ ID NO: 2022913 - DNA, 17 bp, Homo sapiens
ctctgaatggtccaggg

SEQ ID NO: 2022914 - DNA, 20 bp, Homo sapiens
ctctgacaagggctgacctg

SEQ ID NO: 2022915 - DNA, 14 bp, Homo sapiens
ctctgacacacagc

SEQ ID NO: 2022916 - DNA, 22 bp, Homo sapiens
ctctgacagccctgcggagacc

SEQ ID NO: 2022917 - DNA, 16 bp, Homo sapiens
ctctgacccagtgaga

SEQ ID NO: 2022918 - DNA, 16 bp, Homo sapiens
ctctgacctgcaggcc

SEQ ID NO: 2022919 - DNA, 16 bp, Homo sapiens
ctctgactcacacttg

SEQ ID NO: 2022920 - DNA, 12 bp, Homo sapiens
ctctgagaacag

SEQ ID NO: 2022921 - DNA, 13 bp, Homo sapiens
ctctgagaggccc

SEQ ID NO: 2022922 - DNA, 17 bp, Homo sapiens
ctctgagaggccctgga

SEQ ID NO: 2022923 - DNA, 14 bp, Homo sapiens
ctctgagcagtcag

SEQ ID NO: 2022924 - DNA, 11 bp, Homo sapiens
ctctgagccca

SEQ ID NO: 2022925 - DNA, 17 bp, Homo sapiens
ctctgagcccaggccgt

SEQ ID NO: 2022926 - DNA, 16 bp, Homo sapiens
ctctgaggacactaac

SEQ ID NO: 2022927 - DNA, 13 bp, Homo sapiens
ctctgaggccagc

SEQ ID NO: 2022928 - DNA, 16 bp, Homo sapiens
ctctgaggccagcctg

SEQ ID NO: 2022929 - DNA, 19 bp, Homo sapiens
ctctgaggccagcctggcc

SEQ ID NO: 2022930 - DNA, 21 bp, Homo sapiens
ctctgaggccagcctggcctc

SEQ ID NO: 2022931 - DNA, 21 bp, Homo sapiens
ctctgaggcttccagagagtc

SEQ ID NO: 2022932 - DNA, 17 bp, Homo sapiens
ctctgatacccagagca

SEQ ID NO: 2022933 - DNA, 16 bp, Homo sapiens
ctctgatatgggactg

SEQ ID NO: 2022934 - DNA, 19 bp, Homo sapiens
ctctgatatgggactgagc

SEQ ID NO: 2022935 - DNA, 17 bp, Homo sapiens
ctctgatccttcttcct

SEQ ID NO: 2022936 - DNA, 15 bp, Homo sapiens
ctctgatgcatcaga

SEQ ID NO: 2022937 - DNA, 20 bp, Homo sapiens
ctctgatgcatcagaaaggg

SEQ ID NO: 2022938 - DNA, 15 bp, Homo sapiens
ctctgattttcaaag

SEQ ID NO: 2022939 - DNA, 20 bp, Homo sapiens
ctctgattttcaaagctttt

SEQ ID NO: 2022940 - DNA, 15 bp, Homo sapiens
ctctgcacatgtctt

SEQ ID NO: 2022941 - DNA, 18 bp, Homo sapiens
ctctgcacatgtcttgta

SEQ ID NO: 2022942 - DNA, 23 bp, Homo sapiens
ctctgcactccatggccaccccg

SEQ ID NO: 2022943 - DNA, 13 bp, Homo sapiens
ctctgcagccagc

SEQ ID NO: 2022944 - DNA, 19 bp, Homo sapiens
ctctgcagccagcccagcc

SEQ ID NO: 2022945 - DNA, 14 bp, Homo sapiens
ctctgcattctagt

SEQ ID NO: 2022946 - DNA, 15 bp, Homo sapiens
ctctgcattctagta

SEQ ID NO: 2022947 - DNA, 10 bp, Homo sapiens
ctctgccacc

SEQ ID NO: 2022948 - DNA, 12 bp, Homo sapiens
ctctgccacctc

SEQ ID NO: 2022949 - DNA, 14 bp, Homo sapiens
ctctgccacctccc

SEQ ID NO: 2022950 - DNA, 14 bp, Homo sapiens
ctctgccagccaca

SEQ ID NO: 2022951 - DNA, 14 bp, Homo sapiens
ctctgccccaagca

SEQ ID NO: 2022952 - DNA, 18 bp, Homo sapiens
ctctgccccaagcagcca

SEQ ID NO: 2022953 - DNA, 14 bp, Homo sapiens
ctctgccccaagcc

SEQ ID NO: 2022954 - DNA, 18 bp, Homo sapiens
ctctgccccaagccccca

SEQ ID NO: 2022955 - DNA, 17 bp, Homo sapiens
ctctgccccaaggggcc

SEQ ID NO: 2022956 - DNA, 14 bp, Homo sapiens
ctctgccccagagg

SEQ ID NO: 2022957 - DNA, 22 bp, Homo sapiens
ctctgccccagaggcctctctc

SEQ ID NO: 2022958 - DNA, 16 bp, Homo sapiens
ctctgccccagctctg

SEQ ID NO: 2022959 - DNA, 19 bp, Homo sapiens
ctctgccccttctgtttcc

SEQ ID NO: 2022960 - DNA, 20 bp, Homo sapiens
ctctgccccttgggcatcca

SEQ ID NO: 2022961 - DNA, 14 bp, Homo sapiens
ctctgccctccctg

SEQ ID NO: 2022962 - DNA, 13 bp, Homo sapiens
ctctgccctgcct

SEQ ID NO: 2022963 - DNA, 16 bp, Homo sapiens
ctctgccctgcctccc

SEQ ID NO: 2022964 - DNA, 23 bp, Homo sapiens
ctctgccctgcctccctttctgg

SEQ ID NO: 2022965 - DNA, 14 bp, Homo sapiens
ctctgccctgtata

SEQ ID NO: 2022966 - DNA, 17 bp, Homo sapiens
ctctgcctccctctcca

SEQ ID NO: 2022967 - DNA, 14 bp, Homo sapiens
ctctgcctcctctt

SEQ ID NO: 2022968 - DNA, 15 bp, Homo sapiens
ctctgcctcctcttc

SEQ ID NO: 2022969 - DNA, 16 bp, Homo sapiens
ctctgcctctgacaca

SEQ ID NO: 2022970 - DNA, 22 bp, Homo sapiens
ctctgcctgaagtcacacagtg

SEQ ID NO: 2022971 - DNA, 22 bp, Homo sapiens
ctctgccttttttcacagcccg

SEQ ID NO: 2022972 - DNA, 20 bp, Homo sapiens
ctctgcggtggtgccagagg

SEQ ID NO: 2022973 - DNA, 23 bp, Homo sapiens
ctctgcgtcccccagccctcagg

SEQ ID NO: 2022974 - DNA, 22 bp, Homo sapiens
ctctgcgtgcagggacaaagag

SEQ ID NO: 2022975 - DNA, 13 bp, Homo sapiens
ctctgctcctctc

SEQ ID NO: 2022976 - DNA, 18 bp, Homo sapiens
ctctgctcctctccccag

SEQ ID NO: 2022977 - DNA, 13 bp, Homo sapiens
ctctgctctagcc

SEQ ID NO: 2022978 - DNA, 15 bp, Homo sapiens
ctctgctctagccag

SEQ ID NO: 2022979 - DNA, 16 bp, Homo sapiens
ctctgctctagccagg

SEQ ID NO: 2022980 - DNA, 15 bp, Homo sapiens
ctctgctctgatgca

SEQ ID NO: 2022981 - DNA, 15 bp, Homo sapiens
ctctgctcttgcctg

SEQ ID NO: 2022982 - DNA, 23 bp, Homo sapiens
ctctgctgacagacacaggcccg

SEQ ID NO: 2022983 - DNA, 13 bp, Homo sapiens
ctctgctggcctg

SEQ ID NO: 2022984 - DNA, 15 bp, Homo sapiens
ctctgctggcctggc

SEQ ID NO: 2022985 - DNA, 17 bp, Homo sapiens
ctctgctggcctggccg

SEQ ID NO: 2022986 - DNA, 21 bp, Homo sapiens
ctctgctggcctggccggcaa

SEQ ID NO: 2022987 - DNA, 21 bp, Homo sapiens
ctctgcttactaatgtgcccc

SEQ ID NO: 2022988 - DNA, 20 bp, Homo sapiens
ctctgcttgcatcacttggg

SEQ ID NO: 2022989 - DNA, 20 bp, Homo sapiens
ctctggaaaatgtgacccag

SEQ ID NO: 2022990 - DNA, 13 bp, Homo sapiens
ctctggagccaga

SEQ ID NO: 2022991 - DNA, 17 bp, Homo sapiens
ctctggaggctgcagag

SEQ ID NO: 2022992 - DNA, 19 bp, Homo sapiens
ctctggaggctgcagagct

SEQ ID NO: 2022993 - DNA, 23 bp, Homo sapiens
ctctggatcctgctgtggcctca

SEQ ID NO: 2022994 - DNA, 13 bp, Homo sapiens
ctctggatggcac

SEQ ID NO: 2022995 - DNA, 14 bp, Homo sapiens
ctctggcagagaag

SEQ ID NO: 2022996 - DNA, 14 bp, Homo sapiens
ctctggccaccctg

SEQ ID NO: 2022997 - DNA, 16 bp, Homo sapiens
ctctggccaccctggc

SEQ ID NO: 2022998 - DNA, 19 bp, Homo sapiens
ctctggccaccctggcccg

SEQ ID NO: 2022999 - DNA, 22 bp, Homo sapiens
ctctggccaccctggcccgccc

SEQ ID NO: 2023000 - DNA, 14 bp, Homo sapiens
ctctggccaggcat

SEQ ID NO: 2023001 - DNA, 13 bp, Homo sapiens
ctctggcccagcc

SEQ ID NO: 2023002 - DNA, 19 bp, Homo sapiens
ctctggcccagcctaccct

SEQ ID NO: 2023003 - DNA, 15 bp, Homo sapiens
ctctggccctgcctt

SEQ ID NO: 2023004 - DNA, 15 bp, Homo sapiens
ctctggccttttcct

SEQ ID NO: 2023005 - DNA, 16 bp, Homo sapiens
ctctggcggcttcctg

SEQ ID NO: 2023006 - DNA, 20 bp, Homo sapiens
ctctggcggcttcctgtcca

SEQ ID NO: 2023007 - DNA, 12 bp, Homo sapiens
ctctggctccag

SEQ ID NO: 2023008 - DNA, 13 bp, Homo sapiens
ctctggctccaga

SEQ ID NO: 2023009 - DNA, 22 bp, Homo sapiens
ctctggctccgaaaaactttgt

SEQ ID NO: 2023010 - DNA, 13 bp, Homo sapiens
ctctggctggcta

SEQ ID NO: 2023011 - DNA, 14 bp, Homo sapiens
ctctggcttccagg

SEQ ID NO: 2023012 - DNA, 17 bp, Homo sapiens
ctctggcttccaggtat

SEQ ID NO: 2023013 - DNA, 14 bp, Homo sapiens
ctctgggaaggggt

SEQ ID NO: 2023014 - DNA, 14 bp, Homo sapiens
ctctgggctcaggg

SEQ ID NO: 2023015 - DNA, 18 bp, Homo sapiens
ctctgggctcagggctgg

SEQ ID NO: 2023016 - DNA, 20 bp, Homo sapiens
ctctgggctcagggctggag

SEQ ID NO: 2023017 - DNA, 21 bp, Homo sapiens
ctctggggccctgggcctcag

SEQ ID NO: 2023018 - DNA, 21 bp, Homo sapiens
ctctgggtttcatatccagct

SEQ ID NO: 2023019 - DNA, 20 bp, Homo sapiens
ctctggtcaggcccactgca

SEQ ID NO: 2023020 - DNA, 20 bp, Homo sapiens
ctctggtggtgcttttgtat

SEQ ID NO: 2023021 - DNA, 15 bp, Homo sapiens
ctctgtcaatgaaaa

SEQ ID NO: 2023022 - DNA, 20 bp, Homo sapiens
ctctgtcagccagccgccct

SEQ ID NO: 2023023 - DNA, 21 bp, Homo sapiens
ctctgtcagccagccgccctg

SEQ ID NO: 2023024 - DNA, 22 bp, Homo sapiens
ctctgtcatcactccctggatg

SEQ ID NO: 2023025 - DNA, 17 bp, Homo sapiens
ctctgtccaggccactg

SEQ ID NO: 2023026 - DNA, 23 bp, Homo sapiens
ctctgtccaggccactgtggcca

SEQ ID NO: 2023027 - DNA, 14 bp, Homo sapiens
ctctgtccagggcc

SEQ ID NO: 2023028 - DNA, 17 bp, Homo sapiens
ctctgtccctcactgcc

SEQ ID NO: 2023029 - DNA, 12 bp, Homo sapiens
ctctgtccctct

SEQ ID NO: 2023030 - DNA, 18 bp, Homo sapiens
ctctgtccctctttgcct

SEQ ID NO: 2023031 - DNA, 13 bp, Homo sapiens
ctctgtcctggga

SEQ ID NO: 2023032 - DNA, 14 bp, Homo sapiens
ctctgtcctgggag

SEQ ID NO: 2023033 - DNA, 21 bp, Homo sapiens
ctctgtctctgctcttgcctg

SEQ ID NO: 2023034 - DNA, 21 bp, Homo sapiens
ctctgtgaacgatttagaaag

SEQ ID NO: 2023035 - DNA, 13 bp, Homo sapiens
ctctgtggcctgt

SEQ ID NO: 2023036 - DNA, 14 bp, Homo sapiens
ctctgtggcctgtg

SEQ ID NO: 2023037 - DNA, 21 bp, Homo sapiens
ctctgtgtcaggtggggcagc

SEQ ID NO: 2023038 - DNA, 17 bp, Homo sapiens
ctctgtgtcctctcccc

SEQ ID NO: 2023039 - DNA, 17 bp, Homo sapiens
ctctgtgtccttccctg

SEQ ID NO: 2023040 - DNA, 17 bp, Homo sapiens
ctctgtgtgcacaaata

SEQ ID NO: 2023041 - DNA, 14 bp, Homo sapiens
ctctgttcatttcc

SEQ ID NO: 2023042 - DNA, 14 bp, Homo sapiens
ctctgttctttata

SEQ ID NO: 2023043 - DNA, 15 bp, Homo sapiens
ctgaccccatcacct

SEQ ID NO: 2023044 - DNA, 18 bp, Homo sapiens
ctgaccccatcacctact

SEQ ID NO: 2023045 - DNA, 22 bp, Homo sapiens
ctgaccctggagcggctctcct

SEQ ID NO: 2023046 - DNA, 16 bp, Homo sapiens
ctgacccttccagaca

SEQ ID NO: 2023047 - DNA, 16 bp, Homo sapiens
ctgacctcaagtgatc

SEQ ID NO: 2023048 - DNA, 14 bp, Homo sapiens
ctgacctcaccggc

SEQ ID NO: 2023049 - DNA, 22 bp, Homo sapiens
ctgacctcaccggcatgctggc

SEQ ID NO: 2023050 - DNA, 16 bp, Homo sapiens
ctgacctcccagccct

SEQ ID NO: 2023051 - DNA, 21 bp, Homo sapiens
ctgagctctgagaggccctgg

SEQ ID NO: 2023052 - DNA, 23 bp, Homo sapiens
ctgagctctgagaggccctggat

SEQ ID NO: 2023053 - DNA, 17 bp, Homo sapiens
ctgatggagaaggaagg

SEQ ID NO: 2023054 - DNA, 20 bp, Homo sapiens
ctgatggccaagggggtgga

SEQ ID NO: 2023055 - DNA, 20 bp, Homo sapiens
ctgatgggtcccaaaagctt

SEQ ID NO: 2023056 - DNA, 15 bp, Homo sapiens
ctgatggtgagctgg

SEQ ID NO: 2023057 - DNA, 19 bp, Homo sapiens
ctgatggtgagctgggaag

SEQ ID NO: 2023058 - DNA, 23 bp, Homo sapiens
ctgatggtgctcacgactcttcc

SEQ ID NO: 2023059 - DNA, 16 bp, Homo sapiens
ctgatgttgagctgag

SEQ ID NO: 2023060 - DNA, 22 bp, Homo sapiens
ctgatgttgagggaacagacag

SEQ ID NO: 2023061 - DNA, 12 bp, Homo sapiens
ctgatgtttgtt

SEQ ID NO: 2023062 - DNA, 17 bp, Homo sapiens
ctgattcacatctcatt

SEQ ID NO: 2023063 - DNA, 23 bp, Homo sapiens
ctgattcagcctggccatcccca

SEQ ID NO: 2023064 - DNA, 20 bp, Homo sapiens
ctgattcccaagctctgctc

SEQ ID NO: 2023065 - DNA, 22 bp, Homo sapiens
ctgattcccaagctctgctcct

SEQ ID NO: 2023066 - DNA, 19 bp, Homo sapiens
ctgattcgaatgacactgt

SEQ ID NO: 2023067 - DNA, 19 bp, Homo sapiens
ctgattctgggatgctcct

SEQ ID NO: 2023068 - DNA, 15 bp, Homo sapiens
ctgattggacatttt

SEQ ID NO: 2023069 - DNA, 14 bp, Homo sapiens
ctgatttaatgttt

SEQ ID NO: 2023070 - DNA, 17 bp, Homo sapiens
ctgatttaatgttttct

SEQ ID NO: 2023071 - DNA, 18 bp, Homo sapiens
ctgatttaatgttttctg

SEQ ID NO: 2023072 - DNA, 16 bp, Homo sapiens
ctgatttccaggcccc

SEQ ID NO: 2023073 - DNA, 18 bp, Homo sapiens
ctgattttcaaagctttt

SEQ ID NO: 2023074 - DNA, 18 bp, Homo sapiens
ctgattttgtagttaatt

SEQ ID NO: 2023075 - DNA, 17 bp, Homo sapiens
ctgatttttttgttgtt

SEQ ID NO: 2023076 - DNA, 11 bp, Homo sapiens
ctgcaaaattt

SEQ ID NO: 2023077 - DNA, 22 bp, Homo sapiens
ctgcaaatattagcaaagaagc

SEQ ID NO: 2023078 - DNA, 21 bp, Homo sapiens
ctgcaacctccacctcctgag

SEQ ID NO: 2023079 - DNA, 20 bp, Homo sapiens
ctgcaacctccgcctcttgg

SEQ ID NO: 2023080 - DNA, 18 bp, Homo sapiens
ctgcaacctcttcctcct

SEQ ID NO: 2023081 - DNA, 18 bp, Homo sapiens
ctgcaactagccaaggct

SEQ ID NO: 2023082 - DNA, 21 bp, Homo sapiens
ctgcaactagccaaggctagt

SEQ ID NO: 2023083 - DNA, 13 bp, Homo sapiens
ctgcaagaagtct

SEQ ID NO: 2023084 - DNA, 18 bp, Homo sapiens
ctgcaagagccttggtgt

SEQ ID NO: 2023085 - DNA, 19 bp, Homo sapiens
ctgcaagagccttggtgtc

SEQ ID NO: 2023086 - DNA, 15 bp, Homo sapiens
ctgcaagaggctcct

SEQ ID NO: 2023087 - DNA, 18 bp, Homo sapiens
ctgcaagaggctcctgtc

SEQ ID NO: 2023088 - DNA, 15 bp, Homo sapiens
ctgcaagatttcaca

SEQ ID NO: 2023089 - DNA, 14 bp, Homo sapiens
ctgcaagccccagg

SEQ ID NO: 2023090 - DNA, 16 bp, Homo sapiens
ctgcaagccccagggc

SEQ ID NO: 2023091 - DNA, 18 bp, Homo sapiens
ctgcaagccccagggcct

SEQ ID NO: 2023092 - DNA, 17 bp, Homo sapiens
ctgcaaggtctttggtt

SEQ ID NO: 2023093 - DNA, 14 bp, Homo sapiens
ctgcaatctccagg

SEQ ID NO: 2023094 - DNA, 17 bp, Homo sapiens
ctgcaatgggcactggg

SEQ ID NO: 2023095 - DNA, 16 bp, Homo sapiens
ctgcaattctacagtt

SEQ ID NO: 2023096 - DNA, 15 bp, Homo sapiens
ctgcaattgcttagg

SEQ ID NO: 2023097 - DNA, 17 bp, Homo sapiens
ctgcacaagatatttat

SEQ ID NO: 2023098 - DNA, 15 bp, Homo sapiens
ctgcacacacagctc

SEQ ID NO: 2023099 - DNA, 16 bp, Homo sapiens
ctgcacacacagctcc

SEQ ID NO: 2023100 - DNA, 16 bp, Homo sapiens
ctgcacactatttccc

SEQ ID NO: 2023101 - DNA, 17 bp, Homo sapiens
ctgcacagatatttcca

SEQ ID NO: 2023102 - DNA, 13 bp, Homo sapiens
ctgcacagcggcc

SEQ ID NO: 2023103 - DNA, 22 bp, Homo sapiens
ctgcacagtgcatctcagccca

SEQ ID NO: 2023104 - DNA, 20 bp, Homo sapiens
ctgcacagtttagaacagag

SEQ ID NO: 2023105 - DNA, 13 bp, Homo sapiens
ctgcacattcctg

SEQ ID NO: 2023106 - DNA, 22 bp, Homo sapiens
ctgcaccagagtgaaagggcta

SEQ ID NO: 2023107 - DNA, 20 bp, Homo sapiens
ctgcaccagcccttccctgc

SEQ ID NO: 2023108 - DNA, 17 bp, Homo sapiens
ctgcaccatcacacatg

SEQ ID NO: 2023109 - DNA, 18 bp, Homo sapiens
ctgcaccatcacacatgc

SEQ ID NO: 2023110 - DNA, 12 bp, Homo sapiens
ctgcacccagaa

SEQ ID NO: 2023111 - DNA, 20 bp, Homo sapiens
ctgcacccgtacccccgtgg

SEQ ID NO: 2023112 - DNA, 20 bp, Homo sapiens
ctgcacccttcctcctcctt

SEQ ID NO: 2023113 - DNA, 22 bp, Homo sapiens
ctgcacccttcctcctcctttg

SEQ ID NO: 2023114 - DNA, 15 bp, Homo sapiens
ctgcaccgggccaca

SEQ ID NO: 2023115 - DNA, 11 bp, Homo sapiens
ctgcacctccc

SEQ ID NO: 2023116 - DNA, 14 bp, Homo sapiens
ctgcacctcccccc

SEQ ID NO: 2023117 - DNA, 19 bp, Homo sapiens
ctgcacctccccccactgc

SEQ ID NO: 2023118 - DNA, 20 bp, Homo sapiens
ctgcacctccccccactgca

SEQ ID NO: 2023119 - DNA, 16 bp, Homo sapiens
ctgcacctgccagcct

SEQ ID NO: 2023120 - DNA, 22 bp, Homo sapiens
ctgcacgaatggaagaggcacc

SEQ ID NO: 2023121 - DNA, 20 bp, Homo sapiens
ctgcacgccaccgctgcctt

SEQ ID NO: 2023122 - DNA, 18 bp, Homo sapiens
ctgcacgccgtggagcat

SEQ ID NO: 2023123 - DNA, 16 bp, Homo sapiens
ctgcactatagcctag

SEQ ID NO: 2023124 - DNA, 18 bp, Homo sapiens
ctgcactatagcctaggt

SEQ ID NO: 2023125 - DNA, 12 bp, Homo sapiens
ctgcactccaga

SEQ ID NO: 2023126 - DNA, 19 bp, Homo sapiens
ctgcactccagcctgggcg

SEQ ID NO: 2023127 - DNA, 12 bp, Homo sapiens
ctgcactccatg

SEQ ID NO: 2023128 - DNA, 15 bp, Homo sapiens
ctgcactccatggcc

SEQ ID NO: 2023129 - DNA, 17 bp, Homo sapiens
ctgcactccatggccac

SEQ ID NO: 2023130 - DNA, 18 bp, Homo sapiens
ctgcactccatggccacc

SEQ ID NO: 2023131 - DNA, 12 bp, Homo sapiens
ctgcactgaaaa

SEQ ID NO: 2023132 - DNA, 14 bp, Homo sapiens
ctgcactgaaaagg

SEQ ID NO: 2023133 - DNA, 17 bp, Homo sapiens
ctgcactgggtgtggcc

SEQ ID NO: 2023134 - DNA, 21 bp, Homo sapiens
ctgcagaacgtattggtccag

SEQ ID NO: 2023135 - DNA, 14 bp, Homo sapiens
ctgcagaaggccaa

SEQ ID NO: 2023136 - DNA, 15 bp, Homo sapiens
ctgcagactcactgt

SEQ ID NO: 2023137 - DNA, 16 bp, Homo sapiens
ctgcagagcacacagg

SEQ ID NO: 2023138 - DNA, 16 bp, Homo sapiens
ctgcagagctgaccca

SEQ ID NO: 2023139 - DNA, 17 bp, Homo sapiens
ctgcagagctgacccag

SEQ ID NO: 2023140 - DNA, 13 bp, Homo sapiens
ctgcagaggacag

SEQ ID NO: 2023141 - DNA, 19 bp, Homo sapiens
ctgcagaggacagagctgg

SEQ ID NO: 2023142 - DNA, 14 bp, Homo sapiens
ctgcagaggaccac

SEQ ID NO: 2023143 - DNA, 19 bp, Homo sapiens
ctgcagaggaccacagtgg

SEQ ID NO: 2023144 - DNA, 19 bp, Homo sapiens
ctgcagaggattgaggctt

SEQ ID NO: 2023145 - DNA, 23 bp, Homo sapiens
ctgcagaggggaaaccagtgtag

SEQ ID NO: 2023146 - DNA, 20 bp, Homo sapiens
ctgcagaggggctttctgga

SEQ ID NO: 2023147 - DNA, 18 bp, Homo sapiens
ctgcagatagccagacac

SEQ ID NO: 2023148 - DNA, 19 bp, Homo sapiens
ctgcagatttcctgtgtgg

SEQ ID NO: 2023149 - DNA, 14 bp, Homo sapiens
ctgcagcaactccc

SEQ ID NO: 2023150 - DNA, 15 bp, Homo sapiens
ctgcagcaactccca

SEQ ID NO: 2023151 - DNA, 17 bp, Homo sapiens
ctgcagcaactcccacg

SEQ ID NO: 2023152 - DNA, 12 bp, Homo sapiens
ctgcagcacttt

SEQ ID NO: 2023153 - DNA, 11 bp, Homo sapiens
ctgcagcctca

SEQ ID NO: 2023154 - DNA, 17 bp, Homo sapiens
ctgcagcctcctcctga

SEQ ID NO: 2023155 - DNA, 18 bp, Homo sapiens
ctgcagcctcctcctgac

SEQ ID NO: 2023156 - DNA, 21 bp, Homo sapiens
ctgcagctatgcgcaatgtgg

SEQ ID NO: 2023157 - DNA, 21 bp, Homo sapiens
ctgcagctctttcttctttga

SEQ ID NO: 2023158 - DNA, 11 bp, Homo sapiens
ctgcagctgct

SEQ ID NO: 2023159 - DNA, 13 bp, Homo sapiens
ctgcagctgcttg

SEQ ID NO: 2023160 - DNA, 15 bp, Homo sapiens
ctgcagctgggcccc

SEQ ID NO: 2023161 - DNA, 20 bp, Homo sapiens
ctgcagctgggccccatgct

SEQ ID NO: 2023162 - DNA, 22 bp, Homo sapiens
ctgcagctgggccccatgctct

SEQ ID NO: 2023163 - DNA, 23 bp, Homo sapiens
ctgcagctgggccccatgctctg

SEQ ID NO: 2023164 - DNA, 11 bp, Homo sapiens
ctgcagcttcc

SEQ ID NO: 2023165 - DNA, 12 bp, Homo sapiens
ctgcagcttcct

SEQ ID NO: 2023166 - DNA, 19 bp, Homo sapiens
ctgcagcttcctgtcaaca

SEQ ID NO: 2023167 - DNA, 12 bp, Homo sapiens
ctgcagctttac

SEQ ID NO: 2023168 - DNA, 15 bp, Homo sapiens
ctggggaggaagggc

SEQ ID NO: 2023169 - DNA, 17 bp, Homo sapiens
ctggggaggaagggcca

SEQ ID NO: 2023170 - DNA, 19 bp, Homo sapiens
ctggggaggaagggccagg

SEQ ID NO: 2023171 - DNA, 20 bp, Homo sapiens
ctggggaggaagggccagga

SEQ ID NO: 2023172 - DNA, 12 bp, Homo sapiens
ctggggagtccc

SEQ ID NO: 2023173 - DNA, 15 bp, Homo sapiens
ctggggatgtgggag

SEQ ID NO: 2023174 - DNA, 16 bp, Homo sapiens
ctggggatgtgggagg

SEQ ID NO: 2023175 - DNA, 15 bp, Homo sapiens
ctggggcagaggggc

SEQ ID NO: 2023176 - DNA, 22 bp, Homo sapiens
ctggggcagaggggcagccgct

SEQ ID NO: 2023177 - DNA, 17 bp, Homo sapiens
ctggggcatgtgtgcct

SEQ ID NO: 2023178 - DNA, 19 bp, Homo sapiens
ctggggcatgtgtgcctgt

SEQ ID NO: 2023179 - DNA, 21 bp, Homo sapiens
ctggggcatgtgtgcctgtgg

SEQ ID NO: 2023180 - DNA, 22 bp, Homo sapiens
ctggggcatgtgtgcctgtggc

SEQ ID NO: 2023181 - DNA, 21 bp, Homo sapiens
ctggggccagtgtaaggcata

SEQ ID NO: 2023182 - DNA, 22 bp, Homo sapiens
ctggggccagtgtaaggcatag

SEQ ID NO: 2023183 - DNA, 13 bp, Homo sapiens
ctggggccctggg

SEQ ID NO: 2023184 - DNA, 14 bp, Homo sapiens
ctggggccctgggc

SEQ ID NO: 2023185 - DNA, 16 bp, Homo sapiens
ctggggccctgggcct

SEQ ID NO: 2023186 - DNA, 17 bp, Homo sapiens
ctggggccctgggcctc

SEQ ID NO: 2023187 - DNA, 20 bp, Homo sapiens
ctggggcctcggagcctcat

SEQ ID NO: 2023188 - DNA, 14 bp, Homo sapiens
ctggggcctgtact

SEQ ID NO: 2023189 - DNA, 19 bp, Homo sapiens
ctggggcctgtactgcctg

SEQ ID NO: 2023190 - DNA, 20 bp, Homo sapiens
ctggggcctgtactgcctgc

SEQ ID NO: 2023191 - DNA, 19 bp, Homo sapiens
ctggggctctaacgcctga

SEQ ID NO: 2023192 - DNA, 23 bp, Homo sapiens
ctggggctctaacgcctgagccc

SEQ ID NO: 2023193 - DNA, 19 bp, Homo sapiens
ctggggctctgtgcaggga

SEQ ID NO: 2023194 - DNA, 15 bp, Homo sapiens
ctggggcttctcctg

SEQ ID NO: 2023195 - DNA, 18 bp, Homo sapiens
ctggggcttgcaagagga

SEQ ID NO: 2023196 - DNA, 19 bp, Homo sapiens
ctggggcttgcaagaggag

SEQ ID NO: 2023197 - DNA, 14 bp, Homo sapiens
ctgggggaagccct

SEQ ID NO: 2023198 - DNA, 16 bp, Homo sapiens
ctgggggaagccctgg

SEQ ID NO: 2023199 - DNA, 17 bp, Homo sapiens
ctgggggaagccctgga

SEQ ID NO: 2023200 - DNA, 23 bp, Homo sapiens
ctgggggatgtgcacggcagctt

SEQ ID NO: 2023201 - DNA, 13 bp, Homo sapiens
ctgggggcctggc

SEQ ID NO: 2023202 - DNA, 18 bp, Homo sapiens
ctgggggcctggctggct

SEQ ID NO: 2023203 - DNA, 18 bp, Homo sapiens
ctgggggctagcagaagt

SEQ ID NO: 2023204 - DNA, 13 bp, Homo sapiens
ctgggggtggcag

SEQ ID NO: 2023205 - DNA, 19 bp, Homo sapiens
ctggggttcagcccctcct

SEQ ID NO: 2023206 - DNA, 22 bp, Homo sapiens
ctgggtaactgtcaagtcatga

SEQ ID NO: 2023207 - DNA, 18 bp, Homo sapiens
ctgggtaatgaaacaaag

SEQ ID NO: 2023208 - DNA, 20 bp, Homo sapiens
ctgggtacttgtggacacag

SEQ ID NO: 2023209 - DNA, 22 bp, Homo sapiens
ctgggtccctcggagctgccag

SEQ ID NO: 2023210 - DNA, 16 bp, Homo sapiens
ctgggtgagaatcctg

SEQ ID NO: 2023211 - DNA, 21 bp, Homo sapiens
ctgggtgccgggctgcacaga

SEQ ID NO: 2023212 - DNA, 16 bp, Homo sapiens
ctgggtggcctcggga

SEQ ID NO: 2023213 - DNA, 23 bp, Homo sapiens
ctgggtggcctcgggacacctgc

SEQ ID NO: 2023214 - DNA, 21 bp, Homo sapiens
ctgggtggctactctgtgcca

SEQ ID NO: 2023215 - DNA, 22 bp, Homo sapiens
ctgggtggctactctgtgccag

SEQ ID NO: 2023216 - DNA, 12 bp, Homo sapiens
ctgggtggctcc

SEQ ID NO: 2023217 - DNA, 15 bp, Homo sapiens
ctgggtggctcctgc

SEQ ID NO: 2023218 - DNA, 18 bp, Homo sapiens
ctgggtggctcctgccac

SEQ ID NO: 2023219 - DNA, 23 bp, Homo sapiens
ctgggtgggatggatgctgggga

SEQ ID NO: 2023220 - DNA, 13 bp, Homo sapiens
ctgggtggggctg

SEQ ID NO: 2023221 - DNA, 20 bp, Homo sapiens
ctgggtggggctgctcctcc

SEQ ID NO: 2023222 - DNA, 21 bp, Homo sapiens
ctgggtggggctgctcctcca

SEQ ID NO: 2023223 - DNA, 15 bp, Homo sapiens
ctgggtggtgaagga

SEQ ID NO: 2023224 - DNA, 19 bp, Homo sapiens
ctgggtgttgaccactcca

SEQ ID NO: 2023225 - DNA, 20 bp, Homo sapiens
ctgggtgttttcaaatgtca

SEQ ID NO: 2023226 - DNA, 15 bp, Homo sapiens
ctgggttcactgcaa

SEQ ID NO: 2023227 - DNA, 17 bp, Homo sapiens
ctgggttcattccccgg

SEQ ID NO: 2023228 - DNA, 22 bp, Homo sapiens
ctgggttcattccccggccctc

SEQ ID NO: 2023229 - DNA, 15 bp, Homo sapiens
ctgggttggagggtg

SEQ ID NO: 2023230 - DNA, 22 bp, Homo sapiens
ctgggtttattacatggcagtg

SEQ ID NO: 2023231 - DNA, 19 bp, Homo sapiens
ctgggttttctaactgtaa

SEQ ID NO: 2023232 - DNA, 20 bp, Homo sapiens
ctgggttttctaactgtaaa

SEQ ID NO: 2023233 - DNA, 15 bp, Homo sapiens
ctgggttttgtctct

SEQ ID NO: 2023234 - DNA, 15 bp, Homo sapiens
ctggtaagcagaggc

SEQ ID NO: 2023235 - DNA, 15 bp, Homo sapiens
ctggtacagcagggt

SEQ ID NO: 2023236 - DNA, 17 bp, Homo sapiens
ctggtacagcagggtct

SEQ ID NO: 2023237 - DNA, 23 bp, Homo sapiens
ctggtacagcagggtcttgctgt

SEQ ID NO: 2023238 - DNA, 18 bp, Homo sapiens
ctggtagaattgggaagc

SEQ ID NO: 2023239 - DNA, 19 bp, Homo sapiens
ctggtcacaggactctgcc

SEQ ID NO: 2023240 - DNA, 21 bp, Homo sapiens
ctggtcacaggactctgcctc

SEQ ID NO: 2023241 - DNA, 22 bp, Homo sapiens
ctggtcaggcccactgcagaga

SEQ ID NO: 2023242 - DNA, 18 bp, Homo sapiens
ctggtccactcagggctg

SEQ ID NO: 2023243 - DNA, 13 bp, Homo sapiens
ctggtcccactca

SEQ ID NO: 2023244 - DNA, 14 bp, Homo sapiens
ctggtcctgtgtgc

SEQ ID NO: 2023245 - DNA, 11 bp, Homo sapiens
ctgtattttaa

SEQ ID NO: 2023246 - DNA, 14 bp, Homo sapiens
ctgtattttaaggt

SEQ ID NO: 2023247 - DNA, 18 bp, Homo sapiens
ctgtcaagtcatgatgga

SEQ ID NO: 2023248 - DNA, 19 bp, Homo sapiens
ctgtcaatgattattttca

SEQ ID NO: 2023249 - DNA, 20 bp, Homo sapiens
ctgtcaatgattattttcat

SEQ ID NO: 2023250 - DNA, 23 bp, Homo sapiens
ctgtcaccaagctcacagttcct

SEQ ID NO: 2023251 - DNA, 14 bp, Homo sapiens
ctgtcaccctggcc

SEQ ID NO: 2023252 - DNA, 15 bp, Homo sapiens
ctgtcaccctggccc

SEQ ID NO: 2023253 - DNA, 19 bp, Homo sapiens
ctgtcaccctggccccaac

SEQ ID NO: 2023254 - DNA, 17 bp, Homo sapiens
ctgtcactgctctggac

SEQ ID NO: 2023255 - DNA, 24 bp, Homo sapiens
ctgtcactgctctggactgtgtgg

SEQ ID NO: 2023256 - DNA, 12 bp, Homo sapiens
ctgtcagagctg

SEQ ID NO: 2023257 - DNA, 22 bp, Homo sapiens
ctgtcagagctgttggcctcgc

SEQ ID NO: 2023258 - DNA, 13 bp, Homo sapiens
ctgtcagaggcta

SEQ ID NO: 2023259 - DNA, 22 bp, Homo sapiens
ctgtcagatgggaagacatgaa

SEQ ID NO: 2023260 - DNA, 16 bp, Homo sapiens
ctgtcagccagccgcc

SEQ ID NO: 2023261 - DNA, 22 bp, Homo sapiens
ctgtcagccagccgccctgggc

SEQ ID NO: 2023262 - DNA, 16 bp, Homo sapiens
ctgtcatcaattaaag

SEQ ID NO: 2023263 - DNA, 19 bp, Homo sapiens
ctgtcatcactccctggat

SEQ ID NO: 2023264 - DNA, 14 bp, Homo sapiens
ctgtcatccagaaa

SEQ ID NO: 2023265 - DNA, 16 bp, Homo sapiens
ctgtcatccagaaaat

SEQ ID NO: 2023266 - DNA, 18 bp, Homo sapiens
ctgtcatcccgctcctgc

SEQ ID NO: 2023267 - DNA, 21 bp, Homo sapiens
ctgtcatcccgctcctgctga

SEQ ID NO: 2023268 - DNA, 15 bp, Homo sapiens
ctgtcatctagcccc

SEQ ID NO: 2023269 - DNA, 16 bp, Homo sapiens
ctgtcatctagcccct

SEQ ID NO: 2023270 - DNA, 13 bp, Homo sapiens
ctgtcatctctct

SEQ ID NO: 2023271 - DNA, 16 bp, Homo sapiens
ctgtcatctctctggg

SEQ ID NO: 2023272 - DNA, 17 bp, Homo sapiens
ctgtcatctctctgggg

SEQ ID NO: 2023273 - DNA, 19 bp, Homo sapiens
ctgtcatggaaaagcccag

SEQ ID NO: 2023274 - DNA, 14 bp, Homo sapiens
ctgtcattcaaatg

SEQ ID NO: 2023275 - DNA, 13 bp, Homo sapiens
ctgtcattcagga

SEQ ID NO: 2023276 - DNA, 23 bp, Homo sapiens
ctgtcattcccaccaccctgagg

SEQ ID NO: 2023277 - DNA, 17 bp, Homo sapiens
ctgtcatttgagcaggg

SEQ ID NO: 2023278 - DNA, 16 bp, Homo sapiens
ctgtccaacctaaccc

SEQ ID NO: 2023279 - DNA, 23 bp, Homo sapiens
ctgtccaacctaacccctttcct

SEQ ID NO: 2023280 - DNA, 14 bp, Homo sapiens
ctgtccactctcgg

SEQ ID NO: 2023281 - DNA, 16 bp, Homo sapiens
ctgtccaggacatgat

SEQ ID NO: 2023282 - DNA, 18 bp, Homo sapiens
ctgtccaggcactgctgc

SEQ ID NO: 2023283 - DNA, 21 bp, Homo sapiens
ctgtccaggccactgtggcca

SEQ ID NO: 2023284 - DNA, 22 bp, Homo sapiens
ctgtccaggccactgtggccag

SEQ ID NO: 2023285 - DNA, 14 bp, Homo sapiens
ctgtccataaagta

SEQ ID NO: 2023286 - DNA, 19 bp, Homo sapiens
ctgtcccaccaactctgca

SEQ ID NO: 2023287 - DNA, 21 bp, Homo sapiens
ctgtcccaccgggagcctccc

SEQ ID NO: 2023288 - DNA, 15 bp, Homo sapiens
ctgtcccacctcttc

SEQ ID NO: 2023289 - DNA, 11 bp, Homo sapiens
ctgtcccagag

SEQ ID NO: 2023290 - DNA, 21 bp, Homo sapiens
ctgtcccagagcttattggcc

SEQ ID NO: 2023291 - DNA, 23 bp, Homo sapiens
ctgtcccagagcttattggccac

SEQ ID NO: 2023292 - DNA, 23 bp, Homo sapiens
ctgtccccctgagatcagagtcc

SEQ ID NO: 2023293 - DNA, 14 bp, Homo sapiens
ctgtcccctctccc

SEQ ID NO: 2023294 - DNA, 14 bp, Homo sapiens
ctgtcccgccttcc

SEQ ID NO: 2023295 - DNA, 15 bp, Homo sapiens
ctgtcccgccttcct

SEQ ID NO: 2023296 - DNA, 19 bp, Homo sapiens
ctgtcccggttcaccttgc

SEQ ID NO: 2023297 - DNA, 12 bp, Homo sapiens
ctgtccctaccc

SEQ ID NO: 2023298 - DNA, 17 bp, Homo sapiens
ctgtccctcactgcctt

SEQ ID NO: 2023299 - DNA, 16 bp, Homo sapiens
ctgtccctctttgcct

SEQ ID NO: 2023300 - DNA, 18 bp, Homo sapiens
ctgtccctctttgcctgt

SEQ ID NO: 2023301 - DNA, 14 bp, Homo sapiens
ctgtccgcctctgc

SEQ ID NO: 2023302 - DNA, 14 bp, Homo sapiens
ctgtcctacccacc

SEQ ID NO: 2023303 - DNA, 16 bp, Homo sapiens
ctgtcctactctgtgt

SEQ ID NO: 2023304 - DNA, 23 bp, Homo sapiens
ctgtcctcaaaataaggggcacc

SEQ ID NO: 2023305 - DNA, 18 bp, Homo sapiens
ctgtcctcccatcccctg

SEQ ID NO: 2023306 - DNA, 21 bp, Homo sapiens
ctgtcctcccatcccctggac

SEQ ID NO: 2023307 - DNA, 19 bp, Homo sapiens
ctgtcctctcgagcccaga

SEQ ID NO: 2023308 - DNA, 14 bp, Homo sapiens
ctgtcctgggagtg

SEQ ID NO: 2023309 - DNA, 20 bp, Homo sapiens
ctgtcctgggagtgagctgg

SEQ ID NO: 2023310 - DNA, 21 bp, Homo sapiens
ctgtcctgggagtgagctggt

SEQ ID NO: 2023311 - DNA, 14 bp, Homo sapiens
ctgtcctggtacag

SEQ ID NO: 2023312 - DNA, 14 bp, Homo sapiens
ctgtccttttagga

SEQ ID NO: 2023313 - DNA, 15 bp, Homo sapiens
ctgtcgattagactg

SEQ ID NO: 2023314 - DNA, 17 bp, Homo sapiens
ctgtcgattagactgga

SEQ ID NO: 2023315 - DNA, 20 bp, Homo sapiens
ctgtcgattagactggacag

SEQ ID NO: 2023316 - DNA, 23 bp, Homo sapiens
ctgtcgattagactggacagctt

SEQ ID NO: 2023317 - DNA, 15 bp, Homo sapiens
ctgtcgctgggctgt

SEQ ID NO: 2023318 - DNA, 13 bp, Homo sapiens
ctgtctaaaaaac

SEQ ID NO: 2023319 - DNA, 17 bp, Homo sapiens
ctgtctacctcacagaa

SEQ ID NO: 2023320 - DNA, 20 bp, Homo sapiens
ctgtctcaagagggcactgg

SEQ ID NO: 2023321 - DNA, 23 bp, Homo sapiens
ctgtctcaagagggcactggtgg

SEQ ID NO: 2023322 - DNA, 15 bp, Homo sapiens
ctgtctctagccact

SEQ ID NO: 2023323 - DNA, 20 bp, Homo sapiens
ctgtctctagccactttggt

SEQ ID NO: 2023324 - DNA, 20 bp, Homo sapiens
ctgtctctcttgctttgttc

SEQ ID NO: 2023325 - DNA, 21 bp, Homo sapiens
ctgtctctcttgctttgttct

SEQ ID NO: 2023326 - DNA, 17 bp, Homo sapiens
ctgtctctgctcttgcc

SEQ ID NO: 2023327 - DNA, 14 bp, Homo sapiens
ctgtctgccagcca

SEQ ID NO: 2023328 - DNA, 16 bp, Homo sapiens
ctgtctgccagccagc

SEQ ID NO: 2023329 - DNA, 17 bp, Homo sapiens
ctgtctgccagccagca

SEQ ID NO: 2023330 - DNA, 21 bp, Homo sapiens
ctgtctggtgtagctcctctg

SEQ ID NO: 2023331 - DNA, 23 bp, Homo sapiens
ctgtctggtgtagctcctctgct

SEQ ID NO: 2023332 - DNA, 13 bp, Homo sapiens
ctgtctgtcctgg

SEQ ID NO: 2023333 - DNA, 14 bp, Homo sapiens
ctgtctgtcctgga

SEQ ID NO: 2023334 - DNA, 14 bp, Homo sapiens
ctgtctgtctgtcc

SEQ ID NO: 2023335 - DNA, 15 bp, Homo sapiens
ctgtcttcacaacct

SEQ ID NO: 2023336 - DNA, 22 bp, Homo sapiens
ctgtcttcatagcagattttaa

SEQ ID NO: 2023337 - DNA, 16 bp, Homo sapiens
ctgtcttccactgtac

SEQ ID NO: 2023338 - DNA, 17 bp, Homo sapiens
ctgtcttgccagccaga

SEQ ID NO: 2023339 - DNA, 15 bp, Homo sapiens
ctgtcttgcctgcca

SEQ ID NO: 2023340 - DNA, 22 bp, Homo sapiens
ctgtctttcagcattcagtccg

SEQ ID NO: 2023341 - DNA, 23 bp, Homo sapiens
ctgtctttctctaaatatgatta

SEQ ID NO: 2023342 - DNA, 15 bp, Homo sapiens
ctgtgaaaatgagga

SEQ ID NO: 2023343 - DNA, 18 bp, Homo sapiens
ctgtgaaaatgaggagga

SEQ ID NO: 2023344 - DNA, 14 bp, Homo sapiens
ctgtgaaagtatgt

SEQ ID NO: 2023345 - DNA, 17 bp, Homo sapiens
ctgtgaaagtatgtgat

SEQ ID NO: 2023346 - DNA, 19 bp, Homo sapiens
ctgtgaaagtatgtgatat

SEQ ID NO: 2023347 - DNA, 20 bp, Homo sapiens
ctgtgaaatcagaagtgcaa

SEQ ID NO: 2023348 - DNA, 17 bp, Homo sapiens
ctgtgaacccaggacaa

SEQ ID NO: 2023349 - DNA, 22 bp, Homo sapiens
ctgtgaacccaggacaagcatg

SEQ ID NO: 2023350 - DNA, 16 bp, Homo sapiens
ctgtgaacgatttaga

SEQ ID NO: 2023351 - DNA, 22 bp, Homo sapiens
ctgtgaagacccagcaggaagc

SEQ ID NO: 2023352 - DNA, 14 bp, Homo sapiens
ctgtgacaggaagc

SEQ ID NO: 2023353 - DNA, 15 bp, Homo sapiens
ctgtgaccacacgct

SEQ ID NO: 2023354 - DNA, 14 bp, Homo sapiens
ctgtgaccccacct

SEQ ID NO: 2023355 - DNA, 16 bp, Homo sapiens
ctgtgacctgccccgc

SEQ ID NO: 2023356 - DNA, 16 bp, Homo sapiens
ctgtgacctgctgagc

SEQ ID NO: 2023357 - DNA, 21 bp, Homo sapiens
ctgtgacctgctgagctctga

SEQ ID NO: 2023358 - DNA, 15 bp, Homo sapiens
ctgtgagcaagaagt

SEQ ID NO: 2023359 - DNA, 21 bp, Homo sapiens
ctgtgagcccctggtcctgag

SEQ ID NO: 2023360 - DNA, 21 bp, Homo sapiens
tccacccaggctgcactgcag

SEQ ID NO: 2023361 - DNA, 22 bp, Homo sapiens
tccacccaggctgcactgcagt

SEQ ID NO: 2023362 - DNA, 23 bp, Homo sapiens
tccacccaggctgcactgcagtg

SEQ ID NO: 2023363 - DNA, 24 bp, Homo sapiens
tccacccaggctgcactgcagtga

SEQ ID NO: 2023364 - DNA, 13 bp, Homo sapiens
tccacccagtgct

SEQ ID NO: 2023365 - DNA, 15 bp, Homo sapiens
tccacccagtgctgc

SEQ ID NO: 2023366 - DNA, 17 bp, Homo sapiens
tccacccagtgctgcca

SEQ ID NO: 2023367 - DNA, 24 bp, Homo sapiens
tccacccattcccccatgtggctg

SEQ ID NO: 2023368 - DNA, 20 bp, Homo sapiens
tccaccccactggatcttca

SEQ ID NO: 2023369 - DNA, 14 bp, Homo sapiens
tccaccccctccag

SEQ ID NO: 2023370 - DNA, 20 bp, Homo sapiens
tccaccccctccagctccag

SEQ ID NO: 2023371 - DNA, 21 bp, Homo sapiens
tccaccccctccagctccagt

SEQ ID NO: 2023372 - DNA, 14 bp, Homo sapiens
tccaccctatccct

SEQ ID NO: 2023373 - DNA, 22 bp, Homo sapiens
tccaccctcaaatgtcagagct

SEQ ID NO: 2023374 - DNA, 14 bp, Homo sapiens
tccaccctgctctc

SEQ ID NO: 2023375 - DNA, 12 bp, Homo sapiens
tccaccctggaa

SEQ ID NO: 2023376 - DNA, 13 bp, Homo sapiens
tccacctcagcct

SEQ ID NO: 2023377 - DNA, 14 bp, Homo sapiens
tccacctcagcctt

SEQ ID NO: 2023378 - DNA, 13 bp, Homo sapiens
tccacctcctaga

SEQ ID NO: 2023379 - DNA, 17 bp, Homo sapiens
tccacctctccttggaa

SEQ ID NO: 2023380 - DNA, 22 bp, Homo sapiens
tccacctgcctatccatcctgc

SEQ ID NO: 2023381 - DNA, 22 bp, Homo sapiens
tccacctgttcaggagctgaag

SEQ ID NO: 2023382 - DNA, 15 bp, Homo sapiens
tccaccttgctcttc

SEQ ID NO: 2023383 - DNA, 18 bp, Homo sapiens
tccacgcctcctggccag

SEQ ID NO: 2023384 - DNA, 18 bp, Homo sapiens
tccacgggggcggcaggc

SEQ ID NO: 2023385 - DNA, 22 bp, Homo sapiens
tccacgggtctcacttatacca

SEQ ID NO: 2023386 - DNA, 21 bp, Homo sapiens
tccacggtgcgtggctgtggc

SEQ ID NO: 2023387 - DNA, 23 bp, Homo sapiens
tccacggtgcgtggctgtggcac

SEQ ID NO: 2023388 - DNA, 16 bp, Homo sapiens
tccacgtccccctggg

SEQ ID NO: 2023389 - DNA, 21 bp, Homo sapiens
tccactaaatgagctcctgcg

SEQ ID NO: 2023390 - DNA, 20 bp, Homo sapiens
tccactcaatatgtgatttt

SEQ ID NO: 2023391 - DNA, 13 bp, Homo sapiens
tccactcactcca

SEQ ID NO: 2023392 - DNA, 17 bp, Homo sapiens
tccactcactccagccc

SEQ ID NO: 2023393 - DNA, 18 bp, Homo sapiens
tccactcactccagccca

SEQ ID NO: 2023394 - DNA, 21 bp, Homo sapiens
tccactcactccagcccaaca

SEQ ID NO: 2023395 - DNA, 12 bp, Homo sapiens
tccactccaagg

SEQ ID NO: 2023396 - DNA, 17 bp, Homo sapiens
tccactcccccacctga

SEQ ID NO: 2023397 - DNA, 18 bp, Homo sapiens
tccactcccccacctgac

SEQ ID NO: 2023398 - DNA, 12 bp, Homo sapiens
tccactctcagg

SEQ ID NO: 2023399 - DNA, 15 bp, Homo sapiens
tccactgccttcgat

SEQ ID NO: 2023400 - DNA, 20 bp, Homo sapiens
tccactgctctcagcctccc

SEQ ID NO: 2023401 - DNA, 16 bp, Homo sapiens
tccactggctccacat

SEQ ID NO: 2023402 - DNA, 12 bp, Homo sapiens
tccactgtcacc

SEQ ID NO: 2023403 - DNA, 18 bp, Homo sapiens
tccactgtcttgcctgcc

SEQ ID NO: 2023404 - DNA, 22 bp, Homo sapiens
tccactgtgccatgtgccaggt

SEQ ID NO: 2023405 - DNA, 19 bp, Homo sapiens
tccactgtgctattacaaa

SEQ ID NO: 2023406 - DNA, 21 bp, Homo sapiens
tccacttagaaattgcatttc

SEQ ID NO: 2023407 - DNA, 13 bp, Homo sapiens
tccagaaaatata

SEQ ID NO: 2023408 - DNA, 20 bp, Homo sapiens
tccagaaaatataaatgcat

SEQ ID NO: 2023409 - DNA, 22 bp, Homo sapiens
tccagaaaatataaatgcatga

SEQ ID NO: 2023410 - DNA, 22 bp, Homo sapiens
tccagaaaatgtgtcagcatgc

SEQ ID NO: 2023411 - DNA, 20 bp, Homo sapiens
tccagaagaatattcaggac

SEQ ID NO: 2023412 - DNA, 22 bp, Homo sapiens
tccagaagaatattcaggactt

SEQ ID NO: 2023413 - DNA, 17 bp, Homo sapiens
tccagaagatgccctcc

SEQ ID NO: 2023414 - DNA, 15 bp, Homo sapiens
tccagaataagtgct

SEQ ID NO: 2023415 - DNA, 16 bp, Homo sapiens
tccagaataagtgctg

SEQ ID NO: 2023416 - DNA, 18 bp, Homo sapiens
tccagaatctgctgttgc

SEQ ID NO: 2023417 - DNA, 19 bp, Homo sapiens
tccagacatacgaaacaca

SEQ ID NO: 2023418 - DNA, 15 bp, Homo sapiens
tccagaccacctgcc

SEQ ID NO: 2023419 - DNA, 19 bp, Homo sapiens
tccagaccacctgccagcc

SEQ ID NO: 2023420 - DNA, 20 bp, Homo sapiens
tccagaccacctgccagcca

SEQ ID NO: 2023421 - DNA, 21 bp, Homo sapiens
tccagaccacctgccagccat

SEQ ID NO: 2023422 - DNA, 23 bp, Homo sapiens
tccagaccacctgccagccatca

SEQ ID NO: 2023423 - DNA, 19 bp, Homo sapiens
tccagaccattgtcttcca

SEQ ID NO: 2023424 - DNA, 17 bp, Homo sapiens
tccagacccctggcttt

SEQ ID NO: 2023425 - DNA, 21 bp, Homo sapiens
tccagacccctgtggcagacc

SEQ ID NO: 2023426 - DNA, 18 bp, Homo sapiens
tccagacccggctgcgtg

SEQ ID NO: 2023427 - DNA, 14 bp, Homo sapiens
tccagaccctgcct

SEQ ID NO: 2023428 - DNA, 22 bp, Homo sapiens
tccagactgcttccaattttct

SEQ ID NO: 2023429 - DNA, 22 bp, Homo sapiens
tccagagagaggatgcagaggg

SEQ ID NO: 2023430 - DNA, 15 bp, Homo sapiens
tccagagagtcctct

SEQ ID NO: 2023431 - DNA, 19 bp, Homo sapiens
tccagagagtcctctggat

SEQ ID NO: 2023432 - DNA, 17 bp, Homo sapiens
tccagagcactgctcca

SEQ ID NO: 2023433 - DNA, 13 bp, Homo sapiens
tccagagccagcc

SEQ ID NO: 2023434 - DNA, 14 bp, Homo sapiens
tccagagccagcct

SEQ ID NO: 2023435 - DNA, 17 bp, Homo sapiens
tccagagccagcctggg

SEQ ID NO: 2023436 - DNA, 18 bp, Homo sapiens
tccagagccagcctggga

SEQ ID NO: 2023437 - DNA, 20 bp, Homo sapiens
tccagagggttgtgattttg

SEQ ID NO: 2023438 - DNA, 19 bp, Homo sapiens
tccagagtgtgcagactga

SEQ ID NO: 2023439 - DNA, 20 bp, Homo sapiens
tccagagtgtgcagactgat

SEQ ID NO: 2023440 - DNA, 18 bp, Homo sapiens
tccagattcttccactgg

SEQ ID NO: 2023441 - DNA, 22 bp, Homo sapiens
tccagattttttacagctgcct

SEQ ID NO: 2023442 - DNA, 14 bp, Homo sapiens
tccagcagctgcgg

SEQ ID NO: 2023443 - DNA, 15 bp, Homo sapiens
tccagcatccagcct

SEQ ID NO: 2023444 - DNA, 20 bp, Homo sapiens
tccagccagcgcctccctcc

SEQ ID NO: 2023445 - DNA, 23 bp, Homo sapiens
tccagccagcgcctccctccacc

SEQ ID NO: 2023446 - DNA, 13 bp, Homo sapiens
tccagccagctcc

SEQ ID NO: 2023447 - DNA, 16 bp, Homo sapiens
tccagccagctcctgg

SEQ ID NO: 2023448 - DNA, 21 bp, Homo sapiens
tccagccagctcctgggcagc

SEQ ID NO: 2023449 - DNA, 19 bp, Homo sapiens
tccagccatcaagagactg

SEQ ID NO: 2023450 - DNA, 16 bp, Homo sapiens
tccagcccacacccct

SEQ ID NO: 2023451 - DNA, 13 bp, Homo sapiens
tccagcctctccc

SEQ ID NO: 2023452 - DNA, 17 bp, Homo sapiens
tccagcctctcccggct

SEQ ID NO: 2023453 - DNA, 13 bp, Homo sapiens
tccagcctgagca

SEQ ID NO: 2023454 - DNA, 11 bp, Homo sapiens
tccagcctggg

SEQ ID NO: 2023455 - DNA, 18 bp, Homo sapiens
tccagccttctctctctg

SEQ ID NO: 2023456 - DNA, 17 bp, Homo sapiens
tccagctagccaactcc

SEQ ID NO: 2023457 - DNA, 15 bp, Homo sapiens
tccagctagtgaccc

SEQ ID NO: 2023458 - DNA, 16 bp, Homo sapiens
tccagctcaccagccc

SEQ ID NO: 2023459 - DNA, 17 bp, Homo sapiens
tccagctcaccagcccc

SEQ ID NO: 2023460 - DNA, 10 bp, Homo sapiens
tccagctccc

SEQ ID NO: 2023461 - DNA, 10 bp, Homo sapiens
tccagctctt

SEQ ID NO: 2023462 - DNA, 13 bp, Homo sapiens
tccagctcttggc

SEQ ID NO: 2023463 - DNA, 22 bp, Homo sapiens
accaaagagactggagcatctg

SEQ ID NO: 2023464 - DNA, 22 bp, Homo sapiens
accaaagatatatacacaggat

SEQ ID NO: 2023465 - DNA, 23 bp, Homo sapiens
accaaagatatatacacaggatc

SEQ ID NO: 2023466 - DNA, 19 bp, Homo sapiens
accaaaggacattatgtgt

SEQ ID NO: 2023467 - DNA, 20 bp, Homo sapiens
accaaaggacattatgtgtg

SEQ ID NO: 2023468 - DNA, 21 bp, Homo sapiens
accaaaggacattatgtgtgc

SEQ ID NO: 2023469 - DNA, 16 bp, Homo sapiens
accaaattgcttctag

SEQ ID NO: 2023470 - DNA, 23 bp, Homo sapiens
accaaattgcttctaggagtcaa

SEQ ID NO: 2023471 - DNA, 14 bp, Homo sapiens
accaacacgagcag

SEQ ID NO: 2023472 - DNA, 15 bp, Homo sapiens
accaacagcttttcc

SEQ ID NO: 2023473 - DNA, 16 bp, Homo sapiens
accaacagttccttca

SEQ ID NO: 2023474 - DNA, 18 bp, Homo sapiens
accaacatcccattgccc

SEQ ID NO: 2023475 - DNA, 22 bp, Homo sapiens
accaacatcccattgccctggt

SEQ ID NO: 2023476 - DNA, 15 bp, Homo sapiens
accaacatggagaaa

SEQ ID NO: 2023477 - DNA, 16 bp, Homo sapiens
accaacatggagaaac

SEQ ID NO: 2023478 - DNA, 19 bp, Homo sapiens
accaaccctgtttcctgag

SEQ ID NO: 2023479 - DNA, 14 bp, Homo sapiens
accaacctccccgc

SEQ ID NO: 2023480 - DNA, 15 bp, Homo sapiens
accaacctccccgca

SEQ ID NO: 2023481 - DNA, 23 bp, Homo sapiens
accaacgggaccccctggccctg

SEQ ID NO: 2023482 - DNA, 23 bp, Homo sapiens
accaactctgcactccatggcca

SEQ ID NO: 2023483 - DNA, 14 bp, Homo sapiens
accaactggcttct

SEQ ID NO: 2023484 - DNA, 15 bp, Homo sapiens
accaagatacttaag

SEQ ID NO: 2023485 - DNA, 19 bp, Homo sapiens
accaagattggcctgaggc

SEQ ID NO: 2023486 - DNA, 18 bp, Homo sapiens
accaagcttcagagccta

SEQ ID NO: 2023487 - DNA, 20 bp, Homo sapiens
accaagcttcagagcctagc

SEQ ID NO: 2023488 - DNA, 21 bp, Homo sapiens
accaagcttcagagcctagcc

SEQ ID NO: 2023489 - DNA, 22 bp, Homo sapiens
accaagcttcagagcctagcca

SEQ ID NO: 2023490 - DNA, 12 bp, Homo sapiens
accaaggcagcc

SEQ ID NO: 2023491 - DNA, 21 bp, Homo sapiens
accaaggcagcctccagagcc

SEQ ID NO: 2023492 - DNA, 15 bp, Homo sapiens
accaaggtcttcagc

SEQ ID NO: 2023493 - DNA, 19 bp, Homo sapiens
accaataacttcagagaag

SEQ ID NO: 2023494 - DNA, 17 bp, Homo sapiens
accaatactactgtaaa

SEQ ID NO: 2023495 - DNA, 23 bp, Homo sapiens
accaatcccgtgaaagaattatt

SEQ ID NO: 2023496 - DNA, 15 bp, Homo sapiens
accaatcctggcagg

SEQ ID NO: 2023497 - DNA, 15 bp, Homo sapiens
accaatctctaagcc

SEQ ID NO: 2023498 - DNA, 12 bp, Homo sapiens
accaatgcatgc

SEQ ID NO: 2023499 - DNA, 18 bp, Homo sapiens
accaatgcatgcagccac

SEQ ID NO: 2023500 - DNA, 22 bp, Homo sapiens
accaatgccaagataattcact

SEQ ID NO: 2023501 - DNA, 19 bp, Homo sapiens
accaatgcttttatcaaac

SEQ ID NO: 2023502 - DNA, 16 bp, Homo sapiens
accaatgttgtgatta

SEQ ID NO: 2023503 - DNA, 20 bp, Homo sapiens
accaattgtacattccctgc

SEQ ID NO: 2023504 - DNA, 16 bp, Homo sapiens
accaattttaaataca

SEQ ID NO: 2023505 - DNA, 16 bp, Homo sapiens
accacaaccaggaaga

SEQ ID NO: 2023506 - DNA, 18 bp, Homo sapiens
accacacacctcaccaga

SEQ ID NO: 2023507 - DNA, 15 bp, Homo sapiens
accacaccaaacctc

SEQ ID NO: 2023508 - DNA, 16 bp, Homo sapiens
accacaccgcagaagc

SEQ ID NO: 2023509 - DNA, 16 bp, Homo sapiens
accacacctccctgaa

SEQ ID NO: 2023510 - DNA, 22 bp, Homo sapiens
accacacctccctgaaccatcc

SEQ ID NO: 2023511 - DNA, 18 bp, Homo sapiens
accacactgaatctcccc

SEQ ID NO: 2023512 - DNA, 16 bp, Homo sapiens
accacagcagctgaac

SEQ ID NO: 2023513 - DNA, 21 bp, Homo sapiens
accacagcagctgaacagcca

SEQ ID NO: 2023514 - DNA, 11 bp, Homo sapiens
accacagcagt

SEQ ID NO: 2023515 - DNA, 13 bp, Homo sapiens
accacaggctgcc

SEQ ID NO: 2023516 - DNA, 16 bp, Homo sapiens
accacagtgggtggca

SEQ ID NO: 2023517 - DNA, 19 bp, Homo sapiens
accacagtgggtggcacct

SEQ ID NO: 2023518 - DNA, 16 bp, Homo sapiens
accacatctacaattt

SEQ ID NO: 2023519 - DNA, 16 bp, Homo sapiens
accacatcttgctctg

SEQ ID NO: 2023520 - DNA, 17 bp, Homo sapiens
accacatcttgctctgc

SEQ ID NO: 2023521 - DNA, 18 bp, Homo sapiens
accacatcttgctctgct

SEQ ID NO: 2023522 - DNA, 19 bp, Homo sapiens
accacatcttgctctgctg

SEQ ID NO: 2023523 - DNA, 18 bp, Homo sapiens
accacatgtgcacatgca

SEQ ID NO: 2023524 - DNA, 18 bp, Homo sapiens
accaccagatgagaagtt

SEQ ID NO: 2023525 - DNA, 17 bp, Homo sapiens
accaccagccccagcaa

SEQ ID NO: 2023526 - DNA, 23 bp, Homo sapiens
accacccactctcctctgcctca

SEQ ID NO: 2023527 - DNA, 14 bp, Homo sapiens
accaccccttcctg

SEQ ID NO: 2023528 - DNA, 15 bp, Homo sapiens
accaccctcccacca

SEQ ID NO: 2023529 - DNA, 13 bp, Homo sapiens
accaccctgaggc

SEQ ID NO: 2023530 - DNA, 20 bp, Homo sapiens
accacctaggccactcctcc

SEQ ID NO: 2023531 - DNA, 15 bp, Homo sapiens
accacctcactcctg

SEQ ID NO: 2023532 - DNA, 17 bp, Homo sapiens
accacctctccagaggc

SEQ ID NO: 2023533 - DNA, 13 bp, Homo sapiens
accacctgccagc

SEQ ID NO: 2023534 - DNA, 15 bp, Homo sapiens
accacctgccagcca

SEQ ID NO: 2023535 - DNA, 17 bp, Homo sapiens
accacctgccagccatc

SEQ ID NO: 2023536 - DNA, 18 bp, Homo sapiens
accacctgccagccatca

SEQ ID NO: 2023537 - DNA, 15 bp, Homo sapiens
accacctgcttctga

SEQ ID NO: 2023538 - DNA, 14 bp, Homo sapiens
accaccttcccagc

SEQ ID NO: 2023539 - DNA, 19 bp, Homo sapiens
accaccttcccagctctcc

SEQ ID NO: 2023540 - DNA, 20 bp, Homo sapiens
accaccttcccagctctccc

SEQ ID NO: 2023541 - DNA, 13 bp, Homo sapiens
accaccttccctc

SEQ ID NO: 2023542 - DNA, 19 bp, Homo sapiens
accaccttggactcctccc

SEQ ID NO: 2023543 - DNA, 20 bp, Homo sapiens
accaccttggactcctccca

SEQ ID NO: 2023544 - DNA, 17 bp, Homo sapiens
accacgatgtggccctg

SEQ ID NO: 2023545 - DNA, 19 bp, Homo sapiens
accacgatgtggccctggc

SEQ ID NO: 2023546 - DNA, 20 bp, Homo sapiens
accacgatgtggccctggcc

SEQ ID NO: 2023547 - DNA, 21 bp, Homo sapiens
accacgatgtggccctggcct

SEQ ID NO: 2023548 - DNA, 18 bp, Homo sapiens
accacggcgtttttttac

SEQ ID NO: 2023549 - DNA, 19 bp, Homo sapiens
accacggcgtttttttaca

SEQ ID NO: 2023550 - DNA, 17 bp, Homo sapiens
accacgggcctcagttt

SEQ ID NO: 2023551 - DNA, 14 bp, Homo sapiens
accacgtctgccag

SEQ ID NO: 2023552 - DNA, 20 bp, Homo sapiens
accactagaactctccatct

SEQ ID NO: 2023553 - DNA, 17 bp, Homo sapiens
accactaggactctgag

SEQ ID NO: 2023554 - DNA, 19 bp, Homo sapiens
accactagggtcctggccc

SEQ ID NO: 2023555 - DNA, 20 bp, Homo sapiens
accactctggcagccacact

SEQ ID NO: 2023556 - DNA, 18 bp, Homo sapiens
accactgaacatttgctt

SEQ ID NO: 2023557 - DNA, 14 bp, Homo sapiens
accactgccctgcc

SEQ ID NO: 2023558 - DNA, 16 bp, Homo sapiens
accactgccctgcctg

SEQ ID NO: 2023559 - DNA, 17 bp, Homo sapiens
accactgccctgcctgc

SEQ ID NO: 2023560 - DNA, 20 bp, Homo sapiens
accactgccctgcctgccca

SEQ ID NO: 2023561 - DNA, 22 bp, Homo sapiens
accactggttaaaataaagcct

SEQ ID NO: 2023562 - DNA, 14 bp, Homo sapiens
accactgtacatat

SEQ ID NO: 2023563 - DNA, 16 bp, Homo sapiens
accactgtgtatttaa

SEQ ID NO: 2023564 - DNA, 17 bp, Homo sapiens
accacttcattcttgaa

SEQ ID NO: 2023565 - DNA, 16 bp, Homo sapiens
accacttcttttataa

SEQ ID NO: 2023566 - DNA, 16 bp, Homo sapiens
accacttggctgctca

SEQ ID NO: 2023567 - DNA, 16 bp, Homo sapiens
accagaaacagggaca

SEQ ID NO: 2023568 - DNA, 13 bp, Homo sapiens
accagaacaaggt

SEQ ID NO: 2023569 - DNA, 14 bp, Homo sapiens
accagaatcataat

SEQ ID NO: 2023570 - DNA, 16 bp, Homo sapiens
accagaatcataattt

SEQ ID NO: 2023571 - DNA, 17 bp, Homo sapiens
accagaattgtgcaaat

SEQ ID NO: 2023572 - DNA, 23 bp, Homo sapiens
accagacaccttgacagggcaca

SEQ ID NO: 2023573 - DNA, 17 bp, Homo sapiens
accagacctagacctgg

SEQ ID NO: 2023574 - DNA, 12 bp, Homo sapiens
accagagcccac

SEQ ID NO: 2023575 - DNA, 16 bp, Homo sapiens
accagagccccccaca

SEQ ID NO: 2023576 - DNA, 21 bp, Homo sapiens
accagagccccccacaatgat

SEQ ID NO: 2023577 - DNA, 13 bp, Homo sapiens
accagaggaagcc

SEQ ID NO: 2023578 - DNA, 14 bp, Homo sapiens
accagaggctgcag

SEQ ID NO: 2023579 - DNA, 20 bp, Homo sapiens
accagataagaatgctggtt

SEQ ID NO: 2023580 - DNA, 20 bp, Homo sapiens
accagatgaaataatgttct

SEQ ID NO: 2023581 - DNA, 14 bp, Homo sapiens
accagcaacatctc

SEQ ID NO: 2023582 - DNA, 23 bp, Homo sapiens
accagcaacatctcgagccccct

SEQ ID NO: 2023583 - DNA, 13 bp, Homo sapiens
accagcagaaaag

SEQ ID NO: 2023584 - DNA, 23 bp, Homo sapiens
accagcagaaaagtgcttagaaa

SEQ ID NO: 2023585 - DNA, 12 bp, Homo sapiens
accagcaggtgt

SEQ ID NO: 2023586 - DNA, 18 bp, Homo sapiens
accagcatgtcactccca

SEQ ID NO: 2023587 - DNA, 15 bp, Homo sapiens
accagcattttacta

SEQ ID NO: 2023588 - DNA, 15 bp, Homo sapiens
accagccacacagag

SEQ ID NO: 2023589 - DNA, 17 bp, Homo sapiens
accagccacacagagcc

SEQ ID NO: 2023590 - DNA, 15 bp, Homo sapiens
accagccatcatgtg

SEQ ID NO: 2023591 - DNA, 18 bp, Homo sapiens
accagccccagcaagagc

SEQ ID NO: 2023592 - DNA, 17 bp, Homo sapiens
accagccccctggatgg

SEQ ID NO: 2023593 - DNA, 16 bp, Homo sapiens
accagcccggcctgct

SEQ ID NO: 2023594 - DNA, 19 bp, Homo sapiens
accagccgaccggccctgc

SEQ ID NO: 2023595 - DNA, 13 bp, Homo sapiens
accagcctggcca

SEQ ID NO: 2023596 - DNA, 14 bp, Homo sapiens
accagcctggccaa

SEQ ID NO: 2023597 - DNA, 14 bp, Homo sapiens
accagcctgggcag

SEQ ID NO: 2023598 - DNA, 20 bp, Homo sapiens
accagcctggtcaacatggt

SEQ ID NO: 2023599 - DNA, 20 bp, Homo sapiens
accagcctggtgcccatcct

SEQ ID NO: 2023600 - DNA, 19 bp, Homo sapiens
accagctatctgtcatctc

SEQ ID NO: 2023601 - DNA, 13 bp, Homo sapiens
accagctcagagg

SEQ ID NO: 2023602 - DNA, 12 bp, Homo sapiens
accagctctgtg

SEQ ID NO: 2023603 - DNA, 19 bp, Homo sapiens
accagctctgtggcctgtg

SEQ ID NO: 2023604 - DNA, 20 bp, Homo sapiens
accagctctgtggcctgtgt

SEQ ID NO: 2023605 - DNA, 20 bp, Homo sapiens
accagctgaaagttgggact

SEQ ID NO: 2023606 - DNA, 11 bp, Homo sapiens
accagctgcta

SEQ ID NO: 2023607 - DNA, 13 bp, Homo sapiens
accagctgctctg

SEQ ID NO: 2023608 - DNA, 15 bp, Homo sapiens
accagctgctctgcc

SEQ ID NO: 2023609 - DNA, 18 bp, Homo sapiens
accagctgctctgcccct

SEQ ID NO: 2023610 - DNA, 16 bp, Homo sapiens
accagcttctccaggc

SEQ ID NO: 2023611 - DNA, 17 bp, Homo sapiens
accaggacaggaccaga

SEQ ID NO: 2023612 - DNA, 20 bp, Homo sapiens
accaggactatagcccaggt

SEQ ID NO: 2023613 - DNA, 17 bp, Homo sapiens
accaggcaccaaaagaa

SEQ ID NO: 2023614 - DNA, 20 bp, Homo sapiens
accaggcaccaaaagaagta

SEQ ID NO: 2023615 - DNA, 21 bp, Homo sapiens
accaggcaccaaaagaagtaa

SEQ ID NO: 2023616 - DNA, 15 bp, Homo sapiens
accaggcaccaggca

SEQ ID NO: 2023617 - DNA, 21 bp, Homo sapiens
accaggccgggcttgggccct

SEQ ID NO: 2023618 - DNA, 19 bp, Homo sapiens
accagggcactgtctgcgt

SEQ ID NO: 2023619 - DNA, 14 bp, Homo sapiens
accagggcgcaagc

SEQ ID NO: 2023620 - DNA, 22 bp, Homo sapiens
accaggggtgctatgacatgca

SEQ ID NO: 2023621 - DNA, 19 bp, Homo sapiens
accagggtccgcaccagct

SEQ ID NO: 2023622 - DNA, 17 bp, Homo sapiens
accagtatggaagggag

SEQ ID NO: 2023623 - DNA, 19 bp, Homo sapiens
accagtatggaagggaggg

SEQ ID NO: 2023624 - DNA, 14 bp, Homo sapiens
accagtgaaccaaa

SEQ ID NO: 2023625 - DNA, 16 bp, Homo sapiens
accagtgtagccttgc

SEQ ID NO: 2023626 - DNA, 21 bp, Homo sapiens
accagtgtagccttgcccgga

SEQ ID NO: 2023627 - DNA, 18 bp, Homo sapiens
accagtgtcccctccact

SEQ ID NO: 2023628 - DNA, 16 bp, Homo sapiens
accagttaagaatgga

SEQ ID NO: 2023629 - DNA, 20 bp, Homo sapiens
accagttaagaatggaagaa

SEQ ID NO: 2023630 - DNA, 17 bp, Homo sapiens
accagttatgtgaatga

SEQ ID NO: 2023631 - DNA, 16 bp, Homo sapiens
accagttggccatgat

SEQ ID NO: 2023632 - DNA, 18 bp, Homo sapiens
accagttgggagcactgg

SEQ ID NO: 2023633 - DNA, 15 bp, Homo sapiens
accataatgttacat

SEQ ID NO: 2023634 - DNA, 22 bp, Homo sapiens
accatagttatttacttgaaag

SEQ ID NO: 2023635 - DNA, 17 bp, Homo sapiens
accatatgtctgcttct

SEQ ID NO: 2023636 - DNA, 19 bp, Homo sapiens
accatatgtctgcttctgt

SEQ ID NO: 2023637 - DNA, 14 bp, Homo sapiens
accatcaaatgctg

SEQ ID NO: 2023638 - DNA, 15 bp, Homo sapiens
accatccaccaggcc

SEQ ID NO: 2023639 - DNA, 14 bp, Homo sapiens
accatcctggcccc

SEQ ID NO: 2023640 - DNA, 17 bp, Homo sapiens
accatcgcgtgcaatga

SEQ ID NO: 2023641 - DNA, 12 bp, Homo sapiens
accatctccagc

SEQ ID NO: 2023642 - DNA, 12 bp, Homo sapiens
accatctgctgc

SEQ ID NO: 2023643 - DNA, 13 bp, Homo sapiens
accatctgctgcc

SEQ ID NO: 2023644 - DNA, 14 bp, Homo sapiens
accatctgctgccc

SEQ ID NO: 2023645 - DNA, 20 bp, Homo sapiens
accatcttaaatgacagtga

SEQ ID NO: 2023646 - DNA, 21 bp, Homo sapiens
accatgagaagagggcctgtg

SEQ ID NO: 2023647 - DNA, 12 bp, Homo sapiens
accatgccaggg

SEQ ID NO: 2023648 - DNA, 12 bp, Homo sapiens
accatgctgctt

SEQ ID NO: 2023649 - DNA, 15 bp, Homo sapiens
accatgtagttttaa

SEQ ID NO: 2023650 - DNA, 21 bp, Homo sapiens
accatgtttgagctcagaccc

SEQ ID NO: 2023651 - DNA, 18 bp, Homo sapiens
accattatgaagaagaga

SEQ ID NO: 2023652 - DNA, 13 bp, Homo sapiens
accattgacctca

SEQ ID NO: 2023653 - DNA, 19 bp, Homo sapiens
accattgacctcagctgca

SEQ ID NO: 2023654 - DNA, 20 bp, Homo sapiens
accattgacctcagctgcac

SEQ ID NO: 2023655 - DNA, 13 bp, Homo sapiens
accattgtcttcc

SEQ ID NO: 2023656 - DNA, 16 bp, Homo sapiens
accattgtcttccaac

SEQ ID NO: 2023657 - DNA, 18 bp, Homo sapiens
accattgtcttccaaccc

SEQ ID NO: 2023658 - DNA, 21 bp, Homo sapiens
accattgtcttccaaccccag

SEQ ID NO: 2023659 - DNA, 17 bp, Homo sapiens
accattgttccttacct

SEQ ID NO: 2023660 - DNA, 15 bp, Homo sapiens
accatttaattcata

SEQ ID NO: 2023661 - DNA, 18 bp, Homo sapiens
acccaaagaccaatattc

SEQ ID NO: 2023662 - DNA, 18 bp, Homo sapiens
acccaaagaggtatttat

SEQ ID NO: 2023663 - DNA, 17 bp, Homo sapiens
acccaaagcatggacta

SEQ ID NO: 2023664 - DNA, 15 bp, Homo sapiens
acccaaataaatgtg

SEQ ID NO: 2023665 - DNA, 16 bp, Homo sapiens
acccaaataaatgtgt

SEQ ID NO: 2023666 - DNA, 15 bp, Homo sapiens
acccaagcaaggcca

SEQ ID NO: 2023667 - DNA, 15 bp, Homo sapiens
acccaaggaggaaaa

SEQ ID NO: 2023668 - DNA, 16 bp, Homo sapiens
acccaagtgggggcag

SEQ ID NO: 2023669 - DNA, 12 bp, Homo sapiens
acccacacatgt

SEQ ID NO: 2023670 - DNA, 17 bp, Homo sapiens
acccaccaaactgcaca

SEQ ID NO: 2023671 - DNA, 22 bp, Homo sapiens
acccacccatcttcctgctgct

SEQ ID NO: 2023672 - DNA, 13 bp, Homo sapiens
acccacctcagcc

SEQ ID NO: 2023673 - DNA, 14 bp, Homo sapiens
acccacctcagcct

SEQ ID NO: 2023674 - DNA, 16 bp, Homo sapiens
acccacctcagcctcc

SEQ ID NO: 2023675 - DNA, 11 bp, Homo sapiens
acccacctgct

SEQ ID NO: 2023676 - DNA, 21 bp, Homo sapiens
acccacgtgagagaatctgcc

SEQ ID NO: 2023677 - DNA, 14 bp, Homo sapiens
acccactcaccagg

SEQ ID NO: 2023678 - DNA, 14 bp, Homo sapiens
acccactctttgct

SEQ ID NO: 2023679 - DNA, 23 bp, Homo sapiens
acccactctttgctacaataaat

SEQ ID NO: 2023680 - DNA, 11 bp, Homo sapiens
acccactgctt

SEQ ID NO: 2023681 - DNA, 12 bp, Homo sapiens
acccactggcca

SEQ ID NO: 2023682 - DNA, 23 bp, Homo sapiens
acccactggccagtcctagagct

SEQ ID NO: 2023683 - DNA, 17 bp, Homo sapiens
acccactgtccgcctct

SEQ ID NO: 2023684 - DNA, 19 bp, Homo sapiens
acccactgtccgcctctgc

SEQ ID NO: 2023685 - DNA, 15 bp, Homo sapiens
acccactgtgcttac

SEQ ID NO: 2023686 - DNA, 18 bp, Homo sapiens
acccagactctaaatatt

SEQ ID NO: 2023687 - DNA, 24 bp, Homo sapiens
acccagagcattacgtgagccagg

SEQ ID NO: 2023688 - DNA, 20 bp, Homo sapiens
acccagagccttctcctgcc

SEQ ID NO: 2023689 - DNA, 23 bp, Homo sapiens
acccagagccttctcctgcctac

SEQ ID NO: 2023690 - DNA, 22 bp, Homo sapiens
acccagagggtagggcagcaga

SEQ ID NO: 2023691 - DNA, 21 bp, Homo sapiens
acccagcaggaagccaggctg

SEQ ID NO: 2023692 - DNA, 17 bp, Homo sapiens
acccagcccacttctgc

SEQ ID NO: 2023693 - DNA, 14 bp, Homo sapiens
acccagcccattct

SEQ ID NO: 2023694 - DNA, 17 bp, Homo sapiens
acccagccccttgagaa

SEQ ID NO: 2023695 - DNA, 23 bp, Homo sapiens
acccagcgagccctggtggcagt

SEQ ID NO: 2023696 - DNA, 17 bp, Homo sapiens
acccagctactctgtcc

SEQ ID NO: 2023697 - DNA, 22 bp, Homo sapiens
acccagctccttttgtccccag

SEQ ID NO: 2023698 - DNA, 20 bp, Homo sapiens
acccaggaggtggaggttgc

SEQ ID NO: 2023699 - DNA, 21 bp, Homo sapiens
acccaggaggtggaggttgca

SEQ ID NO: 2023700 - DNA, 19 bp, Homo sapiens
acccaggcaggccctgcct

SEQ ID NO: 2023701 - DNA, 16 bp, Homo sapiens
acccaggccctccatg

SEQ ID NO: 2023702 - DNA, 21 bp, Homo sapiens
acccaggccctccatgggcta

SEQ ID NO: 2023703 - DNA, 13 bp, Homo sapiens
acccaggccgcct

SEQ ID NO: 2023704 - DNA, 17 bp, Homo sapiens
acccaggccgcctgcca

SEQ ID NO: 2023705 - DNA, 12 bp, Homo sapiens
acccaggctcca

SEQ ID NO: 2023706 - DNA, 16 bp, Homo sapiens
acccaggctgcactgc

SEQ ID NO: 2023707 - DNA, 18 bp, Homo sapiens
acccaggctgcactgcag

SEQ ID NO: 2023708 - DNA, 20 bp, Homo sapiens
acccaggctgcactgcagtg

SEQ ID NO: 2023709 - DNA, 21 bp, Homo sapiens
acccagggctccctcctggag

SEQ ID NO: 2023710 - DNA, 22 bp, Homo sapiens
acccagggctccctcctggagc

SEQ ID NO: 2023711 - DNA, 17 bp, Homo sapiens
acccagtccccgtgccc

SEQ ID NO: 2023712 - DNA, 14 bp, Homo sapiens
acccagtccctggg

SEQ ID NO: 2023713 - DNA, 15 bp, Homo sapiens
acccagtcctggcca

SEQ ID NO: 2023714 - DNA, 13 bp, Homo sapiens
acccagtgctgcc

SEQ ID NO: 2023715 - DNA, 14 bp, Homo sapiens
acccagtgctgcca

SEQ ID NO: 2023716 - DNA, 16 bp, Homo sapiens
acccagtgctgccatg

SEQ ID NO: 2023717 - DNA, 23 bp, Homo sapiens
acccagtgctgccatgccactgc

SEQ ID NO: 2023718 - DNA, 14 bp, Homo sapiens
acccagtgtaaaga

SEQ ID NO: 2023719 - DNA, 22 bp, Homo sapiens
acccagtgtaaagaataaatga

SEQ ID NO: 2023720 - DNA, 23 bp, Homo sapiens
acccagtgtaaagaataaatgaa

SEQ ID NO: 2023721 - DNA, 18 bp, Homo sapiens
acccatagatcttctgaa

SEQ ID NO: 2023722 - DNA, 16 bp, Homo sapiens
acccatcttccccgga

SEQ ID NO: 2023723 - DNA, 16 bp, Homo sapiens
acccatcttcctgctg

SEQ ID NO: 2023724 - DNA, 20 bp, Homo sapiens
acccatgaagacaggacagt

SEQ ID NO: 2023725 - DNA, 23 bp, Homo sapiens
acccatgtaaatgtccaaaatgt

SEQ ID NO: 2023726 - DNA, 19 bp, Homo sapiens
acccattaggcatgcctaa

SEQ ID NO: 2023727 - DNA, 13 bp, Homo sapiens
acccattcctatt

SEQ ID NO: 2023728 - DNA, 21 bp, Homo sapiens
accccaaagagcctggagaag

SEQ ID NO: 2023729 - DNA, 15 bp, Homo sapiens
accccaaagcccctt

SEQ ID NO: 2023730 - DNA, 18 bp, Homo sapiens
accccaagcagcattcag

SEQ ID NO: 2023731 - DNA, 13 bp, Homo sapiens
accccaagggaca

SEQ ID NO: 2023732 - DNA, 21 bp, Homo sapiens
accccacccccttcagtgccc

SEQ ID NO: 2023733 - DNA, 22 bp, Homo sapiens
accccacccccttcagtgccca

SEQ ID NO: 2023734 - DNA, 16 bp, Homo sapiens
accccactccagccct

SEQ ID NO: 2023735 - DNA, 14 bp, Homo sapiens
accccagacactgg

SEQ ID NO: 2023736 - DNA, 12 bp, Homo sapiens
accccagagttg

SEQ ID NO: 2023737 - DNA, 15 bp, Homo sapiens
accccagctagggct

SEQ ID NO: 2023738 - DNA, 17 bp, Homo sapiens
accccagctccctagga

SEQ ID NO: 2023739 - DNA, 14 bp, Homo sapiens
accccagctggcct

SEQ ID NO: 2023740 - DNA, 23 bp, Homo sapiens
accccagctggcctctagaacac

SEQ ID NO: 2023741 - DNA, 23 bp, Homo sapiens
accccaggacgccactcatttca

SEQ ID NO: 2023742 - DNA, 16 bp, Homo sapiens
accccaggatcccaga

SEQ ID NO: 2023743 - DNA, 18 bp, Homo sapiens
accccaggcatcccatcc

SEQ ID NO: 2023744 - DNA, 15 bp, Homo sapiens
accccagggcacagg

SEQ ID NO: 2023745 - DNA, 16 bp, Homo sapiens
accccagggcacagga

SEQ ID NO: 2023746 - DNA, 13 bp, Homo sapiens
accccaggtttct

SEQ ID NO: 2023747 - DNA, 15 bp, Homo sapiens
accccagttctgctc

SEQ ID NO: 2023748 - DNA, 13 bp, Homo sapiens
acccttctcttct

SEQ ID NO: 2023749 - DNA, 13 bp, Homo sapiens
acccttctgggca

SEQ ID NO: 2023750 - DNA, 16 bp, Homo sapiens
acccttctttaaatca

SEQ ID NO: 2023751 - DNA, 17 bp, Homo sapiens
acccttctttaaatcaa

SEQ ID NO: 2023752 - DNA, 14 bp, Homo sapiens
acccttctttcctc

SEQ ID NO: 2023753 - DNA, 14 bp, Homo sapiens
acccttgcattaga

SEQ ID NO: 2023754 - DNA, 13 bp, Homo sapiens
acccttgctgctg

SEQ ID NO: 2023755 - DNA, 14 bp, Homo sapiens
acccttgctgctgc

SEQ ID NO: 2023756 - DNA, 13 bp, Homo sapiens
acccttggacttg

SEQ ID NO: 2023757 - DNA, 14 bp, Homo sapiens
acccttgtacccca

SEQ ID NO: 2023758 - DNA, 15 bp, Homo sapiens
acccttgtaccccat

SEQ ID NO: 2023759 - DNA, 19 bp, Homo sapiens
acccttgtaccccatccct

SEQ ID NO: 2023760 - DNA, 17 bp, Homo sapiens
acccttgtgcttggtgg

SEQ ID NO: 2023761 - DNA, 15 bp, Homo sapiens
accctttccttcctt

SEQ ID NO: 2023762 - DNA, 18 bp, Homo sapiens
accctttccttccttccc

SEQ ID NO: 2023763 - DNA, 19 bp, Homo sapiens
accctttccttccttccct

SEQ ID NO: 2023764 - DNA, 13 bp, Homo sapiens
acccttttaacat

SEQ ID NO: 2023765 - DNA, 15 bp, Homo sapiens
acccttttcctccag

SEQ ID NO: 2023766 - DNA, 18 bp, Homo sapiens
acccttttcctccagaca

SEQ ID NO: 2023767 - DNA, 18 bp, Homo sapiens
accgaattttattttaca

SEQ ID NO: 2023768 - DNA, 17 bp, Homo sapiens
accgagtctctgtataa

SEQ ID NO: 2023769 - DNA, 21 bp, Homo sapiens
accgagtctcttctccactgg

SEQ ID NO: 2023770 - DNA, 24 bp, Homo sapiens
accgagtctcttctccactggatg

SEQ ID NO: 2023771 - DNA, 12 bp, Homo sapiens
accgcagaagga

SEQ ID NO: 2023772 - DNA, 14 bp, Homo sapiens
accgcagcatgtgg

SEQ ID NO: 2023773 - DNA, 19 bp, Homo sapiens
accgcgcatctcttcctga

SEQ ID NO: 2023774 - DNA, 19 bp, Homo sapiens
accgcgtctaccctgggat

SEQ ID NO: 2023775 - DNA, 16 bp, Homo sapiens
accgctaaaagaaact

SEQ ID NO: 2023776 - DNA, 14 bp, Homo sapiens
accgctacaccact

SEQ ID NO: 2023777 - DNA, 20 bp, Homo sapiens
accgctacaccactctggca

SEQ ID NO: 2023778 - DNA, 20 bp, Homo sapiens
accgctgccttttgctgctg

SEQ ID NO: 2023779 - DNA, 22 bp, Homo sapiens
accgctgccttttgctgctgct

SEQ ID NO: 2023780 - DNA, 17 bp, Homo sapiens
accgcttcacccctgca

SEQ ID NO: 2023781 - DNA, 18 bp, Homo sapiens
accgcttcacccctgcac

SEQ ID NO: 2023782 - DNA, 20 bp, Homo sapiens
accgcttcacccctgcactt

SEQ ID NO: 2023783 - DNA, 12 bp, Homo sapiens
accggcagaaaa

SEQ ID NO: 2023784 - DNA, 17 bp, Homo sapiens
accggcatgctggcctg

SEQ ID NO: 2023785 - DNA, 19 bp, Homo sapiens
accgggacagacctggaca

SEQ ID NO: 2023786 - DNA, 12 bp, Homo sapiens
accgggcactca

SEQ ID NO: 2023787 - DNA, 20 bp, Homo sapiens
accgggcactcagaagacac

SEQ ID NO: 2023788 - DNA, 15 bp, Homo sapiens
accgggccacagaga

SEQ ID NO: 2023789 - DNA, 19 bp, Homo sapiens
accgggccacagagaaagt

SEQ ID NO: 2023790 - DNA, 12 bp, Homo sapiens
accgggccactc

SEQ ID NO: 2023791 - DNA, 21 bp, Homo sapiens
accgggccactccttcctgcc

SEQ ID NO: 2023792 - DNA, 13 bp, Homo sapiens
accgggctggggt

SEQ ID NO: 2023793 - DNA, 22 bp, Homo sapiens
accggggaacccagccctgggg

SEQ ID NO: 2023794 - DNA, 17 bp, Homo sapiens
accgggggccagacaca

SEQ ID NO: 2023795 - DNA, 18 bp, Homo sapiens
accgggggccagacacag

SEQ ID NO: 2023796 - DNA, 14 bp, Homo sapiens
accgggtgggcctg

SEQ ID NO: 2023797 - DNA, 17 bp, Homo sapiens
accgggtgggcctggcc

SEQ ID NO: 2023798 - DNA, 13 bp, Homo sapiens
accggtacagaaa

SEQ ID NO: 2023799 - DNA, 14 bp, Homo sapiens
accgtaattttatt

SEQ ID NO: 2023800 - DNA, 22 bp, Homo sapiens
accgtcatggcttaatgtttat

SEQ ID NO: 2023801 - DNA, 20 bp, Homo sapiens
accgtcttgggtcgccctac

SEQ ID NO: 2023802 - DNA, 20 bp, Homo sapiens
accgtgatttggaagagagg

SEQ ID NO: 2023803 - DNA, 16 bp, Homo sapiens
accgtggcccttcctg

SEQ ID NO: 2023804 - DNA, 17 bp, Homo sapiens
accgtgtccagcacaga

SEQ ID NO: 2023805 - DNA, 20 bp, Homo sapiens
accgtgtcccaaggagctga

SEQ ID NO: 2023806 - DNA, 20 bp, Homo sapiens
accgttttcatcctggcctc

SEQ ID NO: 2023807 - DNA, 14 bp, Homo sapiens
acctaaatgacctc

SEQ ID NO: 2023808 - DNA, 15 bp, Homo sapiens
acctaacccctttcc

SEQ ID NO: 2023809 - DNA, 17 bp, Homo sapiens
acctaacccctttcctg

SEQ ID NO: 2023810 - DNA, 19 bp, Homo sapiens
acctaacgccctatttttg

SEQ ID NO: 2023811 - DNA, 16 bp, Homo sapiens
acctaatcaggctgag

SEQ ID NO: 2023812 - DNA, 17 bp, Homo sapiens
acctaatcaggctgagg

SEQ ID NO: 2023813 - DNA, 14 bp, Homo sapiens
acctaccaaaaaat

SEQ ID NO: 2023814 - DNA, 18 bp, Homo sapiens
acctaccaccccttcctg

SEQ ID NO: 2023815 - DNA, 16 bp, Homo sapiens
acctaccaccttccct

SEQ ID NO: 2023816 - DNA, 17 bp, Homo sapiens
acctagaacttcaaaat

SEQ ID NO: 2023817 - DNA, 14 bp, Homo sapiens
acctagaagggcta

SEQ ID NO: 2023818 - DNA, 13 bp, Homo sapiens
acctagacctggg

SEQ ID NO: 2023819 - DNA, 17 bp, Homo sapiens
acctaggccactcctcc

SEQ ID NO: 2023820 - DNA, 16 bp, Homo sapiens
acctataatgtgtgta

SEQ ID NO: 2023821 - DNA, 17 bp, Homo sapiens
acctataatgtgtgtat

SEQ ID NO: 2023822 - DNA, 22 bp, Homo sapiens
acctataatgtgtgtatgtgta

SEQ ID NO: 2023823 - DNA, 22 bp, Homo sapiens
acctatagtcccagctactcag

SEQ ID NO: 2023824 - DNA, 20 bp, Homo sapiens
acctatcaatcctgccccca

SEQ ID NO: 2023825 - DNA, 12 bp, Homo sapiens
acctatgtcatt

SEQ ID NO: 2023826 - DNA, 19 bp, Homo sapiens
acctatgtcatttcatttc

SEQ ID NO: 2023827 - DNA, 22 bp, Homo sapiens
acctcaactaacccttaaaaat

SEQ ID NO: 2023828 - DNA, 19 bp, Homo sapiens
acctcaatgccctgccatt

SEQ ID NO: 2023829 - DNA, 15 bp, Homo sapiens
acctcacagtgaccc

SEQ ID NO: 2023830 - DNA, 21 bp, Homo sapiens
acctcacagtgacccttccca

SEQ ID NO: 2023831 - DNA, 21 bp, Homo sapiens
acctcaccggcatgctggcct

SEQ ID NO: 2023832 - DNA, 19 bp, Homo sapiens
acctcacctttgcaaagtt

SEQ ID NO: 2023833 - DNA, 20 bp, Homo sapiens
acctcactattcaagtatta

SEQ ID NO: 2023834 - DNA, 23 bp, Homo sapiens
acctcactggggtcctggggcct

SEQ ID NO: 2023835 - DNA, 16 bp, Homo sapiens
acctcagccaaacaca

SEQ ID NO: 2023836 - DNA, 14 bp, Homo sapiens
acctcagccatgag

SEQ ID NO: 2023837 - DNA, 13 bp, Homo sapiens
acctcagctgcac

SEQ ID NO: 2023838 - DNA, 22 bp, Homo sapiens
acctcagctgcacattcctggc

SEQ ID NO: 2023839 - DNA, 17 bp, Homo sapiens
acctcagtaatttagaa

SEQ ID NO: 2023840 - DNA, 21 bp, Homo sapiens
acctcagtttcctcatctgca

SEQ ID NO: 2023841 - DNA, 20 bp, Homo sapiens
acctcatgacagccagagcc

SEQ ID NO: 2023842 - DNA, 21 bp, Homo sapiens
acctcatgacagccagagcct

SEQ ID NO: 2023843 - DNA, 22 bp, Homo sapiens
acctcatgacagccagagcctg

SEQ ID NO: 2023844 - DNA, 23 bp, Homo sapiens
acctcatggtcatggacagatag

SEQ ID NO: 2023845 - DNA, 15 bp, Homo sapiens
acctcattcgcctgt

SEQ ID NO: 2023846 - DNA, 12 bp, Homo sapiens
acctccacccac

SEQ ID NO: 2023847 - DNA, 15 bp, Homo sapiens
acctccacctcctga

SEQ ID NO: 2023848 - DNA, 20 bp, Homo sapiens
acctcccaaggactttccag

SEQ ID NO: 2023849 - DNA, 19 bp, Homo sapiens
acctcccaccccactccag

SEQ ID NO: 2023850 - DNA, 13 bp, Homo sapiens
acctcccagccct

SEQ ID NO: 2023851 - DNA, 15 bp, Homo sapiens
acctcccagccctat

SEQ ID NO: 2023852 - DNA, 20 bp, Homo sapiens
acctcccagccctatggatg

SEQ ID NO: 2023853 - DNA, 21 bp, Homo sapiens
acctcccaggggctccacctg

SEQ ID NO: 2023854 - DNA, 22 bp, Homo sapiens
acctccccacccccgctggggg

SEQ ID NO: 2023855 - DNA, 14 bp, Homo sapiens
acctccccccactg

SEQ ID NO: 2023856 - DNA, 17 bp, Homo sapiens
acctccccccactgcag

SEQ ID NO: 2023857 - DNA, 20 bp, Homo sapiens
acctccccggcctctctctt

SEQ ID NO: 2023858 - DNA, 14 bp, Homo sapiens
acctcccctatcca

SEQ ID NO: 2023859 - DNA, 21 bp, Homo sapiens
acctcccctatccacccagcc

SEQ ID NO: 2023860 - DNA, 23 bp, Homo sapiens
acctcccctatccacccagccca

SEQ ID NO: 2023861 - DNA, 11 bp, Homo sapiens
acctccctact

SEQ ID NO: 2023862 - DNA, 17 bp, Homo sapiens
acctccgccccagacac

SEQ ID NO: 2023863 - DNA, 18 bp, Homo sapiens
acctccgccccagacaca

SEQ ID NO: 2023864 - DNA, 23 bp, Homo sapiens
acctcctacgtcaaacatgaagt

SEQ ID NO: 2023865 - DNA, 19 bp, Homo sapiens
actcagtttgtcagacttt

SEQ ID NO: 2023866 - DNA, 13 bp, Homo sapiens
actcagttttctt

SEQ ID NO: 2023867 - DNA, 20 bp, Homo sapiens
actcataagttggaccagag

SEQ ID NO: 2023868 - DNA, 23 bp, Homo sapiens
actcataagttggaccagaggaa

SEQ ID NO: 2023869 - DNA, 12 bp, Homo sapiens
actcatcataaa

SEQ ID NO: 2023870 - DNA, 15 bp, Homo sapiens
actcatcataaaata

SEQ ID NO: 2023871 - DNA, 20 bp, Homo sapiens
actcatctgttatcctgcta

SEQ ID NO: 2023872 - DNA, 23 bp, Homo sapiens
actcatctgttatcctgctagct

SEQ ID NO: 2023873 - DNA, 14 bp, Homo sapiens
actcatgtacattg

SEQ ID NO: 2023874 - DNA, 19 bp, Homo sapiens
actcatgttgttcccacac

SEQ ID NO: 2023875 - DNA, 13 bp, Homo sapiens
actcatttcatct

SEQ ID NO: 2023876 - DNA, 21 bp, Homo sapiens
actcatttctaaaagaatatt

SEQ ID NO: 2023877 - DNA, 20 bp, Homo sapiens
actcattttaaaaaatggaa

SEQ ID NO: 2023878 - DNA, 20 bp, Homo sapiens
actcatttttcatgataatg

SEQ ID NO: 2023879 - DNA, 21 bp, Homo sapiens
actccaaagaaatgtaaggga

SEQ ID NO: 2023880 - DNA, 19 bp, Homo sapiens
actccaagcttcaagtgat

SEQ ID NO: 2023881 - DNA, 23 bp, Homo sapiens
actccacagcggaggagaccagc

SEQ ID NO: 2023882 - DNA, 13 bp, Homo sapiens
actccaccaccca

SEQ ID NO: 2023883 - DNA, 14 bp, Homo sapiens
actccaccacccaa

SEQ ID NO: 2023884 - DNA, 14 bp, Homo sapiens
actccactctcctt

SEQ ID NO: 2023885 - DNA, 16 bp, Homo sapiens
actccagaatctgctg

SEQ ID NO: 2023886 - DNA, 17 bp, Homo sapiens
actccagaatctgctgt

SEQ ID NO: 2023887 - DNA, 18 bp, Homo sapiens
actccagacccctggctt

SEQ ID NO: 2023888 - DNA, 11 bp, Homo sapiens
actccagagaa

SEQ ID NO: 2023889 - DNA, 9 bp, Homo sapiens
actccagcc

SEQ ID NO: 2023890 - DNA, 15 bp, Homo sapiens
actccagccagcgcc

SEQ ID NO: 2023891 - DNA, 15 bp, Homo sapiens
actccagcctgagca

SEQ ID NO: 2023892 - DNA, 18 bp, Homo sapiens
actccagcctgggcaaca

SEQ ID NO: 2023893 - DNA, 23 bp, Homo sapiens
actccagcctgggcaacagagca

SEQ ID NO: 2023894 - DNA, 11 bp, Homo sapiens
actccagctcc

SEQ ID NO: 2023895 - DNA, 18 bp, Homo sapiens
actccagtgagctggaat

SEQ ID NO: 2023896 - DNA, 21 bp, Homo sapiens
actccatacataacttgatat

SEQ ID NO: 2023897 - DNA, 15 bp, Homo sapiens
actccatggccaccc

SEQ ID NO: 2023898 - DNA, 22 bp, Homo sapiens
actccatggccaccccgtgcca

SEQ ID NO: 2023899 - DNA, 20 bp, Homo sapiens
actccatgtgtgctgtcctc

SEQ ID NO: 2023900 - DNA, 18 bp, Homo sapiens
actccattcccaactaga

SEQ ID NO: 2023901 - DNA, 20 bp, Homo sapiens
actcccagaccacctccctg

SEQ ID NO: 2023902 - DNA, 19 bp, Homo sapiens
actccccaggccaggccac

SEQ ID NO: 2023903 - DNA, 16 bp, Homo sapiens
actccccgcctgtcct

SEQ ID NO: 2023904 - DNA, 19 bp, Homo sapiens
actccctaagaaaccccag

SEQ ID NO: 2023905 - DNA, 14 bp, Homo sapiens
actccctccatgtg

SEQ ID NO: 2023906 - DNA, 13 bp, Homo sapiens
actccctccctgg

SEQ ID NO: 2023907 - DNA, 17 bp, Homo sapiens
actccctggctctcaga

SEQ ID NO: 2023908 - DNA, 19 bp, Homo sapiens
actcccttaggcattattt

SEQ ID NO: 2023909 - DNA, 23 bp, Homo sapiens
actcccttaggcattatttaatg

SEQ ID NO: 2023910 - DNA, 11 bp, Homo sapiens
actcccttcct

SEQ ID NO: 2023911 - DNA, 15 bp, Homo sapiens
actcccttcctggcc

SEQ ID NO: 2023912 - DNA, 18 bp, Homo sapiens
actccggaatgaccagca

SEQ ID NO: 2023913 - DNA, 18 bp, Homo sapiens
actccgggaccattgacc

SEQ ID NO: 2023914 - DNA, 20 bp, Homo sapiens
actccgggaccattgacctc

SEQ ID NO: 2023915 - DNA, 19 bp, Homo sapiens
actccggtgtgcctgcagc

SEQ ID NO: 2023916 - DNA, 17 bp, Homo sapiens
actcctacctcagccta

SEQ ID NO: 2023917 - DNA, 21 bp, Homo sapiens
actcctcaaaagcaaatgaga

SEQ ID NO: 2023918 - DNA, 19 bp, Homo sapiens
actcctcactgccccacca

SEQ ID NO: 2023919 - DNA, 20 bp, Homo sapiens
actcctcactgccccaccag

SEQ ID NO: 2023920 - DNA, 13 bp, Homo sapiens
actcctctgtcca

SEQ ID NO: 2023921 - DNA, 14 bp, Homo sapiens
actcctctgtccag

SEQ ID NO: 2023922 - DNA, 23 bp, Homo sapiens
actcctctgtctctgctcttgcc

SEQ ID NO: 2023923 - DNA, 13 bp, Homo sapiens
actcctgcaaaat

SEQ ID NO: 2023924 - DNA, 12 bp, Homo sapiens
actcctgcctgt

SEQ ID NO: 2023925 - DNA, 17 bp, Homo sapiens
actcctgcctgtgtttg

SEQ ID NO: 2023926 - DNA, 21 bp, Homo sapiens
actcctgtctgtcctggaggt

SEQ ID NO: 2023927 - DNA, 20 bp, Homo sapiens
actcctgtgggagcctcgca

SEQ ID NO: 2023928 - DNA, 16 bp, Homo sapiens
actcctgttacttacc

SEQ ID NO: 2023929 - DNA, 20 bp, Homo sapiens
actcctgttacttacctaaa

SEQ ID NO: 2023930 - DNA, 12 bp, Homo sapiens
actccttagaga

SEQ ID NO: 2023931 - DNA, 12 bp, Homo sapiens
actccttcctgc

SEQ ID NO: 2023932 - DNA, 23 bp, Homo sapiens
actccttgattttagccttctct

SEQ ID NO: 2023933 - DNA, 14 bp, Homo sapiens
actcctttcctctg

SEQ ID NO: 2023934 - DNA, 15 bp, Homo sapiens
actcctttcctctga

SEQ ID NO: 2023935 - DNA, 20 bp, Homo sapiens
actcctttgcattccatgat

SEQ ID NO: 2023936 - DNA, 18 bp, Homo sapiens
actcgaagcccttccagt

SEQ ID NO: 2023937 - DNA, 20 bp, Homo sapiens
actcgaagcccttccagtgg

SEQ ID NO: 2023938 - DNA, 22 bp, Homo sapiens
actcgaagcccttccagtggta

SEQ ID NO: 2023939 - DNA, 13 bp, Homo sapiens
actcgcagtcgca

SEQ ID NO: 2023940 - DNA, 22 bp, Homo sapiens
actcggcctcccaaagtgctgg

SEQ ID NO: 2023941 - DNA, 22 bp, Homo sapiens
actcgggaggctgagacaggag

SEQ ID NO: 2023942 - DNA, 17 bp, Homo sapiens
actctaaatatttcatg

SEQ ID NO: 2023943 - DNA, 17 bp, Homo sapiens
actctaaattctttatt

SEQ ID NO: 2023944 - DNA, 23 bp, Homo sapiens
actctaaattctttatttctgtc

SEQ ID NO: 2023945 - DNA, 21 bp, Homo sapiens
actctaattcccattttgcaa

SEQ ID NO: 2023946 - DNA, 13 bp, Homo sapiens
actctacaaagag

SEQ ID NO: 2023947 - DNA, 23 bp, Homo sapiens
actctaccctggtaggaaagcac

SEQ ID NO: 2023948 - DNA, 21 bp, Homo sapiens
actctacctgcaagatttcac

SEQ ID NO: 2023949 - DNA, 20 bp, Homo sapiens
actctacttagcatgtccct

SEQ ID NO: 2023950 - DNA, 17 bp, Homo sapiens
actctagaacatgcaca

SEQ ID NO: 2023951 - DNA, 20 bp, Homo sapiens
actctagaacatgcacattt

SEQ ID NO: 2023952 - DNA, 17 bp, Homo sapiens
actctagcctgggccag

SEQ ID NO: 2023953 - DNA, 16 bp, Homo sapiens
actctagtgacttcct

SEQ ID NO: 2023954 - DNA, 15 bp, Homo sapiens
actctatagactcta

SEQ ID NO: 2023955 - DNA, 18 bp, Homo sapiens
actctatagactctagga

SEQ ID NO: 2023956 - DNA, 17 bp, Homo sapiens
actctatgccccaaata

SEQ ID NO: 2023957 - DNA, 13 bp, Homo sapiens
actctcaggaggc

SEQ ID NO: 2023958 - DNA, 14 bp, Homo sapiens
actctcattcccca

SEQ ID NO: 2023959 - DNA, 16 bp, Homo sapiens
actctcattccccagg

SEQ ID NO: 2023960 - DNA, 13 bp, Homo sapiens
actctccatctta

SEQ ID NO: 2023961 - DNA, 15 bp, Homo sapiens
actctccccctttca

SEQ ID NO: 2023962 - DNA, 20 bp, Homo sapiens
actctcccctccctcttcct

SEQ ID NO: 2023963 - DNA, 22 bp, Homo sapiens
actctcccctccctcttccttc

SEQ ID NO: 2023964 - DNA, 18 bp, Homo sapiens
actctccttcgtgtctct

SEQ ID NO: 2023965 - DNA, 13 bp, Homo sapiens
actctctccaccc

SEQ ID NO: 2023966 - DNA, 13 bp, Homo sapiens
actctctgctcta

SEQ ID NO: 2023967 - DNA, 14 bp, Homo sapiens
actctctgctctag

SEQ ID NO: 2023968 - DNA, 15 bp, Homo sapiens
actctctgctctagc

SEQ ID NO: 2023969 - DNA, 24 bp, Homo sapiens
actctctgctctagccaggagtct

SEQ ID NO: 2023970 - DNA, 21 bp, Homo sapiens
actctctgtacaaaaacaaaa

SEQ ID NO: 2023971 - DNA, 22 bp, Homo sapiens
actctctgtacaaaaacaaaac

SEQ ID NO: 2023972 - DNA, 13 bp, Homo sapiens
actctgaaaaaca

SEQ ID NO: 2023973 - DNA, 14 bp, Homo sapiens
actctgacaagggc

SEQ ID NO: 2023974 - DNA, 15 bp, Homo sapiens
actctgagcccaggc

SEQ ID NO: 2023975 - DNA, 21 bp, Homo sapiens
actctgcacatgtcttgtaca

SEQ ID NO: 2023976 - DNA, 11 bp, Homo sapiens
actctgcactc

SEQ ID NO: 2023977 - DNA, 18 bp, Homo sapiens
actctggaagccccccac

SEQ ID NO: 2023978 - DNA, 11 bp, Homo sapiens
actctggaagt

SEQ ID NO: 2023979 - DNA, 15 bp, Homo sapiens
actctggcagccaca

SEQ ID NO: 2023980 - DNA, 16 bp, Homo sapiens
actctggcagccacac

SEQ ID NO: 2023981 - DNA, 13 bp, Homo sapiens
actctgggaaata

SEQ ID NO: 2023982 - DNA, 13 bp, Homo sapiens
acggcttcaggcc

SEQ ID NO: 2023983 - DNA, 16 bp, Homo sapiens
acgggagcctcctctg

SEQ ID NO: 2023984 - DNA, 16 bp, Homo sapiens
acgggaggcctcagtt

SEQ ID NO: 2023985 - DNA, 14 bp, Homo sapiens
acgggcctcagttt

SEQ ID NO: 2023986 - DNA, 15 bp, Homo sapiens
acgggcctcagtttc

SEQ ID NO: 2023987 - DNA, 12 bp, Homo sapiens
acggggagaaaa

SEQ ID NO: 2023988 - DNA, 18 bp, Homo sapiens
acgggggtgcggcaggag

SEQ ID NO: 2023989 - DNA, 21 bp, Homo sapiens
acgggggtgcggcaggagcag

SEQ ID NO: 2023990 - DNA, 14 bp, Homo sapiens
acggggtccttcaa

SEQ ID NO: 2023991 - DNA, 15 bp, Homo sapiens
acggggtttcaccat

SEQ ID NO: 2023992 - DNA, 21 bp, Homo sapiens
acggtcccacactggtgactg

SEQ ID NO: 2023993 - DNA, 20 bp, Homo sapiens
acggtcctttaggcagcctg

SEQ ID NO: 2023994 - DNA, 14 bp, Homo sapiens
acggtgttgcagag

SEQ ID NO: 2023995 - DNA, 18 bp, Homo sapiens
acggttaacttgtatatt

SEQ ID NO: 2023996 - DNA, 23 bp, Homo sapiens
acgtaatgtatttatatgttaat

SEQ ID NO: 2023997 - DNA, 14 bp, Homo sapiens
acgtataaatatga

SEQ ID NO: 2023998 - DNA, 14 bp, Homo sapiens
acgtatcatttcta

SEQ ID NO: 2023999 - DNA, 13 bp, Homo sapiens
acgtatttaatag

SEQ ID NO: 2024000 - DNA, 17 bp, Homo sapiens
acgtatttatatttgga

SEQ ID NO: 2024001 - DNA, 21 bp, Homo sapiens
acgtatttatatttggaaaga

SEQ ID NO: 2024002 - DNA, 17 bp, Homo sapiens
acgtcaaacatgaagtg

SEQ ID NO: 2024003 - DNA, 17 bp, Homo sapiens
acgtcaagtctccttcc

SEQ ID NO: 2024004 - DNA, 21 bp, Homo sapiens
acgtcatcggaggctgggccc

SEQ ID NO: 2024005 - DNA, 18 bp, Homo sapiens
acgtccagaatttttcat

SEQ ID NO: 2024006 - DNA, 13 bp, Homo sapiens
acgtccccctggg

SEQ ID NO: 2024007 - DNA, 20 bp, Homo sapiens
acgtcctgctggcacctcag

SEQ ID NO: 2024008 - DNA, 23 bp, Homo sapiens
acgtcctgctggcacctcagaca

SEQ ID NO: 2024009 - DNA, 13 bp, Homo sapiens
acgtcctggaatg

SEQ ID NO: 2024010 - DNA, 17 bp, Homo sapiens
acgtctcaagactgaaa

SEQ ID NO: 2024011 - DNA, 13 bp, Homo sapiens
acgtctgacaggc

SEQ ID NO: 2024012 - DNA, 15 bp, Homo sapiens
acgtctgacaggcaa

SEQ ID NO: 2024013 - DNA, 16 bp, Homo sapiens
acgtctgccaggccca

SEQ ID NO: 2024014 - DNA, 23 bp, Homo sapiens
acgtcttgctatttgagcatgca

SEQ ID NO: 2024015 - DNA, 13 bp, Homo sapiens
acgtgaaatattt

SEQ ID NO: 2024016 - DNA, 15 bp, Homo sapiens
acgtgaatgtctcag

SEQ ID NO: 2024017 - DNA, 18 bp, Homo sapiens
acgtgatggtctgagact

SEQ ID NO: 2024018 - DNA, 21 bp, Homo sapiens
acgtgcacctgtactcaggag

SEQ ID NO: 2024019 - DNA, 23 bp, Homo sapiens
acgtgcacctgtactcaggaggc

SEQ ID NO: 2024020 - DNA, 14 bp, Homo sapiens
acgtgccaggcccg

SEQ ID NO: 2024021 - DNA, 23 bp, Homo sapiens
acgtgcctgtgatcccagctact

SEQ ID NO: 2024022 - DNA, 19 bp, Homo sapiens
acgtgctcgcagcctggcg

SEQ ID NO: 2024023 - DNA, 22 bp, Homo sapiens
acgtgctcttctgttctcaaat

SEQ ID NO: 2024024 - DNA, 15 bp, Homo sapiens
acgtggggagggtgg

SEQ ID NO: 2024025 - DNA, 17 bp, Homo sapiens
acgtggggagggtggag

SEQ ID NO: 2024026 - DNA, 15 bp, Homo sapiens
acgtgtgcagactgt

SEQ ID NO: 2024027 - DNA, 12 bp, Homo sapiens
acgttaaaagac

SEQ ID NO: 2024028 - DNA, 16 bp, Homo sapiens
acgttaaaagacagtg

SEQ ID NO: 2024029 - DNA, 21 bp, Homo sapiens
acgttaagggaaggaactctg

SEQ ID NO: 2024030 - DNA, 21 bp, Homo sapiens
acgttccttactgcagaatag

SEQ ID NO: 2024031 - DNA, 23 bp, Homo sapiens
acgttcgaggcggtttccaggaa

SEQ ID NO: 2024032 - DNA, 21 bp, Homo sapiens
acgttctatataaggaggaaa

SEQ ID NO: 2024033 - DNA, 18 bp, Homo sapiens
acgttctatattgtgcca

SEQ ID NO: 2024034 - DNA, 14 bp, Homo sapiens
acgttctccagccc

SEQ ID NO: 2024035 - DNA, 22 bp, Homo sapiens
acgttctccagcccacacccct

SEQ ID NO: 2024036 - DNA, 17 bp, Homo sapiens
acgttgacccctttccc

SEQ ID NO: 2024037 - DNA, 14 bp, Homo sapiens
acgtttgtgagaag

SEQ ID NO: 2024038 - DNA, 14 bp, Homo sapiens
actaaaagaatttg

SEQ ID NO: 2024039 - DNA, 20 bp, Homo sapiens
actaaaagttcttctccaat

SEQ ID NO: 2024040 - DNA, 21 bp, Homo sapiens
actaaagatatcagagctctt

SEQ ID NO: 2024041 - DNA, 22 bp, Homo sapiens
actaaagatatcagagctctta

SEQ ID NO: 2024042 - DNA, 11 bp, Homo sapiens
actaaagcagt

SEQ ID NO: 2024043 - DNA, 20 bp, Homo sapiens
actaaagcagtggacaccag

SEQ ID NO: 2024044 - DNA, 15 bp, Homo sapiens
actaaagcagtgttt

SEQ ID NO: 2024045 - DNA, 16 bp, Homo sapiens
actaaatatatgtctg

SEQ ID NO: 2024046 - DNA, 18 bp, Homo sapiens
actaaatatatgtctgtg

SEQ ID NO: 2024047 - DNA, 21 bp, Homo sapiens
actaaatatatgtctgtgtgt

SEQ ID NO: 2024048 - DNA, 13 bp, Homo sapiens
actaaatctttta

SEQ ID NO: 2024049 - DNA, 15 bp, Homo sapiens
actaaatgagctcct

SEQ ID NO: 2024050 - DNA, 19 bp, Homo sapiens
actaacactcagaagcctg

SEQ ID NO: 2024051 - DNA, 20 bp, Homo sapiens
actaacataaaatctgtgaa

SEQ ID NO: 2024052 - DNA, 13 bp, Homo sapiens
actaaccacgctg

SEQ ID NO: 2024053 - DNA, 17 bp, Homo sapiens
actaactatcaaataga

SEQ ID NO: 2024054 - DNA, 18 bp, Homo sapiens
actaagccacaagaaatt

SEQ ID NO: 2024055 - DNA, 21 bp, Homo sapiens
actaagccctcgaaccaaggc

SEQ ID NO: 2024056 - DNA, 16 bp, Homo sapiens
actaagccctgtcgag

SEQ ID NO: 2024057 - DNA, 18 bp, Homo sapiens
actaagccctgtcgagac

SEQ ID NO: 2024058 - DNA, 16 bp, Homo sapiens
actaagctttctcctt

SEQ ID NO: 2024059 - DNA, 18 bp, Homo sapiens
actaagttatagtatatc

SEQ ID NO: 2024060 - DNA, 22 bp, Homo sapiens
actaataaaagcataaatgcaa

SEQ ID NO: 2024061 - DNA, 19 bp, Homo sapiens
actaatagagacacagaga

SEQ ID NO: 2024062 - DNA, 19 bp, Homo sapiens
actaatctgggaagggaag

SEQ ID NO: 2024063 - DNA, 15 bp, Homo sapiens
actaattaaaatctg

SEQ ID NO: 2024064 - DNA, 18 bp, Homo sapiens
actaattaaaatctggaa

SEQ ID NO: 2024065 - DNA, 19 bp, Homo sapiens
actaattaaaatctggaaa

SEQ ID NO: 2024066 - DNA, 20 bp, Homo sapiens
actaattaaaatctggaaat

SEQ ID NO: 2024067 - DNA, 14 bp, Homo sapiens
actaatttaaacca

SEQ ID NO: 2024068 - DNA, 17 bp, Homo sapiens
actaatttaaaccagca

SEQ ID NO: 2024069 - DNA, 18 bp, Homo sapiens
actaatttaaaccagcag

SEQ ID NO: 2024070 - DNA, 18 bp, Homo sapiens
actacaaaatttgaaatt

SEQ ID NO: 2024071 - DNA, 23 bp, Homo sapiens
actacaaagcttctatcccagga

SEQ ID NO: 2024072 - DNA, 14 bp, Homo sapiens
actacaaattatca

SEQ ID NO: 2024073 - DNA, 17 bp, Homo sapiens
actacactccagcctga

SEQ ID NO: 2024074 - DNA, 18 bp, Homo sapiens
actacactccagcctgag

SEQ ID NO: 2024075 - DNA, 20 bp, Homo sapiens
actacactccagcctgagca

SEQ ID NO: 2024076 - DNA, 20 bp, Homo sapiens
actacagaataatgtgttaa

SEQ ID NO: 2024077 - DNA, 15 bp, Homo sapiens
actacaggcacccac

SEQ ID NO: 2024078 - DNA, 22 bp, Homo sapiens
actacagggtgaggtgcttgcc

SEQ ID NO: 2024079 - DNA, 23 bp, Homo sapiens
actacaggtgtgagtcaccaagc

SEQ ID NO: 2024080 - DNA, 22 bp, Homo sapiens
actacagtgacaaattgtaact

SEQ ID NO: 2024081 - DNA, 12 bp, Homo sapiens
actacatgcact

SEQ ID NO: 2024082 - DNA, 18 bp, Homo sapiens
actacatgtggtttatag

SEQ ID NO: 2024083 - DNA, 20 bp, Homo sapiens
actacccgagcccagctaca

SEQ ID NO: 2024084 - DNA, 13 bp, Homo sapiens
actaccctccaga

SEQ ID NO: 2024085 - DNA, 14 bp, Homo sapiens
actaccctccagag

SEQ ID NO: 2024086 - DNA, 15 bp, Homo sapiens
actacgttaagggaa

SEQ ID NO: 2024087 - DNA, 13 bp, Homo sapiens
actactaaagtgc

SEQ ID NO: 2024088 - DNA, 19 bp, Homo sapiens
actactagatgtctttagg

SEQ ID NO: 2024089 - DNA, 18 bp, Homo sapiens
actactgctgcaaagtgc

SEQ ID NO: 2024090 - DNA, 19 bp, Homo sapiens
actactgctgcaaagtgca

SEQ ID NO: 2024091 - DNA, 21 bp, Homo sapiens
actactgctgcaaagtgcaaa

SEQ ID NO: 2024092 - DNA, 15 bp, Homo sapiens
actactgtaaatgta

SEQ ID NO: 2024093 - DNA, 14 bp, Homo sapiens
actactgtaattaa

SEQ ID NO: 2024094 - DNA, 18 bp, Homo sapiens
actactgtggaaaaatat

SEQ ID NO: 2024095 - DNA, 21 bp, Homo sapiens
actactgtggaaaaatattta

SEQ ID NO: 2024096 - DNA, 16 bp, Homo sapiens
actacttgttaccttt

SEQ ID NO: 2024097 - DNA, 17 bp, Homo sapiens
actactttgtgttttca

SEQ ID NO: 2024098 - DNA, 23 bp, Homo sapiens
acctcctagaggtgggcagctgg

SEQ ID NO: 2024099 - DNA, 21 bp, Homo sapiens
acctcctagcaagacctgttg

SEQ ID NO: 2024100 - DNA, 14 bp, Homo sapiens
acctcctattttaa

SEQ ID NO: 2024101 - DNA, 12 bp, Homo sapiens
acctcctccact

SEQ ID NO: 2024102 - DNA, 18 bp, Homo sapiens
acctcctccactcactcc

SEQ ID NO: 2024103 - DNA, 15 bp, Homo sapiens
acctcctcctgccct

SEQ ID NO: 2024104 - DNA, 14 bp, Homo sapiens
acctcctgcccagg

SEQ ID NO: 2024105 - DNA, 20 bp, Homo sapiens
acctcctgcccaggagagcc

SEQ ID NO: 2024106 - DNA, 21 bp, Homo sapiens
acctcctgcccaggagagcca

SEQ ID NO: 2024107 - DNA, 12 bp, Homo sapiens
acctcctgcctc

SEQ ID NO: 2024108 - DNA, 23 bp, Homo sapiens
acctcctgcctcgaactggctgc

SEQ ID NO: 2024109 - DNA, 21 bp, Homo sapiens
acctccttcctcagtcctgga

SEQ ID NO: 2024110 - DNA, 22 bp, Homo sapiens
acctccttcctcagtcctggaa

SEQ ID NO: 2024111 - DNA, 14 bp, Homo sapiens
acctcgtcctcccc

SEQ ID NO: 2024112 - DNA, 15 bp, Homo sapiens
acctcgtcctccccc

SEQ ID NO: 2024113 - DNA, 21 bp, Homo sapiens
acctctagtgctactgctaga

SEQ ID NO: 2024114 - DNA, 20 bp, Homo sapiens
acctctatatgttgctgaaa

SEQ ID NO: 2024115 - DNA, 22 bp, Homo sapiens
acctctatatgttgctgaaaca

SEQ ID NO: 2024116 - DNA, 19 bp, Homo sapiens
acctctcaatattcaataa

SEQ ID NO: 2024117 - DNA, 21 bp, Homo sapiens
acctctcaatattcaataaag

SEQ ID NO: 2024118 - DNA, 21 bp, Homo sapiens
acctctcccctggaactgtct

SEQ ID NO: 2024119 - DNA, 12 bp, Homo sapiens
acctctctcctt

SEQ ID NO: 2024120 - DNA, 15 bp, Homo sapiens
acctctctccttctg

SEQ ID NO: 2024121 - DNA, 22 bp, Homo sapiens
acctctcttatagaatatttat

SEQ ID NO: 2024122 - DNA, 14 bp, Homo sapiens
acctctcttcagcc

SEQ ID NO: 2024123 - DNA, 19 bp, Homo sapiens
acctctgaaggcaaatata

SEQ ID NO: 2024124 - DNA, 14 bp, Homo sapiens
acctctgcctcaat

SEQ ID NO: 2024125 - DNA, 12 bp, Homo sapiens
acctctgcctga

SEQ ID NO: 2024126 - DNA, 23 bp, Homo sapiens
acctctgctctgaggcttccaga

SEQ ID NO: 2024127 - DNA, 11 bp, Homo sapiens
acctctgtgtg

SEQ ID NO: 2024128 - DNA, 13 bp, Homo sapiens
acctcttccttcc

SEQ ID NO: 2024129 - DNA, 14 bp, Homo sapiens
acctcttctatgca

SEQ ID NO: 2024130 - DNA, 21 bp, Homo sapiens
acctcttctcttcctgtaaca

SEQ ID NO: 2024131 - DNA, 13 bp, Homo sapiens
acctcttctgcca

SEQ ID NO: 2024132 - DNA, 14 bp, Homo sapiens
acctcttctgccag

SEQ ID NO: 2024133 - DNA, 22 bp, Homo sapiens
acctcttgggcatgctcagccc

SEQ ID NO: 2024134 - DNA, 23 bp, Homo sapiens
acctcttgggcatgctcagccct

SEQ ID NO: 2024135 - DNA, 19 bp, Homo sapiens
acctctttattttttgatt

SEQ ID NO: 2024136 - DNA, 21 bp, Homo sapiens
acctgaaaaaaagtttacaag

SEQ ID NO: 2024137 - DNA, 13 bp, Homo sapiens
acctgaacctggg

SEQ ID NO: 2024138 - DNA, 18 bp, Homo sapiens
acctgaagactcattctt

SEQ ID NO: 2024139 - DNA, 19 bp, Homo sapiens
acctgaagggtgacatccc

SEQ ID NO: 2024140 - DNA, 17 bp, Homo sapiens
acctgacaatggcagct

SEQ ID NO: 2024141 - DNA, 22 bp, Homo sapiens
acctgacaatggcagctagact

SEQ ID NO: 2024142 - DNA, 16 bp, Homo sapiens
acctgacacaagagga

SEQ ID NO: 2024143 - DNA, 15 bp, Homo sapiens
acctgacacatcttg

SEQ ID NO: 2024144 - DNA, 22 bp, Homo sapiens
acctgacagatgtcagccgagc

SEQ ID NO: 2024145 - DNA, 17 bp, Homo sapiens
acctgaccaacatggag

SEQ ID NO: 2024146 - DNA, 15 bp, Homo sapiens
acctgaccagaatgc

SEQ ID NO: 2024147 - DNA, 15 bp, Homo sapiens
acctgaccggcacct

SEQ ID NO: 2024148 - DNA, 16 bp, Homo sapiens
acctgaccggcacctg

SEQ ID NO: 2024149 - DNA, 10 bp, Homo sapiens
acctgagcct

SEQ ID NO: 2024150 - DNA, 12 bp, Homo sapiens
acctgagcctgc

SEQ ID NO: 2024151 - DNA, 23 bp, Homo sapiens
acctgaggatgcaacaaatattt

SEQ ID NO: 2024152 - DNA, 15 bp, Homo sapiens
acctgaggcagatga

SEQ ID NO: 2024153 - DNA, 15 bp, Homo sapiens
acctgaggcctgaag

SEQ ID NO: 2024154 - DNA, 16 bp, Homo sapiens
acctgaggctcctgtg

SEQ ID NO: 2024155 - DNA, 22 bp, Homo sapiens
acctgagtcaccctacctgtgc

SEQ ID NO: 2024156 - DNA, 22 bp, Homo sapiens
acctgagtcggccccacatggg

SEQ ID NO: 2024157 - DNA, 14 bp, Homo sapiens
acctgatcacctct

SEQ ID NO: 2024158 - DNA, 21 bp, Homo sapiens
acctgatgttaaaattccatc

SEQ ID NO: 2024159 - DNA, 13 bp, Homo sapiens
acctgcaaaaaat

SEQ ID NO: 2024160 - DNA, 14 bp, Homo sapiens
acctgcaagcccca

SEQ ID NO: 2024161 - DNA, 22 bp, Homo sapiens
acctgcaagccccagggcctgg

SEQ ID NO: 2024162 - DNA, 22 bp, Homo sapiens
acctgcaagtgcccgccctgcc

SEQ ID NO: 2024163 - DNA, 18 bp, Homo sapiens
acctgcacctccccccac

SEQ ID NO: 2024164 - DNA, 20 bp, Homo sapiens
acctgcacgtgatctgctgg

SEQ ID NO: 2024165 - DNA, 15 bp, Homo sapiens
acctgcaggccaaga

SEQ ID NO: 2024166 - DNA, 19 bp, Homo sapiens
acctgcatccgtagttccc

SEQ ID NO: 2024167 - DNA, 15 bp, Homo sapiens
acctgccaccgccag

SEQ ID NO: 2024168 - DNA, 15 bp, Homo sapiens
acctgccacttccag

SEQ ID NO: 2024169 - DNA, 13 bp, Homo sapiens
acctgccagccat

SEQ ID NO: 2024170 - DNA, 17 bp, Homo sapiens
acctgccagccatcaca

SEQ ID NO: 2024171 - DNA, 15 bp, Homo sapiens
acctgccccagcgcg

SEQ ID NO: 2024172 - DNA, 19 bp, Homo sapiens
acctgccccagcgcggctt

SEQ ID NO: 2024173 - DNA, 16 bp, Homo sapiens
acctgccccgcccagc

SEQ ID NO: 2024174 - DNA, 14 bp, Homo sapiens
acctgcccctcccc

SEQ ID NO: 2024175 - DNA, 12 bp, Homo sapiens
acctgccctctc

SEQ ID NO: 2024176 - DNA, 23 bp, Homo sapiens
acctgccctgccctgccacctgt

SEQ ID NO: 2024177 - DNA, 19 bp, Homo sapiens
acctgcctatccatcctgc

SEQ ID NO: 2024178 - DNA, 21 bp, Homo sapiens
acctgcctatccatcctgcga

SEQ ID NO: 2024179 - DNA, 19 bp, Homo sapiens
acctgcctctcacacacat

SEQ ID NO: 2024180 - DNA, 20 bp, Homo sapiens
acctgcgagaggtccctgct

SEQ ID NO: 2024181 - DNA, 12 bp, Homo sapiens
acctgctctcct

SEQ ID NO: 2024182 - DNA, 17 bp, Homo sapiens
acctgctgagctctgag

SEQ ID NO: 2024183 - DNA, 19 bp, Homo sapiens
acctgcttcatgctcagcc

SEQ ID NO: 2024184 - DNA, 21 bp, Homo sapiens
acctgcttcatgctcagccct

SEQ ID NO: 2024185 - DNA, 18 bp, Homo sapiens
acctgcttctgaactcaa

SEQ ID NO: 2024186 - DNA, 22 bp, Homo sapiens
acctggagagccagaacctgga

SEQ ID NO: 2024187 - DNA, 23 bp, Homo sapiens
acctggagagccagaacctggag

SEQ ID NO: 2024188 - DNA, 13 bp, Homo sapiens
acctggagagcta

SEQ ID NO: 2024189 - DNA, 22 bp, Homo sapiens
acctggagagctagaacctgga

SEQ ID NO: 2024190 - DNA, 22 bp, Homo sapiens
acctggagggctagaacctgga

SEQ ID NO: 2024191 - DNA, 21 bp, Homo sapiens
acctggccccatgtctctcag

SEQ ID NO: 2024192 - DNA, 23 bp, Homo sapiens
acctggccccatgtctctcagaa

SEQ ID NO: 2024193 - DNA, 21 bp, Homo sapiens
acctggccgcctccaggagcc

SEQ ID NO: 2024194 - DNA, 14 bp, Homo sapiens
acctggcctgctgg

SEQ ID NO: 2024195 - DNA, 14 bp, Homo sapiens
acctgggaaaacag

SEQ ID NO: 2024196 - DNA, 13 bp, Homo sapiens
acctgggaagggg

SEQ ID NO: 2024197 - DNA, 19 bp, Homo sapiens
acctgggccctggggcctg

SEQ ID NO: 2024198 - DNA, 18 bp, Homo sapiens
acctgggcctttcctgtg

SEQ ID NO: 2024199 - DNA, 18 bp, Homo sapiens
acctgggcgccaactgct

SEQ ID NO: 2024200 - DNA, 23 bp, Homo sapiens
acctggtcacaggactctgcctc

SEQ ID NO: 2024201 - DNA, 12 bp, Homo sapiens
acctggtggcac

SEQ ID NO: 2024202 - DNA, 20 bp, Homo sapiens
acctggtggcaccagatgca

SEQ ID NO: 2024203 - DNA, 16 bp, Homo sapiens
acctggttggccgtgg

SEQ ID NO: 2024204 - DNA, 15 bp, Homo sapiens
acctgtagtgagaaa

SEQ ID NO: 2024205 - DNA, 20 bp, Homo sapiens
acctgtagtgagaaactgat

SEQ ID NO: 2024206 - DNA, 22 bp, Homo sapiens
acctgtcaatgatacagtccct

SEQ ID NO: 2024207 - DNA, 18 bp, Homo sapiens
acctgtcaccgtgagcag

SEQ ID NO: 2024208 - DNA, 22 bp, Homo sapiens
acctgtgcagtcccgtggaggg

SEQ ID NO: 2024209 - DNA, 12 bp, Homo sapiens
acctgtgtctta

SEQ ID NO: 2024210 - DNA, 16 bp, Homo sapiens
acctgtgtggacagga

SEQ ID NO: 2024211 - DNA, 17 bp, Homo sapiens
acctgtgtttcttgcct

SEQ ID NO: 2024212 - DNA, 18 bp, Homo sapiens
acctgttaaaatgtacac

SEQ ID NO: 2024213 - DNA, 20 bp, Homo sapiens
acctgttaaaatgtacactg

SEQ ID NO: 2024214 - DNA, 17 bp, Homo sapiens
accccagttctgctcct

SEQ ID NO: 2024215 - DNA, 23 bp, Homo sapiens
accccagttctgctcctctccag

SEQ ID NO: 2024216 - DNA, 15 bp, Homo sapiens
accccagtttttgtt

SEQ ID NO: 2024217 - DNA, 15 bp, Homo sapiens
accccatcccttcct

SEQ ID NO: 2024218 - DNA, 14 bp, Homo sapiens
accccatgggcttg

SEQ ID NO: 2024219 - DNA, 21 bp, Homo sapiens
acccccaccgaagagccctga

SEQ ID NO: 2024220 - DNA, 22 bp, Homo sapiens
acccccaccgaagagccctgag

SEQ ID NO: 2024221 - DNA, 22 bp, Homo sapiens
acccccactctcattccccagg

SEQ ID NO: 2024222 - DNA, 15 bp, Homo sapiens
acccccagagacctt

SEQ ID NO: 2024223 - DNA, 16 bp, Homo sapiens
acccccagcccacaga

SEQ ID NO: 2024224 - DNA, 17 bp, Homo sapiens
acccccagcccacagag

SEQ ID NO: 2024225 - DNA, 20 bp, Homo sapiens
acccccagcccacagagcct

SEQ ID NO: 2024226 - DNA, 22 bp, Homo sapiens
acccccagccccgactccagcc

SEQ ID NO: 2024227 - DNA, 13 bp, Homo sapiens
acccccagcctgc

SEQ ID NO: 2024228 - DNA, 17 bp, Homo sapiens
acccccagcctgggcct

SEQ ID NO: 2024229 - DNA, 19 bp, Homo sapiens
acccccagtgccacagaga

SEQ ID NO: 2024230 - DNA, 11 bp, Homo sapiens
acccccagtgt

SEQ ID NO: 2024231 - DNA, 22 bp, Homo sapiens
acccccgagtttggtccctggg

SEQ ID NO: 2024232 - DNA, 15 bp, Homo sapiens
acccccgccacggcc

SEQ ID NO: 2024233 - DNA, 20 bp, Homo sapiens
acccccgccacggccaccct

SEQ ID NO: 2024234 - DNA, 22 bp, Homo sapiens
acccccgctccagatctgcact

SEQ ID NO: 2024235 - DNA, 16 bp, Homo sapiens
acccccgtggtctttg

SEQ ID NO: 2024236 - DNA, 16 bp, Homo sapiens
accccctcattcccct

SEQ ID NO: 2024237 - DNA, 17 bp, Homo sapiens
accccctcattcccctc

SEQ ID NO: 2024238 - DNA, 18 bp, Homo sapiens
accccctcattcccctcg

SEQ ID NO: 2024239 - DNA, 15 bp, Homo sapiens
accccctccagctcc

SEQ ID NO: 2024240 - DNA, 14 bp, Homo sapiens
accccctcccaccc

SEQ ID NO: 2024241 - DNA, 19 bp, Homo sapiens
accccctctttgtgtactt

SEQ ID NO: 2024242 - DNA, 18 bp, Homo sapiens
acccccttcagtgcccac

SEQ ID NO: 2024243 - DNA, 20 bp, Homo sapiens
accccgcctcccagccccag

SEQ ID NO: 2024244 - DNA, 22 bp, Homo sapiens
accccgcggtgctctggcggct

SEQ ID NO: 2024245 - DNA, 14 bp, Homo sapiens
accccgtgccaccc

SEQ ID NO: 2024246 - DNA, 21 bp, Homo sapiens
accccgtgtccccggcctcag

SEQ ID NO: 2024247 - DNA, 17 bp, Homo sapiens
acccctaacctggctta

SEQ ID NO: 2024248 - DNA, 11 bp, Homo sapiens
acccctcagtg

SEQ ID NO: 2024249 - DNA, 14 bp, Homo sapiens
acccctcagtgctc

SEQ ID NO: 2024250 - DNA, 20 bp, Homo sapiens
acccctcagtgctcggcagt

SEQ ID NO: 2024251 - DNA, 22 bp, Homo sapiens
acccctccaaagccccaccttt

SEQ ID NO: 2024252 - DNA, 17 bp, Homo sapiens
acccctcccctcccccc

SEQ ID NO: 2024253 - DNA, 21 bp, Homo sapiens
acccctcccttgctcagtgcc

SEQ ID NO: 2024254 - DNA, 22 bp, Homo sapiens
acccctcccttgctcagtgcct

SEQ ID NO: 2024255 - DNA, 15 bp, Homo sapiens
acccctctcagcccc

SEQ ID NO: 2024256 - DNA, 12 bp, Homo sapiens
acccctgcactt

SEQ ID NO: 2024257 - DNA, 14 bp, Homo sapiens
acccctgcctgggt

SEQ ID NO: 2024258 - DNA, 19 bp, Homo sapiens
acccctggaccaccagccc

SEQ ID NO: 2024259 - DNA, 13 bp, Homo sapiens
acccctggccggc

SEQ ID NO: 2024260 - DNA, 19 bp, Homo sapiens
acccctggcttttcactgc

SEQ ID NO: 2024261 - DNA, 15 bp, Homo sapiens
accccttatccagga

SEQ ID NO: 2024262 - DNA, 16 bp, Homo sapiens
accccttatccaggac

SEQ ID NO: 2024263 - DNA, 18 bp, Homo sapiens
accccttatccaggactc

SEQ ID NO: 2024264 - DNA, 12 bp, Homo sapiens
accccttcctgt

SEQ ID NO: 2024265 - DNA, 14 bp, Homo sapiens
accccttcctgtcc

SEQ ID NO: 2024266 - DNA, 11 bp, Homo sapiens
accccttcctt

SEQ ID NO: 2024267 - DNA, 17 bp, Homo sapiens
accccttcctttcctct

SEQ ID NO: 2024268 - DNA, 20 bp, Homo sapiens
accccttcgctcctgtgtct

SEQ ID NO: 2024269 - DNA, 11 bp, Homo sapiens
acccctttccc

SEQ ID NO: 2024270 - DNA, 13 bp, Homo sapiens
acccctttccccc

SEQ ID NO: 2024271 - DNA, 16 bp, Homo sapiens
acccctttcccccacc

SEQ ID NO: 2024272 - DNA, 22 bp, Homo sapiens
acccctttcccccaccccagag

SEQ ID NO: 2024273 - DNA, 17 bp, Homo sapiens
acccctttctggctctc

SEQ ID NO: 2024274 - DNA, 18 bp, Homo sapiens
acccgaagcccaggctga

SEQ ID NO: 2024275 - DNA, 23 bp, Homo sapiens
acccgaagcccaggctgaagagt

SEQ ID NO: 2024276 - DNA, 14 bp, Homo sapiens
acccgactgtgaaa

SEQ ID NO: 2024277 - DNA, 22 bp, Homo sapiens
acccgagcccagctacattcct

SEQ ID NO: 2024278 - DNA, 12 bp, Homo sapiens
acccgctctgga

SEQ ID NO: 2024279 - DNA, 18 bp, Homo sapiens
acccggcaccccctgcag

SEQ ID NO: 2024280 - DNA, 19 bp, Homo sapiens
acccggcaccccctgcagc

SEQ ID NO: 2024281 - DNA, 22 bp, Homo sapiens
acccggcccctgctggttcagg

SEQ ID NO: 2024282 - DNA, 19 bp, Homo sapiens
acccgtacccccgtggtct

SEQ ID NO: 2024283 - DNA, 17 bp, Homo sapiens
acccgtaggcagcctct

SEQ ID NO: 2024284 - DNA, 18 bp, Homo sapiens
acccgtgccaagtccagg

SEQ ID NO: 2024285 - DNA, 21 bp, Homo sapiens
acccgtgccaagtccaggtcc

SEQ ID NO: 2024286 - DNA, 17 bp, Homo sapiens
acccgtggaggctgctc

SEQ ID NO: 2024287 - DNA, 18 bp, Homo sapiens
acccgttctgctggcctg

SEQ ID NO: 2024288 - DNA, 20 bp, Homo sapiens
acccgttctgctggcctgga

SEQ ID NO: 2024289 - DNA, 22 bp, Homo sapiens
acccgttctgctggcctggatc

SEQ ID NO: 2024290 - DNA, 16 bp, Homo sapiens
accctaagcctccttt

SEQ ID NO: 2024291 - DNA, 21 bp, Homo sapiens
accctaatagactaaatgaaa

SEQ ID NO: 2024292 - DNA, 18 bp, Homo sapiens
accctacttcttttgctc

SEQ ID NO: 2024293 - DNA, 23 bp, Homo sapiens
accctatagagagggggctctcc

SEQ ID NO: 2024294 - DNA, 17 bp, Homo sapiens
accctatatgtagtata

SEQ ID NO: 2024295 - DNA, 23 bp, Homo sapiens
accctatattttgcatagtacca

SEQ ID NO: 2024296 - DNA, 14 bp, Homo sapiens
accctcaaatgtca

SEQ ID NO: 2024297 - DNA, 16 bp, Homo sapiens
accctcaaatgtcaga

SEQ ID NO: 2024298 - DNA, 20 bp, Homo sapiens
accctcaaatgtcagagcta

SEQ ID NO: 2024299 - DNA, 11 bp, Homo sapiens
accctcagcct

SEQ ID NO: 2024300 - DNA, 12 bp, Homo sapiens
accctcagcctt

SEQ ID NO: 2024301 - DNA, 14 bp, Homo sapiens
accctcagccttga

SEQ ID NO: 2024302 - DNA, 18 bp, Homo sapiens
accctcataccatctgct

SEQ ID NO: 2024303 - DNA, 18 bp, Homo sapiens
accctccaccgcagaagg

SEQ ID NO: 2024304 - DNA, 14 bp, Homo sapiens
accctccccattca

SEQ ID NO: 2024305 - DNA, 23 bp, Homo sapiens
accctcccccaggaggtcgaccc

SEQ ID NO: 2024306 - DNA, 13 bp, Homo sapiens
accctcccccgca

SEQ ID NO: 2024307 - DNA, 15 bp, Homo sapiens
accctccgccttcac

SEQ ID NO: 2024308 - DNA, 17 bp, Homo sapiens
accctcgtggacacctg

SEQ ID NO: 2024309 - DNA, 19 bp, Homo sapiens
accctcgtggacacctgcc

SEQ ID NO: 2024310 - DNA, 21 bp, Homo sapiens
accctctccatgcccaaccta

SEQ ID NO: 2024311 - DNA, 14 bp, Homo sapiens
accctctcctgggg

SEQ ID NO: 2024312 - DNA, 16 bp, Homo sapiens
accctctgggcagctg

SEQ ID NO: 2024313 - DNA, 16 bp, Homo sapiens
accctgagcctgacct

SEQ ID NO: 2024314 - DNA, 17 bp, Homo sapiens
accctgaggagtctgag

SEQ ID NO: 2024315 - DNA, 16 bp, Homo sapiens
accctggaaaggggag

SEQ ID NO: 2024316 - DNA, 19 bp, Homo sapiens
accctggaaaggggagttg

SEQ ID NO: 2024317 - DNA, 10 bp, Homo sapiens
accctggaat

SEQ ID NO: 2024318 - DNA, 21 bp, Homo sapiens
accctggaattcagcaccctg

SEQ ID NO: 2024319 - DNA, 22 bp, Homo sapiens
accctggaattcagcaccctgg

SEQ ID NO: 2024320 - DNA, 20 bp, Homo sapiens
accctggagcggctctcctg

SEQ ID NO: 2024321 - DNA, 14 bp, Homo sapiens
accctggccccaac

SEQ ID NO: 2024322 - DNA, 18 bp, Homo sapiens
accctggcccgcccctcg

SEQ ID NO: 2024323 - DNA, 13 bp, Homo sapiens
accctggctcttc

SEQ ID NO: 2024324 - DNA, 16 bp, Homo sapiens
accctggggagaaagt

SEQ ID NO: 2024325 - DNA, 16 bp, Homo sapiens
accctgttttatactg

SEQ ID NO: 2024326 - DNA, 16 bp, Homo sapiens
accctgttttccacac

SEQ ID NO: 2024327 - DNA, 20 bp, Homo sapiens
accctgttttccacaccatc

SEQ ID NO: 2024328 - DNA, 21 bp, Homo sapiens
acccttcacataccctccccc

SEQ ID NO: 2024329 - DNA, 13 bp, Homo sapiens
acccttccacctc

SEQ ID NO: 2024330 - DNA, 20 bp, Homo sapiens
acccttcccaatcagcactg

SEQ ID NO: 2024331 - DNA, 19 bp, Homo sapiens
acctgttactattatctgt

SEQ ID NO: 2024332 - DNA, 13 bp, Homo sapiens
accttaaaaagta

SEQ ID NO: 2024333 - DNA, 17 bp, Homo sapiens
accttaatattattggg

SEQ ID NO: 2024334 - DNA, 22 bp, Homo sapiens
accttaatattattggggttgg

SEQ ID NO: 2024335 - DNA, 16 bp, Homo sapiens
accttacattcctaga

SEQ ID NO: 2024336 - DNA, 19 bp, Homo sapiens
accttacttaaagcttgtt

SEQ ID NO: 2024337 - DNA, 19 bp, Homo sapiens
accttagcagctcttcccc

SEQ ID NO: 2024338 - DNA, 21 bp, Homo sapiens
accttagctggcattacagct

SEQ ID NO: 2024339 - DNA, 22 bp, Homo sapiens
accttagctggcattacagctg

SEQ ID NO: 2024340 - DNA, 23 bp, Homo sapiens
accttagtccgcaagttcaggga

SEQ ID NO: 2024341 - DNA, 14 bp, Homo sapiens
accttattgtacct

SEQ ID NO: 2024342 - DNA, 20 bp, Homo sapiens
accttcaataaagtatctac

SEQ ID NO: 2024343 - DNA, 12 bp, Homo sapiens
accttcccagct

SEQ ID NO: 2024344 - DNA, 17 bp, Homo sapiens
accttcccagctctccc

SEQ ID NO: 2024345 - DNA, 15 bp, Homo sapiens
accttccccagactc

SEQ ID NO: 2024346 - DNA, 15 bp, Homo sapiens
accttccctctttct

SEQ ID NO: 2024347 - DNA, 18 bp, Homo sapiens
accttcctgccaccagtc

SEQ ID NO: 2024348 - DNA, 14 bp, Homo sapiens
accttccttctaaa

SEQ ID NO: 2024349 - DNA, 22 bp, Homo sapiens
accttctcaaaagattgtttta

SEQ ID NO: 2024350 - DNA, 19 bp, Homo sapiens
accttctggcttccttctc

SEQ ID NO: 2024351 - DNA, 12 bp, Homo sapiens
accttctgtggc

SEQ ID NO: 2024352 - DNA, 20 bp, Homo sapiens
accttcttggcttctgggac

SEQ ID NO: 2024353 - DNA, 21 bp, Homo sapiens
accttgaacactgggggaggg

SEQ ID NO: 2024354 - DNA, 20 bp, Homo sapiens
accttgaccatcgtccttcc

SEQ ID NO: 2024355 - DNA, 14 bp, Homo sapiens
accttgatttaaaa

SEQ ID NO: 2024356 - DNA, 20 bp, Homo sapiens
accttgcagcatttttattt

SEQ ID NO: 2024357 - DNA, 19 bp, Homo sapiens
accttgcatctcattgctc

SEQ ID NO: 2024358 - DNA, 16 bp, Homo sapiens
accttgccgagagagg

SEQ ID NO: 2024359 - DNA, 18 bp, Homo sapiens
accttgccgagagaggcg

SEQ ID NO: 2024360 - DNA, 15 bp, Homo sapiens
accttggactcctcc

SEQ ID NO: 2024361 - DNA, 18 bp, Homo sapiens
accttggactcctcccac

SEQ ID NO: 2024362 - DNA, 17 bp, Homo sapiens
accttggagagacacag

SEQ ID NO: 2024363 - DNA, 21 bp, Homo sapiens
accttgggtttgtattttaaa

SEQ ID NO: 2024364 - DNA, 12 bp, Homo sapiens
accttgtgtctg

SEQ ID NO: 2024365 - DNA, 13 bp, Homo sapiens
acctttacataat

SEQ ID NO: 2024366 - DNA, 18 bp, Homo sapiens
acctttattgtgatctat

SEQ ID NO: 2024367 - DNA, 17 bp, Homo sapiens
acctttcagctgtgaac

SEQ ID NO: 2024368 - DNA, 17 bp, Homo sapiens
acctttcccatgctgaa

SEQ ID NO: 2024369 - DNA, 14 bp, Homo sapiens
acctttccctcacc

SEQ ID NO: 2024370 - DNA, 22 bp, Homo sapiens
acctttccctcaccccctccca

SEQ ID NO: 2024371 - DNA, 11 bp, Homo sapiens
acctttctagt

SEQ ID NO: 2024372 - DNA, 15 bp, Homo sapiens
acctttctagttgaa

SEQ ID NO: 2024373 - DNA, 13 bp, Homo sapiens
acctttggaaaaa

SEQ ID NO: 2024374 - DNA, 18 bp, Homo sapiens
acctttgggatcagcctc

SEQ ID NO: 2024375 - DNA, 14 bp, Homo sapiens
acctttggtgcaga

SEQ ID NO: 2024376 - DNA, 16 bp, Homo sapiens
acctttggtgcagagg

SEQ ID NO: 2024377 - DNA, 17 bp, Homo sapiens
accttttctctcccata

SEQ ID NO: 2024378 - DNA, 19 bp, Homo sapiens
accttttgaagtagtttgt

SEQ ID NO: 2024379 - DNA, 20 bp, Homo sapiens
accttttgtatttaaaacct

SEQ ID NO: 2024380 - DNA, 18 bp, Homo sapiens
acctttttttctctccta

SEQ ID NO: 2024381 - DNA, 17 bp, Homo sapiens
acgaacccactgtgctt

SEQ ID NO: 2024382 - DNA, 17 bp, Homo sapiens
acgaacccctcccctcc

SEQ ID NO: 2024383 - DNA, 23 bp, Homo sapiens
acgaaggggccccggggctggca

SEQ ID NO: 2024384 - DNA, 19 bp, Homo sapiens
acgaatttggtgtggctgt

SEQ ID NO: 2024385 - DNA, 12 bp, Homo sapiens
acgactgaagaa

SEQ ID NO: 2024386 - DNA, 16 bp, Homo sapiens
acgagtcacctgcaag

SEQ ID NO: 2024387 - DNA, 17 bp, Homo sapiens
acgatgtggccctggcc

SEQ ID NO: 2024388 - DNA, 18 bp, Homo sapiens
acgatgtggccctggcct

SEQ ID NO: 2024389 - DNA, 19 bp, Homo sapiens
acgatgtggccctggcctg

SEQ ID NO: 2024390 - DNA, 17 bp, Homo sapiens
acgcaaagggctgaaag

SEQ ID NO: 2024391 - DNA, 21 bp, Homo sapiens
acgcaaagggctgaaagccat

SEQ ID NO: 2024392 - DNA, 22 bp, Homo sapiens
acgcaagggagaagaaatccat

SEQ ID NO: 2024393 - DNA, 23 bp, Homo sapiens
acgcaagggagaagaaatccata

SEQ ID NO: 2024394 - DNA, 19 bp, Homo sapiens
acgcacacatggacacaga

SEQ ID NO: 2024395 - DNA, 15 bp, Homo sapiens
acgcagaggcggaaa

SEQ ID NO: 2024396 - DNA, 20 bp, Homo sapiens
acgcagaggcggaaaccttg

SEQ ID NO: 2024397 - DNA, 23 bp, Homo sapiens
acgcagaggcggaaaccttgcag

SEQ ID NO: 2024398 - DNA, 22 bp, Homo sapiens
acgcagccctgctttgggctgc

SEQ ID NO: 2024399 - DNA, 23 bp, Homo sapiens
acgcagccctgctttgggctgcc

SEQ ID NO: 2024400 - DNA, 12 bp, Homo sapiens
acgcagccctgg

SEQ ID NO: 2024401 - DNA, 20 bp, Homo sapiens
acgcagccctgggggccagc

SEQ ID NO: 2024402 - DNA, 16 bp, Homo sapiens
acgcaggaactcccag

SEQ ID NO: 2024403 - DNA, 17 bp, Homo sapiens
acgcaggaactcccagc

SEQ ID NO: 2024404 - DNA, 14 bp, Homo sapiens
acgccaacagcccc

SEQ ID NO: 2024405 - DNA, 12 bp, Homo sapiens
acgccactcatt

SEQ ID NO: 2024406 - DNA, 16 bp, Homo sapiens
acgccactcatttcat

SEQ ID NO: 2024407 - DNA, 18 bp, Homo sapiens
acgccagtttcaccattt

SEQ ID NO: 2024408 - DNA, 18 bp, Homo sapiens
acgcccagctgaggctgg

SEQ ID NO: 2024409 - DNA, 22 bp, Homo sapiens
acgccctgcgttggagccactc

SEQ ID NO: 2024410 - DNA, 21 bp, Homo sapiens
acgcctcttttccctctctag

SEQ ID NO: 2024411 - DNA, 11 bp, Homo sapiens
acgcctgagcc

SEQ ID NO: 2024412 - DNA, 20 bp, Homo sapiens
acgcctgtaatcccagcact

SEQ ID NO: 2024413 - DNA, 13 bp, Homo sapiens
acgcgcacacaca

SEQ ID NO: 2024414 - DNA, 12 bp, Homo sapiens
acgcgtctcctg

SEQ ID NO: 2024415 - DNA, 20 bp, Homo sapiens
acgcgtgcacacaccagagc

SEQ ID NO: 2024416 - DNA, 23 bp, Homo sapiens
acgcgtgcacacaccagagccca

SEQ ID NO: 2024417 - DNA, 12 bp, Homo sapiens
acgctctctgtc

SEQ ID NO: 2024418 - DNA, 15 bp, Homo sapiens
acgctctctgtctgg

SEQ ID NO: 2024419 - DNA, 12 bp, Homo sapiens
acgctctggaca

SEQ ID NO: 2024420 - DNA, 23 bp, Homo sapiens
acgctggaccttgaactgggtac

SEQ ID NO: 2024421 - DNA, 18 bp, Homo sapiens
acgctggagtgcagtgag

SEQ ID NO: 2024422 - DNA, 20 bp, Homo sapiens
acgctgtcctctcgagccca

SEQ ID NO: 2024423 - DNA, 14 bp, Homo sapiens
acgcttccagacca

SEQ ID NO: 2024424 - DNA, 15 bp, Homo sapiens
acgcttccagaccac

SEQ ID NO: 2024425 - DNA, 19 bp, Homo sapiens
acgcttccagaccacctgc

SEQ ID NO: 2024426 - DNA, 20 bp, Homo sapiens
acgcttccagaccacctgcc

SEQ ID NO: 2024427 - DNA, 17 bp, Homo sapiens
acgctttctagctgttg

SEQ ID NO: 2024428 - DNA, 23 bp, Homo sapiens
acgcttttgggaaaactgggtgg

SEQ ID NO: 2024429 - DNA, 16 bp, Homo sapiens
acggacgtttccatca

SEQ ID NO: 2024430 - DNA, 16 bp, Homo sapiens
acggagagtgcttggg

SEQ ID NO: 2024431 - DNA, 15 bp, Homo sapiens
acggagtacagacgt

SEQ ID NO: 2024432 - DNA, 16 bp, Homo sapiens
acggatgattggatta

SEQ ID NO: 2024433 - DNA, 15 bp, Homo sapiens
acggatgcacagaga

SEQ ID NO: 2024434 - DNA, 19 bp, Homo sapiens
acggcacctgggccctggg

SEQ ID NO: 2024435 - DNA, 21 bp, Homo sapiens
acggcacctgggccctggggc

SEQ ID NO: 2024436 - DNA, 20 bp, Homo sapiens
acggcagagaccccaggatc

SEQ ID NO: 2024437 - DNA, 11 bp, Homo sapiens
acggcagctgt

SEQ ID NO: 2024438 - DNA, 15 bp, Homo sapiens
acggcagctgtagct

SEQ ID NO: 2024439 - DNA, 18 bp, Homo sapiens
acggcagcttgagcctgt

SEQ ID NO: 2024440 - DNA, 15 bp, Homo sapiens
acggccaccctcctt

SEQ ID NO: 2024441 - DNA, 20 bp, Homo sapiens
acggccaccctccttcccgc

SEQ ID NO: 2024442 - DNA, 16 bp, Homo sapiens
acggccaggccagagg

SEQ ID NO: 2024443 - DNA, 14 bp, Homo sapiens
acggcggcagggtg

SEQ ID NO: 2024444 - DNA, 17 bp, Homo sapiens
acggcggcggccctcaa

SEQ ID NO: 2024445 - DNA, 13 bp, Homo sapiens
acggctggacctg

SEQ ID NO: 2024446 - DNA, 15 bp, Homo sapiens
acggctggacctgca

SEQ ID NO: 2024447 - DNA, 16 bp, Homo sapiens
acggctggacctgcac

SEQ ID NO: 2024448 - DNA, 21 bp, Homo sapiens
agcaagacttctctttgcctc

SEQ ID NO: 2024449 - DNA, 12 bp, Homo sapiens
agcaagagagag

SEQ ID NO: 2024450 - DNA, 13 bp, Homo sapiens
agcaagagctggc

SEQ ID NO: 2024451 - DNA, 21 bp, Homo sapiens
agcaagatcctgtctttaagg

SEQ ID NO: 2024452 - DNA, 15 bp, Homo sapiens
agcaagcattcagaa

SEQ ID NO: 2024453 - DNA, 18 bp, Homo sapiens
agcaagcattcagaagaa

SEQ ID NO: 2024454 - DNA, 22 bp, Homo sapiens
agcaagcattcagaagaaaaag

SEQ ID NO: 2024455 - DNA, 17 bp, Homo sapiens
agcaagcttaatggctg

SEQ ID NO: 2024456 - DNA, 18 bp, Homo sapiens
agcaagggctccagcatc

SEQ ID NO: 2024457 - DNA, 20 bp, Homo sapiens
agcaagggctccagcatcca

SEQ ID NO: 2024458 - DNA, 16 bp, Homo sapiens
agcaagggtgatggga

SEQ ID NO: 2024459 - DNA, 16 bp, Homo sapiens
agcaagtgagagctgg

SEQ ID NO: 2024460 - DNA, 11 bp, Homo sapiens
agcaataatta

SEQ ID NO: 2024461 - DNA, 22 bp, Homo sapiens
agcaataattaggatctatgca

SEQ ID NO: 2024462 - DNA, 22 bp, Homo sapiens
agcaatatttccctggaattta

SEQ ID NO: 2024463 - DNA, 18 bp, Homo sapiens
agcaatgatgtccagaag

SEQ ID NO: 2024464 - DNA, 21 bp, Homo sapiens
agcaattcatttcactttaaa

SEQ ID NO: 2024465 - DNA, 23 bp, Homo sapiens
agcaattcatttcactttaaagt

SEQ ID NO: 2024466 - DNA, 14 bp, Homo sapiens
agcaattctaccca

SEQ ID NO: 2024467 - DNA, 15 bp, Homo sapiens
agcaattgccctgta

SEQ ID NO: 2024468 - DNA, 22 bp, Homo sapiens
agcaatttcgccgttgaagagg

SEQ ID NO: 2024469 - DNA, 15 bp, Homo sapiens
agcaatttgcacatg

SEQ ID NO: 2024470 - DNA, 16 bp, Homo sapiens
agcacaaagctcaaga

SEQ ID NO: 2024471 - DNA, 19 bp, Homo sapiens
agcacaagttatttaaatc

SEQ ID NO: 2024472 - DNA, 17 bp, Homo sapiens
agcacaagttccagctg

SEQ ID NO: 2024473 - DNA, 13 bp, Homo sapiens
agcacacgaaccc

SEQ ID NO: 2024474 - DNA, 15 bp, Homo sapiens
agcacacggccctgc

SEQ ID NO: 2024475 - DNA, 17 bp, Homo sapiens
agcacacggccctgccc

SEQ ID NO: 2024476 - DNA, 15 bp, Homo sapiens
agcacagacattaaa

SEQ ID NO: 2024477 - DNA, 12 bp, Homo sapiens
agcacagccctg

SEQ ID NO: 2024478 - DNA, 22 bp, Homo sapiens
agcacagccctgggagggggct

SEQ ID NO: 2024479 - DNA, 16 bp, Homo sapiens
agcacagcttcatttc

SEQ ID NO: 2024480 - DNA, 13 bp, Homo sapiens
agcacaggcagct

SEQ ID NO: 2024481 - DNA, 16 bp, Homo sapiens
agcacaggctaatttt

SEQ ID NO: 2024482 - DNA, 17 bp, Homo sapiens
agcacaggctaattttt

SEQ ID NO: 2024483 - DNA, 20 bp, Homo sapiens
agcacaggggccccagatct

SEQ ID NO: 2024484 - DNA, 18 bp, Homo sapiens
agcacagtgttaaatgaa

SEQ ID NO: 2024485 - DNA, 14 bp, Homo sapiens
agcacagttttaag

SEQ ID NO: 2024486 - DNA, 19 bp, Homo sapiens
agcacatgcgtatatgtgc

SEQ ID NO: 2024487 - DNA, 20 bp, Homo sapiens
agcacattcttaaaggaaaa

SEQ ID NO: 2024488 - DNA, 21 bp, Homo sapiens
agcacatttctcctgtttaca

SEQ ID NO: 2024489 - DNA, 20 bp, Homo sapiens
agcaccagcttctccaggct

SEQ ID NO: 2024490 - DNA, 23 bp, Homo sapiens
agcaccaggcacgaacccacctg

SEQ ID NO: 2024491 - DNA, 23 bp, Homo sapiens
agcacccacgtgagagaatctgc

SEQ ID NO: 2024492 - DNA, 11 bp, Homo sapiens
agcacccaggc

SEQ ID NO: 2024493 - DNA, 12 bp, Homo sapiens
agcacccaggct

SEQ ID NO: 2024494 - DNA, 15 bp, Homo sapiens
agcacccaggctcca

SEQ ID NO: 2024495 - DNA, 12 bp, Homo sapiens
agcaccccctca

SEQ ID NO: 2024496 - DNA, 21 bp, Homo sapiens
agcaccccctcattcccctcg

SEQ ID NO: 2024497 - DNA, 13 bp, Homo sapiens
agcaccctccccc

SEQ ID NO: 2024498 - DNA, 12 bp, Homo sapiens
agcaccctctcc

SEQ ID NO: 2024499 - DNA, 13 bp, Homo sapiens
agcaccctctcct

SEQ ID NO: 2024500 - DNA, 12 bp, Homo sapiens
agcaccctgggt

SEQ ID NO: 2024501 - DNA, 13 bp, Homo sapiens
agcaccctgggtg

SEQ ID NO: 2024502 - DNA, 21 bp, Homo sapiens
agcaccctgttccctctttct

SEQ ID NO: 2024503 - DNA, 17 bp, Homo sapiens
agcacccttctgctgta

SEQ ID NO: 2024504 - DNA, 18 bp, Homo sapiens
agcacctagtccagtgac

SEQ ID NO: 2024505 - DNA, 16 bp, Homo sapiens
agcacctcctgcctcg

SEQ ID NO: 2024506 - DNA, 11 bp, Homo sapiens
agcacctgccg

SEQ ID NO: 2024507 - DNA, 13 bp, Homo sapiens
agcacctgttttt

SEQ ID NO: 2024508 - DNA, 17 bp, Homo sapiens
agcacgaaatgttattt

SEQ ID NO: 2024509 - DNA, 17 bp, Homo sapiens
agcactaaagcagtgga

SEQ ID NO: 2024510 - DNA, 23 bp, Homo sapiens
agcactaaagcagtggacaccag

SEQ ID NO: 2024511 - DNA, 19 bp, Homo sapiens
agcactaaggtgtgctctg

SEQ ID NO: 2024512 - DNA, 21 bp, Homo sapiens
agcactcccttaggcattatt

SEQ ID NO: 2024513 - DNA, 21 bp, Homo sapiens
agcactcctcggtactcccat

SEQ ID NO: 2024514 - DNA, 15 bp, Homo sapiens
agcactcctctgtct

SEQ ID NO: 2024515 - DNA, 19 bp, Homo sapiens
agcactcctctgtctctgc

SEQ ID NO: 2024516 - DNA, 22 bp, Homo sapiens
agcactcgagaccatcctggcc

SEQ ID NO: 2024517 - DNA, 14 bp, Homo sapiens
agcactctctaaat

SEQ ID NO: 2024518 - DNA, 20 bp, Homo sapiens
agcactctctaaatcttcct

SEQ ID NO: 2024519 - DNA, 16 bp, Homo sapiens
agcactgacttctaag

SEQ ID NO: 2024520 - DNA, 17 bp, Homo sapiens
agcactgacttctaagt

SEQ ID NO: 2024521 - DNA, 14 bp, Homo sapiens
agcactgatgttgt

SEQ ID NO: 2024522 - DNA, 17 bp, Homo sapiens
agcactgatttcacaac

SEQ ID NO: 2024523 - DNA, 18 bp, Homo sapiens
agcactgatttcacaaca

SEQ ID NO: 2024524 - DNA, 21 bp, Homo sapiens
agcactgcagatagccagaca

SEQ ID NO: 2024525 - DNA, 16 bp, Homo sapiens
agcactgccaggaggg

SEQ ID NO: 2024526 - DNA, 17 bp, Homo sapiens
agcactgccaggaggga

SEQ ID NO: 2024527 - DNA, 12 bp, Homo sapiens
agcactgctcca

SEQ ID NO: 2024528 - DNA, 23 bp, Homo sapiens
agcactggagtgcagggaggaga

SEQ ID NO: 2024529 - DNA, 12 bp, Homo sapiens
agcactggccag

SEQ ID NO: 2024530 - DNA, 13 bp, Homo sapiens
agcactggccaga

SEQ ID NO: 2024531 - DNA, 19 bp, Homo sapiens
agcactggccagagagggc

SEQ ID NO: 2024532 - DNA, 17 bp, Homo sapiens
agcactgggttgacttt

SEQ ID NO: 2024533 - DNA, 20 bp, Homo sapiens
agcactgtgaagacccagca

SEQ ID NO: 2024534 - DNA, 22 bp, Homo sapiens
agcacttctttcctctccaatt

SEQ ID NO: 2024535 - DNA, 15 bp, Homo sapiens
agcacttgcgtcctg

SEQ ID NO: 2024536 - DNA, 16 bp, Homo sapiens
agcacttgcgtcctgc

SEQ ID NO: 2024537 - DNA, 23 bp, Homo sapiens
agcacttggagccaagggttcag

SEQ ID NO: 2024538 - DNA, 17 bp, Homo sapiens
agcactttaaccctctc

SEQ ID NO: 2024539 - DNA, 21 bp, Homo sapiens
agcactttaaccctctcttcc

SEQ ID NO: 2024540 - DNA, 22 bp, Homo sapiens
agcactttaaccctctcttccc

SEQ ID NO: 2024541 - DNA, 22 bp, Homo sapiens
agcactttacagatgagattcc

SEQ ID NO: 2024542 - DNA, 14 bp, Homo sapiens
agcactttgggagg

SEQ ID NO: 2024543 - DNA, 22 bp, Homo sapiens
agcactttgggaggccaaggtg

SEQ ID NO: 2024544 - DNA, 14 bp, Homo sapiens
agcagaaaagtgct

SEQ ID NO: 2024545 - DNA, 17 bp, Homo sapiens
agcagaaaagtgcttag

SEQ ID NO: 2024546 - DNA, 21 bp, Homo sapiens
agcagaaaagtgcttagaaag

SEQ ID NO: 2024547 - DNA, 21 bp, Homo sapiens
agcagaaagccagggtcctga

SEQ ID NO: 2024548 - DNA, 16 bp, Homo sapiens
agcagaagagggaggc

SEQ ID NO: 2024549 - DNA, 23 bp, Homo sapiens
agcagagaatgaaagggcccaga

SEQ ID NO: 2024550 - DNA, 13 bp, Homo sapiens
agcagagagccct

SEQ ID NO: 2024551 - DNA, 15 bp, Homo sapiens
agcagagagccctgg

SEQ ID NO: 2024552 - DNA, 14 bp, Homo sapiens
agcagagcaggggc

SEQ ID NO: 2024553 - DNA, 17 bp, Homo sapiens
agcagagctgatggaga

SEQ ID NO: 2024554 - DNA, 21 bp, Homo sapiens
agcagagctgatggagaagga

SEQ ID NO: 2024555 - DNA, 19 bp, Homo sapiens
agcagaggagtccagggcg

SEQ ID NO: 2024556 - DNA, 14 bp, Homo sapiens
agcagagtgaggat

SEQ ID NO: 2024557 - DNA, 17 bp, Homo sapiens
agcagagtgaggatgtg

SEQ ID NO: 2024558 - DNA, 18 bp, Homo sapiens
agcagagtgaggatgtgt

SEQ ID NO: 2024559 - DNA, 16 bp, Homo sapiens
agcagataaagacagc

SEQ ID NO: 2024560 - DNA, 13 bp, Homo sapiens
agcagatctgaaa

SEQ ID NO: 2024561 - DNA, 17 bp, Homo sapiens
agcagatggaaagaaag

SEQ ID NO: 2024562 - DNA, 13 bp, Homo sapiens
agcagattttaat

SEQ ID NO: 2024563 - DNA, 20 bp, Homo sapiens
agcagcaaaaatataaaata

SEQ ID NO: 2024564 - DNA, 21 bp, Homo sapiens
agcagcacgattttgcacaaa

SEQ ID NO: 2024565 - DNA, 21 bp, Homo sapiens
agagacattgcctccacctct

SEQ ID NO: 2024566 - DNA, 23 bp, Homo sapiens
agagaccacagcaattggctcct

SEQ ID NO: 2024567 - DNA, 12 bp, Homo sapiens
agagacccaagg

SEQ ID NO: 2024568 - DNA, 13 bp, Homo sapiens
agagacccaagga

SEQ ID NO: 2024569 - DNA, 15 bp, Homo sapiens
agagacccagatctc

SEQ ID NO: 2024570 - DNA, 21 bp, Homo sapiens
agagaccccttcctttcctct

SEQ ID NO: 2024571 - DNA, 21 bp, Homo sapiens
agagaccctcactgctgggga

SEQ ID NO: 2024572 - DNA, 23 bp, Homo sapiens
agagaccctcactgctggggagt

SEQ ID NO: 2024573 - DNA, 14 bp, Homo sapiens
agagacctgaggca

SEQ ID NO: 2024574 - DNA, 20 bp, Homo sapiens
agagaccttttctctcccat

SEQ ID NO: 2024575 - DNA, 23 bp, Homo sapiens
agagaccttttctctcccatacc

SEQ ID NO: 2024576 - DNA, 20 bp, Homo sapiens
agagacgcagccctgggggc

SEQ ID NO: 2024577 - DNA, 14 bp, Homo sapiens
agagacgtgtacat

SEQ ID NO: 2024578 - DNA, 22 bp, Homo sapiens
agagactatggagcctggcaca

SEQ ID NO: 2024579 - DNA, 18 bp, Homo sapiens
agagactcaaagagactc

SEQ ID NO: 2024580 - DNA, 21 bp, Homo sapiens
agagactccaagattcaaaga

SEQ ID NO: 2024581 - DNA, 19 bp, Homo sapiens
agagactctcttagggaaa

SEQ ID NO: 2024582 - DNA, 16 bp, Homo sapiens
agagactctggaagcc

SEQ ID NO: 2024583 - DNA, 23 bp, Homo sapiens
agagactctggaagccccccacc

SEQ ID NO: 2024584 - DNA, 17 bp, Homo sapiens
agagactgaaagcagca

SEQ ID NO: 2024585 - DNA, 18 bp, Homo sapiens
agagactgaaagcagcag

SEQ ID NO: 2024586 - DNA, 20 bp, Homo sapiens
agagactgaaagcagcagct

SEQ ID NO: 2024587 - DNA, 18 bp, Homo sapiens
agagacttggggaccaga

SEQ ID NO: 2024588 - DNA, 16 bp, Homo sapiens
agagacttttaatcag

SEQ ID NO: 2024589 - DNA, 17 bp, Homo sapiens
agagacttttaatcaga

SEQ ID NO: 2024590 - DNA, 19 bp, Homo sapiens
agagagaaaacttatttga

SEQ ID NO: 2024591 - DNA, 17 bp, Homo sapiens
agagagaaacatttatg

SEQ ID NO: 2024592 - DNA, 20 bp, Homo sapiens
agagagacagagacagagag

SEQ ID NO: 2024593 - DNA, 16 bp, Homo sapiens
agagagaccacttttc

SEQ ID NO: 2024594 - DNA, 22 bp, Homo sapiens
agagagatatatctgaaaactg

SEQ ID NO: 2024595 - DNA, 16 bp, Homo sapiens
agagagattggatttt

SEQ ID NO: 2024596 - DNA, 15 bp, Homo sapiens
agagagccctggtcc

SEQ ID NO: 2024597 - DNA, 18 bp, Homo sapiens
agagagcgagcgctaccc

SEQ ID NO: 2024598 - DNA, 17 bp, Homo sapiens
agagaggaatcagactt

SEQ ID NO: 2024599 - DNA, 19 bp, Homo sapiens
agagaggcacctgctggaa

SEQ ID NO: 2024600 - DNA, 20 bp, Homo sapiens
agagaggccttttggaatgt

SEQ ID NO: 2024601 - DNA, 17 bp, Homo sapiens
agagaggttctggggag

SEQ ID NO: 2024602 - DNA, 22 bp, Homo sapiens
agagagtcctctggatggcacc

SEQ ID NO: 2024603 - DNA, 17 bp, Homo sapiens
agagagtggctcctccc

SEQ ID NO: 2024604 - DNA, 15 bp, Homo sapiens
agagatatatctgaa

SEQ ID NO: 2024605 - DNA, 19 bp, Homo sapiens
agagatatatctgaaaact

SEQ ID NO: 2024606 - DNA, 23 bp, Homo sapiens
agagatatatctgaaaactggaa

SEQ ID NO: 2024607 - DNA, 20 bp, Homo sapiens
agagatcaggaagagaagga

SEQ ID NO: 2024608 - DNA, 18 bp, Homo sapiens
agagatctagaaagtggg

SEQ ID NO: 2024609 - DNA, 16 bp, Homo sapiens
agagatgcatgcgcag

SEQ ID NO: 2024610 - DNA, 23 bp, Homo sapiens
agagatgcctccaccgctgccta

SEQ ID NO: 2024611 - DNA, 12 bp, Homo sapiens
agagatgttttt

SEQ ID NO: 2024612 - DNA, 16 bp, Homo sapiens
agagattaatttgtgt

SEQ ID NO: 2024613 - DNA, 18 bp, Homo sapiens
agagattgccccagagcc

SEQ ID NO: 2024614 - DNA, 15 bp, Homo sapiens
agagattgcttctca

SEQ ID NO: 2024615 - DNA, 21 bp, Homo sapiens
agagatttcaacatatcattt

SEQ ID NO: 2024616 - DNA, 18 bp, Homo sapiens
agagattttgtcgggaca

SEQ ID NO: 2024617 - DNA, 20 bp, Homo sapiens
agagattttgtcgggacaga

SEQ ID NO: 2024618 - DNA, 22 bp, Homo sapiens
agagcacaagaggaagagagag

SEQ ID NO: 2024619 - DNA, 19 bp, Homo sapiens
agagcacaagttccagctg

SEQ ID NO: 2024620 - DNA, 19 bp, Homo sapiens
agagcacctagtccagtga

SEQ ID NO: 2024621 - DNA, 20 bp, Homo sapiens
agagcagaacggagccccag

SEQ ID NO: 2024622 - DNA, 14 bp, Homo sapiens
agagcagagagcag

SEQ ID NO: 2024623 - DNA, 16 bp, Homo sapiens
agagcagcctgatggc

SEQ ID NO: 2024624 - DNA, 19 bp, Homo sapiens
agagcagcctgatggccaa

SEQ ID NO: 2024625 - DNA, 20 bp, Homo sapiens
agagcaggccacgctcaggc

SEQ ID NO: 2024626 - DNA, 13 bp, Homo sapiens
agagcaggctcag

SEQ ID NO: 2024627 - DNA, 18 bp, Homo sapiens
agagcatcatgcctctga

SEQ ID NO: 2024628 - DNA, 19 bp, Homo sapiens
agagcatcatgcctctgag

SEQ ID NO: 2024629 - DNA, 20 bp, Homo sapiens
agagcatcatgcctctgagg

SEQ ID NO: 2024630 - DNA, 21 bp, Homo sapiens
agagcatcatgcctctgaggc

SEQ ID NO: 2024631 - DNA, 19 bp, Homo sapiens
agagcatcgtgacccttca

SEQ ID NO: 2024632 - DNA, 21 bp, Homo sapiens
agagcatcgtgacccttcagg

SEQ ID NO: 2024633 - DNA, 21 bp, Homo sapiens
agagcattacgtgagccaggt

SEQ ID NO: 2024634 - DNA, 21 bp, Homo sapiens
agagccaccagggcactgtct

SEQ ID NO: 2024635 - DNA, 16 bp, Homo sapiens
agagccactacctttg

SEQ ID NO: 2024636 - DNA, 14 bp, Homo sapiens
agagccagccctcc

SEQ ID NO: 2024637 - DNA, 20 bp, Homo sapiens
agagccagccctccctgtcc

SEQ ID NO: 2024638 - DNA, 22 bp, Homo sapiens
agagccagccctccctgtcctc

SEQ ID NO: 2024639 - DNA, 12 bp, Homo sapiens
agagccagcctg

SEQ ID NO: 2024640 - DNA, 17 bp, Homo sapiens
agagccagcctgggact

SEQ ID NO: 2024641 - DNA, 13 bp, Homo sapiens
agagccagctctc

SEQ ID NO: 2024642 - DNA, 16 bp, Homo sapiens
agagccagctctctct

SEQ ID NO: 2024643 - DNA, 18 bp, Homo sapiens
agagccagctctctctac

SEQ ID NO: 2024644 - DNA, 14 bp, Homo sapiens
agagccatgggcct

SEQ ID NO: 2024645 - DNA, 23 bp, Homo sapiens
agagcccccaagcctctgcccca

SEQ ID NO: 2024646 - DNA, 22 bp, Homo sapiens
agagccccccgtgtggcttaca

SEQ ID NO: 2024647 - DNA, 23 bp, Homo sapiens
agagccctgagctcaggctgagc

SEQ ID NO: 2024648 - DNA, 14 bp, Homo sapiens
agagccctgctgtg

SEQ ID NO: 2024649 - DNA, 15 bp, Homo sapiens
agagccctgggaccg

SEQ ID NO: 2024650 - DNA, 19 bp, Homo sapiens
agagccctgtcagtagagt

SEQ ID NO: 2024651 - DNA, 15 bp, Homo sapiens
agagcccttcatttg

SEQ ID NO: 2024652 - DNA, 23 bp, Homo sapiens
agagccgcaaatcaaccccagac

SEQ ID NO: 2024653 - DNA, 15 bp, Homo sapiens
agagcctaagaaaat

SEQ ID NO: 2024654 - DNA, 16 bp, Homo sapiens
agagcctagccacctc

SEQ ID NO: 2024655 - DNA, 21 bp, Homo sapiens
agagcctagccacctcccacc

SEQ ID NO: 2024656 - DNA, 14 bp, Homo sapiens
agagcctgactgtg

SEQ ID NO: 2024657 - DNA, 14 bp, Homo sapiens
agagcctggagaag

SEQ ID NO: 2024658 - DNA, 16 bp, Homo sapiens
agagcctggggcatcc

SEQ ID NO: 2024659 - DNA, 23 bp, Homo sapiens
agagcctggggctctaacgcctg

SEQ ID NO: 2024660 - DNA, 22 bp, Homo sapiens
agagccttcacaaccagccaca

SEQ ID NO: 2024661 - DNA, 20 bp, Homo sapiens
agagccttctcctgcctaca

SEQ ID NO: 2024662 - DNA, 23 bp, Homo sapiens
agagcctttggatgaccagaaca

SEQ ID NO: 2024663 - DNA, 13 bp, Homo sapiens
agagcggctgccc

SEQ ID NO: 2024664 - DNA, 14 bp, Homo sapiens
agagcgggagtgac

SEQ ID NO: 2024665 - DNA, 21 bp, Homo sapiens
agagcgggcctcttccctcag

SEQ ID NO: 2024666 - DNA, 14 bp, Homo sapiens
agagcggggaggtg

SEQ ID NO: 2024667 - DNA, 14 bp, Homo sapiens
agagctacataatt

SEQ ID NO: 2024668 - DNA, 17 bp, Homo sapiens
agagctagaacatggag

SEQ ID NO: 2024669 - DNA, 19 bp, Homo sapiens
agagctagaacatggagag

SEQ ID NO: 2024670 - DNA, 18 bp, Homo sapiens
agagctagaacctggagg

SEQ ID NO: 2024671 - DNA, 16 bp, Homo sapiens
agagctagcgctgccg

SEQ ID NO: 2024672 - DNA, 14 bp, Homo sapiens
agagctcctgtccc

SEQ ID NO: 2024673 - DNA, 16 bp, Homo sapiens
agagctcctgtcccta

SEQ ID NO: 2024674 - DNA, 17 bp, Homo sapiens
agagctcctgtccctac

SEQ ID NO: 2024675 - DNA, 19 bp, Homo sapiens
agagctcctgtccctaccc

SEQ ID NO: 2024676 - DNA, 20 bp, Homo sapiens
agagctcctgtccctaccca

SEQ ID NO: 2024677 - DNA, 19 bp, Homo sapiens
agagctcgctcttgggagt

SEQ ID NO: 2024678 - DNA, 15 bp, Homo sapiens
agagctgctgtcctt

SEQ ID NO: 2024679 - DNA, 19 bp, Homo sapiens
agagctgctgtccttttag

SEQ ID NO: 2024680 - DNA, 15 bp, Homo sapiens
agagctggaaggcag

SEQ ID NO: 2024681 - DNA, 22 bp, Homo sapiens
agagctggaaggcagggcagag

SEQ ID NO: 2024682 - DNA, 23 bp, Homo sapiens
agagctgggaggcatggccctgg

SEQ ID NO: 2024683 - DNA, 18 bp, Homo sapiens
agagctgttcacagccag

SEQ ID NO: 2024684 - DNA, 16 bp, Homo sapiens
agagctgttggcctcg

SEQ ID NO: 2024685 - DNA, 18 bp, Homo sapiens
agagcttagcctggagca

SEQ ID NO: 2024686 - DNA, 18 bp, Homo sapiens
agagcttattggccactg

SEQ ID NO: 2024687 - DNA, 18 bp, Homo sapiens
agagcttggacagtctga

SEQ ID NO: 2024688 - DNA, 21 bp, Homo sapiens
agagcttggacagtctgagct

SEQ ID NO: 2024689 - DNA, 23 bp, Homo sapiens
agagctttctgtccttttggcac

SEQ ID NO: 2024690 - DNA, 12 bp, Homo sapiens
agagctttcttt

SEQ ID NO: 2024691 - DNA, 16 bp, Homo sapiens
agagctttctttcaca

SEQ ID NO: 2024692 - DNA, 16 bp, Homo sapiens
agaggaaaaaaatgac

SEQ ID NO: 2024693 - DNA, 17 bp, Homo sapiens
agaggaaaaaaatgact

SEQ ID NO: 2024694 - DNA, 22 bp, Homo sapiens
agaggaaaggacatgggtagca

SEQ ID NO: 2024695 - DNA, 13 bp, Homo sapiens
agaggaagagaga

SEQ ID NO: 2024696 - DNA, 13 bp, Homo sapiens
agaggaagagcag

SEQ ID NO: 2024697 - DNA, 23 bp, Homo sapiens
agaggaagatgaagagaagctga

SEQ ID NO: 2024698 - DNA, 14 bp, Homo sapiens
agaggaagcaagaa

SEQ ID NO: 2024699 - DNA, 13 bp, Homo sapiens
agaggaagggtgg

SEQ ID NO: 2024700 - DNA, 24 bp, Homo sapiens
agaggaatcagacttcacactgca

SEQ ID NO: 2024701 - DNA, 22 bp, Homo sapiens
agaggacttttctttgtggctt

SEQ ID NO: 2024702 - DNA, 23 bp, Homo sapiens
agaggacttttctttgtggcttc

SEQ ID NO: 2024703 - DNA, 11 bp, Homo sapiens
agaggagaaga

SEQ ID NO: 2024704 - DNA, 13 bp, Homo sapiens
agaggagaccctg

SEQ ID NO: 2024705 - DNA, 12 bp, Homo sapiens
agaggagaggaa

SEQ ID NO: 2024706 - DNA, 13 bp, Homo sapiens
agaggagcacctg

SEQ ID NO: 2024707 - DNA, 21 bp, Homo sapiens
agaggagggcgtgactcaccc

SEQ ID NO: 2024708 - DNA, 19 bp, Homo sapiens
agaggagtccagggcggga

SEQ ID NO: 2024709 - DNA, 16 bp, Homo sapiens
agaggagtgactgagc

SEQ ID NO: 2024710 - DNA, 13 bp, Homo sapiens
agaggatgatttc

SEQ ID NO: 2024711 - DNA, 18 bp, Homo sapiens
agaggcaagagacagaat

SEQ ID NO: 2024712 - DNA, 13 bp, Homo sapiens
agaggcagagaaa

SEQ ID NO: 2024713 - DNA, 17 bp, Homo sapiens
agaggcagagaaagaag

SEQ ID NO: 2024714 - DNA, 20 bp, Homo sapiens
agaggcagagaaagaagaga

SEQ ID NO: 2024715 - DNA, 17 bp, Homo sapiens
agaggcaggagtggcag

SEQ ID NO: 2024716 - DNA, 21 bp, Homo sapiens
agaggcagggtctcactctgt

SEQ ID NO: 2024717 - DNA, 13 bp, Homo sapiens
agaggcagtgaga

SEQ ID NO: 2024718 - DNA, 18 bp, Homo sapiens
agaggcatgtgatgtgca

SEQ ID NO: 2024719 - DNA, 22 bp, Homo sapiens
agaggcatgtgatgtgcaagga

SEQ ID NO: 2024720 - DNA, 16 bp, Homo sapiens
agaggcatttaaaatg

SEQ ID NO: 2024721 - DNA, 19 bp, Homo sapiens
agaggcatttaaaatggaa

SEQ ID NO: 2024722 - DNA, 16 bp, Homo sapiens
agaggccatggcagaa

SEQ ID NO: 2024723 - DNA, 15 bp, Homo sapiens
agaggccctggatca

SEQ ID NO: 2024724 - DNA, 22 bp, Homo sapiens
agaggccctggatcagcgtggc

SEQ ID NO: 2024725 - DNA, 15 bp, Homo sapiens
agaggcggaaacctt

SEQ ID NO: 2024726 - DNA, 16 bp, Homo sapiens
agaggcggaaaccttg

SEQ ID NO: 2024727 - DNA, 19 bp, Homo sapiens
agaggcggaaaccttgcag

SEQ ID NO: 2024728 - DNA, 20 bp, Homo sapiens
agaggcggaaaccttgcagc

SEQ ID NO: 2024729 - DNA, 16 bp, Homo sapiens
agaggctaagatgaga

SEQ ID NO: 2024730 - DNA, 19 bp, Homo sapiens
agaggctattattttcact

SEQ ID NO: 2024731 - DNA, 15 bp, Homo sapiens
agaggctatttaaaa

SEQ ID NO: 2024732 - DNA, 19 bp, Homo sapiens
agaggctggaggcagggcc

SEQ ID NO: 2024733 - DNA, 20 bp, Homo sapiens
agaggctggaggcagggcct

SEQ ID NO: 2024734 - DNA, 15 bp, Homo sapiens
agaggctggcaagga

SEQ ID NO: 2024735 - DNA, 21 bp, Homo sapiens
agaggcttcttcagatcagtg

SEQ ID NO: 2024736 - DNA, 18 bp, Homo sapiens
agagggaatgttccctgc

SEQ ID NO: 2024737 - DNA, 22 bp, Homo sapiens
agagggaccaaattgcttctag

SEQ ID NO: 2024738 - DNA, 14 bp, Homo sapiens
agagggaggcttcc

SEQ ID NO: 2024739 - DNA, 18 bp, Homo sapiens
agagggccaagacttggc

SEQ ID NO: 2024740 - DNA, 19 bp, Homo sapiens
agagggccatgcaattcat

SEQ ID NO: 2024741 - DNA, 13 bp, Homo sapiens
agagggcccagct

SEQ ID NO: 2024742 - DNA, 15 bp, Homo sapiens
agagggcccagctgt

SEQ ID NO: 2024743 - DNA, 20 bp, Homo sapiens
agagggcccagctgtagcca

SEQ ID NO: 2024744 - DNA, 16 bp, Homo sapiens
agagggcccaggcagg

SEQ ID NO: 2024745 - DNA, 19 bp, Homo sapiens
agagggcctgtgggagcct

SEQ ID NO: 2024746 - DNA, 20 bp, Homo sapiens
agagggctgcgagcatttcc

SEQ ID NO: 2024747 - DNA, 22 bp, Homo sapiens
agagggctgcgagcatttccct

SEQ ID NO: 2024748 - DNA, 22 bp, Homo sapiens
agagggctgttggacagctgct

SEQ ID NO: 2024749 - DNA, 22 bp, Homo sapiens
agaggggaacagactggaagca

SEQ ID NO: 2024750 - DNA, 14 bp, Homo sapiens
agaggggaggggcc

SEQ ID NO: 2024751 - DNA, 18 bp, Homo sapiens
agaggggaggggcctagg

SEQ ID NO: 2024752 - DNA, 23 bp, Homo sapiens
agaggggcagccgctaggagaga

SEQ ID NO: 2024753 - DNA, 16 bp, Homo sapiens
agaggggcaggggagt

SEQ ID NO: 2024754 - DNA, 12 bp, Homo sapiens
agaggggcctgg

SEQ ID NO: 2024755 - DNA, 13 bp, Homo sapiens
agaggggcctggg

SEQ ID NO: 2024756 - DNA, 22 bp, Homo sapiens
agaggggctaggggctggtcct

SEQ ID NO: 2024757 - DNA, 20 bp, Homo sapiens
agaggggtacatttccctgt

SEQ ID NO: 2024758 - DNA, 22 bp, Homo sapiens
agagggtgggagcctaaggaag

SEQ ID NO: 2024759 - DNA, 20 bp, Homo sapiens
agagggtggtgacctctgcc

SEQ ID NO: 2024760 - DNA, 23 bp, Homo sapiens
agagggtggtgacctctgcctga

SEQ ID NO: 2024761 - DNA, 20 bp, Homo sapiens
agaggtaaaagtgtgagcag

SEQ ID NO: 2024762 - DNA, 21 bp, Homo sapiens
agaggtaactatcaatattta

SEQ ID NO: 2024763 - DNA, 17 bp, Homo sapiens
agaggtatttatcttta

SEQ ID NO: 2024764 - DNA, 15 bp, Homo sapiens
agaggtccctgctta

SEQ ID NO: 2024765 - DNA, 22 bp, Homo sapiens
agaggtctccatcatggcagtg

SEQ ID NO: 2024766 - DNA, 16 bp, Homo sapiens
agaggtctgagccctg

SEQ ID NO: 2024767 - DNA, 22 bp, Homo sapiens
agaggtgacccaatgctcctgg

SEQ ID NO: 2024768 - DNA, 17 bp, Homo sapiens
agaggtgaccccagggc

SEQ ID NO: 2024769 - DNA, 18 bp, Homo sapiens
agaggtgaccccagggca

SEQ ID NO: 2024770 - DNA, 16 bp, Homo sapiens
agaggtgagaaattta

SEQ ID NO: 2024771 - DNA, 13 bp, Homo sapiens
agaggtggccaga

SEQ ID NO: 2024772 - DNA, 12 bp, Homo sapiens
agaggtgggcag

SEQ ID NO: 2024773 - DNA, 19 bp, Homo sapiens
agaggtgggcagcagctca

SEQ ID NO: 2024774 - DNA, 14 bp, Homo sapiens
agaggtgggcagct

SEQ ID NO: 2024775 - DNA, 18 bp, Homo sapiens
agaggtgggcagctgggc

SEQ ID NO: 2024776 - DNA, 11 bp, Homo sapiens
agaggtgggga

SEQ ID NO: 2024777 - DNA, 23 bp, Homo sapiens
agaggtggggagggagacagaga

SEQ ID NO: 2024778 - DNA, 16 bp, Homo sapiens
agaggttatctgcctg

SEQ ID NO: 2024779 - DNA, 18 bp, Homo sapiens
agaggttatctgcctggc

SEQ ID NO: 2024780 - DNA, 20 bp, Homo sapiens
agaggttatctgcctggcct

SEQ ID NO: 2024781 - DNA, 12 bp, Homo sapiens
agaggttttgtt

SEQ ID NO: 2024782 - DNA, 16 bp, Homo sapiens
agagtacagtgagcca

SEQ ID NO: 2024783 - DNA, 19 bp, Homo sapiens
agagtacagtgagccaaga

SEQ ID NO: 2024784 - DNA, 21 bp, Homo sapiens
agagtagatggtgaaatttat

SEQ ID NO: 2024785 - DNA, 12 bp, Homo sapiens
agagtagcaagt

SEQ ID NO: 2024786 - DNA, 17 bp, Homo sapiens
agagtagccgagagcct

SEQ ID NO: 2024787 - DNA, 19 bp, Homo sapiens
agagtagccgagagcctgc

SEQ ID NO: 2024788 - DNA, 14 bp, Homo sapiens
agagtataggatgg

SEQ ID NO: 2024789 - DNA, 15 bp, Homo sapiens
agagtataggatgga

SEQ ID NO: 2024790 - DNA, 15 bp, Homo sapiens
agagtatatatgtac

SEQ ID NO: 2024791 - DNA, 16 bp, Homo sapiens
agagtatatatgtaca

SEQ ID NO: 2024792 - DNA, 20 bp, Homo sapiens
agagtatatatgtacagtta

SEQ ID NO: 2024793 - DNA, 18 bp, Homo sapiens
agagtatattatgtattt

SEQ ID NO: 2024794 - DNA, 21 bp, Homo sapiens
agagtatgcaagaagaatata

SEQ ID NO: 2024795 - DNA, 13 bp, Homo sapiens
agagtcagaggag

SEQ ID NO: 2024796 - DNA, 21 bp, Homo sapiens
agaattctaagattgtacata

SEQ ID NO: 2024797 - DNA, 17 bp, Homo sapiens
agaattcttcaggtgga

SEQ ID NO: 2024798 - DNA, 19 bp, Homo sapiens
agaattgaacccaggaggt

SEQ ID NO: 2024799 - DNA, 14 bp, Homo sapiens
agaattgggaagct

SEQ ID NO: 2024800 - DNA, 18 bp, Homo sapiens
agaattgtgcaaatggaa

SEQ ID NO: 2024801 - DNA, 23 bp, Homo sapiens
agaattgtgcaaatggaagacaa

SEQ ID NO: 2024802 - DNA, 16 bp, Homo sapiens
agaatttctaccattt

SEQ ID NO: 2024803 - DNA, 16 bp, Homo sapiens
agaatttgtattttgc

SEQ ID NO: 2024804 - DNA, 17 bp, Homo sapiens
agaatttgtattttgct

SEQ ID NO: 2024805 - DNA, 13 bp, Homo sapiens
agaattttaaatt

SEQ ID NO: 2024806 - DNA, 16 bp, Homo sapiens
agaattttaagtgctt

SEQ ID NO: 2024807 - DNA, 14 bp, Homo sapiens
agaattttaccaaa

SEQ ID NO: 2024808 - DNA, 20 bp, Homo sapiens
agaattttcagaccccagcg

SEQ ID NO: 2024809 - DNA, 21 bp, Homo sapiens
agaattttcagaccccagcgg

SEQ ID NO: 2024810 - DNA, 21 bp, Homo sapiens
agaatttttaatgacttttta

SEQ ID NO: 2024811 - DNA, 17 bp, Homo sapiens
agacaaaaacagcctca

SEQ ID NO: 2024812 - DNA, 22 bp, Homo sapiens
agacaaaaacagcctcacagaa

SEQ ID NO: 2024813 - DNA, 17 bp, Homo sapiens
agacaaaccactgtaca

SEQ ID NO: 2024814 - DNA, 13 bp, Homo sapiens
agacaacagaagt

SEQ ID NO: 2024815 - DNA, 17 bp, Homo sapiens
agacaactcttccattt

SEQ ID NO: 2024816 - DNA, 20 bp, Homo sapiens
agacaactcttccatttatt

SEQ ID NO: 2024817 - DNA, 16 bp, Homo sapiens
agacaagagctgctgt

SEQ ID NO: 2024818 - DNA, 12 bp, Homo sapiens
agacaagccctg

SEQ ID NO: 2024819 - DNA, 14 bp, Homo sapiens
agacaagccctggc

SEQ ID NO: 2024820 - DNA, 13 bp, Homo sapiens
agacaaggaacca

SEQ ID NO: 2024821 - DNA, 16 bp, Homo sapiens
agacaataaaacattc

SEQ ID NO: 2024822 - DNA, 14 bp, Homo sapiens
agacaattcagaag

SEQ ID NO: 2024823 - DNA, 10 bp, Homo sapiens
agacacaccc

SEQ ID NO: 2024824 - DNA, 19 bp, Homo sapiens
agacacagagtggagccct

SEQ ID NO: 2024825 - DNA, 23 bp, Homo sapiens
agacacagagtggagccctcagt

SEQ ID NO: 2024826 - DNA, 15 bp, Homo sapiens
agacacagatacatg

SEQ ID NO: 2024827 - DNA, 18 bp, Homo sapiens
agacacagcgtccctagc

SEQ ID NO: 2024828 - DNA, 12 bp, Homo sapiens
agacacaggccc

SEQ ID NO: 2024829 - DNA, 17 bp, Homo sapiens
agacacaggcccggctc

SEQ ID NO: 2024830 - DNA, 17 bp, Homo sapiens
agacacatcaaatgccc

SEQ ID NO: 2024831 - DNA, 18 bp, Homo sapiens
agacacatcaaatgcccc

SEQ ID NO: 2024832 - DNA, 22 bp, Homo sapiens
agacacatggctatcctagaga

SEQ ID NO: 2024833 - DNA, 14 bp, Homo sapiens
agacacctgcacct

SEQ ID NO: 2024834 - DNA, 17 bp, Homo sapiens
agacacctgcacctccc

SEQ ID NO: 2024835 - DNA, 15 bp, Homo sapiens
agacactaagttata

SEQ ID NO: 2024836 - DNA, 16 bp, Homo sapiens
agacactcccagggac

SEQ ID NO: 2024837 - DNA, 20 bp, Homo sapiens
agacactcctataaggagag

SEQ ID NO: 2024838 - DNA, 21 bp, Homo sapiens
agacacttcatggaccaagaa

SEQ ID NO: 2024839 - DNA, 18 bp, Homo sapiens
agacagaaacagagagag

SEQ ID NO: 2024840 - DNA, 17 bp, Homo sapiens
agacagaacccctacat

SEQ ID NO: 2024841 - DNA, 21 bp, Homo sapiens
agacagaccggggttcaagcc

SEQ ID NO: 2024842 - DNA, 10 bp, Homo sapiens
agacagagcc

SEQ ID NO: 2024843 - DNA, 14 bp, Homo sapiens
agacagagccccca

SEQ ID NO: 2024844 - DNA, 17 bp, Homo sapiens
agacagagcccccaagc

SEQ ID NO: 2024845 - DNA, 16 bp, Homo sapiens
agacagatcccatcca

SEQ ID NO: 2024846 - DNA, 18 bp, Homo sapiens
agacagcacttggctcct

SEQ ID NO: 2024847 - DNA, 16 bp, Homo sapiens
agacagcagctcaggc

SEQ ID NO: 2024848 - DNA, 20 bp, Homo sapiens
agacagcgaactagaagaaa

SEQ ID NO: 2024849 - DNA, 14 bp, Homo sapiens
agacagctgacaga

SEQ ID NO: 2024850 - DNA, 18 bp, Homo sapiens
agacaggaaaatcctctg

SEQ ID NO: 2024851 - DNA, 21 bp, Homo sapiens
agacaggaaaatcctctggct

SEQ ID NO: 2024852 - DNA, 14 bp, Homo sapiens
agacaggagaaatg

SEQ ID NO: 2024853 - DNA, 19 bp, Homo sapiens
agacaggcgctggacagag

SEQ ID NO: 2024854 - DNA, 19 bp, Homo sapiens
agacagggcaatcttgtcc

SEQ ID NO: 2024855 - DNA, 21 bp, Homo sapiens
agacagggttttgccatgttg

SEQ ID NO: 2024856 - DNA, 17 bp, Homo sapiens
agacaggtaaatgggca

SEQ ID NO: 2024857 - DNA, 15 bp, Homo sapiens
agacaggtggcctag

SEQ ID NO: 2024858 - DNA, 17 bp, Homo sapiens
agacagtagaggcatga

SEQ ID NO: 2024859 - DNA, 21 bp, Homo sapiens
agacagtagccaagttatatt

SEQ ID NO: 2024860 - DNA, 18 bp, Homo sapiens
agacagtatatttatagt

SEQ ID NO: 2024861 - DNA, 18 bp, Homo sapiens
agacagtcctaacaatat

SEQ ID NO: 2024862 - DNA, 12 bp, Homo sapiens
agacagtgatct

SEQ ID NO: 2024863 - DNA, 20 bp, Homo sapiens
agacagtgatctccatatgt

SEQ ID NO: 2024864 - DNA, 15 bp, Homo sapiens
agacagttcaagaaa

SEQ ID NO: 2024865 - DNA, 18 bp, Homo sapiens
agacatccatgtttgtaa

SEQ ID NO: 2024866 - DNA, 17 bp, Homo sapiens
agacatgttgtaaatta

SEQ ID NO: 2024867 - DNA, 22 bp, Homo sapiens
agacattaactcattagactgg

SEQ ID NO: 2024868 - DNA, 14 bp, Homo sapiens
agacattgcctcca

SEQ ID NO: 2024869 - DNA, 13 bp, Homo sapiens
agacatttttatt

SEQ ID NO: 2024870 - DNA, 14 bp, Homo sapiens
agaccaacctgacc

SEQ ID NO: 2024871 - DNA, 13 bp, Homo sapiens
agaccacctccct

SEQ ID NO: 2024872 - DNA, 22 bp, Homo sapiens
agaccacctccctgccctgtcc

SEQ ID NO: 2024873 - DNA, 15 bp, Homo sapiens
agaccacctgccagc

SEQ ID NO: 2024874 - DNA, 16 bp, Homo sapiens
agaccacctgccagcc

SEQ ID NO: 2024875 - DNA, 22 bp, Homo sapiens
agaccacctgccagccatcaca

SEQ ID NO: 2024876 - DNA, 23 bp, Homo sapiens
agaccacctgccagccatcacaa

SEQ ID NO: 2024877 - DNA, 16 bp, Homo sapiens
agaccacctgcttctg

SEQ ID NO: 2024878 - DNA, 17 bp, Homo sapiens
agaccacctgcttctga

SEQ ID NO: 2024879 - DNA, 14 bp, Homo sapiens
agaccagactgtgg

SEQ ID NO: 2024880 - DNA, 16 bp, Homo sapiens
agaccagactgtggag

SEQ ID NO: 2024881 - DNA, 22 bp, Homo sapiens
agaccagactgtggagaaataa

SEQ ID NO: 2024882 - DNA, 12 bp, Homo sapiens
agaccagctcag

SEQ ID NO: 2024883 - DNA, 22 bp, Homo sapiens
agaccagctcagaggcccagga

SEQ ID NO: 2024884 - DNA, 17 bp, Homo sapiens
agaccagtactgggaag

SEQ ID NO: 2024885 - DNA, 13 bp, Homo sapiens
agaccagttggga

SEQ ID NO: 2024886 - DNA, 21 bp, Homo sapiens
agaccagttgggagcactgga

SEQ ID NO: 2024887 - DNA, 23 bp, Homo sapiens
agaccagttgggagcactggagt

SEQ ID NO: 2024888 - DNA, 13 bp, Homo sapiens
agaccatcctggc

SEQ ID NO: 2024889 - DNA, 20 bp, Homo sapiens
agaccattgtcttccaaccc

SEQ ID NO: 2024890 - DNA, 16 bp, Homo sapiens
agaccatttaacatgc

SEQ ID NO: 2024891 - DNA, 16 bp, Homo sapiens
agacccaaggaggaaa

SEQ ID NO: 2024892 - DNA, 16 bp, Homo sapiens
agacccagatctcatg

SEQ ID NO: 2024893 - DNA, 17 bp, Homo sapiens
agacccagatctcatgg

SEQ ID NO: 2024894 - DNA, 15 bp, Homo sapiens
agacccattcctatt

SEQ ID NO: 2024895 - DNA, 15 bp, Homo sapiens
agacccctgtggcag

SEQ ID NO: 2024896 - DNA, 13 bp, Homo sapiens
agaccccttcctt

SEQ ID NO: 2024897 - DNA, 15 bp, Homo sapiens
agaccccttcctttc

SEQ ID NO: 2024898 - DNA, 16 bp, Homo sapiens
agaccctaccccacca

SEQ ID NO: 2024899 - DNA, 18 bp, Homo sapiens
agaccctaccccaccacg

SEQ ID NO: 2024900 - DNA, 11 bp, Homo sapiens
agaccctcact

SEQ ID NO: 2024901 - DNA, 14 bp, Homo sapiens
agaccctgagactc

SEQ ID NO: 2024902 - DNA, 11 bp, Homo sapiens
agaccctgcct

SEQ ID NO: 2024903 - DNA, 15 bp, Homo sapiens
agaccctgcctgagc

SEQ ID NO: 2024904 - DNA, 14 bp, Homo sapiens
agaccgaattttat

SEQ ID NO: 2024905 - DNA, 17 bp, Homo sapiens
agaccgcttcacccctg

SEQ ID NO: 2024906 - DNA, 14 bp, Homo sapiens
agaccgggggccag

SEQ ID NO: 2024907 - DNA, 22 bp, Homo sapiens
agaccgtgtcccaaggagctga

SEQ ID NO: 2024908 - DNA, 19 bp, Homo sapiens
agacctaaatgacctcagc

SEQ ID NO: 2024909 - DNA, 18 bp, Homo sapiens
agacctagacctgggcca

SEQ ID NO: 2024910 - DNA, 19 bp, Homo sapiens
agacctagacctgggccaa

SEQ ID NO: 2024911 - DNA, 11 bp, Homo sapiens
agacctcagcc

SEQ ID NO: 2024912 - DNA, 20 bp, Homo sapiens
agacctcagcctgtgctgcc

SEQ ID NO: 2024913 - DNA, 15 bp, Homo sapiens
acttgtcctatgtca

SEQ ID NO: 2024914 - DNA, 14 bp, Homo sapiens
acttgtctgaggcc

SEQ ID NO: 2024915 - DNA, 15 bp, Homo sapiens
acttgtctgaggcct

SEQ ID NO: 2024916 - DNA, 17 bp, Homo sapiens
acttgtctgaggcctca

SEQ ID NO: 2024917 - DNA, 22 bp, Homo sapiens
acttgtgctgatcgtgctaaat

SEQ ID NO: 2024918 - DNA, 15 bp, Homo sapiens
acttgtggacacagc

SEQ ID NO: 2024919 - DNA, 20 bp, Homo sapiens
acttgtgtactgataaaata

SEQ ID NO: 2024920 - DNA, 22 bp, Homo sapiens
acttgtgtctctgtgcttttaa

SEQ ID NO: 2024921 - DNA, 17 bp, Homo sapiens
acttgttacctttccca

SEQ ID NO: 2024922 - DNA, 18 bp, Homo sapiens
acttgttccttctgcttc

SEQ ID NO: 2024923 - DNA, 16 bp, Homo sapiens
actttaaaataaaaaa

SEQ ID NO: 2024924 - DNA, 15 bp, Homo sapiens
actttaaaataaaat

SEQ ID NO: 2024925 - DNA, 14 bp, Homo sapiens
actttaaagtcttt

SEQ ID NO: 2024926 - DNA, 19 bp, Homo sapiens
actttaaccctctcttccc

SEQ ID NO: 2024927 - DNA, 15 bp, Homo sapiens
actttaagagagaaa

SEQ ID NO: 2024928 - DNA, 17 bp, Homo sapiens
actttaagagagaaatc

SEQ ID NO: 2024929 - DNA, 23 bp, Homo sapiens
actttaagagagaaatctgaaaa

SEQ ID NO: 2024930 - DNA, 23 bp, Homo sapiens
actttaattctcatgtgatcctt

SEQ ID NO: 2024931 - DNA, 12 bp, Homo sapiens
actttaattgtg

SEQ ID NO: 2024932 - DNA, 22 bp, Homo sapiens
actttagccactggtttctcag

SEQ ID NO: 2024933 - DNA, 15 bp, Homo sapiens
actttagctatgtgg

SEQ ID NO: 2024934 - DNA, 22 bp, Homo sapiens
actttatctgtgaccacacgct

SEQ ID NO: 2024935 - DNA, 21 bp, Homo sapiens
actttcaggtactaaatacct

SEQ ID NO: 2024936 - DNA, 17 bp, Homo sapiens
actttccatctgcttgt

SEQ ID NO: 2024937 - DNA, 17 bp, Homo sapiens
actttcctacaaaatgg

SEQ ID NO: 2024938 - DNA, 14 bp, Homo sapiens
actttctgtaaact

SEQ ID NO: 2024939 - DNA, 18 bp, Homo sapiens
actttctgtaaactcaaa

SEQ ID NO: 2024940 - DNA, 13 bp, Homo sapiens
actttctttctca

SEQ ID NO: 2024941 - DNA, 16 bp, Homo sapiens
actttctttctcacta

SEQ ID NO: 2024942 - DNA, 15 bp, Homo sapiens
actttcttttctgga

SEQ ID NO: 2024943 - DNA, 16 bp, Homo sapiens
actttgaggtgtctca

SEQ ID NO: 2024944 - DNA, 18 bp, Homo sapiens
actttggcttctcctgtg

SEQ ID NO: 2024945 - DNA, 19 bp, Homo sapiens
actttggcttctcctgtga

SEQ ID NO: 2024946 - DNA, 12 bp, Homo sapiens
actttgggaggc

SEQ ID NO: 2024947 - DNA, 22 bp, Homo sapiens
actttgtacagtggagaaatat

SEQ ID NO: 2024948 - DNA, 13 bp, Homo sapiens
actttgtctctga

SEQ ID NO: 2024949 - DNA, 17 bp, Homo sapiens
actttgttaaaaatatt

SEQ ID NO: 2024950 - DNA, 12 bp, Homo sapiens
acttttaaacag

SEQ ID NO: 2024951 - DNA, 18 bp, Homo sapiens
acttttaatgaacaaatg

SEQ ID NO: 2024952 - DNA, 20 bp, Homo sapiens
acttttaatgccttccacat

SEQ ID NO: 2024953 - DNA, 16 bp, Homo sapiens
acttttagtaaagtca

SEQ ID NO: 2024954 - DNA, 16 bp, Homo sapiens
acttttccaagccctt

SEQ ID NO: 2024955 - DNA, 17 bp, Homo sapiens
acttttcctccctcagt

SEQ ID NO: 2024956 - DNA, 11 bp, Homo sapiens
acttttctgta

SEQ ID NO: 2024957 - DNA, 14 bp, Homo sapiens
acttttctttgtgg

SEQ ID NO: 2024958 - DNA, 18 bp, Homo sapiens
acttttggtttttatatt

SEQ ID NO: 2024959 - DNA, 17 bp, Homo sapiens
acttttgtaagacaaag

SEQ ID NO: 2024960 - DNA, 22 bp, Homo sapiens
actttttagccagtgacttttt

SEQ ID NO: 2024961 - DNA, 14 bp, Homo sapiens
actttttataatgt

SEQ ID NO: 2024962 - DNA, 13 bp, Homo sapiens
actttttattcaa

SEQ ID NO: 2024963 - DNA, 21 bp, Homo sapiens
actttttattcaattctgtat

SEQ ID NO: 2024964 - DNA, 13 bp, Homo sapiens
actttttcttaaa

SEQ ID NO: 2024965 - DNA, 20 bp, Homo sapiens
agaaaaaaaaaaacttacac

SEQ ID NO: 2024966 - DNA, 12 bp, Homo sapiens
agaaaaaaatat

SEQ ID NO: 2024967 - DNA, 14 bp, Homo sapiens
agaaaaaaatatat

SEQ ID NO: 2024968 - DNA, 22 bp, Homo sapiens
agaaaaaatacattttatatta

SEQ ID NO: 2024969 - DNA, 21 bp, Homo sapiens
agaaaaaattaagagatacat

SEQ ID NO: 2024970 - DNA, 23 bp, Homo sapiens
agaaaaacaaactcgttttttac

SEQ ID NO: 2024971 - DNA, 16 bp, Homo sapiens
agaaaaaccaatgatt

SEQ ID NO: 2024972 - DNA, 14 bp, Homo sapiens
agaaaaagaagcaa

SEQ ID NO: 2024973 - DNA, 17 bp, Homo sapiens
agaaaacacttgtaagt

SEQ ID NO: 2024974 - DNA, 16 bp, Homo sapiens
agaaaacctccagtag

SEQ ID NO: 2024975 - DNA, 21 bp, Homo sapiens
agaaaacggagagtgcttggg

SEQ ID NO: 2024976 - DNA, 16 bp, Homo sapiens
agaaaactgaaaatct

SEQ ID NO: 2024977 - DNA, 22 bp, Homo sapiens
agaaaactggaaatctggattt

SEQ ID NO: 2024978 - DNA, 19 bp, Homo sapiens
agaaaagatgagaggcaga

SEQ ID NO: 2024979 - DNA, 15 bp, Homo sapiens
agaaaagatttaagt

SEQ ID NO: 2024980 - DNA, 21 bp, Homo sapiens
agaaaagcagacgcagcagct

SEQ ID NO: 2024981 - DNA, 14 bp, Homo sapiens
agaaaaggcatgga

SEQ ID NO: 2024982 - DNA, 16 bp, Homo sapiens
agaaaagtagaattat

SEQ ID NO: 2024983 - DNA, 18 bp, Homo sapiens
agaaaagtagaattatat

SEQ ID NO: 2024984 - DNA, 19 bp, Homo sapiens
agaaaagtagaattatatc

SEQ ID NO: 2024985 - DNA, 20 bp, Homo sapiens
agaaaagtgcttagaaagtt

SEQ ID NO: 2024986 - DNA, 14 bp, Homo sapiens
agaaaatataaatg

SEQ ID NO: 2024987 - DNA, 15 bp, Homo sapiens
agaaaatataaatgc

SEQ ID NO: 2024988 - DNA, 14 bp, Homo sapiens
agaaaatgaagaaa

SEQ ID NO: 2024989 - DNA, 16 bp, Homo sapiens
agaaaatgaagcccta

SEQ ID NO: 2024990 - DNA, 14 bp, Homo sapiens
agaaaattagtaat

SEQ ID NO: 2024991 - DNA, 21 bp, Homo sapiens
agaaaatttgaagtaaaggat

SEQ ID NO: 2024992 - DNA, 19 bp, Homo sapiens
agaaacacaaatgtaaaat

SEQ ID NO: 2024993 - DNA, 22 bp, Homo sapiens
agaaacacagggttttgtattc

SEQ ID NO: 2024994 - DNA, 16 bp, Homo sapiens
agaaacacagttttga

SEQ ID NO: 2024995 - DNA, 15 bp, Homo sapiens
agaaacaccattcat

SEQ ID NO: 2024996 - DNA, 15 bp, Homo sapiens
agaaacagagacagg

SEQ ID NO: 2024997 - DNA, 14 bp, Homo sapiens
agaaacagatacca

SEQ ID NO: 2024998 - DNA, 18 bp, Homo sapiens
agaaacagggacaaagaa

SEQ ID NO: 2024999 - DNA, 19 bp, Homo sapiens
agaaacaggggatcaaagt

SEQ ID NO: 2025000 - DNA, 12 bp, Homo sapiens
agaaacatgaca

SEQ ID NO: 2025001 - DNA, 23 bp, Homo sapiens
agaaaccagtatggaagggaggg

SEQ ID NO: 2025002 - DNA, 22 bp, Homo sapiens
agaaacccaccagcctaagaag

SEQ ID NO: 2025003 - DNA, 18 bp, Homo sapiens
agaaaccgtaattttatt

SEQ ID NO: 2025004 - DNA, 17 bp, Homo sapiens
agaaaccttaatatgtg

SEQ ID NO: 2025005 - DNA, 20 bp, Homo sapiens
agaaaccttattgtacctct

SEQ ID NO: 2025006 - DNA, 17 bp, Homo sapiens
agaaactcacgatgaaa

SEQ ID NO: 2025007 - DNA, 14 bp, Homo sapiens
agaaactccttttg

SEQ ID NO: 2025008 - DNA, 20 bp, Homo sapiens
agaaactccttttgctgtct

SEQ ID NO: 2025009 - DNA, 22 bp, Homo sapiens
agaaactccttttgctgtcttt

SEQ ID NO: 2025010 - DNA, 13 bp, Homo sapiens
agaaactgaggaa

SEQ ID NO: 2025011 - DNA, 16 bp, Homo sapiens
agaaactgaggaattt

SEQ ID NO: 2025012 - DNA, 22 bp, Homo sapiens
agaaactgaggagtagctgaga

SEQ ID NO: 2025013 - DNA, 17 bp, Homo sapiens
agaaagaaaagaccctg

SEQ ID NO: 2025014 - DNA, 21 bp, Homo sapiens
agaaagaaaagaccctgagac

SEQ ID NO: 2025015 - DNA, 16 bp, Homo sapiens
agaaagaaaatgaaga

SEQ ID NO: 2025016 - DNA, 13 bp, Homo sapiens
agaaagaaacact

SEQ ID NO: 2025017 - DNA, 18 bp, Homo sapiens
agaaagaaagggaaactg

SEQ ID NO: 2025018 - DNA, 11 bp, Homo sapiens
agaaagaaata

SEQ ID NO: 2025019 - DNA, 12 bp, Homo sapiens
agaaagaaggaa

SEQ ID NO: 2025020 - DNA, 21 bp, Homo sapiens
agaaagaaggacacttgtatg

SEQ ID NO: 2025021 - DNA, 15 bp, Homo sapiens
agaaagacagagctg

SEQ ID NO: 2025022 - DNA, 18 bp, Homo sapiens
agaaagactattcaaaca

SEQ ID NO: 2025023 - DNA, 23 bp, Homo sapiens
agaaagactattcaaacagtctc

SEQ ID NO: 2025024 - DNA, 19 bp, Homo sapiens
agaaagaggtgaccccagg

SEQ ID NO: 2025025 - DNA, 13 bp, Homo sapiens
agaaagatccacc

SEQ ID NO: 2025026 - DNA, 16 bp, Homo sapiens
agaaagctctgcatgt

SEQ ID NO: 2025027 - DNA, 23 bp, Homo sapiens
agaaaggattaagatacactcct

SEQ ID NO: 2025028 - DNA, 15 bp, Homo sapiens
agaaagggaggccca

SEQ ID NO: 2025029 - DNA, 17 bp, Homo sapiens
agaaagggaggcccagc

SEQ ID NO: 2025030 - DNA, 23 bp, Homo sapiens
agaaagggaggcccagccgcagg

SEQ ID NO: 2025031 - DNA, 19 bp, Homo sapiens
agaaagggagggctctgag

SEQ ID NO: 2025032 - DNA, 22 bp, Homo sapiens
agaaagtacttctccaccctgc

SEQ ID NO: 2025033 - DNA, 20 bp, Homo sapiens
agaaagtcgaattaatagct

SEQ ID NO: 2025034 - DNA, 21 bp, Homo sapiens
agaaagtcgaattaatagctt

SEQ ID NO: 2025035 - DNA, 19 bp, Homo sapiens
agaaagtgacctatttttt

SEQ ID NO: 2025036 - DNA, 21 bp, Homo sapiens
agaaagtgacctattttttaa

SEQ ID NO: 2025037 - DNA, 17 bp, Homo sapiens
agaaagtgcagaatcaa

SEQ ID NO: 2025038 - DNA, 21 bp, Homo sapiens
agaaagtggccatgccaccct

SEQ ID NO: 2025039 - DNA, 12 bp, Homo sapiens
agaaagttattg

SEQ ID NO: 2025040 - DNA, 22 bp, Homo sapiens
agaaagttattgtgttgcctta

SEQ ID NO: 2025041 - DNA, 17 bp, Homo sapiens
agaaataagtggttatt

SEQ ID NO: 2025042 - DNA, 21 bp, Homo sapiens
agaaataagtggttatttctc

SEQ ID NO: 2025043 - DNA, 14 bp, Homo sapiens
agaaataagttttt

SEQ ID NO: 2025044 - DNA, 16 bp, Homo sapiens
agaaataagtttttgt

SEQ ID NO: 2025045 - DNA, 15 bp, Homo sapiens
agaaatactgctctg

SEQ ID NO: 2025046 - DNA, 18 bp, Homo sapiens
agaaatactgctctgaat

SEQ ID NO: 2025047 - DNA, 19 bp, Homo sapiens
agaaatactgctctgaata

SEQ ID NO: 2025048 - DNA, 13 bp, Homo sapiens
agaaatatatata

SEQ ID NO: 2025049 - DNA, 15 bp, Homo sapiens
agaaatatatataca

SEQ ID NO: 2025050 - DNA, 17 bp, Homo sapiens
agaaatatatatacata

SEQ ID NO: 2025051 - DNA, 18 bp, Homo sapiens
agaaatatatatacatat

SEQ ID NO: 2025052 - DNA, 20 bp, Homo sapiens
agaaatatatatacatatgt

SEQ ID NO: 2025053 - DNA, 13 bp, Homo sapiens
agaaatatgattt

SEQ ID NO: 2025054 - DNA, 21 bp, Homo sapiens
agaaatatgcacaatagcagt

SEQ ID NO: 2025055 - DNA, 14 bp, Homo sapiens
agaaatatgtggtt

SEQ ID NO: 2025056 - DNA, 15 bp, Homo sapiens
agaaatatgtggttt

SEQ ID NO: 2025057 - DNA, 18 bp, Homo sapiens
agaaatattataaatcca

SEQ ID NO: 2025058 - DNA, 17 bp, Homo sapiens
agaaatatttataaact

SEQ ID NO: 2025059 - DNA, 16 bp, Homo sapiens
agaaatcattgtagaa

SEQ ID NO: 2025060 - DNA, 17 bp, Homo sapiens
agaaatcattttgcaat

SEQ ID NO: 2025061 - DNA, 19 bp, Homo sapiens
agaaatccccccttcagaa

SEQ ID NO: 2025062 - DNA, 20 bp, Homo sapiens
agaaatccccccttcagaac

SEQ ID NO: 2025063 - DNA, 22 bp, Homo sapiens
agaaatccctgtttaatattta

SEQ ID NO: 2025064 - DNA, 12 bp, Homo sapiens
agaaatgctttg

SEQ ID NO: 2025065 - DNA, 17 bp, Homo sapiens
agaaattagaaacctta

SEQ ID NO: 2025066 - DNA, 17 bp, Homo sapiens
agaaattatttaataaa

SEQ ID NO: 2025067 - DNA, 16 bp, Homo sapiens
agaaattccttcccac

SEQ ID NO: 2025068 - DNA, 21 bp, Homo sapiens
agaaattctgtcatagaaagt

SEQ ID NO: 2025069 - DNA, 20 bp, Homo sapiens
agaaattgcatttcctgaca

SEQ ID NO: 2025070 - DNA, 14 bp, Homo sapiens
agaaattgcctcct

SEQ ID NO: 2025071 - DNA, 15 bp, Homo sapiens
agaaattgcctcctt

SEQ ID NO: 2025072 - DNA, 16 bp, Homo sapiens
agaaattgttcctgat

SEQ ID NO: 2025073 - DNA, 18 bp, Homo sapiens
agaaattgttcctgatgt

SEQ ID NO: 2025074 - DNA, 24 bp, Homo sapiens
agaaatttaaactataagcaagaa

SEQ ID NO: 2025075 - DNA, 23 bp, Homo sapiens
agaaattttactgacagaaatgc

SEQ ID NO: 2025076 - DNA, 19 bp, Homo sapiens
agaaatttttatttttgaa

SEQ ID NO: 2025077 - DNA, 19 bp, Homo sapiens
agaacaaacctctatatgt

SEQ ID NO: 2025078 - DNA, 17 bp, Homo sapiens
agaacaacaacaacaat

SEQ ID NO: 2025079 - DNA, 18 bp, Homo sapiens
agaacaacaacaacaata

SEQ ID NO: 2025080 - DNA, 13 bp, Homo sapiens
agaacaattgtcc

SEQ ID NO: 2025081 - DNA, 17 bp, Homo sapiens
agaacacccactggcca

SEQ ID NO: 2025082 - DNA, 23 bp, Homo sapiens
agaacagcagggtagtctggttt

SEQ ID NO: 2025083 - DNA, 18 bp, Homo sapiens
agaacagccgctcctgtc

SEQ ID NO: 2025084 - DNA, 16 bp, Homo sapiens
agaacaggcaagtgaa

SEQ ID NO: 2025085 - DNA, 21 bp, Homo sapiens
agaacatagacagaagaaaca

SEQ ID NO: 2025086 - DNA, 15 bp, Homo sapiens
agaacatccaaggag

SEQ ID NO: 2025087 - DNA, 11 bp, Homo sapiens
agaacatttac

SEQ ID NO: 2025088 - DNA, 18 bp, Homo sapiens
agaaccaaaagttttcct

SEQ ID NO: 2025089 - DNA, 16 bp, Homo sapiens
agaaccaagcttcaga

SEQ ID NO: 2025090 - DNA, 20 bp, Homo sapiens
agaaccaagcttcagagcct

SEQ ID NO: 2025091 - DNA, 12 bp, Homo sapiens
agaaccagaggg

SEQ ID NO: 2025092 - DNA, 17 bp, Homo sapiens
agaacccctacatgaaa

SEQ ID NO: 2025093 - DNA, 12 bp, Homo sapiens
agaacctggaga

SEQ ID NO: 2025094 - DNA, 17 bp, Homo sapiens
agaacctggagagctag

SEQ ID NO: 2025095 - DNA, 17 bp, Homo sapiens
agaactcagttttaact

SEQ ID NO: 2025096 - DNA, 19 bp, Homo sapiens
agaactccggaatgaccag

SEQ ID NO: 2025097 - DNA, 17 bp, Homo sapiens
agaactccttattttgt

SEQ ID NO: 2025098 - DNA, 18 bp, Homo sapiens
agaactccttattttgta

SEQ ID NO: 2025099 - DNA, 19 bp, Homo sapiens
agaactccttattttgtat

SEQ ID NO: 2025100 - DNA, 20 bp, Homo sapiens
agaactgaacgtcctgcagc

SEQ ID NO: 2025101 - DNA, 13 bp, Homo sapiens
agaactgccattg

SEQ ID NO: 2025102 - DNA, 22 bp, Homo sapiens
agaactgctaaatactgtacat

SEQ ID NO: 2025103 - DNA, 14 bp, Homo sapiens
agaactgggatttg

SEQ ID NO: 2025104 - DNA, 13 bp, Homo sapiens
agaacttcaatca

SEQ ID NO: 2025105 - DNA, 22 bp, Homo sapiens
agaacttcgaccctttctctga

SEQ ID NO: 2025106 - DNA, 23 bp, Homo sapiens
agaactttgtacagtggagaaat

SEQ ID NO: 2025107 - DNA, 15 bp, Homo sapiens
agaagaaaaagaagc

SEQ ID NO: 2025108 - DNA, 15 bp, Homo sapiens
agaagaaagtgtaga

SEQ ID NO: 2025109 - DNA, 13 bp, Homo sapiens
agaagaaatccat

SEQ ID NO: 2025110 - DNA, 16 bp, Homo sapiens
agaagaatattcagga

SEQ ID NO: 2025111 - DNA, 18 bp, Homo sapiens
agaagaatattcaggact

SEQ ID NO: 2025112 - DNA, 17 bp, Homo sapiens
agaagaattgaacccag

SEQ ID NO: 2025113 - DNA, 19 bp, Homo sapiens
agaagactgggctagggag

SEQ ID NO: 2025114 - DNA, 12 bp, Homo sapiens
agaagagacagg

SEQ ID NO: 2025115 - DNA, 24 bp, Homo sapiens
agaagagatgggatttcatcatgt

SEQ ID NO: 2025116 - DNA, 22 bp, Homo sapiens
agaagagctgttcacagccaga

SEQ ID NO: 2025117 - DNA, 17 bp, Homo sapiens
agaagaggctggtgctg

SEQ ID NO: 2025118 - DNA, 22 bp, Homo sapiens
agaagaggctggtgctgtggcc

SEQ ID NO: 2025119 - DNA, 15 bp, Homo sapiens
agaagagtttgcaaa

SEQ ID NO: 2025120 - DNA, 22 bp, Homo sapiens
agaagatgccctccaatccttt

SEQ ID NO: 2025121 - DNA, 19 bp, Homo sapiens
agaagatggactctgaaaa

SEQ ID NO: 2025122 - DNA, 23 bp, Homo sapiens
agaagcaacctcagtaatttaga

SEQ ID NO: 2025123 - DNA, 17 bp, Homo sapiens
agaagcagtgagccgca

SEQ ID NO: 2025124 - DNA, 17 bp, Homo sapiens
agaagcatcaccatgca

SEQ ID NO: 2025125 - DNA, 20 bp, Homo sapiens
agaagccacgctgtcctctc

SEQ ID NO: 2025126 - DNA, 12 bp, Homo sapiens
agaagccaggag

SEQ ID NO: 2025127 - DNA, 20 bp, Homo sapiens
agaagccaggagcaaatgtt

SEQ ID NO: 2025128 - DNA, 21 bp, Homo sapiens
agaagcccaatattataattt

SEQ ID NO: 2025129 - DNA, 17 bp, Homo sapiens
agaagcctgaggctggg

SEQ ID NO: 2025130 - DNA, 14 bp, Homo sapiens
agaagcctgggggc

SEQ ID NO: 2025131 - DNA, 21 bp, Homo sapiens
agaagcctgggggcctggctg

SEQ ID NO: 2025132 - DNA, 14 bp, Homo sapiens
agaagcgagcactg

SEQ ID NO: 2025133 - DNA, 16 bp, Homo sapiens
agaagcgctcatctgg

SEQ ID NO: 2025134 - DNA, 23 bp, Homo sapiens
agaagcgggacgagaccctacag

SEQ ID NO: 2025135 - DNA, 20 bp, Homo sapiens
agaagcggtttccaggccac

SEQ ID NO: 2025136 - DNA, 22 bp, Homo sapiens
agaagcggtttccaggccaccg

SEQ ID NO: 2025137 - DNA, 18 bp, Homo sapiens
agaagctaaaacctgagc

SEQ ID NO: 2025138 - DNA, 13 bp, Homo sapiens
agaagctaagctg

SEQ ID NO: 2025139 - DNA, 23 bp, Homo sapiens
agaagctctggccccaggcttgt

SEQ ID NO: 2025140 - DNA, 23 bp, Homo sapiens
agaagctctgtttataaaaacaa

SEQ ID NO: 2025141 - DNA, 13 bp, Homo sapiens
agaagctgaggat

SEQ ID NO: 2025142 - DNA, 16 bp, Homo sapiens
agaagctgaggatcct

SEQ ID NO: 2025143 - DNA, 18 bp, Homo sapiens
agaagcttccattccaag

SEQ ID NO: 2025144 - DNA, 9 bp, Homo sapiens
agaaggaag

SEQ ID NO: 2025145 - DNA, 17 bp, Homo sapiens
agaaggaaggaggcaga

SEQ ID NO: 2025146 - DNA, 16 bp, Homo sapiens
actgctgagccactcg

SEQ ID NO: 2025147 - DNA, 12 bp, Homo sapiens
actgctgcacca

SEQ ID NO: 2025148 - DNA, 12 bp, Homo sapiens
actgctggctgc

SEQ ID NO: 2025149 - DNA, 15 bp, Homo sapiens
actgctggctgcctt

SEQ ID NO: 2025150 - DNA, 18 bp, Homo sapiens
actgctgtcattgtccat

SEQ ID NO: 2025151 - DNA, 22 bp, Homo sapiens
actgctgttaattgattaaaat

SEQ ID NO: 2025152 - DNA, 18 bp, Homo sapiens
actgcttgtgtttttaac

SEQ ID NO: 2025153 - DNA, 20 bp, Homo sapiens
actgctttccagcctgggca

SEQ ID NO: 2025154 - DNA, 14 bp, Homo sapiens
actgcttttggtct

SEQ ID NO: 2025155 - DNA, 15 bp, Homo sapiens
actgcttttggtctg

SEQ ID NO: 2025156 - DNA, 15 bp, Homo sapiens
actggaaccagggag

SEQ ID NO: 2025157 - DNA, 18 bp, Homo sapiens
actggaacttgaactgat

SEQ ID NO: 2025158 - DNA, 16 bp, Homo sapiens
actggaagttttgcat

SEQ ID NO: 2025159 - DNA, 20 bp, Homo sapiens
actggacatcacagcagaat

SEQ ID NO: 2025160 - DNA, 19 bp, Homo sapiens
actggaccccgcctcccag

SEQ ID NO: 2025161 - DNA, 22 bp, Homo sapiens
actggacgcccagctgaggctg

SEQ ID NO: 2025162 - DNA, 13 bp, Homo sapiens
actggagcaccag

SEQ ID NO: 2025163 - DNA, 15 bp, Homo sapiens
actggagcaccaggc

SEQ ID NO: 2025164 - DNA, 19 bp, Homo sapiens
actggagcaccaggcacga

SEQ ID NO: 2025165 - DNA, 14 bp, Homo sapiens
actggagcatctga

SEQ ID NO: 2025166 - DNA, 17 bp, Homo sapiens
actggagcatctgactc

SEQ ID NO: 2025167 - DNA, 16 bp, Homo sapiens
actggagcccaggagt

SEQ ID NO: 2025168 - DNA, 22 bp, Homo sapiens
actggagcccgagggcctgaca

SEQ ID NO: 2025169 - DNA, 21 bp, Homo sapiens
actggaggtcacattcaggaa

SEQ ID NO: 2025170 - DNA, 19 bp, Homo sapiens
actggagtgaggcttccag

SEQ ID NO: 2025171 - DNA, 20 bp, Homo sapiens
actggagtgaggcttccagg

SEQ ID NO: 2025172 - DNA, 22 bp, Homo sapiens
actggagtgaggcttccaggct

SEQ ID NO: 2025173 - DNA, 17 bp, Homo sapiens
actggagtgcagggagg

SEQ ID NO: 2025174 - DNA, 15 bp, Homo sapiens
actggagttacatta

SEQ ID NO: 2025175 - DNA, 14 bp, Homo sapiens
actggatatgttgt

SEQ ID NO: 2025176 - DNA, 19 bp, Homo sapiens
actggcacagttttctgag

SEQ ID NO: 2025177 - DNA, 21 bp, Homo sapiens
actggcacagttttctgagaa

SEQ ID NO: 2025178 - DNA, 13 bp, Homo sapiens
actggcaggtgca

SEQ ID NO: 2025179 - DNA, 21 bp, Homo sapiens
actggcaggtgcagatgggct

SEQ ID NO: 2025180 - DNA, 14 bp, Homo sapiens
actggccaagctga

SEQ ID NO: 2025181 - DNA, 13 bp, Homo sapiens
actggccagagag

SEQ ID NO: 2025182 - DNA, 19 bp, Homo sapiens
actggccagagagggccca

SEQ ID NO: 2025183 - DNA, 18 bp, Homo sapiens
actggccagtcctagagc

SEQ ID NO: 2025184 - DNA, 21 bp, Homo sapiens
actggccagtcctagagctcc

SEQ ID NO: 2025185 - DNA, 17 bp, Homo sapiens
actggcctcaaagcaag

SEQ ID NO: 2025186 - DNA, 14 bp, Homo sapiens
actggctcacccct

SEQ ID NO: 2025187 - DNA, 22 bp, Homo sapiens
actggctcacccctctcccccg

SEQ ID NO: 2025188 - DNA, 23 bp, Homo sapiens
actggcttctgtgcactagcctg

SEQ ID NO: 2025189 - DNA, 17 bp, Homo sapiens
actgggaaggctacttc

SEQ ID NO: 2025190 - DNA, 15 bp, Homo sapiens
actgggaccaggcac

SEQ ID NO: 2025191 - DNA, 23 bp, Homo sapiens
actggggagttataaaaatacaa

SEQ ID NO: 2025192 - DNA, 18 bp, Homo sapiens
actggggatgtgggaggg

SEQ ID NO: 2025193 - DNA, 15 bp, Homo sapiens
actgggggaaaagat

SEQ ID NO: 2025194 - DNA, 20 bp, Homo sapiens
actggggtcctggggcctcg

SEQ ID NO: 2025195 - DNA, 14 bp, Homo sapiens
actggggtgcgaga

SEQ ID NO: 2025196 - DNA, 15 bp, Homo sapiens
actgggtagtagcta

SEQ ID NO: 2025197 - DNA, 23 bp, Homo sapiens
actgggtgggatggatgctgggg

SEQ ID NO: 2025198 - DNA, 22 bp, Homo sapiens
actgggttatttttgtccctgc

SEQ ID NO: 2025199 - DNA, 23 bp, Homo sapiens
actggtccactcagggctgccac

SEQ ID NO: 2025200 - DNA, 20 bp, Homo sapiens
actggtggcccgacagcctg

SEQ ID NO: 2025201 - DNA, 15 bp, Homo sapiens
actggtttctcagaa

SEQ ID NO: 2025202 - DNA, 16 bp, Homo sapiens
actgtaaatatccaca

SEQ ID NO: 2025203 - DNA, 23 bp, Homo sapiens
actgtaaatatgtttgtgcctta

SEQ ID NO: 2025204 - DNA, 12 bp, Homo sapiens
actgtaaatcac

SEQ ID NO: 2025205 - DNA, 15 bp, Homo sapiens
actgtaaatcacttg

SEQ ID NO: 2025206 - DNA, 20 bp, Homo sapiens
actgtaaatcacttgtaaat

SEQ ID NO: 2025207 - DNA, 22 bp, Homo sapiens
actgtaaatcacttgtaaataa

SEQ ID NO: 2025208 - DNA, 22 bp, Homo sapiens
actgtaagtttattttttctac

SEQ ID NO: 2025209 - DNA, 18 bp, Homo sapiens
actgtaatcttaaaagtg

SEQ ID NO: 2025210 - DNA, 17 bp, Homo sapiens
actgtaattaagtgcaa

SEQ ID NO: 2025211 - DNA, 15 bp, Homo sapiens
actgtaattggtgac

SEQ ID NO: 2025212 - DNA, 22 bp, Homo sapiens
actgtaattggtgacaatgtca

SEQ ID NO: 2025213 - DNA, 13 bp, Homo sapiens
actgtaattttgt

SEQ ID NO: 2025214 - DNA, 17 bp, Homo sapiens
actgtacatagatgtat

SEQ ID NO: 2025215 - DNA, 20 bp, Homo sapiens
actgtactcctcccaggcgc

SEQ ID NO: 2025216 - DNA, 17 bp, Homo sapiens
actgtacttattttcca

SEQ ID NO: 2025217 - DNA, 17 bp, Homo sapiens
actgtatcaaatctgta

SEQ ID NO: 2025218 - DNA, 14 bp, Homo sapiens
actgtcaccctcca

SEQ ID NO: 2025219 - DNA, 17 bp, Homo sapiens
actgtcaccctccacct

SEQ ID NO: 2025220 - DNA, 19 bp, Homo sapiens
actgtcagcccacagcagc

SEQ ID NO: 2025221 - DNA, 21 bp, Homo sapiens
actgtcagctcccctcggaga

SEQ ID NO: 2025222 - DNA, 23 bp, Homo sapiens
actgtcagctcccctcggagaag

SEQ ID NO: 2025223 - DNA, 20 bp, Homo sapiens
actgtccctcaaatgaccca

SEQ ID NO: 2025224 - DNA, 18 bp, Homo sapiens
actgtcctacccaccctc

SEQ ID NO: 2025225 - DNA, 20 bp, Homo sapiens
actgtctcctggtctgtgct

SEQ ID NO: 2025226 - DNA, 19 bp, Homo sapiens
actgtctggttttaacaat

SEQ ID NO: 2025227 - DNA, 16 bp, Homo sapiens
actgtcttgcctgcca

SEQ ID NO: 2025228 - DNA, 10 bp, Homo sapiens
actgtgaaag

SEQ ID NO: 2025229 - DNA, 13 bp, Homo sapiens
actgtgaaagtat

SEQ ID NO: 2025230 - DNA, 18 bp, Homo sapiens
actgtgaacctggagggc

SEQ ID NO: 2025231 - DNA, 23 bp, Homo sapiens
actgtgactctttttagggccag

SEQ ID NO: 2025232 - DNA, 11 bp, Homo sapiens
actgtgactga

SEQ ID NO: 2025233 - DNA, 16 bp, Homo sapiens
actgtgagactgtatg

SEQ ID NO: 2025234 - DNA, 21 bp, Homo sapiens
actgtgatggggtgggcaggg

SEQ ID NO: 2025235 - DNA, 17 bp, Homo sapiens
actgtgccatgtgccag

SEQ ID NO: 2025236 - DNA, 18 bp, Homo sapiens
actgtgccatgtgccagg

SEQ ID NO: 2025237 - DNA, 16 bp, Homo sapiens
actgtgcctagttcct

SEQ ID NO: 2025238 - DNA, 20 bp, Homo sapiens
actgtgcgttttagagtatg

SEQ ID NO: 2025239 - DNA, 16 bp, Homo sapiens
actgtgcttacagtga

SEQ ID NO: 2025240 - DNA, 17 bp, Homo sapiens
actgtgcttacagtgac

SEQ ID NO: 2025241 - DNA, 21 bp, Homo sapiens
actgtggccagagctggaagg

SEQ ID NO: 2025242 - DNA, 18 bp, Homo sapiens
actgtggcgttctgctgc

SEQ ID NO: 2025243 - DNA, 19 bp, Homo sapiens
actgtggctgcagagacct

SEQ ID NO: 2025244 - DNA, 17 bp, Homo sapiens
actgtggctttggcaga

SEQ ID NO: 2025245 - DNA, 13 bp, Homo sapiens
actgtgtgaagaa

SEQ ID NO: 2025246 - DNA, 14 bp, Homo sapiens
actgtgtgaagaaa

SEQ ID NO: 2025247 - DNA, 16 bp, Homo sapiens
actgtgttcagtgcct

SEQ ID NO: 2025248 - DNA, 17 bp, Homo sapiens
actgttaatagttcagg

SEQ ID NO: 2025249 - DNA, 16 bp, Homo sapiens
actgttactccacagc

SEQ ID NO: 2025250 - DNA, 14 bp, Homo sapiens
actgttacttttta

SEQ ID NO: 2025251 - DNA, 20 bp, Homo sapiens
actgttactttttagtcttt

SEQ ID NO: 2025252 - DNA, 19 bp, Homo sapiens
actgttattgaaaatatat

SEQ ID NO: 2025253 - DNA, 13 bp, Homo sapiens
actgttctgtgtg

SEQ ID NO: 2025254 - DNA, 21 bp, Homo sapiens
actgttgaaaattattttaaa

SEQ ID NO: 2025255 - DNA, 12 bp, Homo sapiens
actgttgcccag

SEQ ID NO: 2025256 - DNA, 18 bp, Homo sapiens
actgttgcccaggctggc

SEQ ID NO: 2025257 - DNA, 18 bp, Homo sapiens
actgtttatggtattttc

SEQ ID NO: 2025258 - DNA, 23 bp, Homo sapiens
actgtttttatatgcacatgtaa

SEQ ID NO: 2025259 - DNA, 18 bp, Homo sapiens
actgtttttcggacagtt

SEQ ID NO: 2025260 - DNA, 15 bp, Homo sapiens
actgtttttgaagaa

SEQ ID NO: 2025261 - DNA, 22 bp, Homo sapiens
actgtttttgaagaagggaaat

SEQ ID NO: 2025262 - DNA, 15 bp, Homo sapiens
acttaaaaaaatgac

SEQ ID NO: 2025263 - DNA, 23 bp, Homo sapiens
acttaaaaaacttgtaaatgctg

SEQ ID NO: 2025264 - DNA, 14 bp, Homo sapiens
acttaaaaaatgtc

SEQ ID NO: 2025265 - DNA, 15 bp, Homo sapiens
acttaaaaaatgtcc

SEQ ID NO: 2025266 - DNA, 14 bp, Homo sapiens
acttaaaagattca

SEQ ID NO: 2025267 - DNA, 16 bp, Homo sapiens
acttaaatagtatttc

SEQ ID NO: 2025268 - DNA, 13 bp, Homo sapiens
acttaaatcactg

SEQ ID NO: 2025269 - DNA, 14 bp, Homo sapiens
acttaaatcactga

SEQ ID NO: 2025270 - DNA, 14 bp, Homo sapiens
acttaaattttaag

SEQ ID NO: 2025271 - DNA, 19 bp, Homo sapiens
acttaattacatccagaaa

SEQ ID NO: 2025272 - DNA, 12 bp, Homo sapiens
acttacatgatt

SEQ ID NO: 2025273 - DNA, 17 bp, Homo sapiens
acttacctagatttaca

SEQ ID NO: 2025274 - DNA, 19 bp, Homo sapiens
acttaccttcaataaagta

SEQ ID NO: 2025275 - DNA, 16 bp, Homo sapiens
acttactcccattttc

SEQ ID NO: 2025276 - DNA, 15 bp, Homo sapiens
acttagaataaaatt

SEQ ID NO: 2025277 - DNA, 22 bp, Homo sapiens
acttagaataaaattgtaaaat

SEQ ID NO: 2025278 - DNA, 21 bp, Homo sapiens
acttagcccaagaggtctgag

SEQ ID NO: 2025279 - DNA, 16 bp, Homo sapiens
acttagctatcagaag

SEQ ID NO: 2025280 - DNA, 17 bp, Homo sapiens
acttagtatattttctt

SEQ ID NO: 2025281 - DNA, 20 bp, Homo sapiens
acttatttacctataaaatg

SEQ ID NO: 2025282 - DNA, 11 bp, Homo sapiens
acttatttgag

SEQ ID NO: 2025283 - DNA, 21 bp, Homo sapiens
acttattttccaataaaattt

SEQ ID NO: 2025284 - DNA, 14 bp, Homo sapiens
acttatttttgaca

SEQ ID NO: 2025285 - DNA, 19 bp, Homo sapiens
acttatttttgacagtgtt

SEQ ID NO: 2025286 - DNA, 12 bp, Homo sapiens
acttcaatgaac

SEQ ID NO: 2025287 - DNA, 17 bp, Homo sapiens
acttcacacacaggcaa

SEQ ID NO: 2025288 - DNA, 14 bp, Homo sapiens
acttcacactgcaa

SEQ ID NO: 2025289 - DNA, 15 bp, Homo sapiens
acttcacactgcaag

SEQ ID NO: 2025290 - DNA, 16 bp, Homo sapiens
acttcacactgcaaga

SEQ ID NO: 2025291 - DNA, 23 bp, Homo sapiens
acttcacactgcaagagccttgg

SEQ ID NO: 2025292 - DNA, 17 bp, Homo sapiens
acttcagaacatgctgg

SEQ ID NO: 2025293 - DNA, 17 bp, Homo sapiens
acttcaggctcttctcc

SEQ ID NO: 2025294 - DNA, 20 bp, Homo sapiens
acttcaggctcttctccttt

SEQ ID NO: 2025295 - DNA, 20 bp, Homo sapiens
acttcaggtggagagcacta

SEQ ID NO: 2025296 - DNA, 17 bp, Homo sapiens
acttcaggttgttctgt

SEQ ID NO: 2025297 - DNA, 22 bp, Homo sapiens
acttcaggttgttctgtataaa

SEQ ID NO: 2025298 - DNA, 17 bp, Homo sapiens
acttcagtcctggtctg

SEQ ID NO: 2025299 - DNA, 14 bp, Homo sapiens
acttcagtcttgga

SEQ ID NO: 2025300 - DNA, 19 bp, Homo sapiens
acttcataaatgttcagct

SEQ ID NO: 2025301 - DNA, 13 bp, Homo sapiens
acttcatggacca

SEQ ID NO: 2025302 - DNA, 14 bp, Homo sapiens
acttcatggaccaa

SEQ ID NO: 2025303 - DNA, 14 bp, Homo sapiens
acttcattcttgaa

SEQ ID NO: 2025304 - DNA, 19 bp, Homo sapiens
acttcattcttgaaagctg

SEQ ID NO: 2025305 - DNA, 17 bp, Homo sapiens
acttcatttggtgctgg

SEQ ID NO: 2025306 - DNA, 16 bp, Homo sapiens
acttcattttcagagt

SEQ ID NO: 2025307 - DNA, 18 bp, Homo sapiens
acttcattttcagagtga

SEQ ID NO: 2025308 - DNA, 19 bp, Homo sapiens
acttcattttcagagtgac

SEQ ID NO: 2025309 - DNA, 16 bp, Homo sapiens
acttcccagaggcaga

SEQ ID NO: 2025310 - DNA, 24 bp, Homo sapiens
acttcccagttcaggagtcccaag

SEQ ID NO: 2025311 - DNA, 19 bp, Homo sapiens
acttcccattttggaagtt

SEQ ID NO: 2025312 - DNA, 20 bp, Homo sapiens
acttcctcctgatggccaag

SEQ ID NO: 2025313 - DNA, 18 bp, Homo sapiens
acttcctggggccccgct

SEQ ID NO: 2025314 - DNA, 22 bp, Homo sapiens
acttcctggtgaggcccagcct

SEQ ID NO: 2025315 - DNA, 13 bp, Homo sapiens
acttcctgtgtac

SEQ ID NO: 2025316 - DNA, 15 bp, Homo sapiens
acttcgactcaggat

SEQ ID NO: 2025317 - DNA, 23 bp, Homo sapiens
acttcgtgcgcaacaacaaggac

SEQ ID NO: 2025318 - DNA, 11 bp, Homo sapiens
acttctaatat

SEQ ID NO: 2025319 - DNA, 20 bp, Homo sapiens
acttctcattttttaaaaaa

SEQ ID NO: 2025320 - DNA, 14 bp, Homo sapiens
acttctccaccctg

SEQ ID NO: 2025321 - DNA, 22 bp, Homo sapiens
acttctctttcttattttgtaa

SEQ ID NO: 2025322 - DNA, 14 bp, Homo sapiens
acttctctttgcct

SEQ ID NO: 2025323 - DNA, 21 bp, Homo sapiens
acttcttaaaggcctggaacc

SEQ ID NO: 2025324 - DNA, 21 bp, Homo sapiens
acttcttaatgctttcctccc

SEQ ID NO: 2025325 - DNA, 23 bp, Homo sapiens
acttcttaatgctttcctccctg

SEQ ID NO: 2025326 - DNA, 24 bp, Homo sapiens
acttcttgaaacagcctgggtgac

SEQ ID NO: 2025327 - DNA, 16 bp, Homo sapiens
acttcttggaaaaaaa

SEQ ID NO: 2025328 - DNA, 17 bp, Homo sapiens
acttctttgcagagcct

SEQ ID NO: 2025329 - DNA, 19 bp, Homo sapiens
acttcttttgctcttagct

SEQ ID NO: 2025330 - DNA, 19 bp, Homo sapiens
acttgaaaaaatgttctat

SEQ ID NO: 2025331 - DNA, 18 bp, Homo sapiens
acttgaaataccagtgaa

SEQ ID NO: 2025332 - DNA, 17 bp, Homo sapiens
acttgaaattatatctg

SEQ ID NO: 2025333 - DNA, 17 bp, Homo sapiens
acttgaacccgggaggc

SEQ ID NO: 2025334 - DNA, 22 bp, Homo sapiens
acttgaatctgttactgaaatg

SEQ ID NO: 2025335 - DNA, 22 bp, Homo sapiens
acttgacaacatcccacagtgg

SEQ ID NO: 2025336 - DNA, 20 bp, Homo sapiens
acttgacagaacactgtctt

SEQ ID NO: 2025337 - DNA, 12 bp, Homo sapiens
acttgacagtgg

SEQ ID NO: 2025338 - DNA, 14 bp, Homo sapiens
acttgacagtggaa

SEQ ID NO: 2025339 - DNA, 14 bp, Homo sapiens
acttgacattcctt

SEQ ID NO: 2025340 - DNA, 23 bp, Homo sapiens
acttgagctgtatatatatatgt

SEQ ID NO: 2025341 - DNA, 12 bp, Homo sapiens
acttgaggacac

SEQ ID NO: 2025342 - DNA, 13 bp, Homo sapiens
acttgaggacaca

SEQ ID NO: 2025343 - DNA, 18 bp, Homo sapiens
acttgaggacacatgtcc

SEQ ID NO: 2025344 - DNA, 18 bp, Homo sapiens
acttgagttacaccagac

SEQ ID NO: 2025345 - DNA, 16 bp, Homo sapiens
acttgcacaagcttgt

SEQ ID NO: 2025346 - DNA, 17 bp, Homo sapiens
acttgcacaagcttgta

SEQ ID NO: 2025347 - DNA, 14 bp, Homo sapiens
acttgcacatctct

SEQ ID NO: 2025348 - DNA, 15 bp, Homo sapiens
acttgcacatctctg

SEQ ID NO: 2025349 - DNA, 19 bp, Homo sapiens
acttgcacatctctgcagt

SEQ ID NO: 2025350 - DNA, 19 bp, Homo sapiens
acttgcagactctacagag

SEQ ID NO: 2025351 - DNA, 23 bp, Homo sapiens
acttgcagactctacagaggcca

SEQ ID NO: 2025352 - DNA, 14 bp, Homo sapiens
acttgcagagttca

SEQ ID NO: 2025353 - DNA, 14 bp, Homo sapiens
acttgcgtcctgca

SEQ ID NO: 2025354 - DNA, 17 bp, Homo sapiens
acttgcgtcctgcagag

SEQ ID NO: 2025355 - DNA, 18 bp, Homo sapiens
acttgcttctaaatgccc

SEQ ID NO: 2025356 - DNA, 14 bp, Homo sapiens
acttggaagctccg

SEQ ID NO: 2025357 - DNA, 23 bp, Homo sapiens
acttggagagggacgaagaaagg

SEQ ID NO: 2025358 - DNA, 19 bp, Homo sapiens
acttggagccaagggttca

SEQ ID NO: 2025359 - DNA, 15 bp, Homo sapiens
acttggagcccgtgc

SEQ ID NO: 2025360 - DNA, 16 bp, Homo sapiens
acttggcaacagaagc

SEQ ID NO: 2025361 - DNA, 13 bp, Homo sapiens
acttggctgctca

SEQ ID NO: 2025362 - DNA, 20 bp, Homo sapiens
acttgggagacctgtaatca

SEQ ID NO: 2025363 - DNA, 17 bp, Homo sapiens
acttgggcacccccagc

SEQ ID NO: 2025364 - DNA, 14 bp, Homo sapiens
acttggggaccaga

SEQ ID NO: 2025365 - DNA, 20 bp, Homo sapiens
acttggggtcaccaccctcc

SEQ ID NO: 2025366 - DNA, 14 bp, Homo sapiens
acttggttttgcta

SEQ ID NO: 2025367 - DNA, 20 bp, Homo sapiens
acttggtttttggctctttc

SEQ ID NO: 2025368 - DNA, 14 bp, Homo sapiens
acttgtaaataaat

SEQ ID NO: 2025369 - DNA, 15 bp, Homo sapiens
acttgtaaatacacc

SEQ ID NO: 2025370 - DNA, 14 bp, Homo sapiens
acttgtaaatgctg

SEQ ID NO: 2025371 - DNA, 14 bp, Homo sapiens
acttgtaagttgct

SEQ ID NO: 2025372 - DNA, 14 bp, Homo sapiens
acttgtacaaaata

SEQ ID NO: 2025373 - DNA, 18 bp, Homo sapiens
acttgtacaaaataaaca

SEQ ID NO: 2025374 - DNA, 22 bp, Homo sapiens
acttgtactatgttaataactt

SEQ ID NO: 2025375 - DNA, 14 bp, Homo sapiens
acttgtataaatgt

SEQ ID NO: 2025376 - DNA, 20 bp, Homo sapiens
acttgtataaatgtatatac

SEQ ID NO: 2025377 - DNA, 11 bp, Homo sapiens
acttgtatctg

SEQ ID NO: 2025378 - DNA, 22 bp, Homo sapiens
acttgtcactatgctatttctg

SEQ ID NO: 2025379 - DNA, 20 bp, Homo sapiens
actacttttgtaccagtgtg

SEQ ID NO: 2025380 - DNA, 22 bp, Homo sapiens
actactttttatactccataca

SEQ ID NO: 2025381 - DNA, 23 bp, Homo sapiens
actagaacctggagggctagaac

SEQ ID NO: 2025382 - DNA, 18 bp, Homo sapiens
actagaatggtagcacta

SEQ ID NO: 2025383 - DNA, 21 bp, Homo sapiens
actagagcctgtgctaaagaa

SEQ ID NO: 2025384 - DNA, 17 bp, Homo sapiens
actagagctgggaaaca

SEQ ID NO: 2025385 - DNA, 18 bp, Homo sapiens
actagaggtgagaaattt

SEQ ID NO: 2025386 - DNA, 20 bp, Homo sapiens
actagatcaaggagcccaga

SEQ ID NO: 2025387 - DNA, 13 bp, Homo sapiens
actagatctcctg

SEQ ID NO: 2025388 - DNA, 15 bp, Homo sapiens
actagatctcctgta

SEQ ID NO: 2025389 - DNA, 18 bp, Homo sapiens
actagatctcctgtaatt

SEQ ID NO: 2025390 - DNA, 11 bp, Homo sapiens
actagcaggca

SEQ ID NO: 2025391 - DNA, 12 bp, Homo sapiens
actagccaaggc

SEQ ID NO: 2025392 - DNA, 21 bp, Homo sapiens
actagccatgataactgcaat

SEQ ID NO: 2025393 - DNA, 19 bp, Homo sapiens
actagctaaggaagggaaa

SEQ ID NO: 2025394 - DNA, 16 bp, Homo sapiens
actagcttttcaaaca

SEQ ID NO: 2025395 - DNA, 13 bp, Homo sapiens
actaggacctcat

SEQ ID NO: 2025396 - DNA, 19 bp, Homo sapiens
actaggacctcatatcttc

SEQ ID NO: 2025397 - DNA, 22 bp, Homo sapiens
actagggtcctggccctcttct

SEQ ID NO: 2025398 - DNA, 14 bp, Homo sapiens
actaggttctaggt

SEQ ID NO: 2025399 - DNA, 19 bp, Homo sapiens
actagttgaacatctcact

SEQ ID NO: 2025400 - DNA, 15 bp, Homo sapiens
actataaactactgt

SEQ ID NO: 2025401 - DNA, 16 bp, Homo sapiens
actataaactactgta

SEQ ID NO: 2025402 - DNA, 17 bp, Homo sapiens
actataaactactgtaa

SEQ ID NO: 2025403 - DNA, 17 bp, Homo sapiens
actataaccatcagtta

SEQ ID NO: 2025404 - DNA, 19 bp, Homo sapiens
actataaccatcagttact

SEQ ID NO: 2025405 - DNA, 20 bp, Homo sapiens
actataaccatcagttactg

SEQ ID NO: 2025406 - DNA, 22 bp, Homo sapiens
actataaccatcagttactggt

SEQ ID NO: 2025407 - DNA, 22 bp, Homo sapiens
actataactgtcatctagcccc

SEQ ID NO: 2025408 - DNA, 20 bp, Homo sapiens
actatagcccaggtcctctg

SEQ ID NO: 2025409 - DNA, 17 bp, Homo sapiens
actatagcctaggtgac

SEQ ID NO: 2025410 - DNA, 14 bp, Homo sapiens
actatatacatgtg

SEQ ID NO: 2025411 - DNA, 16 bp, Homo sapiens
actatatacatgtgtg

SEQ ID NO: 2025412 - DNA, 17 bp, Homo sapiens
actatatagagatgttt

SEQ ID NO: 2025413 - DNA, 22 bp, Homo sapiens
actatatgataaagagggatgt

SEQ ID NO: 2025414 - DNA, 15 bp, Homo sapiens
actatattgtacaca

SEQ ID NO: 2025415 - DNA, 19 bp, Homo sapiens
actatcaaactgaagccag

SEQ ID NO: 2025416 - DNA, 16 bp, Homo sapiens
actatcaatatttaag

SEQ ID NO: 2025417 - DNA, 18 bp, Homo sapiens
actatcaatatttaagtt

SEQ ID NO: 2025418 - DNA, 11 bp, Homo sapiens
actatcacata

SEQ ID NO: 2025419 - DNA, 13 bp, Homo sapiens
actatcacataca

SEQ ID NO: 2025420 - DNA, 16 bp, Homo sapiens
actatcacatacaatt

SEQ ID NO: 2025421 - DNA, 20 bp, Homo sapiens
actatcacatacaatttgca

SEQ ID NO: 2025422 - DNA, 16 bp, Homo sapiens
actatctgtgaagtta

SEQ ID NO: 2025423 - DNA, 16 bp, Homo sapiens
actatcttggtgaatt

SEQ ID NO: 2025424 - DNA, 13 bp, Homo sapiens
actatctttctga

SEQ ID NO: 2025425 - DNA, 14 bp, Homo sapiens
actatctttctgat

SEQ ID NO: 2025426 - DNA, 15 bp, Homo sapiens
actatctttctgata

SEQ ID NO: 2025427 - DNA, 14 bp, Homo sapiens
actatgatcacagt

SEQ ID NO: 2025428 - DNA, 16 bp, Homo sapiens
actatgatcacagtga

SEQ ID NO: 2025429 - DNA, 14 bp, Homo sapiens
actatgctgaagag

SEQ ID NO: 2025430 - DNA, 19 bp, Homo sapiens
actatggagcctggcacag

SEQ ID NO: 2025431 - DNA, 18 bp, Homo sapiens
actatggtatgctggcca

SEQ ID NO: 2025432 - DNA, 20 bp, Homo sapiens
actatggtatgctggccagc

SEQ ID NO: 2025433 - DNA, 21 bp, Homo sapiens
actatggtatgctggccagca

SEQ ID NO: 2025434 - DNA, 16 bp, Homo sapiens
actatggtatttgagt

SEQ ID NO: 2025435 - DNA, 19 bp, Homo sapiens
actatggttcccaataaaa

SEQ ID NO: 2025436 - DNA, 21 bp, Homo sapiens
actatggttcccaataaaagt

SEQ ID NO: 2025437 - DNA, 23 bp, Homo sapiens
actatggttcccaataaaagtga

SEQ ID NO: 2025438 - DNA, 19 bp, Homo sapiens
actatgttgcccaggcagg

SEQ ID NO: 2025439 - DNA, 23 bp, Homo sapiens
actatgttgcccaggcaggtctt

SEQ ID NO: 2025440 - DNA, 16 bp, Homo sapiens
actattaagggaaagg

SEQ ID NO: 2025441 - DNA, 14 bp, Homo sapiens
actattaattccaa

SEQ ID NO: 2025442 - DNA, 15 bp, Homo sapiens
actattaattccaag

SEQ ID NO: 2025443 - DNA, 15 bp, Homo sapiens
actattacttgaact

SEQ ID NO: 2025444 - DNA, 14 bp, Homo sapiens
actattagagaaac

SEQ ID NO: 2025445 - DNA, 18 bp, Homo sapiens
actattcaaacagtctca

SEQ ID NO: 2025446 - DNA, 14 bp, Homo sapiens
actattgggaggga

SEQ ID NO: 2025447 - DNA, 17 bp, Homo sapiens
actattgggagggatga

SEQ ID NO: 2025448 - DNA, 15 bp, Homo sapiens
actatttaacttgag

SEQ ID NO: 2025449 - DNA, 17 bp, Homo sapiens
actattttttaataaaa

SEQ ID NO: 2025450 - DNA, 15 bp, Homo sapiens
actcaaaacttaaca

SEQ ID NO: 2025451 - DNA, 19 bp, Homo sapiens
actcaacaataaagactga

SEQ ID NO: 2025452 - DNA, 18 bp, Homo sapiens
actcaaccaacctccccg

SEQ ID NO: 2025453 - DNA, 17 bp, Homo sapiens
actcaagaggctgaggc

SEQ ID NO: 2025454 - DNA, 17 bp, Homo sapiens
actcaagtttttacaaa

SEQ ID NO: 2025455 - DNA, 13 bp, Homo sapiens
actcaataaaaga

SEQ ID NO: 2025456 - DNA, 15 bp, Homo sapiens
actcaatattttcca

SEQ ID NO: 2025457 - DNA, 21 bp, Homo sapiens
actcaatattttccatgaaaa

SEQ ID NO: 2025458 - DNA, 23 bp, Homo sapiens
actcaatattttccatgaaaatg

SEQ ID NO: 2025459 - DNA, 12 bp, Homo sapiens
actcacacaggc

SEQ ID NO: 2025460 - DNA, 14 bp, Homo sapiens
actcacacaggcat

SEQ ID NO: 2025461 - DNA, 19 bp, Homo sapiens
actcacacaggcatttcct

SEQ ID NO: 2025462 - DNA, 12 bp, Homo sapiens
actcacatgccg

SEQ ID NO: 2025463 - DNA, 14 bp, Homo sapiens
actcaccagggtcc

SEQ ID NO: 2025464 - DNA, 19 bp, Homo sapiens
actcaccagggtccgcacc

SEQ ID NO: 2025465 - DNA, 23 bp, Homo sapiens
actcaccagggtccgcaccagct

SEQ ID NO: 2025466 - DNA, 17 bp, Homo sapiens
actcaccagtgtcccct

SEQ ID NO: 2025467 - DNA, 15 bp, Homo sapiens
actcaccatgtaaaa

SEQ ID NO: 2025468 - DNA, 12 bp, Homo sapiens
actcacccaagc

SEQ ID NO: 2025469 - DNA, 18 bp, Homo sapiens
actcacccatgtgccaag

SEQ ID NO: 2025470 - DNA, 13 bp, Homo sapiens
actcacctcctcc

SEQ ID NO: 2025471 - DNA, 15 bp, Homo sapiens
actcacctctctcta

SEQ ID NO: 2025472 - DNA, 14 bp, Homo sapiens
actcacctctgcct

SEQ ID NO: 2025473 - DNA, 16 bp, Homo sapiens
actcacctctgcctca

SEQ ID NO: 2025474 - DNA, 15 bp, Homo sapiens
actcacgatgaaatt

SEQ ID NO: 2025475 - DNA, 16 bp, Homo sapiens
actcacgatgaaattg

SEQ ID NO: 2025476 - DNA, 14 bp, Homo sapiens
actcactccagccc

SEQ ID NO: 2025477 - DNA, 15 bp, Homo sapiens
actcactccagccca

SEQ ID NO: 2025478 - DNA, 20 bp, Homo sapiens
actcagaaaagaaaaccatt

SEQ ID NO: 2025479 - DNA, 13 bp, Homo sapiens
actcagaagcctg

SEQ ID NO: 2025480 - DNA, 14 bp, Homo sapiens
actcagaagcctga

SEQ ID NO: 2025481 - DNA, 18 bp, Homo sapiens
actcagaagcctgaggct

SEQ ID NO: 2025482 - DNA, 15 bp, Homo sapiens
actcagaagcctggg

SEQ ID NO: 2025483 - DNA, 15 bp, Homo sapiens
actcagagcagagca

SEQ ID NO: 2025484 - DNA, 18 bp, Homo sapiens
actcagagcccctccctg

SEQ ID NO: 2025485 - DNA, 16 bp, Homo sapiens
actcagcagcagagag

SEQ ID NO: 2025486 - DNA, 11 bp, Homo sapiens
actcagccctg

SEQ ID NO: 2025487 - DNA, 16 bp, Homo sapiens
actcagccctgggccc

SEQ ID NO: 2025488 - DNA, 21 bp, Homo sapiens
actcagccctgggccccacca

SEQ ID NO: 2025489 - DNA, 17 bp, Homo sapiens
actcagctctcctgctg

SEQ ID NO: 2025490 - DNA, 14 bp, Homo sapiens
actcaggaggctga

SEQ ID NO: 2025491 - DNA, 20 bp, Homo sapiens
actcaggaggctgaggcaga

SEQ ID NO: 2025492 - DNA, 18 bp, Homo sapiens
actcaggaggctgagggg

SEQ ID NO: 2025493 - DNA, 18 bp, Homo sapiens
actcagggccccagcact

SEQ ID NO: 2025494 - DNA, 23 bp, Homo sapiens
actcagtatagcattgaacattt

SEQ ID NO: 2025495 - DNA, 14 bp, Homo sapiens
actcagtttgtcag

SEQ ID NO: 2025496 - DNA, 17 bp, Homo sapiens
actctgggctgctaccc

SEQ ID NO: 2025497 - DNA, 18 bp, Homo sapiens
actctgggtccctcggag

SEQ ID NO: 2025498 - DNA, 23 bp, Homo sapiens
actctgtcaatttccctgactcc

SEQ ID NO: 2025499 - DNA, 14 bp, Homo sapiens
actctgtcagatgg

SEQ ID NO: 2025500 - DNA, 16 bp, Homo sapiens
actctgtcagatggga

SEQ ID NO: 2025501 - DNA, 15 bp, Homo sapiens
actctgtcagccagc

SEQ ID NO: 2025502 - DNA, 21 bp, Homo sapiens
actctgtcagccagccgccct

SEQ ID NO: 2025503 - DNA, 13 bp, Homo sapiens
actctgtccaggc

SEQ ID NO: 2025504 - DNA, 17 bp, Homo sapiens
actctgtccaggccact

SEQ ID NO: 2025505 - DNA, 19 bp, Homo sapiens
actctgtgccagagcctgg

SEQ ID NO: 2025506 - DNA, 20 bp, Homo sapiens
actctgtgccagagcctggg

SEQ ID NO: 2025507 - DNA, 19 bp, Homo sapiens
actctgtgtcaggtggggc

SEQ ID NO: 2025508 - DNA, 15 bp, Homo sapiens
actcttatgaaatgg

SEQ ID NO: 2025509 - DNA, 20 bp, Homo sapiens
actcttcaaggtctgctttt

SEQ ID NO: 2025510 - DNA, 15 bp, Homo sapiens
actcttccatttatt

SEQ ID NO: 2025511 - DNA, 16 bp, Homo sapiens
actcttgcctttccac

SEQ ID NO: 2025512 - DNA, 23 bp, Homo sapiens
actctttgacgggaggcctcagt

SEQ ID NO: 2025513 - DNA, 18 bp, Homo sapiens
actctttgctacaataaa

SEQ ID NO: 2025514 - DNA, 19 bp, Homo sapiens
actctttgctacaataaat

SEQ ID NO: 2025515 - DNA, 20 bp, Homo sapiens
actctttgctacaataaatg

SEQ ID NO: 2025516 - DNA, 13 bp, Homo sapiens
actctttgtaaga

SEQ ID NO: 2025517 - DNA, 19 bp, Homo sapiens
actctttttagggccaggc

SEQ ID NO: 2025518 - DNA, 20 bp, Homo sapiens
actctttttagggccaggca

SEQ ID NO: 2025519 - DNA, 14 bp, Homo sapiens
actgaaaaatgtca

SEQ ID NO: 2025520 - DNA, 16 bp, Homo sapiens
actgaaaactgtaaat

SEQ ID NO: 2025521 - DNA, 19 bp, Homo sapiens
actgaaaagactcagtgtt

SEQ ID NO: 2025522 - DNA, 15 bp, Homo sapiens
actgaaagcagcagc

SEQ ID NO: 2025523 - DNA, 13 bp, Homo sapiens
actgaaaggttac

SEQ ID NO: 2025524 - DNA, 20 bp, Homo sapiens
actgaacatttgctttgttt

SEQ ID NO: 2025525 - DNA, 17 bp, Homo sapiens
actgaactgcacgttct

SEQ ID NO: 2025526 - DNA, 21 bp, Homo sapiens
actgaacttcaggataataaa

SEQ ID NO: 2025527 - DNA, 12 bp, Homo sapiens
actgaagagaca

SEQ ID NO: 2025528 - DNA, 20 bp, Homo sapiens
actgaagagaccacagcaat

SEQ ID NO: 2025529 - DNA, 14 bp, Homo sapiens
actgaaggagaagg

SEQ ID NO: 2025530 - DNA, 20 bp, Homo sapiens
actgaaggggcacaccactg

SEQ ID NO: 2025531 - DNA, 23 bp, Homo sapiens
actgaatcatgttaatagacagt

SEQ ID NO: 2025532 - DNA, 21 bp, Homo sapiens
actgaatctcccctcctcaca

SEQ ID NO: 2025533 - DNA, 15 bp, Homo sapiens
actgaattaagttat

SEQ ID NO: 2025534 - DNA, 17 bp, Homo sapiens
actgaattaagttattg

SEQ ID NO: 2025535 - DNA, 14 bp, Homo sapiens
actgacaagatgga

SEQ ID NO: 2025536 - DNA, 19 bp, Homo sapiens
actgacacaggccagcccc

SEQ ID NO: 2025537 - DNA, 22 bp, Homo sapiens
actgacattgttggccaaagcc

SEQ ID NO: 2025538 - DNA, 15 bp, Homo sapiens
actgaccagcctcca

SEQ ID NO: 2025539 - DNA, 15 bp, Homo sapiens
actgacccacagcct

SEQ ID NO: 2025540 - DNA, 20 bp, Homo sapiens
actgacccacagcctctgcc

SEQ ID NO: 2025541 - DNA, 14 bp, Homo sapiens
actgaccccctccc

SEQ ID NO: 2025542 - DNA, 17 bp, Homo sapiens
actgaccccctcccctg

SEQ ID NO: 2025543 - DNA, 18 bp, Homo sapiens
actgaccccctcccctga

SEQ ID NO: 2025544 - DNA, 15 bp, Homo sapiens
actgaccctggagcg

SEQ ID NO: 2025545 - DNA, 18 bp, Homo sapiens
actgaccctggagcggct

SEQ ID NO: 2025546 - DNA, 19 bp, Homo sapiens
actgacccttccagacata

SEQ ID NO: 2025547 - DNA, 20 bp, Homo sapiens
actgaccttggagagacaca

SEQ ID NO: 2025548 - DNA, 21 bp, Homo sapiens
actgaccttggagagacacag

SEQ ID NO: 2025549 - DNA, 14 bp, Homo sapiens
actgactccttaga

SEQ ID NO: 2025550 - DNA, 15 bp, Homo sapiens
actgacttctaagta

SEQ ID NO: 2025551 - DNA, 17 bp, Homo sapiens
actgagattttggtatt

SEQ ID NO: 2025552 - DNA, 22 bp, Homo sapiens
actgagcaagatcttgtctcca

SEQ ID NO: 2025553 - DNA, 20 bp, Homo sapiens
actgagccaaacacactgta

SEQ ID NO: 2025554 - DNA, 17 bp, Homo sapiens
actgagcctagctacct

SEQ ID NO: 2025555 - DNA, 14 bp, Homo sapiens
actgagccttgtaa

SEQ ID NO: 2025556 - DNA, 24 bp, Homo sapiens
actgaggaagggagacatattctt

SEQ ID NO: 2025557 - DNA, 16 bp, Homo sapiens
actgaggaattttctt

SEQ ID NO: 2025558 - DNA, 18 bp, Homo sapiens
actgaggagtagctgaga

SEQ ID NO: 2025559 - DNA, 21 bp, Homo sapiens
actgaggagtagctgagagga

SEQ ID NO: 2025560 - DNA, 22 bp, Homo sapiens
actgaggagtagctgagaggaa

SEQ ID NO: 2025561 - DNA, 13 bp, Homo sapiens
actgaggcagaca

SEQ ID NO: 2025562 - DNA, 22 bp, Homo sapiens
actgaggcagacagcagctcag

SEQ ID NO: 2025563 - DNA, 21 bp, Homo sapiens
actgaggcctaaaagtaaaca

SEQ ID NO: 2025564 - DNA, 16 bp, Homo sapiens
actgaggccttctcaa

SEQ ID NO: 2025565 - DNA, 14 bp, Homo sapiens
actgagtaaattgg

SEQ ID NO: 2025566 - DNA, 18 bp, Homo sapiens
actgagtaaattggaaac

SEQ ID NO: 2025567 - DNA, 20 bp, Homo sapiens
actgagtaaattggaaacat

SEQ ID NO: 2025568 - DNA, 22 bp, Homo sapiens
actgagtggcttgtgattctgg

SEQ ID NO: 2025569 - DNA, 23 bp, Homo sapiens
actgagtgtgggagtgcagagaa

SEQ ID NO: 2025570 - DNA, 17 bp, Homo sapiens
actgatcaaaaataaac

SEQ ID NO: 2025571 - DNA, 18 bp, Homo sapiens
actgatcaaaaataaact

SEQ ID NO: 2025572 - DNA, 22 bp, Homo sapiens
actgatgcgaaaacttgaatct

SEQ ID NO: 2025573 - DNA, 21 bp, Homo sapiens
actgattgttttagagactat

SEQ ID NO: 2025574 - DNA, 15 bp, Homo sapiens
actgcaaaggcgcag

SEQ ID NO: 2025575 - DNA, 20 bp, Homo sapiens
actgcaacctccacctcctg

SEQ ID NO: 2025576 - DNA, 22 bp, Homo sapiens
actgcaacctccgcctcttggg

SEQ ID NO: 2025577 - DNA, 17 bp, Homo sapiens
actgcaacctcttcctc

SEQ ID NO: 2025578 - DNA, 22 bp, Homo sapiens
actgcaacctcttcctcctggt

SEQ ID NO: 2025579 - DNA, 16 bp, Homo sapiens
actgcaagagccttgg

SEQ ID NO: 2025580 - DNA, 17 bp, Homo sapiens
actgcaagaggctcctg

SEQ ID NO: 2025581 - DNA, 13 bp, Homo sapiens
actgcaatactaa

SEQ ID NO: 2025582 - DNA, 19 bp, Homo sapiens
actgcacacacagctcctc

SEQ ID NO: 2025583 - DNA, 20 bp, Homo sapiens
actgcactccagcctgggcg

SEQ ID NO: 2025584 - DNA, 21 bp, Homo sapiens
actgcactccagcctgggcga

SEQ ID NO: 2025585 - DNA, 13 bp, Homo sapiens
actgcactccagt

SEQ ID NO: 2025586 - DNA, 21 bp, Homo sapiens
actgcagatagccagacacat

SEQ ID NO: 2025587 - DNA, 19 bp, Homo sapiens
actgcagcctcaacctcct

SEQ ID NO: 2025588 - DNA, 21 bp, Homo sapiens
actgcagcctcaacctcctgg

SEQ ID NO: 2025589 - DNA, 22 bp, Homo sapiens
actgcagcctcaacctcctggg

SEQ ID NO: 2025590 - DNA, 14 bp, Homo sapiens
actgcagctgctga

SEQ ID NO: 2025591 - DNA, 15 bp, Homo sapiens
actgcagctttacat

SEQ ID NO: 2025592 - DNA, 12 bp, Homo sapiens
actgcaggcccc

SEQ ID NO: 2025593 - DNA, 15 bp, Homo sapiens
actgcaggccccgct

SEQ ID NO: 2025594 - DNA, 18 bp, Homo sapiens
actgcatgcacttcttac

SEQ ID NO: 2025595 - DNA, 12 bp, Homo sapiens
actgccaagaaa

SEQ ID NO: 2025596 - DNA, 13 bp, Homo sapiens
actgccagcaacg

SEQ ID NO: 2025597 - DNA, 16 bp, Homo sapiens
actgccaggcacctgg

SEQ ID NO: 2025598 - DNA, 15 bp, Homo sapiens
actgccccatctcct

SEQ ID NO: 2025599 - DNA, 14 bp, Homo sapiens
actgccctgcctgc

SEQ ID NO: 2025600 - DNA, 15 bp, Homo sapiens
actgcctcttcctcc

SEQ ID NO: 2025601 - DNA, 14 bp, Homo sapiens
actgcctttctgct

SEQ ID NO: 2025602 - DNA, 19 bp, Homo sapiens
actgcgggatggtcctggg

SEQ ID NO: 2025603 - DNA, 22 bp, Homo sapiens
actgcgggatggtcctggggct

SEQ ID NO: 2025604 - DNA, 19 bp, Homo sapiens
actgcgggcaccagaatgc

SEQ ID NO: 2025605 - DNA, 19 bp, Homo sapiens
actgctaaatactgtacat

SEQ ID NO: 2025606 - DNA, 18 bp, Homo sapiens
actgctacaccttagcag

SEQ ID NO: 2025607 - DNA, 21 bp, Homo sapiens
actgctaggcgagtgccagga

SEQ ID NO: 2025608 - DNA, 19 bp, Homo sapiens
actgctccccagccctggc

SEQ ID NO: 2025609 - DNA, 20 bp, Homo sapiens
actgctccccagccctggct

SEQ ID NO: 2025610 - DNA, 19 bp, Homo sapiens
actgctctgaatattttgt

SEQ ID NO: 2025611 - DNA, 11 bp, Homo sapiens
actgctctgcc

SEQ ID NO: 2025612 - DNA, 16 bp, Homo sapiens
tcagcagccctcctca

SEQ ID NO: 2025613 - DNA, 15 bp, Homo sapiens
tcagcaggaacctgt

SEQ ID NO: 2025614 - DNA, 22 bp, Homo sapiens
agaaggaattctaggcatccca

SEQ ID NO: 2025615 - DNA, 21 bp, Homo sapiens
agaaggacattttctctttaa

SEQ ID NO: 2025616 - DNA, 14 bp, Homo sapiens
agaaggagaaggaa

SEQ ID NO: 2025617 - DNA, 12 bp, Homo sapiens
agaaggagggca

SEQ ID NO: 2025618 - DNA, 16 bp, Homo sapiens
agaaggagggcagagc

SEQ ID NO: 2025619 - DNA, 18 bp, Homo sapiens
agaaggagggcagagcca

SEQ ID NO: 2025620 - DNA, 19 bp, Homo sapiens
agaaggagggcagagccat

SEQ ID NO: 2025621 - DNA, 20 bp, Homo sapiens
agaaggagtcagaaactgtt

SEQ ID NO: 2025622 - DNA, 20 bp, Homo sapiens
agaaggagttctgacattca

SEQ ID NO: 2025623 - DNA, 21 bp, Homo sapiens
agaaggatgaatgaggtccca

SEQ ID NO: 2025624 - DNA, 16 bp, Homo sapiens
agaaggcaaaaatagt

SEQ ID NO: 2025625 - DNA, 14 bp, Homo sapiens
agaaggccacatgt

SEQ ID NO: 2025626 - DNA, 14 bp, Homo sapiens
agaaggccgctgcc

SEQ ID NO: 2025627 - DNA, 13 bp, Homo sapiens
agaaggcgaggag

SEQ ID NO: 2025628 - DNA, 15 bp, Homo sapiens
agaaggcgaggagag

SEQ ID NO: 2025629 - DNA, 13 bp, Homo sapiens
agaaggctggggc

SEQ ID NO: 2025630 - DNA, 15 bp, Homo sapiens
agaagggaaatctta

SEQ ID NO: 2025631 - DNA, 14 bp, Homo sapiens
agaagggaaattca

SEQ ID NO: 2025632 - DNA, 23 bp, Homo sapiens
agaagggagttgctcactcagga

SEQ ID NO: 2025633 - DNA, 16 bp, Homo sapiens
agaagggataatagac

SEQ ID NO: 2025634 - DNA, 13 bp, Homo sapiens
agaagggctagaa

SEQ ID NO: 2025635 - DNA, 21 bp, Homo sapiens
agaagggctagaacctggaga

SEQ ID NO: 2025636 - DNA, 23 bp, Homo sapiens
agaagggctagaacctggagagc

SEQ ID NO: 2025637 - DNA, 19 bp, Homo sapiens
agaaggggacagcgccacc

SEQ ID NO: 2025638 - DNA, 19 bp, Homo sapiens
agaagggttatattttact

SEQ ID NO: 2025639 - DNA, 21 bp, Homo sapiens
agaagggttttccaccctgga

SEQ ID NO: 2025640 - DNA, 21 bp, Homo sapiens
agaaggtattccttttgtgta

SEQ ID NO: 2025641 - DNA, 20 bp, Homo sapiens
agaaggtccttaatgatccg

SEQ ID NO: 2025642 - DNA, 13 bp, Homo sapiens
agaagtaaaagct

SEQ ID NO: 2025643 - DNA, 16 bp, Homo sapiens
agaagtaaaagctaat

SEQ ID NO: 2025644 - DNA, 17 bp, Homo sapiens
agaagtaaatttgtcca

SEQ ID NO: 2025645 - DNA, 20 bp, Homo sapiens
agaagtaaatttgtccaatg

SEQ ID NO: 2025646 - DNA, 21 bp, Homo sapiens
agaagtaggcatgagggatca

SEQ ID NO: 2025647 - DNA, 18 bp, Homo sapiens
agaagtaggggaagacat

SEQ ID NO: 2025648 - DNA, 19 bp, Homo sapiens
agaagtaggggaagacatg

SEQ ID NO: 2025649 - DNA, 15 bp, Homo sapiens
agaagtatccaatta

SEQ ID NO: 2025650 - DNA, 16 bp, Homo sapiens
agaagtatccaattat

SEQ ID NO: 2025651 - DNA, 17 bp, Homo sapiens
agaagtcaaagtaaaac

SEQ ID NO: 2025652 - DNA, 14 bp, Homo sapiens
agaagtcacacagt

SEQ ID NO: 2025653 - DNA, 20 bp, Homo sapiens
agaagtcagttggagaaaat

SEQ ID NO: 2025654 - DNA, 22 bp, Homo sapiens
agaagtcataaacagcatttat

SEQ ID NO: 2025655 - DNA, 17 bp, Homo sapiens
agaagtcatgaagccca

SEQ ID NO: 2025656 - DNA, 20 bp, Homo sapiens
agaagtcatgaagcccaagt

SEQ ID NO: 2025657 - DNA, 22 bp, Homo sapiens
agaagtccctcccatctctacc

SEQ ID NO: 2025658 - DNA, 15 bp, Homo sapiens
agaagtctcttccag

SEQ ID NO: 2025659 - DNA, 17 bp, Homo sapiens
agaagtgagggctgggc

SEQ ID NO: 2025660 - DNA, 17 bp, Homo sapiens
agaagtgcaaaggtgtg

SEQ ID NO: 2025661 - DNA, 19 bp, Homo sapiens
agaagtgcaaaggtgtgca

SEQ ID NO: 2025662 - DNA, 23 bp, Homo sapiens
agaagtgggccaggacaggcccg

SEQ ID NO: 2025663 - DNA, 12 bp, Homo sapiens
agaagtgtttta

SEQ ID NO: 2025664 - DNA, 23 bp, Homo sapiens
agaagtttctggagcaagagaga

SEQ ID NO: 2025665 - DNA, 20 bp, Homo sapiens
agaagtttgatattaaagga

SEQ ID NO: 2025666 - DNA, 13 bp, Homo sapiens
agaataaaaattg

SEQ ID NO: 2025667 - DNA, 22 bp, Homo sapiens
agaataaaaattgacttcttgc

SEQ ID NO: 2025668 - DNA, 22 bp, Homo sapiens
agaataaatccttgggagtcat

SEQ ID NO: 2025669 - DNA, 13 bp, Homo sapiens
agaataaatgaag

SEQ ID NO: 2025670 - DNA, 15 bp, Homo sapiens
agaataagaaaacaa

SEQ ID NO: 2025671 - DNA, 12 bp, Homo sapiens
agaataagtgct

SEQ ID NO: 2025672 - DNA, 15 bp, Homo sapiens
agaataagtgctgtt

SEQ ID NO: 2025673 - DNA, 22 bp, Homo sapiens
agaataatatgctgccaaattt

SEQ ID NO: 2025674 - DNA, 13 bp, Homo sapiens
agaataatctttg

SEQ ID NO: 2025675 - DNA, 17 bp, Homo sapiens
agaataatgtgttaaac

SEQ ID NO: 2025676 - DNA, 14 bp, Homo sapiens
agaataattgtgta

SEQ ID NO: 2025677 - DNA, 16 bp, Homo sapiens
agaataattgtgtaca

SEQ ID NO: 2025678 - DNA, 12 bp, Homo sapiens
agaatacagaaa

SEQ ID NO: 2025679 - DNA, 14 bp, Homo sapiens
agaatacagaaaat

SEQ ID NO: 2025680 - DNA, 18 bp, Homo sapiens
agaatacagtaagctgct

SEQ ID NO: 2025681 - DNA, 15 bp, Homo sapiens
agaatacttctcatt

SEQ ID NO: 2025682 - DNA, 19 bp, Homo sapiens
agaatacttctcatttttt

SEQ ID NO: 2025683 - DNA, 17 bp, Homo sapiens
agaataggtcattttct

SEQ ID NO: 2025684 - DNA, 21 bp, Homo sapiens
agaataggtcattttctattc

SEQ ID NO: 2025685 - DNA, 14 bp, Homo sapiens
agaatataaataaa

SEQ ID NO: 2025686 - DNA, 14 bp, Homo sapiens
agaatataattatc

SEQ ID NO: 2025687 - DNA, 16 bp, Homo sapiens
agaatatatttttgat

SEQ ID NO: 2025688 - DNA, 20 bp, Homo sapiens
agaatatcaagatgattctg

SEQ ID NO: 2025689 - DNA, 14 bp, Homo sapiens
agaatatggacaaa

SEQ ID NO: 2025690 - DNA, 15 bp, Homo sapiens
agaatatgttcacat

SEQ ID NO: 2025691 - DNA, 18 bp, Homo sapiens
agaatattgttaaaacct

SEQ ID NO: 2025692 - DNA, 16 bp, Homo sapiens
agaatatttcaaatga

SEQ ID NO: 2025693 - DNA, 22 bp, Homo sapiens
agaatcagggcaggcttgccac

SEQ ID NO: 2025694 - DNA, 16 bp, Homo sapiens
agaatcataattttca

SEQ ID NO: 2025695 - DNA, 14 bp, Homo sapiens
agaatcatacttag

SEQ ID NO: 2025696 - DNA, 13 bp, Homo sapiens
agaatcctgcctc

SEQ ID NO: 2025697 - DNA, 17 bp, Homo sapiens
agaatcctgcctctccc

SEQ ID NO: 2025698 - DNA, 18 bp, Homo sapiens
agaatctgaagctattga

SEQ ID NO: 2025699 - DNA, 13 bp, Homo sapiens
agaatctggagag

SEQ ID NO: 2025700 - DNA, 16 bp, Homo sapiens
agaatctggagagcta

SEQ ID NO: 2025701 - DNA, 17 bp, Homo sapiens
agaatctggctcctgtt

SEQ ID NO: 2025702 - DNA, 17 bp, Homo sapiens
agaatgaaaattgtatg

SEQ ID NO: 2025703 - DNA, 18 bp, Homo sapiens
agaatgaaagggcccaga

SEQ ID NO: 2025704 - DNA, 22 bp, Homo sapiens
agaatgaagacctaaatgacct

SEQ ID NO: 2025705 - DNA, 14 bp, Homo sapiens
agaatgagagtgtg

SEQ ID NO: 2025706 - DNA, 12 bp, Homo sapiens
agaatgagcctc

SEQ ID NO: 2025707 - DNA, 20 bp, Homo sapiens
agaatgatatccagtaagca

SEQ ID NO: 2025708 - DNA, 23 bp, Homo sapiens
agaatgatatccagtaagcacat

SEQ ID NO: 2025709 - DNA, 22 bp, Homo sapiens
agaatgatggacttttgggggt

SEQ ID NO: 2025710 - DNA, 13 bp, Homo sapiens
agaatgatttcat

SEQ ID NO: 2025711 - DNA, 14 bp, Homo sapiens
agaatgatttcatg

SEQ ID NO: 2025712 - DNA, 19 bp, Homo sapiens
agaatgcagattcctgggc

SEQ ID NO: 2025713 - DNA, 22 bp, Homo sapiens
agaatgcagattcctgggcctg

SEQ ID NO: 2025714 - DNA, 23 bp, Homo sapiens
agaatgcagattcctgggcctgt

SEQ ID NO: 2025715 - DNA, 15 bp, Homo sapiens
agaatgcccaactct

SEQ ID NO: 2025716 - DNA, 18 bp, Homo sapiens
agaatgctggttttccta

SEQ ID NO: 2025717 - DNA, 20 bp, Homo sapiens
agaatgcttaatcagataga

SEQ ID NO: 2025718 - DNA, 21 bp, Homo sapiens
agaatggcagctggaatttaa

SEQ ID NO: 2025719 - DNA, 23 bp, Homo sapiens
agaatggtgtgggagagggatga

SEQ ID NO: 2025720 - DNA, 23 bp, Homo sapiens
agaatggttgccttaaagaaagt

SEQ ID NO: 2025721 - DNA, 17 bp, Homo sapiens
agaatgtaaagcttgtc

SEQ ID NO: 2025722 - DNA, 17 bp, Homo sapiens
agaatgtgttttctgaa

SEQ ID NO: 2025723 - DNA, 21 bp, Homo sapiens
agaatgttaagacttgacagt

SEQ ID NO: 2025724 - DNA, 13 bp, Homo sapiens
agaattatatagg

SEQ ID NO: 2025725 - DNA, 14 bp, Homo sapiens
agaattatatctaa

SEQ ID NO: 2025726 - DNA, 18 bp, Homo sapiens
agaattatgaggcattga

SEQ ID NO: 2025727 - DNA, 19 bp, Homo sapiens
agaattatgaggcattgag

SEQ ID NO: 2025728 - DNA, 18 bp, Homo sapiens
agaattcacaccttaggt

SEQ ID NO: 2025729 - DNA, 13 bp, Homo sapiens
agaattccaagga

SEQ ID NO: 2025730 - DNA, 20 bp, Homo sapiens
agagtctcactgttgcccag

SEQ ID NO: 2025731 - DNA, 18 bp, Homo sapiens
agagtctgaaagacagaa

SEQ ID NO: 2025732 - DNA, 14 bp, Homo sapiens
agagtctgagcccc

SEQ ID NO: 2025733 - DNA, 16 bp, Homo sapiens
agagtgaaagggctat

SEQ ID NO: 2025734 - DNA, 17 bp, Homo sapiens
agagtgaaagggctatg

SEQ ID NO: 2025735 - DNA, 18 bp, Homo sapiens
agagtgactccaagaaca

SEQ ID NO: 2025736 - DNA, 13 bp, Homo sapiens
agagtgagaataa

SEQ ID NO: 2025737 - DNA, 19 bp, Homo sapiens
agagtgagaataattgtgt

SEQ ID NO: 2025738 - DNA, 19 bp, Homo sapiens
agagtgagactctgtctca

SEQ ID NO: 2025739 - DNA, 13 bp, Homo sapiens
agagtgagagaca

SEQ ID NO: 2025740 - DNA, 19 bp, Homo sapiens
agagtgcccttaaaataat

SEQ ID NO: 2025741 - DNA, 22 bp, Homo sapiens
agagtgctgagaaggacacctc

SEQ ID NO: 2025742 - DNA, 16 bp, Homo sapiens
agagtggagtctgagt

SEQ ID NO: 2025743 - DNA, 24 bp, Homo sapiens
agagtggcccctcacctgggcctt

SEQ ID NO: 2025744 - DNA, 15 bp, Homo sapiens
agagtggctcctccc

SEQ ID NO: 2025745 - DNA, 15 bp, Homo sapiens
agagtgggctgcctg

SEQ ID NO: 2025746 - DNA, 19 bp, Homo sapiens
agagtgtgaaatagacatt

SEQ ID NO: 2025747 - DNA, 11 bp, Homo sapiens
agagtgtgacc

SEQ ID NO: 2025748 - DNA, 21 bp, Homo sapiens
agagtgtgaccaaaagttaca

SEQ ID NO: 2025749 - DNA, 16 bp, Homo sapiens
agagtgtgcagactga

SEQ ID NO: 2025750 - DNA, 19 bp, Homo sapiens
agagtgtgggaagggagag

SEQ ID NO: 2025751 - DNA, 12 bp, Homo sapiens
agagttattcaa

SEQ ID NO: 2025752 - DNA, 16 bp, Homo sapiens
agagttattcaaatga

SEQ ID NO: 2025753 - DNA, 13 bp, Homo sapiens
agagttgaaccta

SEQ ID NO: 2025754 - DNA, 17 bp, Homo sapiens
agagttgctttaaagta

SEQ ID NO: 2025755 - DNA, 14 bp, Homo sapiens
agagtttaacacaa

SEQ ID NO: 2025756 - DNA, 22 bp, Homo sapiens
agagtttaacacaagtcctgtg

SEQ ID NO: 2025757 - DNA, 21 bp, Homo sapiens
agagtttaactttgggcccag

SEQ ID NO: 2025758 - DNA, 22 bp, Homo sapiens
agagtttaactttgggcccaga

SEQ ID NO: 2025759 - DNA, 17 bp, Homo sapiens
agagtttctgcagttcc

SEQ ID NO: 2025760 - DNA, 19 bp, Homo sapiens
agagtttctgcagttccat

SEQ ID NO: 2025761 - DNA, 18 bp, Homo sapiens
agataaaatatcctcagg

SEQ ID NO: 2025762 - DNA, 16 bp, Homo sapiens
agataaagatgatcta

SEQ ID NO: 2025763 - DNA, 13 bp, Homo sapiens
agataaagtggtt

SEQ ID NO: 2025764 - DNA, 18 bp, Homo sapiens
agataacaagatctttca

SEQ ID NO: 2025765 - DNA, 22 bp, Homo sapiens
agataactgaaaattatttaaa

SEQ ID NO: 2025766 - DNA, 14 bp, Homo sapiens
agataactgagaat

SEQ ID NO: 2025767 - DNA, 15 bp, Homo sapiens
agataatatctgtga

SEQ ID NO: 2025768 - DNA, 17 bp, Homo sapiens
agataatatctgtgagg

SEQ ID NO: 2025769 - DNA, 21 bp, Homo sapiens
agataatatctgtgaggtgct

SEQ ID NO: 2025770 - DNA, 14 bp, Homo sapiens
agataatcagcctc

SEQ ID NO: 2025771 - DNA, 16 bp, Homo sapiens
agataatgtatataaa

SEQ ID NO: 2025772 - DNA, 17 bp, Homo sapiens
agataatgttctttaat

SEQ ID NO: 2025773 - DNA, 19 bp, Homo sapiens
agatacagccccaaaccag

SEQ ID NO: 2025774 - DNA, 19 bp, Homo sapiens
agatacaggaaaagctgct

SEQ ID NO: 2025775 - DNA, 16 bp, Homo sapiens
agatacatagatggac

SEQ ID NO: 2025776 - DNA, 15 bp, Homo sapiens
agatacatttcatct

SEQ ID NO: 2025777 - DNA, 18 bp, Homo sapiens
agataccaggttgaaaga

SEQ ID NO: 2025778 - DNA, 19 bp, Homo sapiens
agataccaggttgaaagac

SEQ ID NO: 2025779 - DNA, 17 bp, Homo sapiens
agatacggttgcttcac

SEQ ID NO: 2025780 - DNA, 17 bp, Homo sapiens
agatactttgctagccg

SEQ ID NO: 2025781 - DNA, 12 bp, Homo sapiens
agatagaatgac

SEQ ID NO: 2025782 - DNA, 15 bp, Homo sapiens
agatagaatgacagt

SEQ ID NO: 2025783 - DNA, 16 bp, Homo sapiens
agatagaatgacagtc

SEQ ID NO: 2025784 - DNA, 16 bp, Homo sapiens
agatagccagacacat

SEQ ID NO: 2025785 - DNA, 23 bp, Homo sapiens
agatagggaagagagaaacattt

SEQ ID NO: 2025786 - DNA, 19 bp, Homo sapiens
agataggtttgagttcaaa

SEQ ID NO: 2025787 - DNA, 22 bp, Homo sapiens
agataggtttgagttcaaattt

SEQ ID NO: 2025788 - DNA, 14 bp, Homo sapiens
agatagtacataaa

SEQ ID NO: 2025789 - DNA, 14 bp, Homo sapiens
agatagttaaaaga

SEQ ID NO: 2025790 - DNA, 18 bp, Homo sapiens
agatagttaaaagactgc

SEQ ID NO: 2025791 - DNA, 22 bp, Homo sapiens
agatagttaaaagactgcagct

SEQ ID NO: 2025792 - DNA, 22 bp, Homo sapiens
agatatatatttactaaaagaa

SEQ ID NO: 2025793 - DNA, 23 bp, Homo sapiens
agatatatatttactaaaagaat

SEQ ID NO: 2025794 - DNA, 20 bp, Homo sapiens
agatatatctgaaaactgga

SEQ ID NO: 2025795 - DNA, 17 bp, Homo sapiens
agatatgatatgtaaac

SEQ ID NO: 2025796 - DNA, 19 bp, Homo sapiens
agatatgcacacacagatg

SEQ ID NO: 2025797 - DNA, 22 bp, Homo sapiens
agatatgcacacacagatgcac

SEQ ID NO: 2025798 - DNA, 21 bp, Homo sapiens
agatatttccatttcttcctc

SEQ ID NO: 2025799 - DNA, 17 bp, Homo sapiens
agatatttttgtacgtt

SEQ ID NO: 2025800 - DNA, 18 bp, Homo sapiens
agatattttttcagaaat

SEQ ID NO: 2025801 - DNA, 20 bp, Homo sapiens
agatcaattaattcttaata

SEQ ID NO: 2025802 - DNA, 17 bp, Homo sapiens
agatcacgccactgcac

SEQ ID NO: 2025803 - DNA, 22 bp, Homo sapiens
agatcacgccactgcactccag

SEQ ID NO: 2025804 - DNA, 18 bp, Homo sapiens
agatcatcttgaatattt

SEQ ID NO: 2025805 - DNA, 18 bp, Homo sapiens
agatccacacacagagga

SEQ ID NO: 2025806 - DNA, 14 bp, Homo sapiens
agatccaccctcaa

SEQ ID NO: 2025807 - DNA, 22 bp, Homo sapiens
agatccatttggacaaaatgga

SEQ ID NO: 2025808 - DNA, 19 bp, Homo sapiens
agatcccatccatcagctc

SEQ ID NO: 2025809 - DNA, 19 bp, Homo sapiens
agatcccatgtcacctcag

SEQ ID NO: 2025810 - DNA, 15 bp, Homo sapiens
agatcccgcctcttc

SEQ ID NO: 2025811 - DNA, 19 bp, Homo sapiens
agatcccgcctcttcttct

SEQ ID NO: 2025812 - DNA, 22 bp, Homo sapiens
agatcccgcctcttcttcttca

SEQ ID NO: 2025813 - DNA, 16 bp, Homo sapiens
agatcctaactgagaa

SEQ ID NO: 2025814 - DNA, 19 bp, Homo sapiens
agatcctaggtgctggatg

SEQ ID NO: 2025815 - DNA, 16 bp, Homo sapiens
agatcctctgctgact

SEQ ID NO: 2025816 - DNA, 21 bp, Homo sapiens
agatcctgtctttaaggaaaa

SEQ ID NO: 2025817 - DNA, 20 bp, Homo sapiens
agatcctttaaatccttcca

SEQ ID NO: 2025818 - DNA, 14 bp, Homo sapiens
agatcgctggcaga

SEQ ID NO: 2025819 - DNA, 14 bp, Homo sapiens
agatcgcttgagcc

SEQ ID NO: 2025820 - DNA, 20 bp, Homo sapiens
agatcgcttgagcccaggag

SEQ ID NO: 2025821 - DNA, 18 bp, Homo sapiens
agatcgtattaattatct

SEQ ID NO: 2025822 - DNA, 20 bp, Homo sapiens
agatctaagcctttccataa

SEQ ID NO: 2025823 - DNA, 15 bp, Homo sapiens
agatctccctccagg

SEQ ID NO: 2025824 - DNA, 18 bp, Homo sapiens
agatctcctatttttcag

SEQ ID NO: 2025825 - DNA, 19 bp, Homo sapiens
agatctcctatttttcaga

SEQ ID NO: 2025826 - DNA, 20 bp, Homo sapiens
agatctcctatttttcagaa

SEQ ID NO: 2025827 - DNA, 15 bp, Homo sapiens
agatctcctgtaatt

SEQ ID NO: 2025828 - DNA, 23 bp, Homo sapiens
agatctcctgtaattttgtagta

SEQ ID NO: 2025829 - DNA, 16 bp, Homo sapiens
agatctgaaaggcaca

SEQ ID NO: 2025830 - DNA, 16 bp, Homo sapiens
agatctgatggtgagc

SEQ ID NO: 2025831 - DNA, 15 bp, Homo sapiens
agatctgcactgggt

SEQ ID NO: 2025832 - DNA, 13 bp, Homo sapiens
agatctgcctggg

SEQ ID NO: 2025833 - DNA, 15 bp, Homo sapiens
agatctgcctgggcc

SEQ ID NO: 2025834 - DNA, 16 bp, Homo sapiens
agatctgcctgggcct

SEQ ID NO: 2025835 - DNA, 23 bp, Homo sapiens
agatctggaaccttaccacgtta

SEQ ID NO: 2025836 - DNA, 16 bp, Homo sapiens
agatcttctttataac

SEQ ID NO: 2025837 - DNA, 22 bp, Homo sapiens
agatcttgtctccactaaatga

SEQ ID NO: 2025838 - DNA, 13 bp, Homo sapiens
agatctttcagga

SEQ ID NO: 2025839 - DNA, 12 bp, Homo sapiens
agatcttttaaa

SEQ ID NO: 2025840 - DNA, 14 bp, Homo sapiens
agatcttttaaaaa

SEQ ID NO: 2025841 - DNA, 15 bp, Homo sapiens
agatctttttgtgaa

SEQ ID NO: 2025842 - DNA, 17 bp, Homo sapiens
agatgaaagaggaggtt

SEQ ID NO: 2025843 - DNA, 12 bp, Homo sapiens
agatgaagagaa

SEQ ID NO: 2025844 - DNA, 17 bp, Homo sapiens
agatgaagagtgagagg

SEQ ID NO: 2025845 - DNA, 19 bp, Homo sapiens
agatgaagagtgagagggc

SEQ ID NO: 2025846 - DNA, 17 bp, Homo sapiens
agatgaatactaaatgg

SEQ ID NO: 2025847 - DNA, 13 bp, Homo sapiens
agatgacagctct

SEQ ID NO: 2025848 - DNA, 15 bp, Homo sapiens
agatgactgagtcct

SEQ ID NO: 2025849 - DNA, 15 bp, Homo sapiens
agatgagaggcagag

SEQ ID NO: 2025850 - DNA, 16 bp, Homo sapiens
agatgagaggcagagg

SEQ ID NO: 2025851 - DNA, 19 bp, Homo sapiens
agatgagatttgccagcac

SEQ ID NO: 2025852 - DNA, 19 bp, Homo sapiens
agatgagcagtcacactgt

SEQ ID NO: 2025853 - DNA, 17 bp, Homo sapiens
agatgagggtgactgtc

SEQ ID NO: 2025854 - DNA, 19 bp, Homo sapiens
agatgataaatatttatgc

SEQ ID NO: 2025855 - DNA, 22 bp, Homo sapiens
agatgatctctccacggtagca

SEQ ID NO: 2025856 - DNA, 14 bp, Homo sapiens
agatgatgatgatg

SEQ ID NO: 2025857 - DNA, 15 bp, Homo sapiens
agatgatgatgatga

SEQ ID NO: 2025858 - DNA, 17 bp, Homo sapiens
agatgatgatgatgatg

SEQ ID NO: 2025859 - DNA, 14 bp, Homo sapiens
agatgcaacctcac

SEQ ID NO: 2025860 - DNA, 16 bp, Homo sapiens
agatgcaacctcacta

SEQ ID NO: 2025861 - DNA, 12 bp, Homo sapiens
agatgcctccac

SEQ ID NO: 2025862 - DNA, 13 bp, Homo sapiens
agatgcctccacc

SEQ ID NO: 2025863 - DNA, 21 bp, Homo sapiens
agatggaatagaaaagatgag

SEQ ID NO: 2025864 - DNA, 22 bp, Homo sapiens
agatggaatagaaaagatgaga

SEQ ID NO: 2025865 - DNA, 21 bp, Homo sapiens
agatggacccctcccttgctc

SEQ ID NO: 2025866 - DNA, 17 bp, Homo sapiens
agatggagttcttgtgc

SEQ ID NO: 2025867 - DNA, 14 bp, Homo sapiens
agatggctgtgcct

SEQ ID NO: 2025868 - DNA, 19 bp, Homo sapiens
agatggctgtgcctctgcc

SEQ ID NO: 2025869 - DNA, 20 bp, Homo sapiens
agatggctgtgcctctgcct

SEQ ID NO: 2025870 - DNA, 22 bp, Homo sapiens
agatggctgtgcctctgcctgt

SEQ ID NO: 2025871 - DNA, 19 bp, Homo sapiens
agatgggcacatgaggagg

SEQ ID NO: 2025872 - DNA, 22 bp, Homo sapiens
agatgggcacatgaggagggtg

SEQ ID NO: 2025873 - DNA, 17 bp, Homo sapiens
agatgggtattaaactt

SEQ ID NO: 2025874 - DNA, 18 bp, Homo sapiens
agatgggtattaaacttg

SEQ ID NO: 2025875 - DNA, 22 bp, Homo sapiens
agatgggtctggctgagctgaa

SEQ ID NO: 2025876 - DNA, 23 bp, Homo sapiens
agatggtagcagataaagacagc

SEQ ID NO: 2025877 - DNA, 21 bp, Homo sapiens
agatgtaactaggccatttgt

SEQ ID NO: 2025878 - DNA, 23 bp, Homo sapiens
agatgtaactaggccatttgtat

SEQ ID NO: 2025879 - DNA, 14 bp, Homo sapiens
agatgtaaggaatt

SEQ ID NO: 2025880 - DNA, 13 bp, Homo sapiens
agatgtaggaggg

SEQ ID NO: 2025881 - DNA, 18 bp, Homo sapiens
agatgtcaaatatctcag

SEQ ID NO: 2025882 - DNA, 22 bp, Homo sapiens
agatgtgaacacatcagcttgc

SEQ ID NO: 2025883 - DNA, 17 bp, Homo sapiens
agatgtgataaggatca

SEQ ID NO: 2025884 - DNA, 13 bp, Homo sapiens
agatgtgatgctg

SEQ ID NO: 2025885 - DNA, 16 bp, Homo sapiens
agatgtgcaaatgcaa

SEQ ID NO: 2025886 - DNA, 18 bp, Homo sapiens
agatgtgcaaatgcaagc

SEQ ID NO: 2025887 - DNA, 21 bp, Homo sapiens
agatgtgtttttaatgttaaa

SEQ ID NO: 2025888 - DNA, 19 bp, Homo sapiens
agatgtttgtcagatatga

SEQ ID NO: 2025889 - DNA, 13 bp, Homo sapiens
agatgtttttaaa

SEQ ID NO: 2025890 - DNA, 11 bp, Homo sapiens
agattaaagga

SEQ ID NO: 2025891 - DNA, 14 bp, Homo sapiens
agattaatggcact

SEQ ID NO: 2025892 - DNA, 17 bp, Homo sapiens
agattaatggcactgat

SEQ ID NO: 2025893 - DNA, 19 bp, Homo sapiens
agattaatttgtgtagatt

SEQ ID NO: 2025894 - DNA, 21 bp, Homo sapiens
agattaccccctcattgttta

SEQ ID NO: 2025895 - DNA, 20 bp, Homo sapiens
agattacctgccacttccag

SEQ ID NO: 2025896 - DNA, 17 bp, Homo sapiens
agattagctctggacca

SEQ ID NO: 2025897 - DNA, 15 bp, Homo sapiens
agattatatatcata

SEQ ID NO: 2025898 - DNA, 18 bp, Homo sapiens
agattatatatcataaag

SEQ ID NO: 2025899 - DNA, 20 bp, Homo sapiens
agattatatatcataaagta

SEQ ID NO: 2025900 - DNA, 14 bp, Homo sapiens
agattatattataa

SEQ ID NO: 2025901 - DNA, 22 bp, Homo sapiens
agattattttagtctgtcatcc

SEQ ID NO: 2025902 - DNA, 14 bp, Homo sapiens
agattcatctatgg

SEQ ID NO: 2025903 - DNA, 15 bp, Homo sapiens
agattcatctatgga

SEQ ID NO: 2025904 - DNA, 22 bp, Homo sapiens
agattcatctatggagggcaga

SEQ ID NO: 2025905 - DNA, 17 bp, Homo sapiens
agattccacacaaaatg

SEQ ID NO: 2025906 - DNA, 18 bp, Homo sapiens
agattccagagagtggct

SEQ ID NO: 2025907 - DNA, 12 bp, Homo sapiens
agattccaggat

SEQ ID NO: 2025908 - DNA, 19 bp, Homo sapiens
agattccctctcctccccc

SEQ ID NO: 2025909 - DNA, 19 bp, Homo sapiens
agattcctcttgcctctct

SEQ ID NO: 2025910 - DNA, 14 bp, Homo sapiens
agattcctgggcct

SEQ ID NO: 2025911 - DNA, 16 bp, Homo sapiens
agattcctgggcctgt

SEQ ID NO: 2025912 - DNA, 19 bp, Homo sapiens
agattctagccaaactatt

SEQ ID NO: 2025913 - DNA, 20 bp, Homo sapiens
agattcttccactggctcca

SEQ ID NO: 2025914 - DNA, 19 bp, Homo sapiens
agattgcaacaggctgggc

SEQ ID NO: 2025915 - DNA, 21 bp, Homo sapiens
agattgcaacaggctgggctt

SEQ ID NO: 2025916 - DNA, 16 bp, Homo sapiens
agattgcgccactgca

SEQ ID NO: 2025917 - DNA, 16 bp, Homo sapiens
agattgcgtggacccc

SEQ ID NO: 2025918 - DNA, 20 bp, Homo sapiens
agattggacatggtctcctc

SEQ ID NO: 2025919 - DNA, 12 bp, Homo sapiens
agattgtaattc

SEQ ID NO: 2025920 - DNA, 19 bp, Homo sapiens
agattgtacatatggaaat

SEQ ID NO: 2025921 - DNA, 15 bp, Homo sapiens
agattgttaaaataa

SEQ ID NO: 2025922 - DNA, 12 bp, Homo sapiens
agattgtttgca

SEQ ID NO: 2025923 - DNA, 22 bp, Homo sapiens
agattgttttatcatgacatgt

SEQ ID NO: 2025924 - DNA, 22 bp, Homo sapiens
agatttcctccatggtggaagg

SEQ ID NO: 2025925 - DNA, 16 bp, Homo sapiens
agatttgtatttatat

SEQ ID NO: 2025926 - DNA, 18 bp, Homo sapiens
agatttgtatttatatta

SEQ ID NO: 2025927 - DNA, 20 bp, Homo sapiens
agatttgtatttatattaga

SEQ ID NO: 2025928 - DNA, 13 bp, Homo sapiens
agattttaaattc

SEQ ID NO: 2025929 - DNA, 19 bp, Homo sapiens
agattttaaattcacaata

SEQ ID NO: 2025930 - DNA, 22 bp, Homo sapiens
agattttaaattcacaatagaa

SEQ ID NO: 2025931 - DNA, 17 bp, Homo sapiens
agattttaattttgaat

SEQ ID NO: 2025932 - DNA, 21 bp, Homo sapiens
agattttaattttgaataaat

SEQ ID NO: 2025933 - DNA, 23 bp, Homo sapiens
agattttccacaagattcccaga

SEQ ID NO: 2025934 - DNA, 20 bp, Homo sapiens
agattttgtgcagttaatac

SEQ ID NO: 2025935 - DNA, 14 bp, Homo sapiens
agattttttaataa

SEQ ID NO: 2025936 - DNA, 19 bp, Homo sapiens
agattttttttgtaacttc

SEQ ID NO: 2025937 - DNA, 17 bp, Homo sapiens
agcaaaactccatctca

SEQ ID NO: 2025938 - DNA, 16 bp, Homo sapiens
agcaaagagtgggctg

SEQ ID NO: 2025939 - DNA, 22 bp, Homo sapiens
agcaaagagtgggctgcatctg

SEQ ID NO: 2025940 - DNA, 17 bp, Homo sapiens
agcaaaggaaaccaaag

SEQ ID NO: 2025941 - DNA, 23 bp, Homo sapiens
agcaaagtctaaagtttacagta

SEQ ID NO: 2025942 - DNA, 21 bp, Homo sapiens
agcaaatcctcttctaactca

SEQ ID NO: 2025943 - DNA, 20 bp, Homo sapiens
agcaaatcgaatgaaattaa

SEQ ID NO: 2025944 - DNA, 16 bp, Homo sapiens
agcaaatgtggctcct

SEQ ID NO: 2025945 - DNA, 13 bp, Homo sapiens
agcaaatgtttct

SEQ ID NO: 2025946 - DNA, 14 bp, Homo sapiens
agcaaatgtttctg

SEQ ID NO: 2025947 - DNA, 14 bp, Homo sapiens
agcaaattagtaat

SEQ ID NO: 2025948 - DNA, 14 bp, Homo sapiens
agcaaatttcaaaa

SEQ ID NO: 2025949 - DNA, 18 bp, Homo sapiens
agcaacacaagctggaag

SEQ ID NO: 2025950 - DNA, 13 bp, Homo sapiens
agcaacacagagc

SEQ ID NO: 2025951 - DNA, 20 bp, Homo sapiens
agcaacagagtgagaccctg

SEQ ID NO: 2025952 - DNA, 17 bp, Homo sapiens
agcaacaggaatctcag

SEQ ID NO: 2025953 - DNA, 19 bp, Homo sapiens
agcaacaggaatctcagag

SEQ ID NO: 2025954 - DNA, 12 bp, Homo sapiens
agcaacatttta

SEQ ID NO: 2025955 - DNA, 15 bp, Homo sapiens
agcaacctgtagagt

SEQ ID NO: 2025956 - DNA, 16 bp, Homo sapiens
agcaaccttcatttta

SEQ ID NO: 2025957 - DNA, 21 bp, Homo sapiens
agcaactacagtctaaagctg

SEQ ID NO: 2025958 - DNA, 13 bp, Homo sapiens
agcaacttgcttc

SEQ ID NO: 2025959 - DNA, 16 bp, Homo sapiens
agcaacttgcttctaa

SEQ ID NO: 2025960 - DNA, 16 bp, Homo sapiens
agcaagacgtcctgga

SEQ ID NO: 2025961 - DNA, 12 bp, Homo sapiens
agcaagactctg

SEQ ID NO: 2025962 - DNA, 16 bp, Homo sapiens
agcagcattcagcaca

SEQ ID NO: 2025963 - DNA, 10 bp, Homo sapiens
agcagccagc

SEQ ID NO: 2025964 - DNA, 13 bp, Homo sapiens
agcagccagccag

SEQ ID NO: 2025965 - DNA, 13 bp, Homo sapiens
agcagccagccct

SEQ ID NO: 2025966 - DNA, 21 bp, Homo sapiens
agcagccagccctgcctggag

SEQ ID NO: 2025967 - DNA, 23 bp, Homo sapiens
agcagccagccctgcctggagga

SEQ ID NO: 2025968 - DNA, 14 bp, Homo sapiens
agcagccagctctc

SEQ ID NO: 2025969 - DNA, 16 bp, Homo sapiens
agcagccagctctcag

SEQ ID NO: 2025970 - DNA, 23 bp, Homo sapiens
agcagccagctctcagccaacga

SEQ ID NO: 2025971 - DNA, 13 bp, Homo sapiens
agcagccccccag

SEQ ID NO: 2025972 - DNA, 17 bp, Homo sapiens
agcagccccccagcact

SEQ ID NO: 2025973 - DNA, 16 bp, Homo sapiens
agcagccccctgcccg

SEQ ID NO: 2025974 - DNA, 23 bp, Homo sapiens
agcagcccctctttaacctcatc

SEQ ID NO: 2025975 - DNA, 14 bp, Homo sapiens
agcagccctaagga

SEQ ID NO: 2025976 - DNA, 12 bp, Homo sapiens
agcagccctcct

SEQ ID NO: 2025977 - DNA, 13 bp, Homo sapiens
agcagccctcctc

SEQ ID NO: 2025978 - DNA, 14 bp, Homo sapiens
agcagccctcctca

SEQ ID NO: 2025979 - DNA, 14 bp, Homo sapiens
agcagcctcctggg

SEQ ID NO: 2025980 - DNA, 18 bp, Homo sapiens
agcagctaggactgagga

SEQ ID NO: 2025981 - DNA, 13 bp, Homo sapiens
agcagctgagcag

SEQ ID NO: 2025982 - DNA, 14 bp, Homo sapiens
agcagctgagcagg

SEQ ID NO: 2025983 - DNA, 16 bp, Homo sapiens
agcagctgcgggtctg

SEQ ID NO: 2025984 - DNA, 13 bp, Homo sapiens
agcagctgggccg

SEQ ID NO: 2025985 - DNA, 14 bp, Homo sapiens
agcagctgggccgg

SEQ ID NO: 2025986 - DNA, 18 bp, Homo sapiens
agcagctgggccggccag

SEQ ID NO: 2025987 - DNA, 21 bp, Homo sapiens
agcagctgggccggccagcct

SEQ ID NO: 2025988 - DNA, 12 bp, Homo sapiens
agcaggaaatag

SEQ ID NO: 2025989 - DNA, 15 bp, Homo sapiens
agcaggaacagagac

SEQ ID NO: 2025990 - DNA, 19 bp, Homo sapiens
agcaggaacagagactctg

SEQ ID NO: 2025991 - DNA, 21 bp, Homo sapiens
agcaggaacagagactctgga

SEQ ID NO: 2025992 - DNA, 22 bp, Homo sapiens
agcaggaacctgtactgggtta

SEQ ID NO: 2025993 - DNA, 19 bp, Homo sapiens
agcaggaaggatggcaagc

SEQ ID NO: 2025994 - DNA, 23 bp, Homo sapiens
agcaggactgaattgtccccagt

SEQ ID NO: 2025995 - DNA, 16 bp, Homo sapiens
agcaggcacatggagg

SEQ ID NO: 2025996 - DNA, 15 bp, Homo sapiens
agcaggcagagcggg

SEQ ID NO: 2025997 - DNA, 15 bp, Homo sapiens
agcaggcccgacaga

SEQ ID NO: 2025998 - DNA, 23 bp, Homo sapiens
agcaggcccgacagagagatgaa

SEQ ID NO: 2025999 - DNA, 16 bp, Homo sapiens
agcaggctactgtcag

SEQ ID NO: 2026000 - DNA, 22 bp, Homo sapiens
agcagggccggggaactggcca

SEQ ID NO: 2026001 - DNA, 14 bp, Homo sapiens
agcaggtaccactg

SEQ ID NO: 2026002 - DNA, 14 bp, Homo sapiens
agcaggtctctggc

SEQ ID NO: 2026003 - DNA, 17 bp, Homo sapiens
agcaggtctctggcaga

SEQ ID NO: 2026004 - DNA, 16 bp, Homo sapiens
agcaggtgcaagagac

SEQ ID NO: 2026005 - DNA, 19 bp, Homo sapiens
agcaggtgcaagagacaga

SEQ ID NO: 2026006 - DNA, 17 bp, Homo sapiens
agcaggtgggaaatggt

SEQ ID NO: 2026007 - DNA, 13 bp, Homo sapiens
agcaggtggtcct

SEQ ID NO: 2026008 - DNA, 20 bp, Homo sapiens
agcaggtggtcctgagacct

SEQ ID NO: 2026009 - DNA, 19 bp, Homo sapiens
agcaggtgtggtggctcat

SEQ ID NO: 2026010 - DNA, 21 bp, Homo sapiens
agcaggttgaggggctcctgg

SEQ ID NO: 2026011 - DNA, 11 bp, Homo sapiens
agcagtacatg

SEQ ID NO: 2026012 - DNA, 15 bp, Homo sapiens
agcagtccctgagac

SEQ ID NO: 2026013 - DNA, 19 bp, Homo sapiens
agcagtcctcttattccta

SEQ ID NO: 2026014 - DNA, 19 bp, Homo sapiens
agcagtgattgtcttaata

SEQ ID NO: 2026015 - DNA, 15 bp, Homo sapiens
agcagtgcctcgagg

SEQ ID NO: 2026016 - DNA, 20 bp, Homo sapiens
agcagtgcctcgaggcaccg

SEQ ID NO: 2026017 - DNA, 17 bp, Homo sapiens
agcagtgccttccataa

SEQ ID NO: 2026018 - DNA, 12 bp, Homo sapiens
agcagtggacac

SEQ ID NO: 2026019 - DNA, 15 bp, Homo sapiens
agcagtgtcttccat

SEQ ID NO: 2026020 - DNA, 17 bp, Homo sapiens
agcagtgtcttccataa

SEQ ID NO: 2026021 - DNA, 20 bp, Homo sapiens
agcagtgtcttccataatgt

SEQ ID NO: 2026022 - DNA, 17 bp, Homo sapiens
agcagtgtgtccttggg

SEQ ID NO: 2026023 - DNA, 22 bp, Homo sapiens
agcagtgtgtccttggggcaca

SEQ ID NO: 2026024 - DNA, 21 bp, Homo sapiens
agcagtgttccccatctgggt

SEQ ID NO: 2026025 - DNA, 16 bp, Homo sapiens
agcagttccatgaaga

SEQ ID NO: 2026026 - DNA, 17 bp, Homo sapiens
agcagttctgcagagga

SEQ ID NO: 2026027 - DNA, 16 bp, Homo sapiens
agcagttgaaaagact

SEQ ID NO: 2026028 - DNA, 23 bp, Homo sapiens
agcagttgaaaagactccaaaga

SEQ ID NO: 2026029 - DNA, 14 bp, Homo sapiens
agcagtttgctttg

SEQ ID NO: 2026030 - DNA, 18 bp, Homo sapiens
agcataatgctcccatct

SEQ ID NO: 2026031 - DNA, 13 bp, Homo sapiens
agcatacatttat

SEQ ID NO: 2026032 - DNA, 13 bp, Homo sapiens
agcataccaacac

SEQ ID NO: 2026033 - DNA, 22 bp, Homo sapiens
agcataccaacacgagcaggct

SEQ ID NO: 2026034 - DNA, 20 bp, Homo sapiens
agcatatgcctacttgtaat

SEQ ID NO: 2026035 - DNA, 13 bp, Homo sapiens
agcatcacctcag

SEQ ID NO: 2026036 - DNA, 20 bp, Homo sapiens
agcatcacctcaggccaggt

SEQ ID NO: 2026037 - DNA, 13 bp, Homo sapiens
agcatcatgcctc

SEQ ID NO: 2026038 - DNA, 15 bp, Homo sapiens
agcatcatgcctctg

SEQ ID NO: 2026039 - DNA, 13 bp, Homo sapiens
agcatcattgtaa

SEQ ID NO: 2026040 - DNA, 14 bp, Homo sapiens
agcatcattgtaaa

SEQ ID NO: 2026041 - DNA, 14 bp, Homo sapiens
agcatccagcctgt

SEQ ID NO: 2026042 - DNA, 14 bp, Homo sapiens
agcatcctggcacc

SEQ ID NO: 2026043 - DNA, 18 bp, Homo sapiens
agcatcctggcacccggc

SEQ ID NO: 2026044 - DNA, 23 bp, Homo sapiens
agcatcctggcacccggcccctg

SEQ ID NO: 2026045 - DNA, 19 bp, Homo sapiens
agcatccttttctgcagag

SEQ ID NO: 2026046 - DNA, 20 bp, Homo sapiens
agcatctcagcctaccatga

SEQ ID NO: 2026047 - DNA, 21 bp, Homo sapiens
agcatctctgtgtacccactc

SEQ ID NO: 2026048 - DNA, 19 bp, Homo sapiens
agcatctgcctctattcaa

SEQ ID NO: 2026049 - DNA, 18 bp, Homo sapiens
agcatctgctcttctctt

SEQ ID NO: 2026050 - DNA, 12 bp, Homo sapiens
agcatcttctgg

SEQ ID NO: 2026051 - DNA, 22 bp, Homo sapiens
agcatgaatggtatggaactct

SEQ ID NO: 2026052 - DNA, 19 bp, Homo sapiens
agcatgagagaattgtatc

SEQ ID NO: 2026053 - DNA, 19 bp, Homo sapiens
agcatgattttaagaggct

SEQ ID NO: 2026054 - DNA, 16 bp, Homo sapiens
agcatgcacagctgct

SEQ ID NO: 2026055 - DNA, 18 bp, Homo sapiens
agcatgcacagctgcttg

SEQ ID NO: 2026056 - DNA, 18 bp, Homo sapiens
agcatggactctgggttt

SEQ ID NO: 2026057 - DNA, 15 bp, Homo sapiens
agcatggagagcctc

SEQ ID NO: 2026058 - DNA, 22 bp, Homo sapiens
agcatggagagcctcttagtga

SEQ ID NO: 2026059 - DNA, 15 bp, Homo sapiens
agcatggctatttta

SEQ ID NO: 2026060 - DNA, 21 bp, Homo sapiens
agcatgggactgtgcctttgg

SEQ ID NO: 2026061 - DNA, 21 bp, Homo sapiens
agcatggtcacaagcacaaag

SEQ ID NO: 2026062 - DNA, 21 bp, Homo sapiens
agcatggtcccacatccctgg

SEQ ID NO: 2026063 - DNA, 15 bp, Homo sapiens
agcatgtaggagaat

SEQ ID NO: 2026064 - DNA, 18 bp, Homo sapiens
agcatgtggcatgttcat

SEQ ID NO: 2026065 - DNA, 16 bp, Homo sapiens
agcatgtgttgaaaaa

SEQ ID NO: 2026066 - DNA, 14 bp, Homo sapiens
agcattaggctttt

SEQ ID NO: 2026067 - DNA, 17 bp, Homo sapiens
agcattcagaagaaaaa

SEQ ID NO: 2026068 - DNA, 19 bp, Homo sapiens
agcattcagaagaaaaaga

SEQ ID NO: 2026069 - DNA, 13 bp, Homo sapiens
agcattcagcaca

SEQ ID NO: 2026070 - DNA, 21 bp, Homo sapiens
agcattcagcacaccccaagg

SEQ ID NO: 2026071 - DNA, 19 bp, Homo sapiens
agcattcaggcagcactga

SEQ ID NO: 2026072 - DNA, 20 bp, Homo sapiens
agcattcaggcagcactgac

SEQ ID NO: 2026073 - DNA, 18 bp, Homo sapiens
agcattctgagctgggct

SEQ ID NO: 2026074 - DNA, 14 bp, Homo sapiens
agcattcttagact

SEQ ID NO: 2026075 - DNA, 17 bp, Homo sapiens
agcattgtaaatgtgct

SEQ ID NO: 2026076 - DNA, 19 bp, Homo sapiens
agcatttgccattcctgga

SEQ ID NO: 2026077 - DNA, 20 bp, Homo sapiens
agcattttactacttgttac

SEQ ID NO: 2026078 - DNA, 18 bp, Homo sapiens
agcattttactgtctgta

SEQ ID NO: 2026079 - DNA, 20 bp, Homo sapiens
agacctgacaccgtccctca

SEQ ID NO: 2026080 - DNA, 21 bp, Homo sapiens
agacctgggccaaaagggcag

SEQ ID NO: 2026081 - DNA, 19 bp, Homo sapiens
agaccttctccaaatgaga

SEQ ID NO: 2026082 - DNA, 22 bp, Homo sapiens
agaccttttctctcccatacca

SEQ ID NO: 2026083 - DNA, 13 bp, Homo sapiens
agacgctcctgaa

SEQ ID NO: 2026084 - DNA, 16 bp, Homo sapiens
agacgctgccgctgcc

SEQ ID NO: 2026085 - DNA, 14 bp, Homo sapiens
agacggattgcatt

SEQ ID NO: 2026086 - DNA, 15 bp, Homo sapiens
agacggctggacctg

SEQ ID NO: 2026087 - DNA, 15 bp, Homo sapiens
agacgtcctggaatg

SEQ ID NO: 2026088 - DNA, 19 bp, Homo sapiens
agacgtcctggaatgaagc

SEQ ID NO: 2026089 - DNA, 12 bp, Homo sapiens
agacgtgaatgt

SEQ ID NO: 2026090 - DNA, 19 bp, Homo sapiens
agacgtgaatgtctcagcg

SEQ ID NO: 2026091 - DNA, 22 bp, Homo sapiens
agacgtttttgtgctgtgggca

SEQ ID NO: 2026092 - DNA, 15 bp, Homo sapiens
agactaacctgccca

SEQ ID NO: 2026093 - DNA, 15 bp, Homo sapiens
agactaagccctgtc

SEQ ID NO: 2026094 - DNA, 23 bp, Homo sapiens
agactaagccctgtcgagacact

SEQ ID NO: 2026095 - DNA, 19 bp, Homo sapiens
agactaatagagacacaga

SEQ ID NO: 2026096 - DNA, 16 bp, Homo sapiens
agactaattaaaatct

SEQ ID NO: 2026097 - DNA, 14 bp, Homo sapiens
agactagttgaaca

SEQ ID NO: 2026098 - DNA, 18 bp, Homo sapiens
agactataaagcagtaga

SEQ ID NO: 2026099 - DNA, 20 bp, Homo sapiens
agactatcttactatttcac

SEQ ID NO: 2026100 - DNA, 15 bp, Homo sapiens
agactatggagcctg

SEQ ID NO: 2026101 - DNA, 12 bp, Homo sapiens
agactatgtgtc

SEQ ID NO: 2026102 - DNA, 20 bp, Homo sapiens
agactatgtgtcatgatttc

SEQ ID NO: 2026103 - DNA, 23 bp, Homo sapiens
agactatgtgtcatgatttcaat

SEQ ID NO: 2026104 - DNA, 16 bp, Homo sapiens
agactattaagagcaa

SEQ ID NO: 2026105 - DNA, 21 bp, Homo sapiens
agactattcaaacagtctcag

SEQ ID NO: 2026106 - DNA, 17 bp, Homo sapiens
agactatttaacttgag

SEQ ID NO: 2026107 - DNA, 12 bp, Homo sapiens
agactcacctct

SEQ ID NO: 2026108 - DNA, 18 bp, Homo sapiens
agactcacctctgcctca

SEQ ID NO: 2026109 - DNA, 17 bp, Homo sapiens
agactcagctccagaat

SEQ ID NO: 2026110 - DNA, 13 bp, Homo sapiens
agactcagctctg

SEQ ID NO: 2026111 - DNA, 18 bp, Homo sapiens
agactcagctctgacatt

SEQ ID NO: 2026112 - DNA, 12 bp, Homo sapiens
agactcagggcc

SEQ ID NO: 2026113 - DNA, 12 bp, Homo sapiens
agactcagtgtt

SEQ ID NO: 2026114 - DNA, 15 bp, Homo sapiens
agactcagtttgtca

SEQ ID NO: 2026115 - DNA, 15 bp, Homo sapiens
agactcatctacaca

SEQ ID NO: 2026116 - DNA, 16 bp, Homo sapiens
agactccaaagaaatg

SEQ ID NO: 2026117 - DNA, 14 bp, Homo sapiens
agactccagaatct

SEQ ID NO: 2026118 - DNA, 24 bp, Homo sapiens
agactccagaatctgctgttgcca

SEQ ID NO: 2026119 - DNA, 14 bp, Homo sapiens
agactcctgtccct

SEQ ID NO: 2026120 - DNA, 17 bp, Homo sapiens
agactcctttcctctga

SEQ ID NO: 2026121 - DNA, 21 bp, Homo sapiens
agactctaaatatttcatgat

SEQ ID NO: 2026122 - DNA, 17 bp, Homo sapiens
agactctacagaggcca

SEQ ID NO: 2026123 - DNA, 14 bp, Homo sapiens
agactctcttagga

SEQ ID NO: 2026124 - DNA, 16 bp, Homo sapiens
agactctgaaatctca

SEQ ID NO: 2026125 - DNA, 20 bp, Homo sapiens
agactctgaaatctcagaat

SEQ ID NO: 2026126 - DNA, 16 bp, Homo sapiens
agactctggaagcccc

SEQ ID NO: 2026127 - DNA, 20 bp, Homo sapiens
agactctgggtccctcggag

SEQ ID NO: 2026128 - DNA, 18 bp, Homo sapiens
agactctgtctcaaaaaa

SEQ ID NO: 2026129 - DNA, 16 bp, Homo sapiens
agactctgtggggcct

SEQ ID NO: 2026130 - DNA, 18 bp, Homo sapiens
agactgaaagcagcagct

SEQ ID NO: 2026131 - DNA, 22 bp, Homo sapiens
agactgaattttaaatgttcac

SEQ ID NO: 2026132 - DNA, 17 bp, Homo sapiens
agactgacacctcactg

SEQ ID NO: 2026133 - DNA, 20 bp, Homo sapiens
agactgatgggacatcaaat

SEQ ID NO: 2026134 - DNA, 19 bp, Homo sapiens
agactgcaagaggctcctg

SEQ ID NO: 2026135 - DNA, 11 bp, Homo sapiens
agactgcagct

SEQ ID NO: 2026136 - DNA, 14 bp, Homo sapiens
agactgcagctgct

SEQ ID NO: 2026137 - DNA, 16 bp, Homo sapiens
agactgcagctgctga

SEQ ID NO: 2026138 - DNA, 17 bp, Homo sapiens
agactgcagctgctgaa

SEQ ID NO: 2026139 - DNA, 20 bp, Homo sapiens
agactgctgggactggccag

SEQ ID NO: 2026140 - DNA, 19 bp, Homo sapiens
agactggaagcacagcttc

SEQ ID NO: 2026141 - DNA, 16 bp, Homo sapiens
agactggacagcttgt

SEQ ID NO: 2026142 - DNA, 16 bp, Homo sapiens
agactggagcatctga

SEQ ID NO: 2026143 - DNA, 18 bp, Homo sapiens
agactggagcatctgact

SEQ ID NO: 2026144 - DNA, 14 bp, Homo sapiens
agactggagtgagg

SEQ ID NO: 2026145 - DNA, 14 bp, Homo sapiens
agactggcacagtt

SEQ ID NO: 2026146 - DNA, 20 bp, Homo sapiens
agactgggaccttagaaatc

SEQ ID NO: 2026147 - DNA, 17 bp, Homo sapiens
agactgggtgaaagtga

SEQ ID NO: 2026148 - DNA, 17 bp, Homo sapiens
agactgtacttattttc

SEQ ID NO: 2026149 - DNA, 23 bp, Homo sapiens
agactgtatgttttaattgcatt

SEQ ID NO: 2026150 - DNA, 20 bp, Homo sapiens
agactgtggctgctagcact

SEQ ID NO: 2026151 - DNA, 17 bp, Homo sapiens
agactgttaaatgaaac

SEQ ID NO: 2026152 - DNA, 14 bp, Homo sapiens
agactgttgctcaa

SEQ ID NO: 2026153 - DNA, 13 bp, Homo sapiens
agacttaagaaag

SEQ ID NO: 2026154 - DNA, 18 bp, Homo sapiens
agacttacttattcttcc

SEQ ID NO: 2026155 - DNA, 24 bp, Homo sapiens
agacttcaggttgttctgtataaa

SEQ ID NO: 2026156 - DNA, 19 bp, Homo sapiens
agacttcagtcctggtctg

SEQ ID NO: 2026157 - DNA, 19 bp, Homo sapiens
agacttccaaacctgacag

SEQ ID NO: 2026158 - DNA, 21 bp, Homo sapiens
agacttccaaacctgacagat

SEQ ID NO: 2026159 - DNA, 15 bp, Homo sapiens
agacttccctgaatg

SEQ ID NO: 2026160 - DNA, 15 bp, Homo sapiens
agacttctggaaggc

SEQ ID NO: 2026161 - DNA, 18 bp, Homo sapiens
agacttctggaaggctgg

SEQ ID NO: 2026162 - DNA, 12 bp, Homo sapiens
agacttgacagt

SEQ ID NO: 2026163 - DNA, 17 bp, Homo sapiens
agacttggggaccagag

SEQ ID NO: 2026164 - DNA, 13 bp, Homo sapiens
agactttagctta

SEQ ID NO: 2026165 - DNA, 18 bp, Homo sapiens
agagaaaaaccaatgatt

SEQ ID NO: 2026166 - DNA, 14 bp, Homo sapiens
agagaaaaagaaat

SEQ ID NO: 2026167 - DNA, 19 bp, Homo sapiens
agagaaaagattaaaatta

SEQ ID NO: 2026168 - DNA, 15 bp, Homo sapiens
agagaaagaaaatga

SEQ ID NO: 2026169 - DNA, 16 bp, Homo sapiens
agagaaagaaagggaa

SEQ ID NO: 2026170 - DNA, 15 bp, Homo sapiens
agagaaagaagagac

SEQ ID NO: 2026171 - DNA, 15 bp, Homo sapiens
agagaaatgtgaagg

SEQ ID NO: 2026172 - DNA, 17 bp, Homo sapiens
agagaagaaagaacgga

SEQ ID NO: 2026173 - DNA, 20 bp, Homo sapiens
agagaagccacgctgtcctc

SEQ ID NO: 2026174 - DNA, 13 bp, Homo sapiens
agagaaggcagga

SEQ ID NO: 2026175 - DNA, 20 bp, Homo sapiens
agagaaggcaggaatgtgtg

SEQ ID NO: 2026176 - DNA, 21 bp, Homo sapiens
agagaagtatccaattatgtg

SEQ ID NO: 2026177 - DNA, 13 bp, Homo sapiens
agagaatatttca

SEQ ID NO: 2026178 - DNA, 21 bp, Homo sapiens
agagaatatttcaaatgaaca

SEQ ID NO: 2026179 - DNA, 23 bp, Homo sapiens
agagaatatttcaaatgaacacg

SEQ ID NO: 2026180 - DNA, 19 bp, Homo sapiens
agagaatcacacaagtttg

SEQ ID NO: 2026181 - DNA, 15 bp, Homo sapiens
agagaatcatactta

SEQ ID NO: 2026182 - DNA, 14 bp, Homo sapiens
agagaattctaaga

SEQ ID NO: 2026183 - DNA, 20 bp, Homo sapiens
agagaattctaagattgtac

SEQ ID NO: 2026184 - DNA, 23 bp, Homo sapiens
agagaatttctaccatttcagag

SEQ ID NO: 2026185 - DNA, 16 bp, Homo sapiens
agagacaataaaacat

SEQ ID NO: 2026186 - DNA, 14 bp, Homo sapiens
agagacacctgcac

SEQ ID NO: 2026187 - DNA, 18 bp, Homo sapiens
agagacacctgcacctcc

SEQ ID NO: 2026188 - DNA, 20 bp, Homo sapiens
agagacacctgcacctcccc

SEQ ID NO: 2026189 - DNA, 21 bp, Homo sapiens
agagacacctgcacctccccc

SEQ ID NO: 2026190 - DNA, 22 bp, Homo sapiens
agagacacctgcacctcccccc

SEQ ID NO: 2026191 - DNA, 17 bp, Homo sapiens
agagacactcccaggga

SEQ ID NO: 2026192 - DNA, 13 bp, Homo sapiens
agagacagagccc

SEQ ID NO: 2026193 - DNA, 14 bp, Homo sapiens
agagacagagcccc

SEQ ID NO: 2026194 - DNA, 16 bp, Homo sapiens
agagacagagccccca

SEQ ID NO: 2026195 - DNA, 20 bp, Homo sapiens
agagacaggcccaagagatg

SEQ ID NO: 2026196 - DNA, 23 bp, Homo sapiens
agcattttactgtctgtaagaga

SEQ ID NO: 2026197 - DNA, 11 bp, Homo sapiens
agcattttata

SEQ ID NO: 2026198 - DNA, 14 bp, Homo sapiens
agcattttcacatt

SEQ ID NO: 2026199 - DNA, 20 bp, Homo sapiens
agcatttttattcatgccat

SEQ ID NO: 2026200 - DNA, 16 bp, Homo sapiens
agcatttttgatttat

SEQ ID NO: 2026201 - DNA, 14 bp, Homo sapiens
agccaaacacactg

SEQ ID NO: 2026202 - DNA, 15 bp, Homo sapiens
agccaaacacactgt

SEQ ID NO: 2026203 - DNA, 17 bp, Homo sapiens
agccaaagagaaaagat

SEQ ID NO: 2026204 - DNA, 16 bp, Homo sapiens
agccaaagctaggcct

SEQ ID NO: 2026205 - DNA, 18 bp, Homo sapiens
agccaaagctaggcctgg

SEQ ID NO: 2026206 - DNA, 19 bp, Homo sapiens
agccaaagctaggcctggc

SEQ ID NO: 2026207 - DNA, 13 bp, Homo sapiens
agccaaatttata

SEQ ID NO: 2026208 - DNA, 12 bp, Homo sapiens
agccaactccat

SEQ ID NO: 2026209 - DNA, 15 bp, Homo sapiens
agccaactcctcctt

SEQ ID NO: 2026210 - DNA, 19 bp, Homo sapiens
agccaacttggctttcccg

SEQ ID NO: 2026211 - DNA, 19 bp, Homo sapiens
agccaagatcgcgccactg

SEQ ID NO: 2026212 - DNA, 20 bp, Homo sapiens
agccaagcttcaaccctcag

SEQ ID NO: 2026213 - DNA, 21 bp, Homo sapiens
agccaagcttcaaccctcagc

SEQ ID NO: 2026214 - DNA, 20 bp, Homo sapiens
agccaaggtgggctgagccc

SEQ ID NO: 2026215 - DNA, 22 bp, Homo sapiens
agccaaggtgggctgagccctg

SEQ ID NO: 2026216 - DNA, 19 bp, Homo sapiens
agccaagttatattgaata

SEQ ID NO: 2026217 - DNA, 22 bp, Homo sapiens
agccacacagagcctgcctcag

SEQ ID NO: 2026218 - DNA, 17 bp, Homo sapiens
agccacacttctcagga

SEQ ID NO: 2026219 - DNA, 20 bp, Homo sapiens
agccacacttctcaggacac

SEQ ID NO: 2026220 - DNA, 17 bp, Homo sapiens
agccacagaagccagga

SEQ ID NO: 2026221 - DNA, 18 bp, Homo sapiens
agccacagaccacctgct

SEQ ID NO: 2026222 - DNA, 23 bp, Homo sapiens
agccacatccctttgaaacaaga

SEQ ID NO: 2026223 - DNA, 13 bp, Homo sapiens
agccaccctgagg

SEQ ID NO: 2026224 - DNA, 14 bp, Homo sapiens
agccaccctgagga

SEQ ID NO: 2026225 - DNA, 20 bp, Homo sapiens
agccaccgtctacagatggc

SEQ ID NO: 2026226 - DNA, 16 bp, Homo sapiens
agccacctcccaagga

SEQ ID NO: 2026227 - DNA, 15 bp, Homo sapiens
agccacctcccaccc

SEQ ID NO: 2026228 - DNA, 16 bp, Homo sapiens
agccacctcccacccc

SEQ ID NO: 2026229 - DNA, 21 bp, Homo sapiens
agccacctcccaccccactcc

SEQ ID NO: 2026230 - DNA, 22 bp, Homo sapiens
agccacctcccaccccactcca

SEQ ID NO: 2026231 - DNA, 14 bp, Homo sapiens
agccacctctcttt

SEQ ID NO: 2026232 - DNA, 15 bp, Homo sapiens
agccacgctgtcctc

SEQ ID NO: 2026233 - DNA, 18 bp, Homo sapiens
agccacgttccttactgc

SEQ ID NO: 2026234 - DNA, 20 bp, Homo sapiens
agccacgttccttactgcag

SEQ ID NO: 2026235 - DNA, 16 bp, Homo sapiens
agccactacctttgtc

SEQ ID NO: 2026236 - DNA, 15 bp, Homo sapiens
agccactcgggaggc

SEQ ID NO: 2026237 - DNA, 19 bp, Homo sapiens
agccactcgggaggctgag

SEQ ID NO: 2026238 - DNA, 13 bp, Homo sapiens
agccactgaagct

SEQ ID NO: 2026239 - DNA, 21 bp, Homo sapiens
agccactgcaccgggccacag

SEQ ID NO: 2026240 - DNA, 19 bp, Homo sapiens
agccagaaataaagttggt

SEQ ID NO: 2026241 - DNA, 18 bp, Homo sapiens
agccagaagcctctgcct

SEQ ID NO: 2026242 - DNA, 22 bp, Homo sapiens
agccagaaggggcacgcctgcc

SEQ ID NO: 2026243 - DNA, 14 bp, Homo sapiens
agccagacacatgg

SEQ ID NO: 2026244 - DNA, 15 bp, Homo sapiens
agccagagagacaga

SEQ ID NO: 2026245 - DNA, 20 bp, Homo sapiens
agccagagcctgtctttcag

SEQ ID NO: 2026246 - DNA, 22 bp, Homo sapiens
agccagagggtgggagcctaag

SEQ ID NO: 2026247 - DNA, 13 bp, Homo sapiens
agccagatccacc

SEQ ID NO: 2026248 - DNA, 23 bp, Homo sapiens
agccagattttttaaaatttata

SEQ ID NO: 2026249 - DNA, 16 bp, Homo sapiens
agccagcagccagctc

SEQ ID NO: 2026250 - DNA, 20 bp, Homo sapiens
agccagcagccagctctcag

SEQ ID NO: 2026251 - DNA, 12 bp, Homo sapiens
agccagcccagc

SEQ ID NO: 2026252 - DNA, 15 bp, Homo sapiens
agccagcccagccca

SEQ ID NO: 2026253 - DNA, 17 bp, Homo sapiens
agccagcccagcccagc

SEQ ID NO: 2026254 - DNA, 12 bp, Homo sapiens
agccagccctcc

SEQ ID NO: 2026255 - DNA, 23 bp, Homo sapiens
agccagccctgcctggaggacct

SEQ ID NO: 2026256 - DNA, 24 bp, Homo sapiens
agccagccctgcctggaggacctg

SEQ ID NO: 2026257 - DNA, 17 bp, Homo sapiens
agccagccggtgcctgg

SEQ ID NO: 2026258 - DNA, 18 bp, Homo sapiens
agccagccggtgcctggc

SEQ ID NO: 2026259 - DNA, 13 bp, Homo sapiens
agccagcctggga

SEQ ID NO: 2026260 - DNA, 12 bp, Homo sapiens
agccagcgcctc

SEQ ID NO: 2026261 - DNA, 16 bp, Homo sapiens
agccagcgcctccctc

SEQ ID NO: 2026262 - DNA, 19 bp, Homo sapiens
agccagcgcctccctccac

SEQ ID NO: 2026263 - DNA, 21 bp, Homo sapiens
agccagcgcctccctccaccc

SEQ ID NO: 2026264 - DNA, 13 bp, Homo sapiens
agccagctcctgg

SEQ ID NO: 2026265 - DNA, 13 bp, Homo sapiens
agccagctctcag

SEQ ID NO: 2026266 - DNA, 13 bp, Homo sapiens
agccagctctctc

SEQ ID NO: 2026267 - DNA, 22 bp, Homo sapiens
agccagctgtgttcacactgta

SEQ ID NO: 2026268 - DNA, 13 bp, Homo sapiens
agccaggagcaaa

SEQ ID NO: 2026269 - DNA, 16 bp, Homo sapiens
agccaggaggagagga

SEQ ID NO: 2026270 - DNA, 21 bp, Homo sapiens
agccaggaggagaggaaagga

SEQ ID NO: 2026271 - DNA, 16 bp, Homo sapiens
agccaggagtctgtgc

SEQ ID NO: 2026272 - DNA, 21 bp, Homo sapiens
agccaggagtctgtgctcttt

SEQ ID NO: 2026273 - DNA, 14 bp, Homo sapiens
agccaggctctgcc

SEQ ID NO: 2026274 - DNA, 12 bp, Homo sapiens
agccagggccag

SEQ ID NO: 2026275 - DNA, 20 bp, Homo sapiens
agccagggtcctgagtggct

SEQ ID NO: 2026276 - DNA, 12 bp, Homo sapiens
agccagggtctc

SEQ ID NO: 2026277 - DNA, 23 bp, Homo sapiens
agccaggttagcctttgccctgt

SEQ ID NO: 2026278 - DNA, 18 bp, Homo sapiens
agccagtcttgcctaggc

SEQ ID NO: 2026279 - DNA, 19 bp, Homo sapiens
agccagtcttgcctaggcc

SEQ ID NO: 2026280 - DNA, 13 bp, Homo sapiens
agccagtgaagga

SEQ ID NO: 2026281 - DNA, 18 bp, Homo sapiens
agccagtgaaggagccac

SEQ ID NO: 2026282 - DNA, 14 bp, Homo sapiens
agccagtgactttt

SEQ ID NO: 2026283 - DNA, 23 bp, Homo sapiens
agccatcacaaggggaacgcaga

SEQ ID NO: 2026284 - DNA, 18 bp, Homo sapiens
agccatcatgtgcctgga

SEQ ID NO: 2026285 - DNA, 19 bp, Homo sapiens
agccatcatgtgcctggaa

SEQ ID NO: 2026286 - DNA, 18 bp, Homo sapiens
agccatcccgtcttctcc

SEQ ID NO: 2026287 - DNA, 22 bp, Homo sapiens
agccatctctctactcctacct

SEQ ID NO: 2026288 - DNA, 22 bp, Homo sapiens
agccatgaccagttctggccag

SEQ ID NO: 2026289 - DNA, 14 bp, Homo sapiens
agccatgcctcatg

SEQ ID NO: 2026290 - DNA, 16 bp, Homo sapiens
agccatgcctcatgcc

SEQ ID NO: 2026291 - DNA, 14 bp, Homo sapiens
agccatggctcagg

SEQ ID NO: 2026292 - DNA, 18 bp, Homo sapiens
agccatggctcaggcaag

SEQ ID NO: 2026293 - DNA, 19 bp, Homo sapiens
agccatggctcaggcaagc

SEQ ID NO: 2026294 - DNA, 21 bp, Homo sapiens
agccatggctcaggcaagccc

SEQ ID NO: 2026295 - DNA, 22 bp, Homo sapiens
agccatggctcaggcaagcccc

SEQ ID NO: 2026296 - DNA, 14 bp, Homo sapiens
agccatgggcctgg

SEQ ID NO: 2026297 - DNA, 16 bp, Homo sapiens
agccatgggcctgggc

SEQ ID NO: 2026298 - DNA, 17 bp, Homo sapiens
agccatgggcctgggcc

SEQ ID NO: 2026299 - DNA, 20 bp, Homo sapiens
agccatgggcctgggcctgc

SEQ ID NO: 2026300 - DNA, 17 bp, Homo sapiens
agccatggtgacacaca

SEQ ID NO: 2026301 - DNA, 18 bp, Homo sapiens
agccatggtgacacacag

SEQ ID NO: 2026302 - DNA, 21 bp, Homo sapiens
agccatggtgacacacagcag

SEQ ID NO: 2026303 - DNA, 21 bp, Homo sapiens
agccatgtaccagtgtactgc

SEQ ID NO: 2026304 - DNA, 20 bp, Homo sapiens
agccattaccatggagacaa

SEQ ID NO: 2026305 - DNA, 22 bp, Homo sapiens
agccatttgttggggcagtggt

SEQ ID NO: 2026306 - DNA, 20 bp, Homo sapiens
agccattttggggggccccc

SEQ ID NO: 2026307 - DNA, 19 bp, Homo sapiens
agccattttttgaggagag

SEQ ID NO: 2026308 - DNA, 14 bp, Homo sapiens
agcccaaagaagga

SEQ ID NO: 2026309 - DNA, 16 bp, Homo sapiens
agcccaaagaaggaaa

SEQ ID NO: 2026310 - DNA, 21 bp, Homo sapiens
agcccaacgggaagcaacctc

SEQ ID NO: 2026311 - DNA, 14 bp, Homo sapiens
agcccaagaggact

SEQ ID NO: 2026312 - DNA, 22 bp, Homo sapiens
agcccttccatgtcgcctctgc

SEQ ID NO: 2026313 - DNA, 14 bp, Homo sapiens
agcccttccctgct

SEQ ID NO: 2026314 - DNA, 17 bp, Homo sapiens
agcccttccctgctttg

SEQ ID NO: 2026315 - DNA, 15 bp, Homo sapiens
agcccttctgccttt

SEQ ID NO: 2026316 - DNA, 21 bp, Homo sapiens
agccctttacttgacctccta

SEQ ID NO: 2026317 - DNA, 13 bp, Homo sapiens
agccctttctgtg

SEQ ID NO: 2026318 - DNA, 21 bp, Homo sapiens
agccctttgcaggcccagcag

SEQ ID NO: 2026319 - DNA, 14 bp, Homo sapiens
agccgacctcagcc

SEQ ID NO: 2026320 - DNA, 23 bp, Homo sapiens
agccgactgcacagcggcccctg

SEQ ID NO: 2026321 - DNA, 14 bp, Homo sapiens
agccgagagcctgc

SEQ ID NO: 2026322 - DNA, 18 bp, Homo sapiens
agccgagagcctgctccc

SEQ ID NO: 2026323 - DNA, 17 bp, Homo sapiens
agccgagatcacgccac

SEQ ID NO: 2026324 - DNA, 21 bp, Homo sapiens
agccgagatcacgccactgca

SEQ ID NO: 2026325 - DNA, 20 bp, Homo sapiens
agccgcaaatcaaccccaga

SEQ ID NO: 2026326 - DNA, 16 bp, Homo sapiens
agccgcatcttctcca

SEQ ID NO: 2026327 - DNA, 17 bp, Homo sapiens
agccgccatcagcccaa

SEQ ID NO: 2026328 - DNA, 17 bp, Homo sapiens
agccgccgggcaggcct

SEQ ID NO: 2026329 - DNA, 15 bp, Homo sapiens
agccgctaggagaga

SEQ ID NO: 2026330 - DNA, 19 bp, Homo sapiens
agccgctaggagagactga

SEQ ID NO: 2026331 - DNA, 19 bp, Homo sapiens
agccgctcctgtctgccag

SEQ ID NO: 2026332 - DNA, 22 bp, Homo sapiens
agccgctgtgagcccctggtcc

SEQ ID NO: 2026333 - DNA, 21 bp, Homo sapiens
agccggaccaagatgggcaca

SEQ ID NO: 2026334 - DNA, 17 bp, Homo sapiens
agccgggtacctcagtt

SEQ ID NO: 2026335 - DNA, 14 bp, Homo sapiens
agccggtgcctggc

SEQ ID NO: 2026336 - DNA, 12 bp, Homo sapiens
agccgtagaggg

SEQ ID NO: 2026337 - DNA, 15 bp, Homo sapiens
agccgtagagggtgg

SEQ ID NO: 2026338 - DNA, 16 bp, Homo sapiens
agccgtcagccaaatg

SEQ ID NO: 2026339 - DNA, 15 bp, Homo sapiens
agccgtccatggcac

SEQ ID NO: 2026340 - DNA, 18 bp, Homo sapiens
agccgtccatggcaccag

SEQ ID NO: 2026341 - DNA, 19 bp, Homo sapiens
agccgtctgactccagagt

SEQ ID NO: 2026342 - DNA, 23 bp, Homo sapiens
agccgtctgactccagagtctga

SEQ ID NO: 2026343 - DNA, 15 bp, Homo sapiens
agccgtgccttcagc

SEQ ID NO: 2026344 - DNA, 16 bp, Homo sapiens
agccgtgccttcagct

SEQ ID NO: 2026345 - DNA, 15 bp, Homo sapiens
agcctaaatctaatc

SEQ ID NO: 2026346 - DNA, 16 bp, Homo sapiens
agcctaaatctaatca

SEQ ID NO: 2026347 - DNA, 15 bp, Homo sapiens
agcctaatacaacat

SEQ ID NO: 2026348 - DNA, 23 bp, Homo sapiens
agcctaatgaaagggaaagtcag

SEQ ID NO: 2026349 - DNA, 13 bp, Homo sapiens
agcctaccccctg

SEQ ID NO: 2026350 - DNA, 20 bp, Homo sapiens
agcctacccttgtaccccat

SEQ ID NO: 2026351 - DNA, 12 bp, Homo sapiens
agcctagccacc

SEQ ID NO: 2026352 - DNA, 14 bp, Homo sapiens
agcctagccacctc

SEQ ID NO: 2026353 - DNA, 15 bp, Homo sapiens
agcctagccacctcc

SEQ ID NO: 2026354 - DNA, 22 bp, Homo sapiens
agcctagccacctcccacccca

SEQ ID NO: 2026355 - DNA, 17 bp, Homo sapiens
agcctagccgacctcag

SEQ ID NO: 2026356 - DNA, 20 bp, Homo sapiens
agcctagccgacctcagcct

SEQ ID NO: 2026357 - DNA, 15 bp, Homo sapiens
agcctaggtgacaga

SEQ ID NO: 2026358 - DNA, 22 bp, Homo sapiens
agcctatttatttgaaagtcct

SEQ ID NO: 2026359 - DNA, 17 bp, Homo sapiens
agcctcaacctcctggg

SEQ ID NO: 2026360 - DNA, 19 bp, Homo sapiens
agcctcaacctcctgggct

SEQ ID NO: 2026361 - DNA, 18 bp, Homo sapiens
agcctcactattacttga

SEQ ID NO: 2026362 - DNA, 22 bp, Homo sapiens
agcctcactattacttgaactt

SEQ ID NO: 2026363 - DNA, 23 bp, Homo sapiens
agcctcactattacttgaacttt

SEQ ID NO: 2026364 - DNA, 13 bp, Homo sapiens
agcctcactgata

SEQ ID NO: 2026365 - DNA, 17 bp, Homo sapiens
agcctcactgatatatt

SEQ ID NO: 2026366 - DNA, 22 bp, Homo sapiens
agcctcacttttaatgaacaaa

SEQ ID NO: 2026367 - DNA, 16 bp, Homo sapiens
agcctcagcatcctgg

SEQ ID NO: 2026368 - DNA, 19 bp, Homo sapiens
agcctcagcatcctggcac

SEQ ID NO: 2026369 - DNA, 15 bp, Homo sapiens
agcctcagctcagcc

SEQ ID NO: 2026370 - DNA, 16 bp, Homo sapiens
agcctcagctcagcct

SEQ ID NO: 2026371 - DNA, 18 bp, Homo sapiens
agcctcagtgccacttga

SEQ ID NO: 2026372 - DNA, 23 bp, Homo sapiens
agcctcagtgccacttgacattc

SEQ ID NO: 2026373 - DNA, 19 bp, Homo sapiens
agcctcatatttaaagaca

SEQ ID NO: 2026374 - DNA, 20 bp, Homo sapiens
agcctcatatttaaagacag

SEQ ID NO: 2026375 - DNA, 19 bp, Homo sapiens
agcctcatccgaggcaggg

SEQ ID NO: 2026376 - DNA, 18 bp, Homo sapiens
agcctccaccttgctctt

SEQ ID NO: 2026377 - DNA, 15 bp, Homo sapiens
agcctccagagccag

SEQ ID NO: 2026378 - DNA, 17 bp, Homo sapiens
agcctccagagccagcc

SEQ ID NO: 2026379 - DNA, 21 bp, Homo sapiens
agcctccagagccagcctggg

SEQ ID NO: 2026380 - DNA, 24 bp, Homo sapiens
agcctccagagccagcctgggact

SEQ ID NO: 2026381 - DNA, 18 bp, Homo sapiens
agcctccatgctgcctcc

SEQ ID NO: 2026382 - DNA, 20 bp, Homo sapiens
agcctccatttagttctttg

SEQ ID NO: 2026383 - DNA, 21 bp, Homo sapiens
agcctccatttagttctttgt

SEQ ID NO: 2026384 - DNA, 14 bp, Homo sapiens
agcctccatttctg

SEQ ID NO: 2026385 - DNA, 20 bp, Homo sapiens
agcctcccaaagtgctggga

SEQ ID NO: 2026386 - DNA, 11 bp, Homo sapiens
agcctcccaga

SEQ ID NO: 2026387 - DNA, 12 bp, Homo sapiens
agcctcccagag

SEQ ID NO: 2026388 - DNA, 13 bp, Homo sapiens
agcctcccagagt

SEQ ID NO: 2026389 - DNA, 12 bp, Homo sapiens
agcctcccccac

SEQ ID NO: 2026390 - DNA, 19 bp, Homo sapiens
agcctcccgaatagctggg

SEQ ID NO: 2026391 - DNA, 18 bp, Homo sapiens
agcctcccgagtagctgg

SEQ ID NO: 2026392 - DNA, 20 bp, Homo sapiens
agcctcccgagtagctggga

SEQ ID NO: 2026393 - DNA, 14 bp, Homo sapiens
agcctccctcctcg

SEQ ID NO: 2026394 - DNA, 22 bp, Homo sapiens
agcctccgtttatgggccttgc

SEQ ID NO: 2026395 - DNA, 23 bp, Homo sapiens
agcctccgtttatgggccttgct

SEQ ID NO: 2026396 - DNA, 19 bp, Homo sapiens
agcctcctaagcagctggg

SEQ ID NO: 2026397 - DNA, 21 bp, Homo sapiens
agcctcctaagcagctgggac

SEQ ID NO: 2026398 - DNA, 16 bp, Homo sapiens
agcctcctcccaccac

SEQ ID NO: 2026399 - DNA, 21 bp, Homo sapiens
agcctcctcccaccaccctcc

SEQ ID NO: 2026400 - DNA, 13 bp, Homo sapiens
agcctcctcctga

SEQ ID NO: 2026401 - DNA, 16 bp, Homo sapiens
agcctcctcctgacca

SEQ ID NO: 2026402 - DNA, 13 bp, Homo sapiens
agcctcctctctc

SEQ ID NO: 2026403 - DNA, 14 bp, Homo sapiens
agcctcctgacctg

SEQ ID NO: 2026404 - DNA, 17 bp, Homo sapiens
agcctcctgacctgagg

SEQ ID NO: 2026405 - DNA, 15 bp, Homo sapiens
agcctcggtggccat

SEQ ID NO: 2026406 - DNA, 16 bp, Homo sapiens
agcctcggtggccatg

SEQ ID NO: 2026407 - DNA, 17 bp, Homo sapiens
agcctcggtggccatgc

SEQ ID NO: 2026408 - DNA, 20 bp, Homo sapiens
agcctcggtggccatgcttc

SEQ ID NO: 2026409 - DNA, 23 bp, Homo sapiens
agcctctccaggaatgcctcctc

SEQ ID NO: 2026410 - DNA, 14 bp, Homo sapiens
agcctctcccggct

SEQ ID NO: 2026411 - DNA, 15 bp, Homo sapiens
agcctctcccggctg

SEQ ID NO: 2026412 - DNA, 17 bp, Homo sapiens
agcctctcccggctgcc

SEQ ID NO: 2026413 - DNA, 18 bp, Homo sapiens
agcctctcccggctgcct

SEQ ID NO: 2026414 - DNA, 19 bp, Homo sapiens
agcctctcccggctgcctg

SEQ ID NO: 2026415 - DNA, 18 bp, Homo sapiens
agcctctccttgcctggt

SEQ ID NO: 2026416 - DNA, 22 bp, Homo sapiens
agcctctgcagcggaatctgtt

SEQ ID NO: 2026417 - DNA, 18 bp, Homo sapiens
agcctctgccccaagggg

SEQ ID NO: 2026418 - DNA, 13 bp, Homo sapiens
agcctctgccctg

SEQ ID NO: 2026419 - DNA, 16 bp, Homo sapiens
agcctctgcctgtgca

SEQ ID NO: 2026420 - DNA, 23 bp, Homo sapiens
agcctcttaaagctgcctgtagt

SEQ ID NO: 2026421 - DNA, 20 bp, Homo sapiens
agcctgaacatgacatttct

SEQ ID NO: 2026422 - DNA, 20 bp, Homo sapiens
agcctgaattttgttgctgt

SEQ ID NO: 2026423 - DNA, 22 bp, Homo sapiens
agcctgactgtgttcagtgcct

SEQ ID NO: 2026424 - DNA, 11 bp, Homo sapiens
agcctgaggct

SEQ ID NO: 2026425 - DNA, 11 bp, Homo sapiens
agcctgctccc

SEQ ID NO: 2026426 - DNA, 17 bp, Homo sapiens
agcctgctcccccaccc

SEQ ID NO: 2026427 - DNA, 23 bp, Homo sapiens
agcctgctcccccaccccctccc

SEQ ID NO: 2026428 - DNA, 22 bp, Homo sapiens
agcccaagaggtctgagccctg

SEQ ID NO: 2026429 - DNA, 17 bp, Homo sapiens
agcccaagtgccatccc

SEQ ID NO: 2026430 - DNA, 16 bp, Homo sapiens
agcccaataaacctct

SEQ ID NO: 2026431 - DNA, 16 bp, Homo sapiens
agcccaatattataat

SEQ ID NO: 2026432 - DNA, 10 bp, Homo sapiens
agcccacacc

SEQ ID NO: 2026433 - DNA, 12 bp, Homo sapiens
agcccacagagc

SEQ ID NO: 2026434 - DNA, 14 bp, Homo sapiens
agcccacagagcct

SEQ ID NO: 2026435 - DNA, 15 bp, Homo sapiens
agcccacagagcctg

SEQ ID NO: 2026436 - DNA, 14 bp, Homo sapiens
agcccaccttggct

SEQ ID NO: 2026437 - DNA, 13 bp, Homo sapiens
agcccacttctgc

SEQ ID NO: 2026438 - DNA, 13 bp, Homo sapiens
agcccagcactgt

SEQ ID NO: 2026439 - DNA, 14 bp, Homo sapiens
agcccagcactgtg

SEQ ID NO: 2026440 - DNA, 15 bp, Homo sapiens
agcccagcagggcct

SEQ ID NO: 2026441 - DNA, 14 bp, Homo sapiens
agcccagccacctc

SEQ ID NO: 2026442 - DNA, 23 bp, Homo sapiens
agcccagccattaccatggagac

SEQ ID NO: 2026443 - DNA, 15 bp, Homo sapiens
agcccagctacattc

SEQ ID NO: 2026444 - DNA, 16 bp, Homo sapiens
agcccagctacattcc

SEQ ID NO: 2026445 - DNA, 23 bp, Homo sapiens
agcccagctacattcctcagctg

SEQ ID NO: 2026446 - DNA, 13 bp, Homo sapiens
agcccagctggtg

SEQ ID NO: 2026447 - DNA, 16 bp, Homo sapiens
agcccagctggtggga

SEQ ID NO: 2026448 - DNA, 21 bp, Homo sapiens
agcccaggagctgagtcacct

SEQ ID NO: 2026449 - DNA, 21 bp, Homo sapiens
agcccaggccgttccccttgg

SEQ ID NO: 2026450 - DNA, 21 bp, Homo sapiens
agcccagggcatcccatgggg

SEQ ID NO: 2026451 - DNA, 15 bp, Homo sapiens
agcccaggggagcag

SEQ ID NO: 2026452 - DNA, 18 bp, Homo sapiens
agcccagtgacctgaccg

SEQ ID NO: 2026453 - DNA, 15 bp, Homo sapiens
agcccagtgcttctc

SEQ ID NO: 2026454 - DNA, 14 bp, Homo sapiens
agcccagtttccct

SEQ ID NO: 2026455 - DNA, 14 bp, Homo sapiens
agcccataaggcca

SEQ ID NO: 2026456 - DNA, 21 bp, Homo sapiens
agcccattctctctcctgtcc

SEQ ID NO: 2026457 - DNA, 13 bp, Homo sapiens
agcccatttcaat

SEQ ID NO: 2026458 - DNA, 23 bp, Homo sapiens
agccccaaagtcaattaaaggct

SEQ ID NO: 2026459 - DNA, 15 bp, Homo sapiens
agccccacacggagg

SEQ ID NO: 2026460 - DNA, 17 bp, Homo sapiens
agccccacagcacccag

SEQ ID NO: 2026461 - DNA, 18 bp, Homo sapiens
agccccacagcacccagg

SEQ ID NO: 2026462 - DNA, 19 bp, Homo sapiens
agccccacagcacccaggc

SEQ ID NO: 2026463 - DNA, 18 bp, Homo sapiens
agccccaggcctctgtgt

SEQ ID NO: 2026464 - DNA, 15 bp, Homo sapiens
agccccagggcccta

SEQ ID NO: 2026465 - DNA, 15 bp, Homo sapiens
agccccagtgcccac

SEQ ID NO: 2026466 - DNA, 16 bp, Homo sapiens
agccccagtgcccaca

SEQ ID NO: 2026467 - DNA, 19 bp, Homo sapiens
agccccatcttggtcctgt

SEQ ID NO: 2026468 - DNA, 20 bp, Homo sapiens
agccccatcttggtcctgtc

SEQ ID NO: 2026469 - DNA, 21 bp, Homo sapiens
agccccatcttggtcctgtca

SEQ ID NO: 2026470 - DNA, 13 bp, Homo sapiens
agccccattctgc

SEQ ID NO: 2026471 - DNA, 19 bp, Homo sapiens
agccccattctgcctgccc

SEQ ID NO: 2026472 - DNA, 23 bp, Homo sapiens
agccccattctgcctgcccaggc

SEQ ID NO: 2026473 - DNA, 13 bp, Homo sapiens
agcccccaagcct

SEQ ID NO: 2026474 - DNA, 17 bp, Homo sapiens
agcccccaccccacgga

SEQ ID NO: 2026475 - DNA, 20 bp, Homo sapiens
agcccccacctccgccccag

SEQ ID NO: 2026476 - DNA, 23 bp, Homo sapiens
agcccccactttcctacaaaatg

SEQ ID NO: 2026477 - DNA, 13 bp, Homo sapiens
agccccccagcac

SEQ ID NO: 2026478 - DNA, 14 bp, Homo sapiens
agccccgactccag

SEQ ID NO: 2026479 - DNA, 22 bp, Homo sapiens
agccccgaggccttctctgaag

SEQ ID NO: 2026480 - DNA, 20 bp, Homo sapiens
agccccgctcctcccctctt

SEQ ID NO: 2026481 - DNA, 16 bp, Homo sapiens
agccccgggcctgcct

SEQ ID NO: 2026482 - DNA, 17 bp, Homo sapiens
agccccgggcctgcctc

SEQ ID NO: 2026483 - DNA, 16 bp, Homo sapiens
agcccctcagcccttg

SEQ ID NO: 2026484 - DNA, 11 bp, Homo sapiens
agcccctcctc

SEQ ID NO: 2026485 - DNA, 16 bp, Homo sapiens
agcccctcctcccctt

SEQ ID NO: 2026486 - DNA, 19 bp, Homo sapiens
agcccctcctccccttcct

SEQ ID NO: 2026487 - DNA, 18 bp, Homo sapiens
agcccctcctctgccacc

SEQ ID NO: 2026488 - DNA, 20 bp, Homo sapiens
agcccctcctctgccacctc

SEQ ID NO: 2026489 - DNA, 14 bp, Homo sapiens
agcccctggtcctg

SEQ ID NO: 2026490 - DNA, 22 bp, Homo sapiens
agccccttactatgatctcagg

SEQ ID NO: 2026491 - DNA, 23 bp, Homo sapiens
agccccttactatgatctcagga

SEQ ID NO: 2026492 - DNA, 19 bp, Homo sapiens
agccccttgtcctctcccg

SEQ ID NO: 2026493 - DNA, 14 bp, Homo sapiens
agcccgaagcccag

SEQ ID NO: 2026494 - DNA, 14 bp, Homo sapiens
agcccgaggaccgg

SEQ ID NO: 2026495 - DNA, 18 bp, Homo sapiens
agcccgcccaaggggact

SEQ ID NO: 2026496 - DNA, 15 bp, Homo sapiens
agcccggccagggcc

SEQ ID NO: 2026497 - DNA, 16 bp, Homo sapiens
agcccggccagggcct

SEQ ID NO: 2026498 - DNA, 11 bp, Homo sapiens
agcccggcctg

SEQ ID NO: 2026499 - DNA, 22 bp, Homo sapiens
agcccggcctgctcccagcagc

SEQ ID NO: 2026500 - DNA, 20 bp, Homo sapiens
agcccgtgcagtacaggcaa

SEQ ID NO: 2026501 - DNA, 13 bp, Homo sapiens
agcccgtgtcctg

SEQ ID NO: 2026502 - DNA, 16 bp, Homo sapiens
agcccgtgtcctgcct

SEQ ID NO: 2026503 - DNA, 14 bp, Homo sapiens
agccctaaacatca

SEQ ID NO: 2026504 - DNA, 15 bp, Homo sapiens
agccctaaacatcat

SEQ ID NO: 2026505 - DNA, 21 bp, Homo sapiens
agccctaaacatcattcttga

SEQ ID NO: 2026506 - DNA, 20 bp, Homo sapiens
agccctacatcttcagctcc

SEQ ID NO: 2026507 - DNA, 16 bp, Homo sapiens
agccctatggatgtgg

SEQ ID NO: 2026508 - DNA, 13 bp, Homo sapiens
agccctcagaaca

SEQ ID NO: 2026509 - DNA, 14 bp, Homo sapiens
agccctcaggccag

SEQ ID NO: 2026510 - DNA, 18 bp, Homo sapiens
agccctcaggccagtgcc

SEQ ID NO: 2026511 - DNA, 19 bp, Homo sapiens
agccctcaggccagtgcca

SEQ ID NO: 2026512 - DNA, 20 bp, Homo sapiens
agccctcaggccagtgccag

SEQ ID NO: 2026513 - DNA, 23 bp, Homo sapiens
agccctcagtcagttcccggagc

SEQ ID NO: 2026514 - DNA, 21 bp, Homo sapiens
agccctcccccttccccttct

SEQ ID NO: 2026515 - DNA, 22 bp, Homo sapiens
agccctccctgcccctcccttc

SEQ ID NO: 2026516 - DNA, 15 bp, Homo sapiens
agccctccctgtcct

SEQ ID NO: 2026517 - DNA, 17 bp, Homo sapiens
agccctccctgtcctcc

SEQ ID NO: 2026518 - DNA, 20 bp, Homo sapiens
agccctccctgtcctcctcg

SEQ ID NO: 2026519 - DNA, 11 bp, Homo sapiens
agccctccttc

SEQ ID NO: 2026520 - DNA, 12 bp, Homo sapiens
agccctccttcc

SEQ ID NO: 2026521 - DNA, 13 bp, Homo sapiens
agccctccttcca

SEQ ID NO: 2026522 - DNA, 20 bp, Homo sapiens
agccctcgaaccaaggcagc

SEQ ID NO: 2026523 - DNA, 23 bp, Homo sapiens
agccctcgaaccaaggcagcctc

SEQ ID NO: 2026524 - DNA, 24 bp, Homo sapiens
agccctcgaaccaaggcagcctcc

SEQ ID NO: 2026525 - DNA, 18 bp, Homo sapiens
agccctgagctcaggctg

SEQ ID NO: 2026526 - DNA, 21 bp, Homo sapiens
agccctgagctcaggctgagc

SEQ ID NO: 2026527 - DNA, 23 bp, Homo sapiens
agccctgcagccaaacagagcct

SEQ ID NO: 2026528 - DNA, 14 bp, Homo sapiens
agccctgccaggag

SEQ ID NO: 2026529 - DNA, 12 bp, Homo sapiens
agccctgcctgg

SEQ ID NO: 2026530 - DNA, 16 bp, Homo sapiens
agccctgcctggagga

SEQ ID NO: 2026531 - DNA, 17 bp, Homo sapiens
agccctgctgtgggaga

SEQ ID NO: 2026532 - DNA, 13 bp, Homo sapiens
agccctggcagga

SEQ ID NO: 2026533 - DNA, 21 bp, Homo sapiens
agccctggcaggatgaccctg

SEQ ID NO: 2026534 - DNA, 14 bp, Homo sapiens
agccctggctctgc

SEQ ID NO: 2026535 - DNA, 13 bp, Homo sapiens
agccctgggaccg

SEQ ID NO: 2026536 - DNA, 14 bp, Homo sapiens
agccctgggaccgc

SEQ ID NO: 2026537 - DNA, 17 bp, Homo sapiens
agccctgggccccacca

SEQ ID NO: 2026538 - DNA, 18 bp, Homo sapiens
agccctgggggccagctg

SEQ ID NO: 2026539 - DNA, 23 bp, Homo sapiens
agccctgggggccagctggtgct

SEQ ID NO: 2026540 - DNA, 16 bp, Homo sapiens
agccctggtggcagtg

SEQ ID NO: 2026541 - DNA, 23 bp, Homo sapiens
agccctgtcgagacacttgcctt

SEQ ID NO: 2026542 - DNA, 13 bp, Homo sapiens
agcccttcatttg

SEQ ID NO: 2026543 - DNA, 14 bp, Homo sapiens
agcccttccagtgg

SEQ ID NO: 2026544 - DNA, 22 bp, Homo sapiens
agcccttccagtggtaccagct

SEQ ID NO: 2026545 - DNA, 13 bp, Homo sapiens
agcctggactttg

SEQ ID NO: 2026546 - DNA, 13 bp, Homo sapiens
agcctggagaagc

SEQ ID NO: 2026547 - DNA, 17 bp, Homo sapiens
agcctggcccatagaaa

SEQ ID NO: 2026548 - DNA, 14 bp, Homo sapiens
agcctggcttctgg

SEQ ID NO: 2026549 - DNA, 21 bp, Homo sapiens
agcctggcttctggagccctt

SEQ ID NO: 2026550 - DNA, 23 bp, Homo sapiens
agcctggcttctggagcccttgg

SEQ ID NO: 2026551 - DNA, 18 bp, Homo sapiens
agcctgggaccagggcat

SEQ ID NO: 2026552 - DNA, 16 bp, Homo sapiens
agcctgggactcccag

SEQ ID NO: 2026553 - DNA, 19 bp, Homo sapiens
agcctgggactcccagtga

SEQ ID NO: 2026554 - DNA, 20 bp, Homo sapiens
agcctgggcaacagagcaag

SEQ ID NO: 2026555 - DNA, 20 bp, Homo sapiens
agcctgggcagcatagcaag

SEQ ID NO: 2026556 - DNA, 15 bp, Homo sapiens
agcctgggccagaga

SEQ ID NO: 2026557 - DNA, 16 bp, Homo sapiens
agcctgggccagagaa

SEQ ID NO: 2026558 - DNA, 19 bp, Homo sapiens
agcctgggcctatggagag

SEQ ID NO: 2026559 - DNA, 14 bp, Homo sapiens
agcctgggcgacag

SEQ ID NO: 2026560 - DNA, 15 bp, Homo sapiens
agcctgggggcctgg

SEQ ID NO: 2026561 - DNA, 18 bp, Homo sapiens
agcctgggggcctggctg

SEQ ID NO: 2026562 - DNA, 21 bp, Homo sapiens
agcctgggggcctggctggct

SEQ ID NO: 2026563 - DNA, 23 bp, Homo sapiens
agcctgggggcctggctggctga

SEQ ID NO: 2026564 - DNA, 22 bp, Homo sapiens
agcctggtagaattgggaagct

SEQ ID NO: 2026565 - DNA, 18 bp, Homo sapiens
agcctgtaatcccagcta

SEQ ID NO: 2026566 - DNA, 23 bp, Homo sapiens
agcctgtccactaacttgtcttt

SEQ ID NO: 2026567 - DNA, 12 bp, Homo sapiens
agcctgtcctgg

SEQ ID NO: 2026568 - DNA, 23 bp, Homo sapiens
agcctgtcctggtacagcagggt

SEQ ID NO: 2026569 - DNA, 15 bp, Homo sapiens
agcctgtctttcagc

SEQ ID NO: 2026570 - DNA, 19 bp, Homo sapiens
agcctgtgaacccaggaca

SEQ ID NO: 2026571 - DNA, 21 bp, Homo sapiens
agcctgtgattaacttgctta

SEQ ID NO: 2026572 - DNA, 21 bp, Homo sapiens
agcctgtgcatgtatgtcttg

SEQ ID NO: 2026573 - DNA, 14 bp, Homo sapiens
agcctgtgccacct

SEQ ID NO: 2026574 - DNA, 19 bp, Homo sapiens
agcctgtgccacctgcaag

SEQ ID NO: 2026575 - DNA, 12 bp, Homo sapiens
agcctgtgcctc

SEQ ID NO: 2026576 - DNA, 20 bp, Homo sapiens
agcctgtggcggtgcctggg

SEQ ID NO: 2026577 - DNA, 14 bp, Homo sapiens
agcctgttcatggc

SEQ ID NO: 2026578 - DNA, 17 bp, Homo sapiens
agcctgttcatggcaga

SEQ ID NO: 2026579 - DNA, 14 bp, Homo sapiens
agcctgttggaccc

SEQ ID NO: 2026580 - DNA, 22 bp, Homo sapiens
agccttaaatttttgtcatttt

SEQ ID NO: 2026581 - DNA, 22 bp, Homo sapiens
agccttagaagtcacacagtat

SEQ ID NO: 2026582 - DNA, 20 bp, Homo sapiens
agccttcacaaccagccaca

SEQ ID NO: 2026583 - DNA, 19 bp, Homo sapiens
agccttccccctcccaggg

SEQ ID NO: 2026584 - DNA, 20 bp, Homo sapiens
agccttccccttgcccaggg

SEQ ID NO: 2026585 - DNA, 22 bp, Homo sapiens
agccttccccttgcccagggct

SEQ ID NO: 2026586 - DNA, 11 bp, Homo sapiens
agccttctctc

SEQ ID NO: 2026587 - DNA, 12 bp, Homo sapiens
agccttctctgt

SEQ ID NO: 2026588 - DNA, 14 bp, Homo sapiens
agccttgaaaaaca

SEQ ID NO: 2026589 - DNA, 18 bp, Homo sapiens
agccttgaaaaacaagtc

SEQ ID NO: 2026590 - DNA, 20 bp, Homo sapiens
agccttgccttttaaaagaa

SEQ ID NO: 2026591 - DNA, 16 bp, Homo sapiens
agccttggtgtccacc

SEQ ID NO: 2026592 - DNA, 18 bp, Homo sapiens
agccttggtgtccacctg

SEQ ID NO: 2026593 - DNA, 18 bp, Homo sapiens
agccttgtaattctaaat

SEQ ID NO: 2026594 - DNA, 14 bp, Homo sapiens
agccttgtgccctg

SEQ ID NO: 2026595 - DNA, 16 bp, Homo sapiens
agccttgtgccctgcc

SEQ ID NO: 2026596 - DNA, 17 bp, Homo sapiens
agccttgtgccctgccc

SEQ ID NO: 2026597 - DNA, 18 bp, Homo sapiens
agccttgtgccctgcccc

SEQ ID NO: 2026598 - DNA, 20 bp, Homo sapiens
agccttgtgccctgccccca

SEQ ID NO: 2026599 - DNA, 23 bp, Homo sapiens
agcctttccataaggaatgtagc

SEQ ID NO: 2026600 - DNA, 16 bp, Homo sapiens
agcctttgccctgtca

SEQ ID NO: 2026601 - DNA, 13 bp, Homo sapiens
agccttttcttat

SEQ ID NO: 2026602 - DNA, 12 bp, Homo sapiens
agcctttttcac

SEQ ID NO: 2026603 - DNA, 21 bp, Homo sapiens
agcctttttttagtaaatcct

SEQ ID NO: 2026604 - DNA, 12 bp, Homo sapiens
agcgaaactccg

SEQ ID NO: 2026605 - DNA, 22 bp, Homo sapiens
agcgaacatgcctgattttaaa

SEQ ID NO: 2026606 - DNA, 14 bp, Homo sapiens
agcgaagcagagag

SEQ ID NO: 2026607 - DNA, 22 bp, Homo sapiens
agcgagacccttgcattagaaa

SEQ ID NO: 2026608 - DNA, 23 bp, Homo sapiens
agcgagacccttgcattagaaac

SEQ ID NO: 2026609 - DNA, 15 bp, Homo sapiens
agcgagctgctctgc

SEQ ID NO: 2026610 - DNA, 18 bp, Homo sapiens
agcgagctgctctgctat

SEQ ID NO: 2026611 - DNA, 19 bp, Homo sapiens
agcgatgaatttggagact

SEQ ID NO: 2026612 - DNA, 23 bp, Homo sapiens
agcgattccctctcccaggcccc

SEQ ID NO: 2026613 - DNA, 17 bp, Homo sapiens
agcgcacctgccccctg

SEQ ID NO: 2026614 - DNA, 19 bp, Homo sapiens
agcgcacctgccccctggt

SEQ ID NO: 2026615 - DNA, 23 bp, Homo sapiens
agcgcagccgccgggcaggcctg

SEQ ID NO: 2026616 - DNA, 19 bp, Homo sapiens
agcgcagggaggatgccac

SEQ ID NO: 2026617 - DNA, 20 bp, Homo sapiens
agcgcagggaggatgccaca

SEQ ID NO: 2026618 - DNA, 12 bp, Homo sapiens
agcgccctgcag

SEQ ID NO: 2026619 - DNA, 17 bp, Homo sapiens
agcgccctgcagaccct

SEQ ID NO: 2026620 - DNA, 19 bp, Homo sapiens
agcgccctgcagaccctgc

SEQ ID NO: 2026621 - DNA, 15 bp, Homo sapiens
agcgcctccctccac

SEQ ID NO: 2026622 - DNA, 18 bp, Homo sapiens
agcgcctgccctccctgg

SEQ ID NO: 2026623 - DNA, 24 bp, Homo sapiens
agcgcctgtgctgaggactccctc

SEQ ID NO: 2026624 - DNA, 16 bp, Homo sapiens
agcgcgggcggaggcg

SEQ ID NO: 2026625 - DNA, 19 bp, Homo sapiens
agcgcgggcggaggcggct

SEQ ID NO: 2026626 - DNA, 13 bp, Homo sapiens
agcgctggctcag

SEQ ID NO: 2026627 - DNA, 16 bp, Homo sapiens
agcgctttctggaaaa

SEQ ID NO: 2026628 - DNA, 17 bp, Homo sapiens
agcgctttctggaaaag

SEQ ID NO: 2026629 - DNA, 22 bp, Homo sapiens
agcgggatctcgtatctttaaa

SEQ ID NO: 2026630 - DNA, 15 bp, Homo sapiens
agcgggcctcttccc

SEQ ID NO: 2026631 - DNA, 16 bp, Homo sapiens
agcggggacagctcct

SEQ ID NO: 2026632 - DNA, 17 bp, Homo sapiens
agcggggacagctcctt

SEQ ID NO: 2026633 - DNA, 14 bp, Homo sapiens
agcggggaggtgcc

SEQ ID NO: 2026634 - DNA, 13 bp, Homo sapiens
agcggttgcttct

SEQ ID NO: 2026635 - DNA, 16 bp, Homo sapiens
agcgtccctagcagtg

SEQ ID NO: 2026636 - DNA, 15 bp, Homo sapiens
agcgtgagccactgc

SEQ ID NO: 2026637 - DNA, 17 bp, Homo sapiens
agcgtgagccactgcac

SEQ ID NO: 2026638 - DNA, 19 bp, Homo sapiens
agcgtgagccactgcaccg

SEQ ID NO: 2026639 - DNA, 17 bp, Homo sapiens
agcgtggctgtgctctc

SEQ ID NO: 2026640 - DNA, 23 bp, Homo sapiens
agcgtttagtttctagaggcctc

SEQ ID NO: 2026641 - DNA, 18 bp, Homo sapiens
agctaaattacaattgtc

SEQ ID NO: 2026642 - DNA, 16 bp, Homo sapiens
agctaacagggaaggc

SEQ ID NO: 2026643 - DNA, 21 bp, Homo sapiens
agctaacagggaaggcaggca

SEQ ID NO: 2026644 - DNA, 18 bp, Homo sapiens
agctaacattttaaataa

SEQ ID NO: 2026645 - DNA, 18 bp, Homo sapiens
agctaagctaggaatgaa

SEQ ID NO: 2026646 - DNA, 19 bp, Homo sapiens
agctaagtgaaaaggtcat

SEQ ID NO: 2026647 - DNA, 23 bp, Homo sapiens
agctaatctgtagggctggacct

SEQ ID NO: 2026648 - DNA, 13 bp, Homo sapiens
agctaatgaaatt

SEQ ID NO: 2026649 - DNA, 15 bp, Homo sapiens
agctaatgaaattga

SEQ ID NO: 2026650 - DNA, 16 bp, Homo sapiens
agctaatgaagctatt

SEQ ID NO: 2026651 - DNA, 19 bp, Homo sapiens
agctaattaaggtttgccc

SEQ ID NO: 2026652 - DNA, 19 bp, Homo sapiens
agctacacctgaggctgag

SEQ ID NO: 2026653 - DNA, 20 bp, Homo sapiens
agctacactattgcattgtt

SEQ ID NO: 2026654 - DNA, 12 bp, Homo sapiens
agctacattcct

SEQ ID NO: 2026655 - DNA, 16 bp, Homo sapiens
agctacattcctcagc

SEQ ID NO: 2026656 - DNA, 18 bp, Homo sapiens
agctacctgtgtggacag

SEQ ID NO: 2026657 - DNA, 16 bp, Homo sapiens
agctacgtatttaata

SEQ ID NO: 2026658 - DNA, 21 bp, Homo sapiens
agctactcagaagcctgaggc

SEQ ID NO: 2026659 - DNA, 15 bp, Homo sapiens
agctactcaggaggc

SEQ ID NO: 2026660 - DNA, 19 bp, Homo sapiens
agctactctcttgccagca

SEQ ID NO: 2026661 - DNA, 17 bp, Homo sapiens
agctactctgtccaggc

SEQ ID NO: 2026662 - DNA, 19 bp, Homo sapiens
agctactctgtccaggcca

SEQ ID NO: 2026663 - DNA, 23 bp, Homo sapiens
agctactctgtccaggccactgt

SEQ ID NO: 2026664 - DNA, 14 bp, Homo sapiens
agctactgaattta

SEQ ID NO: 2026665 - DNA, 16 bp, Homo sapiens
agctacttgggaggct

SEQ ID NO: 2026666 - DNA, 15 bp, Homo sapiens
agctagaaatatgat

SEQ ID NO: 2026667 - DNA, 16 bp, Homo sapiens
agctagaacctggaga

SEQ ID NO: 2026668 - DNA, 21 bp, Homo sapiens
agctagaagtgggccaggaca

SEQ ID NO: 2026669 - DNA, 22 bp, Homo sapiens
agctagaagtgggccaggacag

SEQ ID NO: 2026670 - DNA, 24 bp, Homo sapiens
agctagaagtgggccaggacaggc

SEQ ID NO: 2026671 - DNA, 14 bp, Homo sapiens
agctagaattgagt

SEQ ID NO: 2026672 - DNA, 20 bp, Homo sapiens
agctagaattgagtgtttaa

SEQ ID NO: 2026673 - DNA, 17 bp, Homo sapiens
agctagactggagtgag

SEQ ID NO: 2026674 - DNA, 20 bp, Homo sapiens
agctagccagagggtgggag

SEQ ID NO: 2026675 - DNA, 21 bp, Homo sapiens
agctagcgctgccgcacccca

SEQ ID NO: 2026676 - DNA, 19 bp, Homo sapiens
agctaggagcaaagcctgt

SEQ ID NO: 2026677 - DNA, 12 bp, Homo sapiens
agctaggcctgg

SEQ ID NO: 2026678 - DNA, 18 bp, Homo sapiens
agctagttcgtagctttc

SEQ ID NO: 2026679 - DNA, 16 bp, Homo sapiens
agctatgagggtcccc

SEQ ID NO: 2026680 - DNA, 18 bp, Homo sapiens
agctatgattatgccact

SEQ ID NO: 2026681 - DNA, 17 bp, Homo sapiens
agctatggccccagggt

SEQ ID NO: 2026682 - DNA, 16 bp, Homo sapiens
agctatgttccctcca

SEQ ID NO: 2026683 - DNA, 19 bp, Homo sapiens
agctatgttccctccagca

SEQ ID NO: 2026684 - DNA, 21 bp, Homo sapiens
agctattactgtctggtttta

SEQ ID NO: 2026685 - DNA, 23 bp, Homo sapiens
agctattgatgtttccagaaaat

SEQ ID NO: 2026686 - DNA, 18 bp, Homo sapiens
agctattgcatgtaaaat

SEQ ID NO: 2026687 - DNA, 20 bp, Homo sapiens
agctattgcatgtaaaatgc

SEQ ID NO: 2026688 - DNA, 10 bp, Homo sapiens
agctattttt

SEQ ID NO: 2026689 - DNA, 20 bp, Homo sapiens
agctcaagcaggaagttcaa

SEQ ID NO: 2026690 - DNA, 23 bp, Homo sapiens
agctcaagtcttccctgatcaag

SEQ ID NO: 2026691 - DNA, 21 bp, Homo sapiens
agctcacaagcccaggctgga

SEQ ID NO: 2026692 - DNA, 17 bp, Homo sapiens
agctcacccaataaaca

SEQ ID NO: 2026693 - DNA, 12 bp, Homo sapiens
agctcactccct

SEQ ID NO: 2026694 - DNA, 18 bp, Homo sapiens
agctcagacccccactct

SEQ ID NO: 2026695 - DNA, 23 bp, Homo sapiens
agctcagacttgccaggctccct

SEQ ID NO: 2026696 - DNA, 15 bp, Homo sapiens
agctcagaggcccag

SEQ ID NO: 2026697 - DNA, 21 bp, Homo sapiens
agctcagctactgatttttgt

SEQ ID NO: 2026698 - DNA, 13 bp, Homo sapiens
agctcaggaggcg

SEQ ID NO: 2026699 - DNA, 20 bp, Homo sapiens
agctcaggaggcgaataaat

SEQ ID NO: 2026700 - DNA, 23 bp, Homo sapiens
agctcaggaggcgaataaatgtt

SEQ ID NO: 2026701 - DNA, 14 bp, Homo sapiens
agctcaggctgagc

SEQ ID NO: 2026702 - DNA, 15 bp, Homo sapiens
agctcaggctgagcc

SEQ ID NO: 2026703 - DNA, 16 bp, Homo sapiens
agctcaggctgagccc

SEQ ID NO: 2026704 - DNA, 18 bp, Homo sapiens
agctcaggctgagcccag

SEQ ID NO: 2026705 - DNA, 13 bp, Homo sapiens
agctcagtcccat

SEQ ID NO: 2026706 - DNA, 21 bp, Homo sapiens
agctcagtcccatcagagagc

SEQ ID NO: 2026707 - DNA, 15 bp, Homo sapiens
agctccaacagcttg

SEQ ID NO: 2026708 - DNA, 19 bp, Homo sapiens
agctccaacagcttgacca

SEQ ID NO: 2026709 - DNA, 19 bp, Homo sapiens
agctccaccctcaccagga

SEQ ID NO: 2026710 - DNA, 22 bp, Homo sapiens
agctccaccctcaccaggatga

SEQ ID NO: 2026711 - DNA, 21 bp, Homo sapiens
agctccacggtgcgtggctgt

SEQ ID NO: 2026712 - DNA, 16 bp, Homo sapiens
agctccagtttccaag

SEQ ID NO: 2026713 - DNA, 16 bp, Homo sapiens
agctcccagatgctgg

SEQ ID NO: 2026714 - DNA, 21 bp, Homo sapiens
agctcccatagcgctggctca

SEQ ID NO: 2026715 - DNA, 22 bp, Homo sapiens
agctcccatagcgctggctcag

SEQ ID NO: 2026716 - DNA, 10 bp, Homo sapiens
agctccccag

SEQ ID NO: 2026717 - DNA, 13 bp, Homo sapiens
agctccccaggac

SEQ ID NO: 2026718 - DNA, 17 bp, Homo sapiens
agctcccctcggagaag

SEQ ID NO: 2026719 - DNA, 20 bp, Homo sapiens
agctcccctcggagaagagc

SEQ ID NO: 2026720 - DNA, 22 bp, Homo sapiens
agctcccctcggagaagagctg

SEQ ID NO: 2026721 - DNA, 15 bp, Homo sapiens
agctccctaggagac

SEQ ID NO: 2026722 - DNA, 18 bp, Homo sapiens
agctcccttcccctgcct

SEQ ID NO: 2026723 - DNA, 20 bp, Homo sapiens
agctcccttcccctgcctgg

SEQ ID NO: 2026724 - DNA, 14 bp, Homo sapiens
agctcccttcctga

SEQ ID NO: 2026725 - DNA, 15 bp, Homo sapiens
agctccgtcatctgc

SEQ ID NO: 2026726 - DNA, 22 bp, Homo sapiens
agctcctcgctgcgtctccatc

SEQ ID NO: 2026727 - DNA, 14 bp, Homo sapiens
agctcctctccttg

SEQ ID NO: 2026728 - DNA, 18 bp, Homo sapiens
agctcctctccttgggct

SEQ ID NO: 2026729 - DNA, 20 bp, Homo sapiens
agctcctctccttgggctcc

SEQ ID NO: 2026730 - DNA, 14 bp, Homo sapiens
agctcctctgctgc

SEQ ID NO: 2026731 - DNA, 12 bp, Homo sapiens
agctcctctgtc

SEQ ID NO: 2026732 - DNA, 24 bp, Homo sapiens
agctcctctgtctcgagcgccctg

SEQ ID NO: 2026733 - DNA, 19 bp, Homo sapiens
agctcctgtccctacccac

SEQ ID NO: 2026734 - DNA, 20 bp, Homo sapiens
agctcctgtccctacccact

SEQ ID NO: 2026735 - DNA, 12 bp, Homo sapiens
agctcctgtcct

SEQ ID NO: 2026736 - DNA, 13 bp, Homo sapiens
agctcctgtcctc

SEQ ID NO: 2026737 - DNA, 15 bp, Homo sapiens
agctcctgtcctccc

SEQ ID NO: 2026738 - DNA, 12 bp, Homo sapiens
agctccttctgt

SEQ ID NO: 2026739 - DNA, 21 bp, Homo sapiens
agctccttctgtcctactctg

SEQ ID NO: 2026740 - DNA, 23 bp, Homo sapiens
agctccttttgtccccagggccc

SEQ ID NO: 2026741 - DNA, 13 bp, Homo sapiens
agctcgctaaagt

SEQ ID NO: 2026742 - DNA, 15 bp, Homo sapiens
agctcgctcttggga

SEQ ID NO: 2026743 - DNA, 15 bp, Homo sapiens
agctcggtggaccca

SEQ ID NO: 2026744 - DNA, 18 bp, Homo sapiens
agctcggtggacccaggg

SEQ ID NO: 2026745 - DNA, 14 bp, Homo sapiens
agctctagttcaaa

SEQ ID NO: 2026746 - DNA, 22 bp, Homo sapiens
agctctattaagatttccaagt

SEQ ID NO: 2026747 - DNA, 12 bp, Homo sapiens
agctctcagcca

SEQ ID NO: 2026748 - DNA, 13 bp, Homo sapiens
agctctcagccaa

SEQ ID NO: 2026749 - DNA, 17 bp, Homo sapiens
agctctccctctggccc

SEQ ID NO: 2026750 - DNA, 22 bp, Homo sapiens
agctctccctctggccctgcct

SEQ ID NO: 2026751 - DNA, 12 bp, Homo sapiens
agctctctgtat

SEQ ID NO: 2026752 - DNA, 21 bp, Homo sapiens
agctctctgtataaacattaa

SEQ ID NO: 2026753 - DNA, 18 bp, Homo sapiens
agctctctttggaatgaa

SEQ ID NO: 2026754 - DNA, 21 bp, Homo sapiens
agctctgaagtcacatcacag

SEQ ID NO: 2026755 - DNA, 21 bp, Homo sapiens
agctctgaatctgataggaaa

SEQ ID NO: 2026756 - DNA, 20 bp, Homo sapiens
agctctgacattctgattcg

SEQ ID NO: 2026757 - DNA, 10 bp, Homo sapiens
agctctgaga

SEQ ID NO: 2026758 - DNA, 13 bp, Homo sapiens
agctctgagaggc

SEQ ID NO: 2026759 - DNA, 15 bp, Homo sapiens
agctctgagaggccc

SEQ ID NO: 2026760 - DNA, 18 bp, Homo sapiens
agctctgagaggccctgg

SEQ ID NO: 2026761 - DNA, 19 bp, Homo sapiens
agctctgagaggccctgga

SEQ ID NO: 2026762 - DNA, 20 bp, Homo sapiens
agctctgagaggccctggat

SEQ ID NO: 2026763 - DNA, 21 bp, Homo sapiens
agctctgagaggccctggatc

SEQ ID NO: 2026764 - DNA, 15 bp, Homo sapiens
agctctgatgagaga

SEQ ID NO: 2026765 - DNA, 21 bp, Homo sapiens
agctctgcagagcaggaaaca

SEQ ID NO: 2026766 - DNA, 13 bp, Homo sapiens
agctctgcattat

SEQ ID NO: 2026767 - DNA, 12 bp, Homo sapiens
agctctgctcct

SEQ ID NO: 2026768 - DNA, 22 bp, Homo sapiens
agctctgctcctctccccagca

SEQ ID NO: 2026769 - DNA, 15 bp, Homo sapiens
agctctggaccagcc

SEQ ID NO: 2026770 - DNA, 20 bp, Homo sapiens
agctctggccccaggcttgt

SEQ ID NO: 2026771 - DNA, 12 bp, Homo sapiens
agctctggcttc

SEQ ID NO: 2026772 - DNA, 22 bp, Homo sapiens
agctctgtagaaagaatgtgtt

SEQ ID NO: 2026773 - DNA, 13 bp, Homo sapiens
agctctgtccact

SEQ ID NO: 2026774 - DNA, 23 bp, Homo sapiens
agctctgtcctgggagtgagctg

SEQ ID NO: 2026775 - DNA, 14 bp, Homo sapiens
agctctgtggcctg

SEQ ID NO: 2026776 - DNA, 15 bp, Homo sapiens
agctctgtggcctgt

SEQ ID NO: 2026777 - DNA, 17 bp, Homo sapiens
aggacattatgtgtgca

SEQ ID NO: 2026778 - DNA, 18 bp, Homo sapiens
aggacattgcggacagcc

SEQ ID NO: 2026779 - DNA, 23 bp, Homo sapiens
aggacattgcggacagccacggc

SEQ ID NO: 2026780 - DNA, 18 bp, Homo sapiens
aggacattttctctttaa

SEQ ID NO: 2026781 - DNA, 19 bp, Homo sapiens
aggaccaactggcttctgt

SEQ ID NO: 2026782 - DNA, 19 bp, Homo sapiens
aggaccacagtgggtggca

SEQ ID NO: 2026783 - DNA, 23 bp, Homo sapiens
aggaccaggactatagcccaggt

SEQ ID NO: 2026784 - DNA, 16 bp, Homo sapiens
aggaccagtcccagag

SEQ ID NO: 2026785 - DNA, 16 bp, Homo sapiens
aggacccaggccctcc

SEQ ID NO: 2026786 - DNA, 13 bp, Homo sapiens
aggacccaggccg

SEQ ID NO: 2026787 - DNA, 20 bp, Homo sapiens
aggacccctccatgtgggct

SEQ ID NO: 2026788 - DNA, 17 bp, Homo sapiens
aggacccggaggggcct

SEQ ID NO: 2026789 - DNA, 18 bp, Homo sapiens
aggacccggaggggcctg

SEQ ID NO: 2026790 - DNA, 22 bp, Homo sapiens
aggacccggaggggcctggcag

SEQ ID NO: 2026791 - DNA, 13 bp, Homo sapiens
aggaccgggctgg

SEQ ID NO: 2026792 - DNA, 23 bp, Homo sapiens
aggaccgtggccctgccctctcc

SEQ ID NO: 2026793 - DNA, 13 bp, Homo sapiens
aggacctcaggcg

SEQ ID NO: 2026794 - DNA, 13 bp, Homo sapiens
aggacctgagcct

SEQ ID NO: 2026795 - DNA, 15 bp, Homo sapiens
aggacctgagcctgc

SEQ ID NO: 2026796 - DNA, 16 bp, Homo sapiens
aggacctgagcctgcc

SEQ ID NO: 2026797 - DNA, 21 bp, Homo sapiens
aggacctgagcctgccgagca

SEQ ID NO: 2026798 - DNA, 12 bp, Homo sapiens
aggacgccactc

SEQ ID NO: 2026799 - DNA, 19 bp, Homo sapiens
aggacgccactcatttcat

SEQ ID NO: 2026800 - DNA, 20 bp, Homo sapiens
aggacgccactcatttcatc

SEQ ID NO: 2026801 - DNA, 16 bp, Homo sapiens
aggacggttgtaagca

SEQ ID NO: 2026802 - DNA, 21 bp, Homo sapiens
aggacggttgtaagcagttgt

SEQ ID NO: 2026803 - DNA, 22 bp, Homo sapiens
aggactaacactcagaagcctg

SEQ ID NO: 2026804 - DNA, 22 bp, Homo sapiens
aggactaacataaaatctgtga

SEQ ID NO: 2026805 - DNA, 19 bp, Homo sapiens
aggactacgttaagggaag

SEQ ID NO: 2026806 - DNA, 21 bp, Homo sapiens
aggactagaaaaacttgggtc

SEQ ID NO: 2026807 - DNA, 17 bp, Homo sapiens
aggactagaacctggag

SEQ ID NO: 2026808 - DNA, 18 bp, Homo sapiens
aggactatagcccaggtc

SEQ ID NO: 2026809 - DNA, 20 bp, Homo sapiens
aggactatagcccaggtcct

SEQ ID NO: 2026810 - DNA, 13 bp, Homo sapiens
aggactccccagg

SEQ ID NO: 2026811 - DNA, 16 bp, Homo sapiens
aggactccccaggcca

SEQ ID NO: 2026812 - DNA, 20 bp, Homo sapiens
aggactccccaggccaggcc

SEQ ID NO: 2026813 - DNA, 17 bp, Homo sapiens
aggactccctccatgtg

SEQ ID NO: 2026814 - DNA, 17 bp, Homo sapiens
aggactccttaaatttg

SEQ ID NO: 2026815 - DNA, 17 bp, Homo sapiens
aggactctgaggctctt

SEQ ID NO: 2026816 - DNA, 12 bp, Homo sapiens
aggactctgcct

SEQ ID NO: 2026817 - DNA, 17 bp, Homo sapiens
aggactctgcctcctct

SEQ ID NO: 2026818 - DNA, 14 bp, Homo sapiens
aggactctgccttt

SEQ ID NO: 2026819 - DNA, 18 bp, Homo sapiens
aggacttaacggctccag

SEQ ID NO: 2026820 - DNA, 16 bp, Homo sapiens
aggacttagctggcca

SEQ ID NO: 2026821 - DNA, 14 bp, Homo sapiens
aggacttcccgagc

SEQ ID NO: 2026822 - DNA, 14 bp, Homo sapiens
aggacttctgcagc

SEQ ID NO: 2026823 - DNA, 15 bp, Homo sapiens
aggacttctgcagct

SEQ ID NO: 2026824 - DNA, 14 bp, Homo sapiens
aggacttctgcctg

SEQ ID NO: 2026825 - DNA, 16 bp, Homo sapiens
aggacttggtctgatt

SEQ ID NO: 2026826 - DNA, 16 bp, Homo sapiens
aggagaaacagagaca

SEQ ID NO: 2026827 - DNA, 13 bp, Homo sapiens
aggagaaactgag

SEQ ID NO: 2026828 - DNA, 12 bp, Homo sapiens
aggagaaataaa

SEQ ID NO: 2026829 - DNA, 15 bp, Homo sapiens
aggagaaggaaaaag

SEQ ID NO: 2026830 - DNA, 15 bp, Homo sapiens
aggagaatgagcctc

SEQ ID NO: 2026831 - DNA, 20 bp, Homo sapiens
aggagaatggtgtgaacccg

SEQ ID NO: 2026832 - DNA, 14 bp, Homo sapiens
aggagaccaaggcg

SEQ ID NO: 2026833 - DNA, 14 bp, Homo sapiens
aggagaccagctca

SEQ ID NO: 2026834 - DNA, 16 bp, Homo sapiens
aggagaccagctcaga

SEQ ID NO: 2026835 - DNA, 23 bp, Homo sapiens
aggagaccagctcagaggcccag

SEQ ID NO: 2026836 - DNA, 12 bp, Homo sapiens
aggagaccctgg

SEQ ID NO: 2026837 - DNA, 13 bp, Homo sapiens
aggagaccctgga

SEQ ID NO: 2026838 - DNA, 11 bp, Homo sapiens
aggagactcac

SEQ ID NO: 2026839 - DNA, 14 bp, Homo sapiens
aggagactcacctc

SEQ ID NO: 2026840 - DNA, 19 bp, Homo sapiens
aggagactcacctctgcct

SEQ ID NO: 2026841 - DNA, 21 bp, Homo sapiens
aggagactcacctctgcctca

SEQ ID NO: 2026842 - DNA, 14 bp, Homo sapiens
aggagagaaggaca

SEQ ID NO: 2026843 - DNA, 19 bp, Homo sapiens
aggagagactgaaagcagc

SEQ ID NO: 2026844 - DNA, 13 bp, Homo sapiens
aggagagagatct

SEQ ID NO: 2026845 - DNA, 19 bp, Homo sapiens
aggagagataccttgaaaa

SEQ ID NO: 2026846 - DNA, 18 bp, Homo sapiens
aggagaggggaagggcca

SEQ ID NO: 2026847 - DNA, 20 bp, Homo sapiens
aggagagtggttgttgccaa

SEQ ID NO: 2026848 - DNA, 15 bp, Homo sapiens
aggagatataaaatc

SEQ ID NO: 2026849 - DNA, 14 bp, Homo sapiens
aggagattttcctt

SEQ ID NO: 2026850 - DNA, 18 bp, Homo sapiens
aggagattttccttccta

SEQ ID NO: 2026851 - DNA, 14 bp, Homo sapiens
aggagcaaagcctg

SEQ ID NO: 2026852 - DNA, 15 bp, Homo sapiens
aggagcaatttgcac

SEQ ID NO: 2026853 - DNA, 18 bp, Homo sapiens
aggagcaatttgcacatg

SEQ ID NO: 2026854 - DNA, 19 bp, Homo sapiens
aggagcacacggccctgcc

SEQ ID NO: 2026855 - DNA, 22 bp, Homo sapiens
aggagcacacggccctgcccca

SEQ ID NO: 2026856 - DNA, 16 bp, Homo sapiens
aggagcacctgaaccc

SEQ ID NO: 2026857 - DNA, 18 bp, Homo sapiens
aggagcagacagagaaat

SEQ ID NO: 2026858 - DNA, 16 bp, Homo sapiens
aggagcagcttcagtt

SEQ ID NO: 2026859 - DNA, 20 bp, Homo sapiens
aggagcagcttcagttgttt

SEQ ID NO: 2026860 - DNA, 15 bp, Homo sapiens
aggagcaggaacaga

SEQ ID NO: 2026861 - DNA, 18 bp, Homo sapiens
aggagcaggaacagagac

SEQ ID NO: 2026862 - DNA, 19 bp, Homo sapiens
aggagcaggaacagagact

SEQ ID NO: 2026863 - DNA, 11 bp, Homo sapiens
aggagcctggc

SEQ ID NO: 2026864 - DNA, 11 bp, Homo sapiens
aggagcctgtg

SEQ ID NO: 2026865 - DNA, 19 bp, Homo sapiens
aggagcctgtgaacccagg

SEQ ID NO: 2026866 - DNA, 14 bp, Homo sapiens
aggagctacctgtg

SEQ ID NO: 2026867 - DNA, 15 bp, Homo sapiens
aggagctacctgtgt

SEQ ID NO: 2026868 - DNA, 18 bp, Homo sapiens
aggagctgatttccaggc

SEQ ID NO: 2026869 - DNA, 23 bp, Homo sapiens
aggagctgatttccaggcccctg

SEQ ID NO: 2026870 - DNA, 15 bp, Homo sapiens
aggagctgccgcaag

SEQ ID NO: 2026871 - DNA, 21 bp, Homo sapiens
aggagctgccgcaaggccctg

SEQ ID NO: 2026872 - DNA, 16 bp, Homo sapiens
aggagctgggaggaaa

SEQ ID NO: 2026873 - DNA, 17 bp, Homo sapiens
aggagctgggaggaaaa

SEQ ID NO: 2026874 - DNA, 17 bp, Homo sapiens
aggagcttccagtgcat

SEQ ID NO: 2026875 - DNA, 16 bp, Homo sapiens
aggagcttgcaagaag

SEQ ID NO: 2026876 - DNA, 14 bp, Homo sapiens
aggaggaaggcaaa

SEQ ID NO: 2026877 - DNA, 23 bp, Homo sapiens
aggaggaaggcaaagcccctgga

SEQ ID NO: 2026878 - DNA, 13 bp, Homo sapiens
aggaggagctgcc

SEQ ID NO: 2026879 - DNA, 14 bp, Homo sapiens
aggaggagctgccg

SEQ ID NO: 2026880 - DNA, 13 bp, Homo sapiens
aggaggaggagga

SEQ ID NO: 2026881 - DNA, 18 bp, Homo sapiens
aggaggatggacgaacag

SEQ ID NO: 2026882 - DNA, 23 bp, Homo sapiens
aggaggattgcttgagcccagga

SEQ ID NO: 2026883 - DNA, 22 bp, Homo sapiens
aggaggccctggtgtcaggcag

SEQ ID NO: 2026884 - DNA, 11 bp, Homo sapiens
aggaggcctgg

SEQ ID NO: 2026885 - DNA, 18 bp, Homo sapiens
aggaggcgaataaatgtt

SEQ ID NO: 2026886 - DNA, 19 bp, Homo sapiens
aggaggcgaataaatgttc

SEQ ID NO: 2026887 - DNA, 22 bp, Homo sapiens
aggaggcgcagcccgaagccca

SEQ ID NO: 2026888 - DNA, 13 bp, Homo sapiens
aggaggctgaggg

SEQ ID NO: 2026889 - DNA, 15 bp, Homo sapiens
aggaggctgcatgct

SEQ ID NO: 2026890 - DNA, 19 bp, Homo sapiens
aggagggacaaaggagcct

SEQ ID NO: 2026891 - DNA, 20 bp, Homo sapiens
aggagggacaaaggagcctg

SEQ ID NO: 2026892 - DNA, 22 bp, Homo sapiens
aggagggacaaaggagcctgtg

SEQ ID NO: 2026893 - DNA, 23 bp, Homo sapiens
aggagggacaaaggagcctgtga

SEQ ID NO: 2026894 - DNA, 17 bp, Homo sapiens
agctttttgtcttttct

SEQ ID NO: 2026895 - DNA, 15 bp, Homo sapiens
aggaaaaaaaataat

SEQ ID NO: 2026896 - DNA, 14 bp, Homo sapiens
aggaaaaagaaatg

SEQ ID NO: 2026897 - DNA, 23 bp, Homo sapiens
aggaaaaccaagccgtggcttcc

SEQ ID NO: 2026898 - DNA, 22 bp, Homo sapiens
aggaaaacgggaaagaatataa

SEQ ID NO: 2026899 - DNA, 12 bp, Homo sapiens
aggaaaactgtt

SEQ ID NO: 2026900 - DNA, 14 bp, Homo sapiens
aggaaaagaaggct

SEQ ID NO: 2026901 - DNA, 16 bp, Homo sapiens
aggaaaaggcctgggg

SEQ ID NO: 2026902 - DNA, 17 bp, Homo sapiens
aggaaaaggcctggggt

SEQ ID NO: 2026903 - DNA, 19 bp, Homo sapiens
aggaaaagtacatttaata

SEQ ID NO: 2026904 - DNA, 19 bp, Homo sapiens
aggaaaagtcaacatcttc

SEQ ID NO: 2026905 - DNA, 16 bp, Homo sapiens
aggaaaagtgcaatgc

SEQ ID NO: 2026906 - DNA, 22 bp, Homo sapiens
aggaaaatgcttctgttgtaat

SEQ ID NO: 2026907 - DNA, 16 bp, Homo sapiens
aggaaaattgaatgca

SEQ ID NO: 2026908 - DNA, 21 bp, Homo sapiens
aggaaactctgcattctagta

SEQ ID NO: 2026909 - DNA, 16 bp, Homo sapiens
aggaaagcagtgtgtc

SEQ ID NO: 2026910 - DNA, 21 bp, Homo sapiens
aggaaagcagtgtgtccttgg

SEQ ID NO: 2026911 - DNA, 19 bp, Homo sapiens
aggaaagccccagcactaa

SEQ ID NO: 2026912 - DNA, 13 bp, Homo sapiens
aggaaagccctcc

SEQ ID NO: 2026913 - DNA, 14 bp, Homo sapiens
aggaaagccctccc

SEQ ID NO: 2026914 - DNA, 17 bp, Homo sapiens
aggaaagccctccccct

SEQ ID NO: 2026915 - DNA, 23 bp, Homo sapiens
aggaaagccctcccccttcccct

SEQ ID NO: 2026916 - DNA, 19 bp, Homo sapiens
aggaaaggggcgagcaccc

SEQ ID NO: 2026917 - DNA, 16 bp, Homo sapiens
aggaaataaaaccttt

SEQ ID NO: 2026918 - DNA, 19 bp, Homo sapiens
aggaaataaaacctttcaa

SEQ ID NO: 2026919 - DNA, 21 bp, Homo sapiens
aggaaataaaacctttcaaat

SEQ ID NO: 2026920 - DNA, 15 bp, Homo sapiens
aggaaatagaattga

SEQ ID NO: 2026921 - DNA, 14 bp, Homo sapiens
aggaaatagtgttc

SEQ ID NO: 2026922 - DNA, 19 bp, Homo sapiens
aggaaatcaaatatgcaaa

SEQ ID NO: 2026923 - DNA, 21 bp, Homo sapiens
aggaaatcaaatatgcaaagc

SEQ ID NO: 2026924 - DNA, 18 bp, Homo sapiens
aggaaatggagaagctct

SEQ ID NO: 2026925 - DNA, 13 bp, Homo sapiens
aggaacaagagaa

SEQ ID NO: 2026926 - DNA, 18 bp, Homo sapiens
aggaacacccggaaagac

SEQ ID NO: 2026927 - DNA, 23 bp, Homo sapiens
aggaacactggaaaataaatttt

SEQ ID NO: 2026928 - DNA, 14 bp, Homo sapiens
aggaacagaaggat

SEQ ID NO: 2026929 - DNA, 17 bp, Homo sapiens
aggaacagagactctgg

SEQ ID NO: 2026930 - DNA, 21 bp, Homo sapiens
aggaacagagactctggaagc

SEQ ID NO: 2026931 - DNA, 16 bp, Homo sapiens
aggaacagagtatata

SEQ ID NO: 2026932 - DNA, 14 bp, Homo sapiens
aggaacctgaacct

SEQ ID NO: 2026933 - DNA, 23 bp, Homo sapiens
aggaacctgtactgggttatttt

SEQ ID NO: 2026934 - DNA, 22 bp, Homo sapiens
aggaacgagcactggccagaga

SEQ ID NO: 2026935 - DNA, 22 bp, Homo sapiens
aggaactaggatagatgtgatt

SEQ ID NO: 2026936 - DNA, 13 bp, Homo sapiens
aggaactcccagc

SEQ ID NO: 2026937 - DNA, 23 bp, Homo sapiens
aggaactcccagcaacacaagct

SEQ ID NO: 2026938 - DNA, 16 bp, Homo sapiens
aggaagaaaccccaag

SEQ ID NO: 2026939 - DNA, 18 bp, Homo sapiens
aggaagaagggataatag

SEQ ID NO: 2026940 - DNA, 20 bp, Homo sapiens
aggaagaatggtgtgggaga

SEQ ID NO: 2026941 - DNA, 14 bp, Homo sapiens
aggaagagaaacca

SEQ ID NO: 2026942 - DNA, 16 bp, Homo sapiens
aggaagagaaggagca

SEQ ID NO: 2026943 - DNA, 13 bp, Homo sapiens
aggaagagagaga

SEQ ID NO: 2026944 - DNA, 14 bp, Homo sapiens
aggaagagagagag

SEQ ID NO: 2026945 - DNA, 17 bp, Homo sapiens
aggaagagcaggcacat

SEQ ID NO: 2026946 - DNA, 17 bp, Homo sapiens
aggaagatgaaagagga

SEQ ID NO: 2026947 - DNA, 19 bp, Homo sapiens
aggaagatgaagagaagct

SEQ ID NO: 2026948 - DNA, 22 bp, Homo sapiens
aggaagatgaagagaagctgag

SEQ ID NO: 2026949 - DNA, 15 bp, Homo sapiens
aggaagcaagcttaa

SEQ ID NO: 2026950 - DNA, 17 bp, Homo sapiens
aggaagcaagcttaatg

SEQ ID NO: 2026951 - DNA, 15 bp, Homo sapiens
aggaagccacagctg

SEQ ID NO: 2026952 - DNA, 14 bp, Homo sapiens
aggaagccaggctg

SEQ ID NO: 2026953 - DNA, 16 bp, Homo sapiens
aggaagcccaaggcag

SEQ ID NO: 2026954 - DNA, 16 bp, Homo sapiens
aggaagccccaagcca

SEQ ID NO: 2026955 - DNA, 15 bp, Homo sapiens
aggaagcgtggggta

SEQ ID NO: 2026956 - DNA, 19 bp, Homo sapiens
aggaaggagactcacctct

SEQ ID NO: 2026957 - DNA, 13 bp, Homo sapiens
aggaaggcaaagc

SEQ ID NO: 2026958 - DNA, 16 bp, Homo sapiens
aggaaggcagcattcc

SEQ ID NO: 2026959 - DNA, 12 bp, Homo sapiens
aggaaggcagct

SEQ ID NO: 2026960 - DNA, 17 bp, Homo sapiens
aggaagggacacacaca

SEQ ID NO: 2026961 - DNA, 18 bp, Homo sapiens
aggaagggcatccttctg

SEQ ID NO: 2026962 - DNA, 20 bp, Homo sapiens
aggaagggcatccttctgcc

SEQ ID NO: 2026963 - DNA, 13 bp, Homo sapiens
aggaagggccagg

SEQ ID NO: 2026964 - DNA, 14 bp, Homo sapiens
aggaagggccagga

SEQ ID NO: 2026965 - DNA, 17 bp, Homo sapiens
aggaagggccaggagag

SEQ ID NO: 2026966 - DNA, 21 bp, Homo sapiens
aggaagggccaggagagagat

SEQ ID NO: 2026967 - DNA, 16 bp, Homo sapiens
aggaagggggttgtgg

SEQ ID NO: 2026968 - DNA, 16 bp, Homo sapiens
aggaaggtagcccagc

SEQ ID NO: 2026969 - DNA, 21 bp, Homo sapiens
aggaaggtgctgagcttagcc

SEQ ID NO: 2026970 - DNA, 23 bp, Homo sapiens
aggaagtgggggccgctggccca

SEQ ID NO: 2026971 - DNA, 16 bp, Homo sapiens
aggaataattatttat

SEQ ID NO: 2026972 - DNA, 17 bp, Homo sapiens
aggaataattatttatt

SEQ ID NO: 2026973 - DNA, 18 bp, Homo sapiens
aggaataattatttattt

SEQ ID NO: 2026974 - DNA, 22 bp, Homo sapiens
aggaataattatttatttaata

SEQ ID NO: 2026975 - DNA, 23 bp, Homo sapiens
aggaatatcccaaacttcggaaa

SEQ ID NO: 2026976 - DNA, 16 bp, Homo sapiens
aggaatatgactgttt

SEQ ID NO: 2026977 - DNA, 17 bp, Homo sapiens
aggaatcaaaaattgaa

SEQ ID NO: 2026978 - DNA, 15 bp, Homo sapiens
aggaatcctttgaga

SEQ ID NO: 2026979 - DNA, 19 bp, Homo sapiens
aggaatctacctgtggtga

SEQ ID NO: 2026980 - DNA, 16 bp, Homo sapiens
aggaatctcagagaca

SEQ ID NO: 2026981 - DNA, 17 bp, Homo sapiens
aggaatctcagagacag

SEQ ID NO: 2026982 - DNA, 22 bp, Homo sapiens
aggaatctgaaagtatattttc

SEQ ID NO: 2026983 - DNA, 20 bp, Homo sapiens
aggaatctgtgcagatgagc

SEQ ID NO: 2026984 - DNA, 16 bp, Homo sapiens
aggaatgcctgtgtga

SEQ ID NO: 2026985 - DNA, 18 bp, Homo sapiens
aggaatgtagctggtttc

SEQ ID NO: 2026986 - DNA, 23 bp, Homo sapiens
aggaattcccagcccaaagctgt

SEQ ID NO: 2026987 - DNA, 20 bp, Homo sapiens
aggaattgaagatgtaagga

SEQ ID NO: 2026988 - DNA, 22 bp, Homo sapiens
aggaattgaagatgtaaggaat

SEQ ID NO: 2026989 - DNA, 14 bp, Homo sapiens
aggacaaccattcc

SEQ ID NO: 2026990 - DNA, 18 bp, Homo sapiens
aggacaacctgcccctcc

SEQ ID NO: 2026991 - DNA, 21 bp, Homo sapiens
aggacaacctgcccctcccca

SEQ ID NO: 2026992 - DNA, 13 bp, Homo sapiens
aggacaagcatgg

SEQ ID NO: 2026993 - DNA, 13 bp, Homo sapiens
aggacacactaat

SEQ ID NO: 2026994 - DNA, 13 bp, Homo sapiens
aggacacatcccg

SEQ ID NO: 2026995 - DNA, 18 bp, Homo sapiens
aggacacatcccggcctc

SEQ ID NO: 2026996 - DNA, 13 bp, Homo sapiens
aggacacctgccc

SEQ ID NO: 2026997 - DNA, 18 bp, Homo sapiens
aggacacctgccccagcg

SEQ ID NO: 2026998 - DNA, 20 bp, Homo sapiens
aggacacctgccccagcgcg

SEQ ID NO: 2026999 - DNA, 15 bp, Homo sapiens
aggacacgtggcctg

SEQ ID NO: 2027000 - DNA, 13 bp, Homo sapiens
aggacagctggct

SEQ ID NO: 2027001 - DNA, 23 bp, Homo sapiens
aggacagctggctgctgacagga

SEQ ID NO: 2027002 - DNA, 22 bp, Homo sapiens
aggacagggaggtgaccccagg

SEQ ID NO: 2027003 - DNA, 18 bp, Homo sapiens
aggacagtgcttcagcct

SEQ ID NO: 2027004 - DNA, 20 bp, Homo sapiens
aggacagtgcttcagcctga

SEQ ID NO: 2027005 - DNA, 18 bp, Homo sapiens
aggacagttgggctatgt

SEQ ID NO: 2027006 - DNA, 16 bp, Homo sapiens
aggacatggagagaga

SEQ ID NO: 2027007 - DNA, 14 bp, Homo sapiens
aggacatggggcat

SEQ ID NO: 2027008 - DNA, 23 bp, Homo sapiens
aggacatggggcatagaaactga

SEQ ID NO: 2027009 - DNA, 23 bp, Homo sapiens
aggacatgtttttgttttctttg

SEQ ID NO: 2027010 - DNA, 15 bp, Homo sapiens
attttctttgaaatt

SEQ ID NO: 2027011 - DNA, 17 bp, Homo sapiens
attttcttttgtaaatg

SEQ ID NO: 2027012 - DNA, 19 bp, Homo sapiens
attttcttttgtaaatgtt

SEQ ID NO: 2027013 - DNA, 21 bp, Homo sapiens
attttgcaatcccttaatatc

SEQ ID NO: 2027014 - DNA, 11 bp, Homo sapiens
attttgcacaa

SEQ ID NO: 2027015 - DNA, 12 bp, Homo sapiens
attttgcagcag

SEQ ID NO: 2027016 - DNA, 18 bp, Homo sapiens
attttgcagcagaagcca

SEQ ID NO: 2027017 - DNA, 14 bp, Homo sapiens
attttgcatttagt

SEQ ID NO: 2027018 - DNA, 14 bp, Homo sapiens
attttgcttaaaat

SEQ ID NO: 2027019 - DNA, 14 bp, Homo sapiens
attttggagaaatt

SEQ ID NO: 2027020 - DNA, 21 bp, Homo sapiens
attttggagaaattatttaat

SEQ ID NO: 2027021 - DNA, 18 bp, Homo sapiens
attttggtccaagttgtg

SEQ ID NO: 2027022 - DNA, 13 bp, Homo sapiens
attttgtaaaaca

SEQ ID NO: 2027023 - DNA, 10 bp, Homo sapiens
attttgtaat

SEQ ID NO: 2027024 - DNA, 13 bp, Homo sapiens
attttgtaataaa

SEQ ID NO: 2027025 - DNA, 15 bp, Homo sapiens
attttgtaataaact

SEQ ID NO: 2027026 - DNA, 16 bp, Homo sapiens
attttgtacagaattt

SEQ ID NO: 2027027 - DNA, 16 bp, Homo sapiens
attttgtattttcaac

SEQ ID NO: 2027028 - DNA, 22 bp, Homo sapiens
attttgtattttcaactttata

SEQ ID NO: 2027029 - DNA, 20 bp, Homo sapiens
attttgtatttttgaataaa

SEQ ID NO: 2027030 - DNA, 15 bp, Homo sapiens
attttgtcactgtct

SEQ ID NO: 2027031 - DNA, 19 bp, Homo sapiens
attttgtccattttaaaaa

SEQ ID NO: 2027032 - DNA, 21 bp, Homo sapiens
attttgtctcctacctgctgc

SEQ ID NO: 2027033 - DNA, 19 bp, Homo sapiens
attttgtgaaagaaggagc

SEQ ID NO: 2027034 - DNA, 22 bp, Homo sapiens
attttgtgcagttaatacttaa

SEQ ID NO: 2027035 - DNA, 22 bp, Homo sapiens
attttgttgtgattttgtacag

SEQ ID NO: 2027036 - DNA, 20 bp, Homo sapiens
attttgtttcagaattttgt

SEQ ID NO: 2027037 - DNA, 22 bp, Homo sapiens
attttgtttcagaattttgtat

SEQ ID NO: 2027038 - DNA, 16 bp, Homo sapiens
attttgtttgtaatcc

SEQ ID NO: 2027039 - DNA, 13 bp, Homo sapiens
atttttaaacaag

SEQ ID NO: 2027040 - DNA, 14 bp, Homo sapiens
atttttaaattata

SEQ ID NO: 2027041 - DNA, 19 bp, Homo sapiens
atttttacaataaataatc

SEQ ID NO: 2027042 - DNA, 15 bp, Homo sapiens
atttttactaaagca

SEQ ID NO: 2027043 - DNA, 18 bp, Homo sapiens
atttttactaaagcagtg

SEQ ID NO: 2027044 - DNA, 19 bp, Homo sapiens
atttttactaaagcagtgt

SEQ ID NO: 2027045 - DNA, 16 bp, Homo sapiens
atttttagagattaat

SEQ ID NO: 2027046 - DNA, 16 bp, Homo sapiens
atttttagtaaagaca

SEQ ID NO: 2027047 - DNA, 15 bp, Homo sapiens
atttttatacatatc

SEQ ID NO: 2027048 - DNA, 20 bp, Homo sapiens
atttttatatcagcctgagt

SEQ ID NO: 2027049 - DNA, 16 bp, Homo sapiens
atttttcaaccagcat

SEQ ID NO: 2027050 - DNA, 23 bp, Homo sapiens
atttttcaaccagcattttacta

SEQ ID NO: 2027051 - DNA, 18 bp, Homo sapiens
atttttcagctctctgta

SEQ ID NO: 2027052 - DNA, 18 bp, Homo sapiens
atttttcttaatcaagaa

SEQ ID NO: 2027053 - DNA, 17 bp, Homo sapiens
atttttgcaattattct

SEQ ID NO: 2027054 - DNA, 16 bp, Homo sapiens
atttttggtgtatttg

SEQ ID NO: 2027055 - DNA, 23 bp, Homo sapiens
atttttgtaataaaaggtatgaa

SEQ ID NO: 2027056 - DNA, 20 bp, Homo sapiens
atttttgtacccttcctaca

SEQ ID NO: 2027057 - DNA, 17 bp, Homo sapiens
atttttgtccctgctcc

SEQ ID NO: 2027058 - DNA, 15 bp, Homo sapiens
atttttgtgtttcta

SEQ ID NO: 2027059 - DNA, 14 bp, Homo sapiens
attttttaaaaaag

SEQ ID NO: 2027060 - DNA, 17 bp, Homo sapiens
attttttaaaaaagctt

SEQ ID NO: 2027061 - DNA, 18 bp, Homo sapiens
attttttaaaaaagctta

SEQ ID NO: 2027062 - DNA, 14 bp, Homo sapiens
attttttaaaagaa

SEQ ID NO: 2027063 - DNA, 17 bp, Homo sapiens
attttttaaaataattt

SEQ ID NO: 2027064 - DNA, 22 bp, Homo sapiens
attttttaagtatttatatatt

SEQ ID NO: 2027065 - DNA, 15 bp, Homo sapiens
attttttaatcattt

SEQ ID NO: 2027066 - DNA, 15 bp, Homo sapiens
attttttaattatta

SEQ ID NO: 2027067 - DNA, 20 bp, Homo sapiens
attttttaattattatttat

SEQ ID NO: 2027068 - DNA, 12 bp, Homo sapiens
attttttattgt

SEQ ID NO: 2027069 - DNA, 16 bp, Homo sapiens
attttttatttccaca

SEQ ID NO: 2027070 - DNA, 19 bp, Homo sapiens
attttttcctgtaagacaa

SEQ ID NO: 2027071 - DNA, 14 bp, Homo sapiens
attttttctacaca

SEQ ID NO: 2027072 - DNA, 18 bp, Homo sapiens
attttttgagtaattcta

SEQ ID NO: 2027073 - DNA, 18 bp, Homo sapiens
attttttgcatcagtatt

SEQ ID NO: 2027074 - DNA, 18 bp, Homo sapiens
atttttttaagctgtaaa

SEQ ID NO: 2027075 - DNA, 19 bp, Homo sapiens
atttttttaccttaaatct

SEQ ID NO: 2027076 - DNA, 18 bp, Homo sapiens
attttttttaagtattta

SEQ ID NO: 2027077 - DNA, 15 bp, Homo sapiens
attttttttaatgta

SEQ ID NO: 2027078 - DNA, 23 bp, Homo sapiens
attttttttactgtgcatacatg

SEQ ID NO: 2027079 - DNA, 17 bp, Homo sapiens
atttttttttcctagcc

SEQ ID NO: 2027080 - DNA, 23 bp, Homo sapiens
atttttttttttgtttctgagaa

SEQ ID NO: 2027081 - DNA, 18 bp, Homo sapiens
caaaaaaaaaccatgcat

SEQ ID NO: 2027082 - DNA, 13 bp, Homo sapiens
caaaaaaacacta

SEQ ID NO: 2027083 - DNA, 19 bp, Homo sapiens
caaaaaaagggcaataaat

SEQ ID NO: 2027084 - DNA, 19 bp, Homo sapiens
caaaaaagtatttttttaa

SEQ ID NO: 2027085 - DNA, 12 bp, Homo sapiens
caaaaacaaaac

SEQ ID NO: 2027086 - DNA, 13 bp, Homo sapiens
caaaaacacagca

SEQ ID NO: 2027087 - DNA, 17 bp, Homo sapiens
caaaaacctcacccgag

SEQ ID NO: 2027088 - DNA, 19 bp, Homo sapiens
caaaaataaactagtttcc

SEQ ID NO: 2027089 - DNA, 22 bp, Homo sapiens
caaaaataaactagtttccagt

SEQ ID NO: 2027090 - DNA, 22 bp, Homo sapiens
caaaaatgttcccttgaccatt

SEQ ID NO: 2027091 - DNA, 20 bp, Homo sapiens
caaaaattacactacaagtt

SEQ ID NO: 2027092 - DNA, 14 bp, Homo sapiens
caaaaattagccgg

SEQ ID NO: 2027093 - DNA, 20 bp, Homo sapiens
caaaaattagccggacgtgg

SEQ ID NO: 2027094 - DNA, 17 bp, Homo sapiens
caaaaattagccgggca

SEQ ID NO: 2027095 - DNA, 15 bp, Homo sapiens
caaaacaaaacaaca

SEQ ID NO: 2027096 - DNA, 17 bp, Homo sapiens
caaaacaacaacaatac

SEQ ID NO: 2027097 - DNA, 16 bp, Homo sapiens
caaaacaagaaagaaa

SEQ ID NO: 2027098 - DNA, 14 bp, Homo sapiens
caaaacaatgttta

SEQ ID NO: 2027099 - DNA, 14 bp, Homo sapiens
caaaacatatcaat

SEQ ID NO: 2027100 - DNA, 20 bp, Homo sapiens
caaaacctcatgacagccag

SEQ ID NO: 2027101 - DNA, 22 bp, Homo sapiens
caaaacctcatgacagccagag

SEQ ID NO: 2027102 - DNA, 22 bp, Homo sapiens
caaaacctttccccagacacat

SEQ ID NO: 2027103 - DNA, 17 bp, Homo sapiens
caaaactgcactgtcaa

SEQ ID NO: 2027104 - DNA, 14 bp, Homo sapiens
caaaagaagaagtt

SEQ ID NO: 2027105 - DNA, 18 bp, Homo sapiens
caaaagaagtaaaagcaa

SEQ ID NO: 2027106 - DNA, 19 bp, Homo sapiens
caaaagaagtaaaagcaaa

SEQ ID NO: 2027107 - DNA, 21 bp, Homo sapiens
caaaagaagtaaaagctaatt

SEQ ID NO: 2027108 - DNA, 15 bp, Homo sapiens
caaaagaatcagaaa

SEQ ID NO: 2027109 - DNA, 20 bp, Homo sapiens
caaaagacagcactacagat

SEQ ID NO: 2027110 - DNA, 16 bp, Homo sapiens
caaaagacatgttgta

SEQ ID NO: 2027111 - DNA, 12 bp, Homo sapiens
caaaagagaaaa

SEQ ID NO: 2027112 - DNA, 12 bp, Homo sapiens
caaaagagagaa

SEQ ID NO: 2027113 - DNA, 16 bp, Homo sapiens
caaaagagagaatgag

SEQ ID NO: 2027114 - DNA, 15 bp, Homo sapiens
caaaagattgtttta

SEQ ID NO: 2027115 - DNA, 14 bp, Homo sapiens
caaaagcctgggtg

SEQ ID NO: 2027116 - DNA, 11 bp, Homo sapiens
caaaagctgct

SEQ ID NO: 2027117 - DNA, 16 bp, Homo sapiens
caaaaggcagcccttt

SEQ ID NO: 2027118 - DNA, 15 bp, Homo sapiens
caaaagggcagccag

SEQ ID NO: 2027119 - DNA, 13 bp, Homo sapiens
caaaaggtgcctg

SEQ ID NO: 2027120 - DNA, 18 bp, Homo sapiens
caaaaggtgcctgtgagg

SEQ ID NO: 2027121 - DNA, 23 bp, Homo sapiens
caaaaggtgcctgtgaggcaggg

SEQ ID NO: 2027122 - DNA, 15 bp, Homo sapiens
caaaagtaccataga

SEQ ID NO: 2027123 - DNA, 19 bp, Homo sapiens
caaaagtcaaaaggtgcct

SEQ ID NO: 2027124 - DNA, 20 bp, Homo sapiens
caaaagtggattttcctgaa

SEQ ID NO: 2027125 - DNA, 20 bp, Homo sapiens
caaaagtggggctaaatgaa

SEQ ID NO: 2027126 - DNA, 21 bp, Homo sapiens
caaaagtggggctaaatgaag

SEQ ID NO: 2027127 - DNA, 18 bp, Homo sapiens
caaaagttacatgtttgc

SEQ ID NO: 2027128 - DNA, 17 bp, Homo sapiens
caaaagttcgaaagaaa

SEQ ID NO: 2027129 - DNA, 16 bp, Homo sapiens
caaaataaaatgaaaa

SEQ ID NO: 2027130 - DNA, 21 bp, Homo sapiens
caaaataaaattatggtgaaa

SEQ ID NO: 2027131 - DNA, 15 bp, Homo sapiens
caaaataatttaact

SEQ ID NO: 2027132 - DNA, 18 bp, Homo sapiens
caaaataatttaactaat

SEQ ID NO: 2027133 - DNA, 21 bp, Homo sapiens
caaaataatttaactaattta

SEQ ID NO: 2027134 - DNA, 17 bp, Homo sapiens
caaaatactacacatcc

SEQ ID NO: 2027135 - DNA, 23 bp, Homo sapiens
caaaatattatgcaaactactgt

SEQ ID NO: 2027136 - DNA, 17 bp, Homo sapiens
caaaatatttgtacata

SEQ ID NO: 2027137 - DNA, 17 bp, Homo sapiens
caaaatcacaagcaata

SEQ ID NO: 2027138 - DNA, 22 bp, Homo sapiens
caaaatcatgaatatttcaaaa

SEQ ID NO: 2027139 - DNA, 16 bp, Homo sapiens
caaaatccttgcttat

SEQ ID NO: 2027140 - DNA, 12 bp, Homo sapiens
caaaatggaagg

SEQ ID NO: 2027141 - DNA, 15 bp, Homo sapiens
caaaatgtcacactt

SEQ ID NO: 2027142 - DNA, 20 bp, Homo sapiens
caaaatgtcacacttgtttc

SEQ ID NO: 2027143 - DNA, 22 bp, Homo sapiens
caaaatgtcacacttgtttctt

SEQ ID NO: 2027144 - DNA, 23 bp, Homo sapiens
caaaatgtcacacttgtttcttg

SEQ ID NO: 2027145 - DNA, 17 bp, Homo sapiens
caaaatgttcgtattct

SEQ ID NO: 2027146 - DNA, 15 bp, Homo sapiens
caaaatttccagtac

SEQ ID NO: 2027147 - DNA, 17 bp, Homo sapiens
caaaatttccagtacct

SEQ ID NO: 2027148 - DNA, 18 bp, Homo sapiens
caaaatttctttttttaa

SEQ ID NO: 2027149 - DNA, 12 bp, Homo sapiens
caaaatttgaaa

SEQ ID NO: 2027150 - DNA, 14 bp, Homo sapiens
caaaatttgaaatt

SEQ ID NO: 2027151 - DNA, 14 bp, Homo sapiens
caaaattttattcc

SEQ ID NO: 2027152 - DNA, 21 bp, Homo sapiens
caaacaaggggctgttacata

SEQ ID NO: 2027153 - DNA, 20 bp, Homo sapiens
caaacaataataaagagaga

SEQ ID NO: 2027154 - DNA, 17 bp, Homo sapiens
caaacacaccgatgcac

SEQ ID NO: 2027155 - DNA, 13 bp, Homo sapiens
caaacacactgta

SEQ ID NO: 2027156 - DNA, 15 bp, Homo sapiens
caaacacctcccagg

SEQ ID NO: 2027157 - DNA, 12 bp, Homo sapiens
caaacactccac

SEQ ID NO: 2027158 - DNA, 16 bp, Homo sapiens
caaacagtctcaggaa

SEQ ID NO: 2027159 - DNA, 17 bp, Homo sapiens
caaacagtctcaggaaa

SEQ ID NO: 2027160 - DNA, 21 bp, Homo sapiens
caaacatgaagtgtgtttcct

SEQ ID NO: 2027161 - DNA, 20 bp, Homo sapiens
caaaccaccctaaaatgaca

SEQ ID NO: 2027162 - DNA, 15 bp, Homo sapiens
caaaccactgtacat

SEQ ID NO: 2027163 - DNA, 13 bp, Homo sapiens
caaaccaggactc

SEQ ID NO: 2027164 - DNA, 12 bp, Homo sapiens
caaaccaggatt

SEQ ID NO: 2027165 - DNA, 15 bp, Homo sapiens
caaaccagggtgcat

SEQ ID NO: 2027166 - DNA, 18 bp, Homo sapiens
caaaccatttaattcata

SEQ ID NO: 2027167 - DNA, 19 bp, Homo sapiens
caaaccatttaattcataa

SEQ ID NO: 2027168 - DNA, 23 bp, Homo sapiens
caaaccatttaattcataattag

SEQ ID NO: 2027169 - DNA, 14 bp, Homo sapiens
caaacccatcagac

SEQ ID NO: 2027170 - DNA, 18 bp, Homo sapiens
caaaccccgaccacctgc

SEQ ID NO: 2027171 - DNA, 22 bp, Homo sapiens
caaactacaaagctgaagaaaa

SEQ ID NO: 2027172 - DNA, 12 bp, Homo sapiens
caaactcctgcc

SEQ ID NO: 2027173 - DNA, 13 bp, Homo sapiens
caaactcctgcct

SEQ ID NO: 2027174 - DNA, 14 bp, Homo sapiens
caaactcctgcctg

SEQ ID NO: 2027175 - DNA, 18 bp, Homo sapiens
caaactcctgcctgtgtt

SEQ ID NO: 2027176 - DNA, 19 bp, Homo sapiens
caaactgagtaaattggaa

SEQ ID NO: 2027177 - DNA, 21 bp, Homo sapiens
caaactgagtaaattggaaac

SEQ ID NO: 2027178 - DNA, 20 bp, Homo sapiens
caaactgatgcgaaaacttg

SEQ ID NO: 2027179 - DNA, 21 bp, Homo sapiens
caaactgatgcgaaaacttga

SEQ ID NO: 2027180 - DNA, 23 bp, Homo sapiens
caaactgatggaccgggtgggcc

SEQ ID NO: 2027181 - DNA, 16 bp, Homo sapiens
caaactgatttctcac

SEQ ID NO: 2027182 - DNA, 15 bp, Homo sapiens
caaactgtgccctgc

SEQ ID NO: 2027183 - DNA, 22 bp, Homo sapiens
caaagaaaaaaatatattttat

SEQ ID NO: 2027184 - DNA, 11 bp, Homo sapiens
caaagaacagt

SEQ ID NO: 2027185 - DNA, 22 bp, Homo sapiens
caaagaactgccccatctcctc

SEQ ID NO: 2027186 - DNA, 22 bp, Homo sapiens
caaagaaggcacaggtgtaaat

SEQ ID NO: 2027187 - DNA, 13 bp, Homo sapiens
caaagacaagaaa

SEQ ID NO: 2027188 - DNA, 16 bp, Homo sapiens
caaagacttagtatat

SEQ ID NO: 2027189 - DNA, 14 bp, Homo sapiens
caaagagactggag

SEQ ID NO: 2027190 - DNA, 18 bp, Homo sapiens
caaagagactggagcatc

SEQ ID NO: 2027191 - DNA, 18 bp, Homo sapiens
caaagagcctggagaagc

SEQ ID NO: 2027192 - DNA, 20 bp, Homo sapiens
caaagagtgggctgcatctg

SEQ ID NO: 2027193 - DNA, 16 bp, Homo sapiens
caaagagttaatatat

SEQ ID NO: 2027194 - DNA, 21 bp, Homo sapiens
caaagagttcaagaaataagt

SEQ ID NO: 2027195 - DNA, 16 bp, Homo sapiens
caaagatgtttgtcag

SEQ ID NO: 2027196 - DNA, 18 bp, Homo sapiens
caaagatgtttgtcagat

SEQ ID NO: 2027197 - DNA, 22 bp, Homo sapiens
caaagatgtttgtcagatatga

SEQ ID NO: 2027198 - DNA, 22 bp, Homo sapiens
caaagattttacctgggatatg

SEQ ID NO: 2027199 - DNA, 14 bp, Homo sapiens
caaagcacagtgtt

SEQ ID NO: 2027200 - DNA, 21 bp, Homo sapiens
caaagcaccagcttctccagg

SEQ ID NO: 2027201 - DNA, 15 bp, Homo sapiens
caaagcccttttata

SEQ ID NO: 2027202 - DNA, 23 bp, Homo sapiens
caaagccgtgcctttctctggct

SEQ ID NO: 2027203 - DNA, 19 bp, Homo sapiens
caaagcctgttcatggcag

SEQ ID NO: 2027204 - DNA, 20 bp, Homo sapiens
caaagcctgttcatggcaga

SEQ ID NO: 2027205 - DNA, 14 bp, Homo sapiens
caaagctaggcctg

SEQ ID NO: 2027206 - DNA, 22 bp, Homo sapiens
caaagctcaagatgacagctct

SEQ ID NO: 2027207 - DNA, 21 bp, Homo sapiens
caaagcttctatcccaggagg

SEQ ID NO: 2027208 - DNA, 13 bp, Homo sapiens
caaaggaaaccaa

SEQ ID NO: 2027209 - DNA, 14 bp, Homo sapiens
caaaggaaaccaaa

SEQ ID NO: 2027210 - DNA, 20 bp, Homo sapiens
caaaggaaaccaaaggaatc

SEQ ID NO: 2027211 - DNA, 22 bp, Homo sapiens
caaaggaatcgtttcaaatgga

SEQ ID NO: 2027212 - DNA, 19 bp, Homo sapiens
caaaggaatctccagtttt

SEQ ID NO: 2027213 - DNA, 18 bp, Homo sapiens
caaaggacattatgtgtg

SEQ ID NO: 2027214 - DNA, 20 bp, Homo sapiens
caaaggagacgggggagcag

SEQ ID NO: 2027215 - DNA, 13 bp, Homo sapiens
caaaggagcctgt

SEQ ID NO: 2027216 - DNA, 14 bp, Homo sapiens
caaaggagcctgtg

SEQ ID NO: 2027217 - DNA, 23 bp, Homo sapiens
caaaggagcctgtgaacccagga

SEQ ID NO: 2027218 - DNA, 23 bp, Homo sapiens
caaaggcgcagtgcttctctaca

SEQ ID NO: 2027219 - DNA, 22 bp, Homo sapiens
caaagggagcactgggttgact

SEQ ID NO: 2027220 - DNA, 20 bp, Homo sapiens
caaagggcagtaaagttttc

SEQ ID NO: 2027221 - DNA, 16 bp, Homo sapiens
caaaggggagaagggc

SEQ ID NO: 2027222 - DNA, 23 bp, Homo sapiens
caaaggggagaagggccagccct

SEQ ID NO: 2027223 - DNA, 15 bp, Homo sapiens
caaaggggctgctgg

SEQ ID NO: 2027224 - DNA, 16 bp, Homo sapiens
caaaggggctgctggg

SEQ ID NO: 2027225 - DNA, 14 bp, Homo sapiens
caaaggtataattt

SEQ ID NO: 2027226 - DNA, 18 bp, Homo sapiens
caaaggtctttttaaacc

SEQ ID NO: 2027227 - DNA, 20 bp, Homo sapiens
caaaggtctttttaaaccag

SEQ ID NO: 2027228 - DNA, 14 bp, Homo sapiens
caaaggtggctctc

SEQ ID NO: 2027229 - DNA, 16 bp, Homo sapiens
caaaggtgtgcaaact

SEQ ID NO: 2027230 - DNA, 11 bp, Homo sapiens
caaaggttttc

SEQ ID NO: 2027231 - DNA, 16 bp, Homo sapiens
caaagtaaaacttgct

SEQ ID NO: 2027232 - DNA, 22 bp, Homo sapiens
caaagtagagaagtatccaatt

SEQ ID NO: 2027233 - DNA, 15 bp, Homo sapiens
caaagtctaaagttt

SEQ ID NO: 2027234 - DNA, 16 bp, Homo sapiens
caaagtctaaagttta

SEQ ID NO: 2027235 - DNA, 20 bp, Homo sapiens
caaagtctaaagtttacagt

SEQ ID NO: 2027236 - DNA, 14 bp, Homo sapiens
caaagtctgtgtga

SEQ ID NO: 2027237 - DNA, 22 bp, Homo sapiens
caaagtcttaaaataacttata

SEQ ID NO: 2027238 - DNA, 15 bp, Homo sapiens
caaagtgcagccctt

SEQ ID NO: 2027239 - DNA, 17 bp, Homo sapiens
caaagtgcagcccttcc

SEQ ID NO: 2027240 - DNA, 13 bp, Homo sapiens
caaagtgccctca

SEQ ID NO: 2027241 - DNA, 14 bp, Homo sapiens
caaagtgccctcat

SEQ ID NO: 2027242 - DNA, 19 bp, Homo sapiens
caaagtgtaagcacttctg

SEQ ID NO: 2027243 - DNA, 21 bp, Homo sapiens
atttaaaatagcaaaagaaga

SEQ ID NO: 2027244 - DNA, 21 bp, Homo sapiens
atttaaaatcattcaatatct

SEQ ID NO: 2027245 - DNA, 14 bp, Homo sapiens
atttaaaatgatta

SEQ ID NO: 2027246 - DNA, 21 bp, Homo sapiens
atttaaaatgtgtttcttaca

SEQ ID NO: 2027247 - DNA, 16 bp, Homo sapiens
atttaaacagcagtgt

SEQ ID NO: 2027248 - DNA, 18 bp, Homo sapiens
atttaaaccagcagaaaa

SEQ ID NO: 2027249 - DNA, 19 bp, Homo sapiens
atttaaaccgctaaaagaa

SEQ ID NO: 2027250 - DNA, 22 bp, Homo sapiens
atttaaaccgctaaaagaaact

SEQ ID NO: 2027251 - DNA, 24 bp, Homo sapiens
atttaaaccgctaaaagaaacttt

SEQ ID NO: 2027252 - DNA, 20 bp, Homo sapiens
atttaaactataagcaagaa

SEQ ID NO: 2027253 - DNA, 20 bp, Homo sapiens
atttaaactgttctgtgtgg

SEQ ID NO: 2027254 - DNA, 19 bp, Homo sapiens
atttaaagaacaccctata

SEQ ID NO: 2027255 - DNA, 20 bp, Homo sapiens
atttaaaggggagatactct

SEQ ID NO: 2027256 - DNA, 22 bp, Homo sapiens
atttaaagttgtttgtgccttt

SEQ ID NO: 2027257 - DNA, 18 bp, Homo sapiens
atttaaatgttgaaatct

SEQ ID NO: 2027258 - DNA, 18 bp, Homo sapiens
atttaaattctttttcaa

SEQ ID NO: 2027259 - DNA, 20 bp, Homo sapiens
atttaaattctttttcaaaa

SEQ ID NO: 2027260 - DNA, 13 bp, Homo sapiens
atttaacatgcaa

SEQ ID NO: 2027261 - DNA, 12 bp, Homo sapiens
atttaactaatt

SEQ ID NO: 2027262 - DNA, 13 bp, Homo sapiens
atttaactaattt

SEQ ID NO: 2027263 - DNA, 14 bp, Homo sapiens
atttaactaattta

SEQ ID NO: 2027264 - DNA, 16 bp, Homo sapiens
atttaactaatttaaa

SEQ ID NO: 2027265 - DNA, 19 bp, Homo sapiens
atttaactaatttaaacca

SEQ ID NO: 2027266 - DNA, 21 bp, Homo sapiens
atttaacttaacattctgtaa

SEQ ID NO: 2027267 - DNA, 22 bp, Homo sapiens
atttaacttgagggtaataaac

SEQ ID NO: 2027268 - DNA, 15 bp, Homo sapiens
atttaagataattat

SEQ ID NO: 2027269 - DNA, 15 bp, Homo sapiens
atttaagcattttac

SEQ ID NO: 2027270 - DNA, 21 bp, Homo sapiens
atttaagcctcatatttaaag

SEQ ID NO: 2027271 - DNA, 18 bp, Homo sapiens
atttaagcttatgtcaga

SEQ ID NO: 2027272 - DNA, 23 bp, Homo sapiens
atttaaggatgactttttttctg

SEQ ID NO: 2027273 - DNA, 13 bp, Homo sapiens
atttaagggaaaa

SEQ ID NO: 2027274 - DNA, 13 bp, Homo sapiens
atttaagtatata

SEQ ID NO: 2027275 - DNA, 22 bp, Homo sapiens
atttaagtttgttgctgtcaag

SEQ ID NO: 2027276 - DNA, 16 bp, Homo sapiens
atttaataaaaaaaca

SEQ ID NO: 2027277 - DNA, 16 bp, Homo sapiens
atttaataacaattgt

SEQ ID NO: 2027278 - DNA, 16 bp, Homo sapiens
atttaatatagctatt

SEQ ID NO: 2027279 - DNA, 16 bp, Homo sapiens
atttaatatctgagaa

SEQ ID NO: 2027280 - DNA, 22 bp, Homo sapiens
atttaatatctgagaagtgtat

SEQ ID NO: 2027281 - DNA, 15 bp, Homo sapiens
atttaatgttttctg

SEQ ID NO: 2027282 - DNA, 21 bp, Homo sapiens
atttaatgttttctgctgttt

SEQ ID NO: 2027283 - DNA, 13 bp, Homo sapiens
atttaattcataa

SEQ ID NO: 2027284 - DNA, 17 bp, Homo sapiens
atttaatttttacatga

SEQ ID NO: 2027285 - DNA, 19 bp, Homo sapiens
atttaatttttacatgacc

SEQ ID NO: 2027286 - DNA, 15 bp, Homo sapiens
atttaatttttgcaa

SEQ ID NO: 2027287 - DNA, 16 bp, Homo sapiens
atttaatttttgcaat

SEQ ID NO: 2027288 - DNA, 14 bp, Homo sapiens
atttacaataaata

SEQ ID NO: 2027289 - DNA, 21 bp, Homo sapiens
atttacaataaatattctgca

SEQ ID NO: 2027290 - DNA, 13 bp, Homo sapiens
atttacacattct

SEQ ID NO: 2027291 - DNA, 21 bp, Homo sapiens
atttacagcctcacttgaatg

SEQ ID NO: 2027292 - DNA, 15 bp, Homo sapiens
atttacatatgaaat

SEQ ID NO: 2027293 - DNA, 21 bp, Homo sapiens
atttacatatgaaatttaata

SEQ ID NO: 2027294 - DNA, 20 bp, Homo sapiens
atttacatgaattgcatttt

SEQ ID NO: 2027295 - DNA, 21 bp, Homo sapiens
atttacatgaattgcatttta

SEQ ID NO: 2027296 - DNA, 18 bp, Homo sapiens
atttaccacagcagctga

SEQ ID NO: 2027297 - DNA, 19 bp, Homo sapiens
atttaccagggatgtagat

SEQ ID NO: 2027298 - DNA, 20 bp, Homo sapiens
atttaccttttctgttgtac

SEQ ID NO: 2027299 - DNA, 15 bp, Homo sapiens
atttactaaaagaat

SEQ ID NO: 2027300 - DNA, 15 bp, Homo sapiens
atttactaagccaca

SEQ ID NO: 2027301 - DNA, 15 bp, Homo sapiens
atttactacttttgc

SEQ ID NO: 2027302 - DNA, 21 bp, Homo sapiens
atttactgagcttctctgtga

SEQ ID NO: 2027303 - DNA, 13 bp, Homo sapiens
atttacttgaaag

SEQ ID NO: 2027304 - DNA, 18 bp, Homo sapiens
atttacttgtagaaatct

SEQ ID NO: 2027305 - DNA, 15 bp, Homo sapiens
atttactttgaattt

SEQ ID NO: 2027306 - DNA, 12 bp, Homo sapiens
atttagaaaaca

SEQ ID NO: 2027307 - DNA, 13 bp, Homo sapiens
atttagaaaacat

SEQ ID NO: 2027308 - DNA, 23 bp, Homo sapiens
atttagaaaacattcatccagtt

SEQ ID NO: 2027309 - DNA, 18 bp, Homo sapiens
atttagaaaactttaaag

SEQ ID NO: 2027310 - DNA, 22 bp, Homo sapiens
atttagaaagaagcccaatatt

SEQ ID NO: 2027311 - DNA, 13 bp, Homo sapiens
atttagaatatat

SEQ ID NO: 2027312 - DNA, 18 bp, Homo sapiens
atttagaccctgtttcct

SEQ ID NO: 2027313 - DNA, 13 bp, Homo sapiens
atttagatatgca

SEQ ID NO: 2027314 - DNA, 18 bp, Homo sapiens
atttagattgttaaaata

SEQ ID NO: 2027315 - DNA, 20 bp, Homo sapiens
atttagcacccttctgctgt

SEQ ID NO: 2027316 - DNA, 13 bp, Homo sapiens
atttaggcaagag

SEQ ID NO: 2027317 - DNA, 17 bp, Homo sapiens
atttaggcaagagaaaa

SEQ ID NO: 2027318 - DNA, 17 bp, Homo sapiens
atttaggtttctgagtt

SEQ ID NO: 2027319 - DNA, 21 bp, Homo sapiens
atttagtcacaccatcttaaa

SEQ ID NO: 2027320 - DNA, 14 bp, Homo sapiens
atttagttatagtt

SEQ ID NO: 2027321 - DNA, 14 bp, Homo sapiens
atttataaatgtgt

SEQ ID NO: 2027322 - DNA, 20 bp, Homo sapiens
atttataactcatcataaaa

SEQ ID NO: 2027323 - DNA, 22 bp, Homo sapiens
atttataactcatcataaaata

SEQ ID NO: 2027324 - DNA, 17 bp, Homo sapiens
atttataagcagattta

SEQ ID NO: 2027325 - DNA, 22 bp, Homo sapiens
atttataagcagatttaacaat

SEQ ID NO: 2027326 - DNA, 14 bp, Homo sapiens
atttataatgtttg

SEQ ID NO: 2027327 - DNA, 16 bp, Homo sapiens
atttatacaaaataat

SEQ ID NO: 2027328 - DNA, 22 bp, Homo sapiens
atttatacaaaataatttaact

SEQ ID NO: 2027329 - DNA, 10 bp, Homo sapiens
atttatactc

SEQ ID NO: 2027330 - DNA, 11 bp, Homo sapiens
atttatactct

SEQ ID NO: 2027331 - DNA, 23 bp, Homo sapiens
atttatactctagaacatgcaca

SEQ ID NO: 2027332 - DNA, 22 bp, Homo sapiens
atttatagtttgtacatgcatt

SEQ ID NO: 2027333 - DNA, 17 bp, Homo sapiens
atttatatatttataac

SEQ ID NO: 2027334 - DNA, 19 bp, Homo sapiens
atttatatatttataactc

SEQ ID NO: 2027335 - DNA, 18 bp, Homo sapiens
atttatatctatagtagt

SEQ ID NO: 2027336 - DNA, 17 bp, Homo sapiens
atttatatgtgtaattt

SEQ ID NO: 2027337 - DNA, 12 bp, Homo sapiens
atttatatgtta

SEQ ID NO: 2027338 - DNA, 14 bp, Homo sapiens
atttatatgttaat

SEQ ID NO: 2027339 - DNA, 21 bp, Homo sapiens
atttatattgtaaatattgtg

SEQ ID NO: 2027340 - DNA, 20 bp, Homo sapiens
atttatattgtatattctgg

SEQ ID NO: 2027341 - DNA, 17 bp, Homo sapiens
atttatatttggaaaga

SEQ ID NO: 2027342 - DNA, 14 bp, Homo sapiens
atttatattttccc

SEQ ID NO: 2027343 - DNA, 14 bp, Homo sapiens
atttatcagtgaca

SEQ ID NO: 2027344 - DNA, 23 bp, Homo sapiens
atttatcagtgacagagttcact

SEQ ID NO: 2027345 - DNA, 18 bp, Homo sapiens
atttatcctgaaatttca

SEQ ID NO: 2027346 - DNA, 19 bp, Homo sapiens
atttatcttgtctctgggc

SEQ ID NO: 2027347 - DNA, 22 bp, Homo sapiens
atttatctttacttttaaacag

SEQ ID NO: 2027348 - DNA, 18 bp, Homo sapiens
atttatgatcacttggaa

SEQ ID NO: 2027349 - DNA, 19 bp, Homo sapiens
atttatgcatggaaacctg

SEQ ID NO: 2027350 - DNA, 19 bp, Homo sapiens
atttatgcttaaaatatgt

SEQ ID NO: 2027351 - DNA, 12 bp, Homo sapiens
atttatggagga

SEQ ID NO: 2027352 - DNA, 13 bp, Homo sapiens
atttatggcttat

SEQ ID NO: 2027353 - DNA, 18 bp, Homo sapiens
atttatggtcaacactta

SEQ ID NO: 2027354 - DNA, 17 bp, Homo sapiens
atttatggtttctgcgt

SEQ ID NO: 2027355 - DNA, 12 bp, Homo sapiens
atttatgtaaac

SEQ ID NO: 2027356 - DNA, 15 bp, Homo sapiens
atttattaagtctgg

SEQ ID NO: 2027357 - DNA, 16 bp, Homo sapiens
atttattagttaatat

SEQ ID NO: 2027358 - DNA, 21 bp, Homo sapiens
atttattattttcacctgttt

SEQ ID NO: 2027359 - DNA, 18 bp, Homo sapiens
atttattgaagaaacaga

SEQ ID NO: 2027360 - DNA, 14 bp, Homo sapiens
atttattgcttgat

SEQ ID NO: 2027361 - DNA, 13 bp, Homo sapiens
atttattggggat

SEQ ID NO: 2027362 - DNA, 19 bp, Homo sapiens
atttattgtcattactgcc

SEQ ID NO: 2027363 - DNA, 20 bp, Homo sapiens
atttatttaataacaattgt

SEQ ID NO: 2027364 - DNA, 21 bp, Homo sapiens
atttatttctttgtgataaca

SEQ ID NO: 2027365 - DNA, 22 bp, Homo sapiens
atttattttaaaaaatgaaaat

SEQ ID NO: 2027366 - DNA, 23 bp, Homo sapiens
atttattttaacaaaagaagatt

SEQ ID NO: 2027367 - DNA, 21 bp, Homo sapiens
atttattttgtatttttgaat

SEQ ID NO: 2027368 - DNA, 18 bp, Homo sapiens
atttcaaaagacatgttg

SEQ ID NO: 2027369 - DNA, 19 bp, Homo sapiens
atttcaacatatcattttt

SEQ ID NO: 2027370 - DNA, 13 bp, Homo sapiens
atttcaactccag

SEQ ID NO: 2027371 - DNA, 21 bp, Homo sapiens
atttcaagaaaaaataaatgg

SEQ ID NO: 2027372 - DNA, 15 bp, Homo sapiens
atttcaagaccttct

SEQ ID NO: 2027373 - DNA, 15 bp, Homo sapiens
atttcaattctcaaa

SEQ ID NO: 2027374 - DNA, 21 bp, Homo sapiens
atttcaatttccaagagctga

SEQ ID NO: 2027375 - DNA, 15 bp, Homo sapiens
atttcacaacagatc

SEQ ID NO: 2027376 - DNA, 20 bp, Homo sapiens
atttcacaacagatcaattt

SEQ ID NO: 2027377 - DNA, 18 bp, Homo sapiens
atttcacattaatggtct

SEQ ID NO: 2027378 - DNA, 16 bp, Homo sapiens
atttcactttaaagtc

SEQ ID NO: 2027379 - DNA, 19 bp, Homo sapiens
atttcagaaggagaaggaa

SEQ ID NO: 2027380 - DNA, 20 bp, Homo sapiens
atttcaggttttgtaaagat

SEQ ID NO: 2027381 - DNA, 21 bp, Homo sapiens
atttcaggttttgtaaagatg

SEQ ID NO: 2027382 - DNA, 15 bp, Homo sapiens
atttcagtttgttta

SEQ ID NO: 2027383 - DNA, 12 bp, Homo sapiens
atttcataaaga

SEQ ID NO: 2027384 - DNA, 21 bp, Homo sapiens
atttcatacaaaactgttcac

SEQ ID NO: 2027385 - DNA, 19 bp, Homo sapiens
atttcatccagtttgttct

SEQ ID NO: 2027386 - DNA, 20 bp, Homo sapiens
atttcatctatttctgagaa

SEQ ID NO: 2027387 - DNA, 21 bp, Homo sapiens
atttcatctcatttaagggaa

SEQ ID NO: 2027388 - DNA, 14 bp, Homo sapiens
atttcatgtaacca

SEQ ID NO: 2027389 - DNA, 18 bp, Homo sapiens
atttcattgactgaactg

SEQ ID NO: 2027390 - DNA, 19 bp, Homo sapiens
atttcattgactgaactgc

SEQ ID NO: 2027391 - DNA, 12 bp, Homo sapiens
atttcattgtat

SEQ ID NO: 2027392 - DNA, 14 bp, Homo sapiens
atttcattgtatga

SEQ ID NO: 2027393 - DNA, 19 bp, Homo sapiens
atttcattgtatgatgtgt

SEQ ID NO: 2027394 - DNA, 20 bp, Homo sapiens
atttcattgtatgatgtgtt

SEQ ID NO: 2027395 - DNA, 15 bp, Homo sapiens
atttccaaataaaat

SEQ ID NO: 2027396 - DNA, 13 bp, Homo sapiens
atttccaaatgaa

SEQ ID NO: 2027397 - DNA, 19 bp, Homo sapiens
atttccaagtaatataatg

SEQ ID NO: 2027398 - DNA, 13 bp, Homo sapiens
atttccaggcccc

SEQ ID NO: 2027399 - DNA, 19 bp, Homo sapiens
atttccaggcccctgagga

SEQ ID NO: 2027400 - DNA, 19 bp, Homo sapiens
atttccaggggcacacaat

SEQ ID NO: 2027401 - DNA, 20 bp, Homo sapiens
atttccagtacctttgtcac

SEQ ID NO: 2027402 - DNA, 16 bp, Homo sapiens
atttccatttcttcct

SEQ ID NO: 2027403 - DNA, 18 bp, Homo sapiens
atttccatttcttcctca

SEQ ID NO: 2027404 - DNA, 15 bp, Homo sapiens
atttcccagaaggga

SEQ ID NO: 2027405 - DNA, 18 bp, Homo sapiens
atttccctggaatttaat

SEQ ID NO: 2027406 - DNA, 14 bp, Homo sapiens
atttccgtgaaggg

SEQ ID NO: 2027407 - DNA, 22 bp, Homo sapiens
atttcctacagaaatactgctc

SEQ ID NO: 2027408 - DNA, 13 bp, Homo sapiens
atttcctatctgt

SEQ ID NO: 2027409 - DNA, 14 bp, Homo sapiens
atttcctatctgta

SEQ ID NO: 2027410 - DNA, 19 bp, Homo sapiens
atttcctattttaaaacca

SEQ ID NO: 2027411 - DNA, 21 bp, Homo sapiens
atttcctattttaaaaccatg

SEQ ID NO: 2027412 - DNA, 22 bp, Homo sapiens
atttcctcaacgttgctcccca

SEQ ID NO: 2027413 - DNA, 14 bp, Homo sapiens
atttcctgtgtctt

SEQ ID NO: 2027414 - DNA, 13 bp, Homo sapiens
atttccttggagg

SEQ ID NO: 2027415 - DNA, 15 bp, Homo sapiens
atttccttggaggcc

SEQ ID NO: 2027416 - DNA, 16 bp, Homo sapiens
atttccttggaggcca

SEQ ID NO: 2027417 - DNA, 14 bp, Homo sapiens
atttctaaaaaaca

SEQ ID NO: 2027418 - DNA, 21 bp, Homo sapiens
atttctaaaaaacagaggcca

SEQ ID NO: 2027419 - DNA, 12 bp, Homo sapiens
atttctaaaaga

SEQ ID NO: 2027420 - DNA, 18 bp, Homo sapiens
atttctactgtgactgat

SEQ ID NO: 2027421 - DNA, 13 bp, Homo sapiens
atttctagcagag

SEQ ID NO: 2027422 - DNA, 14 bp, Homo sapiens
atttctagcagagt

SEQ ID NO: 2027423 - DNA, 11 bp, Homo sapiens
atttctaggta

SEQ ID NO: 2027424 - DNA, 22 bp, Homo sapiens
atttctatcttgaatttcatgc

SEQ ID NO: 2027425 - DNA, 23 bp, Homo sapiens
atttctattcaaggtggccaaat

SEQ ID NO: 2027426 - DNA, 13 bp, Homo sapiens
atttctatttatt

SEQ ID NO: 2027427 - DNA, 16 bp, Homo sapiens
atttctatttatttac

SEQ ID NO: 2027428 - DNA, 17 bp, Homo sapiens
atttctatttatttact

SEQ ID NO: 2027429 - DNA, 18 bp, Homo sapiens
atttctatttttgtagaa

SEQ ID NO: 2027430 - DNA, 20 bp, Homo sapiens
atttctcaacaaagcacagt

SEQ ID NO: 2027431 - DNA, 22 bp, Homo sapiens
atttctcaacaaagcacagtgt

SEQ ID NO: 2027432 - DNA, 16 bp, Homo sapiens
atttctcaatcagtgc

SEQ ID NO: 2027433 - DNA, 18 bp, Homo sapiens
atttctcgggtgcatttg

SEQ ID NO: 2027434 - DNA, 20 bp, Homo sapiens
atttctctccccactgaaaa

SEQ ID NO: 2027435 - DNA, 18 bp, Homo sapiens
atttctctgagcagtcag

SEQ ID NO: 2027436 - DNA, 20 bp, Homo sapiens
atttctgctcttccaaagct

SEQ ID NO: 2027437 - DNA, 12 bp, Homo sapiens
atttctggcctc

SEQ ID NO: 2027438 - DNA, 18 bp, Homo sapiens
atttctggcctcagcagg

SEQ ID NO: 2027439 - DNA, 16 bp, Homo sapiens
atttctggcttctagt

SEQ ID NO: 2027440 - DNA, 16 bp, Homo sapiens
atttcttaaaatgttt

SEQ ID NO: 2027441 - DNA, 15 bp, Homo sapiens
atttcttatgatttt

SEQ ID NO: 2027442 - DNA, 13 bp, Homo sapiens
atttcttcactgt

SEQ ID NO: 2027443 - DNA, 18 bp, Homo sapiens
atttcttcctcactatga

SEQ ID NO: 2027444 - DNA, 17 bp, Homo sapiens
atttcttcgctgctcta

SEQ ID NO: 2027445 - DNA, 21 bp, Homo sapiens
atttcttcgctgctctagctg

SEQ ID NO: 2027446 - DNA, 23 bp, Homo sapiens
atttcttcgctgctctagctggc

SEQ ID NO: 2027447 - DNA, 21 bp, Homo sapiens
atttcttttttaaatgaagaa

SEQ ID NO: 2027448 - DNA, 11 bp, Homo sapiens
atttgaaattt

SEQ ID NO: 2027449 - DNA, 17 bp, Homo sapiens
atttgaatatcattaaa

SEQ ID NO: 2027450 - DNA, 23 bp, Homo sapiens
atttgacaaaatttgttgaaatt

SEQ ID NO: 2027451 - DNA, 14 bp, Homo sapiens
atttgagagaagcc

SEQ ID NO: 2027452 - DNA, 14 bp, Homo sapiens
atttgagcatgcac

SEQ ID NO: 2027453 - DNA, 23 bp, Homo sapiens
atttgaggagcagcttcagttgt

SEQ ID NO: 2027454 - DNA, 14 bp, Homo sapiens
atttgatgctaaat

SEQ ID NO: 2027455 - DNA, 17 bp, Homo sapiens
atttgatgtacatgtgt

SEQ ID NO: 2027456 - DNA, 19 bp, Homo sapiens
atttgattgtaaaaacaaa

SEQ ID NO: 2027457 - DNA, 13 bp, Homo sapiens
atttgatttctat

SEQ ID NO: 2027458 - DNA, 15 bp, Homo sapiens
atttgcagagacagg

SEQ ID NO: 2027459 - DNA, 22 bp, Homo sapiens
atttgcagagacaggacctgac

SEQ ID NO: 2027460 - DNA, 17 bp, Homo sapiens
atttgccattcctggaa

SEQ ID NO: 2027461 - DNA, 17 bp, Homo sapiens
atttgcctaattcctgg

SEQ ID NO: 2027462 - DNA, 13 bp, Homo sapiens
atttgcctgtaac

SEQ ID NO: 2027463 - DNA, 15 bp, Homo sapiens
atttgcctgtaacaa

SEQ ID NO: 2027464 - DNA, 22 bp, Homo sapiens
atttgcctgtaacaagccagat

SEQ ID NO: 2027465 - DNA, 15 bp, Homo sapiens
atttgcttatttata

SEQ ID NO: 2027466 - DNA, 18 bp, Homo sapiens
atttgcttatttatattc

SEQ ID NO: 2027467 - DNA, 18 bp, Homo sapiens
atttgctttttcaccaga

SEQ ID NO: 2027468 - DNA, 20 bp, Homo sapiens
atttggaagagaggcacctg

SEQ ID NO: 2027469 - DNA, 19 bp, Homo sapiens
atttggcctgcactaattt

SEQ ID NO: 2027470 - DNA, 20 bp, Homo sapiens
atttggtgtggctgtattca

SEQ ID NO: 2027471 - DNA, 21 bp, Homo sapiens
atttggtgtggctgtattcag

SEQ ID NO: 2027472 - DNA, 15 bp, Homo sapiens
atttggttctaatag

SEQ ID NO: 2027473 - DNA, 18 bp, Homo sapiens
atttggtttagaacataa

SEQ ID NO: 2027474 - DNA, 22 bp, Homo sapiens
atttgtaatagatgtttgatag

SEQ ID NO: 2027475 - DNA, 15 bp, Homo sapiens
atttgtaatgtatct

SEQ ID NO: 2027476 - DNA, 19 bp, Homo sapiens
atttgtaattgcttacatt

SEQ ID NO: 2027477 - DNA, 20 bp, Homo sapiens
atttgtaattgcttacattt

SEQ ID NO: 2027478 - DNA, 16 bp, Homo sapiens
atttgtacaaatactg

SEQ ID NO: 2027479 - DNA, 18 bp, Homo sapiens
atttgtacagttcagttc

SEQ ID NO: 2027480 - DNA, 11 bp, Homo sapiens
atttgtacatt

SEQ ID NO: 2027481 - DNA, 15 bp, Homo sapiens
atttgtacattcctg

SEQ ID NO: 2027482 - DNA, 16 bp, Homo sapiens
atttgtacattcctga

SEQ ID NO: 2027483 - DNA, 23 bp, Homo sapiens
atttgtactgaaaaatggtaatt

SEQ ID NO: 2027484 - DNA, 20 bp, Homo sapiens
atttgtagaagggttatatt

SEQ ID NO: 2027485 - DNA, 19 bp, Homo sapiens
atttgtatctctgaagcat

SEQ ID NO: 2027486 - DNA, 20 bp, Homo sapiens
atttgtatctctgaagcatg

SEQ ID NO: 2027487 - DNA, 22 bp, Homo sapiens
atttgtatctctgaagcatgtt

SEQ ID NO: 2027488 - DNA, 14 bp, Homo sapiens
atttgtatctgaag

SEQ ID NO: 2027489 - DNA, 17 bp, Homo sapiens
atttgtatctgaaggag

SEQ ID NO: 2027490 - DNA, 23 bp, Homo sapiens
atttgtattaccattacttgtat

SEQ ID NO: 2027491 - DNA, 23 bp, Homo sapiens
atttgtattcccttttatttcca

SEQ ID NO: 2027492 - DNA, 24 bp, Homo sapiens
atttgtattcccttttatttccaa

SEQ ID NO: 2027493 - DNA, 13 bp, Homo sapiens
atttgtatttata

SEQ ID NO: 2027494 - DNA, 21 bp, Homo sapiens
atttgtatttatattagagtg

SEQ ID NO: 2027495 - DNA, 11 bp, Homo sapiens
atttgtatttt

SEQ ID NO: 2027496 - DNA, 15 bp, Homo sapiens
atttgtccaattctc

SEQ ID NO: 2027497 - DNA, 15 bp, Homo sapiens
atttgtctttcagga

SEQ ID NO: 2027498 - DNA, 23 bp, Homo sapiens
atttgtgaaatgatggtgaaagt

SEQ ID NO: 2027499 - DNA, 20 bp, Homo sapiens
atttgtgagccaaagagaaa

SEQ ID NO: 2027500 - DNA, 24 bp, Homo sapiens
atttgtggcccaagcctggtctcc

SEQ ID NO: 2027501 - DNA, 18 bp, Homo sapiens
atttgtgtagattgtgta

SEQ ID NO: 2027502 - DNA, 16 bp, Homo sapiens
atttgtgtatgtgtat

SEQ ID NO: 2027503 - DNA, 16 bp, Homo sapiens
atttgttaaatattta

SEQ ID NO: 2027504 - DNA, 17 bp, Homo sapiens
atttgttaaatatttac

SEQ ID NO: 2027505 - DNA, 12 bp, Homo sapiens
atttgttaatgg

SEQ ID NO: 2027506 - DNA, 23 bp, Homo sapiens
atttgttaatttagaaaacttta

SEQ ID NO: 2027507 - DNA, 18 bp, Homo sapiens
atttgttatttgtacagt

SEQ ID NO: 2027508 - DNA, 17 bp, Homo sapiens
atttgttattttcagta

SEQ ID NO: 2027509 - DNA, 14 bp, Homo sapiens
atttgttcccaaga

SEQ ID NO: 2027510 - DNA, 14 bp, Homo sapiens
atttgttgaaatta

SEQ ID NO: 2027511 - DNA, 15 bp, Homo sapiens
atttgttggaatgaa

SEQ ID NO: 2027512 - DNA, 13 bp, Homo sapiens
atttgtttagaag

SEQ ID NO: 2027513 - DNA, 15 bp, Homo sapiens
atttgttttcatggt

SEQ ID NO: 2027514 - DNA, 16 bp, Homo sapiens
atttgtttttcttatc

SEQ ID NO: 2027515 - DNA, 19 bp, Homo sapiens
attttaaaaagatttgttt

SEQ ID NO: 2027516 - DNA, 14 bp, Homo sapiens
attttaaaaccatg

SEQ ID NO: 2027517 - DNA, 16 bp, Homo sapiens
attttaaaaccatgca

SEQ ID NO: 2027518 - DNA, 20 bp, Homo sapiens
attttaaaaccatgcagctt

SEQ ID NO: 2027519 - DNA, 20 bp, Homo sapiens
attttaaaaggttgactcaa

SEQ ID NO: 2027520 - DNA, 12 bp, Homo sapiens
attttaaaatct

SEQ ID NO: 2027521 - DNA, 13 bp, Homo sapiens
attttaaaatctg

SEQ ID NO: 2027522 - DNA, 18 bp, Homo sapiens
attttaaaattttatctc

SEQ ID NO: 2027523 - DNA, 13 bp, Homo sapiens
attttaaacaaag

SEQ ID NO: 2027524 - DNA, 22 bp, Homo sapiens
attttaaacaaaggttgagatg

SEQ ID NO: 2027525 - DNA, 16 bp, Homo sapiens
attttaaagtggttct

SEQ ID NO: 2027526 - DNA, 14 bp, Homo sapiens
attttaaatgtttt

SEQ ID NO: 2027527 - DNA, 16 bp, Homo sapiens
attttaaattcacaat

SEQ ID NO: 2027528 - DNA, 18 bp, Homo sapiens
attttaacaaaagcaaga

SEQ ID NO: 2027529 - DNA, 17 bp, Homo sapiens
attttaactttatcaca

SEQ ID NO: 2027530 - DNA, 17 bp, Homo sapiens
attttaagacgtgaatg

SEQ ID NO: 2027531 - DNA, 23 bp, Homo sapiens
attttaagacgtgaatgtctcag

SEQ ID NO: 2027532 - DNA, 15 bp, Homo sapiens
attttaatattttgt

SEQ ID NO: 2027533 - DNA, 19 bp, Homo sapiens
attttaatttatatttgaa

SEQ ID NO: 2027534 - DNA, 18 bp, Homo sapiens
attttaatttatgagttt

SEQ ID NO: 2027535 - DNA, 14 bp, Homo sapiens
attttacagagaat

SEQ ID NO: 2027536 - DNA, 15 bp, Homo sapiens
attttacagagaatc

SEQ ID NO: 2027537 - DNA, 22 bp, Homo sapiens
attttactactgtggaaaaata

SEQ ID NO: 2027538 - DNA, 16 bp, Homo sapiens
attttactgacagaaa

SEQ ID NO: 2027539 - DNA, 18 bp, Homo sapiens
attttactgacagaaatg

SEQ ID NO: 2027540 - DNA, 23 bp, Homo sapiens
attttactgtctgtaagagaatt

SEQ ID NO: 2027541 - DNA, 18 bp, Homo sapiens
attttagccttaaatttt

SEQ ID NO: 2027542 - DNA, 17 bp, Homo sapiens
attttagccttctctgt

SEQ ID NO: 2027543 - DNA, 18 bp, Homo sapiens
attttagcgtgctcactg

SEQ ID NO: 2027544 - DNA, 15 bp, Homo sapiens
attttagctgcagaa

SEQ ID NO: 2027545 - DNA, 23 bp, Homo sapiens
attttaggcctcctctctgccac

SEQ ID NO: 2027546 - DNA, 14 bp, Homo sapiens
attttagtgactgt

SEQ ID NO: 2027547 - DNA, 18 bp, Homo sapiens
attttagtgactgtaatt

SEQ ID NO: 2027548 - DNA, 19 bp, Homo sapiens
attttataagcaaatttca

SEQ ID NO: 2027549 - DNA, 22 bp, Homo sapiens
attttatacatagtcacaaaaa

SEQ ID NO: 2027550 - DNA, 16 bp, Homo sapiens
attttatatctggatt

SEQ ID NO: 2027551 - DNA, 20 bp, Homo sapiens
attttatatgaaatgtttca

SEQ ID NO: 2027552 - DNA, 21 bp, Homo sapiens
attttatctgtgttgtctctc

SEQ ID NO: 2027553 - DNA, 16 bp, Homo sapiens
attttatgaatgtctt

SEQ ID NO: 2027554 - DNA, 15 bp, Homo sapiens
attttattaaagcaa

SEQ ID NO: 2027555 - DNA, 21 bp, Homo sapiens
attttattaaagcaacatttt

SEQ ID NO: 2027556 - DNA, 14 bp, Homo sapiens
attttattaaatct

SEQ ID NO: 2027557 - DNA, 20 bp, Homo sapiens
attttatttattagctgtaa

SEQ ID NO: 2027558 - DNA, 13 bp, Homo sapiens
attttatttgtat

SEQ ID NO: 2027559 - DNA, 20 bp, Homo sapiens
attttcaacgcagccctgct

SEQ ID NO: 2027560 - DNA, 13 bp, Homo sapiens
attttcaagaaac

SEQ ID NO: 2027561 - DNA, 16 bp, Homo sapiens
attttcaagaaactga

SEQ ID NO: 2027562 - DNA, 23 bp, Homo sapiens
attttcaagaaactgaggaattt

SEQ ID NO: 2027563 - DNA, 22 bp, Homo sapiens
attttcaagagaagaaaaaatt

SEQ ID NO: 2027564 - DNA, 17 bp, Homo sapiens
attttcaatgcacatta

SEQ ID NO: 2027565 - DNA, 20 bp, Homo sapiens
attttcacatgacgtaaaat

SEQ ID NO: 2027566 - DNA, 13 bp, Homo sapiens
attttcactgtag

SEQ ID NO: 2027567 - DNA, 19 bp, Homo sapiens
attttcaggtttcttaaaa

SEQ ID NO: 2027568 - DNA, 22 bp, Homo sapiens
attttcagtagggctacaaaac

SEQ ID NO: 2027569 - DNA, 13 bp, Homo sapiens
attttcatgactt

SEQ ID NO: 2027570 - DNA, 18 bp, Homo sapiens
attttcatgtatatgtgt

SEQ ID NO: 2027571 - DNA, 11 bp, Homo sapiens
attttcatgtt

SEQ ID NO: 2027572 - DNA, 19 bp, Homo sapiens
attttcattaaaaatgaaa

SEQ ID NO: 2027573 - DNA, 17 bp, Homo sapiens
attttcattttaattta

SEQ ID NO: 2027574 - DNA, 13 bp, Homo sapiens
attttccaataaa

SEQ ID NO: 2027575 - DNA, 17 bp, Homo sapiens
attttccagggcaatca

SEQ ID NO: 2027576 - DNA, 17 bp, Homo sapiens
attttcccctgaagact

SEQ ID NO: 2027577 - DNA, 11 bp, Homo sapiens
attttcctcct

SEQ ID NO: 2027578 - DNA, 20 bp, Homo sapiens
attttcctcgcctaggcctg

SEQ ID NO: 2027579 - DNA, 13 bp, Homo sapiens
attttcgtgcatt

SEQ ID NO: 2027580 - DNA, 23 bp, Homo sapiens
attttctacctgtgttcattctt

SEQ ID NO: 2027581 - DNA, 19 bp, Homo sapiens
attttctatagctcttcta

SEQ ID NO: 2027582 - DNA, 12 bp, Homo sapiens
attttctgaatt

SEQ ID NO: 2027583 - DNA, 15 bp, Homo sapiens
attttctgctacttt

SEQ ID NO: 2027584 - DNA, 18 bp, Homo sapiens
attttctggaatacatga

SEQ ID NO: 2027585 - DNA, 22 bp, Homo sapiens
attttctggaatacatgaaata

SEQ ID NO: 2027586 - DNA, 19 bp, Homo sapiens
attttcttatcttctgcaa

SEQ ID NO: 2027587 - DNA, 18 bp, Homo sapiens
attttcttcatgcaatga

SEQ ID NO: 2027588 - DNA, 21 bp, Homo sapiens
attttcttcatgcaatgacat

SEQ ID NO: 2027589 - DNA, 15 bp, Homo sapiens
attttcttcccattt

SEQ ID NO: 2027590 - DNA, 17 bp, Homo sapiens
attttcttgcctgaggc

SEQ ID NO: 2027591 - DNA, 18 bp, Homo sapiens
attccatgggatgttaag

SEQ ID NO: 2027592 - DNA, 16 bp, Homo sapiens
attcccaactgctctg

SEQ ID NO: 2027593 - DNA, 15 bp, Homo sapiens
attcccaagaaatgc

SEQ ID NO: 2027594 - DNA, 16 bp, Homo sapiens
attcccaagaaatgct

SEQ ID NO: 2027595 - DNA, 19 bp, Homo sapiens
attcccagagcaaaataat

SEQ ID NO: 2027596 - DNA, 12 bp, Homo sapiens
attcccagccca

SEQ ID NO: 2027597 - DNA, 14 bp, Homo sapiens
attcccagctgtct

SEQ ID NO: 2027598 - DNA, 14 bp, Homo sapiens
attccccattcttc

SEQ ID NO: 2027599 - DNA, 15 bp, Homo sapiens
attccccattcttcc

SEQ ID NO: 2027600 - DNA, 21 bp, Homo sapiens
attcccccatgtggctgaaga

SEQ ID NO: 2027601 - DNA, 16 bp, Homo sapiens
attccccgctgcccaa

SEQ ID NO: 2027602 - DNA, 21 bp, Homo sapiens
attcccctatctctagaattt

SEQ ID NO: 2027603 - DNA, 14 bp, Homo sapiens
attccctatcaaaa

SEQ ID NO: 2027604 - DNA, 21 bp, Homo sapiens
attccctatcttttagtttta

SEQ ID NO: 2027605 - DNA, 18 bp, Homo sapiens
attccctctcccaggccc

SEQ ID NO: 2027606 - DNA, 15 bp, Homo sapiens
attccgaagagggaa

SEQ ID NO: 2027607 - DNA, 18 bp, Homo sapiens
attcctacaaagatgttt

SEQ ID NO: 2027608 - DNA, 15 bp, Homo sapiens
attcctagagagcag

SEQ ID NO: 2027609 - DNA, 18 bp, Homo sapiens
attcctagagagcagaaa

SEQ ID NO: 2027610 - DNA, 21 bp, Homo sapiens
attcctagagagcagaaataa

SEQ ID NO: 2027611 - DNA, 23 bp, Homo sapiens
attcctaggaggaaaaagaaatg

SEQ ID NO: 2027612 - DNA, 23 bp, Homo sapiens
attcctagttccccgtgaacttc

SEQ ID NO: 2027613 - DNA, 14 bp, Homo sapiens
attcctcagggaca

SEQ ID NO: 2027614 - DNA, 13 bp, Homo sapiens
attcctctgggaa

SEQ ID NO: 2027615 - DNA, 17 bp, Homo sapiens
attcctcttgcctctct

SEQ ID NO: 2027616 - DNA, 14 bp, Homo sapiens
attcctgaccctcc

SEQ ID NO: 2027617 - DNA, 12 bp, Homo sapiens
attcctgcattt

SEQ ID NO: 2027618 - DNA, 21 bp, Homo sapiens
attcctggcatgacactctag

SEQ ID NO: 2027619 - DNA, 12 bp, Homo sapiens
attcctggcccc

SEQ ID NO: 2027620 - DNA, 15 bp, Homo sapiens
attcctgggcctgtc

SEQ ID NO: 2027621 - DNA, 17 bp, Homo sapiens
attcctgtagcatcttc

SEQ ID NO: 2027622 - DNA, 21 bp, Homo sapiens
attccttagcttagacctcag

SEQ ID NO: 2027623 - DNA, 18 bp, Homo sapiens
attccttcccactcatgt

SEQ ID NO: 2027624 - DNA, 17 bp, Homo sapiens
attccttgtcaccagca

SEQ ID NO: 2027625 - DNA, 21 bp, Homo sapiens
attccttgtcaccagcaacat

SEQ ID NO: 2027626 - DNA, 20 bp, Homo sapiens
attccttttgatggggagaa

SEQ ID NO: 2027627 - DNA, 18 bp, Homo sapiens
attccttttgtgtacagt

SEQ ID NO: 2027628 - DNA, 19 bp, Homo sapiens
attcgaggtgtcaccctgc

SEQ ID NO: 2027629 - DNA, 21 bp, Homo sapiens
attcgcctgtgggaagagaag

SEQ ID NO: 2027630 - DNA, 22 bp, Homo sapiens
attcgcctgtgggaagagaagg

SEQ ID NO: 2027631 - DNA, 14 bp, Homo sapiens
attctaaaatgatt

SEQ ID NO: 2027632 - DNA, 16 bp, Homo sapiens
attctaaaatgattgt

SEQ ID NO: 2027633 - DNA, 14 bp, Homo sapiens
attctaaaatgcct

SEQ ID NO: 2027634 - DNA, 16 bp, Homo sapiens
attctaaagctttctg

SEQ ID NO: 2027635 - DNA, 15 bp, Homo sapiens
attctaagattgtac

SEQ ID NO: 2027636 - DNA, 14 bp, Homo sapiens
attctaatgtcttc

SEQ ID NO: 2027637 - DNA, 16 bp, Homo sapiens
attctaatgtcttcat

SEQ ID NO: 2027638 - DNA, 15 bp, Homo sapiens
attctaattttatat

SEQ ID NO: 2027639 - DNA, 23 bp, Homo sapiens
attctaattttatatatagagaa

SEQ ID NO: 2027640 - DNA, 22 bp, Homo sapiens
attctacagcatacagagcagg

SEQ ID NO: 2027641 - DNA, 15 bp, Homo sapiens
attctacagtttctt

SEQ ID NO: 2027642 - DNA, 22 bp, Homo sapiens
attctacagtttcttactgttt

SEQ ID NO: 2027643 - DNA, 17 bp, Homo sapiens
attctactaaatatttt

SEQ ID NO: 2027644 - DNA, 18 bp, Homo sapiens
attctactaaatatttta

SEQ ID NO: 2027645 - DNA, 17 bp, Homo sapiens
attctagccaaactatt

SEQ ID NO: 2027646 - DNA, 20 bp, Homo sapiens
attctagccaaactattcta

SEQ ID NO: 2027647 - DNA, 15 bp, Homo sapiens
attctatgagaacaa

SEQ ID NO: 2027648 - DNA, 16 bp, Homo sapiens
attctcacaattgtaa

SEQ ID NO: 2027649 - DNA, 16 bp, Homo sapiens
attctcactccaccac

SEQ ID NO: 2027650 - DNA, 17 bp, Homo sapiens
attctcactccaccacc

SEQ ID NO: 2027651 - DNA, 23 bp, Homo sapiens
attctccagccatcaagagactg

SEQ ID NO: 2027652 - DNA, 11 bp, Homo sapiens
attctcctcct

SEQ ID NO: 2027653 - DNA, 19 bp, Homo sapiens
attctcctgcctcagcctc

SEQ ID NO: 2027654 - DNA, 22 bp, Homo sapiens
attctctctaaaaataaaatga

SEQ ID NO: 2027655 - DNA, 10 bp, Homo sapiens
attctctctc

SEQ ID NO: 2027656 - DNA, 17 bp, Homo sapiens
attctgaagccattgtc

SEQ ID NO: 2027657 - DNA, 15 bp, Homo sapiens
attctgaatctgaaa

SEQ ID NO: 2027658 - DNA, 20 bp, Homo sapiens
attctgaccacccttctcat

SEQ ID NO: 2027659 - DNA, 20 bp, Homo sapiens
attctgattcgaatgacact

SEQ ID NO: 2027660 - DNA, 22 bp, Homo sapiens
attctgattcgaatgacactgt

SEQ ID NO: 2027661 - DNA, 20 bp, Homo sapiens
attctgatttttttgttgtt

SEQ ID NO: 2027662 - DNA, 11 bp, Homo sapiens
attctgcctgc

SEQ ID NO: 2027663 - DNA, 13 bp, Homo sapiens
attctgcctgccc

SEQ ID NO: 2027664 - DNA, 16 bp, Homo sapiens
attctgcctgcccagg

SEQ ID NO: 2027665 - DNA, 23 bp, Homo sapiens
attctggaaaaaaaatatatata

SEQ ID NO: 2027666 - DNA, 22 bp, Homo sapiens
attctggctgcaagggccagag

SEQ ID NO: 2027667 - DNA, 23 bp, Homo sapiens
attctggctgcaagggccagagt

SEQ ID NO: 2027668 - DNA, 10 bp, Homo sapiens
attctgggat

SEQ ID NO: 2027669 - DNA, 22 bp, Homo sapiens
attctgggatggaccctcgcag

SEQ ID NO: 2027670 - DNA, 14 bp, Homo sapiens
attctgtaaaatgt

SEQ ID NO: 2027671 - DNA, 17 bp, Homo sapiens
attctgtcatagaaagt

SEQ ID NO: 2027672 - DNA, 15 bp, Homo sapiens
attctgtgaagaatg

SEQ ID NO: 2027673 - DNA, 16 bp, Homo sapiens
attctgtgaagaatga

SEQ ID NO: 2027674 - DNA, 17 bp, Homo sapiens
attctgtgaagaatgaa

SEQ ID NO: 2027675 - DNA, 19 bp, Homo sapiens
attctgttaaaatcaggat

SEQ ID NO: 2027676 - DNA, 14 bp, Homo sapiens
attctgttgcccag

SEQ ID NO: 2027677 - DNA, 22 bp, Homo sapiens
attctgttgcccaggctggcct

SEQ ID NO: 2027678 - DNA, 22 bp, Homo sapiens
attcttaagggaacttccacat

SEQ ID NO: 2027679 - DNA, 16 bp, Homo sapiens
attcttacaaacatgt

SEQ ID NO: 2027680 - DNA, 18 bp, Homo sapiens
attcttaccgagaaaagg

SEQ ID NO: 2027681 - DNA, 20 bp, Homo sapiens
attcttaccgagaaaaggag

SEQ ID NO: 2027682 - DNA, 13 bp, Homo sapiens
attcttatttctg

SEQ ID NO: 2027683 - DNA, 15 bp, Homo sapiens
attcttatttctgtg

SEQ ID NO: 2027684 - DNA, 12 bp, Homo sapiens
attcttccactg

SEQ ID NO: 2027685 - DNA, 20 bp, Homo sapiens
attcttccagtagttgaaca

SEQ ID NO: 2027686 - DNA, 21 bp, Homo sapiens
attcttccagtgcaacaaaat

SEQ ID NO: 2027687 - DNA, 15 bp, Homo sapiens
attcttccatctgat

SEQ ID NO: 2027688 - DNA, 23 bp, Homo sapiens
attcttccatctgattgtgatgt

SEQ ID NO: 2027689 - DNA, 23 bp, Homo sapiens
attcttccgtcacatatacaaaa

SEQ ID NO: 2027690 - DNA, 12 bp, Homo sapiens
attcttcctagt

SEQ ID NO: 2027691 - DNA, 17 bp, Homo sapiens
attcttcctagttttct

SEQ ID NO: 2027692 - DNA, 19 bp, Homo sapiens
attcttcctagttttctcc

SEQ ID NO: 2027693 - DNA, 14 bp, Homo sapiens
attcttctgcctca

SEQ ID NO: 2027694 - DNA, 11 bp, Homo sapiens
attcttctgct

SEQ ID NO: 2027695 - DNA, 19 bp, Homo sapiens
attcttctgcttcagcctc

SEQ ID NO: 2027696 - DNA, 15 bp, Homo sapiens
attcttgtgcctcag

SEQ ID NO: 2027697 - DNA, 16 bp, Homo sapiens
attcttgtgcctcagc

SEQ ID NO: 2027698 - DNA, 20 bp, Homo sapiens
attgaaatttaaaaataaag

SEQ ID NO: 2027699 - DNA, 17 bp, Homo sapiens
attgaaatttactgtga

SEQ ID NO: 2027700 - DNA, 15 bp, Homo sapiens
attgaactgagccaa

SEQ ID NO: 2027701 - DNA, 19 bp, Homo sapiens
attgaacttaaataaatgt

SEQ ID NO: 2027702 - DNA, 16 bp, Homo sapiens
attgaagaaaagcact

SEQ ID NO: 2027703 - DNA, 17 bp, Homo sapiens
attgaagaaacagatac

SEQ ID NO: 2027704 - DNA, 21 bp, Homo sapiens
attgaagagagatatatctga

SEQ ID NO: 2027705 - DNA, 17 bp, Homo sapiens
attgaataagtattctt

SEQ ID NO: 2027706 - DNA, 20 bp, Homo sapiens
attgacaacattttattacc

SEQ ID NO: 2027707 - DNA, 18 bp, Homo sapiens
attgacaaggtagacatg

SEQ ID NO: 2027708 - DNA, 16 bp, Homo sapiens
attatgtctcaaaata

SEQ ID NO: 2027709 - DNA, 15 bp, Homo sapiens
attatgtgacaacct

SEQ ID NO: 2027710 - DNA, 17 bp, Homo sapiens
attatgtgacaaccttt

SEQ ID NO: 2027711 - DNA, 21 bp, Homo sapiens
attatgtgccattttaataaa

SEQ ID NO: 2027712 - DNA, 11 bp, Homo sapiens
attatgtgtgc

SEQ ID NO: 2027713 - DNA, 21 bp, Homo sapiens
attatgtgtgcatgtgtgtat

SEQ ID NO: 2027714 - DNA, 23 bp, Homo sapiens
attatgtgttcaaggaccacatg

SEQ ID NO: 2027715 - DNA, 13 bp, Homo sapiens
attatgttgttca

SEQ ID NO: 2027716 - DNA, 23 bp, Homo sapiens
attattaataaattttaacattt

SEQ ID NO: 2027717 - DNA, 19 bp, Homo sapiens
attattaataccaaatatt

SEQ ID NO: 2027718 - DNA, 13 bp, Homo sapiens
attattagattct

SEQ ID NO: 2027719 - DNA, 14 bp, Homo sapiens
attattcactagta

SEQ ID NO: 2027720 - DNA, 13 bp, Homo sapiens
attattcatttaa

SEQ ID NO: 2027721 - DNA, 16 bp, Homo sapiens
attattcatttaaaat

SEQ ID NO: 2027722 - DNA, 18 bp, Homo sapiens
attattcatttaaaatga

SEQ ID NO: 2027723 - DNA, 17 bp, Homo sapiens
attattccctgtacaat

SEQ ID NO: 2027724 - DNA, 16 bp, Homo sapiens
attattctgattccac

SEQ ID NO: 2027725 - DNA, 20 bp, Homo sapiens
attattggaatataattgtt

SEQ ID NO: 2027726 - DNA, 14 bp, Homo sapiens
attatttacaatgc

SEQ ID NO: 2027727 - DNA, 14 bp, Homo sapiens
attatttatttaat

SEQ ID NO: 2027728 - DNA, 18 bp, Homo sapiens
attatttcatacaaaact

SEQ ID NO: 2027729 - DNA, 21 bp, Homo sapiens
attatttcatacaaaactgtt

SEQ ID NO: 2027730 - DNA, 17 bp, Homo sapiens
attatttgtgtaataga

SEQ ID NO: 2027731 - DNA, 18 bp, Homo sapiens
attatttgtgtaatagaa

SEQ ID NO: 2027732 - DNA, 14 bp, Homo sapiens
attattttaaacaa

SEQ ID NO: 2027733 - DNA, 16 bp, Homo sapiens
attattttaatatttt

SEQ ID NO: 2027734 - DNA, 19 bp, Homo sapiens
attattttcattacaatgg

SEQ ID NO: 2027735 - DNA, 21 bp, Homo sapiens
attattttcattacaatggaa

SEQ ID NO: 2027736 - DNA, 17 bp, Homo sapiens
attattttgttgtgatt

SEQ ID NO: 2027737 - DNA, 11 bp, Homo sapiens
attatttttgt

SEQ ID NO: 2027738 - DNA, 20 bp, Homo sapiens
attatttttgtgtttctaaa

SEQ ID NO: 2027739 - DNA, 14 bp, Homo sapiens
attcaaaaagtgtt

SEQ ID NO: 2027740 - DNA, 16 bp, Homo sapiens
attcaaaaagtgttta

SEQ ID NO: 2027741 - DNA, 17 bp, Homo sapiens
attcaaaaagtgtttat

SEQ ID NO: 2027742 - DNA, 18 bp, Homo sapiens
attcaaacagtctcagga

SEQ ID NO: 2027743 - DNA, 19 bp, Homo sapiens
attcaaacagtctcaggaa

SEQ ID NO: 2027744 - DNA, 20 bp, Homo sapiens
attcaaacagtctcaggaaa

SEQ ID NO: 2027745 - DNA, 15 bp, Homo sapiens
attcaaaccatttaa

SEQ ID NO: 2027746 - DNA, 21 bp, Homo sapiens
attcaaaccatttaattcata

SEQ ID NO: 2027747 - DNA, 15 bp, Homo sapiens
attcaaactgctcca

SEQ ID NO: 2027748 - DNA, 16 bp, Homo sapiens
attcaaactgctccaa

SEQ ID NO: 2027749 - DNA, 17 bp, Homo sapiens
attcaaactgctccaag

SEQ ID NO: 2027750 - DNA, 18 bp, Homo sapiens
attcaaactgctccaagt

SEQ ID NO: 2027751 - DNA, 13 bp, Homo sapiens
attcaacacatta

SEQ ID NO: 2027752 - DNA, 22 bp, Homo sapiens
attcaacacattacttgcacaa

SEQ ID NO: 2027753 - DNA, 18 bp, Homo sapiens
attcaacctgtgtcttat

SEQ ID NO: 2027754 - DNA, 22 bp, Homo sapiens
attcaagcctgtgaataaaaac

SEQ ID NO: 2027755 - DNA, 17 bp, Homo sapiens
attcaaggagatataaa

SEQ ID NO: 2027756 - DNA, 21 bp, Homo sapiens
attcaaggcatttctatcaca

SEQ ID NO: 2027757 - DNA, 20 bp, Homo sapiens
attcaagtattaggggtaat

SEQ ID NO: 2027758 - DNA, 14 bp, Homo sapiens
attcaagtgcctct

SEQ ID NO: 2027759 - DNA, 22 bp, Homo sapiens
attcaatgtttatgcaaggaag

SEQ ID NO: 2027760 - DNA, 14 bp, Homo sapiens
attcaattctgtat

SEQ ID NO: 2027761 - DNA, 20 bp, Homo sapiens
attcacaactaggacctcat

SEQ ID NO: 2027762 - DNA, 14 bp, Homo sapiens
attcacaatagaaa

SEQ ID NO: 2027763 - DNA, 13 bp, Homo sapiens
attcacactgtgc

SEQ ID NO: 2027764 - DNA, 13 bp, Homo sapiens
attcacagagcct

SEQ ID NO: 2027765 - DNA, 15 bp, Homo sapiens
attcacagagccttt

SEQ ID NO: 2027766 - DNA, 16 bp, Homo sapiens
attcacatctcatttt

SEQ ID NO: 2027767 - DNA, 13 bp, Homo sapiens
attcacatttgat

SEQ ID NO: 2027768 - DNA, 17 bp, Homo sapiens
attcacatttgatgtac

SEQ ID NO: 2027769 - DNA, 20 bp, Homo sapiens
attcacatttgatgtacatg

SEQ ID NO: 2027770 - DNA, 21 bp, Homo sapiens
attcacatttgatgtacatgt

SEQ ID NO: 2027771 - DNA, 14 bp, Homo sapiens
attcactattagag

SEQ ID NO: 2027772 - DNA, 16 bp, Homo sapiens
attcactattagagaa

SEQ ID NO: 2027773 - DNA, 19 bp, Homo sapiens
attcactattagagaaaca

SEQ ID NO: 2027774 - DNA, 21 bp, Homo sapiens
attcactcccacacccaagaa

SEQ ID NO: 2027775 - DNA, 22 bp, Homo sapiens
attcactttaccttcagcagtt

SEQ ID NO: 2027776 - DNA, 21 bp, Homo sapiens
attcagaaaacataatataag

SEQ ID NO: 2027777 - DNA, 16 bp, Homo sapiens
attcagaagaaaaaga

SEQ ID NO: 2027778 - DNA, 17 bp, Homo sapiens
attcagaagaaaaagaa

SEQ ID NO: 2027779 - DNA, 18 bp, Homo sapiens
attcagatatatttttca

SEQ ID NO: 2027780 - DNA, 19 bp, Homo sapiens
attcagatcgtattaatta

SEQ ID NO: 2027781 - DNA, 22 bp, Homo sapiens
attcagatcgtattaattatct

SEQ ID NO: 2027782 - DNA, 15 bp, Homo sapiens
attcagcacacccca

SEQ ID NO: 2027783 - DNA, 19 bp, Homo sapiens
attcagcacaccccaaggg

SEQ ID NO: 2027784 - DNA, 20 bp, Homo sapiens
attcagcacaccccaaggga

SEQ ID NO: 2027785 - DNA, 20 bp, Homo sapiens
attcagcaccctgggtgcca

SEQ ID NO: 2027786 - DNA, 20 bp, Homo sapiens
attcagcactgatttcacaa

SEQ ID NO: 2027787 - DNA, 20 bp, Homo sapiens
attcagcttcatttgtgtca

SEQ ID NO: 2027788 - DNA, 17 bp, Homo sapiens
attcaggaaaaggcctg

SEQ ID NO: 2027789 - DNA, 18 bp, Homo sapiens
attcaggaaaaggcctgg

SEQ ID NO: 2027790 - DNA, 21 bp, Homo sapiens
attcaggaaaaggcctggggt

SEQ ID NO: 2027791 - DNA, 17 bp, Homo sapiens
attcaggactggctcac

SEQ ID NO: 2027792 - DNA, 12 bp, Homo sapiens
attcaggcactg

SEQ ID NO: 2027793 - DNA, 17 bp, Homo sapiens
attcaggcactgagaat

SEQ ID NO: 2027794 - DNA, 16 bp, Homo sapiens
attcaggcagcactga

SEQ ID NO: 2027795 - DNA, 20 bp, Homo sapiens
attcagtgctgtggcctggg

SEQ ID NO: 2027796 - DNA, 19 bp, Homo sapiens
attcagtgcttcttaaaga

SEQ ID NO: 2027797 - DNA, 14 bp, Homo sapiens
attcataacaatgt

SEQ ID NO: 2027798 - DNA, 13 bp, Homo sapiens
attcatatgcttc

SEQ ID NO: 2027799 - DNA, 22 bp, Homo sapiens
attcatctctctttaatataaa

SEQ ID NO: 2027800 - DNA, 14 bp, Homo sapiens
attcatgccatctg

SEQ ID NO: 2027801 - DNA, 20 bp, Homo sapiens
attcatgccatctgttttca

SEQ ID NO: 2027802 - DNA, 17 bp, Homo sapiens
attcatgctttctcctt

SEQ ID NO: 2027803 - DNA, 19 bp, Homo sapiens
attcatgctttctcctttt

SEQ ID NO: 2027804 - DNA, 13 bp, Homo sapiens
attcatgggtgtc

SEQ ID NO: 2027805 - DNA, 15 bp, Homo sapiens
attcatgtaataaat

SEQ ID NO: 2027806 - DNA, 17 bp, Homo sapiens
attcatgtaataaatct

SEQ ID NO: 2027807 - DNA, 16 bp, Homo sapiens
attcatgtacagcatg

SEQ ID NO: 2027808 - DNA, 14 bp, Homo sapiens
attcattcagtgag

SEQ ID NO: 2027809 - DNA, 10 bp, Homo sapiens
attcatttaa

SEQ ID NO: 2027810 - DNA, 12 bp, Homo sapiens
attcatttcaca

SEQ ID NO: 2027811 - DNA, 13 bp, Homo sapiens
attcatttcacat

SEQ ID NO: 2027812 - DNA, 20 bp, Homo sapiens
attcatttcacattaatggt

SEQ ID NO: 2027813 - DNA, 17 bp, Homo sapiens
attcatttcactttaaa

SEQ ID NO: 2027814 - DNA, 14 bp, Homo sapiens
attcatttcatcta

SEQ ID NO: 2027815 - DNA, 17 bp, Homo sapiens
attccaaacttctaaat

SEQ ID NO: 2027816 - DNA, 18 bp, Homo sapiens
attccaaacttctaaatg

SEQ ID NO: 2027817 - DNA, 20 bp, Homo sapiens
attccaaacttctaaatgtt

SEQ ID NO: 2027818 - DNA, 14 bp, Homo sapiens
attccaacagctca

SEQ ID NO: 2027819 - DNA, 22 bp, Homo sapiens
attccaagattaaaagttcata

SEQ ID NO: 2027820 - DNA, 19 bp, Homo sapiens
attccaagtcaacactctt

SEQ ID NO: 2027821 - DNA, 12 bp, Homo sapiens
attccactggac

SEQ ID NO: 2027822 - DNA, 17 bp, Homo sapiens
attccagacctgaagaa

SEQ ID NO: 2027823 - DNA, 18 bp, Homo sapiens
attccagagagtggctcc

SEQ ID NO: 2027824 - DNA, 19 bp, Homo sapiens
attccagagagtggctcct

SEQ ID NO: 2027825 - DNA, 18 bp, Homo sapiens
attgacaataatttcagg

SEQ ID NO: 2027826 - DNA, 20 bp, Homo sapiens
attgacaataatttcaggtt

SEQ ID NO: 2027827 - DNA, 15 bp, Homo sapiens
attgacacacagcac

SEQ ID NO: 2027828 - DNA, 23 bp, Homo sapiens
attgacctcagctgcacattcct

SEQ ID NO: 2027829 - DNA, 18 bp, Homo sapiens
attgactatcaaactgaa

SEQ ID NO: 2027830 - DNA, 21 bp, Homo sapiens
attgactatcaaactgaagcc

SEQ ID NO: 2027831 - DNA, 20 bp, Homo sapiens
attgagaagttttgtacaga

SEQ ID NO: 2027832 - DNA, 17 bp, Homo sapiens
attgagaattttaaatt

SEQ ID NO: 2027833 - DNA, 18 bp, Homo sapiens
attgagccattttttaaa

SEQ ID NO: 2027834 - DNA, 17 bp, Homo sapiens
attgagctgcagaaacg

SEQ ID NO: 2027835 - DNA, 14 bp, Homo sapiens
attgagggaaaaca

SEQ ID NO: 2027836 - DNA, 17 bp, Homo sapiens
attgagggaaaacataa

SEQ ID NO: 2027837 - DNA, 19 bp, Homo sapiens
attgagtttaagtctctga

SEQ ID NO: 2027838 - DNA, 13 bp, Homo sapiens
attgatacttcag

SEQ ID NO: 2027839 - DNA, 14 bp, Homo sapiens
attgatacttcagg

SEQ ID NO: 2027840 - DNA, 14 bp, Homo sapiens
attgatatgaaaaa

SEQ ID NO: 2027841 - DNA, 15 bp, Homo sapiens
attgatcaaattcat

SEQ ID NO: 2027842 - DNA, 17 bp, Homo sapiens
attgatcaaattcattt

SEQ ID NO: 2027843 - DNA, 17 bp, Homo sapiens
attgatcttttcagtgt

SEQ ID NO: 2027844 - DNA, 22 bp, Homo sapiens
attgatgtttccagaaaatata

SEQ ID NO: 2027845 - DNA, 14 bp, Homo sapiens
attgattaaaatct

SEQ ID NO: 2027846 - DNA, 16 bp, Homo sapiens
attgatttcaagacct

SEQ ID NO: 2027847 - DNA, 14 bp, Homo sapiens
attgatttgaccca

SEQ ID NO: 2027848 - DNA, 21 bp, Homo sapiens
attgatttttgtaataaaagg

SEQ ID NO: 2027849 - DNA, 22 bp, Homo sapiens
attgcaaagtcgacatactcat

SEQ ID NO: 2027850 - DNA, 17 bp, Homo sapiens
attgcaacaggctgggc

SEQ ID NO: 2027851 - DNA, 9 bp, Homo sapiens
attgcacaa

SEQ ID NO: 2027852 - DNA, 13 bp, Homo sapiens
attgcacaatttg

SEQ ID NO: 2027853 - DNA, 16 bp, Homo sapiens
attgcacaatttgagc

SEQ ID NO: 2027854 - DNA, 13 bp, Homo sapiens
attgcacttttaa

SEQ ID NO: 2027855 - DNA, 21 bp, Homo sapiens
attgcagttcaaatcctcacc

SEQ ID NO: 2027856 - DNA, 16 bp, Homo sapiens
attgcatatatacata

SEQ ID NO: 2027857 - DNA, 13 bp, Homo sapiens
attgcatgtaaaa

SEQ ID NO: 2027858 - DNA, 19 bp, Homo sapiens
attgcattctgaatgaata

SEQ ID NO: 2027859 - DNA, 21 bp, Homo sapiens
attgcattctgaatgaataaa

SEQ ID NO: 2027860 - DNA, 15 bp, Homo sapiens
attgcatttctgctc

SEQ ID NO: 2027861 - DNA, 15 bp, Homo sapiens
attgccccagagccc

SEQ ID NO: 2027862 - DNA, 10 bp, Homo sapiens
attgcctcca

SEQ ID NO: 2027863 - DNA, 15 bp, Homo sapiens
attgctactgtccta

SEQ ID NO: 2027864 - DNA, 23 bp, Homo sapiens
attgctagtgatttcattaccaa

SEQ ID NO: 2027865 - DNA, 15 bp, Homo sapiens
attgctgctggtaat

SEQ ID NO: 2027866 - DNA, 16 bp, Homo sapiens
attgctgttgttgcag

SEQ ID NO: 2027867 - DNA, 17 bp, Homo sapiens
attgcttaaaatagcaa

SEQ ID NO: 2027868 - DNA, 13 bp, Homo sapiens
attgcttacattt

SEQ ID NO: 2027869 - DNA, 14 bp, Homo sapiens
attgcttacatttt

SEQ ID NO: 2027870 - DNA, 16 bp, Homo sapiens
attgcttattcttgag

SEQ ID NO: 2027871 - DNA, 22 bp, Homo sapiens
attgcttcttgtgaaaccacag

SEQ ID NO: 2027872 - DNA, 23 bp, Homo sapiens
attgctttgaagcagttgtgtca

SEQ ID NO: 2027873 - DNA, 14 bp, Homo sapiens
attggaagaaattc

SEQ ID NO: 2027874 - DNA, 21 bp, Homo sapiens
attggaagtgttcaagaaata

SEQ ID NO: 2027875 - DNA, 15 bp, Homo sapiens
attggaattctggat

SEQ ID NO: 2027876 - DNA, 19 bp, Homo sapiens
attggattattcatttaaa

SEQ ID NO: 2027877 - DNA, 21 bp, Homo sapiens
attggattattcatttaaaat

SEQ ID NO: 2027878 - DNA, 20 bp, Homo sapiens
attggcagttggaggacaca

SEQ ID NO: 2027879 - DNA, 13 bp, Homo sapiens
attggccactggg

SEQ ID NO: 2027880 - DNA, 14 bp, Homo sapiens
attggccagagagt

SEQ ID NO: 2027881 - DNA, 15 bp, Homo sapiens
attggctataacatg

SEQ ID NO: 2027882 - DNA, 22 bp, Homo sapiens
attggctcctccatctagagat

SEQ ID NO: 2027883 - DNA, 18 bp, Homo sapiens
attgggaagctgggggaa

SEQ ID NO: 2027884 - DNA, 19 bp, Homo sapiens
attgggagggacagggctt

SEQ ID NO: 2027885 - DNA, 19 bp, Homo sapiens
attggggaagactgtggct

SEQ ID NO: 2027886 - DNA, 16 bp, Homo sapiens
attgggttttatcagt

SEQ ID NO: 2027887 - DNA, 18 bp, Homo sapiens
attggtatcaagaaagtc

SEQ ID NO: 2027888 - DNA, 16 bp, Homo sapiens
attggtctttctacat

SEQ ID NO: 2027889 - DNA, 16 bp, Homo sapiens
attggtgacaatgtca

SEQ ID NO: 2027890 - DNA, 13 bp, Homo sapiens
attggtgataagt

SEQ ID NO: 2027891 - DNA, 15 bp, Homo sapiens
attggtgataagtgg

SEQ ID NO: 2027892 - DNA, 16 bp, Homo sapiens
attggtgataagtgga

SEQ ID NO: 2027893 - DNA, 13 bp, Homo sapiens
attggtgttgccc

SEQ ID NO: 2027894 - DNA, 14 bp, Homo sapiens
attgtaaaaacaaa

SEQ ID NO: 2027895 - DNA, 15 bp, Homo sapiens
attgtaaacatgtgt

SEQ ID NO: 2027896 - DNA, 16 bp, Homo sapiens
attgtaaacatgtgtt

SEQ ID NO: 2027897 - DNA, 14 bp, Homo sapiens
attgtaaatgtgct

SEQ ID NO: 2027898 - DNA, 18 bp, Homo sapiens
attgtaaatttggattta

SEQ ID NO: 2027899 - DNA, 19 bp, Homo sapiens
attgtaaattttagagcat

SEQ ID NO: 2027900 - DNA, 13 bp, Homo sapiens
attgtaatgaata

SEQ ID NO: 2027901 - DNA, 15 bp, Homo sapiens
attgtacactatcta

SEQ ID NO: 2027902 - DNA, 19 bp, Homo sapiens
attgtacatatggaaatcc

SEQ ID NO: 2027903 - DNA, 18 bp, Homo sapiens
attgtacctctcttatag

SEQ ID NO: 2027904 - DNA, 15 bp, Homo sapiens
attgtagcatttctt

SEQ ID NO: 2027905 - DNA, 19 bp, Homo sapiens
attgtagggttattagtcc

SEQ ID NO: 2027906 - DNA, 17 bp, Homo sapiens
attgtataaaaatagaa

SEQ ID NO: 2027907 - DNA, 17 bp, Homo sapiens
attgtataaactatcag

SEQ ID NO: 2027908 - DNA, 15 bp, Homo sapiens
attgtatagagatat

SEQ ID NO: 2027909 - DNA, 21 bp, Homo sapiens
attgtatagagatatgcagaa

SEQ ID NO: 2027910 - DNA, 22 bp, Homo sapiens
attgtatatatgtgtgtttaaa

SEQ ID NO: 2027911 - DNA, 15 bp, Homo sapiens
attgtatattctgga

SEQ ID NO: 2027912 - DNA, 15 bp, Homo sapiens
attgtcattactgcc

SEQ ID NO: 2027913 - DNA, 16 bp, Homo sapiens
attgtcattactgcct

SEQ ID NO: 2027914 - DNA, 18 bp, Homo sapiens
attgtcattactgccttt

SEQ ID NO: 2027915 - DNA, 13 bp, Homo sapiens
attgtcatttata

SEQ ID NO: 2027916 - DNA, 14 bp, Homo sapiens
attgtccatgccta

SEQ ID NO: 2027917 - DNA, 15 bp, Homo sapiens
attgtccttcagagc

SEQ ID NO: 2027918 - DNA, 19 bp, Homo sapiens
attgtctagaagcggtttc

SEQ ID NO: 2027919 - DNA, 16 bp, Homo sapiens
attgtctcagtgctgg

SEQ ID NO: 2027920 - DNA, 17 bp, Homo sapiens
attgtcttccaacccca

SEQ ID NO: 2027921 - DNA, 19 bp, Homo sapiens
attgtcttccaaccccagc

SEQ ID NO: 2027922 - DNA, 23 bp, Homo sapiens
attgtcttccaaccccagctggc

SEQ ID NO: 2027923 - DNA, 16 bp, Homo sapiens
attgtgaccaagttat

SEQ ID NO: 2027924 - DNA, 17 bp, Homo sapiens
attgtgcaatgtaaata

SEQ ID NO: 2027925 - DNA, 20 bp, Homo sapiens
attgtgcaatgtaaatattt

SEQ ID NO: 2027926 - DNA, 22 bp, Homo sapiens
attgtgccatgtcaaacaaata

SEQ ID NO: 2027927 - DNA, 19 bp, Homo sapiens
attgtgcctatgataaatt

SEQ ID NO: 2027928 - DNA, 12 bp, Homo sapiens
attgtgtgttag

SEQ ID NO: 2027929 - DNA, 19 bp, Homo sapiens
attgttaaaaccttactta

SEQ ID NO: 2027930 - DNA, 23 bp, Homo sapiens
attgttcatgttaccaaagcaat

SEQ ID NO: 2027931 - DNA, 22 bp, Homo sapiens
attgttgtgggctttctccggg

SEQ ID NO: 2027932 - DNA, 20 bp, Homo sapiens
attgtttaaaaacaggaaaa

SEQ ID NO: 2027933 - DNA, 21 bp, Homo sapiens
attgtttaagtgttgtaaata

SEQ ID NO: 2027934 - DNA, 19 bp, Homo sapiens
attgtttctttaagaaagt

SEQ ID NO: 2027935 - DNA, 20 bp, Homo sapiens
attgtttctttaagaaagta

SEQ ID NO: 2027936 - DNA, 18 bp, Homo sapiens
attgtttggcttcctcct

SEQ ID NO: 2027937 - DNA, 24 bp, Homo sapiens
attgtttgttgattttctagactt

SEQ ID NO: 2027938 - DNA, 18 bp, Homo sapiens
attgttttatcatgacat

SEQ ID NO: 2027939 - DNA, 14 bp, Homo sapiens
atttaaaaaaatca

SEQ ID NO: 2027940 - DNA, 22 bp, Homo sapiens
atttaaaaaataaaaaaataca

SEQ ID NO: 2027941 - DNA, 16 bp, Homo sapiens
atttaaaaccttgatt

SEQ ID NO: 2027942 - DNA, 16 bp, Homo sapiens
atggaaagcagcagct

SEQ ID NO: 2027943 - DNA, 13 bp, Homo sapiens
atggaaatatgtt

SEQ ID NO: 2027944 - DNA, 14 bp, Homo sapiens
atggaaccttccct

SEQ ID NO: 2027945 - DNA, 19 bp, Homo sapiens
atggaacttctaatatatt

SEQ ID NO: 2027946 - DNA, 16 bp, Homo sapiens
atggaagattttaaat

SEQ ID NO: 2027947 - DNA, 17 bp, Homo sapiens
atggaagattttaaatt

SEQ ID NO: 2027948 - DNA, 16 bp, Homo sapiens
atggaaggagacttag

SEQ ID NO: 2027949 - DNA, 15 bp, Homo sapiens
atggaagggaggggt

SEQ ID NO: 2027950 - DNA, 17 bp, Homo sapiens
atggaaggtttgtatat

SEQ ID NO: 2027951 - DNA, 17 bp, Homo sapiens
atggaagtggcagtgaa

SEQ ID NO: 2027952 - DNA, 18 bp, Homo sapiens
atggaagtggcagtgaaa

SEQ ID NO: 2027953 - DNA, 22 bp, Homo sapiens
atggaatacagtgttattttct

SEQ ID NO: 2027954 - DNA, 20 bp, Homo sapiens
atggaatagaaaagatgaga

SEQ ID NO: 2027955 - DNA, 22 bp, Homo sapiens
atggaatagaaaagatgagagg

SEQ ID NO: 2027956 - DNA, 17 bp, Homo sapiens
atggaatttctcccagt

SEQ ID NO: 2027957 - DNA, 12 bp, Homo sapiens
atggaatttgta

SEQ ID NO: 2027958 - DNA, 17 bp, Homo sapiens
atggaatttgtaagttt

SEQ ID NO: 2027959 - DNA, 21 bp, Homo sapiens
atggaatttgtaagtttatgt

SEQ ID NO: 2027960 - DNA, 13 bp, Homo sapiens
atggacacagacc

SEQ ID NO: 2027961 - DNA, 19 bp, Homo sapiens
atggacagaagaaggcagc

SEQ ID NO: 2027962 - DNA, 22 bp, Homo sapiens
atggacccacgaacgctcttag

SEQ ID NO: 2027963 - DNA, 17 bp, Homo sapiens
atggaccctcgcagcag

SEQ ID NO: 2027964 - DNA, 18 bp, Homo sapiens
atggaccctcgcagcagg

SEQ ID NO: 2027965 - DNA, 18 bp, Homo sapiens
atggaccgggtgggcctg

SEQ ID NO: 2027966 - DNA, 23 bp, Homo sapiens
atggaccgggtgggcctggcctg

SEQ ID NO: 2027967 - DNA, 18 bp, Homo sapiens
atggactctgaaaaacat

SEQ ID NO: 2027968 - DNA, 12 bp, Homo sapiens
atggacttcaaa

SEQ ID NO: 2027969 - DNA, 14 bp, Homo sapiens
atggacttcaaatt

SEQ ID NO: 2027970 - DNA, 23 bp, Homo sapiens
atggacttttgggggttggatgg

SEQ ID NO: 2027971 - DNA, 13 bp, Homo sapiens
atggagaaggaag

SEQ ID NO: 2027972 - DNA, 15 bp, Homo sapiens
atggagaaggaaggc

SEQ ID NO: 2027973 - DNA, 14 bp, Homo sapiens
atggagacagcgaa

SEQ ID NO: 2027974 - DNA, 21 bp, Homo sapiens
atggagactggtcctgtgtgc

SEQ ID NO: 2027975 - DNA, 21 bp, Homo sapiens
atggagagagactcaaagaga

SEQ ID NO: 2027976 - DNA, 15 bp, Homo sapiens
atggagagccctggg

SEQ ID NO: 2027977 - DNA, 18 bp, Homo sapiens
atggagagccctgggacc

SEQ ID NO: 2027978 - DNA, 15 bp, Homo sapiens
atggagcctcttctg

SEQ ID NO: 2027979 - DNA, 20 bp, Homo sapiens
atggagcctggcacaggact

SEQ ID NO: 2027980 - DNA, 21 bp, Homo sapiens
atggagcctggcacaggactg

SEQ ID NO: 2027981 - DNA, 23 bp, Homo sapiens
atggagcctggcacaggactgat

SEQ ID NO: 2027982 - DNA, 23 bp, Homo sapiens
atggagcgcacctgccccctggt

SEQ ID NO: 2027983 - DNA, 14 bp, Homo sapiens
atggaggagaaata

SEQ ID NO: 2027984 - DNA, 16 bp, Homo sapiens
atggaggatggagaga

SEQ ID NO: 2027985 - DNA, 20 bp, Homo sapiens
atggaggcaggctccccctg

SEQ ID NO: 2027986 - DNA, 13 bp, Homo sapiens
atggagggagcca

SEQ ID NO: 2027987 - DNA, 21 bp, Homo sapiens
atggagggattattcttccag

SEQ ID NO: 2027988 - DNA, 11 bp, Homo sapiens
atggagggcag

SEQ ID NO: 2027989 - DNA, 14 bp, Homo sapiens
atggagggtggggc

SEQ ID NO: 2027990 - DNA, 22 bp, Homo sapiens
atggagggtggggccgggtgaa

SEQ ID NO: 2027991 - DNA, 22 bp, Homo sapiens
atggagtgacggtcccacactg

SEQ ID NO: 2027992 - DNA, 19 bp, Homo sapiens
atggagtgtgcgtgtgtgc

SEQ ID NO: 2027993 - DNA, 18 bp, Homo sapiens
atggatcccaattcattt

SEQ ID NO: 2027994 - DNA, 16 bp, Homo sapiens
atggatcctggaggat

SEQ ID NO: 2027995 - DNA, 17 bp, Homo sapiens
atggatggacagaatga

SEQ ID NO: 2027996 - DNA, 17 bp, Homo sapiens
atggatgtggggtcccc

SEQ ID NO: 2027997 - DNA, 20 bp, Homo sapiens
atggatgtggggtccccatc

SEQ ID NO: 2027998 - DNA, 12 bp, Homo sapiens
atggattctaaa

SEQ ID NO: 2027999 - DNA, 17 bp, Homo sapiens
atggcaacacgtggagg

SEQ ID NO: 2028000 - DNA, 23 bp, Homo sapiens
atggcaagttttgatatgagtat

SEQ ID NO: 2028001 - DNA, 19 bp, Homo sapiens
atggcaccagccccctgga

SEQ ID NO: 2028002 - DNA, 19 bp, Homo sapiens
atggcagaggaatatcaat

SEQ ID NO: 2028003 - DNA, 20 bp, Homo sapiens
atggcagcagttccatgaag

SEQ ID NO: 2028004 - DNA, 12 bp, Homo sapiens
atggcagctgga

SEQ ID NO: 2028005 - DNA, 15 bp, Homo sapiens
atggcagtgtctttc

SEQ ID NO: 2028006 - DNA, 16 bp, Homo sapiens
atggcatttttttaaa

SEQ ID NO: 2028007 - DNA, 18 bp, Homo sapiens
atggccaccccgtgccac

SEQ ID NO: 2028008 - DNA, 22 bp, Homo sapiens
atggccaccccgtgccacccgt

SEQ ID NO: 2028009 - DNA, 12 bp, Homo sapiens
atggccatggaa

SEQ ID NO: 2028010 - DNA, 14 bp, Homo sapiens
atggccccagggtt

SEQ ID NO: 2028011 - DNA, 18 bp, Homo sapiens
atggccctgcaaaaatat

SEQ ID NO: 2028012 - DNA, 14 bp, Homo sapiens
atggcctctggcca

SEQ ID NO: 2028013 - DNA, 18 bp, Homo sapiens
atggccttccctccccac

SEQ ID NO: 2028014 - DNA, 20 bp, Homo sapiens
atggcgattccctctcaccc

SEQ ID NO: 2028015 - DNA, 23 bp, Homo sapiens
atggcgcgggaggcaccagctct

SEQ ID NO: 2028016 - DNA, 19 bp, Homo sapiens
atggcgtaatgggcctgcc

SEQ ID NO: 2028017 - DNA, 21 bp, Homo sapiens
atggcgtaatgggcctgccca

SEQ ID NO: 2028018 - DNA, 20 bp, Homo sapiens
atggcgtgtccctctcggaa

SEQ ID NO: 2028019 - DNA, 15 bp, Homo sapiens
atggcgttgcaggcc

SEQ ID NO: 2028020 - DNA, 17 bp, Homo sapiens
atggctaattcccagag

SEQ ID NO: 2028021 - DNA, 21 bp, Homo sapiens
atggctataaatatataaaaa

SEQ ID NO: 2028022 - DNA, 15 bp, Homo sapiens
atggctataggtgct

SEQ ID NO: 2028023 - DNA, 19 bp, Homo sapiens
atggctatgtttttaatgt

SEQ ID NO: 2028024 - DNA, 15 bp, Homo sapiens
atggctattataatg

SEQ ID NO: 2028025 - DNA, 19 bp, Homo sapiens
atggctcaggcaagcccct

SEQ ID NO: 2028026 - DNA, 13 bp, Homo sapiens
atggctgcctgca

SEQ ID NO: 2028027 - DNA, 12 bp, Homo sapiens
atggctgtattt

SEQ ID NO: 2028028 - DNA, 19 bp, Homo sapiens
atggctgtgcctctgcctg

SEQ ID NO: 2028029 - DNA, 17 bp, Homo sapiens
atggcttataaatgtgt

SEQ ID NO: 2028030 - DNA, 19 bp, Homo sapiens
atggcttatttgtataatg

SEQ ID NO: 2028031 - DNA, 16 bp, Homo sapiens
atggcttggggagcag

SEQ ID NO: 2028032 - DNA, 20 bp, Homo sapiens
atggctttaaactaccctcc

SEQ ID NO: 2028033 - DNA, 15 bp, Homo sapiens
atggctttaattata

SEQ ID NO: 2028034 - DNA, 20 bp, Homo sapiens
atgggaaagcattgtaaatg

SEQ ID NO: 2028035 - DNA, 14 bp, Homo sapiens
atgggaaagtgcaa

SEQ ID NO: 2028036 - DNA, 18 bp, Homo sapiens
atgggaagatggtagcag

SEQ ID NO: 2028037 - DNA, 19 bp, Homo sapiens
atgggaagatggtagcaga

SEQ ID NO: 2028038 - DNA, 18 bp, Homo sapiens
atgggactgtgcctttgg

SEQ ID NO: 2028039 - DNA, 20 bp, Homo sapiens
atgggagctggttagaaatg

SEQ ID NO: 2028040 - DNA, 22 bp, Homo sapiens
atgggagctggttagaaatgca

SEQ ID NO: 2028041 - DNA, 14 bp, Homo sapiens
atgggagggggctc

SEQ ID NO: 2028042 - DNA, 17 bp, Homo sapiens
atgggatctgtaaggaa

SEQ ID NO: 2028043 - DNA, 23 bp, Homo sapiens
atgggatctgtaaggaactggaa

SEQ ID NO: 2028044 - DNA, 20 bp, Homo sapiens
atgggcaattctgacttctc

SEQ ID NO: 2028045 - DNA, 23 bp, Homo sapiens
atgggcaattctgacttctccca

SEQ ID NO: 2028046 - DNA, 18 bp, Homo sapiens
atgggcacatgaggaggg

SEQ ID NO: 2028047 - DNA, 22 bp, Homo sapiens
atgggcacatgaggagggtgcc

SEQ ID NO: 2028048 - DNA, 11 bp, Homo sapiens
atgggcagtgc

SEQ ID NO: 2028049 - DNA, 15 bp, Homo sapiens
atgggcattgggctg

SEQ ID NO: 2028050 - DNA, 18 bp, Homo sapiens
atgggcattgggctgaca

SEQ ID NO: 2028051 - DNA, 21 bp, Homo sapiens
atgggccaattaaaatatata

SEQ ID NO: 2028052 - DNA, 23 bp, Homo sapiens
atgggccagggtttacccagtgg

SEQ ID NO: 2028053 - DNA, 18 bp, Homo sapiens
atgggcctcctgtgtgtg

SEQ ID NO: 2028054 - DNA, 14 bp, Homo sapiens
atgggcctgcccaa

SEQ ID NO: 2028055 - DNA, 23 bp, Homo sapiens
atgggctagtgtgagtggcagcc

SEQ ID NO: 2028056 - DNA, 20 bp, Homo sapiens
atgggcttggacttcctggg

SEQ ID NO: 2028057 - DNA, 23 bp, Homo sapiens
atgggcttggacttcctggggcc

SEQ ID NO: 2028058 - DNA, 16 bp, Homo sapiens
atgcagattcctgggc

SEQ ID NO: 2028059 - DNA, 20 bp, Homo sapiens
atgcagattcctgggcctgt

SEQ ID NO: 2028060 - DNA, 20 bp, Homo sapiens
atgcagcgaaccaatatttg

SEQ ID NO: 2028061 - DNA, 17 bp, Homo sapiens
atgcagggaagagggca

SEQ ID NO: 2028062 - DNA, 14 bp, Homo sapiens
atgcagtccagaat

SEQ ID NO: 2028063 - DNA, 20 bp, Homo sapiens
atgcagtccagaataagtgc

SEQ ID NO: 2028064 - DNA, 21 bp, Homo sapiens
atgcagtccagaataagtgct

SEQ ID NO: 2028065 - DNA, 17 bp, Homo sapiens
atgcatagtgctaagaa

SEQ ID NO: 2028066 - DNA, 11 bp, Homo sapiens
atgcatatact

SEQ ID NO: 2028067 - DNA, 16 bp, Homo sapiens
atgcatcatcagccta

SEQ ID NO: 2028068 - DNA, 11 bp, Homo sapiens
atgcatgattt

SEQ ID NO: 2028069 - DNA, 17 bp, Homo sapiens
atgcatgattttataca

SEQ ID NO: 2028070 - DNA, 21 bp, Homo sapiens
atgcatgattttatacatagt

SEQ ID NO: 2028071 - DNA, 12 bp, Homo sapiens
atgcatggaaac

SEQ ID NO: 2028072 - DNA, 23 bp, Homo sapiens
atgcatggaaacctgaaaaaaag

SEQ ID NO: 2028073 - DNA, 19 bp, Homo sapiens
atgcatggtgcagttgaca

SEQ ID NO: 2028074 - DNA, 16 bp, Homo sapiens
atgcattgtcttgtgg

SEQ ID NO: 2028075 - DNA, 18 bp, Homo sapiens
atgcattgtcttgtggag

SEQ ID NO: 2028076 - DNA, 15 bp, Homo sapiens
atgcatttaattctg

SEQ ID NO: 2028077 - DNA, 14 bp, Homo sapiens
atgcatttccacac

SEQ ID NO: 2028078 - DNA, 21 bp, Homo sapiens
atgcattttcaagatacattt

SEQ ID NO: 2028079 - DNA, 18 bp, Homo sapiens
atgcattttgcagcagtg

SEQ ID NO: 2028080 - DNA, 19 bp, Homo sapiens
atgcattttgcagcagtga

SEQ ID NO: 2028081 - DNA, 15 bp, Homo sapiens
atgccaacaccttct

SEQ ID NO: 2028082 - DNA, 21 bp, Homo sapiens
atgccaacatacccttcttta

SEQ ID NO: 2028083 - DNA, 15 bp, Homo sapiens
atgccacccagcaac

SEQ ID NO: 2028084 - DNA, 14 bp, Homo sapiens
atgccaccctctcc

SEQ ID NO: 2028085 - DNA, 16 bp, Homo sapiens
atgccaccctctccat

SEQ ID NO: 2028086 - DNA, 20 bp, Homo sapiens
atgccaccctgttttcagct

SEQ ID NO: 2028087 - DNA, 14 bp, Homo sapiens
atgccactgccagg

SEQ ID NO: 2028088 - DNA, 15 bp, Homo sapiens
atgccactgccaggc

SEQ ID NO: 2028089 - DNA, 18 bp, Homo sapiens
atgccactgccaggcacc

SEQ ID NO: 2028090 - DNA, 19 bp, Homo sapiens
atgccactgccaggcacct

SEQ ID NO: 2028091 - DNA, 21 bp, Homo sapiens
atgccactgccaggcacctgg

SEQ ID NO: 2028092 - DNA, 21 bp, Homo sapiens
atgccactgctttccagcctg

SEQ ID NO: 2028093 - DNA, 22 bp, Homo sapiens
atgccagagacggaagcctttt

SEQ ID NO: 2028094 - DNA, 18 bp, Homo sapiens
atgccagctcagtcccat

SEQ ID NO: 2028095 - DNA, 19 bp, Homo sapiens
atgccagctcagtcccatc

SEQ ID NO: 2028096 - DNA, 20 bp, Homo sapiens
atgccagcttcctgtgggcc

SEQ ID NO: 2028097 - DNA, 19 bp, Homo sapiens
atgccaggctaatttttat

SEQ ID NO: 2028098 - DNA, 17 bp, Homo sapiens
atgccaggttaggaagg

SEQ ID NO: 2028099 - DNA, 19 bp, Homo sapiens
atgccatggacagaagaag

SEQ ID NO: 2028100 - DNA, 12 bp, Homo sapiens
atgcccagttca

SEQ ID NO: 2028101 - DNA, 20 bp, Homo sapiens
atgcccctgtactccagcct

SEQ ID NO: 2028102 - DNA, 22 bp, Homo sapiens
atgccctaagtgttgaagaaga

SEQ ID NO: 2028103 - DNA, 13 bp, Homo sapiens
atgccctccaatc

SEQ ID NO: 2028104 - DNA, 19 bp, Homo sapiens
atgccgctcttctgtcatc

SEQ ID NO: 2028105 - DNA, 21 bp, Homo sapiens
atgccgctcttctgtcatccc

SEQ ID NO: 2028106 - DNA, 21 bp, Homo sapiens
atgcctaatatttaggcaaga

SEQ ID NO: 2028107 - DNA, 13 bp, Homo sapiens
atgcctacagata

SEQ ID NO: 2028108 - DNA, 15 bp, Homo sapiens
atgcctcagtttccc

SEQ ID NO: 2028109 - DNA, 20 bp, Homo sapiens
atgcctccaaaaattcacat

SEQ ID NO: 2028110 - DNA, 19 bp, Homo sapiens
atgcctccaagccattcac

SEQ ID NO: 2028111 - DNA, 17 bp, Homo sapiens
atgcctctgaggccagc

SEQ ID NO: 2028112 - DNA, 22 bp, Homo sapiens
atgcctctgaggccagcctggc

SEQ ID NO: 2028113 - DNA, 22 bp, Homo sapiens
atgcctctgatatgggactgag

SEQ ID NO: 2028114 - DNA, 17 bp, Homo sapiens
atgcctgagggtggaga

SEQ ID NO: 2028115 - DNA, 13 bp, Homo sapiens
atgcctggccccc

SEQ ID NO: 2028116 - DNA, 18 bp, Homo sapiens
atgcctggcccccctcca

SEQ ID NO: 2028117 - DNA, 19 bp, Homo sapiens
atgcctggcccccctccag

SEQ ID NO: 2028118 - DNA, 17 bp, Homo sapiens
atgcctggtggcagctg

SEQ ID NO: 2028119 - DNA, 18 bp, Homo sapiens
atgcctggtggcagctgc

SEQ ID NO: 2028120 - DNA, 20 bp, Homo sapiens
atgcctgtcagtttcatgga

SEQ ID NO: 2028121 - DNA, 18 bp, Homo sapiens
atgccttatgtaattatt

SEQ ID NO: 2028122 - DNA, 14 bp, Homo sapiens
atgccttcctgtct

SEQ ID NO: 2028123 - DNA, 19 bp, Homo sapiens
atgccttgacaacagactg

SEQ ID NO: 2028124 - DNA, 22 bp, Homo sapiens
atgccttgagtctttaatccca

SEQ ID NO: 2028125 - DNA, 17 bp, Homo sapiens
atgcctttagatgtgag

SEQ ID NO: 2028126 - DNA, 22 bp, Homo sapiens
atgcctttctagtcctattcta

SEQ ID NO: 2028127 - DNA, 14 bp, Homo sapiens
atgccttttatttc

SEQ ID NO: 2028128 - DNA, 21 bp, Homo sapiens
atgccttttcccaaaatgttg

SEQ ID NO: 2028129 - DNA, 18 bp, Homo sapiens
atgcgaaaacttgaatct

SEQ ID NO: 2028130 - DNA, 21 bp, Homo sapiens
atgcgcaagggcaaaccattt

SEQ ID NO: 2028131 - DNA, 16 bp, Homo sapiens
atgcgcaatgtggcat

SEQ ID NO: 2028132 - DNA, 21 bp, Homo sapiens
atgcgtacgtttcctgagaag

SEQ ID NO: 2028133 - DNA, 17 bp, Homo sapiens
atgcgtcccaagcagcc

SEQ ID NO: 2028134 - DNA, 23 bp, Homo sapiens
atgctaaaggttgtattgcatat

SEQ ID NO: 2028135 - DNA, 16 bp, Homo sapiens
atgctaagagaagtag

SEQ ID NO: 2028136 - DNA, 21 bp, Homo sapiens
atgctacagtactatgtaaat

SEQ ID NO: 2028137 - DNA, 19 bp, Homo sapiens
atgctaccatgcctctcca

SEQ ID NO: 2028138 - DNA, 17 bp, Homo sapiens
atgctcaaccactgtgg

SEQ ID NO: 2028139 - DNA, 15 bp, Homo sapiens
atgctcaagtttttc

SEQ ID NO: 2028140 - DNA, 16 bp, Homo sapiens
atgctcaagtttttca

SEQ ID NO: 2028141 - DNA, 15 bp, Homo sapiens
atgctcacagtctca

SEQ ID NO: 2028142 - DNA, 16 bp, Homo sapiens
atgctcgtgtgatttc

SEQ ID NO: 2028143 - DNA, 17 bp, Homo sapiens
atgctcgtgtgatttcc

SEQ ID NO: 2028144 - DNA, 22 bp, Homo sapiens
atgctctctgcagccagcccag

SEQ ID NO: 2028145 - DNA, 21 bp, Homo sapiens
atgctctgccccaagccccca

SEQ ID NO: 2028146 - DNA, 15 bp, Homo sapiens
atgctgaatgaatcc

SEQ ID NO: 2028147 - DNA, 13 bp, Homo sapiens
atgctgaattatt

SEQ ID NO: 2028148 - DNA, 21 bp, Homo sapiens
atgctgactgtactcctccca

SEQ ID NO: 2028149 - DNA, 18 bp, Homo sapiens
atgctgacttgcagagtt

SEQ ID NO: 2028150 - DNA, 14 bp, Homo sapiens
atgctgccaaattt

SEQ ID NO: 2028151 - DNA, 22 bp, Homo sapiens
atgctgccccgttccctgtcag

SEQ ID NO: 2028152 - DNA, 23 bp, Homo sapiens
atgctggcctcccaataaagctg

SEQ ID NO: 2028153 - DNA, 19 bp, Homo sapiens
atgctggctgttggctggg

SEQ ID NO: 2028154 - DNA, 19 bp, Homo sapiens
atgctgtagaatgcttggc

SEQ ID NO: 2028155 - DNA, 18 bp, Homo sapiens
atgctgtgctctttgaag

SEQ ID NO: 2028156 - DNA, 17 bp, Homo sapiens
atgctgttgcctcatct

SEQ ID NO: 2028157 - DNA, 15 bp, Homo sapiens
atgctgttttaataa

SEQ ID NO: 2028158 - DNA, 18 bp, Homo sapiens
atgcttaaaatatgtatg

SEQ ID NO: 2028159 - DNA, 18 bp, Homo sapiens
atgcttcagttgtacttc

SEQ ID NO: 2028160 - DNA, 14 bp, Homo sapiens
atgcttcttgcccc

SEQ ID NO: 2028161 - DNA, 22 bp, Homo sapiens
atgcttcttgccccttgggcct

SEQ ID NO: 2028162 - DNA, 22 bp, Homo sapiens
atgctttcctaaagtctctgct

SEQ ID NO: 2028163 - DNA, 13 bp, Homo sapiens
atgctttctcctt

SEQ ID NO: 2028164 - DNA, 22 bp, Homo sapiens
atgctttgtcttcagcctctcc

SEQ ID NO: 2028165 - DNA, 22 bp, Homo sapiens
atgctttgtgtgattgaatctg

SEQ ID NO: 2028166 - DNA, 13 bp, Homo sapiens
atggaaaagccca

SEQ ID NO: 2028167 - DNA, 19 bp, Homo sapiens
atggaaaagcccagtgacc

SEQ ID NO: 2028168 - DNA, 16 bp, Homo sapiens
atggaaaataaattat

SEQ ID NO: 2028169 - DNA, 14 bp, Homo sapiens
atggaaacagggca

SEQ ID NO: 2028170 - DNA, 17 bp, Homo sapiens
atggaaacagggcagtg

SEQ ID NO: 2028171 - DNA, 16 bp, Homo sapiens
atggaaacctgaaaaa

SEQ ID NO: 2028172 - DNA, 15 bp, Homo sapiens
atggaaactggccag

SEQ ID NO: 2028173 - DNA, 20 bp, Homo sapiens
atggaaactggccaggggtc

SEQ ID NO: 2028174 - DNA, 15 bp, Homo sapiens
agctggtttcctcat

SEQ ID NO: 2028175 - DNA, 21 bp, Homo sapiens
agctggtttcctcattcctga

SEQ ID NO: 2028176 - DNA, 22 bp, Homo sapiens
agctggtttcctcattcctgaa

SEQ ID NO: 2028177 - DNA, 20 bp, Homo sapiens
agctggtttgtcaaacaaca

SEQ ID NO: 2028178 - DNA, 22 bp, Homo sapiens
agctggtttttagcggagacgg

SEQ ID NO: 2028179 - DNA, 13 bp, Homo sapiens
agctgtactcaga

SEQ ID NO: 2028180 - DNA, 14 bp, Homo sapiens
agctgtactcagag

SEQ ID NO: 2028181 - DNA, 15 bp, Homo sapiens
agctgtactcagagc

SEQ ID NO: 2028182 - DNA, 17 bp, Homo sapiens
agctgtactcagagcag

SEQ ID NO: 2028183 - DNA, 16 bp, Homo sapiens
agctgtagaaatgtat

SEQ ID NO: 2028184 - DNA, 14 bp, Homo sapiens
agctgtagccatgg

SEQ ID NO: 2028185 - DNA, 16 bp, Homo sapiens
agctgtagccatggct

SEQ ID NO: 2028186 - DNA, 19 bp, Homo sapiens
agctgtagccatggctcag

SEQ ID NO: 2028187 - DNA, 21 bp, Homo sapiens
agctgtagccatggctcaggc

SEQ ID NO: 2028188 - DNA, 20 bp, Homo sapiens
agctgtaggtgtgcgggacc

SEQ ID NO: 2028189 - DNA, 10 bp, Homo sapiens
agctgtcatg

SEQ ID NO: 2028190 - DNA, 19 bp, Homo sapiens
agctgtcatggaaaagccc

SEQ ID NO: 2028191 - DNA, 22 bp, Homo sapiens
agctgtcatggaaaagcccagt

SEQ ID NO: 2028192 - DNA, 14 bp, Homo sapiens
agctgtccctgtca

SEQ ID NO: 2028193 - DNA, 14 bp, Homo sapiens
agctgtctccagga

SEQ ID NO: 2028194 - DNA, 16 bp, Homo sapiens
agctgtctgtggcttc

SEQ ID NO: 2028195 - DNA, 23 bp, Homo sapiens
agctgtgacctgctgagctctga

SEQ ID NO: 2028196 - DNA, 18 bp, Homo sapiens
agctgtgtccttgcacct

SEQ ID NO: 2028197 - DNA, 13 bp, Homo sapiens
agctgtgtgaaat

SEQ ID NO: 2028198 - DNA, 19 bp, Homo sapiens
agctgttatttctattttt

SEQ ID NO: 2028199 - DNA, 17 bp, Homo sapiens
agctgttgagctgtttt

SEQ ID NO: 2028200 - DNA, 16 bp, Homo sapiens
agctgttggcctcgcc

SEQ ID NO: 2028201 - DNA, 15 bp, Homo sapiens
agctgttggcctggg

SEQ ID NO: 2028202 - DNA, 13 bp, Homo sapiens
agctgtttattta

SEQ ID NO: 2028203 - DNA, 19 bp, Homo sapiens
agctgtttatttattcact

SEQ ID NO: 2028204 - DNA, 20 bp, Homo sapiens
agctgtttatttattcactg

SEQ ID NO: 2028205 - DNA, 13 bp, Homo sapiens
agcttaaaacttt

SEQ ID NO: 2028206 - DNA, 16 bp, Homo sapiens
agcttaaaactttgaa

SEQ ID NO: 2028207 - DNA, 22 bp, Homo sapiens
agcttaaaactttgaagttagc

SEQ ID NO: 2028208 - DNA, 19 bp, Homo sapiens
agcttaaaattggtaattg

SEQ ID NO: 2028209 - DNA, 12 bp, Homo sapiens
agcttaaataaa

SEQ ID NO: 2028210 - DNA, 14 bp, Homo sapiens
agcttaaataaatt

SEQ ID NO: 2028211 - DNA, 16 bp, Homo sapiens
agcttaaataaattca

SEQ ID NO: 2028212 - DNA, 24 bp, Homo sapiens
agcttaaattgcttttgttgtgac

SEQ ID NO: 2028213 - DNA, 22 bp, Homo sapiens
agcttaacattgacttcttggt

SEQ ID NO: 2028214 - DNA, 18 bp, Homo sapiens
agcttaagtataattaat

SEQ ID NO: 2028215 - DNA, 19 bp, Homo sapiens
agcttaatggctgataatt

SEQ ID NO: 2028216 - DNA, 22 bp, Homo sapiens
agcttaatggctgataatttta

SEQ ID NO: 2028217 - DNA, 15 bp, Homo sapiens
agcttacctgacaca

SEQ ID NO: 2028218 - DNA, 15 bp, Homo sapiens
agcttagacctcagc

SEQ ID NO: 2028219 - DNA, 17 bp, Homo sapiens
agcttagacctcagcct

SEQ ID NO: 2028220 - DNA, 19 bp, Homo sapiens
agcttagacctcagcctgt

SEQ ID NO: 2028221 - DNA, 20 bp, Homo sapiens
agcttagacctcagcctgtg

SEQ ID NO: 2028222 - DNA, 13 bp, Homo sapiens
agcttagccttgt

SEQ ID NO: 2028223 - DNA, 20 bp, Homo sapiens
agcttagccttgtgccctgc

SEQ ID NO: 2028224 - DNA, 21 bp, Homo sapiens
agcttagccttgtgccctgcc

SEQ ID NO: 2028225 - DNA, 19 bp, Homo sapiens
agcttatcatgctgtcttt

SEQ ID NO: 2028226 - DNA, 18 bp, Homo sapiens
agcttatggggtatttta

SEQ ID NO: 2028227 - DNA, 15 bp, Homo sapiens
agcttattaaaactc

SEQ ID NO: 2028228 - DNA, 17 bp, Homo sapiens
agcttattggccactgg

SEQ ID NO: 2028229 - DNA, 20 bp, Homo sapiens
agcttattggccactgggtc

SEQ ID NO: 2028230 - DNA, 12 bp, Homo sapiens
agcttcaaagct

SEQ ID NO: 2028231 - DNA, 21 bp, Homo sapiens
agcttcaagtgatatatgtat

SEQ ID NO: 2028232 - DNA, 23 bp, Homo sapiens
agcttcagacttttatcaaaatc

SEQ ID NO: 2028233 - DNA, 12 bp, Homo sapiens
agcttcagagcc

SEQ ID NO: 2028234 - DNA, 13 bp, Homo sapiens
agcttcagagcct

SEQ ID NO: 2028235 - DNA, 16 bp, Homo sapiens
agcttcagagcctagc

SEQ ID NO: 2028236 - DNA, 18 bp, Homo sapiens
agcttcagagcctagcca

SEQ ID NO: 2028237 - DNA, 21 bp, Homo sapiens
agcttcatcaatttttataca

SEQ ID NO: 2028238 - DNA, 16 bp, Homo sapiens
agcttcatgcctcagt

SEQ ID NO: 2028239 - DNA, 18 bp, Homo sapiens
agcttcatgcctcagttt

SEQ ID NO: 2028240 - DNA, 21 bp, Homo sapiens
agcttcatgcctcagtttccc

SEQ ID NO: 2028241 - DNA, 23 bp, Homo sapiens
agcttcatgcctcagtttcccca

SEQ ID NO: 2028242 - DNA, 16 bp, Homo sapiens
agcttcatttccgtga

SEQ ID NO: 2028243 - DNA, 18 bp, Homo sapiens
agcttcatttcctgtgtc

SEQ ID NO: 2028244 - DNA, 19 bp, Homo sapiens
agcttcatttcctgtgtct

SEQ ID NO: 2028245 - DNA, 16 bp, Homo sapiens
agcttcccctcgctgt

SEQ ID NO: 2028246 - DNA, 20 bp, Homo sapiens
agcttcccctcgctgtcctg

SEQ ID NO: 2028247 - DNA, 21 bp, Homo sapiens
agcttcccctcgctgtcctgc

SEQ ID NO: 2028248 - DNA, 22 bp, Homo sapiens
agcttcccctcgctgtcctgct

SEQ ID NO: 2028249 - DNA, 15 bp, Homo sapiens
agcttcctgtcaaca

SEQ ID NO: 2028250 - DNA, 22 bp, Homo sapiens
agcttcctgtgggccaggagct

SEQ ID NO: 2028251 - DNA, 17 bp, Homo sapiens
agcttctatcccaggag

SEQ ID NO: 2028252 - DNA, 12 bp, Homo sapiens
agcttctccagg

SEQ ID NO: 2028253 - DNA, 14 bp, Homo sapiens
agcttctccaggct

SEQ ID NO: 2028254 - DNA, 15 bp, Homo sapiens
agcttctccaggctc

SEQ ID NO: 2028255 - DNA, 23 bp, Homo sapiens
agcttctccaggctctttggggt

SEQ ID NO: 2028256 - DNA, 13 bp, Homo sapiens
agcttctctgtga

SEQ ID NO: 2028257 - DNA, 14 bp, Homo sapiens
agcttctctgtgaa

SEQ ID NO: 2028258 - DNA, 19 bp, Homo sapiens
agcttgaaggatctgtttt

SEQ ID NO: 2028259 - DNA, 22 bp, Homo sapiens
agcttgaccagacctagacctg

SEQ ID NO: 2028260 - DNA, 23 bp, Homo sapiens
agcttgagcctgtcacgtggtca

SEQ ID NO: 2028261 - DNA, 15 bp, Homo sapiens
agcttgcaagaagca

SEQ ID NO: 2028262 - DNA, 16 bp, Homo sapiens
agcttgccctgttaaa

SEQ ID NO: 2028263 - DNA, 18 bp, Homo sapiens
agcttgccctgttaaaag

SEQ ID NO: 2028264 - DNA, 14 bp, Homo sapiens
agcttgggaatgga

SEQ ID NO: 2028265 - DNA, 18 bp, Homo sapiens
agcttgggtttttgttac

SEQ ID NO: 2028266 - DNA, 18 bp, Homo sapiens
agcttgtaaatagctcag

SEQ ID NO: 2028267 - DNA, 16 bp, Homo sapiens
agcttgtagccagccg

SEQ ID NO: 2028268 - DNA, 19 bp, Homo sapiens
agcttgtatatacatatta

SEQ ID NO: 2028269 - DNA, 21 bp, Homo sapiens
agcttgtatatacatattata

SEQ ID NO: 2028270 - DNA, 22 bp, Homo sapiens
agcttgtatatacatattataa

SEQ ID NO: 2028271 - DNA, 17 bp, Homo sapiens
agcttgtgagagctggt

SEQ ID NO: 2028272 - DNA, 17 bp, Homo sapiens
agcttgtttgttctagt

SEQ ID NO: 2028273 - DNA, 15 bp, Homo sapiens
agctttacatgcaat

SEQ ID NO: 2028274 - DNA, 14 bp, Homo sapiens
agctttaccagctg

SEQ ID NO: 2028275 - DNA, 21 bp, Homo sapiens
agctttatctgtcacacaagg

SEQ ID NO: 2028276 - DNA, 22 bp, Homo sapiens
agctttcaaaaattagtgaagt

SEQ ID NO: 2028277 - DNA, 15 bp, Homo sapiens
agctttcagagccag

SEQ ID NO: 2028278 - DNA, 19 bp, Homo sapiens
agctttcagagccagtgaa

SEQ ID NO: 2028279 - DNA, 21 bp, Homo sapiens
agctttcccaaataaactcta

SEQ ID NO: 2028280 - DNA, 13 bp, Homo sapiens
agctttctccttt

SEQ ID NO: 2028281 - DNA, 14 bp, Homo sapiens
agctttctcctttg

SEQ ID NO: 2028282 - DNA, 11 bp, Homo sapiens
agctttcttct

SEQ ID NO: 2028283 - DNA, 15 bp, Homo sapiens
agctttcttctacaa

SEQ ID NO: 2028284 - DNA, 21 bp, Homo sapiens
agctttcttctacaaccagag

SEQ ID NO: 2028285 - DNA, 23 bp, Homo sapiens
agctttcttctacaaccagagcc

SEQ ID NO: 2028286 - DNA, 21 bp, Homo sapiens
agctttgaatacccccagaga

SEQ ID NO: 2028287 - DNA, 22 bp, Homo sapiens
agctttgaatacccccagagac

SEQ ID NO: 2028288 - DNA, 14 bp, Homo sapiens
agcttttcccagga

SEQ ID NO: 2028289 - DNA, 13 bp, Homo sapiens
agcttttcccttc

SEQ ID NO: 2028290 - DNA, 18 bp, Homo sapiens
atgagaagagggcctgtg

SEQ ID NO: 2028291 - DNA, 18 bp, Homo sapiens
atgagaccactgttatca

SEQ ID NO: 2028292 - DNA, 13 bp, Homo sapiens
atgagagaatggg

SEQ ID NO: 2028293 - DNA, 19 bp, Homo sapiens
atgagagtggcttaaaaac

SEQ ID NO: 2028294 - DNA, 22 bp, Homo sapiens
atgagatctaagcctttccata

SEQ ID NO: 2028295 - DNA, 13 bp, Homo sapiens
atgagcagtcaca

SEQ ID NO: 2028296 - DNA, 23 bp, Homo sapiens
atgagccgctgtgagcccctggt

SEQ ID NO: 2028297 - DNA, 11 bp, Homo sapiens
atgagctcctg

SEQ ID NO: 2028298 - DNA, 14 bp, Homo sapiens
atgagctctgaaca

SEQ ID NO: 2028299 - DNA, 14 bp, Homo sapiens
atgaggaataatta

SEQ ID NO: 2028300 - DNA, 13 bp, Homo sapiens
atgaggacatgtt

SEQ ID NO: 2028301 - DNA, 14 bp, Homo sapiens
atgaggagagaagg

SEQ ID NO: 2028302 - DNA, 13 bp, Homo sapiens
atgaggcagagga

SEQ ID NO: 2028303 - DNA, 14 bp, Homo sapiens
atgagggcagcagc

SEQ ID NO: 2028304 - DNA, 17 bp, Homo sapiens
atgagggcagcagccag

SEQ ID NO: 2028305 - DNA, 19 bp, Homo sapiens
atgagggcagcagccagcc

SEQ ID NO: 2028306 - DNA, 16 bp, Homo sapiens
atgaggtcccaggcag

SEQ ID NO: 2028307 - DNA, 20 bp, Homo sapiens
atgaggtcccaggcagagaa

SEQ ID NO: 2028308 - DNA, 21 bp, Homo sapiens
atgagtctgcataaacttcat

SEQ ID NO: 2028309 - DNA, 22 bp, Homo sapiens
atgagtggatggatggacagaa

SEQ ID NO: 2028310 - DNA, 22 bp, Homo sapiens
atgagttgttttcagactcaga

SEQ ID NO: 2028311 - DNA, 13 bp, Homo sapiens
atgagtttttgat

SEQ ID NO: 2028312 - DNA, 21 bp, Homo sapiens
atgagtttttgatagctttat

SEQ ID NO: 2028313 - DNA, 18 bp, Homo sapiens
atgataaagatgtcaaat

SEQ ID NO: 2028314 - DNA, 22 bp, Homo sapiens
atgataccctgaatttggcctg

SEQ ID NO: 2028315 - DNA, 21 bp, Homo sapiens
atgatatccagtaagcacatg

SEQ ID NO: 2028316 - DNA, 14 bp, Homo sapiens
atgatatccctgat

SEQ ID NO: 2028317 - DNA, 18 bp, Homo sapiens
atgatattgcatatgcat

SEQ ID NO: 2028318 - DNA, 14 bp, Homo sapiens
atgatattttcaga

SEQ ID NO: 2028319 - DNA, 14 bp, Homo sapiens
atgatcacatggaa

SEQ ID NO: 2028320 - DNA, 15 bp, Homo sapiens
atgatcacggctcac

SEQ ID NO: 2028321 - DNA, 18 bp, Homo sapiens
atgatcagctgtttgtca

SEQ ID NO: 2028322 - DNA, 19 bp, Homo sapiens
atgatcagctgtttgtcat

SEQ ID NO: 2028323 - DNA, 20 bp, Homo sapiens
atgatcagctgtttgtcata

SEQ ID NO: 2028324 - DNA, 22 bp, Homo sapiens
atgatcatgtaaatgattatct

SEQ ID NO: 2028325 - DNA, 19 bp, Homo sapiens
atgatccttgttttaagat

SEQ ID NO: 2028326 - DNA, 23 bp, Homo sapiens
atgatccttgttttaagattgta

SEQ ID NO: 2028327 - DNA, 17 bp, Homo sapiens
atgatcgagccactgca

SEQ ID NO: 2028328 - DNA, 18 bp, Homo sapiens
atgatctaatacaaagat

SEQ ID NO: 2028329 - DNA, 16 bp, Homo sapiens
atgatctactcagaaa

SEQ ID NO: 2028330 - DNA, 14 bp, Homo sapiens
atgatctgaaaaat

SEQ ID NO: 2028331 - DNA, 20 bp, Homo sapiens
atgatctgactttaattgtg

SEQ ID NO: 2028332 - DNA, 22 bp, Homo sapiens
atgatctgactttaattgtgtg

SEQ ID NO: 2028333 - DNA, 17 bp, Homo sapiens
atgatcttgttaatgca

SEQ ID NO: 2028334 - DNA, 17 bp, Homo sapiens
atgatgaaaataataaa

SEQ ID NO: 2028335 - DNA, 14 bp, Homo sapiens
atgatgaccaagaa

SEQ ID NO: 2028336 - DNA, 18 bp, Homo sapiens
atgatgatctttaaaata

SEQ ID NO: 2028337 - DNA, 14 bp, Homo sapiens
atgatgatgatgat

SEQ ID NO: 2028338 - DNA, 20 bp, Homo sapiens
atgatgattaaacacctgac

SEQ ID NO: 2028339 - DNA, 22 bp, Homo sapiens
atgatgattaaacacctgacac

SEQ ID NO: 2028340 - DNA, 15 bp, Homo sapiens
atgatggagacttca

SEQ ID NO: 2028341 - DNA, 14 bp, Homo sapiens
atgatgtccagaag

SEQ ID NO: 2028342 - DNA, 19 bp, Homo sapiens
atgatgtccagaagaatat

SEQ ID NO: 2028343 - DNA, 23 bp, Homo sapiens
atgatgtccagaagaatattcag

SEQ ID NO: 2028344 - DNA, 14 bp, Homo sapiens
atgatgtgttgtga

SEQ ID NO: 2028345 - DNA, 15 bp, Homo sapiens
atgatgtgttgtgat

SEQ ID NO: 2028346 - DNA, 21 bp, Homo sapiens
atgatgttaaaaaaataagaa

SEQ ID NO: 2028347 - DNA, 22 bp, Homo sapiens
atgatgttaaaaaaataagaag

SEQ ID NO: 2028348 - DNA, 16 bp, Homo sapiens
atgattaaacacctga

SEQ ID NO: 2028349 - DNA, 16 bp, Homo sapiens
atgattatatgacaat

SEQ ID NO: 2028350 - DNA, 18 bp, Homo sapiens
atgattattttcattaca

SEQ ID NO: 2028351 - DNA, 23 bp, Homo sapiens
atgattcacaactaggacctcat

SEQ ID NO: 2028352 - DNA, 15 bp, Homo sapiens
atgattcataacaat

SEQ ID NO: 2028353 - DNA, 13 bp, Homo sapiens
atgattcatttta

SEQ ID NO: 2028354 - DNA, 14 bp, Homo sapiens
atgattggattatt

SEQ ID NO: 2028355 - DNA, 14 bp, Homo sapiens
atgatttaaaaaat

SEQ ID NO: 2028356 - DNA, 22 bp, Homo sapiens
atgatttaaaaaataaatataa

SEQ ID NO: 2028357 - DNA, 16 bp, Homo sapiens
atgatttaagcatttt

SEQ ID NO: 2028358 - DNA, 17 bp, Homo sapiens
atgatttaagcatttta

SEQ ID NO: 2028359 - DNA, 16 bp, Homo sapiens
atgatttacagagaag

SEQ ID NO: 2028360 - DNA, 20 bp, Homo sapiens
atgatttagggaagcaggga

SEQ ID NO: 2028361 - DNA, 14 bp, Homo sapiens
atgatttatagttt

SEQ ID NO: 2028362 - DNA, 15 bp, Homo sapiens
atgatttatatatgg

SEQ ID NO: 2028363 - DNA, 16 bp, Homo sapiens
atgatttcaatgattg

SEQ ID NO: 2028364 - DNA, 13 bp, Homo sapiens
atgatttcagaag

SEQ ID NO: 2028365 - DNA, 14 bp, Homo sapiens
atgatttcatttca

SEQ ID NO: 2028366 - DNA, 20 bp, Homo sapiens
atgatttccaaagagaaaaa

SEQ ID NO: 2028367 - DNA, 16 bp, Homo sapiens
atgattttacagagaa

SEQ ID NO: 2028368 - DNA, 13 bp, Homo sapiens
atgattttataca

SEQ ID NO: 2028369 - DNA, 16 bp, Homo sapiens
atgattttatttgaca

SEQ ID NO: 2028370 - DNA, 23 bp, Homo sapiens
atgattttatttgacaaaatttg

SEQ ID NO: 2028371 - DNA, 14 bp, Homo sapiens
atgattttctattt

SEQ ID NO: 2028372 - DNA, 18 bp, Homo sapiens
atgatttttacaataatt

SEQ ID NO: 2028373 - DNA, 13 bp, Homo sapiens
atgatttttagat

SEQ ID NO: 2028374 - DNA, 11 bp, Homo sapiens
atgcaaaaatc

SEQ ID NO: 2028375 - DNA, 13 bp, Homo sapiens
atgcaaaatgaaa

SEQ ID NO: 2028376 - DNA, 12 bp, Homo sapiens
atgcaaagcact

SEQ ID NO: 2028377 - DNA, 15 bp, Homo sapiens
atgcaaagcactgac

SEQ ID NO: 2028378 - DNA, 20 bp, Homo sapiens
atgcaacaaaatatttaatt

SEQ ID NO: 2028379 - DNA, 16 bp, Homo sapiens
atgcaacaaatattta

SEQ ID NO: 2028380 - DNA, 19 bp, Homo sapiens
atgcaacaaatatttatat

SEQ ID NO: 2028381 - DNA, 14 bp, Homo sapiens
atgcaacaacatgt

SEQ ID NO: 2028382 - DNA, 22 bp, Homo sapiens
atgcaagaagaatataaataaa

SEQ ID NO: 2028383 - DNA, 15 bp, Homo sapiens
atgcaaggaaggaaa

SEQ ID NO: 2028384 - DNA, 16 bp, Homo sapiens
atgcaaggaaggaaag

SEQ ID NO: 2028385 - DNA, 17 bp, Homo sapiens
atgcaagtgagaagctg

SEQ ID NO: 2028386 - DNA, 16 bp, Homo sapiens
atgcaataatgtgcaa

SEQ ID NO: 2028387 - DNA, 15 bp, Homo sapiens
atgcaatgaaacaga

SEQ ID NO: 2028388 - DNA, 19 bp, Homo sapiens
atgcaatttattaaaatga

SEQ ID NO: 2028389 - DNA, 11 bp, Homo sapiens
atgcacaattt

SEQ ID NO: 2028390 - DNA, 19 bp, Homo sapiens
atgcacaatttagaaaaca

SEQ ID NO: 2028391 - DNA, 20 bp, Homo sapiens
atgcacaatttagaaaacat

SEQ ID NO: 2028392 - DNA, 19 bp, Homo sapiens
atgcacacaaacacctcct

SEQ ID NO: 2028393 - DNA, 12 bp, Homo sapiens
atgcacacacag

SEQ ID NO: 2028394 - DNA, 13 bp, Homo sapiens
atgcacagagata

SEQ ID NO: 2028395 - DNA, 19 bp, Homo sapiens
atgcacagagatatgcaca

SEQ ID NO: 2028396 - DNA, 14 bp, Homo sapiens
atgcacagctgctt

SEQ ID NO: 2028397 - DNA, 16 bp, Homo sapiens
atgcacagctgcttgt

SEQ ID NO: 2028398 - DNA, 13 bp, Homo sapiens
atgcacatttata

SEQ ID NO: 2028399 - DNA, 22 bp, Homo sapiens
atgcacatttatatatatatgt

SEQ ID NO: 2028400 - DNA, 19 bp, Homo sapiens
atgcaccagtgccgcctgt

SEQ ID NO: 2028401 - DNA, 18 bp, Homo sapiens
atgcacctaaagaaaaac

SEQ ID NO: 2028402 - DNA, 15 bp, Homo sapiens
atgcaccttgtgtct

SEQ ID NO: 2028403 - DNA, 16 bp, Homo sapiens
atgcaccttgtgtctg

SEQ ID NO: 2028404 - DNA, 17 bp, Homo sapiens
atgcacgcacacatcag

SEQ ID NO: 2028405 - DNA, 22 bp, Homo sapiens
atgcactgacccttccagacat

SEQ ID NO: 2028406 - DNA, 13 bp, Homo sapiens
atgcactggccac

SEQ ID NO: 2028407 - DNA, 11 bp, Homo sapiens
atggggagaaa

SEQ ID NO: 2028408 - DNA, 22 bp, Homo sapiens
atggggagaaagggcaaattat

SEQ ID NO: 2028409 - DNA, 12 bp, Homo sapiens
atggggagaggc

SEQ ID NO: 2028410 - DNA, 13 bp, Homo sapiens
atggggagaggca

SEQ ID NO: 2028411 - DNA, 17 bp, Homo sapiens
atgggggcactgaggac

SEQ ID NO: 2028412 - DNA, 21 bp, Homo sapiens
atggggtgggcagggctggga

SEQ ID NO: 2028413 - DNA, 14 bp, Homo sapiens
atgggtattaaact

SEQ ID NO: 2028414 - DNA, 15 bp, Homo sapiens
atgggtattaaactt

SEQ ID NO: 2028415 - DNA, 22 bp, Homo sapiens
atgggtattaaacttgtcagaa

SEQ ID NO: 2028416 - DNA, 23 bp, Homo sapiens
atggtaaaagttacttattctag

SEQ ID NO: 2028417 - DNA, 12 bp, Homo sapiens
atggtagcagat

SEQ ID NO: 2028418 - DNA, 14 bp, Homo sapiens
atggtatgagctga

SEQ ID NO: 2028419 - DNA, 20 bp, Homo sapiens
atggtatgagctgagggggg

SEQ ID NO: 2028420 - DNA, 15 bp, Homo sapiens
atggtatgctggcca

SEQ ID NO: 2028421 - DNA, 22 bp, Homo sapiens
atggtatgctggccagcaccct

SEQ ID NO: 2028422 - DNA, 21 bp, Homo sapiens
atggtattttcgtgcatttgt

SEQ ID NO: 2028423 - DNA, 23 bp, Homo sapiens
atggtcacgaggtccagacccac

SEQ ID NO: 2028424 - DNA, 15 bp, Homo sapiens
atggtcagctcacac

SEQ ID NO: 2028425 - DNA, 17 bp, Homo sapiens
atggtcagttgaggaat

SEQ ID NO: 2028426 - DNA, 20 bp, Homo sapiens
atggtcccacatccctgggc

SEQ ID NO: 2028427 - DNA, 22 bp, Homo sapiens
atggtcccacatccctgggcct

SEQ ID NO: 2028428 - DNA, 17 bp, Homo sapiens
atggtcccttcttccct

SEQ ID NO: 2028429 - DNA, 12 bp, Homo sapiens
atggtcctgggg

SEQ ID NO: 2028430 - DNA, 19 bp, Homo sapiens
atggtcctggggctctgtg

SEQ ID NO: 2028431 - DNA, 19 bp, Homo sapiens
atggtctctcgggcccccc

SEQ ID NO: 2028432 - DNA, 21 bp, Homo sapiens
atggtctctcgggccccccac

SEQ ID NO: 2028433 - DNA, 13 bp, Homo sapiens
atggtgagctggg

SEQ ID NO: 2028434 - DNA, 16 bp, Homo sapiens
atggtgagctgggaag

SEQ ID NO: 2028435 - DNA, 22 bp, Homo sapiens
atggtgaggaagccccaagcca

SEQ ID NO: 2028436 - DNA, 18 bp, Homo sapiens
atggtgcagttgacagca

SEQ ID NO: 2028437 - DNA, 23 bp, Homo sapiens
atggtgcttgttaatgctttctg

SEQ ID NO: 2028438 - DNA, 23 bp, Homo sapiens
atggtggaagggggtgtgcgtgc

SEQ ID NO: 2028439 - DNA, 12 bp, Homo sapiens
atggtggctggg

SEQ ID NO: 2028440 - DNA, 14 bp, Homo sapiens
atggtggtttgtca

SEQ ID NO: 2028441 - DNA, 23 bp, Homo sapiens
atggtggtttgtcatatattcat

SEQ ID NO: 2028442 - DNA, 16 bp, Homo sapiens
atggtgttgtatactt

SEQ ID NO: 2028443 - DNA, 20 bp, Homo sapiens
atggttccatgcctgagggt

SEQ ID NO: 2028444 - DNA, 20 bp, Homo sapiens
atggttcccctgttcactct

SEQ ID NO: 2028445 - DNA, 22 bp, Homo sapiens
atggttctcagatcttgacagt

SEQ ID NO: 2028446 - DNA, 17 bp, Homo sapiens
atggttgccaggacgaa

SEQ ID NO: 2028447 - DNA, 15 bp, Homo sapiens
atggttgccttaaag

SEQ ID NO: 2028448 - DNA, 23 bp, Homo sapiens
atggttggtaacacaaattttca

SEQ ID NO: 2028449 - DNA, 18 bp, Homo sapiens
atggttgtctgtttttgt

SEQ ID NO: 2028450 - DNA, 15 bp, Homo sapiens
atggtttactgctgt

SEQ ID NO: 2028451 - DNA, 16 bp, Homo sapiens
atggtttactgctgtc

SEQ ID NO: 2028452 - DNA, 18 bp, Homo sapiens
atggtttactgctgtcat

SEQ ID NO: 2028453 - DNA, 19 bp, Homo sapiens
atggtttactgctgtcatt

SEQ ID NO: 2028454 - DNA, 21 bp, Homo sapiens
atggtttgaatataaacacta

SEQ ID NO: 2028455 - DNA, 14 bp, Homo sapiens
atggttttctccaa

SEQ ID NO: 2028456 - DNA, 20 bp, Homo sapiens
atggttttctccaagagcta

SEQ ID NO: 2028457 - DNA, 21 bp, Homo sapiens
atgtaaaagagtcatctggta

SEQ ID NO: 2028458 - DNA, 21 bp, Homo sapiens
atgtaaaaggtattaaattga

SEQ ID NO: 2028459 - DNA, 22 bp, Homo sapiens
atgtaaaatgcagtccagaata

SEQ ID NO: 2028460 - DNA, 15 bp, Homo sapiens
atgtaaacagtgcct

SEQ ID NO: 2028461 - DNA, 16 bp, Homo sapiens
atgtaaacagtgcctg

SEQ ID NO: 2028462 - DNA, 17 bp, Homo sapiens
atgtaaacagtgcctgc

SEQ ID NO: 2028463 - DNA, 20 bp, Homo sapiens
atgtaaacagtgcctgctga

SEQ ID NO: 2028464 - DNA, 13 bp, Homo sapiens
atgtaaagtatgt

SEQ ID NO: 2028465 - DNA, 17 bp, Homo sapiens
atgtaaatagtgcagaa

SEQ ID NO: 2028466 - DNA, 20 bp, Homo sapiens
atgtaaatattttaaagaat

SEQ ID NO: 2028467 - DNA, 21 bp, Homo sapiens
atgtaaatattttaaagaatt

SEQ ID NO: 2028468 - DNA, 20 bp, Homo sapiens
atgtaacaggtaaccacaat

SEQ ID NO: 2028469 - DNA, 15 bp, Homo sapiens
atgtaacatccagaa

SEQ ID NO: 2028470 - DNA, 16 bp, Homo sapiens
atgtaacatccagaag

SEQ ID NO: 2028471 - DNA, 21 bp, Homo sapiens
atgtaaccaagagtattccat

SEQ ID NO: 2028472 - DNA, 15 bp, Homo sapiens
atgtaactattgaat

SEQ ID NO: 2028473 - DNA, 17 bp, Homo sapiens
atgtaacttttcttaca

SEQ ID NO: 2028474 - DNA, 12 bp, Homo sapiens
atgtaaggaatt

SEQ ID NO: 2028475 - DNA, 14 bp, Homo sapiens
atgtaagggaaact

SEQ ID NO: 2028476 - DNA, 22 bp, Homo sapiens
atgtaagggaaactgccagcaa

SEQ ID NO: 2028477 - DNA, 22 bp, Homo sapiens
atgtaagtaattgcatttctgc

SEQ ID NO: 2028478 - DNA, 13 bp, Homo sapiens
atgtaataaatct

SEQ ID NO: 2028479 - DNA, 16 bp, Homo sapiens
atgtaatcaatgtttc

SEQ ID NO: 2028480 - DNA, 16 bp, Homo sapiens
atgtacaagttttgta

SEQ ID NO: 2028481 - DNA, 20 bp, Homo sapiens
atgtacaagttttgtataaa

SEQ ID NO: 2028482 - DNA, 22 bp, Homo sapiens
atgtacaagttttgtataaata

SEQ ID NO: 2028483 - DNA, 13 bp, Homo sapiens
atgtacagagtgg

SEQ ID NO: 2028484 - DNA, 22 bp, Homo sapiens
atgtacatgtgtagggaaagtt

SEQ ID NO: 2028485 - DNA, 14 bp, Homo sapiens
atgtacattaatta

SEQ ID NO: 2028486 - DNA, 16 bp, Homo sapiens
atgtaccagtgtactg

SEQ ID NO: 2028487 - DNA, 21 bp, Homo sapiens
atgtaccatgtacatgaagaa

SEQ ID NO: 2028488 - DNA, 19 bp, Homo sapiens
atgtactataatgtgatga

SEQ ID NO: 2028489 - DNA, 17 bp, Homo sapiens
atgtactgttattgaaa

SEQ ID NO: 2028490 - DNA, 15 bp, Homo sapiens
atgtacttcctgtgt

SEQ ID NO: 2028491 - DNA, 20 bp, Homo sapiens
atgtacttcctgtgtactct

SEQ ID NO: 2028492 - DNA, 23 bp, Homo sapiens
atgtagaacttcaagaagtaaga

SEQ ID NO: 2028493 - DNA, 20 bp, Homo sapiens
atgtagactatatacatgtg

SEQ ID NO: 2028494 - DNA, 22 bp, Homo sapiens
atgtagattaaggtgatgtgat

SEQ ID NO: 2028495 - DNA, 15 bp, Homo sapiens
atgtagcagaataat

SEQ ID NO: 2028496 - DNA, 13 bp, Homo sapiens
atgtaggagggac

SEQ ID NO: 2028497 - DNA, 23 bp, Homo sapiens
atgtaggcccctggtctgccctg

SEQ ID NO: 2028498 - DNA, 16 bp, Homo sapiens
atgtagtataaagaaa

SEQ ID NO: 2028499 - DNA, 16 bp, Homo sapiens
atgtagtatgatgtaa

SEQ ID NO: 2028500 - DNA, 17 bp, Homo sapiens
atgtagttttaacagaa

SEQ ID NO: 2028501 - DNA, 14 bp, Homo sapiens
atgtataatatttt

SEQ ID NO: 2028502 - DNA, 12 bp, Homo sapiens
atgtatacacac

SEQ ID NO: 2028503 - DNA, 17 bp, Homo sapiens
atgtatatacacatata

SEQ ID NO: 2028504 - DNA, 21 bp, Homo sapiens
atgtatatactatacaacaat

SEQ ID NO: 2028505 - DNA, 19 bp, Homo sapiens
atgtatatatatatagtaa

SEQ ID NO: 2028506 - DNA, 15 bp, Homo sapiens
atgtatatctatatc

SEQ ID NO: 2028507 - DNA, 19 bp, Homo sapiens
atgtatatctatatctcta

SEQ ID NO: 2028508 - DNA, 16 bp, Homo sapiens
atgtatatgtatatat

SEQ ID NO: 2028509 - DNA, 19 bp, Homo sapiens
atgtatatgtatatctata

SEQ ID NO: 2028510 - DNA, 16 bp, Homo sapiens
atgtatcatagaaatg

SEQ ID NO: 2028511 - DNA, 17 bp, Homo sapiens
atgtatcatagaaatgt

SEQ ID NO: 2028512 - DNA, 15 bp, Homo sapiens
atgtatctacctcac

SEQ ID NO: 2028513 - DNA, 16 bp, Homo sapiens
atgtatctatttatta

SEQ ID NO: 2028514 - DNA, 18 bp, Homo sapiens
atgtatcttatttatata

SEQ ID NO: 2028515 - DNA, 23 bp, Homo sapiens
atgtatgtgaaagtgtaaaatag

SEQ ID NO: 2028516 - DNA, 22 bp, Homo sapiens
atgtatgtgcacatgtgtctgt

SEQ ID NO: 2028517 - DNA, 16 bp, Homo sapiens
atgtatgtttacatat

SEQ ID NO: 2028518 - DNA, 18 bp, Homo sapiens
atgtattaagccaaacat

SEQ ID NO: 2028519 - DNA, 17 bp, Homo sapiens
atgtattatcacatcaa

SEQ ID NO: 2028520 - DNA, 19 bp, Homo sapiens
atgtattgtaaacagaagg

SEQ ID NO: 2028521 - DNA, 20 bp, Homo sapiens
atgtattgtaaacatgtgtt

SEQ ID NO: 2028522 - DNA, 20 bp, Homo sapiens
atgtatttatatgttaattt

SEQ ID NO: 2028523 - DNA, 17 bp, Homo sapiens
atgtatttttgtaccct

SEQ ID NO: 2028524 - DNA, 13 bp, Homo sapiens
atgtcaaaatcat

SEQ ID NO: 2028525 - DNA, 13 bp, Homo sapiens
atgtcaaacaaat

SEQ ID NO: 2028526 - DNA, 20 bp, Homo sapiens
atgtcaaagagaaaacttat

SEQ ID NO: 2028527 - DNA, 17 bp, Homo sapiens
atgtcaaatatctcaga

SEQ ID NO: 2028528 - DNA, 18 bp, Homo sapiens
atgtcaatttgtatatca

SEQ ID NO: 2028529 - DNA, 23 bp, Homo sapiens
atgtcacacttgtttcttgttca

SEQ ID NO: 2028530 - DNA, 16 bp, Homo sapiens
atgtcacaggcaggtc

SEQ ID NO: 2028531 - DNA, 16 bp, Homo sapiens
atgtcaccaccttccc

SEQ ID NO: 2028532 - DNA, 20 bp, Homo sapiens
atgtcaccaccttcccagct

SEQ ID NO: 2028533 - DNA, 15 bp, Homo sapiens
atgtcacctcagctg

SEQ ID NO: 2028534 - DNA, 17 bp, Homo sapiens
atgtcacctcagctgat

SEQ ID NO: 2028535 - DNA, 23 bp, Homo sapiens
atgtcagacatccatgtttgtaa

SEQ ID NO: 2028536 - DNA, 15 bp, Homo sapiens
atgtcagagctatgt

SEQ ID NO: 2028537 - DNA, 22 bp, Homo sapiens
atgtcagagctatgttccctcc

SEQ ID NO: 2028538 - DNA, 16 bp, Homo sapiens
atgtcaggcctgtgtg

SEQ ID NO: 2028539 - DNA, 17 bp, Homo sapiens
atgtcatgtacttcctg

SEQ ID NO: 2028540 - DNA, 18 bp, Homo sapiens
atgtcatgtacttcctgt

SEQ ID NO: 2028541 - DNA, 22 bp, Homo sapiens
atgtccagaagaatattcagga

SEQ ID NO: 2028542 - DNA, 20 bp, Homo sapiens
atgtcccaacttgtaaaaat

SEQ ID NO: 2028543 - DNA, 15 bp, Homo sapiens
atgtcccatctgctc

SEQ ID NO: 2028544 - DNA, 21 bp, Homo sapiens
atgtcccatctgctcctccca

SEQ ID NO: 2028545 - DNA, 22 bp, Homo sapiens
atgtcccatctgctcctcccat

SEQ ID NO: 2028546 - DNA, 14 bp, Homo sapiens
atgtcccttgctgt

SEQ ID NO: 2028547 - DNA, 16 bp, Homo sapiens
atgtcctaaggacaca

SEQ ID NO: 2028548 - DNA, 19 bp, Homo sapiens
atgtcctaaggacacacta

SEQ ID NO: 2028549 - DNA, 23 bp, Homo sapiens
atgtcctaggggccgagggaaat

SEQ ID NO: 2028550 - DNA, 23 bp, Homo sapiens
atgtcctccaacaataaagagct

SEQ ID NO: 2028551 - DNA, 17 bp, Homo sapiens
atgtcctccttgttcta

SEQ ID NO: 2028552 - DNA, 14 bp, Homo sapiens
atgtcgcctctgca

SEQ ID NO: 2028553 - DNA, 13 bp, Homo sapiens
atgtctaattgag

SEQ ID NO: 2028554 - DNA, 13 bp, Homo sapiens
atgtctatttaag

SEQ ID NO: 2028555 - DNA, 23 bp, Homo sapiens
atgtctatttaagcctcatattt

SEQ ID NO: 2028556 - DNA, 17 bp, Homo sapiens
atgtctcagcctcctca

SEQ ID NO: 2028557 - DNA, 17 bp, Homo sapiens
atgtctcaggtccctgc

SEQ ID NO: 2028558 - DNA, 15 bp, Homo sapiens
atgtctcgctagtga

SEQ ID NO: 2028559 - DNA, 15 bp, Homo sapiens
atgtctcttgtagaa

SEQ ID NO: 2028560 - DNA, 23 bp, Homo sapiens
atgtctctttaatgtcacaggca

SEQ ID NO: 2028561 - DNA, 13 bp, Homo sapiens
atgtctgcttctg

SEQ ID NO: 2028562 - DNA, 19 bp, Homo sapiens
atgtctgcttctgtccagg

SEQ ID NO: 2028563 - DNA, 13 bp, Homo sapiens
atgtctgtatcta

SEQ ID NO: 2028564 - DNA, 16 bp, Homo sapiens
atgtcttggacactgt

SEQ ID NO: 2028565 - DNA, 20 bp, Homo sapiens
atgtcttggacactgtacaa

SEQ ID NO: 2028566 - DNA, 17 bp, Homo sapiens
atgtcttgtacatgtgt

SEQ ID NO: 2028567 - DNA, 22 bp, Homo sapiens
atgtctttaggcagcagctttt

SEQ ID NO: 2028568 - DNA, 22 bp, Homo sapiens
atgtctttctccaaagttatcc

SEQ ID NO: 2028569 - DNA, 16 bp, Homo sapiens
atgtgaatcagaccct

SEQ ID NO: 2028570 - DNA, 20 bp, Homo sapiens
atgtgaatgatctctctgaa

SEQ ID NO: 2028571 - DNA, 16 bp, Homo sapiens
atgtgaattctgtgaa

SEQ ID NO: 2028572 - DNA, 17 bp, Homo sapiens
atgtgaattctgtgaag

SEQ ID NO: 2028573 - DNA, 18 bp, Homo sapiens
atgtgaattctgtgaaga

SEQ ID NO: 2028574 - DNA, 19 bp, Homo sapiens
atgtgacaacctttgtgta

SEQ ID NO: 2028575 - DNA, 12 bp, Homo sapiens
atgtgacagaca

SEQ ID NO: 2028576 - DNA, 19 bp, Homo sapiens
atgtgagcacatgcgtata

SEQ ID NO: 2028577 - DNA, 20 bp, Homo sapiens
atgtgataaggatcagaaca

SEQ ID NO: 2028578 - DNA, 13 bp, Homo sapiens
atgtgatcactga

SEQ ID NO: 2028579 - DNA, 16 bp, Homo sapiens
atgtgatcactgagac

SEQ ID NO: 2028580 - DNA, 17 bp, Homo sapiens
atgtgatgttaactatt

SEQ ID NO: 2028581 - DNA, 15 bp, Homo sapiens
atgtgattccttttg

SEQ ID NO: 2028582 - DNA, 15 bp, Homo sapiens
atgtgcaaattttgc

SEQ ID NO: 2028583 - DNA, 20 bp, Homo sapiens
atgtgcaagttgtactgtat

SEQ ID NO: 2028584 - DNA, 23 bp, Homo sapiens
atgtgcacatgcacgtgtgtgca

SEQ ID NO: 2028585 - DNA, 16 bp, Homo sapiens
atgtgcacatgtgtct

SEQ ID NO: 2028586 - DNA, 22 bp, Homo sapiens
atgtgcatggaaatgtcctcca

SEQ ID NO: 2028587 - DNA, 21 bp, Homo sapiens
atgtgccaggtttttggtctg

SEQ ID NO: 2028588 - DNA, 14 bp, Homo sapiens
atgtgctggagctg

SEQ ID NO: 2028589 - DNA, 18 bp, Homo sapiens
atgtgctggagctggctt

SEQ ID NO: 2028590 - DNA, 17 bp, Homo sapiens
atgtggaatataaagat

SEQ ID NO: 2028591 - DNA, 23 bp, Homo sapiens
atgtggattagctagaatgcaca

SEQ ID NO: 2028592 - DNA, 20 bp, Homo sapiens
atgtggcaaagtgctgtacc

SEQ ID NO: 2028593 - DNA, 17 bp, Homo sapiens
atgtggcattggggggc

SEQ ID NO: 2028594 - DNA, 20 bp, Homo sapiens
atgtggcccctgaacaagaa

SEQ ID NO: 2028595 - DNA, 19 bp, Homo sapiens
atgtggcctaaaaatgcaa

SEQ ID NO: 2028596 - DNA, 10 bp, Homo sapiens
atgtggctga

SEQ ID NO: 2028597 - DNA, 11 bp, Homo sapiens
atgtggctgaa

SEQ ID NO: 2028598 - DNA, 11 bp, Homo sapiens
atgtgggaggg

SEQ ID NO: 2028599 - DNA, 21 bp, Homo sapiens
atgtgggcgtttgtaaattct

SEQ ID NO: 2028600 - DNA, 15 bp, Homo sapiens
atgtggtatgtagcc

SEQ ID NO: 2028601 - DNA, 21 bp, Homo sapiens
atgtggtgggacagggaccca

SEQ ID NO: 2028602 - DNA, 15 bp, Homo sapiens
atgtggttcttcaaa

SEQ ID NO: 2028603 - DNA, 16 bp, Homo sapiens
atgtgtaattttttaa

SEQ ID NO: 2028604 - DNA, 17 bp, Homo sapiens
atgtgtagattgcgtgg

SEQ ID NO: 2028605 - DNA, 14 bp, Homo sapiens
atgtgtagcctgtg

SEQ ID NO: 2028606 - DNA, 15 bp, Homo sapiens
atgtgtagcctgtgc

SEQ ID NO: 2028607 - DNA, 23 bp, Homo sapiens
atgtgtatatatacatacacttg

SEQ ID NO: 2028608 - DNA, 21 bp, Homo sapiens
atgtgtatttgtatgtactgt

SEQ ID NO: 2028609 - DNA, 14 bp, Homo sapiens
atgtgtcagcatgc

SEQ ID NO: 2028610 - DNA, 15 bp, Homo sapiens
atgtgtcccctcact

SEQ ID NO: 2028611 - DNA, 22 bp, Homo sapiens
atgtgtcccctcactctgtcag

SEQ ID NO: 2028612 - DNA, 20 bp, Homo sapiens
atgtgtctttatcagtgatg

SEQ ID NO: 2028613 - DNA, 20 bp, Homo sapiens
atgtgtgaaggtcttgcctg

SEQ ID NO: 2028614 - DNA, 11 bp, Homo sapiens
atgtgtgcatg

SEQ ID NO: 2028615 - DNA, 12 bp, Homo sapiens
atgtgtgcatgt

SEQ ID NO: 2028616 - DNA, 13 bp, Homo sapiens
atgtgtgcatgtg

SEQ ID NO: 2028617 - DNA, 14 bp, Homo sapiens
atgtgtgcatgtga

SEQ ID NO: 2028618 - DNA, 11 bp, Homo sapiens
atgtgtgccat

SEQ ID NO: 2028619 - DNA, 20 bp, Homo sapiens
atgtgtgccatagagtttaa

SEQ ID NO: 2028620 - DNA, 12 bp, Homo sapiens
atgtgtgcctgt

SEQ ID NO: 2028621 - DNA, 15 bp, Homo sapiens
atgtgtgcctgtggc

SEQ ID NO: 2028622 - DNA, 23 bp, Homo sapiens
atgtgtgcctgtggcagaaaaga

SEQ ID NO: 2028623 - DNA, 15 bp, Homo sapiens
atgtgtgggaaaggg

SEQ ID NO: 2028624 - DNA, 14 bp, Homo sapiens
atgtgtgtatatat

SEQ ID NO: 2028625 - DNA, 20 bp, Homo sapiens
atgtgtgtatatatgtgtat

SEQ ID NO: 2028626 - DNA, 18 bp, Homo sapiens
atgtgtgtatatgtatgt

SEQ ID NO: 2028627 - DNA, 20 bp, Homo sapiens
atgtgtgtatgggtgtgtgt

SEQ ID NO: 2028628 - DNA, 16 bp, Homo sapiens
atgtgtgtggtgtgtg

SEQ ID NO: 2028629 - DNA, 20 bp, Homo sapiens
atgtgtgtggtgtgtgtgct

SEQ ID NO: 2028630 - DNA, 12 bp, Homo sapiens
atgtgtgtgtat

SEQ ID NO: 2028631 - DNA, 16 bp, Homo sapiens
atgtgtgtgtatgcta

SEQ ID NO: 2028632 - DNA, 19 bp, Homo sapiens
atgtgtgtttaaataaagt

SEQ ID NO: 2028633 - DNA, 13 bp, Homo sapiens
atgtgttgtgata

SEQ ID NO: 2028634 - DNA, 14 bp, Homo sapiens
atgtgtttgatttt

SEQ ID NO: 2028635 - DNA, 16 bp, Homo sapiens
atgtgttttgcacgtc

SEQ ID NO: 2028636 - DNA, 21 bp, Homo sapiens
atgttaaaatattgatttcta

SEQ ID NO: 2028637 - DNA, 21 bp, Homo sapiens
atgttaaagaggcgtcttgta

SEQ ID NO: 2028638 - DNA, 22 bp, Homo sapiens
atgttaaagaggcgtcttgtat

SEQ ID NO: 2028639 - DNA, 12 bp, Homo sapiens
atgttaaagcat

SEQ ID NO: 2028640 - DNA, 18 bp, Homo sapiens
atgttaaagcatcagaga

SEQ ID NO: 2028641 - DNA, 18 bp, Homo sapiens
atgttaacctcagtgtca

SEQ ID NO: 2028642 - DNA, 20 bp, Homo sapiens
atgttaagacttgacagtgg

SEQ ID NO: 2028643 - DNA, 17 bp, Homo sapiens
atgttaagttacttcac

SEQ ID NO: 2028644 - DNA, 15 bp, Homo sapiens
atgttaattaaactg

SEQ ID NO: 2028645 - DNA, 22 bp, Homo sapiens
atgttaattcagcactgatttc

SEQ ID NO: 2028646 - DNA, 13 bp, Homo sapiens
atgttaatttgtt

SEQ ID NO: 2028647 - DNA, 20 bp, Homo sapiens
atgttacatctgttttaaat

SEQ ID NO: 2028648 - DNA, 17 bp, Homo sapiens
atgttagaagtccaggc

SEQ ID NO: 2028649 - DNA, 13 bp, Homo sapiens
atgttatatattt

SEQ ID NO: 2028650 - DNA, 14 bp, Homo sapiens
atgttatgtgacta

SEQ ID NO: 2028651 - DNA, 15 bp, Homo sapiens
atgttatttgtaata

SEQ ID NO: 2028652 - DNA, 19 bp, Homo sapiens
atgttatttgtaatagatg

SEQ ID NO: 2028653 - DNA, 14 bp, Homo sapiens
atgttcaactggag

SEQ ID NO: 2028654 - DNA, 17 bp, Homo sapiens
atgttcattaaattttc

SEQ ID NO: 2028655 - DNA, 20 bp, Homo sapiens
atgttcattaaattttctat

SEQ ID NO: 2028656 - DNA, 16 bp, Homo sapiens
atgttcccttgaccat

SEQ ID NO: 2028657 - DNA, 17 bp, Homo sapiens
atgttcctagtgaaaga

SEQ ID NO: 2028658 - DNA, 23 bp, Homo sapiens
atgttctaacagcatctgcctct

SEQ ID NO: 2028659 - DNA, 15 bp, Homo sapiens
atgttctatatgcat

SEQ ID NO: 2028660 - DNA, 14 bp, Homo sapiens
atgttctcagaatc

SEQ ID NO: 2028661 - DNA, 17 bp, Homo sapiens
atgttctcagaatcagg

SEQ ID NO: 2028662 - DNA, 13 bp, Homo sapiens
atgttgaaatctt

SEQ ID NO: 2028663 - DNA, 20 bp, Homo sapiens
atgttgagggaacagacagg

SEQ ID NO: 2028664 - DNA, 13 bp, Homo sapiens
atgttgataaaga

SEQ ID NO: 2028665 - DNA, 13 bp, Homo sapiens
atgttgcatgcct

SEQ ID NO: 2028666 - DNA, 17 bp, Homo sapiens
atgttgccatgaggcct

SEQ ID NO: 2028667 - DNA, 14 bp, Homo sapiens
atgttgcccaggca

SEQ ID NO: 2028668 - DNA, 20 bp, Homo sapiens
atgttgcccaggcaggtctt

SEQ ID NO: 2028669 - DNA, 15 bp, Homo sapiens
atgttgctggactgt

SEQ ID NO: 2028670 - DNA, 19 bp, Homo sapiens
atgttggatagtcagctgt

SEQ ID NO: 2028671 - DNA, 14 bp, Homo sapiens
atgttggccaggct

SEQ ID NO: 2028672 - DNA, 16 bp, Homo sapiens
atgttggccaggctgg

SEQ ID NO: 2028673 - DNA, 18 bp, Homo sapiens
atgttgggatttatatct

SEQ ID NO: 2028674 - DNA, 23 bp, Homo sapiens
atgttgtaataaaacttatgcta

SEQ ID NO: 2028675 - DNA, 15 bp, Homo sapiens
atgttgtcaggaatc

SEQ ID NO: 2028676 - DNA, 16 bp, Homo sapiens
atgttgttatgctatt

SEQ ID NO: 2028677 - DNA, 17 bp, Homo sapiens
atgttgttatgctatta

SEQ ID NO: 2028678 - DNA, 17 bp, Homo sapiens
atgttgttatttaaaga

SEQ ID NO: 2028679 - DNA, 16 bp, Homo sapiens
atgttgttcccacaca

SEQ ID NO: 2028680 - DNA, 17 bp, Homo sapiens
atgtttaaatataaatg

SEQ ID NO: 2028681 - DNA, 14 bp, Homo sapiens
atgtttaaattgta

SEQ ID NO: 2028682 - DNA, 17 bp, Homo sapiens
atgtttaaattgtaaat

SEQ ID NO: 2028683 - DNA, 16 bp, Homo sapiens
atgtttacactctttg

SEQ ID NO: 2028684 - DNA, 18 bp, Homo sapiens
atgtttacactctttgta

SEQ ID NO: 2028685 - DNA, 19 bp, Homo sapiens
atgtttacactctttgtaa

SEQ ID NO: 2028686 - DNA, 15 bp, Homo sapiens
atgtttacagaactg

SEQ ID NO: 2028687 - DNA, 13 bp, Homo sapiens
atgtttacatatc

SEQ ID NO: 2028688 - DNA, 20 bp, Homo sapiens
atgtttattcatgggtgtca

SEQ ID NO: 2028689 - DNA, 18 bp, Homo sapiens
atgtttattcctgataat

SEQ ID NO: 2028690 - DNA, 23 bp, Homo sapiens
atgtttatttcataaagaattgt

SEQ ID NO: 2028691 - DNA, 14 bp, Homo sapiens
atgtttcacaacag

SEQ ID NO: 2028692 - DNA, 21 bp, Homo sapiens
atgtttcacataaaacctcat

SEQ ID NO: 2028693 - DNA, 13 bp, Homo sapiens
atgtttccaacct

SEQ ID NO: 2028694 - DNA, 14 bp, Homo sapiens
atgtttccagaaaa

SEQ ID NO: 2028695 - DNA, 17 bp, Homo sapiens
atgtttccagaaaatat

SEQ ID NO: 2028696 - DNA, 19 bp, Homo sapiens
atgtttccagaaaatataa

SEQ ID NO: 2028697 - DNA, 22 bp, Homo sapiens
atgtttctgcagtagtctctgt

SEQ ID NO: 2028698 - DNA, 20 bp, Homo sapiens
atgtttgaactgccaagaaa

SEQ ID NO: 2028699 - DNA, 21 bp, Homo sapiens
atgtttgatagattttctgct

SEQ ID NO: 2028700 - DNA, 15 bp, Homo sapiens
atgtttgatttagta

SEQ ID NO: 2028701 - DNA, 17 bp, Homo sapiens
atgtttgcacctttcta

SEQ ID NO: 2028702 - DNA, 21 bp, Homo sapiens
atgtttgcacctttctagttg

SEQ ID NO: 2028703 - DNA, 22 bp, Homo sapiens
atgtttgcctctgcctctgaca

SEQ ID NO: 2028704 - DNA, 16 bp, Homo sapiens
atgtttgctattgaca

SEQ ID NO: 2028705 - DNA, 14 bp, Homo sapiens
atgtttgtaaaact

SEQ ID NO: 2028706 - DNA, 19 bp, Homo sapiens
atgtttgtaaattaatact

SEQ ID NO: 2028707 - DNA, 22 bp, Homo sapiens
atgtttgtactagttgatgaag

SEQ ID NO: 2028708 - DNA, 19 bp, Homo sapiens
atgtttgtgccttaaaagg

SEQ ID NO: 2028709 - DNA, 21 bp, Homo sapiens
atgttttaaacatagaaagtt

SEQ ID NO: 2028710 - DNA, 16 bp, Homo sapiens
atgttttaagaggcag

SEQ ID NO: 2028711 - DNA, 18 bp, Homo sapiens
atgttttctgctgtttaa

SEQ ID NO: 2028712 - DNA, 20 bp, Homo sapiens
atgttttgtcccatttcctt

SEQ ID NO: 2028713 - DNA, 21 bp, Homo sapiens
atgttttgtcccatttccttg

SEQ ID NO: 2028714 - DNA, 17 bp, Homo sapiens
attaaaaaatttccagt

SEQ ID NO: 2028715 - DNA, 20 bp, Homo sapiens
attaaaaaccactgaacatt

SEQ ID NO: 2028716 - DNA, 20 bp, Homo sapiens
attaaaaactgagtgactct

SEQ ID NO: 2028717 - DNA, 13 bp, Homo sapiens
attaaaacacagc

SEQ ID NO: 2028718 - DNA, 16 bp, Homo sapiens
attaaaacacagcttt

SEQ ID NO: 2028719 - DNA, 16 bp, Homo sapiens
attaaaagaatatttt

SEQ ID NO: 2028720 - DNA, 14 bp, Homo sapiens
attaaaagttcata

SEQ ID NO: 2028721 - DNA, 19 bp, Homo sapiens
attaaaataaataaatgca

SEQ ID NO: 2028722 - DNA, 12 bp, Homo sapiens
attaaaatatat

SEQ ID NO: 2028723 - DNA, 13 bp, Homo sapiens
attaaaatgaata

SEQ ID NO: 2028724 - DNA, 18 bp, Homo sapiens
attaaaatgattgtaaaa

SEQ ID NO: 2028725 - DNA, 19 bp, Homo sapiens
attaaaatgattgtaaaat

SEQ ID NO: 2028726 - DNA, 20 bp, Homo sapiens
attaaaatgattgtaaaata

SEQ ID NO: 2028727 - DNA, 13 bp, Homo sapiens
attaaaattagtg

SEQ ID NO: 2028728 - DNA, 14 bp, Homo sapiens
attaaacacctgac

SEQ ID NO: 2028729 - DNA, 17 bp, Homo sapiens
attaaacacctgacaca

SEQ ID NO: 2028730 - DNA, 19 bp, Homo sapiens
attaaacacctgacacatc

SEQ ID NO: 2028731 - DNA, 13 bp, Homo sapiens
attaaacagccaa

SEQ ID NO: 2028732 - DNA, 17 bp, Homo sapiens
attaaacctggatacta

SEQ ID NO: 2028733 - DNA, 15 bp, Homo sapiens
attaaactgaagaag

SEQ ID NO: 2028734 - DNA, 18 bp, Homo sapiens
attaaactgaagaaggat

SEQ ID NO: 2028735 - DNA, 17 bp, Homo sapiens
attaaagcaacatttta

SEQ ID NO: 2028736 - DNA, 15 bp, Homo sapiens
attaaagcatttact

SEQ ID NO: 2028737 - DNA, 20 bp, Homo sapiens
attaaagcatttactttgaa

SEQ ID NO: 2028738 - DNA, 16 bp, Homo sapiens
attaaaggaaggaaaa

SEQ ID NO: 2028739 - DNA, 13 bp, Homo sapiens
attaaaggctttt

SEQ ID NO: 2028740 - DNA, 14 bp, Homo sapiens
attaaaggcttttg

SEQ ID NO: 2028741 - DNA, 12 bp, Homo sapiens
attaaagtgtta

SEQ ID NO: 2028742 - DNA, 14 bp, Homo sapiens
attaaatacagaca

SEQ ID NO: 2028743 - DNA, 19 bp, Homo sapiens
attaaatacagacactaag

SEQ ID NO: 2028744 - DNA, 22 bp, Homo sapiens
attaaatatgttagcaaagagt

SEQ ID NO: 2028745 - DNA, 15 bp, Homo sapiens
attaaatttaattag

SEQ ID NO: 2028746 - DNA, 15 bp, Homo sapiens
attaaatttctggat

SEQ ID NO: 2028747 - DNA, 15 bp, Homo sapiens
attaaattttctatg

SEQ ID NO: 2028748 - DNA, 14 bp, Homo sapiens
attaacaaattatg

SEQ ID NO: 2028749 - DNA, 11 bp, Homo sapiens
attaacactgc

SEQ ID NO: 2028750 - DNA, 22 bp, Homo sapiens
attaacattgggaaatcttata

SEQ ID NO: 2028751 - DNA, 13 bp, Homo sapiens
attaacctagaga

SEQ ID NO: 2028752 - DNA, 22 bp, Homo sapiens
attaactgggtaatgaaacaaa

SEQ ID NO: 2028753 - DNA, 17 bp, Homo sapiens
attaacttttttagaat

SEQ ID NO: 2028754 - DNA, 11 bp, Homo sapiens
attaagacttt

SEQ ID NO: 2028755 - DNA, 14 bp, Homo sapiens
attaagatacactc

SEQ ID NO: 2028756 - DNA, 16 bp, Homo sapiens
attaagatttccaagt

SEQ ID NO: 2028757 - DNA, 15 bp, Homo sapiens
attaagccaaacatg

SEQ ID NO: 2028758 - DNA, 14 bp, Homo sapiens
atctccctcccaca

SEQ ID NO: 2028759 - DNA, 12 bp, Homo sapiens
atctccctgccg

SEQ ID NO: 2028760 - DNA, 19 bp, Homo sapiens
atctccctgccgcctcaat

SEQ ID NO: 2028761 - DNA, 12 bp, Homo sapiens
atctcccttcct

SEQ ID NO: 2028762 - DNA, 22 bp, Homo sapiens
atctcctcccatggccttccct

SEQ ID NO: 2028763 - DNA, 22 bp, Homo sapiens
atctcctcctatttatgaaaac

SEQ ID NO: 2028764 - DNA, 13 bp, Homo sapiens
atctcctgtaatt

SEQ ID NO: 2028765 - DNA, 20 bp, Homo sapiens
atctcctgtaattttgtagt

SEQ ID NO: 2028766 - DNA, 16 bp, Homo sapiens
atctcgagccccctgg

SEQ ID NO: 2028767 - DNA, 18 bp, Homo sapiens
atctcgtgccagggcagg

SEQ ID NO: 2028768 - DNA, 18 bp, Homo sapiens
atctctactaaaaataca

SEQ ID NO: 2028769 - DNA, 15 bp, Homo sapiens
atctctagaatttta

SEQ ID NO: 2028770 - DNA, 21 bp, Homo sapiens
atctctagaattttaagtgct

SEQ ID NO: 2028771 - DNA, 17 bp, Homo sapiens
atctctatttaatattt

SEQ ID NO: 2028772 - DNA, 21 bp, Homo sapiens
atctctcaggagcacaggcag

SEQ ID NO: 2028773 - DNA, 23 bp, Homo sapiens
atctctcttccctaatcctccaa

SEQ ID NO: 2028774 - DNA, 13 bp, Homo sapiens
atctctgaaagca

SEQ ID NO: 2028775 - DNA, 13 bp, Homo sapiens
atctctgaagcat

SEQ ID NO: 2028776 - DNA, 17 bp, Homo sapiens
atctctgaagcatgttt

SEQ ID NO: 2028777 - DNA, 21 bp, Homo sapiens
atctctgtgactcgcttagct

SEQ ID NO: 2028778 - DNA, 24 bp, Homo sapiens
atctctgtgtacccactcctcact

SEQ ID NO: 2028779 - DNA, 21 bp, Homo sapiens
atctcttttttcaactggctg

SEQ ID NO: 2028780 - DNA, 13 bp, Homo sapiens
atctgaaaactgg

SEQ ID NO: 2028781 - DNA, 16 bp, Homo sapiens
atctgaaagtatattt

SEQ ID NO: 2028782 - DNA, 18 bp, Homo sapiens
atctgaagacctaccagg

SEQ ID NO: 2028783 - DNA, 18 bp, Homo sapiens
atctgaagctattgatgt

SEQ ID NO: 2028784 - DNA, 20 bp, Homo sapiens
atctgaagcttcactcactg

SEQ ID NO: 2028785 - DNA, 19 bp, Homo sapiens
atctgaatttttaaacaag

SEQ ID NO: 2028786 - DNA, 22 bp, Homo sapiens
atctgagaaaagctttgaaccc

SEQ ID NO: 2028787 - DNA, 17 bp, Homo sapiens
atctgagaagtgtatat

SEQ ID NO: 2028788 - DNA, 19 bp, Homo sapiens
atctgagatctccctccag

SEQ ID NO: 2028789 - DNA, 22 bp, Homo sapiens
atctgagcaagagctggcaaag

SEQ ID NO: 2028790 - DNA, 22 bp, Homo sapiens
atctgagcctaaatctaatcag

SEQ ID NO: 2028791 - DNA, 16 bp, Homo sapiens
atctgataaaattgtg

SEQ ID NO: 2028792 - DNA, 18 bp, Homo sapiens
atctgataaaattgtgat

SEQ ID NO: 2028793 - DNA, 19 bp, Homo sapiens
atctgatatgcagagtatt

SEQ ID NO: 2028794 - DNA, 22 bp, Homo sapiens
atctgatcgggataacaaaatc

SEQ ID NO: 2028795 - DNA, 17 bp, Homo sapiens
atctgatggtgagctgg

SEQ ID NO: 2028796 - DNA, 18 bp, Homo sapiens
atctgattggacattttc

SEQ ID NO: 2028797 - DNA, 17 bp, Homo sapiens
atctgattgtgatgtga

SEQ ID NO: 2028798 - DNA, 11 bp, Homo sapiens
atctgatttaa

SEQ ID NO: 2028799 - DNA, 16 bp, Homo sapiens
atctgatttaatgttt

SEQ ID NO: 2028800 - DNA, 21 bp, Homo sapiens
atctgatttaatgttttctgc

SEQ ID NO: 2028801 - DNA, 19 bp, Homo sapiens
atctgcactgggtgtggcc

SEQ ID NO: 2028802 - DNA, 21 bp, Homo sapiens
atctgcattccccgctgccca

SEQ ID NO: 2028803 - DNA, 22 bp, Homo sapiens
atctgcattccccgctgcccaa

SEQ ID NO: 2028804 - DNA, 14 bp, Homo sapiens
atctgcatttataa

SEQ ID NO: 2028805 - DNA, 19 bp, Homo sapiens
atctgcatttataaatgtg

SEQ ID NO: 2028806 - DNA, 21 bp, Homo sapiens
atctgcatttataaatgtgtg

SEQ ID NO: 2028807 - DNA, 22 bp, Homo sapiens
atctgcatttataaatgtgtgg

SEQ ID NO: 2028808 - DNA, 12 bp, Homo sapiens
atctgcctggcc

SEQ ID NO: 2028809 - DNA, 14 bp, Homo sapiens
atctgcctggcctg

SEQ ID NO: 2028810 - DNA, 17 bp, Homo sapiens
atctgcctggcctggct

SEQ ID NO: 2028811 - DNA, 17 bp, Homo sapiens
atctgcctgggcctgtg

SEQ ID NO: 2028812 - DNA, 23 bp, Homo sapiens
atctgcctgggcctgtgcagcag

SEQ ID NO: 2028813 - DNA, 18 bp, Homo sapiens
atctgcctgtggccttgc

SEQ ID NO: 2028814 - DNA, 22 bp, Homo sapiens
atctgcggggcttctgggtggc

SEQ ID NO: 2028815 - DNA, 18 bp, Homo sapiens
atctgctcagcaggccct

SEQ ID NO: 2028816 - DNA, 14 bp, Homo sapiens
atctgctgttgcca

SEQ ID NO: 2028817 - DNA, 19 bp, Homo sapiens
atctgctgttgccatagcc

SEQ ID NO: 2028818 - DNA, 14 bp, Homo sapiens
atctgcttcagtgg

SEQ ID NO: 2028819 - DNA, 17 bp, Homo sapiens
atctggactcctctgtc

SEQ ID NO: 2028820 - DNA, 19 bp, Homo sapiens
atctggactcctctgtcca

SEQ ID NO: 2028821 - DNA, 22 bp, Homo sapiens
atctggactcctctgtccaggc

SEQ ID NO: 2028822 - DNA, 22 bp, Homo sapiens
atctggagagctagaacctgga

SEQ ID NO: 2028823 - DNA, 15 bp, Homo sapiens
atctggattccagag

SEQ ID NO: 2028824 - DNA, 14 bp, Homo sapiens
atctggctcctgtt

SEQ ID NO: 2028825 - DNA, 14 bp, Homo sapiens
atctgggactttca

SEQ ID NO: 2028826 - DNA, 21 bp, Homo sapiens
atctgggaggcagaacaggct

SEQ ID NO: 2028827 - DNA, 22 bp, Homo sapiens
atctgggattcccaccaaggtc

SEQ ID NO: 2028828 - DNA, 16 bp, Homo sapiens
atctggggctctggga

SEQ ID NO: 2028829 - DNA, 17 bp, Homo sapiens
atctggtagatttttaa

SEQ ID NO: 2028830 - DNA, 18 bp, Homo sapiens
atctgtaaggaactggaa

SEQ ID NO: 2028831 - DNA, 19 bp, Homo sapiens
atctgtaaggaactggaac

SEQ ID NO: 2028832 - DNA, 15 bp, Homo sapiens
atctgtactgtaatt

SEQ ID NO: 2028833 - DNA, 16 bp, Homo sapiens
atctgtactgtaattt

SEQ ID NO: 2028834 - DNA, 17 bp, Homo sapiens
atctgtagggctggacc

SEQ ID NO: 2028835 - DNA, 16 bp, Homo sapiens
atctgtcatctctctg

SEQ ID NO: 2028836 - DNA, 17 bp, Homo sapiens
atctgtcccctctcccc

SEQ ID NO: 2028837 - DNA, 16 bp, Homo sapiens
atctgtcttgccagcc

SEQ ID NO: 2028838 - DNA, 17 bp, Homo sapiens
atctgtcttgccagcca

SEQ ID NO: 2028839 - DNA, 18 bp, Homo sapiens
atctgtcttgccagccag

SEQ ID NO: 2028840 - DNA, 21 bp, Homo sapiens
atctgtcttgccagccagaag

SEQ ID NO: 2028841 - DNA, 13 bp, Homo sapiens
atctgtgaattaa

SEQ ID NO: 2028842 - DNA, 18 bp, Homo sapiens
atctgtgaggtgctgatg

SEQ ID NO: 2028843 - DNA, 22 bp, Homo sapiens
atctgtgcaaatccttgatact

SEQ ID NO: 2028844 - DNA, 14 bp, Homo sapiens
atctgtgtctctgg

SEQ ID NO: 2028845 - DNA, 14 bp, Homo sapiens
atctgttactgaaa

SEQ ID NO: 2028846 - DNA, 15 bp, Homo sapiens
atctgttgttttgtt

SEQ ID NO: 2028847 - DNA, 21 bp, Homo sapiens
atctgtttgagaatatgatca

SEQ ID NO: 2028848 - DNA, 14 bp, Homo sapiens
atctgttttaaatt

SEQ ID NO: 2028849 - DNA, 22 bp, Homo sapiens
atctgttttgtatatgatctaa

SEQ ID NO: 2028850 - DNA, 19 bp, Homo sapiens
atctgtttttaaaaatcat

SEQ ID NO: 2028851 - DNA, 14 bp, Homo sapiens
atctgtttttctaa

SEQ ID NO: 2028852 - DNA, 13 bp, Homo sapiens
atcttattcacat

SEQ ID NO: 2028853 - DNA, 15 bp, Homo sapiens
atcttcaaagcttga

SEQ ID NO: 2028854 - DNA, 13 bp, Homo sapiens
atcttcagctccc

SEQ ID NO: 2028855 - DNA, 15 bp, Homo sapiens
atcttcagctcccat

SEQ ID NO: 2028856 - DNA, 16 bp, Homo sapiens
atcttcagctcccata

SEQ ID NO: 2028857 - DNA, 20 bp, Homo sapiens
atcttcagttttatctttaa

SEQ ID NO: 2028858 - DNA, 22 bp, Homo sapiens
atcttcagttttatctttaatc

SEQ ID NO: 2028859 - DNA, 12 bp, Homo sapiens
atcttcctgctg

SEQ ID NO: 2028860 - DNA, 13 bp, Homo sapiens
atcttcctgctgc

SEQ ID NO: 2028861 - DNA, 16 bp, Homo sapiens
atcttccttgtgagga

SEQ ID NO: 2028862 - DNA, 17 bp, Homo sapiens
atcttccttgtgaggat

SEQ ID NO: 2028863 - DNA, 14 bp, Homo sapiens
atcttcgtcctgcc

SEQ ID NO: 2028864 - DNA, 16 bp, Homo sapiens
atcttcgtcctgcccc

SEQ ID NO: 2028865 - DNA, 19 bp, Homo sapiens
atcttctccatctggcagg

SEQ ID NO: 2028866 - DNA, 18 bp, Homo sapiens
atcttctccattctagat

SEQ ID NO: 2028867 - DNA, 12 bp, Homo sapiens
atcttctctctt

SEQ ID NO: 2028868 - DNA, 19 bp, Homo sapiens
atcttctgaaatgaaacaa

SEQ ID NO: 2028869 - DNA, 18 bp, Homo sapiens
atcttctgcagacactgt

SEQ ID NO: 2028870 - DNA, 20 bp, Homo sapiens
atcttcttatgcaatttcct

SEQ ID NO: 2028871 - DNA, 15 bp, Homo sapiens
atcttgaagaatatt

SEQ ID NO: 2028872 - DNA, 17 bp, Homo sapiens
atcttgaagaatattgt

SEQ ID NO: 2028873 - DNA, 14 bp, Homo sapiens
atcttgacatgtaa

SEQ ID NO: 2028874 - DNA, 24 bp, Homo sapiens
atcttgcccctccagagacaggaa

SEQ ID NO: 2028875 - DNA, 15 bp, Homo sapiens
atcttggctcactgc

SEQ ID NO: 2028876 - DNA, 19 bp, Homo sapiens
atcttggtcctgtcaccct

SEQ ID NO: 2028877 - DNA, 22 bp, Homo sapiens
atcttggtcctgtcaccctggc

SEQ ID NO: 2028878 - DNA, 21 bp, Homo sapiens
atcttggttgatgccaaaaaa

SEQ ID NO: 2028879 - DNA, 23 bp, Homo sapiens
atcttgtatttgggccaaggtgt

SEQ ID NO: 2028880 - DNA, 15 bp, Homo sapiens
atcttgtccacagtc

SEQ ID NO: 2028881 - DNA, 17 bp, Homo sapiens
atcttgttaaattgctt

SEQ ID NO: 2028882 - DNA, 18 bp, Homo sapiens
atctttaaaaagcagtcc

SEQ ID NO: 2028883 - DNA, 14 bp, Homo sapiens
atctttaagtattg

SEQ ID NO: 2028884 - DNA, 16 bp, Homo sapiens
atctttaagtattgtt

SEQ ID NO: 2028885 - DNA, 12 bp, Homo sapiens
atctttcctgtc

SEQ ID NO: 2028886 - DNA, 18 bp, Homo sapiens
atctttccttgtctctca

SEQ ID NO: 2028887 - DNA, 14 bp, Homo sapiens
atctttctttacct

SEQ ID NO: 2028888 - DNA, 21 bp, Homo sapiens
atctttctttacctgagacca

SEQ ID NO: 2028889 - DNA, 22 bp, Homo sapiens
atctttctttacctgagaccag

SEQ ID NO: 2028890 - DNA, 20 bp, Homo sapiens
atctttctttggatgggact

SEQ ID NO: 2028891 - DNA, 21 bp, Homo sapiens
atctttcttttgattcttcct

SEQ ID NO: 2028892 - DNA, 16 bp, Homo sapiens
atctttgaaagctgaa

SEQ ID NO: 2028893 - DNA, 16 bp, Homo sapiens
atctttgattcagaca

SEQ ID NO: 2028894 - DNA, 21 bp, Homo sapiens
atctttgtgacaggaaagccc

SEQ ID NO: 2028895 - DNA, 18 bp, Homo sapiens
atctttgttttaaccagt

SEQ ID NO: 2028896 - DNA, 14 bp, Homo sapiens
atcttttgtgagat

SEQ ID NO: 2028897 - DNA, 14 bp, Homo sapiens
atctttttctctaa

SEQ ID NO: 2028898 - DNA, 19 bp, Homo sapiens
atgaaaaacacggcagctg

SEQ ID NO: 2028899 - DNA, 13 bp, Homo sapiens
atgaaaagctaga

SEQ ID NO: 2028900 - DNA, 22 bp, Homo sapiens
atgaaaatcagttatattcttt

SEQ ID NO: 2028901 - DNA, 13 bp, Homo sapiens
atgaaaatgaata

SEQ ID NO: 2028902 - DNA, 15 bp, Homo sapiens
atgaaaatgtaactt

SEQ ID NO: 2028903 - DNA, 15 bp, Homo sapiens
atgaaacacttctca

SEQ ID NO: 2028904 - DNA, 15 bp, Homo sapiens
atgaaacagatgata

SEQ ID NO: 2028905 - DNA, 21 bp, Homo sapiens
atgaaacagatgataaatatt

SEQ ID NO: 2028906 - DNA, 21 bp, Homo sapiens
atgaaactatggctttaaact

SEQ ID NO: 2028907 - DNA, 18 bp, Homo sapiens
atgaaactcctgattttg

SEQ ID NO: 2028908 - DNA, 20 bp, Homo sapiens
atgaaagatggctgtgcctc

SEQ ID NO: 2028909 - DNA, 12 bp, Homo sapiens
atgaaagcatgt

SEQ ID NO: 2028910 - DNA, 18 bp, Homo sapiens
atgaaagcatgtggcatg

SEQ ID NO: 2028911 - DNA, 19 bp, Homo sapiens
atgaaagccaaatttatat

SEQ ID NO: 2028912 - DNA, 19 bp, Homo sapiens
atgaaagggcccagagagg

SEQ ID NO: 2028913 - DNA, 22 bp, Homo sapiens
atgaaataaattggtgataagt

SEQ ID NO: 2028914 - DNA, 19 bp, Homo sapiens
atgaaatacacaagtaaac

SEQ ID NO: 2028915 - DNA, 17 bp, Homo sapiens
atgaaatatttgcttat

SEQ ID NO: 2028916 - DNA, 17 bp, Homo sapiens
atgaaatgactgtctaa

SEQ ID NO: 2028917 - DNA, 21 bp, Homo sapiens
atgaaatgataaagatgtcaa

SEQ ID NO: 2028918 - DNA, 12 bp, Homo sapiens
atgaaatgtctt

SEQ ID NO: 2028919 - DNA, 14 bp, Homo sapiens
atgaaattgagaag

SEQ ID NO: 2028920 - DNA, 20 bp, Homo sapiens
atgaaattgtctagcagagc

SEQ ID NO: 2028921 - DNA, 21 bp, Homo sapiens
atgaaatttaatatagctatt

SEQ ID NO: 2028922 - DNA, 19 bp, Homo sapiens
atgaaattttctagacttt

SEQ ID NO: 2028923 - DNA, 22 bp, Homo sapiens
atgaaattttctagactttctg

SEQ ID NO: 2028924 - DNA, 16 bp, Homo sapiens
atgaacagaacataga

SEQ ID NO: 2028925 - DNA, 12 bp, Homo sapiens
atgaacagcaga

SEQ ID NO: 2028926 - DNA, 22 bp, Homo sapiens
atgaaccacatcttgctctgct

SEQ ID NO: 2028927 - DNA, 23 bp, Homo sapiens
atgaaccacatcttgctctgctg

SEQ ID NO: 2028928 - DNA, 13 bp, Homo sapiens
atgaaccatcctt

SEQ ID NO: 2028929 - DNA, 23 bp, Homo sapiens
atgaacctcaagctgcatctaga

SEQ ID NO: 2028930 - DNA, 13 bp, Homo sapiens
atgaactgtgaca

SEQ ID NO: 2028931 - DNA, 14 bp, Homo sapiens
atgaactgtgacag

SEQ ID NO: 2028932 - DNA, 17 bp, Homo sapiens
atgaactgtgacaggaa

SEQ ID NO: 2028933 - DNA, 22 bp, Homo sapiens
atgaacttgaggacacatgtcc

SEQ ID NO: 2028934 - DNA, 15 bp, Homo sapiens
atgaagaaaaaatac

SEQ ID NO: 2028935 - DNA, 20 bp, Homo sapiens
atgaagaaaaaatacatttt

SEQ ID NO: 2028936 - DNA, 21 bp, Homo sapiens
atgaagacaggacagtgcttc

SEQ ID NO: 2028937 - DNA, 22 bp, Homo sapiens
atgaagacccagtgtaaagaat

SEQ ID NO: 2028938 - DNA, 12 bp, Homo sapiens
atgaagacctaa

SEQ ID NO: 2028939 - DNA, 16 bp, Homo sapiens
atgaagacctaaatga

SEQ ID NO: 2028940 - DNA, 21 bp, Homo sapiens
atgaagactgttaaatgaaac

SEQ ID NO: 2028941 - DNA, 21 bp, Homo sapiens
atgaagatgtctaatagttat

SEQ ID NO: 2028942 - DNA, 21 bp, Homo sapiens
atgaagcctgtgccacctgca

SEQ ID NO: 2028943 - DNA, 16 bp, Homo sapiens
atgaaggcaaaaaaat

SEQ ID NO: 2028944 - DNA, 23 bp, Homo sapiens
atgaaggcgtgcaaggggctcag

SEQ ID NO: 2028945 - DNA, 18 bp, Homo sapiens
atgaaggtgtcatacaga

SEQ ID NO: 2028946 - DNA, 21 bp, Homo sapiens
atgaaggttaggatttaacag

SEQ ID NO: 2028947 - DNA, 23 bp, Homo sapiens
atgaagtgtgtttccttcagtgc

SEQ ID NO: 2028948 - DNA, 19 bp, Homo sapiens
atgaagtttgaacttcata

SEQ ID NO: 2028949 - DNA, 17 bp, Homo sapiens
atgaataaagacaccta

SEQ ID NO: 2028950 - DNA, 21 bp, Homo sapiens
atgaatacagggcatgcattt

SEQ ID NO: 2028951 - DNA, 22 bp, Homo sapiens
atgaatgataagcaggaaggat

SEQ ID NO: 2028952 - DNA, 15 bp, Homo sapiens
atgaatgatgtttta

SEQ ID NO: 2028953 - DNA, 12 bp, Homo sapiens
atgaatgttctt

SEQ ID NO: 2028954 - DNA, 13 bp, Homo sapiens
atgacaaacccag

SEQ ID NO: 2028955 - DNA, 14 bp, Homo sapiens
atgacaacagaagc

SEQ ID NO: 2028956 - DNA, 20 bp, Homo sapiens
atgacaagcaaggtttctgg

SEQ ID NO: 2028957 - DNA, 14 bp, Homo sapiens
atgacaatgcaatg

SEQ ID NO: 2028958 - DNA, 23 bp, Homo sapiens
atgacacggtaggccaagctgaa

SEQ ID NO: 2028959 - DNA, 12 bp, Homo sapiens
atgacagagcga

SEQ ID NO: 2028960 - DNA, 17 bp, Homo sapiens
atgacagccagagcctg

SEQ ID NO: 2028961 - DNA, 19 bp, Homo sapiens
atgacagctcttctaagga

SEQ ID NO: 2028962 - DNA, 15 bp, Homo sapiens
atgacagctgtccct

SEQ ID NO: 2028963 - DNA, 16 bp, Homo sapiens
atgacagctgtccctg

SEQ ID NO: 2028964 - DNA, 21 bp, Homo sapiens
atgacagctgtccctgtcacc

SEQ ID NO: 2028965 - DNA, 20 bp, Homo sapiens
atgacagtccgtcaaaacag

SEQ ID NO: 2028966 - DNA, 16 bp, Homo sapiens
atgacatgcactgacc

SEQ ID NO: 2028967 - DNA, 22 bp, Homo sapiens
atgacatgcactgacccttcca

SEQ ID NO: 2028968 - DNA, 17 bp, Homo sapiens
atgacatgttatatatt

SEQ ID NO: 2028969 - DNA, 16 bp, Homo sapiens
atgaccaatctctgtg

SEQ ID NO: 2028970 - DNA, 17 bp, Homo sapiens
atgaccacgggcctcag

SEQ ID NO: 2028971 - DNA, 23 bp, Homo sapiens
atgaccacgggcctcagtttccc

SEQ ID NO: 2028972 - DNA, 14 bp, Homo sapiens
atgaccagcaaata

SEQ ID NO: 2028973 - DNA, 15 bp, Homo sapiens
atgaccatcctgtcc

SEQ ID NO: 2028974 - DNA, 12 bp, Homo sapiens
atgacctcagca

SEQ ID NO: 2028975 - DNA, 21 bp, Homo sapiens
atgacgtcaatagcagcccag

SEQ ID NO: 2028976 - DNA, 14 bp, Homo sapiens
atgactaaaaatat

SEQ ID NO: 2028977 - DNA, 14 bp, Homo sapiens
atgactataaacat

SEQ ID NO: 2028978 - DNA, 21 bp, Homo sapiens
atgactgctccccagccctgg

SEQ ID NO: 2028979 - DNA, 23 bp, Homo sapiens
atgactgctccccagccctggct

SEQ ID NO: 2028980 - DNA, 18 bp, Homo sapiens
atgactgtaaacatagat

SEQ ID NO: 2028981 - DNA, 19 bp, Homo sapiens
atgactgtttttcggacag

SEQ ID NO: 2028982 - DNA, 22 bp, Homo sapiens
atgactgtttttcggacagttt

SEQ ID NO: 2028983 - DNA, 18 bp, Homo sapiens
atgactgtttttgtagtg

SEQ ID NO: 2028984 - DNA, 20 bp, Homo sapiens
atgacttgggcacccccagc

SEQ ID NO: 2028985 - DNA, 13 bp, Homo sapiens
atgactttttata

SEQ ID NO: 2028986 - DNA, 12 bp, Homo sapiens
atgagaaaaaac

SEQ ID NO: 2028987 - DNA, 22 bp, Homo sapiens
atgagaaactttgatctctgct

SEQ ID NO: 2028988 - DNA, 14 bp, Homo sapiens
atgagaaatgtgaa

SEQ ID NO: 2028989 - DNA, 16 bp, Homo sapiens
atgagaagagggcctg

SEQ ID NO: 2028990 - DNA, 19 bp, Homo sapiens
atattccaccattcacatt

SEQ ID NO: 2028991 - DNA, 18 bp, Homo sapiens
atattcccctatctctag

SEQ ID NO: 2028992 - DNA, 21 bp, Homo sapiens
atattccgggtgccattccca

SEQ ID NO: 2028993 - DNA, 22 bp, Homo sapiens
atattcctattgtgcaatgtaa

SEQ ID NO: 2028994 - DNA, 21 bp, Homo sapiens
atattctacacatatatgtat

SEQ ID NO: 2028995 - DNA, 22 bp, Homo sapiens
atattctacacatatatgtata

SEQ ID NO: 2028996 - DNA, 22 bp, Homo sapiens
atattctcacgggcagtagctg

SEQ ID NO: 2028997 - DNA, 11 bp, Homo sapiens
atattctggaa

SEQ ID NO: 2028998 - DNA, 13 bp, Homo sapiens
atattctggaaaa

SEQ ID NO: 2028999 - DNA, 15 bp, Homo sapiens
atattctggaaaaaa

SEQ ID NO: 2029000 - DNA, 22 bp, Homo sapiens
atattctggaaaaaaaatatat

SEQ ID NO: 2029001 - DNA, 18 bp, Homo sapiens
atattgaatgtttccaac

SEQ ID NO: 2029002 - DNA, 17 bp, Homo sapiens
atattgcttatgtctct

SEQ ID NO: 2029003 - DNA, 13 bp, Homo sapiens
atattggtattca

SEQ ID NO: 2029004 - DNA, 12 bp, Homo sapiens
atattgtatgta

SEQ ID NO: 2029005 - DNA, 18 bp, Homo sapiens
atattgtatgtaagtaat

SEQ ID NO: 2029006 - DNA, 22 bp, Homo sapiens
atattgtcagagttctgctcta

SEQ ID NO: 2029007 - DNA, 9 bp, Homo sapiens
atatttaaa

SEQ ID NO: 2029008 - DNA, 18 bp, Homo sapiens
atatttaaacagcagtgt

SEQ ID NO: 2029009 - DNA, 14 bp, Homo sapiens
atatttaaagacag

SEQ ID NO: 2029010 - DNA, 19 bp, Homo sapiens
atatttaactctctttatg

SEQ ID NO: 2029011 - DNA, 18 bp, Homo sapiens
atatttaagccttttgtg

SEQ ID NO: 2029012 - DNA, 13 bp, Homo sapiens
atatttaagtata

SEQ ID NO: 2029013 - DNA, 15 bp, Homo sapiens
atatttacatatgaa

SEQ ID NO: 2029014 - DNA, 19 bp, Homo sapiens
atatttacatatgaaattt

SEQ ID NO: 2029015 - DNA, 13 bp, Homo sapiens
atatttactttaa

SEQ ID NO: 2029016 - DNA, 19 bp, Homo sapiens
atatttagattgttaaaat

SEQ ID NO: 2029017 - DNA, 21 bp, Homo sapiens
atatttagttatagtttcaga

SEQ ID NO: 2029018 - DNA, 21 bp, Homo sapiens
atatttataactcatcataaa

SEQ ID NO: 2029019 - DNA, 12 bp, Homo sapiens
atatttatgctt

SEQ ID NO: 2029020 - DNA, 14 bp, Homo sapiens
atatttattacctc

SEQ ID NO: 2029021 - DNA, 23 bp, Homo sapiens
atatttattgtttatttatcagt

SEQ ID NO: 2029022 - DNA, 19 bp, Homo sapiens
atatttattttttttaagt

SEQ ID NO: 2029023 - DNA, 13 bp, Homo sapiens
atatttcaaatga

SEQ ID NO: 2029024 - DNA, 14 bp, Homo sapiens
atatttccatttct

SEQ ID NO: 2029025 - DNA, 13 bp, Homo sapiens
atatttgaaactg

SEQ ID NO: 2029026 - DNA, 16 bp, Homo sapiens
atatttgcttatttat

SEQ ID NO: 2029027 - DNA, 19 bp, Homo sapiens
atatttgcttatttatatt

SEQ ID NO: 2029028 - DNA, 20 bp, Homo sapiens
atatttgcttatttatattc

SEQ ID NO: 2029029 - DNA, 13 bp, Homo sapiens
atatttggaaaga

SEQ ID NO: 2029030 - DNA, 15 bp, Homo sapiens
atatttggaaagaga

SEQ ID NO: 2029031 - DNA, 12 bp, Homo sapiens
atatttgtacat

SEQ ID NO: 2029032 - DNA, 22 bp, Homo sapiens
atatttgtatcacaaatcttaa

SEQ ID NO: 2029033 - DNA, 14 bp, Homo sapiens
atattttaaagaat

SEQ ID NO: 2029034 - DNA, 12 bp, Homo sapiens
atattttacagt

SEQ ID NO: 2029035 - DNA, 21 bp, Homo sapiens
atattttagatgcaatgtgat

SEQ ID NO: 2029036 - DNA, 13 bp, Homo sapiens
atattttagcctt

SEQ ID NO: 2029037 - DNA, 14 bp, Homo sapiens
atattttataattt

SEQ ID NO: 2029038 - DNA, 21 bp, Homo sapiens
atattttatatgaaatgtttc

SEQ ID NO: 2029039 - DNA, 13 bp, Homo sapiens
atattttatgatt

SEQ ID NO: 2029040 - DNA, 15 bp, Homo sapiens
atattttatgattta

SEQ ID NO: 2029041 - DNA, 19 bp, Homo sapiens
atattttcaacgcagccct

SEQ ID NO: 2029042 - DNA, 20 bp, Homo sapiens
atattttcaacgcagccctg

SEQ ID NO: 2029043 - DNA, 18 bp, Homo sapiens
atattttccatgaaaatg

SEQ ID NO: 2029044 - DNA, 21 bp, Homo sapiens
atattttccctctcttgcctt

SEQ ID NO: 2029045 - DNA, 13 bp, Homo sapiens
atattttgtatat

SEQ ID NO: 2029046 - DNA, 13 bp, Homo sapiens
atatttttataga

SEQ ID NO: 2029047 - DNA, 14 bp, Homo sapiens
atatttttatagac

SEQ ID NO: 2029048 - DNA, 18 bp, Homo sapiens
atatttttatatttagtt

SEQ ID NO: 2029049 - DNA, 16 bp, Homo sapiens
atatttttgatggtaa

SEQ ID NO: 2029050 - DNA, 21 bp, Homo sapiens
atatttttggttgtcaatatt

SEQ ID NO: 2029051 - DNA, 22 bp, Homo sapiens
atatttttgtacgttatatatt

SEQ ID NO: 2029052 - DNA, 23 bp, Homo sapiens
atatttttgtacgttatatattg

SEQ ID NO: 2029053 - DNA, 14 bp, Homo sapiens
atcaaaaataaact

SEQ ID NO: 2029054 - DNA, 16 bp, Homo sapiens
atcaaaaatattccat

SEQ ID NO: 2029055 - DNA, 19 bp, Homo sapiens
atcaaaagctgcttgacta

SEQ ID NO: 2029056 - DNA, 17 bp, Homo sapiens
atcaaaataaattgaaa

SEQ ID NO: 2029057 - DNA, 18 bp, Homo sapiens
atcaaaatcactatcttt

SEQ ID NO: 2029058 - DNA, 22 bp, Homo sapiens
atcaaacaccaacataaaaatg

SEQ ID NO: 2029059 - DNA, 14 bp, Homo sapiens
atcaaactgaagcc

SEQ ID NO: 2029060 - DNA, 15 bp, Homo sapiens
atcaaactgaagcca

SEQ ID NO: 2029061 - DNA, 17 bp, Homo sapiens
atcaaactgaagccaga

SEQ ID NO: 2029062 - DNA, 14 bp, Homo sapiens
atcaaagtaaaaaa

SEQ ID NO: 2029063 - DNA, 14 bp, Homo sapiens
atcaaatatgcaaa

SEQ ID NO: 2029064 - DNA, 17 bp, Homo sapiens
atcaaatctgtatatgt

SEQ ID NO: 2029065 - DNA, 20 bp, Homo sapiens
atcaaatgctgtagaatgct

SEQ ID NO: 2029066 - DNA, 21 bp, Homo sapiens
atcaacatctttttcctccct

SEQ ID NO: 2029067 - DNA, 20 bp, Homo sapiens
atcaaccccttcgctcctgt

SEQ ID NO: 2029068 - DNA, 22 bp, Homo sapiens
atcaaccccttcgctcctgtgt

SEQ ID NO: 2029069 - DNA, 16 bp, Homo sapiens
atcaactccagctccc

SEQ ID NO: 2029070 - DNA, 16 bp, Homo sapiens
atcaacttgaagcaag

SEQ ID NO: 2029071 - DNA, 14 bp, Homo sapiens
atcaagaatattca

SEQ ID NO: 2029072 - DNA, 13 bp, Homo sapiens
atcaagcccttta

SEQ ID NO: 2029073 - DNA, 12 bp, Homo sapiens
atcaataaaaat

SEQ ID NO: 2029074 - DNA, 20 bp, Homo sapiens
atcaatcatctgtgtgaaaa

SEQ ID NO: 2029075 - DNA, 17 bp, Homo sapiens
atcaatcctgcccccag

SEQ ID NO: 2029076 - DNA, 22 bp, Homo sapiens
atcaatccttcttatgtttgct

SEQ ID NO: 2029077 - DNA, 19 bp, Homo sapiens
atcaatggaaacagggcag

SEQ ID NO: 2029078 - DNA, 23 bp, Homo sapiens
atcaatgttcacgcaacttgaaa

SEQ ID NO: 2029079 - DNA, 17 bp, Homo sapiens
atcaattaattcttaat

SEQ ID NO: 2029080 - DNA, 19 bp, Homo sapiens
atcaatttaaaatcattca

SEQ ID NO: 2029081 - DNA, 13 bp, Homo sapiens
atcaatttcccag

SEQ ID NO: 2029082 - DNA, 15 bp, Homo sapiens
atcaatttcccagaa

SEQ ID NO: 2029083 - DNA, 16 bp, Homo sapiens
atcaatttttatacat

SEQ ID NO: 2029084 - DNA, 20 bp, Homo sapiens
atcacaagaatcacctcaaa

SEQ ID NO: 2029085 - DNA, 15 bp, Homo sapiens
atcacaagcaataat

SEQ ID NO: 2029086 - DNA, 14 bp, Homo sapiens
atcacacctctggg

SEQ ID NO: 2029087 - DNA, 15 bp, Homo sapiens
atcacacctctgggc

SEQ ID NO: 2029088 - DNA, 14 bp, Homo sapiens
atcacagaggcttc

SEQ ID NO: 2029089 - DNA, 22 bp, Homo sapiens
atcacagatgggtattaaactt

SEQ ID NO: 2029090 - DNA, 14 bp, Homo sapiens
atcacagcagaatg

SEQ ID NO: 2029091 - DNA, 12 bp, Homo sapiens
atcacagggcag

SEQ ID NO: 2029092 - DNA, 20 bp, Homo sapiens
atcacagggcagagccggga

SEQ ID NO: 2029093 - DNA, 18 bp, Homo sapiens
atcacaggggcggggcag

SEQ ID NO: 2029094 - DNA, 14 bp, Homo sapiens
atcacatacaattt

SEQ ID NO: 2029095 - DNA, 18 bp, Homo sapiens
atcacatcaagcatgcaa

SEQ ID NO: 2029096 - DNA, 21 bp, Homo sapiens
atcaccatgtaacaaccagag

SEQ ID NO: 2029097 - DNA, 18 bp, Homo sapiens
atcacccagtcctggcca

SEQ ID NO: 2029098 - DNA, 22 bp, Homo sapiens
atcaccgacgcgtctcctgttt

SEQ ID NO: 2029099 - DNA, 15 bp, Homo sapiens
atcacctcaggccag

SEQ ID NO: 2029100 - DNA, 12 bp, Homo sapiens
atcacctgaggt

SEQ ID NO: 2029101 - DNA, 12 bp, Homo sapiens
atcacctggagg

SEQ ID NO: 2029102 - DNA, 15 bp, Homo sapiens
atcacgccactgcac

SEQ ID NO: 2029103 - DNA, 18 bp, Homo sapiens
atcacgctttttgaaaaa

SEQ ID NO: 2029104 - DNA, 17 bp, Homo sapiens
atcacggatcaatagac

SEQ ID NO: 2029105 - DNA, 14 bp, Homo sapiens
atcacggcatgttt

SEQ ID NO: 2029106 - DNA, 18 bp, Homo sapiens
atcacggctcactgcagc

SEQ ID NO: 2029107 - DNA, 19 bp, Homo sapiens
atcctgctttccctcccca

SEQ ID NO: 2029108 - DNA, 16 bp, Homo sapiens
atcctggattcactca

SEQ ID NO: 2029109 - DNA, 20 bp, Homo sapiens
atcctggattcactcactca

SEQ ID NO: 2029110 - DNA, 14 bp, Homo sapiens
atcctggcccctcc

SEQ ID NO: 2029111 - DNA, 12 bp, Homo sapiens
atcctgggcctt

SEQ ID NO: 2029112 - DNA, 17 bp, Homo sapiens
atcctgggccttacctc

SEQ ID NO: 2029113 - DNA, 17 bp, Homo sapiens
atcctgtatattatggt

SEQ ID NO: 2029114 - DNA, 19 bp, Homo sapiens
atcctgtcgattagactgg

SEQ ID NO: 2029115 - DNA, 19 bp, Homo sapiens
atcctgtctttaaggaaaa

SEQ ID NO: 2029116 - DNA, 22 bp, Homo sapiens
atccttaggaaaatgcttctgt

SEQ ID NO: 2029117 - DNA, 20 bp, Homo sapiens
atccttcaagaactctgggc

SEQ ID NO: 2029118 - DNA, 17 bp, Homo sapiens
atccttcaccagagccc

SEQ ID NO: 2029119 - DNA, 20 bp, Homo sapiens
atccttcaccagcaactctg

SEQ ID NO: 2029120 - DNA, 13 bp, Homo sapiens
atccttcccatga

SEQ ID NO: 2029121 - DNA, 11 bp, Homo sapiens
atccttctgcc

SEQ ID NO: 2029122 - DNA, 19 bp, Homo sapiens
atccttcttatgtttgctt

SEQ ID NO: 2029123 - DNA, 15 bp, Homo sapiens
atccttgaactgtca

SEQ ID NO: 2029124 - DNA, 19 bp, Homo sapiens
atccttgagcactcagtct

SEQ ID NO: 2029125 - DNA, 14 bp, Homo sapiens
atccttggagagca

SEQ ID NO: 2029126 - DNA, 15 bp, Homo sapiens
atccttggagagcag

SEQ ID NO: 2029127 - DNA, 23 bp, Homo sapiens
atccttgtctttactgacaagaa

SEQ ID NO: 2029128 - DNA, 17 bp, Homo sapiens
atcctttaaatccttcc

SEQ ID NO: 2029129 - DNA, 13 bp, Homo sapiens
atcctttgcccca

SEQ ID NO: 2029130 - DNA, 19 bp, Homo sapiens
atcctttgccccaaggctg

SEQ ID NO: 2029131 - DNA, 18 bp, Homo sapiens
atccttttatgttattta

SEQ ID NO: 2029132 - DNA, 15 bp, Homo sapiens
atccttttctgcaga

SEQ ID NO: 2029133 - DNA, 18 bp, Homo sapiens
atcctttttctttataaa

SEQ ID NO: 2029134 - DNA, 12 bp, Homo sapiens
atcgaaaattca

SEQ ID NO: 2029135 - DNA, 16 bp, Homo sapiens
atcgaacaaactgatg

SEQ ID NO: 2029136 - DNA, 17 bp, Homo sapiens
atcgaacaaactgatgc

SEQ ID NO: 2029137 - DNA, 14 bp, Homo sapiens
atcgacctcactgt

SEQ ID NO: 2029138 - DNA, 12 bp, Homo sapiens
atcgattggctt

SEQ ID NO: 2029139 - DNA, 22 bp, Homo sapiens
atcgcaccttttataccagaga

SEQ ID NO: 2029140 - DNA, 17 bp, Homo sapiens
atcgctgccttgccatg

SEQ ID NO: 2029141 - DNA, 22 bp, Homo sapiens
atcgctgtgaaaatgaggagga

SEQ ID NO: 2029142 - DNA, 14 bp, Homo sapiens
atcgcttgagccca

SEQ ID NO: 2029143 - DNA, 17 bp, Homo sapiens
atcgcttgagcccagga

SEQ ID NO: 2029144 - DNA, 19 bp, Homo sapiens
atcgcttgagcccaggagt

SEQ ID NO: 2029145 - DNA, 13 bp, Homo sapiens
atcggagacagtg

SEQ ID NO: 2029146 - DNA, 16 bp, Homo sapiens
atcggagcctcctctc

SEQ ID NO: 2029147 - DNA, 22 bp, Homo sapiens
atcggaggtggtggaggaggag

SEQ ID NO: 2029148 - DNA, 23 bp, Homo sapiens
atcggcccacagctcccacccca

SEQ ID NO: 2029149 - DNA, 15 bp, Homo sapiens
atcgggaacagtgtt

SEQ ID NO: 2029150 - DNA, 16 bp, Homo sapiens
atcgggaacagtgttt

SEQ ID NO: 2029151 - DNA, 17 bp, Homo sapiens
atcgggaacagtgtttc

SEQ ID NO: 2029152 - DNA, 18 bp, Homo sapiens
atcgggagcagtgtcttc

SEQ ID NO: 2029153 - DNA, 13 bp, Homo sapiens
atcgtagaagaga

SEQ ID NO: 2029154 - DNA, 18 bp, Homo sapiens
atcgtctcctttgacatt

SEQ ID NO: 2029155 - DNA, 16 bp, Homo sapiens
atcgtgacccttcagg

SEQ ID NO: 2029156 - DNA, 18 bp, Homo sapiens
atcgtgccgttactctcc

SEQ ID NO: 2029157 - DNA, 23 bp, Homo sapiens
atcgtgccgttactctccaacct

SEQ ID NO: 2029158 - DNA, 15 bp, Homo sapiens
atcgtgcctataaat

SEQ ID NO: 2029159 - DNA, 12 bp, Homo sapiens
atcgtgctaaat

SEQ ID NO: 2029160 - DNA, 15 bp, Homo sapiens
atcgttatgtgtgta

SEQ ID NO: 2029161 - DNA, 21 bp, Homo sapiens
atcgttatgtgtgtatatgta

SEQ ID NO: 2029162 - DNA, 18 bp, Homo sapiens
atctaagcctttccataa

SEQ ID NO: 2029163 - DNA, 16 bp, Homo sapiens
atctaagttaatttaa

SEQ ID NO: 2029164 - DNA, 17 bp, Homo sapiens
atctaagttaatttaaa

SEQ ID NO: 2029165 - DNA, 21 bp, Homo sapiens
atctaatagcgggttactttc

SEQ ID NO: 2029166 - DNA, 20 bp, Homo sapiens
atctaatatgtaacaagcca

SEQ ID NO: 2029167 - DNA, 22 bp, Homo sapiens
atctaatgtaagaaaatttgaa

SEQ ID NO: 2029168 - DNA, 21 bp, Homo sapiens
atctaatgtctcttcctctgt

SEQ ID NO: 2029169 - DNA, 15 bp, Homo sapiens
atctaatttatacaa

SEQ ID NO: 2029170 - DNA, 18 bp, Homo sapiens
atctaatttatacaaaat

SEQ ID NO: 2029171 - DNA, 21 bp, Homo sapiens
atctaatttatacaaaataat

SEQ ID NO: 2029172 - DNA, 13 bp, Homo sapiens
atctacacagcct

SEQ ID NO: 2029173 - DNA, 16 bp, Homo sapiens
atctacagctcacctc

SEQ ID NO: 2029174 - DNA, 21 bp, Homo sapiens
atctaccgacctgtctccctg

SEQ ID NO: 2029175 - DNA, 16 bp, Homo sapiens
atctacctgccctctc

SEQ ID NO: 2029176 - DNA, 14 bp, Homo sapiens
atctacctgtggtg

SEQ ID NO: 2029177 - DNA, 16 bp, Homo sapiens
atctactcagaaattt

SEQ ID NO: 2029178 - DNA, 17 bp, Homo sapiens
atctagaaagaaaagac

SEQ ID NO: 2029179 - DNA, 21 bp, Homo sapiens
atctagaacacaggcaaaatc

SEQ ID NO: 2029180 - DNA, 21 bp, Homo sapiens
atctagaatgtgttttctgaa

SEQ ID NO: 2029181 - DNA, 21 bp, Homo sapiens
atctagatcaattaattctta

SEQ ID NO: 2029182 - DNA, 22 bp, Homo sapiens
atctagatcaattaattcttaa

SEQ ID NO: 2029183 - DNA, 18 bp, Homo sapiens
atctagttttttttgtaa

SEQ ID NO: 2029184 - DNA, 21 bp, Homo sapiens
atctatagtagtcaattagta

SEQ ID NO: 2029185 - DNA, 15 bp, Homo sapiens
atctatattaaagtg

SEQ ID NO: 2029186 - DNA, 15 bp, Homo sapiens
atctatcaatagtca

SEQ ID NO: 2029187 - DNA, 17 bp, Homo sapiens
atctatcaatagtcaag

SEQ ID NO: 2029188 - DNA, 13 bp, Homo sapiens
atctatgcaattt

SEQ ID NO: 2029189 - DNA, 16 bp, Homo sapiens
atctatgcaattttta

SEQ ID NO: 2029190 - DNA, 14 bp, Homo sapiens
atctatggagggca

SEQ ID NO: 2029191 - DNA, 19 bp, Homo sapiens
atctatggcagtccagcca

SEQ ID NO: 2029192 - DNA, 20 bp, Homo sapiens
atctatggcagtccagccag

SEQ ID NO: 2029193 - DNA, 20 bp, Homo sapiens
atctatggccctgcaaaaat

SEQ ID NO: 2029194 - DNA, 23 bp, Homo sapiens
atctatggccctgcaaaaatata

SEQ ID NO: 2029195 - DNA, 17 bp, Homo sapiens
atctattataaaaccat

SEQ ID NO: 2029196 - DNA, 15 bp, Homo sapiens
atctattcagacaag

SEQ ID NO: 2029197 - DNA, 14 bp, Homo sapiens
atctatttacataa

SEQ ID NO: 2029198 - DNA, 15 bp, Homo sapiens
atctatttacataaa

SEQ ID NO: 2029199 - DNA, 15 bp, Homo sapiens
atctcactgcccagt

SEQ ID NO: 2029200 - DNA, 13 bp, Homo sapiens
atctcactttgcc

SEQ ID NO: 2029201 - DNA, 20 bp, Homo sapiens
atctcagaattccttttcta

SEQ ID NO: 2029202 - DNA, 20 bp, Homo sapiens
atctcagataaagtgaccag

SEQ ID NO: 2029203 - DNA, 11 bp, Homo sapiens
atctcagccca

SEQ ID NO: 2029204 - DNA, 12 bp, Homo sapiens
atctcaggagct

SEQ ID NO: 2029205 - DNA, 18 bp, Homo sapiens
atctcagggtccagaccc

SEQ ID NO: 2029206 - DNA, 14 bp, Homo sapiens
atctcaggtgccac

SEQ ID NO: 2029207 - DNA, 16 bp, Homo sapiens
atctcaggtgccactc

SEQ ID NO: 2029208 - DNA, 16 bp, Homo sapiens
atctcatttaagggaa

SEQ ID NO: 2029209 - DNA, 17 bp, Homo sapiens
atctcatttaagggaaa

SEQ ID NO: 2029210 - DNA, 12 bp, Homo sapiens
atctccaaggac

SEQ ID NO: 2029211 - DNA, 15 bp, Homo sapiens
atctccaattgcctc

SEQ ID NO: 2029212 - DNA, 15 bp, Homo sapiens
atctccactccagat

SEQ ID NO: 2029213 - DNA, 12 bp, Homo sapiens
atctccaggatt

SEQ ID NO: 2029214 - DNA, 20 bp, Homo sapiens
atctccaggattgaagagca

SEQ ID NO: 2029215 - DNA, 17 bp, Homo sapiens
atctccagggctgcccc

SEQ ID NO: 2029216 - DNA, 13 bp, Homo sapiens
atctccagtgtgc

SEQ ID NO: 2029217 - DNA, 22 bp, Homo sapiens
atctccatttcacacaggtcct

SEQ ID NO: 2029218 - DNA, 13 bp, Homo sapiens
atctccccaggcc

SEQ ID NO: 2029219 - DNA, 17 bp, Homo sapiens
atctccccaggcctcca

SEQ ID NO: 2029220 - DNA, 22 bp, Homo sapiens
atctccccaggcctccagcctc

SEQ ID NO: 2029221 - DNA, 20 bp, Homo sapiens
atctcccccatcccccactg

SEQ ID NO: 2029222 - DNA, 13 bp, Homo sapiens
atctcccctcctc

SEQ ID NO: 2029223 - DNA, 16 bp, Homo sapiens
atctcccctcctcaca

SEQ ID NO: 2029224 - DNA, 22 bp, Homo sapiens
atcacggctcactgcagcctca

SEQ ID NO: 2029225 - DNA, 20 bp, Homo sapiens
atcactaatactaattcatt

SEQ ID NO: 2029226 - DNA, 19 bp, Homo sapiens
atcactataaccatcagtt

SEQ ID NO: 2029227 - DNA, 20 bp, Homo sapiens
atcactataaccatcagtta

SEQ ID NO: 2029228 - DNA, 13 bp, Homo sapiens
atcactccctgga

SEQ ID NO: 2029229 - DNA, 16 bp, Homo sapiens
atcactccctggatgt

SEQ ID NO: 2029230 - DNA, 12 bp, Homo sapiens
atcactgctccc

SEQ ID NO: 2029231 - DNA, 19 bp, Homo sapiens
atcactggagcaccaggca

SEQ ID NO: 2029232 - DNA, 12 bp, Homo sapiens
atcactggagcc

SEQ ID NO: 2029233 - DNA, 17 bp, Homo sapiens
atcactggagcccagga

SEQ ID NO: 2029234 - DNA, 18 bp, Homo sapiens
atcactggcaatgaaaaa

SEQ ID NO: 2029235 - DNA, 22 bp, Homo sapiens
atcactggcaatgaaaaattct

SEQ ID NO: 2029236 - DNA, 23 bp, Homo sapiens
atcactggcaatgaaaaattctc

SEQ ID NO: 2029237 - DNA, 14 bp, Homo sapiens
atcacttactcagt

SEQ ID NO: 2029238 - DNA, 15 bp, Homo sapiens
atcacttgtaaataa

SEQ ID NO: 2029239 - DNA, 22 bp, Homo sapiens
atcacttgtaaataaatagatt

SEQ ID NO: 2029240 - DNA, 14 bp, Homo sapiens
atcacttgtacaaa

SEQ ID NO: 2029241 - DNA, 17 bp, Homo sapiens
atcacttgtacaaaata

SEQ ID NO: 2029242 - DNA, 16 bp, Homo sapiens
atcactttgttaaaaa

SEQ ID NO: 2029243 - DNA, 13 bp, Homo sapiens
atcacttttcagt

SEQ ID NO: 2029244 - DNA, 14 bp, Homo sapiens
atcacttttctgta

SEQ ID NO: 2029245 - DNA, 13 bp, Homo sapiens
atcagaaaagtag

SEQ ID NO: 2029246 - DNA, 14 bp, Homo sapiens
atcagaaaagtaga

SEQ ID NO: 2029247 - DNA, 15 bp, Homo sapiens
atcagaaagggaggg

SEQ ID NO: 2029248 - DNA, 17 bp, Homo sapiens
atcagaaagggagggct

SEQ ID NO: 2029249 - DNA, 12 bp, Homo sapiens
atcagaacagga

SEQ ID NO: 2029250 - DNA, 22 bp, Homo sapiens
atcagaagaccacaaaaattga

SEQ ID NO: 2029251 - DNA, 17 bp, Homo sapiens
atcagaagataacttga

SEQ ID NO: 2029252 - DNA, 14 bp, Homo sapiens
atcagaaggctggg

SEQ ID NO: 2029253 - DNA, 20 bp, Homo sapiens
atcagaaggctggggccagt

SEQ ID NO: 2029254 - DNA, 23 bp, Homo sapiens
atcagaaggctggggccagtgta

SEQ ID NO: 2029255 - DNA, 13 bp, Homo sapiens
atcagaatctgtg

SEQ ID NO: 2029256 - DNA, 20 bp, Homo sapiens
atcagaccataatgttacat

SEQ ID NO: 2029257 - DNA, 18 bp, Homo sapiens
atcagaccctaccccacc

SEQ ID NO: 2029258 - DNA, 20 bp, Homo sapiens
atcagaccctaccccaccac

SEQ ID NO: 2029259 - DNA, 13 bp, Homo sapiens
atcagacctctga

SEQ ID NO: 2029260 - DNA, 20 bp, Homo sapiens
atcagagtgacatccaggag

SEQ ID NO: 2029261 - DNA, 20 bp, Homo sapiens
atcagagttgcttttctaat

SEQ ID NO: 2029262 - DNA, 14 bp, Homo sapiens
atcagatctgtctt

SEQ ID NO: 2029263 - DNA, 15 bp, Homo sapiens
atcagcactgaaaat

SEQ ID NO: 2029264 - DNA, 20 bp, Homo sapiens
atcagcctccgccattccaa

SEQ ID NO: 2029265 - DNA, 20 bp, Homo sapiens
atcagcctgagtctcctgtg

SEQ ID NO: 2029266 - DNA, 22 bp, Homo sapiens
atcagcctgagtctcctgtgcc

SEQ ID NO: 2029267 - DNA, 16 bp, Homo sapiens
atcagcgtggccttgt

SEQ ID NO: 2029268 - DNA, 11 bp, Homo sapiens
atcagctccct

SEQ ID NO: 2029269 - DNA, 16 bp, Homo sapiens
atcagctgtttgtcat

SEQ ID NO: 2029270 - DNA, 23 bp, Homo sapiens
atcagcttttaataaaattgaca

SEQ ID NO: 2029271 - DNA, 17 bp, Homo sapiens
atcaggaagagaaggag

SEQ ID NO: 2029272 - DNA, 15 bp, Homo sapiens
atcaggcacaggcag

SEQ ID NO: 2029273 - DNA, 21 bp, Homo sapiens
atcaggcacaggcaggaagag

SEQ ID NO: 2029274 - DNA, 23 bp, Homo sapiens
atcaggcacaggcaggaagagag

SEQ ID NO: 2029275 - DNA, 13 bp, Homo sapiens
atcaggcactggt

SEQ ID NO: 2029276 - DNA, 21 bp, Homo sapiens
atcaggtcattattttttaca

SEQ ID NO: 2029277 - DNA, 20 bp, Homo sapiens
atcaggtcctcagagaattt

SEQ ID NO: 2029278 - DNA, 14 bp, Homo sapiens
atcaggtgctgcca

SEQ ID NO: 2029279 - DNA, 15 bp, Homo sapiens
atcagtattaatact

SEQ ID NO: 2029280 - DNA, 17 bp, Homo sapiens
atcagtattaatactaa

SEQ ID NO: 2029281 - DNA, 23 bp, Homo sapiens
atcagtattaatactaaaatatg

SEQ ID NO: 2029282 - DNA, 19 bp, Homo sapiens
atcagtcataactaaataa

SEQ ID NO: 2029283 - DNA, 16 bp, Homo sapiens
atcagtctcagaatgt

SEQ ID NO: 2029284 - DNA, 15 bp, Homo sapiens
atcagttactcagcc

SEQ ID NO: 2029285 - DNA, 19 bp, Homo sapiens
atcagttactcagccctgg

SEQ ID NO: 2029286 - DNA, 13 bp, Homo sapiens
atcagttactggt

SEQ ID NO: 2029287 - DNA, 14 bp, Homo sapiens
atcagttactggtt

SEQ ID NO: 2029288 - DNA, 17 bp, Homo sapiens
atcagttttatccacag

SEQ ID NO: 2029289 - DNA, 21 bp, Homo sapiens
atcagttttttcacctggaag

SEQ ID NO: 2029290 - DNA, 13 bp, Homo sapiens
atcataaaataaa

SEQ ID NO: 2029291 - DNA, 13 bp, Homo sapiens
atcataattttca

SEQ ID NO: 2029292 - DNA, 22 bp, Homo sapiens
atcatactaccggctacatcaa

SEQ ID NO: 2029293 - DNA, 15 bp, Homo sapiens
atcatagaaatgtaa

SEQ ID NO: 2029294 - DNA, 17 bp, Homo sapiens
atcataggtatttcaaa

SEQ ID NO: 2029295 - DNA, 18 bp, Homo sapiens
atcataggtatttcaaaa

SEQ ID NO: 2029296 - DNA, 23 bp, Homo sapiens
atcatagtggcttaaaacaacac

SEQ ID NO: 2029297 - DNA, 16 bp, Homo sapiens
atcatataataaatgt

SEQ ID NO: 2029298 - DNA, 20 bp, Homo sapiens
atcatatgacatgccaccct

SEQ ID NO: 2029299 - DNA, 23 bp, Homo sapiens
atcatatgacatgccaccctctc

SEQ ID NO: 2029300 - DNA, 16 bp, Homo sapiens
atcatcagtgtagaac

SEQ ID NO: 2029301 - DNA, 21 bp, Homo sapiens
atcatcccatctaagctgcag

SEQ ID NO: 2029302 - DNA, 15 bp, Homo sapiens
atcatcgaaaattca

SEQ ID NO: 2029303 - DNA, 13 bp, Homo sapiens
atcatctgtgtga

SEQ ID NO: 2029304 - DNA, 16 bp, Homo sapiens
atcatctgtgtgaaaa

SEQ ID NO: 2029305 - DNA, 18 bp, Homo sapiens
atcatctgtgtgaaaatg

SEQ ID NO: 2029306 - DNA, 20 bp, Homo sapiens
atcatgaaaagaggaacagg

SEQ ID NO: 2029307 - DNA, 19 bp, Homo sapiens
atcatgaaacacttctcat

SEQ ID NO: 2029308 - DNA, 20 bp, Homo sapiens
atcatgaatatttcaaaata

SEQ ID NO: 2029309 - DNA, 17 bp, Homo sapiens
atcatgaccagcaaata

SEQ ID NO: 2029310 - DNA, 21 bp, Homo sapiens
atcatgatctgactttaattg

SEQ ID NO: 2029311 - DNA, 22 bp, Homo sapiens
atcatgatctgactttaattgt

SEQ ID NO: 2029312 - DNA, 20 bp, Homo sapiens
atcatgcaagtgctatgcca

SEQ ID NO: 2029313 - DNA, 17 bp, Homo sapiens
atcatgcctctgaggcc

SEQ ID NO: 2029314 - DNA, 19 bp, Homo sapiens
atcatgcctctgaggccag

SEQ ID NO: 2029315 - DNA, 15 bp, Homo sapiens
atcatggagctgagg

SEQ ID NO: 2029316 - DNA, 12 bp, Homo sapiens
atcatggagtga

SEQ ID NO: 2029317 - DNA, 16 bp, Homo sapiens
atcatgtaaatgatta

SEQ ID NO: 2029318 - DNA, 13 bp, Homo sapiens
atcatgtacattt

SEQ ID NO: 2029319 - DNA, 15 bp, Homo sapiens
atcatgtacatttct

SEQ ID NO: 2029320 - DNA, 18 bp, Homo sapiens
atcatgtcaggcctgtgt

SEQ ID NO: 2029321 - DNA, 11 bp, Homo sapiens
atcattaatac

SEQ ID NO: 2029322 - DNA, 21 bp, Homo sapiens
atcattaatgtaggtttagat

SEQ ID NO: 2029323 - DNA, 16 bp, Homo sapiens
atcattataaacgtga

SEQ ID NO: 2029324 - DNA, 16 bp, Homo sapiens
atcattatgtaatgtc

SEQ ID NO: 2029325 - DNA, 14 bp, Homo sapiens
atcattctttcccc

SEQ ID NO: 2029326 - DNA, 22 bp, Homo sapiens
atcattctttcccctcagagct

SEQ ID NO: 2029327 - DNA, 23 bp, Homo sapiens
atcattctttcccctcagagctc

SEQ ID NO: 2029328 - DNA, 18 bp, Homo sapiens
atcattgctttgaagcag

SEQ ID NO: 2029329 - DNA, 13 bp, Homo sapiens
atcattgtaaatt

SEQ ID NO: 2029330 - DNA, 19 bp, Homo sapiens
atcatttcttttccaaaat

SEQ ID NO: 2029331 - DNA, 13 bp, Homo sapiens
atcatttgcaatg

SEQ ID NO: 2029332 - DNA, 12 bp, Homo sapiens
atcattttaaga

SEQ ID NO: 2029333 - DNA, 14 bp, Homo sapiens
atcattttaattat

SEQ ID NO: 2029334 - DNA, 22 bp, Homo sapiens
atcattttcttatcttctgcaa

SEQ ID NO: 2029335 - DNA, 22 bp, Homo sapiens
atcattttgcaatcccttaata

SEQ ID NO: 2029336 - DNA, 19 bp, Homo sapiens
atcattttgcctcttttct

SEQ ID NO: 2029337 - DNA, 14 bp, Homo sapiens
atcatttttttaac

SEQ ID NO: 2029338 - DNA, 13 bp, Homo sapiens
atccaaacagaaa

SEQ ID NO: 2029339 - DNA, 18 bp, Homo sapiens
atccaaccccccacctgc

SEQ ID NO: 2029340 - DNA, 18 bp, Homo sapiens
atccaagctggtcccact

SEQ ID NO: 2029341 - DNA, 13 bp, Homo sapiens
atccaatcctcag

SEQ ID NO: 2029342 - DNA, 21 bp, Homo sapiens
atccaatcctcaggatttcat

SEQ ID NO: 2029343 - DNA, 13 bp, Homo sapiens
atccaattatgtg

SEQ ID NO: 2029344 - DNA, 18 bp, Homo sapiens
atccacaaagccgtgcct

SEQ ID NO: 2029345 - DNA, 14 bp, Homo sapiens
atccacaagccatt

SEQ ID NO: 2029346 - DNA, 16 bp, Homo sapiens
atccacacacagagga

SEQ ID NO: 2029347 - DNA, 19 bp, Homo sapiens
atccacacacgcaggaact

SEQ ID NO: 2029348 - DNA, 20 bp, Homo sapiens
atccacagactccctcccct

SEQ ID NO: 2029349 - DNA, 17 bp, Homo sapiens
atccacagccaacaaac

SEQ ID NO: 2029350 - DNA, 13 bp, Homo sapiens
atccacccacctc

SEQ ID NO: 2029351 - DNA, 15 bp, Homo sapiens
atccacccacctcag

SEQ ID NO: 2029352 - DNA, 15 bp, Homo sapiens
atccacccagtgctg

SEQ ID NO: 2029353 - DNA, 16 bp, Homo sapiens
atccacccagtgctgc

SEQ ID NO: 2029354 - DNA, 19 bp, Homo sapiens
atccacccagtgctgccat

SEQ ID NO: 2029355 - DNA, 22 bp, Homo sapiens
atccaccccactggatcttcag

SEQ ID NO: 2029356 - DNA, 21 bp, Homo sapiens
atccaccctatccctgtacag

SEQ ID NO: 2029357 - DNA, 16 bp, Homo sapiens
atccacgcacacatgg

SEQ ID NO: 2029358 - DNA, 21 bp, Homo sapiens
atccactgtgccatgtgccag

SEQ ID NO: 2029359 - DNA, 15 bp, Homo sapiens
atccagaaaatgtgt

SEQ ID NO: 2029360 - DNA, 23 bp, Homo sapiens
atccagaaaatgtgtcagcatgc

SEQ ID NO: 2029361 - DNA, 13 bp, Homo sapiens
atccagaaagaaa

SEQ ID NO: 2029362 - DNA, 20 bp, Homo sapiens
atccagaattgaccttttga

SEQ ID NO: 2029363 - DNA, 14 bp, Homo sapiens
atccagctgagtga

SEQ ID NO: 2029364 - DNA, 13 bp, Homo sapiens
atccaggactctg

SEQ ID NO: 2029365 - DNA, 15 bp, Homo sapiens
atccaggactctgtc

SEQ ID NO: 2029366 - DNA, 16 bp, Homo sapiens
atccaggtgggagaga

SEQ ID NO: 2029367 - DNA, 14 bp, Homo sapiens
atccagtaagcaca

SEQ ID NO: 2029368 - DNA, 16 bp, Homo sapiens
atccagttcatgagaa

SEQ ID NO: 2029369 - DNA, 16 bp, Homo sapiens
atccagttgcaataaa

SEQ ID NO: 2029370 - DNA, 19 bp, Homo sapiens
atccagtttcccaccacct

SEQ ID NO: 2029371 - DNA, 16 bp, Homo sapiens
atccataaggtgcagt

SEQ ID NO: 2029372 - DNA, 14 bp, Homo sapiens
atccatcagctccc

SEQ ID NO: 2029373 - DNA, 15 bp, Homo sapiens
atccatcagctccct

SEQ ID NO: 2029374 - DNA, 13 bp, Homo sapiens
atccatcaggcca

SEQ ID NO: 2029375 - DNA, 13 bp, Homo sapiens
atccatcctgcga

SEQ ID NO: 2029376 - DNA, 19 bp, Homo sapiens
atccatgtcctatgtgtga

SEQ ID NO: 2029377 - DNA, 18 bp, Homo sapiens
atccatgttagtttttac

SEQ ID NO: 2029378 - DNA, 19 bp, Homo sapiens
atccatgttagtttttact

SEQ ID NO: 2029379 - DNA, 20 bp, Homo sapiens
atccatgttagtttttactt

SEQ ID NO: 2029380 - DNA, 17 bp, Homo sapiens
atccattcccaagaaat

SEQ ID NO: 2029381 - DNA, 19 bp, Homo sapiens
atccattcccaagaaatgc

SEQ ID NO: 2029382 - DNA, 18 bp, Homo sapiens
atccatttcatctatttc

SEQ ID NO: 2029383 - DNA, 20 bp, Homo sapiens
atccatttggacaaaatgga

SEQ ID NO: 2029384 - DNA, 23 bp, Homo sapiens
atccatttggacaaaatggaagg

SEQ ID NO: 2029385 - DNA, 13 bp, Homo sapiens
atcccaaaagtca

SEQ ID NO: 2029386 - DNA, 19 bp, Homo sapiens
atcccaattcatttcatct

SEQ ID NO: 2029387 - DNA, 15 bp, Homo sapiens
atcccacagtggcac

SEQ ID NO: 2029388 - DNA, 21 bp, Homo sapiens
atcccacattcggaccctgcc

SEQ ID NO: 2029389 - DNA, 18 bp, Homo sapiens
atcccacccacatgtgac

SEQ ID NO: 2029390 - DNA, 13 bp, Homo sapiens
atcccagaaatta

SEQ ID NO: 2029391 - DNA, 20 bp, Homo sapiens
atcccagagcttcccaggat

SEQ ID NO: 2029392 - DNA, 22 bp, Homo sapiens
atcccagcactttgggaggctg

SEQ ID NO: 2029393 - DNA, 19 bp, Homo sapiens
atcccagccccaattttct

SEQ ID NO: 2029394 - DNA, 21 bp, Homo sapiens
atcccagccctacccttgtta

SEQ ID NO: 2029395 - DNA, 22 bp, Homo sapiens
atcccagctacttgggaggctg

SEQ ID NO: 2029396 - DNA, 18 bp, Homo sapiens
atcccaggaggggcctct

SEQ ID NO: 2029397 - DNA, 23 bp, Homo sapiens
atcccaggggaccacacctccct

SEQ ID NO: 2029398 - DNA, 11 bp, Homo sapiens
atcccagtttg

SEQ ID NO: 2029399 - DNA, 16 bp, Homo sapiens
atcccatccatcagct

SEQ ID NO: 2029400 - DNA, 12 bp, Homo sapiens
atcccatccctt

SEQ ID NO: 2029401 - DNA, 16 bp, Homo sapiens
atcccatgtcacctca

SEQ ID NO: 2029402 - DNA, 14 bp, Homo sapiens
atcccattgccctg

SEQ ID NO: 2029403 - DNA, 16 bp, Homo sapiens
atcccattgccctggt

SEQ ID NO: 2029404 - DNA, 14 bp, Homo sapiens
atcccccactgcca

SEQ ID NO: 2029405 - DNA, 16 bp, Homo sapiens
atcccccactgccaca

SEQ ID NO: 2029406 - DNA, 20 bp, Homo sapiens
atcccccactgccacaccct

SEQ ID NO: 2029407 - DNA, 22 bp, Homo sapiens
atccccggctgcttccttctgc

SEQ ID NO: 2029408 - DNA, 16 bp, Homo sapiens
atcccctcgtcctgtc

SEQ ID NO: 2029409 - DNA, 17 bp, Homo sapiens
atcccctcgtcctgtcc

SEQ ID NO: 2029410 - DNA, 19 bp, Homo sapiens
atcccctcgtcctgtccca

SEQ ID NO: 2029411 - DNA, 22 bp, Homo sapiens
atcccctttattaattcattaa

SEQ ID NO: 2029412 - DNA, 14 bp, Homo sapiens
atcccctttcctcc

SEQ ID NO: 2029413 - DNA, 20 bp, Homo sapiens
atcccctttcctccccacct

SEQ ID NO: 2029414 - DNA, 15 bp, Homo sapiens
atcccggcctcttcc

SEQ ID NO: 2029415 - DNA, 16 bp, Homo sapiens
atcccggcctcttcca

SEQ ID NO: 2029416 - DNA, 17 bp, Homo sapiens
atccctccatccggctc

SEQ ID NO: 2029417 - DNA, 19 bp, Homo sapiens
atccctcggaagccgtctg

SEQ ID NO: 2029418 - DNA, 18 bp, Homo sapiens
atccctgaggtcacctgg

SEQ ID NO: 2029419 - DNA, 13 bp, Homo sapiens
atccctgggcccc

SEQ ID NO: 2029420 - DNA, 14 bp, Homo sapiens
atccctgggcctgc

SEQ ID NO: 2029421 - DNA, 20 bp, Homo sapiens
atccctgggcctgctgctga

SEQ ID NO: 2029422 - DNA, 18 bp, Homo sapiens
atccctgttacccagaga

SEQ ID NO: 2029423 - DNA, 16 bp, Homo sapiens
atccctgtttaatatt

SEQ ID NO: 2029424 - DNA, 18 bp, Homo sapiens
atccctgtttaatattta

SEQ ID NO: 2029425 - DNA, 20 bp, Homo sapiens
atccctgtttaatatttaaa

SEQ ID NO: 2029426 - DNA, 23 bp, Homo sapiens
atccctgtttaatatttaaacag

SEQ ID NO: 2029427 - DNA, 17 bp, Homo sapiens
atcccttcctccccagt

SEQ ID NO: 2029428 - DNA, 22 bp, Homo sapiens
atccgagtgtttgccaggctta

SEQ ID NO: 2029429 - DNA, 14 bp, Homo sapiens
atccgcagcccagg

SEQ ID NO: 2029430 - DNA, 10 bp, Homo sapiens
atccgcctgc

SEQ ID NO: 2029431 - DNA, 23 bp, Homo sapiens
atccgcctgcagaggacagagct

SEQ ID NO: 2029432 - DNA, 22 bp, Homo sapiens
atcctaagtgggaagtgaagcc

SEQ ID NO: 2029433 - DNA, 23 bp, Homo sapiens
atcctaagtgggaagtgaagccc

SEQ ID NO: 2029434 - DNA, 16 bp, Homo sapiens
atcctaccaatgcatg

SEQ ID NO: 2029435 - DNA, 15 bp, Homo sapiens
atcctaggtgctgga

SEQ ID NO: 2029436 - DNA, 16 bp, Homo sapiens
atcctaggtgctggat

SEQ ID NO: 2029437 - DNA, 20 bp, Homo sapiens
atcctattaaaacacagctt

SEQ ID NO: 2029438 - DNA, 23 bp, Homo sapiens
atcctcaccatccacagcaagat

SEQ ID NO: 2029439 - DNA, 18 bp, Homo sapiens
atcctcaggtagtactgg

SEQ ID NO: 2029440 - DNA, 18 bp, Homo sapiens
atcctcccacctcagcct

SEQ ID NO: 2029441 - DNA, 15 bp, Homo sapiens
atcctcccttcctcc

SEQ ID NO: 2029442 - DNA, 20 bp, Homo sapiens
atcctccttataagcccagc

SEQ ID NO: 2029443 - DNA, 14 bp, Homo sapiens
atcctgaaatttca

SEQ ID NO: 2029444 - DNA, 16 bp, Homo sapiens
atcctgaaatttcaga

SEQ ID NO: 2029445 - DNA, 17 bp, Homo sapiens
atcctgaaatttcagat

SEQ ID NO: 2029446 - DNA, 22 bp, Homo sapiens
atcctgcattttacgtctttgg

SEQ ID NO: 2029447 - DNA, 14 bp, Homo sapiens
atcctgcccccagc

SEQ ID NO: 2029448 - DNA, 12 bp, Homo sapiens
atcctgcctctc

SEQ ID NO: 2029449 - DNA, 14 bp, Homo sapiens
atcctgcctctccc

SEQ ID NO: 2029450 - DNA, 17 bp, Homo sapiens
atcctgccttcatggaa

SEQ ID NO: 2029451 - DNA, 15 bp, Homo sapiens
atcctgctagctgta

SEQ ID NO: 2029452 - DNA, 16 bp, Homo sapiens
atcctgctagctgtag

SEQ ID NO: 2029453 - DNA, 13 bp, Homo sapiens
atcctgctgtggc

SEQ ID NO: 2029454 - DNA, 14 bp, Homo sapiens
atcctgctgtggcc

SEQ ID NO: 2029455 - DNA, 14 bp, Homo sapiens
atcctgcttcctag

SEQ ID NO: 2029456 - DNA, 23 bp, Homo sapiens
atcctgcttcctaggccccagag

SEQ ID NO: 2029457 - DNA, 16 bp, Homo sapiens
atcctgctttccctcc

SEQ ID NO: 2029458 - DNA, 18 bp, Homo sapiens
atagtaggaccaatgttg

SEQ ID NO: 2029459 - DNA, 16 bp, Homo sapiens
atagtatatctggaca

SEQ ID NO: 2029460 - DNA, 17 bp, Homo sapiens
atagtatatctggacaa

SEQ ID NO: 2029461 - DNA, 16 bp, Homo sapiens
atagtatatttatact

SEQ ID NO: 2029462 - DNA, 16 bp, Homo sapiens
atagtatggtggctgg

SEQ ID NO: 2029463 - DNA, 17 bp, Homo sapiens
atagtatggtggctggg

SEQ ID NO: 2029464 - DNA, 14 bp, Homo sapiens
atagtattgaaagt

SEQ ID NO: 2029465 - DNA, 15 bp, Homo sapiens
atagtattgaaagtg

SEQ ID NO: 2029466 - DNA, 22 bp, Homo sapiens
atagtcaaaccataaacttcat

SEQ ID NO: 2029467 - DNA, 21 bp, Homo sapiens
atagtcaagaaaaattattgt

SEQ ID NO: 2029468 - DNA, 18 bp, Homo sapiens
atagtcacaaaaatggtg

SEQ ID NO: 2029469 - DNA, 14 bp, Homo sapiens
atagtcacaagagc

SEQ ID NO: 2029470 - DNA, 21 bp, Homo sapiens
atagtcagctgtaccaagccc

SEQ ID NO: 2029471 - DNA, 18 bp, Homo sapiens
atagtcatttattttaaa

SEQ ID NO: 2029472 - DNA, 16 bp, Homo sapiens
atagtccaatatttgg

SEQ ID NO: 2029473 - DNA, 17 bp, Homo sapiens
atagtccaatatttggc

SEQ ID NO: 2029474 - DNA, 22 bp, Homo sapiens
atagtgctaagaaagcaagcca

SEQ ID NO: 2029475 - DNA, 15 bp, Homo sapiens
atagtgctatatata

SEQ ID NO: 2029476 - DNA, 20 bp, Homo sapiens
atagtgctatatatataaat

SEQ ID NO: 2029477 - DNA, 17 bp, Homo sapiens
atagtggcttaaaacaa

SEQ ID NO: 2029478 - DNA, 14 bp, Homo sapiens
atagtgtaaaataa

SEQ ID NO: 2029479 - DNA, 22 bp, Homo sapiens
atagttattgttttatgttcta

SEQ ID NO: 2029480 - DNA, 18 bp, Homo sapiens
atagttgtgggtgggaga

SEQ ID NO: 2029481 - DNA, 16 bp, Homo sapiens
atagtttactatttta

SEQ ID NO: 2029482 - DNA, 14 bp, Homo sapiens
atagtttcagatat

SEQ ID NO: 2029483 - DNA, 18 bp, Homo sapiens
atagtttggatatgtaaa

SEQ ID NO: 2029484 - DNA, 23 bp, Homo sapiens
atagtttggatatgtaaaacatt

SEQ ID NO: 2029485 - DNA, 18 bp, Homo sapiens
atataaaaagaaaagata

SEQ ID NO: 2029486 - DNA, 23 bp, Homo sapiens
atataaaaagaaaagataaagat

SEQ ID NO: 2029487 - DNA, 14 bp, Homo sapiens
atataaaaatatat

SEQ ID NO: 2029488 - DNA, 20 bp, Homo sapiens
atataaaagttaaactactt

SEQ ID NO: 2029489 - DNA, 21 bp, Homo sapiens
atataaaatagttgtccatat

SEQ ID NO: 2029490 - DNA, 21 bp, Homo sapiens
atataaatatatatttttcaa

SEQ ID NO: 2029491 - DNA, 12 bp, Homo sapiens
atataaatgcat

SEQ ID NO: 2029492 - DNA, 15 bp, Homo sapiens
atataaatgcatgat

SEQ ID NO: 2029493 - DNA, 23 bp, Homo sapiens
atataaatgcatgattttataca

SEQ ID NO: 2029494 - DNA, 23 bp, Homo sapiens
atataaatggctggtttttagaa

SEQ ID NO: 2029495 - DNA, 15 bp, Homo sapiens
atataacaaccttta

SEQ ID NO: 2029496 - DNA, 14 bp, Homo sapiens
atataaggaggaaa

SEQ ID NO: 2029497 - DNA, 21 bp, Homo sapiens
atataataaatgtacattaat

SEQ ID NO: 2029498 - DNA, 19 bp, Homo sapiens
atataatactaaagtgtct

SEQ ID NO: 2029499 - DNA, 14 bp, Homo sapiens
atatacaaaagcaa

SEQ ID NO: 2029500 - DNA, 15 bp, Homo sapiens
atatacacatacata

SEQ ID NO: 2029501 - DNA, 16 bp, Homo sapiens
atatacacatacatac

SEQ ID NO: 2029502 - DNA, 17 bp, Homo sapiens
atatacacatacataca

SEQ ID NO: 2029503 - DNA, 15 bp, Homo sapiens
atatacagctcagaa

SEQ ID NO: 2029504 - DNA, 16 bp, Homo sapiens
atatacatattataaa

SEQ ID NO: 2029505 - DNA, 14 bp, Homo sapiens
atatacatgtgtgt

SEQ ID NO: 2029506 - DNA, 22 bp, Homo sapiens
atatacatgtgtgtatatatgt

SEQ ID NO: 2029507 - DNA, 23 bp, Homo sapiens
atatacatgtgtgtatatatgtg

SEQ ID NO: 2029508 - DNA, 18 bp, Homo sapiens
atatacattctttatctt

SEQ ID NO: 2029509 - DNA, 22 bp, Homo sapiens
atatacatttcataaggcctgc

SEQ ID NO: 2029510 - DNA, 15 bp, Homo sapiens
atatacctataatgt

SEQ ID NO: 2029511 - DNA, 17 bp, Homo sapiens
atatacctataatgtgt

SEQ ID NO: 2029512 - DNA, 21 bp, Homo sapiens
atatacctataatgtgtgtat

SEQ ID NO: 2029513 - DNA, 15 bp, Homo sapiens
atataccttctcaaa

SEQ ID NO: 2029514 - DNA, 17 bp, Homo sapiens
atatactatacaacaat

SEQ ID NO: 2029515 - DNA, 18 bp, Homo sapiens
atatagaaagctgtttat

SEQ ID NO: 2029516 - DNA, 16 bp, Homo sapiens
atatagagatgttttt

SEQ ID NO: 2029517 - DNA, 22 bp, Homo sapiens
atatagagatgtttttaaaagt

SEQ ID NO: 2029518 - DNA, 17 bp, Homo sapiens
atatagcagcaaaaata

SEQ ID NO: 2029519 - DNA, 19 bp, Homo sapiens
atatagcagcaaaaatata

SEQ ID NO: 2029520 - DNA, 20 bp, Homo sapiens
atatagcagcaaaaatataa

SEQ ID NO: 2029521 - DNA, 23 bp, Homo sapiens
atatagcgtgggttatcagttaa

SEQ ID NO: 2029522 - DNA, 15 bp, Homo sapiens
atataggttgtgcaa

SEQ ID NO: 2029523 - DNA, 17 bp, Homo sapiens
atatagtaatgcactct

SEQ ID NO: 2029524 - DNA, 18 bp, Homo sapiens
atatagtatatttatact

SEQ ID NO: 2029525 - DNA, 16 bp, Homo sapiens
atatagtttactattt

SEQ ID NO: 2029526 - DNA, 13 bp, Homo sapiens
atatataaatata

SEQ ID NO: 2029527 - DNA, 17 bp, Homo sapiens
atatataatggtttact

SEQ ID NO: 2029528 - DNA, 10 bp, Homo sapiens
atatatacat

SEQ ID NO: 2029529 - DNA, 11 bp, Homo sapiens
atatatacata

SEQ ID NO: 2029530 - DNA, 14 bp, Homo sapiens
atatatacatatat

SEQ ID NO: 2029531 - DNA, 12 bp, Homo sapiens
atatatacatgt

SEQ ID NO: 2029532 - DNA, 13 bp, Homo sapiens
atatatagaatct

SEQ ID NO: 2029533 - DNA, 14 bp, Homo sapiens
atatatagtgctat

SEQ ID NO: 2029534 - DNA, 14 bp, Homo sapiens
atatatataaatat

SEQ ID NO: 2029535 - DNA, 14 bp, Homo sapiens
atatatatacacat

SEQ ID NO: 2029536 - DNA, 16 bp, Homo sapiens
atatatatacacatac

SEQ ID NO: 2029537 - DNA, 14 bp, Homo sapiens
atatatatacatat

SEQ ID NO: 2029538 - DNA, 15 bp, Homo sapiens
atatatatagtaact

SEQ ID NO: 2029539 - DNA, 15 bp, Homo sapiens
atatatatatacaca

SEQ ID NO: 2029540 - DNA, 14 bp, Homo sapiens
atatatatatgtat

SEQ ID NO: 2029541 - DNA, 15 bp, Homo sapiens
atatatatgtacagt

SEQ ID NO: 2029542 - DNA, 16 bp, Homo sapiens
atatatatgtacagtt

SEQ ID NO: 2029543 - DNA, 14 bp, Homo sapiens
atatatatgtatat

SEQ ID NO: 2029544 - DNA, 16 bp, Homo sapiens
atatatatgtatatgt

SEQ ID NO: 2029545 - DNA, 17 bp, Homo sapiens
atatatatgtgcagtat

SEQ ID NO: 2029546 - DNA, 22 bp, Homo sapiens
atatatatgtgcagtattttat

SEQ ID NO: 2029547 - DNA, 12 bp, Homo sapiens
atatatatgtgt

SEQ ID NO: 2029548 - DNA, 11 bp, Homo sapiens
atatatattta

SEQ ID NO: 2029549 - DNA, 13 bp, Homo sapiens
atatatcataaag

SEQ ID NO: 2029550 - DNA, 20 bp, Homo sapiens
atatatcatattggtattca

SEQ ID NO: 2029551 - DNA, 16 bp, Homo sapiens
atatatcccagaaatt

SEQ ID NO: 2029552 - DNA, 18 bp, Homo sapiens
atatatctatctatttga

SEQ ID NO: 2029553 - DNA, 20 bp, Homo sapiens
atatatctatctatttgagg

SEQ ID NO: 2029554 - DNA, 15 bp, Homo sapiens
atatatctgcttcag

SEQ ID NO: 2029555 - DNA, 20 bp, Homo sapiens
atatatcttatgttaaagga

SEQ ID NO: 2029556 - DNA, 19 bp, Homo sapiens
atatatggcatatttatat

SEQ ID NO: 2029557 - DNA, 12 bp, Homo sapiens
atatatgtacag

SEQ ID NO: 2029558 - DNA, 14 bp, Homo sapiens
atatatgtacagtt

SEQ ID NO: 2029559 - DNA, 15 bp, Homo sapiens
atatatgtatatgta

SEQ ID NO: 2029560 - DNA, 17 bp, Homo sapiens
atatatgtatttattgt

SEQ ID NO: 2029561 - DNA, 20 bp, Homo sapiens
atatatgtgtatatatacat

SEQ ID NO: 2029562 - DNA, 23 bp, Homo sapiens
atatattcatgtaataaatctga

SEQ ID NO: 2029563 - DNA, 19 bp, Homo sapiens
atatattctacacatatat

SEQ ID NO: 2029564 - DNA, 18 bp, Homo sapiens
atatatttaatacctttg

SEQ ID NO: 2029565 - DNA, 16 bp, Homo sapiens
atatatttaattgtgt

SEQ ID NO: 2029566 - DNA, 19 bp, Homo sapiens
atatatttactaaaagaat

SEQ ID NO: 2029567 - DNA, 14 bp, Homo sapiens
atatatttcattct

SEQ ID NO: 2029568 - DNA, 23 bp, Homo sapiens
atatatttgattgtaaaaacaaa

SEQ ID NO: 2029569 - DNA, 14 bp, Homo sapiens
atatattttatgat

SEQ ID NO: 2029570 - DNA, 18 bp, Homo sapiens
atatattttatgatttaa

SEQ ID NO: 2029571 - DNA, 15 bp, Homo sapiens
atatatttttatatt

SEQ ID NO: 2029572 - DNA, 17 bp, Homo sapiens
atatatttttcaaccag

SEQ ID NO: 2029573 - DNA, 19 bp, Homo sapiens
atatatttttcaaccagca

SEQ ID NO: 2029574 - DNA, 14 bp, Homo sapiens
atatatttttcaca

SEQ ID NO: 2029575 - DNA, 15 bp, Homo sapiens
atatatttttcacag

SEQ ID NO: 2029576 - DNA, 15 bp, Homo sapiens
atatatttttggttg

SEQ ID NO: 2029577 - DNA, 20 bp, Homo sapiens
atatatttttggttgtcaat

SEQ ID NO: 2029578 - DNA, 17 bp, Homo sapiens
atatcaattcaacacat

SEQ ID NO: 2029579 - DNA, 12 bp, Homo sapiens
atatcacctctc

SEQ ID NO: 2029580 - DNA, 15 bp, Homo sapiens
atatcagaaaagtag

SEQ ID NO: 2029581 - DNA, 21 bp, Homo sapiens
atatcagaaaagtagaattat

SEQ ID NO: 2029582 - DNA, 14 bp, Homo sapiens
atatcagacctctg

SEQ ID NO: 2029583 - DNA, 20 bp, Homo sapiens
atatcagcctgagtctcctg

SEQ ID NO: 2029584 - DNA, 21 bp, Homo sapiens
atatcagcctgagtctcctgt

SEQ ID NO: 2029585 - DNA, 21 bp, Homo sapiens
atatcagttataattattcca

SEQ ID NO: 2029586 - DNA, 15 bp, Homo sapiens
atatcataaagtatg

SEQ ID NO: 2029587 - DNA, 14 bp, Homo sapiens
atatcatattggta

SEQ ID NO: 2029588 - DNA, 22 bp, Homo sapiens
atatcatgctttaaagtgtaat

SEQ ID NO: 2029589 - DNA, 23 bp, Homo sapiens
atatcattataactgaaggagaa

SEQ ID NO: 2029590 - DNA, 16 bp, Homo sapiens
atatccagctgagtga

SEQ ID NO: 2029591 - DNA, 15 bp, Homo sapiens
atatcctaaacatca

SEQ ID NO: 2029592 - DNA, 22 bp, Homo sapiens
atatccttctagatcatacaca

SEQ ID NO: 2029593 - DNA, 20 bp, Homo sapiens
atatcctttgccccaaggct

SEQ ID NO: 2029594 - DNA, 21 bp, Homo sapiens
atatcggaggtggtggaggag

SEQ ID NO: 2029595 - DNA, 14 bp, Homo sapiens
atatctaatttata

SEQ ID NO: 2029596 - DNA, 16 bp, Homo sapiens
atatctaatttataca

SEQ ID NO: 2029597 - DNA, 17 bp, Homo sapiens
atatctaatttatacaa

SEQ ID NO: 2029598 - DNA, 18 bp, Homo sapiens
atatctacctgccctctc

SEQ ID NO: 2029599 - DNA, 21 bp, Homo sapiens
atatctacctgccctctctca

SEQ ID NO: 2029600 - DNA, 22 bp, Homo sapiens
atatctacctgccctctctcag

SEQ ID NO: 2029601 - DNA, 22 bp, Homo sapiens
atatctatagtagtcaattagt

SEQ ID NO: 2029602 - DNA, 23 bp, Homo sapiens
atatctatagtagtcaattagta

SEQ ID NO: 2029603 - DNA, 18 bp, Homo sapiens
atatctatctatttgagg

SEQ ID NO: 2029604 - DNA, 17 bp, Homo sapiens
atatctgaaaactggaa

SEQ ID NO: 2029605 - DNA, 19 bp, Homo sapiens
atatctgccccagtagtca

SEQ ID NO: 2029606 - DNA, 16 bp, Homo sapiens
atatctgcttcagtgg

SEQ ID NO: 2029607 - DNA, 15 bp, Homo sapiens
atatctggacaagcc

SEQ ID NO: 2029608 - DNA, 18 bp, Homo sapiens
atatctgtggtcttcaaa

SEQ ID NO: 2029609 - DNA, 12 bp, Homo sapiens
atatcttgaaga

SEQ ID NO: 2029610 - DNA, 13 bp, Homo sapiens
atatcttgaagaa

SEQ ID NO: 2029611 - DNA, 17 bp, Homo sapiens
atatcttgaagaatatt

SEQ ID NO: 2029612 - DNA, 14 bp, Homo sapiens
atatgaaaaatatg

SEQ ID NO: 2029613 - DNA, 18 bp, Homo sapiens
atatgaaaaatatgatat

SEQ ID NO: 2029614 - DNA, 14 bp, Homo sapiens
atatgaaatttaat

SEQ ID NO: 2029615 - DNA, 17 bp, Homo sapiens
atatgaaggactattaa

SEQ ID NO: 2029616 - DNA, 20 bp, Homo sapiens
atatgaagtaagttctgaaa

SEQ ID NO: 2029617 - DNA, 18 bp, Homo sapiens
atatgacaatcctgaaga

SEQ ID NO: 2029618 - DNA, 14 bp, Homo sapiens
atatgacatgccac

SEQ ID NO: 2029619 - DNA, 17 bp, Homo sapiens
atatgacatgccaccct

SEQ ID NO: 2029620 - DNA, 18 bp, Homo sapiens
atatgagtatacaatata

SEQ ID NO: 2029621 - DNA, 22 bp, Homo sapiens
atatgagtatacaatatataaa

SEQ ID NO: 2029622 - DNA, 16 bp, Homo sapiens
atatgatattgcatat

SEQ ID NO: 2029623 - DNA, 16 bp, Homo sapiens
atatgatcatgtaaat

SEQ ID NO: 2029624 - DNA, 21 bp, Homo sapiens
atatgatgttaaaaaaataag

SEQ ID NO: 2029625 - DNA, 12 bp, Homo sapiens
atatgatttata

SEQ ID NO: 2029626 - DNA, 16 bp, Homo sapiens
atatgattttatttga

SEQ ID NO: 2029627 - DNA, 18 bp, Homo sapiens
atatgattttttaaaaga

SEQ ID NO: 2029628 - DNA, 22 bp, Homo sapiens
atatgattttttaaaagaaatt

SEQ ID NO: 2029629 - DNA, 15 bp, Homo sapiens
atatgcaaagcactg

SEQ ID NO: 2029630 - DNA, 23 bp, Homo sapiens
atatgcaaagcactgacttctaa

SEQ ID NO: 2029631 - DNA, 18 bp, Homo sapiens
atatgctgccaaattttg

SEQ ID NO: 2029632 - DNA, 16 bp, Homo sapiens
atatggaaatcctgtt

SEQ ID NO: 2029633 - DNA, 16 bp, Homo sapiens
atatggaaccttccct

SEQ ID NO: 2029634 - DNA, 19 bp, Homo sapiens
atatggaaccttccctcca

SEQ ID NO: 2029635 - DNA, 18 bp, Homo sapiens
atatggaacttctaatat

SEQ ID NO: 2029636 - DNA, 18 bp, Homo sapiens
atatggactcagttttct

SEQ ID NO: 2029637 - DNA, 18 bp, Homo sapiens
atatggcaagaaagctgg

SEQ ID NO: 2029638 - DNA, 20 bp, Homo sapiens
atatggggatgcagcattat

SEQ ID NO: 2029639 - DNA, 12 bp, Homo sapiens
atatgtaaaata

SEQ ID NO: 2029640 - DNA, 17 bp, Homo sapiens
atatgtaacaagccacc

SEQ ID NO: 2029641 - DNA, 16 bp, Homo sapiens
atatgtacagttatct

SEQ ID NO: 2029642 - DNA, 18 bp, Homo sapiens
atatgtagtataaagaaa

SEQ ID NO: 2029643 - DNA, 13 bp, Homo sapiens
atatgtatatcta

SEQ ID NO: 2029644 - DNA, 14 bp, Homo sapiens
atatgtatatctat

SEQ ID NO: 2029645 - DNA, 18 bp, Homo sapiens
atatgtatatgtatatat

SEQ ID NO: 2029646 - DNA, 16 bp, Homo sapiens
atatgtatgtgtgtat

SEQ ID NO: 2029647 - DNA, 22 bp, Homo sapiens
atatgtattaagccaaacatga

SEQ ID NO: 2029648 - DNA, 18 bp, Homo sapiens
atatgtatttattgtcat

SEQ ID NO: 2029649 - DNA, 21 bp, Homo sapiens
atatgtcagacatgaaaacta

SEQ ID NO: 2029650 - DNA, 12 bp, Homo sapiens
atatgtctgcca

SEQ ID NO: 2029651 - DNA, 13 bp, Homo sapiens
atatgtctgcttc

SEQ ID NO: 2029652 - DNA, 22 bp, Homo sapiens
atatgtctgcttctgtccagga

SEQ ID NO: 2029653 - DNA, 14 bp, Homo sapiens
atatgtctgtgtgt

SEQ ID NO: 2029654 - DNA, 11 bp, Homo sapiens
atatgtgcagt

SEQ ID NO: 2029655 - DNA, 13 bp, Homo sapiens
atatgtgtaattt

SEQ ID NO: 2029656 - DNA, 15 bp, Homo sapiens
atatgtgtatatata

SEQ ID NO: 2029657 - DNA, 18 bp, Homo sapiens
atatgtgtatatatacat

SEQ ID NO: 2029658 - DNA, 12 bp, Homo sapiens
atatgtgtgtgt

SEQ ID NO: 2029659 - DNA, 20 bp, Homo sapiens
atatgttaacctcagtgtca

SEQ ID NO: 2029660 - DNA, 16 bp, Homo sapiens
atatgttcaactggag

SEQ ID NO: 2029661 - DNA, 15 bp, Homo sapiens
atatgttcattaaat

SEQ ID NO: 2029662 - DNA, 12 bp, Homo sapiens
atatgttgctga

SEQ ID NO: 2029663 - DNA, 15 bp, Homo sapiens
atatgttgctgaaac

SEQ ID NO: 2029664 - DNA, 11 bp, Homo sapiens
atatgttgtaa

SEQ ID NO: 2029665 - DNA, 13 bp, Homo sapiens
atatgtttgtgcc

SEQ ID NO: 2029666 - DNA, 20 bp, Homo sapiens
atatgttttaagaggcaggg

SEQ ID NO: 2029667 - DNA, 12 bp, Homo sapiens
atattaaaggct

SEQ ID NO: 2029668 - DNA, 15 bp, Homo sapiens
atattaaagtgttat

SEQ ID NO: 2029669 - DNA, 13 bp, Homo sapiens
atattaaatacag

SEQ ID NO: 2029670 - DNA, 17 bp, Homo sapiens
atattaaatacagacac

SEQ ID NO: 2029671 - DNA, 20 bp, Homo sapiens
atattaaatacagacactaa

SEQ ID NO: 2029672 - DNA, 23 bp, Homo sapiens
atattaaatatgttagcaaagag

SEQ ID NO: 2029673 - DNA, 16 bp, Homo sapiens
atattagagtgccctt

SEQ ID NO: 2029674 - DNA, 17 bp, Homo sapiens
atattagagtgccctta

SEQ ID NO: 2029675 - DNA, 14 bp, Homo sapiens
atattagcaaagaa

SEQ ID NO: 2029676 - DNA, 15 bp, Homo sapiens
atattagcatttagt

SEQ ID NO: 2029677 - DNA, 18 bp, Homo sapiens
atattataaataaatgcc

SEQ ID NO: 2029678 - DNA, 19 bp, Homo sapiens
atattataataatgttctc

SEQ ID NO: 2029679 - DNA, 20 bp, Homo sapiens
atattataataatgttctct

SEQ ID NO: 2029680 - DNA, 22 bp, Homo sapiens
atattataataatgttctctgg

SEQ ID NO: 2029681 - DNA, 18 bp, Homo sapiens
atattatggtgtaatgca

SEQ ID NO: 2029682 - DNA, 22 bp, Homo sapiens
atattatggtgtaatgcacaat

SEQ ID NO: 2029683 - DNA, 11 bp, Homo sapiens
atattattggg

SEQ ID NO: 2029684 - DNA, 23 bp, Homo sapiens
atattatttgctaattaaaaagt

SEQ ID NO: 2029685 - DNA, 20 bp, Homo sapiens
atattcaataaagctgctga

SEQ ID NO: 2029686 - DNA, 22 bp, Homo sapiens
atattcacacctcacgctctgg

SEQ ID NO: 2029687 - DNA, 17 bp, Homo sapiens
atattcagagaatatca

SEQ ID NO: 2029688 - DNA, 18 bp, Homo sapiens
atattcatgcttcttcct

SEQ ID NO: 2029689 - DNA, 14 bp, Homo sapiens
atattcatgtaata

SEQ ID NO: 2029690 - DNA, 17 bp, Homo sapiens
atattcatgtaataaat

SEQ ID NO: 2029691 - DNA, 23 bp, Homo sapiens
atattcattgtataaaaatagaa

SEQ ID NO: 2029692 - DNA, 16 bp, Homo sapiens
agttgggagcactgga

SEQ ID NO: 2029693 - DNA, 13 bp, Homo sapiens
agttggtgacaga

SEQ ID NO: 2029694 - DNA, 16 bp, Homo sapiens
agttgtacgtaatgta

SEQ ID NO: 2029695 - DNA, 14 bp, Homo sapiens
agttgtatctcttt

SEQ ID NO: 2029696 - DNA, 16 bp, Homo sapiens
agttgtatctcttttg

SEQ ID NO: 2029697 - DNA, 19 bp, Homo sapiens
agttgtctattctgagcct

SEQ ID NO: 2029698 - DNA, 21 bp, Homo sapiens
agttgtctattctgagccttg

SEQ ID NO: 2029699 - DNA, 13 bp, Homo sapiens
agttgtcttgtcc

SEQ ID NO: 2029700 - DNA, 18 bp, Homo sapiens
agttgtggaaagcctctg

SEQ ID NO: 2029701 - DNA, 19 bp, Homo sapiens
agttgtggaaagcctctgc

SEQ ID NO: 2029702 - DNA, 21 bp, Homo sapiens
agttgtggaaagcctctgctg

SEQ ID NO: 2029703 - DNA, 15 bp, Homo sapiens
agttgttcacatata

SEQ ID NO: 2029704 - DNA, 19 bp, Homo sapiens
agttgttttggtgcctgcc

SEQ ID NO: 2029705 - DNA, 22 bp, Homo sapiens
agtttaacacaagtcctgtgaa

SEQ ID NO: 2029706 - DNA, 20 bp, Homo sapiens
agtttaactttgggcccaga

SEQ ID NO: 2029707 - DNA, 15 bp, Homo sapiens
agtttaagtctctga

SEQ ID NO: 2029708 - DNA, 14 bp, Homo sapiens
agtttacagtaaat

SEQ ID NO: 2029709 - DNA, 16 bp, Homo sapiens
agtttacagtaaataa

SEQ ID NO: 2029710 - DNA, 20 bp, Homo sapiens
agtttacagtaaataaattg

SEQ ID NO: 2029711 - DNA, 16 bp, Homo sapiens
agtttactattttact

SEQ ID NO: 2029712 - DNA, 13 bp, Homo sapiens
agtttacttcatg

SEQ ID NO: 2029713 - DNA, 16 bp, Homo sapiens
agtttagaagcgctca

SEQ ID NO: 2029714 - DNA, 21 bp, Homo sapiens
agtttagaagcgctcatctgg

SEQ ID NO: 2029715 - DNA, 14 bp, Homo sapiens
agtttagaggaaaa

SEQ ID NO: 2029716 - DNA, 14 bp, Homo sapiens
agtttagatttcaa

SEQ ID NO: 2029717 - DNA, 21 bp, Homo sapiens
agtttagatttcaagaaaaaa

SEQ ID NO: 2029718 - DNA, 23 bp, Homo sapiens
agtttataagcccaaatggctct

SEQ ID NO: 2029719 - DNA, 15 bp, Homo sapiens
agtttattggaagtg

SEQ ID NO: 2029720 - DNA, 18 bp, Homo sapiens
agtttattggaagtgttc

SEQ ID NO: 2029721 - DNA, 20 bp, Homo sapiens
agtttattgtaatatatggg

SEQ ID NO: 2029722 - DNA, 12 bp, Homo sapiens
agtttatttcat

SEQ ID NO: 2029723 - DNA, 13 bp, Homo sapiens
agtttatttcatg

SEQ ID NO: 2029724 - DNA, 16 bp, Homo sapiens
agtttatttgttgaga

SEQ ID NO: 2029725 - DNA, 17 bp, Homo sapiens
agtttattttttctaca

SEQ ID NO: 2029726 - DNA, 19 bp, Homo sapiens
agtttattttttctacaca

SEQ ID NO: 2029727 - DNA, 14 bp, Homo sapiens
agtttcaatgtgat

SEQ ID NO: 2029728 - DNA, 17 bp, Homo sapiens
agtttcaattcagtgct

SEQ ID NO: 2029729 - DNA, 13 bp, Homo sapiens
agtttcaccattt

SEQ ID NO: 2029730 - DNA, 18 bp, Homo sapiens
agtttcagagaagttctg

SEQ ID NO: 2029731 - DNA, 23 bp, Homo sapiens
agtttcagatatatatcatattg

SEQ ID NO: 2029732 - DNA, 20 bp, Homo sapiens
agtttcattctcctgcctgt

SEQ ID NO: 2029733 - DNA, 12 bp, Homo sapiens
agtttccagtgg

SEQ ID NO: 2029734 - DNA, 13 bp, Homo sapiens
agtttcccttcta

SEQ ID NO: 2029735 - DNA, 22 bp, Homo sapiens
agtttctgattcactattagag

SEQ ID NO: 2029736 - DNA, 16 bp, Homo sapiens
agtttctggccctggc

SEQ ID NO: 2029737 - DNA, 13 bp, Homo sapiens
agtttctttctgt

SEQ ID NO: 2029738 - DNA, 23 bp, Homo sapiens
agtttgagacaagccctggcaac

SEQ ID NO: 2029739 - DNA, 15 bp, Homo sapiens
agtttgagaccagcc

SEQ ID NO: 2029740 - DNA, 16 bp, Homo sapiens
agtttgagaccagcct

SEQ ID NO: 2029741 - DNA, 20 bp, Homo sapiens
agtttgcactgtatgctgga

SEQ ID NO: 2029742 - DNA, 21 bp, Homo sapiens
agtttgcagaaaagcacctgc

SEQ ID NO: 2029743 - DNA, 15 bp, Homo sapiens
agtttgctgggttta

SEQ ID NO: 2029744 - DNA, 16 bp, Homo sapiens
agtttgggccactgca

SEQ ID NO: 2029745 - DNA, 21 bp, Homo sapiens
agtttgttctccgggtgtggc

SEQ ID NO: 2029746 - DNA, 11 bp, Homo sapiens
agttttaaata

SEQ ID NO: 2029747 - DNA, 16 bp, Homo sapiens
agttttaaatatgaac

SEQ ID NO: 2029748 - DNA, 21 bp, Homo sapiens
agttttaaatatgaacaaaga

SEQ ID NO: 2029749 - DNA, 18 bp, Homo sapiens
agttttaacagaaccaga

SEQ ID NO: 2029750 - DNA, 15 bp, Homo sapiens
agttttagttgcaga

SEQ ID NO: 2029751 - DNA, 15 bp, Homo sapiens
agttttataaaactc

SEQ ID NO: 2029752 - DNA, 12 bp, Homo sapiens
agttttatcatt

SEQ ID NO: 2029753 - DNA, 20 bp, Homo sapiens
agttttatggcatgatttat

SEQ ID NO: 2029754 - DNA, 17 bp, Homo sapiens
agttttctcctcccagg

SEQ ID NO: 2029755 - DNA, 13 bp, Homo sapiens
agttttctgagaa

SEQ ID NO: 2029756 - DNA, 16 bp, Homo sapiens
agttttctttgtaaag

SEQ ID NO: 2029757 - DNA, 14 bp, Homo sapiens
agttttgaaagaaa

SEQ ID NO: 2029758 - DNA, 18 bp, Homo sapiens
agttttgatatgagtata

SEQ ID NO: 2029759 - DNA, 13 bp, Homo sapiens
agttttgatgaaa

SEQ ID NO: 2029760 - DNA, 15 bp, Homo sapiens
agttttgatgaaatt

SEQ ID NO: 2029761 - DNA, 17 bp, Homo sapiens
agtttttacctaccaca

SEQ ID NO: 2029762 - DNA, 16 bp, Homo sapiens
agtttttactttctgt

SEQ ID NO: 2029763 - DNA, 14 bp, Homo sapiens
agtttttagtttgt

SEQ ID NO: 2029764 - DNA, 16 bp, Homo sapiens
agttttttttgtaaac

SEQ ID NO: 2029765 - DNA, 19 bp, Homo sapiens
ataaaaaaaagaaatgaaa

SEQ ID NO: 2029766 - DNA, 16 bp, Homo sapiens
ataaaaaacatttgta

SEQ ID NO: 2029767 - DNA, 12 bp, Homo sapiens
ataaaaaatgga

SEQ ID NO: 2029768 - DNA, 15 bp, Homo sapiens
ataaaaacaaaaaca

SEQ ID NO: 2029769 - DNA, 12 bp, Homo sapiens
ataaaaaccaga

SEQ ID NO: 2029770 - DNA, 16 bp, Homo sapiens
ataaaaagtgcttttg

SEQ ID NO: 2029771 - DNA, 22 bp, Homo sapiens
ataaaaataaatttggttctaa

SEQ ID NO: 2029772 - DNA, 11 bp, Homo sapiens
ataaaaataca

SEQ ID NO: 2029773 - DNA, 16 bp, Homo sapiens
ataaaaatactatgaa

SEQ ID NO: 2029774 - DNA, 14 bp, Homo sapiens
ataaaaattgatga

SEQ ID NO: 2029775 - DNA, 11 bp, Homo sapiens
ataaaaccttt

SEQ ID NO: 2029776 - DNA, 14 bp, Homo sapiens
ataaaacctttcaa

SEQ ID NO: 2029777 - DNA, 20 bp, Homo sapiens
ataaaacctttcaaatttca

SEQ ID NO: 2029778 - DNA, 18 bp, Homo sapiens
ataaaactaaatatatgt

SEQ ID NO: 2029779 - DNA, 19 bp, Homo sapiens
ataaaacttatgctagttt

SEQ ID NO: 2029780 - DNA, 15 bp, Homo sapiens
ataaaagaaaaaata

SEQ ID NO: 2029781 - DNA, 20 bp, Homo sapiens
ataaaagcagcatctgctaa

SEQ ID NO: 2029782 - DNA, 13 bp, Homo sapiens
ataaaataaagta

SEQ ID NO: 2029783 - DNA, 14 bp, Homo sapiens
ataaaataaagtat

SEQ ID NO: 2029784 - DNA, 16 bp, Homo sapiens
ataaaataattttatt

SEQ ID NO: 2029785 - DNA, 22 bp, Homo sapiens
ataaaatactctagcctgggcc

SEQ ID NO: 2029786 - DNA, 18 bp, Homo sapiens
ataaaatagttgtccata

SEQ ID NO: 2029787 - DNA, 19 bp, Homo sapiens
ataaaatatacaaacatgt

SEQ ID NO: 2029788 - DNA, 15 bp, Homo sapiens
ataaaatatcctcag

SEQ ID NO: 2029789 - DNA, 19 bp, Homo sapiens
ataaaatgaggacatgttt

SEQ ID NO: 2029790 - DNA, 13 bp, Homo sapiens
ataaaattagaaa

SEQ ID NO: 2029791 - DNA, 19 bp, Homo sapiens
ataaaattatggtgaaatt

SEQ ID NO: 2029792 - DNA, 21 bp, Homo sapiens
ataaaattgtaaaattgtata

SEQ ID NO: 2029793 - DNA, 13 bp, Homo sapiens
ataaaattgtgat

SEQ ID NO: 2029794 - DNA, 21 bp, Homo sapiens
ataaacatccttcaagaactc

SEQ ID NO: 2029795 - DNA, 16 bp, Homo sapiens
ataaacatgagcgctg

SEQ ID NO: 2029796 - DNA, 14 bp, Homo sapiens
ataaacattaaaca

SEQ ID NO: 2029797 - DNA, 15 bp, Homo sapiens
ataaacattaaacac

SEQ ID NO: 2029798 - DNA, 13 bp, Homo sapiens
ataaaccaaagga

SEQ ID NO: 2029799 - DNA, 15 bp, Homo sapiens
ataaaccaaaggaca

SEQ ID NO: 2029800 - DNA, 19 bp, Homo sapiens
ataaacctggagatgatga

SEQ ID NO: 2029801 - DNA, 20 bp, Homo sapiens
ataaacgtgatgatcagctg

SEQ ID NO: 2029802 - DNA, 12 bp, Homo sapiens
ataaactagttt

SEQ ID NO: 2029803 - DNA, 16 bp, Homo sapiens
ataaactagtttccag

SEQ ID NO: 2029804 - DNA, 22 bp, Homo sapiens
ataaactagtttccagtggatc

SEQ ID NO: 2029805 - DNA, 20 bp, Homo sapiens
ataaactgagcctcttttca

SEQ ID NO: 2029806 - DNA, 14 bp, Homo sapiens
ataaactgtgtgca

SEQ ID NO: 2029807 - DNA, 23 bp, Homo sapiens
ataaacttagtgcggacaagttt

SEQ ID NO: 2029808 - DNA, 13 bp, Homo sapiens
ataaacttcagca

SEQ ID NO: 2029809 - DNA, 15 bp, Homo sapiens
ataaacttgtgtatg

SEQ ID NO: 2029810 - DNA, 13 bp, Homo sapiens
ataaagacagctg

SEQ ID NO: 2029811 - DNA, 17 bp, Homo sapiens
ataaagacagctgacag

SEQ ID NO: 2029812 - DNA, 11 bp, Homo sapiens
ataaagagctc

SEQ ID NO: 2029813 - DNA, 13 bp, Homo sapiens
ataaagataaaat

SEQ ID NO: 2029814 - DNA, 20 bp, Homo sapiens
ataaagatgatctactcaga

SEQ ID NO: 2029815 - DNA, 13 bp, Homo sapiens
ataaagatttttt

SEQ ID NO: 2029816 - DNA, 18 bp, Homo sapiens
ataaagcaaatagacaca

SEQ ID NO: 2029817 - DNA, 14 bp, Homo sapiens
ataaagcctatttt

SEQ ID NO: 2029818 - DNA, 23 bp, Homo sapiens
ataaagctggacaagaagctgct

SEQ ID NO: 2029819 - DNA, 19 bp, Homo sapiens
ataaaggccccaaatacca

SEQ ID NO: 2029820 - DNA, 19 bp, Homo sapiens
ataaaggtggtatgtgtgt

SEQ ID NO: 2029821 - DNA, 21 bp, Homo sapiens
ataaaggtggtatgtgtgtgt

SEQ ID NO: 2029822 - DNA, 14 bp, Homo sapiens
ataaagtatcatca

SEQ ID NO: 2029823 - DNA, 17 bp, Homo sapiens
ataaagtatcatgcatt

SEQ ID NO: 2029824 - DNA, 19 bp, Homo sapiens
ataaagtcacttccagtgt

SEQ ID NO: 2029825 - DNA, 13 bp, Homo sapiens
ataaagtctgagt

SEQ ID NO: 2029826 - DNA, 13 bp, Homo sapiens
ataaagtgtaata

SEQ ID NO: 2029827 - DNA, 17 bp, Homo sapiens
ataaagttaaaaaaaag

SEQ ID NO: 2029828 - DNA, 15 bp, Homo sapiens
ataaagttagtgtgt

SEQ ID NO: 2029829 - DNA, 16 bp, Homo sapiens
ataaagttgataaaga

SEQ ID NO: 2029830 - DNA, 16 bp, Homo sapiens
ataaagttggtgacag

SEQ ID NO: 2029831 - DNA, 14 bp, Homo sapiens
ataaataaaaatat

SEQ ID NO: 2029832 - DNA, 12 bp, Homo sapiens
ataaataaatgc

SEQ ID NO: 2029833 - DNA, 16 bp, Homo sapiens
ataaataaatgcaata

SEQ ID NO: 2029834 - DNA, 13 bp, Homo sapiens
ataaataataaag

SEQ ID NO: 2029835 - DNA, 20 bp, Homo sapiens
ataaatagatttgattattt

SEQ ID NO: 2029836 - DNA, 21 bp, Homo sapiens
ataaatagatttgattatttc

SEQ ID NO: 2029837 - DNA, 14 bp, Homo sapiens
ataaatatatattt

SEQ ID NO: 2029838 - DNA, 18 bp, Homo sapiens
ataaatatatatttttca

SEQ ID NO: 2029839 - DNA, 15 bp, Homo sapiens
ataaatattctgcat

SEQ ID NO: 2029840 - DNA, 20 bp, Homo sapiens
ataaatgcaatatgtattaa

SEQ ID NO: 2029841 - DNA, 22 bp, Homo sapiens
ataaatgcaatatgtattaata

SEQ ID NO: 2029842 - DNA, 22 bp, Homo sapiens
ataaatgcatgattttatacat

SEQ ID NO: 2029843 - DNA, 23 bp, Homo sapiens
ataaatgcatgattttatacata

SEQ ID NO: 2029844 - DNA, 20 bp, Homo sapiens
ataaatgccaactggtcact

SEQ ID NO: 2029845 - DNA, 14 bp, Homo sapiens
ataaatgctgaatg

SEQ ID NO: 2029846 - DNA, 15 bp, Homo sapiens
ataaatggaaatcat

SEQ ID NO: 2029847 - DNA, 19 bp, Homo sapiens
ataaatgtatatacacata

SEQ ID NO: 2029848 - DNA, 15 bp, Homo sapiens
ataaatgtctgttga

SEQ ID NO: 2029849 - DNA, 12 bp, Homo sapiens
ataaatgtgtgg

SEQ ID NO: 2029850 - DNA, 10 bp, Homo sapiens
ataaatgttc

SEQ ID NO: 2029851 - DNA, 11 bp, Homo sapiens
ataaatgttca

SEQ ID NO: 2029852 - DNA, 19 bp, Homo sapiens
ataaattatttttaagaaa

SEQ ID NO: 2029853 - DNA, 22 bp, Homo sapiens
ataaattcagatatatttttca

SEQ ID NO: 2029854 - DNA, 16 bp, Homo sapiens
ataaattgctccttga

SEQ ID NO: 2029855 - DNA, 22 bp, Homo sapiens
ataacaaaatcacaagcaataa

SEQ ID NO: 2029856 - DNA, 12 bp, Homo sapiens
ataacaacaatg

SEQ ID NO: 2029857 - DNA, 14 bp, Homo sapiens
ataacaacttcata

SEQ ID NO: 2029858 - DNA, 17 bp, Homo sapiens
ataacaagatctttcag

SEQ ID NO: 2029859 - DNA, 21 bp, Homo sapiens
ataacaaggttcttctaaaat

SEQ ID NO: 2029860 - DNA, 18 bp, Homo sapiens
ataacaatgtatgtgaaa

SEQ ID NO: 2029861 - DNA, 19 bp, Homo sapiens
ataacagattttttttgga

SEQ ID NO: 2029862 - DNA, 19 bp, Homo sapiens
ataaccacaaccaggaaga

SEQ ID NO: 2029863 - DNA, 22 bp, Homo sapiens
ataaccacttaaaaaatgtcca

SEQ ID NO: 2029864 - DNA, 19 bp, Homo sapiens
ataaccagctgtaacacag

SEQ ID NO: 2029865 - DNA, 17 bp, Homo sapiens
ataaccatcagttactg

SEQ ID NO: 2029866 - DNA, 20 bp, Homo sapiens
ataaccatcagttactggtt

SEQ ID NO: 2029867 - DNA, 13 bp, Homo sapiens
ataacctatatga

SEQ ID NO: 2029868 - DNA, 18 bp, Homo sapiens
ataacgtttaagccaaaa

SEQ ID NO: 2029869 - DNA, 22 bp, Homo sapiens
ataacgtttaagccaaaacaat

SEQ ID NO: 2029870 - DNA, 19 bp, Homo sapiens
ataactagatctcctgtaa

SEQ ID NO: 2029871 - DNA, 21 bp, Homo sapiens
ataactagatctcctgtaatt

SEQ ID NO: 2029872 - DNA, 22 bp, Homo sapiens
ataactagatctcctgtaattt

SEQ ID NO: 2029873 - DNA, 16 bp, Homo sapiens
ataactagtgttgctt

SEQ ID NO: 2029874 - DNA, 19 bp, Homo sapiens
ataactagtgttgcttgga

SEQ ID NO: 2029875 - DNA, 16 bp, Homo sapiens
ataactcatcataaaa

SEQ ID NO: 2029876 - DNA, 19 bp, Homo sapiens
ataactcatcataaaataa

SEQ ID NO: 2029877 - DNA, 14 bp, Homo sapiens
ataactgaaaatta

SEQ ID NO: 2029878 - DNA, 12 bp, Homo sapiens
ataacttaaaat

SEQ ID NO: 2029879 - DNA, 16 bp, Homo sapiens
ataacttaaaatattt

SEQ ID NO: 2029880 - DNA, 14 bp, Homo sapiens
ataacttcagagaa

SEQ ID NO: 2029881 - DNA, 15 bp, Homo sapiens
ataacttcagagaag

SEQ ID NO: 2029882 - DNA, 16 bp, Homo sapiens
ataacttcttaaaagt

SEQ ID NO: 2029883 - DNA, 17 bp, Homo sapiens
ataacttcttaaaagtt

SEQ ID NO: 2029884 - DNA, 18 bp, Homo sapiens
ataacttgctgaatttca

SEQ ID NO: 2029885 - DNA, 19 bp, Homo sapiens
ataacttgctgaatttcag

SEQ ID NO: 2029886 - DNA, 20 bp, Homo sapiens
ataagaaacatgatgtgaga

SEQ ID NO: 2029887 - DNA, 14 bp, Homo sapiens
ataagaaacttttt

SEQ ID NO: 2029888 - DNA, 22 bp, Homo sapiens
ataagaaacttttttatttaaa

SEQ ID NO: 2029889 - DNA, 15 bp, Homo sapiens
ataagaaagtttcac

SEQ ID NO: 2029890 - DNA, 13 bp, Homo sapiens
ataagaacttgat

SEQ ID NO: 2029891 - DNA, 11 bp, Homo sapiens
ataagaagaat

SEQ ID NO: 2029892 - DNA, 19 bp, Homo sapiens
ataagaagaatgcttaatc

SEQ ID NO: 2029893 - DNA, 19 bp, Homo sapiens
ataagaagaggaaattaaa

SEQ ID NO: 2029894 - DNA, 18 bp, Homo sapiens
ataagaatggttgcctta

SEQ ID NO: 2029895 - DNA, 20 bp, Homo sapiens
ataagattagaatgaaaatt

SEQ ID NO: 2029896 - DNA, 15 bp, Homo sapiens
ataagcaaatttcaa

SEQ ID NO: 2029897 - DNA, 19 bp, Homo sapiens
ataagcaaatttcaaaaga

SEQ ID NO: 2029898 - DNA, 21 bp, Homo sapiens
ataagcaaatttcaaaagaca

SEQ ID NO: 2029899 - DNA, 21 bp, Homo sapiens
ataagcaagaaggcaaaaata

SEQ ID NO: 2029900 - DNA, 13 bp, Homo sapiens
ataagcaggaagg

SEQ ID NO: 2029901 - DNA, 21 bp, Homo sapiens
ataagcatctgtgtaacctcc

SEQ ID NO: 2029902 - DNA, 21 bp, Homo sapiens
ataagcccaaatggctctgtg

SEQ ID NO: 2029903 - DNA, 13 bp, Homo sapiens
ataaggaggaaaa

SEQ ID NO: 2029904 - DNA, 14 bp, Homo sapiens
ataaggccagaaac

SEQ ID NO: 2029905 - DNA, 17 bp, Homo sapiens
ataaggccttaatatgt

SEQ ID NO: 2029906 - DNA, 18 bp, Homo sapiens
ataaggccttaatatgtt

SEQ ID NO: 2029907 - DNA, 21 bp, Homo sapiens
ataaggcttaggtgccaggct

SEQ ID NO: 2029908 - DNA, 17 bp, Homo sapiens
ataaggggcacctggga

SEQ ID NO: 2029909 - DNA, 17 bp, Homo sapiens
ataaggtttaaaaagat

SEQ ID NO: 2029910 - DNA, 13 bp, Homo sapiens
ataagtaagtttg

SEQ ID NO: 2029911 - DNA, 13 bp, Homo sapiens
ataagtactgtgt

SEQ ID NO: 2029912 - DNA, 18 bp, Homo sapiens
ataagtactgtgtacaga

SEQ ID NO: 2029913 - DNA, 15 bp, Homo sapiens
ataagtgaataataa

SEQ ID NO: 2029914 - DNA, 19 bp, Homo sapiens
ataagtgcacacagaaata

SEQ ID NO: 2029915 - DNA, 20 bp, Homo sapiens
ataagtgcacacagaaatat

SEQ ID NO: 2029916 - DNA, 23 bp, Homo sapiens
ataagtgcacacagaaatatata

SEQ ID NO: 2029917 - DNA, 17 bp, Homo sapiens
ataagtggaaaaaagag

SEQ ID NO: 2029918 - DNA, 22 bp, Homo sapiens
ataagtggaaaaaagagaaaaa

SEQ ID NO: 2029919 - DNA, 16 bp, Homo sapiens
ataagttccatgttaa

SEQ ID NO: 2029920 - DNA, 17 bp, Homo sapiens
ataagttccatgttaaa

SEQ ID NO: 2029921 - DNA, 21 bp, Homo sapiens
ataagtttctgggacctcagt

SEQ ID NO: 2029922 - DNA, 21 bp, Homo sapiens
ataataaagaactccttattt

SEQ ID NO: 2029923 - DNA, 15 bp, Homo sapiens
ataataactagatct

SEQ ID NO: 2029924 - DNA, 16 bp, Homo sapiens
ataataactagatctc

SEQ ID NO: 2029925 - DNA, 14 bp, Homo sapiens
ataataattttcct

SEQ ID NO: 2029926 - DNA, 21 bp, Homo sapiens
ataatacactaattcctttct

SEQ ID NO: 2029927 - DNA, 19 bp, Homo sapiens
agttagaaatctccagtgt

SEQ ID NO: 2029928 - DNA, 16 bp, Homo sapiens
agttagagaatatatt

SEQ ID NO: 2029929 - DNA, 14 bp, Homo sapiens
agttagcaggaaat

SEQ ID NO: 2029930 - DNA, 15 bp, Homo sapiens
agttagctttaactt

SEQ ID NO: 2029931 - DNA, 21 bp, Homo sapiens
agttagctttaacttaaatag

SEQ ID NO: 2029932 - DNA, 22 bp, Homo sapiens
agttagctttaacttaaatagt

SEQ ID NO: 2029933 - DNA, 18 bp, Homo sapiens
agttaggggagaggaaaa

SEQ ID NO: 2029934 - DNA, 15 bp, Homo sapiens
agttaggttataaga

SEQ ID NO: 2029935 - DNA, 23 bp, Homo sapiens
agttagttctctcgtaactggtt

SEQ ID NO: 2029936 - DNA, 16 bp, Homo sapiens
agttagtttctttggg

SEQ ID NO: 2029937 - DNA, 17 bp, Homo sapiens
agttagtttctttggga

SEQ ID NO: 2029938 - DNA, 12 bp, Homo sapiens
agttataaaaat

SEQ ID NO: 2029939 - DNA, 14 bp, Homo sapiens
agttataaaaatac

SEQ ID NO: 2029940 - DNA, 16 bp, Homo sapiens
agttataaaaatacaa

SEQ ID NO: 2029941 - DNA, 12 bp, Homo sapiens
agttataaatca

SEQ ID NO: 2029942 - DNA, 16 bp, Homo sapiens
agttatagtttcagat

SEQ ID NO: 2029943 - DNA, 18 bp, Homo sapiens
agttatagtttcagatat

SEQ ID NO: 2029944 - DNA, 19 bp, Homo sapiens
agttatattctttaaattt

SEQ ID NO: 2029945 - DNA, 15 bp, Homo sapiens
agttatattgaatat

SEQ ID NO: 2029946 - DNA, 18 bp, Homo sapiens
agttatattgaatatatc

SEQ ID NO: 2029947 - DNA, 13 bp, Homo sapiens
agttatgtgaatg

SEQ ID NO: 2029948 - DNA, 14 bp, Homo sapiens
agttatgtgaatga

SEQ ID NO: 2029949 - DNA, 19 bp, Homo sapiens
agttattccccatcttcca

SEQ ID NO: 2029950 - DNA, 12 bp, Homo sapiens
agttattgattt

SEQ ID NO: 2029951 - DNA, 23 bp, Homo sapiens
agttattgttttatgttctagtg

SEQ ID NO: 2029952 - DNA, 16 bp, Homo sapiens
agttatttacttgaaa

SEQ ID NO: 2029953 - DNA, 21 bp, Homo sapiens
agttatttacttgaaagatgg

SEQ ID NO: 2029954 - DNA, 13 bp, Homo sapiens
agttattttagga

SEQ ID NO: 2029955 - DNA, 18 bp, Homo sapiens
agttattttaggagacag

SEQ ID NO: 2029956 - DNA, 22 bp, Homo sapiens
agttcaaatcctcaccatccac

SEQ ID NO: 2029957 - DNA, 23 bp, Homo sapiens
agttcaaatcctcaccatccaca

SEQ ID NO: 2029958 - DNA, 13 bp, Homo sapiens
agttcaagaaata

SEQ ID NO: 2029959 - DNA, 19 bp, Homo sapiens
agttcaagaaataagtttt

SEQ ID NO: 2029960 - DNA, 17 bp, Homo sapiens
agttcaagaccagcctg

SEQ ID NO: 2029961 - DNA, 20 bp, Homo sapiens
agttcaagaccagcctggcc

SEQ ID NO: 2029962 - DNA, 22 bp, Homo sapiens
agttcaagcctgtgggagtaga

SEQ ID NO: 2029963 - DNA, 21 bp, Homo sapiens
agttcactataaatggtgttt

SEQ ID NO: 2029964 - DNA, 15 bp, Homo sapiens
agttcagggaagcag

SEQ ID NO: 2029965 - DNA, 17 bp, Homo sapiens
agttcagggaagcaggc

SEQ ID NO: 2029966 - DNA, 20 bp, Homo sapiens
agttcagggaagcaggcaga

SEQ ID NO: 2029967 - DNA, 18 bp, Homo sapiens
agttcaggtaacaggcag

SEQ ID NO: 2029968 - DNA, 19 bp, Homo sapiens
agttcaggtaacaggcaga

SEQ ID NO: 2029969 - DNA, 24 bp, Homo sapiens
agttcagttcctctttgcatggaa

SEQ ID NO: 2029970 - DNA, 14 bp, Homo sapiens
agttcataccctgt

SEQ ID NO: 2029971 - DNA, 18 bp, Homo sapiens
agttcatatgtaccatgt

SEQ ID NO: 2029972 - DNA, 18 bp, Homo sapiens
agttcatctatggcagtc

SEQ ID NO: 2029973 - DNA, 22 bp, Homo sapiens
agttccatgaagaccacatcca

SEQ ID NO: 2029974 - DNA, 18 bp, Homo sapiens
agttcccggagcacagcc

SEQ ID NO: 2029975 - DNA, 21 bp, Homo sapiens
agttcccggagcacagccctg

SEQ ID NO: 2029976 - DNA, 14 bp, Homo sapiens
agttccctgaaaac

SEQ ID NO: 2029977 - DNA, 19 bp, Homo sapiens
agttccctgaaaacccaga

SEQ ID NO: 2029978 - DNA, 24 bp, Homo sapiens
agttccctgaaaacccagagagga

SEQ ID NO: 2029979 - DNA, 12 bp, Homo sapiens
agttcctcgccc

SEQ ID NO: 2029980 - DNA, 14 bp, Homo sapiens
agttcctcgccctg

SEQ ID NO: 2029981 - DNA, 16 bp, Homo sapiens
agttcctgcactccag

SEQ ID NO: 2029982 - DNA, 18 bp, Homo sapiens
agttcctgcactccagaa

SEQ ID NO: 2029983 - DNA, 18 bp, Homo sapiens
agttcctgtggccaggag

SEQ ID NO: 2029984 - DNA, 17 bp, Homo sapiens
agttccttataagaatt

SEQ ID NO: 2029985 - DNA, 19 bp, Homo sapiens
agttccttataagaattaa

SEQ ID NO: 2029986 - DNA, 20 bp, Homo sapiens
agttccttcagcttccattt

SEQ ID NO: 2029987 - DNA, 18 bp, Homo sapiens
agttcgagaccagcctgg

SEQ ID NO: 2029988 - DNA, 21 bp, Homo sapiens
agttcgatgggcccaattctt

SEQ ID NO: 2029989 - DNA, 14 bp, Homo sapiens
agttcgcagccacc

SEQ ID NO: 2029990 - DNA, 17 bp, Homo sapiens
agttcgcagccaccctg

SEQ ID NO: 2029991 - DNA, 21 bp, Homo sapiens
agttcgcagccaccctgagga

SEQ ID NO: 2029992 - DNA, 20 bp, Homo sapiens
agttcgtggctgcaaaagaa

SEQ ID NO: 2029993 - DNA, 17 bp, Homo sapiens
agttctacaagcatatt

SEQ ID NO: 2029994 - DNA, 19 bp, Homo sapiens
agttctacaagcatatttg

SEQ ID NO: 2029995 - DNA, 20 bp, Homo sapiens
agttctacaagcatatttga

SEQ ID NO: 2029996 - DNA, 14 bp, Homo sapiens
agttctagagaaga

SEQ ID NO: 2029997 - DNA, 16 bp, Homo sapiens
agttctctcgtaactg

SEQ ID NO: 2029998 - DNA, 12 bp, Homo sapiens
agttctgaaaac

SEQ ID NO: 2029999 - DNA, 16 bp, Homo sapiens
agttctgaaaactgtt

SEQ ID NO: 2030000 - DNA, 19 bp, Homo sapiens
agttctgaactggaacatg

SEQ ID NO: 2030001 - DNA, 18 bp, Homo sapiens
agttctgacattcatttt

SEQ ID NO: 2030002 - DNA, 22 bp, Homo sapiens
agttctgagtgtttttactaca

SEQ ID NO: 2030003 - DNA, 12 bp, Homo sapiens
agttctgctcct

SEQ ID NO: 2030004 - DNA, 15 bp, Homo sapiens
agttctgctcctctc

SEQ ID NO: 2030005 - DNA, 20 bp, Homo sapiens
agttctgctcctctccaggc

SEQ ID NO: 2030006 - DNA, 19 bp, Homo sapiens
agttctggaaaccacgtgg

SEQ ID NO: 2030007 - DNA, 22 bp, Homo sapiens
agttcttaaggattgtgatatt

SEQ ID NO: 2030008 - DNA, 13 bp, Homo sapiens
agttcttctccaa

SEQ ID NO: 2030009 - DNA, 17 bp, Homo sapiens
agttcttggacccctga

SEQ ID NO: 2030010 - DNA, 19 bp, Homo sapiens
agttcttggtgactgtccc

SEQ ID NO: 2030011 - DNA, 20 bp, Homo sapiens
agttcttggtgactgtccca

SEQ ID NO: 2030012 - DNA, 22 bp, Homo sapiens
agttcttgtctgattggctcac

SEQ ID NO: 2030013 - DNA, 16 bp, Homo sapiens
agttctttaggtgcct

SEQ ID NO: 2030014 - DNA, 19 bp, Homo sapiens
agttctttaggtgcctcct

SEQ ID NO: 2030015 - DNA, 21 bp, Homo sapiens
agttctttaggtgcctcctgt

SEQ ID NO: 2030016 - DNA, 23 bp, Homo sapiens
agttctttaggtgcctcctgtct

SEQ ID NO: 2030017 - DNA, 20 bp, Homo sapiens
agttgaaaagactccaaaga

SEQ ID NO: 2030018 - DNA, 15 bp, Homo sapiens
agttgaacactgtca

SEQ ID NO: 2030019 - DNA, 14 bp, Homo sapiens
agttgaacatctca

SEQ ID NO: 2030020 - DNA, 16 bp, Homo sapiens
agttgaagctaagatt

SEQ ID NO: 2030021 - DNA, 20 bp, Homo sapiens
agttgaatggcctgccttga

SEQ ID NO: 2030022 - DNA, 22 bp, Homo sapiens
agttgacaaaaagctcttacac

SEQ ID NO: 2030023 - DNA, 15 bp, Homo sapiens
agttgacgcatcctg

SEQ ID NO: 2030024 - DNA, 22 bp, Homo sapiens
agttgacttgacagaacactgt

SEQ ID NO: 2030025 - DNA, 21 bp, Homo sapiens
agttgagtacagtgaggaggg

SEQ ID NO: 2030026 - DNA, 18 bp, Homo sapiens
agttgagtctcctctctg

SEQ ID NO: 2030027 - DNA, 22 bp, Homo sapiens
agttgagtctcctctctgagac

SEQ ID NO: 2030028 - DNA, 20 bp, Homo sapiens
agttgattctgaatctgaaa

SEQ ID NO: 2030029 - DNA, 18 bp, Homo sapiens
agttgcaataaaatagta

SEQ ID NO: 2030030 - DNA, 16 bp, Homo sapiens
agttgcacagctatga

SEQ ID NO: 2030031 - DNA, 17 bp, Homo sapiens
agttgcacagctatgaa

SEQ ID NO: 2030032 - DNA, 11 bp, Homo sapiens
agttgcagaaa

SEQ ID NO: 2030033 - DNA, 16 bp, Homo sapiens
agttgcagactcagtt

SEQ ID NO: 2030034 - DNA, 22 bp, Homo sapiens
agttgcagactcagtttgtcag

SEQ ID NO: 2030035 - DNA, 16 bp, Homo sapiens
agttgcagattcattt

SEQ ID NO: 2030036 - DNA, 16 bp, Homo sapiens
agttgcgtggactctg

SEQ ID NO: 2030037 - DNA, 20 bp, Homo sapiens
agttgctactcttcagaata

SEQ ID NO: 2030038 - DNA, 15 bp, Homo sapiens
agttgctcactcagg

SEQ ID NO: 2030039 - DNA, 14 bp, Homo sapiens
agttggaaatattc

SEQ ID NO: 2030040 - DNA, 23 bp, Homo sapiens
agttggaaccgtgtccagcacag

SEQ ID NO: 2030041 - DNA, 15 bp, Homo sapiens
agttggacacactgt

SEQ ID NO: 2030042 - DNA, 19 bp, Homo sapiens
agttggagaaaatgaagaa

SEQ ID NO: 2030043 - DNA, 22 bp, Homo sapiens
ataatacactaattcctttcta

SEQ ID NO: 2030044 - DNA, 19 bp, Homo sapiens
ataatactaaagtgtctat

SEQ ID NO: 2030045 - DNA, 13 bp, Homo sapiens
ataatagaagaac

SEQ ID NO: 2030046 - DNA, 19 bp, Homo sapiens
ataatatccactgcaatac

SEQ ID NO: 2030047 - DNA, 13 bp, Homo sapiens
ataatatctgtga

SEQ ID NO: 2030048 - DNA, 14 bp, Homo sapiens
ataatatctgtgag

SEQ ID NO: 2030049 - DNA, 22 bp, Homo sapiens
ataatatgtttgaggttaaaat

SEQ ID NO: 2030050 - DNA, 14 bp, Homo sapiens
ataatatttttaat

SEQ ID NO: 2030051 - DNA, 21 bp, Homo sapiens
ataatcaattattacatttat

SEQ ID NO: 2030052 - DNA, 21 bp, Homo sapiens
ataatcattctttcccctcag

SEQ ID NO: 2030053 - DNA, 14 bp, Homo sapiens
ataatctatttaca

SEQ ID NO: 2030054 - DNA, 11 bp, Homo sapiens
ataatgattta

SEQ ID NO: 2030055 - DNA, 17 bp, Homo sapiens
ataatggaatctatatt

SEQ ID NO: 2030056 - DNA, 18 bp, Homo sapiens
ataatggttgactgggtt

SEQ ID NO: 2030057 - DNA, 15 bp, Homo sapiens
ataatggtttactgc

SEQ ID NO: 2030058 - DNA, 17 bp, Homo sapiens
ataatggtttactgctg

SEQ ID NO: 2030059 - DNA, 19 bp, Homo sapiens
ataatggtttactgctgtc

SEQ ID NO: 2030060 - DNA, 19 bp, Homo sapiens
ataatgtagtatgatgtaa

SEQ ID NO: 2030061 - DNA, 17 bp, Homo sapiens
ataatgtgcaaattttg

SEQ ID NO: 2030062 - DNA, 23 bp, Homo sapiens
ataatgtgcaaattttgcattta

SEQ ID NO: 2030063 - DNA, 17 bp, Homo sapiens
ataatgtggatttccta

SEQ ID NO: 2030064 - DNA, 18 bp, Homo sapiens
ataatgtggatttcctat

SEQ ID NO: 2030065 - DNA, 16 bp, Homo sapiens
ataatgtgtgtatgtg

SEQ ID NO: 2030066 - DNA, 12 bp, Homo sapiens
ataatgtgttaa

SEQ ID NO: 2030067 - DNA, 19 bp, Homo sapiens
ataatgttgttatttaaag

SEQ ID NO: 2030068 - DNA, 23 bp, Homo sapiens
ataattaaaaaccactgaacatt

SEQ ID NO: 2030069 - DNA, 23 bp, Homo sapiens
ataattaatgtgtgtctgaagac

SEQ ID NO: 2030070 - DNA, 17 bp, Homo sapiens
ataattagaacaatagc

SEQ ID NO: 2030071 - DNA, 18 bp, Homo sapiens
ataattagaacaatagct

SEQ ID NO: 2030072 - DNA, 13 bp, Homo sapiens
ataattaggatct

SEQ ID NO: 2030073 - DNA, 18 bp, Homo sapiens
ataattaggatctatgca

SEQ ID NO: 2030074 - DNA, 22 bp, Homo sapiens
ataattaggatctatgcaattt

SEQ ID NO: 2030075 - DNA, 17 bp, Homo sapiens
ataattaggttaacatt

SEQ ID NO: 2030076 - DNA, 19 bp, Homo sapiens
ataattatcggaagcagtg

SEQ ID NO: 2030077 - DNA, 14 bp, Homo sapiens
ataattatgacagt

SEQ ID NO: 2030078 - DNA, 20 bp, Homo sapiens
ataattatgacagttatact

SEQ ID NO: 2030079 - DNA, 17 bp, Homo sapiens
ataattatttatttaat

SEQ ID NO: 2030080 - DNA, 17 bp, Homo sapiens
ataattccctatctttt

SEQ ID NO: 2030081 - DNA, 19 bp, Homo sapiens
ataattccctatcttttag

SEQ ID NO: 2030082 - DNA, 15 bp, Homo sapiens
ataattgatcaaatt

SEQ ID NO: 2030083 - DNA, 13 bp, Homo sapiens
ataattgtgtaca

SEQ ID NO: 2030084 - DNA, 13 bp, Homo sapiens
ataatttaacagt

SEQ ID NO: 2030085 - DNA, 15 bp, Homo sapiens
ataatttaactaatt

SEQ ID NO: 2030086 - DNA, 16 bp, Homo sapiens
ataatttaactaattt

SEQ ID NO: 2030087 - DNA, 17 bp, Homo sapiens
ataatttaactaattta

SEQ ID NO: 2030088 - DNA, 19 bp, Homo sapiens
ataatttaactaatttaaa

SEQ ID NO: 2030089 - DNA, 20 bp, Homo sapiens
ataatttaactaatttaaac

SEQ ID NO: 2030090 - DNA, 22 bp, Homo sapiens
ataatttaactaatttaaacca

SEQ ID NO: 2030091 - DNA, 23 bp, Homo sapiens
ataatttaactaatttaaaccag

SEQ ID NO: 2030092 - DNA, 11 bp, Homo sapiens
ataattttcct

SEQ ID NO: 2030093 - DNA, 21 bp, Homo sapiens
ataattttcctcctaaacaaa

SEQ ID NO: 2030094 - DNA, 15 bp, Homo sapiens
ataatttttaaagta

SEQ ID NO: 2030095 - DNA, 21 bp, Homo sapiens
ataatttttttcaatatttat

SEQ ID NO: 2030096 - DNA, 18 bp, Homo sapiens
atacaaaaacatacttca

SEQ ID NO: 2030097 - DNA, 15 bp, Homo sapiens
atacaaatatattta

SEQ ID NO: 2030098 - DNA, 15 bp, Homo sapiens
atacaacctgagcct

SEQ ID NO: 2030099 - DNA, 13 bp, Homo sapiens
atacaatatataa

SEQ ID NO: 2030100 - DNA, 19 bp, Homo sapiens
atacaatatataaaaatat

SEQ ID NO: 2030101 - DNA, 21 bp, Homo sapiens
atacaatatataaaaatatat

SEQ ID NO: 2030102 - DNA, 15 bp, Homo sapiens
atacacacatataca

SEQ ID NO: 2030103 - DNA, 18 bp, Homo sapiens
atacacacatatacatat

SEQ ID NO: 2030104 - DNA, 19 bp, Homo sapiens
atacacacatatacatata

SEQ ID NO: 2030105 - DNA, 17 bp, Homo sapiens
atacacactcaaatcaa

SEQ ID NO: 2030106 - DNA, 20 bp, Homo sapiens
atacacactcaaatcaagaa

SEQ ID NO: 2030107 - DNA, 14 bp, Homo sapiens
atacacatacatac

SEQ ID NO: 2030108 - DNA, 21 bp, Homo sapiens
atacacatatacctataatgt

SEQ ID NO: 2030109 - DNA, 20 bp, Homo sapiens
atacacatccccagccagaa

SEQ ID NO: 2030110 - DNA, 16 bp, Homo sapiens
atacacatggatgcac

SEQ ID NO: 2030111 - DNA, 18 bp, Homo sapiens
atacaccgggcctggaga

SEQ ID NO: 2030112 - DNA, 19 bp, Homo sapiens
atacactaattcctttcta

SEQ ID NO: 2030113 - DNA, 15 bp, Homo sapiens
atacacttgtataaa

SEQ ID NO: 2030114 - DNA, 14 bp, Homo sapiens
atacagaaaatgct

SEQ ID NO: 2030115 - DNA, 18 bp, Homo sapiens
atacagaggtaactatca

SEQ ID NO: 2030116 - DNA, 22 bp, Homo sapiens
atacagccccaaaccagggtgc

SEQ ID NO: 2030117 - DNA, 20 bp, Homo sapiens
atacagccctcccccagcag

SEQ ID NO: 2030118 - DNA, 21 bp, Homo sapiens
atacagggcatgcattttgca

SEQ ID NO: 2030119 - DNA, 19 bp, Homo sapiens
atacagtaagctgctctat

SEQ ID NO: 2030120 - DNA, 20 bp, Homo sapiens
atacagtccctaaagaaaaa

SEQ ID NO: 2030121 - DNA, 22 bp, Homo sapiens
atacagtgagtcctcctcttcc

SEQ ID NO: 2030122 - DNA, 15 bp, Homo sapiens
atacagtgttatttt

SEQ ID NO: 2030123 - DNA, 14 bp, Homo sapiens
atacataactagtt

SEQ ID NO: 2030124 - DNA, 16 bp, Homo sapiens
atacatacacatacat

SEQ ID NO: 2030125 - DNA, 14 bp, Homo sapiens
atacatacacttgt

SEQ ID NO: 2030126 - DNA, 22 bp, Homo sapiens
atacatacacttgtataaatgt

SEQ ID NO: 2030127 - DNA, 11 bp, Homo sapiens
atacatacata

SEQ ID NO: 2030128 - DNA, 14 bp, Homo sapiens
atacatacatacat

SEQ ID NO: 2030129 - DNA, 15 bp, Homo sapiens
atacatacatatata

SEQ ID NO: 2030130 - DNA, 13 bp, Homo sapiens
atacatagtcaca

SEQ ID NO: 2030131 - DNA, 11 bp, Homo sapiens
atacatatata

SEQ ID NO: 2030132 - DNA, 24 bp, Homo sapiens
atacatatatatatacacatacat

SEQ ID NO: 2030133 - DNA, 19 bp, Homo sapiens
atacatatatatctgataa

SEQ ID NO: 2030134 - DNA, 23 bp, Homo sapiens
atacatatatgtatatatatgca

SEQ ID NO: 2030135 - DNA, 16 bp, Homo sapiens
atacatatcagaaaag

SEQ ID NO: 2030136 - DNA, 20 bp, Homo sapiens
atacatatcagaaaagtaga

SEQ ID NO: 2030137 - DNA, 21 bp, Homo sapiens
atacatatcagaaaagtagaa

SEQ ID NO: 2030138 - DNA, 14 bp, Homo sapiens
atacatattataaa

SEQ ID NO: 2030139 - DNA, 18 bp, Homo sapiens
atacatattataaataaa

SEQ ID NO: 2030140 - DNA, 22 bp, Homo sapiens
atacatattataaataaatgcc

SEQ ID NO: 2030141 - DNA, 12 bp, Homo sapiens
atacatggggaa

SEQ ID NO: 2030142 - DNA, 15 bp, Homo sapiens
atacatgtgtggatg

SEQ ID NO: 2030143 - DNA, 13 bp, Homo sapiens
atacatgtgtgta

SEQ ID NO: 2030144 - DNA, 19 bp, Homo sapiens
atacattccctatcaaaac

SEQ ID NO: 2030145 - DNA, 15 bp, Homo sapiens
atacatttataatgt

SEQ ID NO: 2030146 - DNA, 17 bp, Homo sapiens
atacattttatatctgg

SEQ ID NO: 2030147 - DNA, 19 bp, Homo sapiens
atacattttgttatagaat

SEQ ID NO: 2030148 - DNA, 21 bp, Homo sapiens
atacattttgttatagaatac

SEQ ID NO: 2030149 - DNA, 17 bp, Homo sapiens
ataccaagtatttatta

SEQ ID NO: 2030150 - DNA, 11 bp, Homo sapiens
ataccaagtgt

SEQ ID NO: 2030151 - DNA, 12 bp, Homo sapiens
ataccagagacc

SEQ ID NO: 2030152 - DNA, 14 bp, Homo sapiens
ataccaggttgaaa

SEQ ID NO: 2030153 - DNA, 22 bp, Homo sapiens
ataccagtactcagtatagcat

SEQ ID NO: 2030154 - DNA, 19 bp, Homo sapiens
ataccagtgaaccaaagag

SEQ ID NO: 2030155 - DNA, 17 bp, Homo sapiens
ataccatactcatttct

SEQ ID NO: 2030156 - DNA, 19 bp, Homo sapiens
ataccatactcatttctaa

SEQ ID NO: 2030157 - DNA, 21 bp, Homo sapiens
ataccatactcatttctaaaa

SEQ ID NO: 2030158 - DNA, 16 bp, Homo sapiens
ataccatcactgagtg

SEQ ID NO: 2030159 - DNA, 15 bp, Homo sapiens
ataccatctgctgcc

SEQ ID NO: 2030160 - DNA, 19 bp, Homo sapiens
atacccattcttcagtgcc

SEQ ID NO: 2030161 - DNA, 22 bp, Homo sapiens
atacccattcttcagtgcctag

SEQ ID NO: 2030162 - DNA, 16 bp, Homo sapiens
atacccccagagacct

SEQ ID NO: 2030163 - DNA, 15 bp, Homo sapiens
atacccctgcctggg

SEQ ID NO: 2030164 - DNA, 18 bp, Homo sapiens
atacccttctttaaatca

SEQ ID NO: 2030165 - DNA, 19 bp, Homo sapiens
atacccttctttaaatcaa

SEQ ID NO: 2030166 - DNA, 22 bp, Homo sapiens
atacctactgactgatgacaaa

SEQ ID NO: 2030167 - DNA, 14 bp, Homo sapiens
atacctataatgtg

SEQ ID NO: 2030168 - DNA, 17 bp, Homo sapiens
atacctataatgtgtgt

SEQ ID NO: 2030169 - DNA, 18 bp, Homo sapiens
atacctataatgtgtgta

SEQ ID NO: 2030170 - DNA, 18 bp, Homo sapiens
atacctcaacctatggta

SEQ ID NO: 2030171 - DNA, 15 bp, Homo sapiens
atacctctgaccaac

SEQ ID NO: 2030172 - DNA, 17 bp, Homo sapiens
atacctctgtgtgctcc

SEQ ID NO: 2030173 - DNA, 22 bp, Homo sapiens
atacctgtgtttcttgcctcat

SEQ ID NO: 2030174 - DNA, 16 bp, Homo sapiens
ataccttgaaaaagta

SEQ ID NO: 2030175 - DNA, 23 bp, Homo sapiens
ataccttgaaaaagtagagaaca

SEQ ID NO: 2030176 - DNA, 20 bp, Homo sapiens
atacctttggaaaaatcttg

SEQ ID NO: 2030177 - DNA, 16 bp, Homo sapiens
atacgcactacatgtg

SEQ ID NO: 2030178 - DNA, 17 bp, Homo sapiens
atacgtgttaggaggct

SEQ ID NO: 2030179 - DNA, 12 bp, Homo sapiens
atactaaagtgt

SEQ ID NO: 2030180 - DNA, 20 bp, Homo sapiens
atactaccggctacatcaaa

SEQ ID NO: 2030181 - DNA, 23 bp, Homo sapiens
atactagaaagctctgcatgtgt

SEQ ID NO: 2030182 - DNA, 14 bp, Homo sapiens
atactatatttatg

SEQ ID NO: 2030183 - DNA, 17 bp, Homo sapiens
atactatggaatttctc

SEQ ID NO: 2030184 - DNA, 13 bp, Homo sapiens
atactatgtggga

SEQ ID NO: 2030185 - DNA, 13 bp, Homo sapiens
atactcacctcct

SEQ ID NO: 2030186 - DNA, 17 bp, Homo sapiens
atactcacctcctccca

SEQ ID NO: 2030187 - DNA, 21 bp, Homo sapiens
atactcatttctaaaagaata

SEQ ID NO: 2030188 - DNA, 17 bp, Homo sapiens
atactctagaacatgca

SEQ ID NO: 2030189 - DNA, 19 bp, Homo sapiens
atactctgaggctgtatgt

SEQ ID NO: 2030190 - DNA, 12 bp, Homo sapiens
atactctgtcag

SEQ ID NO: 2030191 - DNA, 14 bp, Homo sapiens
atactctgtcagat

SEQ ID NO: 2030192 - DNA, 16 bp, Homo sapiens
atactctgtcagatgg

SEQ ID NO: 2030193 - DNA, 22 bp, Homo sapiens
atactgccggtcacccaggctc

SEQ ID NO: 2030194 - DNA, 22 bp, Homo sapiens
atactgctctgaatattttgta

SEQ ID NO: 2030195 - DNA, 13 bp, Homo sapiens
atactggaagttt

SEQ ID NO: 2030196 - DNA, 19 bp, Homo sapiens
atactggaagttttgcatt

SEQ ID NO: 2030197 - DNA, 12 bp, Homo sapiens
atactgtacata

SEQ ID NO: 2030198 - DNA, 16 bp, Homo sapiens
atactgtacttaataa

SEQ ID NO: 2030199 - DNA, 17 bp, Homo sapiens
atactgtacttaataaa

SEQ ID NO: 2030200 - DNA, 16 bp, Homo sapiens
atacttaagcaaaagt

SEQ ID NO: 2030201 - DNA, 19 bp, Homo sapiens
atacttatatggaaattct

SEQ ID NO: 2030202 - DNA, 16 bp, Homo sapiens
atacttcaggtgcttt

SEQ ID NO: 2030203 - DNA, 12 bp, Homo sapiens
atacttcattag

SEQ ID NO: 2030204 - DNA, 17 bp, Homo sapiens
atacttgagctgtatat

SEQ ID NO: 2030205 - DNA, 13 bp, Homo sapiens
atacttttttcta

SEQ ID NO: 2030206 - DNA, 19 bp, Homo sapiens
atacttttttcttatttaa

SEQ ID NO: 2030207 - DNA, 17 bp, Homo sapiens
atagaaaactgaaaatc

SEQ ID NO: 2030208 - DNA, 11 bp, Homo sapiens
atagaaacatg

SEQ ID NO: 2030209 - DNA, 15 bp, Homo sapiens
atagaaacatgacac

SEQ ID NO: 2030210 - DNA, 21 bp, Homo sapiens
atagaaagctgtttatttatt

SEQ ID NO: 2030211 - DNA, 19 bp, Homo sapiens
atagaaataagtggttatt

SEQ ID NO: 2030212 - DNA, 18 bp, Homo sapiens
atagaaatacctcattcg

SEQ ID NO: 2030213 - DNA, 13 bp, Homo sapiens
atagaatatttat

SEQ ID NO: 2030214 - DNA, 15 bp, Homo sapiens
atagaatgctgaact

SEQ ID NO: 2030215 - DNA, 15 bp, Homo sapiens
atagacacatcaaat

SEQ ID NO: 2030216 - DNA, 18 bp, Homo sapiens
atagacacatcaaatgcc

SEQ ID NO: 2030217 - DNA, 20 bp, Homo sapiens
atagacagtatatttatagt

SEQ ID NO: 2030218 - DNA, 16 bp, Homo sapiens
atagagatgtttttaa

SEQ ID NO: 2030219 - DNA, 14 bp, Homo sapiens
atagagggccaaga

SEQ ID NO: 2030220 - DNA, 16 bp, Homo sapiens
atagagtttaacacaa

SEQ ID NO: 2030221 - DNA, 22 bp, Homo sapiens
atagatccatttggacaaaatg

SEQ ID NO: 2030222 - DNA, 21 bp, Homo sapiens
atagatctgatggtgagctgg

SEQ ID NO: 2030223 - DNA, 14 bp, Homo sapiens
atagatcttctgaa

SEQ ID NO: 2030224 - DNA, 21 bp, Homo sapiens
atagatcttctgaaatgaaac

SEQ ID NO: 2030225 - DNA, 16 bp, Homo sapiens
atagatgcaagatatt

SEQ ID NO: 2030226 - DNA, 19 bp, Homo sapiens
atagatgtgattcctgcat

SEQ ID NO: 2030227 - DNA, 14 bp, Homo sapiens
atagatttgattat

SEQ ID NO: 2030228 - DNA, 23 bp, Homo sapiens
atagatttgtattttaaaacata

SEQ ID NO: 2030229 - DNA, 16 bp, Homo sapiens
atagcaacactctata

SEQ ID NO: 2030230 - DNA, 23 bp, Homo sapiens
atagcaagaactctgcacagcaa

SEQ ID NO: 2030231 - DNA, 19 bp, Homo sapiens
atagcaagacacatcccta

SEQ ID NO: 2030232 - DNA, 17 bp, Homo sapiens
atagcacaggctaattt

SEQ ID NO: 2030233 - DNA, 16 bp, Homo sapiens
atagcagacagtgttt

SEQ ID NO: 2030234 - DNA, 14 bp, Homo sapiens
atagcagattttaa

SEQ ID NO: 2030235 - DNA, 15 bp, Homo sapiens
atagcagcaaaaata

SEQ ID NO: 2030236 - DNA, 19 bp, Homo sapiens
atagcatctgctcttctct

SEQ ID NO: 2030237 - DNA, 16 bp, Homo sapiens
atagcattctctatca

SEQ ID NO: 2030238 - DNA, 23 bp, Homo sapiens
atagcattgaacatttcttatga

SEQ ID NO: 2030239 - DNA, 19 bp, Homo sapiens
atagcatttttgatttatg

SEQ ID NO: 2030240 - DNA, 21 bp, Homo sapiens
atagcatttttgatttatgca

SEQ ID NO: 2030241 - DNA, 15 bp, Homo sapiens
atagccaaaaatagc

SEQ ID NO: 2030242 - DNA, 23 bp, Homo sapiens
atagccacttaccttcaataaag

SEQ ID NO: 2030243 - DNA, 11 bp, Homo sapiens
atagccagaga

SEQ ID NO: 2030244 - DNA, 13 bp, Homo sapiens
atagccagagagg

SEQ ID NO: 2030245 - DNA, 13 bp, Homo sapiens
atagcgctggctc

SEQ ID NO: 2030246 - DNA, 20 bp, Homo sapiens
atagcgggttactttcacat

SEQ ID NO: 2030247 - DNA, 16 bp, Homo sapiens
atagctacccaaaaga

SEQ ID NO: 2030248 - DNA, 23 bp, Homo sapiens
atagctatcatttcttttccaaa

SEQ ID NO: 2030249 - DNA, 16 bp, Homo sapiens
atagctattgcatgta

SEQ ID NO: 2030250 - DNA, 23 bp, Homo sapiens
atagctattgcatgtaaaatgca

SEQ ID NO: 2030251 - DNA, 12 bp, Homo sapiens
atagctattttt

SEQ ID NO: 2030252 - DNA, 23 bp, Homo sapiens
atagctcttctatttaaaaaata

SEQ ID NO: 2030253 - DNA, 15 bp, Homo sapiens
atagctctttcaggg

SEQ ID NO: 2030254 - DNA, 18 bp, Homo sapiens
atagctgacatctcctct

SEQ ID NO: 2030255 - DNA, 17 bp, Homo sapiens
atagcttgtatagtgta

SEQ ID NO: 2030256 - DNA, 20 bp, Homo sapiens
atagcttgtatagtgtaaaa

SEQ ID NO: 2030257 - DNA, 19 bp, Homo sapiens
ataggaaaagtacatttaa

SEQ ID NO: 2030258 - DNA, 11 bp, Homo sapiens
ataggaagcat

SEQ ID NO: 2030259 - DNA, 21 bp, Homo sapiens
ataggatttatttaaaatagc

SEQ ID NO: 2030260 - DNA, 22 bp, Homo sapiens
ataggccctggatgtgcccaca

SEQ ID NO: 2030261 - DNA, 20 bp, Homo sapiens
ataggcggtcatgtgtgcat

SEQ ID NO: 2030262 - DNA, 22 bp, Homo sapiens
ataggcggtcatgtgtgcatgt

SEQ ID NO: 2030263 - DNA, 16 bp, Homo sapiens
ataggctggagaagct

SEQ ID NO: 2030264 - DNA, 23 bp, Homo sapiens
atagggaagagagaaacatttat

SEQ ID NO: 2030265 - DNA, 15 bp, Homo sapiens
atagggagaaaccaa

SEQ ID NO: 2030266 - DNA, 19 bp, Homo sapiens
atagggcccttagctctcc

SEQ ID NO: 2030267 - DNA, 15 bp, Homo sapiens
ataggtgctacaaaa

SEQ ID NO: 2030268 - DNA, 12 bp, Homo sapiens
ataggtttccac

SEQ ID NO: 2030269 - DNA, 20 bp, Homo sapiens
ataggttttgatttatatgt

SEQ ID NO: 2030270 - DNA, 19 bp, Homo sapiens
atagtaaatcacgcttttt

SEQ ID NO: 2030271 - DNA, 18 bp, Homo sapiens
atagtaagcctccctcct

SEQ ID NO: 2030272 - DNA, 20 bp, Homo sapiens
atagtaagcctccctcctcg

SEQ ID NO: 2030273 - DNA, 14 bp, Homo sapiens
atagtactggcatg

SEQ ID NO: 2030274 - DNA, 19 bp, Homo sapiens
atagtagcagagtcattgt

SEQ ID NO: 2030275 - DNA, 16 bp, Homo sapiens
agggccacgtgccagg

SEQ ID NO: 2030276 - DNA, 12 bp, Homo sapiens
agggccagaagg

SEQ ID NO: 2030277 - DNA, 14 bp, Homo sapiens
agggccagaaggag

SEQ ID NO: 2030278 - DNA, 19 bp, Homo sapiens
agggccagaaggagggcag

SEQ ID NO: 2030279 - DNA, 12 bp, Homo sapiens
agggccagccct

SEQ ID NO: 2030280 - DNA, 13 bp, Homo sapiens
agggccagcccta

SEQ ID NO: 2030281 - DNA, 22 bp, Homo sapiens
agggccagccctacatcttcag

SEQ ID NO: 2030282 - DNA, 23 bp, Homo sapiens
agggccagccctacatcttcagc

SEQ ID NO: 2030283 - DNA, 12 bp, Homo sapiens
agggccaggaga

SEQ ID NO: 2030284 - DNA, 15 bp, Homo sapiens
agggccaggagagag

SEQ ID NO: 2030285 - DNA, 18 bp, Homo sapiens
agggccaggattcctctc

SEQ ID NO: 2030286 - DNA, 12 bp, Homo sapiens
agggccaggcag

SEQ ID NO: 2030287 - DNA, 22 bp, Homo sapiens
agggccaggcaggtgcctggac

SEQ ID NO: 2030288 - DNA, 20 bp, Homo sapiens
agggccaggggtctccctgg

SEQ ID NO: 2030289 - DNA, 21 bp, Homo sapiens
agggccaggggtctccctgga

SEQ ID NO: 2030290 - DNA, 15 bp, Homo sapiens
agggccagtctgggc

SEQ ID NO: 2030291 - DNA, 23 bp, Homo sapiens
agggccatacttttgagaggggt

SEQ ID NO: 2030292 - DNA, 18 bp, Homo sapiens
agggcccagagagggtgg

SEQ ID NO: 2030293 - DNA, 15 bp, Homo sapiens
agggcccagctgtag

SEQ ID NO: 2030294 - DNA, 22 bp, Homo sapiens
agggcccagctgtagccatggc

SEQ ID NO: 2030295 - DNA, 18 bp, Homo sapiens
agggccccagaaggcagg

SEQ ID NO: 2030296 - DNA, 14 bp, Homo sapiens
agggccccagcact

SEQ ID NO: 2030297 - DNA, 14 bp, Homo sapiens
agggcccccacagg

SEQ ID NO: 2030298 - DNA, 17 bp, Homo sapiens
agggcccctccctctgc

SEQ ID NO: 2030299 - DNA, 18 bp, Homo sapiens
agggcccctccctctgcc

SEQ ID NO: 2030300 - DNA, 13 bp, Homo sapiens
agggccctgcaga

SEQ ID NO: 2030301 - DNA, 17 bp, Homo sapiens
agggcccttagctctcc

SEQ ID NO: 2030302 - DNA, 21 bp, Homo sapiens
agggccggggaactggccaag

SEQ ID NO: 2030303 - DNA, 20 bp, Homo sapiens
agggcctgacaggttcccag

SEQ ID NO: 2030304 - DNA, 14 bp, Homo sapiens
agggcctgggggca

SEQ ID NO: 2030305 - DNA, 15 bp, Homo sapiens
agggcctgggggcag

SEQ ID NO: 2030306 - DNA, 21 bp, Homo sapiens
agggcctgggggcagtgactg

SEQ ID NO: 2030307 - DNA, 21 bp, Homo sapiens
agggcctggtgtgaggctggg

SEQ ID NO: 2030308 - DNA, 12 bp, Homo sapiens
agggccttgccc

SEQ ID NO: 2030309 - DNA, 18 bp, Homo sapiens
agggccttgcccagagat

SEQ ID NO: 2030310 - DNA, 23 bp, Homo sapiens
agggccttgcccagagatgcctc

SEQ ID NO: 2030311 - DNA, 19 bp, Homo sapiens
agggcgggaggatgttctg

SEQ ID NO: 2030312 - DNA, 14 bp, Homo sapiens
agggcggggtgggg

SEQ ID NO: 2030313 - DNA, 22 bp, Homo sapiens
agggcgtcgctggacaacccag

SEQ ID NO: 2030314 - DNA, 23 bp, Homo sapiens
agggcgtcgctggacaacccaga

SEQ ID NO: 2030315 - DNA, 21 bp, Homo sapiens
agggctaagagctagcgctgc

SEQ ID NO: 2030316 - DNA, 22 bp, Homo sapiens
agggctaagagctagcgctgcc

SEQ ID NO: 2030317 - DNA, 21 bp, Homo sapiens
agggctactgcagctttacat

SEQ ID NO: 2030318 - DNA, 18 bp, Homo sapiens
agggctagaacctggaag

SEQ ID NO: 2030319 - DNA, 17 bp, Homo sapiens
agggctagaacctggag

SEQ ID NO: 2030320 - DNA, 17 bp, Homo sapiens
agggctagaactggaga

SEQ ID NO: 2030321 - DNA, 14 bp, Homo sapiens
agggctcagcctgg

SEQ ID NO: 2030322 - DNA, 19 bp, Homo sapiens
agggctcagcggggacagc

SEQ ID NO: 2030323 - DNA, 22 bp, Homo sapiens
agggctccagcatccagcctgt

SEQ ID NO: 2030324 - DNA, 19 bp, Homo sapiens
agggctcgggcgctgtggc

SEQ ID NO: 2030325 - DNA, 24 bp, Homo sapiens
agggctcgggcgctgtggctcctg

SEQ ID NO: 2030326 - DNA, 12 bp, Homo sapiens
agggctctcctg

SEQ ID NO: 2030327 - DNA, 17 bp, Homo sapiens
agggctctcctggcttc

SEQ ID NO: 2030328 - DNA, 17 bp, Homo sapiens
agggctgccgggccagg

SEQ ID NO: 2030329 - DNA, 11 bp, Homo sapiens
agggctgcctg

SEQ ID NO: 2030330 - DNA, 18 bp, Homo sapiens
agggctggaaaagtcaca

SEQ ID NO: 2030331 - DNA, 22 bp, Homo sapiens
agggctggaaaagtcacacaga

SEQ ID NO: 2030332 - DNA, 13 bp, Homo sapiens
agggctggaccta

SEQ ID NO: 2030333 - DNA, 14 bp, Homo sapiens
agggctgggcccac

SEQ ID NO: 2030334 - DNA, 21 bp, Homo sapiens
agggctgttggacagctgctt

SEQ ID NO: 2030335 - DNA, 20 bp, Homo sapiens
agggcttggggagcaggtct

SEQ ID NO: 2030336 - DNA, 22 bp, Homo sapiens
agggcttggggagcaggtctct

SEQ ID NO: 2030337 - DNA, 21 bp, Homo sapiens
aggggaaaccagtgtagcctt

SEQ ID NO: 2030338 - DNA, 23 bp, Homo sapiens
aggggaaaccagtgtagccttgc

SEQ ID NO: 2030339 - DNA, 14 bp, Homo sapiens
aggggaacagactg

SEQ ID NO: 2030340 - DNA, 23 bp, Homo sapiens
aggggaagggccagtctgggctg

SEQ ID NO: 2030341 - DNA, 20 bp, Homo sapiens
aggggaagtatgtgtgggta

SEQ ID NO: 2030342 - DNA, 22 bp, Homo sapiens
aggggaccatgaagagactctc

SEQ ID NO: 2030343 - DNA, 19 bp, Homo sapiens
aggggactatttatgaagg

SEQ ID NO: 2030344 - DNA, 15 bp, Homo sapiens
aggggacttgtgcca

SEQ ID NO: 2030345 - DNA, 19 bp, Homo sapiens
aggggagaagggccagccc

SEQ ID NO: 2030346 - DNA, 22 bp, Homo sapiens
aggggaggggcctagggagccg

SEQ ID NO: 2030347 - DNA, 13 bp, Homo sapiens
aggggagtgtggg

SEQ ID NO: 2030348 - DNA, 16 bp, Homo sapiens
aggggagtgtgggtga

SEQ ID NO: 2030349 - DNA, 18 bp, Homo sapiens
aggggcaaagaactgccc

SEQ ID NO: 2030350 - DNA, 19 bp, Homo sapiens
aggggcaaagaactgcccc

SEQ ID NO: 2030351 - DNA, 15 bp, Homo sapiens
aggggcacaccactg

SEQ ID NO: 2030352 - DNA, 20 bp, Homo sapiens
aggggcacaccactgccctg

SEQ ID NO: 2030353 - DNA, 23 bp, Homo sapiens
aggggcacaccactgccctgcct

SEQ ID NO: 2030354 - DNA, 16 bp, Homo sapiens
aggggcacctgccacc

SEQ ID NO: 2030355 - DNA, 19 bp, Homo sapiens
aggggcacctgccaccgcc

SEQ ID NO: 2030356 - DNA, 21 bp, Homo sapiens
aggggcacctgggaaaacaga

SEQ ID NO: 2030357 - DNA, 22 bp, Homo sapiens
aggggcacctgggaaaacagag

SEQ ID NO: 2030358 - DNA, 20 bp, Homo sapiens
aggggcacgcctgcccagcc

SEQ ID NO: 2030359 - DNA, 12 bp, Homo sapiens
aggggcaggcct

SEQ ID NO: 2030360 - DNA, 14 bp, Homo sapiens
aggggcaggcctgg

SEQ ID NO: 2030361 - DNA, 23 bp, Homo sapiens
aggggcaggcctgggacccagct

SEQ ID NO: 2030362 - DNA, 18 bp, Homo sapiens
aggggccagtgagggctg

SEQ ID NO: 2030363 - DNA, 19 bp, Homo sapiens
aggggccagtgagggctgg

SEQ ID NO: 2030364 - DNA, 19 bp, Homo sapiens
aggggcccacaaaggggag

SEQ ID NO: 2030365 - DNA, 22 bp, Homo sapiens
aggggcccacaaaggggagaag

SEQ ID NO: 2030366 - DNA, 22 bp, Homo sapiens
aggggccccagatctgcctggg

SEQ ID NO: 2030367 - DNA, 19 bp, Homo sapiens
aggggccccggggctggca

SEQ ID NO: 2030368 - DNA, 12 bp, Homo sapiens
aggggcctaggg

SEQ ID NO: 2030369 - DNA, 16 bp, Homo sapiens
aggggcctagggagcc

SEQ ID NO: 2030370 - DNA, 21 bp, Homo sapiens
aggggcctcaggggagccccc

SEQ ID NO: 2030371 - DNA, 13 bp, Homo sapiens
aggggcctgccca

SEQ ID NO: 2030372 - DNA, 14 bp, Homo sapiens
aggggcctgcccag

SEQ ID NO: 2030373 - DNA, 12 bp, Homo sapiens
aggggcctggca

SEQ ID NO: 2030374 - DNA, 16 bp, Homo sapiens
aggggcggggcaggaa

SEQ ID NO: 2030375 - DNA, 20 bp, Homo sapiens
aggggctagaacctagagaa

SEQ ID NO: 2030376 - DNA, 16 bp, Homo sapiens
aggggctcagcaaggt

SEQ ID NO: 2030377 - DNA, 14 bp, Homo sapiens
aggggctccacctg

SEQ ID NO: 2030378 - DNA, 13 bp, Homo sapiens
aggggctcctgga

SEQ ID NO: 2030379 - DNA, 23 bp, Homo sapiens
aggggctcctggaaaggctcagt

SEQ ID NO: 2030380 - DNA, 12 bp, Homo sapiens
aggggctgctgg

SEQ ID NO: 2030381 - DNA, 13 bp, Homo sapiens
aggggcttcctgg

SEQ ID NO: 2030382 - DNA, 17 bp, Homo sapiens
aggggctttctggagag

SEQ ID NO: 2030383 - DNA, 20 bp, Homo sapiens
aggggctttctggagaggag

SEQ ID NO: 2030384 - DNA, 15 bp, Homo sapiens
agggggcgctcagga

SEQ ID NO: 2030385 - DNA, 22 bp, Homo sapiens
agggggcgctcaggacccaggc

SEQ ID NO: 2030386 - DNA, 15 bp, Homo sapiens
agggggcggcctatg

SEQ ID NO: 2030387 - DNA, 16 bp, Homo sapiens
agggggctccatggag

SEQ ID NO: 2030388 - DNA, 14 bp, Homo sapiens
aggggggagggctg

SEQ ID NO: 2030389 - DNA, 16 bp, Homo sapiens
agggggtcgtggagag

SEQ ID NO: 2030390 - DNA, 17 bp, Homo sapiens
agggggtcgtggagagc

SEQ ID NO: 2030391 - DNA, 18 bp, Homo sapiens
agggggtcgtggagagct

SEQ ID NO: 2030392 - DNA, 19 bp, Homo sapiens
aggggtaatatattgctgc

SEQ ID NO: 2030393 - DNA, 17 bp, Homo sapiens
aggggtaggcagagcct

SEQ ID NO: 2030394 - DNA, 14 bp, Homo sapiens
aggggtcaaagaaa

SEQ ID NO: 2030395 - DNA, 19 bp, Homo sapiens
aggggtctccctggagtgc

SEQ ID NO: 2030396 - DNA, 17 bp, Homo sapiens
aggggtgatttcagaga

SEQ ID NO: 2030397 - DNA, 13 bp, Homo sapiens
aggggtgccctct

SEQ ID NO: 2030398 - DNA, 15 bp, Homo sapiens
aggggtgggagagcc

SEQ ID NO: 2030399 - DNA, 18 bp, Homo sapiens
aggggtgggagagccagc

SEQ ID NO: 2030400 - DNA, 20 bp, Homo sapiens
aggggttggttgaggtggaa

SEQ ID NO: 2030401 - DNA, 22 bp, Homo sapiens
aggggttgtcaagagagagtca

SEQ ID NO: 2030402 - DNA, 17 bp, Homo sapiens
agggtagggcagcagat

SEQ ID NO: 2030403 - DNA, 19 bp, Homo sapiens
agggtaggggagggtgggg

SEQ ID NO: 2030404 - DNA, 20 bp, Homo sapiens
agggtaggggagtgtgggtg

SEQ ID NO: 2030405 - DNA, 17 bp, Homo sapiens
agggtagtctggtttct

SEQ ID NO: 2030406 - DNA, 16 bp, Homo sapiens
agggtatcaggtgctg

SEQ ID NO: 2030407 - DNA, 16 bp, Homo sapiens
agggtccccagctggt

SEQ ID NO: 2030408 - DNA, 19 bp, Homo sapiens
agggtccgcaccagctgct

SEQ ID NO: 2030409 - DNA, 16 bp, Homo sapiens
agggtctagggagaga

SEQ ID NO: 2030410 - DNA, 19 bp, Homo sapiens
agggtctagggagagaccc

SEQ ID NO: 2030411 - DNA, 20 bp, Homo sapiens
agggtctcactatgttgccc

SEQ ID NO: 2030412 - DNA, 22 bp, Homo sapiens
agggtctcactatgttgcccag

SEQ ID NO: 2030413 - DNA, 14 bp, Homo sapiens
agggtctcactctg

SEQ ID NO: 2030414 - DNA, 15 bp, Homo sapiens
agggtctggagaagc

SEQ ID NO: 2030415 - DNA, 20 bp, Homo sapiens
agggtctgttgtaaatgacc

SEQ ID NO: 2030416 - DNA, 18 bp, Homo sapiens
agggtcttcttggcagct

SEQ ID NO: 2030417 - DNA, 22 bp, Homo sapiens
agggtcttgggctactggcagc

SEQ ID NO: 2030418 - DNA, 13 bp, Homo sapiens
agggtgacatccc

SEQ ID NO: 2030419 - DNA, 18 bp, Homo sapiens
agggtgagaggaagggtg

SEQ ID NO: 2030420 - DNA, 22 bp, Homo sapiens
agggtgctacgtacatgtgagg

SEQ ID NO: 2030421 - DNA, 20 bp, Homo sapiens
agggtggaccccctgagtca

SEQ ID NO: 2030422 - DNA, 20 bp, Homo sapiens
agggtggccccctgtgccag

SEQ ID NO: 2030423 - DNA, 24 bp, Homo sapiens
agggtggccccctgtgccagctca

SEQ ID NO: 2030424 - DNA, 17 bp, Homo sapiens
agggtgggaagaaagaa

SEQ ID NO: 2030425 - DNA, 18 bp, Homo sapiens
agggtgggaagaaagaat

SEQ ID NO: 2030426 - DNA, 20 bp, Homo sapiens
agggtggggcaatggggaga

SEQ ID NO: 2030427 - DNA, 24 bp, Homo sapiens
agggtggggcaatggggagaggca

SEQ ID NO: 2030428 - DNA, 20 bp, Homo sapiens
agggtggtctgagcaccccc

SEQ ID NO: 2030429 - DNA, 18 bp, Homo sapiens
agggtggtgacctctgcc

SEQ ID NO: 2030430 - DNA, 21 bp, Homo sapiens
agggttgaaggcagtctgaac

SEQ ID NO: 2030431 - DNA, 23 bp, Homo sapiens
agggttggcccctgcccggctgc

SEQ ID NO: 2030432 - DNA, 13 bp, Homo sapiens
agggttgggctgg

SEQ ID NO: 2030433 - DNA, 20 bp, Homo sapiens
agggttggtgggctggccca

SEQ ID NO: 2030434 - DNA, 21 bp, Homo sapiens
agggttggtgggctggcccag

SEQ ID NO: 2030435 - DNA, 23 bp, Homo sapiens
agggttggtgggctggcccagcc

SEQ ID NO: 2030436 - DNA, 20 bp, Homo sapiens
agggttgtactattgtttaa

SEQ ID NO: 2030437 - DNA, 21 bp, Homo sapiens
agggttgtactattgtttaaa

SEQ ID NO: 2030438 - DNA, 22 bp, Homo sapiens
agggttgtactattgtttaaaa

SEQ ID NO: 2030439 - DNA, 22 bp, Homo sapiens
agggttgtgattttgtctgctt

SEQ ID NO: 2030440 - DNA, 19 bp, Homo sapiens
agggtttgaggattcctga

SEQ ID NO: 2030441 - DNA, 15 bp, Homo sapiens
agggttttccaccct

SEQ ID NO: 2030442 - DNA, 18 bp, Homo sapiens
agggttttccaccctgga

SEQ ID NO: 2030443 - DNA, 22 bp, Homo sapiens
agggttttgccatgttggccag

SEQ ID NO: 2030444 - DNA, 17 bp, Homo sapiens
aggtaaaagtgtgagca

SEQ ID NO: 2030445 - DNA, 22 bp, Homo sapiens
aggtaaatgggcagtgcctcct

SEQ ID NO: 2030446 - DNA, 17 bp, Homo sapiens
aggtaactatcaatatt

SEQ ID NO: 2030447 - DNA, 22 bp, Homo sapiens
aggtaactatcaatatttaagt

SEQ ID NO: 2030448 - DNA, 17 bp, Homo sapiens
aggtaagagctgatgtg

SEQ ID NO: 2030449 - DNA, 13 bp, Homo sapiens
aggtaatgaggga

SEQ ID NO: 2030450 - DNA, 16 bp, Homo sapiens
aggtacacagctctag

SEQ ID NO: 2030451 - DNA, 15 bp, Homo sapiens
aggtagaacctcacc

SEQ ID NO: 2030452 - DNA, 16 bp, Homo sapiens
aggtagagatgtgtgt

SEQ ID NO: 2030453 - DNA, 20 bp, Homo sapiens
aggtagagtttgaaggaggt

SEQ ID NO: 2030454 - DNA, 21 bp, Homo sapiens
aggtagagtttgaaggaggtg

SEQ ID NO: 2030455 - DNA, 23 bp, Homo sapiens
aggtagagtttgaaggaggtgag

SEQ ID NO: 2030456 - DNA, 20 bp, Homo sapiens
aggtagatcgcttgagccca

SEQ ID NO: 2030457 - DNA, 21 bp, Homo sapiens
aggtagatcgcttgagcccag

SEQ ID NO: 2030458 - DNA, 22 bp, Homo sapiens
aggtagatcgcttgagcccagg

SEQ ID NO: 2030459 - DNA, 22 bp, Homo sapiens
aggtagcccagcactgtgaaga

SEQ ID NO: 2030460 - DNA, 17 bp, Homo sapiens
aggtagcgagctgctct

SEQ ID NO: 2030461 - DNA, 21 bp, Homo sapiens
aggtaggcccttgtcctgcca

SEQ ID NO: 2030462 - DNA, 22 bp, Homo sapiens
aggtaggcccttgtcctgccag

SEQ ID NO: 2030463 - DNA, 20 bp, Homo sapiens
aggtaggtggatcacctgag

SEQ ID NO: 2030464 - DNA, 18 bp, Homo sapiens
aggtagtgggtgaatgtg

SEQ ID NO: 2030465 - DNA, 21 bp, Homo sapiens
aggtatagctgacatctcctc

SEQ ID NO: 2030466 - DNA, 13 bp, Homo sapiens
aggtatgaataag

SEQ ID NO: 2030467 - DNA, 20 bp, Homo sapiens
aggtatgaccttctaggaag

SEQ ID NO: 2030468 - DNA, 14 bp, Homo sapiens
aggtattaaagatg

SEQ ID NO: 2030469 - DNA, 22 bp, Homo sapiens
aggtattccttttgtgtacagt

SEQ ID NO: 2030470 - DNA, 22 bp, Homo sapiens
aggtattgagccattttttaaa

SEQ ID NO: 2030471 - DNA, 14 bp, Homo sapiens
aggtatttatcttt

SEQ ID NO: 2030472 - DNA, 14 bp, Homo sapiens
aggtcaacagagaa

SEQ ID NO: 2030473 - DNA, 18 bp, Homo sapiens
aggtcaacatctaagcct

SEQ ID NO: 2030474 - DNA, 21 bp, Homo sapiens
aggtcaatgccagagacggaa

SEQ ID NO: 2030475 - DNA, 20 bp, Homo sapiens
aggtcacatatgtctgtatc

SEQ ID NO: 2030476 - DNA, 15 bp, Homo sapiens
aggtcagagcctgca

SEQ ID NO: 2030477 - DNA, 17 bp, Homo sapiens
aggtcatagctgagatt

SEQ ID NO: 2030478 - DNA, 23 bp, Homo sapiens
aggtcatctcctttcatccccac

SEQ ID NO: 2030479 - DNA, 13 bp, Homo sapiens
aggtccaagggcc

SEQ ID NO: 2030480 - DNA, 14 bp, Homo sapiens
aggtccaagggcca

SEQ ID NO: 2030481 - DNA, 16 bp, Homo sapiens
aggtccctgcttacct

SEQ ID NO: 2030482 - DNA, 21 bp, Homo sapiens
aggtcctcagtgtcctcaggg

SEQ ID NO: 2030483 - DNA, 19 bp, Homo sapiens
aggtcctgagcactgccag

SEQ ID NO: 2030484 - DNA, 22 bp, Homo sapiens
aggtcctgagcactgccaggag

SEQ ID NO: 2030485 - DNA, 23 bp, Homo sapiens
aggtcctgagcactgccaggagg

SEQ ID NO: 2030486 - DNA, 14 bp, Homo sapiens
aggtcctggtgggg

SEQ ID NO: 2030487 - DNA, 19 bp, Homo sapiens
aggtcctggtggggcagct

SEQ ID NO: 2030488 - DNA, 15 bp, Homo sapiens
aggtctagactttct

SEQ ID NO: 2030489 - DNA, 17 bp, Homo sapiens
aggtctagactttctca

SEQ ID NO: 2030490 - DNA, 20 bp, Homo sapiens
aggtctagactttctcagtg

SEQ ID NO: 2030491 - DNA, 19 bp, Homo sapiens
aggtctccactgaggatgt

SEQ ID NO: 2030492 - DNA, 17 bp, Homo sapiens
aggtctcccacgtggga

SEQ ID NO: 2030493 - DNA, 16 bp, Homo sapiens
aggtctctccactgct

SEQ ID NO: 2030494 - DNA, 22 bp, Homo sapiens
aggtctctccactgctctcagc

SEQ ID NO: 2030495 - DNA, 15 bp, Homo sapiens
aggtctctggcagag

SEQ ID NO: 2030496 - DNA, 20 bp, Homo sapiens
aggtctgacacgtctgccta

SEQ ID NO: 2030497 - DNA, 17 bp, Homo sapiens
aggtcttcttgtgtcct

SEQ ID NO: 2030498 - DNA, 20 bp, Homo sapiens
aggtcttgaactcctggcct

SEQ ID NO: 2030499 - DNA, 22 bp, Homo sapiens
aggtcttgaactcctggcctca

SEQ ID NO: 2030500 - DNA, 14 bp, Homo sapiens
aggtcttggccgac

SEQ ID NO: 2030501 - DNA, 19 bp, Homo sapiens
aggtcttggccgactcagg

SEQ ID NO: 2030502 - DNA, 17 bp, Homo sapiens
aggtctttgcacatgtg

SEQ ID NO: 2030503 - DNA, 18 bp, Homo sapiens
aggtctttggttcagcta

SEQ ID NO: 2030504 - DNA, 13 bp, Homo sapiens
aggtgaaaatgtt

SEQ ID NO: 2030505 - DNA, 22 bp, Homo sapiens
aggtgaagtccctgttctcagc

SEQ ID NO: 2030506 - DNA, 15 bp, Homo sapiens
aggtgaccccagggc

SEQ ID NO: 2030507 - DNA, 23 bp, Homo sapiens
aggtgagaccaaaggatccagag

SEQ ID NO: 2030508 - DNA, 14 bp, Homo sapiens
aggtgagaccacct

SEQ ID NO: 2030509 - DNA, 15 bp, Homo sapiens
aggtgagaccacctc

SEQ ID NO: 2030510 - DNA, 15 bp, Homo sapiens
aggtgagcagaggag

SEQ ID NO: 2030511 - DNA, 20 bp, Homo sapiens
aggtgatccacccacctcag

SEQ ID NO: 2030512 - DNA, 21 bp, Homo sapiens
aggtgatccacccacctcagc

SEQ ID NO: 2030513 - DNA, 17 bp, Homo sapiens
aggtgcaagtgccccag

SEQ ID NO: 2030514 - DNA, 17 bp, Homo sapiens
aggtgcagtaggagcaa

SEQ ID NO: 2030515 - DNA, 15 bp, Homo sapiens
aggtgccaccaataa

SEQ ID NO: 2030516 - DNA, 17 bp, Homo sapiens
aggtgccaccaataaaa

SEQ ID NO: 2030517 - DNA, 19 bp, Homo sapiens
aggtgccaccaataaaaat

SEQ ID NO: 2030518 - DNA, 20 bp, Homo sapiens
aggtgccaccaataaaaatc

SEQ ID NO: 2030519 - DNA, 22 bp, Homo sapiens
aggtgccaccaataaaaatcct

SEQ ID NO: 2030520 - DNA, 17 bp, Homo sapiens
aggtgccccaaaatgca

SEQ ID NO: 2030521 - DNA, 18 bp, Homo sapiens
aggtgcctcacgcctgta

SEQ ID NO: 2030522 - DNA, 23 bp, Homo sapiens
aggtgcctgagctggggcctgga

SEQ ID NO: 2030523 - DNA, 17 bp, Homo sapiens
aggtgcctgtgaggcag

SEQ ID NO: 2030524 - DNA, 19 bp, Homo sapiens
aggtgctacaaaaacacag

SEQ ID NO: 2030525 - DNA, 12 bp, Homo sapiens
aggtgctgagct

SEQ ID NO: 2030526 - DNA, 17 bp, Homo sapiens
aggtgctgagcttagcc

SEQ ID NO: 2030527 - DNA, 23 bp, Homo sapiens
aggtgctgagcttagccttgtgc

SEQ ID NO: 2030528 - DNA, 21 bp, Homo sapiens
aggtgcttcaggataccatat

SEQ ID NO: 2030529 - DNA, 13 bp, Homo sapiens
aggtggaaaaaca

SEQ ID NO: 2030530 - DNA, 16 bp, Homo sapiens
aggtggaagccctcct

SEQ ID NO: 2030531 - DNA, 14 bp, Homo sapiens
aggtggacacacaa

SEQ ID NO: 2030532 - DNA, 13 bp, Homo sapiens
aggtggcagccct

SEQ ID NO: 2030533 - DNA, 15 bp, Homo sapiens
aggtggcatctctaa

SEQ ID NO: 2030534 - DNA, 21 bp, Homo sapiens
aggtggccactttaagagaga

SEQ ID NO: 2030535 - DNA, 19 bp, Homo sapiens
aggtggctctccagttagt

SEQ ID NO: 2030536 - DNA, 19 bp, Homo sapiens
aggtggctgacccagtccc

SEQ ID NO: 2030537 - DNA, 20 bp, Homo sapiens
aggtggctgacccagtccct

SEQ ID NO: 2030538 - DNA, 23 bp, Homo sapiens
aggtggctgacccagtccctggg

SEQ ID NO: 2030539 - DNA, 23 bp, Homo sapiens
aggtgggaaatggtatgagctga

SEQ ID NO: 2030540 - DNA, 16 bp, Homo sapiens
aggtgggagacaagga

SEQ ID NO: 2030541 - DNA, 12 bp, Homo sapiens
aggtgggagaga

SEQ ID NO: 2030542 - DNA, 14 bp, Homo sapiens
aggtgggagagaca

SEQ ID NO: 2030543 - DNA, 22 bp, Homo sapiens
aggtgggagagacactcccagg

SEQ ID NO: 2030544 - DNA, 18 bp, Homo sapiens
aggtgggcagaggctggc

SEQ ID NO: 2030545 - DNA, 17 bp, Homo sapiens
aggtgggcagcagctca

SEQ ID NO: 2030546 - DNA, 18 bp, Homo sapiens
aggtgggcagcagctcag

SEQ ID NO: 2030547 - DNA, 14 bp, Homo sapiens
aggtgggcagctgg

SEQ ID NO: 2030548 - DNA, 23 bp, Homo sapiens
aggtggggtatttaccacagcag

SEQ ID NO: 2030549 - DNA, 21 bp, Homo sapiens
aggtggggtctttgtgagagt

SEQ ID NO: 2030550 - DNA, 21 bp, Homo sapiens
aggtgggtccaggaaggcagc

SEQ ID NO: 2030551 - DNA, 22 bp, Homo sapiens
aggtgggtccaggaaggcagct

SEQ ID NO: 2030552 - DNA, 19 bp, Homo sapiens
aggtgggttttcttcccat

SEQ ID NO: 2030553 - DNA, 21 bp, Homo sapiens
aggtgggttttcttcccatca

SEQ ID NO: 2030554 - DNA, 22 bp, Homo sapiens
aggtgggttttcttcccatcac

SEQ ID NO: 2030555 - DNA, 15 bp, Homo sapiens
aggtggtgcttacat

SEQ ID NO: 2030556 - DNA, 18 bp, Homo sapiens
aggtggtgggggcaggga

SEQ ID NO: 2030557 - DNA, 19 bp, Homo sapiens
aggtggtgttgagaaagaa

SEQ ID NO: 2030558 - DNA, 19 bp, Homo sapiens
aggtggttctaatattttt

SEQ ID NO: 2030559 - DNA, 19 bp, Homo sapiens
aggtgtaaaatatctacct

SEQ ID NO: 2030560 - DNA, 14 bp, Homo sapiens
aggtgtaaatatag

SEQ ID NO: 2030561 - DNA, 16 bp, Homo sapiens
aggtgtccctgcactt

SEQ ID NO: 2030562 - DNA, 16 bp, Homo sapiens
aggtgtctgcacccag

SEQ ID NO: 2030563 - DNA, 22 bp, Homo sapiens
aggtgtgaaccaccacacccag

SEQ ID NO: 2030564 - DNA, 23 bp, Homo sapiens
aggtgtgaaccaccacacccagc

SEQ ID NO: 2030565 - DNA, 23 bp, Homo sapiens
aggtgtggctttaggagcagtgg

SEQ ID NO: 2030566 - DNA, 16 bp, Homo sapiens
aggtgtggtggctcat

SEQ ID NO: 2030567 - DNA, 17 bp, Homo sapiens
aggtgtggtggctcatg

SEQ ID NO: 2030568 - DNA, 21 bp, Homo sapiens
aggtgtggtgtaatttataaa

SEQ ID NO: 2030569 - DNA, 14 bp, Homo sapiens
aggtgtttatacag

SEQ ID NO: 2030570 - DNA, 14 bp, Homo sapiens
aggttaaaatataa

SEQ ID NO: 2030571 - DNA, 23 bp, Homo sapiens
aggttaaaatataaattaagact

SEQ ID NO: 2030572 - DNA, 20 bp, Homo sapiens
aggttactcagcagcagaga

SEQ ID NO: 2030573 - DNA, 18 bp, Homo sapiens
aggttaggatttaacagt

SEQ ID NO: 2030574 - DNA, 21 bp, Homo sapiens
aggttagtgacaaaattggcc

SEQ ID NO: 2030575 - DNA, 12 bp, Homo sapiens
aggttataagaa

SEQ ID NO: 2030576 - DNA, 16 bp, Homo sapiens
aggttataagaaacag

SEQ ID NO: 2030577 - DNA, 14 bp, Homo sapiens
aggttatctgcctg

SEQ ID NO: 2030578 - DNA, 15 bp, Homo sapiens
aggttatctgcctgg

SEQ ID NO: 2030579 - DNA, 16 bp, Homo sapiens
aggttatctgcctggc

SEQ ID NO: 2030580 - DNA, 19 bp, Homo sapiens
aggttatctgcctggcctg

SEQ ID NO: 2030581 - DNA, 14 bp, Homo sapiens
aggttatgcctcat

SEQ ID NO: 2030582 - DNA, 14 bp, Homo sapiens
aggttcccagcagc

SEQ ID NO: 2030583 - DNA, 15 bp, Homo sapiens
aggttcccagcagct

SEQ ID NO: 2030584 - DNA, 11 bp, Homo sapiens
aggttctaaaa

SEQ ID NO: 2030585 - DNA, 13 bp, Homo sapiens
aggttctaggtcc

SEQ ID NO: 2030586 - DNA, 21 bp, Homo sapiens
aggttctaggtcctggcttct

SEQ ID NO: 2030587 - DNA, 14 bp, Homo sapiens
aggttcttgatgtc

SEQ ID NO: 2030588 - DNA, 16 bp, Homo sapiens
aggttcttgatgtcat

SEQ ID NO: 2030589 - DNA, 18 bp, Homo sapiens
aggttcttgatgtcatgt

SEQ ID NO: 2030590 - DNA, 14 bp, Homo sapiens
aggttgaagcacca

SEQ ID NO: 2030591 - DNA, 21 bp, Homo sapiens
aggttgacaataaatgtgctt

SEQ ID NO: 2030592 - DNA, 12 bp, Homo sapiens
aggttgcaggga

SEQ ID NO: 2030593 - DNA, 19 bp, Homo sapiens
aggttgcagtgagctgaga

SEQ ID NO: 2030594 - DNA, 20 bp, Homo sapiens
aggttgcagtgagctgagat

SEQ ID NO: 2030595 - DNA, 20 bp, Homo sapiens
aggttgtctgaagtcactgc

SEQ ID NO: 2030596 - DNA, 23 bp, Homo sapiens
aggttgtggatgctccagggcag

SEQ ID NO: 2030597 - DNA, 14 bp, Homo sapiens
aggttgttctgtat

SEQ ID NO: 2030598 - DNA, 15 bp, Homo sapiens
aggtttctgaaaatt

SEQ ID NO: 2030599 - DNA, 23 bp, Homo sapiens
aggtttcttggggtcccagggaa

SEQ ID NO: 2030600 - DNA, 16 bp, Homo sapiens
aggtttgccagtgaag

SEQ ID NO: 2030601 - DNA, 19 bp, Homo sapiens
aggtttgccagtgaagact

SEQ ID NO: 2030602 - DNA, 23 bp, Homo sapiens
aggtttggggagggggaagagaa

SEQ ID NO: 2030603 - DNA, 17 bp, Homo sapiens
aggtttggtccagcctg

SEQ ID NO: 2030604 - DNA, 16 bp, Homo sapiens
aggtttggtgtgtgga

SEQ ID NO: 2030605 - DNA, 13 bp, Homo sapiens
aggtttgtatatt

SEQ ID NO: 2030606 - DNA, 13 bp, Homo sapiens
aggttttctccac

SEQ ID NO: 2030607 - DNA, 13 bp, Homo sapiens
aggttttgtacaa

SEQ ID NO: 2030608 - DNA, 19 bp, Homo sapiens
agtaaaaaacaacttcttt

SEQ ID NO: 2030609 - DNA, 20 bp, Homo sapiens
agtaaaaccacagcagttga

SEQ ID NO: 2030610 - DNA, 14 bp, Homo sapiens
agtaaaacttgctg

SEQ ID NO: 2030611 - DNA, 12 bp, Homo sapiens
agtaaaagcaaa

SEQ ID NO: 2030612 - DNA, 15 bp, Homo sapiens
agtaaaagctaatta

SEQ ID NO: 2030613 - DNA, 22 bp, Homo sapiens
agtaaaggcctcatctccttta

SEQ ID NO: 2030614 - DNA, 15 bp, Homo sapiens
agtaaagtttaaaaa

SEQ ID NO: 2030615 - DNA, 21 bp, Homo sapiens
agtaaagtttaaaaaatacac

SEQ ID NO: 2030616 - DNA, 16 bp, Homo sapiens
agtaaataaattgttt

SEQ ID NO: 2030617 - DNA, 15 bp, Homo sapiens
agtaacaaggtgtct

SEQ ID NO: 2030618 - DNA, 16 bp, Homo sapiens
agtaacatgccagctt

SEQ ID NO: 2030619 - DNA, 19 bp, Homo sapiens
agtaactgccatcaagatg

SEQ ID NO: 2030620 - DNA, 17 bp, Homo sapiens
agtaagtaccactcagg

SEQ ID NO: 2030621 - DNA, 19 bp, Homo sapiens
agtaagtaccactcaggcc

SEQ ID NO: 2030622 - DNA, 23 bp, Homo sapiens
agtaagtggggttgcaaccactg

SEQ ID NO: 2030623 - DNA, 14 bp, Homo sapiens
agtaagttctgaaa

SEQ ID NO: 2030624 - DNA, 23 bp, Homo sapiens
agtaataaaacccagcatgtaca

SEQ ID NO: 2030625 - DNA, 18 bp, Homo sapiens
agtaatagtccaatattt

SEQ ID NO: 2030626 - DNA, 19 bp, Homo sapiens
agtaatagtccaatatttg

SEQ ID NO: 2030627 - DNA, 20 bp, Homo sapiens
agtaatataatggaagagaa

SEQ ID NO: 2030628 - DNA, 22 bp, Homo sapiens
agtaatatgcctgctatttgaa

SEQ ID NO: 2030629 - DNA, 14 bp, Homo sapiens
agtaatcaggcagc

SEQ ID NO: 2030630 - DNA, 17 bp, Homo sapiens
agtaatcaggcagcctt

SEQ ID NO: 2030631 - DNA, 20 bp, Homo sapiens
agtaatgggccaattaaaat

SEQ ID NO: 2030632 - DNA, 20 bp, Homo sapiens
agtaattatcgggaacagtg

SEQ ID NO: 2030633 - DNA, 14 bp, Homo sapiens
agtaatttagaaat

SEQ ID NO: 2030634 - DNA, 15 bp, Homo sapiens
agtacaattcttact

SEQ ID NO: 2030635 - DNA, 19 bp, Homo sapiens
agtacagtagcttaaataa

SEQ ID NO: 2030636 - DNA, 22 bp, Homo sapiens
agtacataaaggtggtatgtgt

SEQ ID NO: 2030637 - DNA, 14 bp, Homo sapiens
agtacctttgtcac

SEQ ID NO: 2030638 - DNA, 18 bp, Homo sapiens
agtacgtgctaacaggct

SEQ ID NO: 2030639 - DNA, 20 bp, Homo sapiens
agtacgtttttgcattattc

SEQ ID NO: 2030640 - DNA, 21 bp, Homo sapiens
agtacgtttttgcattattca

SEQ ID NO: 2030641 - DNA, 17 bp, Homo sapiens
agtactagaatttgtat

SEQ ID NO: 2030642 - DNA, 18 bp, Homo sapiens
agtactcctgcaaaattt

SEQ ID NO: 2030643 - DNA, 21 bp, Homo sapiens
agtactcctgcaaaattttat

SEQ ID NO: 2030644 - DNA, 12 bp, Homo sapiens
agtacttctaag

SEQ ID NO: 2030645 - DNA, 20 bp, Homo sapiens
agtacttctccaccctgctc

SEQ ID NO: 2030646 - DNA, 17 bp, Homo sapiens
agtagaattatatctaa

SEQ ID NO: 2030647 - DNA, 20 bp, Homo sapiens
agtagaattatatctaattt

SEQ ID NO: 2030648 - DNA, 13 bp, Homo sapiens
agtagacttatag

SEQ ID NO: 2030649 - DNA, 12 bp, Homo sapiens
agtagagaagta

SEQ ID NO: 2030650 - DNA, 11 bp, Homo sapiens
agtagagacag

SEQ ID NO: 2030651 - DNA, 15 bp, Homo sapiens
agtagatggtgaaat

SEQ ID NO: 2030652 - DNA, 22 bp, Homo sapiens
agtagcaaccttcattttacat

SEQ ID NO: 2030653 - DNA, 23 bp, Homo sapiens
agtagcaaccttcattttacatt

SEQ ID NO: 2030654 - DNA, 22 bp, Homo sapiens
agtagcaagttctagagaagag

SEQ ID NO: 2030655 - DNA, 18 bp, Homo sapiens
agtagcaccctggattga

SEQ ID NO: 2030656 - DNA, 14 bp, Homo sapiens
agtagcatgagaga

SEQ ID NO: 2030657 - DNA, 23 bp, Homo sapiens
agtagcatgagagaattgtatca

SEQ ID NO: 2030658 - DNA, 14 bp, Homo sapiens
agtagccaagttat

SEQ ID NO: 2030659 - DNA, 20 bp, Homo sapiens
agtagccctttctgtgtgca

SEQ ID NO: 2030660 - DNA, 16 bp, Homo sapiens
agtagccgagagcctg

SEQ ID NO: 2030661 - DNA, 11 bp, Homo sapiens
agtagctgagc

SEQ ID NO: 2030662 - DNA, 13 bp, Homo sapiens
agtagctgagctc

SEQ ID NO: 2030663 - DNA, 19 bp, Homo sapiens
agtagctgggactacaggc

SEQ ID NO: 2030664 - DNA, 21 bp, Homo sapiens
agtagctgggactacaggcac

SEQ ID NO: 2030665 - DNA, 16 bp, Homo sapiens
agtagcttaaataaat

SEQ ID NO: 2030666 - DNA, 21 bp, Homo sapiens
agtagcttaaataaattcaaa

SEQ ID NO: 2030667 - DNA, 19 bp, Homo sapiens
agtagtaattgatttgacc

SEQ ID NO: 2030668 - DNA, 15 bp, Homo sapiens
agtagtcaattagta

SEQ ID NO: 2030669 - DNA, 19 bp, Homo sapiens
agtagtcaattagtacagt

SEQ ID NO: 2030670 - DNA, 22 bp, Homo sapiens
agtagttgatgaccaatctctg

SEQ ID NO: 2030671 - DNA, 17 bp, Homo sapiens
agtagtttgtataactt

SEQ ID NO: 2030672 - DNA, 19 bp, Homo sapiens
agtataaagtcacttccag

SEQ ID NO: 2030673 - DNA, 18 bp, Homo sapiens
agtataaatggttgtctg

SEQ ID NO: 2030674 - DNA, 15 bp, Homo sapiens
agtatacaatatata

SEQ ID NO: 2030675 - DNA, 18 bp, Homo sapiens
agtatatctggacaagcc

SEQ ID NO: 2030676 - DNA, 11 bp, Homo sapiens
agtatatttat

SEQ ID NO: 2030677 - DNA, 17 bp, Homo sapiens
agtatccaattatgtga

SEQ ID NO: 2030678 - DNA, 19 bp, Homo sapiens
agtatccaattatgtgaca

SEQ ID NO: 2030679 - DNA, 16 bp, Homo sapiens
agtatctaacatgtat

SEQ ID NO: 2030680 - DNA, 22 bp, Homo sapiens
agtatctcatcaacaaagaaat

SEQ ID NO: 2030681 - DNA, 16 bp, Homo sapiens
agtatgaataaagaca

SEQ ID NO: 2030682 - DNA, 19 bp, Homo sapiens
agtatgatttttacaataa

SEQ ID NO: 2030683 - DNA, 16 bp, Homo sapiens
agtatgcaagaagaat

SEQ ID NO: 2030684 - DNA, 17 bp, Homo sapiens
agtatgcaagaagaata

SEQ ID NO: 2030685 - DNA, 18 bp, Homo sapiens
agtatgcaagaagaatat

SEQ ID NO: 2030686 - DNA, 14 bp, Homo sapiens
agtatggaagggag

SEQ ID NO: 2030687 - DNA, 21 bp, Homo sapiens
agtatggaagggaggggtcct

SEQ ID NO: 2030688 - DNA, 15 bp, Homo sapiens
agtatggcctgtgtc

SEQ ID NO: 2030689 - DNA, 15 bp, Homo sapiens
agtatggtggctggg

SEQ ID NO: 2030690 - DNA, 13 bp, Homo sapiens
agtattaaatatt

SEQ ID NO: 2030691 - DNA, 16 bp, Homo sapiens
agtattaaatatttaa

SEQ ID NO: 2030692 - DNA, 18 bp, Homo sapiens
agtattaaatatttaaca

SEQ ID NO: 2030693 - DNA, 18 bp, Homo sapiens
agtattacttctgctaca

SEQ ID NO: 2030694 - DNA, 12 bp, Homo sapiens
agtatttatata

SEQ ID NO: 2030695 - DNA, 17 bp, Homo sapiens
agtatttatatatttat

SEQ ID NO: 2030696 - DNA, 18 bp, Homo sapiens
agtatttgtacaaatact

SEQ ID NO: 2030697 - DNA, 16 bp, Homo sapiens
agtattttatctgtgt

SEQ ID NO: 2030698 - DNA, 21 bp, Homo sapiens
agtcaaaacagagatgtgata

SEQ ID NO: 2030699 - DNA, 15 bp, Homo sapiens
agtcaaaaggtgcct

SEQ ID NO: 2030700 - DNA, 16 bp, Homo sapiens
agtcaaaaggtgcctg

SEQ ID NO: 2030701 - DNA, 22 bp, Homo sapiens
agtcaaatttgaaaataattgt

SEQ ID NO: 2030702 - DNA, 15 bp, Homo sapiens
agtcaacactcttct

SEQ ID NO: 2030703 - DNA, 19 bp, Homo sapiens
agtcaacagttcaaagaag

SEQ ID NO: 2030704 - DNA, 12 bp, Homo sapiens
agtcaactggct

SEQ ID NO: 2030705 - DNA, 17 bp, Homo sapiens
agtcaactggctggcca

SEQ ID NO: 2030706 - DNA, 19 bp, Homo sapiens
agtcaactggctggccagt

SEQ ID NO: 2030707 - DNA, 20 bp, Homo sapiens
agtcaactggctggccagtc

SEQ ID NO: 2030708 - DNA, 18 bp, Homo sapiens
agtcaatcccctcattca

SEQ ID NO: 2030709 - DNA, 16 bp, Homo sapiens
agtcaattagtacagt

SEQ ID NO: 2030710 - DNA, 21 bp, Homo sapiens
agtcaattagtacagtagctt

SEQ ID NO: 2030711 - DNA, 16 bp, Homo sapiens
agtcacaagagcccag

SEQ ID NO: 2030712 - DNA, 15 bp, Homo sapiens
agtcacacagacaca

SEQ ID NO: 2030713 - DNA, 23 bp, Homo sapiens
agtcacaccatcttaaatgacag

SEQ ID NO: 2030714 - DNA, 20 bp, Homo sapiens
agtcacagctgcagctgggc

SEQ ID NO: 2030715 - DNA, 22 bp, Homo sapiens
agtcacagctgcagctgggccc

SEQ ID NO: 2030716 - DNA, 23 bp, Homo sapiens
agtcacagctgcagctgggcccc

SEQ ID NO: 2030717 - DNA, 17 bp, Homo sapiens
agtcacccatgaagaca

SEQ ID NO: 2030718 - DNA, 20 bp, Homo sapiens
agtcaccctacctgtgcctg

SEQ ID NO: 2030719 - DNA, 14 bp, Homo sapiens
agtcacctcctcca

SEQ ID NO: 2030720 - DNA, 16 bp, Homo sapiens
agtcacttatttcata

SEQ ID NO: 2030721 - DNA, 22 bp, Homo sapiens
agtcagaacagcagactcagct

SEQ ID NO: 2030722 - DNA, 21 bp, Homo sapiens
agtcagacatttggtatatta

SEQ ID NO: 2030723 - DNA, 17 bp, Homo sapiens
agtcagagagagtgttt

SEQ ID NO: 2030724 - DNA, 15 bp, Homo sapiens
agtcagaggagaaga

SEQ ID NO: 2030725 - DNA, 13 bp, Homo sapiens
agtcaggaaggga

SEQ ID NO: 2030726 - DNA, 22 bp, Homo sapiens
agtcagggtgggaagaaagaat

SEQ ID NO: 2030727 - DNA, 19 bp, Homo sapiens
agtcagtaggtccaagggc

SEQ ID NO: 2030728 - DNA, 22 bp, Homo sapiens
agtcagtgggaacgtgactgcc

SEQ ID NO: 2030729 - DNA, 19 bp, Homo sapiens
agtcagttcccggagcaca

SEQ ID NO: 2030730 - DNA, 22 bp, Homo sapiens
agtcagttcccggagcacagcc

SEQ ID NO: 2030731 - DNA, 15 bp, Homo sapiens
agtcatattcttatg

SEQ ID NO: 2030732 - DNA, 14 bp, Homo sapiens
agtcatgaagccca

SEQ ID NO: 2030733 - DNA, 23 bp, Homo sapiens
agtcatgatctccctgccgcctc

SEQ ID NO: 2030734 - DNA, 19 bp, Homo sapiens
agtcattgggttttatcag

SEQ ID NO: 2030735 - DNA, 15 bp, Homo sapiens
agtcatttattttaa

SEQ ID NO: 2030736 - DNA, 20 bp, Homo sapiens
agtccaaatgtgatcaactg

SEQ ID NO: 2030737 - DNA, 17 bp, Homo sapiens
agtccaacaatgttgtt

SEQ ID NO: 2030738 - DNA, 18 bp, Homo sapiens
agtccaacctgcctgtgc

SEQ ID NO: 2030739 - DNA, 20 bp, Homo sapiens
agtccagaataagtgctgtt

SEQ ID NO: 2030740 - DNA, 13 bp, Homo sapiens
agtccagagccgg

SEQ ID NO: 2030741 - DNA, 15 bp, Homo sapiens
agtccagccagctcc

SEQ ID NO: 2030742 - DNA, 18 bp, Homo sapiens
agtccaggtcctggtggg

SEQ ID NO: 2030743 - DNA, 21 bp, Homo sapiens
agtccatatttcaatttccaa

SEQ ID NO: 2030744 - DNA, 23 bp, Homo sapiens
agtccatatttcaatttccaaga

SEQ ID NO: 2030745 - DNA, 20 bp, Homo sapiens
agtcccaaggaaagccccag

SEQ ID NO: 2030746 - DNA, 15 bp, Homo sapiens
agtcccaccttggct

SEQ ID NO: 2030747 - DNA, 18 bp, Homo sapiens
agtcccaccttggctgca

SEQ ID NO: 2030748 - DNA, 21 bp, Homo sapiens
agtcccaccttggctgcaggg

SEQ ID NO: 2030749 - DNA, 15 bp, Homo sapiens
agtccccagcccttc

SEQ ID NO: 2030750 - DNA, 16 bp, Homo sapiens
agtccccctgccccag

SEQ ID NO: 2030751 - DNA, 16 bp, Homo sapiens
agtcccctgggcctgg

SEQ ID NO: 2030752 - DNA, 23 bp, Homo sapiens
agtccctcccatctctaccccaa

SEQ ID NO: 2030753 - DNA, 22 bp, Homo sapiens
agtccctgggggaagccctgga

SEQ ID NO: 2030754 - DNA, 20 bp, Homo sapiens
agtccctgttctcagctccg

SEQ ID NO: 2030755 - DNA, 18 bp, Homo sapiens
agtccgccaaacactcca

SEQ ID NO: 2030756 - DNA, 22 bp, Homo sapiens
agtccgcctggccggctccagt

SEQ ID NO: 2030757 - DNA, 12 bp, Homo sapiens
agtccgtccacc

SEQ ID NO: 2030758 - DNA, 16 bp, Homo sapiens
agtcctagagctcctg

SEQ ID NO: 2030759 - DNA, 19 bp, Homo sapiens
agtcctagagctcctgtcc

SEQ ID NO: 2030760 - DNA, 17 bp, Homo sapiens
agtcctatcgactttat

SEQ ID NO: 2030761 - DNA, 20 bp, Homo sapiens
agtcctcacagcctctccct

SEQ ID NO: 2030762 - DNA, 21 bp, Homo sapiens
agtcctcacagcctctccctt

SEQ ID NO: 2030763 - DNA, 22 bp, Homo sapiens
agtcctctggatggcaccagag

SEQ ID NO: 2030764 - DNA, 22 bp, Homo sapiens
agtcctcttttctgagaggact

SEQ ID NO: 2030765 - DNA, 17 bp, Homo sapiens
agtcctgcagaggattt

SEQ ID NO: 2030766 - DNA, 12 bp, Homo sapiens
agtcctggaagc

SEQ ID NO: 2030767 - DNA, 11 bp, Homo sapiens
agtcctggcca

SEQ ID NO: 2030768 - DNA, 22 bp, Homo sapiens
agtcctggccattttcttgcct

SEQ ID NO: 2030769 - DNA, 23 bp, Homo sapiens
agtcctggccattttcttgcctg

SEQ ID NO: 2030770 - DNA, 21 bp, Homo sapiens
agtcctgggagaacctcaggc

SEQ ID NO: 2030771 - DNA, 17 bp, Homo sapiens
agtcctggtctgctcag

SEQ ID NO: 2030772 - DNA, 18 bp, Homo sapiens
agtcctggtctgctcagg

SEQ ID NO: 2030773 - DNA, 20 bp, Homo sapiens
agtcctggtctgctcaggaa

SEQ ID NO: 2030774 - DNA, 18 bp, Homo sapiens
agtccttggtctgctggt

SEQ ID NO: 2030775 - DNA, 21 bp, Homo sapiens
agtcgaattaatagcttttat

SEQ ID NO: 2030776 - DNA, 14 bp, Homo sapiens
agtcgagccctgca

SEQ ID NO: 2030777 - DNA, 20 bp, Homo sapiens
agtcgcaggatccgctgcca

SEQ ID NO: 2030778 - DNA, 23 bp, Homo sapiens
agtcgcaggatccgctgccacca

SEQ ID NO: 2030779 - DNA, 13 bp, Homo sapiens
agtcgtcaagttg

SEQ ID NO: 2030780 - DNA, 20 bp, Homo sapiens
agtcgttggcaccttcaata

SEQ ID NO: 2030781 - DNA, 20 bp, Homo sapiens
agtctaaagctggtttaatg

SEQ ID NO: 2030782 - DNA, 13 bp, Homo sapiens
agtctaaagttta

SEQ ID NO: 2030783 - DNA, 17 bp, Homo sapiens
agtctaaagtttacagt

SEQ ID NO: 2030784 - DNA, 23 bp, Homo sapiens
agtctaaagtttacagtaaataa

SEQ ID NO: 2030785 - DNA, 18 bp, Homo sapiens
agtctaatctctaaatca

SEQ ID NO: 2030786 - DNA, 20 bp, Homo sapiens
agtctaattttgtcaaatca

SEQ ID NO: 2030787 - DNA, 16 bp, Homo sapiens
agtctacctcttcagt

SEQ ID NO: 2030788 - DNA, 15 bp, Homo sapiens
agtctacgctctcct

SEQ ID NO: 2030789 - DNA, 15 bp, Homo sapiens
agtctacgttctcca

SEQ ID NO: 2030790 - DNA, 20 bp, Homo sapiens
agtctacgttctccagccca

SEQ ID NO: 2030791 - DNA, 20 bp, Homo sapiens
agtctaggagctgggaggaa

SEQ ID NO: 2030792 - DNA, 22 bp, Homo sapiens
agtctaggagctgggaggaaaa

SEQ ID NO: 2030793 - DNA, 15 bp, Homo sapiens
agtctagtgaagatg

SEQ ID NO: 2030794 - DNA, 17 bp, Homo sapiens
agtctagtgaagatgtt

SEQ ID NO: 2030795 - DNA, 19 bp, Homo sapiens
agtctcactgttgcccagg

SEQ ID NO: 2030796 - DNA, 23 bp, Homo sapiens
agtctcaggccctgaaggttcct

SEQ ID NO: 2030797 - DNA, 22 bp, Homo sapiens
agtctcagtccagatgccttcc

SEQ ID NO: 2030798 - DNA, 16 bp, Homo sapiens
agtctcctctctgaga

SEQ ID NO: 2030799 - DNA, 14 bp, Homo sapiens
agtctcctgacatt

SEQ ID NO: 2030800 - DNA, 18 bp, Homo sapiens
agtctcctttgcactgag

SEQ ID NO: 2030801 - DNA, 21 bp, Homo sapiens
agtctcctttgcactgagggc

SEQ ID NO: 2030802 - DNA, 18 bp, Homo sapiens
agtctctatgatcttggc

SEQ ID NO: 2030803 - DNA, 18 bp, Homo sapiens
agtctctgactcttgcct

SEQ ID NO: 2030804 - DNA, 21 bp, Homo sapiens
agtctctgggagactttccct

SEQ ID NO: 2030805 - DNA, 14 bp, Homo sapiens
agtctcttctccac

SEQ ID NO: 2030806 - DNA, 15 bp, Homo sapiens
agtctcttctccact

SEQ ID NO: 2030807 - DNA, 22 bp, Homo sapiens
agtctcttggtgatggagtgtg

SEQ ID NO: 2030808 - DNA, 21 bp, Homo sapiens
agtctctttaatcttcagttt

SEQ ID NO: 2030809 - DNA, 22 bp, Homo sapiens
agtctctttaatcttcagtttt

SEQ ID NO: 2030810 - DNA, 18 bp, Homo sapiens
agtctgaacccttgtgct

SEQ ID NO: 2030811 - DNA, 15 bp, Homo sapiens
agtctgagcccccgg

SEQ ID NO: 2030812 - DNA, 14 bp, Homo sapiens
agtctgaggtcctg

SEQ ID NO: 2030813 - DNA, 18 bp, Homo sapiens
agtctgaggtcctgagca

SEQ ID NO: 2030814 - DNA, 22 bp, Homo sapiens
agtctgaggtcctgagcactgc

SEQ ID NO: 2030815 - DNA, 16 bp, Homo sapiens
agtctgagtcctgtct

SEQ ID NO: 2030816 - DNA, 22 bp, Homo sapiens
agtctgattcccaagctctgct

SEQ ID NO: 2030817 - DNA, 16 bp, Homo sapiens
agtctgcataaacttc

SEQ ID NO: 2030818 - DNA, 21 bp, Homo sapiens
agtctgcataaacttcatctt

SEQ ID NO: 2030819 - DNA, 23 bp, Homo sapiens
agtctgcgtctctgctttaaagt

SEQ ID NO: 2030820 - DNA, 16 bp, Homo sapiens
agtctgctatattttc

SEQ ID NO: 2030821 - DNA, 18 bp, Homo sapiens
agtctggaatgcagtggt

SEQ ID NO: 2030822 - DNA, 16 bp, Homo sapiens
agtctgggctgccggg

SEQ ID NO: 2030823 - DNA, 14 bp, Homo sapiens
agtctggtgttctg

SEQ ID NO: 2030824 - DNA, 15 bp, Homo sapiens
agtctggtttctaga

SEQ ID NO: 2030825 - DNA, 20 bp, Homo sapiens
agtctggtttctagacttgt

SEQ ID NO: 2030826 - DNA, 12 bp, Homo sapiens
agtctgtcatcc

SEQ ID NO: 2030827 - DNA, 18 bp, Homo sapiens
agtctgtgtgatgaactt

SEQ ID NO: 2030828 - DNA, 16 bp, Homo sapiens
agtctgtgtgcacaat

SEQ ID NO: 2030829 - DNA, 22 bp, Homo sapiens
agtcttaatatatatatccaga

SEQ ID NO: 2030830 - DNA, 17 bp, Homo sapiens
agtcttacttaaaaaaa

SEQ ID NO: 2030831 - DNA, 13 bp, Homo sapiens
agtcttccctgat

SEQ ID NO: 2030832 - DNA, 20 bp, Homo sapiens
agtcttgctttgctgtctgg

SEQ ID NO: 2030833 - DNA, 15 bp, Homo sapiens
agtcttgtcagaatt

SEQ ID NO: 2030834 - DNA, 23 bp, Homo sapiens
agtctttccgtctccctaaaata

SEQ ID NO: 2030835 - DNA, 20 bp, Homo sapiens
agtctttcttagtgcctgtg

SEQ ID NO: 2030836 - DNA, 13 bp, Homo sapiens
agtctttgttgca

SEQ ID NO: 2030837 - DNA, 13 bp, Homo sapiens
agtcttttactcc

SEQ ID NO: 2030838 - DNA, 17 bp, Homo sapiens
agtgaaaaatatgttga

SEQ ID NO: 2030839 - DNA, 16 bp, Homo sapiens
agtgaaagaggcagct

SEQ ID NO: 2030840 - DNA, 19 bp, Homo sapiens
agtgaacaactatttataa

SEQ ID NO: 2030841 - DNA, 20 bp, Homo sapiens
agtgaacacactcagcagcc

SEQ ID NO: 2030842 - DNA, 13 bp, Homo sapiens
agtgaaccaaaga

SEQ ID NO: 2030843 - DNA, 23 bp, Homo sapiens
agtgaaccaaagagactggagca

SEQ ID NO: 2030844 - DNA, 20 bp, Homo sapiens
agtgaactacgcttgctcat

SEQ ID NO: 2030845 - DNA, 19 bp, Homo sapiens
agtgaactatttctacaca

SEQ ID NO: 2030846 - DNA, 23 bp, Homo sapiens
agtgaacttacacttggagcccg

SEQ ID NO: 2030847 - DNA, 23 bp, Homo sapiens
agtgaagaaaagtgaatgctcaa

SEQ ID NO: 2030848 - DNA, 12 bp, Homo sapiens
agtgaagaatac

SEQ ID NO: 2030849 - DNA, 14 bp, Homo sapiens
agtgaagaatactt

SEQ ID NO: 2030850 - DNA, 17 bp, Homo sapiens
agtgaagacttcttggg

SEQ ID NO: 2030851 - DNA, 22 bp, Homo sapiens
agtgaagccagctgcaggaatc

SEQ ID NO: 2030852 - DNA, 16 bp, Homo sapiens
agtgaaggagaaagga

SEQ ID NO: 2030853 - DNA, 17 bp, Homo sapiens
agtgaagtgagaagttc

SEQ ID NO: 2030854 - DNA, 12 bp, Homo sapiens
agtgaataaact

SEQ ID NO: 2030855 - DNA, 15 bp, Homo sapiens
agtgaataaacttca

SEQ ID NO: 2030856 - DNA, 18 bp, Homo sapiens
agtgaatgctcaagtttt

SEQ ID NO: 2030857 - DNA, 23 bp, Homo sapiens
agtgacaaaattggccagagagt

SEQ ID NO: 2030858 - DNA, 17 bp, Homo sapiens
agtgacaaattgtaact

SEQ ID NO: 2030859 - DNA, 21 bp, Homo sapiens
agtgacaaattgtaactacac

SEQ ID NO: 2030860 - DNA, 21 bp, Homo sapiens
agtgacacccaagagggctgc

SEQ ID NO: 2030861 - DNA, 14 bp, Homo sapiens
agtgacagaggcag

SEQ ID NO: 2030862 - DNA, 16 bp, Homo sapiens
agtgacagaggcagcc

SEQ ID NO: 2030863 - DNA, 19 bp, Homo sapiens
agtgacagaggcagcccca

SEQ ID NO: 2030864 - DNA, 12 bp, Homo sapiens
agtgacagctag

SEQ ID NO: 2030865 - DNA, 20 bp, Homo sapiens
agtgacagctaggatgtgca

SEQ ID NO: 2030866 - DNA, 21 bp, Homo sapiens
agtgacatgggtgtgccaggc

SEQ ID NO: 2030867 - DNA, 22 bp, Homo sapiens
agtgacatgggtgtgccaggct

SEQ ID NO: 2030868 - DNA, 22 bp, Homo sapiens
agtgacccagatattgcactag

SEQ ID NO: 2030869 - DNA, 16 bp, Homo sapiens
agtgactccaagaaca

SEQ ID NO: 2030870 - DNA, 18 bp, Homo sapiens
agtgactccaagaacaat

SEQ ID NO: 2030871 - DNA, 21 bp, Homo sapiens
agtgactcggtgtaaaaccat

SEQ ID NO: 2030872 - DNA, 14 bp, Homo sapiens
agtgactggcaggt

SEQ ID NO: 2030873 - DNA, 15 bp, Homo sapiens
agtgactggcaggtg

SEQ ID NO: 2030874 - DNA, 20 bp, Homo sapiens
agtgactgtcgtgtttacaa

SEQ ID NO: 2030875 - DNA, 15 bp, Homo sapiens
agtgacttcctggtg

SEQ ID NO: 2030876 - DNA, 16 bp, Homo sapiens
agtgacttcctggtga

SEQ ID NO: 2030877 - DNA, 18 bp, Homo sapiens
agtgacttcctggtgagg

SEQ ID NO: 2030878 - DNA, 20 bp, Homo sapiens
agtgagaaaaagctcctgtc

SEQ ID NO: 2030879 - DNA, 19 bp, Homo sapiens
agtgagaataattgtgtac

SEQ ID NO: 2030880 - DNA, 19 bp, Homo sapiens
agtgagaatctggctcctg

SEQ ID NO: 2030881 - DNA, 13 bp, Homo sapiens
agtgagacacaga

SEQ ID NO: 2030882 - DNA, 15 bp, Homo sapiens
agtgagacacagagt

SEQ ID NO: 2030883 - DNA, 13 bp, Homo sapiens
agtgagacagaag

SEQ ID NO: 2030884 - DNA, 21 bp, Homo sapiens
agtgagagacattaactcatt

SEQ ID NO: 2030885 - DNA, 22 bp, Homo sapiens
agtgagagacattaactcatta

SEQ ID NO: 2030886 - DNA, 13 bp, Homo sapiens
agtgagagggcat

SEQ ID NO: 2030887 - DNA, 22 bp, Homo sapiens
agtgagagggcatgcgcacaag

SEQ ID NO: 2030888 - DNA, 16 bp, Homo sapiens
agtgagatttgtattt

SEQ ID NO: 2030889 - DNA, 17 bp, Homo sapiens
agtgagatttgtattta

SEQ ID NO: 2030890 - DNA, 19 bp, Homo sapiens
agtgagccacagaccacct

SEQ ID NO: 2030891 - DNA, 21 bp, Homo sapiens
agtgagccacagaccacctgc

SEQ ID NO: 2030892 - DNA, 19 bp, Homo sapiens
agtgagccgcatcttctcc

SEQ ID NO: 2030893 - DNA, 22 bp, Homo sapiens
agtgagccgcatcttctccatc

SEQ ID NO: 2030894 - DNA, 24 bp, Homo sapiens
agtgagccgcatcttctccatctg

SEQ ID NO: 2030895 - DNA, 21 bp, Homo sapiens
agtgagcctgaattttgttgc

SEQ ID NO: 2030896 - DNA, 23 bp, Homo sapiens
agtgagctgagatcgtgccgtta

SEQ ID NO: 2030897 - DNA, 15 bp, Homo sapiens
agtgaggcttccagg

SEQ ID NO: 2030898 - DNA, 19 bp, Homo sapiens
agtgaggcttccaggctct

SEQ ID NO: 2030899 - DNA, 16 bp, Homo sapiens
agtgagtcgaggacag

SEQ ID NO: 2030900 - DNA, 15 bp, Homo sapiens
agtgagttttttagt

SEQ ID NO: 2030901 - DNA, 16 bp, Homo sapiens
agtgatatatgtattt

SEQ ID NO: 2030902 - DNA, 17 bp, Homo sapiens
agtgatatatgtattta

SEQ ID NO: 2030903 - DNA, 13 bp, Homo sapiens
agtgatcctccca

SEQ ID NO: 2030904 - DNA, 18 bp, Homo sapiens
agtgatcctcccacctca

SEQ ID NO: 2030905 - DNA, 19 bp, Homo sapiens
agtgatcctcccacctcag

SEQ ID NO: 2030906 - DNA, 13 bp, Homo sapiens
agtgatctccata

SEQ ID NO: 2030907 - DNA, 19 bp, Homo sapiens
agtgatctgtcccctctcc

SEQ ID NO: 2030908 - DNA, 21 bp, Homo sapiens
agtgatctgtcccctctcccc

SEQ ID NO: 2030909 - DNA, 14 bp, Homo sapiens
agtgatgtgctgga

SEQ ID NO: 2030910 - DNA, 20 bp, Homo sapiens
agtgatgttgtttgggagag

SEQ ID NO: 2030911 - DNA, 21 bp, Homo sapiens
agtgatgttgtttgggagagt

SEQ ID NO: 2030912 - DNA, 23 bp, Homo sapiens
agtgatgtttttatgatatccct

SEQ ID NO: 2030913 - DNA, 19 bp, Homo sapiens
agtgattctcctgcctcag

SEQ ID NO: 2030914 - DNA, 16 bp, Homo sapiens
agtgattgacacacag

SEQ ID NO: 2030915 - DNA, 15 bp, Homo sapiens
agtgattgtcttaat

SEQ ID NO: 2030916 - DNA, 15 bp, Homo sapiens
agtgcaaagtgccct

SEQ ID NO: 2030917 - DNA, 18 bp, Homo sapiens
agtgcaaatttgatacat

SEQ ID NO: 2030918 - DNA, 11 bp, Homo sapiens
agtgcaacaag

SEQ ID NO: 2030919 - DNA, 15 bp, Homo sapiens
agtgcaatttcccct

SEQ ID NO: 2030920 - DNA, 16 bp, Homo sapiens
agtgcacacagaaata

SEQ ID NO: 2030921 - DNA, 20 bp, Homo sapiens
agtgcacacagaaatatata

SEQ ID NO: 2030922 - DNA, 13 bp, Homo sapiens
agtgcacacttgt

SEQ ID NO: 2030923 - DNA, 16 bp, Homo sapiens
agtgcacttgctggaa

SEQ ID NO: 2030924 - DNA, 22 bp, Homo sapiens
agtgcagagaaagaaagggaaa

SEQ ID NO: 2030925 - DNA, 14 bp, Homo sapiens
agtgcagcccttcc

SEQ ID NO: 2030926 - DNA, 18 bp, Homo sapiens
agtgcagcccttcctcct

SEQ ID NO: 2030927 - DNA, 19 bp, Homo sapiens
agtgcagtagtaattgatt

SEQ ID NO: 2030928 - DNA, 16 bp, Homo sapiens
agtgcatgctctctgc

SEQ ID NO: 2030929 - DNA, 22 bp, Homo sapiens
agtgcatttatgagctcttcat

SEQ ID NO: 2030930 - DNA, 17 bp, Homo sapiens
agtgcattttcccagat

SEQ ID NO: 2030931 - DNA, 19 bp, Homo sapiens
agtgccaaggttgtcctgg

SEQ ID NO: 2030932 - DNA, 15 bp, Homo sapiens
agtgccaagtttgtt

SEQ ID NO: 2030933 - DNA, 11 bp, Homo sapiens
agtgccacaga

SEQ ID NO: 2030934 - DNA, 18 bp, Homo sapiens
agtgccacttgacattcc

SEQ ID NO: 2030935 - DNA, 20 bp, Homo sapiens
agtgccacttgacattcctt

SEQ ID NO: 2030936 - DNA, 17 bp, Homo sapiens
agtgccaggacagctgg

SEQ ID NO: 2030937 - DNA, 19 bp, Homo sapiens
agtgccaggacagctggct

SEQ ID NO: 2030938 - DNA, 20 bp, Homo sapiens
agtgccaggacagctggctg

SEQ ID NO: 2030939 - DNA, 22 bp, Homo sapiens
agtgccaggacagctggctgct

SEQ ID NO: 2030940 - DNA, 13 bp, Homo sapiens
agtgccaggactc

SEQ ID NO: 2030941 - DNA, 17 bp, Homo sapiens
agtgccatttcctgtct

SEQ ID NO: 2030942 - DNA, 16 bp, Homo sapiens
agtgcccaccaacatc

SEQ ID NO: 2030943 - DNA, 14 bp, Homo sapiens
agtgcccgccctgc

SEQ ID NO: 2030944 - DNA, 16 bp, Homo sapiens
agtgcccgccctgccc

SEQ ID NO: 2030945 - DNA, 20 bp, Homo sapiens
agtgcccgccctgcccctgc

SEQ ID NO: 2030946 - DNA, 21 bp, Homo sapiens
agtgccctccacagccgcagc

SEQ ID NO: 2030947 - DNA, 15 bp, Homo sapiens
agtgcctcctgggac

SEQ ID NO: 2030948 - DNA, 19 bp, Homo sapiens
agtgcctcttgttgcagag

SEQ ID NO: 2030949 - DNA, 17 bp, Homo sapiens
agtgccttacctcctgc

SEQ ID NO: 2030950 - DNA, 15 bp, Homo sapiens
agtgccttccataat

SEQ ID NO: 2030951 - DNA, 22 bp, Homo sapiens
agtgccttggagcagaaagcca

SEQ ID NO: 2030952 - DNA, 21 bp, Homo sapiens
agtgcgctcttggtccctggt

SEQ ID NO: 2030953 - DNA, 17 bp, Homo sapiens
agtgctatatatataaa

SEQ ID NO: 2030954 - DNA, 15 bp, Homo sapiens
agtgctattctgtgt

SEQ ID NO: 2030955 - DNA, 19 bp, Homo sapiens
agtgctattctgtgttgaa

SEQ ID NO: 2030956 - DNA, 23 bp, Homo sapiens
agtgctattctgtgttgaacaca

SEQ ID NO: 2030957 - DNA, 13 bp, Homo sapiens
agtgctccccaca

SEQ ID NO: 2030958 - DNA, 16 bp, Homo sapiens
agtgctcggcagtcat

SEQ ID NO: 2030959 - DNA, 18 bp, Homo sapiens
agtgctgccatgccactg

SEQ ID NO: 2030960 - DNA, 19 bp, Homo sapiens
agtgctgccatgccactgc

SEQ ID NO: 2030961 - DNA, 24 bp, Homo sapiens
agtgctgccatgccactgccaggc

SEQ ID NO: 2030962 - DNA, 22 bp, Homo sapiens
agtgctgcgagatcgctggcag

SEQ ID NO: 2030963 - DNA, 20 bp, Homo sapiens
agtgctgggattacaggcat

SEQ ID NO: 2030964 - DNA, 19 bp, Homo sapiens
agtgctgggattacaggtg

SEQ ID NO: 2030965 - DNA, 21 bp, Homo sapiens
agtgctgtacccttccacctc

SEQ ID NO: 2030966 - DNA, 14 bp, Homo sapiens
agtgctgtggcctg

SEQ ID NO: 2030967 - DNA, 17 bp, Homo sapiens
agtgctgttctggagct

SEQ ID NO: 2030968 - DNA, 18 bp, Homo sapiens
agtgctgttctggagctg

SEQ ID NO: 2030969 - DNA, 21 bp, Homo sapiens
agtgctgtttgagatgtgatg

SEQ ID NO: 2030970 - DNA, 14 bp, Homo sapiens
agtgcttagaaagt

SEQ ID NO: 2030971 - DNA, 16 bp, Homo sapiens
agtgcttagaaagtta

SEQ ID NO: 2030972 - DNA, 17 bp, Homo sapiens
agtgcttcagcctgagg

SEQ ID NO: 2030973 - DNA, 21 bp, Homo sapiens
agtgcttcatttgggaaattc

SEQ ID NO: 2030974 - DNA, 21 bp, Homo sapiens
agtgcttcttaaagagttctt

SEQ ID NO: 2030975 - DNA, 20 bp, Homo sapiens
agtgcttgccaccaccagat

SEQ ID NO: 2030976 - DNA, 23 bp, Homo sapiens
agtgcttgggtggtgggtgctgg

SEQ ID NO: 2030977 - DNA, 23 bp, Homo sapiens
agtgctttacctttattaatgaa

SEQ ID NO: 2030978 - DNA, 22 bp, Homo sapiens
agtggaaattcaggtgaaaatg

SEQ ID NO: 2030979 - DNA, 16 bp, Homo sapiens
agtggaaattttctac

SEQ ID NO: 2030980 - DNA, 16 bp, Homo sapiens
agtggaagagcagcct

SEQ ID NO: 2030981 - DNA, 20 bp, Homo sapiens
agtggaagagcagcctgatg

SEQ ID NO: 2030982 - DNA, 22 bp, Homo sapiens
agtggaagagcagcctgatggc

SEQ ID NO: 2030983 - DNA, 14 bp, Homo sapiens
agtggaccaggaca

SEQ ID NO: 2030984 - DNA, 16 bp, Homo sapiens
agtggaccaggacagg

SEQ ID NO: 2030985 - DNA, 19 bp, Homo sapiens
agtggaccaggacaggacc

SEQ ID NO: 2030986 - DNA, 20 bp, Homo sapiens
agtggaccaggacaggacca

SEQ ID NO: 2030987 - DNA, 19 bp, Homo sapiens
agtggagtctgagtctgag

SEQ ID NO: 2030988 - DNA, 23 bp, Homo sapiens
agtggatctccaaggaccaggtt

SEQ ID NO: 2030989 - DNA, 17 bp, Homo sapiens
agtggatggaggagaaa

SEQ ID NO: 2030990 - DNA, 15 bp, Homo sapiens
agtggcagccatgcc

SEQ ID NO: 2030991 - DNA, 22 bp, Homo sapiens
agtggcccctcacctgggcctt

SEQ ID NO: 2030992 - DNA, 20 bp, Homo sapiens
agtggcccctgcccccaaag

SEQ ID NO: 2030993 - DNA, 16 bp, Homo sapiens
agtggcgagaggagag

SEQ ID NO: 2030994 - DNA, 14 bp, Homo sapiens
agtggctcacgcct

SEQ ID NO: 2030995 - DNA, 13 bp, Homo sapiens
agtggctcctccc

SEQ ID NO: 2030996 - DNA, 17 bp, Homo sapiens
agtggctcctcccggtg

SEQ ID NO: 2030997 - DNA, 20 bp, Homo sapiens
agtggctcttctaacctcag

SEQ ID NO: 2030998 - DNA, 23 bp, Homo sapiens
agtggctgaaataaaagcctctg

SEQ ID NO: 2030999 - DNA, 14 bp, Homo sapiens
agtggcttcctccg

SEQ ID NO: 2031000 - DNA, 21 bp, Homo sapiens
agtgggacaaaccagagcaga

SEQ ID NO: 2031001 - DNA, 15 bp, Homo sapiens
agtgggacccataga

SEQ ID NO: 2031002 - DNA, 18 bp, Homo sapiens
agtgggacccatagatct

SEQ ID NO: 2031003 - DNA, 13 bp, Homo sapiens
agtgggagaaaac

SEQ ID NO: 2031004 - DNA, 14 bp, Homo sapiens
agtgggagctgcct

SEQ ID NO: 2031005 - DNA, 16 bp, Homo sapiens
agtgggagctgcctgt

SEQ ID NO: 2031006 - DNA, 15 bp, Homo sapiens
agtgggccaggacag

SEQ ID NO: 2031007 - DNA, 16 bp, Homo sapiens
agtgggccaggacagg

SEQ ID NO: 2031008 - DNA, 16 bp, Homo sapiens
agtgggctgcctgggg

SEQ ID NO: 2031009 - DNA, 21 bp, Homo sapiens
agtggggccagggtgggaggg

SEQ ID NO: 2031010 - DNA, 18 bp, Homo sapiens
agtggggctaaatgaagt

SEQ ID NO: 2031011 - DNA, 18 bp, Homo sapiens
agtgggggccgctggccc

SEQ ID NO: 2031012 - DNA, 15 bp, Homo sapiens
agtgggggctgtgcc

SEQ ID NO: 2031013 - DNA, 22 bp, Homo sapiens
agtgggggtgatgatgaccaag

SEQ ID NO: 2031014 - DNA, 18 bp, Homo sapiens
agtggggtaattctgctt

SEQ ID NO: 2031015 - DNA, 21 bp, Homo sapiens
agtgggttcactagagctggg

SEQ ID NO: 2031016 - DNA, 18 bp, Homo sapiens
agtggtaccagctcactc

SEQ ID NO: 2031017 - DNA, 15 bp, Homo sapiens
agtggttctggatat

SEQ ID NO: 2031018 - DNA, 13 bp, Homo sapiens
agtgtaaaataag

SEQ ID NO: 2031019 - DNA, 17 bp, Homo sapiens
agtgtaaaatagaatgt

SEQ ID NO: 2031020 - DNA, 16 bp, Homo sapiens
agtgtaaggcataggg

SEQ ID NO: 2031021 - DNA, 23 bp, Homo sapiens
agtgtaccgcgtctaccctggga

SEQ ID NO: 2031022 - DNA, 15 bp, Homo sapiens
agtgtagaacctaat

SEQ ID NO: 2031023 - DNA, 18 bp, Homo sapiens
agtgtagccttgcccgga

SEQ ID NO: 2031024 - DNA, 14 bp, Homo sapiens
agtgtatatcagaa

SEQ ID NO: 2031025 - DNA, 13 bp, Homo sapiens
agtgtcagtgttg

SEQ ID NO: 2031026 - DNA, 16 bp, Homo sapiens
agtgtcatcagaagat

SEQ ID NO: 2031027 - DNA, 23 bp, Homo sapiens
agtgtccagaccattgtcttcca

SEQ ID NO: 2031028 - DNA, 15 bp, Homo sapiens
agtgtcccctccact

SEQ ID NO: 2031029 - DNA, 17 bp, Homo sapiens
agtgtcccctccactgt

SEQ ID NO: 2031030 - DNA, 22 bp, Homo sapiens
agtgtctgtatcggagacagtg

SEQ ID NO: 2031031 - DNA, 15 bp, Homo sapiens
agtgtcttaattaaa

SEQ ID NO: 2031032 - DNA, 13 bp, Homo sapiens
agtgtcttccata

SEQ ID NO: 2031033 - DNA, 16 bp, Homo sapiens
agtgtgagcagtgagt

SEQ ID NO: 2031034 - DNA, 19 bp, Homo sapiens
agtgtgcacccctccccat

SEQ ID NO: 2031035 - DNA, 13 bp, Homo sapiens
agtgtggagaggg

SEQ ID NO: 2031036 - DNA, 21 bp, Homo sapiens
agtgtggagaggggtgcaccc

SEQ ID NO: 2031037 - DNA, 19 bp, Homo sapiens
agtgtgggtgatcagaagg

SEQ ID NO: 2031038 - DNA, 19 bp, Homo sapiens
agtgtgtcacactgagctg

SEQ ID NO: 2031039 - DNA, 17 bp, Homo sapiens
agtgtgtccttggggca

SEQ ID NO: 2031040 - DNA, 19 bp, Homo sapiens
agtgtgtccttggggcaca

SEQ ID NO: 2031041 - DNA, 20 bp, Homo sapiens
agtgtgtccttggggcacag

SEQ ID NO: 2031042 - DNA, 13 bp, Homo sapiens
agtgtgtgtgcat

SEQ ID NO: 2031043 - DNA, 17 bp, Homo sapiens
agtgtgtgtgcatgtgt

SEQ ID NO: 2031044 - DNA, 19 bp, Homo sapiens
agtgtgtgtgcatgtgtgt

SEQ ID NO: 2031045 - DNA, 13 bp, Homo sapiens
agtgtgtgtgtct

SEQ ID NO: 2031046 - DNA, 21 bp, Homo sapiens
agtgtgttgggaattgcatgc

SEQ ID NO: 2031047 - DNA, 19 bp, Homo sapiens
agtgtgtttccttcagtgc

SEQ ID NO: 2031048 - DNA, 16 bp, Homo sapiens
agtgttatcagtcata

SEQ ID NO: 2031049 - DNA, 17 bp, Homo sapiens
agtgttcaagaaataaa

SEQ ID NO: 2031050 - DNA, 18 bp, Homo sapiens
agtgttcattttagtgac

SEQ ID NO: 2031051 - DNA, 22 bp, Homo sapiens
agtgttcattttagtgactgta

SEQ ID NO: 2031052 - DNA, 19 bp, Homo sapiens
agtgttccagctgcctggg

SEQ ID NO: 2031053 - DNA, 15 bp, Homo sapiens
agtgttcccaaattg

SEQ ID NO: 2031054 - DNA, 21 bp, Homo sapiens
agtgttcctcaccaataactt

SEQ ID NO: 2031055 - DNA, 16 bp, Homo sapiens
agtgttgaaaatgttc

SEQ ID NO: 2031056 - DNA, 23 bp, Homo sapiens
agtgttgaagaagagtttgcaaa

SEQ ID NO: 2031057 - DNA, 15 bp, Homo sapiens
agtgttggctgtgtg

SEQ ID NO: 2031058 - DNA, 16 bp, Homo sapiens
agtgttggctgtgtga

SEQ ID NO: 2031059 - DNA, 19 bp, Homo sapiens
agtgtttagaagagcctga

SEQ ID NO: 2031060 - DNA, 15 bp, Homo sapiens
agtgtttatttttca

SEQ ID NO: 2031061 - DNA, 16 bp, Homo sapiens
agtgtttcccataatt

SEQ ID NO: 2031062 - DNA, 19 bp, Homo sapiens
agtgtttcgacagctgatt

SEQ ID NO: 2031063 - DNA, 20 bp, Homo sapiens
agtgttttaagataaattat

SEQ ID NO: 2031064 - DNA, 16 bp, Homo sapiens
agtgttttctcagaac

SEQ ID NO: 2031065 - DNA, 24 bp, Homo sapiens
agtgttttttcactttagctatgt

SEQ ID NO: 2031066 - DNA, 21 bp, Homo sapiens
agttaaaagactgcagctgct

SEQ ID NO: 2031067 - DNA, 12 bp, Homo sapiens
agttaacagaga

SEQ ID NO: 2031068 - DNA, 14 bp, Homo sapiens
agttaagagtagca

SEQ ID NO: 2031069 - DNA, 16 bp, Homo sapiens
agttaagcagcctttc

SEQ ID NO: 2031070 - DNA, 19 bp, Homo sapiens
agttaaggaccgtggccct

SEQ ID NO: 2031071 - DNA, 20 bp, Homo sapiens
agttaatggggtagaggagg

SEQ ID NO: 2031072 - DNA, 21 bp, Homo sapiens
agttaatggggtagaggaggg

SEQ ID NO: 2031073 - DNA, 16 bp, Homo sapiens
agttacacaattaatt

SEQ ID NO: 2031074 - DNA, 16 bp, Homo sapiens
agttacagatgcaccc

SEQ ID NO: 2031075 - DNA, 23 bp, Homo sapiens
agttacagcgagaggcagagaaa

SEQ ID NO: 2031076 - DNA, 13 bp, Homo sapiens
agttactcagccc

SEQ ID NO: 2031077 - DNA, 17 bp, Homo sapiens
agttactcagccctggg

SEQ ID NO: 2031078 - DNA, 19 bp, Homo sapiens
agttactcttcagttttag

SEQ ID NO: 2031079 - DNA, 22 bp, Homo sapiens
agttacttcactttaattctca

SEQ ID NO: 2031080 - DNA, 14 bp, Homo sapiens
agttacttcctatc

SEQ ID NO: 2031081 - DNA, 15 bp, Homo sapiens
agttacttcctatca

SEQ ID NO: 2031082 - DNA, 15 bp, Homo sapiens
agttacttgtctgag

SEQ ID NO: 2031083 - DNA, 16 bp, Homo sapiens
agttagaaatctccag

SEQ ID NO: 2031084 - DNA, 20 bp, Homo sapiens
agctctgtggcctgtgtcca

SEQ ID NO: 2031085 - DNA, 20 bp, Homo sapiens
agctctgtttataaaaacaa

SEQ ID NO: 2031086 - DNA, 14 bp, Homo sapiens
agctcttcaagctg

SEQ ID NO: 2031087 - DNA, 23 bp, Homo sapiens
agctcttcactcagccacacccc

SEQ ID NO: 2031088 - DNA, 15 bp, Homo sapiens
agctcttcccctttc

SEQ ID NO: 2031089 - DNA, 23 bp, Homo sapiens
agctcttcccctttcctggggga

SEQ ID NO: 2031090 - DNA, 19 bp, Homo sapiens
agctcttctatttaaaaaa

SEQ ID NO: 2031091 - DNA, 20 bp, Homo sapiens
agctcttctatttaaaaaat

SEQ ID NO: 2031092 - DNA, 19 bp, Homo sapiens
agctcttggcattttcctc

SEQ ID NO: 2031093 - DNA, 23 bp, Homo sapiens
agctcttggcccctgtgtgagtt

SEQ ID NO: 2031094 - DNA, 17 bp, Homo sapiens
agctctttcttctttga

SEQ ID NO: 2031095 - DNA, 15 bp, Homo sapiens
agctctttgttcagt

SEQ ID NO: 2031096 - DNA, 12 bp, Homo sapiens
agctgaagaaaa

SEQ ID NO: 2031097 - DNA, 13 bp, Homo sapiens
agctgaagacaaa

SEQ ID NO: 2031098 - DNA, 16 bp, Homo sapiens
agctgaagattttgga

SEQ ID NO: 2031099 - DNA, 16 bp, Homo sapiens
agctgaagtgaaggag

SEQ ID NO: 2031100 - DNA, 14 bp, Homo sapiens
agctgacagctgct

SEQ ID NO: 2031101 - DNA, 16 bp, Homo sapiens
agctgacccagcccct

SEQ ID NO: 2031102 - DNA, 14 bp, Homo sapiens
agctgactttgttg

SEQ ID NO: 2031103 - DNA, 13 bp, Homo sapiens
agctgagaagaag

SEQ ID NO: 2031104 - DNA, 18 bp, Homo sapiens
agctgagaccctcgccac

SEQ ID NO: 2031105 - DNA, 14 bp, Homo sapiens
agctgagagacttt

SEQ ID NO: 2031106 - DNA, 15 bp, Homo sapiens
agctgagagactttt

SEQ ID NO: 2031107 - DNA, 18 bp, Homo sapiens
agctgagagccctgctgt

SEQ ID NO: 2031108 - DNA, 12 bp, Homo sapiens
agctgagaggaa

SEQ ID NO: 2031109 - DNA, 13 bp, Homo sapiens
agctgagaggaag

SEQ ID NO: 2031110 - DNA, 19 bp, Homo sapiens
agctgagaggaagatgaag

SEQ ID NO: 2031111 - DNA, 23 bp, Homo sapiens
agctgagaggaagatgaagagaa

SEQ ID NO: 2031112 - DNA, 16 bp, Homo sapiens
agctgagagtctgaaa

SEQ ID NO: 2031113 - DNA, 14 bp, Homo sapiens
agctgagcagggcc

SEQ ID NO: 2031114 - DNA, 19 bp, Homo sapiens
agctgagctcacaaggcag

SEQ ID NO: 2031115 - DNA, 20 bp, Homo sapiens
agctgagctcacaaggcagc

SEQ ID NO: 2031116 - DNA, 21 bp, Homo sapiens
agctgagctcacaaggcagca

SEQ ID NO: 2031117 - DNA, 17 bp, Homo sapiens
agctgaggcaattctaa

SEQ ID NO: 2031118 - DNA, 22 bp, Homo sapiens
agctgaggggggccgtgcccag

SEQ ID NO: 2031119 - DNA, 16 bp, Homo sapiens
agctgaggtgcccagg

SEQ ID NO: 2031120 - DNA, 17 bp, Homo sapiens
agctgaggtgcccagga

SEQ ID NO: 2031121 - DNA, 16 bp, Homo sapiens
agctgagtcacctcct

SEQ ID NO: 2031122 - DNA, 20 bp, Homo sapiens
agctgagtcacctcctccac

SEQ ID NO: 2031123 - DNA, 15 bp, Homo sapiens
agctgagtgaaaaat

SEQ ID NO: 2031124 - DNA, 23 bp, Homo sapiens
agctgagttacttgtctgaggcc

SEQ ID NO: 2031125 - DNA, 23 bp, Homo sapiens
agctgatgatgtctcttgtagaa

SEQ ID NO: 2031126 - DNA, 22 bp, Homo sapiens
agctgatgtgagtgtgtgtgat

SEQ ID NO: 2031127 - DNA, 16 bp, Homo sapiens
agctgatttccaggcc

SEQ ID NO: 2031128 - DNA, 19 bp, Homo sapiens
agctgattttgtcactgtc

SEQ ID NO: 2031129 - DNA, 15 bp, Homo sapiens
agctgcaagtgacat

SEQ ID NO: 2031130 - DNA, 15 bp, Homo sapiens
agctgcacattcctg

SEQ ID NO: 2031131 - DNA, 20 bp, Homo sapiens
agctgcacattcctggcccc

SEQ ID NO: 2031132 - DNA, 22 bp, Homo sapiens
agctgcacattcctggccccgg

SEQ ID NO: 2031133 - DNA, 17 bp, Homo sapiens
agctgcaccatcacaca

SEQ ID NO: 2031134 - DNA, 18 bp, Homo sapiens
agctgcacctgccagcct

SEQ ID NO: 2031135 - DNA, 22 bp, Homo sapiens
agctgcacctgccagcctggct

SEQ ID NO: 2031136 - DNA, 11 bp, Homo sapiens
agctgcagaac

SEQ ID NO: 2031137 - DNA, 14 bp, Homo sapiens
agctgcagctgggc

SEQ ID NO: 2031138 - DNA, 16 bp, Homo sapiens
agctgcagctgggccc

SEQ ID NO: 2031139 - DNA, 19 bp, Homo sapiens
agctgcagctgggccccat

SEQ ID NO: 2031140 - DNA, 21 bp, Homo sapiens
agctgcagctgggccccatgc

SEQ ID NO: 2031141 - DNA, 22 bp, Homo sapiens
agctgcagctgggccccatgct

SEQ ID NO: 2031142 - DNA, 23 bp, Homo sapiens
agctgcaggaatcaaaaattgaa

SEQ ID NO: 2031143 - DNA, 15 bp, Homo sapiens
agctgcatctactca

SEQ ID NO: 2031144 - DNA, 14 bp, Homo sapiens
agctgccaagcact

SEQ ID NO: 2031145 - DNA, 13 bp, Homo sapiens
agctgccgaccag

SEQ ID NO: 2031146 - DNA, 18 bp, Homo sapiens
agctgccgcaaggccctg

SEQ ID NO: 2031147 - DNA, 22 bp, Homo sapiens
agctgccgcaaggccctgtccc

SEQ ID NO: 2031148 - DNA, 10 bp, Homo sapiens
agctgcctgt

SEQ ID NO: 2031149 - DNA, 15 bp, Homo sapiens
agctgcctgtagtta

SEQ ID NO: 2031150 - DNA, 13 bp, Homo sapiens
agctgcctgttca

SEQ ID NO: 2031151 - DNA, 20 bp, Homo sapiens
agctgcctgttcagctccag

SEQ ID NO: 2031152 - DNA, 14 bp, Homo sapiens
agctgcgggtctga

SEQ ID NO: 2031153 - DNA, 18 bp, Homo sapiens
agctgcgggtctgaagga

SEQ ID NO: 2031154 - DNA, 18 bp, Homo sapiens
agctgcggtccacccagg

SEQ ID NO: 2031155 - DNA, 14 bp, Homo sapiens
agctgctcgcacag

SEQ ID NO: 2031156 - DNA, 11 bp, Homo sapiens
agctgctctgc

SEQ ID NO: 2031157 - DNA, 12 bp, Homo sapiens
agctgctctgct

SEQ ID NO: 2031158 - DNA, 14 bp, Homo sapiens
agctgctgaaacaa

SEQ ID NO: 2031159 - DNA, 20 bp, Homo sapiens
agctgctgaagttctgagcc

SEQ ID NO: 2031160 - DNA, 13 bp, Homo sapiens
agctgctgacagt

SEQ ID NO: 2031161 - DNA, 14 bp, Homo sapiens
agctgctgacagtg

SEQ ID NO: 2031162 - DNA, 16 bp, Homo sapiens
agctgcttgactatca

SEQ ID NO: 2031163 - DNA, 22 bp, Homo sapiens
agctgcttgactatcacataca

SEQ ID NO: 2031164 - DNA, 12 bp, Homo sapiens
agctgcttgtcc

SEQ ID NO: 2031165 - DNA, 22 bp, Homo sapiens
agctgcttgttgtcaagtataa

SEQ ID NO: 2031166 - DNA, 24 bp, Homo sapiens
agctgcttttgtctatgggactca

SEQ ID NO: 2031167 - DNA, 11 bp, Homo sapiens
agctggaaata

SEQ ID NO: 2031168 - DNA, 22 bp, Homo sapiens
agctggaaataaacctggagat

SEQ ID NO: 2031169 - DNA, 12 bp, Homo sapiens
agctggaaggca

SEQ ID NO: 2031170 - DNA, 16 bp, Homo sapiens
agctggaaggcagggc

SEQ ID NO: 2031171 - DNA, 19 bp, Homo sapiens
agctggaattgctgctctc

SEQ ID NO: 2031172 - DNA, 16 bp, Homo sapiens
agctggacaagaagct

SEQ ID NO: 2031173 - DNA, 15 bp, Homo sapiens
agctggagaagaccc

SEQ ID NO: 2031174 - DNA, 17 bp, Homo sapiens
agctggagctcttggaa

SEQ ID NO: 2031175 - DNA, 23 bp, Homo sapiens
agctggagctcttggaagagctc

SEQ ID NO: 2031176 - DNA, 11 bp, Homo sapiens
agctggcagga

SEQ ID NO: 2031177 - DNA, 17 bp, Homo sapiens
agctggcaggacacatc

SEQ ID NO: 2031178 - DNA, 18 bp, Homo sapiens
agctggcattggtctgct

SEQ ID NO: 2031179 - DNA, 20 bp, Homo sapiens
agctggcattggtctgctga

SEQ ID NO: 2031180 - DNA, 20 bp, Homo sapiens
agctggcgactgcagctgca

SEQ ID NO: 2031181 - DNA, 16 bp, Homo sapiens
agctggctgctgacag

SEQ ID NO: 2031182 - DNA, 19 bp, Homo sapiens
agctggctgctgacaggat

SEQ ID NO: 2031183 - DNA, 14 bp, Homo sapiens
agctgggaaacagg

SEQ ID NO: 2031184 - DNA, 20 bp, Homo sapiens
agctgggaaattcatgtgga

SEQ ID NO: 2031185 - DNA, 18 bp, Homo sapiens
agctgggaagctgtactc

SEQ ID NO: 2031186 - DNA, 19 bp, Homo sapiens
agctgggactacaggcacc

SEQ ID NO: 2031187 - DNA, 20 bp, Homo sapiens
agctgggactacaggcaccc

SEQ ID NO: 2031188 - DNA, 13 bp, Homo sapiens
agctgggaggaaa

SEQ ID NO: 2031189 - DNA, 14 bp, Homo sapiens
agctgggaggaaaa

SEQ ID NO: 2031190 - DNA, 18 bp, Homo sapiens
agctgggaggaaaagaaa

SEQ ID NO: 2031191 - DNA, 21 bp, Homo sapiens
agctgggaggcatggccctgg

SEQ ID NO: 2031192 - DNA, 21 bp, Homo sapiens
agctgggcaaacccttctctt

SEQ ID NO: 2031193 - DNA, 16 bp, Homo sapiens
agctgggccccaccta

SEQ ID NO: 2031194 - DNA, 17 bp, Homo sapiens
agctgggccccacctac

SEQ ID NO: 2031195 - DNA, 19 bp, Homo sapiens
agctggggcctggagaggg

SEQ ID NO: 2031196 - DNA, 23 bp, Homo sapiens
agctgggtacggtggcacgtgcc

SEQ ID NO: 2031197 - DNA, 18 bp, Homo sapiens
agctggtcccactcagtc

SEQ ID NO: 2031198 - DNA, 21 bp, Homo sapiens
agctggtcccactcagtccat

SEQ ID NO: 2031199 - DNA, 15 bp, Homo sapiens
agctggtgggaagcg

SEQ ID NO: 2031200 - DNA, 21 bp, Homo sapiens
agctggtggtatctgagttga

SEQ ID NO: 2031201 - DNA, 20 bp, Homo sapiens
aggctgtatcccatgagcct

SEQ ID NO: 2031202 - DNA, 22 bp, Homo sapiens
aggctgtatcccatgagcctca

SEQ ID NO: 2031203 - DNA, 22 bp, Homo sapiens
aggctgtggtggctgtctctgt

SEQ ID NO: 2031204 - DNA, 16 bp, Homo sapiens
aggctgttctgcactg

SEQ ID NO: 2031205 - DNA, 22 bp, Homo sapiens
aggcttaaggagaggagaaact

SEQ ID NO: 2031206 - DNA, 15 bp, Homo sapiens
aggcttaggtgccag

SEQ ID NO: 2031207 - DNA, 16 bp, Homo sapiens
aggcttaggtgccagg

SEQ ID NO: 2031208 - DNA, 18 bp, Homo sapiens
aggcttaggtgccaggct

SEQ ID NO: 2031209 - DNA, 15 bp, Homo sapiens
aggcttatcaaaatc

SEQ ID NO: 2031210 - DNA, 16 bp, Homo sapiens
aggcttccaggctctt

SEQ ID NO: 2031211 - DNA, 18 bp, Homo sapiens
aggcttcctgactgacac

SEQ ID NO: 2031212 - DNA, 19 bp, Homo sapiens
aggcttcctgactgacaca

SEQ ID NO: 2031213 - DNA, 20 bp, Homo sapiens
aggcttcctgactgacacag

SEQ ID NO: 2031214 - DNA, 21 bp, Homo sapiens
aggcttcctgactgacacagg

SEQ ID NO: 2031215 - DNA, 21 bp, Homo sapiens
aggcttccttcatttcctccg

SEQ ID NO: 2031216 - DNA, 16 bp, Homo sapiens
aggcttggaatgaatt

SEQ ID NO: 2031217 - DNA, 17 bp, Homo sapiens
aggcttggaatgaattc

SEQ ID NO: 2031218 - DNA, 21 bp, Homo sapiens
aggctttgccatgggcctgct

SEQ ID NO: 2031219 - DNA, 20 bp, Homo sapiens
aggctttggggtcctagccc

SEQ ID NO: 2031220 - DNA, 23 bp, Homo sapiens
aggctttggggtcctagcccagt

SEQ ID NO: 2031221 - DNA, 20 bp, Homo sapiens
agggaaaacataatatcttg

SEQ ID NO: 2031222 - DNA, 16 bp, Homo sapiens
agggaaactgccagca

SEQ ID NO: 2031223 - DNA, 21 bp, Homo sapiens
agggaaactgccagcaacgca

SEQ ID NO: 2031224 - DNA, 19 bp, Homo sapiens
agggaacagacaggagaaa

SEQ ID NO: 2031225 - DNA, 21 bp, Homo sapiens
agggaacagacaggagaaatg

SEQ ID NO: 2031226 - DNA, 12 bp, Homo sapiens
agggaagagggc

SEQ ID NO: 2031227 - DNA, 16 bp, Homo sapiens
agggaagcaggcagag

SEQ ID NO: 2031228 - DNA, 17 bp, Homo sapiens
agggaagcaggcagagc

SEQ ID NO: 2031229 - DNA, 13 bp, Homo sapiens
agggaagcaggga

SEQ ID NO: 2031230 - DNA, 23 bp, Homo sapiens
agggaaggaactctggcttccag

SEQ ID NO: 2031231 - DNA, 12 bp, Homo sapiens
agggaaggcagg

SEQ ID NO: 2031232 - DNA, 18 bp, Homo sapiens
agggaaggcaggcagggc

SEQ ID NO: 2031233 - DNA, 20 bp, Homo sapiens
agggaaggcaggcagggctc

SEQ ID NO: 2031234 - DNA, 15 bp, Homo sapiens
agggaagtcttactt

SEQ ID NO: 2031235 - DNA, 22 bp, Homo sapiens
agggaatatgtaagtcaggagt

SEQ ID NO: 2031236 - DNA, 22 bp, Homo sapiens
agggaatgttccctgcaccctg

SEQ ID NO: 2031237 - DNA, 19 bp, Homo sapiens
agggaattgattcaagatt

SEQ ID NO: 2031238 - DNA, 14 bp, Homo sapiens
agggacaaaggagc

SEQ ID NO: 2031239 - DNA, 13 bp, Homo sapiens
agggacacacaca

SEQ ID NO: 2031240 - DNA, 14 bp, Homo sapiens
agggacacacacac

SEQ ID NO: 2031241 - DNA, 20 bp, Homo sapiens
agggacagagacacctgcac

SEQ ID NO: 2031242 - DNA, 17 bp, Homo sapiens
agggacagagatggagg

SEQ ID NO: 2031243 - DNA, 17 bp, Homo sapiens
agggacaggataagagg

SEQ ID NO: 2031244 - DNA, 15 bp, Homo sapiens
agggacagggcttgg

SEQ ID NO: 2031245 - DNA, 20 bp, Homo sapiens
agggacagggcttggggagc

SEQ ID NO: 2031246 - DNA, 18 bp, Homo sapiens
agggacccgaagcccagg

SEQ ID NO: 2031247 - DNA, 22 bp, Homo sapiens
agggacccgaagcccaggctga

SEQ ID NO: 2031248 - DNA, 15 bp, Homo sapiens
agggaccttgaaggg

SEQ ID NO: 2031249 - DNA, 20 bp, Homo sapiens
agggactcaagggtccagaa

SEQ ID NO: 2031250 - DNA, 21 bp, Homo sapiens
agggactcaagggtccagaag

SEQ ID NO: 2031251 - DNA, 23 bp, Homo sapiens
agggactgccagtccccctgccc

SEQ ID NO: 2031252 - DNA, 16 bp, Homo sapiens
agggactgtcgctgct

SEQ ID NO: 2031253 - DNA, 22 bp, Homo sapiens
agggactgtcgctgcttcgtgg

SEQ ID NO: 2031254 - DNA, 19 bp, Homo sapiens
agggacttggaagctccgc

SEQ ID NO: 2031255 - DNA, 20 bp, Homo sapiens
agggacttggaagctccgct

SEQ ID NO: 2031256 - DNA, 16 bp, Homo sapiens
agggagaaggatctag

SEQ ID NO: 2031257 - DNA, 22 bp, Homo sapiens
agggagaaggatctagaatgtg

SEQ ID NO: 2031258 - DNA, 18 bp, Homo sapiens
agggagaagggatggagg

SEQ ID NO: 2031259 - DNA, 12 bp, Homo sapiens
agggagacagag

SEQ ID NO: 2031260 - DNA, 13 bp, Homo sapiens
agggagagactct

SEQ ID NO: 2031261 - DNA, 14 bp, Homo sapiens
agggagagcacctt

SEQ ID NO: 2031262 - DNA, 17 bp, Homo sapiens
agggagaggagtgactg

SEQ ID NO: 2031263 - DNA, 18 bp, Homo sapiens
agggaggatgccacagcc

SEQ ID NO: 2031264 - DNA, 16 bp, Homo sapiens
agggaggccgaagcta

SEQ ID NO: 2031265 - DNA, 23 bp, Homo sapiens
agggaggccgaagctaacaggga

SEQ ID NO: 2031266 - DNA, 14 bp, Homo sapiens
agggagggctctga

SEQ ID NO: 2031267 - DNA, 15 bp, Homo sapiens
agggagggctctgag

SEQ ID NO: 2031268 - DNA, 16 bp, Homo sapiens
agggagggctctgagg

SEQ ID NO: 2031269 - DNA, 17 bp, Homo sapiens
agggagggctctgaggc

SEQ ID NO: 2031270 - DNA, 12 bp, Homo sapiens
agggaggggact

SEQ ID NO: 2031271 - DNA, 21 bp, Homo sapiens
agggagggggcgctcaggacc

SEQ ID NO: 2031272 - DNA, 14 bp, Homo sapiens
agggaggggtcctg

SEQ ID NO: 2031273 - DNA, 20 bp, Homo sapiens
agggaggggtcctgatttca

SEQ ID NO: 2031274 - DNA, 20 bp, Homo sapiens
agggagtccgaaagggactt

SEQ ID NO: 2031275 - DNA, 23 bp, Homo sapiens
agggagtccgaaagggacttgga

SEQ ID NO: 2031276 - DNA, 18 bp, Homo sapiens
agggagtgacagaggcag

SEQ ID NO: 2031277 - DNA, 18 bp, Homo sapiens
agggagttgctcactcag

SEQ ID NO: 2031278 - DNA, 20 bp, Homo sapiens
agggagttgctcactcagga

SEQ ID NO: 2031279 - DNA, 13 bp, Homo sapiens
agggatcacaggg

SEQ ID NO: 2031280 - DNA, 14 bp, Homo sapiens
agggatcacagggc

SEQ ID NO: 2031281 - DNA, 22 bp, Homo sapiens
agggatcttgcattcccagtgg

SEQ ID NO: 2031282 - DNA, 18 bp, Homo sapiens
agggatgagagtggctta

SEQ ID NO: 2031283 - DNA, 22 bp, Homo sapiens
agggatgagagtggcttaaaaa

SEQ ID NO: 2031284 - DNA, 17 bp, Homo sapiens
agggatgctgcctgagt

SEQ ID NO: 2031285 - DNA, 20 bp, Homo sapiens
agggatgggggatgggccag

SEQ ID NO: 2031286 - DNA, 22 bp, Homo sapiens
agggatgtgaattgcctgcaga

SEQ ID NO: 2031287 - DNA, 22 bp, Homo sapiens
agggattctggtcttcactgcc

SEQ ID NO: 2031288 - DNA, 16 bp, Homo sapiens
agggcaaacccaaaac

SEQ ID NO: 2031289 - DNA, 14 bp, Homo sapiens
agggcaaattattt

SEQ ID NO: 2031290 - DNA, 13 bp, Homo sapiens
agggcaagggcca

SEQ ID NO: 2031291 - DNA, 22 bp, Homo sapiens
agggcaagggccatgctgaagg

SEQ ID NO: 2031292 - DNA, 15 bp, Homo sapiens
agggcaatcttgtcc

SEQ ID NO: 2031293 - DNA, 20 bp, Homo sapiens
agggcaatcttgtccacagt

SEQ ID NO: 2031294 - DNA, 16 bp, Homo sapiens
agggcactggtggccc

SEQ ID NO: 2031295 - DNA, 17 bp, Homo sapiens
agggcactggtggcccg

SEQ ID NO: 2031296 - DNA, 17 bp, Homo sapiens
agggcagaaggggaaga

SEQ ID NO: 2031297 - DNA, 20 bp, Homo sapiens
agggcagaaggggaagatac

SEQ ID NO: 2031298 - DNA, 19 bp, Homo sapiens
agggcagagccatgggcct

SEQ ID NO: 2031299 - DNA, 20 bp, Homo sapiens
agggcagagccatgggcctg

SEQ ID NO: 2031300 - DNA, 15 bp, Homo sapiens
agggcagagccggga

SEQ ID NO: 2031301 - DNA, 14 bp, Homo sapiens
agggcagaggctgg

SEQ ID NO: 2031302 - DNA, 23 bp, Homo sapiens
agggcagagggaatgttccctgc

SEQ ID NO: 2031303 - DNA, 21 bp, Homo sapiens
agggcagagtgggctgcctgg

SEQ ID NO: 2031304 - DNA, 13 bp, Homo sapiens
agggcagcagcca

SEQ ID NO: 2031305 - DNA, 12 bp, Homo sapiens
agggcagccagg

SEQ ID NO: 2031306 - DNA, 18 bp, Homo sapiens
agggcagccaggggctgc

SEQ ID NO: 2031307 - DNA, 16 bp, Homo sapiens
agggcagcccccactt

SEQ ID NO: 2031308 - DNA, 19 bp, Homo sapiens
agggcagttcgcagccacc

SEQ ID NO: 2031309 - DNA, 15 bp, Homo sapiens
agggcatcaggcact

SEQ ID NO: 2031310 - DNA, 22 bp, Homo sapiens
agggcatcaggcactggtggca

SEQ ID NO: 2031311 - DNA, 17 bp, Homo sapiens
agggcatcttagcttct

SEQ ID NO: 2031312 - DNA, 18 bp, Homo sapiens
agggcatgcattttgcag

SEQ ID NO: 2031313 - DNA, 16 bp, Homo sapiens
agggcatgggagggag

SEQ ID NO: 2031314 - DNA, 16 bp, Homo sapiens
agggccaagacttggc

SEQ ID NO: 2031315 - DNA, 15 bp, Homo sapiens
agggccaagagagac

SEQ ID NO: 2031316 - DNA, 16 bp, Homo sapiens
agggccaagagagaca

SEQ ID NO: 2031317 - DNA, 16 bp, Homo sapiens
gttatttttatatcag

SEQ ID NO: 2031318 - DNA, 23 bp, Homo sapiens
gttatttttatatcagcctgagt

SEQ ID NO: 2031319 - DNA, 19 bp, Homo sapiens
gttatttttgtccctgctc

SEQ ID NO: 2031320 - DNA, 21 bp, Homo sapiens
gttatttttgtccctgctcct

SEQ ID NO: 2031321 - DNA, 22 bp, Homo sapiens
gttatttttgtttcttccaaag

SEQ ID NO: 2031322 - DNA, 22 bp, Homo sapiens
gttcaaatgcattttgggggtt

SEQ ID NO: 2031323 - DNA, 20 bp, Homo sapiens
gttcaacctggtggcaccag

SEQ ID NO: 2031324 - DNA, 15 bp, Homo sapiens
gttcaacttccagaa

SEQ ID NO: 2031325 - DNA, 17 bp, Homo sapiens
cccacccatcttcctgc

SEQ ID NO: 2031326 - DNA, 21 bp, Homo sapiens
cccacccatcttcctgctgct

SEQ ID NO: 2031327 - DNA, 13 bp, Homo sapiens
cccaccccactcc

SEQ ID NO: 2031328 - DNA, 16 bp, Homo sapiens
cccaccccactccagc

SEQ ID NO: 2031329 - DNA, 13 bp, Homo sapiens
cccaccccagagt

SEQ ID NO: 2031330 - DNA, 14 bp, Homo sapiens
cccaccccagagtt

SEQ ID NO: 2031331 - DNA, 16 bp, Homo sapiens
cccacccccagccccg

SEQ ID NO: 2031332 - DNA, 19 bp, Homo sapiens
cccaccccctccccagggg

SEQ ID NO: 2031333 - DNA, 21 bp, Homo sapiens
cccacccctaacctggcttat

SEQ ID NO: 2031334 - DNA, 19 bp, Homo sapiens
cccaccctcaaaccctgtg

SEQ ID NO: 2031335 - DNA, 23 bp, Homo sapiens
cccaccctcgtggacacctgccc

SEQ ID NO: 2031336 - DNA, 23 bp, Homo sapiens
cccaccgggagcctccccctcag

SEQ ID NO: 2031337 - DNA, 18 bp, Homo sapiens
cccaccgggccactcctt

SEQ ID NO: 2031338 - DNA, 22 bp, Homo sapiens
cccaccgggccactccttcctg

SEQ ID NO: 2031339 - DNA, 21 bp, Homo sapiens
cccaccgtcttgggtcgccct

SEQ ID NO: 2031340 - DNA, 12 bp, Homo sapiens
cccacctcagcc

SEQ ID NO: 2031341 - DNA, 16 bp, Homo sapiens
cccacctcatgcctgg

SEQ ID NO: 2031342 - DNA, 17 bp, Homo sapiens
cccacctccgccccaga

SEQ ID NO: 2031343 - DNA, 13 bp, Homo sapiens
cccacctcttcct

SEQ ID NO: 2031344 - DNA, 22 bp, Homo sapiens
cccacctcttccttccgctcct

SEQ ID NO: 2031345 - DNA, 22 bp, Homo sapiens
cccaccttcaattcctgggccc

SEQ ID NO: 2031346 - DNA, 17 bp, Homo sapiens
cccaccttccccagact

SEQ ID NO: 2031347 - DNA, 18 bp, Homo sapiens
cccaccttccccagactc

SEQ ID NO: 2031348 - DNA, 16 bp, Homo sapiens
cccaccttggctgcag

SEQ ID NO: 2031349 - DNA, 19 bp, Homo sapiens
cccaccttggctgcaggga

SEQ ID NO: 2031350 - DNA, 17 bp, Homo sapiens
cccacctttaagtcctc

SEQ ID NO: 2031351 - DNA, 19 bp, Homo sapiens
cccacctttgggatcagcc

SEQ ID NO: 2031352 - DNA, 22 bp, Homo sapiens
cccacctttgggatcagcctcc

SEQ ID NO: 2031353 - DNA, 23 bp, Homo sapiens
cccacgagggagttgggacagga

SEQ ID NO: 2031354 - DNA, 16 bp, Homo sapiens
cccacgagggtcagga

SEQ ID NO: 2031355 - DNA, 14 bp, Homo sapiens
cccacgagtcacct

SEQ ID NO: 2031356 - DNA, 21 bp, Homo sapiens
cccacgctggagtgcagtgag

SEQ ID NO: 2031357 - DNA, 22 bp, Homo sapiens
cccacggatgttgtcaggaatc

SEQ ID NO: 2031358 - DNA, 21 bp, Homo sapiens
cccacgtgagagaatctgcct

SEQ ID NO: 2031359 - DNA, 12 bp, Homo sapiens
cccacgtgggag

SEQ ID NO: 2031360 - DNA, 17 bp, Homo sapiens
cccacgtgtgcagactg

SEQ ID NO: 2031361 - DNA, 23 bp, Homo sapiens
cccactaaaacaaaacaaaaaac

SEQ ID NO: 2031362 - DNA, 23 bp, Homo sapiens
cccactaagtagaataaagaaaa

SEQ ID NO: 2031363 - DNA, 15 bp, Homo sapiens
cccactcacacttgg

SEQ ID NO: 2031364 - DNA, 16 bp, Homo sapiens
cccactcaccagggtc

SEQ ID NO: 2031365 - DNA, 17 bp, Homo sapiens
cccactcaccagggtcc

SEQ ID NO: 2031366 - DNA, 20 bp, Homo sapiens
cctgagctcaggctgagccc

SEQ ID NO: 2031367 - DNA, 16 bp, Homo sapiens
cctgagctcggtggac

SEQ ID NO: 2031368 - DNA, 20 bp, Homo sapiens
cctgagctcggtggacccag

SEQ ID NO: 2031369 - DNA, 22 bp, Homo sapiens
cctgagctcggtggacccaggg

SEQ ID NO: 2031370 - DNA, 12 bp, Homo sapiens
cctgagctgggg

SEQ ID NO: 2031371 - DNA, 14 bp, Homo sapiens
cctgagctggggcc

SEQ ID NO: 2031372 - DNA, 16 bp, Homo sapiens
cctgagctggggccac

SEQ ID NO: 2031373 - DNA, 17 bp, Homo sapiens
cctgagctggggcctgg

SEQ ID NO: 2031374 - DNA, 18 bp, Homo sapiens
cctgagctggggcctgga

SEQ ID NO: 2031375 - DNA, 22 bp, Homo sapiens
cctgagctggggcctggagagg

SEQ ID NO: 2031376 - DNA, 16 bp, Homo sapiens
cctgaggactggagac

SEQ ID NO: 2031377 - DNA, 17 bp, Homo sapiens
cctgaggactggagacc

SEQ ID NO: 2031378 - DNA, 14 bp, Homo sapiens
cctgaggagtctga

SEQ ID NO: 2031379 - DNA, 20 bp, Homo sapiens
cctgaggagtctgaggtcct

SEQ ID NO: 2031380 - DNA, 23 bp, Homo sapiens
cctgaggctcaagaggcccaggg

SEQ ID NO: 2031381 - DNA, 14 bp, Homo sapiens
cctgaggctgagac

SEQ ID NO: 2031382 - DNA, 15 bp, Homo sapiens
cctgaggtcacctgg

SEQ ID NO: 2031383 - DNA, 22 bp, Homo sapiens
cctgagtaccttctacaggccc

SEQ ID NO: 2031384 - DNA, 21 bp, Homo sapiens
cctgagtagctgggattacag

SEQ ID NO: 2031385 - DNA, 17 bp, Homo sapiens
cctgagtcaactggagc

SEQ ID NO: 2031386 - DNA, 23 bp, Homo sapiens
cctgagtcaccctacctgtgcct

SEQ ID NO: 2031387 - DNA, 14 bp, Homo sapiens
cctgagtcactggt

SEQ ID NO: 2031388 - DNA, 14 bp, Homo sapiens
cctgagtcggcccc

SEQ ID NO: 2031389 - DNA, 14 bp, Homo sapiens
cctgagtcttggcc

SEQ ID NO: 2031390 - DNA, 22 bp, Homo sapiens
cctgagtcttggcctgcctccc

SEQ ID NO: 2031391 - DNA, 14 bp, Homo sapiens
cctgagtggatctc

SEQ ID NO: 2031392 - DNA, 19 bp, Homo sapiens
cctgagtggatctccaagg

SEQ ID NO: 2031393 - DNA, 20 bp, Homo sapiens
cctgagtggatctccaagga

SEQ ID NO: 2031394 - DNA, 22 bp, Homo sapiens
cctgataaacattaaacactgt

SEQ ID NO: 2031395 - DNA, 23 bp, Homo sapiens
cctgataaacattaaacactgta

SEQ ID NO: 2031396 - DNA, 19 bp, Homo sapiens
cctgataaagaacatctgt

SEQ ID NO: 2031397 - DNA, 18 bp, Homo sapiens
cctgataacaacctggag

SEQ ID NO: 2031398 - DNA, 16 bp, Homo sapiens
cctgataccctgcttg

SEQ ID NO: 2031399 - DNA, 16 bp, Homo sapiens
cctgatcatggtcagc

SEQ ID NO: 2031400 - DNA, 21 bp, Homo sapiens
cctgatcatggtcagctcaca

SEQ ID NO: 2031401 - DNA, 23 bp, Homo sapiens
cctgatcatggtcagctcacacc

SEQ ID NO: 2031402 - DNA, 22 bp, Homo sapiens
cctgatgaaaaatatgtgcttg

SEQ ID NO: 2031403 - DNA, 13 bp, Homo sapiens
cctgatgacagag

SEQ ID NO: 2031404 - DNA, 16 bp, Homo sapiens
cctgatgacagagcga

SEQ ID NO: 2031405 - DNA, 21 bp, Homo sapiens
cctgatggcacttagctatca

SEQ ID NO: 2031406 - DNA, 13 bp, Homo sapiens
cctgatggccaag

SEQ ID NO: 2031407 - DNA, 21 bp, Homo sapiens
cctgatggccaagggggtgga

SEQ ID NO: 2031408 - DNA, 17 bp, Homo sapiens
cctgatggccaggccag

SEQ ID NO: 2031409 - DNA, 18 bp, Homo sapiens
cctgatggtacaggaaag

SEQ ID NO: 2031410 - DNA, 13 bp, Homo sapiens
cctgattccccac

SEQ ID NO: 2031411 - DNA, 16 bp, Homo sapiens
cctgatttcagggaaa

SEQ ID NO: 2031412 - DNA, 17 bp, Homo sapiens
cctgcaaactcactgct

SEQ ID NO: 2031413 - DNA, 13 bp, Homo sapiens
cctgcaagcccca

SEQ ID NO: 2031414 - DNA, 16 bp, Homo sapiens
cctgcaagccccaggg

SEQ ID NO: 2031415 - DNA, 17 bp, Homo sapiens
cctgcaagccccagggc

SEQ ID NO: 2031416 - DNA, 19 bp, Homo sapiens
cctgcaagccccagggcct

SEQ ID NO: 2031417 - DNA, 23 bp, Homo sapiens
cccctccaatcccaccaaccctc

SEQ ID NO: 2031418 - DNA, 12 bp, Homo sapiens
cccctccactgt

SEQ ID NO: 2031419 - DNA, 15 bp, Homo sapiens
cccctccagaccctg

SEQ ID NO: 2031420 - DNA, 20 bp, Homo sapiens
cccctccaggcatgctggcc

SEQ ID NO: 2031421 - DNA, 12 bp, Homo sapiens
cccctccatgtg

SEQ ID NO: 2031422 - DNA, 14 bp, Homo sapiens
cccctcccagggcc

SEQ ID NO: 2031423 - DNA, 13 bp, Homo sapiens
cccctcccctgaa

SEQ ID NO: 2031424 - DNA, 19 bp, Homo sapiens
cccctccctcctctggccc

SEQ ID NO: 2031425 - DNA, 17 bp, Homo sapiens
cccctccctctgcccca

SEQ ID NO: 2031426 - DNA, 11 bp, Homo sapiens
cccctcctctg

SEQ ID NO: 2031427 - DNA, 13 bp, Homo sapiens
cccctcctctgcc

SEQ ID NO: 2031428 - DNA, 20 bp, Homo sapiens
cccctcgctgtcctgctgtg

SEQ ID NO: 2031429 - DNA, 21 bp, Homo sapiens
cccctcgtcctgtcccagagg

SEQ ID NO: 2031430 - DNA, 19 bp, Homo sapiens
cccctcgtgtgactctctt

SEQ ID NO: 2031431 - DNA, 13 bp, Homo sapiens
cccctctgccctg

SEQ ID NO: 2031432 - DNA, 21 bp, Homo sapiens
cccctgaaagtgacagagacc

SEQ ID NO: 2031433 - DNA, 14 bp, Homo sapiens
cccctgacctcacc

SEQ ID NO: 2031434 - DNA, 13 bp, Homo sapiens
cccctgaggactg

SEQ ID NO: 2031435 - DNA, 14 bp, Homo sapiens
cccctgaggactgg

SEQ ID NO: 2031436 - DNA, 21 bp, Homo sapiens
cccctgcagttggcagaaagg

SEQ ID NO: 2031437 - DNA, 11 bp, Homo sapiens
cccctgccagg

SEQ ID NO: 2031438 - DNA, 15 bp, Homo sapiens
cccctgccagggctc

SEQ ID NO: 2031439 - DNA, 14 bp, Homo sapiens
cccctgccagtgcc

SEQ ID NO: 2031440 - DNA, 12 bp, Homo sapiens
cccctgcctggg

SEQ ID NO: 2031441 - DNA, 13 bp, Homo sapiens
cccctgcttctca

SEQ ID NO: 2031442 - DNA, 18 bp, Homo sapiens
cccctgcttctcagcccc

SEQ ID NO: 2031443 - DNA, 15 bp, Homo sapiens
cccctggagagaagt

SEQ ID NO: 2031444 - DNA, 22 bp, Homo sapiens
cccctggatgggcattgggctg

SEQ ID NO: 2031445 - DNA, 13 bp, Homo sapiens
cccctggccctgc

SEQ ID NO: 2031446 - DNA, 18 bp, Homo sapiens
cccctggcttttcactgc

SEQ ID NO: 2031447 - DNA, 23 bp, Homo sapiens
cccctgggcatcttctggcttga

SEQ ID NO: 2031448 - DNA, 13 bp, Homo sapiens
cccctgggctctg

SEQ ID NO: 2031449 - DNA, 21 bp, Homo sapiens
cccctgggctctgccccagct

SEQ ID NO: 2031450 - DNA, 17 bp, Homo sapiens
cccctggtctgccctgg

SEQ ID NO: 2031451 - DNA, 15 bp, Homo sapiens
cccctggtggacagt

SEQ ID NO: 2031452 - DNA, 20 bp, Homo sapiens
cccctggtggacagtcctgg

SEQ ID NO: 2031453 - DNA, 23 bp, Homo sapiens
cccctggtggacagtcctgggag

SEQ ID NO: 2031454 - DNA, 21 bp, Homo sapiens
cccctgtcccaccaactctgc

SEQ ID NO: 2031455 - DNA, 20 bp, Homo sapiens
cccctgtcttctctcaaagg

SEQ ID NO: 2031456 - DNA, 16 bp, Homo sapiens
cccctgtgccagctca

SEQ ID NO: 2031457 - DNA, 17 bp, Homo sapiens
cccctgtggcagaccgg

SEQ ID NO: 2031458 - DNA, 21 bp, Homo sapiens
ccccttactatgatctcagga

SEQ ID NO: 2031459 - DNA, 16 bp, Homo sapiens
ccccttcatcctctga

SEQ ID NO: 2031460 - DNA, 16 bp, Homo sapiens
ccccttccccatctcc

SEQ ID NO: 2031461 - DNA, 16 bp, Homo sapiens
ccccttccccttctgt

SEQ ID NO: 2031462 - DNA, 22 bp, Homo sapiens
ccccttcctgtcccacctcttc

SEQ ID NO: 2031463 - DNA, 22 bp, Homo sapiens
ccccttgctctcccctgccctg

SEQ ID NO: 2031464 - DNA, 17 bp, Homo sapiens
ccccttggcgggcagcc

SEQ ID NO: 2031465 - DNA, 16 bp, Homo sapiens
ccccttgggcatccac

SEQ ID NO: 2031466 - DNA, 23 bp, Homo sapiens
ccccttgggcatccacccagtgc

SEQ ID NO: 2031467 - DNA, 15 bp, Homo sapiens
cccctttcctggggg

SEQ ID NO: 2031468 - DNA, 23 bp, Homo sapiens
ccccttttgcctggctgtggagg

SEQ ID NO: 2031469 - DNA, 17 bp, Homo sapiens
cccgaagcccaggctga

SEQ ID NO: 2031470 - DNA, 23 bp, Homo sapiens
cccgaaggttatggtcaatccca

SEQ ID NO: 2031471 - DNA, 17 bp, Homo sapiens
cccgaatagctgggact

SEQ ID NO: 2031472 - DNA, 18 bp, Homo sapiens
cccgaatagctgggacta

SEQ ID NO: 2031473 - DNA, 22 bp, Homo sapiens
cccgaatagctgggactacagg

SEQ ID NO: 2031474 - DNA, 13 bp, Homo sapiens
cccgacagcccag

SEQ ID NO: 2031475 - DNA, 14 bp, Homo sapiens
cccgacagcccagc

SEQ ID NO: 2031476 - DNA, 14 bp, Homo sapiens
cccgaccccatctc

SEQ ID NO: 2031477 - DNA, 14 bp, Homo sapiens
cccgaccccgagtc

SEQ ID NO: 2031478 - DNA, 15 bp, Homo sapiens
cccgactagcaggca

SEQ ID NO: 2031479 - DNA, 14 bp, Homo sapiens
cccgactcctcaaa

SEQ ID NO: 2031480 - DNA, 20 bp, Homo sapiens
cccgagaaaacaaacccagg

SEQ ID NO: 2031481 - DNA, 12 bp, Homo sapiens
cccgagcagctg

SEQ ID NO: 2031482 - DNA, 16 bp, Homo sapiens
cccgagcagctgagca

SEQ ID NO: 2031483 - DNA, 19 bp, Homo sapiens
cccgagcagctgagcaggg

SEQ ID NO: 2031484 - DNA, 21 bp, Homo sapiens
cccgagcccagctacattcct

SEQ ID NO: 2031485 - DNA, 17 bp, Homo sapiens
cccgaggaccgggctgg

SEQ ID NO: 2031486 - DNA, 16 bp, Homo sapiens
cccgagtagctgggac

SEQ ID NO: 2031487 - DNA, 17 bp, Homo sapiens
cccgagtagctgggact

SEQ ID NO: 2031488 - DNA, 18 bp, Homo sapiens
cccgcagtccccagccct

SEQ ID NO: 2031489 - DNA, 19 bp, Homo sapiens
cccgcagtccccagccctt

SEQ ID NO: 2031490 - DNA, 16 bp, Homo sapiens
cccgccacggccaccc

SEQ ID NO: 2031491 - DNA, 17 bp, Homo sapiens
cccgccacggccaccct

SEQ ID NO: 2031492 - DNA, 18 bp, Homo sapiens
cccgccacggccaccctc

SEQ ID NO: 2031493 - DNA, 15 bp, Homo sapiens
cccgccagcctcagt

SEQ ID NO: 2031494 - DNA, 16 bp, Homo sapiens
cccgccagcctcagtg

SEQ ID NO: 2031495 - DNA, 13 bp, Homo sapiens
cccgcccagctgc

SEQ ID NO: 2031496 - DNA, 14 bp, Homo sapiens
cccgccctgcccct

SEQ ID NO: 2031497 - DNA, 16 bp, Homo sapiens
cccgccttcctcctcc

SEQ ID NO: 2031498 - DNA, 17 bp, Homo sapiens
cccgccttcctcctcca

SEQ ID NO: 2031499 - DNA, 14 bp, Homo sapiens
cccgcgggcctgga

SEQ ID NO: 2031500 - DNA, 20 bp, Homo sapiens
cccgcggtgctctggcggct

SEQ ID NO: 2031501 - DNA, 23 bp, Homo sapiens
cccgctcagccctccctgcccct

SEQ ID NO: 2031502 - DNA, 12 bp, Homo sapiens
cccgctccagat

SEQ ID NO: 2031503 - DNA, 14 bp, Homo sapiens
cccgctggcagcca

SEQ ID NO: 2031504 - DNA, 16 bp, Homo sapiens
cccgctggcagccacc

SEQ ID NO: 2031505 - DNA, 18 bp, Homo sapiens
cccgctggctcctccagg

SEQ ID NO: 2031506 - DNA, 22 bp, Homo sapiens
cccgcttattctcctccctgtt

SEQ ID NO: 2031507 - DNA, 16 bp, Homo sapiens
cccgctttgcctgctt

SEQ ID NO: 2031508 - DNA, 20 bp, Homo sapiens
cccgctttgcctgcttgaag

SEQ ID NO: 2031509 - DNA, 13 bp, Homo sapiens
cccggagaaggcc

SEQ ID NO: 2031510 - DNA, 19 bp, Homo sapiens
cccggagaaggccgctgcc

SEQ ID NO: 2031511 - DNA, 21 bp, Homo sapiens
cccggagaaggccgctgcccc

SEQ ID NO: 2031512 - DNA, 14 bp, Homo sapiens
cccggagcacagcc

SEQ ID NO: 2031513 - DNA, 15 bp, Homo sapiens
cccggagcacagccc

SEQ ID NO: 2031514 - DNA, 17 bp, Homo sapiens
cccggagcacagccctg

SEQ ID NO: 2031515 - DNA, 18 bp, Homo sapiens
cccggaggggcctggcag

SEQ ID NO: 2031516 - DNA, 19 bp, Homo sapiens
cccggccccatcagaggct

SEQ ID NO: 2031517 - DNA, 22 bp, Homo sapiens
cccggcgcggtggctcacgcct

SEQ ID NO: 2031518 - DNA, 13 bp, Homo sapiens
cccggctccaggc

SEQ ID NO: 2031519 - DNA, 16 bp, Homo sapiens
cccggctccccctgct

SEQ ID NO: 2031520 - DNA, 14 bp, Homo sapiens
cccggctgcctgcc

SEQ ID NO: 2031521 - DNA, 12 bp, Homo sapiens
cccggctgcgga

SEQ ID NO: 2031522 - DNA, 14 bp, Homo sapiens
cccgggcctgcctc

SEQ ID NO: 2031523 - DNA, 15 bp, Homo sapiens
cccgggcctgcctct

SEQ ID NO: 2031524 - DNA, 20 bp, Homo sapiens
cccgggctctggccaccctg

SEQ ID NO: 2031525 - DNA, 17 bp, Homo sapiens
cccggggctggcaagca

SEQ ID NO: 2031526 - DNA, 22 bp, Homo sapiens
cccggggctggcaagcagggaa

SEQ ID NO: 2031527 - DNA, 19 bp, Homo sapiens
cccgggggcagacacctgt

SEQ ID NO: 2031528 - DNA, 16 bp, Homo sapiens
cccgggtccccagctc

SEQ ID NO: 2031529 - DNA, 21 bp, Homo sapiens
cccgggtccccagctccccag

SEQ ID NO: 2031530 - DNA, 14 bp, Homo sapiens
cccgtaatgcttag

SEQ ID NO: 2031531 - DNA, 17 bp, Homo sapiens
cccgtacccccgtggtc

SEQ ID NO: 2031532 - DNA, 20 bp, Homo sapiens
cccgtacccccgtggtcttt

SEQ ID NO: 2031533 - DNA, 21 bp, Homo sapiens
cccgtctggggttcagcccct

SEQ ID NO: 2031534 - DNA, 21 bp, Homo sapiens
cgcaagagaacatttctagaa

SEQ ID NO: 2031535 - DNA, 18 bp, Homo sapiens
cgcaaggccctgtcccag

SEQ ID NO: 2031536 - DNA, 20 bp, Homo sapiens
cgcaaggccctgtcccagca

SEQ ID NO: 2031537 - DNA, 19 bp, Homo sapiens
ccttcaagttagctcagga

SEQ ID NO: 2031538 - DNA, 14 bp, Homo sapiens
ccttcaataaagta

SEQ ID NO: 2031539 - DNA, 15 bp, Homo sapiens
ccttcaattcctggg

SEQ ID NO: 2031540 - DNA, 16 bp, Homo sapiens
ccttcacaaccagcca

SEQ ID NO: 2031541 - DNA, 20 bp, Homo sapiens
ccttcacaaccagccacaca

SEQ ID NO: 2031542 - DNA, 12 bp, Homo sapiens
ccttcacagtgt

SEQ ID NO: 2031543 - DNA, 13 bp, Homo sapiens
ccttcaccagagc

SEQ ID NO: 2031544 - DNA, 17 bp, Homo sapiens
ccttcaccagagcccat

SEQ ID NO: 2031545 - DNA, 15 bp, Homo sapiens
ccttcactccctccc

SEQ ID NO: 2031546 - DNA, 18 bp, Homo sapiens
ccttcactccctccctgg

SEQ ID NO: 2031547 - DNA, 14 bp, Homo sapiens
ccttcactccggtg

SEQ ID NO: 2031548 - DNA, 20 bp, Homo sapiens
ccttcactccggtgtgcctg

SEQ ID NO: 2031549 - DNA, 12 bp, Homo sapiens
ccttcagggcca

SEQ ID NO: 2031550 - DNA, 13 bp, Homo sapiens
ccttcagggccag

SEQ ID NO: 2031551 - DNA, 15 bp, Homo sapiens
ccttcagggccagaa

SEQ ID NO: 2031552 - DNA, 18 bp, Homo sapiens
ccttcagggccagaagga

SEQ ID NO: 2031553 - DNA, 22 bp, Homo sapiens
ccttcagggccagaaggagggc

SEQ ID NO: 2031554 - DNA, 21 bp, Homo sapiens
ccttcagtcttgaatttctaa

SEQ ID NO: 2031555 - DNA, 11 bp, Homo sapiens
ccttcagtgcc

SEQ ID NO: 2031556 - DNA, 18 bp, Homo sapiens
ccttcagtgcccaccaac

SEQ ID NO: 2031557 - DNA, 20 bp, Homo sapiens
ccttcatcgaacaaactgat

SEQ ID NO: 2031558 - DNA, 20 bp, Homo sapiens
ccttcatctggattccagag

SEQ ID NO: 2031559 - DNA, 12 bp, Homo sapiens
ccttcatttcct

SEQ ID NO: 2031560 - DNA, 13 bp, Homo sapiens
ccttcatttcctc

SEQ ID NO: 2031561 - DNA, 23 bp, Homo sapiens
ccttccagctagtgacccacatg

SEQ ID NO: 2031562 - DNA, 13 bp, Homo sapiens
ccttccaggcccc

SEQ ID NO: 2031563 - DNA, 18 bp, Homo sapiens
ccttcccaatcagcactg

SEQ ID NO: 2031564 - DNA, 19 bp, Homo sapiens
ccttcccaatcagcactga

SEQ ID NO: 2031565 - DNA, 20 bp, Homo sapiens
ccttcccaatcagcactgaa

SEQ ID NO: 2031566 - DNA, 21 bp, Homo sapiens
ccttcccaatcagcactgaaa

SEQ ID NO: 2031567 - DNA, 15 bp, Homo sapiens
ccttcccatgccctg

SEQ ID NO: 2031568 - DNA, 23 bp, Homo sapiens
ccttcccccatcccctttcctcc

SEQ ID NO: 2031569 - DNA, 14 bp, Homo sapiens
ccttccccttctgt

SEQ ID NO: 2031570 - DNA, 17 bp, Homo sapiens
ccttccccttctgtgtc

SEQ ID NO: 2031571 - DNA, 18 bp, Homo sapiens
ccttccccttgcccaggg

SEQ ID NO: 2031572 - DNA, 20 bp, Homo sapiens
ccttccccttgcccagggct

SEQ ID NO: 2031573 - DNA, 19 bp, Homo sapiens
ccttccccttttgcctggc

SEQ ID NO: 2031574 - DNA, 22 bp, Homo sapiens
ccttccccttttgcctggctgt

SEQ ID NO: 2031575 - DNA, 13 bp, Homo sapiens
ccttccctccaaa

SEQ ID NO: 2031576 - DNA, 14 bp, Homo sapiens
ccttccctctttcc

SEQ ID NO: 2031577 - DNA, 15 bp, Homo sapiens
ccttccctctttccc

SEQ ID NO: 2031578 - DNA, 13 bp, Homo sapiens
ccttccctgcttt

SEQ ID NO: 2031579 - DNA, 11 bp, Homo sapiens
ccttccctggc

SEQ ID NO: 2031580 - DNA, 17 bp, Homo sapiens
ccttccgctcctttacc

SEQ ID NO: 2031581 - DNA, 13 bp, Homo sapiens
ccttcctcatccc

SEQ ID NO: 2031582 - DNA, 13 bp, Homo sapiens
ccttcctcctcca

SEQ ID NO: 2031583 - DNA, 17 bp, Homo sapiens
ccttcctcctccacagt

SEQ ID NO: 2031584 - DNA, 20 bp, Homo sapiens
ccttcctcctccacagtgct

SEQ ID NO: 2031585 - DNA, 20 bp, Homo sapiens
ccttcctctccactgccttc

SEQ ID NO: 2031586 - DNA, 14 bp, Homo sapiens
ccttcctgcacccg

SEQ ID NO: 2031587 - DNA, 17 bp, Homo sapiens
ccttcctgccaccagtc

SEQ ID NO: 2031588 - DNA, 23 bp, Homo sapiens
ccttcctgccccaactccttcca

SEQ ID NO: 2031589 - DNA, 16 bp, Homo sapiens
ccttcctggacagctg

SEQ ID NO: 2031590 - DNA, 18 bp, Homo sapiens
ccttcctggacagctgtg

SEQ ID NO: 2031591 - DNA, 21 bp, Homo sapiens
ccttcctggacagctgtgcct

SEQ ID NO: 2031592 - DNA, 22 bp, Homo sapiens
ccttcctggacagctgtgcctc

SEQ ID NO: 2031593 - DNA, 17 bp, Homo sapiens
ccttcctggcctcactg

SEQ ID NO: 2031594 - DNA, 19 bp, Homo sapiens
ccttcctggggcatctggc

SEQ ID NO: 2031595 - DNA, 16 bp, Homo sapiens
ccttcctgtcccacct

SEQ ID NO: 2031596 - DNA, 15 bp, Homo sapiens
ccttcctgtgccctg

SEQ ID NO: 2031597 - DNA, 20 bp, Homo sapiens
ccttccttgctgtcctaggc

SEQ ID NO: 2031598 - DNA, 15 bp, Homo sapiens
ccttcgatacaccgg

SEQ ID NO: 2031599 - DNA, 15 bp, Homo sapiens
ccttcgctgccagga

SEQ ID NO: 2031600 - DNA, 19 bp, Homo sapiens
ccttcgctgccaggacacc

SEQ ID NO: 2031601 - DNA, 23 bp, Homo sapiens
ccttcgctgccaggacacctgcc

SEQ ID NO: 2031602 - DNA, 18 bp, Homo sapiens
ccttcgtgtctctcccac

SEQ ID NO: 2031603 - DNA, 14 bp, Homo sapiens
ccttctaggaagct

SEQ ID NO: 2031604 - DNA, 15 bp, Homo sapiens
ccttctatgcagtat

SEQ ID NO: 2031605 - DNA, 15 bp, Homo sapiens
ccttctcctgcctac

SEQ ID NO: 2031606 - DNA, 22 bp, Homo sapiens
ccttctcgcattttctctagct

SEQ ID NO: 2031607 - DNA, 14 bp, Homo sapiens
ccttctctctctgg

SEQ ID NO: 2031608 - DNA, 17 bp, Homo sapiens
ccttctctgttcatttc

SEQ ID NO: 2031609 - DNA, 19 bp, Homo sapiens
ccttctctgttcatttcct

SEQ ID NO: 2031610 - DNA, 21 bp, Homo sapiens
ccttctctgttcatttcctca

SEQ ID NO: 2031611 - DNA, 16 bp, Homo sapiens
ccttctgaagatctca

SEQ ID NO: 2031612 - DNA, 14 bp, Homo sapiens
ccttctgcacccag

SEQ ID NO: 2031613 - DNA, 20 bp, Homo sapiens
ccttctgctggataaaatga

SEQ ID NO: 2031614 - DNA, 21 bp, Homo sapiens
ccttctgctggataaaatgag

SEQ ID NO: 2031615 - DNA, 14 bp, Homo sapiens
ccttctgcttctcc

SEQ ID NO: 2031616 - DNA, 15 bp, Homo sapiens
ccttctggttgcttc

SEQ ID NO: 2031617 - DNA, 20 bp, Homo sapiens
ccttctgtcctactctgtgt

SEQ ID NO: 2031618 - DNA, 21 bp, Homo sapiens
ccttctgtggctcacagaacc

SEQ ID NO: 2031619 - DNA, 12 bp, Homo sapiens
ccttctgtgtca

SEQ ID NO: 2031620 - DNA, 18 bp, Homo sapiens
ccttctgtttccatagga

SEQ ID NO: 2031621 - DNA, 23 bp, Homo sapiens
ccttcttcacccagctaatctgt

SEQ ID NO: 2031622 - DNA, 16 bp, Homo sapiens
ccttctttaaatcaaa

SEQ ID NO: 2031623 - DNA, 17 bp, Homo sapiens
ccttctttaaatcaaaa

SEQ ID NO: 2031624 - DNA, 23 bp, Homo sapiens
ccttctttaaatcaaaagctgct

SEQ ID NO: 2031625 - DNA, 13 bp, Homo sapiens
ccttgaacactgg

SEQ ID NO: 2031626 - DNA, 20 bp, Homo sapiens
ccttgaacactgggggaggg

SEQ ID NO: 2031627 - DNA, 18 bp, Homo sapiens
ccttgaactgttctggcc

SEQ ID NO: 2031628 - DNA, 19 bp, Homo sapiens
ccttgaagccactgaagct

SEQ ID NO: 2031629 - DNA, 22 bp, Homo sapiens
ccttgaagccactgaagctggg

SEQ ID NO: 2031630 - DNA, 16 bp, Homo sapiens
ccttgacaacagactg

SEQ ID NO: 2031631 - DNA, 14 bp, Homo sapiens
ccttgacagggcac

SEQ ID NO: 2031632 - DNA, 21 bp, Homo sapiens
ccttgacagggcacaccgggc

SEQ ID NO: 2031633 - DNA, 14 bp, Homo sapiens
ccttgagaaacctt

SEQ ID NO: 2031634 - DNA, 18 bp, Homo sapiens
ccttgagacctcagccat

SEQ ID NO: 2031635 - DNA, 19 bp, Homo sapiens
ccttgagacctcagccatg

SEQ ID NO: 2031636 - DNA, 13 bp, Homo sapiens
ccttgagcactca

SEQ ID NO: 2031637 - DNA, 23 bp, Homo sapiens
ccttgagcactcagtctagtgaa

SEQ ID NO: 2031638 - DNA, 16 bp, Homo sapiens
ccttgatgaagcccgt

SEQ ID NO: 2031639 - DNA, 22 bp, Homo sapiens
ccttgatgaagcccgtgtcctg

SEQ ID NO: 2031640 - DNA, 20 bp, Homo sapiens
ccttgatgaagcctgtgcca

SEQ ID NO: 2031641 - DNA, 22 bp, Homo sapiens
ccttgatgaagcctgtgccacc

SEQ ID NO: 2031642 - DNA, 14 bp, Homo sapiens
cctgcccggctgcg

SEQ ID NO: 2031643 - DNA, 22 bp, Homo sapiens
cctgccctagagcacactgtag

SEQ ID NO: 2031644 - DNA, 14 bp, Homo sapiens
cctgccctcaggga

SEQ ID NO: 2031645 - DNA, 24 bp, Homo sapiens
cctgccctcccatgttgcatgcct

SEQ ID NO: 2031646 - DNA, 14 bp, Homo sapiens
cctgccctgccacc

SEQ ID NO: 2031647 - DNA, 15 bp, Homo sapiens
cctgccctgccccca

SEQ ID NO: 2031648 - DNA, 15 bp, Homo sapiens
cctgccctgccctgc

SEQ ID NO: 2031649 - DNA, 12 bp, Homo sapiens
cctgccctggag

SEQ ID NO: 2031650 - DNA, 21 bp, Homo sapiens
cctgccctgttgtgtatagat

SEQ ID NO: 2031651 - DNA, 18 bp, Homo sapiens
cctgccgacctcgtcctc

SEQ ID NO: 2031652 - DNA, 14 bp, Homo sapiens
cctgccgcccaaag

SEQ ID NO: 2031653 - DNA, 20 bp, Homo sapiens
cctgcctacattccctggcc

SEQ ID NO: 2031654 - DNA, 22 bp, Homo sapiens
cctgcctacattccctggcctg

SEQ ID NO: 2031655 - DNA, 13 bp, Homo sapiens
cctgcctcagcct

SEQ ID NO: 2031656 - DNA, 16 bp, Homo sapiens
cctgcctcatccacca

SEQ ID NO: 2031657 - DNA, 23 bp, Homo sapiens
cctgcctcccagccctgccagga

SEQ ID NO: 2031658 - DNA, 19 bp, Homo sapiens
cctgcctcgaactggctgc

SEQ ID NO: 2031659 - DNA, 17 bp, Homo sapiens
cctgcctctcacacaca

SEQ ID NO: 2031660 - DNA, 19 bp, Homo sapiens
cctgcctctctgctccaga

SEQ ID NO: 2031661 - DNA, 15 bp, Homo sapiens
cctgcctctgactca

SEQ ID NO: 2031662 - DNA, 17 bp, Homo sapiens
cctgcctgagcccagga

SEQ ID NO: 2031663 - DNA, 18 bp, Homo sapiens
cctgcctgagcccaggag

SEQ ID NO: 2031664 - DNA, 23 bp, Homo sapiens
cctgcctgataccctgcttggtc

SEQ ID NO: 2031665 - DNA, 20 bp, Homo sapiens
cctgcctggaggacctgagc

SEQ ID NO: 2031666 - DNA, 21 bp, Homo sapiens
cctgcctggaggacctgagcc

SEQ ID NO: 2031667 - DNA, 22 bp, Homo sapiens
cctgcctggaggacctgagcct

SEQ ID NO: 2031668 - DNA, 23 bp, Homo sapiens
cctgcctgggttttctaactgta

SEQ ID NO: 2031669 - DNA, 13 bp, Homo sapiens
cctgccttgaagc

SEQ ID NO: 2031670 - DNA, 16 bp, Homo sapiens
cctgccttgaagccac

SEQ ID NO: 2031671 - DNA, 17 bp, Homo sapiens
cctgccttgaagccact

SEQ ID NO: 2031672 - DNA, 21 bp, Homo sapiens
cctgccttgaagccactgaag

SEQ ID NO: 2031673 - DNA, 17 bp, Homo sapiens
cctgccttgatgaagcc

SEQ ID NO: 2031674 - DNA, 20 bp, Homo sapiens
cctgccttgatgaagcctgt

SEQ ID NO: 2031675 - DNA, 15 bp, Homo sapiens
cctgcgaaggggccc

SEQ ID NO: 2031676 - DNA, 13 bp, Homo sapiens
cctgcgttggagc

SEQ ID NO: 2031677 - DNA, 14 bp, Homo sapiens
cctgcgttggagcc

SEQ ID NO: 2031678 - DNA, 16 bp, Homo sapiens
cctgcgttggagccac

SEQ ID NO: 2031679 - DNA, 17 bp, Homo sapiens
cctgcgttggagccact

SEQ ID NO: 2031680 - DNA, 18 bp, Homo sapiens
cctgcgttggagccactc

SEQ ID NO: 2031681 - DNA, 19 bp, Homo sapiens
cctgcgttggagccactcc

SEQ ID NO: 2031682 - DNA, 22 bp, Homo sapiens
cctgcgttttggaagctctgaa

SEQ ID NO: 2031683 - DNA, 17 bp, Homo sapiens
cctgctaatagctgcta

SEQ ID NO: 2031684 - DNA, 14 bp, Homo sapiens
cctgctagagcaac

SEQ ID NO: 2031685 - DNA, 19 bp, Homo sapiens
cctgctagagcaacccctg

SEQ ID NO: 2031686 - DNA, 20 bp, Homo sapiens
cctgctagagcaacccctgt

SEQ ID NO: 2031687 - DNA, 16 bp, Homo sapiens
cctgctagctgtagaa

SEQ ID NO: 2031688 - DNA, 16 bp, Homo sapiens
cctgctcccagcagcc

SEQ ID NO: 2031689 - DNA, 13 bp, Homo sapiens
cctgctcctccca

SEQ ID NO: 2031690 - DNA, 14 bp, Homo sapiens
cctgctcctcccaa

SEQ ID NO: 2031691 - DNA, 18 bp, Homo sapiens
cctgctccttcccaggag

SEQ ID NO: 2031692 - DNA, 18 bp, Homo sapiens
cctgctcgtccccaagtg

SEQ ID NO: 2031693 - DNA, 21 bp, Homo sapiens
cctgctctccgaccagacacc

SEQ ID NO: 2031694 - DNA, 16 bp, Homo sapiens
cctgctctcctcttgc

SEQ ID NO: 2031695 - DNA, 18 bp, Homo sapiens
cctgctctcctcttgcca

SEQ ID NO: 2031696 - DNA, 19 bp, Homo sapiens
cctgctctcctcttgccac

SEQ ID NO: 2031697 - DNA, 21 bp, Homo sapiens
cctgctctcctcttgccactg

SEQ ID NO: 2031698 - DNA, 22 bp, Homo sapiens
cctgctctcctcttgccactgc

SEQ ID NO: 2031699 - DNA, 13 bp, Homo sapiens
cctgctctcttca

SEQ ID NO: 2031700 - DNA, 20 bp, Homo sapiens
cctgctctcttcaggaggcc

SEQ ID NO: 2031701 - DNA, 15 bp, Homo sapiens
cctgctctggggatg

SEQ ID NO: 2031702 - DNA, 11 bp, Homo sapiens
cctgctgagct

SEQ ID NO: 2031703 - DNA, 20 bp, Homo sapiens
cctgctgagctctgagaggc

SEQ ID NO: 2031704 - DNA, 21 bp, Homo sapiens
cctgctgagctctgagaggcc

SEQ ID NO: 2031705 - DNA, 14 bp, Homo sapiens
cctgctgccgcctc

SEQ ID NO: 2031706 - DNA, 15 bp, Homo sapiens
cctgctgccgcctcc

SEQ ID NO: 2031707 - DNA, 18 bp, Homo sapiens
cctgctgccgcctcccag

SEQ ID NO: 2031708 - DNA, 17 bp, Homo sapiens
cctgctgcgtcagacca

SEQ ID NO: 2031709 - DNA, 17 bp, Homo sapiens
cctgctgctgagaacct

SEQ ID NO: 2031710 - DNA, 23 bp, Homo sapiens
cctgctgctgtaactgctgagcc

SEQ ID NO: 2031711 - DNA, 17 bp, Homo sapiens
cctgctggcacctcaga

SEQ ID NO: 2031712 - DNA, 19 bp, Homo sapiens
cctgctgggctctccacct

SEQ ID NO: 2031713 - DNA, 21 bp, Homo sapiens
cctgctgggctctccacctca

SEQ ID NO: 2031714 - DNA, 24 bp, Homo sapiens
cctgctgggctctccacctcagcc

SEQ ID NO: 2031715 - DNA, 15 bp, Homo sapiens
cctgctgggtaaact

SEQ ID NO: 2031716 - DNA, 19 bp, Homo sapiens
cctgctggttcagggttgg

SEQ ID NO: 2031717 - DNA, 23 bp, Homo sapiens
cctgctgtgcaccttacattcct

SEQ ID NO: 2031718 - DNA, 20 bp, Homo sapiens
cctgctgtgtgaattcccag

SEQ ID NO: 2031719 - DNA, 14 bp, Homo sapiens
cctgcttacctgac

SEQ ID NO: 2031720 - DNA, 12 bp, Homo sapiens
cctgcttcctag

SEQ ID NO: 2031721 - DNA, 21 bp, Homo sapiens
cctgcttcttcaagcacctgc

SEQ ID NO: 2031722 - DNA, 22 bp, Homo sapiens
cctgcttgaaggaacagtgctg

SEQ ID NO: 2031723 - DNA, 15 bp, Homo sapiens
cctgcttgtccctgc

SEQ ID NO: 2031724 - DNA, 16 bp, Homo sapiens
cctgctttccctcccc

SEQ ID NO: 2031725 - DNA, 17 bp, Homo sapiens
cctgctttgggctgccc

SEQ ID NO: 2031726 - DNA, 20 bp, Homo sapiens
cctgctttgggctgccctgg

SEQ ID NO: 2031727 - DNA, 17 bp, Homo sapiens
cctggaaaggctcagtc

SEQ ID NO: 2031728 - DNA, 20 bp, Homo sapiens
cctggaaaggctcagtctca

SEQ ID NO: 2031729 - DNA, 12 bp, Homo sapiens
cctggaaatgtg

SEQ ID NO: 2031730 - DNA, 19 bp, Homo sapiens
cctggaaattctggaactg

SEQ ID NO: 2031731 - DNA, 23 bp, Homo sapiens
cctggaagcatttgtttctactt

SEQ ID NO: 2031732 - DNA, 13 bp, Homo sapiens
cctggaagctgtg

SEQ ID NO: 2031733 - DNA, 20 bp, Homo sapiens
cctggaagctgtgtccttgc

SEQ ID NO: 2031734 - DNA, 18 bp, Homo sapiens
cctggaagggaagtgaga

SEQ ID NO: 2031735 - DNA, 11 bp, Homo sapiens
cctggaagggc

SEQ ID NO: 2031736 - DNA, 18 bp, Homo sapiens
cctggaatgaagcatgta

SEQ ID NO: 2031737 - DNA, 19 bp, Homo sapiens
cctggaatgaagcatgtag

SEQ ID NO: 2031738 - DNA, 16 bp, Homo sapiens
cctggaattcagcacc

SEQ ID NO: 2031739 - DNA, 19 bp, Homo sapiens
cctggaattcagcaccctg

SEQ ID NO: 2031740 - DNA, 21 bp, Homo sapiens
cctggaattcagcaccctggg

SEQ ID NO: 2031741 - DNA, 20 bp, Homo sapiens
cctggaatttaattcaaagt

SEQ ID NO: 2031742 - DNA, 13 bp, Homo sapiens
cctggacactagg

SEQ ID NO: 2031743 - DNA, 13 bp, Homo sapiens
cctggacagctgt

SEQ ID NO: 2031744 - DNA, 18 bp, Homo sapiens
cctggacagctgtgcctc

SEQ ID NO: 2031745 - DNA, 19 bp, Homo sapiens
cctggacagctgtgcctcg

SEQ ID NO: 2031746 - DNA, 18 bp, Homo sapiens
cctggaccaccagcccca

SEQ ID NO: 2031747 - DNA, 13 bp, Homo sapiens
cctggacctgagt

SEQ ID NO: 2031748 - DNA, 20 bp, Homo sapiens
cctggactctaagctggagc

SEQ ID NO: 2031749 - DNA, 21 bp, Homo sapiens
cctggactctaagctggagct

SEQ ID NO: 2031750 - DNA, 14 bp, Homo sapiens
cctggactgggagg

SEQ ID NO: 2031751 - DNA, 16 bp, Homo sapiens
cctggagaactagaga

SEQ ID NO: 2031752 - DNA, 17 bp, Homo sapiens
cctggagaagctgatgc

SEQ ID NO: 2031753 - DNA, 12 bp, Homo sapiens
cctggagagggg

SEQ ID NO: 2031754 - DNA, 13 bp, Homo sapiens
cctggagatgatg

SEQ ID NO: 2031755 - DNA, 14 bp, Homo sapiens
cctggagatgatga

SEQ ID NO: 2031756 - DNA, 16 bp, Homo sapiens
cctggagcatcccagg

SEQ ID NO: 2031757 - DNA, 15 bp, Homo sapiens
cctggaggacctgag

SEQ ID NO: 2031758 - DNA, 14 bp, Homo sapiens
ctcactccaccacc

SEQ ID NO: 2031759 - DNA, 19 bp, Homo sapiens
ctcactcctacctggtaat

SEQ ID NO: 2031760 - DNA, 11 bp, Homo sapiens
ctcactcctgc

SEQ ID NO: 2031761 - DNA, 20 bp, Homo sapiens
ctcactcctgttacttacct

SEQ ID NO: 2031762 - DNA, 14 bp, Homo sapiens
ctcactctggcctc

SEQ ID NO: 2031763 - DNA, 15 bp, Homo sapiens
ctcactctggcctca

SEQ ID NO: 2031764 - DNA, 18 bp, Homo sapiens
ctcactctgtcagccagc

SEQ ID NO: 2031765 - DNA, 12 bp, Homo sapiens
ctcactctgtcg

SEQ ID NO: 2031766 - DNA, 18 bp, Homo sapiens
ctcactcttatgaaatgg

SEQ ID NO: 2031767 - DNA, 15 bp, Homo sapiens
ctcactgatatattt

SEQ ID NO: 2031768 - DNA, 23 bp, Homo sapiens
ctcactgcaacctcttcctcctg

SEQ ID NO: 2031769 - DNA, 12 bp, Homo sapiens
ctcactgcagcc

SEQ ID NO: 2031770 - DNA, 14 bp, Homo sapiens
ctcactgcagcctc

SEQ ID NO: 2031771 - DNA, 13 bp, Homo sapiens
ctcactgccttcc

SEQ ID NO: 2031772 - DNA, 15 bp, Homo sapiens
ctcactgccttccag

SEQ ID NO: 2031773 - DNA, 19 bp, Homo sapiens
ctcactgccttccaggagc

SEQ ID NO: 2031774 - DNA, 18 bp, Homo sapiens
ctcactgctggggagtcc

SEQ ID NO: 2031775 - DNA, 17 bp, Homo sapiens
ctcactggctggggcag

SEQ ID NO: 2031776 - DNA, 20 bp, Homo sapiens
ctcactggggtcctggggcc

SEQ ID NO: 2031777 - DNA, 15 bp, Homo sapiens
ctcactgttgcccag

SEQ ID NO: 2031778 - DNA, 17 bp, Homo sapiens
ctcactgttgcccaggc

SEQ ID NO: 2031779 - DNA, 17 bp, Homo sapiens
ctcacttataccaaagg

SEQ ID NO: 2031780 - DNA, 21 bp, Homo sapiens
ctcacttataccaaagggaaa

SEQ ID NO: 2031781 - DNA, 21 bp, Homo sapiens
ctcacttttaatgaacaaatg

SEQ ID NO: 2031782 - DNA, 19 bp, Homo sapiens
ctcagaaaagaaaaccatt

SEQ ID NO: 2031783 - DNA, 22 bp, Homo sapiens
ctcagaaaagaaaaccatttta

SEQ ID NO: 2031784 - DNA, 17 bp, Homo sapiens
ctcagaaatttttattt

SEQ ID NO: 2031785 - DNA, 15 bp, Homo sapiens
ctcagaagacactga

SEQ ID NO: 2031786 - DNA, 17 bp, Homo sapiens
ctcagaagacactgatg

SEQ ID NO: 2031787 - DNA, 22 bp, Homo sapiens
ctcagaagacactgatgggcaa

SEQ ID NO: 2031788 - DNA, 23 bp, Homo sapiens
ctcagaagacactgatgggcaac

SEQ ID NO: 2031789 - DNA, 13 bp, Homo sapiens
ctcagaagcctga

SEQ ID NO: 2031790 - DNA, 17 bp, Homo sapiens
ctcagaagcctgaggct

SEQ ID NO: 2031791 - DNA, 18 bp, Homo sapiens
ctcagaagcctgaggctg

SEQ ID NO: 2031792 - DNA, 14 bp, Homo sapiens
ctcagaagcctggg

SEQ ID NO: 2031793 - DNA, 20 bp, Homo sapiens
ctcagaagcctgggggcctg

SEQ ID NO: 2031794 - DNA, 16 bp, Homo sapiens
ctcagaaggtattcct

SEQ ID NO: 2031795 - DNA, 18 bp, Homo sapiens
ctcagaatccaaagatca

SEQ ID NO: 2031796 - DNA, 22 bp, Homo sapiens
ctcagacaatccactctcagga

SEQ ID NO: 2031797 - DNA, 21 bp, Homo sapiens
ctcagaccaactctctcctgt

SEQ ID NO: 2031798 - DNA, 23 bp, Homo sapiens
ctcagacccccactctcattccc

SEQ ID NO: 2031799 - DNA, 14 bp, Homo sapiens
ctcagactccattt

SEQ ID NO: 2031800 - DNA, 15 bp, Homo sapiens
ctaacattatttatt

SEQ ID NO: 2031801 - DNA, 18 bp, Homo sapiens
ctaaccccaacgcacagg

SEQ ID NO: 2031802 - DNA, 22 bp, Homo sapiens
ctaacccccagtgccacagaga

SEQ ID NO: 2031803 - DNA, 13 bp, Homo sapiens
ctaacccctttcc

SEQ ID NO: 2031804 - DNA, 18 bp, Homo sapiens
ctaacccttaaaaatgca

SEQ ID NO: 2031805 - DNA, 22 bp, Homo sapiens
ctaacctaagcaaaaccactga

SEQ ID NO: 2031806 - DNA, 12 bp, Homo sapiens
ctaacgcctgag

SEQ ID NO: 2031807 - DNA, 17 bp, Homo sapiens
ctaacgcctgagcccag

SEQ ID NO: 2031808 - DNA, 22 bp, Homo sapiens
ctaacgggggtgcggcaggagc

SEQ ID NO: 2031809 - DNA, 15 bp, Homo sapiens
ctaacgtaaatacac

SEQ ID NO: 2031810 - DNA, 13 bp, Homo sapiens
ctaactctggcac

SEQ ID NO: 2031811 - DNA, 14 bp, Homo sapiens
ctaactggactggt

SEQ ID NO: 2031812 - DNA, 11 bp, Homo sapiens
ctaactgtaaa

SEQ ID NO: 2031813 - DNA, 13 bp, Homo sapiens
ctaactgtaaatc

SEQ ID NO: 2031814 - DNA, 16 bp, Homo sapiens
ctaagaaatgctgaaa

SEQ ID NO: 2031815 - DNA, 15 bp, Homo sapiens
ctaagaagctctggc

SEQ ID NO: 2031816 - DNA, 20 bp, Homo sapiens
ctaagaagtccccaggtcat

SEQ ID NO: 2031817 - DNA, 21 bp, Homo sapiens
ctaagacttcagtcctggtct

SEQ ID NO: 2031818 - DNA, 16 bp, Homo sapiens
ctaagagctagcgctg

SEQ ID NO: 2031819 - DNA, 20 bp, Homo sapiens
ctaagaggctatttaaaagt

SEQ ID NO: 2031820 - DNA, 21 bp, Homo sapiens
ctaagatgagatttgccagca

SEQ ID NO: 2031821 - DNA, 12 bp, Homo sapiens
ctaagattgtac

SEQ ID NO: 2031822 - DNA, 16 bp, Homo sapiens
ctaagcaacagaaata

SEQ ID NO: 2031823 - DNA, 16 bp, Homo sapiens
ctaagcagtgcttgta

SEQ ID NO: 2031824 - DNA, 19 bp, Homo sapiens
ctaagccacagcttcttca

SEQ ID NO: 2031825 - DNA, 12 bp, Homo sapiens
ctaagccctgtc

SEQ ID NO: 2031826 - DNA, 20 bp, Homo sapiens
ctaagccctgtcgagacact

SEQ ID NO: 2031827 - DNA, 15 bp, Homo sapiens
ctaagctaaccccct

SEQ ID NO: 2031828 - DNA, 22 bp, Homo sapiens
ctaagctaggaatgaaatcctg

SEQ ID NO: 2031829 - DNA, 19 bp, Homo sapiens
ctaagctgcagcttcctgt

SEQ ID NO: 2031830 - DNA, 17 bp, Homo sapiens
ctaagctggagctcttg

SEQ ID NO: 2031831 - DNA, 20 bp, Homo sapiens
ctaaggaaatggagaagctc

SEQ ID NO: 2031832 - DNA, 15 bp, Homo sapiens
ctaaggaatctgaaa

SEQ ID NO: 2031833 - DNA, 11 bp, Homo sapiens
ctaaggacaca

SEQ ID NO: 2031834 - DNA, 15 bp, Homo sapiens
ctaaggatctctcag

SEQ ID NO: 2031835 - DNA, 22 bp, Homo sapiens
ctaaggccgtgtctctgaggac

SEQ ID NO: 2031836 - DNA, 18 bp, Homo sapiens
ctaagggtgtaagtaatt

SEQ ID NO: 2031837 - DNA, 19 bp, Homo sapiens
ctaagtaaaaccacagcag

SEQ ID NO: 2031838 - DNA, 20 bp, Homo sapiens
ctaagtaaaaccacagcagt

SEQ ID NO: 2031839 - DNA, 23 bp, Homo sapiens
ctaagtaaaaccacagcagttga

SEQ ID NO: 2031840 - DNA, 20 bp, Homo sapiens
ctaagtaggggcagtgatgg

SEQ ID NO: 2031841 - DNA, 14 bp, Homo sapiens
ctaagtgaaaaggt

SEQ ID NO: 2031842 - DNA, 23 bp, Homo sapiens
ctaagtgatcctcccacctcagc

SEQ ID NO: 2031843 - DNA, 18 bp, Homo sapiens
ctaagtgttgaagaagag

SEQ ID NO: 2031844 - DNA, 15 bp, Homo sapiens
ctaagttaatttaaa

SEQ ID NO: 2031845 - DNA, 15 bp, Homo sapiens
ctaagttcagttctg

SEQ ID NO: 2031846 - DNA, 22 bp, Homo sapiens
ctaagttcatgtttgtaaatta

SEQ ID NO: 2031847 - DNA, 12 bp, Homo sapiens
ctaatacaccag

SEQ ID NO: 2031848 - DNA, 13 bp, Homo sapiens
ctaatacctctgt

SEQ ID NO: 2031849 - DNA, 15 bp, Homo sapiens
ctaatacctctgtgt

SEQ ID NO: 2031850 - DNA, 17 bp, Homo sapiens
ctaatacctctgtgtgc

SEQ ID NO: 2031851 - DNA, 18 bp, Homo sapiens
ctaatagactaaatgaaa

SEQ ID NO: 2031852 - DNA, 20 bp, Homo sapiens
ctaatagactaaatgaaatc

SEQ ID NO: 2031853 - DNA, 17 bp, Homo sapiens
ctaatagagacacagag

SEQ ID NO: 2031854 - DNA, 13 bp, Homo sapiens
ctaatagctgcta

SEQ ID NO: 2031855 - DNA, 14 bp, Homo sapiens
ctaatattaaaaat

SEQ ID NO: 2031856 - DNA, 22 bp, Homo sapiens
ctaatcaagagtgagtgaacaa

SEQ ID NO: 2031857 - DNA, 17 bp, Homo sapiens
ctaatcagcattctcac

SEQ ID NO: 2031858 - DNA, 19 bp, Homo sapiens
ctaatcagggaggtcattt

SEQ ID NO: 2031859 - DNA, 18 bp, Homo sapiens
ctaatctcatacctctga

SEQ ID NO: 2031860 - DNA, 21 bp, Homo sapiens
ctaatctcatacctctgacca

SEQ ID NO: 2031861 - DNA, 14 bp, Homo sapiens
ctaatgaaattgag

SEQ ID NO: 2031862 - DNA, 18 bp, Homo sapiens
ctaatgaagggaaaggat

SEQ ID NO: 2031863 - DNA, 23 bp, Homo sapiens
ctaatgaagggaaaggatatttt

SEQ ID NO: 2031864 - DNA, 15 bp, Homo sapiens
ctaatgacacggtag

SEQ ID NO: 2031865 - DNA, 18 bp, Homo sapiens
ctaatgacgatgccgtgt

SEQ ID NO: 2031866 - DNA, 18 bp, Homo sapiens
ctaatgctaagaaatgct

SEQ ID NO: 2031867 - DNA, 21 bp, Homo sapiens
ctaatgtcttcatttcattgt

SEQ ID NO: 2031868 - DNA, 15 bp, Homo sapiens
ctaattaaaatctgg

SEQ ID NO: 2031869 - DNA, 19 bp, Homo sapiens
ctaattaaaatctggaaat

SEQ ID NO: 2031870 - DNA, 19 bp, Homo sapiens
ctaattcccattttgcaaa

SEQ ID NO: 2031871 - DNA, 21 bp, Homo sapiens
ctaattcccattttgcaaaat

SEQ ID NO: 2031872 - DNA, 15 bp, Homo sapiens
ctaattcctttctat

SEQ ID NO: 2031873 - DNA, 19 bp, Homo sapiens
ctaattctcttacccagaa

SEQ ID NO: 2031874 - DNA, 14 bp, Homo sapiens
ctaatttaaaaaat

SEQ ID NO: 2031875 - DNA, 13 bp, Homo sapiens
ctaatttaaacca

SEQ ID NO: 2031876 - DNA, 18 bp, Homo sapiens
ctaatttaaaccagcaga

SEQ ID NO: 2031877 - DNA, 14 bp, Homo sapiens
ctagaacctggagg

SEQ ID NO: 2031878 - DNA, 13 bp, Homo sapiens
ctagaacttcaaa

SEQ ID NO: 2031879 - DNA, 21 bp, Homo sapiens
ctagaagggctagaacctgga

SEQ ID NO: 2031880 - DNA, 17 bp, Homo sapiens
ctagaagtgggccagga

SEQ ID NO: 2031881 - DNA, 21 bp, Homo sapiens
ctagaagtgggccaggacagg

SEQ ID NO: 2031882 - DNA, 17 bp, Homo sapiens
ctagaatggtagcacta

SEQ ID NO: 2031883 - DNA, 22 bp, Homo sapiens
ctagaatttattcaattcctct

SEQ ID NO: 2031884 - DNA, 17 bp, Homo sapiens
ctagaatttgtattttg

SEQ ID NO: 2031885 - DNA, 18 bp, Homo sapiens
ctagaatttgtattttgc

SEQ ID NO: 2031886 - DNA, 19 bp, Homo sapiens
ctagaattttaagtgcttt

SEQ ID NO: 2031887 - DNA, 13 bp, Homo sapiens
ctagacctgggcc

SEQ ID NO: 2031888 - DNA, 19 bp, Homo sapiens
ctagactggagtgaggctt

SEQ ID NO: 2031889 - DNA, 20 bp, Homo sapiens
ctagacttcagaacatgctg

SEQ ID NO: 2031890 - DNA, 22 bp, Homo sapiens
ctagacttcagaacatgctgga

SEQ ID NO: 2031891 - DNA, 12 bp, Homo sapiens
ctagactttctc

SEQ ID NO: 2031892 - DNA, 13 bp, Homo sapiens
ctagactttctgt

SEQ ID NO: 2031893 - DNA, 17 bp, Homo sapiens
ctagagaagaggctggt

SEQ ID NO: 2031894 - DNA, 12 bp, Homo sapiens
ctagagagcaga

SEQ ID NO: 2031895 - DNA, 10 bp, Homo sapiens
ctagagcctg

SEQ ID NO: 2031896 - DNA, 20 bp, Homo sapiens
ctagagctcctgtccctacc

SEQ ID NO: 2031897 - DNA, 21 bp, Homo sapiens
ctagagctcctgtccctaccc

SEQ ID NO: 2031898 - DNA, 23 bp, Homo sapiens
ctagagctcctgtccctacccac

SEQ ID NO: 2031899 - DNA, 19 bp, Homo sapiens
ctagagctgggaaacaggg

SEQ ID NO: 2031900 - DNA, 24 bp, Homo sapiens
ctagagctgggaaacagggagccc

SEQ ID NO: 2031901 - DNA, 14 bp, Homo sapiens
ctagagctttcttt

SEQ ID NO: 2031902 - DNA, 19 bp, Homo sapiens
ctagaggcttccttcattt

SEQ ID NO: 2031903 - DNA, 22 bp, Homo sapiens
ctagagggatacactgaagtta

SEQ ID NO: 2031904 - DNA, 19 bp, Homo sapiens
ctagaggtgagaaatttaa

SEQ ID NO: 2031905 - DNA, 18 bp, Homo sapiens
ctagatactgttgatctt

SEQ ID NO: 2031906 - DNA, 18 bp, Homo sapiens
ctagatcaaggagcccag

SEQ ID NO: 2031907 - DNA, 18 bp, Homo sapiens
ctagatccacacacagag

SEQ ID NO: 2031908 - DNA, 16 bp, Homo sapiens
ctagatcttacatctg

SEQ ID NO: 2031909 - DNA, 20 bp, Homo sapiens
ctagatcttacatctgcagc

SEQ ID NO: 2031910 - DNA, 13 bp, Homo sapiens
ctagatgtcttta

SEQ ID NO: 2031911 - DNA, 17 bp, Homo sapiens
ctagattagaagtgttt

SEQ ID NO: 2031912 - DNA, 15 bp, Homo sapiens
ctagcaaattagaaa

SEQ ID NO: 2031913 - DNA, 19 bp, Homo sapiens
ctagcagagcaggggcagg

SEQ ID NO: 2031914 - DNA, 12 bp, Homo sapiens
ctagcagctgca

SEQ ID NO: 2031915 - DNA, 13 bp, Homo sapiens
ctagcagctgcag

SEQ ID NO: 2031916 - DNA, 20 bp, Homo sapiens
ctagcaggcacaggacacct

SEQ ID NO: 2031917 - DNA, 17 bp, Homo sapiens
ctagccaactcctcctt

SEQ ID NO: 2031918 - DNA, 12 bp, Homo sapiens
ctagccaaggct

SEQ ID NO: 2031919 - DNA, 14 bp, Homo sapiens
ctagccaaggctag

SEQ ID NO: 2031920 - DNA, 14 bp, Homo sapiens
ctagccacctccca

SEQ ID NO: 2031921 - DNA, 15 bp, Homo sapiens
ctagccacctcccac

SEQ ID NO: 2031922 - DNA, 23 bp, Homo sapiens
ctagccacctcccaccccactcc

SEQ ID NO: 2031923 - DNA, 15 bp, Homo sapiens
ctagccaggagtctg

SEQ ID NO: 2031924 - DNA, 14 bp, Homo sapiens
ctagccctccctgg

SEQ ID NO: 2031925 - DNA, 16 bp, Homo sapiens
ctagccctgcggagcc

SEQ ID NO: 2031926 - DNA, 15 bp, Homo sapiens
ctagccgacctcagc

SEQ ID NO: 2031927 - DNA, 21 bp, Homo sapiens
ctagccgggccatgctttcct

SEQ ID NO: 2031928 - DNA, 13 bp, Homo sapiens
ctagcctctccag

SEQ ID NO: 2031929 - DNA, 19 bp, Homo sapiens
ctagcctggcaacagagca

SEQ ID NO: 2031930 - DNA, 20 bp, Homo sapiens
ctagctaccttctctaccca

SEQ ID NO: 2031931 - DNA, 12 bp, Homo sapiens
ctagctggcagg

SEQ ID NO: 2031932 - DNA, 18 bp, Homo sapiens
ctagctgttgagctgttt

SEQ ID NO: 2031933 - DNA, 15 bp, Homo sapiens
ctagcttcatgcctc

SEQ ID NO: 2031934 - DNA, 19 bp, Homo sapiens
ctagcttcatgcctcagtt

SEQ ID NO: 2031935 - DNA, 20 bp, Homo sapiens
ctagcttcatgcctcagttt

SEQ ID NO: 2031936 - DNA, 13 bp, Homo sapiens
ctaggacctcagg

SEQ ID NO: 2031937 - DNA, 15 bp, Homo sapiens
ctaggactctgaggc

SEQ ID NO: 2031938 - DNA, 14 bp, Homo sapiens
ctaggactgaggag

SEQ ID NO: 2031939 - DNA, 21 bp, Homo sapiens
ctaggagagactgaaagcagc

SEQ ID NO: 2031940 - DNA, 15 bp, Homo sapiens
ctaggagcaaagcct

SEQ ID NO: 2031941 - DNA, 17 bp, Homo sapiens
ctaggagcaaagcctgt

SEQ ID NO: 2031942 - DNA, 17 bp, Homo sapiens
ctaggattacaggcctt

SEQ ID NO: 2031943 - DNA, 17 bp, Homo sapiens
cgcaagttcagggaagc

SEQ ID NO: 2031944 - DNA, 22 bp, Homo sapiens
cgcaattgtgggatgtcctctt

SEQ ID NO: 2031945 - DNA, 18 bp, Homo sapiens
cgcaccagctgctctgcc

SEQ ID NO: 2031946 - DNA, 16 bp, Homo sapiens
cgcaccaggccgggct

SEQ ID NO: 2031947 - DNA, 14 bp, Homo sapiens
cgcaccccagagtg

SEQ ID NO: 2031948 - DNA, 17 bp, Homo sapiens
cgcaccgggccctcctt

SEQ ID NO: 2031949 - DNA, 12 bp, Homo sapiens
cgcacctccatc

SEQ ID NO: 2031950 - DNA, 17 bp, Homo sapiens
cgcacctgccccctggt

SEQ ID NO: 2031951 - DNA, 16 bp, Homo sapiens
cgcacgcaacccttgc

SEQ ID NO: 2031952 - DNA, 22 bp, Homo sapiens
cgcactacatgtggtttataga

SEQ ID NO: 2031953 - DNA, 18 bp, Homo sapiens
cgcactcacccatgtgcc

SEQ ID NO: 2031954 - DNA, 12 bp, Homo sapiens
cgcagaaggaag

SEQ ID NO: 2031955 - DNA, 15 bp, Homo sapiens
cgcagagtaaaataa

SEQ ID NO: 2031956 - DNA, 19 bp, Homo sapiens
cgcagcaggtgcaagagac

SEQ ID NO: 2031957 - DNA, 13 bp, Homo sapiens
cgcagccaccctg

SEQ ID NO: 2031958 - DNA, 20 bp, Homo sapiens
cgcagcccgtgaagcagtgc

SEQ ID NO: 2031959 - DNA, 23 bp, Homo sapiens
cgcagcctggcggggcaggaggc

SEQ ID NO: 2031960 - DNA, 14 bp, Homo sapiens
cgcagcggggtagg

SEQ ID NO: 2031961 - DNA, 15 bp, Homo sapiens
cgcaggatccgctgc

SEQ ID NO: 2031962 - DNA, 20 bp, Homo sapiens
cgcaggatccgctgccacca

SEQ ID NO: 2031963 - DNA, 21 bp, Homo sapiens
cgcaggctatttgttcagaga

SEQ ID NO: 2031964 - DNA, 18 bp, Homo sapiens
cgcagggaggatgccaca

SEQ ID NO: 2031965 - DNA, 19 bp, Homo sapiens
cgcagggaggatgccacag

SEQ ID NO: 2031966 - DNA, 19 bp, Homo sapiens
cgcaggtctcagcccggga

SEQ ID NO: 2031967 - DNA, 13 bp, Homo sapiens
cgcagtccccagc

SEQ ID NO: 2031968 - DNA, 21 bp, Homo sapiens
cgcagtccccagcccttctgc

SEQ ID NO: 2031969 - DNA, 16 bp, Homo sapiens
cgcagtcgcaggatcc

SEQ ID NO: 2031970 - DNA, 23 bp, Homo sapiens
cgcagtcgcaggatccgctgcca

SEQ ID NO: 2031971 - DNA, 15 bp, Homo sapiens
cgcagtctggcctgg

SEQ ID NO: 2031972 - DNA, 19 bp, Homo sapiens
cgcagtgcttctctacaga

SEQ ID NO: 2031973 - DNA, 12 bp, Homo sapiens
cgcatcatatgc

SEQ ID NO: 2031974 - DNA, 14 bp, Homo sapiens
cgcatcttctccat

SEQ ID NO: 2031975 - DNA, 14 bp, Homo sapiens
cgcatgccagagcc

SEQ ID NO: 2031976 - DNA, 20 bp, Homo sapiens
cgcatgtaatcccagctact

SEQ ID NO: 2031977 - DNA, 16 bp, Homo sapiens
cgccaaagtgcagccc

SEQ ID NO: 2031978 - DNA, 12 bp, Homo sapiens
cgccacggccac

SEQ ID NO: 2031979 - DNA, 13 bp, Homo sapiens
cgccacggccacc

SEQ ID NO: 2031980 - DNA, 22 bp, Homo sapiens
cgccactacactccagcctgag

SEQ ID NO: 2031981 - DNA, 19 bp, Homo sapiens
cgccactcatttcatctca

SEQ ID NO: 2031982 - DNA, 21 bp, Homo sapiens
cgccactgcactccagcctgg

SEQ ID NO: 2031983 - DNA, 21 bp, Homo sapiens
cgccactgcactccagtctgg

SEQ ID NO: 2031984 - DNA, 13 bp, Homo sapiens
cgccatcagccca

SEQ ID NO: 2031985 - DNA, 19 bp, Homo sapiens
cgccatccgggacgcttcc

SEQ ID NO: 2031986 - DNA, 21 bp, Homo sapiens
cgcccagcctcctcccaccac

SEQ ID NO: 2031987 - DNA, 23 bp, Homo sapiens
cgcccagctgcacctgccagcct

SEQ ID NO: 2031988 - DNA, 11 bp, Homo sapiens
cgcccaggaga

SEQ ID NO: 2031989 - DNA, 13 bp, Homo sapiens
cgcccagtctgga

SEQ ID NO: 2031990 - DNA, 19 bp, Homo sapiens
cgcccagtctggaatgcag

SEQ ID NO: 2031991 - DNA, 22 bp, Homo sapiens
cgcccattcgtctgtcccagag

SEQ ID NO: 2031992 - DNA, 13 bp, Homo sapiens
cgccccagacaca

SEQ ID NO: 2031993 - DNA, 12 bp, Homo sapiens
cgccccaggccc

SEQ ID NO: 2031994 - DNA, 20 bp, Homo sapiens
cgcccccacaccccatctct

SEQ ID NO: 2031995 - DNA, 12 bp, Homo sapiens
cgccccccacct

SEQ ID NO: 2031996 - DNA, 11 bp, Homo sapiens
cgccctgcaga

SEQ ID NO: 2031997 - DNA, 16 bp, Homo sapiens
cgccctgcagaccctg

SEQ ID NO: 2031998 - DNA, 20 bp, Homo sapiens
cgccctgcagaccctgccct

SEQ ID NO: 2031999 - DNA, 21 bp, Homo sapiens
cgccctgcagaccctgccctt

SEQ ID NO: 2032000 - DNA, 18 bp, Homo sapiens
cgccctgcgttggagcca

SEQ ID NO: 2032001 - DNA, 12 bp, Homo sapiens
cgccctgggctg

SEQ ID NO: 2032002 - DNA, 15 bp, Homo sapiens
cgcctaggcctgtga

SEQ ID NO: 2032003 - DNA, 21 bp, Homo sapiens
cgcctagtggggtctccctct

SEQ ID NO: 2032004 - DNA, 22 bp, Homo sapiens
cgcctcaatgtggttgcaaggc

SEQ ID NO: 2032005 - DNA, 14 bp, Homo sapiens
cgcctccaggagcc

SEQ ID NO: 2032006 - DNA, 19 bp, Homo sapiens
cgcctccaggagcctaccc

SEQ ID NO: 2032007 - DNA, 21 bp, Homo sapiens
cgcctccatttttgttgttat

SEQ ID NO: 2032008 - DNA, 15 bp, Homo sapiens
cgcctcccagcctgg

SEQ ID NO: 2032009 - DNA, 10 bp, Homo sapiens
cgcctccccg

SEQ ID NO: 2032010 - DNA, 22 bp, Homo sapiens
cgcctccccgaaacaggctact

SEQ ID NO: 2032011 - DNA, 13 bp, Homo sapiens
cgcctcctggcca

SEQ ID NO: 2032012 - DNA, 15 bp, Homo sapiens
cgcctcctggccaga

SEQ ID NO: 2032013 - DNA, 16 bp, Homo sapiens
cgcctcctggccagac

SEQ ID NO: 2032014 - DNA, 12 bp, Homo sapiens
cgcctctcccac

SEQ ID NO: 2032015 - DNA, 19 bp, Homo sapiens
cgcctctgcccgcagagcc

SEQ ID NO: 2032016 - DNA, 20 bp, Homo sapiens
cgcctctgcccgcagagccc

SEQ ID NO: 2032017 - DNA, 19 bp, Homo sapiens
cgcctcttcttcttcagaa

SEQ ID NO: 2032018 - DNA, 20 bp, Homo sapiens
cgcctcttttccctctctag

SEQ ID NO: 2032019 - DNA, 17 bp, Homo sapiens
cgcctgagcccagggag

SEQ ID NO: 2032020 - DNA, 19 bp, Homo sapiens
cgcctgagcccagggaggc

SEQ ID NO: 2032021 - DNA, 22 bp, Homo sapiens
cgcctgccataccgctggggaa

SEQ ID NO: 2032022 - DNA, 14 bp, Homo sapiens
cgcctgcccagcct

SEQ ID NO: 2032023 - DNA, 18 bp, Homo sapiens
cgcctgcccagcctcgca

SEQ ID NO: 2032024 - DNA, 18 bp, Homo sapiens
cgcctgcccccagcactc

SEQ ID NO: 2032025 - DNA, 19 bp, Homo sapiens
cgcctgcccccagcactcc

SEQ ID NO: 2032026 - DNA, 20 bp, Homo sapiens
cgcctgcccccagcactcct

SEQ ID NO: 2032027 - DNA, 18 bp, Homo sapiens
cgcctgccctccctgggg

SEQ ID NO: 2032028 - DNA, 15 bp, Homo sapiens
cgcctgggcccaggc

SEQ ID NO: 2032029 - DNA, 16 bp, Homo sapiens
cgcctgggcccaggct

SEQ ID NO: 2032030 - DNA, 18 bp, Homo sapiens
cgcctgtagtcccagcca

SEQ ID NO: 2032031 - DNA, 17 bp, Homo sapiens
cgcctgtagtcctagcc

SEQ ID NO: 2032032 - DNA, 16 bp, Homo sapiens
cgcctgtcctgcctct

SEQ ID NO: 2032033 - DNA, 21 bp, Homo sapiens
cgcctgtgcccacgtgtgcag

SEQ ID NO: 2032034 - DNA, 18 bp, Homo sapiens
cgccttcctcctccacag

SEQ ID NO: 2032035 - DNA, 11 bp, Homo sapiens
cgcgcacacac

SEQ ID NO: 2032036 - DNA, 22 bp, Homo sapiens
cgcgcgaagtgggcattgcaaa

SEQ ID NO: 2032037 - DNA, 17 bp, Homo sapiens
cgcggcttggccgccat

SEQ ID NO: 2032038 - DNA, 13 bp, Homo sapiens
cgcggtgctctgg

SEQ ID NO: 2032039 - DNA, 15 bp, Homo sapiens
cgcggtgctctggcg

SEQ ID NO: 2032040 - DNA, 16 bp, Homo sapiens
cgcggtgctctggcgg

SEQ ID NO: 2032041 - DNA, 13 bp, Homo sapiens
cgcgtagagagcc

SEQ ID NO: 2032042 - DNA, 17 bp, Homo sapiens
cgcgtctaccctgggat

SEQ ID NO: 2032043 - DNA, 13 bp, Homo sapiens
cgcgtctgcccca

SEQ ID NO: 2032044 - DNA, 16 bp, Homo sapiens
cgcgtgcacacaccag

SEQ ID NO: 2032045 - DNA, 15 bp, Homo sapiens
cgctaagacctcccc

SEQ ID NO: 2032046 - DNA, 16 bp, Homo sapiens
cgctacaccactctgg

SEQ ID NO: 2032047 - DNA, 17 bp, Homo sapiens
cgctacaccactctggc

SEQ ID NO: 2032048 - DNA, 17 bp, Homo sapiens
cgctagagcagcccaaa

SEQ ID NO: 2032049 - DNA, 22 bp, Homo sapiens
cgctcagcaatagggtgcagtt

SEQ ID NO: 2032050 - DNA, 12 bp, Homo sapiens
cgctcagccctc

SEQ ID NO: 2032051 - DNA, 15 bp, Homo sapiens
cgctcaggacccagg

SEQ ID NO: 2032052 - DNA, 14 bp, Homo sapiens
cgtgagccactgca

SEQ ID NO: 2032053 - DNA, 15 bp, Homo sapiens
cgtgagccactgcac

SEQ ID NO: 2032054 - DNA, 23 bp, Homo sapiens
cgtgatcaagttgaggggcttcc

SEQ ID NO: 2032055 - DNA, 23 bp, Homo sapiens
cgtgatgtagggtaaggtgcctt

SEQ ID NO: 2032056 - DNA, 21 bp, Homo sapiens
cgtgatttggaagagaggcac

SEQ ID NO: 2032057 - DNA, 14 bp, Homo sapiens
cgtgcacacaccag

SEQ ID NO: 2032058 - DNA, 20 bp, Homo sapiens
cgtgcacacaccagagccca

SEQ ID NO: 2032059 - DNA, 14 bp, Homo sapiens
cgtgcacagcgcgg

SEQ ID NO: 2032060 - DNA, 17 bp, Homo sapiens
cgtgcagggacaaagag

SEQ ID NO: 2032061 - DNA, 12 bp, Homo sapiens
cgtgcatttgtg

SEQ ID NO: 2032062 - DNA, 13 bp, Homo sapiens
cgtgcatttgtga

SEQ ID NO: 2032063 - DNA, 23 bp, Homo sapiens
cgtgccaagtccaggtcctggtg

SEQ ID NO: 2032064 - DNA, 13 bp, Homo sapiens
cgtgccaggcccg

SEQ ID NO: 2032065 - DNA, 19 bp, Homo sapiens
cgtgccaggcccggggctg

SEQ ID NO: 2032066 - DNA, 19 bp, Homo sapiens
cgtgccgggagaggactct

SEQ ID NO: 2032067 - DNA, 17 bp, Homo sapiens
cgtgccgttactctcca

SEQ ID NO: 2032068 - DNA, 15 bp, Homo sapiens
cgtgccttcagctct

SEQ ID NO: 2032069 - DNA, 16 bp, Homo sapiens
cgtgccttcagctcta

SEQ ID NO: 2032070 - DNA, 21 bp, Homo sapiens
cgtgcctttctctggctccag

SEQ ID NO: 2032071 - DNA, 22 bp, Homo sapiens
cgtgcctttctctggctccaga

SEQ ID NO: 2032072 - DNA, 22 bp, Homo sapiens
cgtgcgcaacaacaaggaccct

SEQ ID NO: 2032073 - DNA, 22 bp, Homo sapiens
cgtgcgtgttagtgtgtgtgca

SEQ ID NO: 2032074 - DNA, 17 bp, Homo sapiens
cgtgctcgcagcctggc

SEQ ID NO: 2032075 - DNA, 17 bp, Homo sapiens
cgtgctcttctgttctc

SEQ ID NO: 2032076 - DNA, 20 bp, Homo sapiens
cgtgctcttctgttctcaaa

SEQ ID NO: 2032077 - DNA, 16 bp, Homo sapiens
cgtgctttatttatgg

SEQ ID NO: 2032078 - DNA, 12 bp, Homo sapiens
cgtggacacctg

SEQ ID NO: 2032079 - DNA, 17 bp, Homo sapiens
cgtggaccttcctgcca

SEQ ID NO: 2032080 - DNA, 15 bp, Homo sapiens
cgtggagagctagga

SEQ ID NO: 2032081 - DNA, 13 bp, Homo sapiens
cgtggaggctgct

SEQ ID NO: 2032082 - DNA, 14 bp, Homo sapiens
cgtggaggctgctc

SEQ ID NO: 2032083 - DNA, 19 bp, Homo sapiens
cgtggaggtgaagtccctg

SEQ ID NO: 2032084 - DNA, 22 bp, Homo sapiens
cgtggaggtgaagtccctgttc

SEQ ID NO: 2032085 - DNA, 14 bp, Homo sapiens
cgtggcaaatataa

SEQ ID NO: 2032086 - DNA, 21 bp, Homo sapiens
cgtggcagataatcagcctct

SEQ ID NO: 2032087 - DNA, 21 bp, Homo sapiens
cgtggccttccccttttgcct

SEQ ID NO: 2032088 - DNA, 13 bp, Homo sapiens
cgtggccttgttc

SEQ ID NO: 2032089 - DNA, 13 bp, Homo sapiens
cgtggctgtggca

SEQ ID NO: 2032090 - DNA, 15 bp, Homo sapiens
cgtggctgtggcaca

SEQ ID NO: 2032091 - DNA, 19 bp, Homo sapiens
cgtggcttcccgctcagcc

SEQ ID NO: 2032092 - DNA, 22 bp, Homo sapiens
cgtgggagacaagaaatccctg

SEQ ID NO: 2032093 - DNA, 17 bp, Homo sapiens
cgtgggagagagacgtg

SEQ ID NO: 2032094 - DNA, 13 bp, Homo sapiens
cgtgggtggagga

SEQ ID NO: 2032095 - DNA, 23 bp, Homo sapiens
cgtgggtgtgtgtagccaaggtc

SEQ ID NO: 2032096 - DNA, 21 bp, Homo sapiens
cgtggtcaaggcccggcccca

SEQ ID NO: 2032097 - DNA, 13 bp, Homo sapiens
cgtggtctttgaa

SEQ ID NO: 2032098 - DNA, 16 bp, Homo sapiens
cgtggtctttgaataa

SEQ ID NO: 2032099 - DNA, 19 bp, Homo sapiens
cgtggtctttgaataaagt

SEQ ID NO: 2032100 - DNA, 14 bp, Homo sapiens
cgtggttccaagaa

SEQ ID NO: 2032101 - DNA, 20 bp, Homo sapiens
cgtgtagtggaagagcagcc

SEQ ID NO: 2032102 - DNA, 22 bp, Homo sapiens
cgtgtagtggaagagcagcctg

SEQ ID NO: 2032103 - DNA, 16 bp, Homo sapiens
cgtgtccagcacagaa

SEQ ID NO: 2032104 - DNA, 14 bp, Homo sapiens
cgtgtcccaaggag

SEQ ID NO: 2032105 - DNA, 17 bp, Homo sapiens
cgtgtcccaaggagctg

SEQ ID NO: 2032106 - DNA, 16 bp, Homo sapiens
cgtgtccccggcctca

SEQ ID NO: 2032107 - DNA, 17 bp, Homo sapiens
cgtgtccccggcctcag

SEQ ID NO: 2032108 - DNA, 14 bp, Homo sapiens
cgtgtcctgccttg

SEQ ID NO: 2032109 - DNA, 15 bp, Homo sapiens
cgtgtcgtgggtgtg

SEQ ID NO: 2032110 - DNA, 21 bp, Homo sapiens
cgtgtctataatggaaacatt

SEQ ID NO: 2032111 - DNA, 13 bp, Homo sapiens
cgtgtgcagactg

SEQ ID NO: 2032112 - DNA, 17 bp, Homo sapiens
cgttagaggagcaacag

SEQ ID NO: 2032113 - DNA, 13 bp, Homo sapiens
cgttcaccttctt

SEQ ID NO: 2032114 - DNA, 19 bp, Homo sapiens
cgttccaggagcacacggc

SEQ ID NO: 2032115 - DNA, 18 bp, Homo sapiens
cgttccttactgcagaat

SEQ ID NO: 2032116 - DNA, 23 bp, Homo sapiens
cgttcgaggcggtttccaggaag

SEQ ID NO: 2032117 - DNA, 14 bp, Homo sapiens
cgttctccagccca

SEQ ID NO: 2032118 - DNA, 17 bp, Homo sapiens
cgttctgctggcctgga

SEQ ID NO: 2032119 - DNA, 18 bp, Homo sapiens
cgttgaagaggaagggca

SEQ ID NO: 2032120 - DNA, 18 bp, Homo sapiens
cgttgacccctttccccc

SEQ ID NO: 2032121 - DNA, 19 bp, Homo sapiens
cgttgacccctttccccca

SEQ ID NO: 2032122 - DNA, 22 bp, Homo sapiens
cgttgacccctttcccccaccc

SEQ ID NO: 2032123 - DNA, 21 bp, Homo sapiens
cgttggaatcacctggagggc

SEQ ID NO: 2032124 - DNA, 11 bp, Homo sapiens
cgttggagcca

SEQ ID NO: 2032125 - DNA, 15 bp, Homo sapiens
cgttggttctgcact

SEQ ID NO: 2032126 - DNA, 18 bp, Homo sapiens
cgtttaagccaaaacaat

SEQ ID NO: 2032127 - DNA, 22 bp, Homo sapiens
cgtttaagccaaaacaatgttt

SEQ ID NO: 2032128 - DNA, 16 bp, Homo sapiens
cgtttatgggccttgc

SEQ ID NO: 2032129 - DNA, 18 bp, Homo sapiens
cgtttattaatgcctctc

SEQ ID NO: 2032130 - DNA, 20 bp, Homo sapiens
cgtttcctgagaagtgtcta

SEQ ID NO: 2032131 - DNA, 14 bp, Homo sapiens
cgttttcatcctgg

SEQ ID NO: 2032132 - DNA, 15 bp, Homo sapiens
cgttttggaagctct

SEQ ID NO: 2032133 - DNA, 13 bp, Homo sapiens
cgtttttcaagaa

SEQ ID NO: 2032134 - DNA, 17 bp, Homo sapiens
ctaaaaataaaatgatg

SEQ ID NO: 2032135 - DNA, 17 bp, Homo sapiens
ctaaaaataagctttat

SEQ ID NO: 2032136 - DNA, 22 bp, Homo sapiens
ctaaaaatattataacttaaaa

SEQ ID NO: 2032137 - DNA, 19 bp, Homo sapiens
ctaaaacaaaacaaaaaac

SEQ ID NO: 2032138 - DNA, 13 bp, Homo sapiens
ctaaaactatggt

SEQ ID NO: 2032139 - DNA, 16 bp, Homo sapiens
ctaaaagaatttaaat

SEQ ID NO: 2032140 - DNA, 22 bp, Homo sapiens
ctaaaagtggtttttatttcct

SEQ ID NO: 2032141 - DNA, 14 bp, Homo sapiens
ctaaaataaaaacc

SEQ ID NO: 2032142 - DNA, 15 bp, Homo sapiens
ctaaaataaaaacca

SEQ ID NO: 2032143 - DNA, 19 bp, Homo sapiens
ctaaaataaaaaccagaat

SEQ ID NO: 2032144 - DNA, 18 bp, Homo sapiens
ctaaaatagatcctaggt

SEQ ID NO: 2032145 - DNA, 16 bp, Homo sapiens
ctaaacagactattta

SEQ ID NO: 2032146 - DNA, 17 bp, Homo sapiens
ctaaacagatataaatg

SEQ ID NO: 2032147 - DNA, 18 bp, Homo sapiens
ctaaacccccgctccaga

SEQ ID NO: 2032148 - DNA, 17 bp, Homo sapiens
ctaaagaaaaacaaact

SEQ ID NO: 2032149 - DNA, 14 bp, Homo sapiens
ctaaagacagaaaa

SEQ ID NO: 2032150 - DNA, 19 bp, Homo sapiens
ctaaagagttattcaaatg

SEQ ID NO: 2032151 - DNA, 22 bp, Homo sapiens
ctaaagagttattcaaatgaag

SEQ ID NO: 2032152 - DNA, 11 bp, Homo sapiens
ctaaagcagtg

SEQ ID NO: 2032153 - DNA, 18 bp, Homo sapiens
ctaaagcagtggacacca

SEQ ID NO: 2032154 - DNA, 17 bp, Homo sapiens
ctaaagcccaacctcct

SEQ ID NO: 2032155 - DNA, 21 bp, Homo sapiens
ctaaaggtagatcatcttgaa

SEQ ID NO: 2032156 - DNA, 16 bp, Homo sapiens
ctaaagtatgtaaagt

SEQ ID NO: 2032157 - DNA, 16 bp, Homo sapiens
ctaaagtcacatataa

SEQ ID NO: 2032158 - DNA, 13 bp, Homo sapiens
ctaaagtgtctat

SEQ ID NO: 2032159 - DNA, 13 bp, Homo sapiens
ctaaagtttacag

SEQ ID NO: 2032160 - DNA, 14 bp, Homo sapiens
ctaaagtttacagt

SEQ ID NO: 2032161 - DNA, 15 bp, Homo sapiens
ctaaatactgtacat

SEQ ID NO: 2032162 - DNA, 16 bp, Homo sapiens
ctaaatactgtacata

SEQ ID NO: 2032163 - DNA, 12 bp, Homo sapiens
ctaaatatatgt

SEQ ID NO: 2032164 - DNA, 13 bp, Homo sapiens
ctaaatatatgtc

SEQ ID NO: 2032165 - DNA, 12 bp, Homo sapiens
ctaaatatttca

SEQ ID NO: 2032166 - DNA, 13 bp, Homo sapiens
ctaaatccaaaga

SEQ ID NO: 2032167 - DNA, 14 bp, Homo sapiens
cggccctatgcatg

SEQ ID NO: 2032168 - DNA, 18 bp, Homo sapiens
cggccctcaaaagcactt

SEQ ID NO: 2032169 - DNA, 19 bp, Homo sapiens
cggccctgccccatcctgg

SEQ ID NO: 2032170 - DNA, 21 bp, Homo sapiens
cggccctgccccatcctgggc

SEQ ID NO: 2032171 - DNA, 22 bp, Homo sapiens
cggccctgccccatcctgggcc

SEQ ID NO: 2032172 - DNA, 16 bp, Homo sapiens
cggccgcattccctga

SEQ ID NO: 2032173 - DNA, 19 bp, Homo sapiens
cggcctatgacttgggcac

SEQ ID NO: 2032174 - DNA, 12 bp, Homo sapiens
cggcctccactc

SEQ ID NO: 2032175 - DNA, 17 bp, Homo sapiens
cggcctcttccacccat

SEQ ID NO: 2032176 - DNA, 13 bp, Homo sapiens
cggcctgctccca

SEQ ID NO: 2032177 - DNA, 14 bp, Homo sapiens
cggcctgctcccag

SEQ ID NO: 2032178 - DNA, 15 bp, Homo sapiens
cggcgccaccatcct

SEQ ID NO: 2032179 - DNA, 20 bp, Homo sapiens
cggcgcggtggctcacgcct

SEQ ID NO: 2032180 - DNA, 13 bp, Homo sapiens
cggcgctgcaggt

SEQ ID NO: 2032181 - DNA, 20 bp, Homo sapiens
cggcggccctcaaaagcact

SEQ ID NO: 2032182 - DNA, 13 bp, Homo sapiens
cggctactcagca

SEQ ID NO: 2032183 - DNA, 14 bp, Homo sapiens
cggctactcagcag

SEQ ID NO: 2032184 - DNA, 16 bp, Homo sapiens
cggctactcagcagcc

SEQ ID NO: 2032185 - DNA, 18 bp, Homo sapiens
cggctactcagcagccct

SEQ ID NO: 2032186 - DNA, 20 bp, Homo sapiens
cggctactcagcagccctcc

SEQ ID NO: 2032187 - DNA, 21 bp, Homo sapiens
cggctactcagcagccctcct

SEQ ID NO: 2032188 - DNA, 19 bp, Homo sapiens
cggctcactgcagcctcaa

SEQ ID NO: 2032189 - DNA, 13 bp, Homo sapiens
cggctccaggctc

SEQ ID NO: 2032190 - DNA, 14 bp, Homo sapiens
cggctccaggctcc

SEQ ID NO: 2032191 - DNA, 14 bp, Homo sapiens
cggctccaggtccg

SEQ ID NO: 2032192 - DNA, 20 bp, Homo sapiens
cggctccaggtccggagggg

SEQ ID NO: 2032193 - DNA, 22 bp, Homo sapiens
cggctccagtttccccatgggg

SEQ ID NO: 2032194 - DNA, 14 bp, Homo sapiens
cggctccccctgct

SEQ ID NO: 2032195 - DNA, 22 bp, Homo sapiens
cggctccccctgcttctcagcc

SEQ ID NO: 2032196 - DNA, 23 bp, Homo sapiens
cggctgagtcatgatctccctgc

SEQ ID NO: 2032197 - DNA, 13 bp, Homo sapiens
cggctgcctgccg

SEQ ID NO: 2032198 - DNA, 17 bp, Homo sapiens
cggctgcctgccgccca

SEQ ID NO: 2032199 - DNA, 15 bp, Homo sapiens
cggcttcctgtccac

SEQ ID NO: 2032200 - DNA, 17 bp, Homo sapiens
cgggaaagaatataaag

SEQ ID NO: 2032201 - DNA, 12 bp, Homo sapiens
cgggaaattatt

SEQ ID NO: 2032202 - DNA, 20 bp, Homo sapiens
cgggaacagtgtttcccata

SEQ ID NO: 2032203 - DNA, 22 bp, Homo sapiens
cgggaacagtgtttcccataat

SEQ ID NO: 2032204 - DNA, 21 bp, Homo sapiens
cgggaagcctccgtcaggaga

SEQ ID NO: 2032205 - DNA, 12 bp, Homo sapiens
cgggaaggaggg

SEQ ID NO: 2032206 - DNA, 15 bp, Homo sapiens
cgggacacctgccct

SEQ ID NO: 2032207 - DNA, 18 bp, Homo sapiens
cgggacacctgccctgcc

SEQ ID NO: 2032208 - DNA, 12 bp, Homo sapiens
cgggacagacct

SEQ ID NO: 2032209 - DNA, 17 bp, Homo sapiens
cgggacatgcagctctg

SEQ ID NO: 2032210 - DNA, 19 bp, Homo sapiens
cgggaccccctggccctgc

SEQ ID NO: 2032211 - DNA, 21 bp, Homo sapiens
cgggacgagaccctacaggag

SEQ ID NO: 2032212 - DNA, 13 bp, Homo sapiens
cgggacgcttcca

SEQ ID NO: 2032213 - DNA, 16 bp, Homo sapiens
cgggacgcttccagac

SEQ ID NO: 2032214 - DNA, 18 bp, Homo sapiens
cgggacgcttccagacca

SEQ ID NO: 2032215 - DNA, 19 bp, Homo sapiens
cgggacgcttccagaccac

SEQ ID NO: 2032216 - DNA, 23 bp, Homo sapiens
cgggacgcttccagaccacctgc

SEQ ID NO: 2032217 - DNA, 14 bp, Homo sapiens
cgggagcatctctt

SEQ ID NO: 2032218 - DNA, 14 bp, Homo sapiens
cgggagcctccccc

SEQ ID NO: 2032219 - DNA, 14 bp, Homo sapiens
cgggagcctcctct

SEQ ID NO: 2032220 - DNA, 20 bp, Homo sapiens
cgggaggatgttctgggaca

SEQ ID NO: 2032221 - DNA, 15 bp, Homo sapiens
cgggaggcaccagct

SEQ ID NO: 2032222 - DNA, 14 bp, Homo sapiens
cgggaggcctcagt

SEQ ID NO: 2032223 - DNA, 16 bp, Homo sapiens
cgggaggcctcagttc

SEQ ID NO: 2032224 - DNA, 16 bp, Homo sapiens
cgggaggctgagacag

SEQ ID NO: 2032225 - DNA, 17 bp, Homo sapiens
cgggaggctgagacagg

SEQ ID NO: 2032226 - DNA, 17 bp, Homo sapiens
cgggaggctgaggcagg

SEQ ID NO: 2032227 - DNA, 18 bp, Homo sapiens
cgggataacaaaatcaca

SEQ ID NO: 2032228 - DNA, 16 bp, Homo sapiens
cgggatggtcctgggg

SEQ ID NO: 2032229 - DNA, 14 bp, Homo sapiens
cgggcacctgtagt

SEQ ID NO: 2032230 - DNA, 14 bp, Homo sapiens
cgggcagcccagcc

SEQ ID NO: 2032231 - DNA, 15 bp, Homo sapiens
cgggcagcccagcct

SEQ ID NO: 2032232 - DNA, 17 bp, Homo sapiens
cgggcagcccagcctct

SEQ ID NO: 2032233 - DNA, 17 bp, Homo sapiens
cgggcaggtcctgccca

SEQ ID NO: 2032234 - DNA, 21 bp, Homo sapiens
cgggcatggtggcgcaagcct

SEQ ID NO: 2032235 - DNA, 18 bp, Homo sapiens
cgggccactccttcctgc

SEQ ID NO: 2032236 - DNA, 19 bp, Homo sapiens
cgggccactccttcctgcc

SEQ ID NO: 2032237 - DNA, 22 bp, Homo sapiens
cgggccactccttcctgcccca

SEQ ID NO: 2032238 - DNA, 20 bp, Homo sapiens
cgggccatgctttccttttc

SEQ ID NO: 2032239 - DNA, 21 bp, Homo sapiens
cgggccccccacacgcgtgtg

SEQ ID NO: 2032240 - DNA, 18 bp, Homo sapiens
cgggcctcttccctcagt

SEQ ID NO: 2032241 - DNA, 17 bp, Homo sapiens
cgggcgctgtggctcct

SEQ ID NO: 2032242 - DNA, 20 bp, Homo sapiens
cgggcgctgtggctcctgcc

SEQ ID NO: 2032243 - DNA, 13 bp, Homo sapiens
cgggcggaggcgg

SEQ ID NO: 2032244 - DNA, 11 bp, Homo sapiens
cgggctcagca

SEQ ID NO: 2032245 - DNA, 15 bp, Homo sapiens
cgggctctgacagcc

SEQ ID NO: 2032246 - DNA, 23 bp, Homo sapiens
cgggctgcccttcgctgccagga

SEQ ID NO: 2032247 - DNA, 16 bp, Homo sapiens
cgggctgggagctctg

SEQ ID NO: 2032248 - DNA, 20 bp, Homo sapiens
cgggcttgggccctgcacag

SEQ ID NO: 2032249 - DNA, 15 bp, Homo sapiens
cgggcttttccccgg

SEQ ID NO: 2032250 - DNA, 21 bp, Homo sapiens
cggggaacccagccctggggt

SEQ ID NO: 2032251 - DNA, 22 bp, Homo sapiens
cggggaactggccaagctgagg

SEQ ID NO: 2032252 - DNA, 22 bp, Homo sapiens
cggggacagctccttctgtcct

SEQ ID NO: 2032253 - DNA, 23 bp, Homo sapiens
cggggacagctccttctgtccta

SEQ ID NO: 2032254 - DNA, 14 bp, Homo sapiens
cggggaggaggagc

SEQ ID NO: 2032255 - DNA, 18 bp, Homo sapiens
cggggcaggaggcctggc

SEQ ID NO: 2032256 - DNA, 21 bp, Homo sapiens
cggggcaggaggcctggcctt

SEQ ID NO: 2032257 - DNA, 15 bp, Homo sapiens
cggggccccagggct

SEQ ID NO: 2032258 - DNA, 21 bp, Homo sapiens
cggggcccttggggcctggct

SEQ ID NO: 2032259 - DNA, 21 bp, Homo sapiens
cggggcgacccctcagtgctc

SEQ ID NO: 2032260 - DNA, 13 bp, Homo sapiens
cggggctgggaag

SEQ ID NO: 2032261 - DNA, 18 bp, Homo sapiens
cggggcttctgggtggct

SEQ ID NO: 2032262 - DNA, 23 bp, Homo sapiens
cggggcttctgggtggctcctgc

SEQ ID NO: 2032263 - DNA, 17 bp, Homo sapiens
cgggggccagacacaga

SEQ ID NO: 2032264 - DNA, 18 bp, Homo sapiens
cgggggccagacacagat

SEQ ID NO: 2032265 - DNA, 22 bp, Homo sapiens
cgggggcccgaaagctgagacc

SEQ ID NO: 2032266 - DNA, 17 bp, Homo sapiens
cggggtctgtgctgtgc

SEQ ID NO: 2032267 - DNA, 16 bp, Homo sapiens
cggggtgcacaggagg

SEQ ID NO: 2032268 - DNA, 12 bp, Homo sapiens
cggggtgcagaa

SEQ ID NO: 2032269 - DNA, 15 bp, Homo sapiens
cggggtgctgtggtg

SEQ ID NO: 2032270 - DNA, 18 bp, Homo sapiens
cgggtacctcagtttctc

SEQ ID NO: 2032271 - DNA, 15 bp, Homo sapiens
cgggtccccagctcc

SEQ ID NO: 2032272 - DNA, 20 bp, Homo sapiens
cgggtccccagctccccagg

SEQ ID NO: 2032273 - DNA, 22 bp, Homo sapiens
cgggtctcacttataccaaagg

SEQ ID NO: 2032274 - DNA, 22 bp, Homo sapiens
cgggtgcatttgagagaagcca

SEQ ID NO: 2032275 - DNA, 19 bp, Homo sapiens
cgggtggatcacctgaggt

SEQ ID NO: 2032276 - DNA, 15 bp, Homo sapiens
cgggtgggcctggcc

SEQ ID NO: 2032277 - DNA, 20 bp, Homo sapiens
cgggtgggcctggcctgagc

SEQ ID NO: 2032278 - DNA, 18 bp, Homo sapiens
cgggtgtgcctgccctgg

SEQ ID NO: 2032279 - DNA, 19 bp, Homo sapiens
cgggtgtgcctgccctgga

SEQ ID NO: 2032280 - DNA, 20 bp, Homo sapiens
cgggtgtggcctcagccctc

SEQ ID NO: 2032281 - DNA, 21 bp, Homo sapiens
cgggttttattgtttaaaatc

SEQ ID NO: 2032282 - DNA, 12 bp, Homo sapiens
cggtactcccat

SEQ ID NO: 2032283 - DNA, 19 bp, Homo sapiens
ctgtgaacccaggacaagc

SEQ ID NO: 2032284 - DNA, 15 bp, Homo sapiens
ctgtgaagacccagc

SEQ ID NO: 2032285 - DNA, 17 bp, Homo sapiens
ctgtgaagacccagcag

SEQ ID NO: 2032286 - DNA, 19 bp, Homo sapiens
ctgtgaagacccagcagga

SEQ ID NO: 2032287 - DNA, 21 bp, Homo sapiens
ctgtgaagacccagcaggaag

SEQ ID NO: 2032288 - DNA, 19 bp, Homo sapiens
ctgtgaattgagctgcaga

SEQ ID NO: 2032289 - DNA, 21 bp, Homo sapiens
ctgtgaattgagctgcagaaa

SEQ ID NO: 2032290 - DNA, 19 bp, Homo sapiens
ctgtgacaccagaataatg

SEQ ID NO: 2032291 - DNA, 18 bp, Homo sapiens
ctgtgacctgctgagctc

SEQ ID NO: 2032292 - DNA, 20 bp, Homo sapiens
ctgtgacctgctgagctctg

SEQ ID NO: 2032293 - DNA, 14 bp, Homo sapiens
ctgtgactcttttt

SEQ ID NO: 2032294 - DNA, 14 bp, Homo sapiens
ctgtgactgatgtt

SEQ ID NO: 2032295 - DNA, 22 bp, Homo sapiens
ctgtgacttcagctctgtttta

SEQ ID NO: 2032296 - DNA, 14 bp, Homo sapiens
ctgtgagcccctgg

SEQ ID NO: 2032297 - DNA, 15 bp, Homo sapiens
ctgtgagcccctggt

SEQ ID NO: 2032298 - DNA, 16 bp, Homo sapiens
ctgtgagcccctggtc

SEQ ID NO: 2032299 - DNA, 17 bp, Homo sapiens
ctgtgaggaaagcacac

SEQ ID NO: 2032300 - DNA, 20 bp, Homo sapiens
ctgtgaggaaagcacacagt

SEQ ID NO: 2032301 - DNA, 16 bp, Homo sapiens
ctgtgaggggaaggcc

SEQ ID NO: 2032302 - DNA, 17 bp, Homo sapiens
ctgtgaggggaaggcct

SEQ ID NO: 2032303 - DNA, 15 bp, Homo sapiens
ctgtgaggtgctgat

SEQ ID NO: 2032304 - DNA, 19 bp, Homo sapiens
ctgtgaggtgctgatgagt

SEQ ID NO: 2032305 - DNA, 21 bp, Homo sapiens
ctgtgaggtgctgatgagtga

SEQ ID NO: 2032306 - DNA, 16 bp, Homo sapiens
ctgtgtagctgtgacc

SEQ ID NO: 2032307 - DNA, 23 bp, Homo sapiens
ctgtgtagctgtgacctgctgag

SEQ ID NO: 2032308 - DNA, 23 bp, Homo sapiens
ctgtgtattttttaaagctacaa

SEQ ID NO: 2032309 - DNA, 21 bp, Homo sapiens
ctgtgtcaggtggggcagctt

SEQ ID NO: 2032310 - DNA, 22 bp, Homo sapiens
ctgtgtcaggtggggcagcttg

SEQ ID NO: 2032311 - DNA, 12 bp, Homo sapiens
ctgtgtccaatt

SEQ ID NO: 2032312 - DNA, 16 bp, Homo sapiens
ctgtgtccagcagctg

SEQ ID NO: 2032313 - DNA, 21 bp, Homo sapiens
ctgtgtcccccccagtgcagg

SEQ ID NO: 2032314 - DNA, 13 bp, Homo sapiens
ctgtgtcctctcc

SEQ ID NO: 2032315 - DNA, 19 bp, Homo sapiens
ctgtgtccttgcacctgca

SEQ ID NO: 2032316 - DNA, 22 bp, Homo sapiens
ctgtgtccttgcacctgcatcc

SEQ ID NO: 2032317 - DNA, 14 bp, Homo sapiens
ctgtgtcttgcaat

SEQ ID NO: 2032318 - DNA, 23 bp, Homo sapiens
ctgtgtcttgcaatggcagcctt

SEQ ID NO: 2032319 - DNA, 12 bp, Homo sapiens
ctgtgtgaaata

SEQ ID NO: 2032320 - DNA, 19 bp, Homo sapiens
ctgtgtgaaataccagtgt

SEQ ID NO: 2032321 - DNA, 21 bp, Homo sapiens
ctgtgtgaaataccagtgtgg

SEQ ID NO: 2032322 - DNA, 13 bp, Homo sapiens
ctgtgtgaagaaa

SEQ ID NO: 2032323 - DNA, 14 bp, Homo sapiens
cttaacattgattt

SEQ ID NO: 2032324 - DNA, 15 bp, Homo sapiens
cttaacattgattta

SEQ ID NO: 2032325 - DNA, 12 bp, Homo sapiens
cttaaccagcac

SEQ ID NO: 2032326 - DNA, 17 bp, Homo sapiens
cttaagggttgaaggca

SEQ ID NO: 2032327 - DNA, 17 bp, Homo sapiens
cttaataaattcagata

SEQ ID NO: 2032328 - DNA, 16 bp, Homo sapiens
cttaatagtatttatg

SEQ ID NO: 2032329 - DNA, 19 bp, Homo sapiens
cttaatatatatatccaga

SEQ ID NO: 2032330 - DNA, 15 bp, Homo sapiens
cttaatgagaacatt

SEQ ID NO: 2032331 - DNA, 20 bp, Homo sapiens
cttaatgctttcctccctgg

SEQ ID NO: 2032332 - DNA, 20 bp, Homo sapiens
cttaatggctgataatttta

SEQ ID NO: 2032333 - DNA, 22 bp, Homo sapiens
cttaatgttctgaataatttct

SEQ ID NO: 2032334 - DNA, 17 bp, Homo sapiens
cttcaagttagctcagg

SEQ ID NO: 2032335 - DNA, 12 bp, Homo sapiens
cttcaataaagt

SEQ ID NO: 2032336 - DNA, 16 bp, Homo sapiens
cttcaataaattaagt

SEQ ID NO: 2032337 - DNA, 16 bp, Homo sapiens
cttcaattcctgggcc

SEQ ID NO: 2032338 - DNA, 13 bp, Homo sapiens
cttcacaaaatgc

SEQ ID NO: 2032339 - DNA, 14 bp, Homo sapiens
cttcacaaaatgca

SEQ ID NO: 2032340 - DNA, 15 bp, Homo sapiens
cttcacaaccagcca

SEQ ID NO: 2032341 - DNA, 15 bp, Homo sapiens
cttcccagaggcaga

SEQ ID NO: 2032342 - DNA, 16 bp, Homo sapiens
cttcccagaggcagag

SEQ ID NO: 2032343 - DNA, 11 bp, Homo sapiens
cttcccatcac

SEQ ID NO: 2032344 - DNA, 18 bp, Homo sapiens
cttcccatcactggagca

SEQ ID NO: 2032345 - DNA, 14 bp, Homo sapiens
cttcccatccccag

SEQ ID NO: 2032346 - DNA, 23 bp, Homo sapiens
cttcccatgatgccgctcttctg

SEQ ID NO: 2032347 - DNA, 13 bp, Homo sapiens
cttcccatttgta

SEQ ID NO: 2032348 - DNA, 12 bp, Homo sapiens
cttccccacaga

SEQ ID NO: 2032349 - DNA, 16 bp, Homo sapiens
cttccccacagaactg

SEQ ID NO: 2032350 - DNA, 23 bp, Homo sapiens
cttccccagactcagctccagaa

SEQ ID NO: 2032351 - DNA, 15 bp, Homo sapiens
cttccccctccaatc

SEQ ID NO: 2032352 - DNA, 16 bp, Homo sapiens
cttccccctcccaggg

SEQ ID NO: 2032353 - DNA, 15 bp, Homo sapiens
cttcccctgcctggt

SEQ ID NO: 2032354 - DNA, 18 bp, Homo sapiens
cttccccttctgtgtcac

SEQ ID NO: 2032355 - DNA, 23 bp, Homo sapiens
cttccccttgcccagggctcagc

SEQ ID NO: 2032356 - DNA, 23 bp, Homo sapiens
cttccccttgcccttgccctgac

SEQ ID NO: 2032357 - DNA, 16 bp, Homo sapiens
cttccccttttgcctg

SEQ ID NO: 2032358 - DNA, 17 bp, Homo sapiens
cttcccgctcagccctc

SEQ ID NO: 2032359 - DNA, 11 bp, Homo sapiens
cttccctccaa

SEQ ID NO: 2032360 - DNA, 20 bp, Homo sapiens
cttccctccccacagtcctc

SEQ ID NO: 2032361 - DNA, 12 bp, Homo sapiens
cttccctccttc

SEQ ID NO: 2032362 - DNA, 14 bp, Homo sapiens
cttccctccttccc

SEQ ID NO: 2032363 - DNA, 22 bp, Homo sapiens
cttccctctttccccacctctt

SEQ ID NO: 2032364 - DNA, 17 bp, Homo sapiens
cttccctgctttgagga

SEQ ID NO: 2032365 - DNA, 12 bp, Homo sapiens
cttccctgggaa

SEQ ID NO: 2032366 - DNA, 20 bp, Homo sapiens
cttccctgggaactcatcct

SEQ ID NO: 2032367 - DNA, 15 bp, Homo sapiens
cttccctgttttaaa

SEQ ID NO: 2032368 - DNA, 17 bp, Homo sapiens
cttcccttctctccttc

SEQ ID NO: 2032369 - DNA, 22 bp, Homo sapiens
cttccgctcctttacctaccac

SEQ ID NO: 2032370 - DNA, 17 bp, Homo sapiens
cttcctagttttctcct

SEQ ID NO: 2032371 - DNA, 23 bp, Homo sapiens
cttcctagttttctcctcccagg

SEQ ID NO: 2032372 - DNA, 18 bp, Homo sapiens
cttcctcagtcctggaag

SEQ ID NO: 2032373 - DNA, 14 bp, Homo sapiens
cttcctcatcccct

SEQ ID NO: 2032374 - DNA, 22 bp, Homo sapiens
cttcctccgtccacccaggctg

SEQ ID NO: 2032375 - DNA, 23 bp, Homo sapiens
cttcctcctccacagtgctgctt

SEQ ID NO: 2032376 - DNA, 16 bp, Homo sapiens
cttcctcctcctttgc

SEQ ID NO: 2032377 - DNA, 18 bp, Homo sapiens
cttcctcctcctttgcct

SEQ ID NO: 2032378 - DNA, 19 bp, Homo sapiens
cttcctcctgaagcctctg

SEQ ID NO: 2032379 - DNA, 13 bp, Homo sapiens
cttcctcctgatg

SEQ ID NO: 2032380 - DNA, 21 bp, Homo sapiens
cttcctctccactgccttcga

SEQ ID NO: 2032381 - DNA, 12 bp, Homo sapiens
cttcctctccag

SEQ ID NO: 2032382 - DNA, 11 bp, Homo sapiens
cttcctctgct

SEQ ID NO: 2032383 - DNA, 19 bp, Homo sapiens
cttcctctgttctatccca

SEQ ID NO: 2032384 - DNA, 23 bp, Homo sapiens
cttcctgactgacacaggccagc

SEQ ID NO: 2032385 - DNA, 15 bp, Homo sapiens
cttcctgcaaggact

SEQ ID NO: 2032386 - DNA, 11 bp, Homo sapiens
cttcctgcacc

SEQ ID NO: 2032387 - DNA, 15 bp, Homo sapiens
cttcctgcacccgta

SEQ ID NO: 2032388 - DNA, 15 bp, Homo sapiens
cttcctgccaagcca

SEQ ID NO: 2032389 - DNA, 21 bp, Homo sapiens
cttcctgccccaactccttcc

SEQ ID NO: 2032390 - DNA, 15 bp, Homo sapiens
cttcctgctgctgta

SEQ ID NO: 2032391 - DNA, 15 bp, Homo sapiens
cttcctggacagctg

SEQ ID NO: 2032392 - DNA, 16 bp, Homo sapiens
cttcctggacagctgt

SEQ ID NO: 2032393 - DNA, 20 bp, Homo sapiens
cttcctggacagctgtgcct

SEQ ID NO: 2032394 - DNA, 21 bp, Homo sapiens
cttcctggacagctgtgcctc

SEQ ID NO: 2032395 - DNA, 22 bp, Homo sapiens
cttcctggacagctgtgcctcg

SEQ ID NO: 2032396 - DNA, 23 bp, Homo sapiens
cttcctggacagctgtgcctcgc

SEQ ID NO: 2032397 - DNA, 18 bp, Homo sapiens
cttcctggcctcactggc

SEQ ID NO: 2032398 - DNA, 19 bp, Homo sapiens
cttcctggcctcactggct

SEQ ID NO: 2032399 - DNA, 17 bp, Homo sapiens
cttcctggggccccgct

SEQ ID NO: 2032400 - DNA, 21 bp, Homo sapiens
cttcctgggtcctgttcccta

SEQ ID NO: 2032401 - DNA, 23 bp, Homo sapiens
cttcctgggtcctgttccctacc

SEQ ID NO: 2032402 - DNA, 19 bp, Homo sapiens
cttcctggtgaggcccagc

SEQ ID NO: 2032403 - DNA, 20 bp, Homo sapiens
cttcctggtgaggcccagcc

SEQ ID NO: 2032404 - DNA, 22 bp, Homo sapiens
cttcctggtgaggcccagcctg

SEQ ID NO: 2032405 - DNA, 21 bp, Homo sapiens
cttcctgtcccacctcttctc

SEQ ID NO: 2032406 - DNA, 18 bp, Homo sapiens
cttcctgtgggccaggag

SEQ ID NO: 2032407 - DNA, 22 bp, Homo sapiens
cttcctgtgtactctttatttc

SEQ ID NO: 2032408 - DNA, 13 bp, Homo sapiens
cttccttcatttc

SEQ ID NO: 2032409 - DNA, 13 bp, Homo sapiens
cttccttccccca

SEQ ID NO: 2032410 - DNA, 14 bp, Homo sapiens
cttccttccctggc

SEQ ID NO: 2032411 - DNA, 14 bp, Homo sapiens
cttccttctgcacc

SEQ ID NO: 2032412 - DNA, 15 bp, Homo sapiens
cttccttctttctct

SEQ ID NO: 2032413 - DNA, 19 bp, Homo sapiens
cttccttggactcatttta

SEQ ID NO: 2032414 - DNA, 20 bp, Homo sapiens
cttccttggactcattttaa

SEQ ID NO: 2032415 - DNA, 19 bp, Homo sapiens
cttcctttaggtctggttg

SEQ ID NO: 2032416 - DNA, 11 bp, Homo sapiens
cttcctttcct

SEQ ID NO: 2032417 - DNA, 18 bp, Homo sapiens
cttcgactcaggatccag

SEQ ID NO: 2032418 - DNA, 21 bp, Homo sapiens
cttcgaggttgccccttcccc

SEQ ID NO: 2032419 - DNA, 16 bp, Homo sapiens
cttcgatacaccgggc

SEQ ID NO: 2032420 - DNA, 17 bp, Homo sapiens
cttcgctcctgtgtctt

SEQ ID NO: 2032421 - DNA, 13 bp, Homo sapiens
cttcgctgccagg

SEQ ID NO: 2032422 - DNA, 16 bp, Homo sapiens
cttcgctgccaggaca

SEQ ID NO: 2032423 - DNA, 17 bp, Homo sapiens
cttcgctgctctagctg

SEQ ID NO: 2032424 - DNA, 14 bp, Homo sapiens
cttcggggctggga

SEQ ID NO: 2032425 - DNA, 15 bp, Homo sapiens
cttcggggctgggaa

SEQ ID NO: 2032426 - DNA, 15 bp, Homo sapiens
cttcggtttctgagc

SEQ ID NO: 2032427 - DNA, 16 bp, Homo sapiens
cttcgtgtctctccca

SEQ ID NO: 2032428 - DNA, 21 bp, Homo sapiens
cttctaaaatgcttttaatta

SEQ ID NO: 2032429 - DNA, 16 bp, Homo sapiens
cttctaacctcagcca

SEQ ID NO: 2032430 - DNA, 22 bp, Homo sapiens
cttctaagtaaaaccacagcag

SEQ ID NO: 2032431 - DNA, 15 bp, Homo sapiens
cttctacaaccagag

SEQ ID NO: 2032432 - DNA, 17 bp, Homo sapiens
cttctacaaccagagcc

SEQ ID NO: 2032433 - DNA, 23 bp, Homo sapiens
cttctacaggcccggcccagcct

SEQ ID NO: 2032434 - DNA, 17 bp, Homo sapiens
cttctaccttaaaatgt

SEQ ID NO: 2032435 - DNA, 20 bp, Homo sapiens
cttctaggagtcaactggct

SEQ ID NO: 2032436 - DNA, 21 bp, Homo sapiens
cttctaggagtcaactggctg

SEQ ID NO: 2032437 - DNA, 21 bp, Homo sapiens
cttctatgcagtattgccaca

SEQ ID NO: 2032438 - DNA, 19 bp, Homo sapiens
cttctattatagccacatc

SEQ ID NO: 2032439 - DNA, 18 bp, Homo sapiens
cttctatttaaaaaataa

SEQ ID NO: 2032440 - DNA, 19 bp, Homo sapiens
cttctatttaaaaaataaa

SEQ ID NO: 2032441 - DNA, 13 bp, Homo sapiens
cttctattttatt

SEQ ID NO: 2032442 - DNA, 17 bp, Homo sapiens
cttctattttgtaaact

SEQ ID NO: 2032443 - DNA, 23 bp, Homo sapiens
cttctcagccccgggcctgcctc

SEQ ID NO: 2032444 - DNA, 18 bp, Homo sapiens
cttctcaggacacaggcc

SEQ ID NO: 2032445 - DNA, 21 bp, Homo sapiens
cttctcaggacacaggcctgt

SEQ ID NO: 2032446 - DNA, 19 bp, Homo sapiens
cttctccaacaagttgcct

SEQ ID NO: 2032447 - DNA, 18 bp, Homo sapiens
cttctccaccctgctctc

SEQ ID NO: 2032448 - DNA, 13 bp, Homo sapiens
cttctccactgga

SEQ ID NO: 2032449 - DNA, 23 bp, Homo sapiens
ctggatcctgctgtggcctcact

SEQ ID NO: 2032450 - DNA, 24 bp, Homo sapiens
ctggatcctgctgtggcctcactt

SEQ ID NO: 2032451 - DNA, 21 bp, Homo sapiens
ctggatctgggaccctttcct

SEQ ID NO: 2032452 - DNA, 13 bp, Homo sapiens
ctggatgagactt

SEQ ID NO: 2032453 - DNA, 21 bp, Homo sapiens
ctggatggatttgaagcaaag

SEQ ID NO: 2032454 - DNA, 17 bp, Homo sapiens
ctggatgggcattgggc

SEQ ID NO: 2032455 - DNA, 17 bp, Homo sapiens
ctggatgtcccctgtcc

SEQ ID NO: 2032456 - DNA, 19 bp, Homo sapiens
ctggatgtcccctgtccca

SEQ ID NO: 2032457 - DNA, 20 bp, Homo sapiens
ctggattttcagcgaacatg

SEQ ID NO: 2032458 - DNA, 20 bp, Homo sapiens
ctggattttcccctgaagac

SEQ ID NO: 2032459 - DNA, 22 bp, Homo sapiens
ctggcaagcagggaaagctcca

SEQ ID NO: 2032460 - DNA, 12 bp, Homo sapiens
ctggcacacatc

SEQ ID NO: 2032461 - DNA, 21 bp, Homo sapiens
ctggcacacatcaggagttca

SEQ ID NO: 2032462 - DNA, 14 bp, Homo sapiens
ctggcacaggactg

SEQ ID NO: 2032463 - DNA, 15 bp, Homo sapiens
ctggcacaggactga

SEQ ID NO: 2032464 - DNA, 18 bp, Homo sapiens
ctggcacccggcccctgc

SEQ ID NO: 2032465 - DNA, 21 bp, Homo sapiens
ctggcacccggcccctgctgg

SEQ ID NO: 2032466 - DNA, 22 bp, Homo sapiens
ctggcacccggcccctgctggt

SEQ ID NO: 2032467 - DNA, 15 bp, Homo sapiens
ctggcactcccctga

SEQ ID NO: 2032468 - DNA, 14 bp, Homo sapiens
ctggcacttggaga

SEQ ID NO: 2032469 - DNA, 17 bp, Homo sapiens
ctggcagagaaggatgt

SEQ ID NO: 2032470 - DNA, 13 bp, Homo sapiens
ctggcagccgtgc

SEQ ID NO: 2032471 - DNA, 20 bp, Homo sapiens
ctggcagctcctctccttgg

SEQ ID NO: 2032472 - DNA, 23 bp, Homo sapiens
ctggcagctcctctccttgggct

SEQ ID NO: 2032473 - DNA, 21 bp, Homo sapiens
ctggcagctgagagccctgct

SEQ ID NO: 2032474 - DNA, 21 bp, Homo sapiens
ctggcaggaagtctctcccga

SEQ ID NO: 2032475 - DNA, 18 bp, Homo sapiens
ctggcaggatgaccctgc

SEQ ID NO: 2032476 - DNA, 20 bp, Homo sapiens
ctggcaggtgcagatgggct

SEQ ID NO: 2032477 - DNA, 19 bp, Homo sapiens
ctggcatgaccatcctgtc

SEQ ID NO: 2032478 - DNA, 21 bp, Homo sapiens
ctggcatgaccatcctgtcct

SEQ ID NO: 2032479 - DNA, 21 bp, Homo sapiens
ctggcatgtcagagccaggct

SEQ ID NO: 2032480 - DNA, 23 bp, Homo sapiens
ctggcattaattattaataccaa

SEQ ID NO: 2032481 - DNA, 14 bp, Homo sapiens
ctggccaagctgag

SEQ ID NO: 2032482 - DNA, 17 bp, Homo sapiens
ctggccaagctgaggtg

SEQ ID NO: 2032483 - DNA, 12 bp, Homo sapiens
ctggccacccaa

SEQ ID NO: 2032484 - DNA, 12 bp, Homo sapiens
ctggccaccctg

SEQ ID NO: 2032485 - DNA, 13 bp, Homo sapiens
ctggccaccctgg

SEQ ID NO: 2032486 - DNA, 14 bp, Homo sapiens
ctggccaccctggc

SEQ ID NO: 2032487 - DNA, 14 bp, Homo sapiens
ctggccagacgctg

SEQ ID NO: 2032488 - DNA, 16 bp, Homo sapiens
ctggccagacgctgcc

SEQ ID NO: 2032489 - DNA, 15 bp, Homo sapiens
ctggccagagagggc

SEQ ID NO: 2032490 - DNA, 17 bp, Homo sapiens
ctggccagagagggccc

SEQ ID NO: 2032491 - DNA, 23 bp, Homo sapiens
ctggccagagagggcccagctgt

SEQ ID NO: 2032492 - DNA, 18 bp, Homo sapiens
ctggccagatgcaccagc

SEQ ID NO: 2032493 - DNA, 12 bp, Homo sapiens
ctggccagcacc

SEQ ID NO: 2032494 - DNA, 16 bp, Homo sapiens
ctggccaggagctgga

SEQ ID NO: 2032495 - DNA, 19 bp, Homo sapiens
ctggccagtcctagagctc

SEQ ID NO: 2032496 - DNA, 20 bp, Homo sapiens
ctggccagtcctagagctcc

SEQ ID NO: 2032497 - DNA, 22 bp, Homo sapiens
ctggccagtcctagagctcctg

SEQ ID NO: 2032498 - DNA, 18 bp, Homo sapiens
ctggccattttcttgcct

SEQ ID NO: 2032499 - DNA, 19 bp, Homo sapiens
ctggccattttcttgcctg

SEQ ID NO: 2032500 - DNA, 20 bp, Homo sapiens
ctggccattttcttgcctga

SEQ ID NO: 2032501 - DNA, 11 bp, Homo sapiens
ctggcccagcc

SEQ ID NO: 2032502 - DNA, 22 bp, Homo sapiens
ctggcccagccaactgccccgg

SEQ ID NO: 2032503 - DNA, 15 bp, Homo sapiens
ctggcccagggtagg

SEQ ID NO: 2032504 - DNA, 21 bp, Homo sapiens
ctggccccatgtctctcagaa

SEQ ID NO: 2032505 - DNA, 13 bp, Homo sapiens
ctggcccccctcc

SEQ ID NO: 2032506 - DNA, 21 bp, Homo sapiens
ctggccccgggctctggccac

SEQ ID NO: 2032507 - DNA, 22 bp, Homo sapiens
ctggcccctccagaccctgcct

SEQ ID NO: 2032508 - DNA, 23 bp, Homo sapiens
ctggcccctccagaccctgcctg

SEQ ID NO: 2032509 - DNA, 22 bp, Homo sapiens
ctggcccgtcatgttcctcaaa

SEQ ID NO: 2032510 - DNA, 15 bp, Homo sapiens
ctggccctgcctcat

SEQ ID NO: 2032511 - DNA, 14 bp, Homo sapiens
ctggccctgccttc

SEQ ID NO: 2032512 - DNA, 15 bp, Homo sapiens
ctggccctttctgga

SEQ ID NO: 2032513 - DNA, 15 bp, Homo sapiens
ctggccgcctccagg

SEQ ID NO: 2032514 - DNA, 19 bp, Homo sapiens
ctggccgcctccaggagcc

SEQ ID NO: 2032515 - DNA, 18 bp, Homo sapiens
ctggcctcacgcccagcc

SEQ ID NO: 2032516 - DNA, 15 bp, Homo sapiens
ctggcctcactggct

SEQ ID NO: 2032517 - DNA, 16 bp, Homo sapiens
ctggcctcactggctg

SEQ ID NO: 2032518 - DNA, 19 bp, Homo sapiens
ctggcctcactggctgggg

SEQ ID NO: 2032519 - DNA, 15 bp, Homo sapiens
ctggcctcagcagga

SEQ ID NO: 2032520 - DNA, 22 bp, Homo sapiens
ctggcctcccaataaagctgga

SEQ ID NO: 2032521 - DNA, 15 bp, Homo sapiens
ctggcctcctgcctc

SEQ ID NO: 2032522 - DNA, 14 bp, Homo sapiens
ctggcctctagaac

SEQ ID NO: 2032523 - DNA, 12 bp, Homo sapiens
ctggcctgagct

SEQ ID NO: 2032524 - DNA, 13 bp, Homo sapiens
ctggcctgagctg

SEQ ID NO: 2032525 - DNA, 14 bp, Homo sapiens
ctggcctgagctgg

SEQ ID NO: 2032526 - DNA, 23 bp, Homo sapiens
ctggcctgctgggaaccccgcag

SEQ ID NO: 2032527 - DNA, 21 bp, Homo sapiens
ctggcctggatctccccactc

SEQ ID NO: 2032528 - DNA, 17 bp, Homo sapiens
ctggcctggcacacatc

SEQ ID NO: 2032529 - DNA, 22 bp, Homo sapiens
ctggcctggcacacatcaggag

SEQ ID NO: 2032530 - DNA, 14 bp, Homo sapiens
ctggcctggccggc

SEQ ID NO: 2032531 - DNA, 15 bp, Homo sapiens
ctggcctggccggca

SEQ ID NO: 2032532 - DNA, 14 bp, Homo sapiens
ctggcctggctccc

SEQ ID NO: 2032533 - DNA, 18 bp, Homo sapiens
ctggcctgtggcaggcct

SEQ ID NO: 2032534 - DNA, 22 bp, Homo sapiens
ctggcctgtggcaggcctagga

SEQ ID NO: 2032535 - DNA, 22 bp, Homo sapiens
ctggccttgtcaggacccaggc

SEQ ID NO: 2032536 - DNA, 23 bp, Homo sapiens
ctggccttgtcaggacccaggcc

SEQ ID NO: 2032537 - DNA, 22 bp, Homo sapiens
ctggcgaggtgcggccaccacc

SEQ ID NO: 2032538 - DNA, 16 bp, Homo sapiens
ctggcggctactcagc

SEQ ID NO: 2032539 - DNA, 17 bp, Homo sapiens
ctggcggctactcagca

SEQ ID NO: 2032540 - DNA, 22 bp, Homo sapiens
ctggcggctactcagcagccct

SEQ ID NO: 2032541 - DNA, 23 bp, Homo sapiens
ctggcggctactcagcagccctc

SEQ ID NO: 2032542 - DNA, 19 bp, Homo sapiens
ctggcggggcaggaggcct

SEQ ID NO: 2032543 - DNA, 20 bp, Homo sapiens
ctggcggggcaggaggcctg

SEQ ID NO: 2032544 - DNA, 22 bp, Homo sapiens
ctggctactgggaaattactta

SEQ ID NO: 2032545 - DNA, 15 bp, Homo sapiens
ctggctcacccctct

SEQ ID NO: 2032546 - DNA, 22 bp, Homo sapiens
ctggctcacccctctcccccgc

SEQ ID NO: 2032547 - DNA, 18 bp, Homo sapiens
ctggctcccacaggccct

SEQ ID NO: 2032548 - DNA, 19 bp, Homo sapiens
ctggctcccacaggccctt

SEQ ID NO: 2032549 - DNA, 22 bp, Homo sapiens
ctggctcccacaggcccttcct

SEQ ID NO: 2032550 - DNA, 16 bp, Homo sapiens
ctggctccccacgagt

SEQ ID NO: 2032551 - DNA, 20 bp, Homo sapiens
ctggctccgtccaggagcct

SEQ ID NO: 2032552 - DNA, 13 bp, Homo sapiens
ctggctcctccag

SEQ ID NO: 2032553 - DNA, 18 bp, Homo sapiens
ctggctctcctgtagctc

SEQ ID NO: 2032554 - DNA, 14 bp, Homo sapiens
ctggctgaaaatca

SEQ ID NO: 2032555 - DNA, 23 bp, Homo sapiens
ctggctgaccccaaagagcctgg

SEQ ID NO: 2032556 - DNA, 21 bp, Homo sapiens
ctggctgaggatttcaagcct

SEQ ID NO: 2032557 - DNA, 18 bp, Homo sapiens
ctggctgccaggcgttgg

SEQ ID NO: 2032558 - DNA, 22 bp, Homo sapiens
ctggctgccaggcgttggtgcc

SEQ ID NO: 2032559 - DNA, 12 bp, Homo sapiens
ctggctgctctc

SEQ ID NO: 2032560 - DNA, 16 bp, Homo sapiens
ctggctggccagtctg

SEQ ID NO: 2032561 - DNA, 14 bp, Homo sapiens
ctggctggctgagg

SEQ ID NO: 2032562 - DNA, 15 bp, Homo sapiens
ctggctggctgaggg

SEQ ID NO: 2032563 - DNA, 18 bp, Homo sapiens
ctgcctacattccctggc

SEQ ID NO: 2032564 - DNA, 20 bp, Homo sapiens
ctgcctacattccctggcct

SEQ ID NO: 2032565 - DNA, 13 bp, Homo sapiens
ctgcctactcacg

SEQ ID NO: 2032566 - DNA, 14 bp, Homo sapiens
ctgcctactcacga

SEQ ID NO: 2032567 - DNA, 18 bp, Homo sapiens
ctgcctagaaaatgcaaa

SEQ ID NO: 2032568 - DNA, 19 bp, Homo sapiens
ctgcctatttattggggtg

SEQ ID NO: 2032569 - DNA, 13 bp, Homo sapiens
ctgcctcagcctc

SEQ ID NO: 2032570 - DNA, 16 bp, Homo sapiens
ctgcctcccagccctg

SEQ ID NO: 2032571 - DNA, 16 bp, Homo sapiens
ctgcctcccattctga

SEQ ID NO: 2032572 - DNA, 18 bp, Homo sapiens
ctgcctccctctccatat

SEQ ID NO: 2032573 - DNA, 15 bp, Homo sapiens
ctgcctcctcttcaa

SEQ ID NO: 2032574 - DNA, 17 bp, Homo sapiens
ctgcctctctgctccag

SEQ ID NO: 2032575 - DNA, 19 bp, Homo sapiens
ctgcctctctgctccagag

SEQ ID NO: 2032576 - DNA, 18 bp, Homo sapiens
ctgcctctgacacacagc

SEQ ID NO: 2032577 - DNA, 15 bp, Homo sapiens
ctgcctgaagtcaca

SEQ ID NO: 2032578 - DNA, 19 bp, Homo sapiens
ctgcctgaagtcacacagt

SEQ ID NO: 2032579 - DNA, 23 bp, Homo sapiens
ctgcctgaagtcacacagtgagt

SEQ ID NO: 2032580 - DNA, 19 bp, Homo sapiens
ctgcctgcagcctccccca

SEQ ID NO: 2032581 - DNA, 16 bp, Homo sapiens
ctgcctgcatctattc

SEQ ID NO: 2032582 - DNA, 19 bp, Homo sapiens
ctgcctgcccacttagccg

SEQ ID NO: 2032583 - DNA, 15 bp, Homo sapiens
ctgcctgcccaggcc

SEQ ID NO: 2032584 - DNA, 15 bp, Homo sapiens
ctgcctgcggcccag

SEQ ID NO: 2032585 - DNA, 20 bp, Homo sapiens
ctgcctggaggacctgagcc

SEQ ID NO: 2032586 - DNA, 21 bp, Homo sapiens
ctgcctggaggacctgagcct

SEQ ID NO: 2032587 - DNA, 22 bp, Homo sapiens
ctgcctggaggacctgagcctg

SEQ ID NO: 2032588 - DNA, 20 bp, Homo sapiens
ctgcctggaggatccctcca

SEQ ID NO: 2032589 - DNA, 21 bp, Homo sapiens
ctgcctggaggatccctccat

SEQ ID NO: 2032590 - DNA, 13 bp, Homo sapiens
ctgcctggcctgg

SEQ ID NO: 2032591 - DNA, 11 bp, Homo sapiens
ctgcctgggcc

SEQ ID NO: 2032592 - DNA, 12 bp, Homo sapiens
ctgcctgggcct

SEQ ID NO: 2032593 - DNA, 13 bp, Homo sapiens
ctgcctgggcctg

SEQ ID NO: 2032594 - DNA, 18 bp, Homo sapiens
ctgcctgggcctgtgcag

SEQ ID NO: 2032595 - DNA, 15 bp, Homo sapiens
ctgcctgggttttct

SEQ ID NO: 2032596 - DNA, 21 bp, Homo sapiens
ctgcctgggttttctaactgt

SEQ ID NO: 2032597 - DNA, 15 bp, Homo sapiens
ctgcctggtatgagt

SEQ ID NO: 2032598 - DNA, 13 bp, Homo sapiens
ctgcctgtagtta

SEQ ID NO: 2032599 - DNA, 17 bp, Homo sapiens
ctgcctgtagttaggaa

SEQ ID NO: 2032600 - DNA, 18 bp, Homo sapiens
ctgcctgtagttaggaaa

SEQ ID NO: 2032601 - DNA, 19 bp, Homo sapiens
ctgcctgtgtttgtgtgga

SEQ ID NO: 2032602 - DNA, 23 bp, Homo sapiens
ctgcctgttcagctccagctcac

SEQ ID NO: 2032603 - DNA, 15 bp, Homo sapiens
ctgccttcaccttca

SEQ ID NO: 2032604 - DNA, 16 bp, Homo sapiens
ctgccttccaggagca

SEQ ID NO: 2032605 - DNA, 22 bp, Homo sapiens
ctgccttgaagccactgaagct

SEQ ID NO: 2032606 - DNA, 19 bp, Homo sapiens
ctgccttgatgaagcccgt

SEQ ID NO: 2032607 - DNA, 23 bp, Homo sapiens
ctgcctttctcccccgacactgc

SEQ ID NO: 2032608 - DNA, 17 bp, Homo sapiens
ctgcacctgccagcctg

SEQ ID NO: 2032609 - DNA, 18 bp, Homo sapiens
ctgcacctgccagcctgg

SEQ ID NO: 2032610 - DNA, 19 bp, Homo sapiens
ctgcacctgccagcctggc

SEQ ID NO: 2032611 - DNA, 14 bp, Homo sapiens
ctgcactccagcct

SEQ ID NO: 2032612 - DNA, 17 bp, Homo sapiens
ctgcactccagcctggg

SEQ ID NO: 2032613 - DNA, 18 bp, Homo sapiens
ctgcactccagcctgggc

SEQ ID NO: 2032614 - DNA, 11 bp, Homo sapiens
ctgcactccat

SEQ ID NO: 2032615 - DNA, 16 bp, Homo sapiens
ctgcactccatggcca

SEQ ID NO: 2032616 - DNA, 19 bp, Homo sapiens
ctgcactccatggccaccc

SEQ ID NO: 2032617 - DNA, 22 bp, Homo sapiens
ctgcactccatggccaccccgt

SEQ ID NO: 2032618 - DNA, 13 bp, Homo sapiens
ctgcactctagcc

SEQ ID NO: 2032619 - DNA, 23 bp, Homo sapiens
ctgcactctagcctggcaacaga

SEQ ID NO: 2032620 - DNA, 11 bp, Homo sapiens
ctgcactgaaa

SEQ ID NO: 2032621 - DNA, 13 bp, Homo sapiens
ctgcactgcagtg

SEQ ID NO: 2032622 - DNA, 14 bp, Homo sapiens
ctgcacttgcagac

SEQ ID NO: 2032623 - DNA, 18 bp, Homo sapiens
ctgcacttgcagactcta

SEQ ID NO: 2032624 - DNA, 23 bp, Homo sapiens
ctgcacttgcagactctacagag

SEQ ID NO: 2032625 - DNA, 14 bp, Homo sapiens
ctgcagaccctgcc

SEQ ID NO: 2032626 - DNA, 14 bp, Homo sapiens
ctgcagagaccttg

SEQ ID NO: 2032627 - DNA, 20 bp, Homo sapiens
ctgcagagcaggaaacatga

SEQ ID NO: 2032628 - DNA, 21 bp, Homo sapiens
ctgcagagctatggtgaggtg

SEQ ID NO: 2032629 - DNA, 21 bp, Homo sapiens
ctgcagaggaccacagtgggt

SEQ ID NO: 2032630 - DNA, 21 bp, Homo sapiens
ctgcagaggggaaaccagtgt

SEQ ID NO: 2032631 - DNA, 19 bp, Homo sapiens
ctgcagaggggctttctgg

SEQ ID NO: 2032632 - DNA, 23 bp, Homo sapiens
ctgcagaggggctttctggagag

SEQ ID NO: 2032633 - DNA, 15 bp, Homo sapiens
ctgcagattctgatt

SEQ ID NO: 2032634 - DNA, 19 bp, Homo sapiens
ctgcagcactttaaccctc

SEQ ID NO: 2032635 - DNA, 22 bp, Homo sapiens
ctgcagccaaacagagccttca

SEQ ID NO: 2032636 - DNA, 12 bp, Homo sapiens
ctgcagccagcc

SEQ ID NO: 2032637 - DNA, 15 bp, Homo sapiens
ctgcagccagcccag

SEQ ID NO: 2032638 - DNA, 23 bp, Homo sapiens
ctcaggtgatccacccacctcag

SEQ ID NO: 2032639 - DNA, 13 bp, Homo sapiens
ctcaggtgccact

SEQ ID NO: 2032640 - DNA, 14 bp, Homo sapiens
ctcaggtgccactc

SEQ ID NO: 2032641 - DNA, 21 bp, Homo sapiens
ctcaggtgccactccctgagc

SEQ ID NO: 2032642 - DNA, 19 bp, Homo sapiens
ctcaggtgtccctgcactt

SEQ ID NO: 2032643 - DNA, 19 bp, Homo sapiens
ctcaggttctgtgtgtcct

SEQ ID NO: 2032644 - DNA, 19 bp, Homo sapiens
ctcagtaatttagaaatca

SEQ ID NO: 2032645 - DNA, 21 bp, Homo sapiens
ctcagtccagatgccttcctg

SEQ ID NO: 2032646 - DNA, 15 bp, Homo sapiens
ctcagtccatagcag

SEQ ID NO: 2032647 - DNA, 17 bp, Homo sapiens
ctcagtccatagcagag

SEQ ID NO: 2032648 - DNA, 21 bp, Homo sapiens
ctcagtctagtgaagatgttg

SEQ ID NO: 2032649 - DNA, 13 bp, Homo sapiens
ctcagtctcagga

SEQ ID NO: 2032650 - DNA, 13 bp, Homo sapiens
ctcagtgccactt

SEQ ID NO: 2032651 - DNA, 21 bp, Homo sapiens
ctcagtgccacttgacattcc

SEQ ID NO: 2032652 - DNA, 12 bp, Homo sapiens
ctcagtgcctcc

SEQ ID NO: 2032653 - DNA, 13 bp, Homo sapiens
ctcagtgcctcct

SEQ ID NO: 2032654 - DNA, 15 bp, Homo sapiens
ctcagtgcctcctgg

SEQ ID NO: 2032655 - DNA, 19 bp, Homo sapiens
ctcagtgctcggcagtcat

SEQ ID NO: 2032656 - DNA, 23 bp, Homo sapiens
ctcagtgtagttaaagggcagaa

SEQ ID NO: 2032657 - DNA, 14 bp, Homo sapiens
ctcagtgtcattta

SEQ ID NO: 2032658 - DNA, 17 bp, Homo sapiens
ctcagtgtcatttatga

SEQ ID NO: 2032659 - DNA, 18 bp, Homo sapiens
ctcagtgtcatttatgaa

SEQ ID NO: 2032660 - DNA, 13 bp, Homo sapiens
ctcagttaaaatg

SEQ ID NO: 2032661 - DNA, 14 bp, Homo sapiens
ctcagttaaaatgt

SEQ ID NO: 2032662 - DNA, 22 bp, Homo sapiens
ctcagttcaacctggtggcacc

SEQ ID NO: 2032663 - DNA, 11 bp, Homo sapiens
ctcagtttctc

SEQ ID NO: 2032664 - DNA, 18 bp, Homo sapiens
ctcagttttatcattttc

SEQ ID NO: 2032665 - DNA, 23 bp, Homo sapiens
ctcataacatctttgaaaagaaa

SEQ ID NO: 2032666 - DNA, 15 bp, Homo sapiens
ctcataactcattgt

SEQ ID NO: 2032667 - DNA, 20 bp, Homo sapiens
ctcataagttggaccagagg

SEQ ID NO: 2032668 - DNA, 23 bp, Homo sapiens
ctcataagttggaccagaggaag

SEQ ID NO: 2032669 - DNA, 13 bp, Homo sapiens
ctcataccatctg

SEQ ID NO: 2032670 - DNA, 20 bp, Homo sapiens
ctcataccatctgctgcccc

SEQ ID NO: 2032671 - DNA, 21 bp, Homo sapiens
ctcataggaaaagtacattta

SEQ ID NO: 2032672 - DNA, 14 bp, Homo sapiens
ctcatatatttaag

SEQ ID NO: 2032673 - DNA, 16 bp, Homo sapiens
ctcatatcttcctcat

SEQ ID NO: 2032674 - DNA, 16 bp, Homo sapiens
ctccagcctctcccgg

SEQ ID NO: 2032675 - DNA, 17 bp, Homo sapiens
ctccagcctctcccggc

SEQ ID NO: 2032676 - DNA, 13 bp, Homo sapiens
ctccagcctgggc

SEQ ID NO: 2032677 - DNA, 14 bp, Homo sapiens
ctccagctcaccag

SEQ ID NO: 2032678 - DNA, 19 bp, Homo sapiens
ctccagctcaccagcccca

SEQ ID NO: 2032679 - DNA, 20 bp, Homo sapiens
ctccagctcaccagccccag

SEQ ID NO: 2032680 - DNA, 14 bp, Homo sapiens
ctccagctccagtt

SEQ ID NO: 2032681 - DNA, 11 bp, Homo sapiens
ctccagctccc

SEQ ID NO: 2032682 - DNA, 11 bp, Homo sapiens
ctccagctgga

SEQ ID NO: 2032683 - DNA, 20 bp, Homo sapiens
ctccagctggaattgctgct

SEQ ID NO: 2032684 - DNA, 19 bp, Homo sapiens
ctccagcttcccctcgctg

SEQ ID NO: 2032685 - DNA, 20 bp, Homo sapiens
ctccagcttcccctcgctgt

SEQ ID NO: 2032686 - DNA, 23 bp, Homo sapiens
ctccagcttcccctcgctgtcct

SEQ ID NO: 2032687 - DNA, 20 bp, Homo sapiens
ctccaggaaggtagcccagc

SEQ ID NO: 2032688 - DNA, 21 bp, Homo sapiens
ctccaggaaggtagcccagca

SEQ ID NO: 2032689 - DNA, 18 bp, Homo sapiens
ctccaggagcctaccccc

SEQ ID NO: 2032690 - DNA, 16 bp, Homo sapiens
ctccaggcaccatctc

SEQ ID NO: 2032691 - DNA, 21 bp, Homo sapiens
ctccaggcacccttctttcct

SEQ ID NO: 2032692 - DNA, 16 bp, Homo sapiens
ctccaggcatgctggc

SEQ ID NO: 2032693 - DNA, 19 bp, Homo sapiens
ctccaggcatgctggcctc

SEQ ID NO: 2032694 - DNA, 15 bp, Homo sapiens
ctccaggctccttta

SEQ ID NO: 2032695 - DNA, 23 bp, Homo sapiens
ctccaggctcctttagcgcccag

SEQ ID NO: 2032696 - DNA, 20 bp, Homo sapiens
ctccaggctgtatcccatga

SEQ ID NO: 2032697 - DNA, 15 bp, Homo sapiens
ctccaggctgtttct

SEQ ID NO: 2032698 - DNA, 13 bp, Homo sapiens
ctccagggctgcc

SEQ ID NO: 2032699 - DNA, 16 bp, Homo sapiens
ctccagggctgcccct

SEQ ID NO: 2032700 - DNA, 18 bp, Homo sapiens
ctccagggctgcccctgt

SEQ ID NO: 2032701 - DNA, 19 bp, Homo sapiens
ctccaggtccggaggggtt

SEQ ID NO: 2032702 - DNA, 20 bp, Homo sapiens
ctccaggtccggaggggttg

SEQ ID NO: 2032703 - DNA, 22 bp, Homo sapiens
ctccagtatggaagaatggggt

SEQ ID NO: 2032704 - DNA, 18 bp, Homo sapiens
ctccagtctcctgacatt

SEQ ID NO: 2032705 - DNA, 19 bp, Homo sapiens
ctccagtctgatctgtgaa

SEQ ID NO: 2032706 - DNA, 15 bp, Homo sapiens
ctccagtgagctgga

SEQ ID NO: 2032707 - DNA, 17 bp, Homo sapiens
ctccagtgagctggaat

SEQ ID NO: 2032708 - DNA, 17 bp, Homo sapiens
ctccagttttcagttga

SEQ ID NO: 2032709 - DNA, 14 bp, Homo sapiens
ctccataatgccac

SEQ ID NO: 2032710 - DNA, 15 bp, Homo sapiens
ctccatatggaggcc

SEQ ID NO: 2032711 - DNA, 12 bp, Homo sapiens
ctccatcttatt

SEQ ID NO: 2032712 - DNA, 16 bp, Homo sapiens
ctccatgcccaaccta

SEQ ID NO: 2032713 - DNA, 15 bp, Homo sapiens
ctccatgctgcctcc

SEQ ID NO: 2032714 - DNA, 23 bp, Homo sapiens
ctccatggaggaggtgtcccaag

SEQ ID NO: 2032715 - DNA, 15 bp, Homo sapiens
ctccatggccacccc

SEQ ID NO: 2032716 - DNA, 22 bp, Homo sapiens
ctccatggccaccccgtgccac

SEQ ID NO: 2032717 - DNA, 16 bp, Homo sapiens
ctccatgtggccccag

SEQ ID NO: 2032718 - DNA, 13 bp, Homo sapiens
ctccatgtgggct

SEQ ID NO: 2032719 - DNA, 12 bp, Homo sapiens
ctccattgctgt

SEQ ID NO: 2032720 - DNA, 20 bp, Homo sapiens
ctcccaaagctcagacttgc

SEQ ID NO: 2032721 - DNA, 14 bp, Homo sapiens
ctcccaacagagct

SEQ ID NO: 2032722 - DNA, 21 bp, Homo sapiens
ctcccaacccaattcaggact

SEQ ID NO: 2032723 - DNA, 17 bp, Homo sapiens
ctcccaaccccagggcc

SEQ ID NO: 2032724 - DNA, 12 bp, Homo sapiens
ctcccaacctca

SEQ ID NO: 2032725 - DNA, 12 bp, Homo sapiens
ctcccaaggact

SEQ ID NO: 2032726 - DNA, 14 bp, Homo sapiens
ctcccacaggccct

SEQ ID NO: 2032727 - DNA, 15 bp, Homo sapiens
ctcccaccaccctcc

SEQ ID NO: 2032728 - DNA, 14 bp, Homo sapiens
ctcccaccatgcgc

SEQ ID NO: 2032729 - DNA, 20 bp, Homo sapiens
ctcccaccatgcgctgctca

SEQ ID NO: 2032730 - DNA, 22 bp, Homo sapiens
ctcccaccccacccccttcagt

SEQ ID NO: 2032731 - DNA, 23 bp, Homo sapiens
ctcccaccccacccccttcagtg

SEQ ID NO: 2032732 - DNA, 13 bp, Homo sapiens
ctcccaccccact

SEQ ID NO: 2032733 - DNA, 15 bp, Homo sapiens
ctcccaccccactcc

SEQ ID NO: 2032734 - DNA, 16 bp, Homo sapiens
ctcccaccccactcca

SEQ ID NO: 2032735 - DNA, 19 bp, Homo sapiens
ctcccaccccactccagcc

SEQ ID NO: 2032736 - DNA, 20 bp, Homo sapiens
ctcccaccccactccagccc

SEQ ID NO: 2032737 - DNA, 18 bp, Homo sapiens
ctcccaccccatgcatta

SEQ ID NO: 2032738 - DNA, 13 bp, Homo sapiens
ctcccacccccag

SEQ ID NO: 2032739 - DNA, 16 bp, Homo sapiens
ctcccaccccggcctc

SEQ ID NO: 2032740 - DNA, 17 bp, Homo sapiens
ctcccaccccggcctcc

SEQ ID NO: 2032741 - DNA, 19 bp, Homo sapiens
ctcccaccccggcctccac

SEQ ID NO: 2032742 - DNA, 17 bp, Homo sapiens
ctcccaccctaccacag

SEQ ID NO: 2032743 - DNA, 16 bp, Homo sapiens
ctcccagagtgctagg

SEQ ID NO: 2032744 - DNA, 15 bp, Homo sapiens
ctcccagatgctggg

SEQ ID NO: 2032745 - DNA, 18 bp, Homo sapiens
ctcccagcaagtttcacc

SEQ ID NO: 2032746 - DNA, 19 bp, Homo sapiens
ctcccagcaagtttcacct

SEQ ID NO: 2032747 - DNA, 18 bp, Homo sapiens
ctcccagccccaggggtg

SEQ ID NO: 2032748 - DNA, 18 bp, Homo sapiens
ctcccagccctatggatg

SEQ ID NO: 2032749 - DNA, 12 bp, Homo sapiens
ctcccagccctg

SEQ ID NO: 2032750 - DNA, 16 bp, Homo sapiens
ctcccaggagacagtt

SEQ ID NO: 2032751 - DNA, 17 bp, Homo sapiens
ctcccaggcactgtctt

SEQ ID NO: 2032752 - DNA, 20 bp, Homo sapiens
ctcccaggcgccccttcccc

SEQ ID NO: 2032753 - DNA, 19 bp, Homo sapiens
ctcccaggggctccacctg

SEQ ID NO: 2032754 - DNA, 22 bp, Homo sapiens
ctcccaggtggattttgtggag

SEQ ID NO: 2032755 - DNA, 17 bp, Homo sapiens
ctcccataccatcactg

SEQ ID NO: 2032756 - DNA, 22 bp, Homo sapiens
ctcccatagcgctggctcagga

SEQ ID NO: 2032757 - DNA, 14 bp, Homo sapiens
ccattcccccatgt

SEQ ID NO: 2032758 - DNA, 19 bp, Homo sapiens
ccattcccccatgtggctg

SEQ ID NO: 2032759 - DNA, 17 bp, Homo sapiens
ccattcccgtggtctcc

SEQ ID NO: 2032760 - DNA, 12 bp, Homo sapiens
ccattcctcagg

SEQ ID NO: 2032761 - DNA, 16 bp, Homo sapiens
ccattcgtctgtccca

SEQ ID NO: 2032762 - DNA, 19 bp, Homo sapiens
ccattcgtctgtcccagag

SEQ ID NO: 2032763 - DNA, 15 bp, Homo sapiens
ccattctagatgctt

SEQ ID NO: 2032764 - DNA, 15 bp, Homo sapiens
ccattctgcctgccc

SEQ ID NO: 2032765 - DNA, 16 bp, Homo sapiens
ccattctgcctgccca

SEQ ID NO: 2032766 - DNA, 17 bp, Homo sapiens
ccattctgcctgcccag

SEQ ID NO: 2032767 - DNA, 20 bp, Homo sapiens
ccattctgcctgcccaggcc

SEQ ID NO: 2032768 - DNA, 21 bp, Homo sapiens
ccattctgcctgcccaggccc

SEQ ID NO: 2032769 - DNA, 17 bp, Homo sapiens
ccattcttcagtgccta

SEQ ID NO: 2032770 - DNA, 14 bp, Homo sapiens
ccattcttcctagt

SEQ ID NO: 2032771 - DNA, 14 bp, Homo sapiens
ccattgacctcagc

SEQ ID NO: 2032772 - DNA, 23 bp, Homo sapiens
ccattgacttgcacatctctgca

SEQ ID NO: 2032773 - DNA, 20 bp, Homo sapiens
ccattgcatcacctctgtaa

SEQ ID NO: 2032774 - DNA, 14 bp, Homo sapiens
ccattgccctggtt

SEQ ID NO: 2032775 - DNA, 17 bp, Homo sapiens
ccattggctcccatctg

SEQ ID NO: 2032776 - DNA, 13 bp, Homo sapiens
ccattgtcttcca

SEQ ID NO: 2032777 - DNA, 20 bp, Homo sapiens
ccattgtcttccaaccccag

SEQ ID NO: 2032778 - DNA, 18 bp, Homo sapiens
ccattgttccttaccttt

SEQ ID NO: 2032779 - DNA, 14 bp, Homo sapiens
ccatttaattcata

SEQ ID NO: 2032780 - DNA, 16 bp, Homo sapiens
ccatttcacacaggtc

SEQ ID NO: 2032781 - DNA, 14 bp, Homo sapiens
ccatttccagttca

SEQ ID NO: 2032782 - DNA, 15 bp, Homo sapiens
ccatttccagttcat

SEQ ID NO: 2032783 - DNA, 15 bp, Homo sapiens
ccatttcctgtctgg

SEQ ID NO: 2032784 - DNA, 14 bp, Homo sapiens
ccatttccttggag

SEQ ID NO: 2032785 - DNA, 22 bp, Homo sapiens
ccatttccttggaggccaccgg

SEQ ID NO: 2032786 - DNA, 15 bp, Homo sapiens
ccatttcttcctcac

SEQ ID NO: 2032787 - DNA, 18 bp, Homo sapiens
ccatttcttcctcactat

SEQ ID NO: 2032788 - DNA, 18 bp, Homo sapiens
ccatttggacaaaatgga

SEQ ID NO: 2032789 - DNA, 12 bp, Homo sapiens
ccattttaataa

SEQ ID NO: 2032790 - DNA, 20 bp, Homo sapiens
ccattttggggtacccactg

SEQ ID NO: 2032791 - DNA, 20 bp, Homo sapiens
ccatttttagctctgatcag

SEQ ID NO: 2032792 - DNA, 23 bp, Homo sapiens
cccaaaacctcatgacagccaga

SEQ ID NO: 2032793 - DNA, 14 bp, Homo sapiens
cccaaacatctggc

SEQ ID NO: 2032794 - DNA, 23 bp, Homo sapiens
cccaaacattaatcaccaaagta

SEQ ID NO: 2032795 - DNA, 15 bp, Homo sapiens
cccaaaccagggtgc

SEQ ID NO: 2032796 - DNA, 15 bp, Homo sapiens
cccaaacccatcaga

SEQ ID NO: 2032797 - DNA, 23 bp, Homo sapiens
cccaaagaattcctgaagccaga

SEQ ID NO: 2032798 - DNA, 15 bp, Homo sapiens
cccaaagtgctggga

SEQ ID NO: 2032799 - DNA, 21 bp, Homo sapiens
cccaaattccctggacctctg

SEQ ID NO: 2032800 - DNA, 15 bp, Homo sapiens
cccaacaacatccat

SEQ ID NO: 2032801 - DNA, 15 bp, Homo sapiens
cccaacacaatcttt

SEQ ID NO: 2032802 - DNA, 18 bp, Homo sapiens
cccaacagaaggaaggag

SEQ ID NO: 2032803 - DNA, 15 bp, Homo sapiens
cccaacagcaccaat

SEQ ID NO: 2032804 - DNA, 21 bp, Homo sapiens
cccaacccaattcaggactgg

SEQ ID NO: 2032805 - DNA, 22 bp, Homo sapiens
cccaaccccgcggtgctctggc

SEQ ID NO: 2032806 - DNA, 23 bp, Homo sapiens
cccaacccgtggaggctgctcgg

SEQ ID NO: 2032807 - DNA, 13 bp, Homo sapiens
cccaacctcaatg

SEQ ID NO: 2032808 - DNA, 21 bp, Homo sapiens
cccaacctgctctcctcttgc

SEQ ID NO: 2032809 - DNA, 23 bp, Homo sapiens
cccaacctgctctcctcttgcca

SEQ ID NO: 2032810 - DNA, 16 bp, Homo sapiens
cccaacgcacaggaaa

SEQ ID NO: 2032811 - DNA, 14 bp, Homo sapiens
cccaacgggaagca

SEQ ID NO: 2032812 - DNA, 15 bp, Homo sapiens
cccaactcctggaag

SEQ ID NO: 2032813 - DNA, 17 bp, Homo sapiens
cccaactcctggaagct

SEQ ID NO: 2032814 - DNA, 18 bp, Homo sapiens
cccaactccttccagcta

SEQ ID NO: 2032815 - DNA, 20 bp, Homo sapiens
cccaagaatagatgctgact

SEQ ID NO: 2032816 - DNA, 18 bp, Homo sapiens
cccaagagcatcatgcct

SEQ ID NO: 2032817 - DNA, 20 bp, Homo sapiens
cccaagagcatcatgcctct

SEQ ID NO: 2032818 - DNA, 21 bp, Homo sapiens
cccaagagcatcatgcctctg

SEQ ID NO: 2032819 - DNA, 23 bp, Homo sapiens
cccaagagctacgtatttaatag

SEQ ID NO: 2032820 - DNA, 19 bp, Homo sapiens
cccaagcagcattcagcac

SEQ ID NO: 2032821 - DNA, 12 bp, Homo sapiens
cccaagcagcca

SEQ ID NO: 2032822 - DNA, 15 bp, Homo sapiens
cccaagcagccagcc

SEQ ID NO: 2032823 - DNA, 17 bp, Homo sapiens
cccaagcagccagccag

SEQ ID NO: 2032824 - DNA, 15 bp, Homo sapiens
cccaagcctctgccc

SEQ ID NO: 2032825 - DNA, 18 bp, Homo sapiens
cccaagcctggtctcctc

SEQ ID NO: 2032826 - DNA, 12 bp, Homo sapiens
cccaagctctgc

SEQ ID NO: 2032827 - DNA, 15 bp, Homo sapiens
cccaagctctgctcc

SEQ ID NO: 2032828 - DNA, 19 bp, Homo sapiens
cccaagctgttttcttcta

SEQ ID NO: 2032829 - DNA, 22 bp, Homo sapiens
cccaagctttgaatacccccag

SEQ ID NO: 2032830 - DNA, 14 bp, Homo sapiens
cccaaggaaagccc

SEQ ID NO: 2032831 - DNA, 19 bp, Homo sapiens
cccaaggaaagccccagca

SEQ ID NO: 2032832 - DNA, 22 bp, Homo sapiens
cccaaggaaagccccagcacta

SEQ ID NO: 2032833 - DNA, 15 bp, Homo sapiens
cccaaggaggaaaaa

SEQ ID NO: 2032834 - DNA, 14 bp, Homo sapiens
cccaaggctgctca

SEQ ID NO: 2032835 - DNA, 20 bp, Homo sapiens
cccaaggggacttgtgccag

SEQ ID NO: 2032836 - DNA, 22 bp, Homo sapiens
cccaaggggtctgtatatacat

SEQ ID NO: 2032837 - DNA, 19 bp, Homo sapiens
cccaagtagtagtgtcttc

SEQ ID NO: 2032838 - DNA, 12 bp, Homo sapiens
cccaagtgccat

SEQ ID NO: 2032839 - DNA, 17 bp, Homo sapiens
cccaagtgccatcccac

SEQ ID NO: 2032840 - DNA, 14 bp, Homo sapiens
cccaataaaagtga

SEQ ID NO: 2032841 - DNA, 21 bp, Homo sapiens
cccaataaacattaagattga

SEQ ID NO: 2032842 - DNA, 14 bp, Homo sapiens
cccaataaagctgg

SEQ ID NO: 2032843 - DNA, 12 bp, Homo sapiens
cccaatattata

SEQ ID NO: 2032844 - DNA, 12 bp, Homo sapiens
cccaatgctcct

SEQ ID NO: 2032845 - DNA, 21 bp, Homo sapiens
cccaattcttacaaacatgtg

SEQ ID NO: 2032846 - DNA, 15 bp, Homo sapiens
cccacaaaggggaga

SEQ ID NO: 2032847 - DNA, 14 bp, Homo sapiens
cccacacccctcca

SEQ ID NO: 2032848 - DNA, 17 bp, Homo sapiens
cccacacccctccaaag

SEQ ID NO: 2032849 - DNA, 22 bp, Homo sapiens
cccacacggaggcatctgcacc

SEQ ID NO: 2032850 - DNA, 17 bp, Homo sapiens
cccacagaactgcttac

SEQ ID NO: 2032851 - DNA, 20 bp, Homo sapiens
cccacagagatgcatgcgca

SEQ ID NO: 2032852 - DNA, 18 bp, Homo sapiens
cccacagcctctgcctgt

SEQ ID NO: 2032853 - DNA, 15 bp, Homo sapiens
cccacagctcccacc

SEQ ID NO: 2032854 - DNA, 19 bp, Homo sapiens
cccacagctcccaccccac

SEQ ID NO: 2032855 - DNA, 21 bp, Homo sapiens
cccacaggccccccgcagcac

SEQ ID NO: 2032856 - DNA, 18 bp, Homo sapiens
cccacaggcccttcctct

SEQ ID NO: 2032857 - DNA, 18 bp, Homo sapiens
cccacagggaccaagaag

SEQ ID NO: 2032858 - DNA, 19 bp, Homo sapiens
cccacatagtgatggttcc

SEQ ID NO: 2032859 - DNA, 16 bp, Homo sapiens
cccacatcccaggctt

SEQ ID NO: 2032860 - DNA, 13 bp, Homo sapiens
cccacatccctgg

SEQ ID NO: 2032861 - DNA, 17 bp, Homo sapiens
cccacatccctgggcct

SEQ ID NO: 2032862 - DNA, 21 bp, Homo sapiens
cccacatccctgggcctgctg

SEQ ID NO: 2032863 - DNA, 20 bp, Homo sapiens
cccacattcggaccctgccc

SEQ ID NO: 2032864 - DNA, 18 bp, Homo sapiens
cccaccaactctgcactc

SEQ ID NO: 2032865 - DNA, 21 bp, Homo sapiens
cccaccacactccccgcctgt

SEQ ID NO: 2032866 - DNA, 14 bp, Homo sapiens
cccaccacactgaa

SEQ ID NO: 2032867 - DNA, 22 bp, Homo sapiens
cccaccacctaggccactcctc

SEQ ID NO: 2032868 - DNA, 18 bp, Homo sapiens
cccaccaccttggactcc

SEQ ID NO: 2032869 - DNA, 23 bp, Homo sapiens
cccaccactaggactctgaggct

SEQ ID NO: 2032870 - DNA, 23 bp, Homo sapiens
cccaccagcatgtcactcccaga

SEQ ID NO: 2032871 - DNA, 16 bp, Homo sapiens
cccaccagcctaagaa

SEQ ID NO: 2032872 - DNA, 15 bp, Homo sapiens
cccacccacatgtga

SEQ ID NO: 2032873 - DNA, 16 bp, Homo sapiens
ccaggggtctccctgg

SEQ ID NO: 2032874 - DNA, 19 bp, Homo sapiens
ccaggggtctccctggagt

SEQ ID NO: 2032875 - DNA, 20 bp, Homo sapiens
ccaggggtgctatgacatgc

SEQ ID NO: 2032876 - DNA, 14 bp, Homo sapiens
ccagggtgagagct

SEQ ID NO: 2032877 - DNA, 17 bp, Homo sapiens
ccagggtgagagctgct

SEQ ID NO: 2032878 - DNA, 22 bp, Homo sapiens
ccagggtgcatggcttggggag

SEQ ID NO: 2032879 - DNA, 20 bp, Homo sapiens
ccagggttgaaaagttatga

SEQ ID NO: 2032880 - DNA, 16 bp, Homo sapiens
ccagggttgatcacac

SEQ ID NO: 2032881 - DNA, 17 bp, Homo sapiens
ccagggtttacccagtg

SEQ ID NO: 2032882 - DNA, 21 bp, Homo sapiens
ccaggtactgatcctgtttct

SEQ ID NO: 2032883 - DNA, 18 bp, Homo sapiens
ccaggtatctccaggatt

SEQ ID NO: 2032884 - DNA, 10 bp, Homo sapiens
ccaggtcctc

SEQ ID NO: 2032885 - DNA, 23 bp, Homo sapiens
ccaggtcctcccgggagcacaga

SEQ ID NO: 2032886 - DNA, 13 bp, Homo sapiens
ccaggtcctctga

SEQ ID NO: 2032887 - DNA, 15 bp, Homo sapiens
ccaggtcctggtggg

SEQ ID NO: 2032888 - DNA, 14 bp, Homo sapiens
ccaggtgcagtggc

SEQ ID NO: 2032889 - DNA, 16 bp, Homo sapiens
ccaggtgccaccaata

SEQ ID NO: 2032890 - DNA, 13 bp, Homo sapiens
ccaggtgccagtt

SEQ ID NO: 2032891 - DNA, 21 bp, Homo sapiens
ccaggtggccactccagaccc

SEQ ID NO: 2032892 - DNA, 18 bp, Homo sapiens
ccaggtgggagagacact

SEQ ID NO: 2032893 - DNA, 15 bp, Homo sapiens
ccaggtgttgccatt

SEQ ID NO: 2032894 - DNA, 18 bp, Homo sapiens
ccaggtgttgccatttct

SEQ ID NO: 2032895 - DNA, 16 bp, Homo sapiens
ccaggttgaaagacct

SEQ ID NO: 2032896 - DNA, 16 bp, Homo sapiens
ccaggtttctatgtgt

SEQ ID NO: 2032897 - DNA, 21 bp, Homo sapiens
ccagtaagcacatgtttattc

SEQ ID NO: 2032898 - DNA, 17 bp, Homo sapiens
ccagtacctttgtcaca

SEQ ID NO: 2032899 - DNA, 13 bp, Homo sapiens
ccagtactgggaa

SEQ ID NO: 2032900 - DNA, 15 bp, Homo sapiens
ccagtacttctaaga

SEQ ID NO: 2032901 - DNA, 14 bp, Homo sapiens
ccagtatggaaggg

SEQ ID NO: 2032902 - DNA, 17 bp, Homo sapiens
ccagtatggaagggagg

SEQ ID NO: 2032903 - DNA, 17 bp, Homo sapiens
ccagtccccgtgccccg

SEQ ID NO: 2032904 - DNA, 21 bp, Homo sapiens
ccagtccgccaaacactccac

SEQ ID NO: 2032905 - DNA, 12 bp, Homo sapiens
ccagtcctggcc

SEQ ID NO: 2032906 - DNA, 17 bp, Homo sapiens
ccagtcgagccctgcag

SEQ ID NO: 2032907 - DNA, 18 bp, Homo sapiens
ccagtctggaatgcagtg

SEQ ID NO: 2032908 - DNA, 16 bp, Homo sapiens
ccagtctgggctgccg

SEQ ID NO: 2032909 - DNA, 18 bp, Homo sapiens
ccagtctgggctgccggg

SEQ ID NO: 2032910 - DNA, 16 bp, Homo sapiens
ccagtcttgcctaggc

SEQ ID NO: 2032911 - DNA, 12 bp, Homo sapiens
ccagtcttgtgt

SEQ ID NO: 2032912 - DNA, 16 bp, Homo sapiens
ccagtgaaccaaagag

SEQ ID NO: 2032913 - DNA, 21 bp, Homo sapiens
ccagtgaacttacacttggag

SEQ ID NO: 2032914 - DNA, 22 bp, Homo sapiens
ccagtgaacttacacttggagc

SEQ ID NO: 2032915 - DNA, 15 bp, Homo sapiens
ccagtgagctggaat

SEQ ID NO: 2032916 - DNA, 17 bp, Homo sapiens
ccagtgaggaaatggca

SEQ ID NO: 2032917 - DNA, 14 bp, Homo sapiens
ccagtgagggctgg

SEQ ID NO: 2032918 - DNA, 16 bp, Homo sapiens
ccagtgcacttgctgg

SEQ ID NO: 2032919 - DNA, 15 bp, Homo sapiens
ccagtgccacagaga

SEQ ID NO: 2032920 - DNA, 22 bp, Homo sapiens
ccagtgccaggacagctggctg

SEQ ID NO: 2032921 - DNA, 23 bp, Homo sapiens
ccagtgccaggacagctggctgc

SEQ ID NO: 2032922 - DNA, 19 bp, Homo sapiens
ccagtgcccaaagtctgtg

SEQ ID NO: 2032923 - DNA, 22 bp, Homo sapiens
ccagtgcccaaagtctgtgtga

SEQ ID NO: 2032924 - DNA, 14 bp, Homo sapiens
ccagccagtcttgc

SEQ ID NO: 2032925 - DNA, 16 bp, Homo sapiens
ccagccatcacaaggg

SEQ ID NO: 2032926 - DNA, 12 bp, Homo sapiens
ccagcccacacc

SEQ ID NO: 2032927 - DNA, 15 bp, Homo sapiens
ccagcccacacccct

SEQ ID NO: 2032928 - DNA, 17 bp, Homo sapiens
ccagcccacacccctcc

SEQ ID NO: 2032929 - DNA, 13 bp, Homo sapiens
ccagcccacagag

SEQ ID NO: 2032930 - DNA, 17 bp, Homo sapiens
ccagcccattctctctc

SEQ ID NO: 2032931 - DNA, 21 bp, Homo sapiens
ccagcccattctctctcctgt

SEQ ID NO: 2032932 - DNA, 15 bp, Homo sapiens
ccagccccagcaaga

SEQ ID NO: 2032933 - DNA, 13 bp, Homo sapiens
ccagccccagggg

SEQ ID NO: 2032934 - DNA, 16 bp, Homo sapiens
ccagccccaggggtgc

SEQ ID NO: 2032935 - DNA, 13 bp, Homo sapiens
ccagccccagtgc

SEQ ID NO: 2032936 - DNA, 16 bp, Homo sapiens
ccagccccagtgccca

SEQ ID NO: 2032937 - DNA, 14 bp, Homo sapiens
ccagccccctggat

SEQ ID NO: 2032938 - DNA, 22 bp, Homo sapiens
ccagccccctggatgggcattg

SEQ ID NO: 2032939 - DNA, 14 bp, Homo sapiens
ccagccccgactcc

SEQ ID NO: 2032940 - DNA, 18 bp, Homo sapiens
ccagccccgactccagcc

SEQ ID NO: 2032941 - DNA, 19 bp, Homo sapiens
ccagccccgactccagcca

SEQ ID NO: 2032942 - DNA, 22 bp, Homo sapiens
ccagccccgactccagccagcg

SEQ ID NO: 2032943 - DNA, 23 bp, Homo sapiens
ccagccccgttttaaggacatta

SEQ ID NO: 2032944 - DNA, 15 bp, Homo sapiens
ccagcccctcctccc

SEQ ID NO: 2032945 - DNA, 16 bp, Homo sapiens
ccagcccctcctcccc

SEQ ID NO: 2032946 - DNA, 24 bp, Homo sapiens
ccagcccctcctccccttcctgca

SEQ ID NO: 2032947 - DNA, 15 bp, Homo sapiens
ccagcccggcctgct

SEQ ID NO: 2032948 - DNA, 17 bp, Homo sapiens
ccagcccggcctgctcc

SEQ ID NO: 2032949 - DNA, 19 bp, Homo sapiens
ccagcccggcctgctccca

SEQ ID NO: 2032950 - DNA, 9 bp, Homo sapiens
ccagcccta

SEQ ID NO: 2032951 - DNA, 23 bp, Homo sapiens
ccagccctacatcttcagctccc

SEQ ID NO: 2032952 - DNA, 15 bp, Homo sapiens
ccagccctatggatg

SEQ ID NO: 2032953 - DNA, 16 bp, Homo sapiens
ccagccctatggatgt

SEQ ID NO: 2032954 - DNA, 15 bp, Homo sapiens
ccagccctcaggcca

SEQ ID NO: 2032955 - DNA, 20 bp, Homo sapiens
ccagccctcaggccagtgcc

SEQ ID NO: 2032956 - DNA, 21 bp, Homo sapiens
ccagccctccccgcagtggga

SEQ ID NO: 2032957 - DNA, 14 bp, Homo sapiens
ccagccctccctgt

SEQ ID NO: 2032958 - DNA, 14 bp, Homo sapiens
ccagccctgccagg

SEQ ID NO: 2032959 - DNA, 18 bp, Homo sapiens
ccagccctgccaggaggc

SEQ ID NO: 2032960 - DNA, 13 bp, Homo sapiens
ccagccctgcctg

SEQ ID NO: 2032961 - DNA, 14 bp, Homo sapiens
ccagccctgcctgg

SEQ ID NO: 2032962 - DNA, 15 bp, Homo sapiens
ccagccctgcctgga

SEQ ID NO: 2032963 - DNA, 17 bp, Homo sapiens
ccagccctgcctggagg

SEQ ID NO: 2032964 - DNA, 17 bp, Homo sapiens
ccagcccttccctgctt

SEQ ID NO: 2032965 - DNA, 13 bp, Homo sapiens
ccagcccttctgc

SEQ ID NO: 2032966 - DNA, 14 bp, Homo sapiens
ccagcccttctgcc

SEQ ID NO: 2032967 - DNA, 19 bp, Homo sapiens
ccagccgccatcagcccaa

SEQ ID NO: 2032968 - DNA, 12 bp, Homo sapiens
ccagcctcagct

SEQ ID NO: 2032969 - DNA, 13 bp, Homo sapiens
ccagcctcagctc

SEQ ID NO: 2032970 - DNA, 15 bp, Homo sapiens
ccagcctcagctcag

SEQ ID NO: 2032971 - DNA, 22 bp, Homo sapiens
ccagcctcagctcagcctcccc

SEQ ID NO: 2032972 - DNA, 19 bp, Homo sapiens
ccagctccccaggactcac

SEQ ID NO: 2032973 - DNA, 20 bp, Homo sapiens
ccagctccttttgtccccag

SEQ ID NO: 2032974 - DNA, 21 bp, Homo sapiens
ccagctccttttgtccccagg

SEQ ID NO: 2032975 - DNA, 13 bp, Homo sapiens
ccagctctcagcc

SEQ ID NO: 2032976 - DNA, 14 bp, Homo sapiens
ccagctctcagcca

SEQ ID NO: 2032977 - DNA, 20 bp, Homo sapiens
ccagctctccctctggccct

SEQ ID NO: 2032978 - DNA, 22 bp, Homo sapiens
ccagctctccctctggccctgc

SEQ ID NO: 2032979 - DNA, 13 bp, Homo sapiens
ccagctctgtggc

SEQ ID NO: 2032980 - DNA, 15 bp, Homo sapiens
ccagctctgtggcct

SEQ ID NO: 2032981 - DNA, 16 bp, Homo sapiens
ccagctctttgttcag

SEQ ID NO: 2032982 - DNA, 17 bp, Homo sapiens
ccagctgcacctgccag

SEQ ID NO: 2032983 - DNA, 20 bp, Homo sapiens
ccagctgcacctgccagcct

SEQ ID NO: 2032984 - DNA, 16 bp, Homo sapiens
ccagctgcaggaatca

SEQ ID NO: 2032985 - DNA, 20 bp, Homo sapiens
ccagctgcaggaatcaaaaa

SEQ ID NO: 2032986 - DNA, 18 bp, Homo sapiens
ccagctgccgaccagagc

SEQ ID NO: 2032987 - DNA, 19 bp, Homo sapiens
ccagctgccgaccagagcc

SEQ ID NO: 2032988 - DNA, 20 bp, Homo sapiens
ccagctgccttcctcatccc

SEQ ID NO: 2032989 - DNA, 12 bp, Homo sapiens
ccagctggcctc

SEQ ID NO: 2032990 - DNA, 13 bp, Homo sapiens
ccagctggcctct

SEQ ID NO: 2032991 - DNA, 18 bp, Homo sapiens
ccagctggtgctgcaagg

SEQ ID NO: 2032992 - DNA, 19 bp, Homo sapiens
ccagctggtgctgcaagga

SEQ ID NO: 2032993 - DNA, 14 bp, Homo sapiens
ccagctgtagccat

SEQ ID NO: 2032994 - DNA, 15 bp, Homo sapiens
ccagctgtagccatg

SEQ ID NO: 2032995 - DNA, 17 bp, Homo sapiens
ccagctgtagccatggc

SEQ ID NO: 2032996 - DNA, 19 bp, Homo sapiens
ccagctgtagccatggctc

SEQ ID NO: 2032997 - DNA, 21 bp, Homo sapiens
ccagctgtagccatggctcag

SEQ ID NO: 2032998 - DNA, 21 bp, Homo sapiens
ccagctgtgctctggacaggc

SEQ ID NO: 2032999 - DNA, 21 bp, Homo sapiens
ccagcttcccctcgctgtcct

SEQ ID NO: 2033000 - DNA, 22 bp, Homo sapiens
ccagcttcccctcgctgtcctg

SEQ ID NO: 2033001 - DNA, 13 bp, Homo sapiens
ccagcttcctggt

SEQ ID NO: 2033002 - DNA, 15 bp, Homo sapiens
ccagcttcctgtggg

SEQ ID NO: 2033003 - DNA, 21 bp, Homo sapiens
ccagcttcctgtgggccagga

SEQ ID NO: 2033004 - DNA, 14 bp, Homo sapiens
ccagcttctccagg

SEQ ID NO: 2033005 - DNA, 17 bp, Homo sapiens
ccagcttgttatttata

SEQ ID NO: 2033006 - DNA, 22 bp, Homo sapiens
ccaggaacacccgactcctcaa

SEQ ID NO: 2033007 - DNA, 12 bp, Homo sapiens
ccaggaaggcag

SEQ ID NO: 2033008 - DNA, 13 bp, Homo sapiens
ccaggaaggcagc

SEQ ID NO: 2033009 - DNA, 21 bp, Homo sapiens
ccaggaagggggtccacccag

SEQ ID NO: 2033010 - DNA, 22 bp, Homo sapiens
ccaggaagggggtccacccagc

SEQ ID NO: 2033011 - DNA, 17 bp, Homo sapiens
ccaggaaggtagcccag

SEQ ID NO: 2033012 - DNA, 22 bp, Homo sapiens
ccaggaaggtagcccagcactg

SEQ ID NO: 2033013 - DNA, 23 bp, Homo sapiens
ccaggaaggtagcccagcactgt

SEQ ID NO: 2033014 - DNA, 23 bp, Homo sapiens
ccaggaatcggagcgaagcagag

SEQ ID NO: 2033015 - DNA, 19 bp, Homo sapiens
ccaggaatgcctcctccct

SEQ ID NO: 2033016 - DNA, 20 bp, Homo sapiens
ccaggacaagcatggtccca

SEQ ID NO: 2033017 - DNA, 13 bp, Homo sapiens
ccaggacacctgc

SEQ ID NO: 2033018 - DNA, 17 bp, Homo sapiens
ccaggacacctgcccca

SEQ ID NO: 2033019 - DNA, 19 bp, Homo sapiens
ccaggacacctgccccagc

SEQ ID NO: 2033020 - DNA, 23 bp, Homo sapiens
ccaggacacctgccccagcgcgg

SEQ ID NO: 2033021 - DNA, 14 bp, Homo sapiens
ccaggacagctggc

SEQ ID NO: 2033022 - DNA, 15 bp, Homo sapiens
ccaggacagctggct

SEQ ID NO: 2033023 - DNA, 22 bp, Homo sapiens
ccaggacagctggctgctgaca

SEQ ID NO: 2033024 - DNA, 13 bp, Homo sapiens
ccaggacaggacc

SEQ ID NO: 2033025 - DNA, 14 bp, Homo sapiens
ccaggacaggcccg

SEQ ID NO: 2033026 - DNA, 17 bp, Homo sapiens
ccaggacaggcccggcg

SEQ ID NO: 2033027 - DNA, 20 bp, Homo sapiens
ccaggactaatgcatgtggt

SEQ ID NO: 2033028 - DNA, 22 bp, Homo sapiens
ccaggactatagcccaggtcct

SEQ ID NO: 2033029 - DNA, 19 bp, Homo sapiens
ccaggactccccaggccag

SEQ ID NO: 2033030 - DNA, 22 bp, Homo sapiens
ccaggactccccaggccaggcc

SEQ ID NO: 2033031 - DNA, 12 bp, Homo sapiens
ccaggagaactg

SEQ ID NO: 2033032 - DNA, 20 bp, Homo sapiens
ccaggagaagaaagaggtga

SEQ ID NO: 2033033 - DNA, 12 bp, Homo sapiens
ccaggagagaga

SEQ ID NO: 2033034 - DNA, 13 bp, Homo sapiens
ccaggagagagat

SEQ ID NO: 2033035 - DNA, 17 bp, Homo sapiens
ccaggagagccagccct

SEQ ID NO: 2033036 - DNA, 23 bp, Homo sapiens
ccaggagagccagccctccctgt

SEQ ID NO: 2033037 - DNA, 12 bp, Homo sapiens
ccaggagcaaat

SEQ ID NO: 2033038 - DNA, 18 bp, Homo sapiens
ccaggagcacacggccct

SEQ ID NO: 2033039 - DNA, 16 bp, Homo sapiens
ccaggagccccgaggc

SEQ ID NO: 2033040 - DNA, 20 bp, Homo sapiens
ccaggagcctaccccctgaa

SEQ ID NO: 2033041 - DNA, 17 bp, Homo sapiens
ccaggagcctgtgcctc

SEQ ID NO: 2033042 - DNA, 20 bp, Homo sapiens
ccaggagctgagtcacctcc

SEQ ID NO: 2033043 - DNA, 23 bp, Homo sapiens
ccaggagctgagtcacctcctcc

SEQ ID NO: 2033044 - DNA, 16 bp, Homo sapiens
ccaggaggctgcggcc

SEQ ID NO: 2033045 - DNA, 16 bp, Homo sapiens
ccaggagggacaaagg

SEQ ID NO: 2033046 - DNA, 14 bp, Homo sapiens
ccaggaggggcctc

SEQ ID NO: 2033047 - DNA, 15 bp, Homo sapiens
ccaggaggtcctcct

SEQ ID NO: 2033048 - DNA, 19 bp, Homo sapiens
ccaggaggtcctcctctct

SEQ ID NO: 2033049 - DNA, 18 bp, Homo sapiens
ccaggaggtcgaccccaa

SEQ ID NO: 2033050 - DNA, 14 bp, Homo sapiens
ccaggagtctgtgc

SEQ ID NO: 2033051 - DNA, 17 bp, Homo sapiens
ccaggagtctgtgctct

SEQ ID NO: 2033052 - DNA, 15 bp, Homo sapiens
ccaggagttctgaag

SEQ ID NO: 2033053 - DNA, 16 bp, Homo sapiens
ccaggatcccagagct

SEQ ID NO: 2033054 - DNA, 14 bp, Homo sapiens
ccaggatcctgcag

SEQ ID NO: 2033055 - DNA, 18 bp, Homo sapiens
ccaggatcctgcaggaac

SEQ ID NO: 2033056 - DNA, 17 bp, Homo sapiens
ccaggatgaaggcgtgc

SEQ ID NO: 2033057 - DNA, 21 bp, Homo sapiens
ccaggatgaaggcgtgcaagg

SEQ ID NO: 2033058 - DNA, 17 bp, Homo sapiens
ccaggatgacacctcca

SEQ ID NO: 2033059 - DNA, 20 bp, Homo sapiens
ccaggatggcccttcccact

SEQ ID NO: 2033060 - DNA, 16 bp, Homo sapiens
ccaggattcctctctc

SEQ ID NO: 2033061 - DNA, 17 bp, Homo sapiens
ccaggattgaagagcat

SEQ ID NO: 2033062 - DNA, 18 bp, Homo sapiens
ccaggattgaagagcatt

SEQ ID NO: 2033063 - DNA, 20 bp, Homo sapiens
ccaggattttaacaaaagca

SEQ ID NO: 2033064 - DNA, 19 bp, Homo sapiens
ccaggcacctggcctgctg

SEQ ID NO: 2033065 - DNA, 20 bp, Homo sapiens
ccaggcacctggcctgctgg

SEQ ID NO: 2033066 - DNA, 20 bp, Homo sapiens
ccaggcacgaacccacctgc

SEQ ID NO: 2033067 - DNA, 23 bp, Homo sapiens
ccaggcacgaacccacctgctga

SEQ ID NO: 2033068 - DNA, 16 bp, Homo sapiens
ccaggcactgctgccc

SEQ ID NO: 2033069 - DNA, 12 bp, Homo sapiens
ccaggcaggtct

SEQ ID NO: 2033070 - DNA, 19 bp, Homo sapiens
ccaggcaggtgcctggaca

SEQ ID NO: 2033071 - DNA, 14 bp, Homo sapiens
ccaggcatcccatc

SEQ ID NO: 2033072 - DNA, 18 bp, Homo sapiens
ccaggcatcccatccctt

SEQ ID NO: 2033073 - DNA, 16 bp, Homo sapiens
ccaggcatgctggcct

SEQ ID NO: 2033074 - DNA, 12 bp, Homo sapiens
ccaggccaccag

SEQ ID NO: 2033075 - DNA, 15 bp, Homo sapiens
ccaggccaccaggat

SEQ ID NO: 2033076 - DNA, 11 bp, Homo sapiens
ccaggccaccg

SEQ ID NO: 2033077 - DNA, 16 bp, Homo sapiens
ccaggccactgtggcc

SEQ ID NO: 2033078 - DNA, 17 bp, Homo sapiens
ccaggccactgtggcca

SEQ ID NO: 2033079 - DNA, 19 bp, Homo sapiens
ccaggccactgtggccaga

SEQ ID NO: 2033080 - DNA, 14 bp, Homo sapiens
ccaggcccatctca

SEQ ID NO: 2033081 - DNA, 23 bp, Homo sapiens
ccaggcccatctcaggtgccact

SEQ ID NO: 2033082 - DNA, 13 bp, Homo sapiens
ccaggccccatga

SEQ ID NO: 2033083 - DNA, 17 bp, Homo sapiens
ccaggccccatgacctc

SEQ ID NO: 2033084 - DNA, 20 bp, Homo sapiens
ccaggccccatgacctccag

SEQ ID NO: 2033085 - DNA, 19 bp, Homo sapiens
ccaggcccctgaggactgg

SEQ ID NO: 2033086 - DNA, 13 bp, Homo sapiens
ccaggcccctgcc

SEQ ID NO: 2033087 - DNA, 15 bp, Homo sapiens
ccaggcccctgccac

SEQ ID NO: 2033088 - DNA, 16 bp, Homo sapiens
ccaggcccctgccacc

SEQ ID NO: 2033089 - DNA, 19 bp, Homo sapiens
ccaggcccctgccaccctg

SEQ ID NO: 2033090 - DNA, 23 bp, Homo sapiens
ccaggcccctgccaccctgggga

SEQ ID NO: 2033091 - DNA, 16 bp, Homo sapiens
ccaggccctccatggg

SEQ ID NO: 2033092 - DNA, 18 bp, Homo sapiens
ccaggccctccatgggct

SEQ ID NO: 2033093 - DNA, 15 bp, Homo sapiens
ccaggccgcctgcca

SEQ ID NO: 2033094 - DNA, 22 bp, Homo sapiens
ccaggccgttccccttggcttc

SEQ ID NO: 2033095 - DNA, 16 bp, Homo sapiens
ccaggcctccagcctc

SEQ ID NO: 2033096 - DNA, 15 bp, Homo sapiens
ccaggcctctgtgtc

SEQ ID NO: 2033097 - DNA, 18 bp, Homo sapiens
ccaggcgcggtggctcac

SEQ ID NO: 2033098 - DNA, 15 bp, Homo sapiens
ccaggcgggcggcac

SEQ ID NO: 2033099 - DNA, 18 bp, Homo sapiens
ccaggcgttggtgccact

SEQ ID NO: 2033100 - DNA, 21 bp, Homo sapiens
ccaggctagactaggaggttc

SEQ ID NO: 2033101 - DNA, 17 bp, Homo sapiens
ccaggctcacaactgtt

SEQ ID NO: 2033102 - DNA, 19 bp, Homo sapiens
ccaggctccatggggaagt

SEQ ID NO: 2033103 - DNA, 21 bp, Homo sapiens
ccaggctccctttctcttctt

SEQ ID NO: 2033104 - DNA, 13 bp, Homo sapiens
ccaggctctggga

SEQ ID NO: 2033105 - DNA, 17 bp, Homo sapiens
ccaggctctgggaaggg

SEQ ID NO: 2033106 - DNA, 14 bp, Homo sapiens
ccaggctcttcctg

SEQ ID NO: 2033107 - DNA, 18 bp, Homo sapiens
ccaggctcttcctggacc

SEQ ID NO: 2033108 - DNA, 19 bp, Homo sapiens
ccaggctcttcctggacct

SEQ ID NO: 2033109 - DNA, 23 bp, Homo sapiens
ccaggctctttggggtcagccag

SEQ ID NO: 2033110 - DNA, 21 bp, Homo sapiens
ccaggctgagtgagccacaga

SEQ ID NO: 2033111 - DNA, 23 bp, Homo sapiens
ccaggctgagtgagccacagacc

SEQ ID NO: 2033112 - DNA, 14 bp, Homo sapiens
ccaggctgcactgc

SEQ ID NO: 2033113 - DNA, 18 bp, Homo sapiens
ccaggctgcactgcagtg

SEQ ID NO: 2033114 - DNA, 19 bp, Homo sapiens
ccaggctgcactgcagtga

SEQ ID NO: 2033115 - DNA, 12 bp, Homo sapiens
ccaggctggcct

SEQ ID NO: 2033116 - DNA, 12 bp, Homo sapiens
ccaggctggcgt

SEQ ID NO: 2033117 - DNA, 14 bp, Homo sapiens
ccaggctggtctca

SEQ ID NO: 2033118 - DNA, 16 bp, Homo sapiens
ccaggcttcaccctga

SEQ ID NO: 2033119 - DNA, 22 bp, Homo sapiens
ccagggactcagcgtcccctgc

SEQ ID NO: 2033120 - DNA, 13 bp, Homo sapiens
ccagggagaccga

SEQ ID NO: 2033121 - DNA, 20 bp, Homo sapiens
ccagggcacaggagctacct

SEQ ID NO: 2033122 - DNA, 15 bp, Homo sapiens
ccagggcactgtctg

SEQ ID NO: 2033123 - DNA, 15 bp, Homo sapiens
ccagggcatcccatg

SEQ ID NO: 2033124 - DNA, 19 bp, Homo sapiens
ccagggcatccgcagccca

SEQ ID NO: 2033125 - DNA, 20 bp, Homo sapiens
ccagggcatccgcagcccag

SEQ ID NO: 2033126 - DNA, 19 bp, Homo sapiens
ccagggccacgtgccaggc

SEQ ID NO: 2033127 - DNA, 15 bp, Homo sapiens
ccagggccaggggtc

SEQ ID NO: 2033128 - DNA, 21 bp, Homo sapiens
ccagggcccaaagcccagctc

SEQ ID NO: 2033129 - DNA, 12 bp, Homo sapiens
ccagggcccctc

SEQ ID NO: 2033130 - DNA, 21 bp, Homo sapiens
ccagggcccctccctctgccc

SEQ ID NO: 2033131 - DNA, 14 bp, Homo sapiens
ccagggccctgcag

SEQ ID NO: 2033132 - DNA, 22 bp, Homo sapiens
ccagggcctactgccacccgct

SEQ ID NO: 2033133 - DNA, 19 bp, Homo sapiens
ccagggcctgggggcagtg

SEQ ID NO: 2033134 - DNA, 15 bp, Homo sapiens
ccagggcctggtgtg

SEQ ID NO: 2033135 - DNA, 11 bp, Homo sapiens
ccagggctcag

SEQ ID NO: 2033136 - DNA, 20 bp, Homo sapiens
ccagggctcagcctggtggg

SEQ ID NO: 2033137 - DNA, 21 bp, Homo sapiens
ccagggctccctcctggagca

SEQ ID NO: 2033138 - DNA, 19 bp, Homo sapiens
ccagggcttttcccaggaa

SEQ ID NO: 2033139 - DNA, 18 bp, Homo sapiens
ccaggggagagggtctgg

SEQ ID NO: 2033140 - DNA, 20 bp, Homo sapiens
ccaggggagagggtctggag

SEQ ID NO: 2033141 - DNA, 19 bp, Homo sapiens
ccaggggcccacagggaac

SEQ ID NO: 2033142 - DNA, 23 bp, Homo sapiens
ccaggggtatatttagaccctgt

SEQ ID NO: 2033143 - DNA, 19 bp, Homo sapiens
catgtactgagccttgtaa

SEQ ID NO: 2033144 - DNA, 16 bp, Homo sapiens
catgtacttcctgtgt

SEQ ID NO: 2033145 - DNA, 20 bp, Homo sapiens
catgtagcaggactgaattg

SEQ ID NO: 2033146 - DNA, 23 bp, Homo sapiens
catgtagctctatggggggaggg

SEQ ID NO: 2033147 - DNA, 15 bp, Homo sapiens
catgtagctgagttt

SEQ ID NO: 2033148 - DNA, 14 bp, Homo sapiens
catgtagttttaac

SEQ ID NO: 2033149 - DNA, 13 bp, Homo sapiens
catgtatagtgag

SEQ ID NO: 2033150 - DNA, 15 bp, Homo sapiens
catgtatagtgagtg

SEQ ID NO: 2033151 - DNA, 20 bp, Homo sapiens
catgtatctatgcattttct

SEQ ID NO: 2033152 - DNA, 23 bp, Homo sapiens
catgtatctatgcattttctgga

SEQ ID NO: 2033153 - DNA, 22 bp, Homo sapiens
catgtatgtcttggacactgta

SEQ ID NO: 2033154 - DNA, 15 bp, Homo sapiens
catgtatgtgcacat

SEQ ID NO: 2033155 - DNA, 16 bp, Homo sapiens
catgtatgtgcacatg

SEQ ID NO: 2033156 - DNA, 19 bp, Homo sapiens
catgtatgtgcacatgtgt

SEQ ID NO: 2033157 - DNA, 13 bp, Homo sapiens
catctgctcttct

SEQ ID NO: 2033158 - DNA, 17 bp, Homo sapiens
catctgctcttctctta

SEQ ID NO: 2033159 - DNA, 22 bp, Homo sapiens
catctgcttggttggctggcag

SEQ ID NO: 2033160 - DNA, 19 bp, Homo sapiens
catctgcttgtattttcca

SEQ ID NO: 2033161 - DNA, 16 bp, Homo sapiens
catctggattccagag

SEQ ID NO: 2033162 - DNA, 21 bp, Homo sapiens
catctgggaagatttctacct

SEQ ID NO: 2033163 - DNA, 18 bp, Homo sapiens
catctgggaggctggtct

SEQ ID NO: 2033164 - DNA, 15 bp, Homo sapiens
catctgggattccca

SEQ ID NO: 2033165 - DNA, 17 bp, Homo sapiens
catctgtccctgcctca

SEQ ID NO: 2033166 - DNA, 18 bp, Homo sapiens
catctgtcttgccagcca

SEQ ID NO: 2033167 - DNA, 22 bp, Homo sapiens
catctgtcttgccagccagaag

SEQ ID NO: 2033168 - DNA, 19 bp, Homo sapiens
catctgtggaaatgacagc

SEQ ID NO: 2033169 - DNA, 15 bp, Homo sapiens
catctgtgtgaaaat

SEQ ID NO: 2033170 - DNA, 20 bp, Homo sapiens
catcttagatagatggtact

SEQ ID NO: 2033171 - DNA, 18 bp, Homo sapiens
catcttagctttccacag

SEQ ID NO: 2033172 - DNA, 20 bp, Homo sapiens
catcttatgctaactgtaga

SEQ ID NO: 2033173 - DNA, 21 bp, Homo sapiens
catcttatgctaactgtagat

SEQ ID NO: 2033174 - DNA, 13 bp, Homo sapiens
catcttcagctcc

SEQ ID NO: 2033175 - DNA, 16 bp, Homo sapiens
catcttcagctcccat

SEQ ID NO: 2033176 - DNA, 19 bp, Homo sapiens
catcttcagctcccatagc

SEQ ID NO: 2033177 - DNA, 13 bp, Homo sapiens
catcttcctgctg

SEQ ID NO: 2033178 - DNA, 15 bp, Homo sapiens
catcttcctgctgct

SEQ ID NO: 2033179 - DNA, 17 bp, Homo sapiens
catcttcctgctgctgt

SEQ ID NO: 2033180 - DNA, 18 bp, Homo sapiens
catcttcctgctgctgta

SEQ ID NO: 2033181 - DNA, 13 bp, Homo sapiens
catcttctcagtg

SEQ ID NO: 2033182 - DNA, 14 bp, Homo sapiens
catcttctccatct

SEQ ID NO: 2033183 - DNA, 17 bp, Homo sapiens
catcttctccatctggc

SEQ ID NO: 2033184 - DNA, 13 bp, Homo sapiens
catcttgctctgc

SEQ ID NO: 2033185 - DNA, 17 bp, Homo sapiens
catcttgctctgctgac

SEQ ID NO: 2033186 - DNA, 20 bp, Homo sapiens
catcttgctctgctgacaga

SEQ ID NO: 2033187 - DNA, 19 bp, Homo sapiens
caggacacctggccgcctc

SEQ ID NO: 2033188 - DNA, 16 bp, Homo sapiens
caggacagctggctgc

SEQ ID NO: 2033189 - DNA, 17 bp, Homo sapiens
caggacagctggctgct

SEQ ID NO: 2033190 - DNA, 18 bp, Homo sapiens
caggacagctggctgctg

SEQ ID NO: 2033191 - DNA, 12 bp, Homo sapiens
caggacaggacc

SEQ ID NO: 2033192 - DNA, 13 bp, Homo sapiens
caggacaggcccg

SEQ ID NO: 2033193 - DNA, 21 bp, Homo sapiens
caggacagtgcttcagcctga

SEQ ID NO: 2033194 - DNA, 13 bp, Homo sapiens
caggacatggggc

SEQ ID NO: 2033195 - DNA, 17 bp, Homo sapiens
caggacatggggcatag

SEQ ID NO: 2033196 - DNA, 23 bp, Homo sapiens
caggacatggggcatagaaactg

SEQ ID NO: 2033197 - DNA, 14 bp, Homo sapiens
caggaccaggacta

SEQ ID NO: 2033198 - DNA, 14 bp, Homo sapiens
caggacccaggccc

SEQ ID NO: 2033199 - DNA, 15 bp, Homo sapiens
caggacccaggccct

SEQ ID NO: 2033200 - DNA, 17 bp, Homo sapiens
caggacccaggccgcct

SEQ ID NO: 2033201 - DNA, 21 bp, Homo sapiens
caggacccaggccgcctgcca

SEQ ID NO: 2033202 - DNA, 22 bp, Homo sapiens
caggacctccggggagagcaga

SEQ ID NO: 2033203 - DNA, 14 bp, Homo sapiens
caggacctggcttg

SEQ ID NO: 2033204 - DNA, 20 bp, Homo sapiens
caggacctggcttggcttta

SEQ ID NO: 2033205 - DNA, 13 bp, Homo sapiens
caggaccttttga

SEQ ID NO: 2033206 - DNA, 14 bp, Homo sapiens
caggacgccactca

SEQ ID NO: 2033207 - DNA, 16 bp, Homo sapiens
caggacgccactcatt

SEQ ID NO: 2033208 - DNA, 13 bp, Homo sapiens
catcatgcctctg

SEQ ID NO: 2033209 - DNA, 17 bp, Homo sapiens
catcatgcctctgaggc

SEQ ID NO: 2033210 - DNA, 22 bp, Homo sapiens
catcatgcctctgaggccagcc

SEQ ID NO: 2033211 - DNA, 23 bp, Homo sapiens
catcatgcctctgaggccagcct

SEQ ID NO: 2033212 - DNA, 14 bp, Homo sapiens
catcatgtctggct

SEQ ID NO: 2033213 - DNA, 15 bp, Homo sapiens
catcatgtctggcta

SEQ ID NO: 2033214 - DNA, 21 bp, Homo sapiens
catcattatttgcagagacag

SEQ ID NO: 2033215 - DNA, 14 bp, Homo sapiens
catcattgtaaatt

SEQ ID NO: 2033216 - DNA, 22 bp, Homo sapiens
catccaactcctggagatttca

SEQ ID NO: 2033217 - DNA, 14 bp, Homo sapiens
catccaaggaacct

SEQ ID NO: 2033218 - DNA, 21 bp, Homo sapiens
catccaaggaacctaattgaa

SEQ ID NO: 2033219 - DNA, 18 bp, Homo sapiens
catccacacacgcaggaa

SEQ ID NO: 2033220 - DNA, 14 bp, Homo sapiens
catccacccagtgc

SEQ ID NO: 2033221 - DNA, 15 bp, Homo sapiens
catccacccagtgct

SEQ ID NO: 2033222 - DNA, 23 bp, Homo sapiens
catccacccagtgctgccatgcc

SEQ ID NO: 2033223 - DNA, 14 bp, Homo sapiens
catccactgtgcca

SEQ ID NO: 2033224 - DNA, 13 bp, Homo sapiens
catccagcctgtg

SEQ ID NO: 2033225 - DNA, 15 bp, Homo sapiens
catccaggttcagct

SEQ ID NO: 2033226 - DNA, 17 bp, Homo sapiens
catccaggttcagcttg

SEQ ID NO: 2033227 - DNA, 13 bp, Homo sapiens
catccagttcatg

SEQ ID NO: 2033228 - DNA, 18 bp, Homo sapiens
catccagttgcaataaaa

SEQ ID NO: 2033229 - DNA, 21 bp, Homo sapiens
catccagttgcaataaaatag

SEQ ID NO: 2033230 - DNA, 18 bp, Homo sapiens
catccataaagcaagctc

SEQ ID NO: 2033231 - DNA, 21 bp, Homo sapiens
catccataaagcaagctcaac

SEQ ID NO: 2033232 - DNA, 16 bp, Homo sapiens
catccatcagctccct

SEQ ID NO: 2033233 - DNA, 18 bp, Homo sapiens
catccatgtccaaccccc

SEQ ID NO: 2033234 - DNA, 16 bp, Homo sapiens
catccatgtcctatgt

SEQ ID NO: 2033235 - DNA, 18 bp, Homo sapiens
catccatgtttgtaaaac

SEQ ID NO: 2033236 - DNA, 12 bp, Homo sapiens
catccattccca

SEQ ID NO: 2033237 - DNA, 15 bp, Homo sapiens
catccattcctcagg

SEQ ID NO: 2033238 - DNA, 19 bp, Homo sapiens
catccattcctcagggaca

SEQ ID NO: 2033239 - DNA, 23 bp, Homo sapiens
catccatttcagtttgtttactt

SEQ ID NO: 2033240 - DNA, 23 bp, Homo sapiens
catccatttcatctatttctgag

SEQ ID NO: 2033241 - DNA, 21 bp, Homo sapiens
catcccaggaggggcctctga

SEQ ID NO: 2033242 - DNA, 12 bp, Homo sapiens
catcccatcatc

SEQ ID NO: 2033243 - DNA, 13 bp, Homo sapiens
catcccatccctt

SEQ ID NO: 2033244 - DNA, 20 bp, Homo sapiens
catcccatctaagctgcagc

SEQ ID NO: 2033245 - DNA, 15 bp, Homo sapiens
catcccattgccctg

SEQ ID NO: 2033246 - DNA, 22 bp, Homo sapiens
catccccaggtctctccactgc

SEQ ID NO: 2033247 - DNA, 20 bp, Homo sapiens
catcccccactgccacaccc

SEQ ID NO: 2033248 - DNA, 22 bp, Homo sapiens
catcccctcgtcctgtcccaga

SEQ ID NO: 2033249 - DNA, 14 bp, Homo sapiens
catcccctggactg

SEQ ID NO: 2033250 - DNA, 19 bp, Homo sapiens
catcccctggactgggagg

SEQ ID NO: 2033251 - DNA, 21 bp, Homo sapiens
catccccttgtgtcagagaca

SEQ ID NO: 2033252 - DNA, 15 bp, Homo sapiens
catcccctttattaa

SEQ ID NO: 2033253 - DNA, 14 bp, Homo sapiens
catcccctttcctc

SEQ ID NO: 2033254 - DNA, 22 bp, Homo sapiens
catcccgctggtgcctcccggg

SEQ ID NO: 2033255 - DNA, 16 bp, Homo sapiens
catcccggcctcttcc

SEQ ID NO: 2033256 - DNA, 24 bp, Homo sapiens
catccctgggcccctccacgcctc

SEQ ID NO: 2033257 - DNA, 13 bp, Homo sapiens
catccctgggcct

SEQ ID NO: 2033258 - DNA, 14 bp, Homo sapiens
catccctgggcctg

SEQ ID NO: 2033259 - DNA, 21 bp, Homo sapiens
catccctgggcctgctgctga

SEQ ID NO: 2033260 - DNA, 16 bp, Homo sapiens
catcccttccctgtcc

SEQ ID NO: 2033261 - DNA, 14 bp, Homo sapiens
catcccttcctccc

SEQ ID NO: 2033262 - DNA, 19 bp, Homo sapiens
catccctttgaaacaagat

SEQ ID NO: 2033263 - DNA, 13 bp, Homo sapiens
catccgaggcagg

SEQ ID NO: 2033264 - DNA, 16 bp, Homo sapiens
catccgaggcagggtc

SEQ ID NO: 2033265 - DNA, 14 bp, Homo sapiens
catccgcagcccag

SEQ ID NO: 2033266 - DNA, 14 bp, Homo sapiens
catccggctcctgt

SEQ ID NO: 2033267 - DNA, 22 bp, Homo sapiens
catccgggacgcttccagacca

SEQ ID NO: 2033268 - DNA, 23 bp, Homo sapiens
catccgggacgcttccagaccac

SEQ ID NO: 2033269 - DNA, 17 bp, Homo sapiens
catccgtagttccctga

SEQ ID NO: 2033270 - DNA, 19 bp, Homo sapiens
catcctaagtgggaagtga

SEQ ID NO: 2033271 - DNA, 14 bp, Homo sapiens
catcctaccaatgc

SEQ ID NO: 2033272 - DNA, 18 bp, Homo sapiens
catcctaccaatgcatgc

SEQ ID NO: 2033273 - DNA, 16 bp, Homo sapiens
catcctcctcccaact

SEQ ID NO: 2033274 - DNA, 20 bp, Homo sapiens
catcctccttataagcccag

SEQ ID NO: 2033275 - DNA, 20 bp, Homo sapiens
catcctgcagcctcctcctg

SEQ ID NO: 2033276 - DNA, 14 bp, Homo sapiens
catcctggcccctc

SEQ ID NO: 2033277 - DNA, 23 bp, Homo sapiens
catcctggcccctccagaccctg

SEQ ID NO: 2033278 - DNA, 12 bp, Homo sapiens
catcctggcctc

SEQ ID NO: 2033279 - DNA, 18 bp, Homo sapiens
catcctgggccttacctc

SEQ ID NO: 2033280 - DNA, 20 bp, Homo sapiens
catccttcaccagagcccat

SEQ ID NO: 2033281 - DNA, 23 bp, Homo sapiens
catccttcatctggattccagag

SEQ ID NO: 2033282 - DNA, 16 bp, Homo sapiens
catccttgaactgtca

SEQ ID NO: 2033283 - DNA, 19 bp, Homo sapiens
catccttttctgcagaggg

SEQ ID NO: 2033284 - DNA, 20 bp, Homo sapiens
catcgaaaattcatttcaca

SEQ ID NO: 2033285 - DNA, 19 bp, Homo sapiens
catcgaacaaactgatgcg

SEQ ID NO: 2033286 - DNA, 13 bp, Homo sapiens
catcgcactgtgg

SEQ ID NO: 2033287 - DNA, 14 bp, Homo sapiens
catcgcactgtgga

SEQ ID NO: 2033288 - DNA, 20 bp, Homo sapiens
catcggaggctgggcccctg

SEQ ID NO: 2033289 - DNA, 23 bp, Homo sapiens
catcggaggctgggcccctggga

SEQ ID NO: 2033290 - DNA, 14 bp, Homo sapiens
catcgtagaagaga

SEQ ID NO: 2033291 - DNA, 21 bp, Homo sapiens
catcgtataacacaatatgaa

SEQ ID NO: 2033292 - DNA, 16 bp, Homo sapiens
catcgtccttcctctc

SEQ ID NO: 2033293 - DNA, 15 bp, Homo sapiens
catcgtgacccttca

SEQ ID NO: 2033294 - DNA, 19 bp, Homo sapiens
catcgtgacccttcagggc

SEQ ID NO: 2033295 - DNA, 18 bp, Homo sapiens
catctaagcctgttgaga

SEQ ID NO: 2033296 - DNA, 20 bp, Homo sapiens
catctaagctgcagcttcct

SEQ ID NO: 2033297 - DNA, 22 bp, Homo sapiens
catctacacagcagtatgaatg

SEQ ID NO: 2033298 - DNA, 20 bp, Homo sapiens
catctagaggcttccttcat

SEQ ID NO: 2033299 - DNA, 21 bp, Homo sapiens
catctagaggcttccttcatt

SEQ ID NO: 2033300 - DNA, 21 bp, Homo sapiens
catctatggcagtccagccag

SEQ ID NO: 2033301 - DNA, 19 bp, Homo sapiens
catctatgtcccttgctgt

SEQ ID NO: 2033302 - DNA, 18 bp, Homo sapiens
catctattataaaaccat

SEQ ID NO: 2033303 - DNA, 15 bp, Homo sapiens
catctatttctgaga

SEQ ID NO: 2033304 - DNA, 16 bp, Homo sapiens
catctcactgcccagt

SEQ ID NO: 2033305 - DNA, 20 bp, Homo sapiens
catctcagcctaccatgaga

SEQ ID NO: 2033306 - DNA, 12 bp, Homo sapiens
catctcaggtgc

SEQ ID NO: 2033307 - DNA, 14 bp, Homo sapiens
catctcaggtgcca

SEQ ID NO: 2033308 - DNA, 21 bp, Homo sapiens
catctcaggtgccactccctg

SEQ ID NO: 2033309 - DNA, 15 bp, Homo sapiens
catctcattgtagag

SEQ ID NO: 2033310 - DNA, 20 bp, Homo sapiens
catctccaccctgagcctga

SEQ ID NO: 2033311 - DNA, 17 bp, Homo sapiens
catctccatcttgaagg

SEQ ID NO: 2033312 - DNA, 19 bp, Homo sapiens
catctccccaggcctccag

SEQ ID NO: 2033313 - DNA, 13 bp, Homo sapiens
catctcccttcct

SEQ ID NO: 2033314 - DNA, 20 bp, Homo sapiens
catctcctcccatggccttc

SEQ ID NO: 2033315 - DNA, 14 bp, Homo sapiens
catctcctgatttc

SEQ ID NO: 2033316 - DNA, 13 bp, Homo sapiens
catctctctgggg

SEQ ID NO: 2033317 - DNA, 21 bp, Homo sapiens
catctctgtgtacccactcct

SEQ ID NO: 2033318 - DNA, 15 bp, Homo sapiens
catctcttgaggcca

SEQ ID NO: 2033319 - DNA, 12 bp, Homo sapiens
catctgaaagcc

SEQ ID NO: 2033320 - DNA, 14 bp, Homo sapiens
catctgcagaatgg

SEQ ID NO: 2033321 - DNA, 17 bp, Homo sapiens
catctgcggggcttctg

SEQ ID NO: 2033322 - DNA, 19 bp, Homo sapiens
catctgcggggcttctggg

SEQ ID NO: 2033323 - DNA, 15 bp, Homo sapiens
catctgctcctccca

SEQ ID NO: 2033324 - DNA, 18 bp, Homo sapiens
cagcgcggcttggccgcc

SEQ ID NO: 2033325 - DNA, 22 bp, Homo sapiens
cagcgcggcttggccgccatcc

SEQ ID NO: 2033326 - DNA, 16 bp, Homo sapiens
cagcgcgggcggaggc

SEQ ID NO: 2033327 - DNA, 19 bp, Homo sapiens
cagcggaggagaccagctc

SEQ ID NO: 2033328 - DNA, 14 bp, Homo sapiens
cagcggcccctgca

SEQ ID NO: 2033329 - DNA, 15 bp, Homo sapiens
cagcggcccctgcat

SEQ ID NO: 2033330 - DNA, 22 bp, Homo sapiens
cagcgtcccctgctactcctgt

SEQ ID NO: 2033331 - DNA, 13 bp, Homo sapiens
cagcgtggccttg

SEQ ID NO: 2033332 - DNA, 21 bp, Homo sapiens
cagcgtttagtttctagaggc

SEQ ID NO: 2033333 - DNA, 24 bp, Homo sapiens
cagcgtttagtttctagaggcctc

SEQ ID NO: 2033334 - DNA, 15 bp, Homo sapiens
cagcgtttctccacc

SEQ ID NO: 2033335 - DNA, 22 bp, Homo sapiens
cagctaaagcccaacctcctga

SEQ ID NO: 2033336 - DNA, 18 bp, Homo sapiens
cagctaactccagtctcc

SEQ ID NO: 2033337 - DNA, 15 bp, Homo sapiens
cagctaagctaggaa

SEQ ID NO: 2033338 - DNA, 12 bp, Homo sapiens
cagctaatctgt

SEQ ID NO: 2033339 - DNA, 14 bp, Homo sapiens
cagctacacctgag

SEQ ID NO: 2033340 - DNA, 17 bp, Homo sapiens
cagctacacctgaggct

SEQ ID NO: 2033341 - DNA, 20 bp, Homo sapiens
cagctacattcctcagctgc

SEQ ID NO: 2033342 - DNA, 19 bp, Homo sapiens
cagctactcaagaggctga

SEQ ID NO: 2033343 - DNA, 23 bp, Homo sapiens
cagctactcagaagcctgaggct

SEQ ID NO: 2033344 - DNA, 16 bp, Homo sapiens
cagctactcaggaggc

SEQ ID NO: 2033345 - DNA, 20 bp, Homo sapiens
cagctactcgggaggctgag

SEQ ID NO: 2033346 - DNA, 18 bp, Homo sapiens
cagctactctgtccaggc

SEQ ID NO: 2033347 - DNA, 22 bp, Homo sapiens
cagctactctgtccaggccact

SEQ ID NO: 2033348 - DNA, 20 bp, Homo sapiens
cagctacttaagagaaatgg

SEQ ID NO: 2033349 - DNA, 20 bp, Homo sapiens
cagctagccaactcctcctt

SEQ ID NO: 2033350 - DNA, 17 bp, Homo sapiens
cagctaggactgaggag

SEQ ID NO: 2033351 - DNA, 15 bp, Homo sapiens
cagctagtgacccac

SEQ ID NO: 2033352 - DNA, 19 bp, Homo sapiens
cagctagtgacccacatgc

SEQ ID NO: 2033353 - DNA, 20 bp, Homo sapiens
cagctagtgacccacatgcc

SEQ ID NO: 2033354 - DNA, 19 bp, Homo sapiens
cagctatggccccagggtt

SEQ ID NO: 2033355 - DNA, 21 bp, Homo sapiens
cagctatggccccagggttga

SEQ ID NO: 2033356 - DNA, 13 bp, Homo sapiens
cagctatttttat

SEQ ID NO: 2033357 - DNA, 17 bp, Homo sapiens
cagctcacaagcccagg

SEQ ID NO: 2033358 - DNA, 14 bp, Homo sapiens
cagctcaccagccc

SEQ ID NO: 2033359 - DNA, 19 bp, Homo sapiens
cagctcaccagccccagtg

SEQ ID NO: 2033360 - DNA, 20 bp, Homo sapiens
cagctcaccagccccagtgc

SEQ ID NO: 2033361 - DNA, 16 bp, Homo sapiens
cagctcagagatgaaa

SEQ ID NO: 2033362 - DNA, 17 bp, Homo sapiens
cagctcagaggcccagg

SEQ ID NO: 2033363 - DNA, 12 bp, Homo sapiens
cagctcagcctc

SEQ ID NO: 2033364 - DNA, 18 bp, Homo sapiens
cagctcagtcccatcaga

SEQ ID NO: 2033365 - DNA, 14 bp, Homo sapiens
cagctccaacagct

SEQ ID NO: 2033366 - DNA, 17 bp, Homo sapiens
cagctccaacagcttga

SEQ ID NO: 2033367 - DNA, 22 bp, Homo sapiens
cagctccaacagcttgaccaga

SEQ ID NO: 2033368 - DNA, 19 bp, Homo sapiens
cagctccagaataccttct

SEQ ID NO: 2033369 - DNA, 18 bp, Homo sapiens
cagctccagctcaccagc

SEQ ID NO: 2033370 - DNA, 20 bp, Homo sapiens
cagctccagctcaccagccc

SEQ ID NO: 2033371 - DNA, 21 bp, Homo sapiens
cagctcccaaggctctgagca

SEQ ID NO: 2033372 - DNA, 18 bp, Homo sapiens
cagctcccatagcgctgg

SEQ ID NO: 2033373 - DNA, 21 bp, Homo sapiens
cagctcccatagcgctggctc

SEQ ID NO: 2033374 - DNA, 23 bp, Homo sapiens
cagctcccatagcgctggctcag

SEQ ID NO: 2033375 - DNA, 15 bp, Homo sapiens
cagctccccaggact

SEQ ID NO: 2033376 - DNA, 17 bp, Homo sapiens
cagctccccaggactca

SEQ ID NO: 2033377 - DNA, 20 bp, Homo sapiens
cagctcccctcggagaagag

SEQ ID NO: 2033378 - DNA, 22 bp, Homo sapiens
cagctcccctcggagaagagct

SEQ ID NO: 2033379 - DNA, 11 bp, Homo sapiens
cagctccctag

SEQ ID NO: 2033380 - DNA, 20 bp, Homo sapiens
cagctccctaggagaccaag

SEQ ID NO: 2033381 - DNA, 21 bp, Homo sapiens
cagctcccttcccctgcctgg

SEQ ID NO: 2033382 - DNA, 22 bp, Homo sapiens
cagctcccttcccctgcctggt

SEQ ID NO: 2033383 - DNA, 15 bp, Homo sapiens
cagctccgtcatctg

SEQ ID NO: 2033384 - DNA, 16 bp, Homo sapiens
cagctccgtcatctgc

SEQ ID NO: 2033385 - DNA, 21 bp, Homo sapiens
cagctcctctccttgggctcc

SEQ ID NO: 2033386 - DNA, 18 bp, Homo sapiens
cagctcctctgtctcgag

SEQ ID NO: 2033387 - DNA, 12 bp, Homo sapiens
cagctcctctta

SEQ ID NO: 2033388 - DNA, 17 bp, Homo sapiens
cagctcctgggcagctt

SEQ ID NO: 2033389 - DNA, 17 bp, Homo sapiens
cagctccttctgtccta

SEQ ID NO: 2033390 - DNA, 21 bp, Homo sapiens
cagctccttctgtcctactct

SEQ ID NO: 2033391 - DNA, 20 bp, Homo sapiens
cagctccttttgtccccagg

SEQ ID NO: 2033392 - DNA, 22 bp, Homo sapiens
cagctccttttgtccccagggc

SEQ ID NO: 2033393 - DNA, 15 bp, Homo sapiens
cagctctactggtct

SEQ ID NO: 2033394 - DNA, 12 bp, Homo sapiens
cagctctcagcc

SEQ ID NO: 2033395 - DNA, 13 bp, Homo sapiens
cagctctcagcca

SEQ ID NO: 2033396 - DNA, 14 bp, Homo sapiens
cagctctccctctg

SEQ ID NO: 2033397 - DNA, 17 bp, Homo sapiens
cagctctccctctggcc

SEQ ID NO: 2033398 - DNA, 21 bp, Homo sapiens
cagctctccctctggccctgc

SEQ ID NO: 2033399 - DNA, 13 bp, Homo sapiens
cagctctctgtat

SEQ ID NO: 2033400 - DNA, 14 bp, Homo sapiens
cagctctgacattc

SEQ ID NO: 2033401 - DNA, 17 bp, Homo sapiens
cagctctgtcctgggag

SEQ ID NO: 2033402 - DNA, 16 bp, Homo sapiens
cagctctgtggcctgt

SEQ ID NO: 2033403 - DNA, 18 bp, Homo sapiens
cagctctgtggcctgtgt

SEQ ID NO: 2033404 - DNA, 19 bp, Homo sapiens
cagctctgtggcctgtgtc

SEQ ID NO: 2033405 - DNA, 20 bp, Homo sapiens
cagctctgtggcctgtgtcc

SEQ ID NO: 2033406 - DNA, 23 bp, Homo sapiens
cagctctgtggcctgtgtccagc

SEQ ID NO: 2033407 - DNA, 23 bp, Homo sapiens
cagctcttcactcagccacaccc

SEQ ID NO: 2033408 - DNA, 17 bp, Homo sapiens
cagctcttcccctttcc

SEQ ID NO: 2033409 - DNA, 21 bp, Homo sapiens
cagctcttcccctttcctggg

SEQ ID NO: 2033410 - DNA, 15 bp, Homo sapiens
cagctcttctaagga

SEQ ID NO: 2033411 - DNA, 17 bp, Homo sapiens
cagctcttctccaggct

SEQ ID NO: 2033412 - DNA, 19 bp, Homo sapiens
cagctcttggcattttcct

SEQ ID NO: 2033413 - DNA, 17 bp, Homo sapiens
cagctcttggcccctgt

SEQ ID NO: 2033414 - DNA, 19 bp, Homo sapiens
cagctcttggcccctgtgt

SEQ ID NO: 2033415 - DNA, 22 bp, Homo sapiens
cagctcttggcccctgtgtgag

SEQ ID NO: 2033416 - DNA, 16 bp, Homo sapiens
cagctctttgttcagt

SEQ ID NO: 2033417 - DNA, 22 bp, Homo sapiens
cagctgaaacattccgaagagg

SEQ ID NO: 2033418 - DNA, 15 bp, Homo sapiens
cagctgacagataca

SEQ ID NO: 2033419 - DNA, 13 bp, Homo sapiens
cagctgacagctg

SEQ ID NO: 2033420 - DNA, 14 bp, Homo sapiens
cagctgacagctgc

SEQ ID NO: 2033421 - DNA, 15 bp, Homo sapiens
cagctgagagccctg

SEQ ID NO: 2033422 - DNA, 14 bp, Homo sapiens
cagctgagcagggc

SEQ ID NO: 2033423 - DNA, 18 bp, Homo sapiens
cagctgagtgaaaaatct

SEQ ID NO: 2033424 - DNA, 22 bp, Homo sapiens
cagctgattttgtcactgtctt

SEQ ID NO: 2033425 - DNA, 23 bp, Homo sapiens
cagctgattttgtcactgtcttc

SEQ ID NO: 2033426 - DNA, 14 bp, Homo sapiens
cagctgcacattcc

SEQ ID NO: 2033427 - DNA, 18 bp, Homo sapiens
cagagacgcaagggagaa

SEQ ID NO: 2033428 - DNA, 19 bp, Homo sapiens
cagagactcagggccccag

SEQ ID NO: 2033429 - DNA, 20 bp, Homo sapiens
cagagactcagggccccagc

SEQ ID NO: 2033430 - DNA, 14 bp, Homo sapiens
cagagagacagacc

SEQ ID NO: 2033431 - DNA, 16 bp, Homo sapiens
cagagagagacagaga

SEQ ID NO: 2033432 - DNA, 21 bp, Homo sapiens
cagagagagactgagggagag

SEQ ID NO: 2033433 - DNA, 20 bp, Homo sapiens
cagagagcttagcctggagc

SEQ ID NO: 2033434 - DNA, 15 bp, Homo sapiens
cagagaggagcacct

SEQ ID NO: 2033435 - DNA, 13 bp, Homo sapiens
cagagagggccca

SEQ ID NO: 2033436 - DNA, 14 bp, Homo sapiens
cagagagggcccag

SEQ ID NO: 2033437 - DNA, 17 bp, Homo sapiens
cagagagggcccagctg

SEQ ID NO: 2033438 - DNA, 18 bp, Homo sapiens
cagagagggcccagctgt

SEQ ID NO: 2033439 - DNA, 20 bp, Homo sapiens
cagagaggggacatttccct

SEQ ID NO: 2033440 - DNA, 21 bp, Homo sapiens
cagagaggggacatttccctc

SEQ ID NO: 2033441 - DNA, 23 bp, Homo sapiens
cagagaggggacatttccctcct

SEQ ID NO: 2033442 - DNA, 12 bp, Homo sapiens
cagagagggtgg

SEQ ID NO: 2033443 - DNA, 21 bp, Homo sapiens
cagagaggtctcaggttcttt

SEQ ID NO: 2033444 - DNA, 18 bp, Homo sapiens
cagagaggtggagaactg

SEQ ID NO: 2033445 - DNA, 14 bp, Homo sapiens
cagagagtcctctg

SEQ ID NO: 2033446 - DNA, 15 bp, Homo sapiens
cagagagtcctctgg

SEQ ID NO: 2033447 - DNA, 23 bp, Homo sapiens
cagcccgtgaagcagtgcctcga

SEQ ID NO: 2033448 - DNA, 16 bp, Homo sapiens
cagccctaaacatcat

SEQ ID NO: 2033449 - DNA, 19 bp, Homo sapiens
cagccctaaggatctctca

SEQ ID NO: 2033450 - DNA, 18 bp, Homo sapiens
cagccctacatcttcagc

SEQ ID NO: 2033451 - DNA, 14 bp, Homo sapiens
cagccctatggatg

SEQ ID NO: 2033452 - DNA, 15 bp, Homo sapiens
cagccctatggatgt

SEQ ID NO: 2033453 - DNA, 20 bp, Homo sapiens
cagccctatggatgtggggt

SEQ ID NO: 2033454 - DNA, 17 bp, Homo sapiens
cagccctccctgcccct

SEQ ID NO: 2033455 - DNA, 14 bp, Homo sapiens
cagccctccctgtc

SEQ ID NO: 2033456 - DNA, 16 bp, Homo sapiens
cagccctccctgtcct

SEQ ID NO: 2033457 - DNA, 21 bp, Homo sapiens
cagccctccctgtcctcctcg

SEQ ID NO: 2033458 - DNA, 16 bp, Homo sapiens
cagccctcctcacccc

SEQ ID NO: 2033459 - DNA, 13 bp, Homo sapiens
cagccctgccagg

SEQ ID NO: 2033460 - DNA, 11 bp, Homo sapiens
cagccctgctt

SEQ ID NO: 2033461 - DNA, 13 bp, Homo sapiens
cagccctgctttg

SEQ ID NO: 2033462 - DNA, 20 bp, Homo sapiens
cagccctgctttgggctgcc

SEQ ID NO: 2033463 - DNA, 12 bp, Homo sapiens
cagccctgggcc

SEQ ID NO: 2033464 - DNA, 13 bp, Homo sapiens
cagccctgggccc

SEQ ID NO: 2033465 - DNA, 17 bp, Homo sapiens
cagccctgggccccacc

SEQ ID NO: 2033466 - DNA, 23 bp, Homo sapiens
cagccctgggccccaccacctag

SEQ ID NO: 2033467 - DNA, 11 bp, Homo sapiens
cagccctgggg

SEQ ID NO: 2033468 - DNA, 19 bp, Homo sapiens
cagccctgggggccagctg

SEQ ID NO: 2033469 - DNA, 13 bp, Homo sapiens
cagcccttagcag

SEQ ID NO: 2033470 - DNA, 12 bp, Homo sapiens
cagcccttccct

SEQ ID NO: 2033471 - DNA, 16 bp, Homo sapiens
cagcccttctgccttt

SEQ ID NO: 2033472 - DNA, 20 bp, Homo sapiens
cagcccttgagctccccaaa

SEQ ID NO: 2033473 - DNA, 12 bp, Homo sapiens
cagcccttgccc

SEQ ID NO: 2033474 - DNA, 15 bp, Homo sapiens
cagcccttgccccca

SEQ ID NO: 2033475 - DNA, 18 bp, Homo sapiens
cagccgcagacaagtaat

SEQ ID NO: 2033476 - DNA, 16 bp, Homo sapiens
cagccgcagcctccct

SEQ ID NO: 2033477 - DNA, 17 bp, Homo sapiens
cagccgcaggaaggcag

SEQ ID NO: 2033478 - DNA, 13 bp, Homo sapiens
cagccgccctggg

SEQ ID NO: 2033479 - DNA, 16 bp, Homo sapiens
cagccgccctgggctg

SEQ ID NO: 2033480 - DNA, 16 bp, Homo sapiens
cagccgctaggagaga

SEQ ID NO: 2033481 - DNA, 21 bp, Homo sapiens
cagccgctaggagagactgaa

SEQ ID NO: 2033482 - DNA, 14 bp, Homo sapiens
cagccgctcctgtc

SEQ ID NO: 2033483 - DNA, 19 bp, Homo sapiens
cagccgctcctgtctgcca

SEQ ID NO: 2033484 - DNA, 23 bp, Homo sapiens
cagccgctcctgtctgccagcca

SEQ ID NO: 2033485 - DNA, 14 bp, Homo sapiens
cagccgcttctgac

SEQ ID NO: 2033486 - DNA, 20 bp, Homo sapiens
cagccggcgtggcaaatata

SEQ ID NO: 2033487 - DNA, 21 bp, Homo sapiens
cagccggtacctgggaagggg

SEQ ID NO: 2033488 - DNA, 17 bp, Homo sapiens
cagccgtgatgctcagg

SEQ ID NO: 2033489 - DNA, 16 bp, Homo sapiens
cagccgtgccttcagc

SEQ ID NO: 2033490 - DNA, 20 bp, Homo sapiens
cagccgtgccttcagctcta

SEQ ID NO: 2033491 - DNA, 15 bp, Homo sapiens
cagcctagccgacct

SEQ ID NO: 2033492 - DNA, 18 bp, Homo sapiens
cagcctagccgacctcag

SEQ ID NO: 2033493 - DNA, 21 bp, Homo sapiens
cagcctagccgacctcagcct

SEQ ID NO: 2033494 - DNA, 12 bp, Homo sapiens
cagcctcagctc

SEQ ID NO: 2033495 - DNA, 13 bp, Homo sapiens
cagcctcagctca

SEQ ID NO: 2033496 - DNA, 15 bp, Homo sapiens
cagcctcagctcagc

SEQ ID NO: 2033497 - DNA, 21 bp, Homo sapiens
cagcctcagctcagcctcccc

SEQ ID NO: 2033498 - DNA, 15 bp, Homo sapiens
cagcctcagtgccac

SEQ ID NO: 2033499 - DNA, 20 bp, Homo sapiens
cagcctccaagctccatctc

SEQ ID NO: 2033500 - DNA, 15 bp, Homo sapiens
cagcctccagagcca

SEQ ID NO: 2033501 - DNA, 17 bp, Homo sapiens
cagcctccagagccagc

SEQ ID NO: 2033502 - DNA, 18 bp, Homo sapiens
cagcctccagagccagcc

SEQ ID NO: 2033503 - DNA, 20 bp, Homo sapiens
cagcctccagagccagcctg

SEQ ID NO: 2033504 - DNA, 22 bp, Homo sapiens
cagcctccagagccagcctggg

SEQ ID NO: 2033505 - DNA, 23 bp, Homo sapiens
cagcctccagagccagcctggga

SEQ ID NO: 2033506 - DNA, 20 bp, Homo sapiens
cagcctccatgctgcctcca

SEQ ID NO: 2033507 - DNA, 21 bp, Homo sapiens
cagcctcccaaagtgctggga

SEQ ID NO: 2033508 - DNA, 19 bp, Homo sapiens
cagcctcccagagtgctag

SEQ ID NO: 2033509 - DNA, 13 bp, Homo sapiens
cagcctccccaca

SEQ ID NO: 2033510 - DNA, 12 bp, Homo sapiens
cagcctcccccc

SEQ ID NO: 2033511 - DNA, 16 bp, Homo sapiens
cagcctccccccgctg

SEQ ID NO: 2033512 - DNA, 20 bp, Homo sapiens
cagcctccccccgctgggga

SEQ ID NO: 2033513 - DNA, 19 bp, Homo sapiens
cagcctccccctgctgctc

SEQ ID NO: 2033514 - DNA, 22 bp, Homo sapiens
cagcctcccgaatagctgggac

SEQ ID NO: 2033515 - DNA, 21 bp, Homo sapiens
cagcctcccgagtagctggga

SEQ ID NO: 2033516 - DNA, 22 bp, Homo sapiens
cagcctcccgagtagctgggac

SEQ ID NO: 2033517 - DNA, 23 bp, Homo sapiens
cagcctcccgagtagctgggact

SEQ ID NO: 2033518 - DNA, 23 bp, Homo sapiens
cagcctccctctgacctgcaggc

SEQ ID NO: 2033519 - DNA, 15 bp, Homo sapiens
cagcctcctcccacc

SEQ ID NO: 2033520 - DNA, 16 bp, Homo sapiens
cagcctcctcccacca

SEQ ID NO: 2033521 - DNA, 15 bp, Homo sapiens
cagcctcgcatgcca

SEQ ID NO: 2033522 - DNA, 16 bp, Homo sapiens
cagcctcgcatgccag

SEQ ID NO: 2033523 - DNA, 12 bp, Homo sapiens
cagcctctcccg

SEQ ID NO: 2033524 - DNA, 16 bp, Homo sapiens
cagcctctcccggctg

SEQ ID NO: 2033525 - DNA, 22 bp, Homo sapiens
cagcctctgggccaagactcct

SEQ ID NO: 2033526 - DNA, 19 bp, Homo sapiens
cagcctcttaaagctgcct

SEQ ID NO: 2033527 - DNA, 22 bp, Homo sapiens
cagcctgactagaccccaccct

SEQ ID NO: 2033528 - DNA, 19 bp, Homo sapiens
cagcctgaggctgagactg

SEQ ID NO: 2033529 - DNA, 18 bp, Homo sapiens
cagcctgagtctcctgtg

SEQ ID NO: 2033530 - DNA, 16 bp, Homo sapiens
cagcctgatggccaag

SEQ ID NO: 2033531 - DNA, 20 bp, Homo sapiens
cagcctgctccttcccagga

SEQ ID NO: 2033532 - DNA, 22 bp, Homo sapiens
cagcctggactttggttctctc

SEQ ID NO: 2033533 - DNA, 14 bp, Homo sapiens
cagcctggcctcct

SEQ ID NO: 2033534 - DNA, 16 bp, Homo sapiens
cagcctggcctcctgc

SEQ ID NO: 2033535 - DNA, 17 bp, Homo sapiens
cagcctggcctcctgcc

SEQ ID NO: 2033536 - DNA, 20 bp, Homo sapiens
cagcctggcggggcaggagg

SEQ ID NO: 2033537 - DNA, 22 bp, Homo sapiens
cagcctggcggggcaggaggcc

SEQ ID NO: 2033538 - DNA, 23 bp, Homo sapiens
cagcctggcggggcaggaggcct

SEQ ID NO: 2033539 - DNA, 14 bp, Homo sapiens
cagcctggcttctg

SEQ ID NO: 2033540 - DNA, 15 bp, Homo sapiens
cagcctggcttctgg

SEQ ID NO: 2033541 - DNA, 20 bp, Homo sapiens
cagcctgggcaacagagcaa

SEQ ID NO: 2033542 - DNA, 13 bp, Homo sapiens
cagcctgggccta

SEQ ID NO: 2033543 - DNA, 18 bp, Homo sapiens
cagcctgggcctatggag

SEQ ID NO: 2033544 - DNA, 11 bp, Homo sapiens
cagcctgggcg

SEQ ID NO: 2033545 - DNA, 14 bp, Homo sapiens
cagcctgggtgacg

SEQ ID NO: 2033546 - DNA, 18 bp, Homo sapiens
cagcctggtgggcctcct

SEQ ID NO: 2033547 - DNA, 12 bp, Homo sapiens
cagcctgtcctg

SEQ ID NO: 2033548 - DNA, 13 bp, Homo sapiens
cagcctgtcctgg

SEQ ID NO: 2033549 - DNA, 22 bp, Homo sapiens
cagcctgtcctggtacagcagg

SEQ ID NO: 2033550 - DNA, 12 bp, Homo sapiens
cagcctgtggcg

SEQ ID NO: 2033551 - DNA, 20 bp, Homo sapiens
cagcctgtggcggtgcctgg

SEQ ID NO: 2033552 - DNA, 21 bp, Homo sapiens
cagcctgtggcggtgcctggg

SEQ ID NO: 2033553 - DNA, 24 bp, Homo sapiens
cagccttcataggcggtcatgtgt

SEQ ID NO: 2033554 - DNA, 16 bp, Homo sapiens
cagccttccccttgcc

SEQ ID NO: 2033555 - DNA, 13 bp, Homo sapiens
cagccttcctgac

SEQ ID NO: 2033556 - DNA, 12 bp, Homo sapiens
cagcctttctgt

SEQ ID NO: 2033557 - DNA, 13 bp, Homo sapiens
cagcgagaggcag

SEQ ID NO: 2033558 - DNA, 20 bp, Homo sapiens
cagcgagccctggtggcagt

SEQ ID NO: 2033559 - DNA, 23 bp, Homo sapiens
cagcgattccctctcccaggccc

SEQ ID NO: 2033560 - DNA, 16 bp, Homo sapiens
cagcgcctccctccac

SEQ ID NO: 2033561 - DNA, 23 bp, Homo sapiens
cagcgcctccctccaccccagga

SEQ ID NO: 2033562 - DNA, 21 bp, Homo sapiens
cactatggtatgctggccagc

SEQ ID NO: 2033563 - DNA, 22 bp, Homo sapiens
cactatggtatgctggccagca

SEQ ID NO: 2033564 - DNA, 17 bp, Homo sapiens
cactatgttgcccaggc

SEQ ID NO: 2033565 - DNA, 21 bp, Homo sapiens
cactatgttgcccaggcaggt

SEQ ID NO: 2033566 - DNA, 17 bp, Homo sapiens
cactattacttgaactt

SEQ ID NO: 2033567 - DNA, 15 bp, Homo sapiens
cactattcctaggag

SEQ ID NO: 2033568 - DNA, 21 bp, Homo sapiens
cactcaaaaaggtgtgtcaaa

SEQ ID NO: 2033569 - DNA, 16 bp, Homo sapiens
cactcaaatcaagaaa

SEQ ID NO: 2033570 - DNA, 19 bp, Homo sapiens
cactcaaattaatctttct

SEQ ID NO: 2033571 - DNA, 14 bp, Homo sapiens
cactcaacaataaa

SEQ ID NO: 2033572 - DNA, 24 bp, Homo sapiens
cactcaccagggtccgcaccagct

SEQ ID NO: 2033573 - DNA, 18 bp, Homo sapiens
cactcaccagtgtcccct

SEQ ID NO: 2033574 - DNA, 21 bp, Homo sapiens
cactcaccagtgtcccctcca

SEQ ID NO: 2033575 - DNA, 16 bp, Homo sapiens
cactcacccatgtgcc

SEQ ID NO: 2033576 - DNA, 21 bp, Homo sapiens
cactcacccatgtgccaaggt

SEQ ID NO: 2033577 - DNA, 21 bp, Homo sapiens
cactcagaaaagaaaaccatt

SEQ ID NO: 2033578 - DNA, 12 bp, Homo sapiens
cactcagaagac

SEQ ID NO: 2033579 - DNA, 22 bp, Homo sapiens
cactcagaagcctgggggcctg

SEQ ID NO: 2033580 - DNA, 14 bp, Homo sapiens
cactcagcagcccc

SEQ ID NO: 2033581 - DNA, 20 bp, Homo sapiens
cactcagcagccccctgccc

SEQ ID NO: 2033582 - DNA, 14 bp, Homo sapiens
cactcaggactttg

SEQ ID NO: 2033583 - DNA, 13 bp, Homo sapiens
cactcagggctgc

SEQ ID NO: 2033584 - DNA, 16 bp, Homo sapiens
cactcagtccatagca

SEQ ID NO: 2033585 - DNA, 15 bp, Homo sapiens
cactcattcctgtag

SEQ ID NO: 2033586 - DNA, 18 bp, Homo sapiens
cactccaccccctccagc

SEQ ID NO: 2033587 - DNA, 11 bp, Homo sapiens
cactccagccc

SEQ ID NO: 2033588 - DNA, 13 bp, Homo sapiens
cactccagccctg

SEQ ID NO: 2033589 - DNA, 14 bp, Homo sapiens
cactccagcctgag

SEQ ID NO: 2033590 - DNA, 21 bp, Homo sapiens
cactccagcctgagcaacaga

SEQ ID NO: 2033591 - DNA, 16 bp, Homo sapiens
cactccagcctgggcg

SEQ ID NO: 2033592 - DNA, 14 bp, Homo sapiens
cactccatggccac

SEQ ID NO: 2033593 - DNA, 15 bp, Homo sapiens
cactccatggccacc

SEQ ID NO: 2033594 - DNA, 16 bp, Homo sapiens
cactccatggccaccc

SEQ ID NO: 2033595 - DNA, 14 bp, Homo sapiens
cactcccataagct

SEQ ID NO: 2033596 - DNA, 14 bp, Homo sapiens
cactccccaccttc

SEQ ID NO: 2033597 - DNA, 16 bp, Homo sapiens
cactcccccacctgac

SEQ ID NO: 2033598 - DNA, 14 bp, Homo sapiens
cactccctgagctt

SEQ ID NO: 2033599 - DNA, 19 bp, Homo sapiens
cactccggtgtgcctgcag

SEQ ID NO: 2033600 - DNA, 22 bp, Homo sapiens
cactccggtgtgcctgcagccc

SEQ ID NO: 2033601 - DNA, 17 bp, Homo sapiens
cactcctctgtctctgc

SEQ ID NO: 2033602 - DNA, 20 bp, Homo sapiens
cactcctctgtctctgctct

SEQ ID NO: 2033603 - DNA, 21 bp, Homo sapiens
cactcctctgtctctgctctt

SEQ ID NO: 2033604 - DNA, 10 bp, Homo sapiens
cactcctgct

SEQ ID NO: 2033605 - DNA, 13 bp, Homo sapiens
cactccttcctgc

SEQ ID NO: 2033606 - DNA, 15 bp, Homo sapiens
cactccttcctgccc

SEQ ID NO: 2033607 - DNA, 21 bp, Homo sapiens
cactccttcctgccccaactc

SEQ ID NO: 2033608 - DNA, 16 bp, Homo sapiens
cactcgagaccatcct

SEQ ID NO: 2033609 - DNA, 18 bp, Homo sapiens
cactcgggaggctgagac

SEQ ID NO: 2033610 - DNA, 22 bp, Homo sapiens
cactcgggaggctgagacagga

SEQ ID NO: 2033611 - DNA, 17 bp, Homo sapiens
cactctaccctatacaa

SEQ ID NO: 2033612 - DNA, 14 bp, Homo sapiens
cactctacttagca

SEQ ID NO: 2033613 - DNA, 21 bp, Homo sapiens
cactctagtgacttcctggtg

SEQ ID NO: 2033614 - DNA, 12 bp, Homo sapiens
cactctcccctc

SEQ ID NO: 2033615 - DNA, 14 bp, Homo sapiens
cactctcccctccc

SEQ ID NO: 2033616 - DNA, 17 bp, Homo sapiens
cactctcccctccctct

SEQ ID NO: 2033617 - DNA, 21 bp, Homo sapiens
cactctcccctccctcttcct

SEQ ID NO: 2033618 - DNA, 17 bp, Homo sapiens
cactctcggggcccttg

SEQ ID NO: 2033619 - DNA, 19 bp, Homo sapiens
cactctgaataccaagtgt

SEQ ID NO: 2033620 - DNA, 13 bp, Homo sapiens
cactctggcagcc

SEQ ID NO: 2033621 - DNA, 16 bp, Homo sapiens
cactctggcagccaca

SEQ ID NO: 2033622 - DNA, 12 bp, Homo sapiens
cactctggcctc

SEQ ID NO: 2033623 - DNA, 16 bp, Homo sapiens
cactctgtcagccagc

SEQ ID NO: 2033624 - DNA, 17 bp, Homo sapiens
cactctgtcagccagcc

SEQ ID NO: 2033625 - DNA, 22 bp, Homo sapiens
cactctgtcagccagccgccct

SEQ ID NO: 2033626 - DNA, 20 bp, Homo sapiens
cactctgtcgcccagtctgg

SEQ ID NO: 2033627 - DNA, 21 bp, Homo sapiens
cacaataaggtcaatgccaga

SEQ ID NO: 2033628 - DNA, 14 bp, Homo sapiens
cacaatcctgtccc

SEQ ID NO: 2033629 - DNA, 20 bp, Homo sapiens
cacaatctgggactttcact

SEQ ID NO: 2033630 - DNA, 18 bp, Homo sapiens
cacaatctttccttgtct

SEQ ID NO: 2033631 - DNA, 19 bp, Homo sapiens
cacaatctttccttgtctc

SEQ ID NO: 2033632 - DNA, 18 bp, Homo sapiens
cacaatggagtgggagat

SEQ ID NO: 2033633 - DNA, 21 bp, Homo sapiens
cacaatggctaattcccagag

SEQ ID NO: 2033634 - DNA, 18 bp, Homo sapiens
cacaattgatacttcagg

SEQ ID NO: 2033635 - DNA, 23 bp, Homo sapiens
cacaattgatacttcaggtgctt

SEQ ID NO: 2033636 - DNA, 23 bp, Homo sapiens
cacaattttcaggtttcttaaaa

SEQ ID NO: 2033637 - DNA, 15 bp, Homo sapiens
cacacacacacacat

SEQ ID NO: 2033638 - DNA, 12 bp, Homo sapiens
cacacacacata

SEQ ID NO: 2033639 - DNA, 13 bp, Homo sapiens
cacacacactcta

SEQ ID NO: 2033640 - DNA, 21 bp, Homo sapiens
cacacacagagatatgcacac

SEQ ID NO: 2033641 - DNA, 12 bp, Homo sapiens
cacacacagagg

SEQ ID NO: 2033642 - DNA, 23 bp, Homo sapiens
cacacacagaggaagagcaggca

SEQ ID NO: 2033643 - DNA, 14 bp, Homo sapiens
cacacacccctcaa

SEQ ID NO: 2033644 - DNA, 15 bp, Homo sapiens
cacacacggatgcac

SEQ ID NO: 2033645 - DNA, 18 bp, Homo sapiens
cacacagaaatatatata

SEQ ID NO: 2033646 - DNA, 16 bp, Homo sapiens
cacacagagatatgca

SEQ ID NO: 2033647 - DNA, 22 bp, Homo sapiens
cacacagagatatgcacacaca

SEQ ID NO: 2033648 - DNA, 18 bp, Homo sapiens
cacacagagcctgcctca

SEQ ID NO: 2033649 - DNA, 18 bp, Homo sapiens
cacacagcactctctaaa

SEQ ID NO: 2033650 - DNA, 12 bp, Homo sapiens
cacacagcagca

SEQ ID NO: 2033651 - DNA, 19 bp, Homo sapiens
cacacagcagcactgcaga

SEQ ID NO: 2033652 - DNA, 12 bp, Homo sapiens
cacacagcagcc

SEQ ID NO: 2033653 - DNA, 20 bp, Homo sapiens
cacacagctctgtcctggga

SEQ ID NO: 2033654 - DNA, 10 bp, Homo sapiens
cacacaggca

SEQ ID NO: 2033655 - DNA, 16 bp, Homo sapiens
cacacaggcaactgag

SEQ ID NO: 2033656 - DNA, 20 bp, Homo sapiens
cacacaggcaactgaggcag

SEQ ID NO: 2033657 - DNA, 17 bp, Homo sapiens
cacacaggcatttcctg

SEQ ID NO: 2033658 - DNA, 23 bp, Homo sapiens
cacacagtattacttctgctaca

SEQ ID NO: 2033659 - DNA, 19 bp, Homo sapiens
cacacagtctcagtccaga

SEQ ID NO: 2033660 - DNA, 23 bp, Homo sapiens
cacacagtgagtcgaggacaggg

SEQ ID NO: 2033661 - DNA, 15 bp, Homo sapiens
cacacatacacacac

SEQ ID NO: 2033662 - DNA, 13 bp, Homo sapiens
cacacatatacat

SEQ ID NO: 2033663 - DNA, 18 bp, Homo sapiens
cacacatatacatatata

SEQ ID NO: 2033664 - DNA, 19 bp, Homo sapiens
cacacatatacatatatat

SEQ ID NO: 2033665 - DNA, 13 bp, Homo sapiens
cacacatatatat

SEQ ID NO: 2033666 - DNA, 16 bp, Homo sapiens
cacacatggacacaga

SEQ ID NO: 2033667 - DNA, 17 bp, Homo sapiens
cacacatggatgcacac

SEQ ID NO: 2033668 - DNA, 15 bp, Homo sapiens
cacaccactgccctg

SEQ ID NO: 2033669 - DNA, 16 bp, Homo sapiens
cacaccactgccctgc

SEQ ID NO: 2033670 - DNA, 17 bp, Homo sapiens
cacaccatcaccctctg

SEQ ID NO: 2033671 - DNA, 23 bp, Homo sapiens
cacacccagagggtagggcagca

SEQ ID NO: 2033672 - DNA, 13 bp, Homo sapiens
cacacccagccca

SEQ ID NO: 2033673 - DNA, 14 bp, Homo sapiens
cacaccccaaggga

SEQ ID NO: 2033674 - DNA, 18 bp, Homo sapiens
cacaccccaagggacaac

SEQ ID NO: 2033675 - DNA, 13 bp, Homo sapiens
cacaccccagcgc

SEQ ID NO: 2033676 - DNA, 23 bp, Homo sapiens
cacaccccagcgcctgtgctgag

SEQ ID NO: 2033677 - DNA, 23 bp, Homo sapiens
cacaccccccagtcgagccctgc

SEQ ID NO: 2033678 - DNA, 22 bp, Homo sapiens
cacacccggctccccctgcttc

SEQ ID NO: 2033679 - DNA, 14 bp, Homo sapiens
cacaccctccccat

SEQ ID NO: 2033680 - DNA, 23 bp, Homo sapiens
cacaccctccccattcagacact

SEQ ID NO: 2033681 - DNA, 17 bp, Homo sapiens
cacacctcacgctctgg

SEQ ID NO: 2033682 - DNA, 19 bp, Homo sapiens
cacacctcacgctctggac

SEQ ID NO: 2033683 - DNA, 17 bp, Homo sapiens
cacacctccctgaacca

SEQ ID NO: 2033684 - DNA, 14 bp, Homo sapiens
cacacgcacataga

SEQ ID NO: 2033685 - DNA, 22 bp, Homo sapiens
cacacgcaggaactcccagcaa

SEQ ID NO: 2033686 - DNA, 13 bp, Homo sapiens
cacacggccctgc

SEQ ID NO: 2033687 - DNA, 15 bp, Homo sapiens
cacacggccctgccc

SEQ ID NO: 2033688 - DNA, 23 bp, Homo sapiens
cacacggccctgccccatcctgg

SEQ ID NO: 2033689 - DNA, 17 bp, Homo sapiens
cacacgtacttaaatga

SEQ ID NO: 2033690 - DNA, 20 bp, Homo sapiens
cacacgtgctcgcagcctgg

SEQ ID NO: 2033691 - DNA, 21 bp, Homo sapiens
cacacgtgctcgcagcctggc

SEQ ID NO: 2033692 - DNA, 13 bp, Homo sapiens
cacactcagcagc

SEQ ID NO: 2033693 - DNA, 13 bp, Homo sapiens
cacactcagtccc

SEQ ID NO: 2033694 - DNA, 13 bp, Homo sapiens
cacactgagctgg

SEQ ID NO: 2033695 - DNA, 22 bp, Homo sapiens
cacactgagctgggcaccacag

SEQ ID NO: 2033696 - DNA, 20 bp, Homo sapiens
cacactgtaaacccctgggt

SEQ ID NO: 2033697 - DNA, 12 bp, Homo sapiens
cacactgtaaat

SEQ ID NO: 2033698 - DNA, 12 bp, Homo sapiens
cacactgtcaga

SEQ ID NO: 2033699 - DNA, 16 bp, Homo sapiens
cacactgtcagagctg

SEQ ID NO: 2033700 - DNA, 17 bp, Homo sapiens
cacacttcaggctcttc

SEQ ID NO: 2033701 - DNA, 20 bp, Homo sapiens
cacacttcaggctcttctcc

SEQ ID NO: 2033702 - DNA, 21 bp, Homo sapiens
cacacttcaggctcttctcct

SEQ ID NO: 2033703 - DNA, 17 bp, Homo sapiens
cacacttctcaggacac

SEQ ID NO: 2033704 - DNA, 21 bp, Homo sapiens
cacacttcttgaaacagcctg

SEQ ID NO: 2033705 - DNA, 19 bp, Homo sapiens
cacacttgggcgctctgcc

SEQ ID NO: 2033706 - DNA, 21 bp, Homo sapiens
cacacttgggcgctctgccct

SEQ ID NO: 2033707 - DNA, 23 bp, Homo sapiens
cacacttgggcgctctgccctcc

SEQ ID NO: 2033708 - DNA, 13 bp, Homo sapiens
cacagaaacacaa

SEQ ID NO: 2033709 - DNA, 13 bp, Homo sapiens
cacagaaatatat

SEQ ID NO: 2033710 - DNA, 18 bp, Homo sapiens
cacagaaatatatataca

SEQ ID NO: 2033711 - DNA, 21 bp, Homo sapiens
cacagaaatatatatacatat

SEQ ID NO: 2033712 - DNA, 14 bp, Homo sapiens
cacagaagccagga

SEQ ID NO: 2033713 - DNA, 18 bp, Homo sapiens
cacagaaggaatctgtgc

SEQ ID NO: 2033714 - DNA, 15 bp, Homo sapiens
cacagacagatccca

SEQ ID NO: 2033715 - DNA, 19 bp, Homo sapiens
cacagactacagccagaag

SEQ ID NO: 2033716 - DNA, 21 bp, Homo sapiens
cacagactacagccagaagcc

SEQ ID NO: 2033717 - DNA, 18 bp, Homo sapiens
cacagactccctcccctg

SEQ ID NO: 2033718 - DNA, 20 bp, Homo sapiens
cacagacttctggaaggctg

SEQ ID NO: 2033719 - DNA, 21 bp, Homo sapiens
cacagacttctggaaggctgg

SEQ ID NO: 2033720 - DNA, 20 bp, Homo sapiens
cacagagaaagtacttctcc

SEQ ID NO: 2033721 - DNA, 14 bp, Homo sapiens
cacagagagagtca

SEQ ID NO: 2033722 - DNA, 16 bp, Homo sapiens
cacagagatatgcaca

SEQ ID NO: 2033723 - DNA, 14 bp, Homo sapiens
cacagagcctgcct

SEQ ID NO: 2033724 - DNA, 22 bp, Homo sapiens
cacagagcctgcctcagctgct

SEQ ID NO: 2033725 - DNA, 21 bp, Homo sapiens
cacagagctgctattaaatta

SEQ ID NO: 2033726 - DNA, 13 bp, Homo sapiens
cacagaggaagag

SEQ ID NO: 2033727 - DNA, 20 bp, Homo sapiens
cacagaggcagctgtgtggg

SEQ ID NO: 2033728 - DNA, 20 bp, Homo sapiens
cacagagtggagccctcagt

SEQ ID NO: 2033729 - DNA, 15 bp, Homo sapiens
cacagatacatgggg

SEQ ID NO: 2033730 - DNA, 16 bp, Homo sapiens
cacagatgcacacaca

SEQ ID NO: 2033731 - DNA, 22 bp, Homo sapiens
cacagatgcacacacagatgca

SEQ ID NO: 2033732 - DNA, 18 bp, Homo sapiens
cacagatttttgggctcc

SEQ ID NO: 2033733 - DNA, 19 bp, Homo sapiens
cacagcaccagaatgtata

SEQ ID NO: 2033734 - DNA, 13 bp, Homo sapiens
cacagcacccagg

SEQ ID NO: 2033735 - DNA, 18 bp, Homo sapiens
cacagcacccaggctcca

SEQ ID NO: 2033736 - DNA, 19 bp, Homo sapiens
cacagcacccaggctccat

SEQ ID NO: 2033737 - DNA, 14 bp, Homo sapiens
cacagcagaatgaa

SEQ ID NO: 2033738 - DNA, 15 bp, Homo sapiens
cacagcagcactgca

SEQ ID NO: 2033739 - DNA, 18 bp, Homo sapiens
cacagcagcatcttcaaa

SEQ ID NO: 2033740 - DNA, 12 bp, Homo sapiens
cacagcagcccc

SEQ ID NO: 2033741 - DNA, 20 bp, Homo sapiens
cactgccccaccagccacct

SEQ ID NO: 2033742 - DNA, 22 bp, Homo sapiens
cactgccccaccagccacctct

SEQ ID NO: 2033743 - DNA, 18 bp, Homo sapiens
cactgccctgcctgccca

SEQ ID NO: 2033744 - DNA, 16 bp, Homo sapiens
cactgcctcttcctcc

SEQ ID NO: 2033745 - DNA, 13 bp, Homo sapiens
cactgccttccag

SEQ ID NO: 2033746 - DNA, 18 bp, Homo sapiens
cactgccttccaggagca

SEQ ID NO: 2033747 - DNA, 22 bp, Homo sapiens
cactgccttcgatacaccgggc

SEQ ID NO: 2033748 - DNA, 21 bp, Homo sapiens
cactgctacaccttagcagct

SEQ ID NO: 2033749 - DNA, 22 bp, Homo sapiens
cactgctaggcgagtgccagga

SEQ ID NO: 2033750 - DNA, 22 bp, Homo sapiens
cactgctcaagaagacatggag

SEQ ID NO: 2033751 - DNA, 17 bp, Homo sapiens
cactgctctcagcctcc

SEQ ID NO: 2033752 - DNA, 12 bp, Homo sapiens
cactgctgcacc

SEQ ID NO: 2033753 - DNA, 14 bp, Homo sapiens
cactgctgcaccag

SEQ ID NO: 2033754 - DNA, 15 bp, Homo sapiens
cactgctgcaccaga

SEQ ID NO: 2033755 - DNA, 16 bp, Homo sapiens
cactgctggctgcctt

SEQ ID NO: 2033756 - DNA, 13 bp, Homo sapiens
cactgctggggag

SEQ ID NO: 2033757 - DNA, 17 bp, Homo sapiens
cactgcttgaggagggg

SEQ ID NO: 2033758 - DNA, 22 bp, Homo sapiens
cactggaatcgatctgtactgt

SEQ ID NO: 2033759 - DNA, 17 bp, Homo sapiens
cactggagcaccaggca

SEQ ID NO: 2033760 - DNA, 14 bp, Homo sapiens
cactggagcccagg

SEQ ID NO: 2033761 - DNA, 15 bp, Homo sapiens
cactggagcccagga

SEQ ID NO: 2033762 - DNA, 17 bp, Homo sapiens
cactggagtgcagggag

SEQ ID NO: 2033763 - DNA, 22 bp, Homo sapiens
cactggagttacattaatgtta

SEQ ID NO: 2033764 - DNA, 19 bp, Homo sapiens
cactggcacgtttgtgaga

SEQ ID NO: 2033765 - DNA, 21 bp, Homo sapiens
cactggccagtcctagagctc

SEQ ID NO: 2033766 - DNA, 16 bp, Homo sapiens
cactggctggggcaga

SEQ ID NO: 2033767 - DNA, 19 bp, Homo sapiens
cactgggtctcactcctga

SEQ ID NO: 2033768 - DNA, 20 bp, Homo sapiens
cactgggtctcactcctgag

SEQ ID NO: 2033769 - DNA, 22 bp, Homo sapiens
cactggtgactgcgatcttcag

SEQ ID NO: 2033770 - DNA, 21 bp, Homo sapiens
cactggtggcccgacagcctg

SEQ ID NO: 2033771 - DNA, 17 bp, Homo sapiens
cactggttgtaagtaat

SEQ ID NO: 2033772 - DNA, 16 bp, Homo sapiens
cactggtttctcagaa

SEQ ID NO: 2033773 - DNA, 19 bp, Homo sapiens
cactggtttctcagaatcc

SEQ ID NO: 2033774 - DNA, 19 bp, Homo sapiens
cactgtaaacccctgggta

SEQ ID NO: 2033775 - DNA, 19 bp, Homo sapiens
cactgtaaatatccacaga

SEQ ID NO: 2033776 - DNA, 17 bp, Homo sapiens
cactgtaacctcaaact

SEQ ID NO: 2033777 - DNA, 22 bp, Homo sapiens
cactgtaagactcattccctag

SEQ ID NO: 2033778 - DNA, 15 bp, Homo sapiens
cactgtaagtttatt

SEQ ID NO: 2033779 - DNA, 11 bp, Homo sapiens
cactgtacata

SEQ ID NO: 2033780 - DNA, 16 bp, Homo sapiens
cactgtatgctggacg

SEQ ID NO: 2033781 - DNA, 18 bp, Homo sapiens
cactgtatgctggacggc

SEQ ID NO: 2033782 - DNA, 22 bp, Homo sapiens
cactgtattttcattttaattt

SEQ ID NO: 2033783 - DNA, 15 bp, Homo sapiens
cactgtcagagctgt

SEQ ID NO: 2033784 - DNA, 18 bp, Homo sapiens
cactgtccctcaaatgac

SEQ ID NO: 2033785 - DNA, 23 bp, Homo sapiens
cactgtccctcaaatgacccaaa

SEQ ID NO: 2033786 - DNA, 17 bp, Homo sapiens
cactgtccgcctctgcc

SEQ ID NO: 2033787 - DNA, 22 bp, Homo sapiens
cactgtctcaactactcagctc

SEQ ID NO: 2033788 - DNA, 20 bp, Homo sapiens
cactgtctcctggtctgtgc

SEQ ID NO: 2033789 - DNA, 13 bp, Homo sapiens
cactgtctgcgtg

SEQ ID NO: 2033790 - DNA, 19 bp, Homo sapiens
cactgtgaagacccagcag

SEQ ID NO: 2033791 - DNA, 20 bp, Homo sapiens
cactgtgaggggaaggcctt

SEQ ID NO: 2033792 - DNA, 14 bp, Homo sapiens
cactgtgccatgtg

SEQ ID NO: 2033793 - DNA, 15 bp, Homo sapiens
cactgtgccatgtgc

SEQ ID NO: 2033794 - DNA, 12 bp, Homo sapiens
cactgtggccag

SEQ ID NO: 2033795 - DNA, 17 bp, Homo sapiens
cactgtggccagagctg

SEQ ID NO: 2033796 - DNA, 19 bp, Homo sapiens
cactgtggccagagctgga

SEQ ID NO: 2033797 - DNA, 21 bp, Homo sapiens
cactgtgggggctggtcctga

SEQ ID NO: 2033798 - DNA, 20 bp, Homo sapiens
cactgtgttggccaggctgg

SEQ ID NO: 2033799 - DNA, 21 bp, Homo sapiens
cactgtgttggccaggctggt

SEQ ID NO: 2033800 - DNA, 16 bp, Homo sapiens
cactgttactccacag

SEQ ID NO: 2033801 - DNA, 14 bp, Homo sapiens
cactgttgcccagg

SEQ ID NO: 2033802 - DNA, 16 bp, Homo sapiens
cactgttgcccaggct

SEQ ID NO: 2033803 - DNA, 14 bp, Homo sapiens
cacttaaaaaatgt

SEQ ID NO: 2033804 - DNA, 16 bp, Homo sapiens
cacttaaaaaatgtcc

SEQ ID NO: 2033805 - DNA, 18 bp, Homo sapiens
cacttacctagatttaca

SEQ ID NO: 2033806 - DNA, 13 bp, Homo sapiens
cacttaccttcaa

SEQ ID NO: 2033807 - DNA, 14 bp, Homo sapiens
cacttaccttcaat

SEQ ID NO: 2033808 - DNA, 19 bp, Homo sapiens
cacttaccttcaataaagt

SEQ ID NO: 2033809 - DNA, 17 bp, Homo sapiens
cacttagaaattgcatt

SEQ ID NO: 2033810 - DNA, 19 bp, Homo sapiens
cacttagccgtccatggca

SEQ ID NO: 2033811 - DNA, 22 bp, Homo sapiens
cacttagccgtccatggcacca

SEQ ID NO: 2033812 - DNA, 16 bp, Homo sapiens
caagttcctgcactcc

SEQ ID NO: 2033813 - DNA, 19 bp, Homo sapiens
caagttcctgcactccaga

SEQ ID NO: 2033814 - DNA, 16 bp, Homo sapiens
caagttctagagaaga

SEQ ID NO: 2033815 - DNA, 21 bp, Homo sapiens
caagttctagagaagaggctg

SEQ ID NO: 2033816 - DNA, 18 bp, Homo sapiens
caagtttataagcccaaa

SEQ ID NO: 2033817 - DNA, 17 bp, Homo sapiens
caagttttgtataaata

SEQ ID NO: 2033818 - DNA, 19 bp, Homo sapiens
caagtttttacaaaatact

SEQ ID NO: 2033819 - DNA, 16 bp, Homo sapiens
caataaaaaaaagaaa

SEQ ID NO: 2033820 - DNA, 18 bp, Homo sapiens
caataaaaatctttgatt

SEQ ID NO: 2033821 - DNA, 17 bp, Homo sapiens
caataaaatagtattga

SEQ ID NO: 2033822 - DNA, 13 bp, Homo sapiens
caataaaatcatg

SEQ ID NO: 2033823 - DNA, 17 bp, Homo sapiens
caataaacctcttttct

SEQ ID NO: 2033824 - DNA, 12 bp, Homo sapiens
caataaagagct

SEQ ID NO: 2033825 - DNA, 15 bp, Homo sapiens
caataaagctgctga

SEQ ID NO: 2033826 - DNA, 22 bp, Homo sapiens
caataaagctgctgagaatcta

SEQ ID NO: 2033827 - DNA, 19 bp, Homo sapiens
caataaagctggacaagaa

SEQ ID NO: 2033828 - DNA, 11 bp, Homo sapiens
caataaatgct

SEQ ID NO: 2033829 - DNA, 14 bp, Homo sapiens
caataaatgctgaa

SEQ ID NO: 2033830 - DNA, 15 bp, Homo sapiens
caataaatgctgaat

SEQ ID NO: 2033831 - DNA, 17 bp, Homo sapiens
caataacttcagagaag

SEQ ID NO: 2033832 - DNA, 17 bp, Homo sapiens
caataaggtcaatgcca

SEQ ID NO: 2033833 - DNA, 17 bp, Homo sapiens
caataatgtgcaaattt

SEQ ID NO: 2033834 - DNA, 17 bp, Homo sapiens
caataattaatgtgtgt

SEQ ID NO: 2033835 - DNA, 14 bp, Homo sapiens
caataatttcaggt

SEQ ID NO: 2033836 - DNA, 16 bp, Homo sapiens
caatacaacaagaaca

SEQ ID NO: 2033837 - DNA, 18 bp, Homo sapiens
caatacaacaagaacaac

SEQ ID NO: 2033838 - DNA, 23 bp, Homo sapiens
caataccccaagtccacctgcct

SEQ ID NO: 2033839 - DNA, 17 bp, Homo sapiens
caatactaattgagaaa

SEQ ID NO: 2033840 - DNA, 16 bp, Homo sapiens
caatactactgtaaat

SEQ ID NO: 2033841 - DNA, 22 bp, Homo sapiens
caatactattatattatgtagt

SEQ ID NO: 2033842 - DNA, 16 bp, Homo sapiens
caatactgccttaatg

SEQ ID NO: 2033843 - DNA, 20 bp, Homo sapiens
caatagctattgcatgtaaa

SEQ ID NO: 2033844 - DNA, 13 bp, Homo sapiens
caatataaattgg

SEQ ID NO: 2033845 - DNA, 20 bp, Homo sapiens
caatatataaaaatatatat

SEQ ID NO: 2033846 - DNA, 21 bp, Homo sapiens
caatatataaaaatatatata

SEQ ID NO: 2033847 - DNA, 19 bp, Homo sapiens
caatatgaaggactattaa

SEQ ID NO: 2033848 - DNA, 11 bp, Homo sapiens
caatatgctta

SEQ ID NO: 2033849 - DNA, 20 bp, Homo sapiens
caatatgcttattctatcca

SEQ ID NO: 2033850 - DNA, 15 bp, Homo sapiens
caatatgtaaatagt

SEQ ID NO: 2033851 - DNA, 15 bp, Homo sapiens
caatattcaaatgcg

SEQ ID NO: 2033852 - DNA, 16 bp, Homo sapiens
caatattcaataaagc

SEQ ID NO: 2033853 - DNA, 17 bp, Homo sapiens
caatattcaataaagct

SEQ ID NO: 2033854 - DNA, 17 bp, Homo sapiens
caatatttactcatcag

SEQ ID NO: 2033855 - DNA, 19 bp, Homo sapiens
caatatttattattttcac

SEQ ID NO: 2033856 - DNA, 17 bp, Homo sapiens
caatcaaagcagcacat

SEQ ID NO: 2033857 - DNA, 15 bp, Homo sapiens
caatcacagctcctc

SEQ ID NO: 2033858 - DNA, 15 bp, Homo sapiens
caatcatctgtgtga

SEQ ID NO: 2033859 - DNA, 15 bp, Homo sapiens
caatcatgagtcaga

SEQ ID NO: 2033860 - DNA, 22 bp, Homo sapiens
caatccatgttagtttttactt

SEQ ID NO: 2033861 - DNA, 22 bp, Homo sapiens
caatcccaccaaccctcagagc

SEQ ID NO: 2033862 - DNA, 23 bp, Homo sapiens
caatcccaccaaccctcagagcc

SEQ ID NO: 2033863 - DNA, 18 bp, Homo sapiens
caatcccgtgaaagaatt

SEQ ID NO: 2033864 - DNA, 22 bp, Homo sapiens
caatcctaacacattatcggga

SEQ ID NO: 2033865 - DNA, 22 bp, Homo sapiens
caatcctagaaccaagcttcag

SEQ ID NO: 2033866 - DNA, 23 bp, Homo sapiens
caatcctagaaccaagcttcaga

SEQ ID NO: 2033867 - DNA, 20 bp, Homo sapiens
caatcctcaaacatggaaga

SEQ ID NO: 2033868 - DNA, 17 bp, Homo sapiens
caatcctgcccccagcc

SEQ ID NO: 2033869 - DNA, 15 bp, Homo sapiens
caatcctgtccctca

SEQ ID NO: 2033870 - DNA, 12 bp, Homo sapiens
caatctccaggg

SEQ ID NO: 2033871 - DNA, 20 bp, Homo sapiens
caatctctgtgactcgctta

SEQ ID NO: 2033872 - DNA, 15 bp, Homo sapiens
caatctgggactttc

SEQ ID NO: 2033873 - DNA, 16 bp, Homo sapiens
caatcttgtccacagt

SEQ ID NO: 2033874 - DNA, 20 bp, Homo sapiens
caatgaaacagatgataaat

SEQ ID NO: 2033875 - DNA, 19 bp, Homo sapiens
caatgaaatgctctccttt

SEQ ID NO: 2033876 - DNA, 22 bp, Homo sapiens
caatgaaggaaaacctcacttg

SEQ ID NO: 2033877 - DNA, 15 bp, Homo sapiens
caatgacagggatgc

SEQ ID NO: 2033878 - DNA, 19 bp, Homo sapiens
caatgacatcttcaaagct

SEQ ID NO: 2033879 - DNA, 17 bp, Homo sapiens
caatgaggtctgaaatg

SEQ ID NO: 2033880 - DNA, 18 bp, Homo sapiens
caatgaggtctgaaatgg

SEQ ID NO: 2033881 - DNA, 13 bp, Homo sapiens
caatgatggcaat

SEQ ID NO: 2033882 - DNA, 14 bp, Homo sapiens
caatgatgtccaga

SEQ ID NO: 2033883 - DNA, 21 bp, Homo sapiens
caatgatgtgagtacccagga

SEQ ID NO: 2033884 - DNA, 14 bp, Homo sapiens
caatgcacatccat

SEQ ID NO: 2033885 - DNA, 21 bp, Homo sapiens
caatgcccgtaagatggctta

SEQ ID NO: 2033886 - DNA, 20 bp, Homo sapiens
caatgccctaattagggcat

SEQ ID NO: 2033887 - DNA, 13 bp, Homo sapiens
caatgcctctccc

SEQ ID NO: 2033888 - DNA, 15 bp, Homo sapiens
caatgcctctcccac

SEQ ID NO: 2033889 - DNA, 21 bp, Homo sapiens
caatgccttgacaacagactg

SEQ ID NO: 2033890 - DNA, 20 bp, Homo sapiens
caatgctattgaaattactg

SEQ ID NO: 2033891 - DNA, 12 bp, Homo sapiens
caatgctggctg

SEQ ID NO: 2033892 - DNA, 21 bp, Homo sapiens
caatgctggctgttggctggg

SEQ ID NO: 2033893 - DNA, 22 bp, Homo sapiens
caatgctggctgttggctgggg

SEQ ID NO: 2033894 - DNA, 20 bp, Homo sapiens
caatgctttgggaggccaag

SEQ ID NO: 2033895 - DNA, 23 bp, Homo sapiens
caatgctttgggaggccaaggca

SEQ ID NO: 2033896 - DNA, 12 bp, Homo sapiens
caatggcagcct

SEQ ID NO: 2033897 - DNA, 13 bp, Homo sapiens
caatggcagcctt

SEQ ID NO: 2033898 - DNA, 14 bp, Homo sapiens
caatggcagccttg

SEQ ID NO: 2033899 - DNA, 15 bp, Homo sapiens
caatggcagccttgg

SEQ ID NO: 2033900 - DNA, 18 bp, Homo sapiens
caatggcagctagactgg

SEQ ID NO: 2033901 - DNA, 22 bp, Homo sapiens
caatggcagctagactggagtg

SEQ ID NO: 2033902 - DNA, 19 bp, Homo sapiens
caatggctaattcccagag

SEQ ID NO: 2033903 - DNA, 15 bp, Homo sapiens
caatggctgtaaact

SEQ ID NO: 2033904 - DNA, 17 bp, Homo sapiens
caatgggagggggctcc

SEQ ID NO: 2033905 - DNA, 18 bp, Homo sapiens
caatgggagggggctcca

SEQ ID NO: 2033906 - DNA, 22 bp, Homo sapiens
caatgggagggggctccatgga

SEQ ID NO: 2033907 - DNA, 15 bp, Homo sapiens
caatgggcactggga

SEQ ID NO: 2033908 - DNA, 11 bp, Homo sapiens
caatggggaga

SEQ ID NO: 2033909 - DNA, 16 bp, Homo sapiens
caatggtttgcaagga

SEQ ID NO: 2033910 - DNA, 19 bp, Homo sapiens
caatgtaaatattttaaag

SEQ ID NO: 2033911 - DNA, 15 bp, Homo sapiens
caatgtaacattaat

SEQ ID NO: 2033912 - DNA, 18 bp, Homo sapiens
caatgtaacattaattct

SEQ ID NO: 2033913 - DNA, 14 bp, Homo sapiens
caatgtcaggaaca

SEQ ID NO: 2033914 - DNA, 18 bp, Homo sapiens
caatgtgcaagttgtact

SEQ ID NO: 2033915 - DNA, 21 bp, Homo sapiens
caatgtggcctaaaaatgcaa

SEQ ID NO: 2033916 - DNA, 15 bp, Homo sapiens
caatgttagcctcaa

SEQ ID NO: 2033917 - DNA, 18 bp, Homo sapiens
caatgttctgttgtaaag

SEQ ID NO: 2033918 - DNA, 22 bp, Homo sapiens
caatgttctgttgtaaagagtg

SEQ ID NO: 2033919 - DNA, 23 bp, Homo sapiens
caatgtttatgcaaggaaggaaa

SEQ ID NO: 2033920 - DNA, 13 bp, Homo sapiens
caatgttttcctt

SEQ ID NO: 2033921 - DNA, 13 bp, Homo sapiens
caattaaaatata

SEQ ID NO: 2033922 - DNA, 16 bp, Homo sapiens
caattaaaatatatat

SEQ ID NO: 2033923 - DNA, 19 bp, Homo sapiens
caattaaaatatatataaa

SEQ ID NO: 2033924 - DNA, 14 bp, Homo sapiens
caattaaaattaag

SEQ ID NO: 2033925 - DNA, 21 bp, Homo sapiens
caattagcaattgactgtcac

SEQ ID NO: 2033926 - DNA, 16 bp, Homo sapiens
caattagggcctagcc

SEQ ID NO: 2033927 - DNA, 13 bp, Homo sapiens
caattagtacagt

SEQ ID NO: 2033928 - DNA, 22 bp, Homo sapiens
caattatgcactggccacccaa

SEQ ID NO: 2033929 - DNA, 16 bp, Homo sapiens
attaagccaaacatga

SEQ ID NO: 2033930 - DNA, 20 bp, Homo sapiens
attaaggtttgccctgcctg

SEQ ID NO: 2033931 - DNA, 21 bp, Homo sapiens
attaagtctgggatgtagaac

SEQ ID NO: 2033932 - DNA, 16 bp, Homo sapiens
attaataaaaaatgga

SEQ ID NO: 2033933 - DNA, 13 bp, Homo sapiens
attaataaatttt

SEQ ID NO: 2033934 - DNA, 16 bp, Homo sapiens
attaataccaaatatt

SEQ ID NO: 2033935 - DNA, 20 bp, Homo sapiens
attaataccaaatattttag

SEQ ID NO: 2033936 - DNA, 20 bp, Homo sapiens
attaatactaaaatatgtct

SEQ ID NO: 2033937 - DNA, 13 bp, Homo sapiens
attaatagctttt

SEQ ID NO: 2033938 - DNA, 23 bp, Homo sapiens
attaatatgctacagtactatgt

SEQ ID NO: 2033939 - DNA, 22 bp, Homo sapiens
attaatatgttcattaaatttt

SEQ ID NO: 2033940 - DNA, 19 bp, Homo sapiens
attaatcaactttccttaa

SEQ ID NO: 2033941 - DNA, 17 bp, Homo sapiens
attaatcgaaatgaatt

SEQ ID NO: 2033942 - DNA, 23 bp, Homo sapiens
attaatctttctttacctgagac

SEQ ID NO: 2033943 - DNA, 22 bp, Homo sapiens
attaatgaactgtgacaggaag

SEQ ID NO: 2033944 - DNA, 13 bp, Homo sapiens
attaatgcctctc

SEQ ID NO: 2033945 - DNA, 19 bp, Homo sapiens
attaatgcctctcccgcac

SEQ ID NO: 2033946 - DNA, 17 bp, Homo sapiens
attaatggtctaaaaat

SEQ ID NO: 2033947 - DNA, 20 bp, Homo sapiens
attaatgtgtgtctgaagac

SEQ ID NO: 2033948 - DNA, 21 bp, Homo sapiens
attaatgtgtgtctgaagact

SEQ ID NO: 2033949 - DNA, 12 bp, Homo sapiens
attaatgttaat

SEQ ID NO: 2033950 - DNA, 14 bp, Homo sapiens
attaatgttttgta

SEQ ID NO: 2033951 - DNA, 18 bp, Homo sapiens
attaatgttttgtacaat

SEQ ID NO: 2033952 - DNA, 14 bp, Homo sapiens
attaattagatttt

SEQ ID NO: 2033953 - DNA, 14 bp, Homo sapiens
attaattctactaa

SEQ ID NO: 2033954 - DNA, 16 bp, Homo sapiens
attaattctactaaat

SEQ ID NO: 2033955 - DNA, 12 bp, Homo sapiens
attaatttatgg

SEQ ID NO: 2033956 - DNA, 22 bp, Homo sapiens
attaatttgagaattattcctt

SEQ ID NO: 2033957 - DNA, 20 bp, Homo sapiens
attaatttgtttttcttatc

SEQ ID NO: 2033958 - DNA, 12 bp, Homo sapiens
attacaatggaa

SEQ ID NO: 2033959 - DNA, 15 bp, Homo sapiens
attacaatggaaaca

SEQ ID NO: 2033960 - DNA, 17 bp, Homo sapiens
attacaatggaaacaat

SEQ ID NO: 2033961 - DNA, 14 bp, Homo sapiens
attacacccaaaga

SEQ ID NO: 2033962 - DNA, 21 bp, Homo sapiens
attacactacaagtttataag

SEQ ID NO: 2033963 - DNA, 17 bp, Homo sapiens
attacagaggaagttat

SEQ ID NO: 2033964 - DNA, 19 bp, Homo sapiens
attacagatgggcaaatta

SEQ ID NO: 2033965 - DNA, 15 bp, Homo sapiens
attacagtgggtgcc

SEQ ID NO: 2033966 - DNA, 14 bp, Homo sapiens
attacatctaatgc

SEQ ID NO: 2033967 - DNA, 15 bp, Homo sapiens
attacatttccaaat

SEQ ID NO: 2033968 - DNA, 19 bp, Homo sapiens
attaccaagttacttgaaa

SEQ ID NO: 2033969 - DNA, 20 bp, Homo sapiens
attaccaagttacttgaaaa

SEQ ID NO: 2033970 - DNA, 19 bp, Homo sapiens
attaccacgccttgacctt

SEQ ID NO: 2033971 - DNA, 20 bp, Homo sapiens
attacgtgagccaggtaatg

SEQ ID NO: 2033972 - DNA, 15 bp, Homo sapiens
attactacaaaattt

SEQ ID NO: 2033973 - DNA, 18 bp, Homo sapiens
attactatgactgctccc

SEQ ID NO: 2033974 - DNA, 14 bp, Homo sapiens
attactgcatgcac

SEQ ID NO: 2033975 - DNA, 18 bp, Homo sapiens
attactgtctggttttaa

SEQ ID NO: 2033976 - DNA, 16 bp, Homo sapiens
attacttatttttgac

SEQ ID NO: 2033977 - DNA, 17 bp, Homo sapiens
attacttatttttgaca

SEQ ID NO: 2033978 - DNA, 18 bp, Homo sapiens
attacttatttttgacag

SEQ ID NO: 2033979 - DNA, 14 bp, Homo sapiens
attacttctgctac

SEQ ID NO: 2033980 - DNA, 13 bp, Homo sapiens
attacttgaactt

SEQ ID NO: 2033981 - DNA, 14 bp, Homo sapiens
attacttgaacttt

SEQ ID NO: 2033982 - DNA, 12 bp, Homo sapiens
attacttgcaca

SEQ ID NO: 2033983 - DNA, 20 bp, Homo sapiens
attacttgttgcaaaggtct

SEQ ID NO: 2033984 - DNA, 14 bp, Homo sapiens
attactttaaaata

SEQ ID NO: 2033985 - DNA, 23 bp, Homo sapiens
attagaaactgaaaactgtaaat

SEQ ID NO: 2033986 - DNA, 15 bp, Homo sapiens
attagaaattagctg

SEQ ID NO: 2033987 - DNA, 23 bp, Homo sapiens
attagaaattagctgtgtgaaat

SEQ ID NO: 2033988 - DNA, 17 bp, Homo sapiens
attagaaattggctgga

SEQ ID NO: 2033989 - DNA, 18 bp, Homo sapiens
attagaacaggcaagtga

SEQ ID NO: 2033990 - DNA, 23 bp, Homo sapiens
attagaacaggcaagtgaagaaa

SEQ ID NO: 2033991 - DNA, 14 bp, Homo sapiens
attagaagtgttaa

SEQ ID NO: 2033992 - DNA, 16 bp, Homo sapiens
attagactggacagct

SEQ ID NO: 2033993 - DNA, 19 bp, Homo sapiens
attagagggaggagaatga

SEQ ID NO: 2033994 - DNA, 21 bp, Homo sapiens
attagagtgcccttaaaataa

SEQ ID NO: 2033995 - DNA, 18 bp, Homo sapiens
attagatcttcaaacaga

SEQ ID NO: 2033996 - DNA, 19 bp, Homo sapiens
attagatcttcaaacagaa

SEQ ID NO: 2033997 - DNA, 20 bp, Homo sapiens
attagctggttggagagcta

SEQ ID NO: 2033998 - DNA, 20 bp, Homo sapiens
attagctgtaaatacatgtg

SEQ ID NO: 2033999 - DNA, 16 bp, Homo sapiens
attagctgtgtgaaat

SEQ ID NO: 2034000 - DNA, 17 bp, Homo sapiens
attaggaggctcaacaa

SEQ ID NO: 2034001 - DNA, 21 bp, Homo sapiens
attaggaggctcaacaataaa

SEQ ID NO: 2034002 - DNA, 16 bp, Homo sapiens
attaggatctatgcaa

SEQ ID NO: 2034003 - DNA, 17 bp, Homo sapiens
attaggatctatgcaat

SEQ ID NO: 2034004 - DNA, 14 bp, Homo sapiens
attaggatttcatg

SEQ ID NO: 2034005 - DNA, 20 bp, Homo sapiens
attaggtactatctgtgaag

SEQ ID NO: 2034006 - DNA, 23 bp, Homo sapiens
attagtccaaggcctttttcata

SEQ ID NO: 2034007 - DNA, 15 bp, Homo sapiens
attagtgagatttgt

SEQ ID NO: 2034008 - DNA, 17 bp, Homo sapiens
attagtgagatttgtat

SEQ ID NO: 2034009 - DNA, 19 bp, Homo sapiens
attagtgagatttgtattt

SEQ ID NO: 2034010 - DNA, 22 bp, Homo sapiens
attagtttgatttaatatctga

SEQ ID NO: 2034011 - DNA, 20 bp, Homo sapiens
attagttttctttgtaaagg

SEQ ID NO: 2034012 - DNA, 14 bp, Homo sapiens
attataaaaccatg

SEQ ID NO: 2034013 - DNA, 16 bp, Homo sapiens
attataaataaatgcc

SEQ ID NO: 2034014 - DNA, 15 bp, Homo sapiens
attataacttaaaat

SEQ ID NO: 2034015 - DNA, 16 bp, Homo sapiens
attataacttaaaata

SEQ ID NO: 2034016 - DNA, 14 bp, Homo sapiens
attataagaagagg

SEQ ID NO: 2034017 - DNA, 15 bp, Homo sapiens
attataagaagagga

SEQ ID NO: 2034018 - DNA, 22 bp, Homo sapiens
attataatatactatatttatg

SEQ ID NO: 2034019 - DNA, 13 bp, Homo sapiens
attataatgaatt

SEQ ID NO: 2034020 - DNA, 17 bp, Homo sapiens
attataatttaatgcat

SEQ ID NO: 2034021 - DNA, 23 bp, Homo sapiens
attatactgtagctgatgaaact

SEQ ID NO: 2034022 - DNA, 13 bp, Homo sapiens
attatatatcata

SEQ ID NO: 2034023 - DNA, 19 bp, Homo sapiens
attatatatcataaagtat

SEQ ID NO: 2034024 - DNA, 15 bp, Homo sapiens
attatatctaattta

SEQ ID NO: 2034025 - DNA, 19 bp, Homo sapiens
attatatctaatttataca

SEQ ID NO: 2034026 - DNA, 18 bp, Homo sapiens
attatatctgtggtcttc

SEQ ID NO: 2034027 - DNA, 15 bp, Homo sapiens
attatattataataa

SEQ ID NO: 2034028 - DNA, 17 bp, Homo sapiens
attatcggaagcagtgc

SEQ ID NO: 2034029 - DNA, 19 bp, Homo sapiens
attatcggaagcagtgcct

SEQ ID NO: 2034030 - DNA, 21 bp, Homo sapiens
attatcggaagcagtgccttc

SEQ ID NO: 2034031 - DNA, 16 bp, Homo sapiens
attatcgggagcagtg

SEQ ID NO: 2034032 - DNA, 23 bp, Homo sapiens
attatctcaaaactgcactgtca

SEQ ID NO: 2034033 - DNA, 12 bp, Homo sapiens
attatctccctt

SEQ ID NO: 2034034 - DNA, 12 bp, Homo sapiens
attatgacagtt

SEQ ID NO: 2034035 - DNA, 16 bp, Homo sapiens
attatgacagttatac

SEQ ID NO: 2034036 - DNA, 16 bp, Homo sapiens
attatgagtttgctta

SEQ ID NO: 2034037 - DNA, 14 bp, Homo sapiens
attatgccactgct

SEQ ID NO: 2034038 - DNA, 20 bp, Homo sapiens
attatggaagattttaaatt

SEQ ID NO: 2034039 - DNA, 16 bp, Homo sapiens
attatggcaagtgata

SEQ ID NO: 2034040 - DNA, 16 bp, Homo sapiens
attatgggtcctgcaa

SEQ ID NO: 2034041 - DNA, 11 bp, Homo sapiens
attatggtgaa

SEQ ID NO: 2034042 - DNA, 18 bp, Homo sapiens
attatggtgtaatgcaca

SEQ ID NO: 2034043 - DNA, 17 bp, Homo sapiens
attatgtaacatccaga

SEQ ID NO: 2034044 - DNA, 14 bp, Homo sapiens
attatgtagaaata

SEQ ID NO: 2034045 - DNA, 15 bp, Homo sapiens
attatgtatgtttac

SEQ ID NO: 2034046 - DNA, 19 bp, Homo sapiens
caagaagtcaaagtaaaac

SEQ ID NO: 2034047 - DNA, 13 bp, Homo sapiens
caagaagtcttga

SEQ ID NO: 2034048 - DNA, 15 bp, Homo sapiens
caagaatattgtatg

SEQ ID NO: 2034049 - DNA, 23 bp, Homo sapiens
caagaatattgtatgttaaagca

SEQ ID NO: 2034050 - DNA, 13 bp, Homo sapiens
caagaatcctctg

SEQ ID NO: 2034051 - DNA, 22 bp, Homo sapiens
caagaatttcttggtaagaagc

SEQ ID NO: 2034052 - DNA, 15 bp, Homo sapiens
caagacacatcccta

SEQ ID NO: 2034053 - DNA, 14 bp, Homo sapiens
caagacagcagtct

SEQ ID NO: 2034054 - DNA, 13 bp, Homo sapiens
caagaccagcctg

SEQ ID NO: 2034055 - DNA, 22 bp, Homo sapiens
caagacctgttggttagctgga

SEQ ID NO: 2034056 - DNA, 14 bp, Homo sapiens
caagacgtcctgga

SEQ ID NO: 2034057 - DNA, 14 bp, Homo sapiens
caagactccgtctc

SEQ ID NO: 2034058 - DNA, 19 bp, Homo sapiens
caagactccgtctcaaaaa

SEQ ID NO: 2034059 - DNA, 18 bp, Homo sapiens
caagactgttgctcaaat

SEQ ID NO: 2034060 - DNA, 15 bp, Homo sapiens
caagacttaaatagt

SEQ ID NO: 2034061 - DNA, 20 bp, Homo sapiens
caagacttctctttgcctca

SEQ ID NO: 2034062 - DNA, 16 bp, Homo sapiens
caagagacagagcccc

SEQ ID NO: 2034063 - DNA, 18 bp, Homo sapiens
caagagacagagccccca

SEQ ID NO: 2034064 - DNA, 13 bp, Homo sapiens
caagagagaaaga

SEQ ID NO: 2034065 - DNA, 19 bp, Homo sapiens
caagagagacattgcctcc

SEQ ID NO: 2034066 - DNA, 22 bp, Homo sapiens
caagagagagctcgctcttggg

SEQ ID NO: 2034067 - DNA, 24 bp, Homo sapiens
caagagagggccatgcaattcatc

SEQ ID NO: 2034068 - DNA, 15 bp, Homo sapiens
caagagcagaggcag

SEQ ID NO: 2034069 - DNA, 18 bp, Homo sapiens
caagagcatcatgcctct

SEQ ID NO: 2034070 - DNA, 13 bp, Homo sapiens
caagagccctgtc

SEQ ID NO: 2034071 - DNA, 18 bp, Homo sapiens
caagagccttggtgtcca

SEQ ID NO: 2034072 - DNA, 22 bp, Homo sapiens
caagagccttggtgtccacctg

SEQ ID NO: 2034073 - DNA, 22 bp, Homo sapiens
caagagctacgtatttaatagc

SEQ ID NO: 2034074 - DNA, 22 bp, Homo sapiens
caagaggaataagaatggagca

SEQ ID NO: 2034075 - DNA, 12 bp, Homo sapiens
caagaggcccag

SEQ ID NO: 2034076 - DNA, 13 bp, Homo sapiens
caagaggcccagg

SEQ ID NO: 2034077 - DNA, 16 bp, Homo sapiens
caagaggcccagggag

SEQ ID NO: 2034078 - DNA, 16 bp, Homo sapiens
caagaggctcctgtcc

SEQ ID NO: 2034079 - DNA, 15 bp, Homo sapiens
caagaggctgaggca

SEQ ID NO: 2034080 - DNA, 13 bp, Homo sapiens
caagagggcactg

SEQ ID NO: 2034081 - DNA, 14 bp, Homo sapiens
caagagggcactgg

SEQ ID NO: 2034082 - DNA, 15 bp, Homo sapiens
caagagggcactggt

SEQ ID NO: 2034083 - DNA, 14 bp, Homo sapiens
caagaggtctgagc

SEQ ID NO: 2034084 - DNA, 16 bp, Homo sapiens
caagaggtctgagccc

SEQ ID NO: 2034085 - DNA, 22 bp, Homo sapiens
caagagtttatttccaaataaa

SEQ ID NO: 2034086 - DNA, 16 bp, Homo sapiens
caagatcttgtctcca

SEQ ID NO: 2034087 - DNA, 12 bp, Homo sapiens
caagatctttca

SEQ ID NO: 2034088 - DNA, 14 bp, Homo sapiens
caagatgacagctc

SEQ ID NO: 2034089 - DNA, 21 bp, Homo sapiens
caagatggaggggctgactca

SEQ ID NO: 2034090 - DNA, 16 bp, Homo sapiens
caagatgggcacatga

SEQ ID NO: 2034091 - DNA, 20 bp, Homo sapiens
caagatgggcacatgaggag

SEQ ID NO: 2034092 - DNA, 15 bp, Homo sapiens
caagatgtcagactg

SEQ ID NO: 2034093 - DNA, 16 bp, Homo sapiens
caagatgtcagactgg

SEQ ID NO: 2034094 - DNA, 18 bp, Homo sapiens
caagattcccagagacag

SEQ ID NO: 2034095 - DNA, 13 bp, Homo sapiens
caagattgcttaa

SEQ ID NO: 2034096 - DNA, 15 bp, Homo sapiens
caagatttcagaagc

SEQ ID NO: 2034097 - DNA, 21 bp, Homo sapiens
caagattttttttgtaacttc

SEQ ID NO: 2034098 - DNA, 17 bp, Homo sapiens
caagcaacataaaacaa

SEQ ID NO: 2034099 - DNA, 19 bp, Homo sapiens
caagcaaggatatcagagc

SEQ ID NO: 2034100 - DNA, 14 bp, Homo sapiens
caagcaataattag

SEQ ID NO: 2034101 - DNA, 21 bp, Homo sapiens
caagcaataattaggatctat

SEQ ID NO: 2034102 - DNA, 18 bp, Homo sapiens
caagcacctagcctcgct

SEQ ID NO: 2034103 - DNA, 15 bp, Homo sapiens
caagcacctcctgcc

SEQ ID NO: 2034104 - DNA, 17 bp, Homo sapiens
caagcacctcctgcctc

SEQ ID NO: 2034105 - DNA, 18 bp, Homo sapiens
caagcacctgcagattct

SEQ ID NO: 2034106 - DNA, 22 bp, Homo sapiens
caagcactcgagaccatcctgg

SEQ ID NO: 2034107 - DNA, 23 bp, Homo sapiens
caagcactgctaggcgagtgcca

SEQ ID NO: 2034108 - DNA, 17 bp, Homo sapiens
caagcagaggtggccag

SEQ ID NO: 2034109 - DNA, 14 bp, Homo sapiens
caagcagccagcca

SEQ ID NO: 2034110 - DNA, 16 bp, Homo sapiens
caagcagccgcagcgc

SEQ ID NO: 2034111 - DNA, 21 bp, Homo sapiens
caagcagggaaagctccacgg

SEQ ID NO: 2034112 - DNA, 15 bp, Homo sapiens
caagcagggctctgc

SEQ ID NO: 2034113 - DNA, 22 bp, Homo sapiens
caagcattcagaagaaaaagaa

SEQ ID NO: 2034114 - DNA, 13 bp, Homo sapiens
caagcattctcct

SEQ ID NO: 2034115 - DNA, 23 bp, Homo sapiens
caagcattgcttcagaatgaatt

SEQ ID NO: 2034116 - DNA, 16 bp, Homo sapiens
caagcatttgccctgt

SEQ ID NO: 2034117 - DNA, 19 bp, Homo sapiens
caagccaacgacaaagcca

SEQ ID NO: 2034118 - DNA, 15 bp, Homo sapiens
caagccaacttgtaa

SEQ ID NO: 2034119 - DNA, 19 bp, Homo sapiens
caagccacagaagccagga

SEQ ID NO: 2034120 - DNA, 15 bp, Homo sapiens
caagccagatttttt

SEQ ID NO: 2034121 - DNA, 15 bp, Homo sapiens
caagccccagggcct

SEQ ID NO: 2034122 - DNA, 17 bp, Homo sapiens
caagccccagggcctgg

SEQ ID NO: 2034123 - DNA, 14 bp, Homo sapiens
caagcccctcagcc

SEQ ID NO: 2034124 - DNA, 16 bp, Homo sapiens
caagcccctcagccct

SEQ ID NO: 2034125 - DNA, 17 bp, Homo sapiens
caagcccctcagccctt

SEQ ID NO: 2034126 - DNA, 20 bp, Homo sapiens
caagcccctcagcccttgcc

SEQ ID NO: 2034127 - DNA, 15 bp, Homo sapiens
caagcctctgcccca

SEQ ID NO: 2034128 - DNA, 17 bp, Homo sapiens
caagcctctgccccaag

SEQ ID NO: 2034129 - DNA, 18 bp, Homo sapiens
caagcctctgccccaagg

SEQ ID NO: 2034130 - DNA, 22 bp, Homo sapiens
caagcctctgccccaaggggcc

SEQ ID NO: 2034131 - DNA, 14 bp, Homo sapiens
caagcctgcctagg

SEQ ID NO: 2034132 - DNA, 16 bp, Homo sapiens
caagcctggtctcctc

SEQ ID NO: 2034133 - DNA, 21 bp, Homo sapiens
caagcctgtaatcccagctac

SEQ ID NO: 2034134 - DNA, 12 bp, Homo sapiens
caagcctgtggg

SEQ ID NO: 2034135 - DNA, 23 bp, Homo sapiens
caagccttactcacctctctcta

SEQ ID NO: 2034136 - DNA, 15 bp, Homo sapiens
caagcgattcttctg

SEQ ID NO: 2034137 - DNA, 22 bp, Homo sapiens
caagcgattcttgtgcctcagc

SEQ ID NO: 2034138 - DNA, 15 bp, Homo sapiens
caagcgcagggagga

SEQ ID NO: 2034139 - DNA, 18 bp, Homo sapiens
caagcgtgcagcttgttc

SEQ ID NO: 2034140 - DNA, 17 bp, Homo sapiens
caagctagaacctggag

SEQ ID NO: 2034141 - DNA, 17 bp, Homo sapiens
caagctagaaggccaca

SEQ ID NO: 2034142 - DNA, 22 bp, Homo sapiens
caagctatgagggtccccggga

SEQ ID NO: 2034143 - DNA, 14 bp, Homo sapiens
caagctcaaccttg

SEQ ID NO: 2034144 - DNA, 12 bp, Homo sapiens
caagctcacagt

SEQ ID NO: 2034145 - DNA, 20 bp, Homo sapiens
caagctcacagttcctcgcc

SEQ ID NO: 2034146 - DNA, 22 bp, Homo sapiens
caagctcacagttcctcgccct

SEQ ID NO: 2034147 - DNA, 15 bp, Homo sapiens
caagctcagaataga

SEQ ID NO: 2034148 - DNA, 19 bp, Homo sapiens
caacatacccttctttaaa

SEQ ID NO: 2034149 - DNA, 22 bp, Homo sapiens
caacatagtgagatcccatttc

SEQ ID NO: 2034150 - DNA, 15 bp, Homo sapiens
caacatatcattttt

SEQ ID NO: 2034151 - DNA, 23 bp, Homo sapiens
caacatccatgtcctatgtgtga

SEQ ID NO: 2034152 - DNA, 20 bp, Homo sapiens
caacatcccattgccctggt

SEQ ID NO: 2034153 - DNA, 14 bp, Homo sapiens
caacatcttctctc

SEQ ID NO: 2034154 - DNA, 17 bp, Homo sapiens
caacatcttctctcttt

SEQ ID NO: 2034155 - DNA, 19 bp, Homo sapiens
caacatgtataatattttt

SEQ ID NO: 2034156 - DNA, 23 bp, Homo sapiens
caacatgtataatatttttaatt

SEQ ID NO: 2034157 - DNA, 21 bp, Homo sapiens
caacattttatttaagaataa

SEQ ID NO: 2034158 - DNA, 22 bp, Homo sapiens
caaccacatacaacacaaagag

SEQ ID NO: 2034159 - DNA, 14 bp, Homo sapiens
caaccactgtaaaa

SEQ ID NO: 2034160 - DNA, 17 bp, Homo sapiens
caaccactgtaaaatga

SEQ ID NO: 2034161 - DNA, 19 bp, Homo sapiens
caaccactgtaaaatgaaa

SEQ ID NO: 2034162 - DNA, 15 bp, Homo sapiens
caaccagccacacag

SEQ ID NO: 2034163 - DNA, 16 bp, Homo sapiens
caaccagccacacaga

SEQ ID NO: 2034164 - DNA, 13 bp, Homo sapiens
caaccaggaagaa

SEQ ID NO: 2034165 - DNA, 14 bp, Homo sapiens
caaccattccagac

SEQ ID NO: 2034166 - DNA, 14 bp, Homo sapiens
caaccattccccat

SEQ ID NO: 2034167 - DNA, 14 bp, Homo sapiens
caaccccagctggc

SEQ ID NO: 2034168 - DNA, 15 bp, Homo sapiens
caaccccagctggcc

SEQ ID NO: 2034169 - DNA, 21 bp, Homo sapiens
caaccccagggcccccacagg

SEQ ID NO: 2034170 - DNA, 19 bp, Homo sapiens
caaccccagttctgctcct

SEQ ID NO: 2034171 - DNA, 22 bp, Homo sapiens
caaccccagttctgctcctctc

SEQ ID NO: 2034172 - DNA, 14 bp, Homo sapiens
caaccccatcatat

SEQ ID NO: 2034173 - DNA, 16 bp, Homo sapiens
caacccccatttctat

SEQ ID NO: 2034174 - DNA, 20 bp, Homo sapiens
caaccccgcggtgctctggc

SEQ ID NO: 2034175 - DNA, 20 bp, Homo sapiens
caacccctgtacccagctcc

SEQ ID NO: 2034176 - DNA, 14 bp, Homo sapiens
caaccccttcgctc

SEQ ID NO: 2034177 - DNA, 23 bp, Homo sapiens
caacccgtgccaagtccaggtcc

SEQ ID NO: 2034178 - DNA, 17 bp, Homo sapiens
caacccgtggaggctgc

SEQ ID NO: 2034179 - DNA, 13 bp, Homo sapiens
caaccctcagagc

SEQ ID NO: 2034180 - DNA, 18 bp, Homo sapiens
caaccctcagagccaccc

SEQ ID NO: 2034181 - DNA, 21 bp, Homo sapiens
caaccctcagagccaccccta

SEQ ID NO: 2034182 - DNA, 12 bp, Homo sapiens
caaccctcagcc

SEQ ID NO: 2034183 - DNA, 13 bp, Homo sapiens
caaccctcagcct

SEQ ID NO: 2034184 - DNA, 16 bp, Homo sapiens
caaccctcagccttga

SEQ ID NO: 2034185 - DNA, 15 bp, Homo sapiens
caaccctgtttcctg

SEQ ID NO: 2034186 - DNA, 21 bp, Homo sapiens
caacccttagagattgcccca

SEQ ID NO: 2034187 - DNA, 23 bp, Homo sapiens
caacccttagagattgccccaga

SEQ ID NO: 2034188 - DNA, 18 bp, Homo sapiens
caaccgtggcccttcctg

SEQ ID NO: 2034189 - DNA, 13 bp, Homo sapiens
caacctaaatttg

SEQ ID NO: 2034190 - DNA, 20 bp, Homo sapiens
caacctaccaccccttcctg

SEQ ID NO: 2034191 - DNA, 19 bp, Homo sapiens
caacctcaatgccctgcca

SEQ ID NO: 2034192 - DNA, 21 bp, Homo sapiens
caacctcaatgccctgccatt

SEQ ID NO: 2034193 - DNA, 18 bp, Homo sapiens
caacctcagtaatttaga

SEQ ID NO: 2034194 - DNA, 14 bp, Homo sapiens
caacctcctgggct

SEQ ID NO: 2034195 - DNA, 16 bp, Homo sapiens
caacctctctccttct

SEQ ID NO: 2034196 - DNA, 12 bp, Homo sapiens
caacctcttcct

SEQ ID NO: 2034197 - DNA, 15 bp, Homo sapiens
caacctcttcctcct

SEQ ID NO: 2034198 - DNA, 21 bp, Homo sapiens
caacctgaatacccttttctg

SEQ ID NO: 2034199 - DNA, 12 bp, Homo sapiens
caacctgagcct

SEQ ID NO: 2034200 - DNA, 14 bp, Homo sapiens
caacctgcccctcc

SEQ ID NO: 2034201 - DNA, 22 bp, Homo sapiens
caacctgcccctccccagccct

SEQ ID NO: 2034202 - DNA, 11 bp, Homo sapiens
caacctggaga

SEQ ID NO: 2034203 - DNA, 15 bp, Homo sapiens
caacctggtggcacc

SEQ ID NO: 2034204 - DNA, 17 bp, Homo sapiens
caaccttcattttacat

SEQ ID NO: 2034205 - DNA, 17 bp, Homo sapiens
caaccttctgtggctca

SEQ ID NO: 2034206 - DNA, 15 bp, Homo sapiens
caacctttccctcac

SEQ ID NO: 2034207 - DNA, 18 bp, Homo sapiens
caacctttccctcacccc

SEQ ID NO: 2034208 - DNA, 16 bp, Homo sapiens
caacctttgtgtaata

SEQ ID NO: 2034209 - DNA, 15 bp, Homo sapiens
caacgcagccctgct

SEQ ID NO: 2034210 - DNA, 18 bp, Homo sapiens
caacgttaaaagacagtg

SEQ ID NO: 2034211 - DNA, 21 bp, Homo sapiens
caactaacccttaaaaatgca

SEQ ID NO: 2034212 - DNA, 14 bp, Homo sapiens
caactaagccctcg

SEQ ID NO: 2034213 - DNA, 15 bp, Homo sapiens
caactacagtctaaa

SEQ ID NO: 2034214 - DNA, 19 bp, Homo sapiens
caactacagtctaaagctg

SEQ ID NO: 2034215 - DNA, 18 bp, Homo sapiens
caactagatcaaggagcc

SEQ ID NO: 2034216 - DNA, 19 bp, Homo sapiens
caactagatcaaggagccc

SEQ ID NO: 2034217 - DNA, 18 bp, Homo sapiens
caactattaaagtgccat

SEQ ID NO: 2034218 - DNA, 14 bp, Homo sapiens
caactccagctccc

SEQ ID NO: 2034219 - DNA, 13 bp, Homo sapiens
caactcccacgac

SEQ ID NO: 2034220 - DNA, 15 bp, Homo sapiens
caactctccactcca

SEQ ID NO: 2034221 - DNA, 14 bp, Homo sapiens
caactctgcactcc

SEQ ID NO: 2034222 - DNA, 15 bp, Homo sapiens
caactctgcactcca

SEQ ID NO: 2034223 - DNA, 17 bp, Homo sapiens
caactctgcactccatg

SEQ ID NO: 2034224 - DNA, 13 bp, Homo sapiens
caactgaaaagac

SEQ ID NO: 2034225 - DNA, 22 bp, Homo sapiens
caactgaaaagactcagtgttc

SEQ ID NO: 2034226 - DNA, 14 bp, Homo sapiens
caactgacacagga

SEQ ID NO: 2034227 - DNA, 15 bp, Homo sapiens
caactgaccagcctc

SEQ ID NO: 2034228 - DNA, 14 bp, Homo sapiens
caactgaggcagac

SEQ ID NO: 2034229 - DNA, 16 bp, Homo sapiens
caactgaggcagacag

SEQ ID NO: 2034230 - DNA, 20 bp, Homo sapiens
caactgctctgcccactgtg

SEQ ID NO: 2034231 - DNA, 22 bp, Homo sapiens
caactggagcaagaaggaagga

SEQ ID NO: 2034232 - DNA, 14 bp, Homo sapiens
caactggctgggac

SEQ ID NO: 2034233 - DNA, 19 bp, Homo sapiens
caactggtccactcagggc

SEQ ID NO: 2034234 - DNA, 16 bp, Homo sapiens
caactgtgttcattag

SEQ ID NO: 2034235 - DNA, 15 bp, Homo sapiens
caactgtttttgaag

SEQ ID NO: 2034236 - DNA, 15 bp, Homo sapiens
caacttaatgttctg

SEQ ID NO: 2034237 - DNA, 23 bp, Homo sapiens
caacttcccagttcaggagtccc

SEQ ID NO: 2034238 - DNA, 15 bp, Homo sapiens
caacttgcttctaaa

SEQ ID NO: 2034239 - DNA, 22 bp, Homo sapiens
caacttgcttctaaatgcccag

SEQ ID NO: 2034240 - DNA, 13 bp, Homo sapiens
caacttggctttc

SEQ ID NO: 2034241 - DNA, 16 bp, Homo sapiens
caacttgtaaatacac

SEQ ID NO: 2034242 - DNA, 20 bp, Homo sapiens
caacttttcctttgaatcct

SEQ ID NO: 2034243 - DNA, 15 bp, Homo sapiens
caagaaaactggaaa

SEQ ID NO: 2034244 - DNA, 18 bp, Homo sapiens
caagaaaagaggaaaaaa

SEQ ID NO: 2034245 - DNA, 19 bp, Homo sapiens
caagaaaagaggaaaaaaa

SEQ ID NO: 2034246 - DNA, 15 bp, Homo sapiens
caagaaacagaagta

SEQ ID NO: 2034247 - DNA, 18 bp, Homo sapiens
caagaaacagaagtagaa

SEQ ID NO: 2034248 - DNA, 18 bp, Homo sapiens
caagaaactgaggaattt

SEQ ID NO: 2034249 - DNA, 19 bp, Homo sapiens
caagaaactgaggaatttt

SEQ ID NO: 2034250 - DNA, 12 bp, Homo sapiens
caagaaagaaac

SEQ ID NO: 2034251 - DNA, 21 bp, Homo sapiens
caagaaagccgtactgtctat

SEQ ID NO: 2034252 - DNA, 16 bp, Homo sapiens
caagaaatttgatttc

SEQ ID NO: 2034253 - DNA, 12 bp, Homo sapiens
caagaacaacaa

SEQ ID NO: 2034254 - DNA, 14 bp, Homo sapiens
caagaacaacaaca

SEQ ID NO: 2034255 - DNA, 20 bp, Homo sapiens
caagaactctgcacagcaac

SEQ ID NO: 2034256 - DNA, 12 bp, Homo sapiens
caagaagaatat

SEQ ID NO: 2034257 - DNA, 18 bp, Homo sapiens
caagaagaatataaataa

SEQ ID NO: 2034258 - DNA, 18 bp, Homo sapiens
caagaagacatggagact

SEQ ID NO: 2034259 - DNA, 15 bp, Homo sapiens
caagaagcaggaagg

SEQ ID NO: 2034260 - DNA, 23 bp, Homo sapiens
caagaagcattttgtaagttgaa

SEQ ID NO: 2034261 - DNA, 15 bp, Homo sapiens
caagaagctcccaga

SEQ ID NO: 2034262 - DNA, 22 bp, Homo sapiens
caagaagctcccagatgctggg

SEQ ID NO: 2034263 - DNA, 17 bp, Homo sapiens
caagaaggaaggaggca

SEQ ID NO: 2034264 - DNA, 16 bp, Homo sapiens
caagaaggcaaaaata

SEQ ID NO: 2034265 - DNA, 15 bp, Homo sapiens
caaagtgtcagtgtt

SEQ ID NO: 2034266 - DNA, 16 bp, Homo sapiens
caaagtgtcagtgttg

SEQ ID NO: 2034267 - DNA, 11 bp, Homo sapiens
caaagtgttaa

SEQ ID NO: 2034268 - DNA, 13 bp, Homo sapiens
caaagttatattt

SEQ ID NO: 2034269 - DNA, 17 bp, Homo sapiens
caaagttatatttactt

SEQ ID NO: 2034270 - DNA, 16 bp, Homo sapiens
caaagttccaaaatgc

SEQ ID NO: 2034271 - DNA, 18 bp, Homo sapiens
caaagttccaaaatgcca

SEQ ID NO: 2034272 - DNA, 18 bp, Homo sapiens
caaagttcctgttcacct

SEQ ID NO: 2034273 - DNA, 20 bp, Homo sapiens
caaagttcctgttcacctta

SEQ ID NO: 2034274 - DNA, 15 bp, Homo sapiens
caaagttgtagttct

SEQ ID NO: 2034275 - DNA, 17 bp, Homo sapiens
caaataaactctaaaca

SEQ ID NO: 2034276 - DNA, 13 bp, Homo sapiens
caaataatcacat

SEQ ID NO: 2034277 - DNA, 16 bp, Homo sapiens
caaataatgaacagca

SEQ ID NO: 2034278 - DNA, 15 bp, Homo sapiens
caaatactccaagct

SEQ ID NO: 2034279 - DNA, 19 bp, Homo sapiens
caaatactccaagcttcaa

SEQ ID NO: 2034280 - DNA, 21 bp, Homo sapiens
caaatactccaagcttcaagt

SEQ ID NO: 2034281 - DNA, 17 bp, Homo sapiens
caaatataaaacttaca

SEQ ID NO: 2034282 - DNA, 22 bp, Homo sapiens
caaatatagagatatttttgta

SEQ ID NO: 2034283 - DNA, 19 bp, Homo sapiens
caaatatatttaattgtgt

SEQ ID NO: 2034284 - DNA, 13 bp, Homo sapiens
caaatatgcaaag

SEQ ID NO: 2034285 - DNA, 19 bp, Homo sapiens
caaatatgcaaagcactga

SEQ ID NO: 2034286 - DNA, 15 bp, Homo sapiens
caaatattaccaaaa

SEQ ID NO: 2034287 - DNA, 21 bp, Homo sapiens
caaatattgttaccatgaaga

SEQ ID NO: 2034288 - DNA, 15 bp, Homo sapiens
caaatcaaccccaga

SEQ ID NO: 2034289 - DNA, 19 bp, Homo sapiens
caaatcaaccccagactca

SEQ ID NO: 2034290 - DNA, 18 bp, Homo sapiens
caaatcactgtatttatc

SEQ ID NO: 2034291 - DNA, 15 bp, Homo sapiens
caaatccacaagcca

SEQ ID NO: 2034292 - DNA, 13 bp, Homo sapiens
caaatctatatta

SEQ ID NO: 2034293 - DNA, 19 bp, Homo sapiens
caaatctatattaaagtgt

SEQ ID NO: 2034294 - DNA, 20 bp, Homo sapiens
caaatctatattaaagtgtt

SEQ ID NO: 2034295 - DNA, 19 bp, Homo sapiens
caaatctgtatatgttgta

SEQ ID NO: 2034296 - DNA, 12 bp, Homo sapiens
caaatcttcaag

SEQ ID NO: 2034297 - DNA, 14 bp, Homo sapiens
caaatgacatgcac

SEQ ID NO: 2034298 - DNA, 18 bp, Homo sapiens
caaatgacatgcactgac

SEQ ID NO: 2034299 - DNA, 21 bp, Homo sapiens
caaatgattttcatcaattta

SEQ ID NO: 2034300 - DNA, 16 bp, Homo sapiens
caaatgctaaatgcaa

SEQ ID NO: 2034301 - DNA, 17 bp, Homo sapiens
caaatgctgtagaatgc

SEQ ID NO: 2034302 - DNA, 20 bp, Homo sapiens
caaatggatggggataagaa

SEQ ID NO: 2034303 - DNA, 22 bp, Homo sapiens
caaatggatggggataagaata

SEQ ID NO: 2034304 - DNA, 21 bp, Homo sapiens
caaatggcagcagttccatga

SEQ ID NO: 2034305 - DNA, 16 bp, Homo sapiens
caaatggtttttgcaa

SEQ ID NO: 2034306 - DNA, 18 bp, Homo sapiens
caaatgtaattgaataaa

SEQ ID NO: 2034307 - DNA, 14 bp, Homo sapiens
caaatgtcagagct

SEQ ID NO: 2034308 - DNA, 16 bp, Homo sapiens
caaatgtcattatgta

SEQ ID NO: 2034309 - DNA, 21 bp, Homo sapiens
caaatgtcattatgtagaaat

SEQ ID NO: 2034310 - DNA, 20 bp, Homo sapiens
caaatgtgatcaactgttca

SEQ ID NO: 2034311 - DNA, 11 bp, Homo sapiens
caaatgtttct

SEQ ID NO: 2034312 - DNA, 14 bp, Homo sapiens
caaatgtttctgca

SEQ ID NO: 2034313 - DNA, 16 bp, Homo sapiens
caaattactctttctc

SEQ ID NO: 2034314 - DNA, 14 bp, Homo sapiens
caaattattttaat

SEQ ID NO: 2034315 - DNA, 22 bp, Homo sapiens
caaattattttaatattttgta

SEQ ID NO: 2034316 - DNA, 22 bp, Homo sapiens
caaattccaaacttctaaatgt

SEQ ID NO: 2034317 - DNA, 23 bp, Homo sapiens
caaattccaaacttctaaatgtt

SEQ ID NO: 2034318 - DNA, 21 bp, Homo sapiens
caaattctcaacctaccaccc

SEQ ID NO: 2034319 - DNA, 22 bp, Homo sapiens
caaattctcaacctaccacccc

SEQ ID NO: 2034320 - DNA, 14 bp, Homo sapiens
caaattgcttctag

SEQ ID NO: 2034321 - DNA, 11 bp, Homo sapiens
caaattgttca

SEQ ID NO: 2034322 - DNA, 22 bp, Homo sapiens
caaattgttcatgttaccaaag

SEQ ID NO: 2034323 - DNA, 16 bp, Homo sapiens
caaatttaattttgca

SEQ ID NO: 2034324 - DNA, 16 bp, Homo sapiens
caaatttcaaaagaca

SEQ ID NO: 2034325 - DNA, 21 bp, Homo sapiens
caaattttgatgccaagaaag

SEQ ID NO: 2034326 - DNA, 18 bp, Homo sapiens
caaattttgcatttagtt

SEQ ID NO: 2034327 - DNA, 15 bp, Homo sapiens
caaatttttcctgca

SEQ ID NO: 2034328 - DNA, 13 bp, Homo sapiens
caacaaaccaaaa

SEQ ID NO: 2034329 - DNA, 14 bp, Homo sapiens
caacaaaccaaaac

SEQ ID NO: 2034330 - DNA, 14 bp, Homo sapiens
caacaaagaaatat

SEQ ID NO: 2034331 - DNA, 19 bp, Homo sapiens
caacaaagccaacagtcaa

SEQ ID NO: 2034332 - DNA, 21 bp, Homo sapiens
caacaaattaggttttgtaca

SEQ ID NO: 2034333 - DNA, 15 bp, Homo sapiens
caacaacaacaataa

SEQ ID NO: 2034334 - DNA, 17 bp, Homo sapiens
caacaacaaggaccctg

SEQ ID NO: 2034335 - DNA, 11 bp, Homo sapiens
caacaacaata

SEQ ID NO: 2034336 - DNA, 13 bp, Homo sapiens
caacaacaataca

SEQ ID NO: 2034337 - DNA, 18 bp, Homo sapiens
caacaactccaggaaaac

SEQ ID NO: 2034338 - DNA, 13 bp, Homo sapiens
caacaagaacaac

SEQ ID NO: 2034339 - DNA, 14 bp, Homo sapiens
caacaagaacaaca

SEQ ID NO: 2034340 - DNA, 16 bp, Homo sapiens
caacaagaacaacaac

SEQ ID NO: 2034341 - DNA, 14 bp, Homo sapiens
caacaaggaccctg

SEQ ID NO: 2034342 - DNA, 15 bp, Homo sapiens
caacaataacaacaa

SEQ ID NO: 2034343 - DNA, 16 bp, Homo sapiens
caacaataacaacaat

SEQ ID NO: 2034344 - DNA, 19 bp, Homo sapiens
caacaatacaacaagaaca

SEQ ID NO: 2034345 - DNA, 22 bp, Homo sapiens
caacaatacatgctgctaattc

SEQ ID NO: 2034346 - DNA, 19 bp, Homo sapiens
caacaatggggtgggccca

SEQ ID NO: 2034347 - DNA, 12 bp, Homo sapiens
caacacaaagag

SEQ ID NO: 2034348 - DNA, 15 bp, Homo sapiens
caacacaaagagaaa

SEQ ID NO: 2034349 - DNA, 22 bp, Homo sapiens
caacacaaagagaaaaagaaat

SEQ ID NO: 2034350 - DNA, 23 bp, Homo sapiens
caacacaaagagaaaaagaaatg

SEQ ID NO: 2034351 - DNA, 21 bp, Homo sapiens
caacacaagacaccttttgta

SEQ ID NO: 2034352 - DNA, 24 bp, Homo sapiens
caacacagagctggcgactgcagc

SEQ ID NO: 2034353 - DNA, 19 bp, Homo sapiens
caacacctccttgctttgc

SEQ ID NO: 2034354 - DNA, 14 bp, Homo sapiens
caacacgtggaggt

SEQ ID NO: 2034355 - DNA, 22 bp, Homo sapiens
caacactcttcttgagcagacc

SEQ ID NO: 2034356 - DNA, 17 bp, Homo sapiens
caacagagaaggcagga

SEQ ID NO: 2034357 - DNA, 18 bp, Homo sapiens
caacagagaaggcaggaa

SEQ ID NO: 2034358 - DNA, 14 bp, Homo sapiens
caacagatactgga

SEQ ID NO: 2034359 - DNA, 17 bp, Homo sapiens
caacagatactggaagt

SEQ ID NO: 2034360 - DNA, 22 bp, Homo sapiens
caacagctcaagtcttccctga

SEQ ID NO: 2034361 - DNA, 16 bp, Homo sapiens
caacagctcagagatg

SEQ ID NO: 2034362 - DNA, 20 bp, Homo sapiens
caacagcttgaccagaccta

SEQ ID NO: 2034363 - DNA, 16 bp, Homo sapiens
caacaggaatctcaga

SEQ ID NO: 2034364 - DNA, 20 bp, Homo sapiens
caacaggaatctcagagaca

SEQ ID NO: 2034365 - DNA, 21 bp, Homo sapiens
caacaggaatctcagagacag

SEQ ID NO: 2034366 - DNA, 13 bp, Homo sapiens
caacaggctgggc

SEQ ID NO: 2034367 - DNA, 14 bp, Homo sapiens
caacaggctgggct

SEQ ID NO: 2034368 - DNA, 20 bp, Homo sapiens
caacaggctgggcttcagtg

SEQ ID NO: 2034369 - DNA, 23 bp, Homo sapiens
caacaggctgggcttcagtggca

SEQ ID NO: 2034370 - DNA, 24 bp, Homo sapiens
caacaggctgggcttcagtggcag

SEQ ID NO: 2034371 - DNA, 19 bp, Homo sapiens
caacaggctgttctgcact

SEQ ID NO: 2034372 - DNA, 21 bp, Homo sapiens
caacaggctgttctgcactga

SEQ ID NO: 2034373 - DNA, 22 bp, Homo sapiens
caacaggctgttctgcactgaa

SEQ ID NO: 2034374 - DNA, 23 bp, Homo sapiens
caacaggtggcaggaccaggact

SEQ ID NO: 2034375 - DNA, 11 bp, Homo sapiens
caacagtaaca

SEQ ID NO: 2034376 - DNA, 15 bp, Homo sapiens
caacagtaacacatc

SEQ ID NO: 2034377 - DNA, 14 bp, Homo sapiens
caacagtcaaaaca

SEQ ID NO: 2034378 - DNA, 22 bp, Homo sapiens
caacagttttttatgctaatca

SEQ ID NO: 2034379 - DNA, 21 bp, Homo sapiens
caacataaggagaatgtatct

SEQ ID NO: 2034380 - DNA, 18 bp, Homo sapiens
caacatacccttctttaa

SEQ ID NO: 2034381 - DNA, 22 bp, Homo sapiens
gagggcagagccatgggcctgg

SEQ ID NO: 2034382 - DNA, 15 bp, Homo sapiens
gagggcagaggctgg

SEQ ID NO: 2034383 - DNA, 21 bp, Homo sapiens
gagggcaggtgccctctgctc

SEQ ID NO: 2034384 - DNA, 16 bp, Homo sapiens
gagggcagtacctggg

SEQ ID NO: 2034385 - DNA, 18 bp, Homo sapiens
gagggcagttcgcagcca

SEQ ID NO: 2034386 - DNA, 23 bp, Homo sapiens
gagggcagttcgcagccaccctg

SEQ ID NO: 2034387 - DNA, 18 bp, Homo sapiens
gagggcatgcgcacaagg

SEQ ID NO: 2034388 - DNA, 12 bp, Homo sapiens
gagggcccagct

SEQ ID NO: 2034389 - DNA, 19 bp, Homo sapiens
gagggcctgtgggagcctg

SEQ ID NO: 2034390 - DNA, 12 bp, Homo sapiens
gagggcgtgtct

SEQ ID NO: 2034391 - DNA, 13 bp, Homo sapiens
cctgggcctgctt

SEQ ID NO: 2034392 - DNA, 20 bp, Homo sapiens
cctgggcctgcttttccagg

SEQ ID NO: 2034393 - DNA, 20 bp, Homo sapiens
cctgggcctgtcccccaagg

SEQ ID NO: 2034394 - DNA, 14 bp, Homo sapiens
cctgggcctgtgca

SEQ ID NO: 2034395 - DNA, 19 bp, Homo sapiens
cctgggcctgtgcagcagc

SEQ ID NO: 2034396 - DNA, 23 bp, Homo sapiens
cctgggcctgtgcagcagcccag

SEQ ID NO: 2034397 - DNA, 17 bp, Homo sapiens
cctgggccttacctccc

SEQ ID NO: 2034398 - DNA, 14 bp, Homo sapiens
cctgggcctttcct

SEQ ID NO: 2034399 - DNA, 22 bp, Homo sapiens
cctgggctctgccccagctctg

SEQ ID NO: 2034400 - DNA, 24 bp, Homo sapiens
cctgggctctgccccagctctggc

SEQ ID NO: 2034401 - DNA, 19 bp, Homo sapiens
cctgggctgtctgtcacca

SEQ ID NO: 2034402 - DNA, 15 bp, Homo sapiens
cctggggagaaagta

SEQ ID NO: 2034403 - DNA, 13 bp, Homo sapiens
cctggggcctgta

SEQ ID NO: 2034404 - DNA, 14 bp, Homo sapiens
cctggggcctgtac

SEQ ID NO: 2034405 - DNA, 21 bp, Homo sapiens
cctggggctcctttctccagc

SEQ ID NO: 2034406 - DNA, 12 bp, Homo sapiens
cctggggctcta

SEQ ID NO: 2034407 - DNA, 21 bp, Homo sapiens
cctggggctctaacgcctgag

SEQ ID NO: 2034408 - DNA, 23 bp, Homo sapiens
cctggggctctaacgcctgagcc

SEQ ID NO: 2034409 - DNA, 21 bp, Homo sapiens
cctggggcttctcctgaccca

SEQ ID NO: 2034410 - DNA, 19 bp, Homo sapiens
cctgggggcagggagagga

SEQ ID NO: 2034411 - DNA, 20 bp, Homo sapiens
cctgggggcagtgactggca

SEQ ID NO: 2034412 - DNA, 21 bp, Homo sapiens
cctgggggcagtgactggcag

SEQ ID NO: 2034413 - DNA, 23 bp, Homo sapiens
cctgggggcagtgactggcaggt

SEQ ID NO: 2034414 - DNA, 15 bp, Homo sapiens
cctgggggccagctg

SEQ ID NO: 2034415 - DNA, 13 bp, Homo sapiens
cctgggggcctgg

SEQ ID NO: 2034416 - DNA, 12 bp, Homo sapiens
ggcctgctggga

SEQ ID NO: 2034417 - DNA, 20 bp, Homo sapiens
ggcctgctgggctctccacc

SEQ ID NO: 2034418 - DNA, 23 bp, Homo sapiens
ggcctgctgggctctccacctca

SEQ ID NO: 2034419 - DNA, 16 bp, Homo sapiens
ggcctgcttttccagg

SEQ ID NO: 2034420 - DNA, 17 bp, Homo sapiens
ggcctgcttttccagga

SEQ ID NO: 2034421 - DNA, 19 bp, Homo sapiens
ggcctgcttttccaggatc

SEQ ID NO: 2034422 - DNA, 20 bp, Homo sapiens
ggcctgcttttccaggatcc

SEQ ID NO: 2034423 - DNA, 24 bp, Homo sapiens
ggcctggaaccagggaggagagga

SEQ ID NO: 2034424 - DNA, 14 bp, Homo sapiens
ggcctggacactta

SEQ ID NO: 2034425 - DNA, 23 bp, Homo sapiens
ggcctggaccgcttcccagaggc

SEQ ID NO: 2034426 - DNA, 21 bp, Homo sapiens
ggcctggagaggggcctggga

SEQ ID NO: 2034427 - DNA, 21 bp, Homo sapiens
ggcctggatctccccactcta

SEQ ID NO: 2034428 - DNA, 15 bp, Homo sapiens
ggcctggcagccgtg

SEQ ID NO: 2034429 - DNA, 12 bp, Homo sapiens
ggcctggccaga

SEQ ID NO: 2034430 - DNA, 13 bp, Homo sapiens
ggcctggccaggc

SEQ ID NO: 2034431 - DNA, 14 bp, Homo sapiens
ggcctggcctgagc

SEQ ID NO: 2034432 - DNA, 17 bp, Homo sapiens
ggcctggcctgagctgg

SEQ ID NO: 2034433 - DNA, 23 bp, Homo sapiens
ggcctggctccccacgagtcacc

SEQ ID NO: 2034434 - DNA, 14 bp, Homo sapiens
ggcctggctggctg

SEQ ID NO: 2034435 - DNA, 19 bp, Homo sapiens
ggcctggcttgctccaggg

SEQ ID NO: 2034436 - DNA, 15 bp, Homo sapiens
ggcctgggcctgctt

SEQ ID NO: 2034437 - DNA, 18 bp, Homo sapiens
ggcctggggctcctttct

SEQ ID NO: 2034438 - DNA, 17 bp, Homo sapiens
ggcctgggggcagtgac

SEQ ID NO: 2034439 - DNA, 11 bp, Homo sapiens
ggcctggggtg

SEQ ID NO: 2034440 - DNA, 21 bp, Homo sapiens
ggcctggggtgacccggcacc

SEQ ID NO: 2034441 - DNA, 14 bp, Homo sapiens
ggcctgtactgcct

SEQ ID NO: 2034442 - DNA, 16 bp, Homo sapiens
ggcctgtactgcctgc

SEQ ID NO: 2034443 - DNA, 13 bp, Homo sapiens
ggcctgtccccca

SEQ ID NO: 2034444 - DNA, 20 bp, Homo sapiens
ggcctgtgaggtaactggga

SEQ ID NO: 2034445 - DNA, 20 bp, Homo sapiens
ggcctgtgcagcagcccagc

SEQ ID NO: 2034446 - DNA, 21 bp, Homo sapiens
ggcctgtgcagcagcccagct

SEQ ID NO: 2034447 - DNA, 16 bp, Homo sapiens
ggcctgtggcaggcct

SEQ ID NO: 2034448 - DNA, 17 bp, Homo sapiens
ggcctgtgggagcctgc

SEQ ID NO: 2034449 - DNA, 23 bp, Homo sapiens
ggcctgtgtagctgtgacctgct

SEQ ID NO: 2034450 - DNA, 17 bp, Homo sapiens
ggcctgtgtccagcagc

SEQ ID NO: 2034451 - DNA, 17 bp, Homo sapiens
ggccttacctcccctgc

SEQ ID NO: 2034452 - DNA, 21 bp, Homo sapiens
ggccttacctcccctgccagg

SEQ ID NO: 2034453 - DNA, 13 bp, Homo sapiens
ggccaagctgaag

SEQ ID NO: 2034454 - DNA, 23 bp, Homo sapiens
ggccaagctgaagtgaaggagaa

SEQ ID NO: 2034455 - DNA, 23 bp, Homo sapiens
ggccaagctgaggtgcccaggag

SEQ ID NO: 2034456 - DNA, 15 bp, Homo sapiens
ggccaaggcaggtag

SEQ ID NO: 2034457 - DNA, 17 bp, Homo sapiens
ggccaattaaaatatat

SEQ ID NO: 2034458 - DNA, 22 bp, Homo sapiens
ggccacactattaccatgagaa

SEQ ID NO: 2034459 - DNA, 11 bp, Homo sapiens
ggccaccagga

SEQ ID NO: 2034460 - DNA, 24 bp, Homo sapiens
ggccacccgttctgctggcctgga

SEQ ID NO: 2034461 - DNA, 15 bp, Homo sapiens
ggccaccctggcccg

SEQ ID NO: 2034462 - DNA, 11 bp, Homo sapiens
ggccacgtgcc

SEQ ID NO: 2034463 - DNA, 12 bp, Homo sapiens
ggccacgtgcca

SEQ ID NO: 2034464 - DNA, 16 bp, Homo sapiens
ggccacgtgccaggcc

SEQ ID NO: 2034465 - DNA, 17 bp, Homo sapiens
ggccacgtgccaggccc

SEQ ID NO: 2034466 - DNA, 17 bp, Homo sapiens
ggccactccagacccct

SEQ ID NO: 2034467 - DNA, 12 bp, Homo sapiens
ggccactcctcc

SEQ ID NO: 2034468 - DNA, 13 bp, Homo sapiens
ggccactcctcca

SEQ ID NO: 2034469 - DNA, 16 bp, Homo sapiens
ggccactccttcctgc

SEQ ID NO: 2034470 - DNA, 20 bp, Homo sapiens
ggccactctcccctccctct

SEQ ID NO: 2034471 - DNA, 13 bp, Homo sapiens
ggccactgtggcc

SEQ ID NO: 2034472 - DNA, 18 bp, Homo sapiens
ggccactgtggccagagc

SEQ ID NO: 2034473 - DNA, 19 bp, Homo sapiens
ggccactgtggccagagct

SEQ ID NO: 2034474 - DNA, 20 bp, Homo sapiens
ggccagaaggagggcagagc

SEQ ID NO: 2034475 - DNA, 23 bp, Homo sapiens
ggccagacacagatacatgggga

SEQ ID NO: 2034476 - DNA, 17 bp, Homo sapiens
ggccagagagggcccag

SEQ ID NO: 2034477 - DNA, 19 bp, Homo sapiens
ggccagagagggcccagct

SEQ ID NO: 2034478 - DNA, 22 bp, Homo sapiens
ggccagagctggaaggcagggc

SEQ ID NO: 2034479 - DNA, 14 bp, Homo sapiens
ggccagagctggga

SEQ ID NO: 2034480 - DNA, 17 bp, Homo sapiens
ggccagagggagtgaca

SEQ ID NO: 2034481 - DNA, 19 bp, Homo sapiens
ggccagagggagtgacaga

SEQ ID NO: 2034482 - DNA, 20 bp, Homo sapiens
ggccagcaccctctcctggg

SEQ ID NO: 2034483 - DNA, 15 bp, Homo sapiens
ggccagcctcagctc

SEQ ID NO: 2034484 - DNA, 17 bp, Homo sapiens
ggccagcctcagctcag

SEQ ID NO: 2034485 - DNA, 23 bp, Homo sapiens
ggccagcctcagctcagcctccc

SEQ ID NO: 2034486 - DNA, 11 bp, Homo sapiens
ggccagcctgg

SEQ ID NO: 2034487 - DNA, 12 bp, Homo sapiens
ggccagcctggc

SEQ ID NO: 2034488 - DNA, 14 bp, Homo sapiens
ggccagcctggcct

SEQ ID NO: 2034489 - DNA, 15 bp, Homo sapiens
ggccagcctggcctc

SEQ ID NO: 2034490 - DNA, 18 bp, Homo sapiens
ggccagcctggcctcctg

SEQ ID NO: 2034491 - DNA, 18 bp, Homo sapiens
ggccagccttgcactgtg

SEQ ID NO: 2034492 - DNA, 16 bp, Homo sapiens
ggccagctggtgctgc

SEQ ID NO: 2034493 - DNA, 21 bp, Homo sapiens
ggccagctgtcgcatctcagc

SEQ ID NO: 2034494 - DNA, 17 bp, Homo sapiens
ggccaggaatctgccat

SEQ ID NO: 2034495 - DNA, 14 bp, Homo sapiens
ggccaggagagaga

SEQ ID NO: 2034496 - DNA, 17 bp, Homo sapiens
ggccaggagagagatct

SEQ ID NO: 2034497 - DNA, 14 bp, Homo sapiens
ggccaggagctcag

SEQ ID NO: 2034498 - DNA, 20 bp, Homo sapiens
ggccaggagtttgagaccag

SEQ ID NO: 2034499 - DNA, 15 bp, Homo sapiens
ggccaggccaccagg

SEQ ID NO: 2034500 - DNA, 16 bp, Homo sapiens
ggccaggccaccagga

SEQ ID NO: 2034501 - DNA, 20 bp, Homo sapiens
ggccgaagctaacagggaag

SEQ ID NO: 2034502 - DNA, 20 bp, Homo sapiens
ggccgacggcggcggccctc

SEQ ID NO: 2034503 - DNA, 14 bp, Homo sapiens
ggccgagggaaatg

SEQ ID NO: 2034504 - DNA, 22 bp, Homo sapiens
ggccgagtaccttaatctgcca

SEQ ID NO: 2034505 - DNA, 15 bp, Homo sapiens
ggccgcattccctga

SEQ ID NO: 2034506 - DNA, 14 bp, Homo sapiens
ggccgccatccggg

SEQ ID NO: 2034507 - DNA, 16 bp, Homo sapiens
ggccgccatccgggac

SEQ ID NO: 2034508 - DNA, 18 bp, Homo sapiens
ggccgctgctttgcgctg

SEQ ID NO: 2034509 - DNA, 24 bp, Homo sapiens
ggccgctgctttgcgctggtggac

SEQ ID NO: 2034510 - DNA, 14 bp, Homo sapiens
ggccgctggcccag

SEQ ID NO: 2034511 - DNA, 16 bp, Homo sapiens
ggccgctggcccaggg

SEQ ID NO: 2034512 - DNA, 12 bp, Homo sapiens
ggccggccagcc

SEQ ID NO: 2034513 - DNA, 15 bp, Homo sapiens
ggccgggcaggtcct

SEQ ID NO: 2034514 - DNA, 19 bp, Homo sapiens
ggccgggcaggtcctgccc

SEQ ID NO: 2034515 - DNA, 20 bp, Homo sapiens
ggccgggcaggtcctgccca

SEQ ID NO: 2034516 - DNA, 14 bp, Homo sapiens
ggccgggctgccct

SEQ ID NO: 2034517 - DNA, 20 bp, Homo sapiens
ggccggggaactggccaagc

SEQ ID NO: 2034518 - DNA, 21 bp, Homo sapiens
ggccggggaactggccaagct

SEQ ID NO: 2034519 - DNA, 15 bp, Homo sapiens
ggccggtgtgggctg

SEQ ID NO: 2034520 - DNA, 15 bp, Homo sapiens
ggccgtgaggacacg

SEQ ID NO: 2034521 - DNA, 18 bp, Homo sapiens
ggccgtggtccagctctt

SEQ ID NO: 2034522 - DNA, 18 bp, Homo sapiens
ggccgtgtctctgaggac

SEQ ID NO: 2034523 - DNA, 16 bp, Homo sapiens
ggcctaaaagtaaaca

SEQ ID NO: 2034524 - DNA, 17 bp, Homo sapiens
ggcctaaaagtaaacat

SEQ ID NO: 2034525 - DNA, 23 bp, Homo sapiens
ggcctaatctcatacctctgacc

SEQ ID NO: 2034526 - DNA, 17 bp, Homo sapiens
ggcctagatccacacac

SEQ ID NO: 2034527 - DNA, 16 bp, Homo sapiens
ggcctagcaggcacag

SEQ ID NO: 2034528 - DNA, 16 bp, Homo sapiens
ggcctatggagagccc

SEQ ID NO: 2034529 - DNA, 18 bp, Homo sapiens
ggcctatggagagccctg

SEQ ID NO: 2034530 - DNA, 19 bp, Homo sapiens
ggcctattatattaaaata

SEQ ID NO: 2034531 - DNA, 14 bp, Homo sapiens
ggcctcaagtgatt

SEQ ID NO: 2034532 - DNA, 15 bp, Homo sapiens
ggcctcacgcccagc

SEQ ID NO: 2034533 - DNA, 17 bp, Homo sapiens
ggcctcacgcccagcct

SEQ ID NO: 2034534 - DNA, 18 bp, Homo sapiens
ggcctcacgcccagcctc

SEQ ID NO: 2034535 - DNA, 20 bp, Homo sapiens
ggcctcacgcccagcctcct

SEQ ID NO: 2034536 - DNA, 21 bp, Homo sapiens
ggcctcacgcccagcctcctc

SEQ ID NO: 2034537 - DNA, 15 bp, Homo sapiens
ggcctcactggctgg

SEQ ID NO: 2034538 - DNA, 23 bp, Homo sapiens
ggcctcactggctggggcagagg

SEQ ID NO: 2034539 - DNA, 17 bp, Homo sapiens
ggcctcacttccctggg

SEQ ID NO: 2034540 - DNA, 20 bp, Homo sapiens
ggcctcacttccctgggaac

SEQ ID NO: 2034541 - DNA, 21 bp, Homo sapiens
ggcctcagcacccctgtctct

SEQ ID NO: 2034542 - DNA, 18 bp, Homo sapiens
ggcctcagcaggaacctg

SEQ ID NO: 2034543 - DNA, 10 bp, Homo sapiens
ggcctcagcc

SEQ ID NO: 2034544 - DNA, 12 bp, Homo sapiens
ggcctcagccct

SEQ ID NO: 2034545 - DNA, 17 bp, Homo sapiens
ggcctcagtttccccat

SEQ ID NO: 2034546 - DNA, 20 bp, Homo sapiens
ggcctcagtttctccatcag

SEQ ID NO: 2034547 - DNA, 15 bp, Homo sapiens
ggcctcatccctcgg

SEQ ID NO: 2034548 - DNA, 21 bp, Homo sapiens
ggcctcatccctcggaagccg

SEQ ID NO: 2034549 - DNA, 16 bp, Homo sapiens
ggcctccagcctctcc

SEQ ID NO: 2034550 - DNA, 21 bp, Homo sapiens
ggcctcccaataaagctggac

SEQ ID NO: 2034551 - DNA, 18 bp, Homo sapiens
ggcctcctctgtccaggg

SEQ ID NO: 2034552 - DNA, 13 bp, Homo sapiens
ggcctcgcctggg

SEQ ID NO: 2034553 - DNA, 15 bp, Homo sapiens
ggcctcgcctgggcc

SEQ ID NO: 2034554 - DNA, 18 bp, Homo sapiens
ggcctcgcctgggcccag

SEQ ID NO: 2034555 - DNA, 24 bp, Homo sapiens
ggcctcgcctgggcccaggctctg

SEQ ID NO: 2034556 - DNA, 13 bp, Homo sapiens
ggcctcggagcct

SEQ ID NO: 2034557 - DNA, 15 bp, Homo sapiens
ggcctcgtaccagcc

SEQ ID NO: 2034558 - DNA, 20 bp, Homo sapiens
ggcctcgtgccatgatctgt

SEQ ID NO: 2034559 - DNA, 17 bp, Homo sapiens
ggcctctagaacaccca

SEQ ID NO: 2034560 - DNA, 22 bp, Homo sapiens
ggcctctagaacacccactggc

SEQ ID NO: 2034561 - DNA, 18 bp, Homo sapiens
ggcctctctcttcccagc

SEQ ID NO: 2034562 - DNA, 17 bp, Homo sapiens
ggcctctgaaatttccc

SEQ ID NO: 2034563 - DNA, 22 bp, Homo sapiens
ggcctctgaaatttcccacacc

SEQ ID NO: 2034564 - DNA, 12 bp, Homo sapiens
ggcctcttccct

SEQ ID NO: 2034565 - DNA, 20 bp, Homo sapiens
ggcctgagcaacaaagcgag

SEQ ID NO: 2034566 - DNA, 22 bp, Homo sapiens
ggcctgagctggggccacaaat

SEQ ID NO: 2034567 - DNA, 13 bp, Homo sapiens
ggcctgcactaat

SEQ ID NO: 2034568 - DNA, 18 bp, Homo sapiens
ggcctgcctcccagccct

SEQ ID NO: 2034569 - DNA, 18 bp, Homo sapiens
ggcctgcctctgactcac

SEQ ID NO: 2034570 - DNA, 18 bp, Homo sapiens
ggcctgccttgaagccac

SEQ ID NO: 2034571 - DNA, 17 bp, Homo sapiens
ggcctgcgtgccgggag

SEQ ID NO: 2034572 - DNA, 17 bp, Homo sapiens
ggcctgctcccagcagc

SEQ ID NO: 2034573 - DNA, 11 bp, Homo sapiens
ggcctgctgcg

SEQ ID NO: 2034574 - DNA, 18 bp, Homo sapiens
ggcctgctgcgtcagacc

SEQ ID NO: 2034575 - DNA, 19 bp, Homo sapiens
ggcctgctgcgtcagacca

SEQ ID NO: 2034576 - DNA, 19 bp, Homo sapiens
ggcctgctgctgagaacct

SEQ ID NO: 2034577 - DNA, 13 bp, Homo sapiens
ggatttgaagcaa

SEQ ID NO: 2034578 - DNA, 14 bp, Homo sapiens
ggatttgccccttc

SEQ ID NO: 2034579 - DNA, 22 bp, Homo sapiens
ggatttgccccttcccatctct

SEQ ID NO: 2034580 - DNA, 22 bp, Homo sapiens
ggattttaacaaaagcaagact

SEQ ID NO: 2034581 - DNA, 17 bp, Homo sapiens
ggcaaacggagtacaga

SEQ ID NO: 2034582 - DNA, 20 bp, Homo sapiens
ggcaaagaactgccccatct

SEQ ID NO: 2034583 - DNA, 22 bp, Homo sapiens
ggcaaagcacgaaatgttattt

SEQ ID NO: 2034584 - DNA, 21 bp, Homo sapiens
ggcaaagtgctgtacccttcc

SEQ ID NO: 2034585 - DNA, 19 bp, Homo sapiens
ggcaacagagcaagatcct

SEQ ID NO: 2034586 - DNA, 16 bp, Homo sapiens
ggcaaccccagttctg

SEQ ID NO: 2034587 - DNA, 17 bp, Homo sapiens
ggcaaccccagttctgc

SEQ ID NO: 2034588 - DNA, 20 bp, Homo sapiens
ggcaaccccagttctgctcc

SEQ ID NO: 2034589 - DNA, 19 bp, Homo sapiens
ggcaacccccagcctgcta

SEQ ID NO: 2034590 - DNA, 15 bp, Homo sapiens
ggcaaccttgtctct

SEQ ID NO: 2034591 - DNA, 17 bp, Homo sapiens
ggcaacgacggtttcaa

SEQ ID NO: 2034592 - DNA, 20 bp, Homo sapiens
ggcaactgaggcagacagca

SEQ ID NO: 2034593 - DNA, 16 bp, Homo sapiens
ggcaagcccctcagcc

SEQ ID NO: 2034594 - DNA, 18 bp, Homo sapiens
ggcaagcccctcagccct

SEQ ID NO: 2034595 - DNA, 13 bp, Homo sapiens
ggcaagggggcgg

SEQ ID NO: 2034596 - DNA, 23 bp, Homo sapiens
ggcaaggtctccttactctgagc

SEQ ID NO: 2034597 - DNA, 22 bp, Homo sapiens
ggcaagtccctgactctctgtg

SEQ ID NO: 2034598 - DNA, 17 bp, Homo sapiens
ggcaagtgagacaatca

SEQ ID NO: 2034599 - DNA, 14 bp, Homo sapiens
ggcaatgctggctg

SEQ ID NO: 2034600 - DNA, 15 bp, Homo sapiens
ggcaatggggagagg

SEQ ID NO: 2034601 - DNA, 16 bp, Homo sapiens
ggcaatggggagaggc

SEQ ID NO: 2034602 - DNA, 15 bp, Homo sapiens
ggcacaaatgcacct

SEQ ID NO: 2034603 - DNA, 20 bp, Homo sapiens
ggcacaatggctaattccca

SEQ ID NO: 2034604 - DNA, 13 bp, Homo sapiens
ggcacacagcagc

SEQ ID NO: 2034605 - DNA, 17 bp, Homo sapiens
ggcacacagcagccccc

SEQ ID NO: 2034606 - DNA, 22 bp, Homo sapiens
ggcacacagcagccccccagca

SEQ ID NO: 2034607 - DNA, 20 bp, Homo sapiens
ggcacaccactgccctgcct

SEQ ID NO: 2034608 - DNA, 22 bp, Homo sapiens
ggcacaccactgccctgcctgc

SEQ ID NO: 2034609 - DNA, 19 bp, Homo sapiens
ggcacagacttctggaagg

SEQ ID NO: 2034610 - DNA, 13 bp, Homo sapiens
ggcacaggagcta

SEQ ID NO: 2034611 - DNA, 16 bp, Homo sapiens
ggcacaggagctacct

SEQ ID NO: 2034612 - DNA, 17 bp, Homo sapiens
ggcacaggcaggaagag

SEQ ID NO: 2034613 - DNA, 18 bp, Homo sapiens
ggcacaggcaggaagaga

SEQ ID NO: 2034614 - DNA, 19 bp, Homo sapiens
ggcacaggcaggaagagag

SEQ ID NO: 2034615 - DNA, 22 bp, Homo sapiens
ggcacaggcaggaagagagaga

SEQ ID NO: 2034616 - DNA, 16 bp, Homo sapiens
ggcacagggcagtggg

SEQ ID NO: 2034617 - DNA, 16 bp, Homo sapiens
ggcacaggtgtaaata

SEQ ID NO: 2034618 - DNA, 21 bp, Homo sapiens
ggcacagttttctgagaaaga

SEQ ID NO: 2034619 - DNA, 15 bp, Homo sapiens
ggcacatgaggaggg

SEQ ID NO: 2034620 - DNA, 14 bp, Homo sapiens
ggcacatggaggag

SEQ ID NO: 2034621 - DNA, 24 bp, Homo sapiens
ggcaccactagggtcctggccctc

SEQ ID NO: 2034622 - DNA, 22 bp, Homo sapiens
ggcaccactgcactccagcctg

SEQ ID NO: 2034623 - DNA, 12 bp, Homo sapiens
ggcaccagaggc

SEQ ID NO: 2034624 - DNA, 19 bp, Homo sapiens
ggcaccagaggctgcagaa

SEQ ID NO: 2034625 - DNA, 17 bp, Homo sapiens
ggcaccagccccctgga

SEQ ID NO: 2034626 - DNA, 18 bp, Homo sapiens
ggcaccagccccctggat

SEQ ID NO: 2034627 - DNA, 19 bp, Homo sapiens
ggcaccagctctgtggcct

SEQ ID NO: 2034628 - DNA, 15 bp, Homo sapiens
ggcaccccctgcagc

SEQ ID NO: 2034629 - DNA, 14 bp, Homo sapiens
ggcaccccctggag

SEQ ID NO: 2034630 - DNA, 20 bp, Homo sapiens
ggcaccccctggagagaagt

SEQ ID NO: 2034631 - DNA, 17 bp, Homo sapiens
ggaagccgtctgactcc

SEQ ID NO: 2034632 - DNA, 18 bp, Homo sapiens
ggaagccgtctgactcca

SEQ ID NO: 2034633 - DNA, 22 bp, Homo sapiens
ggaagccgtctgactccagagt

SEQ ID NO: 2034634 - DNA, 18 bp, Homo sapiens
ggaagcctccgtcaggag

SEQ ID NO: 2034635 - DNA, 19 bp, Homo sapiens
ggaagcctccgtcaggaga

SEQ ID NO: 2034636 - DNA, 20 bp, Homo sapiens
ggaagcctccgtcaggagag

SEQ ID NO: 2034637 - DNA, 11 bp, Homo sapiens
ggaagctccgc

SEQ ID NO: 2034638 - DNA, 18 bp, Homo sapiens
ggaagctctgaagtcaca

SEQ ID NO: 2034639 - DNA, 13 bp, Homo sapiens
ggaagctgagcag

SEQ ID NO: 2034640 - DNA, 16 bp, Homo sapiens
ggaagctgagcaggcc

SEQ ID NO: 2034641 - DNA, 16 bp, Homo sapiens
ggaagctgggggaagg

SEQ ID NO: 2034642 - DNA, 20 bp, Homo sapiens
ggaagctgtactcagagcag

SEQ ID NO: 2034643 - DNA, 23 bp, Homo sapiens
ggaagctgtactcagagcagagc

SEQ ID NO: 2034644 - DNA, 17 bp, Homo sapiens
ggaagctgtgtccttgc

SEQ ID NO: 2034645 - DNA, 21 bp, Homo sapiens
ggaagctgtgtccttgcacct

SEQ ID NO: 2034646 - DNA, 22 bp, Homo sapiens
ggaaggagactcacctctgcct

SEQ ID NO: 2034647 - DNA, 15 bp, Homo sapiens
ggaaggagacttagg

SEQ ID NO: 2034648 - DNA, 14 bp, Homo sapiens
ggaaggaggcagac

SEQ ID NO: 2034649 - DNA, 20 bp, Homo sapiens
ggaaggagggttagggaggg

SEQ ID NO: 2034650 - DNA, 11 bp, Homo sapiens
ggaaggcaggc

SEQ ID NO: 2034651 - DNA, 12 bp, Homo sapiens
ggaaggcaggca

SEQ ID NO: 2034652 - DNA, 15 bp, Homo sapiens
ggaaggcaggcaggg

SEQ ID NO: 2034653 - DNA, 18 bp, Homo sapiens
ggaaggcaggcagggctc

SEQ ID NO: 2034654 - DNA, 19 bp, Homo sapiens
ggaaggcaggcagggctct

SEQ ID NO: 2034655 - DNA, 21 bp, Homo sapiens
ggaaggcaggcagggctctcc

SEQ ID NO: 2034656 - DNA, 22 bp, Homo sapiens
ggaaggcaggcagggctctcct

SEQ ID NO: 2034657 - DNA, 21 bp, Homo sapiens
ggaaggcagggaggaggcaga

SEQ ID NO: 2034658 - DNA, 18 bp, Homo sapiens
ggaaggcagggcagaggg

SEQ ID NO: 2034659 - DNA, 21 bp, Homo sapiens
ggaaggctaagttcagttctg

SEQ ID NO: 2034660 - DNA, 17 bp, Homo sapiens
ggaaggctgctgtgtag

SEQ ID NO: 2034661 - DNA, 14 bp, Homo sapiens
ggaaggctggctga

SEQ ID NO: 2034662 - DNA, 15 bp, Homo sapiens
ggaagggacacacac

SEQ ID NO: 2034663 - DNA, 16 bp, Homo sapiens
ggaagggaggggtcct

SEQ ID NO: 2034664 - DNA, 11 bp, Homo sapiens
ggaagggccag

SEQ ID NO: 2034665 - DNA, 12 bp, Homo sapiens
ggaagggccagg

SEQ ID NO: 2034666 - DNA, 23 bp, Homo sapiens
ggaagggttggtgggctggccca

SEQ ID NO: 2034667 - DNA, 18 bp, Homo sapiens
ggaagtcgtttcaggaca

SEQ ID NO: 2034668 - DNA, 23 bp, Homo sapiens
ggaagtgaagagggagaagggat

SEQ ID NO: 2034669 - DNA, 15 bp, Homo sapiens
ggaagtgaagcccct

SEQ ID NO: 2034670 - DNA, 22 bp, Homo sapiens
ggaagtgaatccttaaccctaa

SEQ ID NO: 2034671 - DNA, 13 bp, Homo sapiens
ggaagtgggggcc

SEQ ID NO: 2034672 - DNA, 23 bp, Homo sapiens
ggaagtgggggccgctggcccag

SEQ ID NO: 2034673 - DNA, 17 bp, Homo sapiens
ggaagtgttccctgaga

SEQ ID NO: 2034674 - DNA, 18 bp, Homo sapiens
ggaagtgttccctgagaa

SEQ ID NO: 2034675 - DNA, 15 bp, Homo sapiens
ggaagtttctgggtg

SEQ ID NO: 2034676 - DNA, 11 bp, Homo sapiens
ggaagttttca

SEQ ID NO: 2034677 - DNA, 20 bp, Homo sapiens
ggaataagaagcaaataaat

SEQ ID NO: 2034678 - DNA, 13 bp, Homo sapiens
ggaataagccatg

SEQ ID NO: 2034679 - DNA, 12 bp, Homo sapiens
ggaatacagtgt

SEQ ID NO: 2034680 - DNA, 22 bp, Homo sapiens
ggaatattcccctatctctaga

SEQ ID NO: 2034681 - DNA, 14 bp, Homo sapiens
ggaatcacctggag

SEQ ID NO: 2034682 - DNA, 19 bp, Homo sapiens
ggaatcatgtcaggcctgt

SEQ ID NO: 2034683 - DNA, 17 bp, Homo sapiens
ggaatccgcctgcagag

SEQ ID NO: 2034684 - DNA, 19 bp, Homo sapiens
ggaatccgcctgcagagga

SEQ ID NO: 2034685 - DNA, 18 bp, Homo sapiens
ggaatcctttgagaatgt

SEQ ID NO: 2034686 - DNA, 17 bp, Homo sapiens
ggaatcgccccagactc

SEQ ID NO: 2034687 - DNA, 13 bp, Homo sapiens
ggaatcgtttcaa

SEQ ID NO: 2034688 - DNA, 20 bp, Homo sapiens
ggaatctgaaagtatatttt

SEQ ID NO: 2034689 - DNA, 19 bp, Homo sapiens
ggaatctggagagctagaa

SEQ ID NO: 2034690 - DNA, 12 bp, Homo sapiens
ggaatgcaggga

SEQ ID NO: 2034691 - DNA, 21 bp, Homo sapiens
ggaatgcagggaagagggcag

SEQ ID NO: 2034692 - DNA, 15 bp, Homo sapiens
ggaatggaaggcttt

SEQ ID NO: 2034693 - DNA, 21 bp, Homo sapiens
ggaatgttccctgcaccctgg

SEQ ID NO: 2034694 - DNA, 20 bp, Homo sapiens
ggaattcagcaccctgggtg

SEQ ID NO: 2034695 - DNA, 15 bp, Homo sapiens
ggaattgctgctctc

SEQ ID NO: 2034696 - DNA, 15 bp, Homo sapiens
ggacaaaggagcctg

SEQ ID NO: 2034697 - DNA, 15 bp, Homo sapiens
gggtacccactgctc

SEQ ID NO: 2034698 - DNA, 18 bp, Homo sapiens
gggtacccactgctctgg

SEQ ID NO: 2034699 - DNA, 23 bp, Homo sapiens
gggtacttgtggacacagctctt

SEQ ID NO: 2034700 - DNA, 22 bp, Homo sapiens
gggtagcaggtaccactgattt

SEQ ID NO: 2034701 - DNA, 12 bp, Homo sapiens
gggtaggcggga

SEQ ID NO: 2034702 - DNA, 16 bp, Homo sapiens
gggtaggcgggaagga

SEQ ID NO: 2034703 - DNA, 20 bp, Homo sapiens
gggtatcaggtgctgccatc

SEQ ID NO: 2034704 - DNA, 17 bp, Homo sapiens
gggtattagcacctctt

SEQ ID NO: 2034705 - DNA, 12 bp, Homo sapiens
gggtcaaggaat

SEQ ID NO: 2034706 - DNA, 13 bp, Homo sapiens
gggtcagccaggg

SEQ ID NO: 2034707 - DNA, 12 bp, Homo sapiens
gggtcaggctcc

SEQ ID NO: 2034708 - DNA, 20 bp, Homo sapiens
gggtccacccagcaaagagt

SEQ ID NO: 2034709 - DNA, 21 bp, Homo sapiens
gggtccaggaaggcagctgct

SEQ ID NO: 2034710 - DNA, 13 bp, Homo sapiens
gggtccccagctc

SEQ ID NO: 2034711 - DNA, 16 bp, Homo sapiens
gggtccccgggagcac

SEQ ID NO: 2034712 - DNA, 22 bp, Homo sapiens
gggtcctcacctggttgaccca

SEQ ID NO: 2034713 - DNA, 17 bp, Homo sapiens
gggtcctgagtggctga

SEQ ID NO: 2034714 - DNA, 14 bp, Homo sapiens
gggtctcactctgt

SEQ ID NO: 2034715 - DNA, 18 bp, Homo sapiens
gggtctccctctcctgcc

SEQ ID NO: 2034716 - DNA, 19 bp, Homo sapiens
gggtctccctctcctgcct

SEQ ID NO: 2034717 - DNA, 20 bp, Homo sapiens
gggtctccctctcctgccta

SEQ ID NO: 2034718 - DNA, 22 bp, Homo sapiens
gggtctgaaggaatagccagag

SEQ ID NO: 2034719 - DNA, 21 bp, Homo sapiens
gggtctgaggaatccagaccc

SEQ ID NO: 2034720 - DNA, 14 bp, Homo sapiens
gggtctggggaggg

SEQ ID NO: 2034721 - DNA, 17 bp, Homo sapiens
gggtctgtgctgtgcct

SEQ ID NO: 2034722 - DNA, 18 bp, Homo sapiens
gggtctgtgctgtgcctg

SEQ ID NO: 2034723 - DNA, 16 bp, Homo sapiens
gggtctgttgtaaatg

SEQ ID NO: 2034724 - DNA, 15 bp, Homo sapiens
gggtgacatcccagg

SEQ ID NO: 2034725 - DNA, 23 bp, Homo sapiens
gggtgacatcccaggaggggcct

SEQ ID NO: 2034726 - DNA, 20 bp, Homo sapiens
gggtgacccggcaccccctg

SEQ ID NO: 2034727 - DNA, 21 bp, Homo sapiens
gggtgactgaatttgggcctc

SEQ ID NO: 2034728 - DNA, 22 bp, Homo sapiens
gggtgactgaatttgggcctct

SEQ ID NO: 2034729 - DNA, 19 bp, Homo sapiens
gggtgatcagaaggctggg

SEQ ID NO: 2034730 - DNA, 18 bp, Homo sapiens
gggtgatgatgaccaaga

SEQ ID NO: 2034731 - DNA, 19 bp, Homo sapiens
gggtgcatggcttggggag

SEQ ID NO: 2034732 - DNA, 21 bp, Homo sapiens
gggtgcatggcttggggagca

SEQ ID NO: 2034733 - DNA, 20 bp, Homo sapiens
gggtgcatttgagagaagcc

SEQ ID NO: 2034734 - DNA, 21 bp, Homo sapiens
gggtgcatttgagagaagcca

SEQ ID NO: 2034735 - DNA, 13 bp, Homo sapiens
gggtgccctctgg

SEQ ID NO: 2034736 - DNA, 18 bp, Homo sapiens
gggtgcctcagagcaggc

SEQ ID NO: 2034737 - DNA, 14 bp, Homo sapiens
gggtgcggcaggag

SEQ ID NO: 2034738 - DNA, 16 bp, Homo sapiens
gggtgcggcaggagca

SEQ ID NO: 2034739 - DNA, 14 bp, Homo sapiens
gggtggagaagtgt

SEQ ID NO: 2034740 - DNA, 22 bp, Homo sapiens
gggtggatcaccagaggtcagg

SEQ ID NO: 2034741 - DNA, 21 bp, Homo sapiens
gggtggatccactgtgcagga

SEQ ID NO: 2034742 - DNA, 13 bp, Homo sapiens
gggtggatgcctg

SEQ ID NO: 2034743 - DNA, 16 bp, Homo sapiens
gggtggcacctcctga

SEQ ID NO: 2034744 - DNA, 20 bp, Homo sapiens
gggtggccccctgtgccagc

SEQ ID NO: 2034745 - DNA, 18 bp, Homo sapiens
gggtggctactctgtgcc

SEQ ID NO: 2034746 - DNA, 19 bp, Homo sapiens
gggtggctactctgtgcca

SEQ ID NO: 2034747 - DNA, 18 bp, Homo sapiens
gggtggctagtcagagag

SEQ ID NO: 2034748 - DNA, 18 bp, Homo sapiens
gggtggctcctgccactg

SEQ ID NO: 2034749 - DNA, 15 bp, Homo sapiens
gggtgggaagaaaga

SEQ ID NO: 2034750 - DNA, 16 bp, Homo sapiens
gggtgggagagccagc

SEQ ID NO: 2034751 - DNA, 14 bp, Homo sapiens
gggtgggagagccc

SEQ ID NO: 2034752 - DNA, 15 bp, Homo sapiens
gggtgggccactctc

SEQ ID NO: 2034753 - DNA, 12 bp, Homo sapiens
gggtgggcctgg

SEQ ID NO: 2034754 - DNA, 13 bp, Homo sapiens
gggtgggcctggc

SEQ ID NO: 2034755 - DNA, 21 bp, Homo sapiens
gggtggggcaatggggagagg

SEQ ID NO: 2034756 - DNA, 14 bp, Homo sapiens
gggtggggctgctc

SEQ ID NO: 2034757 - DNA, 13 bp, Homo sapiens
gggtgggggaggg

SEQ ID NO: 2034758 - DNA, 19 bp, Homo sapiens
gggtgtaacaggtctcctc

SEQ ID NO: 2034759 - DNA, 13 bp, Homo sapiens
gggtgtgccaggc

SEQ ID NO: 2034760 - DNA, 12 bp, Homo sapiens
gggtgtgccctt

SEQ ID NO: 2034761 - DNA, 12 bp, Homo sapiens
gggtgtggcctc

SEQ ID NO: 2034762 - DNA, 13 bp, Homo sapiens
gggtgtggcctca

SEQ ID NO: 2034763 - DNA, 19 bp, Homo sapiens
gggttatttttgtccctgc

SEQ ID NO: 2034764 - DNA, 22 bp, Homo sapiens
gggttatttttgtccctgctcc

SEQ ID NO: 2034765 - DNA, 16 bp, Homo sapiens
gggttcagcccctcct

SEQ ID NO: 2034766 - DNA, 22 bp, Homo sapiens
gggttcagcccctcctctgcca

SEQ ID NO: 2034767 - DNA, 18 bp, Homo sapiens
gggttctgggagttccct

SEQ ID NO: 2034768 - DNA, 16 bp, Homo sapiens
gggttctttcttcctc

SEQ ID NO: 2034769 - DNA, 17 bp, Homo sapiens
gggttctttcttcctct

SEQ ID NO: 2034770 - DNA, 19 bp, Homo sapiens
gggttctttcttcctctgc

SEQ ID NO: 2034771 - DNA, 16 bp, Homo sapiens
gggttctttggaagga

SEQ ID NO: 2034772 - DNA, 19 bp, Homo sapiens
gggttggcccctgcccggc

SEQ ID NO: 2034773 - DNA, 15 bp, Homo sapiens
gggttgggctggtgt

SEQ ID NO: 2034774 - DNA, 15 bp, Homo sapiens
gggttggttggggtg

SEQ ID NO: 2034775 - DNA, 21 bp, Homo sapiens
gggttgtcaagagagagtcaa

SEQ ID NO: 2034776 - DNA, 21 bp, Homo sapiens
gggttgtgaggcctggccagg

SEQ ID NO: 2034777 - DNA, 15 bp, Homo sapiens
gggttgtgtgtctgt

SEQ ID NO: 2034778 - DNA, 20 bp, Homo sapiens
gggtttcaccatgttggcca

SEQ ID NO: 2034779 - DNA, 21 bp, Homo sapiens
gggtttgagtcaaaagcctgg

SEQ ID NO: 2034780 - DNA, 17 bp, Homo sapiens
gggttttccaccctgga

SEQ ID NO: 2034781 - DNA, 18 bp, Homo sapiens
gggttttctaactgtaaa

SEQ ID NO: 2034782 - DNA, 21 bp, Homo sapiens
gggttttctaactgtaaatca

SEQ ID NO: 2034783 - DNA, 23 bp, Homo sapiens
gggttttctaactgtaaatcact

SEQ ID NO: 2034784 - DNA, 20 bp, Homo sapiens
gggttttgccatgttggcca

SEQ ID NO: 2034785 - DNA, 23 bp, Homo sapiens
gggttttgccatgttggccaggc

SEQ ID NO: 2034786 - DNA, 21 bp, Homo sapiens
ggtaaatatgactcctttctc

SEQ ID NO: 2034787 - DNA, 19 bp, Homo sapiens
ggtaaattgtaaacagcta

SEQ ID NO: 2034788 - DNA, 14 bp, Homo sapiens
ggtaacaggcagat

SEQ ID NO: 2034789 - DNA, 18 bp, Homo sapiens
ggtaacagggagactgca

SEQ ID NO: 2034790 - DNA, 20 bp, Homo sapiens
ggtaagccagagcctggggt

SEQ ID NO: 2034791 - DNA, 19 bp, Homo sapiens
ggtaataagtactgtgtac

SEQ ID NO: 2034792 - DNA, 22 bp, Homo sapiens
ggtaattgttgctaatcttctt

SEQ ID NO: 2034793 - DNA, 23 bp, Homo sapiens
ggtacagcaacaggaatctcaga

SEQ ID NO: 2034794 - DNA, 15 bp, Homo sapiens
ggtacatttccctgt

SEQ ID NO: 2034795 - DNA, 13 bp, Homo sapiens
ggtaccagctcac

SEQ ID NO: 2034796 - DNA, 14 bp, Homo sapiens
ggtaccagctcact

SEQ ID NO: 2034797 - DNA, 15 bp, Homo sapiens
ggtaccagctcactc

SEQ ID NO: 2034798 - DNA, 17 bp, Homo sapiens
ggtacccactgctctgg

SEQ ID NO: 2034799 - DNA, 18 bp, Homo sapiens
ggtaccttgaacactggg

SEQ ID NO: 2034800 - DNA, 19 bp, Homo sapiens
ggtactctccaaaggccct

SEQ ID NO: 2034801 - DNA, 16 bp, Homo sapiens
ggtacttacccggaga

SEQ ID NO: 2034802 - DNA, 12 bp, Homo sapiens
ggtagaagccag

SEQ ID NO: 2034803 - DNA, 15 bp, Homo sapiens
ggtagaatgtaaagc

SEQ ID NO: 2034804 - DNA, 16 bp, Homo sapiens
ggtagaattgggaagc

SEQ ID NO: 2034805 - DNA, 13 bp, Homo sapiens
ggtagagatgtgt

SEQ ID NO: 2034806 - DNA, 19 bp, Homo sapiens
ggtagatcgcttgagccca

SEQ ID NO: 2034807 - DNA, 20 bp, Homo sapiens
ggtagcagataaagacagct

SEQ ID NO: 2034808 - DNA, 14 bp, Homo sapiens
ggcttcctccgtct

SEQ ID NO: 2034809 - DNA, 13 bp, Homo sapiens
ggcttcctcctga

SEQ ID NO: 2034810 - DNA, 13 bp, Homo sapiens
ggcttcctgactg

SEQ ID NO: 2034811 - DNA, 17 bp, Homo sapiens
ggcttcctgtccactct

SEQ ID NO: 2034812 - DNA, 15 bp, Homo sapiens
ggcttctgggacctg

SEQ ID NO: 2034813 - DNA, 17 bp, Homo sapiens
ggcttctgggacctgtg

SEQ ID NO: 2034814 - DNA, 16 bp, Homo sapiens
ggcttctgggtggctc

SEQ ID NO: 2034815 - DNA, 20 bp, Homo sapiens
ggcttctgggtggctcctgc

SEQ ID NO: 2034816 - DNA, 12 bp, Homo sapiens
ggcttctgtgca

SEQ ID NO: 2034817 - DNA, 23 bp, Homo sapiens
ggcttctgtgcactagcctgtga

SEQ ID NO: 2034818 - DNA, 14 bp, Homo sapiens
ggcttcttcttata

SEQ ID NO: 2034819 - DNA, 14 bp, Homo sapiens
ggcttgctccaggg

SEQ ID NO: 2034820 - DNA, 17 bp, Homo sapiens
ggcttgcttgccgagcc

SEQ ID NO: 2034821 - DNA, 14 bp, Homo sapiens
ggcttggccttgtg

SEQ ID NO: 2034822 - DNA, 21 bp, Homo sapiens
ggcttgggaagatcttttaaa

SEQ ID NO: 2034823 - DNA, 17 bp, Homo sapiens
ggcttgggccctgcaca

SEQ ID NO: 2034824 - DNA, 18 bp, Homo sapiens
ggcttggggagcaggtct

SEQ ID NO: 2034825 - DNA, 23 bp, Homo sapiens
ggcttggggagcaggtctctggc

SEQ ID NO: 2034826 - DNA, 15 bp, Homo sapiens
ggcttggggcttcct

SEQ ID NO: 2034827 - DNA, 15 bp, Homo sapiens
ggcttgtaactccac

SEQ ID NO: 2034828 - DNA, 18 bp, Homo sapiens
ggcttgtaactccaccaa

SEQ ID NO: 2034829 - DNA, 16 bp, Homo sapiens
ggcttgtcactagcag

SEQ ID NO: 2034830 - DNA, 15 bp, Homo sapiens
ggcttgtgattctgg

SEQ ID NO: 2034831 - DNA, 14 bp, Homo sapiens
ggctttaacaaaac

SEQ ID NO: 2034832 - DNA, 22 bp, Homo sapiens
ggctttctccggggtctgtgct

SEQ ID NO: 2034833 - DNA, 13 bp, Homo sapiens
ggctttctggaga

SEQ ID NO: 2034834 - DNA, 14 bp, Homo sapiens
ggctttctggagag

SEQ ID NO: 2034835 - DNA, 19 bp, Homo sapiens
ggctttgcaggctctgggc

SEQ ID NO: 2034836 - DNA, 18 bp, Homo sapiens
ggctttgccatgggcctg

SEQ ID NO: 2034837 - DNA, 20 bp, Homo sapiens
ggctttgtctctagccgggc

SEQ ID NO: 2034838 - DNA, 13 bp, Homo sapiens
ggcttttcactgc

SEQ ID NO: 2034839 - DNA, 14 bp, Homo sapiens
ggcttttcactgct

SEQ ID NO: 2034840 - DNA, 19 bp, Homo sapiens
ggcttttcactgctggctg

SEQ ID NO: 2034841 - DNA, 14 bp, Homo sapiens
gggaaaacagagga

SEQ ID NO: 2034842 - DNA, 16 bp, Homo sapiens
gggaaaacataatatc

SEQ ID NO: 2034843 - DNA, 22 bp, Homo sapiens
gggaaaggctctgaaagccagc

SEQ ID NO: 2034844 - DNA, 22 bp, Homo sapiens
gggaacagactggaagcacagc

SEQ ID NO: 2034845 - DNA, 18 bp, Homo sapiens
gggaacagagcgggcctc

SEQ ID NO: 2034846 - DNA, 20 bp, Homo sapiens
gggaacccagccctggggta

SEQ ID NO: 2034847 - DNA, 15 bp, Homo sapiens
gggaaccccgcagcc

SEQ ID NO: 2034848 - DNA, 23 bp, Homo sapiens
gggaaccctgcccactcccagga

SEQ ID NO: 2034849 - DNA, 14 bp, Homo sapiens
gggaacgtgactgc

SEQ ID NO: 2034850 - DNA, 15 bp, Homo sapiens
gggaactccactctc

SEQ ID NO: 2034851 - DNA, 14 bp, Homo sapiens
gggaactctgacaa

SEQ ID NO: 2034852 - DNA, 21 bp, Homo sapiens
gggaactgcatatcggaggtg

SEQ ID NO: 2034853 - DNA, 13 bp, Homo sapiens
gggaactggccaa

SEQ ID NO: 2034854 - DNA, 15 bp, Homo sapiens
gggaactggccaagc

SEQ ID NO: 2034855 - DNA, 16 bp, Homo sapiens
gggaactggccaagct

SEQ ID NO: 2034856 - DNA, 16 bp, Homo sapiens
gggaagaaagagaagg

SEQ ID NO: 2034857 - DNA, 20 bp, Homo sapiens
gggaagacaggtctagactt

SEQ ID NO: 2034858 - DNA, 12 bp, Homo sapiens
gggaagagggca

SEQ ID NO: 2034859 - DNA, 16 bp, Homo sapiens
gggaagatcatttctt

SEQ ID NO: 2034860 - DNA, 16 bp, Homo sapiens
gggaagatggtagcag

SEQ ID NO: 2034861 - DNA, 17 bp, Homo sapiens
gggaagatggtagcaga

SEQ ID NO: 2034862 - DNA, 14 bp, Homo sapiens
gggaagcaggcaga

SEQ ID NO: 2034863 - DNA, 15 bp, Homo sapiens
gggaagcagggacac

SEQ ID NO: 2034864 - DNA, 20 bp, Homo sapiens
gggaagcctccgtcaggaga

SEQ ID NO: 2034865 - DNA, 18 bp, Homo sapiens
gggaagctgggggaaggg

SEQ ID NO: 2034866 - DNA, 17 bp, Homo sapiens
gggaaggaactctggct

SEQ ID NO: 2034867 - DNA, 15 bp, Homo sapiens
gggaaggcaggcagg

SEQ ID NO: 2034868 - DNA, 15 bp, Homo sapiens
gggaaggctgctgtg

SEQ ID NO: 2034869 - DNA, 13 bp, Homo sapiens
gggaagggagagc

SEQ ID NO: 2034870 - DNA, 14 bp, Homo sapiens
gggaagtgaagccc

SEQ ID NO: 2034871 - DNA, 16 bp, Homo sapiens
gggaagtgctccccac

SEQ ID NO: 2034872 - DNA, 16 bp, Homo sapiens
gggaataagccatgac

SEQ ID NO: 2034873 - DNA, 20 bp, Homo sapiens
gggaatcggttcatcaattt

SEQ ID NO: 2034874 - DNA, 16 bp, Homo sapiens
gggaatgaacctggag

SEQ ID NO: 2034875 - DNA, 22 bp, Homo sapiens
gggaatggcacagcccaaagaa

SEQ ID NO: 2034876 - DNA, 15 bp, Homo sapiens
gggaatgttccctgc

SEQ ID NO: 2034877 - DNA, 17 bp, Homo sapiens
gggaatgttccctgcac

SEQ ID NO: 2034878 - DNA, 23 bp, Homo sapiens
gggaatgttccctgcaccctgga

SEQ ID NO: 2034879 - DNA, 19 bp, Homo sapiens
gggaatgtttgcctctgcc

SEQ ID NO: 2034880 - DNA, 22 bp, Homo sapiens
gggaatgtttgggcagaaggga

SEQ ID NO: 2034881 - DNA, 23 bp, Homo sapiens
gggaatgtttgggcagaagggag

SEQ ID NO: 2034882 - DNA, 15 bp, Homo sapiens
gggacaaaggagcct

SEQ ID NO: 2034883 - DNA, 17 bp, Homo sapiens
gggacaaaggagcctgt

SEQ ID NO: 2034884 - DNA, 18 bp, Homo sapiens
gggacaaaggagcctgtg

SEQ ID NO: 2034885 - DNA, 16 bp, Homo sapiens
gggacacctgccctgc

SEQ ID NO: 2034886 - DNA, 12 bp, Homo sapiens
gggacagcccca

SEQ ID NO: 2034887 - DNA, 13 bp, Homo sapiens
gggacagctcctt

SEQ ID NO: 2034888 - DNA, 22 bp, Homo sapiens
gggacagggcttggggagcagg

SEQ ID NO: 2034889 - DNA, 21 bp, Homo sapiens
gggacagtattctcagtgctc

SEQ ID NO: 2034890 - DNA, 20 bp, Homo sapiens
gggaccattgacctcagctg

SEQ ID NO: 2034891 - DNA, 22 bp, Homo sapiens
gggaccattgacctcagctgca

SEQ ID NO: 2034892 - DNA, 22 bp, Homo sapiens
gggacccagctactctgtccag

SEQ ID NO: 2034893 - DNA, 14 bp, Homo sapiens
gggacccctcccaa

SEQ ID NO: 2034894 - DNA, 16 bp, Homo sapiens
gggacgcttccagacc

SEQ ID NO: 2034895 - DNA, 17 bp, Homo sapiens
gggacgcttccagacca

SEQ ID NO: 2034896 - DNA, 17 bp, Homo sapiens
gggactacaggcaccca

SEQ ID NO: 2034897 - DNA, 19 bp, Homo sapiens
gggactcaagggtccagaa

SEQ ID NO: 2034898 - DNA, 17 bp, Homo sapiens
gggactcaatgcactga

SEQ ID NO: 2034899 - DNA, 19 bp, Homo sapiens
gggactcaatgcactgaca

SEQ ID NO: 2034900 - DNA, 16 bp, Homo sapiens
gggagaacctcaggct

SEQ ID NO: 2034901 - DNA, 11 bp, Homo sapiens
gggagacctgg

SEQ ID NO: 2034902 - DNA, 20 bp, Homo sapiens
gggagacggaggttgcagtg

SEQ ID NO: 2034903 - DNA, 14 bp, Homo sapiens
gggagagccagctc

SEQ ID NO: 2034904 - DNA, 12 bp, Homo sapiens
gggagagcccag

SEQ ID NO: 2034905 - DNA, 14 bp, Homo sapiens
gggagaggactctg

SEQ ID NO: 2034906 - DNA, 11 bp, Homo sapiens
gggagcactgg

SEQ ID NO: 2034907 - DNA, 20 bp, Homo sapiens
gggagcacttgcgtcctgca

SEQ ID NO: 2034908 - DNA, 20 bp, Homo sapiens
gggagcagagtataggatgg

SEQ ID NO: 2034909 - DNA, 20 bp, Homo sapiens
gggagcaggtctctggcaga

SEQ ID NO: 2034910 - DNA, 15 bp, Homo sapiens
gggagccaacagcag

SEQ ID NO: 2034911 - DNA, 20 bp, Homo sapiens
gggagcctccccctcagatg

SEQ ID NO: 2034912 - DNA, 21 bp, Homo sapiens
gggagcctcgcaacccgtgcc

SEQ ID NO: 2034913 - DNA, 22 bp, Homo sapiens
gggagctgcctgttcagctcca

SEQ ID NO: 2034914 - DNA, 16 bp, Homo sapiens
gggaggaagggccagg

SEQ ID NO: 2034915 - DNA, 14 bp, Homo sapiens
gggaggaggagctg

SEQ ID NO: 2034916 - DNA, 15 bp, Homo sapiens
gggaggaggcagaga

SEQ ID NO: 2034917 - DNA, 17 bp, Homo sapiens
gggaggatcactggagc

SEQ ID NO: 2034918 - DNA, 12 bp, Homo sapiens
gggaggcaccag

SEQ ID NO: 2034919 - DNA, 16 bp, Homo sapiens
gggaggcaccagctct

SEQ ID NO: 2034920 - DNA, 16 bp, Homo sapiens
gggaggcatggccctg

SEQ ID NO: 2034921 - DNA, 19 bp, Homo sapiens
gggaggccaaggcaggtag

SEQ ID NO: 2034922 - DNA, 22 bp, Homo sapiens
gggaggcggcacattggcagtg

SEQ ID NO: 2034923 - DNA, 15 bp, Homo sapiens
gggcccctccctctg

SEQ ID NO: 2034924 - DNA, 12 bp, Homo sapiens
gggcccctggga

SEQ ID NO: 2034925 - DNA, 21 bp, Homo sapiens
gggccccttggcgggcagccc

SEQ ID NO: 2034926 - DNA, 22 bp, Homo sapiens
gggccctgagctcggtggaccc

SEQ ID NO: 2034927 - DNA, 13 bp, Homo sapiens
gggccctgggcct

SEQ ID NO: 2034928 - DNA, 17 bp, Homo sapiens
gggccctgggcctcagt

SEQ ID NO: 2034929 - DNA, 20 bp, Homo sapiens
gggccctggggcctgtactg

SEQ ID NO: 2034930 - DNA, 17 bp, Homo sapiens
gggcccttggggcctgg

SEQ ID NO: 2034931 - DNA, 20 bp, Homo sapiens
gggcccttggggcctggctt

SEQ ID NO: 2034932 - DNA, 13 bp, Homo sapiens
gggccgctggccc

SEQ ID NO: 2034933 - DNA, 14 bp, Homo sapiens
gggccgctggccca

SEQ ID NO: 2034934 - DNA, 17 bp, Homo sapiens
gggccgtgcccaggggc

SEQ ID NO: 2034935 - DNA, 16 bp, Homo sapiens
gggcctatggagagcc

SEQ ID NO: 2034936 - DNA, 17 bp, Homo sapiens
gggcctccccccagccc

SEQ ID NO: 2034937 - DNA, 21 bp, Homo sapiens
gggcctcctctccctgcacct

SEQ ID NO: 2034938 - DNA, 15 bp, Homo sapiens
gggcctcggagcctc

SEQ ID NO: 2034939 - DNA, 12 bp, Homo sapiens
gggcctcttccc

SEQ ID NO: 2034940 - DNA, 22 bp, Homo sapiens
gggcctgacaggttcccagcag

SEQ ID NO: 2034941 - DNA, 15 bp, Homo sapiens
gggcctgcccaatgc

SEQ ID NO: 2034942 - DNA, 19 bp, Homo sapiens
gggcctgcctctgactcac

SEQ ID NO: 2034943 - DNA, 15 bp, Homo sapiens
gggcctgctgctgag

SEQ ID NO: 2034944 - DNA, 18 bp, Homo sapiens
gggcctgctgctgagaac

SEQ ID NO: 2034945 - DNA, 20 bp, Homo sapiens
gggcctgctgctgagaacct

SEQ ID NO: 2034946 - DNA, 22 bp, Homo sapiens
gggcctgctgctgagaacctgg

SEQ ID NO: 2034947 - DNA, 18 bp, Homo sapiens
gggcctgcttttccagga

SEQ ID NO: 2034948 - DNA, 14 bp, Homo sapiens
gggcctggagaggg

SEQ ID NO: 2034949 - DNA, 15 bp, Homo sapiens
gggcctggcctgagc

SEQ ID NO: 2034950 - DNA, 18 bp, Homo sapiens
gggcctggcctgagctgg

SEQ ID NO: 2034951 - DNA, 19 bp, Homo sapiens
gggcctggcctgagctggg

SEQ ID NO: 2034952 - DNA, 16 bp, Homo sapiens
gggcctggctggctga

SEQ ID NO: 2034953 - DNA, 18 bp, Homo sapiens
gggcctggctggctgagg

SEQ ID NO: 2034954 - DNA, 23 bp, Homo sapiens
gggcctggctggctgagggcagt

SEQ ID NO: 2034955 - DNA, 16 bp, Homo sapiens
gggcctggcttgctcc

SEQ ID NO: 2034956 - DNA, 20 bp, Homo sapiens
gggcctggcttgctccaggg

SEQ ID NO: 2034957 - DNA, 23 bp, Homo sapiens
gggcctggcttgctccagggtct

SEQ ID NO: 2034958 - DNA, 15 bp, Homo sapiens
gggcctgggcctgct

SEQ ID NO: 2034959 - DNA, 16 bp, Homo sapiens
gggcctgtactgcctg

SEQ ID NO: 2034960 - DNA, 18 bp, Homo sapiens
gggcctgtactgcctgct

SEQ ID NO: 2034961 - DNA, 14 bp, Homo sapiens
gggcctgtgcagca

SEQ ID NO: 2034962 - DNA, 21 bp, Homo sapiens
gggccttacctcccctgccag

SEQ ID NO: 2034963 - DNA, 15 bp, Homo sapiens
gggccttgcccagag

SEQ ID NO: 2034964 - DNA, 17 bp, Homo sapiens
gggccttgcccagagat

SEQ ID NO: 2034965 - DNA, 22 bp, Homo sapiens
gggcctttcctgtgccaacctg

SEQ ID NO: 2034966 - DNA, 23 bp, Homo sapiens
gggcgcacatgttatccacaagc

SEQ ID NO: 2034967 - DNA, 22 bp, Homo sapiens
gggcgcccattcgtctgtccca

SEQ ID NO: 2034968 - DNA, 12 bp, Homo sapiens
gggcgctcagga

SEQ ID NO: 2034969 - DNA, 15 bp, Homo sapiens
gggcgctcaggaccc

SEQ ID NO: 2034970 - DNA, 20 bp, Homo sapiens
gggcgctcaggacccaggcc

SEQ ID NO: 2034971 - DNA, 22 bp, Homo sapiens
gggcgctcaggacccaggccct

SEQ ID NO: 2034972 - DNA, 14 bp, Homo sapiens
gggcgctctgccct

SEQ ID NO: 2034973 - DNA, 16 bp, Homo sapiens
gggcggggcaggaatg

SEQ ID NO: 2034974 - DNA, 12 bp, Homo sapiens
gggcgtggacca

SEQ ID NO: 2034975 - DNA, 20 bp, Homo sapiens
gggcgtggaccacccgccct

SEQ ID NO: 2034976 - DNA, 23 bp, Homo sapiens
gggctaccccccctcctgctgcc

SEQ ID NO: 2034977 - DNA, 16 bp, Homo sapiens
gggctactggcagctc

SEQ ID NO: 2034978 - DNA, 17 bp, Homo sapiens
gggctactggcagctcc

SEQ ID NO: 2034979 - DNA, 18 bp, Homo sapiens
gggctactggcagctcct

SEQ ID NO: 2034980 - DNA, 22 bp, Homo sapiens
gggctactggcagctcctctcc

SEQ ID NO: 2034981 - DNA, 14 bp, Homo sapiens
gggctagaacctgg

SEQ ID NO: 2034982 - DNA, 16 bp, Homo sapiens
gggctatggcaagggg

SEQ ID NO: 2034983 - DNA, 18 bp, Homo sapiens
gggctatttctctcccca

SEQ ID NO: 2034984 - DNA, 11 bp, Homo sapiens
gggctcagcct

SEQ ID NO: 2034985 - DNA, 13 bp, Homo sapiens
gggctcagcctgg

SEQ ID NO: 2034986 - DNA, 19 bp, Homo sapiens
gggctcagcggggacagct

SEQ ID NO: 2034987 - DNA, 21 bp, Homo sapiens
gggctcagcggggacagctcc

SEQ ID NO: 2034988 - DNA, 13 bp, Homo sapiens
gggctcagggctg

SEQ ID NO: 2034989 - DNA, 14 bp, Homo sapiens
gggctcagggctgg

SEQ ID NO: 2034990 - DNA, 13 bp, Homo sapiens
gggctccagcatc

SEQ ID NO: 2034991 - DNA, 15 bp, Homo sapiens
gggctccatggagga

SEQ ID NO: 2034992 - DNA, 16 bp, Homo sapiens
gggctccatggaggag

SEQ ID NO: 2034993 - DNA, 19 bp, Homo sapiens
gggctccatggaggaggtg

SEQ ID NO: 2034994 - DNA, 15 bp, Homo sapiens
gggctccctcctgga

SEQ ID NO: 2034995 - DNA, 20 bp, Homo sapiens
gggctcctggaaaggctcag

SEQ ID NO: 2034996 - DNA, 23 bp, Homo sapiens
gggctcctggaaaggctcagtct

SEQ ID NO: 2034997 - DNA, 13 bp, Homo sapiens
gggctcctggctg

SEQ ID NO: 2034998 - DNA, 16 bp, Homo sapiens
gggctcctggctgcca

SEQ ID NO: 2034999 - DNA, 17 bp, Homo sapiens
gggctcctggctgccag

SEQ ID NO: 2035000 - DNA, 18 bp, Homo sapiens
gggctcctttctccagcc

SEQ ID NO: 2035001 - DNA, 18 bp, Homo sapiens
gggctctaacgcctgagc

SEQ ID NO: 2035002 - DNA, 21 bp, Homo sapiens
gggctctaacgcctgagccca

SEQ ID NO: 2035003 - DNA, 18 bp, Homo sapiens
gggctctccaaaggggct

SEQ ID NO: 2035004 - DNA, 23 bp, Homo sapiens
gggctctccaaaggggctgctgg

SEQ ID NO: 2035005 - DNA, 14 bp, Homo sapiens
gggctctccacctc

SEQ ID NO: 2035006 - DNA, 17 bp, Homo sapiens
gggctctccacctcagc

SEQ ID NO: 2035007 - DNA, 19 bp, Homo sapiens
gggctctccacctcagcct

SEQ ID NO: 2035008 - DNA, 21 bp, Homo sapiens
gggctctccacctcagccttg

SEQ ID NO: 2035009 - DNA, 22 bp, Homo sapiens
gggctctcctggcttcccatcc

SEQ ID NO: 2035010 - DNA, 11 bp, Homo sapiens
gggctctgagg

SEQ ID NO: 2035011 - DNA, 16 bp, Homo sapiens
gggctctggccaccct

SEQ ID NO: 2035012 - DNA, 19 bp, Homo sapiens
gggctctggccaccctggc

SEQ ID NO: 2035013 - DNA, 15 bp, Homo sapiens
gggctgacacctacc

SEQ ID NO: 2035014 - DNA, 20 bp, Homo sapiens
gggctgacacctaccatgct

SEQ ID NO: 2035015 - DNA, 21 bp, Homo sapiens
gggctgacacctaccatgctg

SEQ ID NO: 2035016 - DNA, 13 bp, Homo sapiens
gggctgagccctg

SEQ ID NO: 2035017 - DNA, 16 bp, Homo sapiens
gggctgagccctggca

SEQ ID NO: 2035018 - DNA, 13 bp, Homo sapiens
gggctgccctggt

SEQ ID NO: 2035019 - DNA, 14 bp, Homo sapiens
gggctgccctggtg

SEQ ID NO: 2035020 - DNA, 15 bp, Homo sapiens
gggctgccctggtgc

SEQ ID NO: 2035021 - DNA, 21 bp, Homo sapiens
gggctgccctggtgctgccac

SEQ ID NO: 2035022 - DNA, 19 bp, Homo sapiens
gggctgcccttcgctgcca

SEQ ID NO: 2035023 - DNA, 21 bp, Homo sapiens
gggctgcccttcgctgccagg

SEQ ID NO: 2035024 - DNA, 22 bp, Homo sapiens
gggctgcgaaaacgttgacccc

SEQ ID NO: 2035025 - DNA, 18 bp, Homo sapiens
gggctgctcatcacccag

SEQ ID NO: 2035026 - DNA, 19 bp, Homo sapiens
gggctgctcatcacccagt

SEQ ID NO: 2035027 - DNA, 16 bp, Homo sapiens
gggctgctcctccagg

SEQ ID NO: 2035028 - DNA, 18 bp, Homo sapiens
gggctgctcctccagggc

SEQ ID NO: 2035029 - DNA, 14 bp, Homo sapiens
gtaacaggtctcct

SEQ ID NO: 2035030 - DNA, 20 bp, Homo sapiens
gtaacaggtctcctcttaaa

SEQ ID NO: 2035031 - DNA, 21 bp, Homo sapiens
gtaacaggtctcctcttaaaa

SEQ ID NO: 2035032 - DNA, 14 bp, Homo sapiens
gtaacatagattta

SEQ ID NO: 2035033 - DNA, 14 bp, Homo sapiens
gtaacatccagaag

SEQ ID NO: 2035034 - DNA, 20 bp, Homo sapiens
gtaacatttggagtgtgtat

SEQ ID NO: 2035035 - DNA, 20 bp, Homo sapiens
gtaaccaagagtattccatt

SEQ ID NO: 2035036 - DNA, 17 bp, Homo sapiens
gtaactacactaataaa

SEQ ID NO: 2035037 - DNA, 19 bp, Homo sapiens
gtaactactttttatactc

SEQ ID NO: 2035038 - DNA, 14 bp, Homo sapiens
gtaactcagacatt

SEQ ID NO: 2035039 - DNA, 16 bp, Homo sapiens
gtaactgctgagccac

SEQ ID NO: 2035040 - DNA, 17 bp, Homo sapiens
gtaactgctgagccact

SEQ ID NO: 2035041 - DNA, 15 bp, Homo sapiens
gtaacttttgtaaga

SEQ ID NO: 2035042 - DNA, 17 bp, Homo sapiens
gtaacttttgtaagaca

SEQ ID NO: 2035043 - DNA, 16 bp, Homo sapiens
gtaagcactgactggg

SEQ ID NO: 2035044 - DNA, 20 bp, Homo sapiens
gtaagcactgactgggacca

SEQ ID NO: 2035045 - DNA, 12 bp, Homo sapiens
gtaagccagagc

SEQ ID NO: 2035046 - DNA, 14 bp, Homo sapiens
gtaagccagagcct

SEQ ID NO: 2035047 - DNA, 17 bp, Homo sapiens
gtaagcctccctcctcg

SEQ ID NO: 2035048 - DNA, 17 bp, Homo sapiens
gtaagctctggctttct

SEQ ID NO: 2035049 - DNA, 17 bp, Homo sapiens
gtaagggaaactgccag

SEQ ID NO: 2035050 - DNA, 16 bp, Homo sapiens
gtaagggtctgttgta

SEQ ID NO: 2035051 - DNA, 12 bp, Homo sapiens
gtaaggtgcctt

SEQ ID NO: 2035052 - DNA, 23 bp, Homo sapiens
gtaagtaattatcgggaacagtg

SEQ ID NO: 2035053 - DNA, 16 bp, Homo sapiens
gtaagtaccacatcta

SEQ ID NO: 2035054 - DNA, 18 bp, Homo sapiens
gtaagtaccactcaggcc

SEQ ID NO: 2035055 - DNA, 12 bp, Homo sapiens
gtaagtcttttt

SEQ ID NO: 2035056 - DNA, 10 bp, Homo sapiens
gtaataaact

SEQ ID NO: 2035057 - DNA, 14 bp, Homo sapiens
gtaataaactctct

SEQ ID NO: 2035058 - DNA, 19 bp, Homo sapiens
gtaatagaaaactgaaaat

SEQ ID NO: 2035059 - DNA, 18 bp, Homo sapiens
gtaatagtccaatatttg

SEQ ID NO: 2035060 - DNA, 19 bp, Homo sapiens
gtaatagtccaatatttgg

SEQ ID NO: 2035061 - DNA, 22 bp, Homo sapiens
gtaatataatggaagagaaatc

SEQ ID NO: 2035062 - DNA, 12 bp, Homo sapiens
gtaatatattgc

SEQ ID NO: 2035063 - DNA, 15 bp, Homo sapiens
gtaatatattgctgc

SEQ ID NO: 2035064 - DNA, 16 bp, Homo sapiens
gtaatatattgctgct

SEQ ID NO: 2035065 - DNA, 14 bp, Homo sapiens
gtaatcaatgtttc

SEQ ID NO: 2035066 - DNA, 17 bp, Homo sapiens
gtaatccatcactagcc

SEQ ID NO: 2035067 - DNA, 13 bp, Homo sapiens
gtaatcccagcag

SEQ ID NO: 2035068 - DNA, 15 bp, Homo sapiens
gtaatcccagctact

SEQ ID NO: 2035069 - DNA, 18 bp, Homo sapiens
gtaatcctgtatattatg

SEQ ID NO: 2035070 - DNA, 16 bp, Homo sapiens
gtaatcgttatgtgtg

SEQ ID NO: 2035071 - DNA, 22 bp, Homo sapiens
gtaatctccacagtcaaagaag

SEQ ID NO: 2035072 - DNA, 12 bp, Homo sapiens
gtaatgaatatc

SEQ ID NO: 2035073 - DNA, 16 bp, Homo sapiens
gtaatgaatatctgct

SEQ ID NO: 2035074 - DNA, 15 bp, Homo sapiens
gtaatgagggactgg

SEQ ID NO: 2035075 - DNA, 14 bp, Homo sapiens
gtaatgcacaattt

SEQ ID NO: 2035076 - DNA, 19 bp, Homo sapiens
gtaatgcacaatttagaaa

SEQ ID NO: 2035077 - DNA, 16 bp, Homo sapiens
gtaatgggccaattaa

SEQ ID NO: 2035078 - DNA, 12 bp, Homo sapiens
gtaatgtcacca

SEQ ID NO: 2035079 - DNA, 22 bp, Homo sapiens
gtaatgtcaccaccttcccagc

SEQ ID NO: 2035080 - DNA, 19 bp, Homo sapiens
gtaattaagtgcaatttcc

SEQ ID NO: 2035081 - DNA, 16 bp, Homo sapiens
gtaattaataaacgaa

SEQ ID NO: 2035082 - DNA, 18 bp, Homo sapiens
gtaattcagaaaacataa

SEQ ID NO: 2035083 - DNA, 21 bp, Homo sapiens
gtaattcctctcactaaactt

SEQ ID NO: 2035084 - DNA, 12 bp, Homo sapiens
gtaattctaaat

SEQ ID NO: 2035085 - DNA, 14 bp, Homo sapiens
gtaattctaaatga

SEQ ID NO: 2035086 - DNA, 15 bp, Homo sapiens
gtaattctaaatgaa

SEQ ID NO: 2035087 - DNA, 18 bp, Homo sapiens
gtaattctaaatgaatgt

SEQ ID NO: 2035088 - DNA, 22 bp, Homo sapiens
gtaattctccctaaggaatctg

SEQ ID NO: 2035089 - DNA, 23 bp, Homo sapiens
gtaattctccctaaggaatctga

SEQ ID NO: 2035090 - DNA, 14 bp, Homo sapiens
gtaattctgcttct

SEQ ID NO: 2035091 - DNA, 16 bp, Homo sapiens
gtaattgcttacattt

SEQ ID NO: 2035092 - DNA, 18 bp, Homo sapiens
gtaatttataaaattaga

SEQ ID NO: 2035093 - DNA, 14 bp, Homo sapiens
gtaattttttaaat

SEQ ID NO: 2035094 - DNA, 15 bp, Homo sapiens
gtacaaaagtaccat

SEQ ID NO: 2035095 - DNA, 16 bp, Homo sapiens
gtacaaaataaacaaa

SEQ ID NO: 2035096 - DNA, 14 bp, Homo sapiens
gtacaaagtagaga

SEQ ID NO: 2035097 - DNA, 17 bp, Homo sapiens
gtacaaagtagagaagt

SEQ ID NO: 2035098 - DNA, 13 bp, Homo sapiens
gtacaatatttaa

SEQ ID NO: 2035099 - DNA, 13 bp, Homo sapiens
gtacaatgtttca

SEQ ID NO: 2035100 - DNA, 15 bp, Homo sapiens
gtacaatgtttcaga

SEQ ID NO: 2035101 - DNA, 16 bp, Homo sapiens
gtacacacacatacac

SEQ ID NO: 2035102 - DNA, 19 bp, Homo sapiens
gtacacacggaccatgtgg

SEQ ID NO: 2035103 - DNA, 17 bp, Homo sapiens
gtacagacgtatgctta

SEQ ID NO: 2035104 - DNA, 12 bp, Homo sapiens
gtacagcagggt

SEQ ID NO: 2035105 - DNA, 20 bp, Homo sapiens
gtacagcagggtcttgctgt

SEQ ID NO: 2035106 - DNA, 21 bp, Homo sapiens
gtacaggcaaaacacgcaagg

SEQ ID NO: 2035107 - DNA, 24 bp, Homo sapiens
gtacaggcaaaacacgcaagggca

SEQ ID NO: 2035108 - DNA, 23 bp, Homo sapiens
gtacagtagcttaaataaattca

SEQ ID NO: 2035109 - DNA, 14 bp, Homo sapiens
gtacagtgaggagg

SEQ ID NO: 2035110 - DNA, 15 bp, Homo sapiens
gtacagtgaggaggg

SEQ ID NO: 2035111 - DNA, 18 bp, Homo sapiens
gtacagtgaggagggtgg

SEQ ID NO: 2035112 - DNA, 21 bp, Homo sapiens
gtacagttatttatgcctctg

SEQ ID NO: 2035113 - DNA, 19 bp, Homo sapiens
gtacagttcagttcctctt

SEQ ID NO: 2035114 - DNA, 23 bp, Homo sapiens
gtacataaaggtggtatgtgtgt

SEQ ID NO: 2035115 - DNA, 21 bp, Homo sapiens
gtacatagatgtatcattaat

SEQ ID NO: 2035116 - DNA, 15 bp, Homo sapiens
gtacatatggaaatc

SEQ ID NO: 2035117 - DNA, 16 bp, Homo sapiens
gtacatatggaaatcc

SEQ ID NO: 2035118 - DNA, 18 bp, Homo sapiens
gtacatatgtaaaataaa

SEQ ID NO: 2035119 - DNA, 10 bp, Homo sapiens
gtacatgtat

SEQ ID NO: 2035120 - DNA, 18 bp, Homo sapiens
gtacattcctgatactgg

SEQ ID NO: 2035121 - DNA, 14 bp, Homo sapiens
gtacatttccctgt

SEQ ID NO: 2035122 - DNA, 14 bp, Homo sapiens
gtaccaatcatttt

SEQ ID NO: 2035123 - DNA, 15 bp, Homo sapiens
gtaccaatcatttta

SEQ ID NO: 2035124 - DNA, 21 bp, Homo sapiens
gtaccaatcattttaattatt

SEQ ID NO: 2035125 - DNA, 14 bp, Homo sapiens
gtaccactcaggcc

SEQ ID NO: 2035126 - DNA, 16 bp, Homo sapiens
gtaccagcaatatgta

SEQ ID NO: 2035127 - DNA, 24 bp, Homo sapiens
gtaccagccaggatcccaagcgtc

SEQ ID NO: 2035128 - DNA, 19 bp, Homo sapiens
gtaccagtgtactgctttc

SEQ ID NO: 2035129 - DNA, 11 bp, Homo sapiens
gtaccatcaat

SEQ ID NO: 2035130 - DNA, 16 bp, Homo sapiens
gtaccatcaataaagt

SEQ ID NO: 2035131 - DNA, 17 bp, Homo sapiens
gtaccatcaataaagta

SEQ ID NO: 2035132 - DNA, 16 bp, Homo sapiens
gtaccatgttaaagag

SEQ ID NO: 2035133 - DNA, 15 bp, Homo sapiens
gtacccactcctcac

SEQ ID NO: 2035134 - DNA, 20 bp, Homo sapiens
gtacccactcctcactgccc

SEQ ID NO: 2035135 - DNA, 15 bp, Homo sapiens
gtacccactgctctg

SEQ ID NO: 2035136 - DNA, 16 bp, Homo sapiens
gtacccactgctctgg

SEQ ID NO: 2035137 - DNA, 24 bp, Homo sapiens
gtacccagctccttttgtccccag

SEQ ID NO: 2035138 - DNA, 13 bp, Homo sapiens
gtaccccatccct

SEQ ID NO: 2035139 - DNA, 19 bp, Homo sapiens
gtatacacacatatacata

SEQ ID NO: 2035140 - DNA, 23 bp, Homo sapiens
gtatacacacatatacatatata

SEQ ID NO: 2035141 - DNA, 21 bp, Homo sapiens
gtatacagtggattaattaaa

SEQ ID NO: 2035142 - DNA, 13 bp, Homo sapiens
gtatagtgtaaaa

SEQ ID NO: 2035143 - DNA, 20 bp, Homo sapiens
gtatagttttataaaactca

SEQ ID NO: 2035144 - DNA, 20 bp, Homo sapiens
gtatataatactaaagtgtc

SEQ ID NO: 2035145 - DNA, 13 bp, Homo sapiens
gtatatacatttc

SEQ ID NO: 2035146 - DNA, 19 bp, Homo sapiens
gtatatacttcactcactt

SEQ ID NO: 2035147 - DNA, 11 bp, Homo sapiens
gtatatataca

SEQ ID NO: 2035148 - DNA, 15 bp, Homo sapiens
gtatatatacataca

SEQ ID NO: 2035149 - DNA, 19 bp, Homo sapiens
ggtgatcaattaaatgtag

SEQ ID NO: 2035150 - DNA, 14 bp, Homo sapiens
ggtgatcagaaggc

SEQ ID NO: 2035151 - DNA, 12 bp, Homo sapiens
ggtgatcagtgc

SEQ ID NO: 2035152 - DNA, 15 bp, Homo sapiens
ggtgatgagggcagc

SEQ ID NO: 2035153 - DNA, 22 bp, Homo sapiens
ggtgatgagggcagcagccagc

SEQ ID NO: 2035154 - DNA, 18 bp, Homo sapiens
ggtgcaaagttccctact

SEQ ID NO: 2035155 - DNA, 16 bp, Homo sapiens
ggtgcaagagacagag

SEQ ID NO: 2035156 - DNA, 13 bp, Homo sapiens
ggtgcacaggagg

SEQ ID NO: 2035157 - DNA, 19 bp, Homo sapiens
ggtgcacccactcaccagg

SEQ ID NO: 2035158 - DNA, 18 bp, Homo sapiens
ggtgcagttttccaggaa

SEQ ID NO: 2035159 - DNA, 19 bp, Homo sapiens
ggtgcatttgagagaagcc

SEQ ID NO: 2035160 - DNA, 12 bp, Homo sapiens
ggtgccaccaat

SEQ ID NO: 2035161 - DNA, 17 bp, Homo sapiens
ggtgccaccaataaaaa

SEQ ID NO: 2035162 - DNA, 23 bp, Homo sapiens
ggtgccaccaataaaaatcctac

SEQ ID NO: 2035163 - DNA, 15 bp, Homo sapiens
ggtgccactccctga

SEQ ID NO: 2035164 - DNA, 16 bp, Homo sapiens
ggtgccactccctgag

SEQ ID NO: 2035165 - DNA, 18 bp, Homo sapiens
ggtgccactccctgagct

SEQ ID NO: 2035166 - DNA, 22 bp, Homo sapiens
ggtgccacttcttaaaggcctg

SEQ ID NO: 2035167 - DNA, 11 bp, Homo sapiens
ggtgccagagg

SEQ ID NO: 2035168 - DNA, 12 bp, Homo sapiens
ggtgccagaggt

SEQ ID NO: 2035169 - DNA, 17 bp, Homo sapiens
ggtgccatgtggagtgg

SEQ ID NO: 2035170 - DNA, 14 bp, Homo sapiens
ggtgcccaggagaa

SEQ ID NO: 2035171 - DNA, 17 bp, Homo sapiens
ggtgccctctggatcct

SEQ ID NO: 2035172 - DNA, 20 bp, Homo sapiens
ggtgccctctggatcctgct

SEQ ID NO: 2035173 - DNA, 20 bp, Homo sapiens
ggtgcctatttattggggat

SEQ ID NO: 2035174 - DNA, 17 bp, Homo sapiens
ggtgcctcagagcaggc

SEQ ID NO: 2035175 - DNA, 22 bp, Homo sapiens
ggtgcctgcctctgccatgccc

SEQ ID NO: 2035176 - DNA, 24 bp, Homo sapiens
ggtgcctgcctctgccatgcccag

SEQ ID NO: 2035177 - DNA, 19 bp, Homo sapiens
ggtgcctgtgaggcagggg

SEQ ID NO: 2035178 - DNA, 22 bp, Homo sapiens
ggtgcgagagaggtgggcagca

SEQ ID NO: 2035179 - DNA, 15 bp, Homo sapiens
ggtgcgatctgggtt

SEQ ID NO: 2035180 - DNA, 18 bp, Homo sapiens
ggtgcggcaggagcagga

SEQ ID NO: 2035181 - DNA, 13 bp, Homo sapiens
ggtgcgtggctgt

SEQ ID NO: 2035182 - DNA, 21 bp, Homo sapiens
ggtgcgtggctgtggcacaga

SEQ ID NO: 2035183 - DNA, 23 bp, Homo sapiens
ggtgctacaaaaacacagcaagg

SEQ ID NO: 2035184 - DNA, 22 bp, Homo sapiens
ggtgctcacgactcttcctgca

SEQ ID NO: 2035185 - DNA, 16 bp, Homo sapiens
ggtgctgagcttagcc

SEQ ID NO: 2035186 - DNA, 13 bp, Homo sapiens
ggtgctggaggat

SEQ ID NO: 2035187 - DNA, 22 bp, Homo sapiens
ggtgctgtcctgttttactgga

SEQ ID NO: 2035188 - DNA, 20 bp, Homo sapiens
ggtggaagccctccttccac

SEQ ID NO: 2035189 - DNA, 16 bp, Homo sapiens
ggtggaaggcccgagg

SEQ ID NO: 2035190 - DNA, 19 bp, Homo sapiens
ggtggaaggcccgaggggc

SEQ ID NO: 2035191 - DNA, 13 bp, Homo sapiens
ggtggacacacaa

SEQ ID NO: 2035192 - DNA, 16 bp, Homo sapiens
ggtggagaagtgtcgt

SEQ ID NO: 2035193 - DNA, 16 bp, Homo sapiens
ggtggagagcactaga

SEQ ID NO: 2035194 - DNA, 19 bp, Homo sapiens
ggtggaggttgcagtgagc

SEQ ID NO: 2035195 - DNA, 20 bp, Homo sapiens
ggtggaggttgcagtgagcc

SEQ ID NO: 2035196 - DNA, 15 bp, Homo sapiens
ggtggatcacagagg

SEQ ID NO: 2035197 - DNA, 14 bp, Homo sapiens
ggtggatgcctggt

SEQ ID NO: 2035198 - DNA, 18 bp, Homo sapiens
ggtggattcctgggcaag

SEQ ID NO: 2035199 - DNA, 19 bp, Homo sapiens
ggtggcaagggggcggggc

SEQ ID NO: 2035200 - DNA, 20 bp, Homo sapiens
ggtggcaagggggcggggcg

SEQ ID NO: 2035201 - DNA, 20 bp, Homo sapiens
ggtggcacctcctgagaagg

SEQ ID NO: 2035202 - DNA, 11 bp, Homo sapiens
ggtggcagctg

SEQ ID NO: 2035203 - DNA, 15 bp, Homo sapiens
ggtggcaggaccagg

SEQ ID NO: 2035204 - DNA, 22 bp, Homo sapiens
ggtggcagtgggagctgcctgt

SEQ ID NO: 2035205 - DNA, 22 bp, Homo sapiens
ggtggccaatccaggtgggaga

SEQ ID NO: 2035206 - DNA, 23 bp, Homo sapiens
ggtggccaatccaggtgggagag

SEQ ID NO: 2035207 - DNA, 20 bp, Homo sapiens
ggtggccactccagacccct

SEQ ID NO: 2035208 - DNA, 22 bp, Homo sapiens
ggtggccactccagacccctgg

SEQ ID NO: 2035209 - DNA, 19 bp, Homo sapiens
ggtggccatccctgggccc

SEQ ID NO: 2035210 - DNA, 21 bp, Homo sapiens
ggtggccccctgtgccagctc

SEQ ID NO: 2035211 - DNA, 20 bp, Homo sapiens
ggtggcccgacagcctggca

SEQ ID NO: 2035212 - DNA, 22 bp, Homo sapiens
ggtggctactctgtgccagagc

SEQ ID NO: 2035213 - DNA, 19 bp, Homo sapiens
ggtggctcacgcctataat

SEQ ID NO: 2035214 - DNA, 13 bp, Homo sapiens
ggtggctcctgcc

SEQ ID NO: 2035215 - DNA, 17 bp, Homo sapiens
ggtggctcctgccactg

SEQ ID NO: 2035216 - DNA, 13 bp, Homo sapiens
ggtggctgaccca

SEQ ID NO: 2035217 - DNA, 15 bp, Homo sapiens
ggtggctgacccagt

SEQ ID NO: 2035218 - DNA, 18 bp, Homo sapiens
ggtggctgggttggaggg

SEQ ID NO: 2035219 - DNA, 14 bp, Homo sapiens
ggtggcttttgcgg

SEQ ID NO: 2035220 - DNA, 15 bp, Homo sapiens
ggtgggaaccctccc

SEQ ID NO: 2035221 - DNA, 13 bp, Homo sapiens
ggtgggacagccc

SEQ ID NO: 2035222 - DNA, 14 bp, Homo sapiens
ggtgggacagcccc

SEQ ID NO: 2035223 - DNA, 15 bp, Homo sapiens
ggtgggacagcccca

SEQ ID NO: 2035224 - DNA, 20 bp, Homo sapiens
ggtgggagacgaacggaagg

SEQ ID NO: 2035225 - DNA, 13 bp, Homo sapiens
ggtgggagagaca

SEQ ID NO: 2035226 - DNA, 13 bp, Homo sapiens
ggtgggagagcca

SEQ ID NO: 2035227 - DNA, 14 bp, Homo sapiens
ggtgggcagcagct

SEQ ID NO: 2035228 - DNA, 12 bp, Homo sapiens
ggtgggcagctg

SEQ ID NO: 2035229 - DNA, 13 bp, Homo sapiens
ggtgggcagctgg

SEQ ID NO: 2035230 - DNA, 12 bp, Homo sapiens
ggtgggcagggc

SEQ ID NO: 2035231 - DNA, 16 bp, Homo sapiens
ggtgggcctggcctga

SEQ ID NO: 2035232 - DNA, 18 bp, Homo sapiens
ggtgggcctggcctgagc

SEQ ID NO: 2035233 - DNA, 13 bp, Homo sapiens
ggtgggctgagcc

SEQ ID NO: 2035234 - DNA, 18 bp, Homo sapiens
ggtgggctgagccctggc

SEQ ID NO: 2035235 - DNA, 19 bp, Homo sapiens
ggtggggaccaaaaccatg

SEQ ID NO: 2035236 - DNA, 14 bp, Homo sapiens
ggtggggagacctg

SEQ ID NO: 2035237 - DNA, 13 bp, Homo sapiens
ggtggggcagctc

SEQ ID NO: 2035238 - DNA, 12 bp, Homo sapiens
ggtggggcagga

SEQ ID NO: 2035239 - DNA, 12 bp, Homo sapiens
ggtggggctcgt

SEQ ID NO: 2035240 - DNA, 13 bp, Homo sapiens
ggtggggctgctc

SEQ ID NO: 2035241 - DNA, 22 bp, Homo sapiens
ggtggggctgctcctccagggc

SEQ ID NO: 2035242 - DNA, 19 bp, Homo sapiens
ggtgggttctttggaagga

SEQ ID NO: 2035243 - DNA, 16 bp, Homo sapiens
ggtgggttttcttccc

SEQ ID NO: 2035244 - DNA, 17 bp, Homo sapiens
ggtggtcctgagacctg

SEQ ID NO: 2035245 - DNA, 19 bp, Homo sapiens
ggtggttttcagattccac

SEQ ID NO: 2035246 - DNA, 14 bp, Homo sapiens
ggtgtaatgcacaa

SEQ ID NO: 2035247 - DNA, 17 bp, Homo sapiens
ggtgtaatgcacaattt

SEQ ID NO: 2035248 - DNA, 17 bp, Homo sapiens
ggtgtagattacctgcc

SEQ ID NO: 2035249 - DNA, 20 bp, Homo sapiens
ggtgtcaccctgcagagcta

SEQ ID NO: 2035250 - DNA, 10 bp, Homo sapiens
ggtgtcagct

SEQ ID NO: 2035251 - DNA, 15 bp, Homo sapiens
ggtgtcatctgagga

SEQ ID NO: 2035252 - DNA, 20 bp, Homo sapiens
ggtgtctggaaaagcacttt

SEQ ID NO: 2035253 - DNA, 14 bp, Homo sapiens
ggtgtctggaagct

SEQ ID NO: 2035254 - DNA, 22 bp, Homo sapiens
ggtgtcttttccactcctatgg

SEQ ID NO: 2035255 - DNA, 14 bp, Homo sapiens
ggtgtgcctgcagc

SEQ ID NO: 2035256 - DNA, 14 bp, Homo sapiens
ggtgtggtggctca

SEQ ID NO: 2035257 - DNA, 12 bp, Homo sapiens
ggtgtgtctgct

SEQ ID NO: 2035258 - DNA, 20 bp, Homo sapiens
ggtgttgcagagacgcaagg

SEQ ID NO: 2035259 - DNA, 17 bp, Homo sapiens
ggtgttggtgtatttgc

SEQ ID NO: 2035260 - DNA, 17 bp, Homo sapiens
ggtgtttcaaaagtgga

SEQ ID NO: 2035261 - DNA, 16 bp, Homo sapiens
ggtgttttataggtca

SEQ ID NO: 2035262 - DNA, 18 bp, Homo sapiens
ggttaaaatataaattaa

SEQ ID NO: 2035263 - DNA, 17 bp, Homo sapiens
ggttaatctttcctgat

SEQ ID NO: 2035264 - DNA, 21 bp, Homo sapiens
gtccacctggccccatgtctc

SEQ ID NO: 2035265 - DNA, 17 bp, Homo sapiens
gtccagaagaatattca

SEQ ID NO: 2035266 - DNA, 21 bp, Homo sapiens
gtccagaagaatattcaggac

SEQ ID NO: 2035267 - DNA, 14 bp, Homo sapiens
gtccagaccctgaa

SEQ ID NO: 2035268 - DNA, 13 bp, Homo sapiens
gtccagcagctgc

SEQ ID NO: 2035269 - DNA, 20 bp, Homo sapiens
gtccagcagctgcgggtctg

SEQ ID NO: 2035270 - DNA, 22 bp, Homo sapiens
gtccagccagctcctgggcagc

SEQ ID NO: 2035271 - DNA, 19 bp, Homo sapiens
gtccagctcttggcccctg

SEQ ID NO: 2035272 - DNA, 13 bp, Homo sapiens
gtccaggagcctg

SEQ ID NO: 2035273 - DNA, 13 bp, Homo sapiens
gtccaggccactg

SEQ ID NO: 2035274 - DNA, 20 bp, Homo sapiens
gtccaggccactgtggccag

SEQ ID NO: 2035275 - DNA, 16 bp, Homo sapiens
gtccagggccctgagc

SEQ ID NO: 2035276 - DNA, 16 bp, Homo sapiens
gtccagggcctgggaa

SEQ ID NO: 2035277 - DNA, 11 bp, Homo sapiens
gtccataaagt

SEQ ID NO: 2035278 - DNA, 18 bp, Homo sapiens
gtccatatcagacctctg

SEQ ID NO: 2035279 - DNA, 13 bp, Homo sapiens
gcttatcaaaatc

SEQ ID NO: 2035280 - DNA, 22 bp, Homo sapiens
gcttatgacatcacttgtacaa

SEQ ID NO: 2035281 - DNA, 18 bp, Homo sapiens
gcttatggggtattttaa

SEQ ID NO: 2035282 - DNA, 14 bp, Homo sapiens
gcttattggccact

SEQ ID NO: 2035283 - DNA, 18 bp, Homo sapiens
gcttatttaattaaaaaa

SEQ ID NO: 2035284 - DNA, 12 bp, Homo sapiens
gcttattttaaa

SEQ ID NO: 2035285 - DNA, 16 bp, Homo sapiens
gcttcaaaatagagaa

SEQ ID NO: 2035286 - DNA, 21 bp, Homo sapiens
gcttcaagtgatatatgtatt

SEQ ID NO: 2035287 - DNA, 16 bp, Homo sapiens
gcttcacccctgcact

SEQ ID NO: 2035288 - DNA, 20 bp, Homo sapiens
gcttcacccctgcacttcag

SEQ ID NO: 2035289 - DNA, 21 bp, Homo sapiens
gcttcacccctgcacttcaga

SEQ ID NO: 2035290 - DNA, 14 bp, Homo sapiens
gcttcaccttggag

SEQ ID NO: 2035291 - DNA, 12 bp, Homo sapiens
gcttcagcctcc

SEQ ID NO: 2035292 - DNA, 21 bp, Homo sapiens
gcttcagcctgaggctgagac

SEQ ID NO: 2035293 - DNA, 14 bp, Homo sapiens
gcttcagtggagaa

SEQ ID NO: 2035294 - DNA, 14 bp, Homo sapiens
gcttcagtggcagc

SEQ ID NO: 2035295 - DNA, 15 bp, Homo sapiens
gcttcagttgttttc

SEQ ID NO: 2035296 - DNA, 13 bp, Homo sapiens
gcttcatcaattt

SEQ ID NO: 2035297 - DNA, 15 bp, Homo sapiens
gcttcatgcctcagt

SEQ ID NO: 2035298 - DNA, 17 bp, Homo sapiens
gcttcatgcctcagttt

SEQ ID NO: 2035299 - DNA, 20 bp, Homo sapiens
gcttcatgcctcagtttccc

SEQ ID NO: 2035300 - DNA, 18 bp, Homo sapiens
gcttcatgctcagccctg

SEQ ID NO: 2035301 - DNA, 18 bp, Homo sapiens
gcttcatttcctgtgtct

SEQ ID NO: 2035302 - DNA, 15 bp, Homo sapiens
gcttccagaccacct

SEQ ID NO: 2035303 - DNA, 18 bp, Homo sapiens
gcttccagaccacctgcc

SEQ ID NO: 2035304 - DNA, 19 bp, Homo sapiens
gcttccagaccacctgcca

SEQ ID NO: 2035305 - DNA, 21 bp, Homo sapiens
gcttccagagagtcctctgga

SEQ ID NO: 2035306 - DNA, 17 bp, Homo sapiens
gcttccatgagaacagc

SEQ ID NO: 2035307 - DNA, 12 bp, Homo sapiens
gcttccccacag

SEQ ID NO: 2035308 - DNA, 14 bp, Homo sapiens
gcttccccacagaa

SEQ ID NO: 2035309 - DNA, 21 bp, Homo sapiens
gcttccccacagaactgctta

SEQ ID NO: 2035310 - DNA, 17 bp, Homo sapiens
gcttcccctcgctgtcc

SEQ ID NO: 2035311 - DNA, 16 bp, Homo sapiens
gcttcctgggtcctgt

SEQ ID NO: 2035312 - DNA, 12 bp, Homo sapiens
gcttcctggtgt

SEQ ID NO: 2035313 - DNA, 22 bp, Homo sapiens
gcttcctggtgtatttttcagg

SEQ ID NO: 2035314 - DNA, 17 bp, Homo sapiens
gcttccttagccttgct

SEQ ID NO: 2035315 - DNA, 13 bp, Homo sapiens
gcttccttcattt

SEQ ID NO: 2035316 - DNA, 16 bp, Homo sapiens
gcttctagtctggtgt

SEQ ID NO: 2035317 - DNA, 14 bp, Homo sapiens
gcttctatcccagg

SEQ ID NO: 2035318 - DNA, 13 bp, Homo sapiens
gcttctattaaat

SEQ ID NO: 2035319 - DNA, 18 bp, Homo sapiens
gcttctattaaatgtata

SEQ ID NO: 2035320 - DNA, 12 bp, Homo sapiens
gcttctcatccc

SEQ ID NO: 2035321 - DNA, 19 bp, Homo sapiens
gcttctgcagcaactccca

SEQ ID NO: 2035322 - DNA, 21 bp, Homo sapiens
gcttctgcagcaactcccacg

SEQ ID NO: 2035323 - DNA, 12 bp, Homo sapiens
gcttctggagcc

SEQ ID NO: 2035324 - DNA, 18 bp, Homo sapiens
gcttctggagcccttggg

SEQ ID NO: 2035325 - DNA, 15 bp, Homo sapiens
gcttctggctcctcc

SEQ ID NO: 2035326 - DNA, 23 bp, Homo sapiens
gcttctgggtggctcctgccact

SEQ ID NO: 2035327 - DNA, 22 bp, Homo sapiens
gcttctgtgcactagcctgtga

SEQ ID NO: 2035328 - DNA, 19 bp, Homo sapiens
gcttctgttgcgccactga

SEQ ID NO: 2035329 - DNA, 13 bp, Homo sapiens
gcttctgttgtaa

SEQ ID NO: 2035330 - DNA, 21 bp, Homo sapiens
gcttcttcaagcacctgcaga

SEQ ID NO: 2035331 - DNA, 14 bp, Homo sapiens
gcttcttgcccctt

SEQ ID NO: 2035332 - DNA, 22 bp, Homo sapiens
gcttcttgccccttgggcctcc

SEQ ID NO: 2035333 - DNA, 16 bp, Homo sapiens
gcttctttcaaagtgt

SEQ ID NO: 2035334 - DNA, 15 bp, Homo sapiens
gcttgaaggaacagt

SEQ ID NO: 2035335 - DNA, 18 bp, Homo sapiens
gcttgaaggaacagtgct

SEQ ID NO: 2035336 - DNA, 13 bp, Homo sapiens
gcttgaccagacc

SEQ ID NO: 2035337 - DNA, 15 bp, Homo sapiens
gcttgaccagaccta

SEQ ID NO: 2035338 - DNA, 14 bp, Homo sapiens
gcttgactatcaca

SEQ ID NO: 2035339 - DNA, 21 bp, Homo sapiens
gcttgactatcacatacaatt

SEQ ID NO: 2035340 - DNA, 12 bp, Homo sapiens
gcttgagcctgt

SEQ ID NO: 2035341 - DNA, 13 bp, Homo sapiens
gcttgagcctgtc

SEQ ID NO: 2035342 - DNA, 14 bp, Homo sapiens
gcttgagcctgtca

SEQ ID NO: 2035343 - DNA, 21 bp, Homo sapiens
gcttgaggaggggcacctgcc

SEQ ID NO: 2035344 - DNA, 22 bp, Homo sapiens
gcttgaggaggggcacctgcca

SEQ ID NO: 2035345 - DNA, 18 bp, Homo sapiens
gcttgagggttgggctgg

SEQ ID NO: 2035346 - DNA, 19 bp, Homo sapiens
gcttgcactttgtaacatg

SEQ ID NO: 2035347 - DNA, 18 bp, Homo sapiens
gcttgcatcacttggggt

SEQ ID NO: 2035348 - DNA, 20 bp, Homo sapiens
gcttgccgagcctaatgaaa

SEQ ID NO: 2035349 - DNA, 13 bp, Homo sapiens
gcttgcttctgca

SEQ ID NO: 2035350 - DNA, 15 bp, Homo sapiens
gcttgcttctgcagc

SEQ ID NO: 2035351 - DNA, 12 bp, Homo sapiens
gcttgcttgccg

SEQ ID NO: 2035352 - DNA, 19 bp, Homo sapiens
ggactgaattgtccccagt

SEQ ID NO: 2035353 - DNA, 17 bp, Homo sapiens
ggactgagcctggccca

SEQ ID NO: 2035354 - DNA, 14 bp, Homo sapiens
ggactgaggagtgg

SEQ ID NO: 2035355 - DNA, 22 bp, Homo sapiens
ggactggaaccagggagaccga

SEQ ID NO: 2035356 - DNA, 14 bp, Homo sapiens
ggactggctcaccc

SEQ ID NO: 2035357 - DNA, 15 bp, Homo sapiens
ggactgtcatagaaa

SEQ ID NO: 2035358 - DNA, 14 bp, Homo sapiens
ggactgtcgctgct

SEQ ID NO: 2035359 - DNA, 19 bp, Homo sapiens
ggacttaacggctccagga

SEQ ID NO: 2035360 - DNA, 18 bp, Homo sapiens
ggacttctgcagctatgc

SEQ ID NO: 2035361 - DNA, 16 bp, Homo sapiens
ggacttgagcctccat

SEQ ID NO: 2035362 - DNA, 13 bp, Homo sapiens
ggacttgtgccag

SEQ ID NO: 2035363 - DNA, 14 bp, Homo sapiens
ggacttgtgccagc

SEQ ID NO: 2035364 - DNA, 16 bp, Homo sapiens
ggacttgtgtctctgt

SEQ ID NO: 2035365 - DNA, 14 bp, Homo sapiens
ggacttttgggggt

SEQ ID NO: 2035366 - DNA, 13 bp, Homo sapiens
ggagaaaacactt

SEQ ID NO: 2035367 - DNA, 16 bp, Homo sapiens
ggagaaacagagacag

SEQ ID NO: 2035368 - DNA, 14 bp, Homo sapiens
ggagaaaggagccg

SEQ ID NO: 2035369 - DNA, 19 bp, Homo sapiens
ggagaactttccatctgct

SEQ ID NO: 2035370 - DNA, 20 bp, Homo sapiens
ggagaagaaagaggtgaccc

SEQ ID NO: 2035371 - DNA, 15 bp, Homo sapiens
ggagaagaaatccat

SEQ ID NO: 2035372 - DNA, 14 bp, Homo sapiens
ggagaagacccacg

SEQ ID NO: 2035373 - DNA, 15 bp, Homo sapiens
ggagaagcagtgagc

SEQ ID NO: 2035374 - DNA, 19 bp, Homo sapiens
ggagaagcagtgagccgca

SEQ ID NO: 2035375 - DNA, 13 bp, Homo sapiens
ggagaagccgcag

SEQ ID NO: 2035376 - DNA, 12 bp, Homo sapiens
ggagaaggaaaa

SEQ ID NO: 2035377 - DNA, 17 bp, Homo sapiens
ggagaaggaaggagact

SEQ ID NO: 2035378 - DNA, 14 bp, Homo sapiens
ggagaagggccagc

SEQ ID NO: 2035379 - DNA, 15 bp, Homo sapiens
ggagaagggccagcc

SEQ ID NO: 2035380 - DNA, 16 bp, Homo sapiens
ggagaagggccagccc

SEQ ID NO: 2035381 - DNA, 17 bp, Homo sapiens
ggagaatcaataaaaat

SEQ ID NO: 2035382 - DNA, 14 bp, Homo sapiens
ggagacagtagagg

SEQ ID NO: 2035383 - DNA, 18 bp, Homo sapiens
ggagacagtgatctccat

SEQ ID NO: 2035384 - DNA, 17 bp, Homo sapiens
ggagaccaaggcgggag

SEQ ID NO: 2035385 - DNA, 13 bp, Homo sapiens
ggagaccagctca

SEQ ID NO: 2035386 - DNA, 16 bp, Homo sapiens
ggagaccctgagtccg

SEQ ID NO: 2035387 - DNA, 16 bp, Homo sapiens
ggagactcacctctgc

SEQ ID NO: 2035388 - DNA, 21 bp, Homo sapiens
ggagactcacctctgcctcaa

SEQ ID NO: 2035389 - DNA, 13 bp, Homo sapiens
ggagactctgtgg

SEQ ID NO: 2035390 - DNA, 20 bp, Homo sapiens
ggagactggtcctgtgtgca

SEQ ID NO: 2035391 - DNA, 15 bp, Homo sapiens
ggagagaagaaagtg

SEQ ID NO: 2035392 - DNA, 18 bp, Homo sapiens
ggagagactgaaagcagc

SEQ ID NO: 2035393 - DNA, 19 bp, Homo sapiens
ggagagactgaaagcagca

SEQ ID NO: 2035394 - DNA, 13 bp, Homo sapiens
ggagagagactca

SEQ ID NO: 2035395 - DNA, 18 bp, Homo sapiens
ggagagagtattaaatat

SEQ ID NO: 2035396 - DNA, 20 bp, Homo sapiens
ggagagatcatagctcactg

SEQ ID NO: 2035397 - DNA, 14 bp, Homo sapiens
ggagagcagctggc

SEQ ID NO: 2035398 - DNA, 17 bp, Homo sapiens
ggagagcagctggctct

SEQ ID NO: 2035399 - DNA, 12 bp, Homo sapiens
ggagagccagcc

SEQ ID NO: 2035400 - DNA, 11 bp, Homo sapiens
ggagagccctg

SEQ ID NO: 2035401 - DNA, 20 bp, Homo sapiens
ggagagctagaacccggcag

SEQ ID NO: 2035402 - DNA, 19 bp, Homo sapiens
ggagagctagaacctggag

SEQ ID NO: 2035403 - DNA, 21 bp, Homo sapiens
ggagagctaggagcaaagcct

SEQ ID NO: 2035404 - DNA, 13 bp, Homo sapiens
ggagaggcggcct

SEQ ID NO: 2035405 - DNA, 21 bp, Homo sapiens
ggagaggctagaaccaagaag

SEQ ID NO: 2035406 - DNA, 16 bp, Homo sapiens
ggagaggggcctggga

SEQ ID NO: 2035407 - DNA, 19 bp, Homo sapiens
ggagaggggcctgggaaag

SEQ ID NO: 2035408 - DNA, 14 bp, Homo sapiens
ggagagggtctgga

SEQ ID NO: 2035409 - DNA, 20 bp, Homo sapiens
ggagagggtctggagaagca

SEQ ID NO: 2035410 - DNA, 21 bp, Homo sapiens
ggagagggtctggagaagcag

SEQ ID NO: 2035411 - DNA, 21 bp, Homo sapiens
ggagaggtggggagggagaca

SEQ ID NO: 2035412 - DNA, 21 bp, Homo sapiens
ggagagtcccctgaaggtctg

SEQ ID NO: 2035413 - DNA, 21 bp, Homo sapiens
ggagagtggttgttgccaact

SEQ ID NO: 2035414 - DNA, 22 bp, Homo sapiens
ggagatatttatggggggagaa

SEQ ID NO: 2035415 - DNA, 15 bp, Homo sapiens
ggagatgatgatgat

SEQ ID NO: 2035416 - DNA, 15 bp, Homo sapiens
ggagatggtcagtgt

SEQ ID NO: 2035417 - DNA, 22 bp, Homo sapiens
ggagatggtcagtgtggagagg

SEQ ID NO: 2035418 - DNA, 16 bp, Homo sapiens
ggagattttccttcct

SEQ ID NO: 2035419 - DNA, 15 bp, Homo sapiens
ggagcaaagcctgtt

SEQ ID NO: 2035420 - DNA, 23 bp, Homo sapiens
ggagcaaagcctgttcatggcag

SEQ ID NO: 2035421 - DNA, 16 bp, Homo sapiens
ggagcacacggccctg

SEQ ID NO: 2035422 - DNA, 19 bp, Homo sapiens
ggagcacacggccctgccc

SEQ ID NO: 2035423 - DNA, 13 bp, Homo sapiens
ggagcacagccct

SEQ ID NO: 2035424 - DNA, 15 bp, Homo sapiens
ggagcacagccctgg

SEQ ID NO: 2035425 - DNA, 14 bp, Homo sapiens
ggagcacaggcagc

SEQ ID NO: 2035426 - DNA, 17 bp, Homo sapiens
ggagcaccaggcacgaa

SEQ ID NO: 2035427 - DNA, 19 bp, Homo sapiens
ggagcacctgaaccccatg

SEQ ID NO: 2035428 - DNA, 19 bp, Homo sapiens
ggagcacttgcgtcctgca

SEQ ID NO: 2035429 - DNA, 20 bp, Homo sapiens
ggagcacttgcgtcctgcag

SEQ ID NO: 2035430 - DNA, 21 bp, Homo sapiens
ggagcacttgcgtcctgcaga

SEQ ID NO: 2035431 - DNA, 17 bp, Homo sapiens
ggagcagaaagccaggg

SEQ ID NO: 2035432 - DNA, 12 bp, Homo sapiens
ggagcagacaga

SEQ ID NO: 2035433 - DNA, 13 bp, Homo sapiens
ggagcagacagag

SEQ ID NO: 2035434 - DNA, 19 bp, Homo sapiens
ggagcagagctgatggaga

SEQ ID NO: 2035435 - DNA, 19 bp, Homo sapiens
ggagcagagtataggatgg

SEQ ID NO: 2035436 - DNA, 21 bp, Homo sapiens
ggagcaggaacagagactctg

SEQ ID NO: 2035437 - DNA, 22 bp, Homo sapiens
ggagcaggaacagagactctgg

SEQ ID NO: 2035438 - DNA, 14 bp, Homo sapiens
ggagcaggtctctg

SEQ ID NO: 2035439 - DNA, 18 bp, Homo sapiens
ggagcaggtctctggcag

SEQ ID NO: 2035440 - DNA, 12 bp, Homo sapiens
ggagcagtgtct

SEQ ID NO: 2035441 - DNA, 17 bp, Homo sapiens
ggagcagtgtcttccat

SEQ ID NO: 2035442 - DNA, 13 bp, Homo sapiens
ggagcatcccagg

SEQ ID NO: 2035443 - DNA, 16 bp, Homo sapiens
ggagcatctcttgagg

SEQ ID NO: 2035444 - DNA, 15 bp, Homo sapiens
ggagcattgggacct

SEQ ID NO: 2035445 - DNA, 14 bp, Homo sapiens
ggagccaacagcag

SEQ ID NO: 2035446 - DNA, 23 bp, Homo sapiens
ggagccaagggttcagagactca

SEQ ID NO: 2035447 - DNA, 16 bp, Homo sapiens
ggagccaatggagact

SEQ ID NO: 2035448 - DNA, 16 bp, Homo sapiens
ggagccactcctgtcc

SEQ ID NO: 2035449 - DNA, 13 bp, Homo sapiens
ggagcccttgggt

SEQ ID NO: 2035450 - DNA, 19 bp, Homo sapiens
ggagcctccccctcagatg

SEQ ID NO: 2035451 - DNA, 18 bp, Homo sapiens
ggagcctcggtggccatg

SEQ ID NO: 2035452 - DNA, 14 bp, Homo sapiens
ggagcctggcacag

SEQ ID NO: 2035453 - DNA, 17 bp, Homo sapiens
ggagcctgtgaacccag

SEQ ID NO: 2035454 - DNA, 20 bp, Homo sapiens
ggagcctgtgaacccaggac

SEQ ID NO: 2035455 - DNA, 23 bp, Homo sapiens
ggagcgcacctgccccctggtgg

SEQ ID NO: 2035456 - DNA, 19 bp, Homo sapiens
ggagctacctgtgtggaca

SEQ ID NO: 2035457 - DNA, 22 bp, Homo sapiens
ggagctacctgtgtggacagga

SEQ ID NO: 2035458 - DNA, 12 bp, Homo sapiens
ggagctcttgga

SEQ ID NO: 2035459 - DNA, 13 bp, Homo sapiens
ggagctcttggaa

SEQ ID NO: 2035460 - DNA, 20 bp, Homo sapiens
ggagctcttggaagagctct

SEQ ID NO: 2035461 - DNA, 21 bp, Homo sapiens
ggagctgagtcacctcctcca

SEQ ID NO: 2035462 - DNA, 17 bp, Homo sapiens
ggagctgatttccaggc

SEQ ID NO: 2035463 - DNA, 14 bp, Homo sapiens
ggagctgccagccg

SEQ ID NO: 2035464 - DNA, 12 bp, Homo sapiens
ggagctgcctgt

SEQ ID NO: 2035465 - DNA, 12 bp, Homo sapiens
ggagctggaaat

SEQ ID NO: 2035466 - DNA, 14 bp, Homo sapiens
ggagctggaaataa

SEQ ID NO: 2035467 - DNA, 21 bp, Homo sapiens
ggagctggaaataaacctgga

SEQ ID NO: 2035468 - DNA, 18 bp, Homo sapiens
ggatcactggagcccagg

SEQ ID NO: 2035469 - DNA, 16 bp, Homo sapiens
ggatcagaacagcaga

SEQ ID NO: 2035470 - DNA, 17 bp, Homo sapiens
ggatcagaacagcagag

SEQ ID NO: 2035471 - DNA, 13 bp, Homo sapiens
ggatcagcgtggc

SEQ ID NO: 2035472 - DNA, 14 bp, Homo sapiens
ggatccacacctgg

SEQ ID NO: 2035473 - DNA, 23 bp, Homo sapiens
ggatcccagagcttcccaggatc

SEQ ID NO: 2035474 - DNA, 14 bp, Homo sapiens
ggatccctggaggg

SEQ ID NO: 2035475 - DNA, 18 bp, Homo sapiens
ggatcctcacaggagcag

SEQ ID NO: 2035476 - DNA, 19 bp, Homo sapiens
ggatcctcacaggagcaga

SEQ ID NO: 2035477 - DNA, 20 bp, Homo sapiens
ggatcctgctgtggcctcac

SEQ ID NO: 2035478 - DNA, 13 bp, Homo sapiens
ggatctatgcaat

SEQ ID NO: 2035479 - DNA, 13 bp, Homo sapiens
ggatctctcagga

SEQ ID NO: 2035480 - DNA, 21 bp, Homo sapiens
ggatctctcaggagcacaggc

SEQ ID NO: 2035481 - DNA, 16 bp, Homo sapiens
ggatcttgcattccca

SEQ ID NO: 2035482 - DNA, 17 bp, Homo sapiens
ggatcttgcattcccag

SEQ ID NO: 2035483 - DNA, 18 bp, Homo sapiens
ggatgaatgaggtcccag

SEQ ID NO: 2035484 - DNA, 14 bp, Homo sapiens
ggatgaccagaaca

SEQ ID NO: 2035485 - DNA, 18 bp, Homo sapiens
ggatgactagaggcaggg

SEQ ID NO: 2035486 - DNA, 16 bp, Homo sapiens
ggatgagagtggctta

SEQ ID NO: 2035487 - DNA, 19 bp, Homo sapiens
ggatgcacggcggcagggt

SEQ ID NO: 2035488 - DNA, 13 bp, Homo sapiens
ggatgcagagggg

SEQ ID NO: 2035489 - DNA, 13 bp, Homo sapiens
ggatgcagcatta

SEQ ID NO: 2035490 - DNA, 20 bp, Homo sapiens
ggatgccaacaccttcttgg

SEQ ID NO: 2035491 - DNA, 19 bp, Homo sapiens
ggatgctccagggcagcct

SEQ ID NO: 2035492 - DNA, 16 bp, Homo sapiens
ggatggaggagaaata

SEQ ID NO: 2035493 - DNA, 16 bp, Homo sapiens
ggatggatggacagaa

SEQ ID NO: 2035494 - DNA, 16 bp, Homo sapiens
ggatggattgcagtcc

SEQ ID NO: 2035495 - DNA, 12 bp, Homo sapiens
ggatggcaagat

SEQ ID NO: 2035496 - DNA, 22 bp, Homo sapiens
ggatggcccttcccactggagg

SEQ ID NO: 2035497 - DNA, 13 bp, Homo sapiens
ggatgggaagatg

SEQ ID NO: 2035498 - DNA, 15 bp, Homo sapiens
ggatgggaccaggga

SEQ ID NO: 2035499 - DNA, 12 bp, Homo sapiens
ggatggggacac

SEQ ID NO: 2035500 - DNA, 21 bp, Homo sapiens
ggatggggtatggattctaaa

SEQ ID NO: 2035501 - DNA, 16 bp, Homo sapiens
ggatggtcctggggct

SEQ ID NO: 2035502 - DNA, 16 bp, Homo sapiens
ggatgtaaacagtgcc

SEQ ID NO: 2035503 - DNA, 19 bp, Homo sapiens
ggatgtaaacagtgcctgc

SEQ ID NO: 2035504 - DNA, 13 bp, Homo sapiens
ggatgtagaactt

SEQ ID NO: 2035505 - DNA, 15 bp, Homo sapiens
ggatgtcaggcccag

SEQ ID NO: 2035506 - DNA, 23 bp, Homo sapiens
ggatgtcctctttactcccttcc

SEQ ID NO: 2035507 - DNA, 14 bp, Homo sapiens
ggatgtggcactgc

SEQ ID NO: 2035508 - DNA, 13 bp, Homo sapiens
ggatgtgtaaatg

SEQ ID NO: 2035509 - DNA, 17 bp, Homo sapiens
ggatgtgtggggcatgg

SEQ ID NO: 2035510 - DNA, 18 bp, Homo sapiens
ggatgtgtgtctcacccc

SEQ ID NO: 2035511 - DNA, 15 bp, Homo sapiens
ggatgttctgggaca

SEQ ID NO: 2035512 - DNA, 18 bp, Homo sapiens
ggatgttgtcaggaatca

SEQ ID NO: 2035513 - DNA, 15 bp, Homo sapiens
ggattattcatttaa

SEQ ID NO: 2035514 - DNA, 19 bp, Homo sapiens
ggattattcatttaaaatg

SEQ ID NO: 2035515 - DNA, 20 bp, Homo sapiens
ggattcaggaaaaggcctgg

SEQ ID NO: 2035516 - DNA, 21 bp, Homo sapiens
ggattcaggaaaaggcctggg

SEQ ID NO: 2035517 - DNA, 18 bp, Homo sapiens
ggattcctgggcaagaac

SEQ ID NO: 2035518 - DNA, 12 bp, Homo sapiens
ggattctccagg

SEQ ID NO: 2035519 - DNA, 13 bp, Homo sapiens
ggattgaggctta

SEQ ID NO: 2035520 - DNA, 17 bp, Homo sapiens
ggattgcttgagcccag

SEQ ID NO: 2035521 - DNA, 14 bp, Homo sapiens
ggattgggagggac

SEQ ID NO: 2035522 - DNA, 18 bp, Homo sapiens
ggattgggagggacaggg

SEQ ID NO: 2035523 - DNA, 18 bp, Homo sapiens
ggattggggaagactgtg

SEQ ID NO: 2035524 - DNA, 19 bp, Homo sapiens
ggatttacgactgaagaag

SEQ ID NO: 2035525 - DNA, 20 bp, Homo sapiens
ggatttcatgatttcatttc

SEQ ID NO: 2035526 - DNA, 16 bp, Homo sapiens
ggatttcctattttaa

SEQ ID NO: 2035527 - DNA, 19 bp, Homo sapiens
ggatttcttcgctgctcta

SEQ ID NO: 2035528 - DNA, 16 bp, Homo sapiens
gccaaagctaggcctg

SEQ ID NO: 2035529 - DNA, 15 bp, Homo sapiens
gccaaagtgcagccc

SEQ ID NO: 2035530 - DNA, 12 bp, Homo sapiens
gccaaagtgtta

SEQ ID NO: 2035531 - DNA, 14 bp, Homo sapiens
gccaaatgcacaag

SEQ ID NO: 2035532 - DNA, 18 bp, Homo sapiens
gccaaatgtaattgaata

SEQ ID NO: 2035533 - DNA, 23 bp, Homo sapiens
gccaaattatttgtgtaatagaa

SEQ ID NO: 2035534 - DNA, 14 bp, Homo sapiens
gccaaatttatatg

SEQ ID NO: 2035535 - DNA, 20 bp, Homo sapiens
gccaaatttatatgccaccg

SEQ ID NO: 2035536 - DNA, 12 bp, Homo sapiens
gccaacagcagc

SEQ ID NO: 2035537 - DNA, 22 bp, Homo sapiens
gccaacatacccttctttaaat

SEQ ID NO: 2035538 - DNA, 15 bp, Homo sapiens
gccaaccagcttgtc

SEQ ID NO: 2035539 - DNA, 20 bp, Homo sapiens
gccaacgcacgcaacccttg

SEQ ID NO: 2035540 - DNA, 23 bp, Homo sapiens
gccaactcactcttatgaaatgg

SEQ ID NO: 2035541 - DNA, 17 bp, Homo sapiens
gccaacttgtaaataca

SEQ ID NO: 2035542 - DNA, 22 bp, Homo sapiens
gccaagagagacattgcctcca

SEQ ID NO: 2035543 - DNA, 18 bp, Homo sapiens
gccaagatcgcgccactg

SEQ ID NO: 2035544 - DNA, 16 bp, Homo sapiens
gccaagcccacctgca

SEQ ID NO: 2035545 - DNA, 19 bp, Homo sapiens
gccaagcccacctgcacgt

SEQ ID NO: 2035546 - DNA, 22 bp, Homo sapiens
gccaagccctccccatcccatg

SEQ ID NO: 2035547 - DNA, 17 bp, Homo sapiens
gccaagctgaagtgaag

SEQ ID NO: 2035548 - DNA, 14 bp, Homo sapiens
gccaagctgaggtg

SEQ ID NO: 2035549 - DNA, 15 bp, Homo sapiens
gccaagctgaggtgc

SEQ ID NO: 2035550 - DNA, 12 bp, Homo sapiens
gccaaggcagcg

SEQ ID NO: 2035551 - DNA, 21 bp, Homo sapiens
gccaagttcctctagtgccct

SEQ ID NO: 2035552 - DNA, 23 bp, Homo sapiens
gccaataaatcaactccagctcc

SEQ ID NO: 2035553 - DNA, 17 bp, Homo sapiens
gccaatatgtattgtaa

SEQ ID NO: 2035554 - DNA, 22 bp, Homo sapiens
gccaatgaggtctgaaatggag

SEQ ID NO: 2035555 - DNA, 16 bp, Homo sapiens
gccaatggagactgtc

SEQ ID NO: 2035556 - DNA, 22 bp, Homo sapiens
gccaattaaaatatatataaat

SEQ ID NO: 2035557 - DNA, 20 bp, Homo sapiens
gccacaaatcaaagcaaggg

SEQ ID NO: 2035558 - DNA, 23 bp, Homo sapiens
gccacaagaaatttgatttctat

SEQ ID NO: 2035559 - DNA, 19 bp, Homo sapiens
gccacaatgcctctcccac

SEQ ID NO: 2035560 - DNA, 20 bp, Homo sapiens
gccacaatgcctctcccacg

SEQ ID NO: 2035561 - DNA, 19 bp, Homo sapiens
gccacacagagcctgcctc

SEQ ID NO: 2035562 - DNA, 20 bp, Homo sapiens
gccacaccacagcaagccgg

SEQ ID NO: 2035563 - DNA, 15 bp, Homo sapiens
gccacaccctcccca

SEQ ID NO: 2035564 - DNA, 14 bp, Homo sapiens
gccacactcagtcc

SEQ ID NO: 2035565 - DNA, 17 bp, Homo sapiens
gccacactcagtccccc

SEQ ID NO: 2035566 - DNA, 19 bp, Homo sapiens
gccacacttctcaggacac

SEQ ID NO: 2035567 - DNA, 22 bp, Homo sapiens
gccacacttctcaggacacagg

SEQ ID NO: 2035568 - DNA, 22 bp, Homo sapiens
gccacagaccacctgcttctga

SEQ ID NO: 2035569 - DNA, 13 bp, Homo sapiens
gccacagagaaag

SEQ ID NO: 2035570 - DNA, 13 bp, Homo sapiens
gccacagagaaga

SEQ ID NO: 2035571 - DNA, 11 bp, Homo sapiens
gccacagcccc

SEQ ID NO: 2035572 - DNA, 20 bp, Homo sapiens
gccacagccccacagcaccc

SEQ ID NO: 2035573 - DNA, 22 bp, Homo sapiens
gccacagccccacagcacccag

SEQ ID NO: 2035574 - DNA, 23 bp, Homo sapiens
gccacagccccacagcacccagg

SEQ ID NO: 2035575 - DNA, 22 bp, Homo sapiens
gccacagcttcttcatctttaa

SEQ ID NO: 2035576 - DNA, 23 bp, Homo sapiens
gccacatctgtgtctctggaacc

SEQ ID NO: 2035577 - DNA, 11 bp, Homo sapiens
gccacattttg

SEQ ID NO: 2035578 - DNA, 18 bp, Homo sapiens
gccaccacgtctgccagg

SEQ ID NO: 2035579 - DNA, 16 bp, Homo sapiens
gccaccagtcactgtc

SEQ ID NO: 2035580 - DNA, 22 bp, Homo sapiens
gccaccatattcagtgctgtgg

SEQ ID NO: 2035581 - DNA, 16 bp, Homo sapiens
gccacccagcaacaca

SEQ ID NO: 2035582 - DNA, 18 bp, Homo sapiens
gccacccgttctgctggc

SEQ ID NO: 2035583 - DNA, 23 bp, Homo sapiens
gccacccgttctgctggcctgga

SEQ ID NO: 2035584 - DNA, 16 bp, Homo sapiens
gccaccctgaggagtc

SEQ ID NO: 2035585 - DNA, 17 bp, Homo sapiens
gccaccgggacagacct

SEQ ID NO: 2035586 - DNA, 12 bp, Homo sapiens
gccacctcccct

SEQ ID NO: 2035587 - DNA, 13 bp, Homo sapiens
gccacctccccta

SEQ ID NO: 2035588 - DNA, 15 bp, Homo sapiens
gccacctcccctatc

SEQ ID NO: 2035589 - DNA, 16 bp, Homo sapiens
gccacctgcaagtgcc

SEQ ID NO: 2035590 - DNA, 12 bp, Homo sapiens
gccacctgtctg

SEQ ID NO: 2035591 - DNA, 14 bp, Homo sapiens
gccacctgtctgtc

SEQ ID NO: 2035592 - DNA, 15 bp, Homo sapiens
gccacgctgtcctct

SEQ ID NO: 2035593 - DNA, 17 bp, Homo sapiens
gccacggccaccctcct

SEQ ID NO: 2035594 - DNA, 23 bp, Homo sapiens
gctcttctacgtataaatatgaa

SEQ ID NO: 2035595 - DNA, 15 bp, Homo sapiens
gctcttctatttaaa

SEQ ID NO: 2035596 - DNA, 21 bp, Homo sapiens
gctcttctatttaaaaaataa

SEQ ID NO: 2035597 - DNA, 22 bp, Homo sapiens
gctcttctccttggaggacagt

SEQ ID NO: 2035598 - DNA, 13 bp, Homo sapiens
gctcttctccttt

SEQ ID NO: 2035599 - DNA, 16 bp, Homo sapiens
gctcttctgtcatccc

SEQ ID NO: 2035600 - DNA, 18 bp, Homo sapiens
gctcttgaattcctgggc

SEQ ID NO: 2035601 - DNA, 10 bp, Homo sapiens
gctcttgcct

SEQ ID NO: 2035602 - DNA, 11 bp, Homo sapiens
gctcttgcctg

SEQ ID NO: 2035603 - DNA, 13 bp, Homo sapiens
gctcttgcctgca

SEQ ID NO: 2035604 - DNA, 12 bp, Homo sapiens
gctcttggaaga

SEQ ID NO: 2035605 - DNA, 18 bp, Homo sapiens
gctcttggaagagctctt

SEQ ID NO: 2035606 - DNA, 13 bp, Homo sapiens
gctcttggcattt

SEQ ID NO: 2035607 - DNA, 15 bp, Homo sapiens
gctcttggtccctgg

SEQ ID NO: 2035608 - DNA, 16 bp, Homo sapiens
gctcttggtccctggt

SEQ ID NO: 2035609 - DNA, 20 bp, Homo sapiens
gctcttggtccctggtccct

SEQ ID NO: 2035610 - DNA, 13 bp, Homo sapiens
gctctttcagaga

SEQ ID NO: 2035611 - DNA, 18 bp, Homo sapiens
gctctttggggtcagcca

SEQ ID NO: 2035612 - DNA, 13 bp, Homo sapiens
gctctttggtaga

SEQ ID NO: 2035613 - DNA, 18 bp, Homo sapiens
gctctttggtagaaaagg

SEQ ID NO: 2035614 - DNA, 13 bp, Homo sapiens
gctgaaaatcact

SEQ ID NO: 2035615 - DNA, 14 bp, Homo sapiens
gctgaaaatcacta

SEQ ID NO: 2035616 - DNA, 20 bp, Homo sapiens
gctgaaacattccgaagagg

SEQ ID NO: 2035617 - DNA, 13 bp, Homo sapiens
gctgaaagccatt

SEQ ID NO: 2035618 - DNA, 20 bp, Homo sapiens
gctgaaataaaagcctctgg

SEQ ID NO: 2035619 - DNA, 17 bp, Homo sapiens
gctgaactgagcctagc

SEQ ID NO: 2035620 - DNA, 18 bp, Homo sapiens
gctgaagacaaaccactg

SEQ ID NO: 2035621 - DNA, 17 bp, Homo sapiens
gctgaagcctatttatt

SEQ ID NO: 2035622 - DNA, 19 bp, Homo sapiens
gctgaagtgaaggagaaag

SEQ ID NO: 2035623 - DNA, 16 bp, Homo sapiens
gctgaagttctgagcc

SEQ ID NO: 2035624 - DNA, 20 bp, Homo sapiens
gctgacaatactgctgcctt

SEQ ID NO: 2035625 - DNA, 17 bp, Homo sapiens
gctgacacctaccatgc

SEQ ID NO: 2035626 - DNA, 22 bp, Homo sapiens
gctgacacctaccatgctgctt

SEQ ID NO: 2035627 - DNA, 16 bp, Homo sapiens
gctgacagacacaggc

SEQ ID NO: 2035628 - DNA, 19 bp, Homo sapiens
gctgacagacacaggcccg

SEQ ID NO: 2035629 - DNA, 22 bp, Homo sapiens
gctgacagatacatagatggac

SEQ ID NO: 2035630 - DNA, 13 bp, Homo sapiens
gctgacagctgct

SEQ ID NO: 2035631 - DNA, 20 bp, Homo sapiens
gctgacaggatgtggcactg

SEQ ID NO: 2035632 - DNA, 21 bp, Homo sapiens
gctgacaggatgtggcactgc

SEQ ID NO: 2035633 - DNA, 13 bp, Homo sapiens
gctgaccaagaga

SEQ ID NO: 2035634 - DNA, 14 bp, Homo sapiens
gctgaccaagagag

SEQ ID NO: 2035635 - DNA, 13 bp, Homo sapiens
gctgacccagtcc

SEQ ID NO: 2035636 - DNA, 16 bp, Homo sapiens
gctgacccagtccctg

SEQ ID NO: 2035637 - DNA, 19 bp, Homo sapiens
gctgaccccaaagagcctg

SEQ ID NO: 2035638 - DNA, 21 bp, Homo sapiens
gctgactgtactcctcccagg

SEQ ID NO: 2035639 - DNA, 13 bp, Homo sapiens
gctgagaacctgg

SEQ ID NO: 2035640 - DNA, 18 bp, Homo sapiens
gctgagaacctggccttc

SEQ ID NO: 2035641 - DNA, 21 bp, Homo sapiens
gctgagaacctggccttcagt

SEQ ID NO: 2035642 - DNA, 18 bp, Homo sapiens
gctgagaagaagctgagg

SEQ ID NO: 2035643 - DNA, 21 bp, Homo sapiens
gctgagaagaagctgaggatc

SEQ ID NO: 2035644 - DNA, 16 bp, Homo sapiens
gctgagaaggacacct

SEQ ID NO: 2035645 - DNA, 14 bp, Homo sapiens
gctgagactgcggg

SEQ ID NO: 2035646 - DNA, 15 bp, Homo sapiens
gctgagagacccaag

SEQ ID NO: 2035647 - DNA, 17 bp, Homo sapiens
gctgagagacccaagga

SEQ ID NO: 2035648 - DNA, 14 bp, Homo sapiens
gctgagagactttt

SEQ ID NO: 2035649 - DNA, 15 bp, Homo sapiens
gctgagaggaagatg

SEQ ID NO: 2035650 - DNA, 22 bp, Homo sapiens
gctgagaggaagatgaagagaa

SEQ ID NO: 2035651 - DNA, 13 bp, Homo sapiens
gctgagccactcg

SEQ ID NO: 2035652 - DNA, 16 bp, Homo sapiens
gctgagccactcgcag

SEQ ID NO: 2035653 - DNA, 14 bp, Homo sapiens
gctgagcccagcca

SEQ ID NO: 2035654 - DNA, 18 bp, Homo sapiens
gctgagcccagccacctc

SEQ ID NO: 2035655 - DNA, 16 bp, Homo sapiens
gctgagctcacaaggc

SEQ ID NO: 2035656 - DNA, 23 bp, Homo sapiens
gctgagctcacaaggcagcaagg

SEQ ID NO: 2035657 - DNA, 16 bp, Homo sapiens
gctgagctctgagagg

SEQ ID NO: 2035658 - DNA, 11 bp, Homo sapiens
gctgagctgga

SEQ ID NO: 2035659 - DNA, 19 bp, Homo sapiens
gctgaggatttcaagcctg

SEQ ID NO: 2035660 - DNA, 15 bp, Homo sapiens
gctgaggcaattcta

SEQ ID NO: 2035661 - DNA, 16 bp, Homo sapiens
gctgaggcagaagaat

SEQ ID NO: 2035662 - DNA, 18 bp, Homo sapiens
gctgaggcaggagaattg

SEQ ID NO: 2035663 - DNA, 23 bp, Homo sapiens
gctgaggctctgacccagtgaga

SEQ ID NO: 2035664 - DNA, 12 bp, Homo sapiens
gctgagggcagt

SEQ ID NO: 2035665 - DNA, 20 bp, Homo sapiens
gctgagggcagttcgcagcc

SEQ ID NO: 2035666 - DNA, 20 bp, Homo sapiens
gctgaggtgcccaggagaag

SEQ ID NO: 2035667 - DNA, 19 bp, Homo sapiens
gctgagtcacctcctccac

SEQ ID NO: 2035668 - DNA, 17 bp, Homo sapiens
gctgagtctgcagatga

SEQ ID NO: 2035669 - DNA, 18 bp, Homo sapiens
gctgagtggaatgcaggg

SEQ ID NO: 2035670 - DNA, 22 bp, Homo sapiens
gctgagttccttataagaatta

SEQ ID NO: 2035671 - DNA, 13 bp, Homo sapiens
gctgagttggtgt

SEQ ID NO: 2035672 - DNA, 14 bp, Homo sapiens
gctgataattttaa

SEQ ID NO: 2035673 - DNA, 12 bp, Homo sapiens
gctgatgaaact

SEQ ID NO: 2035674 - DNA, 22 bp, Homo sapiens
gctgatgatgtctcttgtagaa

SEQ ID NO: 2035675 - DNA, 23 bp, Homo sapiens
gctgatggataacctatatgatt

SEQ ID NO: 2035676 - DNA, 13 bp, Homo sapiens
gctgattcaagaa

SEQ ID NO: 2035677 - DNA, 17 bp, Homo sapiens
gctgatttccaggcccc

SEQ ID NO: 2035678 - DNA, 22 bp, Homo sapiens
gctgatttccaggcccctgagg

SEQ ID NO: 2035679 - DNA, 13 bp, Homo sapiens
gctgatttctagg

SEQ ID NO: 2035680 - DNA, 22 bp, Homo sapiens
gctgcaaagggtatcaggtgct

SEQ ID NO: 2035681 - DNA, 19 bp, Homo sapiens
gctgcacattcctggcccc

SEQ ID NO: 2035682 - DNA, 17 bp, Homo sapiens
gctgcacctgccagcct

SEQ ID NO: 2035683 - DNA, 18 bp, Homo sapiens
gctgcacctgccagcctg

SEQ ID NO: 2035684 - DNA, 19 bp, Homo sapiens
gctgcacctgccagcctgg

SEQ ID NO: 2035685 - DNA, 20 bp, Homo sapiens
gctgcacctgccagcctggc

SEQ ID NO: 2035686 - DNA, 19 bp, Homo sapiens
gctgcagctgggccccatg

SEQ ID NO: 2035687 - DNA, 21 bp, Homo sapiens
gctgcagctgggccccatgct

SEQ ID NO: 2035688 - DNA, 18 bp, Homo sapiens
gctgcagtcaacagttca

SEQ ID NO: 2035689 - DNA, 20 bp, Homo sapiens
gctgcagtgacgtgcacctg

SEQ ID NO: 2035690 - DNA, 15 bp, Homo sapiens
gctgcatgctctgga

SEQ ID NO: 2035691 - DNA, 17 bp, Homo sapiens
gctgccaaattttggcc

SEQ ID NO: 2035692 - DNA, 15 bp, Homo sapiens
gctgccacacttcag

SEQ ID NO: 2035693 - DNA, 18 bp, Homo sapiens
gctgccacacttcaggct

SEQ ID NO: 2035694 - DNA, 19 bp, Homo sapiens
gctgccaccacgtctgcca

SEQ ID NO: 2035695 - DNA, 20 bp, Homo sapiens
gctgccaccacgtctgccag

SEQ ID NO: 2035696 - DNA, 21 bp, Homo sapiens
gctgccaccacgtctgccagg

SEQ ID NO: 2035697 - DNA, 23 bp, Homo sapiens
gctgccaccacgtctgccaggcc

SEQ ID NO: 2035698 - DNA, 11 bp, Homo sapiens
gctgccaggac

SEQ ID NO: 2035699 - DNA, 21 bp, Homo sapiens
gctgccaggacacctgcccca

SEQ ID NO: 2035700 - DNA, 13 bp, Homo sapiens
gctgccatccagg

SEQ ID NO: 2035701 - DNA, 19 bp, Homo sapiens
gctgccatgccactgccag

SEQ ID NO: 2035702 - DNA, 22 bp, Homo sapiens
gctgccatggcgtgtccctctc

SEQ ID NO: 2035703 - DNA, 22 bp, Homo sapiens
gctgccccgggtccccagctcc

SEQ ID NO: 2035704 - DNA, 15 bp, Homo sapiens
gctgcccctgcagtt

SEQ ID NO: 2035705 - DNA, 13 bp, Homo sapiens
gctgcccctgtag

SEQ ID NO: 2035706 - DNA, 19 bp, Homo sapiens
gctgcccctgtaggttgct

SEQ ID NO: 2035707 - DNA, 15 bp, Homo sapiens
gctgccctgccactt

SEQ ID NO: 2035708 - DNA, 22 bp, Homo sapiens
gctgccctggtgctgccacact

SEQ ID NO: 2035709 - DNA, 23 bp, Homo sapiens
gctgccctggtgctgccacactt

SEQ ID NO: 2035710 - DNA, 16 bp, Homo sapiens
gctgcccttcgctgcc

SEQ ID NO: 2035711 - DNA, 15 bp, Homo sapiens
gccccgactccagcc

SEQ ID NO: 2035712 - DNA, 18 bp, Homo sapiens
gccccgactccagccagc

SEQ ID NO: 2035713 - DNA, 15 bp, Homo sapiens
gccccgaggccttct

SEQ ID NO: 2035714 - DNA, 22 bp, Homo sapiens
gccccgaggccttctctgaagg

SEQ ID NO: 2035715 - DNA, 15 bp, Homo sapiens
gccccgcttccccac

SEQ ID NO: 2035716 - DNA, 15 bp, Homo sapiens
gccccgggcctgcct

SEQ ID NO: 2035717 - DNA, 19 bp, Homo sapiens
gccccgggcctgcctctga

SEQ ID NO: 2035718 - DNA, 19 bp, Homo sapiens
gccccgggctctggccacc

SEQ ID NO: 2035719 - DNA, 22 bp, Homo sapiens
gccccgggctctggccaccctg

SEQ ID NO: 2035720 - DNA, 13 bp, Homo sapiens
gccccggggctgg

SEQ ID NO: 2035721 - DNA, 17 bp, Homo sapiens
gccccggggctggcaag

SEQ ID NO: 2035722 - DNA, 19 bp, Homo sapiens
gccccggggctggcaagca

SEQ ID NO: 2035723 - DNA, 19 bp, Homo sapiens
gccccgggtccccagctcc

SEQ ID NO: 2035724 - DNA, 23 bp, Homo sapiens
gccccgggtccccagctccccag

SEQ ID NO: 2035725 - DNA, 21 bp, Homo sapiens
gccccgttccctgtcagaggc

SEQ ID NO: 2035726 - DNA, 19 bp, Homo sapiens
gcccctagtgctattctgt

SEQ ID NO: 2035727 - DNA, 18 bp, Homo sapiens
gcccctcacctgggcctt

SEQ ID NO: 2035728 - DNA, 17 bp, Homo sapiens
gcccctcagcccttgcc

SEQ ID NO: 2035729 - DNA, 18 bp, Homo sapiens
gcccctcagcccttgccc

SEQ ID NO: 2035730 - DNA, 21 bp, Homo sapiens
gcccctcagcccttgccccca

SEQ ID NO: 2035731 - DNA, 16 bp, Homo sapiens
gcccctccacgcctcc

SEQ ID NO: 2035732 - DNA, 21 bp, Homo sapiens
gcccctccacgcctcctggcc

SEQ ID NO: 2035733 - DNA, 17 bp, Homo sapiens
gcccctccagaccctgc

SEQ ID NO: 2035734 - DNA, 20 bp, Homo sapiens
gcccctccagaccctgcctg

SEQ ID NO: 2035735 - DNA, 23 bp, Homo sapiens
gcccctccagaccctgcctgagc

SEQ ID NO: 2035736 - DNA, 16 bp, Homo sapiens
gcccctccctctgccc

SEQ ID NO: 2035737 - DNA, 18 bp, Homo sapiens
gcccctccctctgcccca

SEQ ID NO: 2035738 - DNA, 19 bp, Homo sapiens
gcccctccctctgccccaa

SEQ ID NO: 2035739 - DNA, 13 bp, Homo sapiens
gcccctccctgct

SEQ ID NO: 2035740 - DNA, 22 bp, Homo sapiens
gcccctcctccccttcctgcac

SEQ ID NO: 2035741 - DNA, 23 bp, Homo sapiens
gcccctcctccccttcctgcacc

SEQ ID NO: 2035742 - DNA, 12 bp, Homo sapiens
gcccctcctctg

SEQ ID NO: 2035743 - DNA, 23 bp, Homo sapiens
gcccctcctctgccacctcccct

SEQ ID NO: 2035744 - DNA, 22 bp, Homo sapiens
gcccctcgccttttaggctcag

SEQ ID NO: 2035745 - DNA, 16 bp, Homo sapiens
gcccctgaacaagaat

SEQ ID NO: 2035746 - DNA, 16 bp, Homo sapiens
gcccctgccaccctgg

SEQ ID NO: 2035747 - DNA, 12 bp, Homo sapiens
gcccctgctggt

SEQ ID NO: 2035748 - DNA, 21 bp, Homo sapiens
gcccctgctggttcagggttg

SEQ ID NO: 2035749 - DNA, 22 bp, Homo sapiens
gcccctgctggttcagggttgg

SEQ ID NO: 2035750 - DNA, 20 bp, Homo sapiens
gcccctgggatgggaccagg

SEQ ID NO: 2035751 - DNA, 22 bp, Homo sapiens
gcccctgggatgggaccaggga

SEQ ID NO: 2035752 - DNA, 20 bp, Homo sapiens
gcccctggtaagcagaggct

SEQ ID NO: 2035753 - DNA, 16 bp, Homo sapiens
gcccctggtctgccct

SEQ ID NO: 2035754 - DNA, 12 bp, Homo sapiens
gcccctgtgtga

SEQ ID NO: 2035755 - DNA, 24 bp, Homo sapiens
gcccctgtgtgagttgagtctcct

SEQ ID NO: 2035756 - DNA, 24 bp, Homo sapiens
gcccctgttcccccgctggcagcc

SEQ ID NO: 2035757 - DNA, 21 bp, Homo sapiens
gccccttactatgatctcagg

SEQ ID NO: 2035758 - DNA, 22 bp, Homo sapiens
gccccttactatgatctcagga

SEQ ID NO: 2035759 - DNA, 17 bp, Homo sapiens
gccccttccccctccaa

SEQ ID NO: 2035760 - DNA, 22 bp, Homo sapiens
gccccttgggcatccacccagt

SEQ ID NO: 2035761 - DNA, 13 bp, Homo sapiens
gccccttgggcct

SEQ ID NO: 2035762 - DNA, 12 bp, Homo sapiens
gcccgaagccca

SEQ ID NO: 2035763 - DNA, 13 bp, Homo sapiens
gcccgaagcccag

SEQ ID NO: 2035764 - DNA, 14 bp, Homo sapiens
gcccgacagcctgg

SEQ ID NO: 2035765 - DNA, 15 bp, Homo sapiens
gcccgacagcctggc

SEQ ID NO: 2035766 - DNA, 16 bp, Homo sapiens
gcccgacagcctggca

SEQ ID NO: 2035767 - DNA, 17 bp, Homo sapiens
gcccgacagttctgaac

SEQ ID NO: 2035768 - DNA, 17 bp, Homo sapiens
gcccgagcagctgagca

SEQ ID NO: 2035769 - DNA, 18 bp, Homo sapiens
gcccgagcagctgagcag

SEQ ID NO: 2035770 - DNA, 20 bp, Homo sapiens
gcccgagcagctgagcaggg

SEQ ID NO: 2035771 - DNA, 13 bp, Homo sapiens
gcccgaggaccgg

SEQ ID NO: 2035772 - DNA, 18 bp, Homo sapiens
gcccgaggaccgggctgg

SEQ ID NO: 2035773 - DNA, 14 bp, Homo sapiens
gcccgccagcctca

SEQ ID NO: 2035774 - DNA, 18 bp, Homo sapiens
gcccgccagcctcagtgc

SEQ ID NO: 2035775 - DNA, 20 bp, Homo sapiens
gcccgccagcctcagtgcca

SEQ ID NO: 2035776 - DNA, 21 bp, Homo sapiens
gcccgccctgcccctgcccca

SEQ ID NO: 2035777 - DNA, 18 bp, Homo sapiens
gcccgcctaggagttgag

SEQ ID NO: 2035778 - DNA, 13 bp, Homo sapiens
gcccggccccatc

SEQ ID NO: 2035779 - DNA, 14 bp, Homo sapiens
gcccggcctgctcc

SEQ ID NO: 2035780 - DNA, 21 bp, Homo sapiens
gcccggcgcggtggctcacgc

SEQ ID NO: 2035781 - DNA, 16 bp, Homo sapiens
gcccggctccaggctc

SEQ ID NO: 2035782 - DNA, 23 bp, Homo sapiens
gcccgggtgtgcctgccctggag

SEQ ID NO: 2035783 - DNA, 18 bp, Homo sapiens
gcccgtcttcagcctagc

SEQ ID NO: 2035784 - DNA, 19 bp, Homo sapiens
gcccgtgaagcagtgcctc

SEQ ID NO: 2035785 - DNA, 22 bp, Homo sapiens
gcccgtgaagcagtgcctcgag

SEQ ID NO: 2035786 - DNA, 14 bp, Homo sapiens
gcccgtgtcctgcc

SEQ ID NO: 2035787 - DNA, 22 bp, Homo sapiens
gccctaacgggggtgcggcagg

SEQ ID NO: 2035788 - DNA, 15 bp, Homo sapiens
gccctaaggatctct

SEQ ID NO: 2035789 - DNA, 21 bp, Homo sapiens
gccctacatcttcagctccca

SEQ ID NO: 2035790 - DNA, 23 bp, Homo sapiens
gccctacatcttcagctcccata

SEQ ID NO: 2035791 - DNA, 19 bp, Homo sapiens
gccctaccagagggaacac

SEQ ID NO: 2035792 - DNA, 12 bp, Homo sapiens
gccctaccctca

SEQ ID NO: 2035793 - DNA, 17 bp, Homo sapiens
gccctagagcacactgt

SEQ ID NO: 2035794 - DNA, 18 bp, Homo sapiens
gccctcaataagccagca

SEQ ID NO: 2035795 - DNA, 23 bp, Homo sapiens
gccctcaatccccaagctggcag

SEQ ID NO: 2035796 - DNA, 14 bp, Homo sapiens
gccctcacccgccc

SEQ ID NO: 2035797 - DNA, 19 bp, Homo sapiens
gccgagccgggcctggggc

SEQ ID NO: 2035798 - DNA, 19 bp, Homo sapiens
gccgagcctaatgaaaggg

SEQ ID NO: 2035799 - DNA, 16 bp, Homo sapiens
gccgcaaggccctgtc

SEQ ID NO: 2035800 - DNA, 13 bp, Homo sapiens
gccgcaccccaga

SEQ ID NO: 2035801 - DNA, 15 bp, Homo sapiens
gccgcaccccagagt

SEQ ID NO: 2035802 - DNA, 16 bp, Homo sapiens
gccgcaccccagagtg

SEQ ID NO: 2035803 - DNA, 21 bp, Homo sapiens
gccgcaggaaggcagaataaa

SEQ ID NO: 2035804 - DNA, 14 bp, Homo sapiens
gccgcattccctga

SEQ ID NO: 2035805 - DNA, 16 bp, Homo sapiens
gccgcattccctgagt

SEQ ID NO: 2035806 - DNA, 18 bp, Homo sapiens
gccgcattccctgagtca

SEQ ID NO: 2035807 - DNA, 23 bp, Homo sapiens
gccgccctgggctgtctgtcacc

SEQ ID NO: 2035808 - DNA, 16 bp, Homo sapiens
gccgccgggcaggcct

SEQ ID NO: 2035809 - DNA, 15 bp, Homo sapiens
gccgcctcccagcct

SEQ ID NO: 2035810 - DNA, 21 bp, Homo sapiens
gccgcctgccataccgctggg

SEQ ID NO: 2035811 - DNA, 20 bp, Homo sapiens
gccgcggtaggtaagggccg

SEQ ID NO: 2035812 - DNA, 19 bp, Homo sapiens
gccgctaggagagactgaa

SEQ ID NO: 2035813 - DNA, 19 bp, Homo sapiens
gccgctcctgtctgccagc

SEQ ID NO: 2035814 - DNA, 22 bp, Homo sapiens
gccgctcctgtctgccagccag

SEQ ID NO: 2035815 - DNA, 20 bp, Homo sapiens
gccgctcttctgtcatcccg

SEQ ID NO: 2035816 - DNA, 16 bp, Homo sapiens
gccgctgccccagccc

SEQ ID NO: 2035817 - DNA, 17 bp, Homo sapiens
gccgctgccgctgcacc

SEQ ID NO: 2035818 - DNA, 16 bp, Homo sapiens
gccgctggcccagggt

SEQ ID NO: 2035819 - DNA, 17 bp, Homo sapiens
gccgctgtgagcccctg

SEQ ID NO: 2035820 - DNA, 15 bp, Homo sapiens
gccgctgttcaccca

SEQ ID NO: 2035821 - DNA, 15 bp, Homo sapiens
gccggaccaagatgg

SEQ ID NO: 2035822 - DNA, 20 bp, Homo sapiens
gccggaccgcgtagagagcc

SEQ ID NO: 2035823 - DNA, 15 bp, Homo sapiens
gccggagccgcccac

SEQ ID NO: 2035824 - DNA, 19 bp, Homo sapiens
gccggcaaccccagttctg

SEQ ID NO: 2035825 - DNA, 23 bp, Homo sapiens
gccggcaaccccagttctgctcc

SEQ ID NO: 2035826 - DNA, 21 bp, Homo sapiens
gccggcacctacatccccagg

SEQ ID NO: 2035827 - DNA, 22 bp, Homo sapiens
gccggcacctacatccccaggt

SEQ ID NO: 2035828 - DNA, 16 bp, Homo sapiens
gccggccagccttgca

SEQ ID NO: 2035829 - DNA, 15 bp, Homo sapiens
gccggccccccctct

SEQ ID NO: 2035830 - DNA, 23 bp, Homo sapiens
gccggcgtggcaaatataaaact

SEQ ID NO: 2035831 - DNA, 18 bp, Homo sapiens
gccgggagaggactctgc

SEQ ID NO: 2035832 - DNA, 14 bp, Homo sapiens
gccgggcaggcctg

SEQ ID NO: 2035833 - DNA, 12 bp, Homo sapiens
gccgggctgccc

SEQ ID NO: 2035834 - DNA, 22 bp, Homo sapiens
gccgggctgcccttcgctgcca

SEQ ID NO: 2035835 - DNA, 23 bp, Homo sapiens
gccgggctgcccttcgctgccag

SEQ ID NO: 2035836 - DNA, 16 bp, Homo sapiens
gccggggaactggcca

SEQ ID NO: 2035837 - DNA, 18 bp, Homo sapiens
gccgggttctagtctcct

SEQ ID NO: 2035838 - DNA, 16 bp, Homo sapiens
gccggtcacccaggct

SEQ ID NO: 2035839 - DNA, 19 bp, Homo sapiens
gccgtccatggcaccagcc

SEQ ID NO: 2035840 - DNA, 18 bp, Homo sapiens
gccgtctgactccagagt

SEQ ID NO: 2035841 - DNA, 21 bp, Homo sapiens
gccgtctgactccagagtctg

SEQ ID NO: 2035842 - DNA, 23 bp, Homo sapiens
gccgtgcactccctaagaaaccc

SEQ ID NO: 2035843 - DNA, 14 bp, Homo sapiens
gccgtgcccagggg

SEQ ID NO: 2035844 - DNA, 17 bp, Homo sapiens
gccgtgccttcagctct

SEQ ID NO: 2035845 - DNA, 23 bp, Homo sapiens
gccgtgctcgcccacaaactgat

SEQ ID NO: 2035846 - DNA, 15 bp, Homo sapiens
gccgtggcttcccgc

SEQ ID NO: 2035847 - DNA, 19 bp, Homo sapiens
gccgtggcttcccgctcag

SEQ ID NO: 2035848 - DNA, 17 bp, Homo sapiens
gccgtggtccagctctt

SEQ ID NO: 2035849 - DNA, 19 bp, Homo sapiens
gccgtggtccagctcttgg

SEQ ID NO: 2035850 - DNA, 22 bp, Homo sapiens
gccgttccgtcccaaacagagg

SEQ ID NO: 2035851 - DNA, 15 bp, Homo sapiens
gcctaaaagtaaaca

SEQ ID NO: 2035852 - DNA, 15 bp, Homo sapiens
gcctaaatccaaaga

SEQ ID NO: 2035853 - DNA, 13 bp, Homo sapiens
gcctaaatctaat

SEQ ID NO: 2035854 - DNA, 16 bp, Homo sapiens
gcctaagtggctgctg

SEQ ID NO: 2035855 - DNA, 15 bp, Homo sapiens
gcctaataaacaatt

SEQ ID NO: 2035856 - DNA, 18 bp, Homo sapiens
gcctaatatttaggcaag

SEQ ID NO: 2035857 - DNA, 17 bp, Homo sapiens
gcctacattccctggcc

SEQ ID NO: 2035858 - DNA, 15 bp, Homo sapiens
gcctaccccctgaaa

SEQ ID NO: 2035859 - DNA, 20 bp, Homo sapiens
gcctagatccacacacagag

SEQ ID NO: 2035860 - DNA, 19 bp, Homo sapiens
gcctagccgacctcagcct

SEQ ID NO: 2035861 - DNA, 15 bp, Homo sapiens
gcctagcctgagcca

SEQ ID NO: 2035862 - DNA, 17 bp, Homo sapiens
gcctaggacctcaggcg

SEQ ID NO: 2035863 - DNA, 21 bp, Homo sapiens
gcctaggccaaatgcacaagc

SEQ ID NO: 2035864 - DNA, 13 bp, Homo sapiens
gcctaggtgacag

SEQ ID NO: 2035865 - DNA, 20 bp, Homo sapiens
gcctaggtgacagagtgaga

SEQ ID NO: 2035866 - DNA, 23 bp, Homo sapiens
gcctagtggggtctccctctcct

SEQ ID NO: 2035867 - DNA, 17 bp, Homo sapiens
gcctataaaatgcccat

SEQ ID NO: 2035868 - DNA, 18 bp, Homo sapiens
gcctatgacttgggcacc

SEQ ID NO: 2035869 - DNA, 13 bp, Homo sapiens
gcctatggagagc

SEQ ID NO: 2035870 - DNA, 16 bp, Homo sapiens
gcctatggagagccct

SEQ ID NO: 2035871 - DNA, 17 bp, Homo sapiens
gcctatggagagccctg

SEQ ID NO: 2035872 - DNA, 22 bp, Homo sapiens
gcctatggagagccctgggacc

SEQ ID NO: 2035873 - DNA, 20 bp, Homo sapiens
gcctattagatgttttacaa

SEQ ID NO: 2035874 - DNA, 15 bp, Homo sapiens
gcctattatattaaa

SEQ ID NO: 2035875 - DNA, 19 bp, Homo sapiens
gcctatttattcattcagt

SEQ ID NO: 2035876 - DNA, 18 bp, Homo sapiens
gcctatttattggggtgc

SEQ ID NO: 2035877 - DNA, 21 bp, Homo sapiens
gcctcaagtgattctcctgcc

SEQ ID NO: 2035878 - DNA, 17 bp, Homo sapiens
gcctcaatgtgaccagg

SEQ ID NO: 2035879 - DNA, 15 bp, Homo sapiens
gcctcacacccagag

SEQ ID NO: 2035880 - DNA, 16 bp, Homo sapiens
gcctcacacccagagg

SEQ ID NO: 2035881 - DNA, 13 bp, Homo sapiens
gcctcacagaaga

SEQ ID NO: 2035882 - DNA, 17 bp, Homo sapiens
gcctcacgcccagcctc

SEQ ID NO: 2035883 - DNA, 19 bp, Homo sapiens
gcctcacgcccagcctcct

SEQ ID NO: 2035884 - DNA, 13 bp, Homo sapiens
gcctcactggctg

SEQ ID NO: 2035885 - DNA, 15 bp, Homo sapiens
gcctcactggctggg

SEQ ID NO: 2035886 - DNA, 16 bp, Homo sapiens
gcctcactggctgggg

SEQ ID NO: 2035887 - DNA, 18 bp, Homo sapiens
gcctcacttccctgggaa

SEQ ID NO: 2035888 - DNA, 19 bp, Homo sapiens
gcctcacttccctgggaac

SEQ ID NO: 2035889 - DNA, 16 bp, Homo sapiens
gcctcacttgaatgtg

SEQ ID NO: 2035890 - DNA, 22 bp, Homo sapiens
gcctcagcaggaacctgtactg

SEQ ID NO: 2035891 - DNA, 13 bp, Homo sapiens
gcctcagccctca

SEQ ID NO: 2035892 - DNA, 14 bp, Homo sapiens
gcctcagcctccca

SEQ ID NO: 2035893 - DNA, 12 bp, Homo sapiens
gcctcagctcag

SEQ ID NO: 2035894 - DNA, 14 bp, Homo sapiens
gcctcagctcagcc

SEQ ID NO: 2035895 - DNA, 20 bp, Homo sapiens
gcctcagctgctcgcacaga

SEQ ID NO: 2035896 - DNA, 12 bp, Homo sapiens
gcctcaggggag

SEQ ID NO: 2035897 - DNA, 14 bp, Homo sapiens
gcctcagtgccact

SEQ ID NO: 2035898 - DNA, 18 bp, Homo sapiens
gcctcagtgtagttaaag

SEQ ID NO: 2035899 - DNA, 22 bp, Homo sapiens
gcctcagttcaacctggtggca

SEQ ID NO: 2035900 - DNA, 11 bp, Homo sapiens
gcctcagtttc

SEQ ID NO: 2035901 - DNA, 13 bp, Homo sapiens
gcctcagtttccc

SEQ ID NO: 2035902 - DNA, 20 bp, Homo sapiens
gcctcagtttccccatttgt

SEQ ID NO: 2035903 - DNA, 20 bp, Homo sapiens
gcctcagtttctccatcagc

SEQ ID NO: 2035904 - DNA, 13 bp, Homo sapiens
gcctcatatttaa

SEQ ID NO: 2035905 - DNA, 22 bp, Homo sapiens
gcctcatatttaaagacaggga

SEQ ID NO: 2035906 - DNA, 17 bp, Homo sapiens
gcctcatccctcggaag

SEQ ID NO: 2035907 - DNA, 13 bp, Homo sapiens
gcctcatgccaca

SEQ ID NO: 2035908 - DNA, 16 bp, Homo sapiens
gcctcatgccacacct

SEQ ID NO: 2035909 - DNA, 22 bp, Homo sapiens
gcctccaaatgccaacttgtcc

SEQ ID NO: 2035910 - DNA, 18 bp, Homo sapiens
gcctccaccgctgcctaa

SEQ ID NO: 2035911 - DNA, 18 bp, Homo sapiens
gcctccacctctccttgg

SEQ ID NO: 2035912 - DNA, 14 bp, Homo sapiens
gcctccacgggggc

SEQ ID NO: 2035913 - DNA, 18 bp, Homo sapiens
gcccagaaaacctccagt

SEQ ID NO: 2035914 - DNA, 16 bp, Homo sapiens
gcccagagatgcctcc

SEQ ID NO: 2035915 - DNA, 17 bp, Homo sapiens
gcccagagatgcctcca

SEQ ID NO: 2035916 - DNA, 22 bp, Homo sapiens
gcccagagatgcctccaccgct

SEQ ID NO: 2035917 - DNA, 16 bp, Homo sapiens
gcccagagctggaaca

SEQ ID NO: 2035918 - DNA, 16 bp, Homo sapiens
gcccagagggcccagg

SEQ ID NO: 2035919 - DNA, 20 bp, Homo sapiens
gcccagagggcccaggcagg

SEQ ID NO: 2035920 - DNA, 13 bp, Homo sapiens
gcccagcactgtg

SEQ ID NO: 2035921 - DNA, 12 bp, Homo sapiens
gcccagccacct

SEQ ID NO: 2035922 - DNA, 22 bp, Homo sapiens
gcccagccacctcccaaggact

SEQ ID NO: 2035923 - DNA, 23 bp, Homo sapiens
gcccagccattaccatggagaca

SEQ ID NO: 2035924 - DNA, 14 bp, Homo sapiens
gcccagcccagctg

SEQ ID NO: 2035925 - DNA, 16 bp, Homo sapiens
gcccagcccagctggt

SEQ ID NO: 2035926 - DNA, 16 bp, Homo sapiens
gcccagccctaaacat

SEQ ID NO: 2035927 - DNA, 14 bp, Homo sapiens
gcccagcctaggcc

SEQ ID NO: 2035928 - DNA, 15 bp, Homo sapiens
gcccagcctaggccc

SEQ ID NO: 2035929 - DNA, 19 bp, Homo sapiens
gcccagcctcctcccacca

SEQ ID NO: 2035930 - DNA, 20 bp, Homo sapiens
gcccagcctcctcccaccac

SEQ ID NO: 2035931 - DNA, 16 bp, Homo sapiens
gcccagcctctgtccc

SEQ ID NO: 2035932 - DNA, 18 bp, Homo sapiens
gcccagcctgtcctggta

SEQ ID NO: 2035933 - DNA, 16 bp, Homo sapiens
gcccagctacattcct

SEQ ID NO: 2035934 - DNA, 21 bp, Homo sapiens
gcccagctacattcctcagct

SEQ ID NO: 2035935 - DNA, 23 bp, Homo sapiens
gcccagctacattcctcagctgc

SEQ ID NO: 2035936 - DNA, 20 bp, Homo sapiens
gcccagctatggccccaggg

SEQ ID NO: 2035937 - DNA, 21 bp, Homo sapiens
gcccagctatggccccagggt

SEQ ID NO: 2035938 - DNA, 13 bp, Homo sapiens
gcccagctgcacc

SEQ ID NO: 2035939 - DNA, 17 bp, Homo sapiens
gcccagctgtagccatg

SEQ ID NO: 2035940 - DNA, 18 bp, Homo sapiens
gcccagctgtagccatgg

SEQ ID NO: 2035941 - DNA, 19 bp, Homo sapiens
gcccagctgtagccatggc

SEQ ID NO: 2035942 - DNA, 20 bp, Homo sapiens
gcccagctgtagccatggct

SEQ ID NO: 2035943 - DNA, 13 bp, Homo sapiens
gcccagcttcctg

SEQ ID NO: 2035944 - DNA, 14 bp, Homo sapiens
gcccagcttcctgg

SEQ ID NO: 2035945 - DNA, 19 bp, Homo sapiens
gcccaggagagccagccct

SEQ ID NO: 2035946 - DNA, 20 bp, Homo sapiens
gcccaggagagccagccctc

SEQ ID NO: 2035947 - DNA, 20 bp, Homo sapiens
gcccaggagctgagtcacct

SEQ ID NO: 2035948 - DNA, 22 bp, Homo sapiens
gcccaggagctgagtcacctcc

SEQ ID NO: 2035949 - DNA, 11 bp, Homo sapiens
gcccaggcagg

SEQ ID NO: 2035950 - DNA, 14 bp, Homo sapiens
gcccaggcaggcca

SEQ ID NO: 2035951 - DNA, 12 bp, Homo sapiens
gcccaggcccct

SEQ ID NO: 2035952 - DNA, 22 bp, Homo sapiens
gcccaggctctgggaaggggtg

SEQ ID NO: 2035953 - DNA, 13 bp, Homo sapiens
gcccaggctgaag

SEQ ID NO: 2035954 - DNA, 16 bp, Homo sapiens
gcccaggctggcctga

SEQ ID NO: 2035955 - DNA, 20 bp, Homo sapiens
gcccagggagcaatgggagg

SEQ ID NO: 2035956 - DNA, 20 bp, Homo sapiens
gcccagggtaggggagggtg

SEQ ID NO: 2035957 - DNA, 15 bp, Homo sapiens
gcccaggtcctctga

SEQ ID NO: 2035958 - DNA, 22 bp, Homo sapiens
gcccagtctggaatgcagtggt

SEQ ID NO: 2035959 - DNA, 15 bp, Homo sapiens
gcccagtgacctgac

SEQ ID NO: 2035960 - DNA, 17 bp, Homo sapiens
gcccagtgacctgaccg

SEQ ID NO: 2035961 - DNA, 19 bp, Homo sapiens
gcccagtgcacttgctgga

SEQ ID NO: 2035962 - DNA, 22 bp, Homo sapiens
gcccagtgcacttgctggaaga

SEQ ID NO: 2035963 - DNA, 19 bp, Homo sapiens
gcccagttgggtggatgcc

SEQ ID NO: 2035964 - DNA, 18 bp, Homo sapiens
gcccatagaaacatgaca

SEQ ID NO: 2035965 - DNA, 18 bp, Homo sapiens
gcccatctcaggtgccac

SEQ ID NO: 2035966 - DNA, 19 bp, Homo sapiens
gcccatctcaggtgccact

SEQ ID NO: 2035967 - DNA, 24 bp, Homo sapiens
gcccatctcaggtgccactccctg

SEQ ID NO: 2035968 - DNA, 20 bp, Homo sapiens
gcccatgctcaaccactgtg

SEQ ID NO: 2035969 - DNA, 21 bp, Homo sapiens
gcccatgctcaaccactgtgg

SEQ ID NO: 2035970 - DNA, 22 bp, Homo sapiens
gcccatgctcaaccactgtggc

SEQ ID NO: 2035971 - DNA, 22 bp, Homo sapiens
gcccatggcctctggccaggca

SEQ ID NO: 2035972 - DNA, 18 bp, Homo sapiens
gcccattcgtctgtccca

SEQ ID NO: 2035973 - DNA, 22 bp, Homo sapiens
gcccattcgtctgtcccagagc

SEQ ID NO: 2035974 - DNA, 15 bp, Homo sapiens
gcccattctctctcc

SEQ ID NO: 2035975 - DNA, 19 bp, Homo sapiens
gcccattctctctcctgtc

SEQ ID NO: 2035976 - DNA, 20 bp, Homo sapiens
gcccattctctctcctgtcc

SEQ ID NO: 2035977 - DNA, 18 bp, Homo sapiens
gcccattttatctttgaa

SEQ ID NO: 2035978 - DNA, 15 bp, Homo sapiens
gccccaaaccagggt

SEQ ID NO: 2035979 - DNA, 21 bp, Homo sapiens
gccccaaatatagcgttccca

SEQ ID NO: 2035980 - DNA, 15 bp, Homo sapiens
gccccaacccccacc

SEQ ID NO: 2035981 - DNA, 15 bp, Homo sapiens
gccccaacccgtgga

SEQ ID NO: 2035982 - DNA, 21 bp, Homo sapiens
gccccaacccgtggaggctgc

SEQ ID NO: 2035983 - DNA, 22 bp, Homo sapiens
gccccaacccgtggaggctgct

SEQ ID NO: 2035984 - DNA, 15 bp, Homo sapiens
gccccaactcctgga

SEQ ID NO: 2035985 - DNA, 16 bp, Homo sapiens
gccccaactcctggaa

SEQ ID NO: 2035986 - DNA, 17 bp, Homo sapiens
gccccaactcctggaag

SEQ ID NO: 2035987 - DNA, 21 bp, Homo sapiens
gccccaactccttccagctag

SEQ ID NO: 2035988 - DNA, 13 bp, Homo sapiens
gccccaagcagcc

SEQ ID NO: 2035989 - DNA, 16 bp, Homo sapiens
gccccaagcagccagc

SEQ ID NO: 2035990 - DNA, 18 bp, Homo sapiens
gccccaagcagccagcca

SEQ ID NO: 2035991 - DNA, 21 bp, Homo sapiens
gccccaagcagccagccagtc

SEQ ID NO: 2035992 - DNA, 23 bp, Homo sapiens
gccccaagcagccagccagtctt

SEQ ID NO: 2035993 - DNA, 18 bp, Homo sapiens
gccccaaggctgctcaga

SEQ ID NO: 2035994 - DNA, 20 bp, Homo sapiens
gccccaaggggcccacaaag

SEQ ID NO: 2035995 - DNA, 22 bp, Homo sapiens
gccccaaggggtttctgtttct

SEQ ID NO: 2035996 - DNA, 13 bp, Homo sapiens
gccccaattttct

SEQ ID NO: 2035997 - DNA, 12 bp, Homo sapiens
gccccacagcac

SEQ ID NO: 2035998 - DNA, 16 bp, Homo sapiens
gccccacagcacccag

SEQ ID NO: 2035999 - DNA, 13 bp, Homo sapiens
gccccaccaccta

SEQ ID NO: 2036000 - DNA, 15 bp, Homo sapiens
gccccaccacctagg

SEQ ID NO: 2036001 - DNA, 15 bp, Homo sapiens
gccccaccagccacc

SEQ ID NO: 2036002 - DNA, 16 bp, Homo sapiens
gccccaccagccacct

SEQ ID NO: 2036003 - DNA, 20 bp, Homo sapiens
gccccaccctcgtggacacc

SEQ ID NO: 2036004 - DNA, 12 bp, Homo sapiens
gccccagacaca

SEQ ID NO: 2036005 - DNA, 22 bp, Homo sapiens
gccccagactcctttcctctga

SEQ ID NO: 2036006 - DNA, 21 bp, Homo sapiens
gccccagagaggggacatttc

SEQ ID NO: 2036007 - DNA, 19 bp, Homo sapiens
gccccagaggcctctctct

SEQ ID NO: 2036008 - DNA, 18 bp, Homo sapiens
gccccagatcaccagccc

SEQ ID NO: 2036009 - DNA, 19 bp, Homo sapiens
gccccagatcaccagcccg

SEQ ID NO: 2036010 - DNA, 16 bp, Homo sapiens
gccccagatctgcctg

SEQ ID NO: 2036011 - DNA, 18 bp, Homo sapiens
gccccagatctgcctggg

SEQ ID NO: 2036012 - DNA, 19 bp, Homo sapiens
gccccagatctgcctgggc

SEQ ID NO: 2036013 - DNA, 15 bp, Homo sapiens
gccccagcccgacag

SEQ ID NO: 2036014 - DNA, 22 bp, Homo sapiens
gccccagcgcggcttggccgcc

SEQ ID NO: 2036015 - DNA, 13 bp, Homo sapiens
gccccaggccctc

SEQ ID NO: 2036016 - DNA, 15 bp, Homo sapiens
gccccaggccctccc

SEQ ID NO: 2036017 - DNA, 17 bp, Homo sapiens
gccccaggccctccctg

SEQ ID NO: 2036018 - DNA, 20 bp, Homo sapiens
gccccagggggcggggtgca

SEQ ID NO: 2036019 - DNA, 15 bp, Homo sapiens
gccccaggtgccacc

SEQ ID NO: 2036020 - DNA, 19 bp, Homo sapiens
gccccaggtgccaccaata

SEQ ID NO: 2036021 - DNA, 12 bp, Homo sapiens
gccccagtgccc

SEQ ID NO: 2036022 - DNA, 13 bp, Homo sapiens
gccccagtgccca

SEQ ID NO: 2036023 - DNA, 16 bp, Homo sapiens
gccccagtgcccacag

SEQ ID NO: 2036024 - DNA, 17 bp, Homo sapiens
gccccagtgcccacagg

SEQ ID NO: 2036025 - DNA, 16 bp, Homo sapiens
gccccatcagaggctg

SEQ ID NO: 2036026 - DNA, 17 bp, Homo sapiens
gccccatcctgggcctt

SEQ ID NO: 2036027 - DNA, 22 bp, Homo sapiens
gccccatctcctcccatggcct

SEQ ID NO: 2036028 - DNA, 20 bp, Homo sapiens
gccccatcttggtcctgtca

SEQ ID NO: 2036029 - DNA, 20 bp, Homo sapiens
gccctgagctcaggctgagc

SEQ ID NO: 2036030 - DNA, 21 bp, Homo sapiens
gccctgagctcaggctgagcc

SEQ ID NO: 2036031 - DNA, 21 bp, Homo sapiens
gccctgagtggatctccaagg

SEQ ID NO: 2036032 - DNA, 12 bp, Homo sapiens
gccctgcacaga

SEQ ID NO: 2036033 - DNA, 15 bp, Homo sapiens
gccctgcagaccctg

SEQ ID NO: 2036034 - DNA, 16 bp, Homo sapiens
gccctgcagaccctgc

SEQ ID NO: 2036035 - DNA, 20 bp, Homo sapiens
gccctgcagaccctgccctt

SEQ ID NO: 2036036 - DNA, 15 bp, Homo sapiens
gccctgccacctgtc

SEQ ID NO: 2036037 - DNA, 18 bp, Homo sapiens
gccctgccacctgtctgt

SEQ ID NO: 2036038 - DNA, 19 bp, Homo sapiens
gccctgccccatcctgggc

SEQ ID NO: 2036039 - DNA, 20 bp, Homo sapiens
gccctgccctctccttcctt

SEQ ID NO: 2036040 - DNA, 16 bp, Homo sapiens
gccctgcctgcccact

SEQ ID NO: 2036041 - DNA, 12 bp, Homo sapiens
gccctgcctgga

SEQ ID NO: 2036042 - DNA, 14 bp, Homo sapiens
gccctgcctggagg

SEQ ID NO: 2036043 - DNA, 19 bp, Homo sapiens
gccctgcctggaggacctg

SEQ ID NO: 2036044 - DNA, 14 bp, Homo sapiens
gccctgccttcagc

SEQ ID NO: 2036045 - DNA, 19 bp, Homo sapiens
gccctgccttcagctttgg

SEQ ID NO: 2036046 - DNA, 16 bp, Homo sapiens
gccctgcgttggagcc

SEQ ID NO: 2036047 - DNA, 15 bp, Homo sapiens
gccctgctctgggga

SEQ ID NO: 2036048 - DNA, 23 bp, Homo sapiens
gccctgctgccgcctcccagcct

SEQ ID NO: 2036049 - DNA, 18 bp, Homo sapiens
gccctgctttgggctgcc

SEQ ID NO: 2036050 - DNA, 21 bp, Homo sapiens
gccctgctttgggctgccctg

SEQ ID NO: 2036051 - DNA, 22 bp, Homo sapiens
gccctgctttgggctgccctgg

SEQ ID NO: 2036052 - DNA, 18 bp, Homo sapiens
gccctggatcagcgtggc

SEQ ID NO: 2036053 - DNA, 17 bp, Homo sapiens
gccctggatgtgcccac

SEQ ID NO: 2036054 - DNA, 19 bp, Homo sapiens
gccctggatgtgcccacag

SEQ ID NO: 2036055 - DNA, 19 bp, Homo sapiens
gccctggcaacatagtgag

SEQ ID NO: 2036056 - DNA, 12 bp, Homo sapiens
gccctggcagga

SEQ ID NO: 2036057 - DNA, 19 bp, Homo sapiens
gccctggcccagagctgga

SEQ ID NO: 2036058 - DNA, 19 bp, Homo sapiens
gccctggctcccacaggcc

SEQ ID NO: 2036059 - DNA, 12 bp, Homo sapiens
gccctggctctg

SEQ ID NO: 2036060 - DNA, 14 bp, Homo sapiens
gccctgggaccgct

SEQ ID NO: 2036061 - DNA, 18 bp, Homo sapiens
gccctgggcacccacctc

SEQ ID NO: 2036062 - DNA, 19 bp, Homo sapiens
gccctgggcacccacctcc

SEQ ID NO: 2036063 - DNA, 12 bp, Homo sapiens
gccctgggcctc

SEQ ID NO: 2036064 - DNA, 13 bp, Homo sapiens
gccctgggcctca

SEQ ID NO: 2036065 - DNA, 12 bp, Homo sapiens
gccctggggcct

SEQ ID NO: 2036066 - DNA, 15 bp, Homo sapiens
gccctggggcctgta

SEQ ID NO: 2036067 - DNA, 19 bp, Homo sapiens
gccctggggcctgtactgc

SEQ ID NO: 2036068 - DNA, 22 bp, Homo sapiens
gccctggggcctgtactgcctg

SEQ ID NO: 2036069 - DNA, 23 bp, Homo sapiens
gccctggggcctgtactgcctgc

SEQ ID NO: 2036070 - DNA, 17 bp, Homo sapiens
gccctgggggccagctg

SEQ ID NO: 2036071 - DNA, 18 bp, Homo sapiens
gccctgggggccagctgg

SEQ ID NO: 2036072 - DNA, 21 bp, Homo sapiens
gccctgggtctaaggggttgg

SEQ ID NO: 2036073 - DNA, 18 bp, Homo sapiens
gccctggtccttccaggc

SEQ ID NO: 2036074 - DNA, 16 bp, Homo sapiens
gccctggtgctgccac

SEQ ID NO: 2036075 - DNA, 20 bp, Homo sapiens
gccctggtggcagtgggagc

SEQ ID NO: 2036076 - DNA, 21 bp, Homo sapiens
gccctggtggcagtgggagct

SEQ ID NO: 2036077 - DNA, 17 bp, Homo sapiens
gccctgtcgagacactt

SEQ ID NO: 2036078 - DNA, 21 bp, Homo sapiens
gccctgtcgagacacttgcct

SEQ ID NO: 2036079 - DNA, 17 bp, Homo sapiens
gccctgttaaaagatga

SEQ ID NO: 2036080 - DNA, 17 bp, Homo sapiens
gcccttaaaataatgat

SEQ ID NO: 2036081 - DNA, 17 bp, Homo sapiens
gcccttattttcaagaa

SEQ ID NO: 2036082 - DNA, 16 bp, Homo sapiens
gcccttcacagtgttt

SEQ ID NO: 2036083 - DNA, 22 bp, Homo sapiens
gcccttccagtggtaccagctc

SEQ ID NO: 2036084 - DNA, 12 bp, Homo sapiens
gcccttccatgt

SEQ ID NO: 2036085 - DNA, 21 bp, Homo sapiens
gcccttcctcctgaagcctct

SEQ ID NO: 2036086 - DNA, 22 bp, Homo sapiens
gcccttcctctccactgccttc

SEQ ID NO: 2036087 - DNA, 19 bp, Homo sapiens
gcccttcctggacagctgt

SEQ ID NO: 2036088 - DNA, 21 bp, Homo sapiens
gcccttcctggacagctgtgc

SEQ ID NO: 2036089 - DNA, 23 bp, Homo sapiens
gcccttcctggacagctgtgcct

SEQ ID NO: 2036090 - DNA, 18 bp, Homo sapiens
gcccttcgctgccaggac

SEQ ID NO: 2036091 - DNA, 21 bp, Homo sapiens
gcccttcgctgccaggacacc

SEQ ID NO: 2036092 - DNA, 20 bp, Homo sapiens
gcccttgcccccatccctcg

SEQ ID NO: 2036093 - DNA, 18 bp, Homo sapiens
gcccttgccctgacctcc

SEQ ID NO: 2036094 - DNA, 16 bp, Homo sapiens
gcccttggggcctggc

SEQ ID NO: 2036095 - DNA, 21 bp, Homo sapiens
gcccttggggtaagccagagc

SEQ ID NO: 2036096 - DNA, 19 bp, Homo sapiens
gcccttggggttcccccag

SEQ ID NO: 2036097 - DNA, 13 bp, Homo sapiens
gcccttgtcctgc

SEQ ID NO: 2036098 - DNA, 14 bp, Homo sapiens
gcccttgtcctgcc

SEQ ID NO: 2036099 - DNA, 18 bp, Homo sapiens
gcccttgtcctgccagct

SEQ ID NO: 2036100 - DNA, 22 bp, Homo sapiens
gcccttgtcctgccagctgcct

SEQ ID NO: 2036101 - DNA, 18 bp, Homo sapiens
gcccttgtttggggcagg

SEQ ID NO: 2036102 - DNA, 20 bp, Homo sapiens
gcccttgtttggggcaggag

SEQ ID NO: 2036103 - DNA, 16 bp, Homo sapiens
gccctttgcaggccca

SEQ ID NO: 2036104 - DNA, 17 bp, Homo sapiens
gccctttgggaggctga

SEQ ID NO: 2036105 - DNA, 15 bp, Homo sapiens
gccgaagctaacagg

SEQ ID NO: 2036106 - DNA, 14 bp, Homo sapiens
gccgaccagagccc

SEQ ID NO: 2036107 - DNA, 11 bp, Homo sapiens
gccgacctcag

SEQ ID NO: 2036108 - DNA, 17 bp, Homo sapiens
gccgacctcagccttcc

SEQ ID NO: 2036109 - DNA, 11 bp, Homo sapiens
gccgactcagg

SEQ ID NO: 2036110 - DNA, 13 bp, Homo sapiens
gccgagagaggcg

SEQ ID NO: 2036111 - DNA, 16 bp, Homo sapiens
gccgagagcctgctcc

SEQ ID NO: 2036112 - DNA, 17 bp, Homo sapiens
gccgagagcctgctccc

SEQ ID NO: 2036113 - DNA, 20 bp, Homo sapiens
gccgagatcacgccactgca

SEQ ID NO: 2036114 - DNA, 20 bp, Homo sapiens
gccgagattgcgccactgca

SEQ ID NO: 2036115 - DNA, 14 bp, Homo sapiens
gccgagcaaccgtg

SEQ ID NO: 2036116 - DNA, 19 bp, Homo sapiens
gccgagcaaccgtggccct

SEQ ID NO: 2036117 - DNA, 15 bp, Homo sapiens
gccgagccgggcctg

SEQ ID NO: 2036118 - DNA, 14 bp, Homo sapiens
gcatcccaggggac

SEQ ID NO: 2036119 - DNA, 15 bp, Homo sapiens
gcatcccaggggacc

SEQ ID NO: 2036120 - DNA, 19 bp, Homo sapiens
gcatcccaggggaccacac

SEQ ID NO: 2036121 - DNA, 21 bp, Homo sapiens
gcatcccaggggaccacacct

SEQ ID NO: 2036122 - DNA, 13 bp, Homo sapiens
gcatcccatccct

SEQ ID NO: 2036123 - DNA, 19 bp, Homo sapiens
gcatccccttggctgtgag

SEQ ID NO: 2036124 - DNA, 20 bp, Homo sapiens
gcatccccttggctgtgagg

SEQ ID NO: 2036125 - DNA, 15 bp, Homo sapiens
gcatccgcagcccag

SEQ ID NO: 2036126 - DNA, 13 bp, Homo sapiens
gcatccggagaat

SEQ ID NO: 2036127 - DNA, 19 bp, Homo sapiens
gcatccgtagttccctgaa

SEQ ID NO: 2036128 - DNA, 13 bp, Homo sapiens
gcatcctggcacc

SEQ ID NO: 2036129 - DNA, 13 bp, Homo sapiens
gcatccttctgcc

SEQ ID NO: 2036130 - DNA, 20 bp, Homo sapiens
gcatccttttctgcagaggg

SEQ ID NO: 2036131 - DNA, 22 bp, Homo sapiens
gcatcgtagaagagatgtggca

SEQ ID NO: 2036132 - DNA, 18 bp, Homo sapiens
gcatcgtgacccttcagg

SEQ ID NO: 2036133 - DNA, 19 bp, Homo sapiens
gcatcgtgacccttcaggg

SEQ ID NO: 2036134 - DNA, 22 bp, Homo sapiens
gcatcgtgacccttcagggcca

SEQ ID NO: 2036135 - DNA, 19 bp, Homo sapiens
gcatctacacagcctggac

SEQ ID NO: 2036136 - DNA, 20 bp, Homo sapiens
gcatctacacagcctggact

SEQ ID NO: 2036137 - DNA, 21 bp, Homo sapiens
gcatctacacagcctggactt

SEQ ID NO: 2036138 - DNA, 22 bp, Homo sapiens
gcatctagaggcttccttcatt

SEQ ID NO: 2036139 - DNA, 22 bp, Homo sapiens
gcatctcttcctgattccccac

SEQ ID NO: 2036140 - DNA, 17 bp, Homo sapiens
gcatctcttgaggccag

SEQ ID NO: 2036141 - DNA, 18 bp, Homo sapiens
gcatctgctaataaaacc

SEQ ID NO: 2036142 - DNA, 23 bp, Homo sapiens
gcatctgggattcccaccaaggt

SEQ ID NO: 2036143 - DNA, 20 bp, Homo sapiens
gcatctgtgtaacctccaca

SEQ ID NO: 2036144 - DNA, 13 bp, Homo sapiens
gcatcttctccat

SEQ ID NO: 2036145 - DNA, 14 bp, Homo sapiens
gcatcttctccatc

SEQ ID NO: 2036146 - DNA, 19 bp, Homo sapiens
gcatcttctggagtctcca

SEQ ID NO: 2036147 - DNA, 20 bp, Homo sapiens
gcatgagggatcacagggcc

SEQ ID NO: 2036148 - DNA, 16 bp, Homo sapiens
gcatgatattttcaga

SEQ ID NO: 2036149 - DNA, 16 bp, Homo sapiens
gcatgatcttgttaat

SEQ ID NO: 2036150 - DNA, 20 bp, Homo sapiens
gcatgatgttaaccagaata

SEQ ID NO: 2036151 - DNA, 11 bp, Homo sapiens
gcatgatttat

SEQ ID NO: 2036152 - DNA, 23 bp, Homo sapiens
gcatgattttaagaggctttggc

SEQ ID NO: 2036153 - DNA, 14 bp, Homo sapiens
gcatgattttatac

SEQ ID NO: 2036154 - DNA, 14 bp, Homo sapiens
gcatgcaataatgt

SEQ ID NO: 2036155 - DNA, 17 bp, Homo sapiens
gcatgcaataatgtgca

SEQ ID NO: 2036156 - DNA, 14 bp, Homo sapiens
gcatgcattttgca

SEQ ID NO: 2036157 - DNA, 21 bp, Homo sapiens
gcatgcattttgcagcagtga

SEQ ID NO: 2036158 - DNA, 11 bp, Homo sapiens
gcatgcctctg

SEQ ID NO: 2036159 - DNA, 21 bp, Homo sapiens
gcatgcctctgatatgggact

SEQ ID NO: 2036160 - DNA, 14 bp, Homo sapiens
gcatgctcagccct

SEQ ID NO: 2036161 - DNA, 17 bp, Homo sapiens
gcatgctcagcccttcc

SEQ ID NO: 2036162 - DNA, 17 bp, Homo sapiens
gcatgctctctgcagcc

SEQ ID NO: 2036163 - DNA, 18 bp, Homo sapiens
gcatgctctctgcagcca

SEQ ID NO: 2036164 - DNA, 17 bp, Homo sapiens
gcatgctggcctgtggc

SEQ ID NO: 2036165 - DNA, 21 bp, Homo sapiens
gcatgctggcctgtggcaggc

SEQ ID NO: 2036166 - DNA, 23 bp, Homo sapiens
gcatggacaccccttatccagga

SEQ ID NO: 2036167 - DNA, 20 bp, Homo sapiens
gcatggcaaggactgcaggg

SEQ ID NO: 2036168 - DNA, 14 bp, Homo sapiens
gcatggccaggtgg

SEQ ID NO: 2036169 - DNA, 17 bp, Homo sapiens
gcatggccaggtggcca

SEQ ID NO: 2036170 - DNA, 15 bp, Homo sapiens
gcatggctgtgagga

SEQ ID NO: 2036171 - DNA, 18 bp, Homo sapiens
gcatgggagggagggaga

SEQ ID NO: 2036172 - DNA, 19 bp, Homo sapiens
gcatggtcccacatccctg

SEQ ID NO: 2036173 - DNA, 21 bp, Homo sapiens
gcatggtcccacatccctggg

SEQ ID NO: 2036174 - DNA, 19 bp, Homo sapiens
gcatggtggcgcaagcctg

SEQ ID NO: 2036175 - DNA, 17 bp, Homo sapiens
gcatggttccttccctg

SEQ ID NO: 2036176 - DNA, 19 bp, Homo sapiens
gcatggttccttccctggg

SEQ ID NO: 2036177 - DNA, 21 bp, Homo sapiens
gcatggttccttccctgggaa

SEQ ID NO: 2036178 - DNA, 22 bp, Homo sapiens
gcatgtaaaatgcagtccagaa

SEQ ID NO: 2036179 - DNA, 23 bp, Homo sapiens
gcatgtaaaatgcagtccagaat

SEQ ID NO: 2036180 - DNA, 19 bp, Homo sapiens
gcatgtacaaaagtaccat

SEQ ID NO: 2036181 - DNA, 16 bp, Homo sapiens
gcaagtgagagctggg

SEQ ID NO: 2036182 - DNA, 16 bp, Homo sapiens
gcaagtgcccgccctg

SEQ ID NO: 2036183 - DNA, 22 bp, Homo sapiens
gcaagtgctatgccaagccatg

SEQ ID NO: 2036184 - DNA, 20 bp, Homo sapiens
gcaagttctagagaagaggc

SEQ ID NO: 2036185 - DNA, 14 bp, Homo sapiens
gcaataaaatagta

SEQ ID NO: 2036186 - DNA, 20 bp, Homo sapiens
gcaataaatgccctctctga

SEQ ID NO: 2036187 - DNA, 14 bp, Homo sapiens
gcaataatgtgcaa

SEQ ID NO: 2036188 - DNA, 22 bp, Homo sapiens
gcaataattaggatctatgcaa

SEQ ID NO: 2036189 - DNA, 13 bp, Homo sapiens
gcaatccatgtta

SEQ ID NO: 2036190 - DNA, 22 bp, Homo sapiens
gcaatccatgttagtttttact

SEQ ID NO: 2036191 - DNA, 16 bp, Homo sapiens
gcaatgaaaaattctc

SEQ ID NO: 2036192 - DNA, 16 bp, Homo sapiens
gcaatgaaaccaaagc

SEQ ID NO: 2036193 - DNA, 23 bp, Homo sapiens
gcaatgggagggggctccatgga

SEQ ID NO: 2036194 - DNA, 16 bp, Homo sapiens
gcaatgggcactggga

SEQ ID NO: 2036195 - DNA, 12 bp, Homo sapiens
gcaatggggaga

SEQ ID NO: 2036196 - DNA, 16 bp, Homo sapiens
gcaatggggagaggca

SEQ ID NO: 2036197 - DNA, 20 bp, Homo sapiens
gcaatggtgttgccctgagt

SEQ ID NO: 2036198 - DNA, 23 bp, Homo sapiens
gcaatggtgttgccctgagtgga

SEQ ID NO: 2036199 - DNA, 19 bp, Homo sapiens
gcaatgtaaatattttaaa

SEQ ID NO: 2036200 - DNA, 23 bp, Homo sapiens
gcaatgtaaatattttaaagaat

SEQ ID NO: 2036201 - DNA, 15 bp, Homo sapiens
gcaattattctaatt

SEQ ID NO: 2036202 - DNA, 20 bp, Homo sapiens
gcaattattctaattttata

SEQ ID NO: 2036203 - DNA, 14 bp, Homo sapiens
gcaattcatcccag

SEQ ID NO: 2036204 - DNA, 18 bp, Homo sapiens
gcaattctacagtttctt

SEQ ID NO: 2036205 - DNA, 15 bp, Homo sapiens
gcaatttcccctctg

SEQ ID NO: 2036206 - DNA, 18 bp, Homo sapiens
gcaatttccttttttgtt

SEQ ID NO: 2036207 - DNA, 19 bp, Homo sapiens
gcaattttaattgattatt

SEQ ID NO: 2036208 - DNA, 16 bp, Homo sapiens
gcaatttttaaactag

SEQ ID NO: 2036209 - DNA, 13 bp, Homo sapiens
gcacaaatattta

SEQ ID NO: 2036210 - DNA, 14 bp, Homo sapiens
gcacaaatatttat

SEQ ID NO: 2036211 - DNA, 15 bp, Homo sapiens
gcacaaatatttatt

SEQ ID NO: 2036212 - DNA, 17 bp, Homo sapiens
gcacaagcttgtatata

SEQ ID NO: 2036213 - DNA, 21 bp, Homo sapiens
gcacaagcttgtatatacata

SEQ ID NO: 2036214 - DNA, 22 bp, Homo sapiens
gcacaagcttgtatatacatat

SEQ ID NO: 2036215 - DNA, 18 bp, Homo sapiens
gcacaagttccagctggt

SEQ ID NO: 2036216 - DNA, 19 bp, Homo sapiens
gcacaatgggcaattctga

SEQ ID NO: 2036217 - DNA, 13 bp, Homo sapiens
gcacaatttagaa

SEQ ID NO: 2036218 - DNA, 15 bp, Homo sapiens
gcacaatttagaaaa

SEQ ID NO: 2036219 - DNA, 18 bp, Homo sapiens
gcacaatttagaaaacat

SEQ ID NO: 2036220 - DNA, 18 bp, Homo sapiens
gcacaatttgagcaattc

SEQ ID NO: 2036221 - DNA, 13 bp, Homo sapiens
gcacacacacaga

SEQ ID NO: 2036222 - DNA, 14 bp, Homo sapiens
gcacacacacagag

SEQ ID NO: 2036223 - DNA, 21 bp, Homo sapiens
gcacacacaccgatgctgact

SEQ ID NO: 2036224 - DNA, 12 bp, Homo sapiens
gcacacaccaga

SEQ ID NO: 2036225 - DNA, 17 bp, Homo sapiens
gcacacaccagagccca

SEQ ID NO: 2036226 - DNA, 22 bp, Homo sapiens
gcacacagaaatatatatacat

SEQ ID NO: 2036227 - DNA, 14 bp, Homo sapiens
gcacacagcagccc

SEQ ID NO: 2036228 - DNA, 17 bp, Homo sapiens
gcacacagcagcccccc

SEQ ID NO: 2036229 - DNA, 20 bp, Homo sapiens
gcacacagcagccccccagc

SEQ ID NO: 2036230 - DNA, 19 bp, Homo sapiens
gcacacaggtacagcaaca

SEQ ID NO: 2036231 - DNA, 15 bp, Homo sapiens
gcacacatggacaca

SEQ ID NO: 2036232 - DNA, 17 bp, Homo sapiens
gcacacatggacacaga

SEQ ID NO: 2036233 - DNA, 13 bp, Homo sapiens
gcacaccactgcc

SEQ ID NO: 2036234 - DNA, 15 bp, Homo sapiens
gcacaccactgccct

SEQ ID NO: 2036235 - DNA, 19 bp, Homo sapiens
gcacaccactgccctgcct

SEQ ID NO: 2036236 - DNA, 15 bp, Homo sapiens
gcacaccccaaggga

SEQ ID NO: 2036237 - DNA, 23 bp, Homo sapiens
gcacacgaaccctgccaggcccc

SEQ ID NO: 2036238 - DNA, 16 bp, Homo sapiens
gcacacggccctgccc

SEQ ID NO: 2036239 - DNA, 17 bp, Homo sapiens
gcacactatttccctct

SEQ ID NO: 2036240 - DNA, 20 bp, Homo sapiens
gcacagaaacacaatatttt

SEQ ID NO: 2036241 - DNA, 19 bp, Homo sapiens
gcacagaaggaatctgtgc

SEQ ID NO: 2036242 - DNA, 21 bp, Homo sapiens
gcacagaaggaatctgtgcag

SEQ ID NO: 2036243 - DNA, 23 bp, Homo sapiens
gcacagacttctggaaggctggc

SEQ ID NO: 2036244 - DNA, 19 bp, Homo sapiens
gcacagaggcagctgtgtg

SEQ ID NO: 2036245 - DNA, 20 bp, Homo sapiens
gcacagaggcagctgtgtgg

SEQ ID NO: 2036246 - DNA, 15 bp, Homo sapiens
gcacagccaaggact

SEQ ID NO: 2036247 - DNA, 14 bp, Homo sapiens
gcacagccctggga

SEQ ID NO: 2036248 - DNA, 16 bp, Homo sapiens
gcacagcgcgggcgga

SEQ ID NO: 2036249 - DNA, 17 bp, Homo sapiens
gcacagcgcgggcggag

SEQ ID NO: 2036250 - DNA, 23 bp, Homo sapiens
gcacagcgcgggcggaggcggct

SEQ ID NO: 2036251 - DNA, 21 bp, Homo sapiens
gcacagcggggccccagggct

SEQ ID NO: 2036252 - DNA, 13 bp, Homo sapiens
gcacagctatgaa

SEQ ID NO: 2036253 - DNA, 21 bp, Homo sapiens
gcacagcttcatttcctgtgt

SEQ ID NO: 2036254 - DNA, 22 bp, Homo sapiens
gcacaggagggggtcgtggaga

SEQ ID NO: 2036255 - DNA, 12 bp, Homo sapiens
gcacaggcagct

SEQ ID NO: 2036256 - DNA, 14 bp, Homo sapiens
gcacaggcagctgg

SEQ ID NO: 2036257 - DNA, 14 bp, Homo sapiens
gcacaggcaggaag

SEQ ID NO: 2036258 - DNA, 15 bp, Homo sapiens
gcacaggcaggaaga

SEQ ID NO: 2036259 - DNA, 18 bp, Homo sapiens
gcacaggcaggaagagag

SEQ ID NO: 2036260 - DNA, 19 bp, Homo sapiens
gcacaggcaggaagagaga

SEQ ID NO: 2036261 - DNA, 20 bp, Homo sapiens
gcacaggcaggaagagagag

SEQ ID NO: 2036262 - DNA, 14 bp, Homo sapiens
gcacaggtgtaaat

SEQ ID NO: 2036263 - DNA, 16 bp, Homo sapiens
gcacaggtgtaaatat

SEQ ID NO: 2036264 - DNA, 22 bp, Homo sapiens
gcacagttgtctattctgagcc

SEQ ID NO: 2036265 - DNA, 13 bp, Homo sapiens
gcacatatggact

SEQ ID NO: 2036266 - DNA, 21 bp, Homo sapiens
gcacatccattcccaagaaat

SEQ ID NO: 2036267 - DNA, 23 bp, Homo sapiens
gcacatccattcccaagaaatgc

SEQ ID NO: 2036268 - DNA, 20 bp, Homo sapiens
gcacatccctgccctcctac

SEQ ID NO: 2036269 - DNA, 20 bp, Homo sapiens
gcacatgccaatgcacgcac

SEQ ID NO: 2036270 - DNA, 13 bp, Homo sapiens
gcacatgtcttgt

SEQ ID NO: 2036271 - DNA, 16 bp, Homo sapiens
gcacattcctggcccc

SEQ ID NO: 2036272 - DNA, 16 bp, Homo sapiens
gcacatttatatatat

SEQ ID NO: 2036273 - DNA, 18 bp, Homo sapiens
gcaccaaaagaagtaaaa

SEQ ID NO: 2036274 - DNA, 21 bp, Homo sapiens
gcaccacggcgtttttttaca

SEQ ID NO: 2036275 - DNA, 18 bp, Homo sapiens
gcaccactgtgtatttaa

SEQ ID NO: 2036276 - DNA, 16 bp, Homo sapiens
gcaccagaatgtatat

SEQ ID NO: 2036277 - DNA, 15 bp, Homo sapiens
gcaccagaggctgca

SEQ ID NO: 2036278 - DNA, 23 bp, Homo sapiens
gcaccagagtgaaagggctatgg

SEQ ID NO: 2036279 - DNA, 15 bp, Homo sapiens
gcaccagccccctgg

SEQ ID NO: 2036280 - DNA, 17 bp, Homo sapiens
gcaccagccccctggat

SEQ ID NO: 2036281 - DNA, 15 bp, Homo sapiens
gcaccagctctgtgg

SEQ ID NO: 2036282 - DNA, 16 bp, Homo sapiens
gcaccagctctgtggc

SEQ ID NO: 2036283 - DNA, 18 bp, Homo sapiens
gcaccagctctgtggcct

SEQ ID NO: 2036284 - DNA, 12 bp, Homo sapiens
gcaccagctgct

SEQ ID NO: 2036285 - DNA, 13 bp, Homo sapiens
gcaccagctgctc

SEQ ID NO: 2036286 - DNA, 16 bp, Homo sapiens
gcaccagctgctctgc

SEQ ID NO: 2036287 - DNA, 20 bp, Homo sapiens
gcaccagctgctctgcccct

SEQ ID NO: 2036288 - DNA, 20 bp, Homo sapiens
gcaccagcttctccaggctc

SEQ ID NO: 2036289 - DNA, 21 bp, Homo sapiens
gcaccaggcacgaacccacct

SEQ ID NO: 2036290 - DNA, 15 bp, Homo sapiens
gcaccaggccgggct

SEQ ID NO: 2036291 - DNA, 14 bp, Homo sapiens
gcaccatctgcttg

SEQ ID NO: 2036292 - DNA, 15 bp, Homo sapiens
gcaccatctgcttgg

SEQ ID NO: 2036293 - DNA, 15 bp, Homo sapiens
gcaccatggaggcag

SEQ ID NO: 2036294 - DNA, 14 bp, Homo sapiens
gcacccacctccac

SEQ ID NO: 2036295 - DNA, 17 bp, Homo sapiens
gcacccacctccacccc

SEQ ID NO: 2036296 - DNA, 15 bp, Homo sapiens
gcacccactcaccag

SEQ ID NO: 2036297 - DNA, 17 bp, Homo sapiens
gcacccagaaattcctt

SEQ ID NO: 2036298 - DNA, 13 bp, Homo sapiens
gcacccaggctcc

SEQ ID NO: 2036299 - DNA, 14 bp, Homo sapiens
gcacccaggctcca

SEQ ID NO: 2036300 - DNA, 23 bp, Homo sapiens
gcaccccatgagtagtgcccact

SEQ ID NO: 2036301 - DNA, 12 bp, Homo sapiens
gcacccccagcc

SEQ ID NO: 2036302 - DNA, 15 bp, Homo sapiens
gcacccccagcctgg

SEQ ID NO: 2036303 - DNA, 17 bp, Homo sapiens
gcacccccagcctgggc

SEQ ID NO: 2036304 - DNA, 18 bp, Homo sapiens
gcacccccagcctgggcc

SEQ ID NO: 2036305 - DNA, 20 bp, Homo sapiens
gcacccccagcctgggccta

SEQ ID NO: 2036306 - DNA, 21 bp, Homo sapiens
gcacccccagcctgggcctat

SEQ ID NO: 2036307 - DNA, 20 bp, Homo sapiens
gcaccccctcattcccctcg

SEQ ID NO: 2036308 - DNA, 13 bp, Homo sapiens
gcaccccctgcag

SEQ ID NO: 2036309 - DNA, 14 bp, Homo sapiens
gcaccccctgcagc

SEQ ID NO: 2036310 - DNA, 24 bp, Homo sapiens
gcaccccctgcagcttgtagccag

SEQ ID NO: 2036311 - DNA, 18 bp, Homo sapiens
gcacccggcccctgctgg

SEQ ID NO: 2036312 - DNA, 23 bp, Homo sapiens
gcacccgtacccccgtggtcttt

SEQ ID NO: 2036313 - DNA, 16 bp, Homo sapiens
gcaccctccgccttca

SEQ ID NO: 2036314 - DNA, 15 bp, Homo sapiens
gcaccctctcctggg

SEQ ID NO: 2036315 - DNA, 18 bp, Homo sapiens
gcaccctctcctgggggt

SEQ ID NO: 2036316 - DNA, 13 bp, Homo sapiens
gcaccctgcagag

SEQ ID NO: 2036317 - DNA, 24 bp, Homo sapiens
gcaccctgcagagcacacaggtac

SEQ ID NO: 2036318 - DNA, 18 bp, Homo sapiens
gcaccctggaaaggggag

SEQ ID NO: 2036319 - DNA, 12 bp, Homo sapiens
gcaccctgggtg

SEQ ID NO: 2036320 - DNA, 20 bp, Homo sapiens
gcacccttcctcctcctttg

SEQ ID NO: 2036321 - DNA, 23 bp, Homo sapiens
gcaccgagaactcgaagcccttc

SEQ ID NO: 2036322 - DNA, 14 bp, Homo sapiens
gcaccgcagcatgt

SEQ ID NO: 2036323 - DNA, 15 bp, Homo sapiens
gcaccgcagcatgtg

SEQ ID NO: 2036324 - DNA, 17 bp, Homo sapiens
gcaccgcagcatgtggg

SEQ ID NO: 2036325 - DNA, 21 bp, Homo sapiens
gcacctaaaccaccagtgccc

SEQ ID NO: 2036326 - DNA, 14 bp, Homo sapiens
gcacctacttacat

SEQ ID NO: 2036327 - DNA, 21 bp, Homo sapiens
gcacctatagtcccagctact

SEQ ID NO: 2036328 - DNA, 23 bp, Homo sapiens
gcacctcccagtttgctgggttt

SEQ ID NO: 2036329 - DNA, 19 bp, Homo sapiens
gcacctccccccactgcag

SEQ ID NO: 2036330 - DNA, 23 bp, Homo sapiens
gcacctccccccactgcaggccc

SEQ ID NO: 2036331 - DNA, 20 bp, Homo sapiens
gcacctcctgagaaggcgag

SEQ ID NO: 2036332 - DNA, 20 bp, Homo sapiens
gcacctgaaccccatgggct

SEQ ID NO: 2036333 - DNA, 22 bp, Homo sapiens
gcacctgcatccgtagttccct

SEQ ID NO: 2036334 - DNA, 11 bp, Homo sapiens
gagaaaaacaa

SEQ ID NO: 2036335 - DNA, 10 bp, Homo sapiens
gagaaaaaga

SEQ ID NO: 2036336 - DNA, 16 bp, Homo sapiens
gagaaaacttatttga

SEQ ID NO: 2036337 - DNA, 19 bp, Homo sapiens
gagaaacagagacaggccc

SEQ ID NO: 2036338 - DNA, 18 bp, Homo sapiens
gagaaacccaccagccta

SEQ ID NO: 2036339 - DNA, 13 bp, Homo sapiens
gagaaagaagaga

SEQ ID NO: 2036340 - DNA, 17 bp, Homo sapiens
gagaaagactattcaaa

SEQ ID NO: 2036341 - DNA, 15 bp, Homo sapiens
gagaaagactgatta

SEQ ID NO: 2036342 - DNA, 15 bp, Homo sapiens
gagaaaggagccgga

SEQ ID NO: 2036343 - DNA, 15 bp, Homo sapiens
gagaaaggattaaga

SEQ ID NO: 2036344 - DNA, 16 bp, Homo sapiens
gagaaaggattaagat

SEQ ID NO: 2036345 - DNA, 16 bp, Homo sapiens
gagaaaggttgaagca

SEQ ID NO: 2036346 - DNA, 19 bp, Homo sapiens
gagaaatgtgaagggtggg

SEQ ID NO: 2036347 - DNA, 21 bp, Homo sapiens
gagaaattttactgacagaaa

SEQ ID NO: 2036348 - DNA, 19 bp, Homo sapiens
gagagacccaaggaggaaa

SEQ ID NO: 2036349 - DNA, 20 bp, Homo sapiens
gagagacccaaggaggaaaa

SEQ ID NO: 2036350 - DNA, 23 bp, Homo sapiens
gagagaccctcactgctggggag

SEQ ID NO: 2036351 - DNA, 16 bp, Homo sapiens
gagagacgtgtacata

SEQ ID NO: 2036352 - DNA, 17 bp, Homo sapiens
gagagacgtgtacatag

SEQ ID NO: 2036353 - DNA, 18 bp, Homo sapiens
gagagactgaaagcagca

SEQ ID NO: 2036354 - DNA, 15 bp, Homo sapiens
gagagagaggcagaa

SEQ ID NO: 2036355 - DNA, 18 bp, Homo sapiens
gagagaggatgcagaggg

SEQ ID NO: 2036356 - DNA, 12 bp, Homo sapiens
gagagaggggaa

SEQ ID NO: 2036357 - DNA, 16 bp, Homo sapiens
gagagaggtgggcagc

SEQ ID NO: 2036358 - DNA, 21 bp, Homo sapiens
gagagaggttctggggaggaa

SEQ ID NO: 2036359 - DNA, 18 bp, Homo sapiens
gagagagtattaaatatt

SEQ ID NO: 2036360 - DNA, 14 bp, Homo sapiens
gagagagtgctgag

SEQ ID NO: 2036361 - DNA, 17 bp, Homo sapiens
gagagatatatctgaaa

SEQ ID NO: 2036362 - DNA, 23 bp, Homo sapiens
gagagattttgtcgggacagaga

SEQ ID NO: 2036363 - DNA, 12 bp, Homo sapiens
gagagccagccc

SEQ ID NO: 2036364 - DNA, 20 bp, Homo sapiens
gagagccagccctccctgtc

SEQ ID NO: 2036365 - DNA, 17 bp, Homo sapiens
gagagccagctctctct

SEQ ID NO: 2036366 - DNA, 12 bp, Homo sapiens
gagagccctgct

SEQ ID NO: 2036367 - DNA, 16 bp, Homo sapiens
gagagccctggtccta

SEQ ID NO: 2036368 - DNA, 19 bp, Homo sapiens
gagagcctcttagtgattg

SEQ ID NO: 2036369 - DNA, 17 bp, Homo sapiens
gagagcctgctccccca

SEQ ID NO: 2036370 - DNA, 21 bp, Homo sapiens
gagagcctgctcccccacccc

SEQ ID NO: 2036371 - DNA, 19 bp, Homo sapiens
gagagctagaacccggcag

SEQ ID NO: 2036372 - DNA, 18 bp, Homo sapiens
gagagctagaacctggag

SEQ ID NO: 2036373 - DNA, 19 bp, Homo sapiens
gagagctagaacctggaga

SEQ ID NO: 2036374 - DNA, 22 bp, Homo sapiens
gagagctaggagcaaagcctgt

SEQ ID NO: 2036375 - DNA, 13 bp, Homo sapiens
gagagctgggtgt

SEQ ID NO: 2036376 - DNA, 18 bp, Homo sapiens
gagagcttagcctggagc

SEQ ID NO: 2036377 - DNA, 23 bp, Homo sapiens
gagaggaaaggacatgggtagca

SEQ ID NO: 2036378 - DNA, 19 bp, Homo sapiens
gagaggaatgcctgtgtga

SEQ ID NO: 2036379 - DNA, 17 bp, Homo sapiens
gagaggagatcagggcg

SEQ ID NO: 2036380 - DNA, 12 bp, Homo sapiens
gagaggagcacc

SEQ ID NO: 2036381 - DNA, 15 bp, Homo sapiens
gagaggatgcagagg

SEQ ID NO: 2036382 - DNA, 14 bp, Homo sapiens
gagaggcatggctg

SEQ ID NO: 2036383 - DNA, 12 bp, Homo sapiens
gagaggcggcct

SEQ ID NO: 2036384 - DNA, 14 bp, Homo sapiens
gagagggcagaggg

SEQ ID NO: 2036385 - DNA, 17 bp, Homo sapiens
gagagggcccagctgta

SEQ ID NO: 2036386 - DNA, 19 bp, Homo sapiens
gagagggcccagctgtagc

SEQ ID NO: 2036387 - DNA, 23 bp, Homo sapiens
gagagggctgttggacagctgct

SEQ ID NO: 2036388 - DNA, 13 bp, Homo sapiens
gagaggggaacag

SEQ ID NO: 2036389 - DNA, 18 bp, Homo sapiens
gagaggggaacagactgg

SEQ ID NO: 2036390 - DNA, 19 bp, Homo sapiens
gagaggggaacagactgga

SEQ ID NO: 2036391 - DNA, 16 bp, Homo sapiens
gagaggggaagggcca

SEQ ID NO: 2036392 - DNA, 17 bp, Homo sapiens
gagaggggaagggccag

SEQ ID NO: 2036393 - DNA, 18 bp, Homo sapiens
gagaggggaagggccagt

SEQ ID NO: 2036394 - DNA, 15 bp, Homo sapiens
gagaggggacatttc

SEQ ID NO: 2036395 - DNA, 16 bp, Homo sapiens
gagaggtagcgagctg

SEQ ID NO: 2036396 - DNA, 16 bp, Homo sapiens
gagaggtgggcagcag

SEQ ID NO: 2036397 - DNA, 16 bp, Homo sapiens
gagagtacagtgagcc

SEQ ID NO: 2036398 - DNA, 19 bp, Homo sapiens
gagagtacagtgagccaag

SEQ ID NO: 2036399 - DNA, 11 bp, Homo sapiens
gagagtaccat

SEQ ID NO: 2036400 - DNA, 18 bp, Homo sapiens
gagagtagccgagagcct

SEQ ID NO: 2036401 - DNA, 20 bp, Homo sapiens
gagagtagccgagagcctgc

SEQ ID NO: 2036402 - DNA, 21 bp, Homo sapiens
gagagtagccgagagcctgct

SEQ ID NO: 2036403 - DNA, 17 bp, Homo sapiens
gagagtattaaatattt

SEQ ID NO: 2036404 - DNA, 21 bp, Homo sapiens
gagagtattaaatatttaaca

SEQ ID NO: 2036405 - DNA, 14 bp, Homo sapiens
gagagtctgtctca

SEQ ID NO: 2036406 - DNA, 16 bp, Homo sapiens
gagagtggctcctccc

SEQ ID NO: 2036407 - DNA, 12 bp, Homo sapiens
gagagtggctta

SEQ ID NO: 2036408 - DNA, 20 bp, Homo sapiens
gagagtgtgaaatagacatt

SEQ ID NO: 2036409 - DNA, 16 bp, Homo sapiens
gagagttcaagcctgt

SEQ ID NO: 2036410 - DNA, 13 bp, Homo sapiens
gagagttggctca

SEQ ID NO: 2036411 - DNA, 19 bp, Homo sapiens
gagagttggctcaggcaga

SEQ ID NO: 2036412 - DNA, 18 bp, Homo sapiens
gagataatatctgtgagg

SEQ ID NO: 2036413 - DNA, 21 bp, Homo sapiens
gagatactctccctgacattt

SEQ ID NO: 2036414 - DNA, 13 bp, Homo sapiens
gagatataaaatc

SEQ ID NO: 2036415 - DNA, 18 bp, Homo sapiens
gagatctgggaggtctcc

SEQ ID NO: 2036416 - DNA, 16 bp, Homo sapiens
gagatgaattaaattt

SEQ ID NO: 2036417 - DNA, 13 bp, Homo sapiens
gagatgactgagt

SEQ ID NO: 2036418 - DNA, 16 bp, Homo sapiens
gagatgatgatgatga

SEQ ID NO: 2036419 - DNA, 12 bp, Homo sapiens
gagatgcagagg

SEQ ID NO: 2036420 - DNA, 14 bp, Homo sapiens
gagatgcagaggta

SEQ ID NO: 2036421 - DNA, 16 bp, Homo sapiens
gagatgcagaggtaaa

SEQ ID NO: 2036422 - DNA, 20 bp, Homo sapiens
gagatgcctccaccgctgcc

SEQ ID NO: 2036423 - DNA, 22 bp, Homo sapiens
gagatggacccctcccttgctc

SEQ ID NO: 2036424 - DNA, 15 bp, Homo sapiens
gagatggtcagtgtg

SEQ ID NO: 2036425 - DNA, 14 bp, Homo sapiens
gagatgtaattgtt

SEQ ID NO: 2036426 - DNA, 16 bp, Homo sapiens
gagatgtaattgtttt

SEQ ID NO: 2036427 - DNA, 18 bp, Homo sapiens
gagatgtaccatgttaaa

SEQ ID NO: 2036428 - DNA, 21 bp, Homo sapiens
gagatgtaccatgttaaagag

SEQ ID NO: 2036429 - DNA, 17 bp, Homo sapiens
gagatgtttttaaaagt

SEQ ID NO: 2036430 - DNA, 21 bp, Homo sapiens
gagatgtttttaaaagtttca

SEQ ID NO: 2036431 - DNA, 23 bp, Homo sapiens
gagattaattttaacttaaattt

SEQ ID NO: 2036432 - DNA, 15 bp, Homo sapiens
gagattatgttcttt

SEQ ID NO: 2036433 - DNA, 20 bp, Homo sapiens
gagattccctctcctccccc

SEQ ID NO: 2036434 - DNA, 21 bp, Homo sapiens
gagattgcgccactgcactcc

SEQ ID NO: 2036435 - DNA, 22 bp, Homo sapiens
gagatttaccagggatgtagat

SEQ ID NO: 2036436 - DNA, 15 bp, Homo sapiens
gagatttgtatttat

SEQ ID NO: 2036437 - DNA, 16 bp, Homo sapiens
gagatttgtatttata

SEQ ID NO: 2036438 - DNA, 22 bp, Homo sapiens
gagcaaagcctgttcatggcag

SEQ ID NO: 2036439 - DNA, 14 bp, Homo sapiens
gagcaaagtctaaa

SEQ ID NO: 2036440 - DNA, 16 bp, Homo sapiens
gagcaaagtctaaagt

SEQ ID NO: 2036441 - DNA, 19 bp, Homo sapiens
gagcaaagtctaaagttta

SEQ ID NO: 2036442 - DNA, 17 bp, Homo sapiens
gagcaaatgagggaggg

SEQ ID NO: 2036443 - DNA, 18 bp, Homo sapiens
gagcaaatgcttaaaaca

SEQ ID NO: 2036444 - DNA, 20 bp, Homo sapiens
gagcaacagagtgagaccct

SEQ ID NO: 2036445 - DNA, 14 bp, Homo sapiens
gagcaacccctgta

SEQ ID NO: 2036446 - DNA, 18 bp, Homo sapiens
gagcaacccctgtaccca

SEQ ID NO: 2036447 - DNA, 22 bp, Homo sapiens
gagcaacccctgtacccagctc

SEQ ID NO: 2036448 - DNA, 23 bp, Homo sapiens
gagcaacccctgtacccagctcc

SEQ ID NO: 2036449 - DNA, 15 bp, Homo sapiens
gagcaaccgtggccc

SEQ ID NO: 2036450 - DNA, 14 bp, Homo sapiens
gagcaagactctgt

SEQ ID NO: 2036451 - DNA, 18 bp, Homo sapiens
gagcaagagagggcaagt

SEQ ID NO: 2036452 - DNA, 20 bp, Homo sapiens
gagcaagcatttatgtttat

SEQ ID NO: 2036453 - DNA, 14 bp, Homo sapiens
gagcaatgggaggg

SEQ ID NO: 2036454 - DNA, 14 bp, Homo sapiens
gagccttttcttat

SEQ ID NO: 2036455 - DNA, 21 bp, Homo sapiens
gagcgaagggggtcaaaggaa

SEQ ID NO: 2036456 - DNA, 20 bp, Homo sapiens
gagcgccctgcagaccctgc

SEQ ID NO: 2036457 - DNA, 21 bp, Homo sapiens
gagcgccctgcagaccctgcc

SEQ ID NO: 2036458 - DNA, 15 bp, Homo sapiens
gagcgctacccactt

SEQ ID NO: 2036459 - DNA, 18 bp, Homo sapiens
gagcgctttctggaaaag

SEQ ID NO: 2036460 - DNA, 14 bp, Homo sapiens
gagcggctctcctg

SEQ ID NO: 2036461 - DNA, 20 bp, Homo sapiens
gagcgggcctcttccctcag

SEQ ID NO: 2036462 - DNA, 13 bp, Homo sapiens
gagcggggaggtg

SEQ ID NO: 2036463 - DNA, 15 bp, Homo sapiens
gagctacgtatttaa

SEQ ID NO: 2036464 - DNA, 19 bp, Homo sapiens
gagctactctcttgccagc

SEQ ID NO: 2036465 - DNA, 21 bp, Homo sapiens
gagctactctcttgccagcat

SEQ ID NO: 2036466 - DNA, 17 bp, Homo sapiens
gagctagaacctggagg

SEQ ID NO: 2036467 - DNA, 18 bp, Homo sapiens
gagctagaagctggagga

SEQ ID NO: 2036468 - DNA, 20 bp, Homo sapiens
gagctaggagcaaagcctgt

SEQ ID NO: 2036469 - DNA, 18 bp, Homo sapiens
gagctcacaaggcagcaa

SEQ ID NO: 2036470 - DNA, 22 bp, Homo sapiens
gagctcacaaggcagcaaggcc

SEQ ID NO: 2036471 - DNA, 18 bp, Homo sapiens
gagctcagacccccactc

SEQ ID NO: 2036472 - DNA, 21 bp, Homo sapiens
gagctcagacccccactctca

SEQ ID NO: 2036473 - DNA, 17 bp, Homo sapiens
gagctcaggacactaat

SEQ ID NO: 2036474 - DNA, 14 bp, Homo sapiens
gagctcaggctgag

SEQ ID NO: 2036475 - DNA, 23 bp, Homo sapiens
gagctccgctaagacctccccac

SEQ ID NO: 2036476 - DNA, 19 bp, Homo sapiens
gagctcctgtccctaccca

SEQ ID NO: 2036477 - DNA, 20 bp, Homo sapiens
gagctcctgtccctacccac

SEQ ID NO: 2036478 - DNA, 22 bp, Homo sapiens
gagctcctgtccctacccactc

SEQ ID NO: 2036479 - DNA, 23 bp, Homo sapiens
gagctcctgtccctacccactct

SEQ ID NO: 2036480 - DNA, 11 bp, Homo sapiens
gagctctgaga

SEQ ID NO: 2036481 - DNA, 15 bp, Homo sapiens
gagctctgagaggcc

SEQ ID NO: 2036482 - DNA, 17 bp, Homo sapiens
gagctcttcatgtttca

SEQ ID NO: 2036483 - DNA, 20 bp, Homo sapiens
gagctcttcggtttctgagc

SEQ ID NO: 2036484 - DNA, 17 bp, Homo sapiens
gagctgaagcccatgct

SEQ ID NO: 2036485 - DNA, 17 bp, Homo sapiens
gagctgagtcacctcct

SEQ ID NO: 2036486 - DNA, 21 bp, Homo sapiens
gagctgagtcacctcctccac

SEQ ID NO: 2036487 - DNA, 17 bp, Homo sapiens
gagctgatttccaggcc

SEQ ID NO: 2036488 - DNA, 20 bp, Homo sapiens
gagctgccgcaaggccctgt

SEQ ID NO: 2036489 - DNA, 22 bp, Homo sapiens
gagctgccgcaaggccctgtcc

SEQ ID NO: 2036490 - DNA, 15 bp, Homo sapiens
gagctgcctgttcag

SEQ ID NO: 2036491 - DNA, 16 bp, Homo sapiens
gagctgcctgttcagc

SEQ ID NO: 2036492 - DNA, 22 bp, Homo sapiens
gagctgcctgttcagctccagc

SEQ ID NO: 2036493 - DNA, 14 bp, Homo sapiens
gagctgctctgcta

SEQ ID NO: 2036494 - DNA, 16 bp, Homo sapiens
gagctgctctggaaaa

SEQ ID NO: 2036495 - DNA, 17 bp, Homo sapiens
gagctggaaataaacct

SEQ ID NO: 2036496 - DNA, 16 bp, Homo sapiens
gagctggaaggcaggg

SEQ ID NO: 2036497 - DNA, 20 bp, Homo sapiens
gagctggaaggcagggcaga

SEQ ID NO: 2036498 - DNA, 16 bp, Homo sapiens
gagctggctgtcttcc

SEQ ID NO: 2036499 - DNA, 14 bp, Homo sapiens
gagctgggaaacag

SEQ ID NO: 2036500 - DNA, 19 bp, Homo sapiens
gagctgggaagctgtactc

SEQ ID NO: 2036501 - DNA, 23 bp, Homo sapiens
gagctgggaagctgtactcagag

SEQ ID NO: 2036502 - DNA, 18 bp, Homo sapiens
gagctgggaggcatggcc

SEQ ID NO: 2036503 - DNA, 18 bp, Homo sapiens
gagctggggcctggagag

SEQ ID NO: 2036504 - DNA, 19 bp, Homo sapiens
gagctgtatatatatatgt

SEQ ID NO: 2036505 - DNA, 14 bp, Homo sapiens
gagctgtctccagg

SEQ ID NO: 2036506 - DNA, 14 bp, Homo sapiens
gagcttgcaagaag

SEQ ID NO: 2036507 - DNA, 21 bp, Homo sapiens
gagcttgcaagaagcaggaag

SEQ ID NO: 2036508 - DNA, 13 bp, Homo sapiens
gagcttggacagt

SEQ ID NO: 2036509 - DNA, 21 bp, Homo sapiens
gagctttctgtccttttggca

SEQ ID NO: 2036510 - DNA, 20 bp, Homo sapiens
gaggaaaaccaagccgtggc

SEQ ID NO: 2036511 - DNA, 21 bp, Homo sapiens
gaggaaaaccaagccgtggct

SEQ ID NO: 2036512 - DNA, 18 bp, Homo sapiens
gaggaagagagagaccct

SEQ ID NO: 2036513 - DNA, 19 bp, Homo sapiens
gaggaagagcaggcacatg

SEQ ID NO: 2036514 - DNA, 16 bp, Homo sapiens
gaggaagatgaagaga

SEQ ID NO: 2036515 - DNA, 10 bp, Homo sapiens
gaggaaggca

SEQ ID NO: 2036516 - DNA, 13 bp, Homo sapiens
gaggaaggcaaag

SEQ ID NO: 2036517 - DNA, 21 bp, Homo sapiens
gaggaagggccaggagagaga

SEQ ID NO: 2036518 - DNA, 20 bp, Homo sapiens
gaggaatcatgtcaggcctg

SEQ ID NO: 2036519 - DNA, 13 bp, Homo sapiens
gaggacacatgtc

SEQ ID NO: 2036520 - DNA, 17 bp, Homo sapiens
gaggacacgtggcctgc

SEQ ID NO: 2036521 - DNA, 12 bp, Homo sapiens
gaggacagtggg

SEQ ID NO: 2036522 - DNA, 17 bp, Homo sapiens
gaggacatggagagaga

SEQ ID NO: 2036523 - DNA, 21 bp, Homo sapiens
gaggacatgtttttgttttct

SEQ ID NO: 2036524 - DNA, 23 bp, Homo sapiens
gaggaccacagtgggtggcacct

SEQ ID NO: 2036525 - DNA, 15 bp, Homo sapiens
gaggacctgagcctg

SEQ ID NO: 2036526 - DNA, 21 bp, Homo sapiens
gaggacctgagcctgccgagc

SEQ ID NO: 2036527 - DNA, 22 bp, Homo sapiens
gaggacgtcatcggaggctggg

SEQ ID NO: 2036528 - DNA, 16 bp, Homo sapiens
gaggactccgggacca

SEQ ID NO: 2036529 - DNA, 23 bp, Homo sapiens
gaggactccgggaccattgacct

SEQ ID NO: 2036530 - DNA, 15 bp, Homo sapiens
gaggagaccagctca

SEQ ID NO: 2036531 - DNA, 16 bp, Homo sapiens
gaggagaccagctcag

SEQ ID NO: 2036532 - DNA, 14 bp, Homo sapiens
gaggagcagagggc

SEQ ID NO: 2036533 - DNA, 18 bp, Homo sapiens
gaggagctcaggacacta

SEQ ID NO: 2036534 - DNA, 19 bp, Homo sapiens
gaggagcttccagtgcatg

SEQ ID NO: 2036535 - DNA, 21 bp, Homo sapiens
gaggagcttgggggatgacta

SEQ ID NO: 2036536 - DNA, 13 bp, Homo sapiens
gaggaggaaggca

SEQ ID NO: 2036537 - DNA, 11 bp, Homo sapiens
gaggaggagga

SEQ ID NO: 2036538 - DNA, 12 bp, Homo sapiens
gaggaggaggaa

SEQ ID NO: 2036539 - DNA, 16 bp, Homo sapiens
gaggaggaggaggaag

SEQ ID NO: 2036540 - DNA, 20 bp, Homo sapiens
gaggaggcagagaagaaaga

SEQ ID NO: 2036541 - DNA, 19 bp, Homo sapiens
gaggagggatgctgcctga

SEQ ID NO: 2036542 - DNA, 16 bp, Homo sapiens
gaggaggggcacctgc

SEQ ID NO: 2036543 - DNA, 12 bp, Homo sapiens
gaggagggtgcc

SEQ ID NO: 2036544 - DNA, 15 bp, Homo sapiens
gaggaggtggcagcc

SEQ ID NO: 2036545 - DNA, 15 bp, Homo sapiens
gaggagtagctgaga

SEQ ID NO: 2036546 - DNA, 17 bp, Homo sapiens
gaggagtagctgagagg

SEQ ID NO: 2036547 - DNA, 16 bp, Homo sapiens
gaggatcactggagcc

SEQ ID NO: 2036548 - DNA, 17 bp, Homo sapiens
gaggatcactggagccc

SEQ ID NO: 2036549 - DNA, 19 bp, Homo sapiens
gaggatcactggagcccag

SEQ ID NO: 2036550 - DNA, 21 bp, Homo sapiens
gaggatccctccatccggctc

SEQ ID NO: 2036551 - DNA, 16 bp, Homo sapiens
gaggatcctcacagga

SEQ ID NO: 2036552 - DNA, 22 bp, Homo sapiens
gaggatcctcacaggagcagac

SEQ ID NO: 2036553 - DNA, 23 bp, Homo sapiens
gaggatctagcttcatgcctcag

SEQ ID NO: 2036554 - DNA, 17 bp, Homo sapiens
gaggatgccacagcccc

SEQ ID NO: 2036555 - DNA, 20 bp, Homo sapiens
gaggatgccacagccccaca

SEQ ID NO: 2036556 - DNA, 23 bp, Homo sapiens
gaggatgccacagccccacagca

SEQ ID NO: 2036557 - DNA, 13 bp, Homo sapiens
gaggatgttctgg

SEQ ID NO: 2036558 - DNA, 22 bp, Homo sapiens
gaggattgcttgagcccaggag

SEQ ID NO: 2036559 - DNA, 17 bp, Homo sapiens
gaggatttcaagcctgc

SEQ ID NO: 2036560 - DNA, 13 bp, Homo sapiens
gaggattttgagt

SEQ ID NO: 2036561 - DNA, 16 bp, Homo sapiens
gaggcaaacatttctt

SEQ ID NO: 2036562 - DNA, 13 bp, Homo sapiens
gaggcaagagaat

SEQ ID NO: 2036563 - DNA, 13 bp, Homo sapiens
gaggcaagagaca

SEQ ID NO: 2036564 - DNA, 19 bp, Homo sapiens
gaggcaatgtcaggaacag

SEQ ID NO: 2036565 - DNA, 21 bp, Homo sapiens
gaggcaatgtcaggaacagaa

SEQ ID NO: 2036566 - DNA, 23 bp, Homo sapiens
gaggcaatgtcaggaacagaagg

SEQ ID NO: 2036567 - DNA, 20 bp, Homo sapiens
gaggcaccagctctgtggcc

SEQ ID NO: 2036568 - DNA, 21 bp, Homo sapiens
gaggcaccagctctgtggcct

SEQ ID NO: 2036569 - DNA, 15 bp, Homo sapiens
gaggcaccggcgctg

SEQ ID NO: 2036570 - DNA, 14 bp, Homo sapiens
gactcaatgcactg

SEQ ID NO: 2036571 - DNA, 17 bp, Homo sapiens
gactcacaagaagacca

SEQ ID NO: 2036572 - DNA, 22 bp, Homo sapiens
gactcacaagaagaccagactg

SEQ ID NO: 2036573 - DNA, 23 bp, Homo sapiens
gactcaccctcataccatctgct

SEQ ID NO: 2036574 - DNA, 12 bp, Homo sapiens
gactcacctctg

SEQ ID NO: 2036575 - DNA, 15 bp, Homo sapiens
gactcagctccagaa

SEQ ID NO: 2036576 - DNA, 13 bp, Homo sapiens
gactcagggacct

SEQ ID NO: 2036577 - DNA, 17 bp, Homo sapiens
gactcagggccccagca

SEQ ID NO: 2036578 - DNA, 15 bp, Homo sapiens
gactcagtttgtcag

SEQ ID NO: 2036579 - DNA, 12 bp, Homo sapiens
gactcatatatt

SEQ ID NO: 2036580 - DNA, 14 bp, Homo sapiens
gactcattcttctg

SEQ ID NO: 2036581 - DNA, 17 bp, Homo sapiens
gactccagaatctgctg

SEQ ID NO: 2036582 - DNA, 18 bp, Homo sapiens
gactccagaatctgctgt

SEQ ID NO: 2036583 - DNA, 22 bp, Homo sapiens
gactccagaatctgctgttgcc

SEQ ID NO: 2036584 - DNA, 12 bp, Homo sapiens
gactccagccag

SEQ ID NO: 2036585 - DNA, 16 bp, Homo sapiens
gactccagccagcgcc

SEQ ID NO: 2036586 - DNA, 21 bp, Homo sapiens
gactccagccagcgcctccct

SEQ ID NO: 2036587 - DNA, 23 bp, Homo sapiens
gactccagccagcgcctccctcc

SEQ ID NO: 2036588 - DNA, 12 bp, Homo sapiens
gactccagcctg

SEQ ID NO: 2036589 - DNA, 15 bp, Homo sapiens
gactccccaggccag

SEQ ID NO: 2036590 - DNA, 14 bp, Homo sapiens
gaccaagagagaaa

SEQ ID NO: 2036591 - DNA, 21 bp, Homo sapiens
gaccaagttataaatcaatgt

SEQ ID NO: 2036592 - DNA, 17 bp, Homo sapiens
gaccacacctccctgaa

SEQ ID NO: 2036593 - DNA, 11 bp, Homo sapiens
gaccacacgct

SEQ ID NO: 2036594 - DNA, 23 bp, Homo sapiens
gaccacacgctgtctcttgagaa

SEQ ID NO: 2036595 - DNA, 15 bp, Homo sapiens
gaccacactttgaga

SEQ ID NO: 2036596 - DNA, 18 bp, Homo sapiens
gaccacactttgagaacc

SEQ ID NO: 2036597 - DNA, 21 bp, Homo sapiens
gaccacagtgggtggcacctc

SEQ ID NO: 2036598 - DNA, 22 bp, Homo sapiens
gaccacagtgggtggcacctcc

SEQ ID NO: 2036599 - DNA, 14 bp, Homo sapiens
gaccaccagcccca

SEQ ID NO: 2036600 - DNA, 16 bp, Homo sapiens
gaccaccagccccagc

SEQ ID NO: 2036601 - DNA, 19 bp, Homo sapiens
gaccaccagccccagcaag

SEQ ID NO: 2036602 - DNA, 16 bp, Homo sapiens
gaccacctctcaatat

SEQ ID NO: 2036603 - DNA, 16 bp, Homo sapiens
gaccacctgccagcca

SEQ ID NO: 2036604 - DNA, 17 bp, Homo sapiens
gaccacctgccagccat

SEQ ID NO: 2036605 - DNA, 14 bp, Homo sapiens
gaccacctgcccaa

SEQ ID NO: 2036606 - DNA, 14 bp, Homo sapiens
gaccacctgcttct

SEQ ID NO: 2036607 - DNA, 16 bp, Homo sapiens
gaccacctgcttctga

SEQ ID NO: 2036608 - DNA, 21 bp, Homo sapiens
gaccacctgcttctgaactca

SEQ ID NO: 2036609 - DNA, 22 bp, Homo sapiens
gaccacggacgtttccatcagg

SEQ ID NO: 2036610 - DNA, 15 bp, Homo sapiens
gaccacgggcctcag

SEQ ID NO: 2036611 - DNA, 19 bp, Homo sapiens
gaccacgggcctcagtttc

SEQ ID NO: 2036612 - DNA, 21 bp, Homo sapiens
gaccacgggcctcagtttccc

SEQ ID NO: 2036613 - DNA, 23 bp, Homo sapiens
gaccagacaccttgacagggcac

SEQ ID NO: 2036614 - DNA, 18 bp, Homo sapiens
gaccagacctagacctgg

SEQ ID NO: 2036615 - DNA, 19 bp, Homo sapiens
gaccagacctagacctggg

SEQ ID NO: 2036616 - DNA, 20 bp, Homo sapiens
gaccagcctccatgctgcct

SEQ ID NO: 2036617 - DNA, 21 bp, Homo sapiens
gaccagcctccatgctgcctc

SEQ ID NO: 2036618 - DNA, 11 bp, Homo sapiens
gaccagcctgg

SEQ ID NO: 2036619 - DNA, 13 bp, Homo sapiens
gaccagcctggcc

SEQ ID NO: 2036620 - DNA, 12 bp, Homo sapiens
gaccagcctggg

SEQ ID NO: 2036621 - DNA, 23 bp, Homo sapiens
gaccagcctgttggacccgctct

SEQ ID NO: 2036622 - DNA, 22 bp, Homo sapiens
gaccaggactatagcccaggtc

SEQ ID NO: 2036623 - DNA, 16 bp, Homo sapiens
gaccaggcaccaggca

SEQ ID NO: 2036624 - DNA, 23 bp, Homo sapiens
gaccaggcatcctccacaatagc

SEQ ID NO: 2036625 - DNA, 20 bp, Homo sapiens
gaccaggctcacaactgttt

SEQ ID NO: 2036626 - DNA, 22 bp, Homo sapiens
gaccagggatgggggatgggcc

SEQ ID NO: 2036627 - DNA, 22 bp, Homo sapiens
gaccaggggtgatttcagagag

SEQ ID NO: 2036628 - DNA, 15 bp, Homo sapiens
gaccagtactgggaa

SEQ ID NO: 2036629 - DNA, 15 bp, Homo sapiens
gaccagtagacaact

SEQ ID NO: 2036630 - DNA, 17 bp, Homo sapiens
gaccagtcccagagcag

SEQ ID NO: 2036631 - DNA, 17 bp, Homo sapiens
gaccagttctggccagg

SEQ ID NO: 2036632 - DNA, 14 bp, Homo sapiens
gaccagttgggagc

SEQ ID NO: 2036633 - DNA, 17 bp, Homo sapiens
gaccagttgggagcact

SEQ ID NO: 2036634 - DNA, 15 bp, Homo sapiens
gaccataatgttaca

SEQ ID NO: 2036635 - DNA, 20 bp, Homo sapiens
gaccataatgttacattatt

SEQ ID NO: 2036636 - DNA, 13 bp, Homo sapiens
gaccatcctattt

SEQ ID NO: 2036637 - DNA, 14 bp, Homo sapiens
gaccatcctgtcct

SEQ ID NO: 2036638 - DNA, 15 bp, Homo sapiens
gaccatcctgtcctt

SEQ ID NO: 2036639 - DNA, 17 bp, Homo sapiens
gaccattgacctcagct

SEQ ID NO: 2036640 - DNA, 18 bp, Homo sapiens
gaccattgacctcagctg

SEQ ID NO: 2036641 - DNA, 16 bp, Homo sapiens
gaccattggctgcgct

SEQ ID NO: 2036642 - DNA, 19 bp, Homo sapiens
gacccaaaaatgttccctt

SEQ ID NO: 2036643 - DNA, 11 bp, Homo sapiens
gacccaaagac

SEQ ID NO: 2036644 - DNA, 12 bp, Homo sapiens
gacccaaagacc

SEQ ID NO: 2036645 - DNA, 23 bp, Homo sapiens
gacccacatgccatttgtactga

SEQ ID NO: 2036646 - DNA, 18 bp, Homo sapiens
gacccacccatcttcctg

SEQ ID NO: 2036647 - DNA, 21 bp, Homo sapiens
gacccacccatcttcctgctg

SEQ ID NO: 2036648 - DNA, 13 bp, Homo sapiens
gacccactcacac

SEQ ID NO: 2036649 - DNA, 11 bp, Homo sapiens
gacccactgct

SEQ ID NO: 2036650 - DNA, 12 bp, Homo sapiens
gacccactgctt

SEQ ID NO: 2036651 - DNA, 23 bp, Homo sapiens
gacccacttcacacacaggcaac

SEQ ID NO: 2036652 - DNA, 17 bp, Homo sapiens
gacccagacacatcgca

SEQ ID NO: 2036653 - DNA, 13 bp, Homo sapiens
gacccagagtgga

SEQ ID NO: 2036654 - DNA, 20 bp, Homo sapiens
gacccagatcctcacaacca

SEQ ID NO: 2036655 - DNA, 15 bp, Homo sapiens
gacccagcaggaagc

SEQ ID NO: 2036656 - DNA, 23 bp, Homo sapiens
gacccagccccttgagaaacctt

SEQ ID NO: 2036657 - DNA, 18 bp, Homo sapiens
gacccagctactctgtcc

SEQ ID NO: 2036658 - DNA, 23 bp, Homo sapiens
gacccagctactctgtccaggcc

SEQ ID NO: 2036659 - DNA, 13 bp, Homo sapiens
gacccaggccctc

SEQ ID NO: 2036660 - DNA, 18 bp, Homo sapiens
gacccaggccctccatgg

SEQ ID NO: 2036661 - DNA, 18 bp, Homo sapiens
gacccaggccgcctgcca

SEQ ID NO: 2036662 - DNA, 16 bp, Homo sapiens
gaccccaaagagcctg

SEQ ID NO: 2036663 - DNA, 18 bp, Homo sapiens
gaccccaaagagcctgga

SEQ ID NO: 2036664 - DNA, 21 bp, Homo sapiens
gaccccaggatcccagagctt

SEQ ID NO: 2036665 - DNA, 15 bp, Homo sapiens
gaccccagggcacag

SEQ ID NO: 2036666 - DNA, 18 bp, Homo sapiens
gaccccagggcacaggag

SEQ ID NO: 2036667 - DNA, 21 bp, Homo sapiens
gacccccaaccaagtggctcc

SEQ ID NO: 2036668 - DNA, 18 bp, Homo sapiens
gacccccactctcattcc

SEQ ID NO: 2036669 - DNA, 23 bp, Homo sapiens
gacccccactctcattccccagg

SEQ ID NO: 2036670 - DNA, 13 bp, Homo sapiens
gacccctcagtgc

SEQ ID NO: 2036671 - DNA, 21 bp, Homo sapiens
gacccctccatgtgggctagt

SEQ ID NO: 2036672 - DNA, 23 bp, Homo sapiens
gacccctgcaccagcccttccct

SEQ ID NO: 2036673 - DNA, 20 bp, Homo sapiens
gacccctggaccaccagccc

SEQ ID NO: 2036674 - DNA, 12 bp, Homo sapiens
gacccctgtggc

SEQ ID NO: 2036675 - DNA, 18 bp, Homo sapiens
gaccccttcctttcctct

SEQ ID NO: 2036676 - DNA, 22 bp, Homo sapiens
gaccccttcctttcctctgcag

SEQ ID NO: 2036677 - DNA, 21 bp, Homo sapiens
gaccggccctgcccctcttcc

SEQ ID NO: 2036678 - DNA, 13 bp, Homo sapiens
gaccgggggccag

SEQ ID NO: 2036679 - DNA, 15 bp, Homo sapiens
gaccgggggccagac

SEQ ID NO: 2036680 - DNA, 15 bp, Homo sapiens
gaccgggtgggcctg

SEQ ID NO: 2036681 - DNA, 13 bp, Homo sapiens
gaccgtggccctg

SEQ ID NO: 2036682 - DNA, 18 bp, Homo sapiens
gaccgttttcatcctggc

SEQ ID NO: 2036683 - DNA, 22 bp, Homo sapiens
gaccgttttcatcctggcctcc

SEQ ID NO: 2036684 - DNA, 15 bp, Homo sapiens
gacctagacctgggc

SEQ ID NO: 2036685 - DNA, 16 bp, Homo sapiens
gacctagacctgggcc

SEQ ID NO: 2036686 - DNA, 16 bp, Homo sapiens
gacctatacctgtgtt

SEQ ID NO: 2036687 - DNA, 20 bp, Homo sapiens
gacctatacctgtgtttctt

SEQ ID NO: 2036688 - DNA, 22 bp, Homo sapiens
gacctcacagtgacccttccca

SEQ ID NO: 2036689 - DNA, 18 bp, Homo sapiens
gacctcaccggcatgctg

SEQ ID NO: 2036690 - DNA, 13 bp, Homo sapiens
gacctcagcaaat

SEQ ID NO: 2036691 - DNA, 11 bp, Homo sapiens
gacctcagcct

SEQ ID NO: 2036692 - DNA, 12 bp, Homo sapiens
gacctcagcctg

SEQ ID NO: 2036693 - DNA, 15 bp, Homo sapiens
gacctcagctgcaca

SEQ ID NO: 2036694 - DNA, 19 bp, Homo sapiens
gacctcaggtgatccaccc

SEQ ID NO: 2036695 - DNA, 19 bp, Homo sapiens
gacctcatatcttcctcat

SEQ ID NO: 2036696 - DNA, 19 bp, Homo sapiens
gacctccagctttcctgta

SEQ ID NO: 2036697 - DNA, 23 bp, Homo sapiens
gacctcccagccctatggatgtg

SEQ ID NO: 2036698 - DNA, 14 bp, Homo sapiens
gacctccccacccc

SEQ ID NO: 2036699 - DNA, 19 bp, Homo sapiens
gacctccggggagagcaga

SEQ ID NO: 2036700 - DNA, 18 bp, Homo sapiens
gacctgagcctgccgagc

SEQ ID NO: 2036701 - DNA, 13 bp, Homo sapiens
gacctgcaggcca

SEQ ID NO: 2036702 - DNA, 22 bp, Homo sapiens
gacctgcctctcacacacatag

SEQ ID NO: 2036703 - DNA, 12 bp, Homo sapiens
gacctgcctgta

SEQ ID NO: 2036704 - DNA, 13 bp, Homo sapiens
gacctgctgagct

SEQ ID NO: 2036705 - DNA, 19 bp, Homo sapiens
gacctggtttgaatggaga

SEQ ID NO: 2036706 - DNA, 18 bp, Homo sapiens
gacctgtctccctggggt

SEQ ID NO: 2036707 - DNA, 19 bp, Homo sapiens
gaccttcctgccaccagtc

SEQ ID NO: 2036708 - DNA, 15 bp, Homo sapiens
gaccttctaggaagc

SEQ ID NO: 2036709 - DNA, 18 bp, Homo sapiens
gaccttggagagacacag

SEQ ID NO: 2036710 - DNA, 13 bp, Homo sapiens
gaccttgtgatct

SEQ ID NO: 2036711 - DNA, 20 bp, Homo sapiens
gaccttgttgcatgatgtat

SEQ ID NO: 2036712 - DNA, 17 bp, Homo sapiens
gacctttcagctgtgaa

SEQ ID NO: 2036713 - DNA, 21 bp, Homo sapiens
gacctttgtcatctttcttct

SEQ ID NO: 2036714 - DNA, 18 bp, Homo sapiens
gaccttttctctcccata

SEQ ID NO: 2036715 - DNA, 18 bp, Homo sapiens
gacgagggatgggatttc

SEQ ID NO: 2036716 - DNA, 15 bp, Homo sapiens
gacgatctttgaata

SEQ ID NO: 2036717 - DNA, 22 bp, Homo sapiens
gacgcagcagctgggacccctc

SEQ ID NO: 2036718 - DNA, 16 bp, Homo sapiens
gacgcagccctggggg

SEQ ID NO: 2036719 - DNA, 23 bp, Homo sapiens
gacgccactcatttcatctcatt

SEQ ID NO: 2036720 - DNA, 23 bp, Homo sapiens
gacgcccctccctcctctggccc

SEQ ID NO: 2036721 - DNA, 21 bp, Homo sapiens
gacgctgccgctgccgctgca

SEQ ID NO: 2036722 - DNA, 11 bp, Homo sapiens
gacgcttccag

SEQ ID NO: 2036723 - DNA, 15 bp, Homo sapiens
gacgcttccagacca

SEQ ID NO: 2036724 - DNA, 20 bp, Homo sapiens
gacgcttccagaccacctgc

SEQ ID NO: 2036725 - DNA, 17 bp, Homo sapiens
gacggacgtcctgctgg

SEQ ID NO: 2036726 - DNA, 16 bp, Homo sapiens
gacggaggttgcagtg

SEQ ID NO: 2036727 - DNA, 14 bp, Homo sapiens
gacggagtcccacc

SEQ ID NO: 2036728 - DNA, 16 bp, Homo sapiens
gacggcagagacccca

SEQ ID NO: 2036729 - DNA, 17 bp, Homo sapiens
gacggctggacctgcac

SEQ ID NO: 2036730 - DNA, 18 bp, Homo sapiens
gacgggaggcctcagttc

SEQ ID NO: 2036731 - DNA, 16 bp, Homo sapiens
gacggggactggggat

SEQ ID NO: 2036732 - DNA, 17 bp, Homo sapiens
gacggggtttcaccatg

SEQ ID NO: 2036733 - DNA, 18 bp, Homo sapiens
gacggttaacttgtatat

SEQ ID NO: 2036734 - DNA, 20 bp, Homo sapiens
gacggttaacttgtatattc

SEQ ID NO: 2036735 - DNA, 21 bp, Homo sapiens
gacggtttcaaaccaggattt

SEQ ID NO: 2036736 - DNA, 14 bp, Homo sapiens
gacgtcaagtctcc

SEQ ID NO: 2036737 - DNA, 18 bp, Homo sapiens
gacgtcaagtctccttcc

SEQ ID NO: 2036738 - DNA, 18 bp, Homo sapiens
gacgtgaatgtctcagcg

SEQ ID NO: 2036739 - DNA, 19 bp, Homo sapiens
gacgtgaatgtctcagcga

SEQ ID NO: 2036740 - DNA, 13 bp, Homo sapiens
gacgtttccatca

SEQ ID NO: 2036741 - DNA, 23 bp, Homo sapiens
gacgtttttgtgctgtgggcagc

SEQ ID NO: 2036742 - DNA, 18 bp, Homo sapiens
gactaaaaatattataac

SEQ ID NO: 2036743 - DNA, 18 bp, Homo sapiens
gactaactatcaaataga

SEQ ID NO: 2036744 - DNA, 22 bp, Homo sapiens
gactaagccctgtcgagacact

SEQ ID NO: 2036745 - DNA, 17 bp, Homo sapiens
gactaataccttgtgtt

SEQ ID NO: 2036746 - DNA, 20 bp, Homo sapiens
gactaatagagacacagaga

SEQ ID NO: 2036747 - DNA, 21 bp, Homo sapiens
gactaattaaaatctggaaat

SEQ ID NO: 2036748 - DNA, 16 bp, Homo sapiens
gactacagccagaagc

SEQ ID NO: 2036749 - DNA, 16 bp, Homo sapiens
gactactatttgaagc

SEQ ID NO: 2036750 - DNA, 15 bp, Homo sapiens
gactagaacctggag

SEQ ID NO: 2036751 - DNA, 16 bp, Homo sapiens
gactagaacctggagg

SEQ ID NO: 2036752 - DNA, 20 bp, Homo sapiens
gactagaacctggagggctg

SEQ ID NO: 2036753 - DNA, 18 bp, Homo sapiens
gactagagctttctttca

SEQ ID NO: 2036754 - DNA, 15 bp, Homo sapiens
gactagaggcaggga

SEQ ID NO: 2036755 - DNA, 22 bp, Homo sapiens
gactagaggcagggaggggact

SEQ ID NO: 2036756 - DNA, 17 bp, Homo sapiens
gactatagcccaggtcc

SEQ ID NO: 2036757 - DNA, 21 bp, Homo sapiens
gactatatacatgtgtgtata

SEQ ID NO: 2036758 - DNA, 18 bp, Homo sapiens
gactatcaaactgaagcc

SEQ ID NO: 2036759 - DNA, 15 bp, Homo sapiens
gactatcacatacaa

SEQ ID NO: 2036760 - DNA, 20 bp, Homo sapiens
gactatggagcctggcacag

SEQ ID NO: 2036761 - DNA, 15 bp, Homo sapiens
gactattcaaacagt

SEQ ID NO: 2036762 - DNA, 22 bp, Homo sapiens
gactattcaaacagtctcagga

SEQ ID NO: 2036763 - DNA, 16 bp, Homo sapiens
gactattttttaataa

SEQ ID NO: 2036764 - DNA, 18 bp, Homo sapiens
gactattttttaataaaa

SEQ ID NO: 2036765 - DNA, 14 bp, Homo sapiens
gactcaagccccgg

SEQ ID NO: 2036766 - DNA, 15 bp, Homo sapiens
gactcaataaaagaa

SEQ ID NO: 2036767 - DNA, 15 bp, Homo sapiens
gactcaataaaatca

SEQ ID NO: 2036768 - DNA, 17 bp, Homo sapiens
gactcaataaaatcatg

SEQ ID NO: 2036769 - DNA, 19 bp, Homo sapiens
gaattattttgttgtgatt

SEQ ID NO: 2036770 - DNA, 19 bp, Homo sapiens
gaattcagcaccctgggtg

SEQ ID NO: 2036771 - DNA, 11 bp, Homo sapiens
gaattcccagg

SEQ ID NO: 2036772 - DNA, 15 bp, Homo sapiens
gaattcctgaagcca

SEQ ID NO: 2036773 - DNA, 19 bp, Homo sapiens
gaattctaagattgtacat

SEQ ID NO: 2036774 - DNA, 23 bp, Homo sapiens
gaattctaggcatcccaggggac

SEQ ID NO: 2036775 - DNA, 20 bp, Homo sapiens
gaattctctctaaaaataaa

SEQ ID NO: 2036776 - DNA, 18 bp, Homo sapiens
gaattctgctacctcact

SEQ ID NO: 2036777 - DNA, 15 bp, Homo sapiens
gaattgaacccagga

SEQ ID NO: 2036778 - DNA, 16 bp, Homo sapiens
gaattgaacccaggag

SEQ ID NO: 2036779 - DNA, 18 bp, Homo sapiens
gaattgaacccaggaggt

SEQ ID NO: 2036780 - DNA, 22 bp, Homo sapiens
gaattgaagataggagagatac

SEQ ID NO: 2036781 - DNA, 19 bp, Homo sapiens
gaattgaaggagaaaatgc

SEQ ID NO: 2036782 - DNA, 16 bp, Homo sapiens
gaattgagctgcagaa

SEQ ID NO: 2036783 - DNA, 17 bp, Homo sapiens
gaattggcctcagtgta

SEQ ID NO: 2036784 - DNA, 13 bp, Homo sapiens
gaattgggaagct

SEQ ID NO: 2036785 - DNA, 14 bp, Homo sapiens
gaattgtccccagt

SEQ ID NO: 2036786 - DNA, 22 bp, Homo sapiens
gaattgtgcgacttcacaaaat

SEQ ID NO: 2036787 - DNA, 21 bp, Homo sapiens
gaatttaaggagggacaagaa

SEQ ID NO: 2036788 - DNA, 19 bp, Homo sapiens
gaatttcttcactgttgaa

SEQ ID NO: 2036789 - DNA, 12 bp, Homo sapiens
gaatttcttggt

SEQ ID NO: 2036790 - DNA, 18 bp, Homo sapiens
gaatttggatacactctc

SEQ ID NO: 2036791 - DNA, 19 bp, Homo sapiens
gaatttggcctgcactaat

SEQ ID NO: 2036792 - DNA, 20 bp, Homo sapiens
gaatttgtaagcaacttgct

SEQ ID NO: 2036793 - DNA, 22 bp, Homo sapiens
gaattttattttacagagcttg

SEQ ID NO: 2036794 - DNA, 23 bp, Homo sapiens
gaattttctttgtgtagctttgc

SEQ ID NO: 2036795 - DNA, 15 bp, Homo sapiens
gaattttgttgctgt

SEQ ID NO: 2036796 - DNA, 17 bp, Homo sapiens
gaatttttaaacaagta

SEQ ID NO: 2036797 - DNA, 18 bp, Homo sapiens
gaatttttaaacaagtat

SEQ ID NO: 2036798 - DNA, 20 bp, Homo sapiens
gaatttttaatgacttttta

SEQ ID NO: 2036799 - DNA, 16 bp, Homo sapiens
gaatttttcattgata

SEQ ID NO: 2036800 - DNA, 16 bp, Homo sapiens
gacaaaaacagcctca

SEQ ID NO: 2036801 - DNA, 18 bp, Homo sapiens
gacaaaattttataagca

SEQ ID NO: 2036802 - DNA, 20 bp, Homo sapiens
gacaaagaggcctttaacca

SEQ ID NO: 2036803 - DNA, 13 bp, Homo sapiens
gacaaaggagcct

SEQ ID NO: 2036804 - DNA, 15 bp, Homo sapiens
gacaaaggagcctgt

SEQ ID NO: 2036805 - DNA, 16 bp, Homo sapiens
gacaaaggagcctgtg

SEQ ID NO: 2036806 - DNA, 23 bp, Homo sapiens
gacaaatattgttaccatgaaga

SEQ ID NO: 2036807 - DNA, 18 bp, Homo sapiens
gacaacatcccacagtgg

SEQ ID NO: 2036808 - DNA, 16 bp, Homo sapiens
gacaacattttattac

SEQ ID NO: 2036809 - DNA, 12 bp, Homo sapiens
gacaacccagaa

SEQ ID NO: 2036810 - DNA, 14 bp, Homo sapiens
gacaacctgcccct

SEQ ID NO: 2036811 - DNA, 14 bp, Homo sapiens
gacaacctgtgcag

SEQ ID NO: 2036812 - DNA, 17 bp, Homo sapiens
gacaacctttgtgtaat

SEQ ID NO: 2036813 - DNA, 19 bp, Homo sapiens
gacaactggtccactcagg

SEQ ID NO: 2036814 - DNA, 16 bp, Homo sapiens
gacaagaaatccctgt

SEQ ID NO: 2036815 - DNA, 12 bp, Homo sapiens
gacaagaagctg

SEQ ID NO: 2036816 - DNA, 15 bp, Homo sapiens
gacaagaagctgcta

SEQ ID NO: 2036817 - DNA, 15 bp, Homo sapiens
gacaagagctgctgt

SEQ ID NO: 2036818 - DNA, 12 bp, Homo sapiens
gacaagcagagg

SEQ ID NO: 2036819 - DNA, 19 bp, Homo sapiens
gacaagccaacttgtaaat

SEQ ID NO: 2036820 - DNA, 22 bp, Homo sapiens
gacaagccaacttgtaaataca

SEQ ID NO: 2036821 - DNA, 14 bp, Homo sapiens
gacaagccctggca

SEQ ID NO: 2036822 - DNA, 15 bp, Homo sapiens
gacaagccctggcaa

SEQ ID NO: 2036823 - DNA, 19 bp, Homo sapiens
gacaaggattgctactgtc

SEQ ID NO: 2036824 - DNA, 13 bp, Homo sapiens
gacaagggctgac

SEQ ID NO: 2036825 - DNA, 15 bp, Homo sapiens
gacaagggctgacct

SEQ ID NO: 2036826 - DNA, 22 bp, Homo sapiens
gacaagggctgacctgcctctc

SEQ ID NO: 2036827 - DNA, 14 bp, Homo sapiens
gacaagtggagggg

SEQ ID NO: 2036828 - DNA, 13 bp, Homo sapiens
gacaataaaacat

SEQ ID NO: 2036829 - DNA, 13 bp, Homo sapiens
gacaataatttca

SEQ ID NO: 2036830 - DNA, 14 bp, Homo sapiens
gacaatataaactg

SEQ ID NO: 2036831 - DNA, 20 bp, Homo sapiens
gacaatatgattttaaattt

SEQ ID NO: 2036832 - DNA, 14 bp, Homo sapiens
gacaatccactctc

SEQ ID NO: 2036833 - DNA, 13 bp, Homo sapiens
gacaatgccttgg

SEQ ID NO: 2036834 - DNA, 14 bp, Homo sapiens
gacaatgccttggg

SEQ ID NO: 2036835 - DNA, 14 bp, Homo sapiens
gacaatggcagcta

SEQ ID NO: 2036836 - DNA, 22 bp, Homo sapiens
gacaatttatatttaataaaat

SEQ ID NO: 2036837 - DNA, 10 bp, Homo sapiens
gacacacaca

SEQ ID NO: 2036838 - DNA, 15 bp, Homo sapiens
gacacacacacacac

SEQ ID NO: 2036839 - DNA, 14 bp, Homo sapiens
gacacacagcactc

SEQ ID NO: 2036840 - DNA, 18 bp, Homo sapiens
gacacacagctctgtcct

SEQ ID NO: 2036841 - DNA, 22 bp, Homo sapiens
gacacactgtaaacccctgggt

SEQ ID NO: 2036842 - DNA, 14 bp, Homo sapiens
gacacagagatgga

SEQ ID NO: 2036843 - DNA, 22 bp, Homo sapiens
gacacagagtggagccctcagt

SEQ ID NO: 2036844 - DNA, 12 bp, Homo sapiens
gacacagctctt

SEQ ID NO: 2036845 - DNA, 23 bp, Homo sapiens
gacacagctcttctccaggctgt

SEQ ID NO: 2036846 - DNA, 16 bp, Homo sapiens
gacacaggccagcccc

SEQ ID NO: 2036847 - DNA, 18 bp, Homo sapiens
gacacaggccagccccat

SEQ ID NO: 2036848 - DNA, 17 bp, Homo sapiens
gacacaggcccggctcc

SEQ ID NO: 2036849 - DNA, 13 bp, Homo sapiens
gacacaggcctgt

SEQ ID NO: 2036850 - DNA, 13 bp, Homo sapiens
tgcattagaaatt

SEQ ID NO: 2036851 - DNA, 23 bp, Homo sapiens
tgcattagaaattagctgtgtga

SEQ ID NO: 2036852 - DNA, 21 bp, Homo sapiens
tgcattagagcccatttcaat

SEQ ID NO: 2036853 - DNA, 21 bp, Homo sapiens
tgcattattcatatgcttccc

SEQ ID NO: 2036854 - DNA, 20 bp, Homo sapiens
tgcattcacaaggtcaaagt

SEQ ID NO: 2036855 - DNA, 21 bp, Homo sapiens
tgcattccatgattttacaga

SEQ ID NO: 2036856 - DNA, 22 bp, Homo sapiens
tgcattccatgattttacagag

SEQ ID NO: 2036857 - DNA, 23 bp, Homo sapiens
tgcattccatgattttacagaga

SEQ ID NO: 2036858 - DNA, 14 bp, Homo sapiens
tgcattcccagtgg

SEQ ID NO: 2036859 - DNA, 19 bp, Homo sapiens
tgcattccccgctgcccaa

SEQ ID NO: 2036860 - DNA, 17 bp, Homo sapiens
tgcattctgaatgaata

SEQ ID NO: 2036861 - DNA, 15 bp, Homo sapiens
tgcattgaatatatt

SEQ ID NO: 2036862 - DNA, 16 bp, Homo sapiens
tgcattgaatatatta

SEQ ID NO: 2036863 - DNA, 16 bp, Homo sapiens
tgcattgtgtgagctt

SEQ ID NO: 2036864 - DNA, 18 bp, Homo sapiens
tgcattgttattgtggaa

SEQ ID NO: 2036865 - DNA, 15 bp, Homo sapiens
tgcatttaattctga

SEQ ID NO: 2036866 - DNA, 16 bp, Homo sapiens
tgcatttataaatgtg

SEQ ID NO: 2036867 - DNA, 20 bp, Homo sapiens
tgcatttataaatgtgtggt

SEQ ID NO: 2036868 - DNA, 23 bp, Homo sapiens
tgcatttcttgacttcacagcag

SEQ ID NO: 2036869 - DNA, 17 bp, Homo sapiens
tgcatttgagagaagcc

SEQ ID NO: 2036870 - DNA, 22 bp, Homo sapiens
tgcatttgagagaagccacgct

SEQ ID NO: 2036871 - DNA, 23 bp, Homo sapiens
tgcatttgagagaagccacgctg

SEQ ID NO: 2036872 - DNA, 18 bp, Homo sapiens
tgcattttgcagcagtga

SEQ ID NO: 2036873 - DNA, 22 bp, Homo sapiens
tgcatttttgatgggaagaaaa

SEQ ID NO: 2036874 - DNA, 20 bp, Homo sapiens
tgccaaagcaaaagaagtaa

SEQ ID NO: 2036875 - DNA, 23 bp, Homo sapiens
tgccaaattttggccaaagtgtt

SEQ ID NO: 2036876 - DNA, 16 bp, Homo sapiens
tgccaacaccttcttg

SEQ ID NO: 2036877 - DNA, 19 bp, Homo sapiens
tgccaacatacccttcttt

SEQ ID NO: 2036878 - DNA, 18 bp, Homo sapiens
tgccaactaagccctcga

SEQ ID NO: 2036879 - DNA, 17 bp, Homo sapiens
tgccaagtccaggtcct

SEQ ID NO: 2036880 - DNA, 20 bp, Homo sapiens
tgccaagtccaggtcctggt

SEQ ID NO: 2036881 - DNA, 16 bp, Homo sapiens
tgccaatatgtattgt

SEQ ID NO: 2036882 - DNA, 20 bp, Homo sapiens
tgccaatgaggtctgaaatg

SEQ ID NO: 2036883 - DNA, 16 bp, Homo sapiens
tgccacaatgcctctc

SEQ ID NO: 2036884 - DNA, 12 bp, Homo sapiens
tgccacacttca

SEQ ID NO: 2036885 - DNA, 22 bp, Homo sapiens
tgccacacttcaggctcttctc

SEQ ID NO: 2036886 - DNA, 23 bp, Homo sapiens
tgccacacttcaggctcttctcc

SEQ ID NO: 2036887 - DNA, 11 bp, Homo sapiens
tgccacagaga

SEQ ID NO: 2036888 - DNA, 19 bp, Homo sapiens
tgccacagccccacagcac

SEQ ID NO: 2036889 - DNA, 22 bp, Homo sapiens
tgccacagccccacagcaccca

SEQ ID NO: 2036890 - DNA, 12 bp, Homo sapiens
tgccaccaataa

SEQ ID NO: 2036891 - DNA, 17 bp, Homo sapiens
tgccaccaataaaaatc

SEQ ID NO: 2036892 - DNA, 21 bp, Homo sapiens
tgccaccaataaaaatcctac

SEQ ID NO: 2036893 - DNA, 22 bp, Homo sapiens
tgccaccaccagatgagaagtt

SEQ ID NO: 2036894 - DNA, 17 bp, Homo sapiens
tgccaccacgtctgcca

SEQ ID NO: 2036895 - DNA, 22 bp, Homo sapiens
tgccaccacgtctgccaggccc

SEQ ID NO: 2036896 - DNA, 16 bp, Homo sapiens
tgccaccactagagct

SEQ ID NO: 2036897 - DNA, 21 bp, Homo sapiens
tgccacccagcaacacagagc

SEQ ID NO: 2036898 - DNA, 17 bp, Homo sapiens
tgccacccgtaggcagc

SEQ ID NO: 2036899 - DNA, 18 bp, Homo sapiens
tgccaccctctccatgcc

SEQ ID NO: 2036900 - DNA, 13 bp, Homo sapiens
tgccacctcccct

SEQ ID NO: 2036901 - DNA, 11 bp, Homo sapiens
tgccacctgtc

SEQ ID NO: 2036902 - DNA, 14 bp, Homo sapiens
tgccacctgtctgt

SEQ ID NO: 2036903 - DNA, 21 bp, Homo sapiens
tgccacctgttaaaatgtaca

SEQ ID NO: 2036904 - DNA, 15 bp, Homo sapiens
tgccactccctgagc

SEQ ID NO: 2036905 - DNA, 16 bp, Homo sapiens
tgccactcctgcttct

SEQ ID NO: 2036906 - DNA, 12 bp, Homo sapiens
tgccactgacct

SEQ ID NO: 2036907 - DNA, 14 bp, Homo sapiens
tgccactgacctca

SEQ ID NO: 2036908 - DNA, 15 bp, Homo sapiens
tgccactgccaggca

SEQ ID NO: 2036909 - DNA, 18 bp, Homo sapiens
tgccactgcctcttcctc

SEQ ID NO: 2036910 - DNA, 20 bp, Homo sapiens
tgccacttcttaaaggcctg

SEQ ID NO: 2036911 - DNA, 21 bp, Homo sapiens
tgccacttcttaaaggcctgg

SEQ ID NO: 2036912 - DNA, 18 bp, Homo sapiens
tgccacttgacattcctt

SEQ ID NO: 2036913 - DNA, 21 bp, Homo sapiens
tgccactttggcttctcctgt

SEQ ID NO: 2036914 - DNA, 23 bp, Homo sapiens
tgccactttggtacatggccagt

SEQ ID NO: 2036915 - DNA, 12 bp, Homo sapiens
tgccagacatgt

SEQ ID NO: 2036916 - DNA, 22 bp, Homo sapiens
tgccagagcccaagtgccatcc

SEQ ID NO: 2036917 - DNA, 12 bp, Homo sapiens
tgccagagcctg

SEQ ID NO: 2036918 - DNA, 13 bp, Homo sapiens
tgccagagcctgg

SEQ ID NO: 2036919 - DNA, 15 bp, Homo sapiens
tgccagagcctgggg

SEQ ID NO: 2036920 - DNA, 17 bp, Homo sapiens
tgccagagcctggggct

SEQ ID NO: 2036921 - DNA, 19 bp, Homo sapiens
tgccagagcctggggctct

SEQ ID NO: 2036922 - DNA, 15 bp, Homo sapiens
tgccagcacaggggc

SEQ ID NO: 2036923 - DNA, 19 bp, Homo sapiens
tgccagcacaggggcccca

SEQ ID NO: 2036924 - DNA, 22 bp, Homo sapiens
tgccagccagcagccagctctc

SEQ ID NO: 2036925 - DNA, 18 bp, Homo sapiens
tgccagccatcacaaggg

SEQ ID NO: 2036926 - DNA, 21 bp, Homo sapiens
tgccagccgggtacctcagtt

SEQ ID NO: 2036927 - DNA, 20 bp, Homo sapiens
tgccagccgtgatgctcagg

SEQ ID NO: 2036928 - DNA, 12 bp, Homo sapiens
tgccagcctggc

SEQ ID NO: 2036929 - DNA, 13 bp, Homo sapiens
tggcccgcccctc

SEQ ID NO: 2036930 - DNA, 21 bp, Homo sapiens
tggcccgcccctcgctgctgc

SEQ ID NO: 2036931 - DNA, 22 bp, Homo sapiens
tggcccgcccctcgctgctgct

SEQ ID NO: 2036932 - DNA, 18 bp, Homo sapiens
tggccctgcaaaaatata

SEQ ID NO: 2036933 - DNA, 21 bp, Homo sapiens
tggccctgccctctccttcct

SEQ ID NO: 2036934 - DNA, 11 bp, Homo sapiens
tggccctgcct

SEQ ID NO: 2036935 - DNA, 13 bp, Homo sapiens
tggccctgcctca

SEQ ID NO: 2036936 - DNA, 13 bp, Homo sapiens
tggccctggcctg

SEQ ID NO: 2036937 - DNA, 18 bp, Homo sapiens
tggccctggcctgctggg

SEQ ID NO: 2036938 - DNA, 12 bp, Homo sapiens
tggccctggggt

SEQ ID NO: 2036939 - DNA, 19 bp, Homo sapiens
tggccctgtgactatggct

SEQ ID NO: 2036940 - DNA, 20 bp, Homo sapiens
tggcccttcctggacagctg

SEQ ID NO: 2036941 - DNA, 20 bp, Homo sapiens
tggccgacggcggcggccct

SEQ ID NO: 2036942 - DNA, 13 bp, Homo sapiens
tggccgactcagg

SEQ ID NO: 2036943 - DNA, 15 bp, Homo sapiens
tggccgactcaggga

SEQ ID NO: 2036944 - DNA, 21 bp, Homo sapiens
tggccgactcagggacctaag

SEQ ID NO: 2036945 - DNA, 21 bp, Homo sapiens
tggccgcaagcgcagggagga

SEQ ID NO: 2036946 - DNA, 18 bp, Homo sapiens
tggccgccatccgggacg

SEQ ID NO: 2036947 - DNA, 13 bp, Homo sapiens
tggccgcctccag

SEQ ID NO: 2036948 - DNA, 18 bp, Homo sapiens
tggccgggtgcggtggct

SEQ ID NO: 2036949 - DNA, 16 bp, Homo sapiens
tggcctaaaaatgcaa

SEQ ID NO: 2036950 - DNA, 20 bp, Homo sapiens
tggcctagcaggcacaggac

SEQ ID NO: 2036951 - DNA, 13 bp, Homo sapiens
tggcctatgcaca

SEQ ID NO: 2036952 - DNA, 15 bp, Homo sapiens
tggcctatgcacata

SEQ ID NO: 2036953 - DNA, 20 bp, Homo sapiens
tggcctattatattaaaata

SEQ ID NO: 2036954 - DNA, 21 bp, Homo sapiens
tggcctattatattaaaatat

SEQ ID NO: 2036955 - DNA, 18 bp, Homo sapiens
tggcctcaagtgattctc

SEQ ID NO: 2036956 - DNA, 23 bp, Homo sapiens
tggcctcaagtgattctcctgcc

SEQ ID NO: 2036957 - DNA, 19 bp, Homo sapiens
tggcctcacgcccagcctc

SEQ ID NO: 2036958 - DNA, 15 bp, Homo sapiens
tggcctcactggctg

SEQ ID NO: 2036959 - DNA, 19 bp, Homo sapiens
tggcctcactggctggggc

SEQ ID NO: 2036960 - DNA, 23 bp, Homo sapiens
tggcctcactggctggggcagag

SEQ ID NO: 2036961 - DNA, 16 bp, Homo sapiens
tggcctcacttccctg

SEQ ID NO: 2036962 - DNA, 14 bp, Homo sapiens
tggcctcagccctc

SEQ ID NO: 2036963 - DNA, 15 bp, Homo sapiens
tggcctcagccctca

SEQ ID NO: 2036964 - DNA, 16 bp, Homo sapiens
tggcctcagccctcag

SEQ ID NO: 2036965 - DNA, 17 bp, Homo sapiens
tggcctcagccctcaga

SEQ ID NO: 2036966 - DNA, 22 bp, Homo sapiens
tggcctcccaataaagctggac

SEQ ID NO: 2036967 - DNA, 14 bp, Homo sapiens
tggcctcctgcctc

SEQ ID NO: 2036968 - DNA, 17 bp, Homo sapiens
tggcctccttttgctgt

SEQ ID NO: 2036969 - DNA, 15 bp, Homo sapiens
tggcctcgcctgggc

SEQ ID NO: 2036970 - DNA, 23 bp, Homo sapiens
tggcctcgggacacctgccctgc

SEQ ID NO: 2036971 - DNA, 13 bp, Homo sapiens
tggcctctagaac

SEQ ID NO: 2036972 - DNA, 23 bp, Homo sapiens
tggcctctagaacacccactggc

SEQ ID NO: 2036973 - DNA, 16 bp, Homo sapiens
tggcctctggccaggc

SEQ ID NO: 2036974 - DNA, 16 bp, Homo sapiens
tggcctgagctggggc

SEQ ID NO: 2036975 - DNA, 22 bp, Homo sapiens
tggcctgcggccgggctgccct

SEQ ID NO: 2036976 - DNA, 21 bp, Homo sapiens
tggcctgctgggctctccacc

SEQ ID NO: 2036977 - DNA, 12 bp, Homo sapiens
tggcctggctcc

SEQ ID NO: 2036978 - DNA, 11 bp, Homo sapiens
tggcctgggca

SEQ ID NO: 2036979 - DNA, 16 bp, Homo sapiens
tggcctgggcgacaga

SEQ ID NO: 2036980 - DNA, 20 bp, Homo sapiens
tggcctgggtgggcaggaac

SEQ ID NO: 2036981 - DNA, 19 bp, Homo sapiens
tggcctgtggcaggcctag

SEQ ID NO: 2036982 - DNA, 14 bp, Homo sapiens
tggcctgtgtccag

SEQ ID NO: 2036983 - DNA, 17 bp, Homo sapiens
tggcctgtgtccagcag

SEQ ID NO: 2036984 - DNA, 20 bp, Homo sapiens
tggcctgtgtccagcagctg

SEQ ID NO: 2036985 - DNA, 21 bp, Homo sapiens
tggcctgtgtccagcagctgc

SEQ ID NO: 2036986 - DNA, 23 bp, Homo sapiens
tggccttccccttttgcctggct

SEQ ID NO: 2036987 - DNA, 21 bp, Homo sapiens
tggccttgcccgccagcctca

SEQ ID NO: 2036988 - DNA, 14 bp, Homo sapiens
tggccttgttctgt

SEQ ID NO: 2036989 - DNA, 14 bp, Homo sapiens
tggcgcaagcctgt

SEQ ID NO: 2036990 - DNA, 16 bp, Homo sapiens
tggcgcgggaggcacc

SEQ ID NO: 2036991 - DNA, 18 bp, Homo sapiens
tggcgcgggaggcaccag

SEQ ID NO: 2036992 - DNA, 15 bp, Homo sapiens
tggcggctactcagc

SEQ ID NO: 2036993 - DNA, 17 bp, Homo sapiens
tggcggctactcagcag

SEQ ID NO: 2036994 - DNA, 23 bp, Homo sapiens
tggcggctactcagcagccctcc

SEQ ID NO: 2036995 - DNA, 19 bp, Homo sapiens
tggcggcttcctgtccact

SEQ ID NO: 2036996 - DNA, 12 bp, Homo sapiens
tggcggggcagg

SEQ ID NO: 2036997 - DNA, 16 bp, Homo sapiens
tggctaattcaattta

SEQ ID NO: 2036998 - DNA, 17 bp, Homo sapiens
tggctaattcaatttat

SEQ ID NO: 2036999 - DNA, 19 bp, Homo sapiens
tggctactctgtgccagag

SEQ ID NO: 2037000 - DNA, 22 bp, Homo sapiens
tggctactctgtgccagagcct

SEQ ID NO: 2037001 - DNA, 24 bp, Homo sapiens
tggctactctgtgccagagcctgg

SEQ ID NO: 2037002 - DNA, 15 bp, Homo sapiens
tggctataggtgcta

SEQ ID NO: 2037003 - DNA, 23 bp, Homo sapiens
tggctataggtgctacaaaaaca

SEQ ID NO: 2037004 - DNA, 13 bp, Homo sapiens
tggctatcctaga

SEQ ID NO: 2037005 - DNA, 19 bp, Homo sapiens
tggctatcctagagaggct

SEQ ID NO: 2037006 - DNA, 20 bp, Homo sapiens
tggctatcctagagaggctg

SEQ ID NO: 2037007 - DNA, 23 bp, Homo sapiens
tggctatctgcatttataaatgt

SEQ ID NO: 2037008 - DNA, 14 bp, Homo sapiens
tggctatggccacc

SEQ ID NO: 2037009 - DNA, 17 bp, Homo sapiens
tggctatgtttttaatg

SEQ ID NO: 2037010 - DNA, 12 bp, Homo sapiens
tggctattttat

SEQ ID NO: 2037011 - DNA, 18 bp, Homo sapiens
tggctcacccctctcccc

SEQ ID NO: 2037012 - DNA, 23 bp, Homo sapiens
tggctcacgcctataatcccagc

SEQ ID NO: 2037013 - DNA, 13 bp, Homo sapiens
tggctcacgcctg

SEQ ID NO: 2037014 - DNA, 16 bp, Homo sapiens
tggctcaggcaagccc

SEQ ID NO: 2037015 - DNA, 22 bp, Homo sapiens
tggctcaggcagacaagagctg

SEQ ID NO: 2037016 - DNA, 11 bp, Homo sapiens
tggctccagaa

SEQ ID NO: 2037017 - DNA, 22 bp, Homo sapiens
tggctccccacgagtcacctgc

SEQ ID NO: 2037018 - DNA, 12 bp, Homo sapiens
tggctcctccag

SEQ ID NO: 2037019 - DNA, 18 bp, Homo sapiens
tggctcctccttcccctg

SEQ ID NO: 2037020 - DNA, 13 bp, Homo sapiens
tggctcctgccac

SEQ ID NO: 2037021 - DNA, 15 bp, Homo sapiens
tggctcctgccactg

SEQ ID NO: 2037022 - DNA, 17 bp, Homo sapiens
tggctcctgccttgatg

SEQ ID NO: 2037023 - DNA, 23 bp, Homo sapiens
tggctcctgccttgatgaagccc

SEQ ID NO: 2037024 - DNA, 18 bp, Homo sapiens
tggctctcaggggccagt

SEQ ID NO: 2037025 - DNA, 16 bp, Homo sapiens
tggctctccaccttgt

SEQ ID NO: 2037026 - DNA, 17 bp, Homo sapiens
tggctctcccatttcct

SEQ ID NO: 2037027 - DNA, 16 bp, Homo sapiens
tggctctcctgtagct

SEQ ID NO: 2037028 - DNA, 14 bp, Homo sapiens
tggctcttcacctg

SEQ ID NO: 2037029 - DNA, 15 bp, Homo sapiens
tggctgaaaaaggcc

SEQ ID NO: 2037030 - DNA, 18 bp, Homo sapiens
tggctgaaaatcactata

SEQ ID NO: 2037031 - DNA, 22 bp, Homo sapiens
tggctgaaataaaagcctctgg

SEQ ID NO: 2037032 - DNA, 21 bp, Homo sapiens
tggctgaatagcttctccaaa

SEQ ID NO: 2037033 - DNA, 15 bp, Homo sapiens
tggctgacccagtcc

SEQ ID NO: 2037034 - DNA, 16 bp, Homo sapiens
tggctgacccagtccc

SEQ ID NO: 2037035 - DNA, 17 bp, Homo sapiens
tggctgacccagtccct

SEQ ID NO: 2037036 - DNA, 19 bp, Homo sapiens
tggctgacccagtccctgg

SEQ ID NO: 2037037 - DNA, 20 bp, Homo sapiens
tggctgaccccaaagagcct

SEQ ID NO: 2037038 - DNA, 20 bp, Homo sapiens
tggctgaggatttcaagcct

SEQ ID NO: 2037039 - DNA, 23 bp, Homo sapiens
tggctgcaaagggtatcaggtgc

SEQ ID NO: 2037040 - DNA, 20 bp, Homo sapiens
tggctgcaagggccagagtt

SEQ ID NO: 2037041 - DNA, 16 bp, Homo sapiens
tggctgcagagacctt

SEQ ID NO: 2037042 - DNA, 13 bp, Homo sapiens
tggctgccaggcg

SEQ ID NO: 2037043 - DNA, 13 bp, Homo sapiens
tggctgctagcac

SEQ ID NO: 2037044 - DNA, 15 bp, Homo sapiens
tggctgctagcactt

SEQ ID NO: 2037045 - DNA, 20 bp, Homo sapiens
tggggcttgcaagaggaggt

SEQ ID NO: 2037046 - DNA, 16 bp, Homo sapiens
tggggcttgggggctc

SEQ ID NO: 2037047 - DNA, 15 bp, Homo sapiens
tgggggaagccctgg

SEQ ID NO: 2037048 - DNA, 21 bp, Homo sapiens
tgggggacttacatgattcat

SEQ ID NO: 2037049 - DNA, 17 bp, Homo sapiens
tgggggagaggggagac

SEQ ID NO: 2037050 - DNA, 12 bp, Homo sapiens
tgggggagggag

SEQ ID NO: 2037051 - DNA, 18 bp, Homo sapiens
tgggggatgggccagggt

SEQ ID NO: 2037052 - DNA, 13 bp, Homo sapiens
tgggggcagaggg

SEQ ID NO: 2037053 - DNA, 18 bp, Homo sapiens
tgggggcagagggcagag

SEQ ID NO: 2037054 - DNA, 16 bp, Homo sapiens
tgggggcctcagtgcc

SEQ ID NO: 2037055 - DNA, 12 bp, Homo sapiens
tgggggcctggc

SEQ ID NO: 2037056 - DNA, 20 bp, Homo sapiens
tgggggcctggctggctgag

SEQ ID NO: 2037057 - DNA, 17 bp, Homo sapiens
tggggggccgggcaggt

SEQ ID NO: 2037058 - DNA, 20 bp, Homo sapiens
tggggggccgggcaggtcct

SEQ ID NO: 2037059 - DNA, 20 bp, Homo sapiens
tggggggtgatgagggcagc

SEQ ID NO: 2037060 - DNA, 17 bp, Homo sapiens
tgggggtggggagacct

SEQ ID NO: 2037061 - DNA, 15 bp, Homo sapiens
tgggggttctttctt

SEQ ID NO: 2037062 - DNA, 19 bp, Homo sapiens
tgggggttctttcttcctc

SEQ ID NO: 2037063 - DNA, 12 bp, Homo sapiens
tgggggttttta

SEQ ID NO: 2037064 - DNA, 20 bp, Homo sapiens
tggggtacaggtttggggag

SEQ ID NO: 2037065 - DNA, 16 bp, Homo sapiens
tggggtacatttctct

SEQ ID NO: 2037066 - DNA, 14 bp, Homo sapiens
tggggtacccactg

SEQ ID NO: 2037067 - DNA, 17 bp, Homo sapiens
tggggtacccactgctc

SEQ ID NO: 2037068 - DNA, 19 bp, Homo sapiens
tggggtacccactgctctg

SEQ ID NO: 2037069 - DNA, 20 bp, Homo sapiens
tggggtatttaccacagcag

SEQ ID NO: 2037070 - DNA, 14 bp, Homo sapiens
tggggtcagccagg

SEQ ID NO: 2037071 - DNA, 21 bp, Homo sapiens
tgtaacacagctgagagactt

SEQ ID NO: 2037072 - DNA, 23 bp, Homo sapiens
tgtaacacagctgagagactttt

SEQ ID NO: 2037073 - DNA, 18 bp, Homo sapiens
tgtaacaggtctcctctt

SEQ ID NO: 2037074 - DNA, 21 bp, Homo sapiens
tgtaacaggtctcctcttaaa

SEQ ID NO: 2037075 - DNA, 11 bp, Homo sapiens
tgtaactattg

SEQ ID NO: 2037076 - DNA, 17 bp, Homo sapiens
tgtaactgctgagccac

SEQ ID NO: 2037077 - DNA, 12 bp, Homo sapiens
tgtaacttcaaa

SEQ ID NO: 2037078 - DNA, 20 bp, Homo sapiens
tgtaacttttgtaagacaaa

SEQ ID NO: 2037079 - DNA, 18 bp, Homo sapiens
tgtaagcaacttgcttct

SEQ ID NO: 2037080 - DNA, 13 bp, Homo sapiens
tgtaaggaattga

SEQ ID NO: 2037081 - DNA, 18 bp, Homo sapiens
tgtaagggaaactgccag

SEQ ID NO: 2037082 - DNA, 19 bp, Homo sapiens
tgtaagggaaactgccagc

SEQ ID NO: 2037083 - DNA, 17 bp, Homo sapiens
tgtaagggtctgttgta

SEQ ID NO: 2037084 - DNA, 23 bp, Homo sapiens
tgtaagggtctgttgtaaatgac

SEQ ID NO: 2037085 - DNA, 22 bp, Homo sapiens
tgtaaggtcttcttgtgtcctg

SEQ ID NO: 2037086 - DNA, 23 bp, Homo sapiens
tgtaagtaattgcatttctgctc

SEQ ID NO: 2037087 - DNA, 18 bp, Homo sapiens
tgtaagtacccctgataa

SEQ ID NO: 2037088 - DNA, 14 bp, Homo sapiens
tgtaagtcaggagt

SEQ ID NO: 2037089 - DNA, 16 bp, Homo sapiens
tgtaagttgaagcaaa

SEQ ID NO: 2037090 - DNA, 15 bp, Homo sapiens
tgtaagtttattttt

SEQ ID NO: 2037091 - DNA, 11 bp, Homo sapiens
tgtaataaact

SEQ ID NO: 2037092 - DNA, 14 bp, Homo sapiens
tgtaataaactctc

SEQ ID NO: 2037093 - DNA, 13 bp, Homo sapiens
tgtaataagaaag

SEQ ID NO: 2037094 - DNA, 18 bp, Homo sapiens
tgtaatagatgtttgata

SEQ ID NO: 2037095 - DNA, 20 bp, Homo sapiens
tgtaatcaatgtttcttcta

SEQ ID NO: 2037096 - DNA, 22 bp, Homo sapiens
tgtaatcccagcactttgggag

SEQ ID NO: 2037097 - DNA, 20 bp, Homo sapiens
tgtaatcctcagctgacaca

SEQ ID NO: 2037098 - DNA, 22 bp, Homo sapiens
tgtaatcctcagctgacacata

SEQ ID NO: 2037099 - DNA, 12 bp, Homo sapiens
tgtaatcctgta

SEQ ID NO: 2037100 - DNA, 21 bp, Homo sapiens
tgtaatcctgtatattatggt

SEQ ID NO: 2037101 - DNA, 18 bp, Homo sapiens
tgtaatcgttatgtgtgt

SEQ ID NO: 2037102 - DNA, 12 bp, Homo sapiens
tgtaatgcacaa

SEQ ID NO: 2037103 - DNA, 23 bp, Homo sapiens
tgtaatgcacaatttagaaaaca

SEQ ID NO: 2037104 - DNA, 15 bp, Homo sapiens
tgtaatgtatcttat

SEQ ID NO: 2037105 - DNA, 13 bp, Homo sapiens
tgtaatgtcacca

SEQ ID NO: 2037106 - DNA, 15 bp, Homo sapiens
tgtaattaatatctt

SEQ ID NO: 2037107 - DNA, 16 bp, Homo sapiens
tgtaattctaaatgaa

SEQ ID NO: 2037108 - DNA, 14 bp, Homo sapiens
tgtaattgcttaca

SEQ ID NO: 2037109 - DNA, 15 bp, Homo sapiens
tgtaattgcttacat

SEQ ID NO: 2037110 - DNA, 16 bp, Homo sapiens
tgtaattgcttacatt

SEQ ID NO: 2037111 - DNA, 17 bp, Homo sapiens
tgtaattgcttacattt

SEQ ID NO: 2037112 - DNA, 23 bp, Homo sapiens
tgtaattgcttacatttttacaa

SEQ ID NO: 2037113 - DNA, 16 bp, Homo sapiens
tgtaatttataaaatt

SEQ ID NO: 2037114 - DNA, 23 bp, Homo sapiens
tgtaatttctaactccttatgtt

SEQ ID NO: 2037115 - DNA, 16 bp, Homo sapiens
tgtaattttgtttgta

SEQ ID NO: 2037116 - DNA, 22 bp, Homo sapiens
tgtaatttttcagctctctgta

SEQ ID NO: 2037117 - DNA, 16 bp, Homo sapiens
tgtaattttttaaatg

SEQ ID NO: 2037118 - DNA, 21 bp, Homo sapiens
tgtacaaaatcgattggcttt

SEQ ID NO: 2037119 - DNA, 18 bp, Homo sapiens
tgtacaaagatatgctaa

SEQ ID NO: 2037120 - DNA, 12 bp, Homo sapiens
tgtacaaatact

SEQ ID NO: 2037121 - DNA, 19 bp, Homo sapiens
tgtacaatacataactagt

SEQ ID NO: 2037122 - DNA, 19 bp, Homo sapiens
tgtacaattactaaattgt

SEQ ID NO: 2037123 - DNA, 18 bp, Homo sapiens
tgtacagaattctgctac

SEQ ID NO: 2037124 - DNA, 15 bp, Homo sapiens
tgtacagaattttta

SEQ ID NO: 2037125 - DNA, 19 bp, Homo sapiens
tgtacagaatttttaatga

SEQ ID NO: 2037126 - DNA, 17 bp, Homo sapiens
tgtacagacgtatgctt

SEQ ID NO: 2037127 - DNA, 15 bp, Homo sapiens
tgtacagttatacat

SEQ ID NO: 2037128 - DNA, 18 bp, Homo sapiens
tgtacagttatctaagtt

SEQ ID NO: 2037129 - DNA, 14 bp, Homo sapiens
tgtacagttcagtt

SEQ ID NO: 2037130 - DNA, 17 bp, Homo sapiens
tgtacatatggaaatcc

SEQ ID NO: 2037131 - DNA, 21 bp, Homo sapiens
tgtacatatggaaatcctgtt

SEQ ID NO: 2037132 - DNA, 15 bp, Homo sapiens
tgtacatatgtaaaa

SEQ ID NO: 2037133 - DNA, 18 bp, Homo sapiens
tgtacatatgtaaaataa

SEQ ID NO: 2037134 - DNA, 22 bp, Homo sapiens
tgtacatgaagaagctaaatcc

SEQ ID NO: 2037135 - DNA, 19 bp, Homo sapiens
tgtacattccctgcatcca

SEQ ID NO: 2037136 - DNA, 12 bp, Homo sapiens
tgtacattcctg

SEQ ID NO: 2037137 - DNA, 15 bp, Homo sapiens
tgtacattcctgata

SEQ ID NO: 2037138 - DNA, 18 bp, Homo sapiens
tgtacattcctgatactg

SEQ ID NO: 2037139 - DNA, 10 bp, Homo sapiens
tgtacatttc

SEQ ID NO: 2037140 - DNA, 18 bp, Homo sapiens
tgtaccagtgtactgctt

SEQ ID NO: 2037141 - DNA, 20 bp, Homo sapiens
tgtaccagtgtactgctttc

SEQ ID NO: 2037142 - DNA, 22 bp, Homo sapiens
tgtaccagtgtactgctttcaa

SEQ ID NO: 2037143 - DNA, 15 bp, Homo sapiens
tgtaccatcaataaa

SEQ ID NO: 2037144 - DNA, 12 bp, Homo sapiens
tgtaccatgtac

SEQ ID NO: 2037145 - DNA, 14 bp, Homo sapiens
tgtaccatgttaaa

SEQ ID NO: 2037146 - DNA, 16 bp, Homo sapiens
tgtaccatgttaaaga

SEQ ID NO: 2037147 - DNA, 16 bp, Homo sapiens
tgtacccaatttaatt

SEQ ID NO: 2037148 - DNA, 14 bp, Homo sapiens
tgtaccccatccct

SEQ ID NO: 2037149 - DNA, 15 bp, Homo sapiens
tgtaccccatccctt

SEQ ID NO: 2037150 - DNA, 17 bp, Homo sapiens
tgtaccccatcccttcc

SEQ ID NO: 2037151 - DNA, 20 bp, Homo sapiens
tgtacccttccacctcctag

SEQ ID NO: 2037152 - DNA, 19 bp, Homo sapiens
tgtaccgcgtctaccctgg

SEQ ID NO: 2037153 - DNA, 17 bp, Homo sapiens
tgtacctatgtgacaga

SEQ ID NO: 2037154 - DNA, 17 bp, Homo sapiens
tgtacgttatatattgt

SEQ ID NO: 2037155 - DNA, 14 bp, Homo sapiens
tgtactcagagcag

SEQ ID NO: 2037156 - DNA, 12 bp, Homo sapiens
tgtactcctccc

SEQ ID NO: 2037157 - DNA, 20 bp, Homo sapiens
tgtactgaaaaatggtaatt

SEQ ID NO: 2037158 - DNA, 12 bp, Homo sapiens
tgtactgcctgc

SEQ ID NO: 2037159 - DNA, 15 bp, Homo sapiens
tgtactgcctgcttg

SEQ ID NO: 2037160 - DNA, 13 bp, Homo sapiens
tgtactgctttca

SEQ ID NO: 2037161 - DNA, 17 bp, Homo sapiens
tgtactgtatgcagttt

SEQ ID NO: 2037162 - DNA, 17 bp, Homo sapiens
tgtacttattttccaat

SEQ ID NO: 2037163 - DNA, 16 bp, Homo sapiens
tgtacttcctgtgtac

SEQ ID NO: 2037164 - DNA, 15 bp, Homo sapiens
tgtactttttattca

SEQ ID NO: 2037165 - DNA, 16 bp, Homo sapiens
tgtactttttattcaa

SEQ ID NO: 2037166 - DNA, 13 bp, Homo sapiens
tgtagaaatctgt

SEQ ID NO: 2037167 - DNA, 12 bp, Homo sapiens
tgtagaaatgta

SEQ ID NO: 2037168 - DNA, 22 bp, Homo sapiens
tggctggcagctgagagccctg

SEQ ID NO: 2037169 - DNA, 17 bp, Homo sapiens
tggctggcccgtcatgt

SEQ ID NO: 2037170 - DNA, 14 bp, Homo sapiens
tggctggggcagag

SEQ ID NO: 2037171 - DNA, 12 bp, Homo sapiens
tggctgggggcc

SEQ ID NO: 2037172 - DNA, 14 bp, Homo sapiens
tggctgggggcctc

SEQ ID NO: 2037173 - DNA, 15 bp, Homo sapiens
tggctgggggcctca

SEQ ID NO: 2037174 - DNA, 20 bp, Homo sapiens
tggctgggggcctcagtgcc

SEQ ID NO: 2037175 - DNA, 17 bp, Homo sapiens
tggctgggtgttttcaa

SEQ ID NO: 2037176 - DNA, 21 bp, Homo sapiens
tggctgtaaactataaactac

SEQ ID NO: 2037177 - DNA, 17 bp, Homo sapiens
tggctgtaatcagttat

SEQ ID NO: 2037178 - DNA, 13 bp, Homo sapiens
tggctgtattttt

SEQ ID NO: 2037179 - DNA, 22 bp, Homo sapiens
tggctgtcaggacaccagcctg

SEQ ID NO: 2037180 - DNA, 13 bp, Homo sapiens
tggctgtctctgt

SEQ ID NO: 2037181 - DNA, 14 bp, Homo sapiens
tggctgtctctgtc

SEQ ID NO: 2037182 - DNA, 15 bp, Homo sapiens
tggctgtctctgtcc

SEQ ID NO: 2037183 - DNA, 15 bp, Homo sapiens
tggctgtgcctctgc

SEQ ID NO: 2037184 - DNA, 19 bp, Homo sapiens
tggctgtgctctcaccagc

SEQ ID NO: 2037185 - DNA, 21 bp, Homo sapiens
tggctgtggttcctaagcctg

SEQ ID NO: 2037186 - DNA, 14 bp, Homo sapiens
tggctgtgtgacag

SEQ ID NO: 2037187 - DNA, 15 bp, Homo sapiens
tggctgtgtgacaga

SEQ ID NO: 2037188 - DNA, 15 bp, Homo sapiens
tggctgttggctggg

SEQ ID NO: 2037189 - DNA, 16 bp, Homo sapiens
tggctgttggctgggg

SEQ ID NO: 2037190 - DNA, 18 bp, Homo sapiens
tggctgttggctgggggc

SEQ ID NO: 2037191 - DNA, 23 bp, Homo sapiens
tggctgttggctgggggcctcag

SEQ ID NO: 2037192 - DNA, 21 bp, Homo sapiens
tggcttacaaattctacagca

SEQ ID NO: 2037193 - DNA, 20 bp, Homo sapiens
tggcttagttaagtcatcca

SEQ ID NO: 2037194 - DNA, 13 bp, Homo sapiens
tggcttataaatg

SEQ ID NO: 2037195 - DNA, 15 bp, Homo sapiens
tggcttataaatgtg

SEQ ID NO: 2037196 - DNA, 16 bp, Homo sapiens
tggcttatttgtataa

SEQ ID NO: 2037197 - DNA, 18 bp, Homo sapiens
tggcttcccatccccagc

SEQ ID NO: 2037198 - DNA, 20 bp, Homo sapiens
tggcttcccatccccagcga

SEQ ID NO: 2037199 - DNA, 18 bp, Homo sapiens
tgtcaccctccacctctt

SEQ ID NO: 2037200 - DNA, 17 bp, Homo sapiens
tgtcaccctgcagagct

SEQ ID NO: 2037201 - DNA, 13 bp, Homo sapiens
tgtcaccctggcc

SEQ ID NO: 2037202 - DNA, 18 bp, Homo sapiens
tgtcaccctggccccaac

SEQ ID NO: 2037203 - DNA, 18 bp, Homo sapiens
tgtcaccgtggaccttcc

SEQ ID NO: 2037204 - DNA, 12 bp, Homo sapiens
tgtcacctcagc

SEQ ID NO: 2037205 - DNA, 17 bp, Homo sapiens
tgtcacgtgaaatattt

SEQ ID NO: 2037206 - DNA, 22 bp, Homo sapiens
tgtcactactcacagtctcttt

SEQ ID NO: 2037207 - DNA, 23 bp, Homo sapiens
tgtcactggtagaccaaaataaa

SEQ ID NO: 2037208 - DNA, 22 bp, Homo sapiens
tgtcagaattggcctcagtgta

SEQ ID NO: 2037209 - DNA, 23 bp, Homo sapiens
tgtcagagacagaccccttggct

SEQ ID NO: 2037210 - DNA, 16 bp, Homo sapiens
tgtcagagctgggagt

SEQ ID NO: 2037211 - DNA, 20 bp, Homo sapiens
tgtcagagctgttggcctcg

SEQ ID NO: 2037212 - DNA, 16 bp, Homo sapiens
tgtcagagttctgctc

SEQ ID NO: 2037213 - DNA, 15 bp, Homo sapiens
tgtcagccagccgcc

SEQ ID NO: 2037214 - DNA, 16 bp, Homo sapiens
tgtcagccagccgccc

SEQ ID NO: 2037215 - DNA, 19 bp, Homo sapiens
tgtcagccagccgccctgg

SEQ ID NO: 2037216 - DNA, 20 bp, Homo sapiens
tgtcagccagccgccctggg

SEQ ID NO: 2037217 - DNA, 20 bp, Homo sapiens
tgtcagcccaagcagagtga

SEQ ID NO: 2037218 - DNA, 15 bp, Homo sapiens
tgtcagcccacagca

SEQ ID NO: 2037219 - DNA, 16 bp, Homo sapiens
tgtcagcccacagcag

SEQ ID NO: 2037220 - DNA, 22 bp, Homo sapiens
tgtcagccgagccgggcctggg

SEQ ID NO: 2037221 - DNA, 12 bp, Homo sapiens
tgtcagccttgc

SEQ ID NO: 2037222 - DNA, 23 bp, Homo sapiens
tgtcagctactgcggaaaaggaa

SEQ ID NO: 2037223 - DNA, 18 bp, Homo sapiens
tgtcagcttttgcttcat

SEQ ID NO: 2037224 - DNA, 16 bp, Homo sapiens
tgtcaggaacagaagg

SEQ ID NO: 2037225 - DNA, 17 bp, Homo sapiens
tgtcaggacccaggccg

SEQ ID NO: 2037226 - DNA, 14 bp, Homo sapiens
tgtcaggcctgtgt

SEQ ID NO: 2037227 - DNA, 17 bp, Homo sapiens
tgtcaggtggggcagct

SEQ ID NO: 2037228 - DNA, 18 bp, Homo sapiens
tgtcaggtggggcagctt

SEQ ID NO: 2037229 - DNA, 16 bp, Homo sapiens
tgtcagtctggtttat

SEQ ID NO: 2037230 - DNA, 15 bp, Homo sapiens
tgtcatagaaattac

SEQ ID NO: 2037231 - DNA, 19 bp, Homo sapiens
tgtcatatattcatgtaat

SEQ ID NO: 2037232 - DNA, 23 bp, Homo sapiens
tgtcatatattcatgtaataaat

SEQ ID NO: 2037233 - DNA, 14 bp, Homo sapiens
tgtcatcaattaaa

SEQ ID NO: 2037234 - DNA, 17 bp, Homo sapiens
tgtcatcactccctgga

SEQ ID NO: 2037235 - DNA, 15 bp, Homo sapiens
tgtcatcagaagata

SEQ ID NO: 2037236 - DNA, 16 bp, Homo sapiens
tgtcatcagaagataa

SEQ ID NO: 2037237 - DNA, 19 bp, Homo sapiens
tgtcatcagaagataactt

SEQ ID NO: 2037238 - DNA, 18 bp, Homo sapiens
tgtcatcccgctcctgct

SEQ ID NO: 2037239 - DNA, 13 bp, Homo sapiens
tgtcatctgagga

SEQ ID NO: 2037240 - DNA, 15 bp, Homo sapiens
tgtcatctgaggagt

SEQ ID NO: 2037241 - DNA, 19 bp, Homo sapiens
tgtcatgatttcaatgatt

SEQ ID NO: 2037242 - DNA, 20 bp, Homo sapiens
tgtcatgatttcaatgattg

SEQ ID NO: 2037243 - DNA, 17 bp, Homo sapiens
tgtcatggaaaagccca

SEQ ID NO: 2037244 - DNA, 19 bp, Homo sapiens
tgtcatggaaaagcccagt

SEQ ID NO: 2037245 - DNA, 22 bp, Homo sapiens
tgtcatgtacttcctgtgtact

SEQ ID NO: 2037246 - DNA, 18 bp, Homo sapiens
tgtcattaaaataaataa

SEQ ID NO: 2037247 - DNA, 23 bp, Homo sapiens
tgtcattaaatggggctcacaaa

SEQ ID NO: 2037248 - DNA, 14 bp, Homo sapiens
tgtcattaatgtgt

SEQ ID NO: 2037249 - DNA, 16 bp, Homo sapiens
tgtcattcaaatgggt

SEQ ID NO: 2037250 - DNA, 16 bp, Homo sapiens
tgtcattcaagcctgt

SEQ ID NO: 2037251 - DNA, 19 bp, Homo sapiens
tgtcattcaagcctgtgaa

SEQ ID NO: 2037252 - DNA, 20 bp, Homo sapiens
tgtcattcaagcctgtgaat

SEQ ID NO: 2037253 - DNA, 23 bp, Homo sapiens
tgtcattcaagcctgtgaataaa

SEQ ID NO: 2037254 - DNA, 16 bp, Homo sapiens
tgtcattgctgtagga

SEQ ID NO: 2037255 - DNA, 18 bp, Homo sapiens
tgtcattgtccatgccta

SEQ ID NO: 2037256 - DNA, 17 bp, Homo sapiens
tgtcatttcatttccta

SEQ ID NO: 2037257 - DNA, 19 bp, Homo sapiens
tgtcatttgagcagggctc

SEQ ID NO: 2037258 - DNA, 22 bp, Homo sapiens
tgtcattttaaaatctgattta

SEQ ID NO: 2037259 - DNA, 21 bp, Homo sapiens
tgtccaacctaacccctttcc

SEQ ID NO: 2037260 - DNA, 18 bp, Homo sapiens
tgtccaatggctgtaaac

SEQ ID NO: 2037261 - DNA, 18 bp, Homo sapiens
tgtccaattatgcactgg

SEQ ID NO: 2037262 - DNA, 19 bp, Homo sapiens
tgtccacagtctcccattc

SEQ ID NO: 2037263 - DNA, 17 bp, Homo sapiens
tgtccacctcaccaggg

SEQ ID NO: 2037264 - DNA, 16 bp, Homo sapiens
tgtccagaagaatatt

SEQ ID NO: 2037265 - DNA, 20 bp, Homo sapiens
tgtccagaagaatattcagg

SEQ ID NO: 2037266 - DNA, 21 bp, Homo sapiens
tgtccagaagaatattcagga

SEQ ID NO: 2037267 - DNA, 21 bp, Homo sapiens
tgtccaggaaaccctggcttg

SEQ ID NO: 2037268 - DNA, 19 bp, Homo sapiens
tgtccagggccctgagctc

SEQ ID NO: 2037269 - DNA, 14 bp, Homo sapiens
tgtccagtttccaa

SEQ ID NO: 2037270 - DNA, 12 bp, Homo sapiens
tgtccataaagt

SEQ ID NO: 2037271 - DNA, 21 bp, Homo sapiens
tgtccatatcagacctctgat

SEQ ID NO: 2037272 - DNA, 14 bp, Homo sapiens
tgtccatgcctaca

SEQ ID NO: 2037273 - DNA, 18 bp, Homo sapiens
tgtccatgcctacagata

SEQ ID NO: 2037274 - DNA, 15 bp, Homo sapiens
tgtcccaaggagctg

SEQ ID NO: 2037275 - DNA, 16 bp, Homo sapiens
tgtcccaaggagctga

SEQ ID NO: 2037276 - DNA, 22 bp, Homo sapiens
tgtcccaccaactctgcactcc

SEQ ID NO: 2037277 - DNA, 22 bp, Homo sapiens
tgtcccaccgggagcctccccc

SEQ ID NO: 2037278 - DNA, 12 bp, Homo sapiens
tgtcccacctct

SEQ ID NO: 2037279 - DNA, 13 bp, Homo sapiens
tgtcccacctctt

SEQ ID NO: 2037280 - DNA, 23 bp, Homo sapiens
tgtcccagagcttattggccact

SEQ ID NO: 2037281 - DNA, 24 bp, Homo sapiens
tgtcccagaggttatctgcctggc

SEQ ID NO: 2037282 - DNA, 23 bp, Homo sapiens
tgtcccagcagaagagggaggct

SEQ ID NO: 2037283 - DNA, 21 bp, Homo sapiens
tgtcccatttccttggaggcc

SEQ ID NO: 2037284 - DNA, 13 bp, Homo sapiens
tgtccccagggcc

SEQ ID NO: 2037285 - DNA, 14 bp, Homo sapiens
tgtccccagggccc

SEQ ID NO: 2037286 - DNA, 17 bp, Homo sapiens
tgtccccagggcccctc

SEQ ID NO: 2037287 - DNA, 19 bp, Homo sapiens
tgtccccagtttgcagaaa

SEQ ID NO: 2037288 - DNA, 13 bp, Homo sapiens
tgtcccccaaggt

SEQ ID NO: 2037289 - DNA, 14 bp, Homo sapiens
tgtccccctgagat

SEQ ID NO: 2037290 - DNA, 16 bp, Homo sapiens
tgtccccggcctcagc

SEQ ID NO: 2037291 - DNA, 17 bp, Homo sapiens
tgtcccctctcccctca

SEQ ID NO: 2037292 - DNA, 14 bp, Homo sapiens
tgtcccctctgtca

SEQ ID NO: 2037293 - DNA, 14 bp, Homo sapiens
tgtcccctgtccca

SEQ ID NO: 2037294 - DNA, 15 bp, Homo sapiens
tgtcccgccttcctc

SEQ ID NO: 2037295 - DNA, 14 bp, Homo sapiens
tgtccctacccact

SEQ ID NO: 2037296 - DNA, 15 bp, Homo sapiens
tgtccctacccactc

SEQ ID NO: 2037297 - DNA, 20 bp, Homo sapiens
tgtccctaccgagtctcttc

SEQ ID NO: 2037298 - DNA, 19 bp, Homo sapiens
tggaagcatgtaggagaat

SEQ ID NO: 2037299 - DNA, 13 bp, Homo sapiens
tggaagcccccca

SEQ ID NO: 2037300 - DNA, 13 bp, Homo sapiens
tggaagccctcct

SEQ ID NO: 2037301 - DNA, 19 bp, Homo sapiens
tggaagccctccttccacg

SEQ ID NO: 2037302 - DNA, 22 bp, Homo sapiens
tggaagccggccggctgggatc

SEQ ID NO: 2037303 - DNA, 13 bp, Homo sapiens
tggaagctccgct

SEQ ID NO: 2037304 - DNA, 14 bp, Homo sapiens
tggaagctgagcag

SEQ ID NO: 2037305 - DNA, 16 bp, Homo sapiens
tggaagctgtgtcctt

SEQ ID NO: 2037306 - DNA, 17 bp, Homo sapiens
tggaaggcagggacaga

SEQ ID NO: 2037307 - DNA, 15 bp, Homo sapiens
tggaaggcagggcag

SEQ ID NO: 2037308 - DNA, 13 bp, Homo sapiens
tggaaggctggct

SEQ ID NO: 2037309 - DNA, 15 bp, Homo sapiens
tggaaggctggctga

SEQ ID NO: 2037310 - DNA, 22 bp, Homo sapiens
tggaagtcgtttcaggacatgg

SEQ ID NO: 2037311 - DNA, 17 bp, Homo sapiens
tggaagtggcagtgaaa

SEQ ID NO: 2037312 - DNA, 20 bp, Homo sapiens
tggaagtgtgtggaaggcag

SEQ ID NO: 2037313 - DNA, 18 bp, Homo sapiens
tggaataataattttcct

SEQ ID NO: 2037314 - DNA, 23 bp, Homo sapiens
tggaataataattttcctcctaa

SEQ ID NO: 2037315 - DNA, 14 bp, Homo sapiens
tggaatacagtgtt

SEQ ID NO: 2037316 - DNA, 15 bp, Homo sapiens
tggaatacagtgtta

SEQ ID NO: 2037317 - DNA, 23 bp, Homo sapiens
tggaatagaaaagatgagaggca

SEQ ID NO: 2037318 - DNA, 22 bp, Homo sapiens
tggaatataattgttttatctg

SEQ ID NO: 2037319 - DNA, 21 bp, Homo sapiens
tggaatcaaggaatcctgagt

SEQ ID NO: 2037320 - DNA, 19 bp, Homo sapiens
tggaatcaatttcccagaa

SEQ ID NO: 2037321 - DNA, 16 bp, Homo sapiens
tggaatcacctggagg

SEQ ID NO: 2037322 - DNA, 17 bp, Homo sapiens
tggaatcagcttttaat

SEQ ID NO: 2037323 - DNA, 23 bp, Homo sapiens
tggaatcagcttttaataaaatt

SEQ ID NO: 2037324 - DNA, 18 bp, Homo sapiens
tggaatcgatctgtactg

SEQ ID NO: 2037325 - DNA, 13 bp, Homo sapiens
tggaatgaagcat

SEQ ID NO: 2037326 - DNA, 19 bp, Homo sapiens
tggaatgactataaacatt

SEQ ID NO: 2037327 - DNA, 18 bp, Homo sapiens
tggaatgcagggaagagg

SEQ ID NO: 2037328 - DNA, 14 bp, Homo sapiens
tggaatgtaatcaa

SEQ ID NO: 2037329 - DNA, 21 bp, Homo sapiens
tggaatgtggcccctgaacaa

SEQ ID NO: 2037330 - DNA, 23 bp, Homo sapiens
tggaatgtggcccctgaacaaga

SEQ ID NO: 2037331 - DNA, 17 bp, Homo sapiens
tggaattcagcaccctg

SEQ ID NO: 2037332 - DNA, 18 bp, Homo sapiens
tggaattgctgctctctg

SEQ ID NO: 2037333 - DNA, 19 bp, Homo sapiens
tggaattgctgctctctga

SEQ ID NO: 2037334 - DNA, 15 bp, Homo sapiens
tggaatttaattcaa

SEQ ID NO: 2037335 - DNA, 22 bp, Homo sapiens
tggaatttctcccagtcattta

SEQ ID NO: 2037336 - DNA, 13 bp, Homo sapiens
tggacaacccaga

SEQ ID NO: 2037337 - DNA, 16 bp, Homo sapiens
tggacaagaagctgct

SEQ ID NO: 2037338 - DNA, 12 bp, Homo sapiens
tggacacactgt

SEQ ID NO: 2037339 - DNA, 16 bp, Homo sapiens
tggacacagctcttct

SEQ ID NO: 2037340 - DNA, 21 bp, Homo sapiens
tggacacagctcttctccagg

SEQ ID NO: 2037341 - DNA, 20 bp, Homo sapiens
tggacacattttctcctagg

SEQ ID NO: 2037342 - DNA, 20 bp, Homo sapiens
tggacaccaggagtccctgg

SEQ ID NO: 2037343 - DNA, 23 bp, Homo sapiens
tggacaccccttatccaggactc

SEQ ID NO: 2037344 - DNA, 14 bp, Homo sapiens
tggacacctgccct

SEQ ID NO: 2037345 - DNA, 17 bp, Homo sapiens
tggacacctgccctgcc

SEQ ID NO: 2037346 - DNA, 23 bp, Homo sapiens
tggacacctgccctgccctgcca

SEQ ID NO: 2037347 - DNA, 16 bp, Homo sapiens
tggacagaatgatgga

SEQ ID NO: 2037348 - DNA, 14 bp, Homo sapiens
tggacagctgtgcc

SEQ ID NO: 2037349 - DNA, 15 bp, Homo sapiens
tggacagctgtgcct

SEQ ID NO: 2037350 - DNA, 17 bp, Homo sapiens
tggagccaatggagact

SEQ ID NO: 2037351 - DNA, 11 bp, Homo sapiens
tggagccactc

SEQ ID NO: 2037352 - DNA, 18 bp, Homo sapiens
tggagccactcctgtccc

SEQ ID NO: 2037353 - DNA, 18 bp, Homo sapiens
tggagcccgagggcctga

SEQ ID NO: 2037354 - DNA, 15 bp, Homo sapiens
tggagcccgtgcagt

SEQ ID NO: 2037355 - DNA, 18 bp, Homo sapiens
tggagcctcggtggccat

SEQ ID NO: 2037356 - DNA, 21 bp, Homo sapiens
tggagcgcacctgccccctgg

SEQ ID NO: 2037357 - DNA, 17 bp, Homo sapiens
tggagcggctctcctga

SEQ ID NO: 2037358 - DNA, 14 bp, Homo sapiens
tggagctcttggaa

SEQ ID NO: 2037359 - DNA, 13 bp, Homo sapiens
tggagctgctgtt

SEQ ID NO: 2037360 - DNA, 22 bp, Homo sapiens
tggagctttagcttctctgcca

SEQ ID NO: 2037361 - DNA, 21 bp, Homo sapiens
tggaggaaaaccaagccgtgg

SEQ ID NO: 2037362 - DNA, 22 bp, Homo sapiens
tggaggaacagctccctagtgg

SEQ ID NO: 2037363 - DNA, 19 bp, Homo sapiens
tggaggaaggtgctgagct

SEQ ID NO: 2037364 - DNA, 11 bp, Homo sapiens
tggaggacagt

SEQ ID NO: 2037365 - DNA, 14 bp, Homo sapiens
tggaggacctgagc

SEQ ID NO: 2037366 - DNA, 18 bp, Homo sapiens
tggaggacctgagcctgc

SEQ ID NO: 2037367 - DNA, 19 bp, Homo sapiens
tggaggactagaacctgga

SEQ ID NO: 2037368 - DNA, 21 bp, Homo sapiens
tggaggactagaacctggagg

SEQ ID NO: 2037369 - DNA, 14 bp, Homo sapiens
tggaggagaaataa

SEQ ID NO: 2037370 - DNA, 15 bp, Homo sapiens
tggaggagaaataaa

SEQ ID NO: 2037371 - DNA, 14 bp, Homo sapiens
tggaggagaaggac

SEQ ID NO: 2037372 - DNA, 22 bp, Homo sapiens
tggaggagctcaggacactaat

SEQ ID NO: 2037373 - DNA, 17 bp, Homo sapiens
tggaggaggaggaggag

SEQ ID NO: 2037374 - DNA, 18 bp, Homo sapiens
tggaggaggcctgggggc

SEQ ID NO: 2037375 - DNA, 23 bp, Homo sapiens
tggaggaggcctgggggcaggga

SEQ ID NO: 2037376 - DNA, 20 bp, Homo sapiens
tggaggaggtgtcccaagct

SEQ ID NO: 2037377 - DNA, 14 bp, Homo sapiens
tggaggcagggcct

SEQ ID NO: 2037378 - DNA, 22 bp, Homo sapiens
tggaggcagggccttgcccaga

SEQ ID NO: 2037379 - DNA, 14 bp, Homo sapiens
tggaggccaacaaa

SEQ ID NO: 2037380 - DNA, 22 bp, Homo sapiens
tggaggccaccgggacagacct

SEQ ID NO: 2037381 - DNA, 23 bp, Homo sapiens
tggaggccaccgggacagacctg

SEQ ID NO: 2037382 - DNA, 24 bp, Homo sapiens
tggaggccaccgggacagacctgg

SEQ ID NO: 2037383 - DNA, 15 bp, Homo sapiens
tggaggcctgatgct

SEQ ID NO: 2037384 - DNA, 20 bp, Homo sapiens
tggagggatgccacccagca

SEQ ID NO: 2037385 - DNA, 22 bp, Homo sapiens
tggagggcaaggggtttccaca

SEQ ID NO: 2037386 - DNA, 13 bp, Homo sapiens
tggagggcagagt

SEQ ID NO: 2037387 - DNA, 23 bp, Homo sapiens
tggagggctagaacctggagagc

SEQ ID NO: 2037388 - DNA, 21 bp, Homo sapiens
tggagggctagaatctggaga

SEQ ID NO: 2037389 - DNA, 21 bp, Homo sapiens
tggagggctggaatctggaga

SEQ ID NO: 2037390 - DNA, 19 bp, Homo sapiens
tggagggggtgtctggaag

SEQ ID NO: 2037391 - DNA, 21 bp, Homo sapiens
tggagggggtgtctggaagct

SEQ ID NO: 2037392 - DNA, 17 bp, Homo sapiens
tggaggtgaagtccctg

SEQ ID NO: 2037393 - DNA, 23 bp, Homo sapiens
tggaggtgggagacaaggaacca

SEQ ID NO: 2037394 - DNA, 16 bp, Homo sapiens
tggagtataatattca

SEQ ID NO: 2037395 - DNA, 15 bp, Homo sapiens
tggagtctcattctg

SEQ ID NO: 2037396 - DNA, 13 bp, Homo sapiens
tggagtctccagt

SEQ ID NO: 2037397 - DNA, 17 bp, Homo sapiens
tggagtctccagtggtt

SEQ ID NO: 2037398 - DNA, 12 bp, Homo sapiens
tggagtgagcag

SEQ ID NO: 2037399 - DNA, 21 bp, Homo sapiens
tggagtgaggcttccaggctc

SEQ ID NO: 2037400 - DNA, 22 bp, Homo sapiens
tggagtgaggcttccaggctct

SEQ ID NO: 2037401 - DNA, 19 bp, Homo sapiens
tggagtgcagggaggagag

SEQ ID NO: 2037402 - DNA, 12 bp, Homo sapiens
tggagtgcgctc

SEQ ID NO: 2037403 - DNA, 12 bp, Homo sapiens
tggagtgtcacc

SEQ ID NO: 2037404 - DNA, 18 bp, Homo sapiens
tggagtgtgcgtgtgtgc

SEQ ID NO: 2037405 - DNA, 16 bp, Homo sapiens
tggagttcttgtgcca

SEQ ID NO: 2037406 - DNA, 20 bp, Homo sapiens
tggataataactagatctcc

SEQ ID NO: 2037407 - DNA, 18 bp, Homo sapiens
tggataatgctgttgcct

SEQ ID NO: 2037408 - DNA, 22 bp, Homo sapiens
tggatacaaggatcagaatgga

SEQ ID NO: 2037409 - DNA, 20 bp, Homo sapiens
tggataccagatatttgaat

SEQ ID NO: 2037410 - DNA, 16 bp, Homo sapiens
tggatatgtaaaacat

SEQ ID NO: 2037411 - DNA, 21 bp, Homo sapiens
tggatatgtaaaacatttatt

SEQ ID NO: 2037412 - DNA, 19 bp, Homo sapiens
tggatatgttgttaaacac

SEQ ID NO: 2037413 - DNA, 20 bp, Homo sapiens
tggatatgttgttaaacacg

SEQ ID NO: 2037414 - DNA, 17 bp, Homo sapiens
tggatcccaattcattt

SEQ ID NO: 2037415 - DNA, 19 bp, Homo sapiens
tggatctatctgtattttc

SEQ ID NO: 2037416 - DNA, 14 bp, Homo sapiens
tggatctccaagga

SEQ ID NO: 2037417 - DNA, 19 bp, Homo sapiens
tggatctccccactctagg

SEQ ID NO: 2037418 - DNA, 20 bp, Homo sapiens
tggatctgggaccctttcct

SEQ ID NO: 2037419 - DNA, 17 bp, Homo sapiens
tggatcttcagaaggct

SEQ ID NO: 2037420 - DNA, 14 bp, Homo sapiens
tggatgaaattttc

SEQ ID NO: 2037421 - DNA, 18 bp, Homo sapiens
tggatgaaattttctaga

SEQ ID NO: 2037422 - DNA, 19 bp, Homo sapiens
tggatgaagattctcctgt

SEQ ID NO: 2037423 - DNA, 22 bp, Homo sapiens
tggatgaagattctcctgtgct

SEQ ID NO: 2037424 - DNA, 21 bp, Homo sapiens
tggatgcctggtggcagctgc

SEQ ID NO: 2037425 - DNA, 19 bp, Homo sapiens
tggatgctccagggcagcc

SEQ ID NO: 2037426 - DNA, 13 bp, Homo sapiens
tggatgctgggga

SEQ ID NO: 2037427 - DNA, 15 bp, Homo sapiens
tggatggaaggagac

SEQ ID NO: 2037428 - DNA, 15 bp, Homo sapiens
tggatggaggagaaa

SEQ ID NO: 2037429 - DNA, 16 bp, Homo sapiens
tggatggaggagaaat

SEQ ID NO: 2037430 - DNA, 17 bp, Homo sapiens
tggatggatggacagaa

SEQ ID NO: 2037431 - DNA, 15 bp, Homo sapiens
tggatgggaagatgg

SEQ ID NO: 2037432 - DNA, 17 bp, Homo sapiens
tggatggggataagaat

SEQ ID NO: 2037433 - DNA, 16 bp, Homo sapiens
tggatgtgcccacagg

SEQ ID NO: 2037434 - DNA, 18 bp, Homo sapiens
tggatgtgcccacaggga

SEQ ID NO: 2037435 - DNA, 19 bp, Homo sapiens
tggattaatgttttgtaca

SEQ ID NO: 2037436 - DNA, 17 bp, Homo sapiens
tggattaattaaatgca

SEQ ID NO: 2037437 - DNA, 13 bp, Homo sapiens
tggattattcatt

SEQ ID NO: 2037438 - DNA, 17 bp, Homo sapiens
tggattattcatttaaa

SEQ ID NO: 2037439 - DNA, 12 bp, Homo sapiens
tggattccagag

SEQ ID NO: 2037440 - DNA, 16 bp, Homo sapiens
tggattccagcatttg

SEQ ID NO: 2037441 - DNA, 22 bp, Homo sapiens
tggattcctaagcagtgcttgt

SEQ ID NO: 2037442 - DNA, 13 bp, Homo sapiens
tggattgagggta

SEQ ID NO: 2037443 - DNA, 18 bp, Homo sapiens
tggatttacgactgaaga

SEQ ID NO: 2037444 - DNA, 19 bp, Homo sapiens
tggatttacgactgaagaa

SEQ ID NO: 2037445 - DNA, 15 bp, Homo sapiens
tggatttcctatttt

SEQ ID NO: 2037446 - DNA, 14 bp, Homo sapiens
tggatttctttaga

SEQ ID NO: 2037447 - DNA, 13 bp, Homo sapiens
tggatttgaagca

SEQ ID NO: 2037448 - DNA, 18 bp, Homo sapiens
tggattttcccctgaaga

SEQ ID NO: 2037449 - DNA, 14 bp, Homo sapiens
tggatttttacaaa

SEQ ID NO: 2037450 - DNA, 23 bp, Homo sapiens
tggattttttccttcaaagttta

SEQ ID NO: 2037451 - DNA, 12 bp, Homo sapiens
tggcaaatataa

SEQ ID NO: 2037452 - DNA, 12 bp, Homo sapiens
tggcaacagaag

SEQ ID NO: 2037453 - DNA, 21 bp, Homo sapiens
tggcaacagttagctggagct

SEQ ID NO: 2037454 - DNA, 22 bp, Homo sapiens
tggcaaccttgtctctatgcca

SEQ ID NO: 2037455 - DNA, 17 bp, Homo sapiens
tggcaagggggtgtcat

SEQ ID NO: 2037456 - DNA, 15 bp, Homo sapiens
tggcaatatttgttc

SEQ ID NO: 2037457 - DNA, 18 bp, Homo sapiens
tggcaatatttgttctgg

SEQ ID NO: 2037458 - DNA, 13 bp, Homo sapiens
tggcaattttgta

SEQ ID NO: 2037459 - DNA, 23 bp, Homo sapiens
tggcacaatggctaattcccaga

SEQ ID NO: 2037460 - DNA, 18 bp, Homo sapiens
tggcacagcccaaagaag

SEQ ID NO: 2037461 - DNA, 13 bp, Homo sapiens
tggcacaggactg

SEQ ID NO: 2037462 - DNA, 16 bp, Homo sapiens
tggcacagggcagtgg

SEQ ID NO: 2037463 - DNA, 18 bp, Homo sapiens
tggcacagggcagtggga

SEQ ID NO: 2037464 - DNA, 18 bp, Homo sapiens
tggcacagttttctgaga

SEQ ID NO: 2037465 - DNA, 20 bp, Homo sapiens
tggcacagttttctgagaaa

SEQ ID NO: 2037466 - DNA, 18 bp, Homo sapiens
tggcaccactgcactcca

SEQ ID NO: 2037467 - DNA, 21 bp, Homo sapiens
tggcaccactgcactccagcc

SEQ ID NO: 2037468 - DNA, 23 bp, Homo sapiens
tggcaccagaggctgcagaaggc

SEQ ID NO: 2037469 - DNA, 19 bp, Homo sapiens
tggcaccagatgcaacctc

SEQ ID NO: 2037470 - DNA, 12 bp, Homo sapiens
tggcaccagccc

SEQ ID NO: 2037471 - DNA, 16 bp, Homo sapiens
tggcaccagccccctg

SEQ ID NO: 2037472 - DNA, 18 bp, Homo sapiens
tggcaccagccccctgga

SEQ ID NO: 2037473 - DNA, 20 bp, Homo sapiens
tggcaccagccccctggatg

SEQ ID NO: 2037474 - DNA, 16 bp, Homo sapiens
tggcacccggcccctg

SEQ ID NO: 2037475 - DNA, 18 bp, Homo sapiens
tggcacccggcccctgct

SEQ ID NO: 2037476 - DNA, 20 bp, Homo sapiens
tggcacccggcccctgctgg

SEQ ID NO: 2037477 - DNA, 21 bp, Homo sapiens
tggcacccggcccctgctggt

SEQ ID NO: 2037478 - DNA, 12 bp, Homo sapiens
tggcacctccta

SEQ ID NO: 2037479 - DNA, 15 bp, Homo sapiens
tggcacctcctgaga

SEQ ID NO: 2037480 - DNA, 18 bp, Homo sapiens
tggcacctcctgagaagg

SEQ ID NO: 2037481 - DNA, 19 bp, Homo sapiens
tggcacggtggctcaggcc

SEQ ID NO: 2037482 - DNA, 22 bp, Homo sapiens
tggcactccctaaccaaatgct

SEQ ID NO: 2037483 - DNA, 23 bp, Homo sapiens
tggcactgcttgaggaggggcac

SEQ ID NO: 2037484 - DNA, 23 bp, Homo sapiens
tggcacttagcccaagaggtctg

SEQ ID NO: 2037485 - DNA, 24 bp, Homo sapiens
tggcagaaaagaggagaccctgga

SEQ ID NO: 2037486 - DNA, 20 bp, Homo sapiens
tggcagaataatctttgggt

SEQ ID NO: 2037487 - DNA, 22 bp, Homo sapiens
tggcagaatggggtgcatgaag

SEQ ID NO: 2037488 - DNA, 18 bp, Homo sapiens
tggcagaccatctccagc

SEQ ID NO: 2037489 - DNA, 14 bp, Homo sapiens
tggcagagaaggcc

SEQ ID NO: 2037490 - DNA, 16 bp, Homo sapiens
tggcagagaaggcctc

SEQ ID NO: 2037491 - DNA, 20 bp, Homo sapiens
tggcagagcccccaaggact

SEQ ID NO: 2037492 - DNA, 15 bp, Homo sapiens
tggcagatgtaggag

SEQ ID NO: 2037493 - DNA, 22 bp, Homo sapiens
tggcagatttagtgaaagctag

SEQ ID NO: 2037494 - DNA, 22 bp, Homo sapiens
tggcagcagttccatgaagaca

SEQ ID NO: 2037495 - DNA, 11 bp, Homo sapiens
tggcagccaca

SEQ ID NO: 2037496 - DNA, 11 bp, Homo sapiens
tggcagccctg

SEQ ID NO: 2037497 - DNA, 19 bp, Homo sapiens
tggcagccgtgccttcagc

SEQ ID NO: 2037498 - DNA, 15 bp, Homo sapiens
tggcagctagactgg

SEQ ID NO: 2037499 - DNA, 16 bp, Homo sapiens
tggcagctagactgga

SEQ ID NO: 2037500 - DNA, 17 bp, Homo sapiens
tggcagctagactggag

SEQ ID NO: 2037501 - DNA, 16 bp, Homo sapiens
tggcagctcctctcct

SEQ ID NO: 2037502 - DNA, 16 bp, Homo sapiens
tggcagctgagagccc

SEQ ID NO: 2037503 - DNA, 17 bp, Homo sapiens
tggcagctgagagccct

SEQ ID NO: 2037504 - DNA, 17 bp, Homo sapiens
tggcagctgcggtccac

SEQ ID NO: 2037505 - DNA, 14 bp, Homo sapiens
tggcagctgggcag

SEQ ID NO: 2037506 - DNA, 18 bp, Homo sapiens
tggcagctgtcattcagg

SEQ ID NO: 2037507 - DNA, 12 bp, Homo sapiens
tggcaggacaca

SEQ ID NO: 2037508 - DNA, 19 bp, Homo sapiens
tggcaggacacatcccggc

SEQ ID NO: 2037509 - DNA, 19 bp, Homo sapiens
tggcaggcacacagcagcc

SEQ ID NO: 2037510 - DNA, 21 bp, Homo sapiens
tggcaggccgaggcaggtgga

SEQ ID NO: 2037511 - DNA, 18 bp, Homo sapiens
tggcaggtgcagatgggc

SEQ ID NO: 2037512 - DNA, 21 bp, Homo sapiens
tggcagtattccatgggatgt

SEQ ID NO: 2037513 - DNA, 20 bp, Homo sapiens
tggcagtgctgattcagcct

SEQ ID NO: 2037514 - DNA, 14 bp, Homo sapiens
tggcagtgggagct

SEQ ID NO: 2037515 - DNA, 16 bp, Homo sapiens
tggcagtgggagctgc

SEQ ID NO: 2037516 - DNA, 19 bp, Homo sapiens
tggcagtgggagctgcctg

SEQ ID NO: 2037517 - DNA, 14 bp, Homo sapiens
tggcagtgtgtcac

SEQ ID NO: 2037518 - DNA, 22 bp, Homo sapiens
tggcagtgtgtcacactgagct

SEQ ID NO: 2037519 - DNA, 22 bp, Homo sapiens
tggcatacgcctgtagtcctag

SEQ ID NO: 2037520 - DNA, 15 bp, Homo sapiens
tggcatatttatatt

SEQ ID NO: 2037521 - DNA, 20 bp, Homo sapiens
tggcatcacagggcagagcc

SEQ ID NO: 2037522 - DNA, 19 bp, Homo sapiens
tggcatgaccatcctgtcc

SEQ ID NO: 2037523 - DNA, 19 bp, Homo sapiens
tggcatgatttatatatgg

SEQ ID NO: 2037524 - DNA, 20 bp, Homo sapiens
tggcatgatttatatatggc

SEQ ID NO: 2037525 - DNA, 20 bp, Homo sapiens
tggcatgcttaaatattgaa

SEQ ID NO: 2037526 - DNA, 23 bp, Homo sapiens
tggcatgtcagagccaggctctg

SEQ ID NO: 2037527 - DNA, 16 bp, Homo sapiens
tggcatgtggagacac

SEQ ID NO: 2037528 - DNA, 17 bp, Homo sapiens
tggcattaattattaat

SEQ ID NO: 2037529 - DNA, 17 bp, Homo sapiens
tggcattttcctcgcct

SEQ ID NO: 2037530 - DNA, 13 bp, Homo sapiens
tggccaagctgag

SEQ ID NO: 2037531 - DNA, 22 bp, Homo sapiens
tggccaagctgaggtgcccagg

SEQ ID NO: 2037532 - DNA, 18 bp, Homo sapiens
tggccacccaacagcacc

SEQ ID NO: 2037533 - DNA, 20 bp, Homo sapiens
tggccaccccgtgccacccg

SEQ ID NO: 2037534 - DNA, 17 bp, Homo sapiens
tggccactccagacccc

SEQ ID NO: 2037535 - DNA, 22 bp, Homo sapiens
tggccactccagacccctggct

SEQ ID NO: 2037536 - DNA, 20 bp, Homo sapiens
tggccactgggtctcactcc

SEQ ID NO: 2037537 - DNA, 23 bp, Homo sapiens
tggccactgggtctcactcctga

SEQ ID NO: 2037538 - DNA, 18 bp, Homo sapiens
tggccagagagggcccag

SEQ ID NO: 2037539 - DNA, 12 bp, Homo sapiens
tggccagagctg

SEQ ID NO: 2037540 - DNA, 20 bp, Homo sapiens
tggccagagctggaaggcag

SEQ ID NO: 2037541 - DNA, 14 bp, Homo sapiens
tggccagagctggg

SEQ ID NO: 2037542 - DNA, 20 bp, Homo sapiens
tggccagagctgggaggcat

SEQ ID NO: 2037543 - DNA, 23 bp, Homo sapiens
tggccagagctgggaggcatggc

SEQ ID NO: 2037544 - DNA, 19 bp, Homo sapiens
tggccagatgcaccagccc

SEQ ID NO: 2037545 - DNA, 15 bp, Homo sapiens
tggccaggagctgga

SEQ ID NO: 2037546 - DNA, 21 bp, Homo sapiens
tggccaggaggttggtgactg

SEQ ID NO: 2037547 - DNA, 20 bp, Homo sapiens
tggccaggctggtctcgaac

SEQ ID NO: 2037548 - DNA, 18 bp, Homo sapiens
tggccagggtgagagctg

SEQ ID NO: 2037549 - DNA, 11 bp, Homo sapiens
tggccaggtgg

SEQ ID NO: 2037550 - DNA, 22 bp, Homo sapiens
tggccagtcctagagctcctgt

SEQ ID NO: 2037551 - DNA, 16 bp, Homo sapiens
tggccagtgtgatccc

SEQ ID NO: 2037552 - DNA, 12 bp, Homo sapiens
tggccatccctg

SEQ ID NO: 2037553 - DNA, 17 bp, Homo sapiens
tggccatccctgggccc

SEQ ID NO: 2037554 - DNA, 19 bp, Homo sapiens
tggccatccctgggcccct

SEQ ID NO: 2037555 - DNA, 20 bp, Homo sapiens
tggccatccctgggcccctc

SEQ ID NO: 2037556 - DNA, 21 bp, Homo sapiens
tggccatggaataaaccattt

SEQ ID NO: 2037557 - DNA, 20 bp, Homo sapiens
tggccatgggctgagcaggc

SEQ ID NO: 2037558 - DNA, 14 bp, Homo sapiens
tggccatttgcttt

SEQ ID NO: 2037559 - DNA, 15 bp, Homo sapiens
tggccatttgctttt

SEQ ID NO: 2037560 - DNA, 16 bp, Homo sapiens
tggccattttcttgcc

SEQ ID NO: 2037561 - DNA, 22 bp, Homo sapiens
tggccattttcttgcctgaggc

SEQ ID NO: 2037562 - DNA, 19 bp, Homo sapiens
tggcccaagcctggtctcc

SEQ ID NO: 2037563 - DNA, 13 bp, Homo sapiens
tggcccaatgcct

SEQ ID NO: 2037564 - DNA, 18 bp, Homo sapiens
tggcccagaattgcattc

SEQ ID NO: 2037565 - DNA, 22 bp, Homo sapiens
tggcccatagaaacatgacact

SEQ ID NO: 2037566 - DNA, 14 bp, Homo sapiens
tggccccagggttg

SEQ ID NO: 2037567 - DNA, 19 bp, Homo sapiens
tggccccatgtctctcaga

SEQ ID NO: 2037568 - DNA, 21 bp, Homo sapiens
tggccccatgtctctcagaat

SEQ ID NO: 2037569 - DNA, 16 bp, Homo sapiens
tggcccccctccaggc

SEQ ID NO: 2037570 - DNA, 23 bp, Homo sapiens
tggcccccctccaggcatgctgg

SEQ ID NO: 2037571 - DNA, 15 bp, Homo sapiens
tggccccctgtgcca

SEQ ID NO: 2037572 - DNA, 24 bp, Homo sapiens
tggccccctgtgccagctcaggtg

SEQ ID NO: 2037573 - DNA, 21 bp, Homo sapiens
tggccccgggctctggccacc

SEQ ID NO: 2037574 - DNA, 22 bp, Homo sapiens
tggccccgggctctggccaccc

SEQ ID NO: 2037575 - DNA, 19 bp, Homo sapiens
tggcccctcacctgggcct

SEQ ID NO: 2037576 - DNA, 14 bp, Homo sapiens
tggcccctgaacaa

SEQ ID NO: 2037577 - DNA, 15 bp, Homo sapiens
tggcccctgtgtgag

SEQ ID NO: 2037578 - DNA, 16 bp, Homo sapiens
tggcccgacagcctgg

SEQ ID NO: 2037579 - DNA, 17 bp, Homo sapiens
tggcccgacagcctggc

SEQ ID NO: 2037580 - DNA, 18 bp, Homo sapiens
tggcccgacagcctggca

SEQ ID NO: 2037581 - DNA, 21 bp, Homo sapiens
tgccatctccaccctgagcct

SEQ ID NO: 2037582 - DNA, 15 bp, Homo sapiens
tgccatctgttttca

SEQ ID NO: 2037583 - DNA, 16 bp, Homo sapiens
tgccatctgttttcaa

SEQ ID NO: 2037584 - DNA, 22 bp, Homo sapiens
tgccatgaggcctttccccagt

SEQ ID NO: 2037585 - DNA, 17 bp, Homo sapiens
tgccatgatctgtattt

SEQ ID NO: 2037586 - DNA, 16 bp, Homo sapiens
tgccatgggcctgctg

SEQ ID NO: 2037587 - DNA, 22 bp, Homo sapiens
tgccatgtagaccccttgaaga

SEQ ID NO: 2037588 - DNA, 14 bp, Homo sapiens
tgccatgtgccagg

SEQ ID NO: 2037589 - DNA, 19 bp, Homo sapiens
tgccatgttggccaggctg

SEQ ID NO: 2037590 - DNA, 20 bp, Homo sapiens
tgccatgttggccaggctgg

SEQ ID NO: 2037591 - DNA, 21 bp, Homo sapiens
tgccatgtttagattccagga

SEQ ID NO: 2037592 - DNA, 12 bp, Homo sapiens
tgccattcccac

SEQ ID NO: 2037593 - DNA, 14 bp, Homo sapiens
tgccattcccagcg

SEQ ID NO: 2037594 - DNA, 22 bp, Homo sapiens
tgccatttaaagcttattaaaa

SEQ ID NO: 2037595 - DNA, 16 bp, Homo sapiens
tgccatttcctgtctg

SEQ ID NO: 2037596 - DNA, 15 bp, Homo sapiens
tgccatttgtactga

SEQ ID NO: 2037597 - DNA, 14 bp, Homo sapiens
tgccattttaataa

SEQ ID NO: 2037598 - DNA, 17 bp, Homo sapiens
tgccattttaataaaat

SEQ ID NO: 2037599 - DNA, 18 bp, Homo sapiens
tgccattttaataaaatg

SEQ ID NO: 2037600 - DNA, 23 bp, Homo sapiens
tgcccaacctgctctcctcttgc

SEQ ID NO: 2037601 - DNA, 16 bp, Homo sapiens
tgcccaatgctttggg

SEQ ID NO: 2037602 - DNA, 20 bp, Homo sapiens
tgcccaatgctttgggaggc

SEQ ID NO: 2037603 - DNA, 20 bp, Homo sapiens
tgcccacaggatcagtctga

SEQ ID NO: 2037604 - DNA, 12 bp, Homo sapiens
tgcccacaggga

SEQ ID NO: 2037605 - DNA, 18 bp, Homo sapiens
tgcccacttcagcccagc

SEQ ID NO: 2037606 - DNA, 16 bp, Homo sapiens
tgcccagaattcccag

SEQ ID NO: 2037607 - DNA, 22 bp, Homo sapiens
tgcccagaattcccagctgtct

SEQ ID NO: 2037608 - DNA, 12 bp, Homo sapiens
tgcccagagatg

SEQ ID NO: 2037609 - DNA, 17 bp, Homo sapiens
tgcccagagatgcctcc

SEQ ID NO: 2037610 - DNA, 18 bp, Homo sapiens
tgcccagagatgcctcca

SEQ ID NO: 2037611 - DNA, 19 bp, Homo sapiens
tgcccagagatgcctccac

SEQ ID NO: 2037612 - DNA, 22 bp, Homo sapiens
tgcccagagatgcctccaccgc

SEQ ID NO: 2037613 - DNA, 18 bp, Homo sapiens
tgcccagagggcccaggc

SEQ ID NO: 2037614 - DNA, 23 bp, Homo sapiens
tgcccagagggcccaggcaggcc

SEQ ID NO: 2037615 - DNA, 11 bp, Homo sapiens
tgcccaggaga

SEQ ID NO: 2037616 - DNA, 14 bp, Homo sapiens
tgcccaggcaggtc

SEQ ID NO: 2037617 - DNA, 15 bp, Homo sapiens
tgcccaggcaggtct

SEQ ID NO: 2037618 - DNA, 16 bp, Homo sapiens
tgcccaggcaggtctt

SEQ ID NO: 2037619 - DNA, 17 bp, Homo sapiens
tgcccaggcaggtcttg

SEQ ID NO: 2037620 - DNA, 17 bp, Homo sapiens
tgcccaggcctgcctgt

SEQ ID NO: 2037621 - DNA, 13 bp, Homo sapiens
tgcccaggctggc

SEQ ID NO: 2037622 - DNA, 23 bp, Homo sapiens
tgcccaggctggcgtgcagtggt

SEQ ID NO: 2037623 - DNA, 18 bp, Homo sapiens
tgcccagggctcagcctg

SEQ ID NO: 2037624 - DNA, 23 bp, Homo sapiens
tgcccagggctcagcctggtggg

SEQ ID NO: 2037625 - DNA, 20 bp, Homo sapiens
tgcccaggggcccacaggga

SEQ ID NO: 2037626 - DNA, 21 bp, Homo sapiens
tgcccagtcgatatctcactt

SEQ ID NO: 2037627 - DNA, 20 bp, Homo sapiens
tgcccatacccctgcctggg

SEQ ID NO: 2037628 - DNA, 21 bp, Homo sapiens
tgcccatttcgaagatataca

SEQ ID NO: 2037629 - DNA, 16 bp, Homo sapiens
tgccccaactccttcc

SEQ ID NO: 2037630 - DNA, 20 bp, Homo sapiens
tgccccaactccttccagct

SEQ ID NO: 2037631 - DNA, 22 bp, Homo sapiens
tgccccaactccttccagctag

SEQ ID NO: 2037632 - DNA, 14 bp, Homo sapiens
tgccccaagcagcc

SEQ ID NO: 2037633 - DNA, 16 bp, Homo sapiens
tgccccaagcagccag

SEQ ID NO: 2037634 - DNA, 18 bp, Homo sapiens
tgccccaagcagccagcc

SEQ ID NO: 2037635 - DNA, 17 bp, Homo sapiens
tgccccaaggctgctca

SEQ ID NO: 2037636 - DNA, 11 bp, Homo sapiens
tgccccaaggg

SEQ ID NO: 2037637 - DNA, 12 bp, Homo sapiens
tgccccaagggg

SEQ ID NO: 2037638 - DNA, 15 bp, Homo sapiens
tgccccaccagccac

SEQ ID NO: 2037639 - DNA, 16 bp, Homo sapiens
tgccccagaggcctct

SEQ ID NO: 2037640 - DNA, 13 bp, Homo sapiens
tgccccagccccg

SEQ ID NO: 2037641 - DNA, 20 bp, Homo sapiens
tgccccagctttatctgtca

SEQ ID NO: 2037642 - DNA, 15 bp, Homo sapiens
tgccccagggctccc

SEQ ID NO: 2037643 - DNA, 13 bp, Homo sapiens
tgccccatcctgg

SEQ ID NO: 2037644 - DNA, 14 bp, Homo sapiens
tgccccatcctggg

SEQ ID NO: 2037645 - DNA, 16 bp, Homo sapiens
tgccccatcctgggcc

SEQ ID NO: 2037646 - DNA, 17 bp, Homo sapiens
tgccccatcctgggcct

SEQ ID NO: 2037647 - DNA, 17 bp, Homo sapiens
tgccccatctcctccca

SEQ ID NO: 2037648 - DNA, 16 bp, Homo sapiens
tgcccccacccagtcc

SEQ ID NO: 2037649 - DNA, 17 bp, Homo sapiens
tgcccccagcactcctc

SEQ ID NO: 2037650 - DNA, 13 bp, Homo sapiens
tgcccccatccca

SEQ ID NO: 2037651 - DNA, 16 bp, Homo sapiens
tgcccccatcccacat

SEQ ID NO: 2037652 - DNA, 14 bp, Homo sapiens
tgcccccatccctc

SEQ ID NO: 2037653 - DNA, 15 bp, Homo sapiens
tgcccccatccctcg

SEQ ID NO: 2037654 - DNA, 17 bp, Homo sapiens
tgcccccatctccccag

SEQ ID NO: 2037655 - DNA, 20 bp, Homo sapiens
tgcccccatctccccaggcc

SEQ ID NO: 2037656 - DNA, 17 bp, Homo sapiens
tgcccccgacagcccag

SEQ ID NO: 2037657 - DNA, 18 bp, Homo sapiens
tgcccccgtcttctctcc

SEQ ID NO: 2037658 - DNA, 22 bp, Homo sapiens
tgccccctggtggacagtcctg

SEQ ID NO: 2037659 - DNA, 17 bp, Homo sapiens
tgccccgggtccccagc

SEQ ID NO: 2037660 - DNA, 21 bp, Homo sapiens
tgccccgggtccccagctccc

SEQ ID NO: 2037661 - DNA, 18 bp, Homo sapiens
tgccccgttccctgtcag

SEQ ID NO: 2037662 - DNA, 15 bp, Homo sapiens
tgcccctcagagagg

SEQ ID NO: 2037663 - DNA, 13 bp, Homo sapiens
tgcccctcccttc

SEQ ID NO: 2037664 - DNA, 15 bp, Homo sapiens
tgcccctcccttcaa

SEQ ID NO: 2037665 - DNA, 23 bp, Homo sapiens
tgccccttaagggttgaaggcag

SEQ ID NO: 2037666 - DNA, 16 bp, Homo sapiens
tgccccttccccaaga

SEQ ID NO: 2037667 - DNA, 18 bp, Homo sapiens
tgccccttccccatctcc

SEQ ID NO: 2037668 - DNA, 12 bp, Homo sapiens
tgccccttgggc

SEQ ID NO: 2037669 - DNA, 18 bp, Homo sapiens
tgccccttgggcatccac

SEQ ID NO: 2037670 - DNA, 16 bp, Homo sapiens
tgcccgcagagcccac

SEQ ID NO: 2037671 - DNA, 14 bp, Homo sapiens
tgcccgccagcctc

SEQ ID NO: 2037672 - DNA, 15 bp, Homo sapiens
tgcccgccctgcccc

SEQ ID NO: 2037673 - DNA, 23 bp, Homo sapiens
tgcccgccctgcccctgccccaa

SEQ ID NO: 2037674 - DNA, 12 bp, Homo sapiens
tgcccgcctagg

SEQ ID NO: 2037675 - DNA, 18 bp, Homo sapiens
tgcccgcctaggagttga

SEQ ID NO: 2037676 - DNA, 16 bp, Homo sapiens
tgcccggattctggga

SEQ ID NO: 2037677 - DNA, 18 bp, Homo sapiens
tgcccggattctgggagg

SEQ ID NO: 2037678 - DNA, 16 bp, Homo sapiens
tgcccgtcttcagcct

SEQ ID NO: 2037679 - DNA, 14 bp, Homo sapiens
tgccctagcgctct

SEQ ID NO: 2037680 - DNA, 12 bp, Homo sapiens
tgccctcaggga

SEQ ID NO: 2037681 - DNA, 19 bp, Homo sapiens
tgccctcccacctccgctg

SEQ ID NO: 2037682 - DNA, 22 bp, Homo sapiens
tgccctcccatgttgcatgcct

SEQ ID NO: 2037683 - DNA, 14 bp, Homo sapiens
tgccctccctggcc

SEQ ID NO: 2037684 - DNA, 16 bp, Homo sapiens
tgccctccctggcctc

SEQ ID NO: 2037685 - DNA, 23 bp, Homo sapiens
tgccctccctggcctcacgccca

SEQ ID NO: 2037686 - DNA, 13 bp, Homo sapiens
tgccctccctggg

SEQ ID NO: 2037687 - DNA, 16 bp, Homo sapiens
tgccctccctggggtc

SEQ ID NO: 2037688 - DNA, 20 bp, Homo sapiens
tgccctccctggggtccttg

SEQ ID NO: 2037689 - DNA, 12 bp, Homo sapiens
tgccctctctga

SEQ ID NO: 2037690 - DNA, 17 bp, Homo sapiens
tgccctctggattctct

SEQ ID NO: 2037691 - DNA, 13 bp, Homo sapiens
tgccctgacctcc

SEQ ID NO: 2037692 - DNA, 15 bp, Homo sapiens
tgccctgacctccca

SEQ ID NO: 2037693 - DNA, 22 bp, Homo sapiens
tgccctgagtggatctccaagg

SEQ ID NO: 2037694 - DNA, 16 bp, Homo sapiens
tgccctgcctcccttt

SEQ ID NO: 2037695 - DNA, 15 bp, Homo sapiens
tgccctgcctgccca

SEQ ID NO: 2037696 - DNA, 16 bp, Homo sapiens
tgccctgcctgcccac

SEQ ID NO: 2037697 - DNA, 17 bp, Homo sapiens
tgccctgcctgcccact

SEQ ID NO: 2037698 - DNA, 17 bp, Homo sapiens
tgcaagccccagggcct

SEQ ID NO: 2037699 - DNA, 19 bp, Homo sapiens
tgcaagccccagggcctgg

SEQ ID NO: 2037700 - DNA, 20 bp, Homo sapiens
tgcaagccccagggcctggg

SEQ ID NO: 2037701 - DNA, 20 bp, Homo sapiens
tgcaaggaagccacagctgg

SEQ ID NO: 2037702 - DNA, 22 bp, Homo sapiens
tgcaaggccctctatttctctc

SEQ ID NO: 2037703 - DNA, 24 bp, Homo sapiens
tgcaaggccgctgttcacccacag

SEQ ID NO: 2037704 - DNA, 16 bp, Homo sapiens
tgcaagggccagagtt

SEQ ID NO: 2037705 - DNA, 14 bp, Homo sapiens
tgcaaggggctcag

SEQ ID NO: 2037706 - DNA, 14 bp, Homo sapiens
tgcaatatgtatta

SEQ ID NO: 2037707 - DNA, 22 bp, Homo sapiens
tgcaatatttcccccttactac

SEQ ID NO: 2037708 - DNA, 15 bp, Homo sapiens
tgcaatgggcactgg

SEQ ID NO: 2037709 - DNA, 15 bp, Homo sapiens
tgcaatttattaaaa

SEQ ID NO: 2037710 - DNA, 16 bp, Homo sapiens
tgcaatttcccctctg

SEQ ID NO: 2037711 - DNA, 14 bp, Homo sapiens
tgcaatttttaaac

SEQ ID NO: 2037712 - DNA, 16 bp, Homo sapiens
tgcaatttttaaacta

SEQ ID NO: 2037713 - DNA, 17 bp, Homo sapiens
tgcaatttttaaactag

SEQ ID NO: 2037714 - DNA, 18 bp, Homo sapiens
tgcaatttttaaactagt

SEQ ID NO: 2037715 - DNA, 21 bp, Homo sapiens
tgcacaaatatttattttctt

SEQ ID NO: 2037716 - DNA, 21 bp, Homo sapiens
tgcacaaccatctgtccctgc

SEQ ID NO: 2037717 - DNA, 16 bp, Homo sapiens
tgcacaagcttgtata

SEQ ID NO: 2037718 - DNA, 17 bp, Homo sapiens
tgcacaagcttgtatat

SEQ ID NO: 2037719 - DNA, 22 bp, Homo sapiens
tgcacaagcttgtatatacata

SEQ ID NO: 2037720 - DNA, 11 bp, Homo sapiens
tgcacaattta

SEQ ID NO: 2037721 - DNA, 13 bp, Homo sapiens
tgcacaatttaga

SEQ ID NO: 2037722 - DNA, 14 bp, Homo sapiens
tgcacaatttagaa

SEQ ID NO: 2037723 - DNA, 15 bp, Homo sapiens
tgcacaatttagaaa

SEQ ID NO: 2037724 - DNA, 20 bp, Homo sapiens
tgcacaatttgagcaattca

SEQ ID NO: 2037725 - DNA, 21 bp, Homo sapiens
tgcacacaaacacctcctagc

SEQ ID NO: 2037726 - DNA, 16 bp, Homo sapiens
tgcacacacacagaga

SEQ ID NO: 2037727 - DNA, 20 bp, Homo sapiens
tgcacacacacggatgcaca

SEQ ID NO: 2037728 - DNA, 21 bp, Homo sapiens
tgcacacacacggatgcacac

SEQ ID NO: 2037729 - DNA, 12 bp, Homo sapiens
tgcacacacagc

SEQ ID NO: 2037730 - DNA, 13 bp, Homo sapiens
tgcacacacagct

SEQ ID NO: 2037731 - DNA, 17 bp, Homo sapiens
tgcacacacagctcctc

SEQ ID NO: 2037732 - DNA, 17 bp, Homo sapiens
tgcacacaccagagccc

SEQ ID NO: 2037733 - DNA, 18 bp, Homo sapiens
tgcacacagaaatatata

SEQ ID NO: 2037734 - DNA, 16 bp, Homo sapiens
tgcacacgcacataga

SEQ ID NO: 2037735 - DNA, 20 bp, Homo sapiens
tgcacacgcacatagagata

SEQ ID NO: 2037736 - DNA, 14 bp, Homo sapiens
tgcacacttgtata

SEQ ID NO: 2037737 - DNA, 17 bp, Homo sapiens
tgcacagatatttccat

SEQ ID NO: 2037738 - DNA, 17 bp, Homo sapiens
tgcacagcgcgggcgga

SEQ ID NO: 2037739 - DNA, 20 bp, Homo sapiens
tgcacagcgcgggcggaggc

SEQ ID NO: 2037740 - DNA, 14 bp, Homo sapiens
tgcacagctgcttg

SEQ ID NO: 2037741 - DNA, 16 bp, Homo sapiens
tgcacagctgcttgtc

SEQ ID NO: 2037742 - DNA, 15 bp, Homo sapiens
tgcacaggagggggt

SEQ ID NO: 2037743 - DNA, 17 bp, Homo sapiens
tgcacagtgcatctcag

SEQ ID NO: 2037744 - DNA, 18 bp, Homo sapiens
tgcacagtttagaacaga

SEQ ID NO: 2037745 - DNA, 14 bp, Homo sapiens
tgcacatatggact

SEQ ID NO: 2037746 - DNA, 17 bp, Homo sapiens
tgcacatatggactctg

SEQ ID NO: 2037747 - DNA, 15 bp, Homo sapiens
tgcacatatttgaat

SEQ ID NO: 2037748 - DNA, 13 bp, Homo sapiens
tgcacatccattc

SEQ ID NO: 2037749 - DNA, 16 bp, Homo sapiens
tgcacatctctgcagt

SEQ ID NO: 2037750 - DNA, 23 bp, Homo sapiens
tgcacatgtcttgtacatgtgta

SEQ ID NO: 2037751 - DNA, 23 bp, Homo sapiens
tgcacattaggaacagagtatat

SEQ ID NO: 2037752 - DNA, 16 bp, Homo sapiens
tgcacatttatatata

SEQ ID NO: 2037753 - DNA, 22 bp, Homo sapiens
tgcaccacggcgtttttttaca

SEQ ID NO: 2037754 - DNA, 12 bp, Homo sapiens
tgcaccagagtg

SEQ ID NO: 2037755 - DNA, 17 bp, Homo sapiens
tgcaccagcccttccct

SEQ ID NO: 2037756 - DNA, 18 bp, Homo sapiens
tgcaccagcccttccctg

SEQ ID NO: 2037757 - DNA, 23 bp, Homo sapiens
tgcaccagcccttccctgctttg

SEQ ID NO: 2037758 - DNA, 20 bp, Homo sapiens
tgcaccagtgccgcctgtgc

SEQ ID NO: 2037759 - DNA, 14 bp, Homo sapiens
tgcaccatctgctt

SEQ ID NO: 2037760 - DNA, 23 bp, Homo sapiens
tgcaccattgcgctctagcctgg

SEQ ID NO: 2037761 - DNA, 15 bp, Homo sapiens
tgcacccactcacca

SEQ ID NO: 2037762 - DNA, 16 bp, Homo sapiens
tgcacccactcaccag

SEQ ID NO: 2037763 - DNA, 17 bp, Homo sapiens
tgcacccactcaccagg

SEQ ID NO: 2037764 - DNA, 21 bp, Homo sapiens
tgcacccagaaattccttccc

SEQ ID NO: 2037765 - DNA, 18 bp, Homo sapiens
tgcacccctccccattca

SEQ ID NO: 2037766 - DNA, 15 bp, Homo sapiens
tgcacccttcctcct

SEQ ID NO: 2037767 - DNA, 22 bp, Homo sapiens
tgcaccgggccacagagaaagt

SEQ ID NO: 2037768 - DNA, 13 bp, Homo sapiens
tgcacctaaagaa

SEQ ID NO: 2037769 - DNA, 16 bp, Homo sapiens
tgcacctaaagaaaaa

SEQ ID NO: 2037770 - DNA, 14 bp, Homo sapiens
tgcacctcccccca

SEQ ID NO: 2037771 - DNA, 11 bp, Homo sapiens
tgcacctgcat

SEQ ID NO: 2037772 - DNA, 15 bp, Homo sapiens
tgcacctgccagcct

SEQ ID NO: 2037773 - DNA, 19 bp, Homo sapiens
  misc_feature (10)..(10): n is a, c, g or t
tgcacctgcnttgtccctg

SEQ ID NO: 2037774 - DNA, 16 bp, Homo sapiens
tgcacctgtactcagg

SEQ ID NO: 2037775 - DNA, 13 bp, Homo sapiens
tgcaccttaccaa

SEQ ID NO: 2037776 - DNA, 19 bp, Homo sapiens
tgcaccttaccaactttct

SEQ ID NO: 2037777 - DNA, 20 bp, Homo sapiens
tgcacgaactggactgtgtg

SEQ ID NO: 2037778 - DNA, 22 bp, Homo sapiens
tgcacggcagcttgagcctgtc

SEQ ID NO: 2037779 - DNA, 16 bp, Homo sapiens
tgcacgtacacacaca

SEQ ID NO: 2037780 - DNA, 16 bp, Homo sapiens
tgcacgtcttgctatt

SEQ ID NO: 2037781 - DNA, 18 bp, Homo sapiens
tgcactaaagtatgtaaa

SEQ ID NO: 2037782 - DNA, 13 bp, Homo sapiens
tgcactagcctgt

SEQ ID NO: 2037783 - DNA, 21 bp, Homo sapiens
tgaccctgcgaaggggccctg

SEQ ID NO: 2037784 - DNA, 23 bp, Homo sapiens
tgaccctgcgaaggggccctggt

SEQ ID NO: 2037785 - DNA, 12 bp, Homo sapiens
tgacccttcagg

SEQ ID NO: 2037786 - DNA, 20 bp, Homo sapiens
tgacccttcagggccagaag

SEQ ID NO: 2037787 - DNA, 16 bp, Homo sapiens
tgaccgagtctaggaa

SEQ ID NO: 2037788 - DNA, 22 bp, Homo sapiens
tgaccgagtctaggaatgcttt

SEQ ID NO: 2037789 - DNA, 17 bp, Homo sapiens
tgacctatacctgtgtt

SEQ ID NO: 2037790 - DNA, 17 bp, Homo sapiens
tgacctcaactaaccct

SEQ ID NO: 2037791 - DNA, 21 bp, Homo sapiens
tgacctcaccggcatgctggc

SEQ ID NO: 2037792 - DNA, 14 bp, Homo sapiens
tgacctcagcaaat

SEQ ID NO: 2037793 - DNA, 15 bp, Homo sapiens
tgacctcagcaaatc

SEQ ID NO: 2037794 - DNA, 21 bp, Homo sapiens
tgacctcaggtgatccaccca

SEQ ID NO: 2037795 - DNA, 11 bp, Homo sapiens
tgacctcccag

SEQ ID NO: 2037796 - DNA, 15 bp, Homo sapiens
tgacctcccagccct

SEQ ID NO: 2037797 - DNA, 17 bp, Homo sapiens
tgacctcctcctgccct

SEQ ID NO: 2037798 - DNA, 18 bp, Homo sapiens
tgacctcctcctgccctc

SEQ ID NO: 2037799 - DNA, 12 bp, Homo sapiens
tgacctctgcct

SEQ ID NO: 2037800 - DNA, 20 bp, Homo sapiens
tgacctgaggctcctgtgct

SEQ ID NO: 2037801 - DNA, 20 bp, Homo sapiens
tgacctgcaggccaagagca

SEQ ID NO: 2037802 - DNA, 13 bp, Homo sapiens
tgacctgccccgc

SEQ ID NO: 2037803 - DNA, 13 bp, Homo sapiens
tgacctgctgagc

SEQ ID NO: 2037804 - DNA, 19 bp, Homo sapiens
tgacctgctgagctctgag

SEQ ID NO: 2037805 - DNA, 15 bp, Homo sapiens
tgacgcatcctgcag

SEQ ID NO: 2037806 - DNA, 22 bp, Homo sapiens
tgacgccctgcgttggagccac

SEQ ID NO: 2037807 - DNA, 20 bp, Homo sapiens
tgacggaagccaacttggct

SEQ ID NO: 2037808 - DNA, 19 bp, Homo sapiens
tgacggatgattggattat

SEQ ID NO: 2037809 - DNA, 23 bp, Homo sapiens
tgacggtcccacactggtgactg

SEQ ID NO: 2037810 - DNA, 23 bp, Homo sapiens
tgacggtcctttaggcagcctgc

SEQ ID NO: 2037811 - DNA, 19 bp, Homo sapiens
tgacgtgcacctgtactca

SEQ ID NO: 2037812 - DNA, 14 bp, Homo sapiens
tgactaaaatattt

SEQ ID NO: 2037813 - DNA, 17 bp, Homo sapiens
tgactagaggcagggag

SEQ ID NO: 2037814 - DNA, 17 bp, Homo sapiens
tgactaggaagaaaaca

SEQ ID NO: 2037815 - DNA, 17 bp, Homo sapiens
tgactagtcatagaaat

SEQ ID NO: 2037816 - DNA, 15 bp, Homo sapiens
tgactataaacatta

SEQ ID NO: 2037817 - DNA, 16 bp, Homo sapiens
tgactatcaaactgaa

SEQ ID NO: 2037818 - DNA, 14 bp, Homo sapiens
tgactatcacatac

SEQ ID NO: 2037819 - DNA, 15 bp, Homo sapiens
tgactatcacataca

SEQ ID NO: 2037820 - DNA, 20 bp, Homo sapiens
tgactatcacatacaatttg

SEQ ID NO: 2037821 - DNA, 20 bp, Homo sapiens
tgactattgaagttgcagat

SEQ ID NO: 2037822 - DNA, 19 bp, Homo sapiens
tgactattttttaataaaa

SEQ ID NO: 2037823 - DNA, 12 bp, Homo sapiens
tgactcacccaa

SEQ ID NO: 2037824 - DNA, 21 bp, Homo sapiens
tgactccagagtctgagcccc

SEQ ID NO: 2037825 - DNA, 15 bp, Homo sapiens
tgactccctgtgggg

SEQ ID NO: 2037826 - DNA, 20 bp, Homo sapiens
tgactcggtgtaaaaccatg

SEQ ID NO: 2037827 - DNA, 21 bp, Homo sapiens
tgactcgtatatgtctcaggt

SEQ ID NO: 2037828 - DNA, 12 bp, Homo sapiens
tgactctaaatt

SEQ ID NO: 2037829 - DNA, 13 bp, Homo sapiens
tgactctctgtga

SEQ ID NO: 2037830 - DNA, 20 bp, Homo sapiens
tgactcttgttttcagtttc

SEQ ID NO: 2037831 - DNA, 23 bp, Homo sapiens
tgactctttttagggccaggcag

SEQ ID NO: 2037832 - DNA, 14 bp, Homo sapiens
tgactgaactgcac

SEQ ID NO: 2037833 - DNA, 17 bp, Homo sapiens
tgactgaactgcacgtt

SEQ ID NO: 2037834 - DNA, 19 bp, Homo sapiens
tgactgaactgcacgttct

SEQ ID NO: 2037835 - DNA, 20 bp, Homo sapiens
tgactgaatttgggcctctt

SEQ ID NO: 2037836 - DNA, 21 bp, Homo sapiens
tgactgaatttgggcctcttg

SEQ ID NO: 2037837 - DNA, 14 bp, Homo sapiens
tgactgacacaggc

SEQ ID NO: 2037838 - DNA, 15 bp, Homo sapiens
tgactgagcttccct

SEQ ID NO: 2037839 - DNA, 19 bp, Homo sapiens
tgactgccccaactcctgg

SEQ ID NO: 2037840 - DNA, 20 bp, Homo sapiens
tgactgctccccagccctgg

SEQ ID NO: 2037841 - DNA, 12 bp, Homo sapiens
tgactggcaggt

SEQ ID NO: 2037842 - DNA, 14 bp, Homo sapiens
tgactggcaggtgc

SEQ ID NO: 2037843 - DNA, 16 bp, Homo sapiens
tgactgggaccaggca

SEQ ID NO: 2037844 - DNA, 23 bp, Homo sapiens
tgactgggtttctctgtatagta

SEQ ID NO: 2037845 - DNA, 16 bp, Homo sapiens
tgactgtactcctccc

SEQ ID NO: 2037846 - DNA, 17 bp, Homo sapiens
tgactgtactcctccca

SEQ ID NO: 2037847 - DNA, 22 bp, Homo sapiens
tgactgtactcctcccaggcgc

SEQ ID NO: 2037848 - DNA, 19 bp, Homo sapiens
tgactgtcgtgtttacaaa

SEQ ID NO: 2037849 - DNA, 22 bp, Homo sapiens
tgactgtcgtgtttacaaaagg

SEQ ID NO: 2037850 - DNA, 19 bp, Homo sapiens
tgactgtgttcagtgcctt

SEQ ID NO: 2037851 - DNA, 22 bp, Homo sapiens
tgactgtgttcagtgccttgga

SEQ ID NO: 2037852 - DNA, 14 bp, Homo sapiens
tgacttcacagcag

SEQ ID NO: 2037853 - DNA, 21 bp, Homo sapiens
tgacttcaggtggagagcact

SEQ ID NO: 2037854 - DNA, 17 bp, Homo sapiens
tgacttcctggtgaggc

SEQ ID NO: 2037855 - DNA, 22 bp, Homo sapiens
tgacttctaagtaaaaccacag

SEQ ID NO: 2037856 - DNA, 16 bp, Homo sapiens
tgacttgcacatctct

SEQ ID NO: 2037857 - DNA, 14 bp, Homo sapiens
tgactttacaggag

SEQ ID NO: 2037858 - DNA, 12 bp, Homo sapiens
tgactttcaggt

SEQ ID NO: 2037859 - DNA, 17 bp, Homo sapiens
tgactttttagccagtg

SEQ ID NO: 2037860 - DNA, 15 bp, Homo sapiens
tgagaaaaggggcat

SEQ ID NO: 2037861 - DNA, 13 bp, Homo sapiens
tgagaaacatgaa

SEQ ID NO: 2037862 - DNA, 22 bp, Homo sapiens
tgagaaactttgatctctgctt

SEQ ID NO: 2037863 - DNA, 17 bp, Homo sapiens
tgagaaagactattcaa

SEQ ID NO: 2037864 - DNA, 13 bp, Homo sapiens
tgagaaatttaaa

SEQ ID NO: 2037865 - DNA, 15 bp, Homo sapiens
tgagaaatttaaact

SEQ ID NO: 2037866 - DNA, 18 bp, Homo sapiens
tgagaaatttaaactata

SEQ ID NO: 2037867 - DNA, 22 bp, Homo sapiens
tgagaacaagtcacagctgcag

SEQ ID NO: 2037868 - DNA, 18 bp, Homo sapiens
tgagaacatttacacatt

SEQ ID NO: 2037869 - DNA, 21 bp, Homo sapiens
tgagaacccttcctttcccaa

SEQ ID NO: 2037870 - DNA, 18 bp, Homo sapiens
tgagaagaagctgaggat

SEQ ID NO: 2037871 - DNA, 20 bp, Homo sapiens
tgagaagagggcctgtggga

SEQ ID NO: 2037872 - DNA, 17 bp, Homo sapiens
tgagaaggcgaggagag

SEQ ID NO: 2037873 - DNA, 19 bp, Homo sapiens
tgagaagttaagcagcctt

SEQ ID NO: 2037874 - DNA, 23 bp, Homo sapiens
tgagaagttaagcagcctttctg

SEQ ID NO: 2037875 - DNA, 18 bp, Homo sapiens
tgagaagttttgtacaga

SEQ ID NO: 2037876 - DNA, 24 bp, Homo sapiens
tgagaagttttgtacagagaatta

SEQ ID NO: 2037877 - DNA, 15 bp, Homo sapiens
tgagaataattgtgt

SEQ ID NO: 2037878 - DNA, 16 bp, Homo sapiens
tgagaataattgtgta

SEQ ID NO: 2037879 - DNA, 18 bp, Homo sapiens
tgagaataattgtgtaca

SEQ ID NO: 2037880 - DNA, 19 bp, Homo sapiens
tgagaataattgtgtacaa

SEQ ID NO: 2037881 - DNA, 16 bp, Homo sapiens
tgagaatcaaaactct

SEQ ID NO: 2037882 - DNA, 14 bp, Homo sapiens
tgagaatcctgcct

SEQ ID NO: 2037883 - DNA, 18 bp, Homo sapiens
tgagaatctatatttaac

SEQ ID NO: 2037884 - DNA, 12 bp, Homo sapiens
tgagaatgtgat

SEQ ID NO: 2037885 - DNA, 21 bp, Homo sapiens
tgaggagtattaagaatgcag

SEQ ID NO: 2037886 - DNA, 15 bp, Homo sapiens
tgaggagtctgaggt

SEQ ID NO: 2037887 - DNA, 17 bp, Homo sapiens
tgaggagtctgaggtcc

SEQ ID NO: 2037888 - DNA, 21 bp, Homo sapiens
tgaggatcctcacaggagcag

SEQ ID NO: 2037889 - DNA, 23 bp, Homo sapiens
tgaggatcctcacaggagcagac

SEQ ID NO: 2037890 - DNA, 19 bp, Homo sapiens
tgaggattatgggtcctgc

SEQ ID NO: 2037891 - DNA, 16 bp, Homo sapiens
tgaggatttcaagcct

SEQ ID NO: 2037892 - DNA, 14 bp, Homo sapiens
tgaggcaagagaat

SEQ ID NO: 2037893 - DNA, 13 bp, Homo sapiens
tgaggcagacagc

SEQ ID NO: 2037894 - DNA, 14 bp, Homo sapiens
tgaggcagacagca

SEQ ID NO: 2037895 - DNA, 13 bp, Homo sapiens
tgaggcagggcaa

SEQ ID NO: 2037896 - DNA, 18 bp, Homo sapiens
tgaggcagggcaaatgac

SEQ ID NO: 2037897 - DNA, 13 bp, Homo sapiens
tgaggccagcctg

SEQ ID NO: 2037898 - DNA, 17 bp, Homo sapiens
tgaggccagcctggcct

SEQ ID NO: 2037899 - DNA, 18 bp, Homo sapiens
tgaggccagcctggcctc

SEQ ID NO: 2037900 - DNA, 14 bp, Homo sapiens
tgaggcccagcctg

SEQ ID NO: 2037901 - DNA, 16 bp, Homo sapiens
tgaggcccagcctgtc

SEQ ID NO: 2037902 - DNA, 19 bp, Homo sapiens
tgaggcctaaaagtaaaca

SEQ ID NO: 2037903 - DNA, 14 bp, Homo sapiens
tgaggcctggccag

SEQ ID NO: 2037904 - DNA, 16 bp, Homo sapiens
tgaggcctggccaggc

SEQ ID NO: 2037905 - DNA, 17 bp, Homo sapiens
tgaggcctggccaggca

SEQ ID NO: 2037906 - DNA, 17 bp, Homo sapiens
tgaggcctttccccagt

SEQ ID NO: 2037907 - DNA, 22 bp, Homo sapiens
tgaggcctttccccagtgtggc

SEQ ID NO: 2037908 - DNA, 23 bp, Homo sapiens
tgaggcctttccccagtgtggcc

SEQ ID NO: 2037909 - DNA, 23 bp, Homo sapiens
tgaggcgggtggatcacctgagg

SEQ ID NO: 2037910 - DNA, 16 bp, Homo sapiens
tgaggctcaagaggcc

SEQ ID NO: 2037911 - DNA, 19 bp, Homo sapiens
tgaggctcaagaggcccag

SEQ ID NO: 2037912 - DNA, 22 bp, Homo sapiens
tgaggctcaagaggcccaggga

SEQ ID NO: 2037913 - DNA, 23 bp, Homo sapiens
tgaggctcaagaggcccagggag

SEQ ID NO: 2037914 - DNA, 16 bp, Homo sapiens
tgaggctctttctggg

SEQ ID NO: 2037915 - DNA, 13 bp, Homo sapiens
tgaggctgagact

SEQ ID NO: 2037916 - DNA, 15 bp, Homo sapiens
tgaggctgaggcagg

SEQ ID NO: 2037917 - DNA, 23 bp, Homo sapiens
tgaggctgggccagcctcagctc

SEQ ID NO: 2037918 - DNA, 24 bp, Homo sapiens
tgaggctgggccagcctcagctca

SEQ ID NO: 2037919 - DNA, 15 bp, Homo sapiens
tgaggcttccagaga

SEQ ID NO: 2037920 - DNA, 14 bp, Homo sapiens
tgaggcttccaggc

SEQ ID NO: 2037921 - DNA, 15 bp, Homo sapiens
tgaggcttccaggct

SEQ ID NO: 2037922 - DNA, 16 bp, Homo sapiens
tgaggcttccaggctc

SEQ ID NO: 2037923 - DNA, 18 bp, Homo sapiens
tgaggcttccaggctctt

SEQ ID NO: 2037924 - DNA, 20 bp, Homo sapiens
tgaggcttccaggctcttcc

SEQ ID NO: 2037925 - DNA, 22 bp, Homo sapiens
tgaggcttccaggctcttcctg

SEQ ID NO: 2037926 - DNA, 20 bp, Homo sapiens
tgagggaacagacaggagaa

SEQ ID NO: 2037927 - DNA, 18 bp, Homo sapiens
tgagggactggaaccagg

SEQ ID NO: 2037928 - DNA, 17 bp, Homo sapiens
tgagggatcacagggcc

SEQ ID NO: 2037929 - DNA, 21 bp, Homo sapiens
tgagggcagcagccagccctg

SEQ ID NO: 2037930 - DNA, 20 bp, Homo sapiens
tgagggcagttcgcagccac

SEQ ID NO: 2037931 - DNA, 23 bp, Homo sapiens
tgagggcagttcgcagccaccct

SEQ ID NO: 2037932 - DNA, 18 bp, Homo sapiens
tgagggccaagaaagagt

SEQ ID NO: 2037933 - DNA, 15 bp, Homo sapiens
tgagggctgggcagc

SEQ ID NO: 2037934 - DNA, 15 bp, Homo sapiens
tgaggggcttcaacc

SEQ ID NO: 2037935 - DNA, 13 bp, Homo sapiens
tgagggtcagggc

SEQ ID NO: 2037936 - DNA, 16 bp, Homo sapiens
tgagggtcagggcagt

SEQ ID NO: 2037937 - DNA, 14 bp, Homo sapiens
tgagggtggagact

SEQ ID NO: 2037938 - DNA, 14 bp, Homo sapiens
tgaggtcagagcct

SEQ ID NO: 2037939 - DNA, 19 bp, Homo sapiens
tgaggtcagagcctgcagt

SEQ ID NO: 2037940 - DNA, 16 bp, Homo sapiens
tgaggtcaggagttcc

SEQ ID NO: 2037941 - DNA, 14 bp, Homo sapiens
tgaggtcctgagca

SEQ ID NO: 2037942 - DNA, 15 bp, Homo sapiens
tgaggtcctgagcac

SEQ ID NO: 2037943 - DNA, 16 bp, Homo sapiens
tgaggtcctgagcact

SEQ ID NO: 2037944 - DNA, 18 bp, Homo sapiens
tgaggtcctgagcactgc

SEQ ID NO: 2037945 - DNA, 22 bp, Homo sapiens
tgaggtcctgagcactgccagg

SEQ ID NO: 2037946 - DNA, 15 bp, Homo sapiens
tgaggtgaaacaatt

SEQ ID NO: 2037947 - DNA, 18 bp, Homo sapiens
tgaggtgaaatgggagat

SEQ ID NO: 2037948 - DNA, 13 bp, Homo sapiens
tgaggtgcccagg

SEQ ID NO: 2037949 - DNA, 16 bp, Homo sapiens
tgaggtgcccaggaga

SEQ ID NO: 2037950 - DNA, 18 bp, Homo sapiens
tgaggtgcccaggagaag

SEQ ID NO: 2037951 - DNA, 14 bp, Homo sapiens
tgaggtgctgatga

SEQ ID NO: 2037952 - DNA, 17 bp, Homo sapiens
tgaggtgcttgccccca

SEQ ID NO: 2037953 - DNA, 17 bp, Homo sapiens
tgaggtggaagccctcc

SEQ ID NO: 2037954 - DNA, 22 bp, Homo sapiens
tgaggtggaagccctccttcca

SEQ ID NO: 2037955 - DNA, 21 bp, Homo sapiens
tgaggttaaaatataaattaa

SEQ ID NO: 2037956 - DNA, 14 bp, Homo sapiens
tgagtaaattggaa

SEQ ID NO: 2037957 - DNA, 21 bp, Homo sapiens
tgagtaattctagctttcaaa

SEQ ID NO: 2037958 - DNA, 16 bp, Homo sapiens
tgagtacagtgaggag

SEQ ID NO: 2037959 - DNA, 19 bp, Homo sapiens
tgagtacagtgaggagggt

SEQ ID NO: 2037960 - DNA, 21 bp, Homo sapiens
tgagtactagaatttgtattt

SEQ ID NO: 2037961 - DNA, 18 bp, Homo sapiens
tgagtatacaatatataa

SEQ ID NO: 2037962 - DNA, 18 bp, Homo sapiens
tgagtcaaaagcctgggt

SEQ ID NO: 2037963 - DNA, 14 bp, Homo sapiens
tgagtcaccaagcc

SEQ ID NO: 2037964 - DNA, 18 bp, Homo sapiens
tgagtcaccaagcccagt

SEQ ID NO: 2037965 - DNA, 20 bp, Homo sapiens
tgagtcaccctacctgtgcc

SEQ ID NO: 2037966 - DNA, 14 bp, Homo sapiens
tgagtcctgtctct

SEQ ID NO: 2037967 - DNA, 16 bp, Homo sapiens
tgagtcctgtctctgc

SEQ ID NO: 2037968 - DNA, 15 bp, Homo sapiens
tgagtcgaggacagg

SEQ ID NO: 2037969 - DNA, 16 bp, Homo sapiens
tgagtcgaggacaggg

SEQ ID NO: 2037970 - DNA, 19 bp, Homo sapiens
tgagtcgaggacagggagg

SEQ ID NO: 2037971 - DNA, 19 bp, Homo sapiens
tgagtcggccccacatggg

SEQ ID NO: 2037972 - DNA, 15 bp, Homo sapiens
tgagtctcttcagaa

SEQ ID NO: 2037973 - DNA, 15 bp, Homo sapiens
tgagtctgaggcccc

SEQ ID NO: 2037974 - DNA, 18 bp, Homo sapiens
tgagtctgagtcctgtct

SEQ ID NO: 2037975 - DNA, 23 bp, Homo sapiens
tgagtctgggcaatgaaaccaaa

SEQ ID NO: 2037976 - DNA, 15 bp, Homo sapiens
tgagtcttggcctgc

SEQ ID NO: 2037977 - DNA, 16 bp, Homo sapiens
tgagtgactcggtgta

SEQ ID NO: 2037978 - DNA, 18 bp, Homo sapiens
tgagtgactcggtgtaaa

SEQ ID NO: 2037979 - DNA, 23 bp, Homo sapiens
tgagtgagaggcgacaggagtat

SEQ ID NO: 2037980 - DNA, 18 bp, Homo sapiens
tgagtgagccacagacca

SEQ ID NO: 2037981 - DNA, 15 bp, Homo sapiens
tgagtgatcctccaa

SEQ ID NO: 2037982 - DNA, 22 bp, Homo sapiens
tccgctgccaccacgtctgcca

SEQ ID NO: 2037983 - DNA, 22 bp, Homo sapiens
tccggaggggttgcgggggagc

SEQ ID NO: 2037984 - DNA, 23 bp, Homo sapiens
tccggaggggttgcgggggagct

SEQ ID NO: 2037985 - DNA, 20 bp, Homo sapiens
tccgggacgcttccagacca

SEQ ID NO: 2037986 - DNA, 21 bp, Homo sapiens
tccgggacgcttccagaccac

SEQ ID NO: 2037987 - DNA, 20 bp, Homo sapiens
tccgggccgggcggaagggg

SEQ ID NO: 2037988 - DNA, 16 bp, Homo sapiens
tccggggtctgtgctg

SEQ ID NO: 2037989 - DNA, 15 bp, Homo sapiens
tccgggtgtggcctc

SEQ ID NO: 2037990 - DNA, 22 bp, Homo sapiens
tccggtgtctggaaaagcactt

SEQ ID NO: 2037991 - DNA, 16 bp, Homo sapiens
tccggtgtgagatata

SEQ ID NO: 2037992 - DNA, 12 bp, Homo sapiens
tccggtgtgcct

SEQ ID NO: 2037993 - DNA, 18 bp, Homo sapiens
tccggtgtgcctgcagcc

SEQ ID NO: 2037994 - DNA, 19 bp, Homo sapiens
tccggtgtgcctgcagccc

SEQ ID NO: 2037995 - DNA, 15 bp, Homo sapiens
tccgtagttccctga

SEQ ID NO: 2037996 - DNA, 14 bp, Homo sapiens
tccgtccacccagg

SEQ ID NO: 2037997 - DNA, 18 bp, Homo sapiens
tccgtccacccaggctgc

SEQ ID NO: 2037998 - DNA, 20 bp, Homo sapiens
tccgtccacccaggctgcac

SEQ ID NO: 2037999 - DNA, 21 bp, Homo sapiens
tccgtccacccaggctgcact

SEQ ID NO: 2038000 - DNA, 17 bp, Homo sapiens
tccgtcccaaacagagg

SEQ ID NO: 2038001 - DNA, 13 bp, Homo sapiens
tccgtgctgggct

SEQ ID NO: 2038002 - DNA, 20 bp, Homo sapiens
tccgtttcagctgacagctg

SEQ ID NO: 2038003 - DNA, 21 bp, Homo sapiens
tcctaaacatcattcattttt

SEQ ID NO: 2038004 - DNA, 22 bp, Homo sapiens
tcctaaacccccgctccagatc

SEQ ID NO: 2038005 - DNA, 18 bp, Homo sapiens
tcctaaagagttattcaa

SEQ ID NO: 2038006 - DNA, 17 bp, Homo sapiens
tcctaactgaagagaca

SEQ ID NO: 2038007 - DNA, 13 bp, Homo sapiens
tcctaactgagaa

SEQ ID NO: 2038008 - DNA, 14 bp, Homo sapiens
tcctaagcagctgg

SEQ ID NO: 2038009 - DNA, 12 bp, Homo sapiens
tcctaaggacac

SEQ ID NO: 2038010 - DNA, 15 bp, Homo sapiens
tcctacaaagatgtt

SEQ ID NO: 2038011 - DNA, 14 bp, Homo sapiens
tcctaccaatgcat

SEQ ID NO: 2038012 - DNA, 18 bp, Homo sapiens
tcctacccaccctccttt

SEQ ID NO: 2038013 - DNA, 14 bp, Homo sapiens
tcctaccccacctc

SEQ ID NO: 2038014 - DNA, 21 bp, Homo sapiens
tcctaccccacctcatgcctg

SEQ ID NO: 2038015 - DNA, 23 bp, Homo sapiens
tcctaccccacctcatgcctggc

SEQ ID NO: 2038016 - DNA, 15 bp, Homo sapiens
tcctactctgtgtca

SEQ ID NO: 2038017 - DNA, 17 bp, Homo sapiens
tcctactttagccactg

SEQ ID NO: 2038018 - DNA, 15 bp, Homo sapiens
tcctagaaccaagct

SEQ ID NO: 2038019 - DNA, 23 bp, Homo sapiens
tcctagaaccaagcttcagagcc

SEQ ID NO: 2038020 - DNA, 20 bp, Homo sapiens
tcctagaagagtcaggaagg

SEQ ID NO: 2038021 - DNA, 21 bp, Homo sapiens
tcctagagaggctggcaagga

SEQ ID NO: 2038022 - DNA, 13 bp, Homo sapiens
tcctagagctcct

SEQ ID NO: 2038023 - DNA, 14 bp, Homo sapiens
tcctagagctcctg

SEQ ID NO: 2038024 - DNA, 18 bp, Homo sapiens
tcctagagctcctgtccc

SEQ ID NO: 2038025 - DNA, 15 bp, Homo sapiens
tcctagaggtgggca

SEQ ID NO: 2038026 - DNA, 18 bp, Homo sapiens
tcctagaggtgggcagct

SEQ ID NO: 2038027 - DNA, 23 bp, Homo sapiens
tcctagaggtgggcagctgggcc

SEQ ID NO: 2038028 - DNA, 16 bp, Homo sapiens
tcctagcccagtgctt

SEQ ID NO: 2038029 - DNA, 13 bp, Homo sapiens
tcctaggtgctgg

SEQ ID NO: 2038030 - DNA, 14 bp, Homo sapiens
tcctaggtgctgga

SEQ ID NO: 2038031 - DNA, 18 bp, Homo sapiens
tcctagtttgacctcaca

SEQ ID NO: 2038032 - DNA, 13 bp, Homo sapiens
tcctagttttctc

SEQ ID NO: 2038033 - DNA, 23 bp, Homo sapiens
tcctataccatatgtctgcttct

SEQ ID NO: 2038034 - DNA, 17 bp, Homo sapiens
tcctatcagaagtttct

SEQ ID NO: 2038035 - DNA, 18 bp, Homo sapiens
tcctatgtcaatttgtat

SEQ ID NO: 2038036 - DNA, 22 bp, Homo sapiens
tcctatgtcaatttgtatatca

SEQ ID NO: 2038037 - DNA, 16 bp, Homo sapiens
tcctattaaaacacag

SEQ ID NO: 2038038 - DNA, 18 bp, Homo sapiens
tcctattaaaacacagct

SEQ ID NO: 2038039 - DNA, 14 bp, Homo sapiens
tcctattctattgc

SEQ ID NO: 2038040 - DNA, 14 bp, Homo sapiens
tcctattttaaaac

SEQ ID NO: 2038041 - DNA, 16 bp, Homo sapiens
tcctattttaaaacca

SEQ ID NO: 2038042 - DNA, 17 bp, Homo sapiens
tcctattttaaaaccat

SEQ ID NO: 2038043 - DNA, 22 bp, Homo sapiens
tcctattttaaaaccatgcagc

SEQ ID NO: 2038044 - DNA, 18 bp, Homo sapiens
tcctcaaaataaggggca

SEQ ID NO: 2038045 - DNA, 19 bp, Homo sapiens
tcctcaacaacaaaccaaa

SEQ ID NO: 2038046 - DNA, 18 bp, Homo sapiens
tcctcaatggacttcaaa

SEQ ID NO: 2038047 - DNA, 16 bp, Homo sapiens
tcctcacagcctctcc

SEQ ID NO: 2038048 - DNA, 19 bp, Homo sapiens
tcctcacagcctctccctt

SEQ ID NO: 2038049 - DNA, 17 bp, Homo sapiens
tcctcaccaataacttc

SEQ ID NO: 2038050 - DNA, 20 bp, Homo sapiens
tcctcaccaataacttcaga

SEQ ID NO: 2038051 - DNA, 22 bp, Homo sapiens
tcctcaccaataacttcagaga

SEQ ID NO: 2038052 - DNA, 21 bp, Homo sapiens
tcctcactatgacactgagca

SEQ ID NO: 2038053 - DNA, 14 bp, Homo sapiens
tcctcactgcccca

SEQ ID NO: 2038054 - DNA, 20 bp, Homo sapiens
tcctcagagaatttctacca

SEQ ID NO: 2038055 - DNA, 12 bp, Homo sapiens
tcctcagctgcc

SEQ ID NO: 2038056 - DNA, 18 bp, Homo sapiens
tcctcaggatttcattga

SEQ ID NO: 2038057 - DNA, 18 bp, Homo sapiens
tcctcagggacagagaca

SEQ ID NO: 2038058 - DNA, 12 bp, Homo sapiens
tcctcatctgca

SEQ ID NO: 2038059 - DNA, 23 bp, Homo sapiens
tcctccaacgttaaaagacagtg

SEQ ID NO: 2038060 - DNA, 22 bp, Homo sapiens
tcctccaattccacagtctctg

SEQ ID NO: 2038061 - DNA, 13 bp, Homo sapiens
tcctccacagtgc

SEQ ID NO: 2038062 - DNA, 16 bp, Homo sapiens
tcctccactccacctc

SEQ ID NO: 2038063 - DNA, 10 bp, Homo sapiens
tcctccagtc

SEQ ID NO: 2038064 - DNA, 22 bp, Homo sapiens
tcctccatctagagattttctt

SEQ ID NO: 2038065 - DNA, 20 bp, Homo sapiens
tcctccatttcaactccaga

SEQ ID NO: 2038066 - DNA, 18 bp, Homo sapiens
tcctcccaaaatactaca

SEQ ID NO: 2038067 - DNA, 16 bp, Homo sapiens
tcctcccacctcagcc

SEQ ID NO: 2038068 - DNA, 18 bp, Homo sapiens
tcctcccacctcagcctc

SEQ ID NO: 2038069 - DNA, 20 bp, Homo sapiens
tcctcccacctcagcctccc

SEQ ID NO: 2038070 - DNA, 15 bp, Homo sapiens
tcctcccatggcctt

SEQ ID NO: 2038071 - DNA, 18 bp, Homo sapiens
tcctcccatggccttccc

SEQ ID NO: 2038072 - DNA, 20 bp, Homo sapiens
tcctcccatggccttccctc

SEQ ID NO: 2038073 - DNA, 17 bp, Homo sapiens
tcctccccaccttcccc

SEQ ID NO: 2038074 - DNA, 20 bp, Homo sapiens
tcctccccaccttccccaga

SEQ ID NO: 2038075 - DNA, 23 bp, Homo sapiens
tcctccccaccttccccagactc

SEQ ID NO: 2038076 - DNA, 13 bp, Homo sapiens
tcctccccagtct

SEQ ID NO: 2038077 - DNA, 22 bp, Homo sapiens
tcctccccattagagtcagcct

SEQ ID NO: 2038078 - DNA, 15 bp, Homo sapiens
tcctcccccagagcc

SEQ ID NO: 2038079 - DNA, 13 bp, Homo sapiens
tcctccccctgcc

SEQ ID NO: 2038080 - DNA, 20 bp, Homo sapiens
tcctccccctgccagtgcct

SEQ ID NO: 2038081 - DNA, 11 bp, Homo sapiens
tcctccccttc

SEQ ID NO: 2038082 - DNA, 15 bp, Homo sapiens
tcctccccttcctgc

SEQ ID NO: 2038083 - DNA, 19 bp, Homo sapiens
tcctccccttcctgcaccc

SEQ ID NO: 2038084 - DNA, 15 bp, Homo sapiens
tcctccctcagtgcc

SEQ ID NO: 2038085 - DNA, 19 bp, Homo sapiens
tcctccctgggcagaaagt

SEQ ID NO: 2038086 - DNA, 17 bp, Homo sapiens
tcctccgtcacctcaga

SEQ ID NO: 2038087 - DNA, 14 bp, Homo sapiens
tcctccgtccaccc

SEQ ID NO: 2038088 - DNA, 18 bp, Homo sapiens
tcctccgtccacccaggc

SEQ ID NO: 2038089 - DNA, 20 bp, Homo sapiens
tcctccgtccacccaggctg

SEQ ID NO: 2038090 - DNA, 23 bp, Homo sapiens
tcctccgtccacccaggctgcac

SEQ ID NO: 2038091 - DNA, 20 bp, Homo sapiens
tcctcctccacagtgctgct

SEQ ID NO: 2038092 - DNA, 15 bp, Homo sapiens
tcctcctcccccaga

SEQ ID NO: 2038093 - DNA, 14 bp, Homo sapiens
tcctcctgaagcct

SEQ ID NO: 2038094 - DNA, 16 bp, Homo sapiens
tcctcctgaagcctct

SEQ ID NO: 2038095 - DNA, 17 bp, Homo sapiens
tcctcctgaagcctctg

SEQ ID NO: 2038096 - DNA, 17 bp, Homo sapiens
tgaatggtgcagaaaaa

SEQ ID NO: 2038097 - DNA, 20 bp, Homo sapiens
tgaatgtctaaggtcacaca

SEQ ID NO: 2038098 - DNA, 14 bp, Homo sapiens
tgaatgtgtcacta

SEQ ID NO: 2038099 - DNA, 17 bp, Homo sapiens
tgaattaaataaaccct

SEQ ID NO: 2038100 - DNA, 11 bp, Homo sapiens
tgaattaaatt

SEQ ID NO: 2038101 - DNA, 15 bp, Homo sapiens
tgaattaaatttaat

SEQ ID NO: 2038102 - DNA, 19 bp, Homo sapiens
tgaattattttgttgtgat

SEQ ID NO: 2038103 - DNA, 22 bp, Homo sapiens
tgaattattttgttgtgatttt

SEQ ID NO: 2038104 - DNA, 19 bp, Homo sapiens
tgaattctgcaatgttttc

SEQ ID NO: 2038105 - DNA, 13 bp, Homo sapiens
tgaatttcaggca

SEQ ID NO: 2038106 - DNA, 14 bp, Homo sapiens
tgataagtggaaaa

SEQ ID NO: 2038107 - DNA, 18 bp, Homo sapiens
tgataatgaacagaacat

SEQ ID NO: 2038108 - DNA, 20 bp, Homo sapiens
tgataatgaacagaacatag

SEQ ID NO: 2038109 - DNA, 13 bp, Homo sapiens
tgataattttaaa

SEQ ID NO: 2038110 - DNA, 13 bp, Homo sapiens
tgatacccagagc

SEQ ID NO: 2038111 - DNA, 13 bp, Homo sapiens
tgatactgatgcc

SEQ ID NO: 2038112 - DNA, 13 bp, Homo sapiens
tgatacttcaggt

SEQ ID NO: 2038113 - DNA, 13 bp, Homo sapiens
tgatagctttatt

SEQ ID NO: 2038114 - DNA, 14 bp, Homo sapiens
tgatagctttattt

SEQ ID NO: 2038115 - DNA, 18 bp, Homo sapiens
tgataggaaataaatgat

SEQ ID NO: 2038116 - DNA, 16 bp, Homo sapiens
tgatatagaaagctgt

SEQ ID NO: 2038117 - DNA, 17 bp, Homo sapiens
tgatatagaaagctgtt

SEQ ID NO: 2038118 - DNA, 13 bp, Homo sapiens
tgatatatgtatt

SEQ ID NO: 2038119 - DNA, 15 bp, Homo sapiens
tgatatatgtattta

SEQ ID NO: 2038120 - DNA, 19 bp, Homo sapiens
tgatatccagtaagcacat

SEQ ID NO: 2038121 - DNA, 16 bp, Homo sapiens
tgatatcccccagcct

SEQ ID NO: 2038122 - DNA, 18 bp, Homo sapiens
tgatatccctgatcctaa

SEQ ID NO: 2038123 - DNA, 11 bp, Homo sapiens
tgatatgaaaa

SEQ ID NO: 2038124 - DNA, 12 bp, Homo sapiens
tgatatgagtat

SEQ ID NO: 2038125 - DNA, 19 bp, Homo sapiens
tgatatgagtatacaatat

SEQ ID NO: 2038126 - DNA, 21 bp, Homo sapiens
tgatatgcagagtatttctgc

SEQ ID NO: 2038127 - DNA, 13 bp, Homo sapiens
tgatattaaagga

SEQ ID NO: 2038128 - DNA, 17 bp, Homo sapiens
tgatattgcatatgcat

SEQ ID NO: 2038129 - DNA, 21 bp, Homo sapiens
tgatattttcaacgcagccct

SEQ ID NO: 2038130 - DNA, 23 bp, Homo sapiens
tgatattttcaacgcagccctgc

SEQ ID NO: 2038131 - DNA, 19 bp, Homo sapiens
tgatcaaaaataaactagt

SEQ ID NO: 2038132 - DNA, 16 bp, Homo sapiens
tgatcaaattcatttt

SEQ ID NO: 2038133 - DNA, 23 bp, Homo sapiens
tgatcaaattcatttttttcact

SEQ ID NO: 2038134 - DNA, 12 bp, Homo sapiens
tgatcaatgaaa

SEQ ID NO: 2038135 - DNA, 15 bp, Homo sapiens
tgatcaattaaatgt

SEQ ID NO: 2038136 - DNA, 17 bp, Homo sapiens
tgatcaattaaatgtag

SEQ ID NO: 2038137 - DNA, 13 bp, Homo sapiens
tgatcacactctg

SEQ ID NO: 2038138 - DNA, 15 bp, Homo sapiens
tgatcacactctggg

SEQ ID NO: 2038139 - DNA, 20 bp, Homo sapiens
tgatcacagtggcgagagga

SEQ ID NO: 2038140 - DNA, 13 bp, Homo sapiens
tgatcacggctca

SEQ ID NO: 2038141 - DNA, 18 bp, Homo sapiens
tgatcactggcaatgaaa

SEQ ID NO: 2038142 - DNA, 12 bp, Homo sapiens
tgatcagaaggc

SEQ ID NO: 2038143 - DNA, 20 bp, Homo sapiens
tgatcagaaggctggggcca

SEQ ID NO: 2038144 - DNA, 21 bp, Homo sapiens
tgatcagaaggctggggccag

SEQ ID NO: 2038145 - DNA, 18 bp, Homo sapiens
tgatcagaccataatgtt

SEQ ID NO: 2038146 - DNA, 16 bp, Homo sapiens
tgatcagctgtttgtc

SEQ ID NO: 2038147 - DNA, 19 bp, Homo sapiens
tgatcagtatgctgtttta

SEQ ID NO: 2038148 - DNA, 21 bp, Homo sapiens
tgatcataagtctaaataaat

SEQ ID NO: 2038149 - DNA, 13 bp, Homo sapiens
tgatcatccactg

SEQ ID NO: 2038150 - DNA, 23 bp, Homo sapiens
tgatcatcccatctaagctgcag

SEQ ID NO: 2038151 - DNA, 17 bp, Homo sapiens
tgatcatggtcagctca

SEQ ID NO: 2038152 - DNA, 16 bp, Homo sapiens
tgatcatgtaaatgat

SEQ ID NO: 2038153 - DNA, 21 bp, Homo sapiens
tgatcatgtaaatgattatct

SEQ ID NO: 2038154 - DNA, 16 bp, Homo sapiens
tgatccacccacctca

SEQ ID NO: 2038155 - DNA, 20 bp, Homo sapiens
tgatccacccacctcagcct

SEQ ID NO: 2038156 - DNA, 22 bp, Homo sapiens
tgatccacccacctcagcctcc

SEQ ID NO: 2038157 - DNA, 19 bp, Homo sapiens
tgatcccaagtgccagtct

SEQ ID NO: 2038158 - DNA, 15 bp, Homo sapiens
tgatcccacttcact

SEQ ID NO: 2038159 - DNA, 18 bp, Homo sapiens
tgatcccacttcactgtg

SEQ ID NO: 2038160 - DNA, 15 bp, Homo sapiens
tgatcccccaggttc

SEQ ID NO: 2038161 - DNA, 21 bp, Homo sapiens
tgatccctgttacccagagaa

SEQ ID NO: 2038162 - DNA, 14 bp, Homo sapiens
tgatccctttccca

SEQ ID NO: 2038163 - DNA, 18 bp, Homo sapiens
tgatcctcccacctcagc

SEQ ID NO: 2038164 - DNA, 22 bp, Homo sapiens
tgatcctcccacctcagcctcc

SEQ ID NO: 2038165 - DNA, 15 bp, Homo sapiens
tgatccttgttttaa

SEQ ID NO: 2038166 - DNA, 19 bp, Homo sapiens
tgatcgggataacaaaatc

SEQ ID NO: 2038167 - DNA, 23 bp, Homo sapiens
tgatcgggataacaaaatcacaa

SEQ ID NO: 2038168 - DNA, 23 bp, Homo sapiens
tgatctcaggagcttgcaagaag

SEQ ID NO: 2038169 - DNA, 21 bp, Homo sapiens
tgatctccatatgttacacta

SEQ ID NO: 2038170 - DNA, 14 bp, Homo sapiens
tgatctctccacgg

SEQ ID NO: 2038171 - DNA, 14 bp, Homo sapiens
tgatctgaaaaata

SEQ ID NO: 2038172 - DNA, 19 bp, Homo sapiens
tgatctgactttaattgtg

SEQ ID NO: 2038173 - DNA, 22 bp, Homo sapiens
tgatctgtatttaatggttttt

SEQ ID NO: 2038174 - DNA, 23 bp, Homo sapiens
tgatctgtatttaatggttttta

SEQ ID NO: 2038175 - DNA, 13 bp, Homo sapiens
tgatctgtcccct

SEQ ID NO: 2038176 - DNA, 19 bp, Homo sapiens
tgatctgtgaattgagctg

SEQ ID NO: 2038177 - DNA, 20 bp, Homo sapiens
tgatctttgcagacaggcaa

SEQ ID NO: 2038178 - DNA, 16 bp, Homo sapiens
tgatcttttcagtgtt

SEQ ID NO: 2038179 - DNA, 23 bp, Homo sapiens
tgatgaaaatgaatagagagtat

SEQ ID NO: 2038180 - DNA, 22 bp, Homo sapiens
tgatgaaactcctgattttgta

SEQ ID NO: 2038181 - DNA, 23 bp, Homo sapiens
tgatgaaatgaggtcagagcctg

SEQ ID NO: 2038182 - DNA, 18 bp, Homo sapiens
tgatgaactcttaatcaa

SEQ ID NO: 2038183 - DNA, 14 bp, Homo sapiens
tgatgaagcctgtg

SEQ ID NO: 2038184 - DNA, 23 bp, Homo sapiens
tgatgaagcctgtgccacctgca

SEQ ID NO: 2038185 - DNA, 17 bp, Homo sapiens
tgatgaccaatctctgt

SEQ ID NO: 2038186 - DNA, 16 bp, Homo sapiens
tgatgagctcctcttc

SEQ ID NO: 2038187 - DNA, 13 bp, Homo sapiens
tgatgagggcagc

SEQ ID NO: 2038188 - DNA, 21 bp, Homo sapiens
tgatgagggcagcagccagcc

SEQ ID NO: 2038189 - DNA, 23 bp, Homo sapiens
tgatgagggcagcagccagccct

SEQ ID NO: 2038190 - DNA, 24 bp, Homo sapiens
tgatgagggcagcagccagccctg

SEQ ID NO: 2038191 - DNA, 14 bp, Homo sapiens
tgatgatctttaaa

SEQ ID NO: 2038192 - DNA, 19 bp, Homo sapiens
tgatgatctttgcagacag

SEQ ID NO: 2038193 - DNA, 22 bp, Homo sapiens
tgatgatctttgcagacaggca

SEQ ID NO: 2038194 - DNA, 20 bp, Homo sapiens
tgatgatgaaatgaggtcag

SEQ ID NO: 2038195 - DNA, 15 bp, Homo sapiens
tgatgatgaccaaga

SEQ ID NO: 2038196 - DNA, 16 bp, Homo sapiens
tgatgatgaccaagaa

SEQ ID NO: 2038197 - DNA, 17 bp, Homo sapiens
tgatgatgatgatgatg

SEQ ID NO: 2038198 - DNA, 15 bp, Homo sapiens
tgatgatgtctcttg

SEQ ID NO: 2038199 - DNA, 19 bp, Homo sapiens
tgatgatgtctcttgtaga

SEQ ID NO: 2038200 - DNA, 17 bp, Homo sapiens
tgatgattaaacacctg

SEQ ID NO: 2038201 - DNA, 21 bp, Homo sapiens
tgatgattaaacacctgacac

SEQ ID NO: 2038202 - DNA, 21 bp, Homo sapiens
tgatgcatcagaaagggaggg

SEQ ID NO: 2038203 - DNA, 15 bp, Homo sapiens
tgatgcatttccaca

SEQ ID NO: 2038204 - DNA, 18 bp, Homo sapiens
tgatgcatttccacactg

SEQ ID NO: 2038205 - DNA, 14 bp, Homo sapiens
tgatgccccttccc

SEQ ID NO: 2038206 - DNA, 23 bp, Homo sapiens
tgatgccgctcttctgtcatccc

SEQ ID NO: 2038207 - DNA, 14 bp, Homo sapiens
tgatgctcaggctt

SEQ ID NO: 2038208 - DNA, 11 bp, Homo sapiens
tgatgctgccc

SEQ ID NO: 2038209 - DNA, 18 bp, Homo sapiens
tgatggaccgggtgggcc

SEQ ID NO: 2038210 - DNA, 20 bp, Homo sapiens
tgatggaccgggtgggcctg

SEQ ID NO: 2038211 - DNA, 22 bp, Homo sapiens
tgatggaccgggtgggcctggc

SEQ ID NO: 2038212 - DNA, 12 bp, Homo sapiens
tgatggagaagg

SEQ ID NO: 2038213 - DNA, 15 bp, Homo sapiens
tgatggagaaggaag

SEQ ID NO: 2038214 - DNA, 16 bp, Homo sapiens
tgatggagaaggaagg

SEQ ID NO: 2038215 - DNA, 17 bp, Homo sapiens
tgatggccaagagcatc

SEQ ID NO: 2038216 - DNA, 20 bp, Homo sapiens
tgatggcgcgggaggcacca

SEQ ID NO: 2038217 - DNA, 23 bp, Homo sapiens
tgatggcgcgggaggcaccagct

SEQ ID NO: 2038218 - DNA, 21 bp, Homo sapiens
tgatgggcaacccccagcctg

SEQ ID NO: 2038219 - DNA, 22 bp, Homo sapiens
tgatgggcaacccccagcctgc

SEQ ID NO: 2038220 - DNA, 19 bp, Homo sapiens
tgatggggagaaagggcaa

SEQ ID NO: 2038221 - DNA, 21 bp, Homo sapiens
tgatggggtgggcagggctgg

SEQ ID NO: 2038222 - DNA, 22 bp, Homo sapiens
tgatggggtgggcagggctggg

SEQ ID NO: 2038223 - DNA, 15 bp, Homo sapiens
tgatggtgctgacct

SEQ ID NO: 2038224 - DNA, 13 bp, Homo sapiens
tgatgtacatgtg

SEQ ID NO: 2038225 - DNA, 13 bp, Homo sapiens
tgatgtcagcctt

SEQ ID NO: 2038226 - DNA, 15 bp, Homo sapiens
tgatgtcagccttgc

SEQ ID NO: 2038227 - DNA, 16 bp, Homo sapiens
tgatgtcagccttgca

SEQ ID NO: 2038228 - DNA, 22 bp, Homo sapiens
tgatgtcatgtacttcctgtgt

SEQ ID NO: 2038229 - DNA, 18 bp, Homo sapiens
tgatgtctcttgtagaag

SEQ ID NO: 2038230 - DNA, 18 bp, Homo sapiens
tgatgtgggtcaaggaat

SEQ ID NO: 2038231 - DNA, 23 bp, Homo sapiens
tgatgtgttgtgatagctaacat

SEQ ID NO: 2038232 - DNA, 14 bp, Homo sapiens
tgatgttaaaattc

SEQ ID NO: 2038233 - DNA, 17 bp, Homo sapiens
tgatgttaaaattccat

SEQ ID NO: 2038234 - DNA, 15 bp, Homo sapiens
tgatgttaactatta

SEQ ID NO: 2038235 - DNA, 17 bp, Homo sapiens
tgatgttgagggaacag

SEQ ID NO: 2038236 - DNA, 15 bp, Homo sapiens
tgatgtttccagaaa

SEQ ID NO: 2038237 - DNA, 17 bp, Homo sapiens
tgatgtttccagaaaat

SEQ ID NO: 2038238 - DNA, 16 bp, Homo sapiens
tgatgttttgttcaaa

SEQ ID NO: 2038239 - DNA, 16 bp, Homo sapiens
tgattaaacacctgac

SEQ ID NO: 2038240 - DNA, 17 bp, Homo sapiens
tgattaaacacctgaca

SEQ ID NO: 2038241 - DNA, 15 bp, Homo sapiens
tgattaaacagactt

SEQ ID NO: 2038242 - DNA, 13 bp, Homo sapiens
tgattacacagtt

SEQ ID NO: 2038243 - DNA, 14 bp, Homo sapiens
tgattacacagttg

SEQ ID NO: 2038244 - DNA, 11 bp, Homo sapiens
tgattatcagg

SEQ ID NO: 2038245 - DNA, 20 bp, Homo sapiens
tgattattttcattacaatg

SEQ ID NO: 2038246 - DNA, 14 bp, Homo sapiens
tgattcaaaagtga

SEQ ID NO: 2038247 - DNA, 15 bp, Homo sapiens
tgattcaagaaacag

SEQ ID NO: 2038248 - DNA, 16 bp, Homo sapiens
tgattcactattagag

SEQ ID NO: 2038249 - DNA, 12 bp, Homo sapiens
tgattcataaca

SEQ ID NO: 2038250 - DNA, 13 bp, Homo sapiens
tgattcataacaa

SEQ ID NO: 2038251 - DNA, 17 bp, Homo sapiens
tgattcattttaacatc

SEQ ID NO: 2038252 - DNA, 22 bp, Homo sapiens
tgattcattttaacatctgaga

SEQ ID NO: 2038253 - DNA, 15 bp, Homo sapiens
tgattccacttttat

SEQ ID NO: 2038254 - DNA, 22 bp, Homo sapiens
tgattcccaagctctgctcctc

SEQ ID NO: 2038255 - DNA, 23 bp, Homo sapiens
tgattcccaagctctgctcctct

SEQ ID NO: 2038256 - DNA, 21 bp, Homo sapiens
tgattccccactcaatgacat

SEQ ID NO: 2038257 - DNA, 18 bp, Homo sapiens
tgattccttgagcatttt

SEQ ID NO: 2038258 - DNA, 14 bp, Homo sapiens
tgattccttttgat

SEQ ID NO: 2038259 - DNA, 23 bp, Homo sapiens
tgattccttttgatggggagaaa

SEQ ID NO: 2038260 - DNA, 18 bp, Homo sapiens
tgattcgaatgacactgt

SEQ ID NO: 2038261 - DNA, 15 bp, Homo sapiens
tgattctaatgtctt

SEQ ID NO: 2038262 - DNA, 15 bp, Homo sapiens
tgattctcctgcctc

SEQ ID NO: 2038263 - DNA, 14 bp, Homo sapiens
tgattctgaatctg

SEQ ID NO: 2038264 - DNA, 17 bp, Homo sapiens
tgattctgaatctgaaa

SEQ ID NO: 2038265 - DNA, 22 bp, Homo sapiens
tgattctgggatggaccctcgc

SEQ ID NO: 2038266 - DNA, 22 bp, Homo sapiens
tgattgaatctgattggacatt

SEQ ID NO: 2038267 - DNA, 16 bp, Homo sapiens
tgattggattattcat

SEQ ID NO: 2038268 - DNA, 17 bp, Homo sapiens
tgattggattattcatt

SEQ ID NO: 2038269 - DNA, 19 bp, Homo sapiens
tgattggattattcattta

SEQ ID NO: 2038270 - DNA, 17 bp, Homo sapiens
tgattgtaaaatagctt

SEQ ID NO: 2038271 - DNA, 15 bp, Homo sapiens
tgatttaaaaaataa

SEQ ID NO: 2038272 - DNA, 18 bp, Homo sapiens
tgatttaaatttataatt

SEQ ID NO: 2038273 - DNA, 14 bp, Homo sapiens
tgatttaagcattt

SEQ ID NO: 2038274 - DNA, 14 bp, Homo sapiens
tgatttaatgtttt

SEQ ID NO: 2038275 - DNA, 18 bp, Homo sapiens
tgatttaatgttttctgc

SEQ ID NO: 2038276 - DNA, 22 bp, Homo sapiens
tgatttatagtttgtacatgca

SEQ ID NO: 2038277 - DNA, 17 bp, Homo sapiens
tgatttatatgtgtaat

SEQ ID NO: 2038278 - DNA, 13 bp, Homo sapiens
tgatttatgcatg

SEQ ID NO: 2038279 - DNA, 22 bp, Homo sapiens
tgatttatgcatggaaacctga

SEQ ID NO: 2038280 - DNA, 19 bp, Homo sapiens
tgatttcaggatactctgt

SEQ ID NO: 2038281 - DNA, 13 bp, Homo sapiens
tgatttcatttca

SEQ ID NO: 2038282 - DNA, 14 bp, Homo sapiens
tgatttccaaagag

SEQ ID NO: 2038283 - DNA, 12 bp, Homo sapiens
tgatttccaggc

SEQ ID NO: 2038284 - DNA, 15 bp, Homo sapiens
tgatttccaggcccc

SEQ ID NO: 2038285 - DNA, 15 bp, Homo sapiens
tgatttgacccactc

SEQ ID NO: 2038286 - DNA, 18 bp, Homo sapiens
tgatttgacccactcaca

SEQ ID NO: 2038287 - DNA, 15 bp, Homo sapiens
tgatttgtactgaaa

SEQ ID NO: 2038288 - DNA, 12 bp, Homo sapiens
tgattttaagag

SEQ ID NO: 2038289 - DNA, 14 bp, Homo sapiens
tgattttacagaga

SEQ ID NO: 2038290 - DNA, 16 bp, Homo sapiens
tgattttacagagaat

SEQ ID NO: 2038291 - DNA, 20 bp, Homo sapiens
tgattttacagagaatctga

SEQ ID NO: 2038292 - DNA, 21 bp, Homo sapiens
tgattttacagagaatctgaa

SEQ ID NO: 2038293 - DNA, 19 bp, Homo sapiens
tgattttagccttctctgt

SEQ ID NO: 2038294 - DNA, 18 bp, Homo sapiens
tgattttatacatagtca

SEQ ID NO: 2038295 - DNA, 15 bp, Homo sapiens
tgattttcatcaatt

SEQ ID NO: 2038296 - DNA, 13 bp, Homo sapiens
tgattttggcatg

SEQ ID NO: 2038297 - DNA, 21 bp, Homo sapiens
tgattttgtacagaattttta

SEQ ID NO: 2038298 - DNA, 20 bp, Homo sapiens
tgattttgtagttaatttat

SEQ ID NO: 2038299 - DNA, 17 bp, Homo sapiens
tgattttgtcactgtct

SEQ ID NO: 2038300 - DNA, 13 bp, Homo sapiens
tgattttttaaaa

SEQ ID NO: 2038301 - DNA, 21 bp, Homo sapiens
tgcaaaagaagtttctggagc

SEQ ID NO: 2038302 - DNA, 20 bp, Homo sapiens
tgcaaaagactaatttaaaa

SEQ ID NO: 2038303 - DNA, 23 bp, Homo sapiens
tgcaaaagactaatttaaaaaat

SEQ ID NO: 2038304 - DNA, 16 bp, Homo sapiens
tgcaaaatttccagta

SEQ ID NO: 2038305 - DNA, 15 bp, Homo sapiens
tgcaaacactgtgta

SEQ ID NO: 2038306 - DNA, 18 bp, Homo sapiens
tgcaaagcactgacttct

SEQ ID NO: 2038307 - DNA, 20 bp, Homo sapiens
tgcaaagcactgacttctaa

SEQ ID NO: 2038308 - DNA, 14 bp, Homo sapiens
tgcaaagtaaaaaa

SEQ ID NO: 2038309 - DNA, 20 bp, Homo sapiens
tgcaaagtaaaaaaatatga

SEQ ID NO: 2038310 - DNA, 12 bp, Homo sapiens
tgcaaagtgcaa

SEQ ID NO: 2038311 - DNA, 14 bp, Homo sapiens
tgcaaagtgcaaat

SEQ ID NO: 2038312 - DNA, 16 bp, Homo sapiens
tgcaaagtgccctcat

SEQ ID NO: 2038313 - DNA, 18 bp, Homo sapiens
tgcaaatattagcaaaga

SEQ ID NO: 2038314 - DNA, 15 bp, Homo sapiens
tgcaaatgcaacaaa

SEQ ID NO: 2038315 - DNA, 13 bp, Homo sapiens
tgcaaatttcaaa

SEQ ID NO: 2038316 - DNA, 15 bp, Homo sapiens
tgcaaattttgcatt

SEQ ID NO: 2038317 - DNA, 16 bp, Homo sapiens
tgcaaattttgcattt

SEQ ID NO: 2038318 - DNA, 20 bp, Homo sapiens
tgcaaattttgcatttagtt

SEQ ID NO: 2038319 - DNA, 18 bp, Homo sapiens
tgcaacaaaatatttaat

SEQ ID NO: 2038320 - DNA, 15 bp, Homo sapiens
tgcaacaacatgtat

SEQ ID NO: 2038321 - DNA, 13 bp, Homo sapiens
tgcaacaggctgg

SEQ ID NO: 2038322 - DNA, 17 bp, Homo sapiens
tgcaacaggctgggctt

SEQ ID NO: 2038323 - DNA, 11 bp, Homo sapiens
tgcaaccactg

SEQ ID NO: 2038324 - DNA, 13 bp, Homo sapiens
tgcaaccactgca

SEQ ID NO: 2038325 - DNA, 13 bp, Homo sapiens
tgcaacctccgcc

SEQ ID NO: 2038326 - DNA, 14 bp, Homo sapiens
tgcaacctccgcct

SEQ ID NO: 2038327 - DNA, 16 bp, Homo sapiens
tgcaactagccaaggc

SEQ ID NO: 2038328 - DNA, 17 bp, Homo sapiens
tgcaactagccaaggct

SEQ ID NO: 2038329 - DNA, 17 bp, Homo sapiens
tgcaacttctttttatt

SEQ ID NO: 2038330 - DNA, 21 bp, Homo sapiens
tgcaacttctttttattttct

SEQ ID NO: 2038331 - DNA, 15 bp, Homo sapiens
tgcaagaagtcttga

SEQ ID NO: 2038332 - DNA, 20 bp, Homo sapiens
tgcaagaagtcttgagaaaa

SEQ ID NO: 2038333 - DNA, 18 bp, Homo sapiens
tgcaagagactctggcct

SEQ ID NO: 2038334 - DNA, 19 bp, Homo sapiens
tgcaagagactctggcctc

SEQ ID NO: 2038335 - DNA, 14 bp, Homo sapiens
tgcaagagccttgg

SEQ ID NO: 2038336 - DNA, 18 bp, Homo sapiens
tgcaagcagcctcctggg

SEQ ID NO: 2038337 - DNA, 17 bp, Homo sapiens
tgcaagcagggctctgc

SEQ ID NO: 2038338 - DNA, 20 bp, Homo sapiens
tgcaagcagggctctgcccc

SEQ ID NO: 2038339 - DNA, 13 bp, Homo sapiens
tgcaagccccagg

SEQ ID NO: 2038340 - DNA, 17 bp, Homo sapiens
tcatgttttgtgactat

SEQ ID NO: 2038341 - DNA, 21 bp, Homo sapiens
tcattaaaataaataaatgca

SEQ ID NO: 2038342 - DNA, 15 bp, Homo sapiens
tcattaaatggggct

SEQ ID NO: 2038343 - DNA, 15 bp, Homo sapiens
tcattaaattttcta

SEQ ID NO: 2038344 - DNA, 23 bp, Homo sapiens
tcattaaggtattattttttcca

SEQ ID NO: 2038345 - DNA, 15 bp, Homo sapiens
tcattactgcctttg

SEQ ID NO: 2038346 - DNA, 13 bp, Homo sapiens
tcattagctgtga

SEQ ID NO: 2038347 - DNA, 17 bp, Homo sapiens
tcattagctgtgatttt

SEQ ID NO: 2038348 - DNA, 16 bp, Homo sapiens
tcattaggtttccttt

SEQ ID NO: 2038349 - DNA, 13 bp, Homo sapiens
tcattatctcaaa

SEQ ID NO: 2038350 - DNA, 20 bp, Homo sapiens
tcattatctcaaaactgcac

SEQ ID NO: 2038351 - DNA, 16 bp, Homo sapiens
tcattatgtagaaata

SEQ ID NO: 2038352 - DNA, 13 bp, Homo sapiens
tcattcaaaacaa

SEQ ID NO: 2038353 - DNA, 17 bp, Homo sapiens
tcattcaagcctgtgaa

SEQ ID NO: 2038354 - DNA, 15 bp, Homo sapiens
tcattcaatatctga

SEQ ID NO: 2038355 - DNA, 13 bp, Homo sapiens
tcattcaggaaaa

SEQ ID NO: 2038356 - DNA, 23 bp, Homo sapiens
tcattccaccttcccatgccctg

SEQ ID NO: 2038357 - DNA, 12 bp, Homo sapiens
tcattccccagg

SEQ ID NO: 2038358 - DNA, 23 bp, Homo sapiens
tcattccccaggtggctgaccca

SEQ ID NO: 2038359 - DNA, 14 bp, Homo sapiens
tcattcctgaaaga

SEQ ID NO: 2038360 - DNA, 20 bp, Homo sapiens
tcattcctgaaagaaacagt

SEQ ID NO: 2038361 - DNA, 20 bp, Homo sapiens
tcattccttcactcatccag

SEQ ID NO: 2038362 - DNA, 13 bp, Homo sapiens
tcattctcctgcc

SEQ ID NO: 2038363 - DNA, 16 bp, Homo sapiens
tcattctcctgcctgt

SEQ ID NO: 2038364 - DNA, 19 bp, Homo sapiens
tcattctcttatatagtat

SEQ ID NO: 2038365 - DNA, 23 bp, Homo sapiens
tcattcttaccgagaaaaggaga

SEQ ID NO: 2038366 - DNA, 12 bp, Homo sapiens
tcattcttctgt

SEQ ID NO: 2038367 - DNA, 14 bp, Homo sapiens
tcattgaagtattt

SEQ ID NO: 2038368 - DNA, 23 bp, Homo sapiens
tcattgagggaaaacataatatc

SEQ ID NO: 2038369 - DNA, 15 bp, Homo sapiens
tcattgatatgaaaa

SEQ ID NO: 2038370 - DNA, 16 bp, Homo sapiens
tcattgatatgaaaaa

SEQ ID NO: 2038371 - DNA, 23 bp, Homo sapiens
tcattgctttgaagcagttgtgt

SEQ ID NO: 2038372 - DNA, 16 bp, Homo sapiens
tcattgggagaagccg

SEQ ID NO: 2038373 - DNA, 17 bp, Homo sapiens
tcattgggttttatcag

SEQ ID NO: 2038374 - DNA, 22 bp, Homo sapiens
tcattgtagaaacacagttttg

SEQ ID NO: 2038375 - DNA, 16 bp, Homo sapiens
tcattgtataaaaata

SEQ ID NO: 2038376 - DNA, 15 bp, Homo sapiens
tcattgtatatatgt

SEQ ID NO: 2038377 - DNA, 21 bp, Homo sapiens
tcattgtatatatgtgtgttt

SEQ ID NO: 2038378 - DNA, 18 bp, Homo sapiens
tcattgtatgatgtgttg

SEQ ID NO: 2038379 - DNA, 15 bp, Homo sapiens
tcattgtcgctcagc

SEQ ID NO: 2038380 - DNA, 16 bp, Homo sapiens
tcattgtcgctcagca

SEQ ID NO: 2038381 - DNA, 11 bp, Homo sapiens
tcattgttaca

SEQ ID NO: 2038382 - DNA, 23 bp, Homo sapiens
tcattgtttattaacaaattatg

SEQ ID NO: 2038383 - DNA, 14 bp, Homo sapiens
tcatttaaaatgat

SEQ ID NO: 2038384 - DNA, 15 bp, Homo sapiens
tcatttaaaatgatt

SEQ ID NO: 2038385 - DNA, 17 bp, Homo sapiens
tcatttaaaatgattag

SEQ ID NO: 2038386 - DNA, 15 bp, Homo sapiens
tcatttatccctcaa

SEQ ID NO: 2038387 - DNA, 15 bp, Homo sapiens
tcatttatgaaaaga

SEQ ID NO: 2038388 - DNA, 15 bp, Homo sapiens
tcatttcactttaaa

SEQ ID NO: 2038389 - DNA, 14 bp, Homo sapiens
tcatttcatctcat

SEQ ID NO: 2038390 - DNA, 14 bp, Homo sapiens
tcatttcattgtat

SEQ ID NO: 2038391 - DNA, 18 bp, Homo sapiens
tcatttctactgtgactg

SEQ ID NO: 2038392 - DNA, 22 bp, Homo sapiens
tcatttctgcatcagctgctga

SEQ ID NO: 2038393 - DNA, 16 bp, Homo sapiens
tcatttgatgctaaat

SEQ ID NO: 2038394 - DNA, 16 bp, Homo sapiens
tcatttgtcacacact

SEQ ID NO: 2038395 - DNA, 16 bp, Homo sapiens
tcattttaaaatctga

SEQ ID NO: 2038396 - DNA, 19 bp, Homo sapiens
tcattttaaaatctgattt

SEQ ID NO: 2038397 - DNA, 20 bp, Homo sapiens
tcattttaacatctgagaaa

SEQ ID NO: 2038398 - DNA, 20 bp, Homo sapiens
tcattttaagaagacatgac

SEQ ID NO: 2038399 - DNA, 14 bp, Homo sapiens
tcattttaatttat

SEQ ID NO: 2038400 - DNA, 18 bp, Homo sapiens
tcattttacccttggctc

SEQ ID NO: 2038401 - DNA, 17 bp, Homo sapiens
tcattttaggcctcctc

SEQ ID NO: 2038402 - DNA, 14 bp, Homo sapiens
tcattttagtgact

SEQ ID NO: 2038403 - DNA, 15 bp, Homo sapiens
tcattttagtgactg

SEQ ID NO: 2038404 - DNA, 17 bp, Homo sapiens
tcattttctattcacca

SEQ ID NO: 2038405 - DNA, 20 bp, Homo sapiens
tcattttgtaacaaatgaac

SEQ ID NO: 2038406 - DNA, 13 bp, Homo sapiens
tcattttttctta

SEQ ID NO: 2038407 - DNA, 16 bp, Homo sapiens
tcatttttttaacaca

SEQ ID NO: 2038408 - DNA, 18 bp, Homo sapiens
tcatttttttccttgcaa

SEQ ID NO: 2038409 - DNA, 19 bp, Homo sapiens
tccaaacaccggcagaaaa

SEQ ID NO: 2038410 - DNA, 21 bp, Homo sapiens
tccaaacctcctgttagctgt

SEQ ID NO: 2038411 - DNA, 13 bp, Homo sapiens
tccaaactcctgc

SEQ ID NO: 2038412 - DNA, 14 bp, Homo sapiens
tccaaactcctgcc

SEQ ID NO: 2038413 - DNA, 16 bp, Homo sapiens
tccaaactcctgcctg

SEQ ID NO: 2038414 - DNA, 19 bp, Homo sapiens
tccaaacttctaaatgttg

SEQ ID NO: 2038415 - DNA, 23 bp, Homo sapiens
tccaaaggaagtctaggagctgg

SEQ ID NO: 2038416 - DNA, 21 bp, Homo sapiens
tccaaaggggctgctggggca

SEQ ID NO: 2038417 - DNA, 19 bp, Homo sapiens
tatccttggagagcagctg

SEQ ID NO: 2038418 - DNA, 16 bp, Homo sapiens
tatcggagacagtgat

SEQ ID NO: 2038419 - DNA, 19 bp, Homo sapiens
tatcggaggtggtggagga

SEQ ID NO: 2038420 - DNA, 14 bp, Homo sapiens
tatcgggaacagtg

SEQ ID NO: 2038421 - DNA, 17 bp, Homo sapiens
tatcgggaacagtgttt

SEQ ID NO: 2038422 - DNA, 14 bp, Homo sapiens
tatcgggagcagtg

SEQ ID NO: 2038423 - DNA, 23 bp, Homo sapiens
tatctaagttaatttaaagttgt

SEQ ID NO: 2038424 - DNA, 15 bp, Homo sapiens
tatctaatacctctg

SEQ ID NO: 2038425 - DNA, 18 bp, Homo sapiens
tatctaatttatacaaaa

SEQ ID NO: 2038426 - DNA, 20 bp, Homo sapiens
tatctactgataaagaaaga

SEQ ID NO: 2038427 - DNA, 18 bp, Homo sapiens
tatctagaaagaaaagac

SEQ ID NO: 2038428 - DNA, 21 bp, Homo sapiens
tatctagaaagaaaagaccct

SEQ ID NO: 2038429 - DNA, 17 bp, Homo sapiens
tatctatatctctaaac

SEQ ID NO: 2038430 - DNA, 17 bp, Homo sapiens
tatctatctatttgagg

SEQ ID NO: 2038431 - DNA, 12 bp, Homo sapiens
tatctatttgag

SEQ ID NO: 2038432 - DNA, 15 bp, Homo sapiens
tatctcagaggctat

SEQ ID NO: 2038433 - DNA, 14 bp, Homo sapiens
tatctcatcaacaa

SEQ ID NO: 2038434 - DNA, 23 bp, Homo sapiens
tatctccttcccctacacctccc

SEQ ID NO: 2038435 - DNA, 16 bp, Homo sapiens
tatctctaaactgctg

SEQ ID NO: 2038436 - DNA, 21 bp, Homo sapiens
tatctctaaactgctgttaat

SEQ ID NO: 2038437 - DNA, 16 bp, Homo sapiens
tatctctatttaatat

SEQ ID NO: 2038438 - DNA, 17 bp, Homo sapiens
tatctctatttaatatt

SEQ ID NO: 2038439 - DNA, 18 bp, Homo sapiens
tatctctatttaatattt

SEQ ID NO: 2038440 - DNA, 16 bp, Homo sapiens
tatctctgaagcatgt

SEQ ID NO: 2038441 - DNA, 18 bp, Homo sapiens
tatctctgaagcatgttt

SEQ ID NO: 2038442 - DNA, 16 bp, Homo sapiens
tatctctgtgtgcaca

SEQ ID NO: 2038443 - DNA, 17 bp, Homo sapiens
tatctctgtgtgcacaa

SEQ ID NO: 2038444 - DNA, 23 bp, Homo sapiens
tatctcttttgaatccatgcttg

SEQ ID NO: 2038445 - DNA, 14 bp, Homo sapiens
tatctgaaaactgg

SEQ ID NO: 2038446 - DNA, 14 bp, Homo sapiens
tatctgaacacata

SEQ ID NO: 2038447 - DNA, 19 bp, Homo sapiens
tatctgaatttttaaacaa

SEQ ID NO: 2038448 - DNA, 20 bp, Homo sapiens
tatctgaatttttaaacaag

SEQ ID NO: 2038449 - DNA, 16 bp, Homo sapiens
tatctgagaagtgtat

SEQ ID NO: 2038450 - DNA, 18 bp, Homo sapiens
tatctgagaagtgtatat

SEQ ID NO: 2038451 - DNA, 19 bp, Homo sapiens
tatctgagaagtgtatata

SEQ ID NO: 2038452 - DNA, 22 bp, Homo sapiens
tatctgcatttataaatgtgtg

SEQ ID NO: 2038453 - DNA, 19 bp, Homo sapiens
tatctgcctggcctggctc

SEQ ID NO: 2038454 - DNA, 20 bp, Homo sapiens
tatctgcttcagtggagaat

SEQ ID NO: 2038455 - DNA, 12 bp, Homo sapiens
tatctggaattt

SEQ ID NO: 2038456 - DNA, 20 bp, Homo sapiens
tatctgtaattaatattcct

SEQ ID NO: 2038457 - DNA, 16 bp, Homo sapiens
tatctgtattttcatt

SEQ ID NO: 2038458 - DNA, 21 bp, Homo sapiens
tatctgtcatttgagcagggc

SEQ ID NO: 2038459 - DNA, 18 bp, Homo sapiens
tatctgtgaggtgctgat

SEQ ID NO: 2038460 - DNA, 13 bp, Homo sapiens
tatctgtggtctt

SEQ ID NO: 2038461 - DNA, 17 bp, Homo sapiens
tatcttactatttcaca

SEQ ID NO: 2038462 - DNA, 23 bp, Homo sapiens
tatcttatttaatttttgcaatt

SEQ ID NO: 2038463 - DNA, 14 bp, Homo sapiens
tatcttcacatagt

SEQ ID NO: 2038464 - DNA, 15 bp, Homo sapiens
tatcttcacatagtt

SEQ ID NO: 2038465 - DNA, 19 bp, Homo sapiens
tatcttctgcagacactgt

SEQ ID NO: 2038466 - DNA, 14 bp, Homo sapiens
tatcttgaaaagaa

SEQ ID NO: 2038467 - DNA, 18 bp, Homo sapiens
tatcttgaagaatattgt

SEQ ID NO: 2038468 - DNA, 14 bp, Homo sapiens
tatcttgaatttca

SEQ ID NO: 2038469 - DNA, 20 bp, Homo sapiens
tatctttgaagccagtattt

SEQ ID NO: 2038470 - DNA, 18 bp, Homo sapiens
tatgaaaaacaaaaataa

SEQ ID NO: 2038471 - DNA, 15 bp, Homo sapiens
tatgaaaaagaagaa

SEQ ID NO: 2038472 - DNA, 14 bp, Homo sapiens
tatgaaaaatatga

SEQ ID NO: 2038473 - DNA, 22 bp, Homo sapiens
tatgaaatgataaagatgtcaa

SEQ ID NO: 2038474 - DNA, 17 bp, Homo sapiens
tatgaaatgtttcacta

SEQ ID NO: 2038475 - DNA, 20 bp, Homo sapiens
tatgaaatttaatatagcta

SEQ ID NO: 2038476 - DNA, 22 bp, Homo sapiens
tatgaaatttaatatagctatt

SEQ ID NO: 2038477 - DNA, 20 bp, Homo sapiens
tatgaagaaaaaatacattt

SEQ ID NO: 2038478 - DNA, 22 bp, Homo sapiens
tatgaatgatgttttagaatga

SEQ ID NO: 2038479 - DNA, 13 bp, Homo sapiens
tatgacaagcaag

SEQ ID NO: 2038480 - DNA, 23 bp, Homo sapiens
tatgacatcacttgtacaaaata

SEQ ID NO: 2038481 - DNA, 18 bp, Homo sapiens
tatgaccttctaggaagc

SEQ ID NO: 2038482 - DNA, 17 bp, Homo sapiens
tatgactgctccccagc

SEQ ID NO: 2038483 - DNA, 22 bp, Homo sapiens
tatgactgctccccagccctgg

SEQ ID NO: 2038484 - DNA, 14 bp, Homo sapiens
tatgactgtaaaca

SEQ ID NO: 2038485 - DNA, 22 bp, Homo sapiens
tatgacttgggcacccccagcc

SEQ ID NO: 2038486 - DNA, 13 bp, Homo sapiens
tatgagctgaggg

SEQ ID NO: 2038487 - DNA, 17 bp, Homo sapiens
tatgaggaataattatt

SEQ ID NO: 2038488 - DNA, 17 bp, Homo sapiens
tatgaggacttgtgtct

SEQ ID NO: 2038489 - DNA, 15 bp, Homo sapiens
tatgagggaaaatga

SEQ ID NO: 2038490 - DNA, 14 bp, Homo sapiens
tatgagtatacaat

SEQ ID NO: 2038491 - DNA, 23 bp, Homo sapiens
tatgagtttttgatagctttatt

SEQ ID NO: 2038492 - DNA, 14 bp, Homo sapiens
tatgatcacagtga

SEQ ID NO: 2038493 - DNA, 23 bp, Homo sapiens
tatgatcacggctcactgcagcc

SEQ ID NO: 2038494 - DNA, 18 bp, Homo sapiens
tatgatgtgggtcaagga

SEQ ID NO: 2038495 - DNA, 18 bp, Homo sapiens
tatgatgtgttgtgatag

SEQ ID NO: 2038496 - DNA, 14 bp, Homo sapiens
tatttcctgctaca

SEQ ID NO: 2038497 - DNA, 13 bp, Homo sapiens
tatttctagcaga

SEQ ID NO: 2038498 - DNA, 11 bp, Homo sapiens
tatttctgaga

SEQ ID NO: 2038499 - DNA, 16 bp, Homo sapiens
tatttctgagaaggtc

SEQ ID NO: 2038500 - DNA, 21 bp, Homo sapiens
tatttctgagaaggtccttaa

SEQ ID NO: 2038501 - DNA, 19 bp, Homo sapiens
tatttctgtaaaatttgtt

SEQ ID NO: 2038502 - DNA, 19 bp, Homo sapiens
tatttgaaactgaatgttt

SEQ ID NO: 2038503 - DNA, 16 bp, Homo sapiens
tatttgaatatcatta

SEQ ID NO: 2038504 - DNA, 23 bp, Homo sapiens
tatttgctaattaaaaagttaat

SEQ ID NO: 2038505 - DNA, 18 bp, Homo sapiens
tatttggaataataattt

SEQ ID NO: 2038506 - DNA, 18 bp, Homo sapiens
tatttggtctctatttca

SEQ ID NO: 2038507 - DNA, 14 bp, Homo sapiens
tatttgtaatagat

SEQ ID NO: 2038508 - DNA, 16 bp, Homo sapiens
tatttgtacaaatact

SEQ ID NO: 2038509 - DNA, 15 bp, Homo sapiens
tatttgtatctctga

SEQ ID NO: 2038510 - DNA, 19 bp, Homo sapiens
tatttgtatgtactgttat

SEQ ID NO: 2038511 - DNA, 19 bp, Homo sapiens
tatttgtattcccttttat

SEQ ID NO: 2038512 - DNA, 15 bp, Homo sapiens
tatttgtctttcagg

SEQ ID NO: 2038513 - DNA, 14 bp, Homo sapiens
tatttgtgtatgtg

SEQ ID NO: 2038514 - DNA, 22 bp, Homo sapiens
tatttgttaatggtttgaatat

SEQ ID NO: 2038515 - DNA, 17 bp, Homo sapiens
tatttgttattttcagt

SEQ ID NO: 2038516 - DNA, 18 bp, Homo sapiens
tatttgtttacatgcaga

SEQ ID NO: 2038517 - DNA, 15 bp, Homo sapiens
tatttgtttggtcac

SEQ ID NO: 2038518 - DNA, 20 bp, Homo sapiens
tattttaaaaccatgcagct

SEQ ID NO: 2038519 - DNA, 19 bp, Homo sapiens
tattttaatttatgagttt

SEQ ID NO: 2038520 - DNA, 18 bp, Homo sapiens
tattttacttctagagat

SEQ ID NO: 2038521 - DNA, 21 bp, Homo sapiens
tattttaggcagggatttgag

SEQ ID NO: 2038522 - DNA, 17 bp, Homo sapiens
tattttagtctgtcatc

SEQ ID NO: 2038523 - DNA, 18 bp, Homo sapiens
tattttatatgaaatgtt

SEQ ID NO: 2038524 - DNA, 10 bp, Homo sapiens
tattttatga

SEQ ID NO: 2038525 - DNA, 22 bp, Homo sapiens
tattttattaaagcaacatttt

SEQ ID NO: 2038526 - DNA, 19 bp, Homo sapiens
tattttcaacgcagccctg

SEQ ID NO: 2038527 - DNA, 17 bp, Homo sapiens
tattttcagtattttgg

SEQ ID NO: 2038528 - DNA, 18 bp, Homo sapiens
tattttcattttaattta

SEQ ID NO: 2038529 - DNA, 20 bp, Homo sapiens
tattttccctctcttgcctt

SEQ ID NO: 2038530 - DNA, 17 bp, Homo sapiens
tattttcgtgcatttgt

SEQ ID NO: 2038531 - DNA, 23 bp, Homo sapiens
tattttcgtgcatttgtgagcca

SEQ ID NO: 2038532 - DNA, 13 bp, Homo sapiens
tattttctgaatt

SEQ ID NO: 2038533 - DNA, 18 bp, Homo sapiens
tattttcttcccatttgt

SEQ ID NO: 2038534 - DNA, 22 bp, Homo sapiens
tattttcttcccatttgtaatg

SEQ ID NO: 2038535 - DNA, 16 bp, Homo sapiens
tattttcttttgtaaa

SEQ ID NO: 2038536 - DNA, 16 bp, Homo sapiens
tattttgaatgtgaag

SEQ ID NO: 2038537 - DNA, 16 bp, Homo sapiens
tattttggagaaatta

SEQ ID NO: 2038538 - DNA, 21 bp, Homo sapiens
tattttgtaaactcaaaatat

SEQ ID NO: 2038539 - DNA, 14 bp, Homo sapiens
tattttgtaataaa

SEQ ID NO: 2038540 - DNA, 17 bp, Homo sapiens
tattttgtaataaactc

SEQ ID NO: 2038541 - DNA, 15 bp, Homo sapiens
tattttgtatatatc

SEQ ID NO: 2038542 - DNA, 15 bp, Homo sapiens
tattttgtctcctac

SEQ ID NO: 2038543 - DNA, 19 bp, Homo sapiens
tattttgttaataataaga

SEQ ID NO: 2038544 - DNA, 15 bp, Homo sapiens
tattttgttgtgatt

SEQ ID NO: 2038545 - DNA, 17 bp, Homo sapiens
tatttttaattaaataa

SEQ ID NO: 2038546 - DNA, 13 bp, Homo sapiens
tatttttagagat

SEQ ID NO: 2038547 - DNA, 16 bp, Homo sapiens
tatttttcaaccagca

SEQ ID NO: 2038548 - DNA, 17 bp, Homo sapiens
tatttttcaaccagcat

SEQ ID NO: 2038549 - DNA, 15 bp, Homo sapiens
tatttttcacagttt

SEQ ID NO: 2038550 - DNA, 11 bp, Homo sapiens
tatttttcata

SEQ ID NO: 2038551 - DNA, 11 bp, Homo sapiens
tatttttgtac

SEQ ID NO: 2038552 - DNA, 14 bp, Homo sapiens
tatttttgtacgtt

SEQ ID NO: 2038553 - DNA, 17 bp, Homo sapiens
tatttttgtagagccag

SEQ ID NO: 2038554 - DNA, 20 bp, Homo sapiens
tatttttgtttcttccaaag

SEQ ID NO: 2038555 - DNA, 12 bp, Homo sapiens
tattttttaaag

SEQ ID NO: 2038556 - DNA, 15 bp, Homo sapiens
tattttttaattatt

SEQ ID NO: 2038557 - DNA, 13 bp, Homo sapiens
tattttttattgt

SEQ ID NO: 2038558 - DNA, 13 bp, Homo sapiens
tattttttctaca

SEQ ID NO: 2038559 - DNA, 19 bp, Homo sapiens
tatttttttaagctgtaaa

SEQ ID NO: 2038560 - DNA, 20 bp, Homo sapiens
tatttttttaagctgtaaaa

SEQ ID NO: 2038561 - DNA, 14 bp, Homo sapiens
tcaaaaaaacacta

SEQ ID NO: 2038562 - DNA, 16 bp, Homo sapiens
tcaaaaaaagccttta

SEQ ID NO: 2038563 - DNA, 14 bp, Homo sapiens
tcaaaaaacaaaaa

SEQ ID NO: 2038564 - DNA, 18 bp, Homo sapiens
tcaaaaaggtgtgtcaaa

SEQ ID NO: 2038565 - DNA, 21 bp, Homo sapiens
tcaaaaataaactagtttcca

SEQ ID NO: 2038566 - DNA, 18 bp, Homo sapiens
tcaaaacaaccatcctgc

SEQ ID NO: 2038567 - DNA, 19 bp, Homo sapiens
tcacctcctccactcactc

SEQ ID NO: 2038568 - DNA, 14 bp, Homo sapiens
tcacctctcttcag

SEQ ID NO: 2038569 - DNA, 19 bp, Homo sapiens
tcacctctggctttgtctc

SEQ ID NO: 2038570 - DNA, 13 bp, Homo sapiens
tcacctctgtaat

SEQ ID NO: 2038571 - DNA, 16 bp, Homo sapiens
tcacctgaagactcat

SEQ ID NO: 2038572 - DNA, 19 bp, Homo sapiens
tcacctgagtcaccctacc

SEQ ID NO: 2038573 - DNA, 16 bp, Homo sapiens
tcacctgcaagcccca

SEQ ID NO: 2038574 - DNA, 17 bp, Homo sapiens
tcacctgcaagccccag

SEQ ID NO: 2038575 - DNA, 18 bp, Homo sapiens
tcacctgcaagccccagg

SEQ ID NO: 2038576 - DNA, 21 bp, Homo sapiens
tcacctgcaagccccagggcc

SEQ ID NO: 2038577 - DNA, 20 bp, Homo sapiens
tcacctgcctgccctcccct

SEQ ID NO: 2038578 - DNA, 23 bp, Homo sapiens
tcacctgttactgaaagtggttt

SEQ ID NO: 2038579 - DNA, 19 bp, Homo sapiens
tcacctgtttttaagctgt

SEQ ID NO: 2038580 - DNA, 21 bp, Homo sapiens
tcacctgtttttaagctgttt

SEQ ID NO: 2038581 - DNA, 22 bp, Homo sapiens
tcacctgtttttaagctgtttc

SEQ ID NO: 2038582 - DNA, 20 bp, Homo sapiens
tcaccttgccgagagaggcg

SEQ ID NO: 2038583 - DNA, 14 bp, Homo sapiens
tcaccttggagcct

SEQ ID NO: 2038584 - DNA, 21 bp, Homo sapiens
tcacctttttgacttttccaa

SEQ ID NO: 2038585 - DNA, 13 bp, Homo sapiens
tcacgactcttcc

SEQ ID NO: 2038586 - DNA, 15 bp, Homo sapiens
tcacgcaacttgaaa

SEQ ID NO: 2038587 - DNA, 16 bp, Homo sapiens
tcacgcaacttgaaat

SEQ ID NO: 2038588 - DNA, 13 bp, Homo sapiens
tcacgcccagcct

SEQ ID NO: 2038589 - DNA, 14 bp, Homo sapiens
tcacgcccagcctc

SEQ ID NO: 2038590 - DNA, 15 bp, Homo sapiens
tcacgcccagcctcc

SEQ ID NO: 2038591 - DNA, 18 bp, Homo sapiens
tcacgcctataatcccag

SEQ ID NO: 2038592 - DNA, 21 bp, Homo sapiens
tcacgcctatgatcccagcac

SEQ ID NO: 2038593 - DNA, 21 bp, Homo sapiens
tcacgcctgtaatcccagcag

SEQ ID NO: 2038594 - DNA, 20 bp, Homo sapiens
tcacgctcccccgcagtccc

SEQ ID NO: 2038595 - DNA, 20 bp, Homo sapiens
tcacgtggtcaaggcccggc

SEQ ID NO: 2038596 - DNA, 13 bp, Homo sapiens
tcactaaacttta

SEQ ID NO: 2038597 - DNA, 19 bp, Homo sapiens
tcactaatactaattcatt

SEQ ID NO: 2038598 - DNA, 23 bp, Homo sapiens
tcactaccctaatagactaaatg

SEQ ID NO: 2038599 - DNA, 14 bp, Homo sapiens
tcactagagctggg

SEQ ID NO: 2038600 - DNA, 17 bp, Homo sapiens
tcactagcagctgcagt

SEQ ID NO: 2038601 - DNA, 13 bp, Homo sapiens
tcactataaatgg

SEQ ID NO: 2038602 - DNA, 19 bp, Homo sapiens
tcactataaccatcagtta

SEQ ID NO: 2038603 - DNA, 22 bp, Homo sapiens
tcactataaccatcagttactg

SEQ ID NO: 2038604 - DNA, 16 bp, Homo sapiens
tcactatctttctgat

SEQ ID NO: 2038605 - DNA, 17 bp, Homo sapiens
tcactatgattttctat

SEQ ID NO: 2038606 - DNA, 17 bp, Homo sapiens
tcactatgctatttctg

SEQ ID NO: 2038607 - DNA, 17 bp, Homo sapiens
tcactatggtatgctgg

SEQ ID NO: 2038608 - DNA, 21 bp, Homo sapiens
tcactatggtatgctggccag

SEQ ID NO: 2038609 - DNA, 17 bp, Homo sapiens
tcactcactcactcatt

SEQ ID NO: 2038610 - DNA, 15 bp, Homo sapiens
tcactcactcattcc

SEQ ID NO: 2038611 - DNA, 14 bp, Homo sapiens
tcactcagccacac

SEQ ID NO: 2038612 - DNA, 13 bp, Homo sapiens
tcactccaccacc

SEQ ID NO: 2038613 - DNA, 16 bp, Homo sapiens
tcactccaccacccaa

SEQ ID NO: 2038614 - DNA, 15 bp, Homo sapiens
tcactccagtgttac

SEQ ID NO: 2038615 - DNA, 11 bp, Homo sapiens
tcactcccaga

SEQ ID NO: 2038616 - DNA, 18 bp, Homo sapiens
tcactcccagaccacctc

SEQ ID NO: 2038617 - DNA, 12 bp, Homo sapiens
tcactccctgga

SEQ ID NO: 2038618 - DNA, 22 bp, Homo sapiens
tcactccggtgtgcctgcagcc

SEQ ID NO: 2038619 - DNA, 23 bp, Homo sapiens
tcactccggtgtgcctgcagccc

SEQ ID NO: 2038620 - DNA, 20 bp, Homo sapiens
tcactcctgttacttaccta

SEQ ID NO: 2038621 - DNA, 20 bp, Homo sapiens
tcactctacttagcatgtcc

SEQ ID NO: 2038622 - DNA, 21 bp, Homo sapiens
tcatatgaaaaaaatgcattt

SEQ ID NO: 2038623 - DNA, 22 bp, Homo sapiens
tcatatgcttcccagagaagct

SEQ ID NO: 2038624 - DNA, 22 bp, Homo sapiens
tcatatgtaccatgtacatgaa

SEQ ID NO: 2038625 - DNA, 14 bp, Homo sapiens
tcatattgtgccaa

SEQ ID NO: 2038626 - DNA, 15 bp, Homo sapiens
tcatattgtgccaat

SEQ ID NO: 2038627 - DNA, 15 bp, Homo sapiens
tcatcaattcccatt

SEQ ID NO: 2038628 - DNA, 14 bp, Homo sapiens
tcatcaatttaaaa

SEQ ID NO: 2038629 - DNA, 15 bp, Homo sapiens
tcatcaatttttata

SEQ ID NO: 2038630 - DNA, 14 bp, Homo sapiens
tcatcactccctgg

SEQ ID NO: 2038631 - DNA, 20 bp, Homo sapiens
tcatcactccctggatgtgt

SEQ ID NO: 2038632 - DNA, 15 bp, Homo sapiens
tcatcaggcttggaa

SEQ ID NO: 2038633 - DNA, 18 bp, Homo sapiens
tcatcaggcttggaatga

SEQ ID NO: 2038634 - DNA, 15 bp, Homo sapiens
tcatcatacatgact

SEQ ID NO: 2038635 - DNA, 20 bp, Homo sapiens
tcatcatgttggccaggctg

SEQ ID NO: 2038636 - DNA, 19 bp, Homo sapiens
tcatcattgtatatatgtg

SEQ ID NO: 2038637 - DNA, 20 bp, Homo sapiens
tcatcattgtatatatgtgt

SEQ ID NO: 2038638 - DNA, 17 bp, Homo sapiens
tcatccactgtgccatg

SEQ ID NO: 2038639 - DNA, 18 bp, Homo sapiens
tcatccactgtgccatgt

SEQ ID NO: 2038640 - DNA, 19 bp, Homo sapiens
tcatccactgtgccatgtg

SEQ ID NO: 2038641 - DNA, 15 bp, Homo sapiens
tcatccagttgcaat

SEQ ID NO: 2038642 - DNA, 22 bp, Homo sapiens
tcatccagtttgttctccgggt

SEQ ID NO: 2038643 - DNA, 21 bp, Homo sapiens
tcatcccatctaagctgcagc

SEQ ID NO: 2038644 - DNA, 14 bp, Homo sapiens
tcatccccagtccc

SEQ ID NO: 2038645 - DNA, 12 bp, Homo sapiens
tcatcccgctcc

SEQ ID NO: 2038646 - DNA, 21 bp, Homo sapiens
tcatccctatgggattcagtg

SEQ ID NO: 2038647 - DNA, 13 bp, Homo sapiens
tcatccctattta

SEQ ID NO: 2038648 - DNA, 22 bp, Homo sapiens
tcatccctatttatagttttta

SEQ ID NO: 2038649 - DNA, 14 bp, Homo sapiens
tcatccgaggcagg

SEQ ID NO: 2038650 - DNA, 16 bp, Homo sapiens
tcatccgtttcagctg

SEQ ID NO: 2038651 - DNA, 13 bp, Homo sapiens
tcatcctggcctc

SEQ ID NO: 2038652 - DNA, 20 bp, Homo sapiens
tcatcctggcctccttttgc

SEQ ID NO: 2038653 - DNA, 15 bp, Homo sapiens
tcatcgaacaaactg

SEQ ID NO: 2038654 - DNA, 19 bp, Homo sapiens
tcatcgaacaaactgatgc

SEQ ID NO: 2038655 - DNA, 14 bp, Homo sapiens
tcatcggaggctgg

SEQ ID NO: 2038656 - DNA, 20 bp, Homo sapiens
tcatctaaaatttttctaga

SEQ ID NO: 2038657 - DNA, 17 bp, Homo sapiens
tcatctacaagcatttg

SEQ ID NO: 2038658 - DNA, 17 bp, Homo sapiens
tcatctatggagggcag

SEQ ID NO: 2038659 - DNA, 21 bp, Homo sapiens
tcatctatggcagtccagcca

SEQ ID NO: 2038660 - DNA, 17 bp, Homo sapiens
tcatctcaaatccttga

SEQ ID NO: 2038661 - DNA, 17 bp, Homo sapiens
tcatctcactgcccagt

SEQ ID NO: 2038662 - DNA, 11 bp, Homo sapiens
tcatctcaggg

SEQ ID NO: 2038663 - DNA, 23 bp, Homo sapiens
tcatctcatttaagggaaaaata

SEQ ID NO: 2038664 - DNA, 20 bp, Homo sapiens
tcatctcatttaatcctccc

SEQ ID NO: 2038665 - DNA, 13 bp, Homo sapiens
tcatctctctggg

SEQ ID NO: 2038666 - DNA, 14 bp, Homo sapiens
tcatctcttctttt

SEQ ID NO: 2038667 - DNA, 11 bp, Homo sapiens
tcatctgagga

SEQ ID NO: 2038668 - DNA, 12 bp, Homo sapiens
tcatctgaggag

SEQ ID NO: 2038669 - DNA, 20 bp, Homo sapiens
tcatctggcttttcgcttgc

SEQ ID NO: 2038670 - DNA, 17 bp, Homo sapiens
tcatctggggacctggt

SEQ ID NO: 2038671 - DNA, 19 bp, Homo sapiens
tcatctgtgtgaaaatggg

SEQ ID NO: 2038672 - DNA, 15 bp, Homo sapiens
tcatcttagctttcc

SEQ ID NO: 2038673 - DNA, 20 bp, Homo sapiens
tcatcttagctttccacagg

SEQ ID NO: 2038674 - DNA, 22 bp, Homo sapiens
tcatcttcaaccttaaggactt

SEQ ID NO: 2038675 - DNA, 18 bp, Homo sapiens
tcatcttgacatgtaatg

SEQ ID NO: 2038676 - DNA, 22 bp, Homo sapiens
tcatcttggtactactagatgt

SEQ ID NO: 2038677 - DNA, 18 bp, Homo sapiens
tcatgaaaagaggaacag

SEQ ID NO: 2038678 - DNA, 23 bp, Homo sapiens
tcatgaaaagaggaacaggtgga

SEQ ID NO: 2038679 - DNA, 11 bp, Homo sapiens
tcatgaaaagt

SEQ ID NO: 2038680 - DNA, 13 bp, Homo sapiens
tcatgaaaagtgc

SEQ ID NO: 2038681 - DNA, 16 bp, Homo sapiens
tcatgaacttggctgt

SEQ ID NO: 2038682 - DNA, 14 bp, Homo sapiens
tcatgacatgttat

SEQ ID NO: 2038683 - DNA, 17 bp, Homo sapiens
tcatgacatgttatata

SEQ ID NO: 2038684 - DNA, 19 bp, Homo sapiens
tcatgacatgttatatatt

SEQ ID NO: 2038685 - DNA, 16 bp, Homo sapiens
tcatgaccagcaaata

SEQ ID NO: 2038686 - DNA, 17 bp, Homo sapiens
tcatgacttttccatgt

SEQ ID NO: 2038687 - DNA, 22 bp, Homo sapiens
tcatgagagaatgggtttactc

SEQ ID NO: 2038688 - DNA, 17 bp, Homo sapiens
tcatgagtcagacattt

SEQ ID NO: 2038689 - DNA, 22 bp, Homo sapiens
tcatgagtggatggatggacag

SEQ ID NO: 2038690 - DNA, 23 bp, Homo sapiens
tcatgagtggatggatggacaga

SEQ ID NO: 2038691 - DNA, 13 bp, Homo sapiens
tcatgatctccct

SEQ ID NO: 2038692 - DNA, 16 bp, Homo sapiens
tcatgatctccctgcc

SEQ ID NO: 2038693 - DNA, 18 bp, Homo sapiens
tcatgatctccctgccgc

SEQ ID NO: 2038694 - DNA, 16 bp, Homo sapiens
tccaaatattattcaa

SEQ ID NO: 2038695 - DNA, 19 bp, Homo sapiens
tccaaatattattcaagtg

SEQ ID NO: 2038696 - DNA, 16 bp, Homo sapiens
tccaaatgaatgacct

SEQ ID NO: 2038697 - DNA, 20 bp, Homo sapiens
tccaacaactccaggaaaac

SEQ ID NO: 2038698 - DNA, 19 bp, Homo sapiens
tccaacagctcaagtcttc

SEQ ID NO: 2038699 - DNA, 13 bp, Homo sapiens
tccaaccccagct

SEQ ID NO: 2038700 - DNA, 15 bp, Homo sapiens
tccaaccccagctgg

SEQ ID NO: 2038701 - DNA, 16 bp, Homo sapiens
tccaaccccagctggc

SEQ ID NO: 2038702 - DNA, 20 bp, Homo sapiens
tccaacctaacccctttcct

SEQ ID NO: 2038703 - DNA, 17 bp, Homo sapiens
tccaacctggacaacaa

SEQ ID NO: 2038704 - DNA, 16 bp, Homo sapiens
tccaacgttaaaagac

SEQ ID NO: 2038705 - DNA, 12 bp, Homo sapiens
tccaagagctga

SEQ ID NO: 2038706 - DNA, 16 bp, Homo sapiens
tccaagattaaaagtt

SEQ ID NO: 2038707 - DNA, 16 bp, Homo sapiens
tccaagcttcaagtga

SEQ ID NO: 2038708 - DNA, 16 bp, Homo sapiens
tccaagctttgggttg

SEQ ID NO: 2038709 - DNA, 19 bp, Homo sapiens
tccaaggaacctaattgaa

SEQ ID NO: 2038710 - DNA, 15 bp, Homo sapiens
tccaaggagaaacag

SEQ ID NO: 2038711 - DNA, 16 bp, Homo sapiens
tccaaggagaaacaga

SEQ ID NO: 2038712 - DNA, 21 bp, Homo sapiens
tccaaggagttccatgaagac

SEQ ID NO: 2038713 - DNA, 21 bp, Homo sapiens
tccaagggtatgggaagccat

SEQ ID NO: 2038714 - DNA, 23 bp, Homo sapiens
tccaagggttgaattctggagga

SEQ ID NO: 2038715 - DNA, 19 bp, Homo sapiens
tccaagtaaagatgtcaat

SEQ ID NO: 2038716 - DNA, 22 bp, Homo sapiens
tccaagtattttatctgtgttg

SEQ ID NO: 2038717 - DNA, 14 bp, Homo sapiens
tccaagtcaacact

SEQ ID NO: 2038718 - DNA, 22 bp, Homo sapiens
tccaagtcaacactcttcttga

SEQ ID NO: 2038719 - DNA, 16 bp, Homo sapiens
tccaagtccaacctgc

SEQ ID NO: 2038720 - DNA, 18 bp, Homo sapiens
tccaagtccaacctgcct

SEQ ID NO: 2038721 - DNA, 23 bp, Homo sapiens
tccaagttcctgcactccagaat

SEQ ID NO: 2038722 - DNA, 21 bp, Homo sapiens
tccaatcctcaggatttcatt

SEQ ID NO: 2038723 - DNA, 14 bp, Homo sapiens
tccaatcctttcca

SEQ ID NO: 2038724 - DNA, 17 bp, Homo sapiens
tccaatggctgtaaact

SEQ ID NO: 2038725 - DNA, 20 bp, Homo sapiens
tccaatggctgtaaactata

SEQ ID NO: 2038726 - DNA, 16 bp, Homo sapiens
tccaattaaaattaag

SEQ ID NO: 2038727 - DNA, 15 bp, Homo sapiens
tccaattatgtgaca

SEQ ID NO: 2038728 - DNA, 13 bp, Homo sapiens
tccaattgtaaaa

SEQ ID NO: 2038729 - DNA, 14 bp, Homo sapiens
tccaattttctgga

SEQ ID NO: 2038730 - DNA, 22 bp, Homo sapiens
tccaattttctggaatacatga

SEQ ID NO: 2038731 - DNA, 14 bp, Homo sapiens
tcccatggccttcc

SEQ ID NO: 2038732 - DNA, 16 bp, Homo sapiens
tcccatgtcacctcag

SEQ ID NO: 2038733 - DNA, 16 bp, Homo sapiens
tcccatgttgcatgcc

SEQ ID NO: 2038734 - DNA, 20 bp, Homo sapiens
tcccatgttgcatgcctatg

SEQ ID NO: 2038735 - DNA, 12 bp, Homo sapiens
tcccattcccct

SEQ ID NO: 2038736 - DNA, 15 bp, Homo sapiens
tcccattccccttaa

SEQ ID NO: 2038737 - DNA, 14 bp, Homo sapiens
tcccattgccctgg

SEQ ID NO: 2038738 - DNA, 16 bp, Homo sapiens
tcccatttccttggag

SEQ ID NO: 2038739 - DNA, 12 bp, Homo sapiens
tcccatttgtaa

SEQ ID NO: 2038740 - DNA, 18 bp, Homo sapiens
tcccattttggaagtttt

SEQ ID NO: 2038741 - DNA, 20 bp, Homo sapiens
tcccattttggaagttttca

SEQ ID NO: 2038742 - DNA, 21 bp, Homo sapiens
tccccaaaacctttccccaga

SEQ ID NO: 2038743 - DNA, 22 bp, Homo sapiens
tccccaaaacctttccccagac

SEQ ID NO: 2038744 - DNA, 18 bp, Homo sapiens
tccccaaacccatcagac

SEQ ID NO: 2038745 - DNA, 15 bp, Homo sapiens
tccccaaactgtgcc

SEQ ID NO: 2038746 - DNA, 22 bp, Homo sapiens
tccccaaactgtgccctgcctt

SEQ ID NO: 2038747 - DNA, 18 bp, Homo sapiens
tccccaaagtcttaaaat

SEQ ID NO: 2038748 - DNA, 13 bp, Homo sapiens
tccccacagaact

SEQ ID NO: 2038749 - DNA, 19 bp, Homo sapiens
tccccacagaactgcttac

SEQ ID NO: 2038750 - DNA, 18 bp, Homo sapiens
tccccacagtcctcacag

SEQ ID NO: 2038751 - DNA, 20 bp, Homo sapiens
tccccacagtcctcacagcc

SEQ ID NO: 2038752 - DNA, 15 bp, Homo sapiens
tccccacccccgctg

SEQ ID NO: 2038753 - DNA, 17 bp, Homo sapiens
tccccacccccgctggg

SEQ ID NO: 2038754 - DNA, 18 bp, Homo sapiens
tccccacctcttccttcc

SEQ ID NO: 2038755 - DNA, 16 bp, Homo sapiens
tccccaccttccccag

SEQ ID NO: 2038756 - DNA, 21 bp, Homo sapiens
tccccacgagtcacctgcaag

SEQ ID NO: 2038757 - DNA, 18 bp, Homo sapiens
tccccactctgctctgat

SEQ ID NO: 2038758 - DNA, 11 bp, Homo sapiens
tccccagacac

SEQ ID NO: 2038759 - DNA, 12 bp, Homo sapiens
tccccagacaca

SEQ ID NO: 2038760 - DNA, 13 bp, Homo sapiens
tccccagattgca

SEQ ID NO: 2038761 - DNA, 17 bp, Homo sapiens
tccctaaccaaatgctg

SEQ ID NO: 2038762 - DNA, 16 bp, Homo sapiens
tccctaaggaatctga

SEQ ID NO: 2038763 - DNA, 16 bp, Homo sapiens
tccctaccccatttgt

SEQ ID NO: 2038764 - DNA, 19 bp, Homo sapiens
tccctaccgagtctcttct

SEQ ID NO: 2038765 - DNA, 18 bp, Homo sapiens
tccctactcccctgggca

SEQ ID NO: 2038766 - DNA, 15 bp, Homo sapiens
tccctacttcctgtg

SEQ ID NO: 2038767 - DNA, 19 bp, Homo sapiens
tccctagaggcaaacattt

SEQ ID NO: 2038768 - DNA, 23 bp, Homo sapiens
tccctagatctttctattccaaa

SEQ ID NO: 2038769 - DNA, 14 bp, Homo sapiens
tccctagctgagga

SEQ ID NO: 2038770 - DNA, 13 bp, Homo sapiens
tccctatcaaaac

SEQ ID NO: 2038771 - DNA, 13 bp, Homo sapiens
tccctcaaatgac

SEQ ID NO: 2038772 - DNA, 23 bp, Homo sapiens
tccctcaccccctcccaccccca

SEQ ID NO: 2038773 - DNA, 14 bp, Homo sapiens
tccctcactgcctt

SEQ ID NO: 2038774 - DNA, 16 bp, Homo sapiens
tccctccaccccagga

SEQ ID NO: 2038775 - DNA, 23 bp, Homo sapiens
tccctccccaaacccatcagaca

SEQ ID NO: 2038776 - DNA, 22 bp, Homo sapiens
tccctccccacagtcctcacag

SEQ ID NO: 2038777 - DNA, 16 bp, Homo sapiens
tccctcctctggccca

SEQ ID NO: 2038778 - DNA, 16 bp, Homo sapiens
tccctcctggagcatc

SEQ ID NO: 2038779 - DNA, 13 bp, Homo sapiens
tccctccttccct

SEQ ID NO: 2038780 - DNA, 15 bp, Homo sapiens
tccctcggacccacc

SEQ ID NO: 2038781 - DNA, 15 bp, Homo sapiens
tccctcgtccacagg

SEQ ID NO: 2038782 - DNA, 20 bp, Homo sapiens
tccctcgtccacaggggcag

SEQ ID NO: 2038783 - DNA, 14 bp, Homo sapiens
tccctctaatttat

SEQ ID NO: 2038784 - DNA, 12 bp, Homo sapiens
tccctctcccag

SEQ ID NO: 2038785 - DNA, 16 bp, Homo sapiens
tccctctcccaggccc

SEQ ID NO: 2038786 - DNA, 13 bp, Homo sapiens
tccctctcctccc

SEQ ID NO: 2038787 - DNA, 15 bp, Homo sapiens
tccctctcctgccta

SEQ ID NO: 2038788 - DNA, 16 bp, Homo sapiens
tccctctcctgcctac

SEQ ID NO: 2038789 - DNA, 11 bp, Homo sapiens
tccctctgccc

SEQ ID NO: 2038790 - DNA, 21 bp, Homo sapiens
tccctctgccccaagcagcca

SEQ ID NO: 2038791 - DNA, 16 bp, Homo sapiens
tccctctggccctgcc

SEQ ID NO: 2038792 - DNA, 18 bp, Homo sapiens
tccctctggccctgcctt

SEQ ID NO: 2038793 - DNA, 16 bp, Homo sapiens
tccctcttccttcccc

SEQ ID NO: 2038794 - DNA, 18 bp, Homo sapiens
tccctcttccttccccca

SEQ ID NO: 2038795 - DNA, 16 bp, Homo sapiens
tccctctttctacatt

SEQ ID NO: 2038796 - DNA, 17 bp, Homo sapiens
tccctgaaaacccagag

SEQ ID NO: 2038797 - DNA, 16 bp, Homo sapiens
tccctgaacatctgtg

SEQ ID NO: 2038798 - DNA, 17 bp, Homo sapiens
tccctgaacatctgtgt

SEQ ID NO: 2038799 - DNA, 18 bp, Homo sapiens
tccctgaacatctgtgtg

SEQ ID NO: 2038800 - DNA, 19 bp, Homo sapiens
tccctgaacctcagtttcc

SEQ ID NO: 2038801 - DNA, 24 bp, Homo sapiens
tccctgacgacactgaagaatcaa

SEQ ID NO: 2038802 - DNA, 16 bp, Homo sapiens
tccctgactccctgtg

SEQ ID NO: 2038803 - DNA, 14 bp, Homo sapiens
tccctgagctttgg

SEQ ID NO: 2038804 - DNA, 19 bp, Homo sapiens
tccctgataacaacctgga

SEQ ID NO: 2038805 - DNA, 13 bp, Homo sapiens
tccctgcaccctg

SEQ ID NO: 2038806 - DNA, 17 bp, Homo sapiens
tccctgcaccctggaaa

SEQ ID NO: 2038807 - DNA, 14 bp, Homo sapiens
tccctgcacttgca

SEQ ID NO: 2038808 - DNA, 16 bp, Homo sapiens
tccctgcatccaatct

SEQ ID NO: 2038809 - DNA, 19 bp, Homo sapiens
tccctgcatccaatctgct

SEQ ID NO: 2038810 - DNA, 14 bp, Homo sapiens
tccctgcatttctg

SEQ ID NO: 2038811 - DNA, 20 bp, Homo sapiens
tccctgcccctcccttcaac

SEQ ID NO: 2038812 - DNA, 21 bp, Homo sapiens
tccctgccctgtcctccagct

SEQ ID NO: 2038813 - DNA, 22 bp, Homo sapiens
tccctgccctgtcctccagctt

SEQ ID NO: 2038814 - DNA, 12 bp, Homo sapiens
tccctgctcctc

SEQ ID NO: 2038815 - DNA, 22 bp, Homo sapiens
tccctggatgtgtggggcatgg

SEQ ID NO: 2038816 - DNA, 23 bp, Homo sapiens
tccctggcatgtcagagccaggc

SEQ ID NO: 2038817 - DNA, 16 bp, Homo sapiens
tccctggctctcagaa

SEQ ID NO: 2038818 - DNA, 18 bp, Homo sapiens
tccctggctctcagaagg

SEQ ID NO: 2038819 - DNA, 15 bp, Homo sapiens
tccctggctctgcca

SEQ ID NO: 2038820 - DNA, 16 bp, Homo sapiens
tccctggctctgccag

SEQ ID NO: 2038821 - DNA, 13 bp, Homo sapiens
tccctggctgacc

SEQ ID NO: 2038822 - DNA, 17 bp, Homo sapiens
tccctgggaactcatcc

SEQ ID NO: 2038823 - DNA, 15 bp, Homo sapiens
tccctgggcccctcc

SEQ ID NO: 2038824 - DNA, 16 bp, Homo sapiens
tccctgggcccctcca

SEQ ID NO: 2038825 - DNA, 18 bp, Homo sapiens
tccctgggcccctccacg

SEQ ID NO: 2038826 - DNA, 20 bp, Homo sapiens
tccctgggcccctccacgcc

SEQ ID NO: 2038827 - DNA, 12 bp, Homo sapiens
tccctgggcctg

SEQ ID NO: 2038828 - DNA, 14 bp, Homo sapiens
tccctgggcctgct

SEQ ID NO: 2038829 - DNA, 16 bp, Homo sapiens
tccctgggcctgctgc

SEQ ID NO: 2038830 - DNA, 16 bp, Homo sapiens
tccctggggtccttgc

SEQ ID NO: 2038831 - DNA, 14 bp, Homo sapiens
tccctggtgcagag

SEQ ID NO: 2038832 - DNA, 22 bp, Homo sapiens
tccctgtcaccaagctcacagt

SEQ ID NO: 2038833 - DNA, 14 bp, Homo sapiens
tccctgtcagaggc

SEQ ID NO: 2038834 - DNA, 15 bp, Homo sapiens
tccctgtcctcctcg

SEQ ID NO: 2038835 - DNA, 12 bp, Homo sapiens
tccctgtggggg

SEQ ID NO: 2038836 - DNA, 19 bp, Homo sapiens
tccctgtgggggtggccat

SEQ ID NO: 2038837 - DNA, 20 bp, Homo sapiens
tccctgtgggggtggccatc

SEQ ID NO: 2038838 - DNA, 23 bp, Homo sapiens
tccctgtgggggtggccatccct

SEQ ID NO: 2038839 - DNA, 10 bp, Homo sapiens
tccctgttct

SEQ ID NO: 2038840 - DNA, 14 bp, Homo sapiens
tccctgtttaatat

SEQ ID NO: 2038841 - DNA, 17 bp, Homo sapiens
tccctgtttcaaactga

SEQ ID NO: 2038842 - DNA, 23 bp, Homo sapiens
tcccttaggcattatttaatgtt

SEQ ID NO: 2038843 - DNA, 11 bp, Homo sapiens
tcccttcaacc

SEQ ID NO: 2038844 - DNA, 12 bp, Homo sapiens
tcccttccagtt

SEQ ID NO: 2038845 - DNA, 15 bp, Homo sapiens
tcccttcctccccag

SEQ ID NO: 2038846 - DNA, 17 bp, Homo sapiens
tcccttctctccttccc

SEQ ID NO: 2038847 - DNA, 17 bp, Homo sapiens
tcccttgaaattttaaa

SEQ ID NO: 2038848 - DNA, 19 bp, Homo sapiens
tcccttgaccattggctgc

SEQ ID NO: 2038849 - DNA, 18 bp, Homo sapiens
tcccttgagacctcagcc

SEQ ID NO: 2038850 - DNA, 19 bp, Homo sapiens
tcccttgctcagtgcctcc

SEQ ID NO: 2038851 - DNA, 17 bp, Homo sapiens
tcaaatgctaaatgcaa

SEQ ID NO: 2038852 - DNA, 20 bp, Homo sapiens
tcaaatgtcattatgtagaa

SEQ ID NO: 2038853 - DNA, 23 bp, Homo sapiens
tcaaattaatctttctttacctg

SEQ ID NO: 2038854 - DNA, 16 bp, Homo sapiens
tcaaattttgcattgt

SEQ ID NO: 2038855 - DNA, 20 bp, Homo sapiens
tcaaattttgcattgtgtga

SEQ ID NO: 2038856 - DNA, 18 bp, Homo sapiens
tcaacaaagaaatattat

SEQ ID NO: 2038857 - DNA, 16 bp, Homo sapiens
tcaacaacaaaccaaa

SEQ ID NO: 2038858 - DNA, 14 bp, Homo sapiens
tcaacaaccatgcc

SEQ ID NO: 2038859 - DNA, 14 bp, Homo sapiens
tcaacaataaaaca

SEQ ID NO: 2038860 - DNA, 14 bp, Homo sapiens
tcaacaataaagac

SEQ ID NO: 2038861 - DNA, 17 bp, Homo sapiens
tcaacaataaagactga

SEQ ID NO: 2038862 - DNA, 22 bp, Homo sapiens
tcaacacacaacagcagatggc

SEQ ID NO: 2038863 - DNA, 17 bp, Homo sapiens
tcaacacccgccccccc

SEQ ID NO: 2038864 - DNA, 14 bp, Homo sapiens
tcaacactcttctt

SEQ ID NO: 2038865 - DNA, 21 bp, Homo sapiens
tcaacactcttcttgagcaga

SEQ ID NO: 2038866 - DNA, 22 bp, Homo sapiens
tcaacagagaaggcaggaatgt

SEQ ID NO: 2038867 - DNA, 13 bp, Homo sapiens
tcaacatatcatt

SEQ ID NO: 2038868 - DNA, 15 bp, Homo sapiens
tcaacatatcatttt

SEQ ID NO: 2038869 - DNA, 14 bp, Homo sapiens
tcaacattctttgc

SEQ ID NO: 2038870 - DNA, 15 bp, Homo sapiens
tcaaccactgtggcg

SEQ ID NO: 2038871 - DNA, 18 bp, Homo sapiens
tcaaccattccccatggg

SEQ ID NO: 2038872 - DNA, 20 bp, Homo sapiens
tcaaccccttcgctcctgtg

SEQ ID NO: 2038873 - DNA, 12 bp, Homo sapiens
tcaaccctcagc

SEQ ID NO: 2038874 - DNA, 16 bp, Homo sapiens
tcaaccgcttgccata

SEQ ID NO: 2038875 - DNA, 17 bp, Homo sapiens
tcaaccgcttgccatat

SEQ ID NO: 2038876 - DNA, 15 bp, Homo sapiens
tcaacctaccacccc

SEQ ID NO: 2038877 - DNA, 22 bp, Homo sapiens
tcaacctaccaccccttcctgt

SEQ ID NO: 2038878 - DNA, 16 bp, Homo sapiens
tcaacctcctgggcta

SEQ ID NO: 2038879 - DNA, 19 bp, Homo sapiens
tcaacctctctccttctgg

SEQ ID NO: 2038880 - DNA, 21 bp, Homo sapiens
tcaacctggtggcaccagatg

SEQ ID NO: 2038881 - DNA, 14 bp, Homo sapiens
tcaactccagaagt

SEQ ID NO: 2038882 - DNA, 24 bp, Homo sapiens
tcaactgaccagcctccatgctgc

SEQ ID NO: 2038883 - DNA, 18 bp, Homo sapiens
tcaactggagcaagaagg

SEQ ID NO: 2038884 - DNA, 23 bp, Homo sapiens
tcaactggagcaagaaggaagga

SEQ ID NO: 2038885 - DNA, 17 bp, Homo sapiens
tcaactggctgggacat

SEQ ID NO: 2038886 - DNA, 19 bp, Homo sapiens
tcaacttggaaaaagaaag

SEQ ID NO: 2038887 - DNA, 15 bp, Homo sapiens
tcaacttttcctttg

SEQ ID NO: 2038888 - DNA, 16 bp, Homo sapiens
tcaagaaaaaataaat

SEQ ID NO: 2038889 - DNA, 22 bp, Homo sapiens
tcaagaaactgaggaattttct

SEQ ID NO: 2038890 - DNA, 23 bp, Homo sapiens
tcaagaaactgaggaattttctt

SEQ ID NO: 2038891 - DNA, 14 bp, Homo sapiens
tcaagaatcctctg

SEQ ID NO: 2038892 - DNA, 16 bp, Homo sapiens
tcaagaatcctctggg

SEQ ID NO: 2038893 - DNA, 14 bp, Homo sapiens
tcaagaccagcctg

SEQ ID NO: 2038894 - DNA, 17 bp, Homo sapiens
tcaagagaagaaaaaat

SEQ ID NO: 2038895 - DNA, 22 bp, Homo sapiens
tcaagagccctgtcagtagagt

SEQ ID NO: 2038896 - DNA, 11 bp, Homo sapiens
tcaagaggccc

SEQ ID NO: 2038897 - DNA, 12 bp, Homo sapiens
tcaagaggccca

SEQ ID NO: 2038898 - DNA, 13 bp, Homo sapiens
tcaagaggcccag

SEQ ID NO: 2038899 - DNA, 16 bp, Homo sapiens
tcaagaggcccaggga

SEQ ID NO: 2038900 - DNA, 17 bp, Homo sapiens
tcaagagggtctgagga

SEQ ID NO: 2038901 - DNA, 18 bp, Homo sapiens
tcaagatacatttcatct

SEQ ID NO: 2038902 - DNA, 22 bp, Homo sapiens
tcaagatgatgatgatctttaa

SEQ ID NO: 2038903 - DNA, 17 bp, Homo sapiens
tcaagatgtcagactgg

SEQ ID NO: 2038904 - DNA, 18 bp, Homo sapiens
tcaagatgtcagactggc

SEQ ID NO: 2038905 - DNA, 22 bp, Homo sapiens
tcaagattatattataataatg

SEQ ID NO: 2038906 - DNA, 18 bp, Homo sapiens
tcaagattttttttgtaa

SEQ ID NO: 2038907 - DNA, 21 bp, Homo sapiens
tcaagattttttttgtaactt

SEQ ID NO: 2038908 - DNA, 22 bp, Homo sapiens
tcaagattttttttgtaacttc

SEQ ID NO: 2038909 - DNA, 14 bp, Homo sapiens
tcaagcagtcctcc

SEQ ID NO: 2038910 - DNA, 20 bp, Homo sapiens
tcaagcatgcaataatgtgc

SEQ ID NO: 2038911 - DNA, 22 bp, Homo sapiens
tcaagcatgcaataatgtgcaa

SEQ ID NO: 2038912 - DNA, 21 bp, Homo sapiens
tcaagccagcaacacagagca

SEQ ID NO: 2038913 - DNA, 14 bp, Homo sapiens
tcaagcctgcctag

SEQ ID NO: 2038914 - DNA, 15 bp, Homo sapiens
tcaagcctgtgaata

SEQ ID NO: 2038915 - DNA, 13 bp, Homo sapiens
tcaagcctgtggg

SEQ ID NO: 2038916 - DNA, 17 bp, Homo sapiens
tcaagcgattcttctgc

SEQ ID NO: 2038917 - DNA, 15 bp, Homo sapiens
tcacataccctcccc

SEQ ID NO: 2038918 - DNA, 16 bp, Homo sapiens
tcacataccctccccc

SEQ ID NO: 2038919 - DNA, 12 bp, Homo sapiens
tcacatatctgt

SEQ ID NO: 2038920 - DNA, 19 bp, Homo sapiens
tcacatatgtctgtatcta

SEQ ID NO: 2038921 - DNA, 22 bp, Homo sapiens
tcacattaatggtctaaaaata

SEQ ID NO: 2038922 - DNA, 16 bp, Homo sapiens
tcacattatttgcatg

SEQ ID NO: 2038923 - DNA, 14 bp, Homo sapiens
tcacatttattctg

SEQ ID NO: 2038924 - DNA, 17 bp, Homo sapiens
tcacatttgatgtacat

SEQ ID NO: 2038925 - DNA, 14 bp, Homo sapiens
tcaccaaagtatta

SEQ ID NO: 2038926 - DNA, 18 bp, Homo sapiens
tcaccaaagtattaatgt

SEQ ID NO: 2038927 - DNA, 22 bp, Homo sapiens
tcaccaagctcacagttcctcg

SEQ ID NO: 2038928 - DNA, 17 bp, Homo sapiens
tcaccaataacttcaga

SEQ ID NO: 2038929 - DNA, 13 bp, Homo sapiens
tcaccaccctccc

SEQ ID NO: 2038930 - DNA, 15 bp, Homo sapiens
tcaccaccctcccct

SEQ ID NO: 2038931 - DNA, 14 bp, Homo sapiens
tcaccaccttccca

SEQ ID NO: 2038932 - DNA, 16 bp, Homo sapiens
tcaccactccattccc

SEQ ID NO: 2038933 - DNA, 13 bp, Homo sapiens
tcaccagagccca

SEQ ID NO: 2038934 - DNA, 18 bp, Homo sapiens
tcaccagagcccatgctc

SEQ ID NO: 2038935 - DNA, 15 bp, Homo sapiens
tcaccagcaacatct

SEQ ID NO: 2038936 - DNA, 13 bp, Homo sapiens
tcaccagccccag

SEQ ID NO: 2038937 - DNA, 17 bp, Homo sapiens
tcaccagccccagtgcc

SEQ ID NO: 2038938 - DNA, 18 bp, Homo sapiens
tcaccagctatctgtcat

SEQ ID NO: 2038939 - DNA, 13 bp, Homo sapiens
tcaccagtgtccc

SEQ ID NO: 2038940 - DNA, 15 bp, Homo sapiens
tcaccatcttggcca

SEQ ID NO: 2038941 - DNA, 13 bp, Homo sapiens
tcaccatgtaaca

SEQ ID NO: 2038942 - DNA, 15 bp, Homo sapiens
tcacccacagggcta

SEQ ID NO: 2038943 - DNA, 17 bp, Homo sapiens
tcacccagctaatctgt

SEQ ID NO: 2038944 - DNA, 12 bp, Homo sapiens
tcacccaggctg

SEQ ID NO: 2038945 - DNA, 16 bp, Homo sapiens
tcacccagtcctggcc

SEQ ID NO: 2038946 - DNA, 17 bp, Homo sapiens
tcacccagtcctggcca

SEQ ID NO: 2038947 - DNA, 12 bp, Homo sapiens
tcacccatgtgc

SEQ ID NO: 2038948 - DNA, 13 bp, Homo sapiens
tcacccccagctt

SEQ ID NO: 2038949 - DNA, 18 bp, Homo sapiens
tcaccccccactcaccag

SEQ ID NO: 2038950 - DNA, 17 bp, Homo sapiens
tcaccccctaccccaga

SEQ ID NO: 2038951 - DNA, 17 bp, Homo sapiens
tcaccccctcccacccc

SEQ ID NO: 2038952 - DNA, 23 bp, Homo sapiens
tcaccccctcccacccccagccc

SEQ ID NO: 2038953 - DNA, 14 bp, Homo sapiens
tcaccccgtctggg

SEQ ID NO: 2038954 - DNA, 13 bp, Homo sapiens
tcacccctgcact

SEQ ID NO: 2038955 - DNA, 16 bp, Homo sapiens
tcacccgaggctgccc

SEQ ID NO: 2038956 - DNA, 15 bp, Homo sapiens
tcaccctacctgtgc

SEQ ID NO: 2038957 - DNA, 15 bp, Homo sapiens
tcaccctccacctct

SEQ ID NO: 2038958 - DNA, 23 bp, Homo sapiens
tcaccctctgggcagctgtcatg

SEQ ID NO: 2038959 - DNA, 12 bp, Homo sapiens
tcaccctgcaga

SEQ ID NO: 2038960 - DNA, 13 bp, Homo sapiens
tcaccctggcccc

SEQ ID NO: 2038961 - DNA, 16 bp, Homo sapiens
tcaccctggccccaac

SEQ ID NO: 2038962 - DNA, 14 bp, Homo sapiens
tcacccttctgggc

SEQ ID NO: 2038963 - DNA, 18 bp, Homo sapiens
tcaccgagacggctggac

SEQ ID NO: 2038964 - DNA, 22 bp, Homo sapiens
tcaccgagacggctggacctgc

SEQ ID NO: 2038965 - DNA, 23 bp, Homo sapiens
tcaccgagacggctggacctgca

SEQ ID NO: 2038966 - DNA, 20 bp, Homo sapiens
tcaccgagagtagccgagag

SEQ ID NO: 2038967 - DNA, 19 bp, Homo sapiens
tcaccgtggaccttcctgc

SEQ ID NO: 2038968 - DNA, 20 bp, Homo sapiens
tcaccgtggaccttcctgcc

SEQ ID NO: 2038969 - DNA, 21 bp, Homo sapiens
tcaccgtggaccttcctgcca

SEQ ID NO: 2038970 - DNA, 14 bp, Homo sapiens
tcacctcagctgat

SEQ ID NO: 2038971 - DNA, 16 bp, Homo sapiens
tcacctcctccactca

SEQ ID NO: 2038972 - DNA, 17 bp, Homo sapiens
tataaccattacatgtt

SEQ ID NO: 2038973 - DNA, 18 bp, Homo sapiens
tataactcatcataaaat

SEQ ID NO: 2038974 - DNA, 18 bp, Homo sapiens
tataacttaaaatatttt

SEQ ID NO: 2038975 - DNA, 15 bp, Homo sapiens
tataacttcttaaaa

SEQ ID NO: 2038976 - DNA, 16 bp, Homo sapiens
tataacttcttaaaag

SEQ ID NO: 2038977 - DNA, 14 bp, Homo sapiens
tataagaacttgat

SEQ ID NO: 2038978 - DNA, 14 bp, Homo sapiens
tataagaattaatc

SEQ ID NO: 2038979 - DNA, 22 bp, Homo sapiens
tataagcaagaaggcaaaaata

SEQ ID NO: 2038980 - DNA, 23 bp, Homo sapiens
tataaggagagttcaagcctgtg

SEQ ID NO: 2038981 - DNA, 17 bp, Homo sapiens
tataaggtttaaaaaga

SEQ ID NO: 2038982 - DNA, 23 bp, Homo sapiens
tataagtgcacacagaaatatat

SEQ ID NO: 2038983 - DNA, 16 bp, Homo sapiens
tataataaatgtacat

SEQ ID NO: 2038984 - DNA, 16 bp, Homo sapiens
tataatactaaagtgt

SEQ ID NO: 2038985 - DNA, 20 bp, Homo sapiens
tataatggaaacatttacaa

SEQ ID NO: 2038986 - DNA, 15 bp, Homo sapiens
tataatggttgactg

SEQ ID NO: 2038987 - DNA, 12 bp, Homo sapiens
tataatggttta

SEQ ID NO: 2038988 - DNA, 13 bp, Homo sapiens
tatatacatgtat

SEQ ID NO: 2038989 - DNA, 15 bp, Homo sapiens
tatatacatgtatag

SEQ ID NO: 2038990 - DNA, 18 bp, Homo sapiens
tatatacatgtatagtga

SEQ ID NO: 2038991 - DNA, 15 bp, Homo sapiens
tatatacatgtgtgt

SEQ ID NO: 2038992 - DNA, 21 bp, Homo sapiens
tatatagcagcaaaaatataa

SEQ ID NO: 2038993 - DNA, 19 bp, Homo sapiens
tatatagtatatttatact

SEQ ID NO: 2038994 - DNA, 21 bp, Homo sapiens
tatatagtatatttatactct

SEQ ID NO: 2038995 - DNA, 14 bp, Homo sapiens
tatatagtgctata

SEQ ID NO: 2038996 - DNA, 15 bp, Homo sapiens
tatatagtgctatat

SEQ ID NO: 2038997 - DNA, 17 bp, Homo sapiens
tatatagtgctatatat

SEQ ID NO: 2038998 - DNA, 22 bp, Homo sapiens
tatatagtttattgacaataat

SEQ ID NO: 2038999 - DNA, 14 bp, Homo sapiens
tatatataaatata

SEQ ID NO: 2039000 - DNA, 17 bp, Homo sapiens
tatatatacacatacat

SEQ ID NO: 2039001 - DNA, 22 bp, Homo sapiens
tatatatacacatacatacaca

SEQ ID NO: 2039002 - DNA, 14 bp, Homo sapiens
tatatatacatatg

SEQ ID NO: 2039003 - DNA, 15 bp, Homo sapiens
tatatatacatatgt

SEQ ID NO: 2039004 - DNA, 18 bp, Homo sapiens
tatatatacatatgtaga

SEQ ID NO: 2039005 - DNA, 12 bp, Homo sapiens
tatatatagaat

SEQ ID NO: 2039006 - DNA, 13 bp, Homo sapiens
tatatatatatgt

SEQ ID NO: 2039007 - DNA, 15 bp, Homo sapiens
tatatatatatgtac

SEQ ID NO: 2039008 - DNA, 15 bp, Homo sapiens
tatatatatatgtgt

SEQ ID NO: 2039009 - DNA, 13 bp, Homo sapiens
tatatatatgtat

SEQ ID NO: 2039010 - DNA, 14 bp, Homo sapiens
tatatatatgtata

SEQ ID NO: 2039011 - DNA, 15 bp, Homo sapiens
tatatatctatctta

SEQ ID NO: 2039012 - DNA, 23 bp, Homo sapiens
tatatatgaagtaagttctgaaa

SEQ ID NO: 2039013 - DNA, 11 bp, Homo sapiens
tatatatgtac

SEQ ID NO: 2039014 - DNA, 15 bp, Homo sapiens
tatatatgtacagtt

SEQ ID NO: 2039015 - DNA, 18 bp, Homo sapiens
taaactagtttccagtgg

SEQ ID NO: 2039016 - DNA, 15 bp, Homo sapiens
taaactataaactac

SEQ ID NO: 2039017 - DNA, 17 bp, Homo sapiens
taaactataaactactg

SEQ ID NO: 2039018 - DNA, 14 bp, Homo sapiens
taaactcaaaatat

SEQ ID NO: 2039019 - DNA, 22 bp, Homo sapiens
taaactcaaaatatttgtacat

SEQ ID NO: 2039020 - DNA, 22 bp, Homo sapiens
taaactctaaacattaatcaat

SEQ ID NO: 2039021 - DNA, 19 bp, Homo sapiens
taaactgaaaaatgtcagt

SEQ ID NO: 2039022 - DNA, 16 bp, Homo sapiens
taaactgaagaaggat

SEQ ID NO: 2039023 - DNA, 17 bp, Homo sapiens
taaactgagcctctttt

SEQ ID NO: 2039024 - DNA, 22 bp, Homo sapiens
taaactgattagtattcaggca

SEQ ID NO: 2039025 - DNA, 20 bp, Homo sapiens
taaactgtatcaaatctgta

SEQ ID NO: 2039026 - DNA, 22 bp, Homo sapiens
taaactgtatcaaatctgtata

SEQ ID NO: 2039027 - DNA, 20 bp, Homo sapiens
taaacttagaataaaattgt

SEQ ID NO: 2039028 - DNA, 14 bp, Homo sapiens
taaacttcagcacc

SEQ ID NO: 2039029 - DNA, 20 bp, Homo sapiens
taaacttgtgtatgatccaa

SEQ ID NO: 2039030 - DNA, 20 bp, Homo sapiens
taaactttacccaaaaacta

SEQ ID NO: 2039031 - DNA, 12 bp, Homo sapiens
taaactttctct

SEQ ID NO: 2039032 - DNA, 15 bp, Homo sapiens
taaactttgtgcctt

SEQ ID NO: 2039033 - DNA, 11 bp, Homo sapiens
taaagaaagtc

SEQ ID NO: 2039034 - DNA, 14 bp, Homo sapiens
taaagaagtaaatt

SEQ ID NO: 2039035 - DNA, 16 bp, Homo sapiens
taaagaagtaaatttg

SEQ ID NO: 2039036 - DNA, 21 bp, Homo sapiens
taaagaagtaaatttgtccaa

SEQ ID NO: 2039037 - DNA, 13 bp, Homo sapiens
taaagaataaatg

SEQ ID NO: 2039038 - DNA, 22 bp, Homo sapiens
taaagacagaaaaaaataaaaa

SEQ ID NO: 2039039 - DNA, 21 bp, Homo sapiens
taaagacagggaagagcagaa

SEQ ID NO: 2039040 - DNA, 18 bp, Homo sapiens
taaagaggcgtcttgtat

SEQ ID NO: 2039041 - DNA, 23 bp, Homo sapiens
taaagaggcgtcttgtattttct

SEQ ID NO: 2039042 - DNA, 16 bp, Homo sapiens
taaagagtatttacaa

SEQ ID NO: 2039043 - DNA, 17 bp, Homo sapiens
taaagataaagccagaa

SEQ ID NO: 2039044 - DNA, 20 bp, Homo sapiens
taaagatatcagagctctta

SEQ ID NO: 2039045 - DNA, 11 bp, Homo sapiens
taaagatgtgt

SEQ ID NO: 2039046 - DNA, 12 bp, Homo sapiens
taaagatttttt

SEQ ID NO: 2039047 - DNA, 20 bp, Homo sapiens
taaagattttttaataattt

SEQ ID NO: 2039048 - DNA, 22 bp, Homo sapiens
taaagcacagtctgatgacaca

SEQ ID NO: 2039049 - DNA, 16 bp, Homo sapiens
taaagcagtagacaat

SEQ ID NO: 2039050 - DNA, 14 bp, Homo sapiens
taaagcatcagaga

SEQ ID NO: 2039051 - DNA, 21 bp, Homo sapiens
taaagcatcagagatggtaat

SEQ ID NO: 2039052 - DNA, 18 bp, Homo sapiens
taaagcccataaggccag

SEQ ID NO: 2039053 - DNA, 15 bp, Homo sapiens
taaagcctatttttc

SEQ ID NO: 2039054 - DNA, 14 bp, Homo sapiens
taaagctactgaat

SEQ ID NO: 2039055 - DNA, 16 bp, Homo sapiens
taaagctactgaattt

SEQ ID NO: 2039056 - DNA, 17 bp, Homo sapiens
taaagctactgaattta

SEQ ID NO: 2039057 - DNA, 17 bp, Homo sapiens
taaagctgcctgtagtt

SEQ ID NO: 2039058 - DNA, 23 bp, Homo sapiens
taaagctgcctgtagttaggaaa

SEQ ID NO: 2039059 - DNA, 13 bp, Homo sapiens
taaagcttaaatt

SEQ ID NO: 2039060 - DNA, 11 bp, Homo sapiens
taaagcttgtc

SEQ ID NO: 2039061 - DNA, 14 bp, Homo sapiens
taaaggaaggaaaa

SEQ ID NO: 2039062 - DNA, 15 bp, Homo sapiens
taaaggattgatcac

SEQ ID NO: 2039063 - DNA, 19 bp, Homo sapiens
taaaggcctcatctccttt

SEQ ID NO: 2039064 - DNA, 20 bp, Homo sapiens
taaagggcaggtggttctaa

SEQ ID NO: 2039065 - DNA, 17 bp, Homo sapiens
taaaggtagagatgtgt

SEQ ID NO: 2039066 - DNA, 23 bp, Homo sapiens
taaaggtggtatgtgtgtgtatg

SEQ ID NO: 2039067 - DNA, 21 bp, Homo sapiens
taaagtacctgtagtgagaaa

SEQ ID NO: 2039068 - DNA, 16 bp, Homo sapiens
taaagtatcatgcatt

SEQ ID NO: 2039069 - DNA, 17 bp, Homo sapiens
taaagtatcatgcattc

SEQ ID NO: 2039070 - DNA, 15 bp, Homo sapiens
taaagtatgtaaaca

SEQ ID NO: 2039071 - DNA, 19 bp, Homo sapiens
taaagtcaacaaccatgcc

SEQ ID NO: 2039072 - DNA, 23 bp, Homo sapiens
taaagtcatggtcattgcaggaa

SEQ ID NO: 2039073 - DNA, 14 bp, Homo sapiens
taaagtctgagtgg

SEQ ID NO: 2039074 - DNA, 19 bp, Homo sapiens
taaagtctgagtgggcggc

SEQ ID NO: 2039075 - DNA, 13 bp, Homo sapiens
taaagtgaccagg

SEQ ID NO: 2039076 - DNA, 16 bp, Homo sapiens
taaagtgataatttct

SEQ ID NO: 2039077 - DNA, 15 bp, Homo sapiens
taaagtgtagcaccc

SEQ ID NO: 2039078 - DNA, 12 bp, Homo sapiens
taaagtgtctat

SEQ ID NO: 2039079 - DNA, 21 bp, Homo sapiens
taaagtgtctattagttttct

SEQ ID NO: 2039080 - DNA, 21 bp, Homo sapiens
taaagttagtgtgttgtctgt

SEQ ID NO: 2039081 - DNA, 17 bp, Homo sapiens
taaagttctgagtgttt

SEQ ID NO: 2039082 - DNA, 16 bp, Homo sapiens
taaagttgataaagat

SEQ ID NO: 2039083 - DNA, 20 bp, Homo sapiens
taaagttgataaagattttt

SEQ ID NO: 2039084 - DNA, 14 bp, Homo sapiens
taaagtttaaaaaa

SEQ ID NO: 2039085 - DNA, 14 bp, Homo sapiens
taaagtttacagta

SEQ ID NO: 2039086 - DNA, 14 bp, Homo sapiens
taaagtttatttca

SEQ ID NO: 2039087 - DNA, 20 bp, Homo sapiens
taaagtttatttcatggatt

SEQ ID NO: 2039088 - DNA, 16 bp, Homo sapiens
taaataaaaatattct

SEQ ID NO: 2039089 - DNA, 10 bp, Homo sapiens
taaataaaag

SEQ ID NO: 2039090 - DNA, 15 bp, Homo sapiens
taaataaaagcagca

SEQ ID NO: 2039091 - DNA, 19 bp, Homo sapiens
taaataaaagcagcatctg

SEQ ID NO: 2039092 - DNA, 20 bp, Homo sapiens
taaataaagtatcatgcatt

SEQ ID NO: 2039093 - DNA, 22 bp, Homo sapiens
taaataaatgaagtatttctca

SEQ ID NO: 2039094 - DNA, 20 bp, Homo sapiens
taaggagaggagaaactgag

SEQ ID NO: 2039095 - DNA, 20 bp, Homo sapiens
taaggagcatgattttaaga

SEQ ID NO: 2039096 - DNA, 19 bp, Homo sapiens
taaggatcagaacagcaga

SEQ ID NO: 2039097 - DNA, 15 bp, Homo sapiens
taaggatgacttttt

SEQ ID NO: 2039098 - DNA, 19 bp, Homo sapiens
taaggatggagccagctct

SEQ ID NO: 2039099 - DNA, 21 bp, Homo sapiens
taaggcttaggtgccaggctg

SEQ ID NO: 2039100 - DNA, 12 bp, Homo sapiens
taagggaaaaat

SEQ ID NO: 2039101 - DNA, 18 bp, Homo sapiens
taagggaataagccatga

SEQ ID NO: 2039102 - DNA, 22 bp, Homo sapiens
taagggctggtctctgctgaag

SEQ ID NO: 2039103 - DNA, 20 bp, Homo sapiens
taagggtctgttgtaaatga

SEQ ID NO: 2039104 - DNA, 21 bp, Homo sapiens
taagggtctgttgtaaatgac

SEQ ID NO: 2039105 - DNA, 20 bp, Homo sapiens
taaggtaatttctgtgtatt

SEQ ID NO: 2039106 - DNA, 18 bp, Homo sapiens
taaggtacaagaagcatt

SEQ ID NO: 2039107 - DNA, 19 bp, Homo sapiens
taaggtacaagaagcattt

SEQ ID NO: 2039108 - DNA, 13 bp, Homo sapiens
taaggtgccttct

SEQ ID NO: 2039109 - DNA, 15 bp, Homo sapiens
taagtaaaaccacag

SEQ ID NO: 2039110 - DNA, 17 bp, Homo sapiens
taagtaaaaccacagca

SEQ ID NO: 2039111 - DNA, 17 bp, Homo sapiens
taagtaccactcaggcc

SEQ ID NO: 2039112 - DNA, 21 bp, Homo sapiens
taagtagatagaaagcaataa

SEQ ID NO: 2039113 - DNA, 17 bp, Homo sapiens
taagtatttacagatgt

SEQ ID NO: 2039114 - DNA, 23 bp, Homo sapiens
taagtatttatatatttataact

SEQ ID NO: 2039115 - DNA, 14 bp, Homo sapiens
taagtcctctcttc

SEQ ID NO: 2039116 - DNA, 17 bp, Homo sapiens
taagtcctctcttctct

SEQ ID NO: 2039117 - DNA, 22 bp, Homo sapiens
taagtctccaagaatacagaaa

SEQ ID NO: 2039118 - DNA, 15 bp, Homo sapiens
taagtctctgactct

SEQ ID NO: 2039119 - DNA, 16 bp, Homo sapiens
taagtgaaaaggtcat

SEQ ID NO: 2039120 - DNA, 15 bp, Homo sapiens
taagtgcacacagaa

SEQ ID NO: 2039121 - DNA, 15 bp, Homo sapiens
taagtgctttgtaat

SEQ ID NO: 2039122 - DNA, 18 bp, Homo sapiens
taagtggaaaaaagagaa

SEQ ID NO: 2039123 - DNA, 22 bp, Homo sapiens
taagtggaaaaaagagaaaaac

SEQ ID NO: 2039124 - DNA, 13 bp, Homo sapiens
taagtggctgctg

SEQ ID NO: 2039125 - DNA, 19 bp, Homo sapiens
taagtgggacattagtaac

SEQ ID NO: 2039126 - DNA, 14 bp, Homo sapiens
taagtgttgtaaat

SEQ ID NO: 2039127 - DNA, 17 bp, Homo sapiens
taagttattttaaaaaa

SEQ ID NO: 2039128 - DNA, 16 bp, Homo sapiens
taagttcatgtttgta

SEQ ID NO: 2039129 - DNA, 17 bp, Homo sapiens
taagttcatgtttgtaa

SEQ ID NO: 2039130 - DNA, 13 bp, Homo sapiens
taagttctaagtt

SEQ ID NO: 2039131 - DNA, 18 bp, Homo sapiens
taagttctgaaaactgtt

SEQ ID NO: 2039132 - DNA, 17 bp, Homo sapiens
taagttggaccagagga

SEQ ID NO: 2039133 - DNA, 20 bp, Homo sapiens
taagttggaccagaggaagc

SEQ ID NO: 2039134 - DNA, 17 bp, Homo sapiens
taagtttatgtctaaag

SEQ ID NO: 2039135 - DNA, 18 bp, Homo sapiens
taagtttatgtctaaaga

SEQ ID NO: 2039136 - DNA, 14 bp, Homo sapiens
taagttttttactt

SEQ ID NO: 2039137 - DNA, 20 bp, Homo sapiens
taataaaaaatggaaagaat

SEQ ID NO: 2039138 - DNA, 11 bp, Homo sapiens
taataaaatga

SEQ ID NO: 2039139 - DNA, 22 bp, Homo sapiens
taataaacatccttcaagaact

SEQ ID NO: 2039140 - DNA, 18 bp, Homo sapiens
taataaacgaagataaat

SEQ ID NO: 2039141 - DNA, 17 bp, Homo sapiens
taataaacttagaataa

SEQ ID NO: 2039142 - DNA, 22 bp, Homo sapiens
taataaatctgagcctaaatct

SEQ ID NO: 2039143 - DNA, 17 bp, Homo sapiens
taataaatgtacattaa

SEQ ID NO: 2039144 - DNA, 23 bp, Homo sapiens
taataaattttaacattttccaa

SEQ ID NO: 2039145 - DNA, 21 bp, Homo sapiens
taataactagatctcctgtaa

SEQ ID NO: 2039146 - DNA, 15 bp, Homo sapiens
taataagtttgatca

SEQ ID NO: 2039147 - DNA, 16 bp, Homo sapiens
taataatgttctctgg

SEQ ID NO: 2039148 - DNA, 13 bp, Homo sapiens
taataatttcatc

SEQ ID NO: 2039149 - DNA, 14 bp, Homo sapiens
taataccaaatatt

SEQ ID NO: 2039150 - DNA, 18 bp, Homo sapiens
taataccaaatattttag

SEQ ID NO: 2039151 - DNA, 18 bp, Homo sapiens
taatactaaaatatgtct

SEQ ID NO: 2039152 - DNA, 18 bp, Homo sapiens
taatagaaaactgaaaat

SEQ ID NO: 2039153 - DNA, 16 bp, Homo sapiens
taatagatgtttgata

SEQ ID NO: 2039154 - DNA, 19 bp, Homo sapiens
taatagtccaatatttggc

SEQ ID NO: 2039155 - DNA, 14 bp, Homo sapiens
taatagtccatgga

SEQ ID NO: 2039156 - DNA, 15 bp, Homo sapiens
taatagttagccctc

SEQ ID NO: 2039157 - DNA, 14 bp, Homo sapiens
taatataaagttgg

SEQ ID NO: 2039158 - DNA, 13 bp, Homo sapiens
taatataagaatc

SEQ ID NO: 2039159 - DNA, 19 bp, Homo sapiens
taatataagaatcatagtg

SEQ ID NO: 2039160 - DNA, 18 bp, Homo sapiens
taatataatggaagagaa

SEQ ID NO: 2039161 - DNA, 15 bp, Homo sapiens
taatatagctatcat

SEQ ID NO: 2039162 - DNA, 17 bp, Homo sapiens
taatatatcccagaaat

SEQ ID NO: 2039163 - DNA, 22 bp, Homo sapiens
taatatatttttatatttagtt

SEQ ID NO: 2039164 - DNA, 17 bp, Homo sapiens
taatatctgagaagtgt

SEQ ID NO: 2039165 - DNA, 14 bp, Homo sapiens
taatatcttgaaga

SEQ ID NO: 2039166 - DNA, 23 bp, Homo sapiens
taatatgattttttaaaagaaat

SEQ ID NO: 2039167 - DNA, 22 bp, Homo sapiens
taatatggaaccttccctccaa

SEQ ID NO: 2039168 - DNA, 15 bp, Homo sapiens
taatatggcaaaaat

SEQ ID NO: 2039169 - DNA, 22 bp, Homo sapiens
taatatgggtgaacaccaactt

SEQ ID NO: 2039170 - DNA, 12 bp, Homo sapiens
taatattgtgct

SEQ ID NO: 2039171 - DNA, 13 bp, Homo sapiens
taatattttgtat

SEQ ID NO: 2039172 - DNA, 13 bp, Homo sapiens
taatcaccaaagt

SEQ ID NO: 2039173 - DNA, 15 bp, Homo sapiens
taatcagcctcttaa

SEQ ID NO: 2039174 - DNA, 12 bp, Homo sapiens
taatcaggcagc

SEQ ID NO: 2039175 - DNA, 14 bp, Homo sapiens
taatcaggcagcct

SEQ ID NO: 2039176 - DNA, 15 bp, Homo sapiens
taatcaggctgaggt

SEQ ID NO: 2039177 - DNA, 22 bp, Homo sapiens
taatcaggtcctcagagaattt

SEQ ID NO: 2039178 - DNA, 15 bp, Homo sapiens
taatcatataataaa

SEQ ID NO: 2039179 - DNA, 22 bp, Homo sapiens
taatcatataataaatgtacat

SEQ ID NO: 2039180 - DNA, 18 bp, Homo sapiens
taatcccagctacacctg

SEQ ID NO: 2039181 - DNA, 16 bp, Homo sapiens
taatcctgtatattat

SEQ ID NO: 2039182 - DNA, 14 bp, Homo sapiens
taatcgaaatgaat

SEQ ID NO: 2039183 - DNA, 14 bp, Homo sapiens
taatctatttacat

SEQ ID NO: 2039184 - DNA, 19 bp, Homo sapiens
taatctggaaggcccctcc

SEQ ID NO: 2039185 - DNA, 20 bp, Homo sapiens
taatctggactcctctgtcc

SEQ ID NO: 2039186 - DNA, 22 bp, Homo sapiens
taatctggactcctctgtccag

SEQ ID NO: 2039187 - DNA, 17 bp, Homo sapiens
taatctgggaagggaag

SEQ ID NO: 2039188 - DNA, 22 bp, Homo sapiens
taatcttaattttgtatttttt

SEQ ID NO: 2039189 - DNA, 19 bp, Homo sapiens
taatcttaggggagagctt

SEQ ID NO: 2039190 - DNA, 20 bp, Homo sapiens
taatcttaggggagagcttt

SEQ ID NO: 2039191 - DNA, 21 bp, Homo sapiens
taatgaaaaggaagttaatac

SEQ ID NO: 2039192 - DNA, 23 bp, Homo sapiens
taatgaaacaaagagttcaagaa

SEQ ID NO: 2039193 - DNA, 13 bp, Homo sapiens
taatgaacaaatg

SEQ ID NO: 2039194 - DNA, 13 bp, Homo sapiens
taatgaacagcag

SEQ ID NO: 2039195 - DNA, 16 bp, Homo sapiens
taatgaactgtgacag

SEQ ID NO: 2039196 - DNA, 17 bp, Homo sapiens
taatgaactgtgacagg

SEQ ID NO: 2039197 - DNA, 18 bp, Homo sapiens
taatgaagctattgagaa

SEQ ID NO: 2039198 - DNA, 13 bp, Homo sapiens
taatgaatatctg

SEQ ID NO: 2039199 - DNA, 15 bp, Homo sapiens
taatgaatatctgct

SEQ ID NO: 2039200 - DNA, 20 bp, Homo sapiens
taatgacacggtaggccaag

SEQ ID NO: 2039201 - DNA, 18 bp, Homo sapiens
taatgactttttataatg

SEQ ID NO: 2039202 - DNA, 19 bp, Homo sapiens
taatgactttttataatgt

SEQ ID NO: 2039203 - DNA, 19 bp, Homo sapiens
taatgatttaagcatttta

SEQ ID NO: 2039204 - DNA, 20 bp, Homo sapiens
taatgatttaagcattttac

SEQ ID NO: 2039205 - DNA, 14 bp, Homo sapiens
taatgcacaattta

SEQ ID NO: 2039206 - DNA, 17 bp, Homo sapiens
taatgcacaatttagaa

SEQ ID NO: 2039207 - DNA, 22 bp, Homo sapiens
taatttttcagctctctgtata

SEQ ID NO: 2039208 - DNA, 21 bp, Homo sapiens
taatttttgatactaagcatt

SEQ ID NO: 2039209 - DNA, 18 bp, Homo sapiens
taatttttttgagacaga

SEQ ID NO: 2039210 - DNA, 17 bp, Homo sapiens
taccgagtctcttctcc

SEQ ID NO: 2039211 - DNA, 17 bp, Homo sapiens
tagaattttagaagaga

SEQ ID NO: 2039212 - DNA, 17 bp, Homo sapiens
tagacacccattttcac

SEQ ID NO: 2039213 - DNA, 14 bp, Homo sapiens
tagacagaagaaac

SEQ ID NO: 2039214 - DNA, 21 bp, Homo sapiens
tagacagagtctcactgttgc

SEQ ID NO: 2039215 - DNA, 14 bp, Homo sapiens
tagacagtgctgcc

SEQ ID NO: 2039216 - DNA, 17 bp, Homo sapiens
tagacagtgctgccctg

SEQ ID NO: 2039217 - DNA, 20 bp, Homo sapiens
tagacagtgctgccctgcga

SEQ ID NO: 2039218 - DNA, 19 bp, Homo sapiens
tagacatttgtaaatgtaa

SEQ ID NO: 2039219 - DNA, 13 bp, Homo sapiens
tagaccaaaataa

SEQ ID NO: 2039220 - DNA, 14 bp, Homo sapiens
tagacctcagcctg

SEQ ID NO: 2039221 - DNA, 15 bp, Homo sapiens
tagacctcagcctgt

SEQ ID NO: 2039222 - DNA, 12 bp, Homo sapiens
tagacctgggcc

SEQ ID NO: 2039223 - DNA, 14 bp, Homo sapiens
tagactaaatgaaa

SEQ ID NO: 2039224 - DNA, 19 bp, Homo sapiens
tagactaattaaaatctgg

SEQ ID NO: 2039225 - DNA, 13 bp, Homo sapiens
tagactatataca

SEQ ID NO: 2039226 - DNA, 19 bp, Homo sapiens
tagactatatacatgtgtg

SEQ ID NO: 2039227 - DNA, 20 bp, Homo sapiens
tagactatatacatgtgtgt

SEQ ID NO: 2039228 - DNA, 15 bp, Homo sapiens
tagactcctgcttct

SEQ ID NO: 2039229 - DNA, 19 bp, Homo sapiens
tagactttctcagtgggac

SEQ ID NO: 2039230 - DNA, 21 bp, Homo sapiens
tagactttctcagtgggacaa

SEQ ID NO: 2039231 - DNA, 11 bp, Homo sapiens
tagactttctg

SEQ ID NO: 2039232 - DNA, 20 bp, Homo sapiens
tagagaagccggctcttcaa

SEQ ID NO: 2039233 - DNA, 11 bp, Homo sapiens
tagagacaggg

SEQ ID NO: 2039234 - DNA, 16 bp, Homo sapiens
tagagagagaccactt

SEQ ID NO: 2039235 - DNA, 14 bp, Homo sapiens
tagagagcagaaat

SEQ ID NO: 2039236 - DNA, 18 bp, Homo sapiens
tagagaggtagcgagctg

SEQ ID NO: 2039237 - DNA, 17 bp, Homo sapiens
tagagatagtacataaa

SEQ ID NO: 2039238 - DNA, 12 bp, Homo sapiens
tagagatgtttt

SEQ ID NO: 2039239 - DNA, 16 bp, Homo sapiens
tagagcacactgtagc

SEQ ID NO: 2039240 - DNA, 12 bp, Homo sapiens
tagagcagccca

SEQ ID NO: 2039241 - DNA, 14 bp, Homo sapiens
tagagccagggtct

SEQ ID NO: 2039242 - DNA, 19 bp, Homo sapiens
tagagccccccgtgtggct

SEQ ID NO: 2039243 - DNA, 23 bp, Homo sapiens
tagagcctggaagggaagtgaga

SEQ ID NO: 2039244 - DNA, 20 bp, Homo sapiens
tagagctgggaaacagggag

SEQ ID NO: 2039245 - DNA, 15 bp, Homo sapiens
tagagcttctggcac

SEQ ID NO: 2039246 - DNA, 19 bp, Homo sapiens
tagagcttggacagtctga

SEQ ID NO: 2039247 - DNA, 12 bp, Homo sapiens
tagagctttctt

SEQ ID NO: 2039248 - DNA, 23 bp, Homo sapiens
tagaggtaccagcaatatgtaaa

SEQ ID NO: 2039249 - DNA, 16 bp, Homo sapiens
tagaggtgggcagctg

SEQ ID NO: 2039250 - DNA, 20 bp, Homo sapiens
tagaggtgggcagctgggcc

SEQ ID NO: 2039251 - DNA, 16 bp, Homo sapiens
tagaggttttgttgtt

SEQ ID NO: 2039252 - DNA, 20 bp, Homo sapiens
tagagtgcccttaaaataat

SEQ ID NO: 2039253 - DNA, 14 bp, Homo sapiens
tagatatataactt

SEQ ID NO: 2039254 - DNA, 23 bp, Homo sapiens
tagatcaaggagcccagaaaacc

SEQ ID NO: 2039255 - DNA, 14 bp, Homo sapiens
tagatcaattaatt

SEQ ID NO: 2039256 - DNA, 22 bp, Homo sapiens
tagatcccatgtcacctcagct

SEQ ID NO: 2039257 - DNA, 19 bp, Homo sapiens
tagatctccaggagaactg

SEQ ID NO: 2039258 - DNA, 15 bp, Homo sapiens
tagatcttacatctg

SEQ ID NO: 2039259 - DNA, 12 bp, Homo sapiens
tagatcttctga

SEQ ID NO: 2039260 - DNA, 20 bp, Homo sapiens
tagatggaccagtagacaac

SEQ ID NO: 2039261 - DNA, 14 bp, Homo sapiens
tagatggtgaaatt

SEQ ID NO: 2039262 - DNA, 15 bp, Homo sapiens
tagatggtgaaattt

SEQ ID NO: 2039263 - DNA, 20 bp, Homo sapiens
tagatggttctcaattgtat

SEQ ID NO: 2039264 - DNA, 13 bp, Homo sapiens
tagatgtgattcc

SEQ ID NO: 2039265 - DNA, 18 bp, Homo sapiens
tagattaatggcactgat

SEQ ID NO: 2039266 - DNA, 20 bp, Homo sapiens
tagattacctgatcatggtc

SEQ ID NO: 2039267 - DNA, 18 bp, Homo sapiens
tagattagctctggacca

SEQ ID NO: 2039268 - DNA, 12 bp, Homo sapiens
tagattccagga

SEQ ID NO: 2039269 - DNA, 21 bp, Homo sapiens
tagattcctcttgcctctctc

SEQ ID NO: 2039270 - DNA, 20 bp, Homo sapiens
tagattctacatattcttta

SEQ ID NO: 2039271 - DNA, 16 bp, Homo sapiens
tagattttagttcact

SEQ ID NO: 2039272 - DNA, 17 bp, Homo sapiens
tagattttcatgttctt

SEQ ID NO: 2039273 - DNA, 15 bp, Homo sapiens
tagattttgtgcagt

SEQ ID NO: 2039274 - DNA, 16 bp, Homo sapiens
tagcaaaagaagaagt

SEQ ID NO: 2039275 - DNA, 17 bp, Homo sapiens
tagcaaccttcatttta

SEQ ID NO: 2039276 - DNA, 21 bp, Homo sapiens
tagcaactacagtctaaagct

SEQ ID NO: 2039277 - DNA, 12 bp, Homo sapiens
tagcaagacaca

SEQ ID NO: 2039278 - DNA, 16 bp, Homo sapiens
tagcaagacctgttgg

SEQ ID NO: 2039279 - DNA, 20 bp, Homo sapiens
tagcaagattgcttaaaata

SEQ ID NO: 2039280 - DNA, 16 bp, Homo sapiens
tagcaaggcatgatgt

SEQ ID NO: 2039281 - DNA, 17 bp, Homo sapiens
tagcaagttctagagaa

SEQ ID NO: 2039282 - DNA, 21 bp, Homo sapiens
tagcaagttctagagaagagg

SEQ ID NO: 2039283 - DNA, 19 bp, Homo sapiens
tagcacaagttatttaaat

SEQ ID NO: 2039284 - DNA, 23 bp, Homo sapiens
tagcagagaatgaaagggcccag

SEQ ID NO: 2039285 - DNA, 14 bp, Homo sapiens
tagcagatggagta

SEQ ID NO: 2039286 - DNA, 18 bp, Homo sapiens
tagcagattttaattttg

SEQ ID NO: 2039287 - DNA, 17 bp, Homo sapiens
tagcaggtaccactgat

SEQ ID NO: 2039288 - DNA, 20 bp, Homo sapiens
tagcatctgctcttctctta

SEQ ID NO: 2039289 - DNA, 16 bp, Homo sapiens
tagcatcttctggagt

SEQ ID NO: 2039290 - DNA, 14 bp, Homo sapiens
tagcattgaacatt

SEQ ID NO: 2039291 - DNA, 16 bp, Homo sapiens
tagcattgaagtgtcg

SEQ ID NO: 2039292 - DNA, 12 bp, Homo sapiens
tagcatttcttg

SEQ ID NO: 2039293 - DNA, 18 bp, Homo sapiens
tagcatttttattcatgc

SEQ ID NO: 2039294 - DNA, 21 bp, Homo sapiens
tagccaaaaatagctaaatac

SEQ ID NO: 2039295 - DNA, 20 bp, Homo sapiens
tagccaaggtgggctgagcc

SEQ ID NO: 2039296 - DNA, 17 bp, Homo sapiens
tagccacctcccacccc

SEQ ID NO: 2039297 - DNA, 18 bp, Homo sapiens
tagccacctcccacccca

SEQ ID NO: 2039298 - DNA, 19 bp, Homo sapiens
tagccacctcccaccccac

SEQ ID NO: 2039299 - DNA, 20 bp, Homo sapiens
tagccacctcccaccccact

SEQ ID NO: 2039300 - DNA, 13 bp, Homo sapiens
tagccactcagga

SEQ ID NO: 2039301 - DNA, 14 bp, Homo sapiens
tagccactcaggag

SEQ ID NO: 2039302 - DNA, 23 bp, Homo sapiens
tagccacttaccttcaataaagt

SEQ ID NO: 2039303 - DNA, 15 bp, Homo sapiens
tagccagagaggagc

SEQ ID NO: 2039304 - DNA, 17 bp, Homo sapiens
tagccagagggtgggag

SEQ ID NO: 2039305 - DNA, 16 bp, Homo sapiens
tagccaggagtctgtg

SEQ ID NO: 2039306 - DNA, 18 bp, Homo sapiens
tagccaggagtctgtgct

SEQ ID NO: 2039307 - DNA, 23 bp, Homo sapiens
tagccagtgactttttctgagct

SEQ ID NO: 2039308 - DNA, 22 bp, Homo sapiens
tagccatgtactataatgtgat

SEQ ID NO: 2039309 - DNA, 17 bp, Homo sapiens
tagcccaagaggtctga

SEQ ID NO: 2039310 - DNA, 14 bp, Homo sapiens
tagcccagcactgt

SEQ ID NO: 2039311 - DNA, 20 bp, Homo sapiens
tagcccagcactgtgaagac

SEQ ID NO: 2039312 - DNA, 13 bp, Homo sapiens
tagcccgaggacc

SEQ ID NO: 2039313 - DNA, 17 bp, Homo sapiens
tagcccggccagggcct

SEQ ID NO: 2039314 - DNA, 14 bp, Homo sapiens
tagccgagagcctg

SEQ ID NO: 2039315 - DNA, 17 bp, Homo sapiens
tagccgagagcctgctc

SEQ ID NO: 2039316 - DNA, 16 bp, Homo sapiens
tagccggccactttgg

SEQ ID NO: 2039317 - DNA, 19 bp, Homo sapiens
tagccgggcatggtggcgc

SEQ ID NO: 2039318 - DNA, 17 bp, Homo sapiens
tagccgtccatggcacc

SEQ ID NO: 2039319 - DNA, 20 bp, Homo sapiens
tagccgtccatggcaccagc

SEQ ID NO: 2039320 - DNA, 14 bp, Homo sapiens
tagtactctctgct

SEQ ID NO: 2039321 - DNA, 13 bp, Homo sapiens
tagtagagacagg

SEQ ID NO: 2039322 - DNA, 14 bp, Homo sapiens
tagtagagacaggg

SEQ ID NO: 2039323 - DNA, 15 bp, Homo sapiens
tagtagagacagggt

SEQ ID NO: 2039324 - DNA, 11 bp, Homo sapiens
tagtagcattt

SEQ ID NO: 2039325 - DNA, 19 bp, Homo sapiens
tagtagccctttctgtgtg

SEQ ID NO: 2039326 - DNA, 14 bp, Homo sapiens
tagtatcttttaaa

SEQ ID NO: 2039327 - DNA, 14 bp, Homo sapiens
tagtattcaggcac

SEQ ID NO: 2039328 - DNA, 23 bp, Homo sapiens
tagtattcaggcactgagaatga

SEQ ID NO: 2039329 - DNA, 21 bp, Homo sapiens
tagtatttttactattataat

SEQ ID NO: 2039330 - DNA, 18 bp, Homo sapiens
tagtcaaaccataaactt

SEQ ID NO: 2039331 - DNA, 23 bp, Homo sapiens
tagtcaagaaaaattattgtata

SEQ ID NO: 2039332 - DNA, 15 bp, Homo sapiens
tagtcaattagtaca

SEQ ID NO: 2039333 - DNA, 13 bp, Homo sapiens
taaccatcagtta

SEQ ID NO: 2039334 - DNA, 22 bp, Homo sapiens
taaccatcagttactggtttca

SEQ ID NO: 2039335 - DNA, 15 bp, Homo sapiens
taaccattaagaaat

SEQ ID NO: 2039336 - DNA, 16 bp, Homo sapiens
taaccattacatgttt

SEQ ID NO: 2039337 - DNA, 17 bp, Homo sapiens
taaccattacatgttta

SEQ ID NO: 2039338 - DNA, 18 bp, Homo sapiens
taaccccaggcatcccat

SEQ ID NO: 2039339 - DNA, 18 bp, Homo sapiens
taacccccagcccacaga

SEQ ID NO: 2039340 - DNA, 18 bp, Homo sapiens
taacccccagtgccacag

SEQ ID NO: 2039341 - DNA, 12 bp, Homo sapiens
taacccctttcc

SEQ ID NO: 2039342 - DNA, 13 bp, Homo sapiens
taacccctttcct

SEQ ID NO: 2039343 - DNA, 16 bp, Homo sapiens
taacccctttcctgcg

SEQ ID NO: 2039344 - DNA, 23 bp, Homo sapiens
taacccgctcatcactggatgaa

SEQ ID NO: 2039345 - DNA, 16 bp, Homo sapiens
taaccctctcttccct

SEQ ID NO: 2039346 - DNA, 18 bp, Homo sapiens
taaccgtttttcaagaaa

SEQ ID NO: 2039347 - DNA, 22 bp, Homo sapiens
taacctatatgatttatagttt

SEQ ID NO: 2039348 - DNA, 20 bp, Homo sapiens
taacctcagtgtcatttatg

SEQ ID NO: 2039349 - DNA, 18 bp, Homo sapiens
taacctctctaagccaca

SEQ ID NO: 2039350 - DNA, 20 bp, Homo sapiens
tgtgaggctgggccagcctc

SEQ ID NO: 2039351 - DNA, 21 bp, Homo sapiens
tgtgaggctgggccagcctca

SEQ ID NO: 2039352 - DNA, 20 bp, Homo sapiens
tgtgagtgactcggtgtaaa

SEQ ID NO: 2039353 - DNA, 14 bp, Homo sapiens
tgtgagtggcagcc

SEQ ID NO: 2039354 - DNA, 16 bp, Homo sapiens
tgtgagtggcagccat

SEQ ID NO: 2039355 - DNA, 17 bp, Homo sapiens
tgtgagtggcagccatg

SEQ ID NO: 2039356 - DNA, 19 bp, Homo sapiens
tgtgagttgagtctcctct

SEQ ID NO: 2039357 - DNA, 22 bp, Homo sapiens
tgtgatacccatagcttccatg

SEQ ID NO: 2039358 - DNA, 15 bp, Homo sapiens
tgtgatcagaccata

SEQ ID NO: 2039359 - DNA, 23 bp, Homo sapiens
tgtgatcccaagtgccagtcttg

SEQ ID NO: 2039360 - DNA, 17 bp, Homo sapiens
tgtgatccttttatgtt

SEQ ID NO: 2039361 - DNA, 20 bp, Homo sapiens
tgtgatctatcaatagtcaa

SEQ ID NO: 2039362 - DNA, 13 bp, Homo sapiens
tgtgatgctggta

SEQ ID NO: 2039363 - DNA, 17 bp, Homo sapiens
tgtgatgctttgaagta

SEQ ID NO: 2039364 - DNA, 20 bp, Homo sapiens
tgtgatgggatctgtaagga

SEQ ID NO: 2039365 - DNA, 16 bp, Homo sapiens
tgtgattaacttgctt

SEQ ID NO: 2039366 - DNA, 15 bp, Homo sapiens
tgtgattccttttga

SEQ ID NO: 2039367 - DNA, 15 bp, Homo sapiens
tgtgattgaatctga

SEQ ID NO: 2039368 - DNA, 13 bp, Homo sapiens
tgtgattggagtg

SEQ ID NO: 2039369 - DNA, 17 bp, Homo sapiens
tgtgattggagtgtgtc

SEQ ID NO: 2039370 - DNA, 17 bp, Homo sapiens
tgtgatttagaactgta

SEQ ID NO: 2039371 - DNA, 23 bp, Homo sapiens
tgtgatttagaactgtatgtcag

SEQ ID NO: 2039372 - DNA, 13 bp, Homo sapiens
tgtgattttgtac

SEQ ID NO: 2039373 - DNA, 15 bp, Homo sapiens
tgtgattttgtacag

SEQ ID NO: 2039374 - DNA, 17 bp, Homo sapiens
tgtgcaatgtaaatatt

SEQ ID NO: 2039375 - DNA, 18 bp, Homo sapiens
tgtgcaatgtaaatattt

SEQ ID NO: 2039376 - DNA, 18 bp, Homo sapiens
tgtgcaccttacattcct

SEQ ID NO: 2039377 - DNA, 22 bp, Homo sapiens
tgtgcaccttacattcctagag

SEQ ID NO: 2039378 - DNA, 22 bp, Homo sapiens
tgtgcaccttaccaactttctg

SEQ ID NO: 2039379 - DNA, 13 bp, Homo sapiens
tgtgcagactgat

SEQ ID NO: 2039380 - DNA, 13 bp, Homo sapiens
tgtgcagcagccc

SEQ ID NO: 2039381 - DNA, 14 bp, Homo sapiens
tgtgcagcagccca

SEQ ID NO: 2039382 - DNA, 15 bp, Homo sapiens
tgtgcagcagcccag

SEQ ID NO: 2039383 - DNA, 21 bp, Homo sapiens
tgtgcagcagcccagcttcct

SEQ ID NO: 2039384 - DNA, 23 bp, Homo sapiens
tgtgcagcagcccagcttcctgg

SEQ ID NO: 2039385 - DNA, 16 bp, Homo sapiens
tgtgcagtattttatt

SEQ ID NO: 2039386 - DNA, 16 bp, Homo sapiens
tgtgcagtcccgtgga

SEQ ID NO: 2039387 - DNA, 21 bp, Homo sapiens
tgtgcagtcccgtggagggta

SEQ ID NO: 2039388 - DNA, 19 bp, Homo sapiens
tgtgcatagagccacgtat

SEQ ID NO: 2039389 - DNA, 13 bp, Homo sapiens
tgtgcatgtatgt

SEQ ID NO: 2039390 - DNA, 14 bp, Homo sapiens
tgtgcatgtatgtg

SEQ ID NO: 2039391 - DNA, 14 bp, Homo sapiens
tgtgcatgtgtgta

SEQ ID NO: 2039392 - DNA, 18 bp, Homo sapiens
tgtgcatgtgtgtataag

SEQ ID NO: 2039393 - DNA, 22 bp, Homo sapiens
tgtgcatgtgtgtgtctgtctt

SEQ ID NO: 2039394 - DNA, 16 bp, Homo sapiens
tgtgccaatatgtatt

SEQ ID NO: 2039395 - DNA, 15 bp, Homo sapiens
tgtgccacctgcaag

SEQ ID NO: 2039396 - DNA, 21 bp, Homo sapiens
tgtgccacctgcaagtgcccg

SEQ ID NO: 2039397 - DNA, 16 bp, Homo sapiens
tgtgccagagcctggg

SEQ ID NO: 2039398 - DNA, 22 bp, Homo sapiens
tgtgccagagcctggggctcta

SEQ ID NO: 2039399 - DNA, 14 bp, Homo sapiens
tgtgccagctcagg

SEQ ID NO: 2039400 - DNA, 21 bp, Homo sapiens
tgtgccatagagtttaacaca

SEQ ID NO: 2039401 - DNA, 22 bp, Homo sapiens
tgtgccatagagtttaacacaa

SEQ ID NO: 2039402 - DNA, 12 bp, Homo sapiens
tgtgccatgtgc

SEQ ID NO: 2039403 - DNA, 20 bp, Homo sapiens
tgtgcccacgtgtgcagact

SEQ ID NO: 2039404 - DNA, 15 bp, Homo sapiens
tgtgcccctgtaaat

SEQ ID NO: 2039405 - DNA, 11 bp, Homo sapiens
tgtgccctctg

SEQ ID NO: 2039406 - DNA, 12 bp, Homo sapiens
tgtgcccttggg

SEQ ID NO: 2039407 - DNA, 17 bp, Homo sapiens
tgtgccgtgaactgcgt

SEQ ID NO: 2039408 - DNA, 21 bp, Homo sapiens
tgtgccgtgaactgcgtgcca

SEQ ID NO: 2039409 - DNA, 13 bp, Homo sapiens
tgtgcctctgcct

SEQ ID NO: 2039410 - DNA, 12 bp, Homo sapiens
tgtgcctgcagc

SEQ ID NO: 2039411 - DNA, 12 bp, Homo sapiens
tgtgcctggaaa

SEQ ID NO: 2039412 - DNA, 13 bp, Homo sapiens
tgtgcctgtggca

SEQ ID NO: 2039413 - DNA, 21 bp, Homo sapiens
tgtgccttaaaaggagagaag

SEQ ID NO: 2039414 - DNA, 15 bp, Homo sapiens
tgtgccttttatagc

SEQ ID NO: 2039415 - DNA, 18 bp, Homo sapiens
tgtgccttttatagctat

SEQ ID NO: 2039416 - DNA, 23 bp, Homo sapiens
tgtgcgtgcgtgttagtgtgtgt

SEQ ID NO: 2039417 - DNA, 15 bp, Homo sapiens
tgtgcgttttagagt

SEQ ID NO: 2039418 - DNA, 16 bp, Homo sapiens
tgtgctattgaactga

SEQ ID NO: 2039419 - DNA, 17 bp, Homo sapiens
tgtgctattgaactgag

SEQ ID NO: 2039420 - DNA, 17 bp, Homo sapiens
tgtgctcacgctccccc

SEQ ID NO: 2039421 - DNA, 16 bp, Homo sapiens
tgtgctctcaccagct

SEQ ID NO: 2039422 - DNA, 12 bp, Homo sapiens
tgtgctctgatc

SEQ ID NO: 2039423 - DNA, 22 bp, Homo sapiens
tgtgctctgatcatccactgtg

SEQ ID NO: 2039424 - DNA, 23 bp, Homo sapiens
tgtgctctgatcatccactgtgc

SEQ ID NO: 2039425 - DNA, 12 bp, Homo sapiens
tgtgctctgtga

SEQ ID NO: 2039426 - DNA, 21 bp, Homo sapiens
tgtgctgacggaagccaactt

SEQ ID NO: 2039427 - DNA, 22 bp, Homo sapiens
tgtgctgagaatagtgtctgat

SEQ ID NO: 2039428 - DNA, 15 bp, Homo sapiens
tgtgctgccctgctc

SEQ ID NO: 2039429 - DNA, 21 bp, Homo sapiens
tgtgctgccctgctctgggga

SEQ ID NO: 2039430 - DNA, 17 bp, Homo sapiens
tgtgctggagctggctt

SEQ ID NO: 2039431 - DNA, 13 bp, Homo sapiens
tgtgctgtgcctg

SEQ ID NO: 2039432 - DNA, 17 bp, Homo sapiens
tgtgctgtgcctgctag

SEQ ID NO: 2039433 - DNA, 14 bp, Homo sapiens
tgtgctgtgggcag

SEQ ID NO: 2039434 - DNA, 20 bp, Homo sapiens
tgtgcttgtcatctgccact

SEQ ID NO: 2039435 - DNA, 20 bp, Homo sapiens
tgtgctttgactcacctgtt

SEQ ID NO: 2039436 - DNA, 15 bp, Homo sapiens
tgtggaaagcctctg

SEQ ID NO: 2039437 - DNA, 16 bp, Homo sapiens
tgtggactttgttcac

SEQ ID NO: 2039438 - DNA, 19 bp, Homo sapiens
tgtggagaggggtgcaccc

SEQ ID NO: 2039439 - DNA, 12 bp, Homo sapiens
tgtggaggcctg

SEQ ID NO: 2039440 - DNA, 13 bp, Homo sapiens
tgtggaggcctga

SEQ ID NO: 2039441 - DNA, 13 bp, Homo sapiens
tgtggagtggaca

SEQ ID NO: 2039442 - DNA, 17 bp, Homo sapiens
tgtggataagggagagt

SEQ ID NO: 2039443 - DNA, 22 bp, Homo sapiens
tgtggatgctccagggcagcct

SEQ ID NO: 2039444 - DNA, 16 bp, Homo sapiens
tgtggatgtgtaaatg

SEQ ID NO: 2039445 - DNA, 16 bp, Homo sapiens
tgtggattccagcatt

SEQ ID NO: 2039446 - DNA, 23 bp, Homo sapiens
tgtggatttcctattttaaaacc

SEQ ID NO: 2039447 - DNA, 20 bp, Homo sapiens
tgtggcaaagtgctgtaccc

SEQ ID NO: 2039448 - DNA, 14 bp, Homo sapiens
tgtggcactgcttg

SEQ ID NO: 2039449 - DNA, 15 bp, Homo sapiens
tgtggcactgcttga

SEQ ID NO: 2039450 - DNA, 18 bp, Homo sapiens
tgtggcagaccgggggcc

SEQ ID NO: 2039451 - DNA, 20 bp, Homo sapiens
tgtggcagaccgggggccag

SEQ ID NO: 2039452 - DNA, 21 bp, Homo sapiens
tgtggcagaccgggggccaga

SEQ ID NO: 2039453 - DNA, 22 bp, Homo sapiens
tgtggcagaccgggggccagac

SEQ ID NO: 2039454 - DNA, 15 bp, Homo sapiens
tgtggcaggcctagg

SEQ ID NO: 2039455 - DNA, 14 bp, Homo sapiens
tgtggcattggggg

SEQ ID NO: 2039456 - DNA, 17 bp, Homo sapiens
cacacatatacatatat

SEQ ID NO: 2039457 - DNA, 13 bp, Homo sapiens
cacacatcaggag

SEQ ID NO: 2039458 - DNA, 20 bp, Homo sapiens
cacatttgatgtacatgtgt

SEQ ID NO: 2039459 - DNA, 23 bp, Homo sapiens
caccaacatcccattgccctggt

SEQ ID NO: 2039460 - DNA, 20 bp, Homo sapiens
caccaaggtcttcagccatc

SEQ ID NO: 2039461 - DNA, 21 bp, Homo sapiens
caccaataacttcagagaagt

SEQ ID NO: 2039462 - DNA, 17 bp, Homo sapiens
caccaatgtacccaccg

SEQ ID NO: 2039463 - DNA, 13 bp, Homo sapiens
caccacacccagc

SEQ ID NO: 2039464 - DNA, 17 bp, Homo sapiens
caccacacccagcccac

SEQ ID NO: 2039465 - DNA, 19 bp, Homo sapiens
caccacacccagcccactt

SEQ ID NO: 2039466 - DNA, 12 bp, Homo sapiens
caccacaggctg

SEQ ID NO: 2039467 - DNA, 19 bp, Homo sapiens
caccacatgtgcacatgca

SEQ ID NO: 2039468 - DNA, 11 bp, Homo sapiens
caccacccaaa

SEQ ID NO: 2039469 - DNA, 12 bp, Homo sapiens
caccaccctccc

SEQ ID NO: 2039470 - DNA, 21 bp, Homo sapiens
caccaccctcccaccatgcgc

SEQ ID NO: 2039471 - DNA, 22 bp, Homo sapiens
caccaccgtgtcatgagagaat

SEQ ID NO: 2039472 - DNA, 23 bp, Homo sapiens
caccacctaggccactcctccaa

SEQ ID NO: 2039473 - DNA, 18 bp, Homo sapiens
caccacctcactcctgtt

SEQ ID NO: 2039474 - DNA, 18 bp, Homo sapiens
caccaccttcccagctct

SEQ ID NO: 2039475 - DNA, 18 bp, Homo sapiens
caccaccttggactcctc

SEQ ID NO: 2039476 - DNA, 13 bp, Homo sapiens
caccacgaatttg

SEQ ID NO: 2039477 - DNA, 18 bp, Homo sapiens
caccacgatgtggccctg

SEQ ID NO: 2039478 - DNA, 22 bp, Homo sapiens
caccacgatgtggccctggcct

SEQ ID NO: 2039479 - DNA, 20 bp, Homo sapiens
caccacggcgtttttttaca

SEQ ID NO: 2039480 - DNA, 15 bp, Homo sapiens
caccacgtctgccag

SEQ ID NO: 2039481 - DNA, 17 bp, Homo sapiens
caccacgtctgccaggc

SEQ ID NO: 2039482 - DNA, 13 bp, Homo sapiens
caccactagagct

SEQ ID NO: 2039483 - DNA, 21 bp, Homo sapiens
caccactctggcagccacact

SEQ ID NO: 2039484 - DNA, 19 bp, Homo sapiens
caccactgccctgcctgcc

SEQ ID NO: 2039485 - DNA, 21 bp, Homo sapiens
caccagaggctgcagaaggcc

SEQ ID NO: 2039486 - DNA, 23 bp, Homo sapiens
caccagaggctgcagaaggccaa

SEQ ID NO: 2039487 - DNA, 14 bp, Homo sapiens
caccagcaacatct

SEQ ID NO: 2039488 - DNA, 13 bp, Homo sapiens
caccagcatgtca

SEQ ID NO: 2039489 - DNA, 15 bp, Homo sapiens
caccagccccagcaa

SEQ ID NO: 2039490 - DNA, 24 bp, Homo sapiens
caccagccccctggatgggcattg

SEQ ID NO: 2039491 - DNA, 18 bp, Homo sapiens
caccagcccggcctgctc

SEQ ID NO: 2039492 - DNA, 21 bp, Homo sapiens
caccagcccttagcagggaaa

SEQ ID NO: 2039493 - DNA, 14 bp, Homo sapiens
caccagcccttccc

SEQ ID NO: 2039494 - DNA, 20 bp, Homo sapiens
caccagcccttccctgcttt

SEQ ID NO: 2039495 - DNA, 21 bp, Homo sapiens
caccagcctggtgcccatcct

SEQ ID NO: 2039496 - DNA, 23 bp, Homo sapiens
caccagcctggtgcccatcctcc

SEQ ID NO: 2039497 - DNA, 11 bp, Homo sapiens
caccagctctg

SEQ ID NO: 2039498 - DNA, 17 bp, Homo sapiens
caccagctctgtggcct

SEQ ID NO: 2039499 - DNA, 21 bp, Homo sapiens
caccagctctgtggcctgtgt

SEQ ID NO: 2039500 - DNA, 23 bp, Homo sapiens
caccagctctgtggcctgtgtcc

SEQ ID NO: 2039501 - DNA, 19 bp, Homo sapiens
caccagctgctctgcccct

SEQ ID NO: 2039502 - DNA, 17 bp, Homo sapiens
caccagcttctccaggc

SEQ ID NO: 2039503 - DNA, 17 bp, Homo sapiens
caccaggagtccctggt

SEQ ID NO: 2039504 - DNA, 19 bp, Homo sapiens
caccaggatgaaggcgtgc

SEQ ID NO: 2039505 - DNA, 15 bp, Homo sapiens
caccaggatggccct

SEQ ID NO: 2039506 - DNA, 20 bp, Homo sapiens
caccaggcacgaacccacct

SEQ ID NO: 2039507 - DNA, 22 bp, Homo sapiens
caccaggcacgaacccacctgc

SEQ ID NO: 2039508 - DNA, 22 bp, Homo sapiens
caccaggggtgctatgacatgc

SEQ ID NO: 2039509 - DNA, 22 bp, Homo sapiens
caccagggtccgcaccagctgc

SEQ ID NO: 2039510 - DNA, 23 bp, Homo sapiens
caccagggtccgcaccagctgct

SEQ ID NO: 2039511 - DNA, 24 bp, Homo sapiens
caccagggtccgcaccagctgctc

SEQ ID NO: 2039512 - DNA, 14 bp, Homo sapiens
caccagtgtcccct

SEQ ID NO: 2039513 - DNA, 13 bp, Homo sapiens
caccatagcctac

SEQ ID NO: 2039514 - DNA, 15 bp, Homo sapiens
caccatcacacatgc

SEQ ID NO: 2039515 - DNA, 15 bp, Homo sapiens
caccatcatgtctgg

SEQ ID NO: 2039516 - DNA, 22 bp, Homo sapiens
caccatgcgctgctcaacctct

SEQ ID NO: 2039517 - DNA, 18 bp, Homo sapiens
caccatggaggcaggctc

SEQ ID NO: 2039518 - DNA, 18 bp, Homo sapiens
caccatgtttgagctcag

SEQ ID NO: 2039519 - DNA, 16 bp, Homo sapiens
caccattcacatttga

SEQ ID NO: 2039520 - DNA, 20 bp, Homo sapiens
caccattcacatttgatgta

SEQ ID NO: 2039521 - DNA, 23 bp, Homo sapiens
caccattcacatttgatgtacat

SEQ ID NO: 2039522 - DNA, 22 bp, Homo sapiens
cacccaaagaggtatttatctt

SEQ ID NO: 2039523 - DNA, 17 bp, Homo sapiens
cacccaaagcatggact

SEQ ID NO: 2039524 - DNA, 22 bp, Homo sapiens
cacccaagtccaggcccaagga

SEQ ID NO: 2039525 - DNA, 21 bp, Homo sapiens
cacccacatgtgacacatatg

SEQ ID NO: 2039526 - DNA, 22 bp, Homo sapiens
cacccaccatcatgtctggcta

SEQ ID NO: 2039527 - DNA, 13 bp, Homo sapiens
cacccacctcagc

SEQ ID NO: 2039528 - DNA, 17 bp, Homo sapiens
cacccacctcagcctcc

SEQ ID NO: 2039529 - DNA, 23 bp, Homo sapiens
cacccacgtgagagaatctgcct

SEQ ID NO: 2039530 - DNA, 12 bp, Homo sapiens
cacccactggcc

SEQ ID NO: 2039531 - DNA, 17 bp, Homo sapiens
cacccactggccagtcc

SEQ ID NO: 2039532 - DNA, 14 bp, Homo sapiens
cacccactgtccgc

SEQ ID NO: 2039533 - DNA, 22 bp, Homo sapiens
cacccagagggtagggcagcag

SEQ ID NO: 2039534 - DNA, 17 bp, Homo sapiens
cacccagcccacttctg

SEQ ID NO: 2039535 - DNA, 24 bp, Homo sapiens
cacccaggagccccgaggccttct

SEQ ID NO: 2039536 - DNA, 16 bp, Homo sapiens
cacccaggctccatgg

SEQ ID NO: 2039537 - DNA, 17 bp, Homo sapiens
cacccaggctgcactgc

SEQ ID NO: 2039538 - DNA, 19 bp, Homo sapiens
cacccaggctgcactgcag

SEQ ID NO: 2039539 - DNA, 21 bp, Homo sapiens
cacccaggctgcactgcagtg

SEQ ID NO: 2039540 - DNA, 14 bp, Homo sapiens
cacccaggctggag

SEQ ID NO: 2039541 - DNA, 16 bp, Homo sapiens
cacccagggctccctc

SEQ ID NO: 2039542 - DNA, 22 bp, Homo sapiens
cacccagggctccctcctggag

SEQ ID NO: 2039543 - DNA, 15 bp, Homo sapiens
cacccagtcctggcc

SEQ ID NO: 2039544 - DNA, 14 bp, Homo sapiens
cacccagtgctgcc

SEQ ID NO: 2039545 - DNA, 22 bp, Homo sapiens
cacccatcctaccaatgcatgc

SEQ ID NO: 2039546 - DNA, 15 bp, Homo sapiens
cacccatcttcctgc

SEQ ID NO: 2039547 - DNA, 22 bp, Homo sapiens
cacccatcttcctgctgctgta

SEQ ID NO: 2039548 - DNA, 14 bp, Homo sapiens
cacccatgaagaca

SEQ ID NO: 2039549 - DNA, 15 bp, Homo sapiens
cacccatgaatcaaa

SEQ ID NO: 2039550 - DNA, 13 bp, Homo sapiens
cacccatgtgcca

SEQ ID NO: 2039551 - DNA, 13 bp, Homo sapiens
caccccaagggac

SEQ ID NO: 2039552 - DNA, 18 bp, Homo sapiens
caccccaagggacaaccc

SEQ ID NO: 2039553 - DNA, 20 bp, Homo sapiens
caccccaagggacaacccca

SEQ ID NO: 2039554 - DNA, 21 bp, Homo sapiens
caccccacattggacttcctt

SEQ ID NO: 2039555 - DNA, 13 bp, Homo sapiens
caccccactccag

SEQ ID NO: 2039556 - DNA, 18 bp, Homo sapiens
caccccactccagccctg

SEQ ID NO: 2039557 - DNA, 18 bp, Homo sapiens
caccccactggatcttca

SEQ ID NO: 2039558 - DNA, 12 bp, Homo sapiens
caccccagagtt

SEQ ID NO: 2039559 - DNA, 18 bp, Homo sapiens
caccccatctctcttccc

SEQ ID NO: 2039560 - DNA, 12 bp, Homo sapiens
cacccccagccc

SEQ ID NO: 2039561 - DNA, 12 bp, Homo sapiens
cacccccagcct

SEQ ID NO: 2039562 - DNA, 13 bp, Homo sapiens
cacccccagcctg

SEQ ID NO: 2039563 - DNA, 14 bp, Homo sapiens
cacccccagcctgg

SEQ ID NO: 2039564 - DNA, 15 bp, Homo sapiens
cacccccagcctggg

SEQ ID NO: 2039565 - DNA, 16 bp, Homo sapiens
cacccccagcctgggc

SEQ ID NO: 2039566 - DNA, 14 bp, Homo sapiens
cacgggggcggcag

SEQ ID NO: 2039567 - DNA, 15 bp, Homo sapiens
cacggtgaaatccag

SEQ ID NO: 2039568 - DNA, 15 bp, Homo sapiens
cacggtgcgtggctg

SEQ ID NO: 2039569 - DNA, 19 bp, Homo sapiens
cacgtacacacacatacac

SEQ ID NO: 2039570 - DNA, 16 bp, Homo sapiens
cacgtacttaaatgaa

SEQ ID NO: 2039571 - DNA, 18 bp, Homo sapiens
cacgtatttatatttgga

SEQ ID NO: 2039572 - DNA, 22 bp, Homo sapiens
cacgtatttatatttggaaaga

SEQ ID NO: 2039573 - DNA, 15 bp, Homo sapiens
cacgtctgccaggcc

SEQ ID NO: 2039574 - DNA, 20 bp, Homo sapiens
cacgtctgccaggcccatct

SEQ ID NO: 2039575 - DNA, 20 bp, Homo sapiens
cacgtgagagaatctgcctg

SEQ ID NO: 2039576 - DNA, 16 bp, Homo sapiens
cacgtgccaggcccgg

SEQ ID NO: 2039577 - DNA, 17 bp, Homo sapiens
cacgtggtgtccctgcg

SEQ ID NO: 2039578 - DNA, 15 bp, Homo sapiens
cacgtgtcctgtagt

SEQ ID NO: 2039579 - DNA, 16 bp, Homo sapiens
cacgtgtcctgtagtt

SEQ ID NO: 2039580 - DNA, 16 bp, Homo sapiens
cacgtgttctcacact

SEQ ID NO: 2039581 - DNA, 13 bp, Homo sapiens
cactaaaaagtgg

SEQ ID NO: 2039582 - DNA, 15 bp, Homo sapiens
cactaaaaagtggct

SEQ ID NO: 2039583 - DNA, 20 bp, Homo sapiens
cactaaaacaaaacaaaaaa

SEQ ID NO: 2039584 - DNA, 16 bp, Homo sapiens
cactaaagtatgtaaa

SEQ ID NO: 2039585 - DNA, 22 bp, Homo sapiens
cactaaagtatgtaaagtatgt

SEQ ID NO: 2039586 - DNA, 15 bp, Homo sapiens
cactaaatgagctcc

SEQ ID NO: 2039587 - DNA, 18 bp, Homo sapiens
cactaaccacgctggacc

SEQ ID NO: 2039588 - DNA, 18 bp, Homo sapiens
cactaacccgttttattc

SEQ ID NO: 2039589 - DNA, 14 bp, Homo sapiens
cactaacctgtaga

SEQ ID NO: 2039590 - DNA, 15 bp, Homo sapiens
cactaacctgtagaa

SEQ ID NO: 2039591 - DNA, 13 bp, Homo sapiens
cactgaagctggg

SEQ ID NO: 2039592 - DNA, 22 bp, Homo sapiens
cactgaagtgcttgcagatcat

SEQ ID NO: 2039593 - DNA, 19 bp, Homo sapiens
cactgaatcatgttaatag

SEQ ID NO: 2039594 - DNA, 23 bp, Homo sapiens
cactgacattgttggccaaagcc

SEQ ID NO: 2039595 - DNA, 19 bp, Homo sapiens
cactgacccacagcctctg

SEQ ID NO: 2039596 - DNA, 22 bp, Homo sapiens
cactgacccacagcctctgcct

SEQ ID NO: 2039597 - DNA, 15 bp, Homo sapiens
cactgacccttccag

SEQ ID NO: 2039598 - DNA, 21 bp, Homo sapiens
cactgacccttccagacatac

SEQ ID NO: 2039599 - DNA, 12 bp, Homo sapiens
cactgacctcac

SEQ ID NO: 2039600 - DNA, 23 bp, Homo sapiens
cactgacctcaccggcatgctgg

SEQ ID NO: 2039601 - DNA, 24 bp, Homo sapiens
cactgacctcaccggcatgctggc

SEQ ID NO: 2039602 - DNA, 22 bp, Homo sapiens
cactgaccttggagagacacag

SEQ ID NO: 2039603 - DNA, 14 bp, Homo sapiens
cactgactgggacc

SEQ ID NO: 2039604 - DNA, 14 bp, Homo sapiens
cactgacttctaag

SEQ ID NO: 2039605 - DNA, 20 bp, Homo sapiens
cactgagcaagatcttgtct

SEQ ID NO: 2039606 - DNA, 12 bp, Homo sapiens
cactgagctggg

SEQ ID NO: 2039607 - DNA, 10 bp, Homo sapiens
cactgagggc

SEQ ID NO: 2039608 - DNA, 18 bp, Homo sapiens
cactgagggccacactat

SEQ ID NO: 2039609 - DNA, 19 bp, Homo sapiens
cactgatggacaaggaggt

SEQ ID NO: 2039610 - DNA, 14 bp, Homo sapiens
cactgatgggcaac

SEQ ID NO: 2039611 - DNA, 22 bp, Homo sapiens
cactgattgggtgccatgtgga

SEQ ID NO: 2039612 - DNA, 21 bp, Homo sapiens
cactgatttcacaacagatca

SEQ ID NO: 2039613 - DNA, 14 bp, Homo sapiens
cactgatttggaga

SEQ ID NO: 2039614 - DNA, 23 bp, Homo sapiens
cactgcaacctccgcctcttggg

SEQ ID NO: 2039615 - DNA, 17 bp, Homo sapiens
cactgcaagaagtcttg

SEQ ID NO: 2039616 - DNA, 18 bp, Homo sapiens
cactgcaagaagtcttga

SEQ ID NO: 2039617 - DNA, 13 bp, Homo sapiens
cactgcaagagcc

SEQ ID NO: 2039618 - DNA, 18 bp, Homo sapiens
cactgcaagagccttggt

SEQ ID NO: 2039619 - DNA, 13 bp, Homo sapiens
caagatctttcag

SEQ ID NO: 2039620 - DNA, 15 bp, Homo sapiens
caagatctttcagga

SEQ ID NO: 2039621 - DNA, 19 bp, Homo sapiens
caagatgacagctcttcta

SEQ ID NO: 2039622 - DNA, 23 bp, Homo sapiens
caagatgacagctcttctaagga

SEQ ID NO: 2039623 - DNA, 21 bp, Homo sapiens
caagatggaaaataaattata

SEQ ID NO: 2039624 - DNA, 13 bp, Homo sapiens
caagatgggcaca

SEQ ID NO: 2039625 - DNA, 14 bp, Homo sapiens
caagatgggcacat

SEQ ID NO: 2039626 - DNA, 17 bp, Homo sapiens
caagatgtcagactggc

SEQ ID NO: 2039627 - DNA, 14 bp, Homo sapiens
caagattcccagag

SEQ ID NO: 2039628 - DNA, 19 bp, Homo sapiens
caagattcccagagacagg

SEQ ID NO: 2039629 - DNA, 16 bp, Homo sapiens
caagattgcttaaaat

SEQ ID NO: 2039630 - DNA, 18 bp, Homo sapiens
caagattgcttaaaatag

SEQ ID NO: 2039631 - DNA, 17 bp, Homo sapiens
caagatttcagaagcca

SEQ ID NO: 2039632 - DNA, 17 bp, Homo sapiens
caagattttccacaaga

SEQ ID NO: 2039633 - DNA, 19 bp, Homo sapiens
caagattttttttgtaact

SEQ ID NO: 2039634 - DNA, 16 bp, Homo sapiens
caagcaaaaggagaga

SEQ ID NO: 2039635 - DNA, 18 bp, Homo sapiens
caagcacaaagctcaaga

SEQ ID NO: 2039636 - DNA, 17 bp, Homo sapiens
caagcacagttttaaga

SEQ ID NO: 2039637 - DNA, 15 bp, Homo sapiens
caagcaccctgttcc

SEQ ID NO: 2039638 - DNA, 18 bp, Homo sapiens
caagcaccctgttccctc

SEQ ID NO: 2039639 - DNA, 18 bp, Homo sapiens
caagcacctcctgcctcg

SEQ ID NO: 2039640 - DNA, 17 bp, Homo sapiens
caagcacctgcagattc

SEQ ID NO: 2039641 - DNA, 19 bp, Homo sapiens
caagcactcgagaccatcc

SEQ ID NO: 2039642 - DNA, 21 bp, Homo sapiens
caagcactcgagaccatcctg

SEQ ID NO: 2039643 - DNA, 18 bp, Homo sapiens
caagcagaggtggccaga

SEQ ID NO: 2039644 - DNA, 15 bp, Homo sapiens
caagcagcattcagc

SEQ ID NO: 2039645 - DNA, 17 bp, Homo sapiens
caagcagcattcagcac

SEQ ID NO: 2039646 - DNA, 13 bp, Homo sapiens
caagcagccagcc

SEQ ID NO: 2039647 - DNA, 15 bp, Homo sapiens
caagcagccagccag

SEQ ID NO: 2039648 - DNA, 22 bp, Homo sapiens
caagcagccagccagtcttgcc

SEQ ID NO: 2039649 - DNA, 21 bp, Homo sapiens
caagcataccaacacgagcag

SEQ ID NO: 2039650 - DNA, 22 bp, Homo sapiens
caagcatatttgagaacccttc

SEQ ID NO: 2039651 - DNA, 13 bp, Homo sapiens
caagcatgcaata

SEQ ID NO: 2039652 - DNA, 21 bp, Homo sapiens
caagcatgcaataatgtgcaa

SEQ ID NO: 2039653 - DNA, 22 bp, Homo sapiens
caagcatgcaataatgtgcaaa

SEQ ID NO: 2039654 - DNA, 22 bp, Homo sapiens
caagcatggtcccacatccctg

SEQ ID NO: 2039655 - DNA, 23 bp, Homo sapiens
caagcatggtcccacatccctgg

SEQ ID NO: 2039656 - DNA, 14 bp, Homo sapiens
caagcattctgtct

SEQ ID NO: 2039657 - DNA, 17 bp, Homo sapiens
caagcatttgccctgtg

SEQ ID NO: 2039658 - DNA, 21 bp, Homo sapiens
caagccaacttgtaaatacac

SEQ ID NO: 2039659 - DNA, 11 bp, Homo sapiens
caagccacaga

SEQ ID NO: 2039660 - DNA, 22 bp, Homo sapiens
caagccacagaagccaggagca

SEQ ID NO: 2039661 - DNA, 22 bp, Homo sapiens
caagccatggtgacacacagca

SEQ ID NO: 2039662 - DNA, 19 bp, Homo sapiens
caagccattcacttcccca

SEQ ID NO: 2039663 - DNA, 18 bp, Homo sapiens
caagcccctcagcccttg

SEQ ID NO: 2039664 - DNA, 21 bp, Homo sapiens
caagccctccccatcccatgt

SEQ ID NO: 2039665 - DNA, 10 bp, Homo sapiens
caagccctgg

SEQ ID NO: 2039666 - DNA, 11 bp, Homo sapiens
caagccctggc

SEQ ID NO: 2039667 - DNA, 13 bp, Homo sapiens
caagccctggcaa

SEQ ID NO: 2039668 - DNA, 21 bp, Homo sapiens
caagccggccccccctctttt

SEQ ID NO: 2039669 - DNA, 14 bp, Homo sapiens
caagccgtggcttc

SEQ ID NO: 2039670 - DNA, 15 bp, Homo sapiens
caagccgtggcttcc

SEQ ID NO: 2039671 - DNA, 16 bp, Homo sapiens
caagccgtggcttccc

SEQ ID NO: 2039672 - DNA, 17 bp, Homo sapiens
caagccgtggcttcccg

SEQ ID NO: 2039673 - DNA, 18 bp, Homo sapiens
caagccgtggcttcccgc

SEQ ID NO: 2039674 - DNA, 18 bp, Homo sapiens
caagcctcactattactt

SEQ ID NO: 2039675 - DNA, 13 bp, Homo sapiens
caagcctctgccc

SEQ ID NO: 2039676 - DNA, 21 bp, Homo sapiens
caagcctgaccacgctttcta

SEQ ID NO: 2039677 - DNA, 12 bp, Homo sapiens
caagcctggtct

SEQ ID NO: 2039678 - DNA, 13 bp, Homo sapiens
caagcctggtctc

SEQ ID NO: 2039679 - DNA, 18 bp, Homo sapiens
caagcctgtaatcccagc

SEQ ID NO: 2039680 - DNA, 14 bp, Homo sapiens
caagccttactcac

SEQ ID NO: 2039681 - DNA, 17 bp, Homo sapiens
caagcgattcttctgct

SEQ ID NO: 2039682 - DNA, 19 bp, Homo sapiens
caagcgattcttctgcttc

SEQ ID NO: 2039683 - DNA, 21 bp, Homo sapiens
caagcgattcttgtgcctcag

SEQ ID NO: 2039684 - DNA, 16 bp, Homo sapiens
caagcgtgagccactg

SEQ ID NO: 2039685 - DNA, 18 bp, Homo sapiens
caagcgtgagccactgca

SEQ ID NO: 2039686 - DNA, 18 bp, Homo sapiens
caagctagaacctggagg

SEQ ID NO: 2039687 - DNA, 16 bp, Homo sapiens
caagctcacagttcct

SEQ ID NO: 2039688 - DNA, 19 bp, Homo sapiens
caagctcacagttcctcgc

SEQ ID NO: 2039689 - DNA, 17 bp, Homo sapiens
caagctctagtgggaag

SEQ ID NO: 2039690 - DNA, 13 bp, Homo sapiens
caagctgaagtga

SEQ ID NO: 2039691 - DNA, 19 bp, Homo sapiens
caagctgaagtgaaggaga

SEQ ID NO: 2039692 - DNA, 20 bp, Homo sapiens
caagctgaagtgaaggagaa

SEQ ID NO: 2039693 - DNA, 19 bp, Homo sapiens
caagctgaggtgcccagga

SEQ ID NO: 2039694 - DNA, 12 bp, Homo sapiens
caagctggaagc

SEQ ID NO: 2039695 - DNA, 19 bp, Homo sapiens
caagctgtcccctctgtca

SEQ ID NO: 2039696 - DNA, 16 bp, Homo sapiens
caagctgttttcttct

SEQ ID NO: 2039697 - DNA, 23 bp, Homo sapiens
caagcttcaaccctcagccttga

SEQ ID NO: 2039698 - DNA, 16 bp, Homo sapiens
caagcttgtatataca

SEQ ID NO: 2039699 - DNA, 18 bp, Homo sapiens
caagcttgtatatacata

SEQ ID NO: 2039700 - DNA, 24 bp, Homo sapiens
caagcttgtatatacatattataa

SEQ ID NO: 2039701 - DNA, 20 bp, Homo sapiens
caagcttgtgagagctggtt

SEQ ID NO: 2039702 - DNA, 21 bp, Homo sapiens
caagctttgaatacccccaga

SEQ ID NO: 2039703 - DNA, 17 bp, Homo sapiens
caaggaaaataatagga

SEQ ID NO: 2039704 - DNA, 21 bp, Homo sapiens
caaggaacctaattgaaattt

SEQ ID NO: 2039705 - DNA, 18 bp, Homo sapiens
caaggaaggaaagaaaga

SEQ ID NO: 2039706 - DNA, 24 bp, Homo sapiens
caaggaagggtgggaagcttgctg

SEQ ID NO: 2039707 - DNA, 22 bp, Homo sapiens
caaggaagtgggggccgctggc

SEQ ID NO: 2039708 - DNA, 18 bp, Homo sapiens
caaggacaacctgcccct

SEQ ID NO: 2039709 - DNA, 19 bp, Homo sapiens
caaggacaatgccttggga

SEQ ID NO: 2039710 - DNA, 21 bp, Homo sapiens
caaggaccctgttttccacac

SEQ ID NO: 2039711 - DNA, 21 bp, Homo sapiens
caaggactacgttaagggaag

SEQ ID NO: 2039712 - DNA, 20 bp, Homo sapiens
caaggactttccagtgagga

SEQ ID NO: 2039713 - DNA, 18 bp, Homo sapiens
cactgcaccgggccacag

SEQ ID NO: 2039714 - DNA, 18 bp, Homo sapiens
cactgcactccagcctgg

SEQ ID NO: 2039715 - DNA, 17 bp, Homo sapiens
cactgcactctagcctg

SEQ ID NO: 2039716 - DNA, 19 bp, Homo sapiens
cactgcagagatggtggtg

SEQ ID NO: 2039717 - DNA, 22 bp, Homo sapiens
cactgcagatagccagacacat

SEQ ID NO: 2039718 - DNA, 13 bp, Homo sapiens
cactgcaggggcc

SEQ ID NO: 2039719 - DNA, 15 bp, Homo sapiens
cactgcagtgatggc

SEQ ID NO: 2039720 - DNA, 14 bp, Homo sapiens
cactgccacaccct

SEQ ID NO: 2039721 - DNA, 17 bp, Homo sapiens
cactgccacaccctccc

SEQ ID NO: 2039722 - DNA, 12 bp, Homo sapiens
cactgccaggag

SEQ ID NO: 2039723 - DNA, 16 bp, Homo sapiens
cactgccaggagggac

SEQ ID NO: 2039724 - DNA, 16 bp, Homo sapiens
cactgccaggcacctg

SEQ ID NO: 2039725 - DNA, 19 bp, Homo sapiens
cactgccaggcacctggcc

SEQ ID NO: 2039726 - DNA, 23 bp, Homo sapiens
cactgccaggcacctggcctgct

SEQ ID NO: 2039727 - DNA, 16 bp, Homo sapiens
cactgccccaccagcc

SEQ ID NO: 2039728 - DNA, 21 bp, Homo sapiens
cactgccccaccagccacctc

SEQ ID NO: 2039729 - DNA, 11 bp, Homo sapiens
cactgccctgc

SEQ ID NO: 2039730 - DNA, 12 bp, Homo sapiens
cactgccctgcc

SEQ ID NO: 2039731 - DNA, 14 bp, Homo sapiens
cactgccctgcctg

SEQ ID NO: 2039732 - DNA, 16 bp, Homo sapiens
cactgccctgcctgcc

SEQ ID NO: 2039733 - DNA, 20 bp, Homo sapiens
cactgctaggcgagtgccag

SEQ ID NO: 2039734 - DNA, 16 bp, Homo sapiens
cactgctctcagcctc

SEQ ID NO: 2039735 - DNA, 18 bp, Homo sapiens
cactgctctcagcctccc

SEQ ID NO: 2039736 - DNA, 16 bp, Homo sapiens
cactgctgcaccagag

SEQ ID NO: 2039737 - DNA, 20 bp, Homo sapiens
cactgctgcaccagagtgaa

SEQ ID NO: 2039738 - DNA, 22 bp, Homo sapiens
cactgcttgaggaggggcacct

SEQ ID NO: 2039739 - DNA, 23 bp, Homo sapiens
cactgcttgaggaggggcacctg

SEQ ID NO: 2039740 - DNA, 20 bp, Homo sapiens
cactggaatcgatctgtact

SEQ ID NO: 2039741 - DNA, 21 bp, Homo sapiens
cactggaatcgatctgtactg

SEQ ID NO: 2039742 - DNA, 18 bp, Homo sapiens
cactggagtgcagggagg

SEQ ID NO: 2039743 - DNA, 23 bp, Homo sapiens
cactggagtgcagggaggagagg

SEQ ID NO: 2039744 - DNA, 11 bp, Homo sapiens
cactggccacc

SEQ ID NO: 2039745 - DNA, 13 bp, Homo sapiens
cactggccagaga

SEQ ID NO: 2039746 - DNA, 14 bp, Homo sapiens
cactggccagagag

SEQ ID NO: 2039747 - DNA, 15 bp, Homo sapiens
cactggccagagagg

SEQ ID NO: 2039748 - DNA, 22 bp, Homo sapiens
cactggccagagagggcccagc

SEQ ID NO: 2039749 - DNA, 23 bp, Homo sapiens
cactggccagagagggcccagct

SEQ ID NO: 2039750 - DNA, 19 bp, Homo sapiens
cactggccagtcctagagc

SEQ ID NO: 2039751 - DNA, 16 bp, Homo sapiens
cactggccccaccctc

SEQ ID NO: 2039752 - DNA, 19 bp, Homo sapiens
cactggcgaggtgcggcca

SEQ ID NO: 2039753 - DNA, 14 bp, Homo sapiens
cactggctggggca

SEQ ID NO: 2039754 - DNA, 19 bp, Homo sapiens
cactggctggggcagaggg

SEQ ID NO: 2039755 - DNA, 20 bp, Homo sapiens
cactgggatgagccgctgtg

SEQ ID NO: 2039756 - DNA, 19 bp, Homo sapiens
cactggggtcctggggcct

SEQ ID NO: 2039757 - DNA, 17 bp, Homo sapiens
cactgggtctcactcct

SEQ ID NO: 2039758 - DNA, 16 bp, Homo sapiens
cactgggttctagaac

SEQ ID NO: 2039759 - DNA, 15 bp, Homo sapiens
cactgggttgacttt

SEQ ID NO: 2039760 - DNA, 20 bp, Homo sapiens
cactggtagaccaaaataaa

SEQ ID NO: 2039761 - DNA, 13 bp, Homo sapiens
cactggtggcccg

SEQ ID NO: 2039762 - DNA, 21 bp, Homo sapiens
cactggttaaaataaagccta

SEQ ID NO: 2039763 - DNA, 14 bp, Homo sapiens
cactgtaaaatgaa

SEQ ID NO: 2039764 - DNA, 16 bp, Homo sapiens
cactgtaaaatgaaat

SEQ ID NO: 2039765 - DNA, 15 bp, Homo sapiens
cactgtaaacccctg

SEQ ID NO: 2039766 - DNA, 14 bp, Homo sapiens
cactgtaagtttat

SEQ ID NO: 2039767 - DNA, 21 bp, Homo sapiens
cactgtaatcttaaaagtgta

SEQ ID NO: 2039768 - DNA, 17 bp, Homo sapiens
cactgtatttgtatctc

SEQ ID NO: 2039769 - DNA, 20 bp, Homo sapiens
cactgtcaccctccacctct

SEQ ID NO: 2039770 - DNA, 14 bp, Homo sapiens
cactgtcagagctg

SEQ ID NO: 2039771 - DNA, 17 bp, Homo sapiens
cactgtcagagctgttg

SEQ ID NO: 2039772 - DNA, 16 bp, Homo sapiens
cactgtccctcaaatg

SEQ ID NO: 2039773 - DNA, 13 bp, Homo sapiens
cactgtcctggct

SEQ ID NO: 2039774 - DNA, 12 bp, Homo sapiens
cactgtctgcgt

SEQ ID NO: 2039775 - DNA, 14 bp, Homo sapiens
cactgtcttcacaa

SEQ ID NO: 2039776 - DNA, 16 bp, Homo sapiens
cactgtcttgcctgcc

SEQ ID NO: 2039777 - DNA, 17 bp, Homo sapiens
cactgtcttgcctgcca

SEQ ID NO: 2039778 - DNA, 22 bp, Homo sapiens
cactgtgacaccagaataatga

SEQ ID NO: 2039779 - DNA, 16 bp, Homo sapiens
cactgtgccatgtgcc

SEQ ID NO: 2039780 - DNA, 16 bp, Homo sapiens
cactgtggccagagct

SEQ ID NO: 2039781 - DNA, 20 bp, Homo sapiens
cactgtggccagagctggaa

SEQ ID NO: 2039782 - DNA, 19 bp, Homo sapiens
cactgtgttggccaggctg

SEQ ID NO: 2039783 - DNA, 21 bp, Homo sapiens
cactgttactttttagtcttt

SEQ ID NO: 2039784 - DNA, 17 bp, Homo sapiens
cactgttgcccaggctg

SEQ ID NO: 2039785 - DNA, 19 bp, Homo sapiens
cactgttgcccaggctggc

SEQ ID NO: 2039786 - DNA, 19 bp, Homo sapiens
cactgtttaactgggagtg

SEQ ID NO: 2039787 - DNA, 16 bp, Homo sapiens
cacttaccttcaataa

SEQ ID NO: 2039788 - DNA, 21 bp, Homo sapiens
cacttaccttcaataaagtat

SEQ ID NO: 2039789 - DNA, 16 bp, Homo sapiens
cacttagcccaagagg

SEQ ID NO: 2039790 - DNA, 21 bp, Homo sapiens
cacttagggataacactgtct

SEQ ID NO: 2039791 - DNA, 16 bp, Homo sapiens
cacttatctgatactt

SEQ ID NO: 2039792 - DNA, 18 bp, Homo sapiens
cacttcacacacaggcaa

SEQ ID NO: 2039793 - DNA, 13 bp, Homo sapiens
cacttcactgtga

SEQ ID NO: 2039794 - DNA, 14 bp, Homo sapiens
cacttcactgtgag

SEQ ID NO: 2039795 - DNA, 19 bp, Homo sapiens
cacttcatggaccaagaat

SEQ ID NO: 2039796 - DNA, 18 bp, Homo sapiens
cagaatctgctgttgcca

SEQ ID NO: 2039797 - DNA, 20 bp, Homo sapiens
cagaatctgctgttgccata

SEQ ID NO: 2039798 - DNA, 23 bp, Homo sapiens
cagaatctgctgttgccatagcc

SEQ ID NO: 2039799 - DNA, 21 bp, Homo sapiens
cagaatgaagacctaaatgac

SEQ ID NO: 2039800 - DNA, 24 bp, Homo sapiens
cagaatgaagacctaaatgacctc

SEQ ID NO: 2039801 - DNA, 15 bp, Homo sapiens
cagaatgatgccaaa

SEQ ID NO: 2039802 - DNA, 15 bp, Homo sapiens
cagaatgctcttcta

SEQ ID NO: 2039803 - DNA, 14 bp, Homo sapiens
cagaatgtatatta

SEQ ID NO: 2039804 - DNA, 21 bp, Homo sapiens
cagaatgtcattttggtactt

SEQ ID NO: 2039805 - DNA, 17 bp, Homo sapiens
cagaatgtttttaaaat

SEQ ID NO: 2039806 - DNA, 14 bp, Homo sapiens
cagaattctgctac

SEQ ID NO: 2039807 - DNA, 13 bp, Homo sapiens
cagaattttgtat

SEQ ID NO: 2039808 - DNA, 13 bp, Homo sapiens
cagaatttttaat

SEQ ID NO: 2039809 - DNA, 15 bp, Homo sapiens
cagaatttttaatga

SEQ ID NO: 2039810 - DNA, 17 bp, Homo sapiens
cagaatttttaatgact

SEQ ID NO: 2039811 - DNA, 21 bp, Homo sapiens
cagaatttttaatgacttttt

SEQ ID NO: 2039812 - DNA, 17 bp, Homo sapiens
cagaattttttgagtaa

SEQ ID NO: 2039813 - DNA, 22 bp, Homo sapiens
cagaattttttgagtaattcta

SEQ ID NO: 2039814 - DNA, 21 bp, Homo sapiens
cagacaaaaacagcctcacag

SEQ ID NO: 2039815 - DNA, 21 bp, Homo sapiens
cagacaaagtaattcctctca

SEQ ID NO: 2039816 - DNA, 13 bp, Homo sapiens
cagacaacagaag

SEQ ID NO: 2039817 - DNA, 14 bp, Homo sapiens
cagacaacagaagt

SEQ ID NO: 2039818 - DNA, 17 bp, Homo sapiens
cagacaacagaagtcat

SEQ ID NO: 2039819 - DNA, 22 bp, Homo sapiens
cagacaacagaagtcatgaagc

SEQ ID NO: 2039820 - DNA, 18 bp, Homo sapiens
cagacaagagctgctgtc

SEQ ID NO: 2039821 - DNA, 21 bp, Homo sapiens
cagacaagagctgctgtcctt

SEQ ID NO: 2039822 - DNA, 13 bp, Homo sapiens
cagacaatccact

SEQ ID NO: 2039823 - DNA, 18 bp, Homo sapiens
cagacaatccactctcag

SEQ ID NO: 2039824 - DNA, 19 bp, Homo sapiens
cagacaatccactctcagg

SEQ ID NO: 2039825 - DNA, 14 bp, Homo sapiens
cagacacaggcccg

SEQ ID NO: 2039826 - DNA, 15 bp, Homo sapiens
cagacacaggcccgg

SEQ ID NO: 2039827 - DNA, 18 bp, Homo sapiens
cagacacaggcccggctc

SEQ ID NO: 2039828 - DNA, 13 bp, Homo sapiens
cagacacctgtgc

SEQ ID NO: 2039829 - DNA, 15 bp, Homo sapiens
cagacacctgtgcac

SEQ ID NO: 2039830 - DNA, 18 bp, Homo sapiens
cagacacctgtgcacccc

SEQ ID NO: 2039831 - DNA, 24 bp, Homo sapiens
cagacacctgtgcaccccatgagt

SEQ ID NO: 2039832 - DNA, 19 bp, Homo sapiens
cagacaccttgacagggca

SEQ ID NO: 2039833 - DNA, 11 bp, Homo sapiens
cagacactaag

SEQ ID NO: 2039834 - DNA, 22 bp, Homo sapiens
cagacacttcatggaccaagaa

SEQ ID NO: 2039835 - DNA, 13 bp, Homo sapiens
cagacagcagctc

SEQ ID NO: 2039836 - DNA, 13 bp, Homo sapiens
cagacaggcaagc

SEQ ID NO: 2039837 - DNA, 18 bp, Homo sapiens
cagacaggcaagcacctc

SEQ ID NO: 2039838 - DNA, 22 bp, Homo sapiens
cagacaggcaagcacctcctgc

SEQ ID NO: 2039839 - DNA, 22 bp, Homo sapiens
cagacatccatgtttgtaaaac

SEQ ID NO: 2039840 - DNA, 14 bp, Homo sapiens
cagacatgaaaact

SEQ ID NO: 2039841 - DNA, 17 bp, Homo sapiens
cagaccacctccctgcc

SEQ ID NO: 2039842 - DNA, 17 bp, Homo sapiens
cagaccacctgccagcc

SEQ ID NO: 2039843 - DNA, 20 bp, Homo sapiens
cagaccacctgccagccatc

SEQ ID NO: 2039844 - DNA, 23 bp, Homo sapiens
cagaccacctgccagccatcaca

SEQ ID NO: 2039845 - DNA, 16 bp, Homo sapiens
cagaccacctgcttct

SEQ ID NO: 2039846 - DNA, 17 bp, Homo sapiens
cagaccacctgcttctg

SEQ ID NO: 2039847 - DNA, 16 bp, Homo sapiens
cagaccataatgttac

SEQ ID NO: 2039848 - DNA, 15 bp, Homo sapiens
cagaccatctccagc

SEQ ID NO: 2039849 - DNA, 21 bp, Homo sapiens
cagaccatctccagcatcctg

SEQ ID NO: 2039850 - DNA, 15 bp, Homo sapiens
cagacccacacatgt

SEQ ID NO: 2039851 - DNA, 16 bp, Homo sapiens
cagacccacacatgtt

SEQ ID NO: 2039852 - DNA, 14 bp, Homo sapiens
cagacccctggctt

SEQ ID NO: 2039853 - DNA, 16 bp, Homo sapiens
cagacccctggctttt

SEQ ID NO: 2039854 - DNA, 23 bp, Homo sapiens
cagaccccttggcttttgcttgg

SEQ ID NO: 2039855 - DNA, 20 bp, Homo sapiens
cagaccggggttcaagccat

SEQ ID NO: 2039856 - DNA, 23 bp, Homo sapiens
cagaccggggttcaagccatggc

SEQ ID NO: 2039857 - DNA, 16 bp, Homo sapiens
cagacctagacctggg

SEQ ID NO: 2039858 - DNA, 20 bp, Homo sapiens
cagacctagacctgggccaa

SEQ ID NO: 2039859 - DNA, 11 bp, Homo sapiens
cagacctctga

SEQ ID NO: 2039860 - DNA, 16 bp, Homo sapiens
cagacctctgatccct

SEQ ID NO: 2039861 - DNA, 17 bp, Homo sapiens
cagacgcagcagctggg

SEQ ID NO: 2039862 - DNA, 20 bp, Homo sapiens
cagacgcagcagctgggacc

SEQ ID NO: 2039863 - DNA, 15 bp, Homo sapiens
cagacgtctcaagac

SEQ ID NO: 2039864 - DNA, 18 bp, Homo sapiens
cagactatttaacttgag

SEQ ID NO: 2039865 - DNA, 19 bp, Homo sapiens
cagactatttaacttgagg

SEQ ID NO: 2039866 - DNA, 15 bp, Homo sapiens
cagactcagctccag

SEQ ID NO: 2039867 - DNA, 14 bp, Homo sapiens
cagactcagctctg

SEQ ID NO: 2039868 - DNA, 18 bp, Homo sapiens
cagactcctcagatctga

SEQ ID NO: 2039869 - DNA, 23 bp, Homo sapiens
cagactccttcaacaattctaaa

SEQ ID NO: 2039870 - DNA, 19 bp, Homo sapiens
cagactctaaatatttcat

SEQ ID NO: 2039871 - DNA, 18 bp, Homo sapiens
cagactctacagaggcca

SEQ ID NO: 2039872 - DNA, 23 bp, Homo sapiens
cagactctacagaggccatgggc

SEQ ID NO: 2039873 - DNA, 21 bp, Homo sapiens
cagactctgggtccctcggag

SEQ ID NO: 2039874 - DNA, 14 bp, Homo sapiens
cagactgcttccaa

SEQ ID NO: 2039875 - DNA, 13 bp, Homo sapiens
cagactggaagca

SEQ ID NO: 2039876 - DNA, 16 bp, Homo sapiens
cagactggaagcacag

SEQ ID NO: 2039877 - DNA, 14 bp, Homo sapiens
cagacttctccaga

SEQ ID NO: 2039878 - DNA, 16 bp, Homo sapiens
cagacttctctttctt

SEQ ID NO: 2039879 - DNA, 15 bp, Homo sapiens
cagacttctggaagg

SEQ ID NO: 2039880 - DNA, 19 bp, Homo sapiens
cagacttctggaaggctgg

SEQ ID NO: 2039881 - DNA, 21 bp, Homo sapiens
cagacttctggaaggctggct

SEQ ID NO: 2039882 - DNA, 18 bp, Homo sapiens
cagagaaagaagagacag

SEQ ID NO: 2039883 - DNA, 23 bp, Homo sapiens
cagagaaagtacttctccaccct

SEQ ID NO: 2039884 - DNA, 18 bp, Homo sapiens
cagagaaatgtgaagggt

SEQ ID NO: 2039885 - DNA, 13 bp, Homo sapiens
cagagaagaaaga

SEQ ID NO: 2039886 - DNA, 15 bp, Homo sapiens
cagagaagataatgt

SEQ ID NO: 2039887 - DNA, 14 bp, Homo sapiens
cagagaaggcagga

SEQ ID NO: 2039888 - DNA, 20 bp, Homo sapiens
cagagaaggcaggaatgtgt

SEQ ID NO: 2039889 - DNA, 15 bp, Homo sapiens
cagagaaggcctctt

SEQ ID NO: 2039890 - DNA, 13 bp, Homo sapiens
cagagaaggcttc

SEQ ID NO: 2039891 - DNA, 14 bp, Homo sapiens
cagagaaggcttcc

SEQ ID NO: 2039892 - DNA, 16 bp, Homo sapiens
cagagaagtcagttgg

SEQ ID NO: 2039893 - DNA, 13 bp, Homo sapiens
cagagaatttcta

SEQ ID NO: 2039894 - DNA, 16 bp, Homo sapiens
cagagaatttctacca

SEQ ID NO: 2039895 - DNA, 13 bp, Homo sapiens
cagagacacctgc

SEQ ID NO: 2039896 - DNA, 16 bp, Homo sapiens
cagagacacctgcacc

SEQ ID NO: 2039897 - DNA, 22 bp, Homo sapiens
cagagacacctgcacctccccc

SEQ ID NO: 2039898 - DNA, 23 bp, Homo sapiens
cagagacagaccccttggctttt

SEQ ID NO: 2039899 - DNA, 14 bp, Homo sapiens
cagagacaggaaaa

SEQ ID NO: 2039900 - DNA, 23 bp, Homo sapiens
cagagacaggaaaatcctctggc

SEQ ID NO: 2039901 - DNA, 17 bp, Homo sapiens
cagagacaggaaagaat

SEQ ID NO: 2039902 - DNA, 14 bp, Homo sapiens
cagagacaggccca

SEQ ID NO: 2039903 - DNA, 23 bp, Homo sapiens
cagagacaggcccaagagatgaa

SEQ ID NO: 2039904 - DNA, 15 bp, Homo sapiens
cagagacaggtggcc

SEQ ID NO: 2039905 - DNA, 21 bp, Homo sapiens
cagagacaggtggcctagcag

SEQ ID NO: 2039906 - DNA, 14 bp, Homo sapiens
cagagacccagatc

SEQ ID NO: 2039907 - DNA, 14 bp, Homo sapiens
cagagaccccagga

SEQ ID NO: 2039908 - DNA, 21 bp, Homo sapiens
cagagaccccttcctttcctc

SEQ ID NO: 2039909 - DNA, 23 bp, Homo sapiens
cagagaccttgcgaccatgtgta

SEQ ID NO: 2039910 - DNA, 21 bp, Homo sapiens
cagagaccttttctctcccat

SEQ ID NO: 2039911 - DNA, 16 bp, Homo sapiens
cagctgggacccctcc

SEQ ID NO: 2039912 - DNA, 23 bp, Homo sapiens
cagctgggacccctcccaacctc

SEQ ID NO: 2039913 - DNA, 20 bp, Homo sapiens
cagctgggccccatgctctg

SEQ ID NO: 2039914 - DNA, 14 bp, Homo sapiens
cagctgggccggcc

SEQ ID NO: 2039915 - DNA, 17 bp, Homo sapiens
cagctgggccggccagc

SEQ ID NO: 2039916 - DNA, 20 bp, Homo sapiens
cagctgggccggccagcctt

SEQ ID NO: 2039917 - DNA, 17 bp, Homo sapiens
cagctggtgctgcaagg

SEQ ID NO: 2039918 - DNA, 18 bp, Homo sapiens
cagctgtaacacagctga

SEQ ID NO: 2039919 - DNA, 15 bp, Homo sapiens
cagctgtagccatgg

SEQ ID NO: 2039920 - DNA, 19 bp, Homo sapiens
cagctgtagccatggctca

SEQ ID NO: 2039921 - DNA, 20 bp, Homo sapiens
cagctgtagccatggctcag

SEQ ID NO: 2039922 - DNA, 23 bp, Homo sapiens
cagctgtagccatggctcaggca

SEQ ID NO: 2039923 - DNA, 17 bp, Homo sapiens
cagctgtagctcccgag

SEQ ID NO: 2039924 - DNA, 18 bp, Homo sapiens
cagctgtcatcaattaaa

SEQ ID NO: 2039925 - DNA, 15 bp, Homo sapiens
cagctgtcatggaaa

SEQ ID NO: 2039926 - DNA, 20 bp, Homo sapiens
cagctgtcatggaaaagccc

SEQ ID NO: 2039927 - DNA, 23 bp, Homo sapiens
cagctgtcatggaaaagcccagt

SEQ ID NO: 2039928 - DNA, 15 bp, Homo sapiens
cagctgtcattcagg

SEQ ID NO: 2039929 - DNA, 12 bp, Homo sapiens
cagctgtccctg

SEQ ID NO: 2039930 - DNA, 17 bp, Homo sapiens
cagctgtccctgtcacc

SEQ ID NO: 2039931 - DNA, 14 bp, Homo sapiens
cagctgtctgtggc

SEQ ID NO: 2039932 - DNA, 18 bp, Homo sapiens
cagctgtgaacatggact

SEQ ID NO: 2039933 - DNA, 14 bp, Homo sapiens
cagctgtgcctcgc

SEQ ID NO: 2039934 - DNA, 17 bp, Homo sapiens
cagctgtgcctcgctcc

SEQ ID NO: 2039935 - DNA, 19 bp, Homo sapiens
cagctgtgctctggacagg

SEQ ID NO: 2039936 - DNA, 24 bp, Homo sapiens
cagctgtgctctggacaggcatgt

SEQ ID NO: 2039937 - DNA, 17 bp, Homo sapiens
cagctgtttctggaaat

SEQ ID NO: 2039938 - DNA, 15 bp, Homo sapiens
cagctgtttgtcata

SEQ ID NO: 2039939 - DNA, 23 bp, Homo sapiens
cagcttaaaattggtaattgaat

SEQ ID NO: 2039940 - DNA, 14 bp, Homo sapiens
cagcttcatcaatt

SEQ ID NO: 2039941 - DNA, 16 bp, Homo sapiens
cagcttcatcaatttt

SEQ ID NO: 2039942 - DNA, 23 bp, Homo sapiens
cagcttcatcaatttttatacat

SEQ ID NO: 2039943 - DNA, 21 bp, Homo sapiens
cagcttcatttccgtgaaggg

SEQ ID NO: 2039944 - DNA, 19 bp, Homo sapiens
cagcttcatttcctgtgtc

SEQ ID NO: 2039945 - DNA, 21 bp, Homo sapiens
cagcttcatttcctgtgtctt

SEQ ID NO: 2039946 - DNA, 17 bp, Homo sapiens
cagcttcatttgtgtca

SEQ ID NO: 2039947 - DNA, 18 bp, Homo sapiens
cagcttgaaactgagatg

SEQ ID NO: 2039948 - DNA, 15 bp, Homo sapiens
cagcttgagggttgg

SEQ ID NO: 2039949 - DNA, 19 bp, Homo sapiens
cagcttgagggttgggctg

SEQ ID NO: 2039950 - DNA, 15 bp, Homo sapiens
cagcttgctcttcag

SEQ ID NO: 2039951 - DNA, 20 bp, Homo sapiens
cagcttgtaaatagctcagg

SEQ ID NO: 2039952 - DNA, 16 bp, Homo sapiens
cagcttgtagccagcc

SEQ ID NO: 2039953 - DNA, 18 bp, Homo sapiens
cagcttgtagccagccgg

SEQ ID NO: 2039954 - DNA, 18 bp, Homo sapiens
cagcttgtggcaagtgaa

SEQ ID NO: 2039955 - DNA, 21 bp, Homo sapiens
cagcttgtggcaagtgaattt

SEQ ID NO: 2039956 - DNA, 18 bp, Homo sapiens
cagctttacacacacaga

SEQ ID NO: 2039957 - DNA, 18 bp, Homo sapiens
cagctttatctgtcacac

SEQ ID NO: 2039958 - DNA, 14 bp, Homo sapiens
cagcttttaataaa

SEQ ID NO: 2039959 - DNA, 17 bp, Homo sapiens
cagcgcagccgccgggc

SEQ ID NO: 2039960 - DNA, 21 bp, Homo sapiens
cagcgcagccgccgggcaggc

SEQ ID NO: 2039961 - DNA, 21 bp, Homo sapiens
cagcgccctggagtcccctgg

SEQ ID NO: 2039962 - DNA, 22 bp, Homo sapiens
cagcgccctggagtcccctggg

SEQ ID NO: 2039963 - DNA, 12 bp, Homo sapiens
cagcgcctccct

SEQ ID NO: 2039964 - DNA, 21 bp, Homo sapiens
cagcgcctccctccaccccag

SEQ ID NO: 2039965 - DNA, 22 bp, Homo sapiens
cagcgcctgtgctgaggactcc

SEQ ID NO: 2039966 - DNA, 15 bp, Homo sapiens
cagcggaggagacca

SEQ ID NO: 2039967 - DNA, 21 bp, Homo sapiens
cagcggaggagaccagctcag

SEQ ID NO: 2039968 - DNA, 15 bp, Homo sapiens
cagcggaggagctcc

SEQ ID NO: 2039969 - DNA, 14 bp, Homo sapiens
cagcggggacagct

SEQ ID NO: 2039970 - DNA, 17 bp, Homo sapiens
cagcggggacagctcct

SEQ ID NO: 2039971 - DNA, 17 bp, Homo sapiens
cagcgtccctagcagtg

SEQ ID NO: 2039972 - DNA, 12 bp, Homo sapiens
cagcgtggcctt

SEQ ID NO: 2039973 - DNA, 23 bp, Homo sapiens
cagctaactccagtctcctgaca

SEQ ID NO: 2039974 - DNA, 19 bp, Homo sapiens
cagctaatcagcattctca

SEQ ID NO: 2039975 - DNA, 14 bp, Homo sapiens
cagctaatctgtag

SEQ ID NO: 2039976 - DNA, 21 bp, Homo sapiens
cagctaatctgtagggctgga

SEQ ID NO: 2039977 - DNA, 16 bp, Homo sapiens
cagctacattcctcag

SEQ ID NO: 2039978 - DNA, 17 bp, Homo sapiens
cagctacattcctcagc

SEQ ID NO: 2039979 - DNA, 19 bp, Homo sapiens
cagctacattcctcagctg

SEQ ID NO: 2039980 - DNA, 21 bp, Homo sapiens
cagctacattcctcagctgcc

SEQ ID NO: 2039981 - DNA, 22 bp, Homo sapiens
cagctacattcctcagctgcca

SEQ ID NO: 2039982 - DNA, 20 bp, Homo sapiens
cagctactcagaagcctgag

SEQ ID NO: 2039983 - DNA, 21 bp, Homo sapiens
cagctactcagaagcctgagg

SEQ ID NO: 2039984 - DNA, 14 bp, Homo sapiens
cagctactcgggag

SEQ ID NO: 2039985 - DNA, 23 bp, Homo sapiens
cagctactcgggaggctgaggca

SEQ ID NO: 2039986 - DNA, 19 bp, Homo sapiens
cagctactctgtccaggcc

SEQ ID NO: 2039987 - DNA, 16 bp, Homo sapiens
cagctactgatttttg

SEQ ID NO: 2039988 - DNA, 15 bp, Homo sapiens
cagctacttgggagg

SEQ ID NO: 2039989 - DNA, 16 bp, Homo sapiens
cagctacttgggaggc

SEQ ID NO: 2039990 - DNA, 23 bp, Homo sapiens
cagctagaaataagcccaacaga

SEQ ID NO: 2039991 - DNA, 13 bp, Homo sapiens
cagctagactgga

SEQ ID NO: 2039992 - DNA, 14 bp, Homo sapiens
cagctagactggag

SEQ ID NO: 2039993 - DNA, 19 bp, Homo sapiens
cagctagccaactcctcct

SEQ ID NO: 2039994 - DNA, 20 bp, Homo sapiens
cagctaggactgaggagtgg

SEQ ID NO: 2039995 - DNA, 13 bp, Homo sapiens
cagctagggctgg

SEQ ID NO: 2039996 - DNA, 19 bp, Homo sapiens
cagctaggtggggcctaga

SEQ ID NO: 2039997 - DNA, 21 bp, Homo sapiens
cagctagtgacccacatgcca

SEQ ID NO: 2039998 - DNA, 14 bp, Homo sapiens
cagctatctgtcat

SEQ ID NO: 2039999 - DNA, 17 bp, Homo sapiens
cagctatgcactgtaaa

SEQ ID NO: 2040000 - DNA, 17 bp, Homo sapiens
cagctatggccccaggg

SEQ ID NO: 2040001 - DNA, 20 bp, Homo sapiens
cagctatggccccagggttg

SEQ ID NO: 2040002 - DNA, 19 bp, Homo sapiens
cagctattagcaactgtgc

SEQ ID NO: 2040003 - DNA, 13 bp, Homo sapiens
cagctcaagtctt

SEQ ID NO: 2040004 - DNA, 21 bp, Homo sapiens
cagctcagaagtttcttcttt

SEQ ID NO: 2040005 - DNA, 13 bp, Homo sapiens
cagctcagagatg

SEQ ID NO: 2040006 - DNA, 20 bp, Homo sapiens
cagctcagcctccccctgct

SEQ ID NO: 2040007 - DNA, 22 bp, Homo sapiens
cagctcagcctccccctgctgc

SEQ ID NO: 2040008 - DNA, 12 bp, Homo sapiens
cagctcaggcac

SEQ ID NO: 2040009 - DNA, 16 bp, Homo sapiens
cagctcaggtgactgg

SEQ ID NO: 2040010 - DNA, 16 bp, Homo sapiens
cagctccagctcacca

SEQ ID NO: 2040011 - DNA, 17 bp, Homo sapiens
caggatactctgtcaga

SEQ ID NO: 2040012 - DNA, 18 bp, Homo sapiens
caggatactctgtcagat

SEQ ID NO: 2040013 - DNA, 23 bp, Homo sapiens
caggatactctgtcagatgggaa

SEQ ID NO: 2040014 - DNA, 16 bp, Homo sapiens
caggatcccaagcgtc

SEQ ID NO: 2040015 - DNA, 15 bp, Homo sapiens
caggatccgctgcca

SEQ ID NO: 2040016 - DNA, 16 bp, Homo sapiens
caggatccgctgccac

SEQ ID NO: 2040017 - DNA, 20 bp, Homo sapiens
caggatcctattctcaccag

SEQ ID NO: 2040018 - DNA, 21 bp, Homo sapiens
caggatcctattctcaccagg

SEQ ID NO: 2040019 - DNA, 15 bp, Homo sapiens
caggatcctgcagga

SEQ ID NO: 2040020 - DNA, 21 bp, Homo sapiens
caggatgacacctccatttct

SEQ ID NO: 2040021 - DNA, 14 bp, Homo sapiens
caggatggggacac

SEQ ID NO: 2040022 - DNA, 17 bp, Homo sapiens
caggatgtggcactgct

SEQ ID NO: 2040023 - DNA, 23 bp, Homo sapiens
caggatgtggcactgcttgagga

SEQ ID NO: 2040024 - DNA, 14 bp, Homo sapiens
caggattccaaagt

SEQ ID NO: 2040025 - DNA, 20 bp, Homo sapiens
caggattccaaagttttgaa

SEQ ID NO: 2040026 - DNA, 15 bp, Homo sapiens
caggattgaagagca

SEQ ID NO: 2040027 - DNA, 20 bp, Homo sapiens
caggatttcattgactgaac

SEQ ID NO: 2040028 - DNA, 22 bp, Homo sapiens
caggattttaacaaaagcaaga

SEQ ID NO: 2040029 - DNA, 17 bp, Homo sapiens
caggcaaattggggagg

SEQ ID NO: 2040030 - DNA, 16 bp, Homo sapiens
caggcaactgaggcag

SEQ ID NO: 2040031 - DNA, 18 bp, Homo sapiens
caggcaagcccctcagcc

SEQ ID NO: 2040032 - DNA, 23 bp, Homo sapiens
caggcaagcccctcagcccttgc

SEQ ID NO: 2040033 - DNA, 14 bp, Homo sapiens
caggcaatgctggc

SEQ ID NO: 2040034 - DNA, 15 bp, Homo sapiens
caggcaatgctggct

SEQ ID NO: 2040035 - DNA, 16 bp, Homo sapiens
caggcaatgctggctg

SEQ ID NO: 2040036 - DNA, 20 bp, Homo sapiens
caggcaatgctggctgttgg

SEQ ID NO: 2040037 - DNA, 15 bp, Homo sapiens
caggcacacagcagc

SEQ ID NO: 2040038 - DNA, 21 bp, Homo sapiens
caggcacacagcagcccccca

SEQ ID NO: 2040039 - DNA, 14 bp, Homo sapiens
caggcacaggacac

SEQ ID NO: 2040040 - DNA, 23 bp, Homo sapiens
caggcacaggcaggaagagagag

SEQ ID NO: 2040041 - DNA, 15 bp, Homo sapiens
caggcaccaaaagaa

SEQ ID NO: 2040042 - DNA, 22 bp, Homo sapiens
caggcacccaccatcatgtctg

SEQ ID NO: 2040043 - DNA, 17 bp, Homo sapiens
caggcaccccctggaga

SEQ ID NO: 2040044 - DNA, 13 bp, Homo sapiens
caggcacctggcc

SEQ ID NO: 2040045 - DNA, 15 bp, Homo sapiens
caggcacctggcctg

SEQ ID NO: 2040046 - DNA, 17 bp, Homo sapiens
caggcacctggcctgct

SEQ ID NO: 2040047 - DNA, 19 bp, Homo sapiens
caggcacctggcctgctgg

SEQ ID NO: 2040048 - DNA, 21 bp, Homo sapiens
caggcacctggcctgctggga

SEQ ID NO: 2040049 - DNA, 19 bp, Homo sapiens
caggcaccttagtggcttt

SEQ ID NO: 2040050 - DNA, 21 bp, Homo sapiens
caggcacgaacccacctgctg

SEQ ID NO: 2040051 - DNA, 16 bp, Homo sapiens
caggcactgagaatga

SEQ ID NO: 2040052 - DNA, 23 bp, Homo sapiens
caggcactgctgcccagcctcca

SEQ ID NO: 2040053 - DNA, 17 bp, Homo sapiens
caggcactggtggcatc

SEQ ID NO: 2040054 - DNA, 14 bp, Homo sapiens
caggcagacaagag

SEQ ID NO: 2040055 - DNA, 18 bp, Homo sapiens
caggcagacaagagctgc

SEQ ID NO: 2040056 - DNA, 21 bp, Homo sapiens
caggcagagacaataaaacat

SEQ ID NO: 2040057 - DNA, 22 bp, Homo sapiens
caggcagagcggggaggtgcct

SEQ ID NO: 2040058 - DNA, 22 bp, Homo sapiens
caggcagaggatgttctggacc

SEQ ID NO: 2040059 - DNA, 14 bp, Homo sapiens
caggcagcactgac

SEQ ID NO: 2040060 - DNA, 18 bp, Homo sapiens
caggcagctggatgagac

SEQ ID NO: 2040061 - DNA, 15 bp, Homo sapiens
caggcaggaagagag

SEQ ID NO: 2040062 - DNA, 21 bp, Homo sapiens
caggcagggctctcctggctt

SEQ ID NO: 2040063 - DNA, 13 bp, Homo sapiens
caggcaggtccag

SEQ ID NO: 2040064 - DNA, 23 bp, Homo sapiens
caggcaggtcttgaactcctggc

SEQ ID NO: 2040065 - DNA, 13 bp, Homo sapiens
caggcaggtttgc

SEQ ID NO: 2040066 - DNA, 15 bp, Homo sapiens
caggcatcccatccc

SEQ ID NO: 2040067 - DNA, 17 bp, Homo sapiens
caggcatcccatccctt

SEQ ID NO: 2040068 - DNA, 19 bp, Homo sapiens
caggcatctacacagcctg

SEQ ID NO: 2040069 - DNA, 14 bp, Homo sapiens
caggcatgctggcc

SEQ ID NO: 2040070 - DNA, 18 bp, Homo sapiens
caggcatgttctctgagg

SEQ ID NO: 2040071 - DNA, 14 bp, Homo sapiens
caggcatttcctgg

SEQ ID NO: 2040072 - DNA, 13 bp, Homo sapiens
caggccaccagga

SEQ ID NO: 2040073 - DNA, 15 bp, Homo sapiens
caggccacgctcagg

SEQ ID NO: 2040074 - DNA, 18 bp, Homo sapiens
caggccacgctcaggccc

SEQ ID NO: 2040075 - DNA, 13 bp, Homo sapiens
caggccactgtgg

SEQ ID NO: 2040076 - DNA, 17 bp, Homo sapiens
caggccactgtggccag

SEQ ID NO: 2040077 - DNA, 15 bp, Homo sapiens
caggccagccccatc

SEQ ID NO: 2040078 - DNA, 15 bp, Homo sapiens
caggccaggtgcagt

SEQ ID NO: 2040079 - DNA, 15 bp, Homo sapiens
caggccagtgccagg

SEQ ID NO: 2040080 - DNA, 21 bp, Homo sapiens
caggccagtgccaggacagct

SEQ ID NO: 2040081 - DNA, 22 bp, Homo sapiens
caggccagtgccaggacagctg

SEQ ID NO: 2040082 - DNA, 16 bp, Homo sapiens
caggcccatctcaggt

SEQ ID NO: 2040083 - DNA, 19 bp, Homo sapiens
caggcccatctcaggtgcc

SEQ ID NO: 2040084 - DNA, 22 bp, Homo sapiens
caggcccatctcaggtgccact

SEQ ID NO: 2040085 - DNA, 13 bp, Homo sapiens
cagggccctgcag

SEQ ID NO: 2040086 - DNA, 22 bp, Homo sapiens
cagggccggggaactggccaag

SEQ ID NO: 2040087 - DNA, 23 bp, Homo sapiens
cagggccggggaactggccaagc

SEQ ID NO: 2040088 - DNA, 24 bp, Homo sapiens
cagggccggggaactggccaagct

SEQ ID NO: 2040089 - DNA, 21 bp, Homo sapiens
cagggcctactgccacccgct

SEQ ID NO: 2040090 - DNA, 22 bp, Homo sapiens
cagggcctggggagatggagga

SEQ ID NO: 2040091 - DNA, 18 bp, Homo sapiens
cagggcctgggggcagtg

SEQ ID NO: 2040092 - DNA, 19 bp, Homo sapiens
cagggcctgggggcagtga

SEQ ID NO: 2040093 - DNA, 20 bp, Homo sapiens
cagggcctgggggcagtgac

SEQ ID NO: 2040094 - DNA, 22 bp, Homo sapiens
cagggcctgggggcagtgactg

SEQ ID NO: 2040095 - DNA, 21 bp, Homo sapiens
cagggcctggtgtgaggctgg

SEQ ID NO: 2040096 - DNA, 15 bp, Homo sapiens
cagggccttgcccag

SEQ ID NO: 2040097 - DNA, 18 bp, Homo sapiens
cagggccttgcccagaga

SEQ ID NO: 2040098 - DNA, 15 bp, Homo sapiens
cagggctcagcctgg

SEQ ID NO: 2040099 - DNA, 20 bp, Homo sapiens
cagggctcagcggggacagc

SEQ ID NO: 2040100 - DNA, 21 bp, Homo sapiens
cagggctccctcctggagcat

SEQ ID NO: 2040101 - DNA, 16 bp, Homo sapiens
cagggctcgggcgctg

SEQ ID NO: 2040102 - DNA, 21 bp, Homo sapiens
cagggctcgggcgctgtggct

SEQ ID NO: 2040103 - DNA, 23 bp, Homo sapiens
cagggctcgggcgctgtggctcc

SEQ ID NO: 2040104 - DNA, 14 bp, Homo sapiens
cagggctctcctgg

SEQ ID NO: 2040105 - DNA, 15 bp, Homo sapiens
cagggctctcctggc

SEQ ID NO: 2040106 - DNA, 18 bp, Homo sapiens
cagggctctcctggcttc

SEQ ID NO: 2040107 - DNA, 18 bp, Homo sapiens
cagggctctttgatggac

SEQ ID NO: 2040108 - DNA, 20 bp, Homo sapiens
cagggctgccactaacctgt

SEQ ID NO: 2040109 - DNA, 23 bp, Homo sapiens
cagggctgccactaacctgtaga

SEQ ID NO: 2040110 - DNA, 18 bp, Homo sapiens
cagggctggagtgcgctc

SEQ ID NO: 2040111 - DNA, 11 bp, Homo sapiens
cagggctggga

SEQ ID NO: 2040112 - DNA, 15 bp, Homo sapiens
cagggcttggggagc

SEQ ID NO: 2040113 - DNA, 18 bp, Homo sapiens
cagggcttttcccaggaa

SEQ ID NO: 2040114 - DNA, 14 bp, Homo sapiens
caggggaaaatgaa

SEQ ID NO: 2040115 - DNA, 17 bp, Homo sapiens
caggggagagggtctgg

SEQ ID NO: 2040116 - DNA, 21 bp, Homo sapiens
caggggagagggtctggagaa

SEQ ID NO: 2040117 - DNA, 22 bp, Homo sapiens
caggggccaaactggtgggagg

SEQ ID NO: 2040118 - DNA, 16 bp, Homo sapiens
caggggcccacaggga

SEQ ID NO: 2040119 - DNA, 16 bp, Homo sapiens
caggggccccagatct

SEQ ID NO: 2040120 - DNA, 16 bp, Homo sapiens
caggggcctgcccagt

SEQ ID NO: 2040121 - DNA, 14 bp, Homo sapiens
caggggcggggcag

SEQ ID NO: 2040122 - DNA, 17 bp, Homo sapiens
caggggcggggcaggaa

SEQ ID NO: 2040123 - DNA, 18 bp, Homo sapiens
caggggcggggcaggaat

SEQ ID NO: 2040124 - DNA, 16 bp, Homo sapiens
caggggctccacctgt

SEQ ID NO: 2040125 - DNA, 20 bp, Homo sapiens
caggggctgctcatcaccca

SEQ ID NO: 2040126 - DNA, 21 bp, Homo sapiens
caggggtcgtcaccacctctc

SEQ ID NO: 2040127 - DNA, 13 bp, Homo sapiens
caggggtctgagc

SEQ ID NO: 2040128 - DNA, 15 bp, Homo sapiens
caggggtctgagcca

SEQ ID NO: 2040129 - DNA, 18 bp, Homo sapiens
caggggtgcctgtggggg

SEQ ID NO: 2040130 - DNA, 13 bp, Homo sapiens
caggggtgggaga

SEQ ID NO: 2040131 - DNA, 21 bp, Homo sapiens
caggggtgggagagccagctc

SEQ ID NO: 2040132 - DNA, 22 bp, Homo sapiens
caggggtgggagagccagctct

SEQ ID NO: 2040133 - DNA, 16 bp, Homo sapiens
cagggtagcaggtacc

SEQ ID NO: 2040134 - DNA, 17 bp, Homo sapiens
cagggtccgcaccagct

SEQ ID NO: 2040135 - DNA, 12 bp, Homo sapiens
cagggtcctgag

SEQ ID NO: 2040136 - DNA, 15 bp, Homo sapiens
cagggtcctgagtgg

SEQ ID NO: 2040137 - DNA, 22 bp, Homo sapiens
cagggtctcactatgttgccca

SEQ ID NO: 2040138 - DNA, 22 bp, Homo sapiens
cagggtctcactctgtcgccca

SEQ ID NO: 2040139 - DNA, 15 bp, Homo sapiens
cagggtcttgggcta

SEQ ID NO: 2040140 - DNA, 17 bp, Homo sapiens
cagggtcttgggctact

SEQ ID NO: 2040141 - DNA, 21 bp, Homo sapiens
cagggtcttgggctactggca

SEQ ID NO: 2040142 - DNA, 15 bp, Homo sapiens
cagggtgagagctgc

SEQ ID NO: 2040143 - DNA, 13 bp, Homo sapiens
cagggtgctgtgg

SEQ ID NO: 2040144 - DNA, 23 bp, Homo sapiens
cagggtggccccctgtgccagct

SEQ ID NO: 2040145 - DNA, 17 bp, Homo sapiens
cagggtgggatggagga

SEQ ID NO: 2040146 - DNA, 17 bp, Homo sapiens
cagggtgggccactctc

SEQ ID NO: 2040147 - DNA, 19 bp, Homo sapiens
cagggtgggccactctccc

SEQ ID NO: 2040148 - DNA, 23 bp, Homo sapiens
cagggtgttacaaggcacttgtc

SEQ ID NO: 2040149 - DNA, 12 bp, Homo sapiens
cagggttggccc

SEQ ID NO: 2040150 - DNA, 15 bp, Homo sapiens
cagggttggcccctg

SEQ ID NO: 2040151 - DNA, 15 bp, Homo sapiens
caggtaacaggcaga

SEQ ID NO: 2040152 - DNA, 14 bp, Homo sapiens
caggtaggaggcaa

SEQ ID NO: 2040153 - DNA, 19 bp, Homo sapiens
caggtaggcccttgtcctg

SEQ ID NO: 2040154 - DNA, 16 bp, Homo sapiens
caggtatcaggcacag

SEQ ID NO: 2040155 - DNA, 20 bp, Homo sapiens
caggtatcaggcacaggcag

SEQ ID NO: 2040156 - DNA, 14 bp, Homo sapiens
caggtatctccagg

SEQ ID NO: 2040157 - DNA, 15 bp, Homo sapiens
caggtatctccagga

SEQ ID NO: 2040158 - DNA, 19 bp, Homo sapiens
caggtcatctcctttcatc

SEQ ID NO: 2040159 - DNA, 22 bp, Homo sapiens
caggtccctcctttggaccctg

SEQ ID NO: 2040160 - DNA, 23 bp, Homo sapiens
caggtccctcctttggaccctgt

SEQ ID NO: 2040161 - DNA, 13 bp, Homo sapiens
caggtccggaggg

SEQ ID NO: 2040162 - DNA, 21 bp, Homo sapiens
caggtcctctgatacccagag

SEQ ID NO: 2040163 - DNA, 21 bp, Homo sapiens
caggtcctgcccatgtgtccc

SEQ ID NO: 2040164 - DNA, 18 bp, Homo sapiens
caggtctagactttctca

SEQ ID NO: 2040165 - DNA, 19 bp, Homo sapiens
caggtctcccacgtgggag

SEQ ID NO: 2040166 - DNA, 22 bp, Homo sapiens
caggtctcccacgtgggagaca

SEQ ID NO: 2040167 - DNA, 11 bp, Homo sapiens
caggtctcctc

SEQ ID NO: 2040168 - DNA, 15 bp, Homo sapiens
caggtctcctcttaa

SEQ ID NO: 2040169 - DNA, 15 bp, Homo sapiens
caggtctctccactg

SEQ ID NO: 2040170 - DNA, 20 bp, Homo sapiens
caggtctctccactgctctc

SEQ ID NO: 2040171 - DNA, 17 bp, Homo sapiens
cagttcaggagtcccaa

SEQ ID NO: 2040172 - DNA, 20 bp, Homo sapiens
cagttcaggagtcccaagga

SEQ ID NO: 2040173 - DNA, 17 bp, Homo sapiens
cagttcatctatggcag

SEQ ID NO: 2040174 - DNA, 17 bp, Homo sapiens
cagttcccggagcacag

SEQ ID NO: 2040175 - DNA, 19 bp, Homo sapiens
cagttcccggagcacagcc

SEQ ID NO: 2040176 - DNA, 23 bp, Homo sapiens
cagttccgggagagcggctgccc

SEQ ID NO: 2040177 - DNA, 17 bp, Homo sapiens
cagttcctcgccctggg

SEQ ID NO: 2040178 - DNA, 17 bp, Homo sapiens
cagttcctctttgcatg

SEQ ID NO: 2040179 - DNA, 14 bp, Homo sapiens
cagttctgctcctc

SEQ ID NO: 2040180 - DNA, 15 bp, Homo sapiens
cagttctgctcctct

SEQ ID NO: 2040181 - DNA, 22 bp, Homo sapiens
cagttctgctcctctccaggca

SEQ ID NO: 2040182 - DNA, 18 bp, Homo sapiens
cagttcttggacccctga

SEQ ID NO: 2040183 - DNA, 16 bp, Homo sapiens
cagttcttggtgactg

SEQ ID NO: 2040184 - DNA, 23 bp, Homo sapiens
cagttcttggtgactgtcccacc

SEQ ID NO: 2040185 - DNA, 22 bp, Homo sapiens
cagttgaaaagactccaaagaa

SEQ ID NO: 2040186 - DNA, 18 bp, Homo sapiens
cagttgaaaatggatttt

SEQ ID NO: 2040187 - DNA, 16 bp, Homo sapiens
cagttgacagcaggtg

SEQ ID NO: 2040188 - DNA, 18 bp, Homo sapiens
cagttggagaaaatgaag

SEQ ID NO: 2040189 - DNA, 13 bp, Homo sapiens
cagttggcagaga

SEQ ID NO: 2040190 - DNA, 22 bp, Homo sapiens
cagttggcagagaaggcctctt

SEQ ID NO: 2040191 - DNA, 15 bp, Homo sapiens
cagttgggagcactg

SEQ ID NO: 2040192 - DNA, 18 bp, Homo sapiens
cagttgggtggatgcctg

SEQ ID NO: 2040193 - DNA, 19 bp, Homo sapiens
cagttgggtggatgcctgg

SEQ ID NO: 2040194 - DNA, 20 bp, Homo sapiens
cagttgtctattctgagcct

SEQ ID NO: 2040195 - DNA, 22 bp, Homo sapiens
cagttgtctattctgagccttg

SEQ ID NO: 2040196 - DNA, 15 bp, Homo sapiens
cagttgtgtttggca

SEQ ID NO: 2040197 - DNA, 13 bp, Homo sapiens
cagtttagtgctt

SEQ ID NO: 2040198 - DNA, 19 bp, Homo sapiens
cagtttcccttctatgcag

SEQ ID NO: 2040199 - DNA, 16 bp, Homo sapiens
cagtttctccatcagc

SEQ ID NO: 2040200 - DNA, 19 bp, Homo sapiens
cagtttggaagtgttaact

SEQ ID NO: 2040201 - DNA, 21 bp, Homo sapiens
cagtttgtacagacgtatgct

SEQ ID NO: 2040202 - DNA, 16 bp, Homo sapiens
cagttttaactagaat

SEQ ID NO: 2040203 - DNA, 14 bp, Homo sapiens
cagtttttaagcta

SEQ ID NO: 2040204 - DNA, 23 bp, Homo sapiens
cagtttttcggtgggacagcccc

SEQ ID NO: 2040205 - DNA, 19 bp, Homo sapiens
cagttttttcacctggaag

SEQ ID NO: 2040206 - DNA, 23 bp, Homo sapiens
cataaaaagaggatgatttcaga

SEQ ID NO: 2040207 - DNA, 15 bp, Homo sapiens
cataaaaatgatcta

SEQ ID NO: 2040208 - DNA, 9 bp, Homo sapiens
cataaaata

SEQ ID NO: 2040209 - DNA, 20 bp, Homo sapiens
cataaaataaagtatatata

SEQ ID NO: 2040210 - DNA, 12 bp, Homo sapiens
cataaaatatac

SEQ ID NO: 2040211 - DNA, 12 bp, Homo sapiens
cataaaatctgt

SEQ ID NO: 2040212 - DNA, 14 bp, Homo sapiens
cataaaatctgtga

SEQ ID NO: 2040213 - DNA, 16 bp, Homo sapiens
cataaacagcatttat

SEQ ID NO: 2040214 - DNA, 22 bp, Homo sapiens
cataaaccaatgagctgtatct

SEQ ID NO: 2040215 - DNA, 14 bp, Homo sapiens
cataaactgagcct

SEQ ID NO: 2040216 - DNA, 15 bp, Homo sapiens
cataaactgtgtgca

SEQ ID NO: 2040217 - DNA, 13 bp, Homo sapiens
cataaagcaaata

SEQ ID NO: 2040218 - DNA, 16 bp, Homo sapiens
cataaaggtatttaga

SEQ ID NO: 2040219 - DNA, 23 bp, Homo sapiens
cataaaggtggtatgtgtgtgta

SEQ ID NO: 2040220 - DNA, 16 bp, Homo sapiens
cataaagtatgccttc

SEQ ID NO: 2040221 - DNA, 20 bp, Homo sapiens
cataaagtatgccttcctgt

SEQ ID NO: 2040222 - DNA, 21 bp, Homo sapiens
cataaagttgataaagatttt

SEQ ID NO: 2040223 - DNA, 13 bp, Homo sapiens
cataacaatgtat

SEQ ID NO: 2040224 - DNA, 19 bp, Homo sapiens
cataagaaaactaagaaat

SEQ ID NO: 2040225 - DNA, 21 bp, Homo sapiens
cataagaatgaataataatta

SEQ ID NO: 2040226 - DNA, 17 bp, Homo sapiens
cataagaccgtgtccca

SEQ ID NO: 2040227 - DNA, 21 bp, Homo sapiens
cataagaccgtgtcccaagga

SEQ ID NO: 2040228 - DNA, 11 bp, Homo sapiens
cataagattaa

SEQ ID NO: 2040229 - DNA, 20 bp, Homo sapiens
cataagattaaaggaaggaa

SEQ ID NO: 2040230 - DNA, 18 bp, Homo sapiens
cataaggcctgccctccc

SEQ ID NO: 2040231 - DNA, 15 bp, Homo sapiens
cataatataagaatc

SEQ ID NO: 2040232 - DNA, 18 bp, Homo sapiens
cataatgttacattatta

SEQ ID NO: 2040233 - DNA, 16 bp, Homo sapiens
cataattagaacaata

SEQ ID NO: 2040234 - DNA, 22 bp, Homo sapiens
cataattagaacaatagctatt

SEQ ID NO: 2040235 - DNA, 15 bp, Homo sapiens
cataattatgacagt

SEQ ID NO: 2040236 - DNA, 17 bp, Homo sapiens
cataattatgacagtta

SEQ ID NO: 2040237 - DNA, 16 bp, Homo sapiens
cataattcttgtatat

SEQ ID NO: 2040238 - DNA, 18 bp, Homo sapiens
cataattcttgtatatta

SEQ ID NO: 2040239 - DNA, 22 bp, Homo sapiens
cataatttagtttcatataaag

SEQ ID NO: 2040240 - DNA, 23 bp, Homo sapiens
cataatttgtacatatgtaaaat

SEQ ID NO: 2040241 - DNA, 13 bp, Homo sapiens
catacatacacat

SEQ ID NO: 2040242 - DNA, 11 bp, Homo sapiens
catacatacat

SEQ ID NO: 2040243 - DNA, 16 bp, Homo sapiens
catacatacatacata

SEQ ID NO: 2040244 - DNA, 17 bp, Homo sapiens
catacatacatatatat

SEQ ID NO: 2040245 - DNA, 16 bp, Homo sapiens
catacatatatatctg

SEQ ID NO: 2040246 - DNA, 17 bp, Homo sapiens
catacatatatatctga

SEQ ID NO: 2040247 - DNA, 20 bp, Homo sapiens
catacatatatatctgataa

SEQ ID NO: 2040248 - DNA, 23 bp, Homo sapiens
catacattaaggagcagggtcct

SEQ ID NO: 2040249 - DNA, 23 bp, Homo sapiens
catacatttataatgtttgctat

SEQ ID NO: 2040250 - DNA, 24 bp, Homo sapiens
catacatttataatgtttgctatt

SEQ ID NO: 2040251 - DNA, 17 bp, Homo sapiens
cataccaacacgagcag

SEQ ID NO: 2040252 - DNA, 16 bp, Homo sapiens
cataccacaataaaaa

SEQ ID NO: 2040253 - DNA, 17 bp, Homo sapiens
cataccatcactgagtg

SEQ ID NO: 2040254 - DNA, 19 bp, Homo sapiens
cataccatctgctgccccg

SEQ ID NO: 2040255 - DNA, 13 bp, Homo sapiens
cataccctccccc

SEQ ID NO: 2040256 - DNA, 20 bp, Homo sapiens
catacccttctttaaatcaa

SEQ ID NO: 2040257 - DNA, 16 bp, Homo sapiens
cataccgctggggaac

SEQ ID NO: 2040258 - DNA, 21 bp, Homo sapiens
cataccgctggggaacagagc

SEQ ID NO: 2040259 - DNA, 15 bp, Homo sapiens
catacctctctctat

SEQ ID NO: 2040260 - DNA, 23 bp, Homo sapiens
catacctctctctatatatacat

SEQ ID NO: 2040261 - DNA, 22 bp, Homo sapiens
cataccttctggttgcttcaga

SEQ ID NO: 2040262 - DNA, 16 bp, Homo sapiens
cataccttggactgac

SEQ ID NO: 2040263 - DNA, 16 bp, Homo sapiens
catacgaaacacaaac

SEQ ID NO: 2040264 - DNA, 18 bp, Homo sapiens
catactcatttctaaaag

SEQ ID NO: 2040265 - DNA, 20 bp, Homo sapiens
catactcatttctaaaagaa

SEQ ID NO: 2040266 - DNA, 21 bp, Homo sapiens
catactcatttctaaaagaat

SEQ ID NO: 2040267 - DNA, 12 bp, Homo sapiens
catactcatttg

SEQ ID NO: 2040268 - DNA, 16 bp, Homo sapiens
catacttcaaaaatgt

SEQ ID NO: 2040269 - DNA, 15 bp, Homo sapiens
catagaaacatgaca

SEQ ID NO: 2040270 - DNA, 20 bp, Homo sapiens
catagaaacatgacactgac

SEQ ID NO: 2040271 - DNA, 15 bp, Homo sapiens
catagaaactgagga

SEQ ID NO: 2040272 - DNA, 16 bp, Homo sapiens
catagaaatacctcat

SEQ ID NO: 2040273 - DNA, 15 bp, Homo sapiens
catagacagaagaaa

SEQ ID NO: 2040274 - DNA, 19 bp, Homo sapiens
catagacagaagaaacaag

SEQ ID NO: 2040275 - DNA, 18 bp, Homo sapiens
catagagtttaacacaag

SEQ ID NO: 2040276 - DNA, 13 bp, Homo sapiens
catagatcttctg

SEQ ID NO: 2040277 - DNA, 14 bp, Homo sapiens
catagatcttctga

SEQ ID NO: 2040278 - DNA, 15 bp, Homo sapiens
catagatcttctgaa

SEQ ID NO: 2040279 - DNA, 15 bp, Homo sapiens
catagatggaccagt

SEQ ID NO: 2040280 - DNA, 20 bp, Homo sapiens
catagattaatggcactgat

SEQ ID NO: 2040281 - DNA, 18 bp, Homo sapiens
catagattccctgagcag

SEQ ID NO: 2040282 - DNA, 18 bp, Homo sapiens
catagattgagaagtttt

SEQ ID NO: 2040283 - DNA, 18 bp, Homo sapiens
catagcagattttaattt

SEQ ID NO: 2040284 - DNA, 15 bp, Homo sapiens
catagccaggaaact

SEQ ID NO: 2040285 - DNA, 22 bp, Homo sapiens
catcccaggcgggcggcacgcc

SEQ ID NO: 2040286 - DNA, 19 bp, Homo sapiens
catcccaggcttcaccctg

SEQ ID NO: 2040287 - DNA, 19 bp, Homo sapiens
catcccaggggaccacacc

SEQ ID NO: 2040288 - DNA, 15 bp, Homo sapiens
catcccatgtattta

SEQ ID NO: 2040289 - DNA, 13 bp, Homo sapiens
catcccattgccc

SEQ ID NO: 2040290 - DNA, 23 bp, Homo sapiens
catccccaaactgtgccctgcct

SEQ ID NO: 2040291 - DNA, 14 bp, Homo sapiens
catcccccactgcc

SEQ ID NO: 2040292 - DNA, 16 bp, Homo sapiens
catcccctttcctccc

SEQ ID NO: 2040293 - DNA, 19 bp, Homo sapiens
catcccctttcctccccac

SEQ ID NO: 2040294 - DNA, 14 bp, Homo sapiens
catcccgctcctgc

SEQ ID NO: 2040295 - DNA, 16 bp, Homo sapiens
catcccgctcctgctg

SEQ ID NO: 2040296 - DNA, 12 bp, Homo sapiens
catcccggcctc

SEQ ID NO: 2040297 - DNA, 13 bp, Homo sapiens
catcccggcctct

SEQ ID NO: 2040298 - DNA, 19 bp, Homo sapiens
catccctcggaagccgtct

SEQ ID NO: 2040299 - DNA, 13 bp, Homo sapiens
catccctgggccc

SEQ ID NO: 2040300 - DNA, 22 bp, Homo sapiens
catccctgggcccctccacgcc

SEQ ID NO: 2040301 - DNA, 22 bp, Homo sapiens
catccctgggcctgctgctgag

SEQ ID NO: 2040302 - DNA, 23 bp, Homo sapiens
catccctgggcctgctgctgaga

SEQ ID NO: 2040303 - DNA, 21 bp, Homo sapiens
catcccttccctgtccacctc

SEQ ID NO: 2040304 - DNA, 15 bp, Homo sapiens
catccgaggcagggt

SEQ ID NO: 2040305 - DNA, 13 bp, Homo sapiens
catccgcagccca

SEQ ID NO: 2040306 - DNA, 19 bp, Homo sapiens
catccggagaattgcctct

SEQ ID NO: 2040307 - DNA, 12 bp, Homo sapiens
catccggctcct

SEQ ID NO: 2040308 - DNA, 13 bp, Homo sapiens
catccgggacgct

SEQ ID NO: 2040309 - DNA, 19 bp, Homo sapiens
catccgggacgcttccaga

SEQ ID NO: 2040310 - DNA, 20 bp, Homo sapiens
catccgggacgcttccagac

SEQ ID NO: 2040311 - DNA, 16 bp, Homo sapiens
catccgtagttccctg

SEQ ID NO: 2040312 - DNA, 18 bp, Homo sapiens
catccgtagttccctgaa

SEQ ID NO: 2040313 - DNA, 23 bp, Homo sapiens
catcctaagtgggaagtgaagcc

SEQ ID NO: 2040314 - DNA, 15 bp, Homo sapiens
catcctaccaatgca

SEQ ID NO: 2040315 - DNA, 18 bp, Homo sapiens
catcctccaattccacag

SEQ ID NO: 2040316 - DNA, 15 bp, Homo sapiens
catcctggcccctcc

SEQ ID NO: 2040317 - DNA, 19 bp, Homo sapiens
catcctggcccctccagac

SEQ ID NO: 2040318 - DNA, 16 bp, Homo sapiens
catcctgtgtggggag

SEQ ID NO: 2040319 - DNA, 11 bp, Homo sapiens
catccttaaag

SEQ ID NO: 2040320 - DNA, 21 bp, Homo sapiens
catccttcaagaactctgggc

SEQ ID NO: 2040321 - DNA, 23 bp, Homo sapiens
catccttcaagaactctgggctg

SEQ ID NO: 2040322 - DNA, 14 bp, Homo sapiens
catccttcaccaga

SEQ ID NO: 2040323 - DNA, 16 bp, Homo sapiens
catccttcaccagagc

SEQ ID NO: 2040324 - DNA, 15 bp, Homo sapiens
catccttctgccttt

SEQ ID NO: 2040325 - DNA, 14 bp, Homo sapiens
catccttgaactgt

SEQ ID NO: 2040326 - DNA, 17 bp, Homo sapiens
catccttttctgcagag

SEQ ID NO: 2040327 - DNA, 22 bp, Homo sapiens
catcggaggctgggcccctggg

SEQ ID NO: 2040328 - DNA, 21 bp, Homo sapiens
catcgtagaagagatgtggca

SEQ ID NO: 2040329 - DNA, 16 bp, Homo sapiens
catcgtgacccttcag

SEQ ID NO: 2040330 - DNA, 21 bp, Homo sapiens
catcgtgacccttcagggcca

SEQ ID NO: 2040331 - DNA, 17 bp, Homo sapiens
catctaagctgcagctt

SEQ ID NO: 2040332 - DNA, 18 bp, Homo sapiens
catctaatgtctcttcct

SEQ ID NO: 2040333 - DNA, 21 bp, Homo sapiens
catctaatgtctcttcctctg

SEQ ID NO: 2040334 - DNA, 22 bp, Homo sapiens
catctaatgtctcttcctctgt

SEQ ID NO: 2040335 - DNA, 18 bp, Homo sapiens
catctacacagcctggac

SEQ ID NO: 2040336 - DNA, 12 bp, Homo sapiens
catctagcccct

SEQ ID NO: 2040337 - DNA, 20 bp, Homo sapiens
catctatggagggcagagtg

SEQ ID NO: 2040338 - DNA, 21 bp, Homo sapiens
catctcaaatccttgagcact

SEQ ID NO: 2040339 - DNA, 13 bp, Homo sapiens
catctcagcccac

SEQ ID NO: 2040340 - DNA, 18 bp, Homo sapiens
catctcagggtccagacc

SEQ ID NO: 2040341 - DNA, 15 bp, Homo sapiens
catctcaggtgccac

SEQ ID NO: 2040342 - DNA, 22 bp, Homo sapiens
catctcaggtgccactccctga

SEQ ID NO: 2040343 - DNA, 22 bp, Homo sapiens
catctcagtgaagaatacttct

SEQ ID NO: 2040344 - DNA, 20 bp, Homo sapiens
catctcattgtagagcttgg

SEQ ID NO: 2040345 - DNA, 19 bp, Homo sapiens
catctcatttaagggaaaa

SEQ ID NO: 2040346 - DNA, 22 bp, Homo sapiens
catctcatttaagggaaaaata

SEQ ID NO: 2040347 - DNA, 19 bp, Homo sapiens
catctcatttaatcctccc

SEQ ID NO: 2040348 - DNA, 17 bp, Homo sapiens
catctccaccctgagcc

SEQ ID NO: 2040349 - DNA, 16 bp, Homo sapiens
catctccatgtagaat

SEQ ID NO: 2040350 - DNA, 23 bp, Homo sapiens
catctccatttcacacaggtcct

SEQ ID NO: 2040351 - DNA, 15 bp, Homo sapiens
catctccccaggcct

SEQ ID NO: 2040352 - DNA, 18 bp, Homo sapiens
catctccccaggcctcca

SEQ ID NO: 2040353 - DNA, 20 bp, Homo sapiens
catctccccaggcctccagc

SEQ ID NO: 2040354 - DNA, 22 bp, Homo sapiens
catctccccaggcctccagcct

SEQ ID NO: 2040355 - DNA, 22 bp, Homo sapiens
catctcccttcctgtgggagca

SEQ ID NO: 2040356 - DNA, 15 bp, Homo sapiens
catctcctgatttct

SEQ ID NO: 2040357 - DNA, 16 bp, Homo sapiens
catctcgagccccctg

SEQ ID NO: 2040358 - DNA, 19 bp, Homo sapiens
catctcgagccccctggat

SEQ ID NO: 2040359 - DNA, 19 bp, Homo sapiens
catctctaattggaagaaa

SEQ ID NO: 2040360 - DNA, 15 bp, Homo sapiens
catctctactaaaaa

SEQ ID NO: 2040361 - DNA, 21 bp, Homo sapiens
catctctctggggccctgggc

SEQ ID NO: 2040362 - DNA, 12 bp, Homo sapiens
catctctcttcc

SEQ ID NO: 2040363 - DNA, 23 bp, Homo sapiens
catctcttcctacccaaccactc

SEQ ID NO: 2040364 - DNA, 20 bp, Homo sapiens
catctcttgaggccaggagt

SEQ ID NO: 2040365 - DNA, 11 bp, Homo sapiens
catctgaggag

SEQ ID NO: 2040366 - DNA, 23 bp, Homo sapiens
catctgcaccctcgatgaagccc

SEQ ID NO: 2040367 - DNA, 23 bp, Homo sapiens
catctgcctctattcaatttaat

SEQ ID NO: 2040368 - DNA, 21 bp, Homo sapiens
catctgcggggcttctgggtg

SEQ ID NO: 2040369 - DNA, 16 bp, Homo sapiens
catctgctcctcccat

SEQ ID NO: 2040370 - DNA, 14 bp, Homo sapiens
catctgctcttctc

SEQ ID NO: 2040371 - DNA, 20 bp, Homo sapiens
catctgctgctgaaactgtg

SEQ ID NO: 2040372 - DNA, 18 bp, Homo sapiens
catctgcttggttggctg

SEQ ID NO: 2040373 - DNA, 14 bp, Homo sapiens
catctgggaggctg

SEQ ID NO: 2040374 - DNA, 15 bp, Homo sapiens
catctgggtccttgc

SEQ ID NO: 2040375 - DNA, 20 bp, Homo sapiens
catctgtcaccaattggtta

SEQ ID NO: 2040376 - DNA, 22 bp, Homo sapiens
catctgtgtctctggaacccag

SEQ ID NO: 2040377 - DNA, 21 bp, Homo sapiens
catctgtgtgtgtccccctat

SEQ ID NO: 2040378 - DNA, 22 bp, Homo sapiens
catctgttaaatgagagaatag

SEQ ID NO: 2040379 - DNA, 17 bp, Homo sapiens
catctgttatcctgcta

SEQ ID NO: 2040380 - DNA, 18 bp, Homo sapiens
catctgttatcctgctag

SEQ ID NO: 2040381 - DNA, 15 bp, Homo sapiens
catcttaaatgacag

SEQ ID NO: 2040382 - DNA, 16 bp, Homo sapiens
catcttaaatgacagt

SEQ ID NO: 2040383 - DNA, 16 bp, Homo sapiens
catcttagctttccac

SEQ ID NO: 2040384 - DNA, 14 bp, Homo sapiens
catcttcaaagctt

SEQ ID NO: 2040385 - DNA, 14 bp, Homo sapiens
catcttcagctccc

SEQ ID NO: 2040386 - DNA, 17 bp, Homo sapiens
catcttcagctcccata

SEQ ID NO: 2040387 - DNA, 17 bp, Homo sapiens
catcttctctctttttt

SEQ ID NO: 2040388 - DNA, 13 bp, Homo sapiens
catcttctggagt

SEQ ID NO: 2040389 - DNA, 19 bp, Homo sapiens
catcttctggagtctccag

SEQ ID NO: 2040390 - DNA, 12 bp, Homo sapiens
catcttctggct

SEQ ID NO: 2040391 - DNA, 17 bp, Homo sapiens
catcttctggcttgact

SEQ ID NO: 2040392 - DNA, 12 bp, Homo sapiens
catcttgccccc

SEQ ID NO: 2040393 - DNA, 18 bp, Homo sapiens
catcttgccccctcatct

SEQ ID NO: 2040394 - DNA, 19 bp, Homo sapiens
caggtctctggcagagaag

SEQ ID NO: 2040395 - DNA, 21 bp, Homo sapiens
caggtctggggcttttagagc

SEQ ID NO: 2040396 - DNA, 21 bp, Homo sapiens
caggtcttgaactcctggcct

SEQ ID NO: 2040397 - DNA, 17 bp, Homo sapiens
caggtgaaaatgttcat

SEQ ID NO: 2040398 - DNA, 15 bp, Homo sapiens
caggtgactggagcc

SEQ ID NO: 2040399 - DNA, 16 bp, Homo sapiens
caggtgatccacccac

SEQ ID NO: 2040400 - DNA, 22 bp, Homo sapiens
caggtgatccacccacctcagc

SEQ ID NO: 2040401 - DNA, 23 bp, Homo sapiens
caggtgatccacccacctcagcc

SEQ ID NO: 2040402 - DNA, 15 bp, Homo sapiens
caggtgcaagagaca

SEQ ID NO: 2040403 - DNA, 20 bp, Homo sapiens
caggtgcaagagacagagcc

SEQ ID NO: 2040404 - DNA, 21 bp, Homo sapiens
caggtgcaagagacagagccc

SEQ ID NO: 2040405 - DNA, 22 bp, Homo sapiens
caggtgcaagagacagagcccc

SEQ ID NO: 2040406 - DNA, 13 bp, Homo sapiens
caggtgcagtggc

SEQ ID NO: 2040407 - DNA, 15 bp, Homo sapiens
caggtgcagtggctc

SEQ ID NO: 2040408 - DNA, 20 bp, Homo sapiens
caggtgccactccctgagct

SEQ ID NO: 2040409 - DNA, 19 bp, Homo sapiens
caggtgccagttatggcta

SEQ ID NO: 2040410 - DNA, 15 bp, Homo sapiens
caggtgcctggacat

SEQ ID NO: 2040411 - DNA, 22 bp, Homo sapiens
caggtgctgacaatactgctgc

SEQ ID NO: 2040412 - DNA, 14 bp, Homo sapiens
caggtgctgccatc

SEQ ID NO: 2040413 - DNA, 16 bp, Homo sapiens
caggtggcaggaccag

SEQ ID NO: 2040414 - DNA, 20 bp, Homo sapiens
caggtggcaggaccaggact

SEQ ID NO: 2040415 - DNA, 19 bp, Homo sapiens
caggtggccactccagacc

SEQ ID NO: 2040416 - DNA, 21 bp, Homo sapiens
caggtggccactccagacccc

SEQ ID NO: 2040417 - DNA, 15 bp, Homo sapiens
caggtggcctagcag

SEQ ID NO: 2040418 - DNA, 18 bp, Homo sapiens
catggaaacctgaaaaaa

SEQ ID NO: 2040419 - DNA, 19 bp, Homo sapiens
catggacaatataaactga

SEQ ID NO: 2040420 - DNA, 20 bp, Homo sapiens
catggacaatataaactgaa

SEQ ID NO: 2040421 - DNA, 22 bp, Homo sapiens
catggacaatataaactgaaaa

SEQ ID NO: 2040422 - DNA, 12 bp, Homo sapiens
catggacacaga

SEQ ID NO: 2040423 - DNA, 15 bp, Homo sapiens
catggacagaagaag

SEQ ID NO: 2040424 - DNA, 21 bp, Homo sapiens
catggacagaagaaggcagca

SEQ ID NO: 2040425 - DNA, 19 bp, Homo sapiens
catggacgttcggggcatg

SEQ ID NO: 2040426 - DNA, 15 bp, Homo sapiens
catggagaaaccctg

SEQ ID NO: 2040427 - DNA, 17 bp, Homo sapiens
catggagaaaccctgtc

SEQ ID NO: 2040428 - DNA, 21 bp, Homo sapiens
catggagaagttgccaagagt

SEQ ID NO: 2040429 - DNA, 12 bp, Homo sapiens
catggagagaga

SEQ ID NO: 2040430 - DNA, 15 bp, Homo sapiens
catggagagagactc

SEQ ID NO: 2040431 - DNA, 14 bp, Homo sapiens
catggagtgagcag

SEQ ID NO: 2040432 - DNA, 23 bp, Homo sapiens
catggagtgagcagtagaagcct

SEQ ID NO: 2040433 - DNA, 15 bp, Homo sapiens
catggatgagagtcc

SEQ ID NO: 2040434 - DNA, 13 bp, Homo sapiens
catggatgagcac

SEQ ID NO: 2040435 - DNA, 15 bp, Homo sapiens
catggatgcacgcac

SEQ ID NO: 2040436 - DNA, 18 bp, Homo sapiens
catggcaccagccccctg

SEQ ID NO: 2040437 - DNA, 22 bp, Homo sapiens
catggcaccagccccctggatg

SEQ ID NO: 2040438 - DNA, 22 bp, Homo sapiens
catggcagaataatctttgggt

SEQ ID NO: 2040439 - DNA, 19 bp, Homo sapiens
catggccaccccgtgccac

SEQ ID NO: 2040440 - DNA, 22 bp, Homo sapiens
catggccacttgggtcttccct

SEQ ID NO: 2040441 - DNA, 13 bp, Homo sapiens
catggccaggtgg

SEQ ID NO: 2040442 - DNA, 15 bp, Homo sapiens
catggccaggtggcc

SEQ ID NO: 2040443 - DNA, 12 bp, Homo sapiens
catggccctggg

SEQ ID NO: 2040444 - DNA, 13 bp, Homo sapiens
catggcgaggctg

SEQ ID NO: 2040445 - DNA, 22 bp, Homo sapiens
catggcgtaatgggcctgccca

SEQ ID NO: 2040446 - DNA, 20 bp, Homo sapiens
catggctatcctagagaggc

SEQ ID NO: 2040447 - DNA, 15 bp, Homo sapiens
catggctattttata

SEQ ID NO: 2040448 - DNA, 17 bp, Homo sapiens
catggctattttatatt

SEQ ID NO: 2040449 - DNA, 18 bp, Homo sapiens
catggctcaggcaagccc

SEQ ID NO: 2040450 - DNA, 15 bp, Homo sapiens
catggcttagaaatc

SEQ ID NO: 2040451 - DNA, 14 bp, Homo sapiens
catggcttggggag

SEQ ID NO: 2040452 - DNA, 17 bp, Homo sapiens
catggcttggggagcag

SEQ ID NO: 2040453 - DNA, 20 bp, Homo sapiens
catgggaaaagaccagggct

SEQ ID NO: 2040454 - DNA, 21 bp, Homo sapiens
catgggaaaggaggcatgcct

SEQ ID NO: 2040455 - DNA, 17 bp, Homo sapiens
catgggactgtgccttt

SEQ ID NO: 2040456 - DNA, 13 bp, Homo sapiens
catgggagggagg

SEQ ID NO: 2040457 - DNA, 14 bp, Homo sapiens
catgggagggaggg

SEQ ID NO: 2040458 - DNA, 21 bp, Homo sapiens
catgggaggtgaaaggggcac

SEQ ID NO: 2040459 - DNA, 17 bp, Homo sapiens
catgggcattgggttct

SEQ ID NO: 2040460 - DNA, 16 bp, Homo sapiens
catgggcctcctgtgt

SEQ ID NO: 2040461 - DNA, 17 bp, Homo sapiens
catgggcctcctgtgtg

SEQ ID NO: 2040462 - DNA, 17 bp, Homo sapiens
catgggcctgggcctgc

SEQ ID NO: 2040463 - DNA, 22 bp, Homo sapiens
catgggctagtgtgagtggcag

SEQ ID NO: 2040464 - DNA, 13 bp, Homo sapiens
catgggcttggac

SEQ ID NO: 2040465 - DNA, 20 bp, Homo sapiens
catgggcttggacttcctgg

SEQ ID NO: 2040466 - DNA, 23 bp, Homo sapiens
catgggggtgctgcagccaggag

SEQ ID NO: 2040467 - DNA, 21 bp, Homo sapiens
catgggtccatgggaataaag

SEQ ID NO: 2040468 - DNA, 14 bp, Homo sapiens
catggtattgtaat

SEQ ID NO: 2040469 - DNA, 17 bp, Homo sapiens
catggtcagctcacacc

SEQ ID NO: 2040470 - DNA, 20 bp, Homo sapiens
catggtcccacatccctggg

SEQ ID NO: 2040471 - DNA, 22 bp, Homo sapiens
catggtcccacatccctgggcc

SEQ ID NO: 2040472 - DNA, 20 bp, Homo sapiens
catggtccggtgtccttttc

SEQ ID NO: 2040473 - DNA, 19 bp, Homo sapiens
catggtgcagttgacagca

SEQ ID NO: 2040474 - DNA, 20 bp, Homo sapiens
catggtgctttcaggtctgg

SEQ ID NO: 2040475 - DNA, 20 bp, Homo sapiens
catggtggcgcaagcctgta

SEQ ID NO: 2040476 - DNA, 22 bp, Homo sapiens
catgtaaaatgcagtccagaat

SEQ ID NO: 2040477 - DNA, 14 bp, Homo sapiens
catgtaaaggcctt

SEQ ID NO: 2040478 - DNA, 15 bp, Homo sapiens
catgtaaaggccttt

SEQ ID NO: 2040479 - DNA, 14 bp, Homo sapiens
catgtaatcagttt

SEQ ID NO: 2040480 - DNA, 20 bp, Homo sapiens
catgtaccagtgtactgctt

SEQ ID NO: 2040481 - DNA, 22 bp, Homo sapiens
catgtaccagtgtactgctttc

SEQ ID NO: 2040482 - DNA, 17 bp, Homo sapiens
catgtaccatcaataaa

SEQ ID NO: 2040483 - DNA, 13 bp, Homo sapiens
catgtactccaga

SEQ ID NO: 2040484 - DNA, 17 bp, Homo sapiens
catgtagaataaatgaa

SEQ ID NO: 2040485 - DNA, 17 bp, Homo sapiens
catgtagattttagttc

SEQ ID NO: 2040486 - DNA, 14 bp, Homo sapiens
catgtagctgagtt

SEQ ID NO: 2040487 - DNA, 15 bp, Homo sapiens
catgtataatatttt

SEQ ID NO: 2040488 - DNA, 18 bp, Homo sapiens
catgtataatatttttaa

SEQ ID NO: 2040489 - DNA, 14 bp, Homo sapiens
catgtatctacctc

SEQ ID NO: 2040490 - DNA, 13 bp, Homo sapiens
catgtatgtcttg

SEQ ID NO: 2040491 - DNA, 17 bp, Homo sapiens
catgtatgtcttggaca

SEQ ID NO: 2040492 - DNA, 12 bp, Homo sapiens
catgtatgtgtg

SEQ ID NO: 2040493 - DNA, 13 bp, Homo sapiens
catgtatgtgtgt

SEQ ID NO: 2040494 - DNA, 15 bp, Homo sapiens
catgtattatcacat

SEQ ID NO: 2040495 - DNA, 17 bp, Homo sapiens
catgtattatcacatca

SEQ ID NO: 2040496 - DNA, 21 bp, Homo sapiens
catgtattcacacacccctca

SEQ ID NO: 2040497 - DNA, 22 bp, Homo sapiens
catgtattgtaaacagaaggag

SEQ ID NO: 2040498 - DNA, 20 bp, Homo sapiens
catgtatttatctctattta

SEQ ID NO: 2040499 - DNA, 14 bp, Homo sapiens
catgtcaaacaaat

SEQ ID NO: 2040500 - DNA, 22 bp, Homo sapiens
catgtcaccgtggaccttcctg

SEQ ID NO: 2040501 - DNA, 23 bp, Homo sapiens
catgtcaccgtggaccttcctgc

SEQ ID NO: 2040502 - DNA, 17 bp, Homo sapiens
catgtcacctcagctga

SEQ ID NO: 2040503 - DNA, 15 bp, Homo sapiens
catgtcactcccaga

SEQ ID NO: 2040504 - DNA, 15 bp, Homo sapiens
catgtcagagccagg

SEQ ID NO: 2040505 - DNA, 18 bp, Homo sapiens
catgtcagagccaggctc

SEQ ID NO: 2040506 - DNA, 16 bp, Homo sapiens
catgtcaggcctgtgt

SEQ ID NO: 2040507 - DNA, 18 bp, Homo sapiens
catgtcctatgtgtgact

SEQ ID NO: 2040508 - DNA, 22 bp, Homo sapiens
catgtccttgtgtgttttgaga

SEQ ID NO: 2040509 - DNA, 14 bp, Homo sapiens
catgtcgcctctgc

SEQ ID NO: 2040510 - DNA, 20 bp, Homo sapiens
catgtcgcctgcccccagca

SEQ ID NO: 2040511 - DNA, 20 bp, Homo sapiens
catgtcggagtagaaattgt

SEQ ID NO: 2040512 - DNA, 15 bp, Homo sapiens
catgtctcacagacg

SEQ ID NO: 2040513 - DNA, 17 bp, Homo sapiens
catgtctcagcctcctc

SEQ ID NO: 2040514 - DNA, 17 bp, Homo sapiens
catgtcttgtacatgtg

SEQ ID NO: 2040515 - DNA, 19 bp, Homo sapiens
catgtgaattctgtgaaga

SEQ ID NO: 2040516 - DNA, 14 bp, Homo sapiens
catgtgacacatat

SEQ ID NO: 2040517 - DNA, 12 bp, Homo sapiens
catgtgatcctt

SEQ ID NO: 2040518 - DNA, 21 bp, Homo sapiens
catgtgccaggtttttggtct

SEQ ID NO: 2040519 - DNA, 13 bp, Homo sapiens
catgtgcctggaa

SEQ ID NO: 2040520 - DNA, 18 bp, Homo sapiens
catgtgctattgaactga

SEQ ID NO: 2040521 - DNA, 21 bp, Homo sapiens
catgtgcttccctaggctgag

SEQ ID NO: 2040522 - DNA, 15 bp, Homo sapiens
catgtggcaacctgt

SEQ ID NO: 2040523 - DNA, 15 bp, Homo sapiens
catgtggtttataga

SEQ ID NO: 2040524 - DNA, 18 bp, Homo sapiens
catgtgtagattgcgtgg

SEQ ID NO: 2040525 - DNA, 19 bp, Homo sapiens
catgtgtagattgcgtgga

SEQ ID NO: 2040526 - DNA, 12 bp, Homo sapiens
catgtgtgcatg

SEQ ID NO: 2040527 - DNA, 14 bp, Homo sapiens
catgtgtgcatgtg

SEQ ID NO: 2040528 - DNA, 20 bp, Homo sapiens
catgtgtgcatgtgagcaca

SEQ ID NO: 2040529 - DNA, 11 bp, Homo sapiens
catgtgtgtat

SEQ ID NO: 2040530 - DNA, 21 bp, Homo sapiens
cattgcgctctagcctgggca

SEQ ID NO: 2040531 - DNA, 15 bp, Homo sapiens
cattgcggacagcca

SEQ ID NO: 2040532 - DNA, 17 bp, Homo sapiens
cattgcggacagccacg

SEQ ID NO: 2040533 - DNA, 21 bp, Homo sapiens
cattgcggacagccacggcca

SEQ ID NO: 2040534 - DNA, 22 bp, Homo sapiens
cattgctttgaagcagttgtgt

SEQ ID NO: 2040535 - DNA, 23 bp, Homo sapiens
cattgctttgaagcagttgtgtc

SEQ ID NO: 2040536 - DNA, 22 bp, Homo sapiens
cattggcagtgtgtcacactga

SEQ ID NO: 2040537 - DNA, 23 bp, Homo sapiens
cattgggttgtagccaaaggttc

SEQ ID NO: 2040538 - DNA, 19 bp, Homo sapiens
cattgggttttatcagtgc

SEQ ID NO: 2040539 - DNA, 19 bp, Homo sapiens
cattgtaaattatttcata

SEQ ID NO: 2040540 - DNA, 14 bp, Homo sapiens
cattgtagaaaagc

SEQ ID NO: 2040541 - DNA, 17 bp, Homo sapiens
cattgtagagcttctgg

SEQ ID NO: 2040542 - DNA, 20 bp, Homo sapiens
cattgtatatatgtgtgttt

SEQ ID NO: 2040543 - DNA, 17 bp, Homo sapiens
cattgtatgtatctatt

SEQ ID NO: 2040544 - DNA, 15 bp, Homo sapiens
cattgtcttccaacc

SEQ ID NO: 2040545 - DNA, 18 bp, Homo sapiens
cattgtcttccaacccca

SEQ ID NO: 2040546 - DNA, 18 bp, Homo sapiens
cattgtgtgagcttctac

SEQ ID NO: 2040547 - DNA, 16 bp, Homo sapiens
cattgttattgtggaa

SEQ ID NO: 2040548 - DNA, 16 bp, Homo sapiens
cattgttgctccctgt

SEQ ID NO: 2040549 - DNA, 15 bp, Homo sapiens
catttaaaatgatta

SEQ ID NO: 2040550 - DNA, 23 bp, Homo sapiens
catttaagaaggagttctgacat

SEQ ID NO: 2040551 - DNA, 14 bp, Homo sapiens
catttaagggaaaa

SEQ ID NO: 2040552 - DNA, 15 bp, Homo sapiens
catttaagggaaaaa

SEQ ID NO: 2040553 - DNA, 14 bp, Homo sapiens
catttaattcataa

SEQ ID NO: 2040554 - DNA, 18 bp, Homo sapiens
catttaattctgaaatca

SEQ ID NO: 2040555 - DNA, 24 bp, Homo sapiens
catttacacattctcacaattgta

SEQ ID NO: 2040556 - DNA, 21 bp, Homo sapiens
catttactttgtgttcacctt

SEQ ID NO: 2040557 - DNA, 14 bp, Homo sapiens
catttagttctttg

SEQ ID NO: 2040558 - DNA, 21 bp, Homo sapiens
catttagttttatggcatgat

SEQ ID NO: 2040559 - DNA, 15 bp, Homo sapiens
catttataaatgtgt

SEQ ID NO: 2040560 - DNA, 17 bp, Homo sapiens
catttataatgtttgct

SEQ ID NO: 2040561 - DNA, 17 bp, Homo sapiens
catttatatatatatgt

SEQ ID NO: 2040562 - DNA, 18 bp, Homo sapiens
catttatatatatatgta

SEQ ID NO: 2040563 - DNA, 20 bp, Homo sapiens
catttatatatatatgtata

SEQ ID NO: 2040564 - DNA, 16 bp, Homo sapiens
catttattctgctcac

SEQ ID NO: 2040565 - DNA, 16 bp, Homo sapiens
catttcaaagctgagt

SEQ ID NO: 2040566 - DNA, 14 bp, Homo sapiens
catttcactttaaa

SEQ ID NO: 2040567 - DNA, 20 bp, Homo sapiens
catttcataaggcctgccct

SEQ ID NO: 2040568 - DNA, 16 bp, Homo sapiens
catttcatctatttct

SEQ ID NO: 2040569 - DNA, 16 bp, Homo sapiens
catttcattgtatgat

SEQ ID NO: 2040570 - DNA, 18 bp, Homo sapiens
catttcattgtatgatgt

SEQ ID NO: 2040571 - DNA, 14 bp, Homo sapiens
catttcatttccta

SEQ ID NO: 2040572 - DNA, 10 bp, Homo sapiens
catttccctc

SEQ ID NO: 2040573 - DNA, 15 bp, Homo sapiens
catttccctcccggg

SEQ ID NO: 2040574 - DNA, 20 bp, Homo sapiens
catttcctgacagaaggact

SEQ ID NO: 2040575 - DNA, 19 bp, Homo sapiens
catttcctgagaccacaga

SEQ ID NO: 2040576 - DNA, 12 bp, Homo sapiens
catttccttgga

SEQ ID NO: 2040577 - DNA, 13 bp, Homo sapiens
catttccttggag

SEQ ID NO: 2040578 - DNA, 17 bp, Homo sapiens
catttcgcccctcattt

SEQ ID NO: 2040579 - DNA, 14 bp, Homo sapiens
catttctaaaagaa

SEQ ID NO: 2040580 - DNA, 22 bp, Homo sapiens
catttctaaaagaatattcaga

SEQ ID NO: 2040581 - DNA, 17 bp, Homo sapiens
catttctaattttaagt

SEQ ID NO: 2040582 - DNA, 18 bp, Homo sapiens
catttctatttatttact

SEQ ID NO: 2040583 - DNA, 22 bp, Homo sapiens
catttctcaatcagtgcagtga

SEQ ID NO: 2040584 - DNA, 22 bp, Homo sapiens
catttctcagtcggtgtgtaat

SEQ ID NO: 2040585 - DNA, 14 bp, Homo sapiens
catttctctgagca

SEQ ID NO: 2040586 - DNA, 19 bp, Homo sapiens
catttctctgagcagtcag

SEQ ID NO: 2040587 - DNA, 23 bp, Homo sapiens
catttctgcatcagctgctgaaa

SEQ ID NO: 2040588 - DNA, 19 bp, Homo sapiens
catttctggcttctagtct

SEQ ID NO: 2040589 - DNA, 15 bp, Homo sapiens
catttcttatgattt

SEQ ID NO: 2040590 - DNA, 14 bp, Homo sapiens
catttcttcctcac

SEQ ID NO: 2040591 - DNA, 21 bp, Homo sapiens
catttgaataaagcctgcttt

SEQ ID NO: 2040592 - DNA, 16 bp, Homo sapiens
catttgagagaagcca

SEQ ID NO: 2040593 - DNA, 16 bp, Homo sapiens
catttgagcagggctc

SEQ ID NO: 2040594 - DNA, 19 bp, Homo sapiens
catttgataaactaaaagc

SEQ ID NO: 2040595 - DNA, 16 bp, Homo sapiens
catttgatgctaaata

SEQ ID NO: 2040596 - DNA, 14 bp, Homo sapiens
catttgatgtacat

SEQ ID NO: 2040597 - DNA, 19 bp, Homo sapiens
catttgcacaggttttcag

SEQ ID NO: 2040598 - DNA, 16 bp, Homo sapiens
catttgccattcctgg

SEQ ID NO: 2040599 - DNA, 23 bp, Homo sapiens
catttgccctgtggattccagca

SEQ ID NO: 2040600 - DNA, 20 bp, Homo sapiens
catttggtgcacttttctgt

SEQ ID NO: 2040601 - DNA, 18 bp, Homo sapiens
catttgtaatgtatctta

SEQ ID NO: 2040602 - DNA, 20 bp, Homo sapiens
catttgtcaaagcattgaga

SEQ ID NO: 2040603 - DNA, 20 bp, Homo sapiens
catttgttgtgactggcacc

SEQ ID NO: 2040604 - DNA, 15 bp, Homo sapiens
catttgtttctactt

SEQ ID NO: 2040605 - DNA, 16 bp, Homo sapiens
cattttaaaagcaatt

SEQ ID NO: 2040606 - DNA, 15 bp, Homo sapiens
cattttaaaatctga

SEQ ID NO: 2040607 - DNA, 16 bp, Homo sapiens
cattttaactttatca

SEQ ID NO: 2040608 - DNA, 19 bp, Homo sapiens
cattttaagaagacatgac

SEQ ID NO: 2040609 - DNA, 20 bp, Homo sapiens
cattttaagaagacatgaca

SEQ ID NO: 2040610 - DNA, 12 bp, Homo sapiens
cattttaataaa

SEQ ID NO: 2040611 - DNA, 17 bp, Homo sapiens
cattttaattattattc

SEQ ID NO: 2040612 - DNA, 21 bp, Homo sapiens
cattttaatttatatttgaaa

SEQ ID NO: 2040613 - DNA, 12 bp, Homo sapiens
cattttactact

SEQ ID NO: 2040614 - DNA, 16 bp, Homo sapiens
cattttactacttgtt

SEQ ID NO: 2040615 - DNA, 17 bp, Homo sapiens
cattttactacttgtta

SEQ ID NO: 2040616 - DNA, 23 bp, Homo sapiens
cattttaggaaaaaaaaaagcat

SEQ ID NO: 2040617 - DNA, 13 bp, Homo sapiens
cattttaggcctc

SEQ ID NO: 2040618 - DNA, 18 bp, Homo sapiens
cattttagttcctttatt

SEQ ID NO: 2040619 - DNA, 14 bp, Homo sapiens
cattttctctagct

SEQ ID NO: 2040620 - DNA, 18 bp, Homo sapiens
cattttctctttaaaaga

SEQ ID NO: 2040621 - DNA, 14 bp, Homo sapiens
cattttcttgcctg

SEQ ID NO: 2040622 - DNA, 17 bp, Homo sapiens
cattttgagtgactcga

SEQ ID NO: 2040623 - DNA, 13 bp, Homo sapiens
cattttgcaaaat

SEQ ID NO: 2040624 - DNA, 17 bp, Homo sapiens
cattttgcaaaatttcc

SEQ ID NO: 2040625 - DNA, 15 bp, Homo sapiens
cattttgcagcagtg

SEQ ID NO: 2040626 - DNA, 18 bp, Homo sapiens
cattttgcagcagtgagt

SEQ ID NO: 2040627 - DNA, 18 bp, Homo sapiens
cattttgtaacaaatgaa

SEQ ID NO: 2040628 - DNA, 17 bp, Homo sapiens
cattttgttatagaata

SEQ ID NO: 2040629 - DNA, 15 bp, Homo sapiens
catttttacaataaa

SEQ ID NO: 2040630 - DNA, 20 bp, Homo sapiens
catttttactactattctgt

SEQ ID NO: 2040631 - DNA, 20 bp, Homo sapiens
catttttattcatgccatct

SEQ ID NO: 2040632 - DNA, 16 bp, Homo sapiens
catttttcatgataat

SEQ ID NO: 2040633 - DNA, 23 bp, Homo sapiens
catttttggtaggcttatcaaaa

SEQ ID NO: 2040634 - DNA, 18 bp, Homo sapiens
catttttttccttgcaaa

SEQ ID NO: 2040635 - DNA, 17 bp, Homo sapiens
cattttttttttttgag

SEQ ID NO: 2040636 - DNA, 21 bp, Homo sapiens
ccaaaacgtgggtatttcctg

SEQ ID NO: 2040637 - DNA, 22 bp, Homo sapiens
ccaaaacgtgggtatttcctgc

SEQ ID NO: 2040638 - DNA, 19 bp, Homo sapiens
ccaaaagggcagccagggg

SEQ ID NO: 2040639 - DNA, 20 bp, Homo sapiens
ccaaaagttacatgtttgca

SEQ ID NO: 2040640 - DNA, 17 bp, Homo sapiens
ccaaaagttttcctgag

SEQ ID NO: 2040641 - DNA, 17 bp, Homo sapiens
ccaaaatgttgaaatat

SEQ ID NO: 2040642 - DNA, 15 bp, Homo sapiens
ccaaacacactgtaa

SEQ ID NO: 2040643 - DNA, 17 bp, Homo sapiens
ccaaacacactgtaaat

SEQ ID NO: 2040644 - DNA, 18 bp, Homo sapiens
ccaaacacactgtaaata

SEQ ID NO: 2040645 - DNA, 12 bp, Homo sapiens
ccaaacagagcc

SEQ ID NO: 2040646 - DNA, 13 bp, Homo sapiens
ccaaacagagcct

SEQ ID NO: 2040647 - DNA, 13 bp, Homo sapiens
ccaaacagagggc

SEQ ID NO: 2040648 - DNA, 16 bp, Homo sapiens
ccaaacccatgaggca

SEQ ID NO: 2040649 - DNA, 15 bp, Homo sapiens
ccaaactaccgttcc

SEQ ID NO: 2040650 - DNA, 16 bp, Homo sapiens
ccaaactcctgcctgt

SEQ ID NO: 2040651 - DNA, 20 bp, Homo sapiens
ccaaactgtgccctgccttc

SEQ ID NO: 2040652 - DNA, 21 bp, Homo sapiens
ccaaagaattcctgaagccag

SEQ ID NO: 2040653 - DNA, 16 bp, Homo sapiens
ccaaagagaaaagatt

SEQ ID NO: 2040654 - DNA, 17 bp, Homo sapiens
ccaaagagactggagca

SEQ ID NO: 2040655 - DNA, 12 bp, Homo sapiens
ccaaagagcctg

SEQ ID NO: 2040656 - DNA, 16 bp, Homo sapiens
ccaaagagcctggaga

SEQ ID NO: 2040657 - DNA, 15 bp, Homo sapiens
ccaaagcaatatttc

SEQ ID NO: 2040658 - DNA, 20 bp, Homo sapiens
ccaccaactctgcactccat

SEQ ID NO: 2040659 - DNA, 11 bp, Homo sapiens
ccaccaataaa

SEQ ID NO: 2040660 - DNA, 13 bp, Homo sapiens
ccaccaataaaaa

SEQ ID NO: 2040661 - DNA, 14 bp, Homo sapiens
ccaccacacccagc

SEQ ID NO: 2040662 - DNA, 17 bp, Homo sapiens
ccaccacacccagccca

SEQ ID NO: 2040663 - DNA, 15 bp, Homo sapiens
ccaccaccctcccac

SEQ ID NO: 2040664 - DNA, 23 bp, Homo sapiens
ccaccaccctcccaccatgcgct

SEQ ID NO: 2040665 - DNA, 13 bp, Homo sapiens
ccaccaccctgag

SEQ ID NO: 2040666 - DNA, 18 bp, Homo sapiens
ccaccacctaggccactc

SEQ ID NO: 2040667 - DNA, 20 bp, Homo sapiens
ccaccacctaggccactcct

SEQ ID NO: 2040668 - DNA, 22 bp, Homo sapiens
ccaccacctaggccactcctcc

SEQ ID NO: 2040669 - DNA, 13 bp, Homo sapiens
ccaccacgtctgc

SEQ ID NO: 2040670 - DNA, 14 bp, Homo sapiens
ccaccacgtctgcc

SEQ ID NO: 2040671 - DNA, 15 bp, Homo sapiens
ccaccacgtctgcca

SEQ ID NO: 2040672 - DNA, 18 bp, Homo sapiens
ccaccacgtctgccaggc

SEQ ID NO: 2040673 - DNA, 20 bp, Homo sapiens
ccaccacgtctgccaggccc

SEQ ID NO: 2040674 - DNA, 15 bp, Homo sapiens
ccaccactagagctg

SEQ ID NO: 2040675 - DNA, 18 bp, Homo sapiens
ccaccagatgagaagtta

SEQ ID NO: 2040676 - DNA, 15 bp, Homo sapiens
ccaccagccacctct

SEQ ID NO: 2040677 - DNA, 17 bp, Homo sapiens
ccaccagccacctcttg

SEQ ID NO: 2040678 - DNA, 13 bp, Homo sapiens
ccaccagcctaag

SEQ ID NO: 2040679 - DNA, 19 bp, Homo sapiens
ccaccagcctaagaagctc

SEQ ID NO: 2040680 - DNA, 11 bp, Homo sapiens
ccaccagggca

SEQ ID NO: 2040681 - DNA, 22 bp, Homo sapiens
ccaccagggcactgtctgcgtg

SEQ ID NO: 2040682 - DNA, 14 bp, Homo sapiens
ccaccagtcactgt

SEQ ID NO: 2040683 - DNA, 19 bp, Homo sapiens
ccaccatcatgtctggcta

SEQ ID NO: 2040684 - DNA, 17 bp, Homo sapiens
ccaccatgcccagtcga

SEQ ID NO: 2040685 - DNA, 22 bp, Homo sapiens
ccacccaattcaaaacattgtg

SEQ ID NO: 2040686 - DNA, 13 bp, Homo sapiens
ccacccacctcag

SEQ ID NO: 2040687 - DNA, 15 bp, Homo sapiens
ccacccacctcagcc

SEQ ID NO: 2040688 - DNA, 18 bp, Homo sapiens
ccacccagcaacacagag

SEQ ID NO: 2040689 - DNA, 11 bp, Homo sapiens
ccacccagccc

SEQ ID NO: 2040690 - DNA, 12 bp, Homo sapiens
ccacccagccca

SEQ ID NO: 2040691 - DNA, 12 bp, Homo sapiens
ccacccaggagc

SEQ ID NO: 2040692 - DNA, 14 bp, Homo sapiens
ccacccaggagccc

SEQ ID NO: 2040693 - DNA, 23 bp, Homo sapiens
ccacccaggagccccgaggcctt

SEQ ID NO: 2040694 - DNA, 15 bp, Homo sapiens
ccacccaggcaggcc

SEQ ID NO: 2040695 - DNA, 13 bp, Homo sapiens
ccacccaggctgc

SEQ ID NO: 2040696 - DNA, 14 bp, Homo sapiens
ccacccaggctgca

SEQ ID NO: 2040697 - DNA, 16 bp, Homo sapiens
ccacccaggctgcact

SEQ ID NO: 2040698 - DNA, 22 bp, Homo sapiens
ccacccaggctgcactgcagtg

SEQ ID NO: 2040699 - DNA, 21 bp, Homo sapiens
ccacccagggctccctcctgg

SEQ ID NO: 2040700 - DNA, 17 bp, Homo sapiens
ccacccagtgctgccat

SEQ ID NO: 2040701 - DNA, 21 bp, Homo sapiens
ccacccatcctaccaatgcat

SEQ ID NO: 2040702 - DNA, 15 bp, Homo sapiens
ccacccatcttcctg

SEQ ID NO: 2040703 - DNA, 12 bp, Homo sapiens
ccaccccaacat

SEQ ID NO: 2040704 - DNA, 13 bp, Homo sapiens
ccaccccagagtt

SEQ ID NO: 2040705 - DNA, 12 bp, Homo sapiens
ccaccccaggac

SEQ ID NO: 2040706 - DNA, 13 bp, Homo sapiens
ccacccccagccc

SEQ ID NO: 2040707 - DNA, 14 bp, Homo sapiens
ccacccccatgcag

SEQ ID NO: 2040708 - DNA, 18 bp, Homo sapiens
ccacccccgccacggcca

SEQ ID NO: 2040709 - DNA, 18 bp, Homo sapiens
ccaccccctccccagggg

SEQ ID NO: 2040710 - DNA, 17 bp, Homo sapiens
ccacccccttcagtgcc

SEQ ID NO: 2040711 - DNA, 15 bp, Homo sapiens
ccaccccggcctcca

SEQ ID NO: 2040712 - DNA, 14 bp, Homo sapiens
ccaccccttcctgt

SEQ ID NO: 2040713 - DNA, 19 bp, Homo sapiens
ccacccgtaggcagcctct

SEQ ID NO: 2040714 - DNA, 19 bp, Homo sapiens
ccacccgttctgctggcct

SEQ ID NO: 2040715 - DNA, 21 bp, Homo sapiens
ccacccgttctgctggcctgg

SEQ ID NO: 2040716 - DNA, 23 bp, Homo sapiens
ccaccctacttcattttcagagt

SEQ ID NO: 2040717 - DNA, 22 bp, Homo sapiens
ccaccctcaaatgtcagagcta

SEQ ID NO: 2040718 - DNA, 20 bp, Homo sapiens
ccaccctcccaccatgcgct

SEQ ID NO: 2040719 - DNA, 14 bp, Homo sapiens
ccaccctcctttca

SEQ ID NO: 2040720 - DNA, 17 bp, Homo sapiens
ccaccctcgtggacacc

SEQ ID NO: 2040721 - DNA, 22 bp, Homo sapiens
ccaccctcgtggacacctgccc

SEQ ID NO: 2040722 - DNA, 12 bp, Homo sapiens
ccaccctctcca

SEQ ID NO: 2040723 - DNA, 13 bp, Homo sapiens
ccaccctctccat

SEQ ID NO: 2040724 - DNA, 15 bp, Homo sapiens
ccaccctgaggagtc

SEQ ID NO: 2040725 - DNA, 21 bp, Homo sapiens
ccaccctgaggagtctgaggt

SEQ ID NO: 2040726 - DNA, 23 bp, Homo sapiens
ccaccctgaggagtctgaggtcc

SEQ ID NO: 2040727 - DNA, 11 bp, Homo sapiens
ccaccctgctc

SEQ ID NO: 2040728 - DNA, 12 bp, Homo sapiens
ccaccctgctct

SEQ ID NO: 2040729 - DNA, 12 bp, Homo sapiens
ccaccctggccc

SEQ ID NO: 2040730 - DNA, 15 bp, Homo sapiens
ccaccctggcccgcc

SEQ ID NO: 2040731 - DNA, 13 bp, Homo sapiens
ccaccgaagagcc

SEQ ID NO: 2040732 - DNA, 15 bp, Homo sapiens
ccaccgaagagccct

SEQ ID NO: 2040733 - DNA, 17 bp, Homo sapiens
ccaccgaagagccctga

SEQ ID NO: 2040734 - DNA, 18 bp, Homo sapiens
ccaccgaagagccctgag

SEQ ID NO: 2040735 - DNA, 20 bp, Homo sapiens
ccaccgaagagccctgagct

SEQ ID NO: 2040736 - DNA, 21 bp, Homo sapiens
ccaccgaagaggaagcaagaa

SEQ ID NO: 2040737 - DNA, 14 bp, Homo sapiens
ccaccgctgcctaa

SEQ ID NO: 2040738 - DNA, 22 bp, Homo sapiens
ccaccgctgccttttgctgctg

SEQ ID NO: 2040739 - DNA, 17 bp, Homo sapiens
ccaccgggacagacctg

SEQ ID NO: 2040740 - DNA, 19 bp, Homo sapiens
ccaccgggacagacctgga

SEQ ID NO: 2040741 - DNA, 21 bp, Homo sapiens
ccaccgggacagacctggaca

SEQ ID NO: 2040742 - DNA, 21 bp, Homo sapiens
ccaccgggccactccttcctg

SEQ ID NO: 2040743 - DNA, 22 bp, Homo sapiens
ccaccgggccactccttcctgc

SEQ ID NO: 2040744 - DNA, 22 bp, Homo sapiens
ccaccgggctgggagctctgca

SEQ ID NO: 2040745 - DNA, 18 bp, Homo sapiens
ccaccgtctacagatggc

SEQ ID NO: 2040746 - DNA, 17 bp, Homo sapiens
ccacctacttgtgactg

SEQ ID NO: 2040747 - DNA, 19 bp, Homo sapiens
ccactgcactccagcctgg

SEQ ID NO: 2040748 - DNA, 20 bp, Homo sapiens
ccactgcactccagcctggg

SEQ ID NO: 2040749 - DNA, 17 bp, Homo sapiens
ccactgcagagatggtg

SEQ ID NO: 2040750 - DNA, 17 bp, Homo sapiens
ccactgcaggccccgct

SEQ ID NO: 2040751 - DNA, 20 bp, Homo sapiens
ccactgccacaccctcccca

SEQ ID NO: 2040752 - DNA, 11 bp, Homo sapiens
ccactgccagg

SEQ ID NO: 2040753 - DNA, 19 bp, Homo sapiens
ccactgccaggcacctggc

SEQ ID NO: 2040754 - DNA, 15 bp, Homo sapiens
ccactgctctcagcc

SEQ ID NO: 2040755 - DNA, 15 bp, Homo sapiens
ccactgctctggtta

SEQ ID NO: 2040756 - DNA, 18 bp, Homo sapiens
ccactgctttccagcctg

SEQ ID NO: 2040757 - DNA, 20 bp, Homo sapiens
ccactgcttttggtctgtgt

SEQ ID NO: 2040758 - DNA, 20 bp, Homo sapiens
ccactggacttgagcttggc

SEQ ID NO: 2040759 - DNA, 11 bp, Homo sapiens
ccactggaggt

SEQ ID NO: 2040760 - DNA, 15 bp, Homo sapiens
ccactggatcttcag

SEQ ID NO: 2040761 - DNA, 15 bp, Homo sapiens
ccactggccagtcct

SEQ ID NO: 2040762 - DNA, 19 bp, Homo sapiens
ccactggccagtcctagag

SEQ ID NO: 2040763 - DNA, 19 bp, Homo sapiens
ccactgggtctcactcctg

SEQ ID NO: 2040764 - DNA, 20 bp, Homo sapiens
ccactgggtctcactcctga

SEQ ID NO: 2040765 - DNA, 21 bp, Homo sapiens
ccactggttaaaataaagcct

SEQ ID NO: 2040766 - DNA, 23 bp, Homo sapiens
ccactggttaaaataaagcctat

SEQ ID NO: 2040767 - DNA, 19 bp, Homo sapiens
ccactggtttctcagaatc

SEQ ID NO: 2040768 - DNA, 12 bp, Homo sapiens
ccactgtacata

SEQ ID NO: 2040769 - DNA, 17 bp, Homo sapiens
ccactgtcaccctccac

SEQ ID NO: 2040770 - DNA, 13 bp, Homo sapiens
ccactgtccgcct

SEQ ID NO: 2040771 - DNA, 14 bp, Homo sapiens
ccactgtccgcctc

SEQ ID NO: 2040772 - DNA, 15 bp, Homo sapiens
ccactgtccgcctct

SEQ ID NO: 2040773 - DNA, 19 bp, Homo sapiens
ccactgtcctggctgctct

SEQ ID NO: 2040774 - DNA, 19 bp, Homo sapiens
ccactgtcttgcctgccag

SEQ ID NO: 2040775 - DNA, 22 bp, Homo sapiens
ccactgtcttgcctgccagggc

SEQ ID NO: 2040776 - DNA, 11 bp, Homo sapiens
ccactgtgcag

SEQ ID NO: 2040777 - DNA, 19 bp, Homo sapiens
ccactgtggccagagctgg

SEQ ID NO: 2040778 - DNA, 16 bp, Homo sapiens
ccagagcactgctcca

SEQ ID NO: 2040779 - DNA, 14 bp, Homo sapiens
ccagagccagcctg

SEQ ID NO: 2040780 - DNA, 18 bp, Homo sapiens
ccagagccagcctgggac

SEQ ID NO: 2040781 - DNA, 19 bp, Homo sapiens
ccagagcccaagtgccatc

SEQ ID NO: 2040782 - DNA, 24 bp, Homo sapiens
ccagagcccaagtgccatcccaca

SEQ ID NO: 2040783 - DNA, 14 bp, Homo sapiens
ccagagcccacctt

SEQ ID NO: 2040784 - DNA, 16 bp, Homo sapiens
ccagagcccaccttgg

SEQ ID NO: 2040785 - DNA, 18 bp, Homo sapiens
ccagagccccacacggag

SEQ ID NO: 2040786 - DNA, 15 bp, Homo sapiens
ccagagccccactcc

SEQ ID NO: 2040787 - DNA, 16 bp, Homo sapiens
ccagagccccccacaa

SEQ ID NO: 2040788 - DNA, 23 bp, Homo sapiens
ccagagccccccacaatgatgat

SEQ ID NO: 2040789 - DNA, 13 bp, Homo sapiens
ccagagcctgggg

SEQ ID NO: 2040790 - DNA, 18 bp, Homo sapiens
ccagagcctggggctcta

SEQ ID NO: 2040791 - DNA, 20 bp, Homo sapiens
ccagagcctggggctctaac

SEQ ID NO: 2040792 - DNA, 17 bp, Homo sapiens
ccagagccttctcctgc

SEQ ID NO: 2040793 - DNA, 12 bp, Homo sapiens
ccagagctggaa

SEQ ID NO: 2040794 - DNA, 21 bp, Homo sapiens
ccagagctggaaggcagggca

SEQ ID NO: 2040795 - DNA, 14 bp, Homo sapiens
ccagagctgggagg

SEQ ID NO: 2040796 - DNA, 18 bp, Homo sapiens
ccagagcttattggccac

SEQ ID NO: 2040797 - DNA, 19 bp, Homo sapiens
ccagagcttattggccact

SEQ ID NO: 2040798 - DNA, 19 bp, Homo sapiens
ccagagctttgttttatat

SEQ ID NO: 2040799 - DNA, 18 bp, Homo sapiens
ccagaggacaaggaagtg

SEQ ID NO: 2040800 - DNA, 19 bp, Homo sapiens
ccagaggctattattttca

SEQ ID NO: 2040801 - DNA, 14 bp, Homo sapiens
ccagaggctgcaga

SEQ ID NO: 2040802 - DNA, 18 bp, Homo sapiens
ccagagggagtgacagag

SEQ ID NO: 2040803 - DNA, 15 bp, Homo sapiens
ccagagggccaagag

SEQ ID NO: 2040804 - DNA, 13 bp, Homo sapiens
ccagagggcccag

SEQ ID NO: 2040805 - DNA, 17 bp, Homo sapiens
ccagagggcccaggcag

SEQ ID NO: 2040806 - DNA, 21 bp, Homo sapiens
ccagaggttatctgcctggcc

SEQ ID NO: 2040807 - DNA, 17 bp, Homo sapiens
ccagagtcagaggagaa

SEQ ID NO: 2040808 - DNA, 13 bp, Homo sapiens
ccagagtctgagc

SEQ ID NO: 2040809 - DNA, 15 bp, Homo sapiens
ccagagtggagtctg

SEQ ID NO: 2040810 - DNA, 17 bp, Homo sapiens
ccagagtggagtctgag

SEQ ID NO: 2040811 - DNA, 24 bp, Homo sapiens
ccaataactaatgctaagaaatgc

SEQ ID NO: 2040812 - DNA, 21 bp, Homo sapiens
ccaataacttcagagaagtca

SEQ ID NO: 2040813 - DNA, 16 bp, Homo sapiens
ccaatatgtattgtaa

SEQ ID NO: 2040814 - DNA, 22 bp, Homo sapiens
ccaatatgtattgtaaacatgt

SEQ ID NO: 2040815 - DNA, 15 bp, Homo sapiens
ccaatcagcactgaa

SEQ ID NO: 2040816 - DNA, 12 bp, Homo sapiens
ccaatcatttta

SEQ ID NO: 2040817 - DNA, 23 bp, Homo sapiens
ccaatccaggtgggagagacact

SEQ ID NO: 2040818 - DNA, 12 bp, Homo sapiens
ccaatcctcagg

SEQ ID NO: 2040819 - DNA, 18 bp, Homo sapiens
ccaatctgctcagcaggc

SEQ ID NO: 2040820 - DNA, 21 bp, Homo sapiens
ccaatctgctcagcaggccct

SEQ ID NO: 2040821 - DNA, 17 bp, Homo sapiens
ccaatgattcataacaa

SEQ ID NO: 2040822 - DNA, 21 bp, Homo sapiens
ccaatgcatgcagccactgtg

SEQ ID NO: 2040823 - DNA, 23 bp, Homo sapiens
ccaatgcatgcagccactgtgct

SEQ ID NO: 2040824 - DNA, 15 bp, Homo sapiens
ccaatggctgtaaac

SEQ ID NO: 2040825 - DNA, 15 bp, Homo sapiens
ccaatgtacccaccg

SEQ ID NO: 2040826 - DNA, 14 bp, Homo sapiens
ccaattaaaatata

SEQ ID NO: 2040827 - DNA, 18 bp, Homo sapiens
ccaattaaaatatatata

SEQ ID NO: 2040828 - DNA, 22 bp, Homo sapiens
ccaattaaaatatatataaata

SEQ ID NO: 2040829 - DNA, 15 bp, Homo sapiens
ccaattaaaattaag

SEQ ID NO: 2040830 - DNA, 21 bp, Homo sapiens
ccaattaaaattaaggtctgg

SEQ ID NO: 2040831 - DNA, 17 bp, Homo sapiens
ccaattatgcactggcc

SEQ ID NO: 2040832 - DNA, 13 bp, Homo sapiens
ccaattatgtgac

SEQ ID NO: 2040833 - DNA, 14 bp, Homo sapiens
ccaattcatttcat

SEQ ID NO: 2040834 - DNA, 17 bp, Homo sapiens
ccaattcatttcatcta

SEQ ID NO: 2040835 - DNA, 19 bp, Homo sapiens
ccaattccacagtctctgg

SEQ ID NO: 2040836 - DNA, 18 bp, Homo sapiens
ccaattcttacaaacatg

SEQ ID NO: 2040837 - DNA, 13 bp, Homo sapiens
ccaattgcctctt

SEQ ID NO: 2040838 - DNA, 13 bp, Homo sapiens
ccaattgtaaaaa

SEQ ID NO: 2040839 - DNA, 14 bp, Homo sapiens
ccaattgtaaaaaa

SEQ ID NO: 2040840 - DNA, 15 bp, Homo sapiens
ccaatttaattccat

SEQ ID NO: 2040841 - DNA, 22 bp, Homo sapiens
ccacaaaatagagattaatttt

SEQ ID NO: 2040842 - DNA, 23 bp, Homo sapiens
ccacaaatcaaagcaagggctcc

SEQ ID NO: 2040843 - DNA, 15 bp, Homo sapiens
ccacaaatctatatt

SEQ ID NO: 2040844 - DNA, 20 bp, Homo sapiens
ccacaaatctatattaaagt

SEQ ID NO: 2040845 - DNA, 14 bp, Homo sapiens
ccacaaccaggaag

SEQ ID NO: 2040846 - DNA, 16 bp, Homo sapiens
ccacaaccaggaagaa

SEQ ID NO: 2040847 - DNA, 17 bp, Homo sapiens
ccacaactgacacagga

SEQ ID NO: 2040848 - DNA, 19 bp, Homo sapiens
ccacaactgacacaggaaa

SEQ ID NO: 2040849 - DNA, 16 bp, Homo sapiens
ccacaagaaatttgat

SEQ ID NO: 2040850 - DNA, 21 bp, Homo sapiens
ccacaagaaatttgatttcta

SEQ ID NO: 2040851 - DNA, 16 bp, Homo sapiens
ccacaagattcccaga

SEQ ID NO: 2040852 - DNA, 19 bp, Homo sapiens
ccacaagattcccagagac

SEQ ID NO: 2040853 - DNA, 16 bp, Homo sapiens
ccacaagccttactca

SEQ ID NO: 2040854 - DNA, 14 bp, Homo sapiens
ccacaatgcctctc

SEQ ID NO: 2040855 - DNA, 18 bp, Homo sapiens
ccacaatgcctctcccac

SEQ ID NO: 2040856 - DNA, 16 bp, Homo sapiens
ccacacacagaggaag

SEQ ID NO: 2040857 - DNA, 18 bp, Homo sapiens
ccacacacagaggaagag

SEQ ID NO: 2040858 - DNA, 12 bp, Homo sapiens
ccacacagagcc

SEQ ID NO: 2040859 - DNA, 13 bp, Homo sapiens
ccacacagagcct

SEQ ID NO: 2040860 - DNA, 15 bp, Homo sapiens
ccacacagagcctgc

SEQ ID NO: 2040861 - DNA, 16 bp, Homo sapiens
ccacacagagcctgcc

SEQ ID NO: 2040862 - DNA, 20 bp, Homo sapiens
ccacacagagcctgcctcag

SEQ ID NO: 2040863 - DNA, 20 bp, Homo sapiens
ccacaccatcaccctctggg

SEQ ID NO: 2040864 - DNA, 14 bp, Homo sapiens
ccacacccagccca

SEQ ID NO: 2040865 - DNA, 15 bp, Homo sapiens
ccacacccagcccac

SEQ ID NO: 2040866 - DNA, 21 bp, Homo sapiens
ccacacccagcccacttctgc

SEQ ID NO: 2040867 - DNA, 16 bp, Homo sapiens
ccacacccctccaaag

SEQ ID NO: 2040868 - DNA, 18 bp, Homo sapiens
ccacacccggctccccct

SEQ ID NO: 2040869 - DNA, 13 bp, Homo sapiens
ccacaccctcccc

SEQ ID NO: 2040870 - DNA, 14 bp, Homo sapiens
ccacacctaaaact

SEQ ID NO: 2040871 - DNA, 14 bp, Homo sapiens
ccacacctccctac

SEQ ID NO: 2040872 - DNA, 15 bp, Homo sapiens
ccacacctccctact

SEQ ID NO: 2040873 - DNA, 12 bp, Homo sapiens
ccacacctgagc

SEQ ID NO: 2040874 - DNA, 17 bp, Homo sapiens
ccacactattaccatga

SEQ ID NO: 2040875 - DNA, 20 bp, Homo sapiens
ccacacttcaggctcttctc

SEQ ID NO: 2040876 - DNA, 14 bp, Homo sapiens
ccacacttctcagg

SEQ ID NO: 2040877 - DNA, 17 bp, Homo sapiens
ccacacttctcaggaca

SEQ ID NO: 2040878 - DNA, 12 bp, Homo sapiens
ccacacttcttg

SEQ ID NO: 2040879 - DNA, 20 bp, Homo sapiens
ccacagacagatcccatcca

SEQ ID NO: 2040880 - DNA, 19 bp, Homo sapiens
ccacagcacccaggctcca

SEQ ID NO: 2040881 - DNA, 13 bp, Homo sapiens
ccacagcaggtgc

SEQ ID NO: 2040882 - DNA, 19 bp, Homo sapiens
ccacagcattcctccatct

SEQ ID NO: 2040883 - DNA, 17 bp, Homo sapiens
ccacagccaacaaacat

SEQ ID NO: 2040884 - DNA, 16 bp, Homo sapiens
ccacagccccacagca

SEQ ID NO: 2040885 - DNA, 18 bp, Homo sapiens
ccacagcggaggagacca

SEQ ID NO: 2040886 - DNA, 20 bp, Homo sapiens
ccacagcggaggagaccagc

SEQ ID NO: 2040887 - DNA, 19 bp, Homo sapiens
ccacagcggaggagctccg

SEQ ID NO: 2040888 - DNA, 13 bp, Homo sapiens
ccacagctcccac

SEQ ID NO: 2040889 - DNA, 22 bp, Homo sapiens
ccacaggcatctacacagcctg

SEQ ID NO: 2040890 - DNA, 15 bp, Homo sapiens
ccacaggcccttcct

SEQ ID NO: 2040891 - DNA, 16 bp, Homo sapiens
ccacaggcccttcctc

SEQ ID NO: 2040892 - DNA, 18 bp, Homo sapiens
ccacaggcccttcctctc

SEQ ID NO: 2040893 - DNA, 17 bp, Homo sapiens
ccacagggctaagagct

SEQ ID NO: 2040894 - DNA, 16 bp, Homo sapiens
ccacaggggcaggcct

SEQ ID NO: 2040895 - DNA, 14 bp, Homo sapiens
ccacagtctcccat

SEQ ID NO: 2040896 - DNA, 13 bp, Homo sapiens
ccacagtctctgg

SEQ ID NO: 2040897 - DNA, 15 bp, Homo sapiens
ccacagtctctggga

SEQ ID NO: 2040898 - DNA, 19 bp, Homo sapiens
ccacagtgggtggcacctc

SEQ ID NO: 2040899 - DNA, 23 bp, Homo sapiens
ccacagtgggtggcacctcctga

SEQ ID NO: 2040900 - DNA, 21 bp, Homo sapiens
ccacatagtgatggttcccct

SEQ ID NO: 2040901 - DNA, 22 bp, Homo sapiens
ccacatagtgatggttcccctg

SEQ ID NO: 2040902 - DNA, 15 bp, Homo sapiens
ccacatccacacacg

SEQ ID NO: 2040903 - DNA, 20 bp, Homo sapiens
ccacatccacacacgcagga

SEQ ID NO: 2040904 - DNA, 18 bp, Homo sapiens
ccagagtggagtctgagt

SEQ ID NO: 2040905 - DNA, 21 bp, Homo sapiens
ccagagtggagtctgagtctg

SEQ ID NO: 2040906 - DNA, 12 bp, Homo sapiens
ccagagtgtgaa

SEQ ID NO: 2040907 - DNA, 20 bp, Homo sapiens
ccagagtgtgcagactgatg

SEQ ID NO: 2040908 - DNA, 21 bp, Homo sapiens
ccagagtgtgggaagggagag

SEQ ID NO: 2040909 - DNA, 23 bp, Homo sapiens
ccagagttgggatgcggggcaga

SEQ ID NO: 2040910 - DNA, 14 bp, Homo sapiens
ccagataagaatgc

SEQ ID NO: 2040911 - DNA, 21 bp, Homo sapiens
ccagatacttcccattttgga

SEQ ID NO: 2040912 - DNA, 13 bp, Homo sapiens
ccagatcactcaa

SEQ ID NO: 2040913 - DNA, 14 bp, Homo sapiens
ccagatcctcacaa

SEQ ID NO: 2040914 - DNA, 14 bp, Homo sapiens
ccagatctcatgga

SEQ ID NO: 2040915 - DNA, 19 bp, Homo sapiens
ccagatctgcactgggtgt

SEQ ID NO: 2040916 - DNA, 13 bp, Homo sapiens
ccagatctgcctg

SEQ ID NO: 2040917 - DNA, 14 bp, Homo sapiens
ccagatctgcctgg

SEQ ID NO: 2040918 - DNA, 17 bp, Homo sapiens
ccagatctgcctgggcc

SEQ ID NO: 2040919 - DNA, 22 bp, Homo sapiens
ccagatctgcctgggcctgtgc

SEQ ID NO: 2040920 - DNA, 15 bp, Homo sapiens
ccagatgagaagtta

SEQ ID NO: 2040921 - DNA, 13 bp, Homo sapiens
ccagatgcaccag

SEQ ID NO: 2040922 - DNA, 15 bp, Homo sapiens
ccagatgcaccagcc

SEQ ID NO: 2040923 - DNA, 18 bp, Homo sapiens
ccagatgcaccagccctt

SEQ ID NO: 2040924 - DNA, 16 bp, Homo sapiens
ccagatgccttcctgt

SEQ ID NO: 2040925 - DNA, 14 bp, Homo sapiens
ccagattgcaacag

SEQ ID NO: 2040926 - DNA, 21 bp, Homo sapiens
ccagattgcaacaggctgggc

SEQ ID NO: 2040927 - DNA, 22 bp, Homo sapiens
ccagattttttaaaatttatat

SEQ ID NO: 2040928 - DNA, 19 bp, Homo sapiens
ccagcaaaccaggactctg

SEQ ID NO: 2040929 - DNA, 22 bp, Homo sapiens
ccagcaacatctcgagccccct

SEQ ID NO: 2040930 - DNA, 17 bp, Homo sapiens
ccagcaactctgactct

SEQ ID NO: 2040931 - DNA, 18 bp, Homo sapiens
ccagcaagtgagagctgg

SEQ ID NO: 2040932 - DNA, 18 bp, Homo sapiens
ccagcaatgatgtccaga

SEQ ID NO: 2040933 - DNA, 12 bp, Homo sapiens
ccagcacagggg

SEQ ID NO: 2040934 - DNA, 15 bp, Homo sapiens
ccagcacaggggccc

SEQ ID NO: 2040935 - DNA, 12 bp, Homo sapiens
ccagcaccgagc

SEQ ID NO: 2040936 - DNA, 18 bp, Homo sapiens
ccagcactaaagcagtgg

SEQ ID NO: 2040937 - DNA, 12 bp, Homo sapiens
ccagcactaacg

SEQ ID NO: 2040938 - DNA, 20 bp, Homo sapiens
ccagcactaaggccgtgtct

SEQ ID NO: 2040939 - DNA, 16 bp, Homo sapiens
ccagcactcctctgtc

SEQ ID NO: 2040940 - DNA, 17 bp, Homo sapiens
ccagcactgtgaagacc

SEQ ID NO: 2040941 - DNA, 21 bp, Homo sapiens
ccagcactttgggaggccaag

SEQ ID NO: 2040942 - DNA, 14 bp, Homo sapiens
ccagcagaaaagtg

SEQ ID NO: 2040943 - DNA, 16 bp, Homo sapiens
ccagcagaaaagtgct

SEQ ID NO: 2040944 - DNA, 17 bp, Homo sapiens
ccagcagaaaagtgctt

SEQ ID NO: 2040945 - DNA, 14 bp, Homo sapiens
ccagcagaagaggg

SEQ ID NO: 2040946 - DNA, 15 bp, Homo sapiens
ccagcagccagctct

SEQ ID NO: 2040947 - DNA, 18 bp, Homo sapiens
ccagcagccagctctcag

SEQ ID NO: 2040948 - DNA, 20 bp, Homo sapiens
ccagcagccctggcctgtgg

SEQ ID NO: 2040949 - DNA, 19 bp, Homo sapiens
ccagcagcggtaccccagg

SEQ ID NO: 2040950 - DNA, 24 bp, Homo sapiens
ccagcagctgcgggtctgaaggaa

SEQ ID NO: 2040951 - DNA, 23 bp, Homo sapiens
ccagcagctgggccggccagcct

SEQ ID NO: 2040952 - DNA, 22 bp, Homo sapiens
ccagcaggccagggactcagcg

SEQ ID NO: 2040953 - DNA, 15 bp, Homo sapiens
ccagcatccagcctg

SEQ ID NO: 2040954 - DNA, 18 bp, Homo sapiens
ccagcatccagcctgtgt

SEQ ID NO: 2040955 - DNA, 13 bp, Homo sapiens
ccagcatcctgct

SEQ ID NO: 2040956 - DNA, 14 bp, Homo sapiens
ccagcatcctgctt

SEQ ID NO: 2040957 - DNA, 15 bp, Homo sapiens
ccagcatcctgcttc

SEQ ID NO: 2040958 - DNA, 19 bp, Homo sapiens
ccagcatccttttctgcag

SEQ ID NO: 2040959 - DNA, 18 bp, Homo sapiens
ccagcatgtcactcccag

SEQ ID NO: 2040960 - DNA, 14 bp, Homo sapiens
ccagcattttacta

SEQ ID NO: 2040961 - DNA, 17 bp, Homo sapiens
ccagccacacagagcct

SEQ ID NO: 2040962 - DNA, 20 bp, Homo sapiens
ccagccacacagagcctgcc

SEQ ID NO: 2040963 - DNA, 23 bp, Homo sapiens
ccagccacacagagcctgcctca

SEQ ID NO: 2040964 - DNA, 19 bp, Homo sapiens
ccagccacctcccaaggac

SEQ ID NO: 2040965 - DNA, 20 bp, Homo sapiens
ccagccacctcccaaggact

SEQ ID NO: 2040966 - DNA, 15 bp, Homo sapiens
ccagccagaagcctc

SEQ ID NO: 2040967 - DNA, 21 bp, Homo sapiens
ccagccagaagcctctgcctc

SEQ ID NO: 2040968 - DNA, 16 bp, Homo sapiens
ccagccagcgcctccc

SEQ ID NO: 2040969 - DNA, 22 bp, Homo sapiens
ccagccagcgcctccctccacc

SEQ ID NO: 2040970 - DNA, 13 bp, Homo sapiens
ccagccagctcct

SEQ ID NO: 2040971 - DNA, 14 bp, Homo sapiens
ccagccagctcctg

SEQ ID NO: 2040972 - DNA, 20 bp, Homo sapiens
ccagccatcaagagactgag

SEQ ID NO: 2040973 - DNA, 15 bp, Homo sapiens
ccagcccacagagcc

SEQ ID NO: 2040974 - DNA, 17 bp, Homo sapiens
ccagcccacagagcctg

SEQ ID NO: 2040975 - DNA, 17 bp, Homo sapiens
ccagcccacttctgcca

SEQ ID NO: 2040976 - DNA, 18 bp, Homo sapiens
ccagcccagcccagctgg

SEQ ID NO: 2040977 - DNA, 13 bp, Homo sapiens
ccagcccagctgg

SEQ ID NO: 2040978 - DNA, 19 bp, Homo sapiens
ccagcccattctctctcct

SEQ ID NO: 2040979 - DNA, 22 bp, Homo sapiens
ccagcccattctctctcctgtc

SEQ ID NO: 2040980 - DNA, 14 bp, Homo sapiens
ccagccccaggggt

SEQ ID NO: 2040981 - DNA, 22 bp, Homo sapiens
ccagccccctaagagagcacct

SEQ ID NO: 2040982 - DNA, 15 bp, Homo sapiens
ccagccccgactcca

SEQ ID NO: 2040983 - DNA, 16 bp, Homo sapiens
ccagccccgactccag

SEQ ID NO: 2040984 - DNA, 14 bp, Homo sapiens
ccaggatgaaggcg

SEQ ID NO: 2040985 - DNA, 23 bp, Homo sapiens
ccaggatggcccttcccactgga

SEQ ID NO: 2040986 - DNA, 15 bp, Homo sapiens
ccaggattcctctct

SEQ ID NO: 2040987 - DNA, 17 bp, Homo sapiens
ccaggcaccaaaagaag

SEQ ID NO: 2040988 - DNA, 16 bp, Homo sapiens
ccaggcaccccctgga

SEQ ID NO: 2040989 - DNA, 17 bp, Homo sapiens
ccaggcaccccctggag

SEQ ID NO: 2040990 - DNA, 19 bp, Homo sapiens
ccaggcaccccctggagag

SEQ ID NO: 2040991 - DNA, 14 bp, Homo sapiens
ccaggcacccttct

SEQ ID NO: 2040992 - DNA, 12 bp, Homo sapiens
ccaggcacctgg

SEQ ID NO: 2040993 - DNA, 21 bp, Homo sapiens
ccaggcacctggcctgctggg

SEQ ID NO: 2040994 - DNA, 18 bp, Homo sapiens
ccaggcacgaacccacct

SEQ ID NO: 2040995 - DNA, 21 bp, Homo sapiens
ccaggcacgaacccacctgct

SEQ ID NO: 2040996 - DNA, 23 bp, Homo sapiens
ccaggcacgtcccggacctgtgg

SEQ ID NO: 2040997 - DNA, 23 bp, Homo sapiens
ccaggcagagacaataaaacatt

SEQ ID NO: 2040998 - DNA, 18 bp, Homo sapiens
ccaggcaggccctgcctt

SEQ ID NO: 2040999 - DNA, 16 bp, Homo sapiens
ccaggcaggggtggga

SEQ ID NO: 2041000 - DNA, 18 bp, Homo sapiens
ccaggcatgctggcctcc

SEQ ID NO: 2041001 - DNA, 14 bp, Homo sapiens
ccaggccaccagga

SEQ ID NO: 2041002 - DNA, 12 bp, Homo sapiens
ccaggccactgt

SEQ ID NO: 2041003 - DNA, 14 bp, Homo sapiens
ccaggccactgtgg

SEQ ID NO: 2041004 - DNA, 14 bp, Homo sapiens
ccaggccagaggga

SEQ ID NO: 2041005 - DNA, 21 bp, Homo sapiens
ccaggccagagggagtgacag

SEQ ID NO: 2041006 - DNA, 21 bp, Homo sapiens
ccaggcccatctcaggtgcca

SEQ ID NO: 2041007 - DNA, 18 bp, Homo sapiens
ccaggccccatgacctcc

SEQ ID NO: 2041008 - DNA, 23 bp, Homo sapiens
ccaggccccatgacctccagctt

SEQ ID NO: 2041009 - DNA, 16 bp, Homo sapiens
ccaggcccctgaggac

SEQ ID NO: 2041010 - DNA, 18 bp, Homo sapiens
ccaggcccctgaggactg

SEQ ID NO: 2041011 - DNA, 14 bp, Homo sapiens
ccaggcccctgcca

SEQ ID NO: 2041012 - DNA, 16 bp, Homo sapiens
ccaggcccggggctgg

SEQ ID NO: 2041013 - DNA, 21 bp, Homo sapiens
ccaggccctaggattcctccc

SEQ ID NO: 2041014 - DNA, 22 bp, Homo sapiens
ccaggccctaggattcctcccc

SEQ ID NO: 2041015 - DNA, 14 bp, Homo sapiens
ccaggccctccatg

SEQ ID NO: 2041016 - DNA, 19 bp, Homo sapiens
ccaggccctccatgggcta

SEQ ID NO: 2041017 - DNA, 14 bp, Homo sapiens
ccaggccctccctg

SEQ ID NO: 2041018 - DNA, 17 bp, Homo sapiens
ccaggccctccctgact

SEQ ID NO: 2041019 - DNA, 18 bp, Homo sapiens
ccaggccgcctgccatac

SEQ ID NO: 2041020 - DNA, 20 bp, Homo sapiens
ccaggccgggcttgggccct

SEQ ID NO: 2041021 - DNA, 22 bp, Homo sapiens
ccaggccggtgtgggctgtgtc

SEQ ID NO: 2041022 - DNA, 21 bp, Homo sapiens
ccaggccgttccccttggctt

SEQ ID NO: 2041023 - DNA, 13 bp, Homo sapiens
ccaggcctccagc

SEQ ID NO: 2041024 - DNA, 17 bp, Homo sapiens
ccaggcctccagcctct

SEQ ID NO: 2041025 - DNA, 18 bp, Homo sapiens
ccaggcctccagcctctc

SEQ ID NO: 2041026 - DNA, 21 bp, Homo sapiens
ccaggcctccagcctctcccg

SEQ ID NO: 2041027 - DNA, 13 bp, Homo sapiens
ccaggcctctgtg

SEQ ID NO: 2041028 - DNA, 16 bp, Homo sapiens
ccaggcctctgtgtcc

SEQ ID NO: 2041029 - DNA, 17 bp, Homo sapiens
ccaggcctctgtgtcct

SEQ ID NO: 2041030 - DNA, 18 bp, Homo sapiens
ccaggcctctgtgtcctt

SEQ ID NO: 2041031 - DNA, 19 bp, Homo sapiens
ccaggcgccccttccccct

SEQ ID NO: 2041032 - DNA, 17 bp, Homo sapiens
ccaggcgggagatggac

SEQ ID NO: 2041033 - DNA, 16 bp, Homo sapiens
ccaggctagactagga

SEQ ID NO: 2041034 - DNA, 19 bp, Homo sapiens
ccaggctcacaactgtttt

SEQ ID NO: 2041035 - DNA, 13 bp, Homo sapiens
ccaggctccatgg

SEQ ID NO: 2041036 - DNA, 16 bp, Homo sapiens
ccaggctccatgggga

SEQ ID NO: 2041037 - DNA, 15 bp, Homo sapiens
ccaggctctgcctgg

SEQ ID NO: 2041038 - DNA, 22 bp, Homo sapiens
ccaggctctgcctggaggatcc

SEQ ID NO: 2041039 - DNA, 20 bp, Homo sapiens
ccaggctctggagccagaga

SEQ ID NO: 2041040 - DNA, 20 bp, Homo sapiens
ccaggctcttcctggacctg

SEQ ID NO: 2041041 - DNA, 22 bp, Homo sapiens
ccaggctcttcctggacctgag

SEQ ID NO: 2041042 - DNA, 23 bp, Homo sapiens
ccaggctcttcctggacctgagt

SEQ ID NO: 2041043 - DNA, 17 bp, Homo sapiens
ccaggctgagtgagcca

SEQ ID NO: 2041044 - DNA, 13 bp, Homo sapiens
ccaggctgcactg

SEQ ID NO: 2041045 - DNA, 15 bp, Homo sapiens
ccaggctgcactgca

SEQ ID NO: 2041046 - DNA, 21 bp, Homo sapiens
ccaggctgctcttgaattcct

SEQ ID NO: 2041047 - DNA, 17 bp, Homo sapiens
ccaggctggcgtgcagt

SEQ ID NO: 2041048 - DNA, 21 bp, Homo sapiens
ccaggctggtctcgaactcct

SEQ ID NO: 2041049 - DNA, 20 bp, Homo sapiens
ccaggctgtatcccatgagc

SEQ ID NO: 2041050 - DNA, 14 bp, Homo sapiens
ccaggctgtttctt

SEQ ID NO: 2041051 - DNA, 23 bp, Homo sapiens
ccaggcttaaggagaggagaaac

SEQ ID NO: 2041052 - DNA, 22 bp, Homo sapiens
ccaggcttgtcactagcagctg

SEQ ID NO: 2041053 - DNA, 21 bp, Homo sapiens
ccagggaatccgcctgcagag

SEQ ID NO: 2041054 - DNA, 22 bp, Homo sapiens
ccagggaatccgcctgcagagg

SEQ ID NO: 2041055 - DNA, 14 bp, Homo sapiens
ccataccgctgggg

SEQ ID NO: 2041056 - DNA, 20 bp, Homo sapiens
ccataccgctggggaacaga

SEQ ID NO: 2041057 - DNA, 15 bp, Homo sapiens
ccatactcatttcta

SEQ ID NO: 2041058 - DNA, 17 bp, Homo sapiens
ccatacttttgagaggg

SEQ ID NO: 2041059 - DNA, 18 bp, Homo sapiens
ccatacttttgagagggg

SEQ ID NO: 2041060 - DNA, 17 bp, Homo sapiens
ccatagaaacatgacac

SEQ ID NO: 2041061 - DNA, 20 bp, Homo sapiens
ccatagaaacatgacactga

SEQ ID NO: 2041062 - DNA, 21 bp, Homo sapiens
ccatagaaacatgacactgac

SEQ ID NO: 2041063 - DNA, 14 bp, Homo sapiens
ccatagatcttctg

SEQ ID NO: 2041064 - DNA, 18 bp, Homo sapiens
ccatagcaagattgctta

SEQ ID NO: 2041065 - DNA, 15 bp, Homo sapiens
ccatagcgctggctc

SEQ ID NO: 2041066 - DNA, 20 bp, Homo sapiens
ccatagcgctggctcaggaa

SEQ ID NO: 2041067 - DNA, 15 bp, Homo sapiens
ccataggaatcatgt

SEQ ID NO: 2041068 - DNA, 22 bp, Homo sapiens
ccatagttatttacttgaaaga

SEQ ID NO: 2041069 - DNA, 22 bp, Homo sapiens
ccatatcagacctctgatccct

SEQ ID NO: 2041070 - DNA, 14 bp, Homo sapiens
ccatatctccttcc

SEQ ID NO: 2041071 - DNA, 16 bp, Homo sapiens
ccatatggaggcctga

SEQ ID NO: 2041072 - DNA, 17 bp, Homo sapiens
ccatatgtctgcttctg

SEQ ID NO: 2041073 - DNA, 18 bp, Homo sapiens
ccatatgtctgcttctgt

SEQ ID NO: 2041074 - DNA, 22 bp, Homo sapiens
ccatatgtgtgaattctgcaac

SEQ ID NO: 2041075 - DNA, 15 bp, Homo sapiens
ccatattctgttggc

SEQ ID NO: 2041076 - DNA, 22 bp, Homo sapiens
ccatattggcatggatttctgt

SEQ ID NO: 2041077 - DNA, 14 bp, Homo sapiens
ccatatttatagaa

SEQ ID NO: 2041078 - DNA, 12 bp, Homo sapiens
ccatcaaatgct

SEQ ID NO: 2041079 - DNA, 11 bp, Homo sapiens
ccatcaataaa

SEQ ID NO: 2041080 - DNA, 17 bp, Homo sapiens
ccatcaataaagtaccc

SEQ ID NO: 2041081 - DNA, 15 bp, Homo sapiens
ccatcaccctctggg

SEQ ID NO: 2041082 - DNA, 21 bp, Homo sapiens
ccatcaccctctgggcagctg

SEQ ID NO: 2041083 - DNA, 19 bp, Homo sapiens
ccatcacctactcacacag

SEQ ID NO: 2041084 - DNA, 18 bp, Homo sapiens
ccatcactggagcaccag

SEQ ID NO: 2041085 - DNA, 13 bp, Homo sapiens
ccatcagctccct

SEQ ID NO: 2041086 - DNA, 22 bp, Homo sapiens
ccatcagggtgggccactctcc

SEQ ID NO: 2041087 - DNA, 22 bp, Homo sapiens
ccatcaggtcccccccaggtgc

SEQ ID NO: 2041088 - DNA, 20 bp, Homo sapiens
ccatcatatcctttgcccca

SEQ ID NO: 2041089 - DNA, 17 bp, Homo sapiens
ccatcatatgacatgcc

SEQ ID NO: 2041090 - DNA, 18 bp, Homo sapiens
ccatcatatgacatgcca

SEQ ID NO: 2041091 - DNA, 12 bp, Homo sapiens
ccatcatgtctg

SEQ ID NO: 2041092 - DNA, 14 bp, Homo sapiens
ccatcatgtctggc

SEQ ID NO: 2041093 - DNA, 18 bp, Homo sapiens
ccatccaggttcagcttg

SEQ ID NO: 2041094 - DNA, 19 bp, Homo sapiens
ccatccaggttcagcttgt

SEQ ID NO: 2041095 - DNA, 17 bp, Homo sapiens
ccatccatcagctccct

SEQ ID NO: 2041096 - DNA, 23 bp, Homo sapiens
ccatcccacattcggaccctgcc

SEQ ID NO: 2041097 - DNA, 13 bp, Homo sapiens
ccatccccagcga

SEQ ID NO: 2041098 - DNA, 19 bp, Homo sapiens
ccatcccgcccttcccaca

SEQ ID NO: 2041099 - DNA, 18 bp, Homo sapiens
ccatccctcggacccacc

SEQ ID NO: 2041100 - DNA, 16 bp, Homo sapiens
ccatccctgggcccct

SEQ ID NO: 2041101 - DNA, 22 bp, Homo sapiens
ccatcccttcctccccagtcta

SEQ ID NO: 2041102 - DNA, 17 bp, Homo sapiens
ccatccgggacgcttcc

SEQ ID NO: 2041103 - DNA, 19 bp, Homo sapiens
ccatccgggacgcttccag

SEQ ID NO: 2041104 - DNA, 19 bp, Homo sapiens
ccatcctaccaatgcatgc

SEQ ID NO: 2041105 - DNA, 11 bp, Homo sapiens
ccagcctgggc

SEQ ID NO: 2041106 - DNA, 19 bp, Homo sapiens
ccagcctgggcaacagagc

SEQ ID NO: 2041107 - DNA, 14 bp, Homo sapiens
ccagcctgggccta

SEQ ID NO: 2041108 - DNA, 19 bp, Homo sapiens
ccagcctgggcctatggag

SEQ ID NO: 2041109 - DNA, 21 bp, Homo sapiens
ccagcctgggcctatggagag

SEQ ID NO: 2041110 - DNA, 16 bp, Homo sapiens
ccagcctgtcctggta

SEQ ID NO: 2041111 - DNA, 18 bp, Homo sapiens
ccagcctgtgtgttctgt

SEQ ID NO: 2041112 - DNA, 18 bp, Homo sapiens
ccagccttctctctctgg

SEQ ID NO: 2041113 - DNA, 13 bp, Homo sapiens
ccagcgagccctg

SEQ ID NO: 2041114 - DNA, 16 bp, Homo sapiens
ccagcgagccctggtg

SEQ ID NO: 2041115 - DNA, 17 bp, Homo sapiens
ccagcgagggcgtgtct

SEQ ID NO: 2041116 - DNA, 13 bp, Homo sapiens
ccagcgcctccct

SEQ ID NO: 2041117 - DNA, 16 bp, Homo sapiens
ccagcgcctccctcca

SEQ ID NO: 2041118 - DNA, 17 bp, Homo sapiens
ccagcgcctccctccac

SEQ ID NO: 2041119 - DNA, 22 bp, Homo sapiens
ccagcgcctgccctccctgggg

SEQ ID NO: 2041120 - DNA, 15 bp, Homo sapiens
ccagcgcctgtgctg

SEQ ID NO: 2041121 - DNA, 12 bp, Homo sapiens
ccagcgcggctt

SEQ ID NO: 2041122 - DNA, 19 bp, Homo sapiens
ccagcgcggcttggccgcc

SEQ ID NO: 2041123 - DNA, 23 bp, Homo sapiens
ccagcgtttagtttctagaggcc

SEQ ID NO: 2041124 - DNA, 14 bp, Homo sapiens
ccagctaactccag

SEQ ID NO: 2041125 - DNA, 20 bp, Homo sapiens
ccagctaatctgtagggctg

SEQ ID NO: 2041126 - DNA, 23 bp, Homo sapiens
ccagctaatctgtagggctggac

SEQ ID NO: 2041127 - DNA, 19 bp, Homo sapiens
ccagctacattcctcagct

SEQ ID NO: 2041128 - DNA, 21 bp, Homo sapiens
ccagctacattcctcagctgc

SEQ ID NO: 2041129 - DNA, 23 bp, Homo sapiens
ccagctacattcctcagctgcca

SEQ ID NO: 2041130 - DNA, 16 bp, Homo sapiens
ccagctactcagaagc

SEQ ID NO: 2041131 - DNA, 21 bp, Homo sapiens
ccagctactcagaagcctgag

SEQ ID NO: 2041132 - DNA, 23 bp, Homo sapiens
ccagctactcagaagcctgaggc

SEQ ID NO: 2041133 - DNA, 13 bp, Homo sapiens
ccagctactcagg

SEQ ID NO: 2041134 - DNA, 16 bp, Homo sapiens
ccagctactctgtcca

SEQ ID NO: 2041135 - DNA, 18 bp, Homo sapiens
ccagctactctgtccagg

SEQ ID NO: 2041136 - DNA, 19 bp, Homo sapiens
ccagctactctgtccaggc

SEQ ID NO: 2041137 - DNA, 16 bp, Homo sapiens
ccagctagggctggac

SEQ ID NO: 2041138 - DNA, 18 bp, Homo sapiens
ccagctagtgacccacat

SEQ ID NO: 2041139 - DNA, 21 bp, Homo sapiens
ccagctagtgacccacatgcc

SEQ ID NO: 2041140 - DNA, 22 bp, Homo sapiens
ccagctcaccagccccagtgcc

SEQ ID NO: 2041141 - DNA, 15 bp, Homo sapiens
ccagctcactccctg

SEQ ID NO: 2041142 - DNA, 22 bp, Homo sapiens
ccagctcagaggcccaggaatc

SEQ ID NO: 2041143 - DNA, 17 bp, Homo sapiens
ccagctcccttcttccc

SEQ ID NO: 2041144 - DNA, 15 bp, Homo sapiens
ccagctctcagccaa

SEQ ID NO: 2041145 - DNA, 12 bp, Homo sapiens
ccagctctggct

SEQ ID NO: 2041146 - DNA, 14 bp, Homo sapiens
ccagctctggcttc

SEQ ID NO: 2041147 - DNA, 17 bp, Homo sapiens
ccagctctgtggcctgt

SEQ ID NO: 2041148 - DNA, 22 bp, Homo sapiens
ccagctctgtggcctgtgtcca

SEQ ID NO: 2041149 - DNA, 14 bp, Homo sapiens
ccagctgaggctgg

SEQ ID NO: 2041150 - DNA, 23 bp, Homo sapiens
ccagctgcaggaatcaaaaattg

SEQ ID NO: 2041151 - DNA, 20 bp, Homo sapiens
ccagctgccgaccagagccc

SEQ ID NO: 2041152 - DNA, 12 bp, Homo sapiens
ccagctgcctgg

SEQ ID NO: 2041153 - DNA, 14 bp, Homo sapiens
ccagctgccttcct

SEQ ID NO: 2041154 - DNA, 9 bp, Homo sapiens
ccagctgct

SEQ ID NO: 2041155 - DNA, 14 bp, Homo sapiens
ccagctgctctgcc

SEQ ID NO: 2041156 - DNA, 16 bp, Homo sapiens
ccagctgctctgcccc

SEQ ID NO: 2041157 - DNA, 21 bp, Homo sapiens
ccagctgctctgccccttggg

SEQ ID NO: 2041158 - DNA, 22 bp, Homo sapiens
ccagctgctctgccccttgggc

SEQ ID NO: 2041159 - DNA, 15 bp, Homo sapiens
ccagctgctgctctg

SEQ ID NO: 2041160 - DNA, 16 bp, Homo sapiens
ccagctgctgctctga

SEQ ID NO: 2041161 - DNA, 19 bp, Homo sapiens
ccagctggaattgctgctc

SEQ ID NO: 2041162 - DNA, 17 bp, Homo sapiens
ccagctggcctctagaa

SEQ ID NO: 2041163 - DNA, 21 bp, Homo sapiens
ccagctggtgctgcaaggaag

SEQ ID NO: 2041164 - DNA, 13 bp, Homo sapiens
ccagctgtctgtg

SEQ ID NO: 2041165 - DNA, 22 bp, Homo sapiens
ccagctgtctgtgtcagcctgt

SEQ ID NO: 2041166 - DNA, 18 bp, Homo sapiens
ccagctgtgctctggaca

SEQ ID NO: 2041167 - DNA, 22 bp, Homo sapiens
ccagctgtgctctggacaggca

SEQ ID NO: 2041168 - DNA, 23 bp, Homo sapiens
ccagctgtgctctggacaggcat

SEQ ID NO: 2041169 - DNA, 15 bp, Homo sapiens
ccagcttcctggtgt

SEQ ID NO: 2041170 - DNA, 14 bp, Homo sapiens
ccagcttcctgtgg

SEQ ID NO: 2041171 - DNA, 22 bp, Homo sapiens
ccagcttcctgtgggccaggag

SEQ ID NO: 2041172 - DNA, 15 bp, Homo sapiens
ccagcttctccaggc

SEQ ID NO: 2041173 - DNA, 14 bp, Homo sapiens
ccagcttgctcttc

SEQ ID NO: 2041174 - DNA, 18 bp, Homo sapiens
ccagctttatctgtcaca

SEQ ID NO: 2041175 - DNA, 12 bp, Homo sapiens
ccagctttcctg

SEQ ID NO: 2041176 - DNA, 16 bp, Homo sapiens
ccaggaaaactgtttt

SEQ ID NO: 2041177 - DNA, 23 bp, Homo sapiens
ccaggaaactctgcattctagta

SEQ ID NO: 2041178 - DNA, 14 bp, Homo sapiens
ccaggaactgggcc

SEQ ID NO: 2041179 - DNA, 14 bp, Homo sapiens
ccaggaaggcagct

SEQ ID NO: 2041180 - DNA, 15 bp, Homo sapiens
ccattgtcttccaac

SEQ ID NO: 2041181 - DNA, 23 bp, Homo sapiens
ccattgtcttccaaccccagctg

SEQ ID NO: 2041182 - DNA, 23 bp, Homo sapiens
ccatttaattcataattagaaca

SEQ ID NO: 2041183 - DNA, 21 bp, Homo sapiens
ccatttaggtttctgagttcc

SEQ ID NO: 2041184 - DNA, 19 bp, Homo sapiens
ccatttagttctttgttat

SEQ ID NO: 2041185 - DNA, 15 bp, Homo sapiens
ccatttcaactccag

SEQ ID NO: 2041186 - DNA, 16 bp, Homo sapiens
ccatttcaactccaga

SEQ ID NO: 2041187 - DNA, 13 bp, Homo sapiens
ccatttcagagag

SEQ ID NO: 2041188 - DNA, 16 bp, Homo sapiens
ccatttcatctatttc

SEQ ID NO: 2041189 - DNA, 20 bp, Homo sapiens
ccatttcattgagggaaaac

SEQ ID NO: 2041190 - DNA, 13 bp, Homo sapiens
ccatttcctgaga

SEQ ID NO: 2041191 - DNA, 13 bp, Homo sapiens
ccatttccttgga

SEQ ID NO: 2041192 - DNA, 13 bp, Homo sapiens
ccatttctattta

SEQ ID NO: 2041193 - DNA, 13 bp, Homo sapiens
ccatttctctgct

SEQ ID NO: 2041194 - DNA, 13 bp, Homo sapiens
ccatttcttcctc

SEQ ID NO: 2041195 - DNA, 12 bp, Homo sapiens
ccatttgtaatg

SEQ ID NO: 2041196 - DNA, 13 bp, Homo sapiens
ccatttgtactga

SEQ ID NO: 2041197 - DNA, 16 bp, Homo sapiens
ccatttgtattaccat

SEQ ID NO: 2041198 - DNA, 21 bp, Homo sapiens
ccattttatctttgaatggtc

SEQ ID NO: 2041199 - DNA, 16 bp, Homo sapiens
ccattttgaggccaga

SEQ ID NO: 2041200 - DNA, 20 bp, Homo sapiens
ccatttttactaaagcagtg

SEQ ID NO: 2041201 - DNA, 21 bp, Homo sapiens
ccatttttgagccaagcttca

SEQ ID NO: 2041202 - DNA, 22 bp, Homo sapiens
cccaaaacctttccccagacac

SEQ ID NO: 2041203 - DNA, 22 bp, Homo sapiens
cccaaaagtcaaaaggtgcctg

SEQ ID NO: 2041204 - DNA, 23 bp, Homo sapiens
cccaaaagtcaaaaggtgcctgt

SEQ ID NO: 2041205 - DNA, 12 bp, Homo sapiens
cccaaaccaggg

SEQ ID NO: 2041206 - DNA, 17 bp, Homo sapiens
cccaaacccatcagaca

SEQ ID NO: 2041207 - DNA, 20 bp, Homo sapiens
cccaaactgtgccctgcctt

SEQ ID NO: 2041208 - DNA, 22 bp, Homo sapiens
cccaaactgttcaagaaataat

SEQ ID NO: 2041209 - DNA, 18 bp, Homo sapiens
cccaaagagcctggagaa

SEQ ID NO: 2041210 - DNA, 19 bp, Homo sapiens
cccaaagagcctggagaag

SEQ ID NO: 2041211 - DNA, 17 bp, Homo sapiens
cccaaagcccagctctt

SEQ ID NO: 2041212 - DNA, 15 bp, Homo sapiens
cccaaagctcagact

SEQ ID NO: 2041213 - DNA, 14 bp, Homo sapiens
cccaaataaatgtg

SEQ ID NO: 2041214 - DNA, 14 bp, Homo sapiens
cccaacccccaccg

SEQ ID NO: 2041215 - DNA, 20 bp, Homo sapiens
cccaaccccgcggtgctctg

SEQ ID NO: 2041216 - DNA, 13 bp, Homo sapiens
cccaacccgtgga

SEQ ID NO: 2041217 - DNA, 20 bp, Homo sapiens
cccaacctcaatgccctgcc

SEQ ID NO: 2041218 - DNA, 21 bp, Homo sapiens
cccaacctcaatgccctgcca

SEQ ID NO: 2041219 - DNA, 16 bp, Homo sapiens
cccaacctcctgacct

SEQ ID NO: 2041220 - DNA, 16 bp, Homo sapiens
cccaacctttccctca

SEQ ID NO: 2041221 - DNA, 20 bp, Homo sapiens
cccaacctttccctcacccc

SEQ ID NO: 2041222 - DNA, 19 bp, Homo sapiens
cccaactattaaagtgcca

SEQ ID NO: 2041223 - DNA, 12 bp, Homo sapiens
cccaactcctgg

SEQ ID NO: 2041224 - DNA, 16 bp, Homo sapiens
cccaactccttccagc

SEQ ID NO: 2041225 - DNA, 15 bp, Homo sapiens
cccaactgctctgcc

SEQ ID NO: 2041226 - DNA, 17 bp, Homo sapiens
cccaactgctctgccca

SEQ ID NO: 2041227 - DNA, 21 bp, Homo sapiens
cccaagaatagatgctgactg

SEQ ID NO: 2041228 - DNA, 22 bp, Homo sapiens
cccaagagcatcatgcctctga

SEQ ID NO: 2041229 - DNA, 18 bp, Homo sapiens
cccaagaggactgagact

SEQ ID NO: 2041230 - DNA, 17 bp, Homo sapiens
cccaagaggtctgagcc

SEQ ID NO: 2041231 - DNA, 22 bp, Homo sapiens
cccaagaggtctgagccctggt

SEQ ID NO: 2041232 - DNA, 12 bp, Homo sapiens
cccaagcagccg

SEQ ID NO: 2041233 - DNA, 18 bp, Homo sapiens
cccaagcctctgccccaa

SEQ ID NO: 2041234 - DNA, 22 bp, Homo sapiens
cccaagcctctgccccaagggg

SEQ ID NO: 2041235 - DNA, 13 bp, Homo sapiens
cccaagctctgct

SEQ ID NO: 2041236 - DNA, 14 bp, Homo sapiens
cccaagctctgctc

SEQ ID NO: 2041237 - DNA, 23 bp, Homo sapiens
cccaagctttgaatacccccaga

SEQ ID NO: 2041238 - DNA, 17 bp, Homo sapiens
cccaaggaacaagagaa

SEQ ID NO: 2041239 - DNA, 22 bp, Homo sapiens
cccaaggagctgatttccaggc

SEQ ID NO: 2041240 - DNA, 12 bp, Homo sapiens
cccaataaaagt

SEQ ID NO: 2041241 - DNA, 19 bp, Homo sapiens
cccaccgggccactccttc

SEQ ID NO: 2041242 - DNA, 18 bp, Homo sapiens
cccacctcatgcctggcc

SEQ ID NO: 2041243 - DNA, 20 bp, Homo sapiens
cccacctcatgcctggcccc

SEQ ID NO: 2041244 - DNA, 14 bp, Homo sapiens
cccacctccacccc

SEQ ID NO: 2041245 - DNA, 16 bp, Homo sapiens
cccacctcttccttcc

SEQ ID NO: 2041246 - DNA, 17 bp, Homo sapiens
cccacctgacaatggca

SEQ ID NO: 2041247 - DNA, 12 bp, Homo sapiens
cccacctgctga

SEQ ID NO: 2041248 - DNA, 21 bp, Homo sapiens
cccaccttcaattcctgggcc

SEQ ID NO: 2041249 - DNA, 13 bp, Homo sapiens
cccaccttcccca

SEQ ID NO: 2041250 - DNA, 16 bp, Homo sapiens
cccaccttgccaagct

SEQ ID NO: 2041251 - DNA, 20 bp, Homo sapiens
cccaccttgccaagctttct

SEQ ID NO: 2041252 - DNA, 22 bp, Homo sapiens
cccaccttggctcaagtcctct

SEQ ID NO: 2041253 - DNA, 17 bp, Homo sapiens
cccaccttggctgcagg

SEQ ID NO: 2041254 - DNA, 20 bp, Homo sapiens
cccacctttaagtcctctct

SEQ ID NO: 2041255 - DNA, 21 bp, Homo sapiens
cccacctttgggatcagcctc

SEQ ID NO: 2041256 - DNA, 19 bp, Homo sapiens
cccacgagtcacctgcaag

SEQ ID NO: 2041257 - DNA, 22 bp, Homo sapiens
cccacgagtcacctgcaagccc

SEQ ID NO: 2041258 - DNA, 20 bp, Homo sapiens
cccacgctggagtgcagtga

SEQ ID NO: 2041259 - DNA, 18 bp, Homo sapiens
cccacgtgagagaatctg

SEQ ID NO: 2041260 - DNA, 20 bp, Homo sapiens
cccacgtgagagaatctgcc

SEQ ID NO: 2041261 - DNA, 16 bp, Homo sapiens
cccactaagctttctc

SEQ ID NO: 2041262 - DNA, 19 bp, Homo sapiens
cccactaagctttctcctt

SEQ ID NO: 2041263 - DNA, 17 bp, Homo sapiens
cccactacgtgccaggc

SEQ ID NO: 2041264 - DNA, 14 bp, Homo sapiens
cccactccagccct

SEQ ID NO: 2041265 - DNA, 16 bp, Homo sapiens
cccactcccaggacca

SEQ ID NO: 2041266 - DNA, 19 bp, Homo sapiens
cccactcctcactgcccca

SEQ ID NO: 2041267 - DNA, 23 bp, Homo sapiens
cccactcctcactgccccaccag

SEQ ID NO: 2041268 - DNA, 21 bp, Homo sapiens
cccactctaggggtcaggctc

SEQ ID NO: 2041269 - DNA, 13 bp, Homo sapiens
cccactctcattc

SEQ ID NO: 2041270 - DNA, 21 bp, Homo sapiens
cccactctcattccccaggtg

SEQ ID NO: 2041271 - DNA, 16 bp, Homo sapiens
cccactctgctctgat

SEQ ID NO: 2041272 - DNA, 18 bp, Homo sapiens
cccactctgctctgatgc

SEQ ID NO: 2041273 - DNA, 23 bp, Homo sapiens
cccactgcaggccccgcttgtcc

SEQ ID NO: 2041274 - DNA, 12 bp, Homo sapiens
cccactgctctg

SEQ ID NO: 2041275 - DNA, 22 bp, Homo sapiens
cccactgcttttggtctgtgtg

SEQ ID NO: 2041276 - DNA, 23 bp, Homo sapiens
cccactgcttttggtctgtgtga

SEQ ID NO: 2041277 - DNA, 16 bp, Homo sapiens
cccacttcagcccagc

SEQ ID NO: 2041278 - DNA, 18 bp, Homo sapiens
cccacttctctccaggct

SEQ ID NO: 2041279 - DNA, 13 bp, Homo sapiens
cccacttgggagc

SEQ ID NO: 2041280 - DNA, 15 bp, Homo sapiens
cccacttgtcatcca

SEQ ID NO: 2041281 - DNA, 20 bp, Homo sapiens
cccagaaaaaaaaaaactta

SEQ ID NO: 2041282 - DNA, 16 bp, Homo sapiens
cccagaaaacctccag

SEQ ID NO: 2041283 - DNA, 17 bp, Homo sapiens
cccagaaaacctccagt

SEQ ID NO: 2041284 - DNA, 19 bp, Homo sapiens
cccagaaattccttcccac

SEQ ID NO: 2041285 - DNA, 12 bp, Homo sapiens
cccagaagggag

SEQ ID NO: 2041286 - DNA, 21 bp, Homo sapiens
cccagaattcccagctgtctg

SEQ ID NO: 2041287 - DNA, 20 bp, Homo sapiens
cccagacacatcgcactgtg

SEQ ID NO: 2041288 - DNA, 13 bp, Homo sapiens
cccagagacagga

SEQ ID NO: 2041289 - DNA, 15 bp, Homo sapiens
cccagagacaggaaa

SEQ ID NO: 2041290 - DNA, 17 bp, Homo sapiens
cccagagacaggaaaat

SEQ ID NO: 2041291 - DNA, 12 bp, Homo sapiens
cccagagacctt

SEQ ID NO: 2041292 - DNA, 15 bp, Homo sapiens
cccagagaggaatca

SEQ ID NO: 2041293 - DNA, 23 bp, Homo sapiens
cccagagaggggacatttccctc

SEQ ID NO: 2041294 - DNA, 14 bp, Homo sapiens
cccagagatgcctc

SEQ ID NO: 2041295 - DNA, 13 bp, Homo sapiens
cccatttccttgg

SEQ ID NO: 2041296 - DNA, 16 bp, Homo sapiens
cccatttctatttatt

SEQ ID NO: 2041297 - DNA, 18 bp, Homo sapiens
cccatttgtaatgtatct

SEQ ID NO: 2041298 - DNA, 18 bp, Homo sapiens
cccattttgagtgactcg

SEQ ID NO: 2041299 - DNA, 16 bp, Homo sapiens
cccatttttgagccaa

SEQ ID NO: 2041300 - DNA, 22 bp, Homo sapiens
cccatttttgagccaagcttca

SEQ ID NO: 2041301 - DNA, 23 bp, Homo sapiens
ccccaaacattaatcaccaaagt

SEQ ID NO: 2041302 - DNA, 14 bp, Homo sapiens
ccccaaagagcctg

SEQ ID NO: 2041303 - DNA, 12 bp, Homo sapiens
ccccaaatatag

SEQ ID NO: 2041304 - DNA, 20 bp, Homo sapiens
ccccaacccgtggaggctgc

SEQ ID NO: 2041305 - DNA, 19 bp, Homo sapiens
ccccaactattaaagtgcc

SEQ ID NO: 2041306 - DNA, 13 bp, Homo sapiens
ccccaactcctgg

SEQ ID NO: 2041307 - DNA, 22 bp, Homo sapiens
ccccaactccttccagctagtg

SEQ ID NO: 2041308 - DNA, 20 bp, Homo sapiens
ccccaagcagcattcagcac

SEQ ID NO: 2041309 - DNA, 14 bp, Homo sapiens
ccccaagctgtttt

SEQ ID NO: 2041310 - DNA, 16 bp, Homo sapiens
ccccaaggggcccaca

SEQ ID NO: 2041311 - DNA, 22 bp, Homo sapiens
ccccaagtccacctgcctatcc

SEQ ID NO: 2041312 - DNA, 21 bp, Homo sapiens
ccccacacgtgctcgcagcct

SEQ ID NO: 2041313 - DNA, 22 bp, Homo sapiens
ccccacaggccccccgcagcac

SEQ ID NO: 2041314 - DNA, 20 bp, Homo sapiens
ccccacatttacctcgaggc

SEQ ID NO: 2041315 - DNA, 23 bp, Homo sapiens
ccccaccacgatgtggccctggc

SEQ ID NO: 2041316 - DNA, 22 bp, Homo sapiens
ccccaccctcaaaccctgtggg

SEQ ID NO: 2041317 - DNA, 18 bp, Homo sapiens
ccccaccgaagagccctg

SEQ ID NO: 2041318 - DNA, 19 bp, Homo sapiens
ccccaccgaagagccctga

SEQ ID NO: 2041319 - DNA, 22 bp, Homo sapiens
ccccacctccgccccagacaca

SEQ ID NO: 2041320 - DNA, 23 bp, Homo sapiens
ccccacctgacaatggcagctag

SEQ ID NO: 2041321 - DNA, 14 bp, Homo sapiens
ccccacctggctca

SEQ ID NO: 2041322 - DNA, 16 bp, Homo sapiens
ccccaccttccccaga

SEQ ID NO: 2041323 - DNA, 14 bp, Homo sapiens
ccccaccttgccaa

SEQ ID NO: 2041324 - DNA, 19 bp, Homo sapiens
ccccaccttgccaagcttt

SEQ ID NO: 2041325 - DNA, 21 bp, Homo sapiens
ccccacctttaagtcctctct

SEQ ID NO: 2041326 - DNA, 18 bp, Homo sapiens
ccccactcaccagtgtcc

SEQ ID NO: 2041327 - DNA, 23 bp, Homo sapiens
ccccactccctggctctcagaag

SEQ ID NO: 2041328 - DNA, 12 bp, Homo sapiens
ccccactctgct

SEQ ID NO: 2041329 - DNA, 13 bp, Homo sapiens
ccccactctgctc

SEQ ID NO: 2041330 - DNA, 14 bp, Homo sapiens
ccccactgccacac

SEQ ID NO: 2041331 - DNA, 21 bp, Homo sapiens
ccccagacacaccccccagtc

SEQ ID NO: 2041332 - DNA, 12 bp, Homo sapiens
ccccagacacat

SEQ ID NO: 2041333 - DNA, 21 bp, Homo sapiens
ccccagacacattctcctgtg

SEQ ID NO: 2041334 - DNA, 17 bp, Homo sapiens
ccccagactcagctcca

SEQ ID NO: 2041335 - DNA, 19 bp, Homo sapiens
ccccagactcagctccaga

SEQ ID NO: 2041336 - DNA, 21 bp, Homo sapiens
ccccagagaccttttctctcc

SEQ ID NO: 2041337 - DNA, 23 bp, Homo sapiens
ccccagagaccttttctctccca

SEQ ID NO: 2041338 - DNA, 22 bp, Homo sapiens
ccccagagccactacctttgtc

SEQ ID NO: 2041339 - DNA, 22 bp, Homo sapiens
ccccagagtgtgggaagggaga

SEQ ID NO: 2041340 - DNA, 11 bp, Homo sapiens
ccccagagttg

SEQ ID NO: 2041341 - DNA, 16 bp, Homo sapiens
ccccagatctgcctgg

SEQ ID NO: 2041342 - DNA, 18 bp, Homo sapiens
ccccagatctgcctgggc

SEQ ID NO: 2041343 - DNA, 20 bp, Homo sapiens
ccccagatctgcctgggcct

SEQ ID NO: 2041344 - DNA, 21 bp, Homo sapiens
ccccagatctgcctgggcctg

SEQ ID NO: 2041345 - DNA, 24 bp, Homo sapiens
ccccagatctgcctgggcctgtgc

SEQ ID NO: 2041346 - DNA, 15 bp, Homo sapiens
ccccagattgcaaca

SEQ ID NO: 2041347 - DNA, 20 bp, Homo sapiens
ccccagcaagtgagagctgg

SEQ ID NO: 2041348 - DNA, 22 bp, Homo sapiens
ccccagcaagtgagagctgggt

SEQ ID NO: 2041349 - DNA, 19 bp, Homo sapiens
ccccagcactcctctgtct

SEQ ID NO: 2041350 - DNA, 19 bp, Homo sapiens
ccccagccatggtgaggaa

SEQ ID NO: 2041351 - DNA, 18 bp, Homo sapiens
ccccagcccacagagcct

SEQ ID NO: 2041352 - DNA, 16 bp, Homo sapiens
ccccagccccctaaga

SEQ ID NO: 2041353 - DNA, 17 bp, Homo sapiens
ccccagccccgactcca

SEQ ID NO: 2041354 - DNA, 19 bp, Homo sapiens
ccccagccctcaggccagt

SEQ ID NO: 2041355 - DNA, 19 bp, Homo sapiens
ccccagccctggctctgca

SEQ ID NO: 2041356 - DNA, 14 bp, Homo sapiens
ccccagcccttctg

SEQ ID NO: 2041357 - DNA, 15 bp, Homo sapiens
ccccagcccttctgc

SEQ ID NO: 2041358 - DNA, 16 bp, Homo sapiens
ccccagcccttctgcc

SEQ ID NO: 2041359 - DNA, 15 bp, Homo sapiens
ccccagcctgacaaa

SEQ ID NO: 2041360 - DNA, 12 bp, Homo sapiens
ccccagcctggg

SEQ ID NO: 2041361 - DNA, 16 bp, Homo sapiens
ccccagcctgggccta

SEQ ID NO: 2041362 - DNA, 20 bp, Homo sapiens
ccccagcctgggcctatgga

SEQ ID NO: 2041363 - DNA, 15 bp, Homo sapiens
ccccagctccccagg

SEQ ID NO: 2041364 - DNA, 15 bp, Homo sapiens
ccccagctggcctct

SEQ ID NO: 2041365 - DNA, 11 bp, Homo sapiens
ccccagctggt

SEQ ID NO: 2041366 - DNA, 19 bp, Homo sapiens
ccctctgggcagctgtcat

SEQ ID NO: 2041367 - DNA, 21 bp, Homo sapiens
ccctctgtcatcactccctgg

SEQ ID NO: 2041368 - DNA, 22 bp, Homo sapiens
ccctctgtcatcactccctgga

SEQ ID NO: 2041369 - DNA, 23 bp, Homo sapiens
ccctctttctttcttttgtgttg

SEQ ID NO: 2041370 - DNA, 14 bp, Homo sapiens
ccctcttttggcct

SEQ ID NO: 2041371 - DNA, 17 bp, Homo sapiens
ccctgaaaacccagaga

SEQ ID NO: 2041372 - DNA, 14 bp, Homo sapiens
ccctgaacaagaat

SEQ ID NO: 2041373 - DNA, 17 bp, Homo sapiens
ccctgaacatctgtgtg

SEQ ID NO: 2041374 - DNA, 18 bp, Homo sapiens
ccctgaacatctgtgtgt

SEQ ID NO: 2041375 - DNA, 15 bp, Homo sapiens
ccctgaacctcagtt

SEQ ID NO: 2041376 - DNA, 16 bp, Homo sapiens
ccctgaacctcagttt

SEQ ID NO: 2041377 - DNA, 17 bp, Homo sapiens
ccctgaacctcagtttc

SEQ ID NO: 2041378 - DNA, 17 bp, Homo sapiens
ccctgaagatttcagag

SEQ ID NO: 2041379 - DNA, 17 bp, Homo sapiens
ccctgaaggttcctgag

SEQ ID NO: 2041380 - DNA, 20 bp, Homo sapiens
ccctgaatggttccatgcct

SEQ ID NO: 2041381 - DNA, 16 bp, Homo sapiens
ccctgacctcccagcc

SEQ ID NO: 2041382 - DNA, 17 bp, Homo sapiens
ccctgacctcccagccc

SEQ ID NO: 2041383 - DNA, 18 bp, Homo sapiens
ccctgactccctgtgggg

SEQ ID NO: 2041384 - DNA, 19 bp, Homo sapiens
ccctgagactccagaatct

SEQ ID NO: 2041385 - DNA, 13 bp, Homo sapiens
ccctgagctcagg

SEQ ID NO: 2041386 - DNA, 17 bp, Homo sapiens
ccctgagctcaggctga

SEQ ID NO: 2041387 - DNA, 21 bp, Homo sapiens
ccctgagctcaggctgagccc

SEQ ID NO: 2041388 - DNA, 23 bp, Homo sapiens
ccctgagctcaggctgagcccag

SEQ ID NO: 2041389 - DNA, 17 bp, Homo sapiens
ccctgaggggtccctga

SEQ ID NO: 2041390 - DNA, 15 bp, Homo sapiens
ccctgaggtcacctg

SEQ ID NO: 2041391 - DNA, 17 bp, Homo sapiens
ccctgcacttcagacac

SEQ ID NO: 2041392 - DNA, 12 bp, Homo sapiens
ccctgcacttgc

SEQ ID NO: 2041393 - DNA, 17 bp, Homo sapiens
ccctgcagagcacacag

SEQ ID NO: 2041394 - DNA, 14 bp, Homo sapiens
ccctgtgacaaaat

SEQ ID NO: 2041395 - DNA, 18 bp, Homo sapiens
ccctgtgactatggctct

SEQ ID NO: 2041396 - DNA, 12 bp, Homo sapiens
ccctgtgccagc

SEQ ID NO: 2041397 - DNA, 16 bp, Homo sapiens
ccctgtgccagctcag

SEQ ID NO: 2041398 - DNA, 21 bp, Homo sapiens
ccctgtggcagaccgggggcc

SEQ ID NO: 2041399 - DNA, 15 bp, Homo sapiens
ccctgtggggcctga

SEQ ID NO: 2041400 - DNA, 12 bp, Homo sapiens
ccctgtgggggt

SEQ ID NO: 2041401 - DNA, 24 bp, Homo sapiens
ccctgtgggggtggccatccctgg

SEQ ID NO: 2041402 - DNA, 13 bp, Homo sapiens
ccctgttcactct

SEQ ID NO: 2041403 - DNA, 22 bp, Homo sapiens
ccctgttcactctacttagcat

SEQ ID NO: 2041404 - DNA, 22 bp, Homo sapiens
cccttactatgatctcaggagc

SEQ ID NO: 2041405 - DNA, 21 bp, Homo sapiens
cccttagagattgccccagag

SEQ ID NO: 2041406 - DNA, 14 bp, Homo sapiens
cccttagctctccc

SEQ ID NO: 2041407 - DNA, 19 bp, Homo sapiens
cccttaggcattatttaat

SEQ ID NO: 2041408 - DNA, 13 bp, Homo sapiens
cccttatccagga

SEQ ID NO: 2041409 - DNA, 14 bp, Homo sapiens
cccttatccaggac

SEQ ID NO: 2041410 - DNA, 16 bp, Homo sapiens
cccttatccaggactc

SEQ ID NO: 2041411 - DNA, 21 bp, Homo sapiens
cccttcacctttggtgcagag

SEQ ID NO: 2041412 - DNA, 13 bp, Homo sapiens
cccttcagggcca

SEQ ID NO: 2041413 - DNA, 14 bp, Homo sapiens
cccttcagggccag

SEQ ID NO: 2041414 - DNA, 17 bp, Homo sapiens
cccttcagtgcccacca

SEQ ID NO: 2041415 - DNA, 11 bp, Homo sapiens
cccttccagtg

SEQ ID NO: 2041416 - DNA, 24 bp, Homo sapiens
cccttccagtggtaccagctcact

SEQ ID NO: 2041417 - DNA, 22 bp, Homo sapiens
cccttccccaagaaggtgagtg

SEQ ID NO: 2041418 - DNA, 13 bp, Homo sapiens
cccttcctctcca

SEQ ID NO: 2041419 - DNA, 20 bp, Homo sapiens
cccttcctctccactgcctt

SEQ ID NO: 2041420 - DNA, 13 bp, Homo sapiens
cccttcctgcacc

SEQ ID NO: 2041421 - DNA, 14 bp, Homo sapiens
cccttcctgcaccc

SEQ ID NO: 2041422 - DNA, 14 bp, Homo sapiens
cccttcctggacag

SEQ ID NO: 2041423 - DNA, 16 bp, Homo sapiens
cccttcctggacagct

SEQ ID NO: 2041424 - DNA, 17 bp, Homo sapiens
cccttcctggacagctg

SEQ ID NO: 2041425 - DNA, 22 bp, Homo sapiens
cccttcctggacagctgtgcct

SEQ ID NO: 2041426 - DNA, 23 bp, Homo sapiens
cccttcctggacagctgtgcctc

SEQ ID NO: 2041427 - DNA, 13 bp, Homo sapiens
cccttcctggcct

SEQ ID NO: 2041428 - DNA, 15 bp, Homo sapiens
cccttcctggcctca

SEQ ID NO: 2041429 - DNA, 16 bp, Homo sapiens
cccttcctttcctctg

SEQ ID NO: 2041430 - DNA, 22 bp, Homo sapiens
cccttcgaggttgccccttccc

SEQ ID NO: 2041431 - DNA, 13 bp, Homo sapiens
cccttcgctcctg

SEQ ID NO: 2041432 - DNA, 15 bp, Homo sapiens
cccttcgctcctgtg

SEQ ID NO: 2041433 - DNA, 21 bp, Homo sapiens
cccttcgctgccaggacacct

SEQ ID NO: 2041434 - DNA, 23 bp, Homo sapiens
cccttctcattccaacagtgagt

SEQ ID NO: 2041435 - DNA, 19 bp, Homo sapiens
cccttctctccttccctct

SEQ ID NO: 2041436 - DNA, 12 bp, Homo sapiens
cccttctgctgt

SEQ ID NO: 2041437 - DNA, 14 bp, Homo sapiens
cccttctttcctct

SEQ ID NO: 2041438 - DNA, 17 bp, Homo sapiens
cccttgaaattttaaac

SEQ ID NO: 2041439 - DNA, 21 bp, Homo sapiens
cccttgaactgttctggcctc

SEQ ID NO: 2041440 - DNA, 23 bp, Homo sapiens
cccttgaagaggggaggggccta

SEQ ID NO: 2041441 - DNA, 22 bp, Homo sapiens
cccttgagaaaccttattgtac

SEQ ID NO: 2041442 - DNA, 13 bp, Homo sapiens
cccttgagacctc

SEQ ID NO: 2041443 - DNA, 17 bp, Homo sapiens
cccttgagacctcagcc

SEQ ID NO: 2041444 - DNA, 20 bp, Homo sapiens
cccttgagctccccaaaaac

SEQ ID NO: 2041445 - DNA, 13 bp, Homo sapiens
cccttgccagaca

SEQ ID NO: 2041446 - DNA, 12 bp, Homo sapiens
cccttgcccagg

SEQ ID NO: 2041447 - DNA, 15 bp, Homo sapiens
cccttgcccagggct

SEQ ID NO: 2041448 - DNA, 20 bp, Homo sapiens
cccttgcccagggctcagcc

SEQ ID NO: 2041449 - DNA, 21 bp, Homo sapiens
cccttgcccagggctcagcct

SEQ ID NO: 2041450 - DNA, 22 bp, Homo sapiens
cccttgcccagggctcagcctg

SEQ ID NO: 2041451 - DNA, 23 bp, Homo sapiens
cccttgcccagggctcagcctgg

SEQ ID NO: 2041452 - DNA, 12 bp, Homo sapiens
cccttgccctga

SEQ ID NO: 2041453 - DNA, 16 bp, Homo sapiens
cccttgcccttgccct

SEQ ID NO: 2041454 - DNA, 22 bp, Homo sapiens
cccttgccgggccttttttcca

SEQ ID NO: 2041455 - DNA, 19 bp, Homo sapiens
cccttgctcagtgcctcct

SEQ ID NO: 2041456 - DNA, 20 bp, Homo sapiens
cccttgctcagtgcctcctg

SEQ ID NO: 2041457 - DNA, 16 bp, Homo sapiens
cccttggaaagttcag

SEQ ID NO: 2041458 - DNA, 19 bp, Homo sapiens
cccttggaaagttcagcca

SEQ ID NO: 2041459 - DNA, 22 bp, Homo sapiens
cccttggaaagttcagccagaa

SEQ ID NO: 2041460 - DNA, 18 bp, Homo sapiens
cccttggcttcctccgtc

SEQ ID NO: 2041461 - DNA, 23 bp, Homo sapiens
cccttggcttttgcttggcagag

SEQ ID NO: 2041462 - DNA, 17 bp, Homo sapiens
cccttgggcctcccccc

SEQ ID NO: 2041463 - DNA, 16 bp, Homo sapiens
cccttggggcctggct

SEQ ID NO: 2041464 - DNA, 17 bp, Homo sapiens
cccttggggcctggctt

SEQ ID NO: 2041465 - DNA, 19 bp, Homo sapiens
cccttggggcctggcttgc

SEQ ID NO: 2041466 - DNA, 23 bp, Homo sapiens
cccttggggcctggcttgctcca

SEQ ID NO: 2041467 - DNA, 22 bp, Homo sapiens
cccttggggtaagccagagcct

SEQ ID NO: 2041468 - DNA, 19 bp, Homo sapiens
cccttggggttcccccaga

SEQ ID NO: 2041469 - DNA, 20 bp, Homo sapiens
cccttggggttcccccagac

SEQ ID NO: 2041470 - DNA, 16 bp, Homo sapiens
cccttgtaccccatcc

SEQ ID NO: 2041471 - DNA, 18 bp, Homo sapiens
cccttgtaccccatccct

SEQ ID NO: 2041472 - DNA, 19 bp, Homo sapiens
cccttgtaccccatccctt

SEQ ID NO: 2041473 - DNA, 19 bp, Homo sapiens
cccttgtcctgccagctgc

SEQ ID NO: 2041474 - DNA, 22 bp, Homo sapiens
cccttgtcctgccagctgcctt

SEQ ID NO: 2041475 - DNA, 13 bp, Homo sapiens
ccctttcctcccc

SEQ ID NO: 2041476 - DNA, 18 bp, Homo sapiens
ccctttccttccttccct

SEQ ID NO: 2041477 - DNA, 20 bp, Homo sapiens
ccctttgggaggctgaggcg

SEQ ID NO: 2041478 - DNA, 14 bp, Homo sapiens
cccttttgcctggc

SEQ ID NO: 2041479 - DNA, 11 bp, Homo sapiens
ccgaaagctga

SEQ ID NO: 2041480 - DNA, 19 bp, Homo sapiens
ccgaaagggacttggaagc

SEQ ID NO: 2041481 - DNA, 15 bp, Homo sapiens
ccgaagagccctgag

SEQ ID NO: 2041482 - DNA, 16 bp, Homo sapiens
ccgaagagccctgagc

SEQ ID NO: 2041483 - DNA, 19 bp, Homo sapiens
ccgaagagccctgagctca

SEQ ID NO: 2041484 - DNA, 22 bp, Homo sapiens
ccgaagagccctgagctcaggc

SEQ ID NO: 2041485 - DNA, 18 bp, Homo sapiens
ccgcttgtccagcgccta

SEQ ID NO: 2041486 - DNA, 21 bp, Homo sapiens
ccgctttcatgaacacagcct

SEQ ID NO: 2041487 - DNA, 19 bp, Homo sapiens
ccgctttctacccagcgag

SEQ ID NO: 2041488 - DNA, 22 bp, Homo sapiens
ccggaccaagatgggcacatga

SEQ ID NO: 2041489 - DNA, 22 bp, Homo sapiens
ccggacctgtggggccccagag

SEQ ID NO: 2041490 - DNA, 17 bp, Homo sapiens
ccggagcacagccctgg

SEQ ID NO: 2041491 - DNA, 20 bp, Homo sapiens
ccggagcacagccctgggag

SEQ ID NO: 2041492 - DNA, 16 bp, Homo sapiens
ccggaggggcctggca

SEQ ID NO: 2041493 - DNA, 21 bp, Homo sapiens
ccggaggggcctggcagccgt

SEQ ID NO: 2041494 - DNA, 19 bp, Homo sapiens
ccggaggggttgcggggga

SEQ ID NO: 2041495 - DNA, 20 bp, Homo sapiens
ccggcaaccccagttctgct

SEQ ID NO: 2041496 - DNA, 21 bp, Homo sapiens
ccggcaaccccagttctgctc

SEQ ID NO: 2041497 - DNA, 23 bp, Homo sapiens
ccggcaaccccagttctgctcct

SEQ ID NO: 2041498 - DNA, 14 bp, Homo sapiens
ccggcaccccctgc

SEQ ID NO: 2041499 - DNA, 17 bp, Homo sapiens
ccggcaccccctgcagc

SEQ ID NO: 2041500 - DNA, 18 bp, Homo sapiens
ccggcaccccctgcagct

SEQ ID NO: 2041501 - DNA, 20 bp, Homo sapiens
ccggcaccccctgcagcttg

SEQ ID NO: 2041502 - DNA, 19 bp, Homo sapiens
cccctgcccggctgcggaa

SEQ ID NO: 2041503 - DNA, 13 bp, Homo sapiens
cccctgccctgct

SEQ ID NO: 2041504 - DNA, 19 bp, Homo sapiens
cccctgctactcctgtgct

SEQ ID NO: 2041505 - DNA, 13 bp, Homo sapiens
cccctgctgctca

SEQ ID NO: 2041506 - DNA, 11 bp, Homo sapiens
cccctgctggt

SEQ ID NO: 2041507 - DNA, 20 bp, Homo sapiens
cccctggaccaccagcccca

SEQ ID NO: 2041508 - DNA, 22 bp, Homo sapiens
cccctggatgtcccctgtccca

SEQ ID NO: 2041509 - DNA, 14 bp, Homo sapiens
cccctggccctgcc

SEQ ID NO: 2041510 - DNA, 22 bp, Homo sapiens
cccctgggcatcttctggcttg

SEQ ID NO: 2041511 - DNA, 14 bp, Homo sapiens
cccctgggcctgga

SEQ ID NO: 2041512 - DNA, 15 bp, Homo sapiens
cccctgggctctgcc

SEQ ID NO: 2041513 - DNA, 23 bp, Homo sapiens
cccctgggctctgccccagctct

SEQ ID NO: 2041514 - DNA, 19 bp, Homo sapiens
cccctggggcttctcctga

SEQ ID NO: 2041515 - DNA, 20 bp, Homo sapiens
cccctggggcttctcctgac

SEQ ID NO: 2041516 - DNA, 22 bp, Homo sapiens
cccctggtggacagtcctggga

SEQ ID NO: 2041517 - DNA, 15 bp, Homo sapiens
cccctgtaaatagtt

SEQ ID NO: 2041518 - DNA, 16 bp, Homo sapiens
cccctgtacccagctc

SEQ ID NO: 2041519 - DNA, 15 bp, Homo sapiens
cccctgtgccagctc

SEQ ID NO: 2041520 - DNA, 16 bp, Homo sapiens
cccctgtggcagaccg

SEQ ID NO: 2041521 - DNA, 15 bp, Homo sapiens
cccctgttcactcta

SEQ ID NO: 2041522 - DNA, 22 bp, Homo sapiens
ccccttaagggttgaaggcagt

SEQ ID NO: 2041523 - DNA, 23 bp, Homo sapiens
ccccttaagggttgaaggcagtc

SEQ ID NO: 2041524 - DNA, 19 bp, Homo sapiens
ccccttactacttcttgga

SEQ ID NO: 2041525 - DNA, 23 bp, Homo sapiens
ccccttactatgatctcaggagc

SEQ ID NO: 2041526 - DNA, 14 bp, Homo sapiens
ccccttatccagga

SEQ ID NO: 2041527 - DNA, 20 bp, Homo sapiens
ccccttcactccctccctgg

SEQ ID NO: 2041528 - DNA, 12 bp, Homo sapiens
ccccttccccat

SEQ ID NO: 2041529 - DNA, 17 bp, Homo sapiens
ccccttccccatctcca

SEQ ID NO: 2041530 - DNA, 12 bp, Homo sapiens
ccccttccccct

SEQ ID NO: 2041531 - DNA, 14 bp, Homo sapiens
ccccttcctgcacc

SEQ ID NO: 2041532 - DNA, 13 bp, Homo sapiens
ccccttcctttcc

SEQ ID NO: 2041533 - DNA, 15 bp, Homo sapiens
ccccttcctttcctc

SEQ ID NO: 2041534 - DNA, 21 bp, Homo sapiens
ccccttcctttcctctgcagc

SEQ ID NO: 2041535 - DNA, 23 bp, Homo sapiens
ccccttcctttcctctgcagcac

SEQ ID NO: 2041536 - DNA, 19 bp, Homo sapiens
ccccttcgctcctgtgtct

SEQ ID NO: 2041537 - DNA, 13 bp, Homo sapiens
cctccagcctctc

SEQ ID NO: 2041538 - DNA, 16 bp, Homo sapiens
cctccagcctctcccg

SEQ ID NO: 2041539 - DNA, 15 bp, Homo sapiens
cctccagctggaatt

SEQ ID NO: 2041540 - DNA, 22 bp, Homo sapiens
cctccagctggaattgctgctc

SEQ ID NO: 2041541 - DNA, 23 bp, Homo sapiens
cctccagctggaattgctgctct

SEQ ID NO: 2041542 - DNA, 13 bp, Homo sapiens
cctccagctttcc

SEQ ID NO: 2041543 - DNA, 13 bp, Homo sapiens
cctccaggcaaaa

SEQ ID NO: 2041544 - DNA, 18 bp, Homo sapiens
cctccaggcatgctggcc

SEQ ID NO: 2041545 - DNA, 19 bp, Homo sapiens
cctccaggcatgctggcct

SEQ ID NO: 2041546 - DNA, 21 bp, Homo sapiens
cctgatggggtggaaggcatg

SEQ ID NO: 2041547 - DNA, 21 bp, Homo sapiens
cctgatggtacaggaaagctc

SEQ ID NO: 2041548 - DNA, 17 bp, Homo sapiens
cctgatgttaaaattcc

SEQ ID NO: 2041549 - DNA, 17 bp, Homo sapiens
cctgatttcagggaaat

SEQ ID NO: 2041550 - DNA, 21 bp, Homo sapiens
cctgcaaaaatataaccatta

SEQ ID NO: 2041551 - DNA, 15 bp, Homo sapiens
cctgcaaactcactg

SEQ ID NO: 2041552 - DNA, 16 bp, Homo sapiens
cctgcaaactcactgc

SEQ ID NO: 2041553 - DNA, 18 bp, Homo sapiens
cctgcaagccccagggcc

SEQ ID NO: 2041554 - DNA, 20 bp, Homo sapiens
cctgcaagccccagggcctg

SEQ ID NO: 2041555 - DNA, 12 bp, Homo sapiens
cctgcaaggact

SEQ ID NO: 2041556 - DNA, 13 bp, Homo sapiens
cctgcaaggacta

SEQ ID NO: 2041557 - DNA, 13 bp, Homo sapiens
cctgcaagtgccc

SEQ ID NO: 2041558 - DNA, 14 bp, Homo sapiens
cctgcaagtgcccg

SEQ ID NO: 2041559 - DNA, 15 bp, Homo sapiens
cctgcaatctccagg

SEQ ID NO: 2041560 - DNA, 20 bp, Homo sapiens
cctgcacaaagcccttccat

SEQ ID NO: 2041561 - DNA, 19 bp, Homo sapiens
cctgcacagatatttccat

SEQ ID NO: 2041562 - DNA, 18 bp, Homo sapiens
cctgcaccagcccttccc

SEQ ID NO: 2041563 - DNA, 12 bp, Homo sapiens
cctgcaccctgg

SEQ ID NO: 2041564 - DNA, 17 bp, Homo sapiens
cctgcacccttcctcct

SEQ ID NO: 2041565 - DNA, 19 bp, Homo sapiens
cctgcacccttcctcctcc

SEQ ID NO: 2041566 - DNA, 15 bp, Homo sapiens
cctgcacgcactgcg

SEQ ID NO: 2041567 - DNA, 16 bp, Homo sapiens
cctgcacgccaccgct

SEQ ID NO: 2041568 - DNA, 22 bp, Homo sapiens
cctgcacgccaccgctgccttt

SEQ ID NO: 2041569 - DNA, 14 bp, Homo sapiens
cctgcactccagaa

SEQ ID NO: 2041570 - DNA, 20 bp, Homo sapiens
cctgcactgacccacagcct

SEQ ID NO: 2041571 - DNA, 17 bp, Homo sapiens
cctgcacttcagacacc

SEQ ID NO: 2041572 - DNA, 19 bp, Homo sapiens
cctgcacttgcagactcta

SEQ ID NO: 2041573 - DNA, 14 bp, Homo sapiens
cctgcagaccctgc

SEQ ID NO: 2041574 - DNA, 16 bp, Homo sapiens
cctgcagactcactgt

SEQ ID NO: 2041575 - DNA, 13 bp, Homo sapiens
cctgcagagagaa

SEQ ID NO: 2041576 - DNA, 15 bp, Homo sapiens
cctgcagagagaagc

SEQ ID NO: 2041577 - DNA, 16 bp, Homo sapiens
cctgcagagagaagcc

SEQ ID NO: 2041578 - DNA, 16 bp, Homo sapiens
cctgcagaggaccaca

SEQ ID NO: 2041579 - DNA, 18 bp, Homo sapiens
cctgcagccaaacagagc

SEQ ID NO: 2041580 - DNA, 16 bp, Homo sapiens
cctgcagcctccccca

SEQ ID NO: 2041581 - DNA, 19 bp, Homo sapiens
cctgcagcctcctcctgac

SEQ ID NO: 2041582 - DNA, 19 bp, Homo sapiens
cctgcaggaacgagcactg

SEQ ID NO: 2041583 - DNA, 21 bp, Homo sapiens
cctgcaggccaagagcagagg

SEQ ID NO: 2041584 - DNA, 18 bp, Homo sapiens
cctgcagtactttacctc

SEQ ID NO: 2041585 - DNA, 19 bp, Homo sapiens
cctgcatcatgacaaagtt

SEQ ID NO: 2041586 - DNA, 18 bp, Homo sapiens
cctgcatccccttggctg

SEQ ID NO: 2041587 - DNA, 21 bp, Homo sapiens
cctgcatccccttggctgtga

SEQ ID NO: 2041588 - DNA, 23 bp, Homo sapiens
cctgcatttgtgaaatgatggtg

SEQ ID NO: 2041589 - DNA, 15 bp, Homo sapiens
cctgccaccgccaga

SEQ ID NO: 2041590 - DNA, 18 bp, Homo sapiens
cctgccaccgccagagga

SEQ ID NO: 2041591 - DNA, 12 bp, Homo sapiens
cctgccacctgt

SEQ ID NO: 2041592 - DNA, 13 bp, Homo sapiens
cctgccacctgtc

SEQ ID NO: 2041593 - DNA, 21 bp, Homo sapiens
cctgccagagcccaagtgcca

SEQ ID NO: 2041594 - DNA, 22 bp, Homo sapiens
cctgccagagcccaagtgccat

SEQ ID NO: 2041595 - DNA, 18 bp, Homo sapiens
cctgccagagctttgttt

SEQ ID NO: 2041596 - DNA, 22 bp, Homo sapiens
cctgccagcaggccagggactc

SEQ ID NO: 2041597 - DNA, 14 bp, Homo sapiens
cctgccagccatca

SEQ ID NO: 2041598 - DNA, 18 bp, Homo sapiens
cctgccagccatcacaag

SEQ ID NO: 2041599 - DNA, 17 bp, Homo sapiens
cctgccagcctggcttc

SEQ ID NO: 2041600 - DNA, 15 bp, Homo sapiens
cctgccagctgcctt

SEQ ID NO: 2041601 - DNA, 20 bp, Homo sapiens
cctgccaggcccccgctggc

SEQ ID NO: 2041602 - DNA, 12 bp, Homo sapiens
cctgccagggcc

SEQ ID NO: 2041603 - DNA, 17 bp, Homo sapiens
cctgccagtgccttacc

SEQ ID NO: 2041604 - DNA, 23 bp, Homo sapiens
cctgccagtgtttagaagagcct

SEQ ID NO: 2041605 - DNA, 17 bp, Homo sapiens
cctgccataccgctggg

SEQ ID NO: 2041606 - DNA, 20 bp, Homo sapiens
cctgccataccgctggggaa

SEQ ID NO: 2041607 - DNA, 20 bp, Homo sapiens
cctgcccacttcagcccagc

SEQ ID NO: 2041608 - DNA, 16 bp, Homo sapiens
cctgcccagcctcgca

SEQ ID NO: 2041609 - DNA, 12 bp, Homo sapiens
cctgcccaggag

SEQ ID NO: 2041610 - DNA, 20 bp, Homo sapiens
cctgcccaggagagccagcc

SEQ ID NO: 2041611 - DNA, 22 bp, Homo sapiens
cctgcccaggagagccagccct

SEQ ID NO: 2041612 - DNA, 17 bp, Homo sapiens
cctgcccatacccctgc

SEQ ID NO: 2041613 - DNA, 19 bp, Homo sapiens
cctgcccatacccctgcct

SEQ ID NO: 2041614 - DNA, 16 bp, Homo sapiens
cctgcccatgggagct

SEQ ID NO: 2041615 - DNA, 12 bp, Homo sapiens
cctgcccatgtg

SEQ ID NO: 2041616 - DNA, 16 bp, Homo sapiens
cctgcccatgtgtccc

SEQ ID NO: 2041617 - DNA, 17 bp, Homo sapiens
cctgccccaactccttc

SEQ ID NO: 2041618 - DNA, 17 bp, Homo sapiens
cctgccccagggctccc

SEQ ID NO: 2041619 - DNA, 17 bp, Homo sapiens
cctgccccatcctgggc

SEQ ID NO: 2041620 - DNA, 22 bp, Homo sapiens
cctgcccccagaccttttatcc

SEQ ID NO: 2041621 - DNA, 15 bp, Homo sapiens
cctgcccccagcact

SEQ ID NO: 2041622 - DNA, 23 bp, Homo sapiens
cctgcccccagcactcctctgtc

SEQ ID NO: 2041623 - DNA, 14 bp, Homo sapiens
cctgcccccatctc

SEQ ID NO: 2041624 - DNA, 22 bp, Homo sapiens
cctgcccccatctccccaggcc

SEQ ID NO: 2041625 - DNA, 15 bp, Homo sapiens
cctgcccccgacagc

SEQ ID NO: 2041626 - DNA, 22 bp, Homo sapiens
cctgcccccgacagcccagcct

SEQ ID NO: 2041627 - DNA, 13 bp, Homo sapiens
cctgccccctggt

SEQ ID NO: 2041628 - DNA, 14 bp, Homo sapiens
cctgccccctggtg

SEQ ID NO: 2041629 - DNA, 16 bp, Homo sapiens
cctgccccgcccagct

SEQ ID NO: 2041630 - DNA, 23 bp, Homo sapiens
cctgcccctcacctgcctgccct

SEQ ID NO: 2041631 - DNA, 16 bp, Homo sapiens
cctgcccctcccttca

SEQ ID NO: 2041632 - DNA, 11 bp, Homo sapiens
cctgcccctgc

SEQ ID NO: 2041633 - DNA, 16 bp, Homo sapiens
cctgcccctgccccaa

SEQ ID NO: 2041634 - DNA, 19 bp, Homo sapiens
cctgccctagagcacactg

SEQ ID NO: 2041635 - DNA, 14 bp, Homo sapiens
cctgccctcccatg

SEQ ID NO: 2041636 - DNA, 11 bp, Homo sapiens
cctgccctgcc

SEQ ID NO: 2041637 - DNA, 18 bp, Homo sapiens
cctgccctgccacctgtc

SEQ ID NO: 2041638 - DNA, 20 bp, Homo sapiens
cctgccctgctgccgcctcc

SEQ ID NO: 2041639 - DNA, 14 bp, Homo sapiens
cctgccgcctcaat

SEQ ID NO: 2041640 - DNA, 14 bp, Homo sapiens
cctgcctacatccc

SEQ ID NO: 2041641 - DNA, 15 bp, Homo sapiens
cctgcctacatccca

SEQ ID NO: 2041642 - DNA, 19 bp, Homo sapiens
cctgcctacattccctggc

SEQ ID NO: 2041643 - DNA, 17 bp, Homo sapiens
cctgcctatccatcctg

SEQ ID NO: 2041644 - DNA, 15 bp, Homo sapiens
cctgcctcagcctcc

SEQ ID NO: 2041645 - DNA, 14 bp, Homo sapiens
cctgcctcagctgc

SEQ ID NO: 2041646 - DNA, 15 bp, Homo sapiens
cctgcctcccagccc

SEQ ID NO: 2041647 - DNA, 21 bp, Homo sapiens
cctgcctcccagccctgccag

SEQ ID NO: 2041648 - DNA, 22 bp, Homo sapiens
cctgcctcccagccctgccagg

SEQ ID NO: 2041649 - DNA, 12 bp, Homo sapiens
cctgcctccctt

SEQ ID NO: 2041650 - DNA, 21 bp, Homo sapiens
cctgcctcgaactggctgcaa

SEQ ID NO: 2041651 - DNA, 13 bp, Homo sapiens
cctgcctctgcca

SEQ ID NO: 2041652 - DNA, 19 bp, Homo sapiens
cctgcctgagcccaggagc

SEQ ID NO: 2041653 - DNA, 21 bp, Homo sapiens
cctgcctgagcccaggagctg

SEQ ID NO: 2041654 - DNA, 13 bp, Homo sapiens
cctgcctggagga

SEQ ID NO: 2041655 - DNA, 13 bp, Homo sapiens
cctgcctgggttt

SEQ ID NO: 2041656 - DNA, 20 bp, Homo sapiens
cctgcctgggttttctaact

SEQ ID NO: 2041657 - DNA, 14 bp, Homo sapiens
cctggtgcttctcc

SEQ ID NO: 2041658 - DNA, 16 bp, Homo sapiens
cctggtgcttctcctc

SEQ ID NO: 2041659 - DNA, 17 bp, Homo sapiens
cctggtggacagtcctg

SEQ ID NO: 2041660 - DNA, 18 bp, Homo sapiens
cctggtggacagtcctgg

SEQ ID NO: 2041661 - DNA, 14 bp, Homo sapiens
cctggtggcaccag

SEQ ID NO: 2041662 - DNA, 12 bp, Homo sapiens
cctggtggcagc

SEQ ID NO: 2041663 - DNA, 13 bp, Homo sapiens
cctggtggcagtg

SEQ ID NO: 2041664 - DNA, 14 bp, Homo sapiens
cctggtggcagtgg

SEQ ID NO: 2041665 - DNA, 18 bp, Homo sapiens
cctggtggcagtgggagc

SEQ ID NO: 2041666 - DNA, 21 bp, Homo sapiens
cctggtggcagtgggagctgc

SEQ ID NO: 2041667 - DNA, 20 bp, Homo sapiens
cctggtggccatgtcgcctg

SEQ ID NO: 2041668 - DNA, 21 bp, Homo sapiens
cctggtggccatgtcgcctgc

SEQ ID NO: 2041669 - DNA, 18 bp, Homo sapiens
cctggtgggcctcctctg

SEQ ID NO: 2041670 - DNA, 13 bp, Homo sapiens
cctggtggggcag

SEQ ID NO: 2041671 - DNA, 14 bp, Homo sapiens
cctggtggggcagc

SEQ ID NO: 2041672 - DNA, 18 bp, Homo sapiens
cctggtggggcagctcct

SEQ ID NO: 2041673 - DNA, 21 bp, Homo sapiens
cctggtggggcagctcctctg

SEQ ID NO: 2041674 - DNA, 16 bp, Homo sapiens
cctggtgtcaggcagg

SEQ ID NO: 2041675 - DNA, 13 bp, Homo sapiens
cctggtgtgaggc

SEQ ID NO: 2041676 - DNA, 21 bp, Homo sapiens
cctggtgtgaggctgggccag

SEQ ID NO: 2041677 - DNA, 15 bp, Homo sapiens
cctggttactctggt

SEQ ID NO: 2041678 - DNA, 17 bp, Homo sapiens
cctggttggccgtggtc

SEQ ID NO: 2041679 - DNA, 15 bp, Homo sapiens
cctggtttagcctgg

SEQ ID NO: 2041680 - DNA, 22 bp, Homo sapiens
cctgtaaatagttttaaatatg

SEQ ID NO: 2041681 - DNA, 16 bp, Homo sapiens
cctgtaacaagccaga

SEQ ID NO: 2041682 - DNA, 13 bp, Homo sapiens
cctgtaatcccag

SEQ ID NO: 2041683 - DNA, 17 bp, Homo sapiens
cctgtaatcccagcact

SEQ ID NO: 2041684 - DNA, 23 bp, Homo sapiens
cctgtaatcccagcactttggga

SEQ ID NO: 2041685 - DNA, 13 bp, Homo sapiens
cctgtacccagct

SEQ ID NO: 2041686 - DNA, 20 bp, Homo sapiens
cctgtacgaacccctcccct

SEQ ID NO: 2041687 - DNA, 15 bp, Homo sapiens
cctgtactaaggagc

SEQ ID NO: 2041688 - DNA, 17 bp, Homo sapiens
cctgtactgcctgcttg

SEQ ID NO: 2041689 - DNA, 20 bp, Homo sapiens
cctgtactgggttatttttg

SEQ ID NO: 2041690 - DNA, 20 bp, Homo sapiens
cctgtagccccagtgacagc

SEQ ID NO: 2041691 - DNA, 22 bp, Homo sapiens
cctgtagccccagtgacagcta

SEQ ID NO: 2041692 - DNA, 15 bp, Homo sapiens
cctgtagctctgcct

SEQ ID NO: 2041693 - DNA, 18 bp, Homo sapiens
cctgtagttaggaaataa

SEQ ID NO: 2041694 - DNA, 19 bp, Homo sapiens
cctgtagttaggaaataaa

SEQ ID NO: 2041695 - DNA, 16 bp, Homo sapiens
cctgtataaccccacc

SEQ ID NO: 2041696 - DNA, 17 bp, Homo sapiens
cctgtataaccccacct

SEQ ID NO: 2041697 - DNA, 17 bp, Homo sapiens
cctgtatagacagcact

SEQ ID NO: 2041698 - DNA, 20 bp, Homo sapiens
cctgtatataatactaaagt

SEQ ID NO: 2041699 - DNA, 22 bp, Homo sapiens
cctgtatataatactaaagtgt

SEQ ID NO: 2041700 - DNA, 17 bp, Homo sapiens
cctgtatgtctccagta

SEQ ID NO: 2041701 - DNA, 19 bp, Homo sapiens
cctgtatttgttcccaaga

SEQ ID NO: 2041702 - DNA, 14 bp, Homo sapiens
cctgtcaccctggc

SEQ ID NO: 2041703 - DNA, 12 bp, Homo sapiens
cctgtcagaggc

SEQ ID NO: 2041704 - DNA, 23 bp, Homo sapiens
cctgtccaacctaacccctttcc

SEQ ID NO: 2041705 - DNA, 22 bp, Homo sapiens
cctgtcccaccaactctgcact

SEQ ID NO: 2041706 - DNA, 16 bp, Homo sapiens
cctgtcccacctcttc

SEQ ID NO: 2041707 - DNA, 13 bp, Homo sapiens
cctgtcccagcag

SEQ ID NO: 2041708 - DNA, 14 bp, Homo sapiens
cctgtcccccaagg

SEQ ID NO: 2041709 - DNA, 18 bp, Homo sapiens
cctgtcccctgaaaaact

SEQ ID NO: 2041710 - DNA, 14 bp, Homo sapiens
cctgtcccgccttc

SEQ ID NO: 2041711 - DNA, 17 bp, Homo sapiens
cctgtccctacccactc

SEQ ID NO: 2041712 - DNA, 18 bp, Homo sapiens
cctgtccctacccactct

SEQ ID NO: 2041713 - DNA, 14 bp, Homo sapiens
cctgtcctccagct

SEQ ID NO: 2041714 - DNA, 13 bp, Homo sapiens
cctgtcctcctcg

SEQ ID NO: 2041715 - DNA, 14 bp, Homo sapiens
cctgtcctgcctct

SEQ ID NO: 2041716 - DNA, 21 bp, Homo sapiens
cctgtcctggtacagcagggt

SEQ ID NO: 2041717 - DNA, 23 bp, Homo sapiens
cctgtcctttgttattatcctgc

SEQ ID NO: 2041718 - DNA, 16 bp, Homo sapiens
cctgtcgattagactg

SEQ ID NO: 2041719 - DNA, 13 bp, Homo sapiens
cctgtctctgcct

SEQ ID NO: 2041720 - DNA, 14 bp, Homo sapiens
cctgtctctgcctg

SEQ ID NO: 2041721 - DNA, 20 bp, Homo sapiens
cctgtctgtcgctgggctgt

SEQ ID NO: 2041722 - DNA, 20 bp, Homo sapiens
cctgtctgtctgtctgtccc

SEQ ID NO: 2041723 - DNA, 22 bp, Homo sapiens
cctgtctgtctgtctgtcccaa

SEQ ID NO: 2041724 - DNA, 17 bp, Homo sapiens
cctgtctttaaggaaaa

SEQ ID NO: 2041725 - DNA, 17 bp, Homo sapiens
cctgtgcagcagcccag

SEQ ID NO: 2041726 - DNA, 20 bp, Homo sapiens
cctgtgcatgtatgtcttgg

SEQ ID NO: 2041727 - DNA, 13 bp, Homo sapiens
cctgtgccaacct

SEQ ID NO: 2041728 - DNA, 15 bp, Homo sapiens
cctgtgccaacctga

SEQ ID NO: 2041729 - DNA, 20 bp, Homo sapiens
cctgtgccaacctgatgccc

SEQ ID NO: 2041730 - DNA, 12 bp, Homo sapiens
cctgtgccacct

SEQ ID NO: 2041731 - DNA, 22 bp, Homo sapiens
cctgtgccacctgcaagtgccc

SEQ ID NO: 2041732 - DNA, 13 bp, Homo sapiens
cctgtgccagctc

SEQ ID NO: 2041733 - DNA, 23 bp, Homo sapiens
cctgtgcccacatcccaggcttc

SEQ ID NO: 2041734 - DNA, 15 bp, Homo sapiens
cctgtgcccctcaga

SEQ ID NO: 2041735 - DNA, 20 bp, Homo sapiens
cctgtgcccctcagagaggc

SEQ ID NO: 2041736 - DNA, 22 bp, Homo sapiens
cctgtgcccctcagagaggcat

SEQ ID NO: 2041737 - DNA, 21 bp, Homo sapiens
cctgtgcctcctcacccccag

SEQ ID NO: 2041738 - DNA, 19 bp, Homo sapiens
cctgtgctactttgccttt

SEQ ID NO: 2041739 - DNA, 23 bp, Homo sapiens
cctgtgctactttgccttttgca

SEQ ID NO: 2041740 - DNA, 15 bp, Homo sapiens
cctgtgctgaggact

SEQ ID NO: 2041741 - DNA, 19 bp, Homo sapiens
cctgtgctgaggactccct

SEQ ID NO: 2041742 - DNA, 21 bp, Homo sapiens
cctgtgctgcccgtcttcagc

SEQ ID NO: 2041743 - DNA, 16 bp, Homo sapiens
cctgtggcagaaaaga

SEQ ID NO: 2041744 - DNA, 23 bp, Homo sapiens
cctgtggcagaaaagaggagacc

SEQ ID NO: 2041745 - DNA, 15 bp, Homo sapiens
cctgtggcagaccgg

SEQ ID NO: 2041746 - DNA, 15 bp, Homo sapiens
cctgtggccttgccc

SEQ ID NO: 2041747 - DNA, 17 bp, Homo sapiens
cctgtggccttgcccgc

SEQ ID NO: 2041748 - DNA, 15 bp, Homo sapiens
cctgtggcggtgcct

SEQ ID NO: 2041749 - DNA, 18 bp, Homo sapiens
cctgtggcggtgcctggg

SEQ ID NO: 2041750 - DNA, 19 bp, Homo sapiens
cctgtggcggtgcctgggt

SEQ ID NO: 2041751 - DNA, 13 bp, Homo sapiens
cctgtgggaagag

SEQ ID NO: 2041752 - DNA, 17 bp, Homo sapiens
cctgtgggagcctcgca

SEQ ID NO: 2041753 - DNA, 14 bp, Homo sapiens
cctgtgggagcctg

SEQ ID NO: 2041754 - DNA, 15 bp, Homo sapiens
cctgtgggagcctgc

SEQ ID NO: 2041755 - DNA, 17 bp, Homo sapiens
cctgtgggggcggctgt

SEQ ID NO: 2041756 - DNA, 14 bp, Homo sapiens
cctgtgggggtggc

SEQ ID NO: 2041757 - DNA, 18 bp, Homo sapiens
cctgtgggggtggccatc

SEQ ID NO: 2041758 - DNA, 22 bp, Homo sapiens
cctgtgggggtggccatccctg

SEQ ID NO: 2041759 - DNA, 14 bp, Homo sapiens
cctgtgtagctgtg

SEQ ID NO: 2041760 - DNA, 19 bp, Homo sapiens
cctgtgtagctgtgacctg

SEQ ID NO: 2041761 - DNA, 21 bp, Homo sapiens
cctgtgtagctgtgacctgct

SEQ ID NO: 2041762 - DNA, 16 bp, Homo sapiens
cctgtgtccagcagct

SEQ ID NO: 2041763 - DNA, 18 bp, Homo sapiens
cctgtgtccagcagctgc

SEQ ID NO: 2041764 - DNA, 11 bp, Homo sapiens
cctgtgtctta

SEQ ID NO: 2041765 - DNA, 19 bp, Homo sapiens
cctgtgtcttgcaatggca

SEQ ID NO: 2041766 - DNA, 21 bp, Homo sapiens
cctgtgtcttgcaatggcagc

SEQ ID NO: 2041767 - DNA, 16 bp, Homo sapiens
cctgtgtgagttgagt

SEQ ID NO: 2041768 - DNA, 14 bp, Homo sapiens
cctgtgtggggagg

SEQ ID NO: 2041769 - DNA, 18 bp, Homo sapiens
cctgttttccacaccatc

SEQ ID NO: 2041770 - DNA, 22 bp, Homo sapiens
ccttaaaaggagagaagaaagt

SEQ ID NO: 2041771 - DNA, 23 bp, Homo sapiens
ccttaaagaaagtcgaattaata

SEQ ID NO: 2041772 - DNA, 13 bp, Homo sapiens
ccttaaatttttg

SEQ ID NO: 2041773 - DNA, 23 bp, Homo sapiens
ccttaaccctaaaattttaaggc

SEQ ID NO: 2041774 - DNA, 21 bp, Homo sapiens
ccttaaggaggtagctcccag

SEQ ID NO: 2041775 - DNA, 19 bp, Homo sapiens
ccttaagggttgaaggcag

SEQ ID NO: 2041776 - DNA, 12 bp, Homo sapiens
ccttaagtcaga

SEQ ID NO: 2041777 - DNA, 13 bp, Homo sapiens
ccttacattccta

SEQ ID NO: 2041778 - DNA, 15 bp, Homo sapiens
ccttacattcctaga

SEQ ID NO: 2041779 - DNA, 21 bp, Homo sapiens
ccttaccaacagcttttccca

SEQ ID NO: 2041780 - DNA, 17 bp, Homo sapiens
ccttactacttcttgga

SEQ ID NO: 2041781 - DNA, 21 bp, Homo sapiens
ccttactacttcttggaaaaa

SEQ ID NO: 2041782 - DNA, 18 bp, Homo sapiens
ccttactatgatctcagg

SEQ ID NO: 2041783 - DNA, 12 bp, Homo sapiens
ccttactcctgt

SEQ ID NO: 2041784 - DNA, 21 bp, Homo sapiens
ccttactcctgtgggagcctc

SEQ ID NO: 2041785 - DNA, 16 bp, Homo sapiens
ccttactctgagccca

SEQ ID NO: 2041786 - DNA, 20 bp, Homo sapiens
ccttactctgagcccaggcc

SEQ ID NO: 2041787 - DNA, 18 bp, Homo sapiens
ccttagaacctttcttac

SEQ ID NO: 2041788 - DNA, 20 bp, Homo sapiens
ccttagagattgccccagag

SEQ ID NO: 2041789 - DNA, 19 bp, Homo sapiens
ccttagctggcattacagc

SEQ ID NO: 2041790 - DNA, 18 bp, Homo sapiens
ccttagcttagacctcag

SEQ ID NO: 2041791 - DNA, 20 bp, Homo sapiens
ccttagcttagacctcagcc

SEQ ID NO: 2041792 - DNA, 22 bp, Homo sapiens
ccttagcttagacctcagcctg

SEQ ID NO: 2041793 - DNA, 19 bp, Homo sapiens
ccttaggcattatttaatg

SEQ ID NO: 2041794 - DNA, 23 bp, Homo sapiens
ccttagtccgcaagttcagggaa

SEQ ID NO: 2041795 - DNA, 18 bp, Homo sapiens
ccttattttcaagaaact

SEQ ID NO: 2041796 - DNA, 15 bp, Homo sapiens
ccttattttgtatta

SEQ ID NO: 2041797 - DNA, 14 bp, Homo sapiens
ccttcaacccgaga

SEQ ID NO: 2041798 - DNA, 13 bp, Homo sapiens
ccttcaactgaaa

SEQ ID NO: 2041799 - DNA, 22 bp, Homo sapiens
ccttcaccagagcccatgctca

SEQ ID NO: 2041800 - DNA, 15 bp, Homo sapiens
ccttcagtgcccacc

SEQ ID NO: 2041801 - DNA, 18 bp, Homo sapiens
ccttcatcgaacaaactg

SEQ ID NO: 2041802 - DNA, 17 bp, Homo sapiens
ccttccaccgggcctga

SEQ ID NO: 2041803 - DNA, 12 bp, Homo sapiens
ccttccacctcc

SEQ ID NO: 2041804 - DNA, 13 bp, Homo sapiens
ccttccagacata

SEQ ID NO: 2041805 - DNA, 22 bp, Homo sapiens
ccttccagacatacgaaacaca

SEQ ID NO: 2041806 - DNA, 15 bp, Homo sapiens
ccttccagtggctcg

SEQ ID NO: 2041807 - DNA, 22 bp, Homo sapiens
ccttccagtggctcgctccctg

SEQ ID NO: 2041808 - DNA, 21 bp, Homo sapiens
ccttccagtggtaccagctca

SEQ ID NO: 2041809 - DNA, 22 bp, Homo sapiens
ccttccagtggtaccagctcac

SEQ ID NO: 2041810 - DNA, 24 bp, Homo sapiens
ccttccagtggtaccagctcactc

SEQ ID NO: 2041811 - DNA, 12 bp, Homo sapiens
ccttccataatt

SEQ ID NO: 2041812 - DNA, 20 bp, Homo sapiens
ccttccatgtcgcctctgca

SEQ ID NO: 2041813 - DNA, 20 bp, Homo sapiens
ccttcccaaggttactcagc

SEQ ID NO: 2041814 - DNA, 22 bp, Homo sapiens
ccttcccacagcattcctccat

SEQ ID NO: 2041815 - DNA, 13 bp, Homo sapiens
ccttcccagctct

SEQ ID NO: 2041816 - DNA, 19 bp, Homo sapiens
ccttcccagctctccctct

SEQ ID NO: 2041817 - DNA, 21 bp, Homo sapiens
ccttcccagctctccctctgg

SEQ ID NO: 2041818 - DNA, 19 bp, Homo sapiens
ccttcccaggagtggagga

SEQ ID NO: 2041819 - DNA, 18 bp, Homo sapiens
ccttcccatgatgccgct

SEQ ID NO: 2041820 - DNA, 12 bp, Homo sapiens
ccttccccagac

SEQ ID NO: 2041821 - DNA, 22 bp, Homo sapiens
ccttcccccatcccctttcctc

SEQ ID NO: 2041822 - DNA, 19 bp, Homo sapiens
ccttccccctccaatccca

SEQ ID NO: 2041823 - DNA, 16 bp, Homo sapiens
ccttccccctcccagg

SEQ ID NO: 2041824 - DNA, 15 bp, Homo sapiens
ccttcccctacacct

SEQ ID NO: 2041825 - DNA, 18 bp, Homo sapiens
ccttccccttctgtgtca

SEQ ID NO: 2041826 - DNA, 21 bp, Homo sapiens
ccttccccttctgtgtcacag

SEQ ID NO: 2041827 - DNA, 18 bp, Homo sapiens
ccttccccttttgcctgg

SEQ ID NO: 2041828 - DNA, 20 bp, Homo sapiens
ccttccccttttgcctggct

SEQ ID NO: 2041829 - DNA, 20 bp, Homo sapiens
ccttcccgccgcccgacccc

SEQ ID NO: 2041830 - DNA, 19 bp, Homo sapiens
ccttccctctttccccacc

SEQ ID NO: 2041831 - DNA, 20 bp, Homo sapiens
ccttccctctttccccacct

SEQ ID NO: 2041832 - DNA, 15 bp, Homo sapiens
ccttccctctttcta

SEQ ID NO: 2041833 - DNA, 21 bp, Homo sapiens
ccttcccttctctccttccct

SEQ ID NO: 2041834 - DNA, 18 bp, Homo sapiens
ccttccgctcctttacct

SEQ ID NO: 2041835 - DNA, 20 bp, Homo sapiens
ccttccgctcctttacctac

SEQ ID NO: 2041836 - DNA, 17 bp, Homo sapiens
ccttcctcagtcctgga

SEQ ID NO: 2041837 - DNA, 12 bp, Homo sapiens
ccttcctcatcc

SEQ ID NO: 2041838 - DNA, 16 bp, Homo sapiens
ccttcctcctccacag

SEQ ID NO: 2041839 - DNA, 16 bp, Homo sapiens
ccttcctcctcctttg

SEQ ID NO: 2041840 - DNA, 14 bp, Homo sapiens
ccttcctctccact

SEQ ID NO: 2041841 - DNA, 15 bp, Homo sapiens
ccttcctctccactg

SEQ ID NO: 2041842 - DNA, 18 bp, Homo sapiens
ccttcctgaccctccgct

SEQ ID NO: 2041843 - DNA, 13 bp, Homo sapiens
ccttcctgcaccc

SEQ ID NO: 2041844 - DNA, 13 bp, Homo sapiens
ccttcctggacag

SEQ ID NO: 2041845 - DNA, 17 bp, Homo sapiens
ccttcctggacagctgt

SEQ ID NO: 2041846 - DNA, 12 bp, Homo sapiens
ccttcctggcct

SEQ ID NO: 2041847 - DNA, 22 bp, Homo sapiens
ccttcctggcctcactggctgg

SEQ ID NO: 2041848 - DNA, 23 bp, Homo sapiens
ccttcctggcctcactggctggg

SEQ ID NO: 2041849 - DNA, 17 bp, Homo sapiens
ccttccttaagccagga

SEQ ID NO: 2041850 - DNA, 14 bp, Homo sapiens
ccttccttccctgg

SEQ ID NO: 2041851 - DNA, 13 bp, Homo sapiens
ccttccttctaaa

SEQ ID NO: 2041852 - DNA, 14 bp, Homo sapiens
ccttcctttcctct

SEQ ID NO: 2041853 - DNA, 17 bp, Homo sapiens
ccttcctttcctctgca

SEQ ID NO: 2041854 - DNA, 22 bp, Homo sapiens
ccttcctttcctctgcagcact

SEQ ID NO: 2041855 - DNA, 17 bp, Homo sapiens
ccttcgaggttgcccct

SEQ ID NO: 2041856 - DNA, 22 bp, Homo sapiens
ccttcgatacaccgggcctgga

SEQ ID NO: 2041857 - DNA, 20 bp, Homo sapiens
ccttcgcggtggaaggcccg

SEQ ID NO: 2041858 - DNA, 18 bp, Homo sapiens
ccttcgctcctgtgtctt

SEQ ID NO: 2041859 - DNA, 14 bp, Homo sapiens
ccttcgctgccagg

SEQ ID NO: 2041860 - DNA, 17 bp, Homo sapiens
ccttcgctgccaggaca

SEQ ID NO: 2041861 - DNA, 13 bp, Homo sapiens
ccttcgtgtctct

SEQ ID NO: 2041862 - DNA, 20 bp, Homo sapiens
ccttcgtgtctctcccaccc

SEQ ID NO: 2041863 - DNA, 15 bp, Homo sapiens
ccttctccaaatgag

SEQ ID NO: 2041864 - DNA, 12 bp, Homo sapiens
ccttgaaaaaaa

SEQ ID NO: 2041865 - DNA, 14 bp, Homo sapiens
ccttgaagccactg

SEQ ID NO: 2041866 - DNA, 15 bp, Homo sapiens
ccttgaatctgcagg

SEQ ID NO: 2041867 - DNA, 19 bp, Homo sapiens
ccttgaatctgcagggagc

SEQ ID NO: 2041868 - DNA, 17 bp, Homo sapiens
ccttgacaacagactga

SEQ ID NO: 2041869 - DNA, 15 bp, Homo sapiens
ccttgacagggcaca

SEQ ID NO: 2041870 - DNA, 19 bp, Homo sapiens
ccttgagaaaccttattgt

SEQ ID NO: 2041871 - DNA, 17 bp, Homo sapiens
ccttgagacctcagcca

SEQ ID NO: 2041872 - DNA, 14 bp, Homo sapiens
ccttgatctgtata

SEQ ID NO: 2041873 - DNA, 14 bp, Homo sapiens
ccttgatgaagccc

SEQ ID NO: 2041874 - DNA, 18 bp, Homo sapiens
ccttgatttaaaatatca

SEQ ID NO: 2041875 - DNA, 21 bp, Homo sapiens
ccttgattttagccttctctg

SEQ ID NO: 2041876 - DNA, 18 bp, Homo sapiens
ccttgcacactcagaagc

SEQ ID NO: 2041877 - DNA, 16 bp, Homo sapiens
ccttgcacctgcatcc

SEQ ID NO: 2041878 - DNA, 13 bp, Homo sapiens
ccttgcactgtgg

SEQ ID NO: 2041879 - DNA, 11 bp, Homo sapiens
ccttgcatcaa

SEQ ID NO: 2041880 - DNA, 23 bp, Homo sapiens
ccttgccaaattccatgtccctg

SEQ ID NO: 2041881 - DNA, 16 bp, Homo sapiens
ccttgccaagctttct

SEQ ID NO: 2041882 - DNA, 19 bp, Homo sapiens
ccttgccaagctttcttct

SEQ ID NO: 2041883 - DNA, 12 bp, Homo sapiens
ccttgcccagag

SEQ ID NO: 2041884 - DNA, 13 bp, Homo sapiens
ccttgcccagaga

SEQ ID NO: 2041885 - DNA, 14 bp, Homo sapiens
ccttgcccagagat

SEQ ID NO: 2041886 - DNA, 19 bp, Homo sapiens
ccttgcccagagatgcctc

SEQ ID NO: 2041887 - DNA, 21 bp, Homo sapiens
ccttgcccagagatgcctcca

SEQ ID NO: 2041888 - DNA, 23 bp, Homo sapiens
ccttgcccagagatgcctccacc

SEQ ID NO: 2041889 - DNA, 20 bp, Homo sapiens
ccttgcccagggctcagcct

SEQ ID NO: 2041890 - DNA, 19 bp, Homo sapiens
ccttgcccgccagcctcag

SEQ ID NO: 2041891 - DNA, 19 bp, Homo sapiens
ccttgcccggattctggga

SEQ ID NO: 2041892 - DNA, 14 bp, Homo sapiens
ccttgccctgacct

SEQ ID NO: 2041893 - DNA, 15 bp, Homo sapiens
ccttgccctgacctc

SEQ ID NO: 2041894 - DNA, 19 bp, Homo sapiens
ccttgccctgacctcccag

SEQ ID NO: 2041895 - DNA, 17 bp, Homo sapiens
ccttgcccttgccctga

SEQ ID NO: 2041896 - DNA, 18 bp, Homo sapiens
ccttgctagacagccagg

SEQ ID NO: 2041897 - DNA, 18 bp, Homo sapiens
ccttgctcaccaagctgt

SEQ ID NO: 2041898 - DNA, 22 bp, Homo sapiens
ccttgctctcccctgccctgct

SEQ ID NO: 2041899 - DNA, 17 bp, Homo sapiens
ccttgctctgcaggcac

SEQ ID NO: 2041900 - DNA, 19 bp, Homo sapiens
ccttgctcttctttctgag

SEQ ID NO: 2041901 - DNA, 13 bp, Homo sapiens
ccttgctgctgcc

SEQ ID NO: 2041902 - DNA, 14 bp, Homo sapiens
ccttgctgctgccc

SEQ ID NO: 2041903 - DNA, 15 bp, Homo sapiens
ccttggactcatttt

SEQ ID NO: 2041904 - DNA, 19 bp, Homo sapiens
ccttggagagacacagcgt

SEQ ID NO: 2041905 - DNA, 14 bp, Homo sapiens
ccttggagagcagc

SEQ ID NO: 2041906 - DNA, 13 bp, Homo sapiens
ccttggagcctga

SEQ ID NO: 2041907 - DNA, 16 bp, Homo sapiens
ccttggaggacagtgg

SEQ ID NO: 2041908 - DNA, 12 bp, Homo sapiens
ccttggaggcca

SEQ ID NO: 2041909 - DNA, 18 bp, Homo sapiens
ccttggatgtagtctgag

SEQ ID NO: 2041910 - DNA, 23 bp, Homo sapiens
ccttggatttctgaatggctgca

SEQ ID NO: 2041911 - DNA, 15 bp, Homo sapiens
ccttggcgggcagcc

SEQ ID NO: 2041912 - DNA, 20 bp, Homo sapiens
ccttggcgggcagcccagcc

SEQ ID NO: 2041913 - DNA, 18 bp, Homo sapiens
ccttggctcaatcctcta

SEQ ID NO: 2041914 - DNA, 14 bp, Homo sapiens
ccttggctgcaggg

SEQ ID NO: 2041915 - DNA, 20 bp, Homo sapiens
ccttggcttttgcttggcag

SEQ ID NO: 2041916 - DNA, 22 bp, Homo sapiens
ccttggcttttgcttggcagag

SEQ ID NO: 2041917 - DNA, 11 bp, Homo sapiens
ccttgggacct

SEQ ID NO: 2041918 - DNA, 23 bp, Homo sapiens
ccttgggaggttttattctgact

SEQ ID NO: 2041919 - DNA, 16 bp, Homo sapiens
ccttgggcatccaccc

SEQ ID NO: 2041920 - DNA, 18 bp, Homo sapiens
ccttgggcatccacccag

SEQ ID NO: 2041921 - DNA, 22 bp, Homo sapiens
ccttgggcatccacccagtgct

SEQ ID NO: 2041922 - DNA, 23 bp, Homo sapiens
ccttgggcctccccccagcccct

SEQ ID NO: 2041923 - DNA, 21 bp, Homo sapiens
ccttgggctcctggctgccag

SEQ ID NO: 2041924 - DNA, 22 bp, Homo sapiens
ccttggggcctggcttgctcca

SEQ ID NO: 2041925 - DNA, 22 bp, Homo sapiens
ccttggggttcccccagacaga

SEQ ID NO: 2041926 - DNA, 16 bp, Homo sapiens
ccttggtgtccacctg

SEQ ID NO: 2041927 - DNA, 18 bp, Homo sapiens
ccttggtgtccacctggc

SEQ ID NO: 2041928 - DNA, 19 bp, Homo sapiens
ccttggtgtccacctggcc

SEQ ID NO: 2041929 - DNA, 21 bp, Homo sapiens
ccttggtgtccacctggcccc

SEQ ID NO: 2041930 - DNA, 19 bp, Homo sapiens
ccttggtgtgaccctctga

SEQ ID NO: 2041931 - DNA, 17 bp, Homo sapiens
ccttggttcccttgtgt

SEQ ID NO: 2041932 - DNA, 16 bp, Homo sapiens
ccttgtaccccatccc

SEQ ID NO: 2041933 - DNA, 17 bp, Homo sapiens
ccttgtaccccatccct

SEQ ID NO: 2041934 - DNA, 21 bp, Homo sapiens
ccttgtaccccatcccttcct

SEQ ID NO: 2041935 - DNA, 21 bp, Homo sapiens
ccttgtatttaaatattaaat

SEQ ID NO: 2041936 - DNA, 14 bp, Homo sapiens
ccttgtcaccagca

SEQ ID NO: 2041937 - DNA, 20 bp, Homo sapiens
ccttgtcaccagcaacatct

SEQ ID NO: 2041938 - DNA, 20 bp, Homo sapiens
ccttgtcaggacccaggccg

SEQ ID NO: 2041939 - DNA, 15 bp, Homo sapiens
ccttgtcctgccagc

SEQ ID NO: 2041940 - DNA, 16 bp, Homo sapiens
ccttgtcctgccagct

SEQ ID NO: 2041941 - DNA, 12 bp, Homo sapiens
ccttgtctctca

SEQ ID NO: 2041942 - DNA, 14 bp, Homo sapiens
ccttgtctctcatt

SEQ ID NO: 2041943 - DNA, 17 bp, Homo sapiens
ccttgtgaccttctcta

SEQ ID NO: 2041944 - DNA, 13 bp, Homo sapiens
ccttgtgctgggg

SEQ ID NO: 2041945 - DNA, 24 bp, Homo sapiens
ccttgtgcttggtggggctcgtgg

SEQ ID NO: 2041946 - DNA, 21 bp, Homo sapiens
ccttgttctgataatgaaaat

SEQ ID NO: 2041947 - DNA, 11 bp, Homo sapiens
ccttgttctgt

SEQ ID NO: 2041948 - DNA, 22 bp, Homo sapiens
ccttgtttgattttagctgcag

SEQ ID NO: 2041949 - DNA, 17 bp, Homo sapiens
ccttgtttggggcagga

SEQ ID NO: 2041950 - DNA, 22 bp, Homo sapiens
ccttgttttaagattgtaattc

SEQ ID NO: 2041951 - DNA, 18 bp, Homo sapiens
cctttaaagtaaaggcct

SEQ ID NO: 2041952 - DNA, 13 bp, Homo sapiens
cctttacctacca

SEQ ID NO: 2041953 - DNA, 16 bp, Homo sapiens
cctttacctaccacct

SEQ ID NO: 2041954 - DNA, 22 bp, Homo sapiens
cctttacctaccaccttccctc

SEQ ID NO: 2041955 - DNA, 14 bp, Homo sapiens
cctttagcgcccag

SEQ ID NO: 2041956 - DNA, 14 bp, Homo sapiens
ctcccacgtgggag

SEQ ID NO: 2041957 - DNA, 15 bp, Homo sapiens
ctcccacgtgggaga

SEQ ID NO: 2041958 - DNA, 19 bp, Homo sapiens
ctcccactggaacagccca

SEQ ID NO: 2041959 - DNA, 16 bp, Homo sapiens
ctcccagaccacctcc

SEQ ID NO: 2041960 - DNA, 13 bp, Homo sapiens
ctcccagatgctg

SEQ ID NO: 2041961 - DNA, 21 bp, Homo sapiens
ctcccagcaacacaagctgga

SEQ ID NO: 2041962 - DNA, 16 bp, Homo sapiens
ctcccagccctatgga

SEQ ID NO: 2041963 - DNA, 16 bp, Homo sapiens
ctcccagccctgccag

SEQ ID NO: 2041964 - DNA, 19 bp, Homo sapiens
ctcccagccctgccaggag

SEQ ID NO: 2041965 - DNA, 19 bp, Homo sapiens
ctcccaggagacagttcaa

SEQ ID NO: 2041966 - DNA, 17 bp, Homo sapiens
ctcccaggcgccccttc

SEQ ID NO: 2041967 - DNA, 12 bp, Homo sapiens
ctcccagggaca

SEQ ID NO: 2041968 - DNA, 22 bp, Homo sapiens
ctcccagggccagggccctgca

SEQ ID NO: 2041969 - DNA, 20 bp, Homo sapiens
ctcccaggtggattttgtgg

SEQ ID NO: 2041970 - DNA, 16 bp, Homo sapiens
ctcccataccatcact

SEQ ID NO: 2041971 - DNA, 18 bp, Homo sapiens
ctcccatagcgctggctc

SEQ ID NO: 2041972 - DNA, 13 bp, Homo sapiens
ctcccatctcctg

SEQ ID NO: 2041973 - DNA, 17 bp, Homo sapiens
ctcccatctctacccca

SEQ ID NO: 2041974 - DNA, 22 bp, Homo sapiens
ctcccatgcacacaaacacctc

SEQ ID NO: 2041975 - DNA, 14 bp, Homo sapiens
ctcccatggccttc

SEQ ID NO: 2041976 - DNA, 14 bp, Homo sapiens
ctccccacagtcct

SEQ ID NO: 2041977 - DNA, 19 bp, Homo sapiens
ctccccacagtcctcacag

SEQ ID NO: 2041978 - DNA, 23 bp, Homo sapiens
ctccccaccttcaattcctgggc

SEQ ID NO: 2041979 - DNA, 23 bp, Homo sapiens
ctccccacgagtcacctgcaagc

SEQ ID NO: 2041980 - DNA, 19 bp, Homo sapiens
ctccccactctgctctgat

SEQ ID NO: 2041981 - DNA, 12 bp, Homo sapiens
ctccccagcaag

SEQ ID NO: 2041982 - DNA, 20 bp, Homo sapiens
ctccccagcaagtgagagct

SEQ ID NO: 2041983 - DNA, 23 bp, Homo sapiens
ctccccagcaagtgagagctggg

SEQ ID NO: 2041984 - DNA, 15 bp, Homo sapiens
ctccccagccctggc

SEQ ID NO: 2041985 - DNA, 16 bp, Homo sapiens
ctccccagccctggct

SEQ ID NO: 2041986 - DNA, 22 bp, Homo sapiens
ctccccaggactcaccctcata

SEQ ID NO: 2041987 - DNA, 20 bp, Homo sapiens
ctccccagtgctacctctct

SEQ ID NO: 2041988 - DNA, 14 bp, Homo sapiens
ctcccccacaaata

SEQ ID NO: 2041989 - DNA, 13 bp, Homo sapiens
ctcccccacctga

SEQ ID NO: 2041990 - DNA, 15 bp, Homo sapiens
ctccccccactgcag

SEQ ID NO: 2041991 - DNA, 17 bp, Homo sapiens
ctcccccgacactgctg

SEQ ID NO: 2041992 - DNA, 14 bp, Homo sapiens
ctcccccgcccaag

SEQ ID NO: 2041993 - DNA, 14 bp, Homo sapiens
ctccccctcttggt

SEQ ID NO: 2041994 - DNA, 13 bp, Homo sapiens
ctccccctgccag

SEQ ID NO: 2041995 - DNA, 18 bp, Homo sapiens
ctccccctgccagtgcct

SEQ ID NO: 2041996 - DNA, 19 bp, Homo sapiens
ctccccctgccagtgcctt

SEQ ID NO: 2041997 - DNA, 14 bp, Homo sapiens
ctccccctgctgct

SEQ ID NO: 2041998 - DNA, 11 bp, Homo sapiens
ctccccctggg

SEQ ID NO: 2041999 - DNA, 16 bp, Homo sapiens
ctccccgcagagctcc

SEQ ID NO: 2042000 - DNA, 20 bp, Homo sapiens
ctccccgcctgtcctgcctc

SEQ ID NO: 2042001 - DNA, 22 bp, Homo sapiens
ctccccgggggcagacacctgt

SEQ ID NO: 2042002 - DNA, 18 bp, Homo sapiens
ctcccctatccacccagc

SEQ ID NO: 2042003 - DNA, 21 bp, Homo sapiens
ctcccctatccacccagccca

SEQ ID NO: 2042004 - DNA, 15 bp, Homo sapiens
ctcccctattttaag

SEQ ID NO: 2042005 - DNA, 16 bp, Homo sapiens
ctcccctcccccctgt

SEQ ID NO: 2042006 - DNA, 19 bp, Homo sapiens
ctcccctcccccctgtaaa

SEQ ID NO: 2042007 - DNA, 14 bp, Homo sapiens
ctcccctccctctt

SEQ ID NO: 2042008 - DNA, 12 bp, Homo sapiens
ctcccctgatcc

SEQ ID NO: 2042009 - DNA, 13 bp, Homo sapiens
ctcccctgccagg

SEQ ID NO: 2042010 - DNA, 16 bp, Homo sapiens
ctcccctgccagggct

SEQ ID NO: 2042011 - DNA, 14 bp, Homo sapiens
ctcccctgccctgc

SEQ ID NO: 2042012 - DNA, 15 bp, Homo sapiens
ctccccttcctgcac

SEQ ID NO: 2042013 - DNA, 20 bp, Homo sapiens
ctccccttcctgcacccgta

SEQ ID NO: 2042014 - DNA, 21 bp, Homo sapiens
ctccccttcctgcacccgtac

SEQ ID NO: 2042015 - DNA, 16 bp, Homo sapiens
ctcccgaatagctggg

SEQ ID NO: 2042016 - DNA, 18 bp, Homo sapiens
ctcccgaatagctgggac

SEQ ID NO: 2042017 - DNA, 23 bp, Homo sapiens
ctcccgaatagctgggactacag

SEQ ID NO: 2042018 - DNA, 15 bp, Homo sapiens
ctcccgagtagctgg

SEQ ID NO: 2042019 - DNA, 18 bp, Homo sapiens
ctccctaagaaaccccag

SEQ ID NO: 2042020 - DNA, 17 bp, Homo sapiens
ctccctaaggaatctga

SEQ ID NO: 2042021 - DNA, 18 bp, Homo sapiens
ctccctactcccctgggc

SEQ ID NO: 2042022 - DNA, 17 bp, Homo sapiens
ctccctagtggcttcct

SEQ ID NO: 2042023 - DNA, 22 bp, Homo sapiens
ctccctagtggcttcctccgtc

SEQ ID NO: 2042024 - DNA, 19 bp, Homo sapiens
ctccctattaacctagaga

SEQ ID NO: 2042025 - DNA, 14 bp, Homo sapiens
ctccctcaacccca

SEQ ID NO: 2042026 - DNA, 18 bp, Homo sapiens
ctccctcacccccaggtg

SEQ ID NO: 2042027 - DNA, 12 bp, Homo sapiens
ctccctccaccc

SEQ ID NO: 2042028 - DNA, 14 bp, Homo sapiens
ctccctccacccca

SEQ ID NO: 2042029 - DNA, 17 bp, Homo sapiens
ctccctcctctggccca

SEQ ID NO: 2042030 - DNA, 15 bp, Homo sapiens
ctccctcctggagca

SEQ ID NO: 2042031 - DNA, 15 bp, Homo sapiens
ctccctctcctgcct

SEQ ID NO: 2042032 - DNA, 17 bp, Homo sapiens
ctccctctcctgcctac

SEQ ID NO: 2042033 - DNA, 17 bp, Homo sapiens
ctccctctgacctgcag

SEQ ID NO: 2042034 - DNA, 18 bp, Homo sapiens
ctccctctgacctgcagg

SEQ ID NO: 2042035 - DNA, 14 bp, Homo sapiens
ctccctctgcccca

SEQ ID NO: 2042036 - DNA, 23 bp, Homo sapiens
ctccctctgccccaagcagccag

SEQ ID NO: 2042037 - DNA, 12 bp, Homo sapiens
ctccctcttcct

SEQ ID NO: 2042038 - DNA, 16 bp, Homo sapiens
ctccctcttccttccc

SEQ ID NO: 2042039 - DNA, 17 bp, Homo sapiens
ctccctcttccttcccc

SEQ ID NO: 2042040 - DNA, 17 bp, Homo sapiens
ctccctgaacctcagtt

SEQ ID NO: 2042041 - DNA, 19 bp, Homo sapiens
ctccctgaacctcagtttc

SEQ ID NO: 2042042 - DNA, 17 bp, Homo sapiens
ctccctgacatttctaa

SEQ ID NO: 2042043 - DNA, 21 bp, Homo sapiens
ctccctgacatttctaacata

SEQ ID NO: 2042044 - DNA, 16 bp, Homo sapiens
ctccctgactccctgt

SEQ ID NO: 2042045 - DNA, 19 bp, Homo sapiens
ctccctgactccctgtggg

SEQ ID NO: 2042046 - DNA, 18 bp, Homo sapiens
ctccctgcccctcccttc

SEQ ID NO: 2042047 - DNA, 18 bp, Homo sapiens
ctccctgccgcctcaatg

SEQ ID NO: 2042048 - DNA, 18 bp, Homo sapiens
ctccctggatcagaacag

SEQ ID NO: 2042049 - DNA, 16 bp, Homo sapiens
ctccctggctctcaga

SEQ ID NO: 2042050 - DNA, 19 bp, Homo sapiens
ctccctgtagctctgcctc

SEQ ID NO: 2042051 - DNA, 14 bp, Homo sapiens
ctccctgtcctcct

SEQ ID NO: 2042052 - DNA, 23 bp, Homo sapiens
ctcccttaggcattatttaatgt

SEQ ID NO: 2042053 - DNA, 18 bp, Homo sapiens
ctcccttcccctgcctgg

SEQ ID NO: 2042054 - DNA, 16 bp, Homo sapiens
ctcccttcctggcctc

SEQ ID NO: 2042055 - DNA, 17 bp, Homo sapiens
ctcccttcctggcctca

SEQ ID NO: 2042056 - DNA, 21 bp, Homo sapiens
ctcccttgctcagtgcctcct

SEQ ID NO: 2042057 - DNA, 23 bp, Homo sapiens
ctcccttgctcagtgcctcctgg

SEQ ID NO: 2042058 - DNA, 17 bp, Homo sapiens
ctcccttttgtccttcc

SEQ ID NO: 2042059 - DNA, 16 bp, Homo sapiens
ctccgcacttggaaag

SEQ ID NO: 2042060 - DNA, 16 bp, Homo sapiens
ctccgccccagacaca

SEQ ID NO: 2042061 - DNA, 21 bp, Homo sapiens
ctccgctaagacctccccacc

SEQ ID NO: 2042062 - DNA, 23 bp, Homo sapiens
ctccgctttctacccagcgagcc

SEQ ID NO: 2042063 - DNA, 22 bp, Homo sapiens
ctccgggaccattgacctcagc

SEQ ID NO: 2042064 - DNA, 19 bp, Homo sapiens
ctccggggagagcagaggg

SEQ ID NO: 2042065 - DNA, 15 bp, Homo sapiens
ctccggggtctgtgc

SEQ ID NO: 2042066 - DNA, 20 bp, Homo sapiens
ctccgggtgtggcctcagcc

SEQ ID NO: 2042067 - DNA, 23 bp, Homo sapiens
ctccggtgtgcctgcagccccgc

SEQ ID NO: 2042068 - DNA, 22 bp, Homo sapiens
ctccgtaggagctcacagtcta

SEQ ID NO: 2042069 - DNA, 20 bp, Homo sapiens
ctccgtcatgaatgccttcc

SEQ ID NO: 2042070 - DNA, 19 bp, Homo sapiens
ctccgtccacccaggctgc

SEQ ID NO: 2042071 - DNA, 23 bp, Homo sapiens
ctccgtccacccaggctgcactg

SEQ ID NO: 2042072 - DNA, 20 bp, Homo sapiens
ctccgtccaggagcctgtgc

SEQ ID NO: 2042073 - DNA, 22 bp, Homo sapiens
ctccgtcttagaagtggaccag

SEQ ID NO: 2042074 - DNA, 15 bp, Homo sapiens
ctccgtttatgggcc

SEQ ID NO: 2042075 - DNA, 21 bp, Homo sapiens
ctccgtttatgggccttgctt

SEQ ID NO: 2042076 - DNA, 20 bp, Homo sapiens
ctcctaagcagctgggacta

SEQ ID NO: 2042077 - DNA, 12 bp, Homo sapiens
ctcctacctcag

SEQ ID NO: 2042078 - DNA, 14 bp, Homo sapiens
ctcctacctcagcc

SEQ ID NO: 2042079 - DNA, 13 bp, Homo sapiens
ctcctacctggta

SEQ ID NO: 2042080 - DNA, 19 bp, Homo sapiens
ctcctagaggtgggcagct

SEQ ID NO: 2042081 - DNA, 14 bp, Homo sapiens
ctcctagctccacc

SEQ ID NO: 2042082 - DNA, 23 bp, Homo sapiens
ctcctagtttgacctcacagtga

SEQ ID NO: 2042083 - DNA, 15 bp, Homo sapiens
ctcctatccttggag

SEQ ID NO: 2042084 - DNA, 19 bp, Homo sapiens
ctcctattttaattggaat

SEQ ID NO: 2042085 - DNA, 15 bp, Homo sapiens
ctcctccaaaggaag

SEQ ID NO: 2042086 - DNA, 19 bp, Homo sapiens
ctcctccacagtgctgctt

SEQ ID NO: 2042087 - DNA, 14 bp, Homo sapiens
ctcctccactccac

SEQ ID NO: 2042088 - DNA, 13 bp, Homo sapiens
ctcctccagggcc

SEQ ID NO: 2042089 - DNA, 14 bp, Homo sapiens
ctcctccagggcca

SEQ ID NO: 2042090 - DNA, 20 bp, Homo sapiens
ctcctccagggccacgtgcc

SEQ ID NO: 2042091 - DNA, 13 bp, Homo sapiens
ctcctcccacaat

SEQ ID NO: 2042092 - DNA, 12 bp, Homo sapiens
ctcctcccacca

SEQ ID NO: 2042093 - DNA, 17 bp, Homo sapiens
ctcctcccaggcgcccc

SEQ ID NO: 2042094 - DNA, 22 bp, Homo sapiens
ctcctcccaggcgccccttccc

SEQ ID NO: 2042095 - DNA, 23 bp, Homo sapiens
ctcctcccaggcgccccttcccc

SEQ ID NO: 2042096 - DNA, 12 bp, Homo sapiens
ctcgcaacccgt

SEQ ID NO: 2042097 - DNA, 15 bp, Homo sapiens
ctcgcagcaggtgca

SEQ ID NO: 2042098 - DNA, 23 bp, Homo sapiens
ctcgcagcaggtgcaagagacag

SEQ ID NO: 2042099 - DNA, 14 bp, Homo sapiens
ctcgcaggtctcag

SEQ ID NO: 2042100 - DNA, 15 bp, Homo sapiens
ctcgcagtcgcagga

SEQ ID NO: 2042101 - DNA, 18 bp, Homo sapiens
ctcgcagtcgcaggatcc

SEQ ID NO: 2042102 - DNA, 17 bp, Homo sapiens
ctcgcatgccagagcct

SEQ ID NO: 2042103 - DNA, 17 bp, Homo sapiens
ctcgcccacaaactgat

SEQ ID NO: 2042104 - DNA, 12 bp, Homo sapiens
ctcgccctgggt

SEQ ID NO: 2042105 - DNA, 11 bp, Homo sapiens
ctcgcctgggc

SEQ ID NO: 2042106 - DNA, 13 bp, Homo sapiens
ctcgcctgggccc

SEQ ID NO: 2042107 - DNA, 19 bp, Homo sapiens
ctcgcctgggcccaggctc

SEQ ID NO: 2042108 - DNA, 20 bp, Homo sapiens
ctcgcctgggcccaggctct

SEQ ID NO: 2042109 - DNA, 21 bp, Homo sapiens
ctcgctccctgtagctctgcc

SEQ ID NO: 2042110 - DNA, 14 bp, Homo sapiens
ctcgctcttgggag

SEQ ID NO: 2042111 - DNA, 15 bp, Homo sapiens
ctcgctgctgctact

SEQ ID NO: 2042112 - DNA, 23 bp, Homo sapiens
ctcgctggaatcaatttcccaga

SEQ ID NO: 2042113 - DNA, 15 bp, Homo sapiens
ctcgcttctcctcca

SEQ ID NO: 2042114 - DNA, 16 bp, Homo sapiens
ctcggaaggctggctg

SEQ ID NO: 2042115 - DNA, 13 bp, Homo sapiens
ctcggagaagagc

SEQ ID NO: 2042116 - DNA, 23 bp, Homo sapiens
ctcggagcctcatccgaggcagg

SEQ ID NO: 2042117 - DNA, 20 bp, Homo sapiens
ctcggatcaccgagagtagc

SEQ ID NO: 2042118 - DNA, 21 bp, Homo sapiens
ctcggcaactaagcagtccct

SEQ ID NO: 2042119 - DNA, 14 bp, Homo sapiens
ctcggcctccaagg

SEQ ID NO: 2042120 - DNA, 19 bp, Homo sapiens
ctcgggcgctgtggctcct

SEQ ID NO: 2042121 - DNA, 20 bp, Homo sapiens
ctcggggcccttggggcctg

SEQ ID NO: 2042122 - DNA, 21 bp, Homo sapiens
ctcggggcccttggggcctgg

SEQ ID NO: 2042123 - DNA, 22 bp, Homo sapiens
ctcggggcccttggggcctggc

SEQ ID NO: 2042124 - DNA, 20 bp, Homo sapiens
ctcggggcgacccctcagtg

SEQ ID NO: 2042125 - DNA, 19 bp, Homo sapiens
ctcggggtgcacaggaggg

SEQ ID NO: 2042126 - DNA, 14 bp, Homo sapiens
ctcgggtgcatttg

SEQ ID NO: 2042127 - DNA, 18 bp, Homo sapiens
ctcggtggccatgcttct

SEQ ID NO: 2042128 - DNA, 12 bp, Homo sapiens
ctcgtaccagcc

SEQ ID NO: 2042129 - DNA, 18 bp, Homo sapiens
ctcgtatatgtctcaggt

SEQ ID NO: 2042130 - DNA, 16 bp, Homo sapiens
ctcgtccacaggggca

SEQ ID NO: 2042131 - DNA, 12 bp, Homo sapiens
ctcgtcctcccc

SEQ ID NO: 2042132 - DNA, 14 bp, Homo sapiens
ctcgtcctccccct

SEQ ID NO: 2042133 - DNA, 16 bp, Homo sapiens
ctcgtcctccccctgc

SEQ ID NO: 2042134 - DNA, 20 bp, Homo sapiens
ctcgtcctccccctgccagt

SEQ ID NO: 2042135 - DNA, 14 bp, Homo sapiens
ctcgtcctgtccca

SEQ ID NO: 2042136 - DNA, 19 bp, Homo sapiens
ctcgtgccatgatctgtat

SEQ ID NO: 2042137 - DNA, 20 bp, Homo sapiens
ctcgtggacacctgccctgc

SEQ ID NO: 2042138 - DNA, 16 bp, Homo sapiens
ctcgtggtagaagcca

SEQ ID NO: 2042139 - DNA, 21 bp, Homo sapiens
ctcgtttttcttcttaagact

SEQ ID NO: 2042140 - DNA, 20 bp, Homo sapiens
ctctaaaaataaaatgatgt

SEQ ID NO: 2042141 - DNA, 19 bp, Homo sapiens
ctctaaacccaaataaatg

SEQ ID NO: 2042142 - DNA, 19 bp, Homo sapiens
ctctaaatcttccttgtga

SEQ ID NO: 2042143 - DNA, 19 bp, Homo sapiens
ctctaaattctttatttct

SEQ ID NO: 2042144 - DNA, 18 bp, Homo sapiens
ctctaacgcctgagccca

SEQ ID NO: 2042145 - DNA, 22 bp, Homo sapiens
ctctaacgcctgagcccaggga

SEQ ID NO: 2042146 - DNA, 20 bp, Homo sapiens
ctctaagctggagctcttgg

SEQ ID NO: 2042147 - DNA, 21 bp, Homo sapiens
ctctacagctaatcagcattc

SEQ ID NO: 2042148 - DNA, 13 bp, Homo sapiens
ctctacatggtat

SEQ ID NO: 2042149 - DNA, 18 bp, Homo sapiens
ctctacccggcccagaga

SEQ ID NO: 2042150 - DNA, 14 bp, Homo sapiens
ctctaccctggtag

SEQ ID NO: 2042151 - DNA, 17 bp, Homo sapiens
ctctaccctggtaggaa

SEQ ID NO: 2042152 - DNA, 22 bp, Homo sapiens
ctctactaaaaatacaaaaatt

SEQ ID NO: 2042153 - DNA, 13 bp, Homo sapiens
ctctactctggaa

SEQ ID NO: 2042154 - DNA, 13 bp, Homo sapiens
ctctactgggaag

SEQ ID NO: 2042155 - DNA, 19 bp, Homo sapiens
ctctactgggaaggctact

SEQ ID NO: 2042156 - DNA, 17 bp, Homo sapiens
ctctacttagcatgtcc

SEQ ID NO: 2042157 - DNA, 21 bp, Homo sapiens
ctctacttctttttctttgag

SEQ ID NO: 2042158 - DNA, 19 bp, Homo sapiens
ctctagaacacccactggc

SEQ ID NO: 2042159 - DNA, 22 bp, Homo sapiens
ctctagaacacccactggccag

SEQ ID NO: 2042160 - DNA, 17 bp, Homo sapiens
ctctagaacatgcacat

SEQ ID NO: 2042161 - DNA, 23 bp, Homo sapiens
ctctagaacatgcacatttatat

SEQ ID NO: 2042162 - DNA, 23 bp, Homo sapiens
ctctagaattttaagtgctttgt

SEQ ID NO: 2042163 - DNA, 21 bp, Homo sapiens
ctctagacactgccacacagg

SEQ ID NO: 2042164 - DNA, 13 bp, Homo sapiens
ctctagccaggag

SEQ ID NO: 2042165 - DNA, 17 bp, Homo sapiens
ctctagccaggagtctg

SEQ ID NO: 2042166 - DNA, 20 bp, Homo sapiens
ctctagccaggagtctgtgc

SEQ ID NO: 2042167 - DNA, 23 bp, Homo sapiens
ctctagccaggagtctgtgctct

SEQ ID NO: 2042168 - DNA, 20 bp, Homo sapiens
ctctagcctgggccagagaa

SEQ ID NO: 2042169 - DNA, 16 bp, Homo sapiens
ctctagctggcaggac

SEQ ID NO: 2042170 - DNA, 14 bp, Homo sapiens
ctctaggctgcccc

SEQ ID NO: 2042171 - DNA, 15 bp, Homo sapiens
ctctagtattccaga

SEQ ID NO: 2042172 - DNA, 21 bp, Homo sapiens
ctctagtgccctccacagccg

SEQ ID NO: 2042173 - DNA, 19 bp, Homo sapiens
ctctagtttctttctgtta

SEQ ID NO: 2042174 - DNA, 18 bp, Homo sapiens
ctctattaagatttccaa

SEQ ID NO: 2042175 - DNA, 15 bp, Homo sapiens
ctctattcctgaccc

SEQ ID NO: 2042176 - DNA, 21 bp, Homo sapiens
ctctattgtagcatttcttga

SEQ ID NO: 2042177 - DNA, 13 bp, Homo sapiens
ctctatttaatat

SEQ ID NO: 2042178 - DNA, 15 bp, Homo sapiens
ctctatttaatattt

SEQ ID NO: 2042179 - DNA, 16 bp, Homo sapiens
ctctatttaatattta

SEQ ID NO: 2042180 - DNA, 17 bp, Homo sapiens
ctctatttaatatttat

SEQ ID NO: 2042181 - DNA, 10 bp, Homo sapiens
ctctcaatat

SEQ ID NO: 2042182 - DNA, 18 bp, Homo sapiens
ctctcaatattcaataaa

SEQ ID NO: 2042183 - DNA, 19 bp, Homo sapiens
ctctcacccgggactctcc

SEQ ID NO: 2042184 - DNA, 14 bp, Homo sapiens
ctctcagcctccca

SEQ ID NO: 2042185 - DNA, 21 bp, Homo sapiens
ctctcaggagcacaggcagct

SEQ ID NO: 2042186 - DNA, 16 bp, Homo sapiens
ctctcaggagtatctt

SEQ ID NO: 2042187 - DNA, 15 bp, Homo sapiens
ctctcaggggccagt

SEQ ID NO: 2042188 - DNA, 13 bp, Homo sapiens
ctctcagttattc

SEQ ID NO: 2042189 - DNA, 13 bp, Homo sapiens
ctctcatgcctgc

SEQ ID NO: 2042190 - DNA, 16 bp, Homo sapiens
ctctcattccccaggt

SEQ ID NO: 2042191 - DNA, 19 bp, Homo sapiens
ctctccaaaggggctgctg

SEQ ID NO: 2042192 - DNA, 21 bp, Homo sapiens
ctctccaaaggggctgctggg

SEQ ID NO: 2042193 - DNA, 13 bp, Homo sapiens
ctcttcctctgtt

SEQ ID NO: 2042194 - DNA, 14 bp, Homo sapiens
ctcttcctgcaagg

SEQ ID NO: 2042195 - DNA, 15 bp, Homo sapiens
ctcttcctggacctg

SEQ ID NO: 2042196 - DNA, 19 bp, Homo sapiens
ctcttcctggacctgagtc

SEQ ID NO: 2042197 - DNA, 23 bp, Homo sapiens
ctcttccttccgctcctttacct

SEQ ID NO: 2042198 - DNA, 15 bp, Homo sapiens
ctcttcggtttctga

SEQ ID NO: 2042199 - DNA, 17 bp, Homo sapiens
ctcttcggtttctgagc

SEQ ID NO: 2042200 - DNA, 15 bp, Homo sapiens
ctcttctaacctcag

SEQ ID NO: 2042201 - DNA, 18 bp, Homo sapiens
ctcttctatttaaaaaat

SEQ ID NO: 2042202 - DNA, 19 bp, Homo sapiens
ctcttctattttgtaaact

SEQ ID NO: 2042203 - DNA, 13 bp, Homo sapiens
ctcttctccactg

SEQ ID NO: 2042204 - DNA, 13 bp, Homo sapiens
ctcttctccaggc

SEQ ID NO: 2042205 - DNA, 16 bp, Homo sapiens
ctcttctcctttcaca

SEQ ID NO: 2042206 - DNA, 21 bp, Homo sapiens
ctcttctctattcctgaccct

SEQ ID NO: 2042207 - DNA, 14 bp, Homo sapiens
ctcttctcttcctg

SEQ ID NO: 2042208 - DNA, 15 bp, Homo sapiens
ctcttctcttcctgt

SEQ ID NO: 2042209 - DNA, 15 bp, Homo sapiens
ctcttctgtcatccc

SEQ ID NO: 2042210 - DNA, 15 bp, Homo sapiens
ctcttcttcttcaga

SEQ ID NO: 2042211 - DNA, 18 bp, Homo sapiens
ctcttcttcttcagaaga

SEQ ID NO: 2042212 - DNA, 22 bp, Homo sapiens
ctcttctttaaagggatggcaa

SEQ ID NO: 2042213 - DNA, 15 bp, Homo sapiens
ctcttgcctgcaccc

SEQ ID NO: 2042214 - DNA, 16 bp, Homo sapiens
ctcttgcctgcaccct

SEQ ID NO: 2042215 - DNA, 21 bp, Homo sapiens
ctcttgcctttcttatttgca

SEQ ID NO: 2042216 - DNA, 12 bp, Homo sapiens
ctcttgctcaaa

SEQ ID NO: 2042217 - DNA, 17 bp, Homo sapiens
ctcttggacctctgctc

SEQ ID NO: 2042218 - DNA, 13 bp, Homo sapiens
ctcttggcccctg

SEQ ID NO: 2042219 - DNA, 14 bp, Homo sapiens
ctcttgtacagtta

SEQ ID NO: 2042220 - DNA, 21 bp, Homo sapiens
ctctttaagagttagtttctt

SEQ ID NO: 2042221 - DNA, 18 bp, Homo sapiens
ctctttaatgtcacaggc

SEQ ID NO: 2042222 - DNA, 21 bp, Homo sapiens
ctctttaatgtcacaggcagg

SEQ ID NO: 2042223 - DNA, 22 bp, Homo sapiens
ctctttaatgtcacaggcaggt

SEQ ID NO: 2042224 - DNA, 16 bp, Homo sapiens
ctctttactcccttcc

SEQ ID NO: 2042225 - DNA, 23 bp, Homo sapiens
ctctttactcccttcctggcctc

SEQ ID NO: 2042226 - DNA, 14 bp, Homo sapiens
ctctttccccacct

SEQ ID NO: 2042227 - DNA, 22 bp, Homo sapiens
ctctttctttcttttgtgttgg

SEQ ID NO: 2042228 - DNA, 12 bp, Homo sapiens
ctctttgcctca

SEQ ID NO: 2042229 - DNA, 20 bp, Homo sapiens
ctctttgcctgtgtgagcat

SEQ ID NO: 2042230 - DNA, 19 bp, Homo sapiens
ctctttgctacaataaatg

SEQ ID NO: 2042231 - DNA, 21 bp, Homo sapiens
ctctttgctacaataaatgct

SEQ ID NO: 2042232 - DNA, 23 bp, Homo sapiens
ctctttgctacaataaatgctga

SEQ ID NO: 2042233 - DNA, 21 bp, Homo sapiens
ctctttgtcagtctgggtgtc

SEQ ID NO: 2042234 - DNA, 14 bp, Homo sapiens
ctcttttggccttg

SEQ ID NO: 2042235 - DNA, 18 bp, Homo sapiens
ctctttttagggccaggc

SEQ ID NO: 2042236 - DNA, 20 bp, Homo sapiens
ctctttttagggccaggcag

SEQ ID NO: 2042237 - DNA, 20 bp, Homo sapiens
ctcttttttcaactggctgg

SEQ ID NO: 2042238 - DNA, 15 bp, Homo sapiens
ctgaaaaaaagttta

SEQ ID NO: 2042239 - DNA, 19 bp, Homo sapiens
ctgaaaaactgatcaaaaa

SEQ ID NO: 2042240 - DNA, 17 bp, Homo sapiens
ctgaaaacccagagagg

SEQ ID NO: 2042241 - DNA, 17 bp, Homo sapiens
ctgaaaacgaaggggcc

SEQ ID NO: 2042242 - DNA, 15 bp, Homo sapiens
ctgaaaactgtaaat

SEQ ID NO: 2042243 - DNA, 19 bp, Homo sapiens
ctgaaaactgtaaatacaa

SEQ ID NO: 2042244 - DNA, 18 bp, Homo sapiens
ctgaaaagactcagtgtt

SEQ ID NO: 2042245 - DNA, 19 bp, Homo sapiens
ctgaaaagactcagtgttc

SEQ ID NO: 2042246 - DNA, 20 bp, Homo sapiens
ctgaaaagcaattgccctgt

SEQ ID NO: 2042247 - DNA, 17 bp, Homo sapiens
ctgaaaaggtttatgaa

SEQ ID NO: 2042248 - DNA, 18 bp, Homo sapiens
ctgaaaatcaaagtaaaa

SEQ ID NO: 2042249 - DNA, 12 bp, Homo sapiens
ctgaaaatcact

SEQ ID NO: 2042250 - DNA, 16 bp, Homo sapiens
ctgaaaatctaatatt

SEQ ID NO: 2042251 - DNA, 22 bp, Homo sapiens
ctgaaacattccgaagagggaa

SEQ ID NO: 2042252 - DNA, 13 bp, Homo sapiens
ctgaaacggcccc

SEQ ID NO: 2042253 - DNA, 21 bp, Homo sapiens
ctgaaagaaacagttaacttt

SEQ ID NO: 2042254 - DNA, 17 bp, Homo sapiens
ctgaaagacagaatgtc

SEQ ID NO: 2042255 - DNA, 21 bp, Homo sapiens
ctgaaagacagaatgtcacca

SEQ ID NO: 2042256 - DNA, 13 bp, Homo sapiens
ctgaaagcagcag

SEQ ID NO: 2042257 - DNA, 16 bp, Homo sapiens
ctgaaagcagcagcta

SEQ ID NO: 2042258 - DNA, 22 bp, Homo sapiens
ctgaaagcagcagctaggactg

SEQ ID NO: 2042259 - DNA, 18 bp, Homo sapiens
ctgaaagtggctcttcta

SEQ ID NO: 2042260 - DNA, 13 bp, Homo sapiens
ctgaaatttcaga

SEQ ID NO: 2042261 - DNA, 14 bp, Homo sapiens
ctgaaatttcagat

SEQ ID NO: 2042262 - DNA, 12 bp, Homo sapiens
ctgaaatttccc

SEQ ID NO: 2042263 - DNA, 13 bp, Homo sapiens
ctgaacaaaagct

SEQ ID NO: 2042264 - DNA, 17 bp, Homo sapiens
ctgaacacatactagaa

SEQ ID NO: 2042265 - DNA, 21 bp, Homo sapiens
ctgaacatttgctttgttttc

SEQ ID NO: 2042266 - DNA, 13 bp, Homo sapiens
ctgaaccactttg

SEQ ID NO: 2042267 - DNA, 14 bp, Homo sapiens
ctgaaccactttgc

SEQ ID NO: 2042268 - DNA, 14 bp, Homo sapiens
ctgaacctcagttt

SEQ ID NO: 2042269 - DNA, 15 bp, Homo sapiens
ctgaacctcagtttc

SEQ ID NO: 2042270 - DNA, 17 bp, Homo sapiens
ctgaacctcagtttcct

SEQ ID NO: 2042271 - DNA, 18 bp, Homo sapiens
ctgaacctcagtttcctc

SEQ ID NO: 2042272 - DNA, 19 bp, Homo sapiens
ctgaacctcagtttcctca

SEQ ID NO: 2042273 - DNA, 20 bp, Homo sapiens
ctgaacctcagtttcctcat

SEQ ID NO: 2042274 - DNA, 14 bp, Homo sapiens
ctgaacgagggata

SEQ ID NO: 2042275 - DNA, 14 bp, Homo sapiens
ctgaactcaagctg

SEQ ID NO: 2042276 - DNA, 16 bp, Homo sapiens
ctgaactcaagctgcg

SEQ ID NO: 2042277 - DNA, 17 bp, Homo sapiens
ctgaactcaagctgcgt

SEQ ID NO: 2042278 - DNA, 13 bp, Homo sapiens
ctgaagaacagta

SEQ ID NO: 2042279 - DNA, 20 bp, Homo sapiens
ctgaagacaaaccactgtac

SEQ ID NO: 2042280 - DNA, 21 bp, Homo sapiens
ctgaagactcattcttctgta

SEQ ID NO: 2042281 - DNA, 21 bp, Homo sapiens
ctgaagatttcagaggctgca

SEQ ID NO: 2042282 - DNA, 11 bp, Homo sapiens
ctgaagccaga

SEQ ID NO: 2042283 - DNA, 12 bp, Homo sapiens
ctgaagccagat

SEQ ID NO: 2042284 - DNA, 17 bp, Homo sapiens
ctgaagcccatgctttc

SEQ ID NO: 2042285 - DNA, 18 bp, Homo sapiens
ctgaagcccatgctttcc

SEQ ID NO: 2042286 - DNA, 21 bp, Homo sapiens
ctgaagcctctgccctgcctc

SEQ ID NO: 2042287 - DNA, 15 bp, Homo sapiens
ctgaagctattgatg

SEQ ID NO: 2042288 - DNA, 14 bp, Homo sapiens
ctgaagctttacca

SEQ ID NO: 2042289 - DNA, 21 bp, Homo sapiens
ctgaaggaatagccagagagg

SEQ ID NO: 2042290 - DNA, 16 bp, Homo sapiens
ctgaaggagattttcc

SEQ ID NO: 2042291 - DNA, 20 bp, Homo sapiens
ctgaaggagattttccttcc

SEQ ID NO: 2042292 - DNA, 22 bp, Homo sapiens
ctgaaggggcacaccactgccc

SEQ ID NO: 2042293 - DNA, 16 bp, Homo sapiens
ctgaagggggcggcct

SEQ ID NO: 2042294 - DNA, 16 bp, Homo sapiens
ctgaagggtgacatcc

SEQ ID NO: 2042295 - DNA, 17 bp, Homo sapiens
ctgaagggtgacatccc

SEQ ID NO: 2042296 - DNA, 16 bp, Homo sapiens
ctgaagtcacacagtg

SEQ ID NO: 2042297 - DNA, 18 bp, Homo sapiens
ctgaagtcacacagtgag

SEQ ID NO: 2042298 - DNA, 21 bp, Homo sapiens
ctgaagtcacatcacaggaca

SEQ ID NO: 2042299 - DNA, 22 bp, Homo sapiens
ctgaagtcactgcacagtgcat

SEQ ID NO: 2042300 - DNA, 14 bp, Homo sapiens
ctgaagtgaaggag

SEQ ID NO: 2042301 - DNA, 18 bp, Homo sapiens
ctgaagtgaaggagaaag

SEQ ID NO: 2042302 - DNA, 20 bp, Homo sapiens
ctgaagtgcttgcagatcat

SEQ ID NO: 2042303 - DNA, 16 bp, Homo sapiens
ctgaagttaacagaga

SEQ ID NO: 2042304 - DNA, 18 bp, Homo sapiens
ctgcagcttgtagccagc

SEQ ID NO: 2042305 - DNA, 22 bp, Homo sapiens
ctgcagcttgtagccagccggg

SEQ ID NO: 2042306 - DNA, 14 bp, Homo sapiens
ctgcagctttacat

SEQ ID NO: 2042307 - DNA, 21 bp, Homo sapiens
ctgcagctttacatgcaattt

SEQ ID NO: 2042308 - DNA, 20 bp, Homo sapiens
ctgcaggaatcaaaaattga

SEQ ID NO: 2042309 - DNA, 16 bp, Homo sapiens
ctgcaggacttctgcc

SEQ ID NO: 2042310 - DNA, 20 bp, Homo sapiens
ctgcaggcaccttagtggct

SEQ ID NO: 2042311 - DNA, 15 bp, Homo sapiens
ctgcaggccaagagc

SEQ ID NO: 2042312 - DNA, 24 bp, Homo sapiens
ctgcaggccaagagcagaggcagc

SEQ ID NO: 2042313 - DNA, 11 bp, Homo sapiens
ctgcaggcccc

SEQ ID NO: 2042314 - DNA, 22 bp, Homo sapiens
ctgcaggccccgcttgtccagc

SEQ ID NO: 2042315 - DNA, 17 bp, Homo sapiens
ctgcagggactgccagt

SEQ ID NO: 2042316 - DNA, 23 bp, Homo sapiens
ctgcagggggtgtgtctgctcag

SEQ ID NO: 2042317 - DNA, 15 bp, Homo sapiens
ctgcaggtacttcct

SEQ ID NO: 2042318 - DNA, 20 bp, Homo sapiens
ctgcaggtacttcctcctga

SEQ ID NO: 2042319 - DNA, 16 bp, Homo sapiens
ctgcagtagtctctgt

SEQ ID NO: 2042320 - DNA, 17 bp, Homo sapiens
ctgcagtcaacagttca

SEQ ID NO: 2042321 - DNA, 18 bp, Homo sapiens
ctgcagtgatggcgcggg

SEQ ID NO: 2042322 - DNA, 12 bp, Homo sapiens
ctgcataaactt

SEQ ID NO: 2042323 - DNA, 17 bp, Homo sapiens
ctgcatatcggaggtgg

SEQ ID NO: 2042324 - DNA, 19 bp, Homo sapiens
ctgcatatcggaggtggtg

SEQ ID NO: 2042325 - DNA, 15 bp, Homo sapiens
ctgcatccccttggc

SEQ ID NO: 2042326 - DNA, 22 bp, Homo sapiens
ctgcatccggagaattgcctct

SEQ ID NO: 2042327 - DNA, 21 bp, Homo sapiens
ctgcatccgtagttccctgaa

SEQ ID NO: 2042328 - DNA, 23 bp, Homo sapiens
ctgcatgcctggtctttcctctg

SEQ ID NO: 2042329 - DNA, 15 bp, Homo sapiens
ctgcatgctctggaa

SEQ ID NO: 2042330 - DNA, 18 bp, Homo sapiens
ctgcatgctctggaagcc

SEQ ID NO: 2042331 - DNA, 20 bp, Homo sapiens
ctgcattccccgctgcccaa

SEQ ID NO: 2042332 - DNA, 22 bp, Homo sapiens
ctgcattgttattgtggaagat

SEQ ID NO: 2042333 - DNA, 16 bp, Homo sapiens
ctgcatttataaatgt

SEQ ID NO: 2042334 - DNA, 17 bp, Homo sapiens
ctgcatttataaatgtg

SEQ ID NO: 2042335 - DNA, 18 bp, Homo sapiens
ctgcatttataaatgtgt

SEQ ID NO: 2042336 - DNA, 19 bp, Homo sapiens
ctgcatttataaatgtgtg

SEQ ID NO: 2042337 - DNA, 13 bp, Homo sapiens
ctgcatttgtgaa

SEQ ID NO: 2042338 - DNA, 20 bp, Homo sapiens
ctgcattttacgtctttgga

SEQ ID NO: 2042339 - DNA, 19 bp, Homo sapiens
ctgcattttattctggatg

SEQ ID NO: 2042340 - DNA, 20 bp, Homo sapiens
ctgcattttattctggatgg

SEQ ID NO: 2042341 - DNA, 24 bp, Homo sapiens
ctgccaagcctattgtgcctctgg

SEQ ID NO: 2042342 - DNA, 15 bp, Homo sapiens
ctgccacaccctccc

SEQ ID NO: 2042343 - DNA, 18 bp, Homo sapiens
ctgccacactcagtcccc

SEQ ID NO: 2042344 - DNA, 18 bp, Homo sapiens
ctgccaccaccagaaagc

SEQ ID NO: 2042345 - DNA, 14 bp, Homo sapiens
ctgccaccacgtct

SEQ ID NO: 2042346 - DNA, 14 bp, Homo sapiens
ctgccaccagtcac

SEQ ID NO: 2042347 - DNA, 17 bp, Homo sapiens
ctgccaccatcctgctg

SEQ ID NO: 2042348 - DNA, 14 bp, Homo sapiens
ctgccaccctgggg

SEQ ID NO: 2042349 - DNA, 16 bp, Homo sapiens
ctgccaccgccagagg

SEQ ID NO: 2042350 - DNA, 18 bp, Homo sapiens
ctgccaccgccagaggac

SEQ ID NO: 2042351 - DNA, 19 bp, Homo sapiens
ctgccaccgccagaggaca

SEQ ID NO: 2042352 - DNA, 20 bp, Homo sapiens
ctgccaccgccagaggacaa

SEQ ID NO: 2042353 - DNA, 22 bp, Homo sapiens
ctgccaccgccagaggacaagg

SEQ ID NO: 2042354 - DNA, 23 bp, Homo sapiens
ctgccaccgccagaggacaagga

SEQ ID NO: 2042355 - DNA, 22 bp, Homo sapiens
ctgccacctcccctatccaccc

SEQ ID NO: 2042356 - DNA, 13 bp, Homo sapiens
ctgccacctgtct

SEQ ID NO: 2042357 - DNA, 14 bp, Homo sapiens
ctgccacctgtctg

SEQ ID NO: 2042358 - DNA, 15 bp, Homo sapiens
ctgccacctgtctgt

SEQ ID NO: 2042359 - DNA, 16 bp, Homo sapiens
ctgccacctgtctgtc

SEQ ID NO: 2042360 - DNA, 17 bp, Homo sapiens
ctgccacctgtctgtct

SEQ ID NO: 2042361 - DNA, 12 bp, Homo sapiens
ctgccactgacc

SEQ ID NO: 2042362 - DNA, 16 bp, Homo sapiens
ctgccactgacctcac

SEQ ID NO: 2042363 - DNA, 17 bp, Homo sapiens
ctgccactgacctcacc

SEQ ID NO: 2042364 - DNA, 23 bp, Homo sapiens
ctgccacttccaggagcccagag

SEQ ID NO: 2042365 - DNA, 19 bp, Homo sapiens
ctgccactttggtacatgg

SEQ ID NO: 2042366 - DNA, 12 bp, Homo sapiens
ctgccagccagc

SEQ ID NO: 2042367 - DNA, 16 bp, Homo sapiens
ctgccagccagcagcc

SEQ ID NO: 2042368 - DNA, 19 bp, Homo sapiens
ctgccagccagcagccagc

SEQ ID NO: 2042369 - DNA, 13 bp, Homo sapiens
ctgccagcctggc

SEQ ID NO: 2042370 - DNA, 22 bp, Homo sapiens
ctgccagcctggcttctggagc

SEQ ID NO: 2042371 - DNA, 12 bp, Homo sapiens
ctgccagctgcc

SEQ ID NO: 2042372 - DNA, 13 bp, Homo sapiens
ctgccagctgcct

SEQ ID NO: 2042373 - DNA, 19 bp, Homo sapiens
ctgccagctgccttcctca

SEQ ID NO: 2042374 - DNA, 11 bp, Homo sapiens
ctgccaggaca

SEQ ID NO: 2042375 - DNA, 12 bp, Homo sapiens
ctgccaggacac

SEQ ID NO: 2042376 - DNA, 22 bp, Homo sapiens
ctgccaggacacctgccccagc

SEQ ID NO: 2042377 - DNA, 16 bp, Homo sapiens
ctgccaggaggctgcg

SEQ ID NO: 2042378 - DNA, 16 bp, Homo sapiens
ctgccaggcacctggc

SEQ ID NO: 2042379 - DNA, 15 bp, Homo sapiens
ctgccaggcccccgc

SEQ ID NO: 2042380 - DNA, 14 bp, Homo sapiens
ctgccaggcgttgg

SEQ ID NO: 2042381 - DNA, 23 bp, Homo sapiens
ctgccaggcgttggtgccacttc

SEQ ID NO: 2042382 - DNA, 16 bp, Homo sapiens
ctgccagggcccctgt

SEQ ID NO: 2042383 - DNA, 22 bp, Homo sapiens
ctgccagggctcgggcgctgtg

SEQ ID NO: 2042384 - DNA, 22 bp, Homo sapiens
ctgccagtccccctgccccagg

SEQ ID NO: 2042385 - DNA, 17 bp, Homo sapiens
ctgccagtgccttacct

SEQ ID NO: 2042386 - DNA, 21 bp, Homo sapiens
ctgccagtgccttacctcctg

SEQ ID NO: 2042387 - DNA, 16 bp, Homo sapiens
ctgccatattctgttg

SEQ ID NO: 2042388 - DNA, 21 bp, Homo sapiens
ctgccatattctgttggccag

SEQ ID NO: 2042389 - DNA, 22 bp, Homo sapiens
ctgccatattctgttggccagt

SEQ ID NO: 2042390 - DNA, 16 bp, Homo sapiens
ctgccatccaggttca

SEQ ID NO: 2042391 - DNA, 19 bp, Homo sapiens
ctgccatccaggttcagct

SEQ ID NO: 2042392 - DNA, 21 bp, Homo sapiens
ctgccatgccactgccaggca

SEQ ID NO: 2042393 - DNA, 23 bp, Homo sapiens
ctgccattaaatccgcaaacagc

SEQ ID NO: 2042394 - DNA, 21 bp, Homo sapiens
ctgccatttgcaccctccgcc

SEQ ID NO: 2042395 - DNA, 21 bp, Homo sapiens
ctgcccaatgctttgggaggc

SEQ ID NO: 2042396 - DNA, 22 bp, Homo sapiens
ctgcccaatgctttgggaggcc

SEQ ID NO: 2042397 - DNA, 17 bp, Homo sapiens
ctgcccacattggaccc

SEQ ID NO: 2042398 - DNA, 17 bp, Homo sapiens
ctgcccaggagagccag

SEQ ID NO: 2042399 - DNA, 16 bp, Homo sapiens
ctgcccaggcccctgc

SEQ ID NO: 2042400 - DNA, 18 bp, Homo sapiens
ctgcccaggcctgcctgt

SEQ ID NO: 2042401 - DNA, 16 bp, Homo sapiens
ctgcccagtgcacttg

SEQ ID NO: 2042402 - DNA, 21 bp, Homo sapiens
ctgcccagtgcacttgctgga

SEQ ID NO: 2042403 - DNA, 15 bp, Homo sapiens
ctgcccatacccctg

SEQ ID NO: 2042404 - DNA, 22 bp, Homo sapiens
ctgcccatgtgtcccctcactc

SEQ ID NO: 2042405 - DNA, 16 bp, Homo sapiens
ctgccccaacccccac

SEQ ID NO: 2042406 - DNA, 20 bp, Homo sapiens
ctgccccaactccttccagc

SEQ ID NO: 2042407 - DNA, 22 bp, Homo sapiens
ctgccccaactccttccagcta

SEQ ID NO: 2042408 - DNA, 24 bp, Homo sapiens
ctgccccaactccttccagctagt

SEQ ID NO: 2042409 - DNA, 14 bp, Homo sapiens
ctgccccaagcccc

SEQ ID NO: 2042410 - DNA, 23 bp, Homo sapiens
ctgccccaagcccccaaccccgc

SEQ ID NO: 2042411 - DNA, 12 bp, Homo sapiens
ctgccccaaggg

SEQ ID NO: 2042412 - DNA, 13 bp, Homo sapiens
ctgccccaagggg

SEQ ID NO: 2042413 - DNA, 14 bp, Homo sapiens
ctgccccaccagcc

SEQ ID NO: 2042414 - DNA, 18 bp, Homo sapiens
ctgccccaccagccacct

SEQ ID NO: 2042415 - DNA, 19 bp, Homo sapiens
ctgccccaccagccacctc

SEQ ID NO: 2042416 - DNA, 12 bp, Homo sapiens
ctgccccaccct

SEQ ID NO: 2042417 - DNA, 13 bp, Homo sapiens
ctgccccagaggc

SEQ ID NO: 2042418 - DNA, 15 bp, Homo sapiens
ctgccccagcgcggc

SEQ ID NO: 2042419 - DNA, 17 bp, Homo sapiens
ctgccccagcgcggctt

SEQ ID NO: 2042420 - DNA, 20 bp, Homo sapiens
ctgagtggaatgcagggaag

SEQ ID NO: 2042421 - DNA, 18 bp, Homo sapiens
ctgagtggatctccaagg

SEQ ID NO: 2042422 - DNA, 23 bp, Homo sapiens
ctgagtggctgaaataaaagcct

SEQ ID NO: 2042423 - DNA, 24 bp, Homo sapiens
ctgagttacttgtctgaggcctca

SEQ ID NO: 2042424 - DNA, 14 bp, Homo sapiens
ctgagttcctgcat

SEQ ID NO: 2042425 - DNA, 22 bp, Homo sapiens
ctgagttccttataagaattaa

SEQ ID NO: 2042426 - DNA, 20 bp, Homo sapiens
ctgagttgacttgacagaac

SEQ ID NO: 2042427 - DNA, 17 bp, Homo sapiens
ctgctgcaccagagtga

SEQ ID NO: 2042428 - DNA, 15 bp, Homo sapiens
ctgctgcccagcctc

SEQ ID NO: 2042429 - DNA, 19 bp, Homo sapiens
ctgctgccgcctcccagcc

SEQ ID NO: 2042430 - DNA, 20 bp, Homo sapiens
ctgctgccgcctcccagcct

SEQ ID NO: 2042431 - DNA, 11 bp, Homo sapiens
ctgctgctcat

SEQ ID NO: 2042432 - DNA, 14 bp, Homo sapiens
ctgctgctcatcca

SEQ ID NO: 2042433 - DNA, 11 bp, Homo sapiens
ctgctgctccc

SEQ ID NO: 2042434 - DNA, 11 bp, Homo sapiens
ctgctgctgag

SEQ ID NO: 2042435 - DNA, 14 bp, Homo sapiens
ctgctgctgagaac

SEQ ID NO: 2042436 - DNA, 19 bp, Homo sapiens
ctgctgctgagaacctggc

SEQ ID NO: 2042437 - DNA, 20 bp, Homo sapiens
ctgctgctgagaacctggcc

SEQ ID NO: 2042438 - DNA, 23 bp, Homo sapiens
ctgctgctgagaacctggccttc

SEQ ID NO: 2042439 - DNA, 21 bp, Homo sapiens
ctgctgctgtaactgctgagc

SEQ ID NO: 2042440 - DNA, 13 bp, Homo sapiens
ctgctgctgtgtt

SEQ ID NO: 2042441 - DNA, 20 bp, Homo sapiens
ctgctggcacctcagacaat

SEQ ID NO: 2042442 - DNA, 13 bp, Homo sapiens
ctgctggcctgga

SEQ ID NO: 2042443 - DNA, 14 bp, Homo sapiens
ctgctggctgcctt

SEQ ID NO: 2042444 - DNA, 21 bp, Homo sapiens
ctgctgggaaccccgcagccc

SEQ ID NO: 2042445 - DNA, 22 bp, Homo sapiens
ctgctgggaaccccgcagcccg

SEQ ID NO: 2042446 - DNA, 16 bp, Homo sapiens
ctgctgggctctccac

SEQ ID NO: 2042447 - DNA, 19 bp, Homo sapiens
ctgctgggctctccacctc

SEQ ID NO: 2042448 - DNA, 23 bp, Homo sapiens
ctgctggttcagggttggcccct

SEQ ID NO: 2042449 - DNA, 17 bp, Homo sapiens
ctgctgtaactgctgag

SEQ ID NO: 2042450 - DNA, 19 bp, Homo sapiens
ctgctgtaactgctgagcc

SEQ ID NO: 2042451 - DNA, 20 bp, Homo sapiens
ctgctgtaactgctgagcca

SEQ ID NO: 2042452 - DNA, 22 bp, Homo sapiens
ctgctgtgcaccttacattcct

SEQ ID NO: 2042453 - DNA, 16 bp, Homo sapiens
ctgctgtggcctcact

SEQ ID NO: 2042454 - DNA, 21 bp, Homo sapiens
ctgctgtggcctcacttccct

SEQ ID NO: 2042455 - DNA, 22 bp, Homo sapiens
ctgctgtggcctcacttccctg

SEQ ID NO: 2042456 - DNA, 20 bp, Homo sapiens
ctgctgtgtgaattcccagg

SEQ ID NO: 2042457 - DNA, 14 bp, Homo sapiens
ctgctgtgtgcctt

SEQ ID NO: 2042458 - DNA, 14 bp, Homo sapiens
ctgcttacccttca

SEQ ID NO: 2042459 - DNA, 14 bp, Homo sapiens
ctgcttacctgacg

SEQ ID NO: 2042460 - DNA, 23 bp, Homo sapiens
ctgcttagtatctcatcaacaaa

SEQ ID NO: 2042461 - DNA, 16 bp, Homo sapiens
ctgcttcagcctcccg

SEQ ID NO: 2042462 - DNA, 12 bp, Homo sapiens
ctgcttcagtgg

SEQ ID NO: 2042463 - DNA, 21 bp, Homo sapiens
ctgcttcatgctcagccctga

SEQ ID NO: 2042464 - DNA, 18 bp, Homo sapiens
ctgcttcccatgcctgca

SEQ ID NO: 2042465 - DNA, 20 bp, Homo sapiens
ctgcttccttctgcacccag

SEQ ID NO: 2042466 - DNA, 15 bp, Homo sapiens
ctgcttctagtattt

SEQ ID NO: 2042467 - DNA, 14 bp, Homo sapiens
ctgcttctcagccc

SEQ ID NO: 2042468 - DNA, 15 bp, Homo sapiens
ctgcttctgaactca

SEQ ID NO: 2042469 - DNA, 16 bp, Homo sapiens
ctgcttctgtccagga

SEQ ID NO: 2042470 - DNA, 17 bp, Homo sapiens
ctgcttgactatcacat

SEQ ID NO: 2042471 - DNA, 18 bp, Homo sapiens
ctgcttgactatcacata

SEQ ID NO: 2042472 - DNA, 21 bp, Homo sapiens
ctgcttgaggaggggcacctg

SEQ ID NO: 2042473 - DNA, 17 bp, Homo sapiens
ctgcttggtcaaatccc

SEQ ID NO: 2042474 - DNA, 13 bp, Homo sapiens
ctgcttgtgggcc

SEQ ID NO: 2042475 - DNA, 20 bp, Homo sapiens
ctgcttgttgtcaagtataa

SEQ ID NO: 2042476 - DNA, 15 bp, Homo sapiens
ctgctttcaacttaa

SEQ ID NO: 2042477 - DNA, 23 bp, Homo sapiens
ctgctttcaacttaaatcactga

SEQ ID NO: 2042478 - DNA, 13 bp, Homo sapiens
ctgctttctcctg

SEQ ID NO: 2042479 - DNA, 14 bp, Homo sapiens
ctgctttctcctgg

SEQ ID NO: 2042480 - DNA, 17 bp, Homo sapiens
ctgctttgcgctggtgg

SEQ ID NO: 2042481 - DNA, 17 bp, Homo sapiens
ctgctttgggctgccct

SEQ ID NO: 2042482 - DNA, 18 bp, Homo sapiens
ctgctttgggctgccctg

SEQ ID NO: 2042483 - DNA, 21 bp, Homo sapiens
ctgctttgggctgccctggtg

SEQ ID NO: 2042484 - DNA, 21 bp, Homo sapiens
ctgcttttccaggatcctgca

SEQ ID NO: 2042485 - DNA, 22 bp, Homo sapiens
ctgcttttccaggatcctgcag

SEQ ID NO: 2042486 - DNA, 15 bp, Homo sapiens
ctgcttttggtctgt

SEQ ID NO: 2042487 - DNA, 19 bp, Homo sapiens
ctggaaaaaaaatatatat

SEQ ID NO: 2042488 - DNA, 14 bp, Homo sapiens
ctggaaaagcactt

SEQ ID NO: 2042489 - DNA, 15 bp, Homo sapiens
ctggaaaagcacttt

SEQ ID NO: 2042490 - DNA, 18 bp, Homo sapiens
ctggaaaagtcacacaga

SEQ ID NO: 2042491 - DNA, 21 bp, Homo sapiens
ctggaaagactgattgtttta

SEQ ID NO: 2042492 - DNA, 13 bp, Homo sapiens
ctggaaaggctca

SEQ ID NO: 2042493 - DNA, 15 bp, Homo sapiens
ctggaaaggctcagt

SEQ ID NO: 2042494 - DNA, 20 bp, Homo sapiens
ctggaaaggctcagtctcag

SEQ ID NO: 2042495 - DNA, 10 bp, Homo sapiens
ctggaaataa

SEQ ID NO: 2042496 - DNA, 17 bp, Homo sapiens
ctgggactacaggtgtg

SEQ ID NO: 2042497 - DNA, 17 bp, Homo sapiens
ctgggagaacctcaggc

SEQ ID NO: 2042498 - DNA, 18 bp, Homo sapiens
ctgggagaacctcaggct

SEQ ID NO: 2042499 - DNA, 15 bp, Homo sapiens
ctgggagagaaggag

SEQ ID NO: 2042500 - DNA, 13 bp, Homo sapiens
ctgggaggaaaag

SEQ ID NO: 2042501 - DNA, 22 bp, Homo sapiens
ctgggaggaaaagaaaagaggg

SEQ ID NO: 2042502 - DNA, 19 bp, Homo sapiens
ctgggaggcatggccctgg

SEQ ID NO: 2042503 - DNA, 18 bp, Homo sapiens
ctgggagtgttctgtttc

SEQ ID NO: 2042504 - DNA, 17 bp, Homo sapiens
ctgggatggaccctcgc

SEQ ID NO: 2042505 - DNA, 22 bp, Homo sapiens
ctgggatggaccctcgcagcag

SEQ ID NO: 2042506 - DNA, 17 bp, Homo sapiens
ctgggatgggaccaggg

SEQ ID NO: 2042507 - DNA, 20 bp, Homo sapiens
ctgggatgggaccagggatg

SEQ ID NO: 2042508 - DNA, 14 bp, Homo sapiens
ctgggatgtagaac

SEQ ID NO: 2042509 - DNA, 14 bp, Homo sapiens
ctgggatgtttctg

SEQ ID NO: 2042510 - DNA, 19 bp, Homo sapiens
ctgggatgtttctgtcaca

SEQ ID NO: 2042511 - DNA, 22 bp, Homo sapiens
ctgggattcaggaaaaggcctg

SEQ ID NO: 2042512 - DNA, 15 bp, Homo sapiens
ctgggattcccacca

SEQ ID NO: 2042513 - DNA, 20 bp, Homo sapiens
ctgggattcccaccaaggtc

SEQ ID NO: 2042514 - DNA, 14 bp, Homo sapiens
ctgggattcctccc

SEQ ID NO: 2042515 - DNA, 19 bp, Homo sapiens
ctgggatttcttcgctgct

SEQ ID NO: 2042516 - DNA, 20 bp, Homo sapiens
ctgggatttcttcgctgctc

SEQ ID NO: 2042517 - DNA, 22 bp, Homo sapiens
ctgggatttcttcgctgctcta

SEQ ID NO: 2042518 - DNA, 21 bp, Homo sapiens
ctgggcaaacccttctcttct

SEQ ID NO: 2042519 - DNA, 22 bp, Homo sapiens
ctgggcaaacccttctcttctc

SEQ ID NO: 2042520 - DNA, 12 bp, Homo sapiens
ctgggcaagaac

SEQ ID NO: 2042521 - DNA, 17 bp, Homo sapiens
ctgggcaccacaggctg

SEQ ID NO: 2042522 - DNA, 14 bp, Homo sapiens
ctgggcacccacct

SEQ ID NO: 2042523 - DNA, 20 bp, Homo sapiens
ctgggcacccacctccaccc

SEQ ID NO: 2042524 - DNA, 18 bp, Homo sapiens
ctgggcagcatagcaaga

SEQ ID NO: 2042525 - DNA, 16 bp, Homo sapiens
ctgggcagctgtcatg

SEQ ID NO: 2042526 - DNA, 23 bp, Homo sapiens
ctgggcaggtctcctctgggagg

SEQ ID NO: 2042527 - DNA, 15 bp, Homo sapiens
ctgggcatctcgtgc

SEQ ID NO: 2042528 - DNA, 16 bp, Homo sapiens
ctgggcatcttctggc

SEQ ID NO: 2042529 - DNA, 17 bp, Homo sapiens
ctgggccaaaagggcag

SEQ ID NO: 2042530 - DNA, 20 bp, Homo sapiens
ctgggccaaaagggcagcca

SEQ ID NO: 2042531 - DNA, 21 bp, Homo sapiens
ctgggccaagttcctctagtg

SEQ ID NO: 2042532 - DNA, 15 bp, Homo sapiens
ctgggccagcctcag

SEQ ID NO: 2042533 - DNA, 20 bp, Homo sapiens
ctgtacccaatttaattcca

SEQ ID NO: 2042534 - DNA, 23 bp, Homo sapiens
ctgtacccagctccttttgtccc

SEQ ID NO: 2042535 - DNA, 17 bp, Homo sapiens
ctgtacccttccacctc

SEQ ID NO: 2042536 - DNA, 20 bp, Homo sapiens
ctgtacgaacccctcccctc

SEQ ID NO: 2042537 - DNA, 14 bp, Homo sapiens
ctgtacgtctgaca

SEQ ID NO: 2042538 - DNA, 16 bp, Homo sapiens
ctgtacgtctgacagg

SEQ ID NO: 2042539 - DNA, 18 bp, Homo sapiens
ctgtacgtctgacaggca

SEQ ID NO: 2042540 - DNA, 16 bp, Homo sapiens
ctgtactcagagcaga

SEQ ID NO: 2042541 - DNA, 20 bp, Homo sapiens
ctgtactcaggaggctgagg

SEQ ID NO: 2042542 - DNA, 19 bp, Homo sapiens
ctgtactcctcccaggcgc

SEQ ID NO: 2042543 - DNA, 14 bp, Homo sapiens
ctgtactgtaattt

SEQ ID NO: 2042544 - DNA, 16 bp, Homo sapiens
ctgtacttaataaatt

SEQ ID NO: 2042545 - DNA, 17 bp, Homo sapiens
ctgtacttattttccaa

SEQ ID NO: 2042546 - DNA, 20 bp, Homo sapiens
ctgtacttcaagttaaagtg

SEQ ID NO: 2042547 - DNA, 19 bp, Homo sapiens
ctgtagagtcactgaccct

SEQ ID NO: 2042548 - DNA, 15 bp, Homo sapiens
ctgtagcatcttctg

SEQ ID NO: 2042549 - DNA, 18 bp, Homo sapiens
ctgtagcatcttctggag

SEQ ID NO: 2042550 - DNA, 18 bp, Homo sapiens
ctgtagccccagtgacag

SEQ ID NO: 2042551 - DNA, 21 bp, Homo sapiens
ctgtagccccagtgacagcta

SEQ ID NO: 2042552 - DNA, 14 bp, Homo sapiens
ctgtagctctcctg

SEQ ID NO: 2042553 - DNA, 15 bp, Homo sapiens
ctgtagctctcctgg

SEQ ID NO: 2042554 - DNA, 20 bp, Homo sapiens
ctgtagctctgcctccctct

SEQ ID NO: 2042555 - DNA, 18 bp, Homo sapiens
ctgtagggctggacctat

SEQ ID NO: 2042556 - DNA, 22 bp, Homo sapiens
ctgtttggtgtaggtaaatcta

SEQ ID NO: 2042557 - DNA, 20 bp, Homo sapiens
ctgtttgtttgacaaagaaa

SEQ ID NO: 2042558 - DNA, 12 bp, Homo sapiens
ctgttttaaatt

SEQ ID NO: 2042559 - DNA, 22 bp, Homo sapiens
ctgttttaaatttatttcaaaa

SEQ ID NO: 2042560 - DNA, 13 bp, Homo sapiens
ctgttttccacac

SEQ ID NO: 2042561 - DNA, 23 bp, Homo sapiens
ctgttttgtatcaaaatcactat

SEQ ID NO: 2042562 - DNA, 17 bp, Homo sapiens
ctgtttttaagctgttt

SEQ ID NO: 2042563 - DNA, 15 bp, Homo sapiens
ctgtttttctgggtg

SEQ ID NO: 2042564 - DNA, 15 bp, Homo sapiens
cttaaaaaaatgaca

SEQ ID NO: 2042565 - DNA, 12 bp, Homo sapiens
cttaaaaaactt

SEQ ID NO: 2042566 - DNA, 13 bp, Homo sapiens
cttaaaaaatgtc

SEQ ID NO: 2042567 - DNA, 14 bp, Homo sapiens
cttaaaacaacact

SEQ ID NO: 2042568 - DNA, 12 bp, Homo sapiens
cttaaaagagta

SEQ ID NO: 2042569 - DNA, 13 bp, Homo sapiens
cttaaaataactt

SEQ ID NO: 2042570 - DNA, 14 bp, Homo sapiens
cttaaaatatttta

SEQ ID NO: 2042571 - DNA, 16 bp, Homo sapiens
cttaaaattggtaatt

SEQ ID NO: 2042572 - DNA, 16 bp, Homo sapiens
cttaaacttgacccag

SEQ ID NO: 2042573 - DNA, 13 bp, Homo sapiens
cttaaaggcctgg

SEQ ID NO: 2042574 - DNA, 21 bp, Homo sapiens
cttaaaggctgtggtagtact

SEQ ID NO: 2042575 - DNA, 13 bp, Homo sapiens
cttaaataaattc

SEQ ID NO: 2042576 - DNA, 15 bp, Homo sapiens
cttaaataaattcaa

SEQ ID NO: 2042577 - DNA, 21 bp, Homo sapiens
cttaaattgcttttgttgtga

SEQ ID NO: 2042578 - DNA, 13 bp, Homo sapiens
cttaacatattta

SEQ ID NO: 2042579 - DNA, 14 bp, Homo sapiens
cttaacattctgta

SEQ ID NO: 2042580 - DNA, 11 bp, Homo sapiens
cttaactgtgt

SEQ ID NO: 2042581 - DNA, 20 bp, Homo sapiens
cttaactgtgtgaagaaatg

SEQ ID NO: 2042582 - DNA, 22 bp, Homo sapiens
cttaactgtgtgaagaaatgga

SEQ ID NO: 2042583 - DNA, 12 bp, Homo sapiens
cttaagagaaat

SEQ ID NO: 2042584 - DNA, 18 bp, Homo sapiens
cttaagatttctcctgac

SEQ ID NO: 2042585 - DNA, 21 bp, Homo sapiens
cttaaggacttagctggccac

SEQ ID NO: 2042586 - DNA, 18 bp, Homo sapiens
cttaaggaggtagctccc

SEQ ID NO: 2042587 - DNA, 19 bp, Homo sapiens
cttaagggttgaaggcagt

SEQ ID NO: 2042588 - DNA, 23 bp, Homo sapiens
cttaagggttgaaggcagtctga

SEQ ID NO: 2042589 - DNA, 17 bp, Homo sapiens
cttaatgagaacattta

SEQ ID NO: 2042590 - DNA, 19 bp, Homo sapiens
cttaatgagaacatttaca

SEQ ID NO: 2042591 - DNA, 14 bp, Homo sapiens
cttaatgagatagt

SEQ ID NO: 2042592 - DNA, 14 bp, Homo sapiens
cttaatgctttcct

SEQ ID NO: 2042593 - DNA, 22 bp, Homo sapiens
cttaatggctgataattttaaa

SEQ ID NO: 2042594 - DNA, 20 bp, Homo sapiens
cttaatgttctgaataattt

SEQ ID NO: 2042595 - DNA, 15 bp, Homo sapiens
cttaatgtttattcc

SEQ ID NO: 2042596 - DNA, 15 bp, Homo sapiens
cttaattctgagctg

SEQ ID NO: 2042597 - DNA, 22 bp, Homo sapiens
cttaattctgagctggcccttt

SEQ ID NO: 2042598 - DNA, 18 bp, Homo sapiens
cttacaaattctacagca

SEQ ID NO: 2042599 - DNA, 14 bp, Homo sapiens
cttaccaactttct

SEQ ID NO: 2042600 - DNA, 16 bp, Homo sapiens
cttaccaactttctgt

SEQ ID NO: 2042601 - DNA, 22 bp, Homo sapiens
cttacccggagaaggccgctgc

SEQ ID NO: 2042602 - DNA, 19 bp, Homo sapiens
cttacctcccctgccaggg

SEQ ID NO: 2042603 - DNA, 22 bp, Homo sapiens
cttacctcccctgccagggctc

SEQ ID NO: 2042604 - DNA, 18 bp, Homo sapiens
cttacctcctgcccagga

SEQ ID NO: 2042605 - DNA, 19 bp, Homo sapiens
cttacctgacacaagagga

SEQ ID NO: 2042606 - DNA, 19 bp, Homo sapiens
cttacctgggcattcttgt

SEQ ID NO: 2042607 - DNA, 20 bp, Homo sapiens
cttacctgtatgtctccagt

SEQ ID NO: 2042608 - DNA, 12 bp, Homo sapiens
cttacctgtgag

SEQ ID NO: 2042609 - DNA, 18 bp, Homo sapiens
cttactacttcttggaaa

SEQ ID NO: 2042610 - DNA, 15 bp, Homo sapiens
cttactcccaggcac

SEQ ID NO: 2042611 - DNA, 16 bp, Homo sapiens
cttactcctgtgggag

SEQ ID NO: 2042612 - DNA, 20 bp, Homo sapiens
cttactcctgtgggagcctc

SEQ ID NO: 2042613 - DNA, 13 bp, Homo sapiens
cttactctgagcc

SEQ ID NO: 2042614 - DNA, 14 bp, Homo sapiens
cttactctgagccc

SEQ ID NO: 2042615 - DNA, 20 bp, Homo sapiens
cttactctgagcccaggccg

SEQ ID NO: 2042616 - DNA, 22 bp, Homo sapiens
cttactctgagcccaggccgtt

SEQ ID NO: 2042617 - DNA, 17 bp, Homo sapiens
cttactctttcactcag

SEQ ID NO: 2042618 - DNA, 12 bp, Homo sapiens
cttacttaaaaa

SEQ ID NO: 2042619 - DNA, 20 bp, Homo sapiens
cttacttaagtcgggggtgg

SEQ ID NO: 2042620 - DNA, 19 bp, Homo sapiens
cttagaaatcattgtagaa

SEQ ID NO: 2042621 - DNA, 20 bp, Homo sapiens
cttagaaatcattgtagaaa

SEQ ID NO: 2042622 - DNA, 23 bp, Homo sapiens
cttagaaatcattgtagaaacac

SEQ ID NO: 2042623 - DNA, 16 bp, Homo sapiens
cttagaaattgcattt

SEQ ID NO: 2042624 - DNA, 15 bp, Homo sapiens
cttagaacctttctt

SEQ ID NO: 2042625 - DNA, 22 bp, Homo sapiens
cttagaagtggaccaggacagg

SEQ ID NO: 2042626 - DNA, 15 bp, Homo sapiens
cttagaataaaattg

SEQ ID NO: 2042627 - DNA, 16 bp, Homo sapiens
cttagaataaaattgt

SEQ ID NO: 2042628 - DNA, 12 bp, Homo sapiens
cttagacctcag

SEQ ID NO: 2042629 - DNA, 16 bp, Homo sapiens
cttagagattgcccca

SEQ ID NO: 2042630 - DNA, 17 bp, Homo sapiens
cttagattagctctgga

SEQ ID NO: 2042631 - DNA, 18 bp, Homo sapiens
cttagattagctctggac

SEQ ID NO: 2042632 - DNA, 20 bp, Homo sapiens
cttagattagctctggacca

SEQ ID NO: 2042633 - DNA, 11 bp, Homo sapiens
cttagcacttc

SEQ ID NO: 2042634 - DNA, 23 bp, Homo sapiens
cttagcagctcttcccctttcct

SEQ ID NO: 2042635 - DNA, 18 bp, Homo sapiens
cttagcagggaaacagct

SEQ ID NO: 2042636 - DNA, 22 bp, Homo sapiens
cttagcatgcctccaaaaattc

SEQ ID NO: 2042637 - DNA, 12 bp, Homo sapiens
cttagcccaaga

SEQ ID NO: 2042638 - DNA, 14 bp, Homo sapiens
cttagcccaagagg

SEQ ID NO: 2042639 - DNA, 17 bp, Homo sapiens
cttagcccaagaggtct

SEQ ID NO: 2042640 - DNA, 14 bp, Homo sapiens
cttagcctcctgac

SEQ ID NO: 2042641 - DNA, 21 bp, Homo sapiens
cttagcctcctgacctgaggc

SEQ ID NO: 2042642 - DNA, 22 bp, Homo sapiens
cttagcctcctgacctgaggct

SEQ ID NO: 2042643 - DNA, 22 bp, Homo sapiens
cttagcctggagcacctttcct

SEQ ID NO: 2042644 - DNA, 15 bp, Homo sapiens
cttagccttgtgccc

SEQ ID NO: 2042645 - DNA, 14 bp, Homo sapiens
cttagctatcagaa

SEQ ID NO: 2042646 - DNA, 17 bp, Homo sapiens
cttagctgtctgctcag

SEQ ID NO: 2042647 - DNA, 14 bp, Homo sapiens
cttagcttagacct

SEQ ID NO: 2042648 - DNA, 15 bp, Homo sapiens
cttagcttagacctc

SEQ ID NO: 2042649 - DNA, 18 bp, Homo sapiens
cttagcttagacctcagc

SEQ ID NO: 2042650 - DNA, 21 bp, Homo sapiens
cttagcttagacctcagcctg

SEQ ID NO: 2042651 - DNA, 23 bp, Homo sapiens
cttagcttctattatagccacat

SEQ ID NO: 2042652 - DNA, 16 bp, Homo sapiens
cttagctttccacagg

SEQ ID NO: 2042653 - DNA, 19 bp, Homo sapiens
cttaggaaaatgcttctgt

SEQ ID NO: 2042654 - DNA, 16 bp, Homo sapiens
cttaggagcagagctc

SEQ ID NO: 2042655 - DNA, 17 bp, Homo sapiens
cttagtatctcatcaac

SEQ ID NO: 2042656 - DNA, 19 bp, Homo sapiens
cttagtgcccgcctaggag

SEQ ID NO: 2042657 - DNA, 23 bp, Homo sapiens
cttagtgcccgcctaggagttga

SEQ ID NO: 2042658 - DNA, 13 bp, Homo sapiens
cttataaatgtgt

SEQ ID NO: 2042659 - DNA, 12 bp, Homo sapiens
cttataagaatt

SEQ ID NO: 2042660 - DNA, 14 bp, Homo sapiens
cttatagaatattt

SEQ ID NO: 2042661 - DNA, 13 bp, Homo sapiens
cttatagcaagaa

SEQ ID NO: 2042662 - DNA, 14 bp, Homo sapiens
cttataggtttcca

SEQ ID NO: 2042663 - DNA, 23 bp, Homo sapiens
cttatagtcaatgtttcttttat

SEQ ID NO: 2042664 - DNA, 19 bp, Homo sapiens
cttatatagcagcaaaaat

SEQ ID NO: 2042665 - DNA, 18 bp, Homo sapiens
cttatatagtattcattt

SEQ ID NO: 2042666 - DNA, 23 bp, Homo sapiens
cttatcagctacttaagagaaat

SEQ ID NO: 2042667 - DNA, 17 bp, Homo sapiens
cttatcccttctttttc

SEQ ID NO: 2042668 - DNA, 15 bp, Homo sapiens
cttatcttgaaaaga

SEQ ID NO: 2042669 - DNA, 21 bp, Homo sapiens
cttatgacatcacttgtacaa

SEQ ID NO: 2042670 - DNA, 15 bp, Homo sapiens
cttatgcctatacct

SEQ ID NO: 2042671 - DNA, 15 bp, Homo sapiens
cttcgctgccaggac

SEQ ID NO: 2042672 - DNA, 17 bp, Homo sapiens
cttcgctgccaggacac

SEQ ID NO: 2042673 - DNA, 18 bp, Homo sapiens
cttcgctgccaggacacc

SEQ ID NO: 2042674 - DNA, 19 bp, Homo sapiens
cttcgctgccaggacacct

SEQ ID NO: 2042675 - DNA, 21 bp, Homo sapiens
cttcgctgccaggacacctgc

SEQ ID NO: 2042676 - DNA, 22 bp, Homo sapiens
cttcgctgccaggacacctgcc

SEQ ID NO: 2042677 - DNA, 13 bp, Homo sapiens
cttcgctgctcta

SEQ ID NO: 2042678 - DNA, 21 bp, Homo sapiens
cttcgctgctctagctggcag

SEQ ID NO: 2042679 - DNA, 16 bp, Homo sapiens
cttcggtttctgagca

SEQ ID NO: 2042680 - DNA, 17 bp, Homo sapiens
cttcgtgtctctcccac

SEQ ID NO: 2042681 - DNA, 17 bp, Homo sapiens
cttctaaaatgctttta

SEQ ID NO: 2042682 - DNA, 13 bp, Homo sapiens
cttctaaacattt

SEQ ID NO: 2042683 - DNA, 14 bp, Homo sapiens
cttctaaacatttt

SEQ ID NO: 2042684 - DNA, 15 bp, Homo sapiens
cttctaaatgcccag

SEQ ID NO: 2042685 - DNA, 20 bp, Homo sapiens
cttctaaatgttggaatttt

SEQ ID NO: 2042686 - DNA, 23 bp, Homo sapiens
cttctaacctcagccaaacacag

SEQ ID NO: 2042687 - DNA, 22 bp, Homo sapiens
cttctaaggaaatggagaagct

SEQ ID NO: 2042688 - DNA, 23 bp, Homo sapiens
cttctaaggaaatggagaagctc

SEQ ID NO: 2042689 - DNA, 17 bp, Homo sapiens
cttctaagtaaaaccac

SEQ ID NO: 2042690 - DNA, 18 bp, Homo sapiens
cttctacaaccagagccc

SEQ ID NO: 2042691 - DNA, 19 bp, Homo sapiens
cttctacaaccagagcccc

SEQ ID NO: 2042692 - DNA, 21 bp, Homo sapiens
cttctacttttaagttgctga

SEQ ID NO: 2042693 - DNA, 17 bp, Homo sapiens
cttctagatctggaacc

SEQ ID NO: 2042694 - DNA, 19 bp, Homo sapiens
cttctaggagtcaactggc

SEQ ID NO: 2042695 - DNA, 16 bp, Homo sapiens
cttctaggttctaaaa

SEQ ID NO: 2042696 - DNA, 19 bp, Homo sapiens
cttctagttagctgcttta

SEQ ID NO: 2042697 - DNA, 16 bp, Homo sapiens
cttctattaaatgtat

SEQ ID NO: 2042698 - DNA, 15 bp, Homo sapiens
cttctattttgtaaa

SEQ ID NO: 2042699 - DNA, 21 bp, Homo sapiens
cttctcaaaagattgttttat

SEQ ID NO: 2042700 - DNA, 21 bp, Homo sapiens
cttctcagccccgggcctgcc

SEQ ID NO: 2042701 - DNA, 23 bp, Homo sapiens
cttctcaggacacaggcctgtgt

SEQ ID NO: 2042702 - DNA, 12 bp, Homo sapiens
cttctcagtgtt

SEQ ID NO: 2042703 - DNA, 21 bp, Homo sapiens
cttctcatcatattgtatgta

SEQ ID NO: 2042704 - DNA, 20 bp, Homo sapiens
cttctcattccaacagtgag

SEQ ID NO: 2042705 - DNA, 20 bp, Homo sapiens
cttctcattttttaaaaaag

SEQ ID NO: 2042706 - DNA, 15 bp, Homo sapiens
cttctccaacactga

SEQ ID NO: 2042707 - DNA, 17 bp, Homo sapiens
cttctccaccctgctct

SEQ ID NO: 2042708 - DNA, 21 bp, Homo sapiens
cttctccaccctgctctccga

SEQ ID NO: 2042709 - DNA, 17 bp, Homo sapiens
cttctccactggatgga

SEQ ID NO: 2042710 - DNA, 17 bp, Homo sapiens
cttctccaggctgtatc

SEQ ID NO: 2042711 - DNA, 13 bp, Homo sapiens
cttctccctggct

SEQ ID NO: 2042712 - DNA, 19 bp, Homo sapiens
cttctcctgacccagtccc

SEQ ID NO: 2042713 - DNA, 14 bp, Homo sapiens
cttctcctttcaca

SEQ ID NO: 2042714 - DNA, 14 bp, Homo sapiens
cttctcgcattttc

SEQ ID NO: 2042715 - DNA, 15 bp, Homo sapiens
cttctctacagactt

SEQ ID NO: 2042716 - DNA, 16 bp, Homo sapiens
cttctctctctggtca

SEQ ID NO: 2042717 - DNA, 18 bp, Homo sapiens
cttctctgccaagccctc

SEQ ID NO: 2042718 - DNA, 14 bp, Homo sapiens
cttctctgttcatt

SEQ ID NO: 2042719 - DNA, 17 bp, Homo sapiens
cttctctgttcatttcc

SEQ ID NO: 2042720 - DNA, 14 bp, Homo sapiens
cttctcttcctgta

SEQ ID NO: 2042721 - DNA, 15 bp, Homo sapiens
cttctctttgcctca

SEQ ID NO: 2042722 - DNA, 17 bp, Homo sapiens
cttctgaactcaagctg

SEQ ID NO: 2042723 - DNA, 12 bp, Homo sapiens
cttctgcaccca

SEQ ID NO: 2042724 - DNA, 14 bp, Homo sapiens
cttctgcagcaact

SEQ ID NO: 2042725 - DNA, 16 bp, Homo sapiens
cttctgcagcaactcc

SEQ ID NO: 2042726 - DNA, 17 bp, Homo sapiens
cttctgcagcaactccc

SEQ ID NO: 2042727 - DNA, 22 bp, Homo sapiens
cttctgcagcaactcccacgac

SEQ ID NO: 2042728 - DNA, 15 bp, Homo sapiens
cttctgccatattct

SEQ ID NO: 2042729 - DNA, 21 bp, Homo sapiens
cttctgctaaatttaataaaa

SEQ ID NO: 2042730 - DNA, 13 bp, Homo sapiens
cttctgcttcagc

SEQ ID NO: 2042731 - DNA, 13 bp, Homo sapiens
cttctgcttctcc

SEQ ID NO: 2042732 - DNA, 15 bp, Homo sapiens
cttctggaaggctgg

SEQ ID NO: 2042733 - DNA, 18 bp, Homo sapiens
cttctggaaggctggctg

SEQ ID NO: 2042734 - DNA, 16 bp, Homo sapiens
cttctggagtctccag

SEQ ID NO: 2042735 - DNA, 18 bp, Homo sapiens
cttctggagtctccagtg

SEQ ID NO: 2042736 - DNA, 21 bp, Homo sapiens
cttctgggaagacaactagga

SEQ ID NO: 2042737 - DNA, 17 bp, Homo sapiens
cttctgggtggctcctg

SEQ ID NO: 2042738 - DNA, 21 bp, Homo sapiens
cttctgggtggctcctgccac

SEQ ID NO: 2042739 - DNA, 22 bp, Homo sapiens
cttctgggtggctcctgccact

SEQ ID NO: 2042740 - DNA, 20 bp, Homo sapiens
cttctgtacgtctgacaggc

SEQ ID NO: 2042741 - DNA, 21 bp, Homo sapiens
cttctgtacgtctgacaggca

SEQ ID NO: 2042742 - DNA, 21 bp, Homo sapiens
cttctgtcatcccgctcctgc

SEQ ID NO: 2042743 - DNA, 15 bp, Homo sapiens
cttctgtccaaggca

SEQ ID NO: 2042744 - DNA, 15 bp, Homo sapiens
cttctgtccaggaca

SEQ ID NO: 2042745 - DNA, 18 bp, Homo sapiens
cttctgtcctactctgtg

SEQ ID NO: 2042746 - DNA, 18 bp, Homo sapiens
cttctgtgcactagcctg

SEQ ID NO: 2042747 - DNA, 15 bp, Homo sapiens
cttctgttctcaaat

SEQ ID NO: 2042748 - DNA, 14 bp, Homo sapiens
cttctgttgtaata

SEQ ID NO: 2042749 - DNA, 16 bp, Homo sapiens
cttcttaaaggcctgg

SEQ ID NO: 2042750 - DNA, 17 bp, Homo sapiens
cttcttaaaggcctgga

SEQ ID NO: 2042751 - DNA, 23 bp, Homo sapiens
cttcttaatgctttcctccctgg

SEQ ID NO: 2042752 - DNA, 22 bp, Homo sapiens
cttcttattctcactccaccac

SEQ ID NO: 2042753 - DNA, 22 bp, Homo sapiens
cttcttcaagcacctgcagatt

SEQ ID NO: 2042754 - DNA, 19 bp, Homo sapiens
cttcttcacccgctgcagc

SEQ ID NO: 2042755 - DNA, 18 bp, Homo sapiens
cttcttcagatcagtgct

SEQ ID NO: 2042756 - DNA, 21 bp, Homo sapiens
cttcttcagccacctctcttt

SEQ ID NO: 2042757 - DNA, 17 bp, Homo sapiens
cttcttcggggaactcc

SEQ ID NO: 2042758 - DNA, 12 bp, Homo sapiens
cttcttcttata

SEQ ID NO: 2042759 - DNA, 20 bp, Homo sapiens
cttcttgaaacagcctgggt

SEQ ID NO: 2042760 - DNA, 15 bp, Homo sapiens
cttcttgagcagacc

SEQ ID NO: 2042761 - DNA, 12 bp, Homo sapiens
cttcttgcccct

SEQ ID NO: 2042762 - DNA, 13 bp, Homo sapiens
cttcttgcccctt

SEQ ID NO: 2042763 - DNA, 14 bp, Homo sapiens
cttcttgccccttg

SEQ ID NO: 2042764 - DNA, 12 bp, Homo sapiens
cttcttggcttc

SEQ ID NO: 2042765 - DNA, 20 bp, Homo sapiens
cttcttggtcttatttatta

SEQ ID NO: 2042766 - DNA, 20 bp, Homo sapiens
cttcttgtgaaaccacaggc

SEQ ID NO: 2042767 - DNA, 18 bp, Homo sapiens
cttcttgtgtcctgatga

SEQ ID NO: 2042768 - DNA, 12 bp, Homo sapiens
cttctttaaatc

SEQ ID NO: 2042769 - DNA, 17 bp, Homo sapiens
cttctttaattgatcta

SEQ ID NO: 2042770 - DNA, 13 bp, Homo sapiens
cttcttttgctct

SEQ ID NO: 2042771 - DNA, 22 bp, Homo sapiens
cttgaaagcagttaaactgatt

SEQ ID NO: 2042772 - DNA, 24 bp, Homo sapiens
cttgaaattatatctgtggtcttc

SEQ ID NO: 2042773 - DNA, 19 bp, Homo sapiens
cttgaaattttaaactata

SEQ ID NO: 2042774 - DNA, 13 bp, Homo sapiens
cttgaacactggg

SEQ ID NO: 2042775 - DNA, 15 bp, Homo sapiens
cttgaacactggggg

SEQ ID NO: 2042776 - DNA, 16 bp, Homo sapiens
cttgaacactggggga

SEQ ID NO: 2042777 - DNA, 15 bp, Homo sapiens
cttgaacccaggaga

SEQ ID NO: 2042778 - DNA, 14 bp, Homo sapiens
cttgaactcctggc

SEQ ID NO: 2042779 - DNA, 23 bp, Homo sapiens
cttgggcatccacccagtgctgc

SEQ ID NO: 2042780 - DNA, 14 bp, Homo sapiens
cttgggccctgcac

SEQ ID NO: 2042781 - DNA, 19 bp, Homo sapiens
cttgggccctgcacagata

SEQ ID NO: 2042782 - DNA, 19 bp, Homo sapiens
cttgggctactggcagctc

SEQ ID NO: 2042783 - DNA, 20 bp, Homo sapiens
cttgggctactggcagctcc

SEQ ID NO: 2042784 - DNA, 17 bp, Homo sapiens
cttgggctcctggctgc

SEQ ID NO: 2042785 - DNA, 19 bp, Homo sapiens
cttgggctcctggctgcca

SEQ ID NO: 2042786 - DNA, 22 bp, Homo sapiens
cttggggagacctctactgcct

SEQ ID NO: 2042787 - DNA, 17 bp, Homo sapiens
cttggggtaagccagag

SEQ ID NO: 2042788 - DNA, 18 bp, Homo sapiens
cttggggtcccagggaag

SEQ ID NO: 2042789 - DNA, 15 bp, Homo sapiens
cttgggtaggcggga

SEQ ID NO: 2042790 - DNA, 16 bp, Homo sapiens
cttgggtcgccctacc

SEQ ID NO: 2042791 - DNA, 16 bp, Homo sapiens
cttggtaaattgtaaa

SEQ ID NO: 2042792 - DNA, 23 bp, Homo sapiens
cttggtactactagatgtcttta

SEQ ID NO: 2042793 - DNA, 15 bp, Homo sapiens
cttggtcatgcttca

SEQ ID NO: 2042794 - DNA, 13 bp, Homo sapiens
cttggtccctggt

SEQ ID NO: 2042795 - DNA, 20 bp, Homo sapiens
cttggtcctgtcaccctggc

SEQ ID NO: 2042796 - DNA, 23 bp, Homo sapiens
cttggtcctgtcaccctggcccc

SEQ ID NO: 2042797 - DNA, 16 bp, Homo sapiens
cttggtctcagcttca

SEQ ID NO: 2042798 - DNA, 15 bp, Homo sapiens
cttggtgactgtccc

SEQ ID NO: 2042799 - DNA, 13 bp, Homo sapiens
cttggtggctgag

SEQ ID NO: 2042800 - DNA, 15 bp, Homo sapiens
cttggtggctgagct

SEQ ID NO: 2042801 - DNA, 21 bp, Homo sapiens
cttggtggggctcgtggcctt

SEQ ID NO: 2042802 - DNA, 16 bp, Homo sapiens
cttggtgtccacctgg

SEQ ID NO: 2042803 - DNA, 17 bp, Homo sapiens
cttggtgtccacctggc

SEQ ID NO: 2042804 - DNA, 17 bp, Homo sapiens
cttggttcccttgtgtg

SEQ ID NO: 2042805 - DNA, 16 bp, Homo sapiens
cttggttcctctacta

SEQ ID NO: 2042806 - DNA, 22 bp, Homo sapiens
cttggttgaagttgtgttaaca

SEQ ID NO: 2042807 - DNA, 18 bp, Homo sapiens
cttggtttggggagaaat

SEQ ID NO: 2042808 - DNA, 16 bp, Homo sapiens
cttggtttttggctct

SEQ ID NO: 2042809 - DNA, 19 bp, Homo sapiens
cttgtaaataaatagattt

SEQ ID NO: 2042810 - DNA, 16 bp, Homo sapiens
cttgtaaatagctcag

SEQ ID NO: 2042811 - DNA, 14 bp, Homo sapiens
cttgtaactccacc

SEQ ID NO: 2042812 - DNA, 15 bp, Homo sapiens
cttgtaactccacca

SEQ ID NO: 2042813 - DNA, 17 bp, Homo sapiens
cttgtaactccaccaac

SEQ ID NO: 2042814 - DNA, 12 bp, Homo sapiens
cttgtacatatt

SEQ ID NO: 2042815 - DNA, 13 bp, Homo sapiens
cttgtacatgtgt

SEQ ID NO: 2042816 - DNA, 19 bp, Homo sapiens
cttgtacatgtgtagcctg

SEQ ID NO: 2042817 - DNA, 19 bp, Homo sapiens
cttgtacctatggctgcct

SEQ ID NO: 2042818 - DNA, 22 bp, Homo sapiens
cttgtagaccactgtcctggct

SEQ ID NO: 2042819 - DNA, 14 bp, Homo sapiens
cttgtagccagccg

SEQ ID NO: 2042820 - DNA, 17 bp, Homo sapiens
cttgtagggatgccttt

SEQ ID NO: 2042821 - DNA, 17 bp, Homo sapiens
cttgtatagtgtaaaat

SEQ ID NO: 2042822 - DNA, 15 bp, Homo sapiens
cttgtatatacatat

SEQ ID NO: 2042823 - DNA, 22 bp, Homo sapiens
cttgtatatacatattataaat

SEQ ID NO: 2042824 - DNA, 18 bp, Homo sapiens
cttgtatatacttcactc

SEQ ID NO: 2042825 - DNA, 16 bp, Homo sapiens
cttgtatattccacca

SEQ ID NO: 2042826 - DNA, 21 bp, Homo sapiens
cttgtatgaaagatggctgtg

SEQ ID NO: 2042827 - DNA, 13 bp, Homo sapiens
cttgtattttcca

SEQ ID NO: 2042828 - DNA, 22 bp, Homo sapiens
cttgtattttcttcccatttgt

SEQ ID NO: 2042829 - DNA, 23 bp, Homo sapiens
cttgtattttcttcccatttgta

SEQ ID NO: 2042830 - DNA, 17 bp, Homo sapiens
cttgtcactagcagctg

SEQ ID NO: 2042831 - DNA, 19 bp, Homo sapiens
cttgtcactagcagctgca

SEQ ID NO: 2042832 - DNA, 20 bp, Homo sapiens
cttgtcactatgctatttct

SEQ ID NO: 2042833 - DNA, 15 bp, Homo sapiens
cttgtcactggtaga

SEQ ID NO: 2042834 - DNA, 13 bp, Homo sapiens
cttgtcaggaccc

SEQ ID NO: 2042835 - DNA, 17 bp, Homo sapiens
cttgtcaggacccaggc

SEQ ID NO: 2042836 - DNA, 22 bp, Homo sapiens
cttgtcaggacccaggccgcct

SEQ ID NO: 2042837 - DNA, 23 bp, Homo sapiens
cttgtcatggaaaatgtcctgtg

SEQ ID NO: 2042838 - DNA, 17 bp, Homo sapiens
cttgtcatgtaccatca

SEQ ID NO: 2042839 - DNA, 14 bp, Homo sapiens
cttgtccacagtct

SEQ ID NO: 2042840 - DNA, 15 bp, Homo sapiens
cttgtccctgcccag

SEQ ID NO: 2042841 - DNA, 19 bp, Homo sapiens
cttgtcctgctctcttcag

SEQ ID NO: 2042842 - DNA, 20 bp, Homo sapiens
cttgtctccactaaatgagc

SEQ ID NO: 2042843 - DNA, 23 bp, Homo sapiens
cttgtctccactaaatgagctcc

SEQ ID NO: 2042844 - DNA, 13 bp, Homo sapiens
cttgtctctgggc

SEQ ID NO: 2042845 - DNA, 14 bp, Homo sapiens
cttgtctgaggcct

SEQ ID NO: 2042846 - DNA, 15 bp, Homo sapiens
cttgtctgaggcctc

SEQ ID NO: 2042847 - DNA, 17 bp, Homo sapiens
cttgtctgaggcctcat

SEQ ID NO: 2042848 - DNA, 20 bp, Homo sapiens
cttgtctgaggcctcatccc

SEQ ID NO: 2042849 - DNA, 16 bp, Homo sapiens
cttgtgagagctggtt

SEQ ID NO: 2042850 - DNA, 16 bp, Homo sapiens
cttgtgccctgccccc

SEQ ID NO: 2042851 - DNA, 21 bp, Homo sapiens
cttgtgccctgcccccatctc

SEQ ID NO: 2042852 - DNA, 23 bp, Homo sapiens
cttgtgctcacgctcccccgcag

SEQ ID NO: 2042853 - DNA, 14 bp, Homo sapiens
cttgtgctgagaat

SEQ ID NO: 2042854 - DNA, 13 bp, Homo sapiens
cttgtggacacag

SEQ ID NO: 2042855 - DNA, 16 bp, Homo sapiens
cttgtggacacagctc

SEQ ID NO: 2042856 - DNA, 18 bp, Homo sapiens
cttgtggacacagctctt

SEQ ID NO: 2042857 - DNA, 21 bp, Homo sapiens
cttgtggacacagctcttctc

SEQ ID NO: 2042858 - DNA, 22 bp, Homo sapiens
cttgtggaggatgaatagatgt

SEQ ID NO: 2042859 - DNA, 15 bp, Homo sapiens
ctctgctctgaggct

SEQ ID NO: 2042860 - DNA, 14 bp, Homo sapiens
ctctgctgacagac

SEQ ID NO: 2042861 - DNA, 16 bp, Homo sapiens
ctctgctgacagacac

SEQ ID NO: 2042862 - DNA, 17 bp, Homo sapiens
ctctgctgacagacaca

SEQ ID NO: 2042863 - DNA, 13 bp, Homo sapiens
ctctgctgccatg

SEQ ID NO: 2042864 - DNA, 13 bp, Homo sapiens
ctctgctgctccc

SEQ ID NO: 2042865 - DNA, 14 bp, Homo sapiens
ctctgctggcctgg

SEQ ID NO: 2042866 - DNA, 16 bp, Homo sapiens
ctctgctggcctggcc

SEQ ID NO: 2042867 - DNA, 19 bp, Homo sapiens
ctctgcttacccttcacct

SEQ ID NO: 2042868 - DNA, 22 bp, Homo sapiens
ctctgcttgcatcacttggggt

SEQ ID NO: 2042869 - DNA, 14 bp, Homo sapiens
ctctgctttaaagt

SEQ ID NO: 2042870 - DNA, 17 bp, Homo sapiens
ctctggaaaactcagga

SEQ ID NO: 2042871 - DNA, 13 bp, Homo sapiens
ctctggaaagcaa

SEQ ID NO: 2042872 - DNA, 21 bp, Homo sapiens
ctctggaagagaggaatgcct

SEQ ID NO: 2042873 - DNA, 22 bp, Homo sapiens
ctctggaagccccccacctttc

SEQ ID NO: 2042874 - DNA, 16 bp, Homo sapiens
ctctggaccaaccctg

SEQ ID NO: 2042875 - DNA, 13 bp, Homo sapiens
ctctggaccagcc

SEQ ID NO: 2042876 - DNA, 15 bp, Homo sapiens
ctctggagccagaga

SEQ ID NO: 2042877 - DNA, 16 bp, Homo sapiens
ctctggagccagagag

SEQ ID NO: 2042878 - DNA, 13 bp, Homo sapiens
ctctggatccctg

SEQ ID NO: 2042879 - DNA, 17 bp, Homo sapiens
ctctggatccctggagg

SEQ ID NO: 2042880 - DNA, 17 bp, Homo sapiens
ctctggatcctgctgtg

SEQ ID NO: 2042881 - DNA, 19 bp, Homo sapiens
ctctggatcctgctgtggc

SEQ ID NO: 2042882 - DNA, 20 bp, Homo sapiens
ctctggatcctgctgtggcc

SEQ ID NO: 2042883 - DNA, 15 bp, Homo sapiens
ctctggatggcacca

SEQ ID NO: 2042884 - DNA, 19 bp, Homo sapiens
ctctggatggcaccagagg

SEQ ID NO: 2042885 - DNA, 11 bp, Homo sapiens
ctctggcagcc

SEQ ID NO: 2042886 - DNA, 13 bp, Homo sapiens
ctctggcagccac

SEQ ID NO: 2042887 - DNA, 11 bp, Homo sapiens
ctctggccacc

SEQ ID NO: 2042888 - DNA, 13 bp, Homo sapiens
ctctggccaccct

SEQ ID NO: 2042889 - DNA, 18 bp, Homo sapiens
ctctggccaccctggccc

SEQ ID NO: 2042890 - DNA, 13 bp, Homo sapiens
ctctggccccagg

SEQ ID NO: 2042891 - DNA, 18 bp, Homo sapiens
ctctggccccaggcttgt

SEQ ID NO: 2042892 - DNA, 13 bp, Homo sapiens
ctctggccctgcc

SEQ ID NO: 2042893 - DNA, 22 bp, Homo sapiens
ctctggcggcttcctgtccact

SEQ ID NO: 2042894 - DNA, 23 bp, Homo sapiens
ctctggctggctaactggaagca

SEQ ID NO: 2042895 - DNA, 18 bp, Homo sapiens
ctctggcttccaggtatc

SEQ ID NO: 2042896 - DNA, 19 bp, Homo sapiens
ctctgggaaataagagaga

SEQ ID NO: 2042897 - DNA, 17 bp, Homo sapiens
ctctgggaaggggtgcc

SEQ ID NO: 2042898 - DNA, 24 bp, Homo sapiens
ctctgggaaggggtgccctctgga

SEQ ID NO: 2042899 - DNA, 14 bp, Homo sapiens
ctctgggagacttt

SEQ ID NO: 2042900 - DNA, 17 bp, Homo sapiens
ctctgggccaagactcc

SEQ ID NO: 2042901 - DNA, 12 bp, Homo sapiens
ctctgggctcag

SEQ ID NO: 2042902 - DNA, 19 bp, Homo sapiens
ctctgggctcagggctgga

SEQ ID NO: 2042903 - DNA, 21 bp, Homo sapiens
ctctgggtaggtgttgaaaat

SEQ ID NO: 2042904 - DNA, 15 bp, Homo sapiens
ctctggtgctgtcct

SEQ ID NO: 2042905 - DNA, 15 bp, Homo sapiens
ctctggttatctaat

SEQ ID NO: 2042906 - DNA, 17 bp, Homo sapiens
ctctgtacaaaaacaaa

SEQ ID NO: 2042907 - DNA, 22 bp, Homo sapiens
ctctgtataatctatttacata

SEQ ID NO: 2042908 - DNA, 13 bp, Homo sapiens
ctctgtcagatgg

SEQ ID NO: 2042909 - DNA, 23 bp, Homo sapiens
ctctgtcagatgggaagacatga

SEQ ID NO: 2042910 - DNA, 14 bp, Homo sapiens
ctctgtcagccagc

SEQ ID NO: 2042911 - DNA, 17 bp, Homo sapiens
ctctgtcatcactccct

SEQ ID NO: 2042912 - DNA, 20 bp, Homo sapiens
ctctgtcatcactccctgga

SEQ ID NO: 2042913 - DNA, 13 bp, Homo sapiens
ctctgtccaggcc

SEQ ID NO: 2042914 - DNA, 14 bp, Homo sapiens
ctctgtccaggcca

SEQ ID NO: 2042915 - DNA, 22 bp, Homo sapiens
ctctgtccaggccactgtggcc

SEQ ID NO: 2042916 - DNA, 20 bp, Homo sapiens
ctctgtccagggccctgagc

SEQ ID NO: 2042917 - DNA, 21 bp, Homo sapiens
ctctgtcccggttcaccttgc

SEQ ID NO: 2042918 - DNA, 22 bp, Homo sapiens
ctctgtcccggttcaccttgcc

SEQ ID NO: 2042919 - DNA, 22 bp, Homo sapiens
ctctgtccctcactgccttcca

SEQ ID NO: 2042920 - DNA, 13 bp, Homo sapiens
ctctgtccctctt

SEQ ID NO: 2042921 - DNA, 15 bp, Homo sapiens
ctctgtccctctttg

SEQ ID NO: 2042922 - DNA, 20 bp, Homo sapiens
ctctgtccctctttgcctgt

SEQ ID NO: 2042923 - DNA, 15 bp, Homo sapiens
ctctgtcctgggagt

SEQ ID NO: 2042924 - DNA, 17 bp, Homo sapiens
ctctgtcgcccagtctg

SEQ ID NO: 2042925 - DNA, 13 bp, Homo sapiens
ctctgtctcgagc

SEQ ID NO: 2042926 - DNA, 18 bp, Homo sapiens
ctctgtctcgagcgccct

SEQ ID NO: 2042927 - DNA, 21 bp, Homo sapiens
ctctgtctcgagcgccctgca

SEQ ID NO: 2042928 - DNA, 10 bp, Homo sapiens
ctctgtctct

SEQ ID NO: 2042929 - DNA, 17 bp, Homo sapiens
ctctgtctctgctcttg

SEQ ID NO: 2042930 - DNA, 21 bp, Homo sapiens
ctctgtctggctgtacgtctg

SEQ ID NO: 2042931 - DNA, 16 bp, Homo sapiens
ctctgtgccagagcct

SEQ ID NO: 2042932 - DNA, 18 bp, Homo sapiens
ctctgtgccagagcctgg

SEQ ID NO: 2042933 - DNA, 20 bp, Homo sapiens
ctctgtgccagagcctgggg

SEQ ID NO: 2042934 - DNA, 21 bp, Homo sapiens
ctctgtgccagagcctggggc

SEQ ID NO: 2042935 - DNA, 19 bp, Homo sapiens
ctctgtgcccctgtaaata

SEQ ID NO: 2042936 - DNA, 21 bp, Homo sapiens
ctctgtgctttgactcacctg

SEQ ID NO: 2042937 - DNA, 16 bp, Homo sapiens
ctctgtggcctgtgtc

SEQ ID NO: 2042938 - DNA, 17 bp, Homo sapiens
ctctgtggcctgtgtcc

SEQ ID NO: 2042939 - DNA, 22 bp, Homo sapiens
ctctgtggcctgtgtccagcag

SEQ ID NO: 2042940 - DNA, 23 bp, Homo sapiens
ctctgtggcctgtgtccagcagc

SEQ ID NO: 2042941 - DNA, 17 bp, Homo sapiens
ctctgtgtacccactcc

SEQ ID NO: 2042942 - DNA, 15 bp, Homo sapiens
ctctgtgtcaggtgg

SEQ ID NO: 2042943 - DNA, 23 bp, Homo sapiens
ctctgtgtcaggtggggcagctt

SEQ ID NO: 2042944 - DNA, 18 bp, Homo sapiens
ctctgtgtcctctcccct

SEQ ID NO: 2042945 - DNA, 14 bp, Homo sapiens
ctctgtgtccttcc

SEQ ID NO: 2042946 - DNA, 16 bp, Homo sapiens
ctctgtgtccttccct

SEQ ID NO: 2042947 - DNA, 13 bp, Homo sapiens
ctctgtgtgctcc

SEQ ID NO: 2042948 - DNA, 16 bp, Homo sapiens
ctctgttcatttcctc

SEQ ID NO: 2042949 - DNA, 17 bp, Homo sapiens
ctctgttcatttcctca

SEQ ID NO: 2042950 - DNA, 16 bp, Homo sapiens
ctcttaaaaaataaaa

SEQ ID NO: 2042951 - DNA, 18 bp, Homo sapiens
ctcttaaaaaataaaaac

SEQ ID NO: 2042952 - DNA, 20 bp, Homo sapiens
ctcttaaagctgcctgtagt

SEQ ID NO: 2042953 - DNA, 13 bp, Homo sapiens
ctcttaatgttgc

SEQ ID NO: 2042954 - DNA, 18 bp, Homo sapiens
ctcttaccgtagcctccg

SEQ ID NO: 2042955 - DNA, 13 bp, Homo sapiens
ctcttagctgtct

SEQ ID NO: 2042956 - DNA, 18 bp, Homo sapiens
ctcttagctttctcaggg

SEQ ID NO: 2042957 - DNA, 21 bp, Homo sapiens
ctcttaggtctaatgatattt

SEQ ID NO: 2042958 - DNA, 21 bp, Homo sapiens
ctcttagtgcccgcctaggag

SEQ ID NO: 2042959 - DNA, 17 bp, Homo sapiens
ctcttatagaatattta

SEQ ID NO: 2042960 - DNA, 14 bp, Homo sapiens
ctcttattgcccac

SEQ ID NO: 2042961 - DNA, 20 bp, Homo sapiens
ctcttattgcccacgctgga

SEQ ID NO: 2042962 - DNA, 17 bp, Homo sapiens
ctcttcaccccccactc

SEQ ID NO: 2042963 - DNA, 22 bp, Homo sapiens
ctcttcactcagccacacccca

SEQ ID NO: 2042964 - DNA, 23 bp, Homo sapiens
ctcttcagaatatggacaaagaa

SEQ ID NO: 2042965 - DNA, 22 bp, Homo sapiens
ctgtcgccccaggccctccctg

SEQ ID NO: 2042966 - DNA, 14 bp, Homo sapiens
ctgtcgtgtttaca

SEQ ID NO: 2042967 - DNA, 19 bp, Homo sapiens
ctgtctatgttgtgatcct

SEQ ID NO: 2042968 - DNA, 23 bp, Homo sapiens
ctgtctcaaaaaaacacaaaagt

SEQ ID NO: 2042969 - DNA, 19 bp, Homo sapiens
ctgtctcaagagggcactg

SEQ ID NO: 2042970 - DNA, 20 bp, Homo sapiens
ctgtctcaagctcttcctta

SEQ ID NO: 2042971 - DNA, 12 bp, Homo sapiens
ctgtctccctgg

SEQ ID NO: 2042972 - DNA, 17 bp, Homo sapiens
ctgtctcgagcgccctg

SEQ ID NO: 2042973 - DNA, 19 bp, Homo sapiens
ctgtctcgagcgccctgca

SEQ ID NO: 2042974 - DNA, 21 bp, Homo sapiens
ctgtctcgagcgccctgcaga

SEQ ID NO: 2042975 - DNA, 12 bp, Homo sapiens
ctgtctctgcct

SEQ ID NO: 2042976 - DNA, 13 bp, Homo sapiens
ctgtctctgcctg

SEQ ID NO: 2042977 - DNA, 17 bp, Homo sapiens
ctgtctctgcctgcggc

SEQ ID NO: 2042978 - DNA, 19 bp, Homo sapiens
ctgtctctgctcttgcctg

SEQ ID NO: 2042979 - DNA, 11 bp, Homo sapiens
ctgtctctgtc

SEQ ID NO: 2042980 - DNA, 20 bp, Homo sapiens
ctgtctgccagccagcagcc

SEQ ID NO: 2042981 - DNA, 15 bp, Homo sapiens
ctgtctgctcagaca

SEQ ID NO: 2042982 - DNA, 19 bp, Homo sapiens
ctgtctggtgtagctcctc

SEQ ID NO: 2042983 - DNA, 16 bp, Homo sapiens
ctgtctggttttaaca

SEQ ID NO: 2042984 - DNA, 18 bp, Homo sapiens
ctgtcttcacaacagatt

SEQ ID NO: 2042985 - DNA, 16 bp, Homo sapiens
ctgtcttgccagccag

SEQ ID NO: 2042986 - DNA, 19 bp, Homo sapiens
ctgtcttgccagccagaag

SEQ ID NO: 2042987 - DNA, 20 bp, Homo sapiens
ctgtcttgcctgccagggcc

SEQ ID NO: 2042988 - DNA, 21 bp, Homo sapiens
ctgtcttgcctgccagggccc

SEQ ID NO: 2042989 - DNA, 21 bp, Homo sapiens
ctgtctttctggccctttctg

SEQ ID NO: 2042990 - DNA, 18 bp, Homo sapiens
ctgtgaacatggactctt

SEQ ID NO: 2042991 - DNA, 14 bp, Homo sapiens
ctgtgaacctggag

SEQ ID NO: 2042992 - DNA, 18 bp, Homo sapiens
ctgtgaacgatttagaaa

SEQ ID NO: 2042993 - DNA, 22 bp, Homo sapiens
ctgtgaacgatttagaaagaag

SEQ ID NO: 2042994 - DNA, 15 bp, Homo sapiens
ctgtgaactcagagc

SEQ ID NO: 2042995 - DNA, 15 bp, Homo sapiens
ctgtgaagaatgaag

SEQ ID NO: 2042996 - DNA, 16 bp, Homo sapiens
ctgtgaagaatgaagt

SEQ ID NO: 2042997 - DNA, 19 bp, Homo sapiens
ctgtgaagaatgaagtgga

SEQ ID NO: 2042998 - DNA, 18 bp, Homo sapiens
ctgtgaagacccagcagg

SEQ ID NO: 2042999 - DNA, 20 bp, Homo sapiens
ctgtgaagacccagcaggaa

SEQ ID NO: 2043000 - DNA, 15 bp, Homo sapiens
ctgtgaattgagctg

SEQ ID NO: 2043001 - DNA, 23 bp, Homo sapiens
ctgtgaattgagctgcagaaacg

SEQ ID NO: 2043002 - DNA, 17 bp, Homo sapiens
ctgtgaccccaccttga

SEQ ID NO: 2043003 - DNA, 22 bp, Homo sapiens
ctgtgacctgccccgcccagct

SEQ ID NO: 2043004 - DNA, 14 bp, Homo sapiens
ctgtgacctgctga

SEQ ID NO: 2043005 - DNA, 17 bp, Homo sapiens
ctgtgacctgctgagct

SEQ ID NO: 2043006 - DNA, 19 bp, Homo sapiens
ctgtgacctgctgagctct

SEQ ID NO: 2043007 - DNA, 22 bp, Homo sapiens
ctgtgacctgctgagctctgag

SEQ ID NO: 2043008 - DNA, 17 bp, Homo sapiens
ctgtgacttcagctctg

SEQ ID NO: 2043009 - DNA, 13 bp, Homo sapiens
ctgtgaggcaggg

SEQ ID NO: 2043010 - DNA, 18 bp, Homo sapiens
ctgtgaggcccctggaca

SEQ ID NO: 2043011 - DNA, 15 bp, Homo sapiens
ctgtgaggggaaggc

SEQ ID NO: 2043012 - DNA, 22 bp, Homo sapiens
ctgtgaggtaactgggatcgca

SEQ ID NO: 2043013 - DNA, 17 bp, Homo sapiens
ctgtgatggggtgggca

SEQ ID NO: 2043014 - DNA, 18 bp, Homo sapiens
ctgtgatggggtgggcag

SEQ ID NO: 2043015 - DNA, 20 bp, Homo sapiens
ctgtgatggggtgggcaggg

SEQ ID NO: 2043016 - DNA, 13 bp, Homo sapiens
ctgtgattaactt

SEQ ID NO: 2043017 - DNA, 19 bp, Homo sapiens
ctgtgattaacttgcttag

SEQ ID NO: 2043018 - DNA, 18 bp, Homo sapiens
ctgtgcaccttacattcc

SEQ ID NO: 2043019 - DNA, 15 bp, Homo sapiens
ctgtgcacggtggac

SEQ ID NO: 2043020 - DNA, 20 bp, Homo sapiens
ctgtgcactagcctgtgatt

SEQ ID NO: 2043021 - DNA, 14 bp, Homo sapiens
ctgtgcagcagccc

SEQ ID NO: 2043022 - DNA, 17 bp, Homo sapiens
ctgtgcagcagcccagc

SEQ ID NO: 2043023 - DNA, 22 bp, Homo sapiens
ctgtgcagcagcccagcttcct

SEQ ID NO: 2043024 - DNA, 21 bp, Homo sapiens
ctgtgcagccccgccctctgc

SEQ ID NO: 2043025 - DNA, 13 bp, Homo sapiens
ctgtgcagggagg

SEQ ID NO: 2043026 - DNA, 16 bp, Homo sapiens
ctgtgccaacctgatg

SEQ ID NO: 2043027 - DNA, 18 bp, Homo sapiens
ctgtgccaacctgatgcc

SEQ ID NO: 2043028 - DNA, 15 bp, Homo sapiens
ctgtgccacctgcaa

SEQ ID NO: 2043029 - DNA, 20 bp, Homo sapiens
ctgtgccagagcctggggct

SEQ ID NO: 2043030 - DNA, 21 bp, Homo sapiens
ctgtgccagagcctggggctc

SEQ ID NO: 2043031 - DNA, 12 bp, Homo sapiens
ctgtgccagctc

SEQ ID NO: 2043032 - DNA, 14 bp, Homo sapiens
ctgtgccagctcag

SEQ ID NO: 2043033 - DNA, 20 bp, Homo sapiens
ctgtgcccctcagagaggca

SEQ ID NO: 2043034 - DNA, 19 bp, Homo sapiens
ctgtgcccctgtaaatagt

SEQ ID NO: 2043035 - DNA, 15 bp, Homo sapiens
ctgtgccctgccttc

SEQ ID NO: 2043036 - DNA, 13 bp, Homo sapiens
ctgtgcctctgcc

SEQ ID NO: 2043037 - DNA, 11 bp, Homo sapiens
ctgtgcctgct

SEQ ID NO: 2043038 - DNA, 18 bp, Homo sapiens
ctgtgcctttgggaggca

SEQ ID NO: 2043039 - DNA, 14 bp, Homo sapiens
ctgtgcgttttaga

SEQ ID NO: 2043040 - DNA, 17 bp, Homo sapiens
ctgtgctctggacaggc

SEQ ID NO: 2043041 - DNA, 18 bp, Homo sapiens
ctgtgctctggacaggca

SEQ ID NO: 2043042 - DNA, 19 bp, Homo sapiens
ctgtgctctggacaggcat

SEQ ID NO: 2043043 - DNA, 16 bp, Homo sapiens
ctgtgctctggaggct

SEQ ID NO: 2043044 - DNA, 15 bp, Homo sapiens
ctgtgctgaggactc

SEQ ID NO: 2043045 - DNA, 20 bp, Homo sapiens
ctgtgctgcccgtcttcagc

SEQ ID NO: 2043046 - DNA, 22 bp, Homo sapiens
ctgtgctgccctgctctgggga

SEQ ID NO: 2043047 - DNA, 15 bp, Homo sapiens
ctgtgctgtgcctgc

SEQ ID NO: 2043048 - DNA, 21 bp, Homo sapiens
ctgtgctgtgcctgctagagc

SEQ ID NO: 2043049 - DNA, 19 bp, Homo sapiens
ctgtgctttgactcacctg

SEQ ID NO: 2043050 - DNA, 19 bp, Homo sapiens
ctgtggaaaaatatttaag

SEQ ID NO: 2043051 - DNA, 14 bp, Homo sapiens
ctgtggaggcctga

SEQ ID NO: 2043052 - DNA, 16 bp, Homo sapiens
ctgtggaggcctgatg

SEQ ID NO: 2043053 - DNA, 17 bp, Homo sapiens
ctgtggaggcctgatgc

SEQ ID NO: 2043054 - DNA, 22 bp, Homo sapiens
ctgtggaggtacactcttatag

SEQ ID NO: 2043055 - DNA, 23 bp, Homo sapiens
ctgtggattttttccttcaaagt

SEQ ID NO: 2043056 - DNA, 14 bp, Homo sapiens
ctgtggcaggccta

SEQ ID NO: 2043057 - DNA, 17 bp, Homo sapiens
ctgtggccagagctgga

SEQ ID NO: 2043058 - DNA, 18 bp, Homo sapiens
ctgtggccagagctggaa

SEQ ID NO: 2043059 - DNA, 19 bp, Homo sapiens
ctgtggccagagctggaag

SEQ ID NO: 2043060 - DNA, 23 bp, Homo sapiens
ctgtggccagcttgttatttata

SEQ ID NO: 2043061 - DNA, 20 bp, Homo sapiens
ctgtggcctcacttccctgg

SEQ ID NO: 2043062 - DNA, 22 bp, Homo sapiens
ctgtggcctcacttccctggga

SEQ ID NO: 2043063 - DNA, 11 bp, Homo sapiens
ctgtggcctgg

SEQ ID NO: 2043064 - DNA, 13 bp, Homo sapiens
ctgtggcctgggc

SEQ ID NO: 2043065 - DNA, 22 bp, Homo sapiens
gaactgttctggcctcagacca

SEQ ID NO: 2043066 - DNA, 15 bp, Homo sapiens
gaacttaaataaatg

SEQ ID NO: 2043067 - DNA, 19 bp, Homo sapiens
gaacttacacttggagccc

SEQ ID NO: 2043068 - DNA, 21 bp, Homo sapiens
gaacttacacttggagcccgt

SEQ ID NO: 2043069 - DNA, 13 bp, Homo sapiens
gaacttctaatat

SEQ ID NO: 2043070 - DNA, 14 bp, Homo sapiens
gaacttctaatata

SEQ ID NO: 2043071 - DNA, 15 bp, Homo sapiens
gaacttctaatatat

SEQ ID NO: 2043072 - DNA, 13 bp, Homo sapiens
gaacttgaggaca

SEQ ID NO: 2043073 - DNA, 16 bp, Homo sapiens
gaacttgaggacacat

SEQ ID NO: 2043074 - DNA, 17 bp, Homo sapiens
gaacttgaggacacatg

SEQ ID NO: 2043075 - DNA, 13 bp, Homo sapiens
gaacttgatttta

SEQ ID NO: 2043076 - DNA, 23 bp, Homo sapiens
gaactttctcttcatactttttt

SEQ ID NO: 2043077 - DNA, 14 bp, Homo sapiens
gaactttgaaggac

SEQ ID NO: 2043078 - DNA, 23 bp, Homo sapiens
gaactttgtacagtggagaaata

SEQ ID NO: 2043079 - DNA, 21 bp, Homo sapiens
gaagaaaactatcctgcgggt

SEQ ID NO: 2043080 - DNA, 22 bp, Homo sapiens
gaagaaaactcctttagcaggt

SEQ ID NO: 2043081 - DNA, 16 bp, Homo sapiens
gaagaaaccccaagca

SEQ ID NO: 2043082 - DNA, 19 bp, Homo sapiens
gaagaaaccccaagcagca

SEQ ID NO: 2043083 - DNA, 17 bp, Homo sapiens
gaagaaagagaaggagc

SEQ ID NO: 2043084 - DNA, 22 bp, Homo sapiens
gaagaaattcctgtagcatctt

SEQ ID NO: 2043085 - DNA, 17 bp, Homo sapiens
gaagaacatccaaggag

SEQ ID NO: 2043086 - DNA, 14 bp, Homo sapiens
gaagaagctgagga

SEQ ID NO: 2043087 - DNA, 14 bp, Homo sapiens
gaagaagggaaatt

SEQ ID NO: 2043088 - DNA, 22 bp, Homo sapiens
gaagaagggaaattcacactgt

SEQ ID NO: 2043089 - DNA, 19 bp, Homo sapiens
gaagaagtttcatcatttt

SEQ ID NO: 2043090 - DNA, 18 bp, Homo sapiens
gaagaatacaaacatatt

SEQ ID NO: 2043091 - DNA, 19 bp, Homo sapiens
gaagaatacaaacatattt

SEQ ID NO: 2043092 - DNA, 17 bp, Homo sapiens
gaagaatattcaggact

SEQ ID NO: 2043093 - DNA, 13 bp, Homo sapiens
gaagaatattcta

SEQ ID NO: 2043094 - DNA, 24 bp, Homo sapiens
gaagaatgcttaatcagatagata

SEQ ID NO: 2043095 - DNA, 18 bp, Homo sapiens
gaagaattgaacccagga

SEQ ID NO: 2043096 - DNA, 20 bp, Homo sapiens
gaagaattttcagaccccag

SEQ ID NO: 2043097 - DNA, 21 bp, Homo sapiens
gaagacaaaccactgtacata

SEQ ID NO: 2043098 - DNA, 16 bp, Homo sapiens
gaagacactgatgggc

SEQ ID NO: 2043099 - DNA, 15 bp, Homo sapiens
gaagacatggagact

SEQ ID NO: 2043100 - DNA, 20 bp, Homo sapiens
gaagacatggagactcctgc

SEQ ID NO: 2043101 - DNA, 23 bp, Homo sapiens
gaagaccaatctcttgaatccca

SEQ ID NO: 2043102 - DNA, 15 bp, Homo sapiens
gaagacccacgtgct

SEQ ID NO: 2043103 - DNA, 23 bp, Homo sapiens
gaagacccagtgtaaagaataaa

SEQ ID NO: 2043104 - DNA, 14 bp, Homo sapiens
gaagaccctccccg

SEQ ID NO: 2043105 - DNA, 17 bp, Homo sapiens
gaagactcattcttctg

SEQ ID NO: 2043106 - DNA, 18 bp, Homo sapiens
gaagactcattcttctgt

SEQ ID NO: 2043107 - DNA, 12 bp, Homo sapiens
gaagactggaag

SEQ ID NO: 2043108 - DNA, 14 bp, Homo sapiens
gaagacttcttggg

SEQ ID NO: 2043109 - DNA, 16 bp, Homo sapiens
gaagagaagctgagaa

SEQ ID NO: 2043110 - DNA, 12 bp, Homo sapiens
gaagagaaggag

SEQ ID NO: 2043111 - DNA, 13 bp, Homo sapiens
gaagagagaaaca

SEQ ID NO: 2043112 - DNA, 14 bp, Homo sapiens
gaagagagagaccc

SEQ ID NO: 2043113 - DNA, 15 bp, Homo sapiens
gaagagagagaccct

SEQ ID NO: 2043114 - DNA, 18 bp, Homo sapiens
gaagagagagagagaggt

SEQ ID NO: 2043115 - DNA, 13 bp, Homo sapiens
gaagagaggcacc

SEQ ID NO: 2043116 - DNA, 18 bp, Homo sapiens
gaagagatgggcttgttt

SEQ ID NO: 2043117 - DNA, 13 bp, Homo sapiens
gaagagcagcctg

SEQ ID NO: 2043118 - DNA, 14 bp, Homo sapiens
gaagagcagcctga

SEQ ID NO: 2043119 - DNA, 18 bp, Homo sapiens
gaagagcagcctgatggc

SEQ ID NO: 2043120 - DNA, 11 bp, Homo sapiens
gaagagccctg

SEQ ID NO: 2043121 - DNA, 12 bp, Homo sapiens
gaagagccctga

SEQ ID NO: 2043122 - DNA, 15 bp, Homo sapiens
gaagagccctgagct

SEQ ID NO: 2043123 - DNA, 20 bp, Homo sapiens
gaagagccctgagctcaggc

SEQ ID NO: 2043124 - DNA, 15 bp, Homo sapiens
gaagagctgttcaca

SEQ ID NO: 2043125 - DNA, 10 bp, Homo sapiens
gaagaggact

SEQ ID NO: 2043126 - DNA, 16 bp, Homo sapiens
gaagaggctggtgctg

SEQ ID NO: 2043127 - DNA, 22 bp, Homo sapiens
gaagagggaggcttcctgactg

SEQ ID NO: 2043128 - DNA, 19 bp, Homo sapiens
gaagagggcagtacctggg

SEQ ID NO: 2043129 - DNA, 20 bp, Homo sapiens
gaagagggcctgtgggagcc

SEQ ID NO: 2043130 - DNA, 16 bp, Homo sapiens
gaagaggggaggggcc

SEQ ID NO: 2043131 - DNA, 17 bp, Homo sapiens
gaagaggggaggggcct

SEQ ID NO: 2043132 - DNA, 21 bp, Homo sapiens
gaagaggggaggggcctaggg

SEQ ID NO: 2043133 - DNA, 14 bp, Homo sapiens
gaagagtgagaggg

SEQ ID NO: 2043134 - DNA, 18 bp, Homo sapiens
gaagatcgttagtatcta

SEQ ID NO: 2043135 - DNA, 23 bp, Homo sapiens
gaagatcttttaaaaaggcagta

SEQ ID NO: 2043136 - DNA, 13 bp, Homo sapiens
gaagatgaagaga

SEQ ID NO: 2043137 - DNA, 12 bp, Homo sapiens
gaagatgccctc

SEQ ID NO: 2043138 - DNA, 17 bp, Homo sapiens
gaagatggtagcagata

SEQ ID NO: 2043139 - DNA, 14 bp, Homo sapiens
gaagatgtgattta

SEQ ID NO: 2043140 - DNA, 15 bp, Homo sapiens
gaagatgtgatttat

SEQ ID NO: 2043141 - DNA, 16 bp, Homo sapiens
gaagcaaagcaccagc

SEQ ID NO: 2043142 - DNA, 14 bp, Homo sapiens
gaagcaaataaata

SEQ ID NO: 2043143 - DNA, 18 bp, Homo sapiens
gaagcaagacgtcctgga

SEQ ID NO: 2043144 - DNA, 21 bp, Homo sapiens
gaagcaagacgtcctggaatg

SEQ ID NO: 2043145 - DNA, 14 bp, Homo sapiens
gaagcacagcttca

SEQ ID NO: 2043146 - DNA, 20 bp, Homo sapiens
gaagcagcctcctaatttga

SEQ ID NO: 2043147 - DNA, 20 bp, Homo sapiens
gaagcaggcagagcggggag

SEQ ID NO: 2043148 - DNA, 23 bp, Homo sapiens
gaagcaggcagagcggggaggtg

SEQ ID NO: 2043149 - DNA, 23 bp, Homo sapiens
gaagcaggttgaggggctcctgg

SEQ ID NO: 2043150 - DNA, 15 bp, Homo sapiens
gaagcagtgagccgc

SEQ ID NO: 2043151 - DNA, 19 bp, Homo sapiens
gaagcagtgccttccataa

SEQ ID NO: 2043152 - DNA, 13 bp, Homo sapiens
gaagcagttgtgt

SEQ ID NO: 2043153 - DNA, 14 bp, Homo sapiens
gaagcagttgtgtc

SEQ ID NO: 2043154 - DNA, 16 bp, Homo sapiens
gaagcagttgtgtcag

SEQ ID NO: 2043155 - DNA, 12 bp, Homo sapiens
gaagcatgtttc

SEQ ID NO: 2043156 - DNA, 13 bp, Homo sapiens
gaagcatgtttca

SEQ ID NO: 2043157 - DNA, 18 bp, Homo sapiens
gaagccaacttggctttc

SEQ ID NO: 2043158 - DNA, 18 bp, Homo sapiens
gaagccactgaagctggg

SEQ ID NO: 2043159 - DNA, 18 bp, Homo sapiens
gaagccaggagcaaatgt

SEQ ID NO: 2043160 - DNA, 15 bp, Homo sapiens
gaagccatctttctt

SEQ ID NO: 2043161 - DNA, 19 bp, Homo sapiens
gaagcccaggctgaagagt

SEQ ID NO: 2043162 - DNA, 15 bp, Homo sapiens
gaagcccagtttccc

SEQ ID NO: 2043163 - DNA, 20 bp, Homo sapiens
gaagccccccacctttctcg

SEQ ID NO: 2043164 - DNA, 21 bp, Homo sapiens
gaagccccttgtcctctcccg

SEQ ID NO: 2043165 - DNA, 16 bp, Homo sapiens
gaagccctccttccac

SEQ ID NO: 2043166 - DNA, 11 bp, Homo sapiens
gaagccctgga

SEQ ID NO: 2043167 - DNA, 18 bp, Homo sapiens
gaagccctggatttcaga

SEQ ID NO: 2043168 - DNA, 22 bp, Homo sapiens
gaagccctggatttcagaaaga

SEQ ID NO: 2043169 - DNA, 23 bp, Homo sapiens
gaagcccttccagtggtaccagc

SEQ ID NO: 2043170 - DNA, 14 bp, Homo sapiens
gaagccgcagggac

SEQ ID NO: 2043171 - DNA, 16 bp, Homo sapiens
gaagccgtctgactcc

SEQ ID NO: 2043172 - DNA, 19 bp, Homo sapiens
gaagccgtctgactccaga

SEQ ID NO: 2043173 - DNA, 20 bp, Homo sapiens
gaagccgtctgactccagag

SEQ ID NO: 2043174 - DNA, 15 bp, Homo sapiens
gaagcctaaataaaa

SEQ ID NO: 2043175 - DNA, 18 bp, Homo sapiens
gaagcctaaataaaaagt

SEQ ID NO: 2043176 - DNA, 15 bp, Homo sapiens
gaagcctctgcctcc

SEQ ID NO: 2043177 - DNA, 19 bp, Homo sapiens
gaagcctctgcctccctag

SEQ ID NO: 2043178 - DNA, 12 bp, Homo sapiens
gaagcctgaggc

SEQ ID NO: 2043179 - DNA, 13 bp, Homo sapiens
gaagcctgggggc

SEQ ID NO: 2043180 - DNA, 16 bp, Homo sapiens
gaagcctgggggcctg

SEQ ID NO: 2043181 - DNA, 21 bp, Homo sapiens
gaagcctgggggcctggctgg

SEQ ID NO: 2043182 - DNA, 13 bp, Homo sapiens
gaagcctgtgcca

SEQ ID NO: 2043183 - DNA, 14 bp, Homo sapiens
gaagcctgtgccac

SEQ ID NO: 2043184 - DNA, 16 bp, Homo sapiens
gaagcctgtgccacct

SEQ ID NO: 2043185 - DNA, 21 bp, Homo sapiens
gaagctaacagggaaggcagg

SEQ ID NO: 2043186 - DNA, 14 bp, Homo sapiens
gaagctaagctgca

SEQ ID NO: 2043187 - DNA, 13 bp, Homo sapiens
gaagctccactgt

SEQ ID NO: 2043188 - DNA, 16 bp, Homo sapiens
gaagctcccagatgct

SEQ ID NO: 2043189 - DNA, 15 bp, Homo sapiens
gaagctctgaagtca

SEQ ID NO: 2043190 - DNA, 12 bp, Homo sapiens
gaagctgagaag

SEQ ID NO: 2043191 - DNA, 14 bp, Homo sapiens
gaagctgagaagaa

SEQ ID NO: 2043192 - DNA, 15 bp, Homo sapiens
gaagctgagaagaag

SEQ ID NO: 2043193 - DNA, 21 bp, Homo sapiens
gaagctgagaagaagctgagg

SEQ ID NO: 2043194 - DNA, 13 bp, Homo sapiens
gaagctgagcagg

SEQ ID NO: 2043195 - DNA, 17 bp, Homo sapiens
gaagctgatgctttgct

SEQ ID NO: 2043196 - DNA, 17 bp, Homo sapiens
gaagctggcagcactca

SEQ ID NO: 2043197 - DNA, 19 bp, Homo sapiens
gaagctgggggaagggtgg

SEQ ID NO: 2043198 - DNA, 23 bp, Homo sapiens
gaagctgtactcagagcagagca

SEQ ID NO: 2043199 - DNA, 12 bp, Homo sapiens
gaagctgtgtcc

SEQ ID NO: 2043200 - DNA, 23 bp, Homo sapiens
gaagctgtgtccttgcacctgca

SEQ ID NO: 2043201 - DNA, 15 bp, Homo sapiens
gaagcttcagaagtt

SEQ ID NO: 2043202 - DNA, 18 bp, Homo sapiens
gaaggaaaaggcagggag

SEQ ID NO: 2043203 - DNA, 20 bp, Homo sapiens
gaaggaactctggcttccag

SEQ ID NO: 2043204 - DNA, 22 bp, Homo sapiens
gaaggaactctggcttccaggt

SEQ ID NO: 2043205 - DNA, 18 bp, Homo sapiens
gaaggaagggacacacac

SEQ ID NO: 2043206 - DNA, 22 bp, Homo sapiens
gaaggaataaattgctccttga

SEQ ID NO: 2043207 - DNA, 17 bp, Homo sapiens
gaaggaatctgtgcaga

SEQ ID NO: 2043208 - DNA, 20 bp, Homo sapiens
gaaggacattgcggacagcc

SEQ ID NO: 2043209 - DNA, 16 bp, Homo sapiens
gaaggaccctggctct

SEQ ID NO: 2043210 - DNA, 22 bp, Homo sapiens
gaaggagactcacctctgcctc

SEQ ID NO: 2043211 - DNA, 23 bp, Homo sapiens
gaaggagactcacctctgcctca

SEQ ID NO: 2043212 - DNA, 15 bp, Homo sapiens
gaaggagggcagagc

SEQ ID NO: 2043213 - DNA, 19 bp, Homo sapiens
gaaggagggttagggaggg

SEQ ID NO: 2043214 - DNA, 13 bp, Homo sapiens
gaaggaggtgagg

SEQ ID NO: 2043215 - DNA, 21 bp, Homo sapiens
gaaggataagagaaacaggcc

SEQ ID NO: 2043216 - DNA, 12 bp, Homo sapiens
gaaggcaaaaaa

SEQ ID NO: 2043217 - DNA, 18 bp, Homo sapiens
gaaggcaaagcccctgga

SEQ ID NO: 2043218 - DNA, 23 bp, Homo sapiens
gaaggcaaatataagctgggaaa

SEQ ID NO: 2043219 - DNA, 19 bp, Homo sapiens
gaaggcacaggtgtaaata

SEQ ID NO: 2043220 - DNA, 17 bp, Homo sapiens
gaaggcagcaggtggca

SEQ ID NO: 2043221 - DNA, 15 bp, Homo sapiens
gaaggcaggcagggc

SEQ ID NO: 2043222 - DNA, 16 bp, Homo sapiens
gaaggcaggcagggct

SEQ ID NO: 2043223 - DNA, 13 bp, Homo sapiens
gaaggcagggaaa

SEQ ID NO: 2043224 - DNA, 15 bp, Homo sapiens
gaatttcctatctgt

SEQ ID NO: 2043225 - DNA, 12 bp, Homo sapiens
gaatttctaaaa

SEQ ID NO: 2043226 - DNA, 17 bp, Homo sapiens
gaatttctaaaaaacag

SEQ ID NO: 2043227 - DNA, 20 bp, Homo sapiens
gaatttcttcactgttgaaa

SEQ ID NO: 2043228 - DNA, 20 bp, Homo sapiens
gaatttctttgtcattcaag

SEQ ID NO: 2043229 - DNA, 13 bp, Homo sapiens
gaatttgctgggg

SEQ ID NO: 2043230 - DNA, 13 bp, Homo sapiens
gaatttgggcctc

SEQ ID NO: 2043231 - DNA, 21 bp, Homo sapiens
gaatttggtgtggctgtattc

SEQ ID NO: 2043232 - DNA, 13 bp, Homo sapiens
gaatttgtaagca

SEQ ID NO: 2043233 - DNA, 23 bp, Homo sapiens
gaattttcagaccccagcggctg

SEQ ID NO: 2043234 - DNA, 17 bp, Homo sapiens
gacaaaaacagcctcac

SEQ ID NO: 2043235 - DNA, 18 bp, Homo sapiens
gacaaaattggccagaga

SEQ ID NO: 2043236 - DNA, 16 bp, Homo sapiens
gacaaaccactgtaca

SEQ ID NO: 2043237 - DNA, 16 bp, Homo sapiens
gacaaaccagagcaga

SEQ ID NO: 2043238 - DNA, 22 bp, Homo sapiens
gacaaagagaataaagacttca

SEQ ID NO: 2043239 - DNA, 18 bp, Homo sapiens
gacaaaggagcctgtgaa

SEQ ID NO: 2043240 - DNA, 19 bp, Homo sapiens
gacaaagggaaggctgctg

SEQ ID NO: 2043241 - DNA, 20 bp, Homo sapiens
gacaaagttccaaaatgcca

SEQ ID NO: 2043242 - DNA, 15 bp, Homo sapiens
gacaaattgtaacta

SEQ ID NO: 2043243 - DNA, 23 bp, Homo sapiens
gacaacaaattaggttttgtaca

SEQ ID NO: 2043244 - DNA, 14 bp, Homo sapiens
gacaacagaagtca

SEQ ID NO: 2043245 - DNA, 13 bp, Homo sapiens
gacaacagactga

SEQ ID NO: 2043246 - DNA, 17 bp, Homo sapiens
gacaacatcccacagtg

SEQ ID NO: 2043247 - DNA, 22 bp, Homo sapiens
gacaacatttctatagccaaaa

SEQ ID NO: 2043248 - DNA, 22 bp, Homo sapiens
gacaacatttttggtgtatttg

SEQ ID NO: 2043249 - DNA, 11 bp, Homo sapiens
gacaacccaga

SEQ ID NO: 2043250 - DNA, 24 bp, Homo sapiens
gacaaccccatcatatgacatgcc

SEQ ID NO: 2043251 - DNA, 14 bp, Homo sapiens
gacaacctttgtgt

SEQ ID NO: 2043252 - DNA, 21 bp, Homo sapiens
gacaagaagctcccagatgct

SEQ ID NO: 2043253 - DNA, 13 bp, Homo sapiens
gacaagaagctgc

SEQ ID NO: 2043254 - DNA, 19 bp, Homo sapiens
gacaagaatatgttcacat

SEQ ID NO: 2043255 - DNA, 17 bp, Homo sapiens
gacaagagctgctgtcc

SEQ ID NO: 2043256 - DNA, 19 bp, Homo sapiens
gacaagataaaggaagtca

SEQ ID NO: 2043257 - DNA, 16 bp, Homo sapiens
gacaagcactgctagg

SEQ ID NO: 2043258 - DNA, 13 bp, Homo sapiens
gacaagccctggc

SEQ ID NO: 2043259 - DNA, 17 bp, Homo sapiens
gacaaggaagtgggggc

SEQ ID NO: 2043260 - DNA, 14 bp, Homo sapiens
gacagcggggaagg

SEQ ID NO: 2043261 - DNA, 11 bp, Homo sapiens
gacagctcctt

SEQ ID NO: 2043262 - DNA, 19 bp, Homo sapiens
gacagctccttctgtccta

SEQ ID NO: 2043263 - DNA, 14 bp, Homo sapiens
gacagctgtgcctc

SEQ ID NO: 2043264 - DNA, 15 bp, Homo sapiens
gacagctgtgcctcg

SEQ ID NO: 2043265 - DNA, 17 bp, Homo sapiens
gacaggaaagccctccc

SEQ ID NO: 2043266 - DNA, 20 bp, Homo sapiens
gacaggaaagccctccccct

SEQ ID NO: 2043267 - DNA, 20 bp, Homo sapiens
gacaggaagcccaaggcagt

SEQ ID NO: 2043268 - DNA, 15 bp, Homo sapiens
gacaggacctgacta

SEQ ID NO: 2043269 - DNA, 19 bp, Homo sapiens
gacaggactaacactcaga

SEQ ID NO: 2043270 - DNA, 21 bp, Homo sapiens
gacaggactaacactcagaag

SEQ ID NO: 2043271 - DNA, 11 bp, Homo sapiens
gacaggagaaa

SEQ ID NO: 2043272 - DNA, 20 bp, Homo sapiens
gacaggagggcaagggccat

SEQ ID NO: 2043273 - DNA, 18 bp, Homo sapiens
gacaggatgtggcactgc

SEQ ID NO: 2043274 - DNA, 18 bp, Homo sapiens
gacaggcaatgctggctg

SEQ ID NO: 2043275 - DNA, 24 bp, Homo sapiens
gacaggcaatgctggctgttggct

SEQ ID NO: 2043276 - DNA, 19 bp, Homo sapiens
gacaggcatgttctctgag

SEQ ID NO: 2043277 - DNA, 14 bp, Homo sapiens
gacaggcccaagag

SEQ ID NO: 2043278 - DNA, 16 bp, Homo sapiens
gacaggcccaagagat

SEQ ID NO: 2043279 - DNA, 21 bp, Homo sapiens
gacaggcccaagagatgaaga

SEQ ID NO: 2043280 - DNA, 16 bp, Homo sapiens
gacagggaagagcaga

SEQ ID NO: 2043281 - DNA, 18 bp, Homo sapiens
gacagggcaatcttgtcc

SEQ ID NO: 2043282 - DNA, 18 bp, Homo sapiens
gacaggttcccagcagct

SEQ ID NO: 2043283 - DNA, 19 bp, Homo sapiens
gacaggttcccagcagctg

SEQ ID NO: 2043284 - DNA, 14 bp, Homo sapiens
gacagtattctcag

SEQ ID NO: 2043285 - DNA, 13 bp, Homo sapiens
gacagtcctggga

SEQ ID NO: 2043286 - DNA, 14 bp, Homo sapiens
gacagtcctgggag

SEQ ID NO: 2043287 - DNA, 23 bp, Homo sapiens
gacagtctcaagcactaaaaagt

SEQ ID NO: 2043288 - DNA, 21 bp, Homo sapiens
gacagtgatctccatatgtta

SEQ ID NO: 2043289 - DNA, 19 bp, Homo sapiens
gaccccatcacctactcac

SEQ ID NO: 2043290 - DNA, 20 bp, Homo sapiens
gaccccccaccaccagccgg

SEQ ID NO: 2043291 - DNA, 13 bp, Homo sapiens
gaccccctgagtc

SEQ ID NO: 2043292 - DNA, 18 bp, Homo sapiens
gacccctccatgtgggct

SEQ ID NO: 2043293 - DNA, 13 bp, Homo sapiens
gacccctggcttt

SEQ ID NO: 2043294 - DNA, 21 bp, Homo sapiens
gacccctggcttttcactgct

SEQ ID NO: 2043295 - DNA, 12 bp, Homo sapiens
gaccccttggct

SEQ ID NO: 2043296 - DNA, 12 bp, Homo sapiens
gacccctttccc

SEQ ID NO: 2043297 - DNA, 17 bp, Homo sapiens
gacccctttcccccacc

SEQ ID NO: 2043298 - DNA, 18 bp, Homo sapiens
gacccctttcccccaccc

SEQ ID NO: 2043299 - DNA, 17 bp, Homo sapiens
gacccggaggggcctgg

SEQ ID NO: 2043300 - DNA, 17 bp, Homo sapiens
gacccggcaccccctgc

SEQ ID NO: 2043301 - DNA, 12 bp, Homo sapiens
gacccggctgcg

SEQ ID NO: 2043302 - DNA, 22 bp, Homo sapiens
gacccgttcaacttttcctttg

SEQ ID NO: 2043303 - DNA, 18 bp, Homo sapiens
gaccctaagaccggcggc

SEQ ID NO: 2043304 - DNA, 11 bp, Homo sapiens
gaccctacccc

SEQ ID NO: 2043305 - DNA, 10 bp, Homo sapiens
gaccctcact

SEQ ID NO: 2043306 - DNA, 19 bp, Homo sapiens
gaccctccaccgcagaagg

SEQ ID NO: 2043307 - DNA, 22 bp, Homo sapiens
gaccctccaccgcagaaggaag

SEQ ID NO: 2043308 - DNA, 15 bp, Homo sapiens
gaccctcctgtccag

SEQ ID NO: 2043309 - DNA, 11 bp, Homo sapiens
gacgccctgcg

SEQ ID NO: 2043310 - DNA, 12 bp, Homo sapiens
gacgcttccaga

SEQ ID NO: 2043311 - DNA, 13 bp, Homo sapiens
gacgcttccagac

SEQ ID NO: 2043312 - DNA, 16 bp, Homo sapiens
gacgcttccagaccac

SEQ ID NO: 2043313 - DNA, 22 bp, Homo sapiens
gacgcttccagaccacctgcca

SEQ ID NO: 2043314 - DNA, 18 bp, Homo sapiens
gacggagtcccaccttgg

SEQ ID NO: 2043315 - DNA, 13 bp, Homo sapiens
gacggctggacct

SEQ ID NO: 2043316 - DNA, 17 bp, Homo sapiens
gacgggagcctcctctg

SEQ ID NO: 2043317 - DNA, 19 bp, Homo sapiens
gacggtcctttaggcagcc

SEQ ID NO: 2043318 - DNA, 21 bp, Homo sapiens
gacggtcctttaggcagcctg

SEQ ID NO: 2043319 - DNA, 23 bp, Homo sapiens
gacggtcctttaggcagcctgcc

SEQ ID NO: 2043320 - DNA, 21 bp, Homo sapiens
gacgtcatcggaggctgggcc

SEQ ID NO: 2043321 - DNA, 21 bp, Homo sapiens
gacgttcggggcatgctgggg

SEQ ID NO: 2043322 - DNA, 14 bp, Homo sapiens
gactaacactcaga

SEQ ID NO: 2043323 - DNA, 19 bp, Homo sapiens
gactaacactcagaagcct

SEQ ID NO: 2043324 - DNA, 19 bp, Homo sapiens
gagacagaccccttggctt

SEQ ID NO: 2043325 - DNA, 9 bp, Homo sapiens
gagacagag

SEQ ID NO: 2043326 - DNA, 15 bp, Homo sapiens
gagacagagagagac

SEQ ID NO: 2043327 - DNA, 15 bp, Homo sapiens
gagacagagccccca

SEQ ID NO: 2043328 - DNA, 18 bp, Homo sapiens
gagacagccacttggttt

SEQ ID NO: 2043329 - DNA, 16 bp, Homo sapiens
gagacaggacctgact

SEQ ID NO: 2043330 - DNA, 17 bp, Homo sapiens
gagacagggcaatcttg

SEQ ID NO: 2043331 - DNA, 19 bp, Homo sapiens
gagacaggtggcctagcag

SEQ ID NO: 2043332 - DNA, 22 bp, Homo sapiens
gagacaggtggcctagcaggca

SEQ ID NO: 2043333 - DNA, 16 bp, Homo sapiens
gagacattaactcatt

SEQ ID NO: 2043334 - DNA, 20 bp, Homo sapiens
gagacattgcctccacctct

SEQ ID NO: 2043335 - DNA, 23 bp, Homo sapiens
gagaccaagactctgaaatctca

SEQ ID NO: 2043336 - DNA, 23 bp, Homo sapiens
gagaccacagcaattggctcctc

SEQ ID NO: 2043337 - DNA, 16 bp, Homo sapiens
gagaccagcctgggca

SEQ ID NO: 2043338 - DNA, 14 bp, Homo sapiens
gagaccagctcaga

SEQ ID NO: 2043339 - DNA, 16 bp, Homo sapiens
gagaccagctcagagg

SEQ ID NO: 2043340 - DNA, 21 bp, Homo sapiens
gagaccagctcagaggcccag

SEQ ID NO: 2043341 - DNA, 19 bp, Homo sapiens
gagaccccttcctttcctc

SEQ ID NO: 2043342 - DNA, 13 bp, Homo sapiens
gagaccctggaat

SEQ ID NO: 2043343 - DNA, 20 bp, Homo sapiens
gagaccgcttcacccctgca

SEQ ID NO: 2043344 - DNA, 11 bp, Homo sapiens
gagacctcagc

SEQ ID NO: 2043345 - DNA, 20 bp, Homo sapiens
gagacctctcaacagatctg

SEQ ID NO: 2043346 - DNA, 13 bp, Homo sapiens
gagacctgaggca

SEQ ID NO: 2043347 - DNA, 10 bp, Homo sapiens
gagacctggt

SEQ ID NO: 2043348 - DNA, 18 bp, Homo sapiens
gagaccttttctctccca

SEQ ID NO: 2043349 - DNA, 20 bp, Homo sapiens
gagaccttttctctcccata

SEQ ID NO: 2043350 - DNA, 19 bp, Homo sapiens
gagacgcaagggagaagaa

SEQ ID NO: 2043351 - DNA, 19 bp, Homo sapiens
gagacggctggacctgcac

SEQ ID NO: 2043352 - DNA, 15 bp, Homo sapiens
gagactaagccctgt

SEQ ID NO: 2043353 - DNA, 22 bp, Homo sapiens
gagactaagccctgtcgagaca

SEQ ID NO: 2043354 - DNA, 21 bp, Homo sapiens
gagactatggagcctggcaca

SEQ ID NO: 2043355 - DNA, 15 bp, Homo sapiens
gagactcacctctgc

SEQ ID NO: 2043356 - DNA, 20 bp, Homo sapiens
gagactccagaatctgctgt

SEQ ID NO: 2043357 - DNA, 16 bp, Homo sapiens
gagactctcttaggga

SEQ ID NO: 2043358 - DNA, 20 bp, Homo sapiens
gagactgaaagcagcagcta

SEQ ID NO: 2043359 - DNA, 22 bp, Homo sapiens
gagactgcgggatggtcctggg

SEQ ID NO: 2043360 - DNA, 20 bp, Homo sapiens
gagactggagcatctgactc

SEQ ID NO: 2043361 - DNA, 17 bp, Homo sapiens
gagacttggggaccaga

SEQ ID NO: 2043362 - DNA, 12 bp, Homo sapiens
gagagaaggaca

SEQ ID NO: 2043363 - DNA, 19 bp, Homo sapiens
gagagaatatttcaaatga

SEQ ID NO: 2043364 - DNA, 18 bp, Homo sapiens
gagagacactcccaggga

SEQ ID NO: 2043365 - DNA, 15 bp, Homo sapiens
gagagacagagacag

SEQ ID NO: 2043366 - DNA, 14 bp, Homo sapiens
gagagacccaagga

SEQ ID NO: 2043367 - DNA, 22 bp, Homo sapiens
gagagaccctcactgctgggga

SEQ ID NO: 2043368 - DNA, 16 bp, Homo sapiens
gagagactcaaagaga

SEQ ID NO: 2043369 - DNA, 11 bp, Homo sapiens
gagagagactg

SEQ ID NO: 2043370 - DNA, 15 bp, Homo sapiens
gagagagagagaggt

SEQ ID NO: 2043371 - DNA, 16 bp, Homo sapiens
gagagagagagaggtt

SEQ ID NO: 2043372 - DNA, 14 bp, Homo sapiens
gagagagaggttct

SEQ ID NO: 2043373 - DNA, 15 bp, Homo sapiens
gagagagaggttctg

SEQ ID NO: 2043374 - DNA, 19 bp, Homo sapiens
gagagagctcgctcttggg

SEQ ID NO: 2043375 - DNA, 21 bp, Homo sapiens
gagagagctcgctcttgggag

SEQ ID NO: 2043376 - DNA, 18 bp, Homo sapiens
gagagaggttctggggag

SEQ ID NO: 2043377 - DNA, 20 bp, Homo sapiens
gagagagtcttccaggtact

SEQ ID NO: 2043378 - DNA, 14 bp, Homo sapiens
gagagagtttatca

SEQ ID NO: 2043379 - DNA, 21 bp, Homo sapiens
gagagatctagaaagtgggtt

SEQ ID NO: 2043380 - DNA, 17 bp, Homo sapiens
gagagcactagaagtgg

SEQ ID NO: 2043381 - DNA, 22 bp, Homo sapiens
gagagcactagaagtggtttcc

SEQ ID NO: 2043382 - DNA, 13 bp, Homo sapiens
gagagcacttgaa

SEQ ID NO: 2043383 - DNA, 11 bp, Homo sapiens
gagagcagctg

SEQ ID NO: 2043384 - DNA, 12 bp, Homo sapiens
gagagcagctgg

SEQ ID NO: 2043385 - DNA, 16 bp, Homo sapiens
gagagccagaacctgg

SEQ ID NO: 2043386 - DNA, 12 bp, Homo sapiens
gagagccagctc

SEQ ID NO: 2043387 - DNA, 13 bp, Homo sapiens
gagagccagctct

SEQ ID NO: 2043388 - DNA, 14 bp, Homo sapiens
gagagccagctctc

SEQ ID NO: 2043389 - DNA, 10 bp, Homo sapiens
gagagcccag

SEQ ID NO: 2043390 - DNA, 13 bp, Homo sapiens
gagagcccagcca

SEQ ID NO: 2043391 - DNA, 16 bp, Homo sapiens
gagagccctgctgtgg

SEQ ID NO: 2043392 - DNA, 19 bp, Homo sapiens
gagagccctgctgtgggag

SEQ ID NO: 2043393 - DNA, 13 bp, Homo sapiens
gagagccctggga

SEQ ID NO: 2043394 - DNA, 14 bp, Homo sapiens
gagagcctcttagt

SEQ ID NO: 2043395 - DNA, 14 bp, Homo sapiens
gagagcctgctccc

SEQ ID NO: 2043396 - DNA, 22 bp, Homo sapiens
gagagcctgctcccccaccccc

SEQ ID NO: 2043397 - DNA, 20 bp, Homo sapiens
gagagctagaacctggagag

SEQ ID NO: 2043398 - DNA, 14 bp, Homo sapiens
gagagctaggagca

SEQ ID NO: 2043399 - DNA, 16 bp, Homo sapiens
gagagctcgctcttgg

SEQ ID NO: 2043400 - DNA, 20 bp, Homo sapiens
gagagctgggtgtcaagagg

SEQ ID NO: 2043401 - DNA, 23 bp, Homo sapiens
gagagctttctgtccttttggca

SEQ ID NO: 2043402 - DNA, 15 bp, Homo sapiens
gagaggaagatgaag

SEQ ID NO: 2043403 - DNA, 18 bp, Homo sapiens
gagaggaagatgaagaga

SEQ ID NO: 2043404 - DNA, 12 bp, Homo sapiens
gagaggaagggt

SEQ ID NO: 2043405 - DNA, 17 bp, Homo sapiens
gagaggacaagatgggt

SEQ ID NO: 2043406 - DNA, 16 bp, Homo sapiens
gagaggactctgcctt

SEQ ID NO: 2043407 - DNA, 19 bp, Homo sapiens
gagaggagaaactgagaaa

SEQ ID NO: 2043408 - DNA, 14 bp, Homo sapiens
gagaggagatcagg

SEQ ID NO: 2043409 - DNA, 16 bp, Homo sapiens
gagaggcagagaaaga

SEQ ID NO: 2043410 - DNA, 12 bp, Homo sapiens
gagaggccctgg

SEQ ID NO: 2043411 - DNA, 19 bp, Homo sapiens
gagaggcgcgtctgcccca

SEQ ID NO: 2043412 - DNA, 18 bp, Homo sapiens
gagaggctgtggtggctg

SEQ ID NO: 2043413 - DNA, 23 bp, Homo sapiens
gagaggctgtggtggctgtctct

SEQ ID NO: 2043414 - DNA, 13 bp, Homo sapiens
gagagggagggag

SEQ ID NO: 2043415 - DNA, 21 bp, Homo sapiens
gagagggctgttggacagctg

SEQ ID NO: 2043416 - DNA, 21 bp, Homo sapiens
gagaggggaataatagaagaa

SEQ ID NO: 2043417 - DNA, 19 bp, Homo sapiens
gagaggggagacagggcaa

SEQ ID NO: 2043418 - DNA, 13 bp, Homo sapiens
gagaggggcctgg

SEQ ID NO: 2043419 - DNA, 14 bp, Homo sapiens
gagaggggcctggg

SEQ ID NO: 2043420 - DNA, 19 bp, Homo sapiens
gagaggggcctgggaaagg

SEQ ID NO: 2043421 - DNA, 22 bp, Homo sapiens
gagaggggcctgggaaaggaaa

SEQ ID NO: 2043422 - DNA, 16 bp, Homo sapiens
gagagggggctctcca

SEQ ID NO: 2043423 - DNA, 16 bp, Homo sapiens
gagaggtccctgctta

SEQ ID NO: 2043424 - DNA, 21 bp, Homo sapiens
gagaggtggagaactgggatt

SEQ ID NO: 2043425 - DNA, 22 bp, Homo sapiens
gagaggtggggagggagacaga

SEQ ID NO: 2043426 - DNA, 16 bp, Homo sapiens
gagaggttctggggag

SEQ ID NO: 2043427 - DNA, 18 bp, Homo sapiens
gagaggttctggggagga

SEQ ID NO: 2043428 - DNA, 22 bp, Homo sapiens
gagaggttctggggaggaaggg

SEQ ID NO: 2043429 - DNA, 17 bp, Homo sapiens
gagagtaatgaggcttg

SEQ ID NO: 2043430 - DNA, 14 bp, Homo sapiens
gagagtaccatgct

SEQ ID NO: 2043431 - DNA, 22 bp, Homo sapiens
gagagtagccgagagcctgctc

SEQ ID NO: 2043432 - DNA, 15 bp, Homo sapiens
gagagtcctctggat

SEQ ID NO: 2043433 - DNA, 21 bp, Homo sapiens
gagagtcctttgggattctag

SEQ ID NO: 2043434 - DNA, 23 bp, Homo sapiens
gagagtgagaataattgtgtaca

SEQ ID NO: 2043435 - DNA, 16 bp, Homo sapiens
gagagttggctcaggc

SEQ ID NO: 2043436 - DNA, 18 bp, Homo sapiens
gagagttggctcaggcag

SEQ ID NO: 2043437 - DNA, 22 bp, Homo sapiens
gagagtttatcattgggagaag

SEQ ID NO: 2043438 - DNA, 22 bp, Homo sapiens
gagatatacaaatatatttaat

SEQ ID NO: 2043439 - DNA, 22 bp, Homo sapiens
gagatatttacatgaattgcat

SEQ ID NO: 2043440 - DNA, 22 bp, Homo sapiens
gagatatttatggggggagaac

SEQ ID NO: 2043441 - DNA, 20 bp, Homo sapiens
gagatcaaccccttcgctcc

SEQ ID NO: 2043442 - DNA, 18 bp, Homo sapiens
gagatcacgccactgcac

SEQ ID NO: 2043443 - DNA, 13 bp, Homo sapiens
gagatcaggaaga

SEQ ID NO: 2043444 - DNA, 17 bp, Homo sapiens
gagatcgctggcagaga

SEQ ID NO: 2043445 - DNA, 21 bp, Homo sapiens
gagatcgtgccgttactctcc

SEQ ID NO: 2043446 - DNA, 20 bp, Homo sapiens
gagatctaagcctttccata

SEQ ID NO: 2043447 - DNA, 21 bp, Homo sapiens
gagatctaagcctttccataa

SEQ ID NO: 2043448 - DNA, 17 bp, Homo sapiens
gagatctccctccaggg

SEQ ID NO: 2043449 - DNA, 19 bp, Homo sapiens
gagatcttacaggtatcag

SEQ ID NO: 2043450 - DNA, 22 bp, Homo sapiens
gagatcttacaggtatcaggca

SEQ ID NO: 2043451 - DNA, 16 bp, Homo sapiens
gagatgactgagtcct

SEQ ID NO: 2043452 - DNA, 21 bp, Homo sapiens
gagatgactgagtcctcgtag

SEQ ID NO: 2043453 - DNA, 13 bp, Homo sapiens
gagatgatgatga

SEQ ID NO: 2043454 - DNA, 14 bp, Homo sapiens
gagatgatgatgat

SEQ ID NO: 2043455 - DNA, 15 bp, Homo sapiens
gagatgatgatgatg

SEQ ID NO: 2043456 - DNA, 17 bp, Homo sapiens
gagatgcatgcgcaggc

SEQ ID NO: 2043457 - DNA, 15 bp, Homo sapiens
gagatgcctccaccg

SEQ ID NO: 2043458 - DNA, 23 bp, Homo sapiens
gagatgcctccaccgctgcctaa

SEQ ID NO: 2043459 - DNA, 18 bp, Homo sapiens
gagatggacccctccctt

SEQ ID NO: 2043460 - DNA, 20 bp, Homo sapiens
gagatggcgctattgcactc

SEQ ID NO: 2043461 - DNA, 18 bp, Homo sapiens
gagatgggcttgttttct

SEQ ID NO: 2043462 - DNA, 23 bp, Homo sapiens
gagatggtcagtgtggagagggg

SEQ ID NO: 2043463 - DNA, 15 bp, Homo sapiens
gagattaattttaac

SEQ ID NO: 2043464 - DNA, 21 bp, Homo sapiens
gagattgcaccactgcactcc

SEQ ID NO: 2043465 - DNA, 14 bp, Homo sapiens
gagattgggcctcc

SEQ ID NO: 2043466 - DNA, 13 bp, Homo sapiens
gagatttcagtta

SEQ ID NO: 2043467 - DNA, 13 bp, Homo sapiens
gagatttgtattt

SEQ ID NO: 2043468 - DNA, 14 bp, Homo sapiens
gagcaaagcctgtt

SEQ ID NO: 2043469 - DNA, 15 bp, Homo sapiens
gagcaaatgtttctg

SEQ ID NO: 2043470 - DNA, 20 bp, Homo sapiens
gagcaacccctgtacccagc

SEQ ID NO: 2043471 - DNA, 21 bp, Homo sapiens
gagcaacccctgtacccagct

SEQ ID NO: 2043472 - DNA, 16 bp, Homo sapiens
gagcaaccgtggccct

SEQ ID NO: 2043473 - DNA, 21 bp, Homo sapiens
gagcaaccgtggcccttcctg

SEQ ID NO: 2043474 - DNA, 22 bp, Homo sapiens
gagcaaccgtggcccttcctgg

SEQ ID NO: 2043475 - DNA, 23 bp, Homo sapiens
gagcaaccgtggcccttcctgga

SEQ ID NO: 2043476 - DNA, 18 bp, Homo sapiens
gagcaactctccactcca

SEQ ID NO: 2043477 - DNA, 19 bp, Homo sapiens
gagcaactctccactccat

SEQ ID NO: 2043478 - DNA, 13 bp, Homo sapiens
gagcaagagctgg

SEQ ID NO: 2043479 - DNA, 13 bp, Homo sapiens
gagcaatgggagg

SEQ ID NO: 2043480 - DNA, 15 bp, Homo sapiens
gagcaatgggagggg

SEQ ID NO: 2043481 - DNA, 22 bp, Homo sapiens
gagcaattcatttcactttaaa

SEQ ID NO: 2043482 - DNA, 21 bp, Homo sapiens
gagcacacaggtacagcaaca

SEQ ID NO: 2043483 - DNA, 22 bp, Homo sapiens
gagcacacggccctgccccatc

SEQ ID NO: 2043484 - DNA, 13 bp, Homo sapiens
gagcacactgtag

SEQ ID NO: 2043485 - DNA, 13 bp, Homo sapiens
gagcacagccctg

SEQ ID NO: 2043486 - DNA, 19 bp, Homo sapiens
gagcacagccctgggaggg

SEQ ID NO: 2043487 - DNA, 14 bp, Homo sapiens
gagcacaggcagct

SEQ ID NO: 2043488 - DNA, 15 bp, Homo sapiens
gagcacaggcagctg

SEQ ID NO: 2043489 - DNA, 13 bp, Homo sapiens
gagcaccaggcac

SEQ ID NO: 2043490 - DNA, 17 bp, Homo sapiens
gagcaccccctcattcc

SEQ ID NO: 2043491 - DNA, 12 bp, Homo sapiens
gagcacctgctt

SEQ ID NO: 2043492 - DNA, 15 bp, Homo sapiens
gagcactgccaggag

SEQ ID NO: 2043493 - DNA, 13 bp, Homo sapiens
gagcactgctcca

SEQ ID NO: 2043494 - DNA, 14 bp, Homo sapiens
gagcactggagtgc

SEQ ID NO: 2043495 - DNA, 20 bp, Homo sapiens
gagcactggagtgcagggag

SEQ ID NO: 2043496 - DNA, 12 bp, Homo sapiens
gagcactggcca

SEQ ID NO: 2043497 - DNA, 17 bp, Homo sapiens
gagcactggccagagag

SEQ ID NO: 2043498 - DNA, 22 bp, Homo sapiens
gagcactggccagagagggccc

SEQ ID NO: 2043499 - DNA, 16 bp, Homo sapiens
gagcacttgcgtcctg

SEQ ID NO: 2043500 - DNA, 18 bp, Homo sapiens
gagcacttgcgtcctgca

SEQ ID NO: 2043501 - DNA, 16 bp, Homo sapiens
gagcagaaagccaggg

SEQ ID NO: 2043502 - DNA, 20 bp, Homo sapiens
gagcagaaagccagggtcct

SEQ ID NO: 2043503 - DNA, 20 bp, Homo sapiens
gagcagaaataaaaagcatg

SEQ ID NO: 2043504 - DNA, 13 bp, Homo sapiens
gagcagacagaga

SEQ ID NO: 2043505 - DNA, 16 bp, Homo sapiens
gagcagacagagaaat

SEQ ID NO: 2043506 - DNA, 23 bp, Homo sapiens
gagcagagctgatggagaaggaa

SEQ ID NO: 2043507 - DNA, 13 bp, Homo sapiens
gagcagaggcagc

SEQ ID NO: 2043508 - DNA, 19 bp, Homo sapiens
gagcagagtataggatgga

SEQ ID NO: 2043509 - DNA, 16 bp, Homo sapiens
gagcagcctgatggcc

SEQ ID NO: 2043510 - DNA, 15 bp, Homo sapiens
gagcagctgagcagg

SEQ ID NO: 2043511 - DNA, 14 bp, Homo sapiens
gagcagctggctct

SEQ ID NO: 2043512 - DNA, 15 bp, Homo sapiens
gagcagcttcagttg

SEQ ID NO: 2043513 - DNA, 17 bp, Homo sapiens
gagcaggaacagagact

SEQ ID NO: 2043514 - DNA, 21 bp, Homo sapiens
gagcaggaacagagactctgg

SEQ ID NO: 2043515 - DNA, 15 bp, Homo sapiens
gagcaggcacatgga

SEQ ID NO: 2043516 - DNA, 19 bp, Homo sapiens
gagcaggcacatggaggag

SEQ ID NO: 2043517 - DNA, 15 bp, Homo sapiens
gagcaggctcagact

SEQ ID NO: 2043518 - DNA, 16 bp, Homo sapiens
gagcagggccggggaa

SEQ ID NO: 2043519 - DNA, 21 bp, Homo sapiens
gagcagggctcagcggggaca

SEQ ID NO: 2043520 - DNA, 13 bp, Homo sapiens
gagcaggggcagg

SEQ ID NO: 2043521 - DNA, 20 bp, Homo sapiens
gagcaggggtccttggtgtg

SEQ ID NO: 2043522 - DNA, 17 bp, Homo sapiens
gagcaggggtctgagcc

SEQ ID NO: 2043523 - DNA, 16 bp, Homo sapiens
gagcaggtctctggca

SEQ ID NO: 2043524 - DNA, 19 bp, Homo sapiens
gagcaggtctctggcagag

SEQ ID NO: 2043525 - DNA, 17 bp, Homo sapiens
gagcagtcagggtggga

SEQ ID NO: 2043526 - DNA, 20 bp, Homo sapiens
gagcagtcagggtgggaaga

SEQ ID NO: 2043527 - DNA, 12 bp, Homo sapiens
gagcagtgtctt

SEQ ID NO: 2043528 - DNA, 21 bp, Homo sapiens
gagcataataaatggatgagg

SEQ ID NO: 2043529 - DNA, 15 bp, Homo sapiens
gagcataatgctccc

SEQ ID NO: 2043530 - DNA, 13 bp, Homo sapiens
gagcatcatgcct

SEQ ID NO: 2043531 - DNA, 14 bp, Homo sapiens
gagcatcatgcctc

SEQ ID NO: 2043532 - DNA, 17 bp, Homo sapiens
gagcatcatgcctctga

SEQ ID NO: 2043533 - DNA, 22 bp, Homo sapiens
gagcatctctgtgtacccactc

SEQ ID NO: 2043534 - DNA, 19 bp, Homo sapiens
gagcatctcttgaggccag

SEQ ID NO: 2043535 - DNA, 20 bp, Homo sapiens
gagcattacgtgagccaggt

SEQ ID NO: 2043536 - DNA, 17 bp, Homo sapiens
gagcatttccctcccgg

SEQ ID NO: 2043537 - DNA, 23 bp, Homo sapiens
gagcatttccctcccgggagagg

SEQ ID NO: 2043538 - DNA, 18 bp, Homo sapiens
gagccaaacacactgtaa

SEQ ID NO: 2043539 - DNA, 20 bp, Homo sapiens
gagccaacagaagcttccat

SEQ ID NO: 2043540 - DNA, 21 bp, Homo sapiens
gagccaactcactcttatgaa

SEQ ID NO: 2043541 - DNA, 21 bp, Homo sapiens
gagccaagatcgcgccactgc

SEQ ID NO: 2043542 - DNA, 23 bp, Homo sapiens
gagccacagaccacctgcttctg

SEQ ID NO: 2043543 - DNA, 17 bp, Homo sapiens
gagccactacctttgtc

SEQ ID NO: 2043544 - DNA, 16 bp, Homo sapiens
gagccactgcactcca

SEQ ID NO: 2043545 - DNA, 12 bp, Homo sapiens
gagccagccctc

SEQ ID NO: 2043546 - DNA, 15 bp, Homo sapiens
gagccagccctccct

SEQ ID NO: 2043547 - DNA, 14 bp, Homo sapiens
gagccagcctggga

SEQ ID NO: 2043548 - DNA, 19 bp, Homo sapiens
gagccagggtctcactatg

SEQ ID NO: 2043549 - DNA, 13 bp, Homo sapiens
gagccatgggcct

SEQ ID NO: 2043550 - DNA, 14 bp, Homo sapiens
gagccatgggcctg

SEQ ID NO: 2043551 - DNA, 21 bp, Homo sapiens
gagccatgggcctgggcctgc

SEQ ID NO: 2043552 - DNA, 18 bp, Homo sapiens
gagcccaagtgccatccc

SEQ ID NO: 2043553 - DNA, 17 bp, Homo sapiens
gagcccaccttggctca

SEQ ID NO: 2043554 - DNA, 21 bp, Homo sapiens
gagcccacgcccgactagcag

SEQ ID NO: 2043555 - DNA, 20 bp, Homo sapiens
gagcccagaaaacctccagt

SEQ ID NO: 2043556 - DNA, 12 bp, Homo sapiens
gagcccagccac

SEQ ID NO: 2043557 - DNA, 13 bp, Homo sapiens
gagcccagccacc

SEQ ID NO: 2043558 - DNA, 14 bp, Homo sapiens
gagcccagccacct

SEQ ID NO: 2043559 - DNA, 23 bp, Homo sapiens
gagcccagccacctcccaaggac

SEQ ID NO: 2043560 - DNA, 20 bp, Homo sapiens
gagcccagctacattcctca

SEQ ID NO: 2043561 - DNA, 11 bp, Homo sapiens
gagcccaggag

SEQ ID NO: 2043562 - DNA, 12 bp, Homo sapiens
gagcccaggagt

SEQ ID NO: 2043563 - DNA, 12 bp, Homo sapiens
gagcccaggccg

SEQ ID NO: 2043564 - DNA, 14 bp, Homo sapiens
gagcccatgctcaa

SEQ ID NO: 2043565 - DNA, 13 bp, Homo sapiens
gagccccaggcct

SEQ ID NO: 2043566 - DNA, 18 bp, Homo sapiens
gagccccaggcctctgtg

SEQ ID NO: 2043567 - DNA, 15 bp, Homo sapiens
gagcccccaagcctc

SEQ ID NO: 2043568 - DNA, 17 bp, Homo sapiens
gagccccccgtgtggct

SEQ ID NO: 2043569 - DNA, 20 bp, Homo sapiens
gagccccccgtgtggcttac

SEQ ID NO: 2043570 - DNA, 13 bp, Homo sapiens
gagccccgaggcc

SEQ ID NO: 2043571 - DNA, 12 bp, Homo sapiens
gagcccctggtc

SEQ ID NO: 2043572 - DNA, 20 bp, Homo sapiens
gagcccgagggcctgacagg

SEQ ID NO: 2043573 - DNA, 19 bp, Homo sapiens
gagccctgagctcaggctg

SEQ ID NO: 2043574 - DNA, 15 bp, Homo sapiens
gagccctgctgtggg

SEQ ID NO: 2043575 - DNA, 12 bp, Homo sapiens
gagccctggtcc

SEQ ID NO: 2043576 - DNA, 13 bp, Homo sapiens
gagccctggtggc

SEQ ID NO: 2043577 - DNA, 17 bp, Homo sapiens
gagccctggtggcagtg

SEQ ID NO: 2043578 - DNA, 21 bp, Homo sapiens
gagccgagatcacgccactgc

SEQ ID NO: 2043579 - DNA, 22 bp, Homo sapiens
gagccgagattgcgccactgca

SEQ ID NO: 2043580 - DNA, 21 bp, Homo sapiens
gagccgcatcttctccatctg

SEQ ID NO: 2043581 - DNA, 13 bp, Homo sapiens
gagccgggcctgg

SEQ ID NO: 2043582 - DNA, 14 bp, Homo sapiens
gagcctagccacct

SEQ ID NO: 2043583 - DNA, 16 bp, Homo sapiens
gagcctagccacctcc

SEQ ID NO: 2043584 - DNA, 20 bp, Homo sapiens
gagcctagccacctcccacc

SEQ ID NO: 2043585 - DNA, 19 bp, Homo sapiens
gagcctcgcaacccgtgcc

SEQ ID NO: 2043586 - DNA, 19 bp, Homo sapiens
gagcctcggtggccatgct

SEQ ID NO: 2043587 - DNA, 13 bp, Homo sapiens
gagcctgccgagc

SEQ ID NO: 2043588 - DNA, 14 bp, Homo sapiens
gagcctgccgagca

SEQ ID NO: 2043589 - DNA, 15 bp, Homo sapiens
gagcctgccgagcaa

SEQ ID NO: 2043590 - DNA, 22 bp, Homo sapiens
gagcctgccgagcaaccgtggc

SEQ ID NO: 2043591 - DNA, 17 bp, Homo sapiens
gagcctgctcccccacc

SEQ ID NO: 2043592 - DNA, 23 bp, Homo sapiens
gagcctggctccgtccaggagcc

SEQ ID NO: 2043593 - DNA, 18 bp, Homo sapiens
gagcctgtgaacccagga

SEQ ID NO: 2043594 - DNA, 15 bp, Homo sapiens
gagccttttcttata

SEQ ID NO: 2043595 - DNA, 15 bp, Homo sapiens
gagcgaaagtttctt

SEQ ID NO: 2043596 - DNA, 20 bp, Homo sapiens
gagcgcacctgccccctggt

SEQ ID NO: 2043597 - DNA, 16 bp, Homo sapiens
gagcgcatcaggcctg

SEQ ID NO: 2043598 - DNA, 15 bp, Homo sapiens
gagcggctctcctga

SEQ ID NO: 2043599 - DNA, 15 bp, Homo sapiens
gagctaagttctaag

SEQ ID NO: 2043600 - DNA, 15 bp, Homo sapiens
gagctacataattta

SEQ ID NO: 2043601 - DNA, 14 bp, Homo sapiens
gagctacctgtgtg

SEQ ID NO: 2043602 - DNA, 15 bp, Homo sapiens
gagctactctcttgc

SEQ ID NO: 2043603 - DNA, 17 bp, Homo sapiens
gagctactctcttgcca

SEQ ID NO: 2043604 - DNA, 19 bp, Homo sapiens
gagctagaacctggagagc

SEQ ID NO: 2043605 - DNA, 15 bp, Homo sapiens
gagctagaagctgga

SEQ ID NO: 2043606 - DNA, 14 bp, Homo sapiens
gagctagcgctgcc

SEQ ID NO: 2043607 - DNA, 23 bp, Homo sapiens
gagctagcgctgccgcaccccag

SEQ ID NO: 2043608 - DNA, 17 bp, Homo sapiens
gagctaggagcaaagcc

SEQ ID NO: 2043609 - DNA, 14 bp, Homo sapiens
gagctcacaaggca

SEQ ID NO: 2043610 - DNA, 23 bp, Homo sapiens
gagctcacaaggcagcaaggccc

SEQ ID NO: 2043611 - DNA, 18 bp, Homo sapiens
gagctcacagtacaatgt

SEQ ID NO: 2043612 - DNA, 20 bp, Homo sapiens
gagctcagacccccactctc

SEQ ID NO: 2043613 - DNA, 15 bp, Homo sapiens
gagctcaggctgagc

SEQ ID NO: 2043614 - DNA, 21 bp, Homo sapiens
gagctcaggctgagcccagcc

SEQ ID NO: 2043615 - DNA, 14 bp, Homo sapiens
gagctcccccttcc

SEQ ID NO: 2043616 - DNA, 18 bp, Homo sapiens
gagctcccccttcccagt

SEQ ID NO: 2043617 - DNA, 15 bp, Homo sapiens
gagctcccttcctga

SEQ ID NO: 2043618 - DNA, 19 bp, Homo sapiens
gagctccgctaagacctcc

SEQ ID NO: 2043619 - DNA, 22 bp, Homo sapiens
gagctccgctaagacctcccca

SEQ ID NO: 2043620 - DNA, 17 bp, Homo sapiens
gagctcctgtccctacc

SEQ ID NO: 2043621 - DNA, 21 bp, Homo sapiens
gagctcctgtccctacccact

SEQ ID NO: 2043622 - DNA, 15 bp, Homo sapiens
gagctcgctcttggg

SEQ ID NO: 2043623 - DNA, 18 bp, Homo sapiens
gagctcgctcttgggagt

SEQ ID NO: 2043624 - DNA, 12 bp, Homo sapiens
gagctctgagag

SEQ ID NO: 2043625 - DNA, 13 bp, Homo sapiens
gagctctgagagg

SEQ ID NO: 2043626 - DNA, 14 bp, Homo sapiens
gagctctgagaggc

SEQ ID NO: 2043627 - DNA, 16 bp, Homo sapiens
gagctctgagaggccc

SEQ ID NO: 2043628 - DNA, 17 bp, Homo sapiens
gagctctgagaggccct

SEQ ID NO: 2043629 - DNA, 18 bp, Homo sapiens
gagctctgagaggccctg

SEQ ID NO: 2043630 - DNA, 21 bp, Homo sapiens
gagctctgagaggccctggat

SEQ ID NO: 2043631 - DNA, 21 bp, Homo sapiens
gagctcttcggtttctgagca

SEQ ID NO: 2043632 - DNA, 12 bp, Homo sapiens
gagctcttggaa

SEQ ID NO: 2043633 - DNA, 20 bp, Homo sapiens
gagctgagattgcgccactg

SEQ ID NO: 2043634 - DNA, 17 bp, Homo sapiens
gagctgaggcaattcta

SEQ ID NO: 2043635 - DNA, 16 bp, Homo sapiens
gagctgagtcacctcc

SEQ ID NO: 2043636 - DNA, 18 bp, Homo sapiens
gagctgatttccaggccc

SEQ ID NO: 2043637 - DNA, 19 bp, Homo sapiens
gagctgatttccaggcccc

SEQ ID NO: 2043638 - DNA, 21 bp, Homo sapiens
gagctgatttccaggcccctg

SEQ ID NO: 2043639 - DNA, 18 bp, Homo sapiens
gagctgccgcaaggccct

SEQ ID NO: 2043640 - DNA, 19 bp, Homo sapiens
gagctgcctgttcagctcc

SEQ ID NO: 2043641 - DNA, 21 bp, Homo sapiens
gagctgcctgttcagctccag

SEQ ID NO: 2043642 - DNA, 22 bp, Homo sapiens
gagctgctcctggctgaggggc

SEQ ID NO: 2043643 - DNA, 24 bp, Homo sapiens
gagctgctgttccaacagacaggg

SEQ ID NO: 2043644 - DNA, 12 bp, Homo sapiens
gagctggaaata

SEQ ID NO: 2043645 - DNA, 20 bp, Homo sapiens
gagctggaaataaacctgga

SEQ ID NO: 2043646 - DNA, 22 bp, Homo sapiens
gagctggaaataaacctggaga

SEQ ID NO: 2043647 - DNA, 23 bp, Homo sapiens
gagctggaaataaacctggagat

SEQ ID NO: 2043648 - DNA, 17 bp, Homo sapiens
gagctggaaggcagggc

SEQ ID NO: 2043649 - DNA, 18 bp, Homo sapiens
gagctggaaggcagggca

SEQ ID NO: 2043650 - DNA, 20 bp, Homo sapiens
gagctggcaaaggtggctct

SEQ ID NO: 2043651 - DNA, 16 bp, Homo sapiens
gagctggcattggtct

SEQ ID NO: 2043652 - DNA, 20 bp, Homo sapiens
gagctgggaaacagggagcc

SEQ ID NO: 2043653 - DNA, 16 bp, Homo sapiens
gagctgggaggaaaag

SEQ ID NO: 2043654 - DNA, 13 bp, Homo sapiens
gagctggggccac

SEQ ID NO: 2043655 - DNA, 23 bp, Homo sapiens
gagctggggcctggagaggggcc

SEQ ID NO: 2043656 - DNA, 15 bp, Homo sapiens
gagctggggtacagg

SEQ ID NO: 2043657 - DNA, 19 bp, Homo sapiens
gagctggggtacaggtttg

SEQ ID NO: 2043658 - DNA, 18 bp, Homo sapiens
gagctgggtgtcaagagg

SEQ ID NO: 2043659 - DNA, 17 bp, Homo sapiens
gagctgttcacagccag

SEQ ID NO: 2043660 - DNA, 15 bp, Homo sapiens
gagctgttggcctcg

SEQ ID NO: 2043661 - DNA, 21 bp, Homo sapiens
gaggcccagcctgtcctggta

SEQ ID NO: 2043662 - DNA, 13 bp, Homo sapiens
gaggcccagggag

SEQ ID NO: 2043663 - DNA, 14 bp, Homo sapiens
gaggccccaggccc

SEQ ID NO: 2043664 - DNA, 16 bp, Homo sapiens
gaggccccaggcccta

SEQ ID NO: 2043665 - DNA, 13 bp, Homo sapiens
gaggccctggatc

SEQ ID NO: 2043666 - DNA, 18 bp, Homo sapiens
gaggccgaagctaacagg

SEQ ID NO: 2043667 - DNA, 11 bp, Homo sapiens
gaggcctcagt

SEQ ID NO: 2043668 - DNA, 13 bp, Homo sapiens
gaggcctcatccc

SEQ ID NO: 2043669 - DNA, 15 bp, Homo sapiens
gaggcctcatccctc

SEQ ID NO: 2043670 - DNA, 18 bp, Homo sapiens
gaggcctctggaaagcaa

SEQ ID NO: 2043671 - DNA, 22 bp, Homo sapiens
gaggcctcttggacctctgctc

SEQ ID NO: 2043672 - DNA, 23 bp, Homo sapiens
gaggcctgccctcagggatcttg

SEQ ID NO: 2043673 - DNA, 16 bp, Homo sapiens
gaggcctggccaggca

SEQ ID NO: 2043674 - DNA, 17 bp, Homo sapiens
gaggcctggccaggcac

SEQ ID NO: 2043675 - DNA, 13 bp, Homo sapiens
gaggcctggcctt

SEQ ID NO: 2043676 - DNA, 23 bp, Homo sapiens
gaggcctggccttgtcaggaccc

SEQ ID NO: 2043677 - DNA, 14 bp, Homo sapiens
gaggccttctctga

SEQ ID NO: 2043678 - DNA, 20 bp, Homo sapiens
gaggtcgggagttcgagacc

SEQ ID NO: 2043679 - DNA, 22 bp, Homo sapiens
gaggtctccactgaggatgtga

SEQ ID NO: 2043680 - DNA, 13 bp, Homo sapiens
gaggtctgagccc

SEQ ID NO: 2043681 - DNA, 19 bp, Homo sapiens
gaggtctgagccctggtgt

SEQ ID NO: 2043682 - DNA, 20 bp, Homo sapiens
gaggtctgagccctggtgtg

SEQ ID NO: 2043683 - DNA, 16 bp, Homo sapiens
gaggtgaccccagggc

SEQ ID NO: 2043684 - DNA, 17 bp, Homo sapiens
gaggtgaccccagggca

SEQ ID NO: 2043685 - DNA, 15 bp, Homo sapiens
gaggtgagaccacct

SEQ ID NO: 2043686 - DNA, 13 bp, Homo sapiens
gaggtgcccagga

SEQ ID NO: 2043687 - DNA, 16 bp, Homo sapiens
gaggtgcctgagctgg

SEQ ID NO: 2043688 - DNA, 17 bp, Homo sapiens
gaggtgcctgagctggg

SEQ ID NO: 2043689 - DNA, 21 bp, Homo sapiens
gaggtgcctgagctggggcct

SEQ ID NO: 2043690 - DNA, 23 bp, Homo sapiens
gaggtgcctgagctggggcctgg

SEQ ID NO: 2043691 - DNA, 11 bp, Homo sapiens
gaggtgctgat

SEQ ID NO: 2043692 - DNA, 20 bp, Homo sapiens
gaggtggatcacagaggctt

SEQ ID NO: 2043693 - DNA, 15 bp, Homo sapiens
gaggtggattcctgg

SEQ ID NO: 2043694 - DNA, 15 bp, Homo sapiens
gaggtggcagccctg

SEQ ID NO: 2043695 - DNA, 16 bp, Homo sapiens
gaggtggcagccctgt

SEQ ID NO: 2043696 - DNA, 21 bp, Homo sapiens
gaggtggccagagctgggagg

SEQ ID NO: 2043697 - DNA, 22 bp, Homo sapiens
gaggtggccagagctgggaggc

SEQ ID NO: 2043698 - DNA, 15 bp, Homo sapiens
gaggtgggcagcagc

SEQ ID NO: 2043699 - DNA, 16 bp, Homo sapiens
gaggtgggcagcagct

SEQ ID NO: 2043700 - DNA, 18 bp, Homo sapiens
gaggtgggcagcagctca

SEQ ID NO: 2043701 - DNA, 13 bp, Homo sapiens
gaggtggtggagg

SEQ ID NO: 2043702 - DNA, 16 bp, Homo sapiens
gaggtggtggaggagg

SEQ ID NO: 2043703 - DNA, 15 bp, Homo sapiens
gaggtgtcccaagct

SEQ ID NO: 2043704 - DNA, 17 bp, Homo sapiens
gaggttatctgcctggc

SEQ ID NO: 2043705 - DNA, 20 bp, Homo sapiens
gaggttatctgcctggcctg

SEQ ID NO: 2043706 - DNA, 21 bp, Homo sapiens
gaggttatctgcctggcctgg

SEQ ID NO: 2043707 - DNA, 11 bp, Homo sapiens
gaggttcctcg

SEQ ID NO: 2043708 - DNA, 18 bp, Homo sapiens
gaggttctggggaggaag

SEQ ID NO: 2043709 - DNA, 23 bp, Homo sapiens
gaggttgagaagactcctgggct

SEQ ID NO: 2043710 - DNA, 19 bp, Homo sapiens
gaggttgcagggagccgag

SEQ ID NO: 2043711 - DNA, 13 bp, Homo sapiens
gaggttgcagtga

SEQ ID NO: 2043712 - DNA, 14 bp, Homo sapiens
gaggttgcagtgag

SEQ ID NO: 2043713 - DNA, 15 bp, Homo sapiens
gaggttgcagtgagc

SEQ ID NO: 2043714 - DNA, 19 bp, Homo sapiens
gaggttgcagtgagctgag

SEQ ID NO: 2043715 - DNA, 21 bp, Homo sapiens
gaggttgtggatgctccaggg

SEQ ID NO: 2043716 - DNA, 16 bp, Homo sapiens
gagtaatatgcctgct

SEQ ID NO: 2043717 - DNA, 14 bp, Homo sapiens
gagtaatcaggcag

SEQ ID NO: 2043718 - DNA, 15 bp, Homo sapiens
gagtaatcaggcagc

SEQ ID NO: 2043719 - DNA, 17 bp, Homo sapiens
gagtaatcaggcagcct

SEQ ID NO: 2043720 - DNA, 14 bp, Homo sapiens
gagtaatttattgt

SEQ ID NO: 2043721 - DNA, 16 bp, Homo sapiens
gagtaatttattgttt

SEQ ID NO: 2043722 - DNA, 19 bp, Homo sapiens
gagtacagacgtctcaaga

SEQ ID NO: 2043723 - DNA, 19 bp, Homo sapiens
gagtaccttctacaggccc

SEQ ID NO: 2043724 - DNA, 20 bp, Homo sapiens
gagtagaaagacagagctgg

SEQ ID NO: 2043725 - DNA, 22 bp, Homo sapiens
gagtagaaagacagagctggga

SEQ ID NO: 2043726 - DNA, 14 bp, Homo sapiens
gagtagaaattgtt

SEQ ID NO: 2043727 - DNA, 18 bp, Homo sapiens
gagtagatggtgaaattt

SEQ ID NO: 2043728 - DNA, 18 bp, Homo sapiens
gagtagcatggactctgg

SEQ ID NO: 2043729 - DNA, 22 bp, Homo sapiens
gagtagctgggactacaggcac

SEQ ID NO: 2043730 - DNA, 19 bp, Homo sapiens
gagtatatatgtacagtta

SEQ ID NO: 2043731 - DNA, 17 bp, Homo sapiens
gagtatcaggtctccca

SEQ ID NO: 2043732 - DNA, 22 bp, Homo sapiens
gagtatgcaagaagaatataaa

SEQ ID NO: 2043733 - DNA, 18 bp, Homo sapiens
gagtatttacaataaaga

SEQ ID NO: 2043734 - DNA, 14 bp, Homo sapiens
gagtcaagttgttc

SEQ ID NO: 2043735 - DNA, 18 bp, Homo sapiens
gagtcaattggaaagact

SEQ ID NO: 2043736 - DNA, 15 bp, Homo sapiens
gagtcacctcctcca

SEQ ID NO: 2043737 - DNA, 12 bp, Homo sapiens
gagtcacctgca

SEQ ID NO: 2043738 - DNA, 14 bp, Homo sapiens
gagtcacctgcaag

SEQ ID NO: 2043739 - DNA, 16 bp, Homo sapiens
gagtcacctgcaagcc

SEQ ID NO: 2043740 - DNA, 23 bp, Homo sapiens
gagtcacctgcaagccccagggc

SEQ ID NO: 2043741 - DNA, 13 bp, Homo sapiens
gagtcagaggaga

SEQ ID NO: 2043742 - DNA, 21 bp, Homo sapiens
gagtcaggacctccggggaga

SEQ ID NO: 2043743 - DNA, 23 bp, Homo sapiens
gagtcaggacttgaacccaggtc

SEQ ID NO: 2043744 - DNA, 20 bp, Homo sapiens
gagtcatgatctccctgccg

SEQ ID NO: 2043745 - DNA, 12 bp, Homo sapiens
gagtccagggcg

SEQ ID NO: 2043746 - DNA, 16 bp, Homo sapiens
gagtcccaaggaaagc

SEQ ID NO: 2043747 - DNA, 12 bp, Homo sapiens
gagtcccacctt

SEQ ID NO: 2043748 - DNA, 19 bp, Homo sapiens
gagtccgaaagggacttgg

SEQ ID NO: 2043749 - DNA, 14 bp, Homo sapiens
gagtcctgtctctg

SEQ ID NO: 2043750 - DNA, 12 bp, Homo sapiens
gagtcggcccca

SEQ ID NO: 2043751 - DNA, 18 bp, Homo sapiens
gagtcggccccacatggg

SEQ ID NO: 2043752 - DNA, 23 bp, Homo sapiens
gagtcgtcatcacttttcagtga

SEQ ID NO: 2043753 - DNA, 18 bp, Homo sapiens
gagtctacctcttcagta

SEQ ID NO: 2043754 - DNA, 22 bp, Homo sapiens
gagtctcactgttgcccaggct

SEQ ID NO: 2043755 - DNA, 12 bp, Homo sapiens
gagtctcttctc

SEQ ID NO: 2043756 - DNA, 14 bp, Homo sapiens
gagtctcttctcca

SEQ ID NO: 2043757 - DNA, 22 bp, Homo sapiens
gagtctgaaagacagaatgtca

SEQ ID NO: 2043758 - DNA, 15 bp, Homo sapiens
gagtctgaggtcctg

SEQ ID NO: 2043759 - DNA, 16 bp, Homo sapiens
gagtctgaggtcctga

SEQ ID NO: 2043760 - DNA, 22 bp, Homo sapiens
gagtctgaggtcctgagcactg

SEQ ID NO: 2043761 - DNA, 14 bp, Homo sapiens
gagtctgagtcctg

SEQ ID NO: 2043762 - DNA, 15 bp, Homo sapiens
gagtctgagtcctgt

SEQ ID NO: 2043763 - DNA, 18 bp, Homo sapiens
gagtctgagtctgagtcc

SEQ ID NO: 2043764 - DNA, 15 bp, Homo sapiens
gagtctgcataaact

SEQ ID NO: 2043765 - DNA, 18 bp, Homo sapiens
gagtctgctatattttca

SEQ ID NO: 2043766 - DNA, 19 bp, Homo sapiens
gagtgaaagggctatggca

SEQ ID NO: 2043767 - DNA, 12 bp, Homo sapiens
gagtgtgaccaa

SEQ ID NO: 2043768 - DNA, 20 bp, Homo sapiens
gagtgtgaccaaaagttaca

SEQ ID NO: 2043769 - DNA, 12 bp, Homo sapiens
gagtgtgggaag

SEQ ID NO: 2043770 - DNA, 17 bp, Homo sapiens
gagtgtgggtgatcaga

SEQ ID NO: 2043771 - DNA, 13 bp, Homo sapiens
gagtgttcctgtt

SEQ ID NO: 2043772 - DNA, 18 bp, Homo sapiens
gagtgttctgtgggcttg

SEQ ID NO: 2043773 - DNA, 22 bp, Homo sapiens
gagtgttctgtgggcttggcct

SEQ ID NO: 2043774 - DNA, 18 bp, Homo sapiens
gagttacagcgagaggca

SEQ ID NO: 2043775 - DNA, 19 bp, Homo sapiens
gagttacttgtctgaggcc

SEQ ID NO: 2043776 - DNA, 18 bp, Homo sapiens
gagttagtttctttggga

SEQ ID NO: 2043777 - DNA, 13 bp, Homo sapiens
gagttataaaaat

SEQ ID NO: 2043778 - DNA, 21 bp, Homo sapiens
gagttattgaatcttaatttt

SEQ ID NO: 2043779 - DNA, 15 bp, Homo sapiens
gagttcaagaccagc

SEQ ID NO: 2043780 - DNA, 17 bp, Homo sapiens
gagttcaagaccagcct

SEQ ID NO: 2043781 - DNA, 18 bp, Homo sapiens
gagttcaagaccagcctg

SEQ ID NO: 2043782 - DNA, 22 bp, Homo sapiens
gagttcaataaatgtctgttga

SEQ ID NO: 2043783 - DNA, 13 bp, Homo sapiens
gagttcatcccag

SEQ ID NO: 2043784 - DNA, 15 bp, Homo sapiens
gagttccatgaagac

SEQ ID NO: 2043785 - DNA, 14 bp, Homo sapiens
gagttcctgcatgc

SEQ ID NO: 2043786 - DNA, 17 bp, Homo sapiens
gagttcgagaccagcct

SEQ ID NO: 2043787 - DNA, 21 bp, Homo sapiens
gagttcttaaggattgtgata

SEQ ID NO: 2043788 - DNA, 21 bp, Homo sapiens
gagttctttaggtgcctcctg

SEQ ID NO: 2043789 - DNA, 15 bp, Homo sapiens
gagttgacgcatcct

SEQ ID NO: 2043790 - DNA, 23 bp, Homo sapiens
gagttgacttgacagaacactgt

SEQ ID NO: 2043791 - DNA, 14 bp, Homo sapiens
gagttggctcaggc

SEQ ID NO: 2043792 - DNA, 16 bp, Homo sapiens
gagttggctcaggcag

SEQ ID NO: 2043793 - DNA, 20 bp, Homo sapiens
gagttgtggaaagcctctgc

SEQ ID NO: 2043794 - DNA, 15 bp, Homo sapiens
gagttgttgccctgg

SEQ ID NO: 2043795 - DNA, 16 bp, Homo sapiens
gagttgttttcagact

SEQ ID NO: 2043796 - DNA, 20 bp, Homo sapiens
gagttgttttggtgcctgcc

SEQ ID NO: 2043797 - DNA, 18 bp, Homo sapiens
gagtttcattctcctgcc

SEQ ID NO: 2043798 - DNA, 15 bp, Homo sapiens
gagtttcgaggtaga

SEQ ID NO: 2043799 - DNA, 14 bp, Homo sapiens
gagttttcaaagat

SEQ ID NO: 2043800 - DNA, 18 bp, Homo sapiens
gagtttttatggggctga

SEQ ID NO: 2043801 - DNA, 15 bp, Homo sapiens
gagttttttttaacc

SEQ ID NO: 2043802 - DNA, 17 bp, Homo sapiens
gataaaatatcctcagg

SEQ ID NO: 2043803 - DNA, 18 bp, Homo sapiens
gataaaatgaggttcaac

SEQ ID NO: 2043804 - DNA, 18 bp, Homo sapiens
gataaacattaaacactg

SEQ ID NO: 2043805 - DNA, 15 bp, Homo sapiens
gataaactaaaagca

SEQ ID NO: 2043806 - DNA, 15 bp, Homo sapiens
gataaagatatcaat

SEQ ID NO: 2043807 - DNA, 12 bp, Homo sapiens
gataaagatgat

SEQ ID NO: 2043808 - DNA, 21 bp, Homo sapiens
gataaagatgtcaaatatctc

SEQ ID NO: 2043809 - DNA, 17 bp, Homo sapiens
gataaagattttttaat

SEQ ID NO: 2043810 - DNA, 13 bp, Homo sapiens
gataacaaaatca

SEQ ID NO: 2043811 - DNA, 15 bp, Homo sapiens
gataacaagatcttt

SEQ ID NO: 2043812 - DNA, 13 bp, Homo sapiens
gataacagaattg

SEQ ID NO: 2043813 - DNA, 21 bp, Homo sapiens
gataactgaaaattatttaaa

SEQ ID NO: 2043814 - DNA, 16 bp, Homo sapiens
gataagaaccacagaa

SEQ ID NO: 2043815 - DNA, 17 bp, Homo sapiens
gataagaatgctggttt

SEQ ID NO: 2043816 - DNA, 22 bp, Homo sapiens
gataagaatgctggttttccta

SEQ ID NO: 2043817 - DNA, 14 bp, Homo sapiens
gataagtggaaaaa

SEQ ID NO: 2043818 - DNA, 19 bp, Homo sapiens
gataagtggaaaaaagaga

SEQ ID NO: 2043819 - DNA, 18 bp, Homo sapiens
gataataactagatctcc

SEQ ID NO: 2043820 - DNA, 16 bp, Homo sapiens
gataatatctgtgagg

SEQ ID NO: 2043821 - DNA, 14 bp, Homo sapiens
gataatcagcctct

SEQ ID NO: 2043822 - DNA, 15 bp, Homo sapiens
gataatcagcctctt

SEQ ID NO: 2043823 - DNA, 16 bp, Homo sapiens
gataatcagcctctta

SEQ ID NO: 2043824 - DNA, 18 bp, Homo sapiens
gataattatgtcccaggg

SEQ ID NO: 2043825 - DNA, 19 bp, Homo sapiens
gatacaccgggcctggaga

SEQ ID NO: 2043826 - DNA, 22 bp, Homo sapiens
gatacactgaagttaacagaga

SEQ ID NO: 2043827 - DNA, 19 bp, Homo sapiens
gatacagccccaaaccagg

SEQ ID NO: 2043828 - DNA, 18 bp, Homo sapiens
gatacaggaaaagctgct

SEQ ID NO: 2043829 - DNA, 18 bp, Homo sapiens
gatacagtccctaaagaa

SEQ ID NO: 2043830 - DNA, 12 bp, Homo sapiens
gatacatagatg

SEQ ID NO: 2043831 - DNA, 15 bp, Homo sapiens
gatacatttcatctg

SEQ ID NO: 2043832 - DNA, 20 bp, Homo sapiens
gataccaggttgaaagacct

SEQ ID NO: 2043833 - DNA, 18 bp, Homo sapiens
gataccatatacagctca

SEQ ID NO: 2043834 - DNA, 17 bp, Homo sapiens
gatactctgtcagatgg

SEQ ID NO: 2043835 - DNA, 19 bp, Homo sapiens
gatagacagtgctgccctg

SEQ ID NO: 2043836 - DNA, 22 bp, Homo sapiens
gatagacagtgctgccctgcga

SEQ ID NO: 2043837 - DNA, 23 bp, Homo sapiens
gatagatggtactctccaaaggc

SEQ ID NO: 2043838 - DNA, 22 bp, Homo sapiens
gatagattttctgctactttgc

SEQ ID NO: 2043839 - DNA, 13 bp, Homo sapiens
gatagcagggcat

SEQ ID NO: 2043840 - DNA, 17 bp, Homo sapiens
gatagcatttttgattt

SEQ ID NO: 2043841 - DNA, 22 bp, Homo sapiens
gatagcatttttgatttatgca

SEQ ID NO: 2043842 - DNA, 14 bp, Homo sapiens
gatagccagacaca

SEQ ID NO: 2043843 - DNA, 20 bp, Homo sapiens
gatagctttattttttaagt

SEQ ID NO: 2043844 - DNA, 18 bp, Homo sapiens
gatatacttttttcttat

SEQ ID NO: 2043845 - DNA, 13 bp, Homo sapiens
gatatatatcata

SEQ ID NO: 2043846 - DNA, 13 bp, Homo sapiens
gatatatgtattt

SEQ ID NO: 2043847 - DNA, 15 bp, Homo sapiens
gatatatgtatttat

SEQ ID NO: 2043848 - DNA, 23 bp, Homo sapiens
gatatatgtatttattgtcatta

SEQ ID NO: 2043849 - DNA, 15 bp, Homo sapiens
gatatcataaaagta

SEQ ID NO: 2043850 - DNA, 20 bp, Homo sapiens
gcccttcctctccactgcct

SEQ ID NO: 2043851 - DNA, 14 bp, Homo sapiens
gcccttcctggaca

SEQ ID NO: 2043852 - DNA, 17 bp, Homo sapiens
gcccttcctggacagct

SEQ ID NO: 2043853 - DNA, 18 bp, Homo sapiens
gcccttcctggacagctg

SEQ ID NO: 2043854 - DNA, 16 bp, Homo sapiens
gcccttcgctgccagg

SEQ ID NO: 2043855 - DNA, 17 bp, Homo sapiens
gcccttcgctgccagga

SEQ ID NO: 2043856 - DNA, 19 bp, Homo sapiens
gcccttcgctgccaggaca

SEQ ID NO: 2043857 - DNA, 12 bp, Homo sapiens
gcccttctgcct

SEQ ID NO: 2043858 - DNA, 12 bp, Homo sapiens
gcccttctttct

SEQ ID NO: 2043859 - DNA, 17 bp, Homo sapiens
gcccttgagctccccaa

SEQ ID NO: 2043860 - DNA, 14 bp, Homo sapiens
gcccttgccctgac

SEQ ID NO: 2043861 - DNA, 21 bp, Homo sapiens
gcccttgccctgacctcccag

SEQ ID NO: 2043862 - DNA, 18 bp, Homo sapiens
gcccttggggcctggctt

SEQ ID NO: 2043863 - DNA, 18 bp, Homo sapiens
gaggccttctctgaagga

SEQ ID NO: 2043864 - DNA, 19 bp, Homo sapiens
gaggcctttccccagtgtg

SEQ ID NO: 2043865 - DNA, 20 bp, Homo sapiens
gaggcgaataaatgttcaaa

SEQ ID NO: 2043866 - DNA, 20 bp, Homo sapiens
gaggcgacttcctctccagc

SEQ ID NO: 2043867 - DNA, 17 bp, Homo sapiens
gaggcgcagcccgaagc

SEQ ID NO: 2043868 - DNA, 20 bp, Homo sapiens
gaggcgccccaacccgtgga

SEQ ID NO: 2043869 - DNA, 20 bp, Homo sapiens
gaggcggaggttgcagtgag

SEQ ID NO: 2043870 - DNA, 12 bp, Homo sapiens
gaggcgggtgga

SEQ ID NO: 2043871 - DNA, 13 bp, Homo sapiens
gaggcgtcttgta

SEQ ID NO: 2043872 - DNA, 23 bp, Homo sapiens
gaggctaagatgagatttgccag

SEQ ID NO: 2043873 - DNA, 16 bp, Homo sapiens
gaggctatttaaaagt

SEQ ID NO: 2043874 - DNA, 16 bp, Homo sapiens
gaggctgagacaggag

SEQ ID NO: 2043875 - DNA, 16 bp, Homo sapiens
gaggctgaggcagaag

SEQ ID NO: 2043876 - DNA, 12 bp, Homo sapiens
gaggctgaggcg

SEQ ID NO: 2043877 - DNA, 16 bp, Homo sapiens
gaggctgcagagctga

SEQ ID NO: 2043878 - DNA, 15 bp, Homo sapiens
gaggctgcaggactt

SEQ ID NO: 2043879 - DNA, 19 bp, Homo sapiens
gaggctgcatgctctggaa

SEQ ID NO: 2043880 - DNA, 22 bp, Homo sapiens
gaggctgcatgctctggaagcc

SEQ ID NO: 2043881 - DNA, 18 bp, Homo sapiens
gaggctgctcggggtgca

SEQ ID NO: 2043882 - DNA, 21 bp, Homo sapiens
gaggctgctcggggtgcacag

SEQ ID NO: 2043883 - DNA, 24 bp, Homo sapiens
gaggctgctcggggtgcacaggag

SEQ ID NO: 2043884 - DNA, 14 bp, Homo sapiens
gaggctggaggcag

SEQ ID NO: 2043885 - DNA, 16 bp, Homo sapiens
gaggctggaggcaggg

SEQ ID NO: 2043886 - DNA, 18 bp, Homo sapiens
gaggctggcactcccctg

SEQ ID NO: 2043887 - DNA, 17 bp, Homo sapiens
gaggctgggccagcctc

SEQ ID NO: 2043888 - DNA, 22 bp, Homo sapiens
gaggctgggccagcctcagctc

SEQ ID NO: 2043889 - DNA, 23 bp, Homo sapiens
gaggctgggccagcctcagctca

SEQ ID NO: 2043890 - DNA, 19 bp, Homo sapiens
gaggctgggcccctgggat

SEQ ID NO: 2043891 - DNA, 23 bp, Homo sapiens
gaggctggtctccctccagctgg

SEQ ID NO: 2043892 - DNA, 19 bp, Homo sapiens
gaggcttaattctgagctg

SEQ ID NO: 2043893 - DNA, 16 bp, Homo sapiens
gaggcttccaggctct

SEQ ID NO: 2043894 - DNA, 14 bp, Homo sapiens
gaggcttcctgact

SEQ ID NO: 2043895 - DNA, 15 bp, Homo sapiens
gaggcttcctgactg

SEQ ID NO: 2043896 - DNA, 15 bp, Homo sapiens
gaggctttggcccaa

SEQ ID NO: 2043897 - DNA, 15 bp, Homo sapiens
gagggaacagacagg

SEQ ID NO: 2043898 - DNA, 19 bp, Homo sapiens
gagggaacagacaggagaa

SEQ ID NO: 2043899 - DNA, 16 bp, Homo sapiens
gagggaatgaacctgg

SEQ ID NO: 2043900 - DNA, 19 bp, Homo sapiens
gagggacaaaggagcctgt

SEQ ID NO: 2043901 - DNA, 20 bp, Homo sapiens
gagggacaaaggagcctgtg

SEQ ID NO: 2043902 - DNA, 21 bp, Homo sapiens
gagggacaaaggagcctgtga

SEQ ID NO: 2043903 - DNA, 17 bp, Homo sapiens
gagggacagggcttggg

SEQ ID NO: 2043904 - DNA, 20 bp, Homo sapiens
gagggacagggcttggggag

SEQ ID NO: 2043905 - DNA, 16 bp, Homo sapiens
gagggacgaagaaagg

SEQ ID NO: 2043906 - DNA, 15 bp, Homo sapiens
gagggactgtcgctg

SEQ ID NO: 2043907 - DNA, 18 bp, Homo sapiens
gagggagagactctgagg

SEQ ID NO: 2043908 - DNA, 12 bp, Homo sapiens
gagggagaggtg

SEQ ID NO: 2043909 - DNA, 15 bp, Homo sapiens
gagggaggcttcctg

SEQ ID NO: 2043910 - DNA, 18 bp, Homo sapiens
gagggaggcttcctgact

SEQ ID NO: 2043911 - DNA, 13 bp, Homo sapiens
gagggagtgacag

SEQ ID NO: 2043912 - DNA, 14 bp, Homo sapiens
gagggatcacaggg

SEQ ID NO: 2043913 - DNA, 17 bp, Homo sapiens
gagggatgctgcctgag

SEQ ID NO: 2043914 - DNA, 21 bp, Homo sapiens
gagggatggagaggcggcctc

SEQ ID NO: 2043915 - DNA, 21 bp, Homo sapiens
gagggatgtaactattgaatt

SEQ ID NO: 2043916 - DNA, 23 bp, Homo sapiens
gagggatgttctagccctccctg

SEQ ID NO: 2043917 - DNA, 18 bp, Homo sapiens
gagggcactcacatgccg

SEQ ID NO: 2043918 - DNA, 18 bp, Homo sapiens
gagggcactggtggcccg

SEQ ID NO: 2043919 - DNA, 14 bp, Homo sapiens
gagggcagagtggg

SEQ ID NO: 2043920 - DNA, 16 bp, Homo sapiens
gagggcagagtgggct

SEQ ID NO: 2043921 - DNA, 17 bp, Homo sapiens
gagggcagagtgggctg

SEQ ID NO: 2043922 - DNA, 21 bp, Homo sapiens
gagggcagagtgggctgcctg

SEQ ID NO: 2043923 - DNA, 15 bp, Homo sapiens
gagggcagcagccag

SEQ ID NO: 2043924 - DNA, 16 bp, Homo sapiens
gagggcagcagccagc

SEQ ID NO: 2043925 - DNA, 22 bp, Homo sapiens
gagggcagcagccagccctgcc

SEQ ID NO: 2043926 - DNA, 20 bp, Homo sapiens
gagggcagcccccactttcc

SEQ ID NO: 2043927 - DNA, 17 bp, Homo sapiens
gagggcagtacctggga

SEQ ID NO: 2043928 - DNA, 19 bp, Homo sapiens
gagggcagttcgcagccac

SEQ ID NO: 2043929 - DNA, 22 bp, Homo sapiens
gagggcatgcgcacaaggctga

SEQ ID NO: 2043930 - DNA, 18 bp, Homo sapiens
gagggcatgggagggagg

SEQ ID NO: 2043931 - DNA, 13 bp, Homo sapiens
gagggcccagctg

SEQ ID NO: 2043932 - DNA, 18 bp, Homo sapiens
gagggcccagctgtagcc

SEQ ID NO: 2043933 - DNA, 23 bp, Homo sapiens
gagggcccagctgtagccatggc

SEQ ID NO: 2043934 - DNA, 18 bp, Homo sapiens
gagggcgcccattcgtct

SEQ ID NO: 2043935 - DNA, 17 bp, Homo sapiens
gagggctagaacctaga

SEQ ID NO: 2043936 - DNA, 20 bp, Homo sapiens
gagggctagaacctggcagg

SEQ ID NO: 2043937 - DNA, 11 bp, Homo sapiens
gagggctctga

SEQ ID NO: 2043938 - DNA, 14 bp, Homo sapiens
gagggctctgaggc

SEQ ID NO: 2043939 - DNA, 14 bp, Homo sapiens
gagggctgcgagca

SEQ ID NO: 2043940 - DNA, 14 bp, Homo sapiens
gagggctgtaggaa

SEQ ID NO: 2043941 - DNA, 12 bp, Homo sapiens
gaggggaaggcc

SEQ ID NO: 2043942 - DNA, 18 bp, Homo sapiens
gaggggaataatagaaga

SEQ ID NO: 2043943 - DNA, 19 bp, Homo sapiens
gaggggaggggcctaggga

SEQ ID NO: 2043944 - DNA, 22 bp, Homo sapiens
gaggggcacctgccaccgccag

SEQ ID NO: 2043945 - DNA, 16 bp, Homo sapiens
gaggggcctagggagc

SEQ ID NO: 2043946 - DNA, 20 bp, Homo sapiens
gaggggcctggcagccgtgc

SEQ ID NO: 2043947 - DNA, 15 bp, Homo sapiens
gaggggctcctggaa

SEQ ID NO: 2043948 - DNA, 19 bp, Homo sapiens
gagggggtcgtggagagct

SEQ ID NO: 2043949 - DNA, 18 bp, Homo sapiens
gaggggtaggcagagcct

SEQ ID NO: 2043950 - DNA, 15 bp, Homo sapiens
gaggggtgcacccac

SEQ ID NO: 2043951 - DNA, 18 bp, Homo sapiens
gaggggttgcgggggagc

SEQ ID NO: 2043952 - DNA, 14 bp, Homo sapiens
gagggtcagggcag

SEQ ID NO: 2043953 - DNA, 15 bp, Homo sapiens
gagggtcagggcagt

SEQ ID NO: 2043954 - DNA, 19 bp, Homo sapiens
gagggtcagggcagtatct

SEQ ID NO: 2043955 - DNA, 19 bp, Homo sapiens
gagggtccccacctgggac

SEQ ID NO: 2043956 - DNA, 17 bp, Homo sapiens
gagggtccccagctggt

SEQ ID NO: 2043957 - DNA, 14 bp, Homo sapiens
gcctcacttccctg

SEQ ID NO: 2043958 - DNA, 15 bp, Homo sapiens
gcctcacttccctgg

SEQ ID NO: 2043959 - DNA, 16 bp, Homo sapiens
gcctcacttccctggg

SEQ ID NO: 2043960 - DNA, 18 bp, Homo sapiens
gcctcacttgaatgtgtc

SEQ ID NO: 2043961 - DNA, 20 bp, Homo sapiens
gcctcacttgaatgtgtcac

SEQ ID NO: 2043962 - DNA, 22 bp, Homo sapiens
gcctcacttttaatgaacaaat

SEQ ID NO: 2043963 - DNA, 17 bp, Homo sapiens
gcctcagaaaccagact

SEQ ID NO: 2043964 - DNA, 15 bp, Homo sapiens
gcctcagagcaggct

SEQ ID NO: 2043965 - DNA, 16 bp, Homo sapiens
gcctcagcatcctggc

SEQ ID NO: 2043966 - DNA, 18 bp, Homo sapiens
gcctcagcatcctggcac

SEQ ID NO: 2043967 - DNA, 14 bp, Homo sapiens
gcctcagccctcag

SEQ ID NO: 2043968 - DNA, 22 bp, Homo sapiens
gcctcagcctcccaaagtgctg

SEQ ID NO: 2043969 - DNA, 15 bp, Homo sapiens
gcctcagctcagcct

SEQ ID NO: 2043970 - DNA, 16 bp, Homo sapiens
gcctcagctcagcctc

SEQ ID NO: 2043971 - DNA, 12 bp, Homo sapiens
gcctcagctgct

SEQ ID NO: 2043972 - DNA, 17 bp, Homo sapiens
gcctcagctgctcgcac

SEQ ID NO: 2043973 - DNA, 19 bp, Homo sapiens
gcctcagctgctcgcacag

SEQ ID NO: 2043974 - DNA, 12 bp, Homo sapiens
gcctcagtgcca

SEQ ID NO: 2043975 - DNA, 24 bp, Homo sapiens
gcctcagtgccacttgacattcct

SEQ ID NO: 2043976 - DNA, 13 bp, Homo sapiens
gcctctgccatgc

SEQ ID NO: 2043977 - DNA, 15 bp, Homo sapiens
gcctctgccccaagg

SEQ ID NO: 2043978 - DNA, 17 bp, Homo sapiens
gcctctgccccaagggg

SEQ ID NO: 2043979 - DNA, 15 bp, Homo sapiens
gcctctgcccgcaga

SEQ ID NO: 2043980 - DNA, 12 bp, Homo sapiens
gcctctgccctg

SEQ ID NO: 2043981 - DNA, 15 bp, Homo sapiens
gcctctgccctgcct

SEQ ID NO: 2043982 - DNA, 15 bp, Homo sapiens
gcctctggaaagcaa

SEQ ID NO: 2043983 - DNA, 13 bp, Homo sapiens
gcctctgtccctc

SEQ ID NO: 2043984 - DNA, 22 bp, Homo sapiens
gcctctgtccctctttgcctgt

SEQ ID NO: 2043985 - DNA, 15 bp, Homo sapiens
gcctctgtcctcgct

SEQ ID NO: 2043986 - DNA, 14 bp, Homo sapiens
gcctctgtgtcctt

SEQ ID NO: 2043987 - DNA, 21 bp, Homo sapiens
gcctctgtgtccttccctgca

SEQ ID NO: 2043988 - DNA, 18 bp, Homo sapiens
gcctcttaaagctgcctg

SEQ ID NO: 2043989 - DNA, 16 bp, Homo sapiens
gcctcttagtgattgt

SEQ ID NO: 2043990 - DNA, 20 bp, Homo sapiens
gcctcttagtgattgtgtct

SEQ ID NO: 2043991 - DNA, 20 bp, Homo sapiens
gcctcttggacctctgctct

SEQ ID NO: 2043992 - DNA, 16 bp, Homo sapiens
gcctcttgtgctcacg

SEQ ID NO: 2043993 - DNA, 20 bp, Homo sapiens
gcctcttgtgctcacgctcc

SEQ ID NO: 2043994 - DNA, 19 bp, Homo sapiens
gcctcttttcaattatttc

SEQ ID NO: 2043995 - DNA, 14 bp, Homo sapiens
gcctgaaccacagc

SEQ ID NO: 2043996 - DNA, 21 bp, Homo sapiens
gcctgaaccacagcggaggag

SEQ ID NO: 2043997 - DNA, 21 bp, Homo sapiens
gcctgaacctggggtcatcga

SEQ ID NO: 2043998 - DNA, 17 bp, Homo sapiens
gcctgaagtcacacagt

SEQ ID NO: 2043999 - DNA, 22 bp, Homo sapiens
gcctgaagtcacacagtgagtc

SEQ ID NO: 2044000 - DNA, 18 bp, Homo sapiens
gcctgacaggttcccagc

SEQ ID NO: 2044001 - DNA, 15 bp, Homo sapiens
gcctggctggctgag

SEQ ID NO: 2044002 - DNA, 16 bp, Homo sapiens
gcctggctggctgagg

SEQ ID NO: 2044003 - DNA, 21 bp, Homo sapiens
gcctggctggctgagggcagt

SEQ ID NO: 2044004 - DNA, 16 bp, Homo sapiens
gcctggctgtggaggc

SEQ ID NO: 2044005 - DNA, 16 bp, Homo sapiens
gcctggcttctggagc

SEQ ID NO: 2044006 - DNA, 18 bp, Homo sapiens
gcctggcttctggagccc

SEQ ID NO: 2044007 - DNA, 22 bp, Homo sapiens
gcctggcttctggagcccttgg

SEQ ID NO: 2044008 - DNA, 15 bp, Homo sapiens
gcctggcttgctcca

SEQ ID NO: 2044009 - DNA, 19 bp, Homo sapiens
gcctggcttgctccagggt

SEQ ID NO: 2044010 - DNA, 23 bp, Homo sapiens
gcctgggaaaggaaaaccaggga

SEQ ID NO: 2044011 - DNA, 16 bp, Homo sapiens
gcctgggaccagggca

SEQ ID NO: 2044012 - DNA, 17 bp, Homo sapiens
gcctgggaccagggcat

SEQ ID NO: 2044013 - DNA, 17 bp, Homo sapiens
gcctgggacccagctac

SEQ ID NO: 2044014 - DNA, 16 bp, Homo sapiens
gcctgggactcccagt

SEQ ID NO: 2044015 - DNA, 20 bp, Homo sapiens
gcctgggcaacagagcaaga

SEQ ID NO: 2044016 - DNA, 12 bp, Homo sapiens
gcctgggcccag

SEQ ID NO: 2044017 - DNA, 14 bp, Homo sapiens
gcctgggcctatgg

SEQ ID NO: 2044018 - DNA, 23 bp, Homo sapiens
gcctgggcctatggagagccctg

SEQ ID NO: 2044019 - DNA, 22 bp, Homo sapiens
gcctgggcctgtgcagcagccc

SEQ ID NO: 2044020 - DNA, 20 bp, Homo sapiens
gcctgggcgacagagcgaga

SEQ ID NO: 2044021 - DNA, 18 bp, Homo sapiens
gcctggggattgggaggg

SEQ ID NO: 2044022 - DNA, 21 bp, Homo sapiens
gcctggggattgggagggaca

SEQ ID NO: 2044023 - DNA, 22 bp, Homo sapiens
gcctggggctctaacgcctgag

SEQ ID NO: 2044024 - DNA, 17 bp, Homo sapiens
gcctgggggcagtgact

SEQ ID NO: 2044025 - DNA, 18 bp, Homo sapiens
gcctgggggcagtgactg

SEQ ID NO: 2044026 - DNA, 14 bp, Homo sapiens
gcctgggggcctgg

SEQ ID NO: 2044027 - DNA, 17 bp, Homo sapiens
gcctgggggcctggctg

SEQ ID NO: 2044028 - DNA, 19 bp, Homo sapiens
gcctgggggcctggctggc

SEQ ID NO: 2044029 - DNA, 20 bp, Homo sapiens
gcctgggtgagaatcctgcc

SEQ ID NO: 2044030 - DNA, 21 bp, Homo sapiens
gcctgggtgagaatcctgcct

SEQ ID NO: 2044031 - DNA, 22 bp, Homo sapiens
gcctgggtgagaatcctgcctc

SEQ ID NO: 2044032 - DNA, 15 bp, Homo sapiens
gcctgggtggggctg

SEQ ID NO: 2044033 - DNA, 16 bp, Homo sapiens
gcctgggtggggctgc

SEQ ID NO: 2044034 - DNA, 18 bp, Homo sapiens
gcctgggtggggctgctc

SEQ ID NO: 2044035 - DNA, 20 bp, Homo sapiens
gcctgggtggggctgctcct

SEQ ID NO: 2044036 - DNA, 24 bp, Homo sapiens
gcctgggtggggctgctcctccag

SEQ ID NO: 2044037 - DNA, 18 bp, Homo sapiens
gcctgggttttctaactg

SEQ ID NO: 2044038 - DNA, 14 bp, Homo sapiens
gcctggtggcagct

SEQ ID NO: 2044039 - DNA, 16 bp, Homo sapiens
gcctggtggcagctgc

SEQ ID NO: 2044040 - DNA, 15 bp, Homo sapiens
gcctggtgggccacg

SEQ ID NO: 2044041 - DNA, 15 bp, Homo sapiens
gcctggtgggcctcc

SEQ ID NO: 2044042 - DNA, 17 bp, Homo sapiens
gcctggtgtgaggctgg

SEQ ID NO: 2044043 - DNA, 14 bp, Homo sapiens
gcctggtttagcct

SEQ ID NO: 2044044 - DNA, 19 bp, Homo sapiens
gcctgtaacaagccagatt

SEQ ID NO: 2044045 - DNA, 19 bp, Homo sapiens
gcctgtaatcccagctact

SEQ ID NO: 2044046 - DNA, 21 bp, Homo sapiens
gcctgtactaaggagcatgat

SEQ ID NO: 2044047 - DNA, 18 bp, Homo sapiens
gcctgtagttaggaaata

SEQ ID NO: 2044048 - DNA, 22 bp, Homo sapiens
gcctgtagttaggaaataaaac

SEQ ID NO: 2044049 - DNA, 13 bp, Homo sapiens
gcctgtccccctg

SEQ ID NO: 2044050 - DNA, 14 bp, Homo sapiens
gcctgtctttcagc

SEQ ID NO: 2044051 - DNA, 21 bp, Homo sapiens
gcctgtgaacccaggacaagc

SEQ ID NO: 2044052 - DNA, 14 bp, Homo sapiens
gcctgtgaggcagg

SEQ ID NO: 2044053 - DNA, 18 bp, Homo sapiens
gcctgtgaggcaggggcg

SEQ ID NO: 2044054 - DNA, 15 bp, Homo sapiens
gcctgtgcagcagcc

SEQ ID NO: 2044055 - DNA, 16 bp, Homo sapiens
gcctgtgcagcagccc

SEQ ID NO: 2044056 - DNA, 18 bp, Homo sapiens
gcctgtgcagcagcccag

SEQ ID NO: 2044057 - DNA, 22 bp, Homo sapiens
gcctgtgcagcagcccagcttc

SEQ ID NO: 2044058 - DNA, 13 bp, Homo sapiens
gcctgtgccacct

SEQ ID NO: 2044059 - DNA, 15 bp, Homo sapiens
gcctgtgctgcccgt

SEQ ID NO: 2044060 - DNA, 23 bp, Homo sapiens
gcctgtgctgcccgtcttcagcc

SEQ ID NO: 2044061 - DNA, 19 bp, Homo sapiens
gcctgtggcagaaaagagg

SEQ ID NO: 2044062 - DNA, 16 bp, Homo sapiens
gcctgtggcaggccta

SEQ ID NO: 2044063 - DNA, 17 bp, Homo sapiens
gcctgtggcaggcctag

SEQ ID NO: 2044064 - DNA, 20 bp, Homo sapiens
gcctgtggcaggcctaggac

SEQ ID NO: 2044065 - DNA, 23 bp, Homo sapiens
gcctgtggcaggcctaggacctc

SEQ ID NO: 2044066 - DNA, 22 bp, Homo sapiens
gcctgtgggggtccatttgggt

SEQ ID NO: 2044067 - DNA, 16 bp, Homo sapiens
gcctgtgtagctgtga

SEQ ID NO: 2044068 - DNA, 12 bp, Homo sapiens
gcctgtgtccag

SEQ ID NO: 2044069 - DNA, 16 bp, Homo sapiens
gcctgtgtccagcagc

SEQ ID NO: 2044070 - DNA, 19 bp, Homo sapiens
gcctgtgtccagcagctgc

SEQ ID NO: 2044071 - DNA, 20 bp, Homo sapiens
gcctgtgtccagcagctgcg

SEQ ID NO: 2044072 - DNA, 13 bp, Homo sapiens
gcctgtgtgagca

SEQ ID NO: 2044073 - DNA, 18 bp, Homo sapiens
gcctgtgtgagcatctct

SEQ ID NO: 2044074 - DNA, 15 bp, Homo sapiens
gcctgttcatggcag

SEQ ID NO: 2044075 - DNA, 16 bp, Homo sapiens
gcctgttcatggcaga

SEQ ID NO: 2044076 - DNA, 23 bp, Homo sapiens
gcctgttcccattcttgcatggc

SEQ ID NO: 2044077 - DNA, 20 bp, Homo sapiens
gccttaaaaggagagaagaa

SEQ ID NO: 2044078 - DNA, 21 bp, Homo sapiens
gccttaatgagaacatttaca

SEQ ID NO: 2044079 - DNA, 15 bp, Homo sapiens
gccttacctcccctg

SEQ ID NO: 2044080 - DNA, 17 bp, Homo sapiens
gccttacctcccctgcc

SEQ ID NO: 2044081 - DNA, 14 bp, Homo sapiens
gccttacctcctgc

SEQ ID NO: 2044082 - DNA, 16 bp, Homo sapiens
gccttacctcctgccc

SEQ ID NO: 2044083 - DNA, 18 bp, Homo sapiens
gccttacctcctgcccag

SEQ ID NO: 2044084 - DNA, 19 bp, Homo sapiens
gccttacctcctgcccagg

SEQ ID NO: 2044085 - DNA, 21 bp, Homo sapiens
gccttacctcctgcccaggag

SEQ ID NO: 2044086 - DNA, 15 bp, Homo sapiens
gccttactcacctct

SEQ ID NO: 2044087 - DNA, 16 bp, Homo sapiens
gccttactcacctctc

SEQ ID NO: 2044088 - DNA, 16 bp, Homo sapiens
gccttagaacctttct

SEQ ID NO: 2044089 - DNA, 13 bp, Homo sapiens
gccttagcacttc

SEQ ID NO: 2044090 - DNA, 17 bp, Homo sapiens
gccttatcttgaaaaga

SEQ ID NO: 2044091 - DNA, 22 bp, Homo sapiens
gccttcacaaccagccacacag

SEQ ID NO: 2044092 - DNA, 16 bp, Homo sapiens
gccttcataggcggtc

SEQ ID NO: 2044093 - DNA, 23 bp, Homo sapiens
gccttcataggcggtcatgtgtg

SEQ ID NO: 2044094 - DNA, 13 bp, Homo sapiens
gccttccataatt

SEQ ID NO: 2044095 - DNA, 23 bp, Homo sapiens
gccttccccctcccagggccagg

SEQ ID NO: 2044096 - DNA, 19 bp, Homo sapiens
gccttccccttttgcctgg

SEQ ID NO: 2044097 - DNA, 23 bp, Homo sapiens
gccttccccttttgcctggctgt

SEQ ID NO: 2044098 - DNA, 13 bp, Homo sapiens
gccttcctcctcc

SEQ ID NO: 2044099 - DNA, 15 bp, Homo sapiens
gccttcctcctccac

SEQ ID NO: 2044100 - DNA, 17 bp, Homo sapiens
gccttcctcctccacag

SEQ ID NO: 2044101 - DNA, 22 bp, Homo sapiens
gccttcgatacaccgggcctgg

SEQ ID NO: 2044102 - DNA, 16 bp, Homo sapiens
gccttctcaaacttta

SEQ ID NO: 2044103 - DNA, 16 bp, Homo sapiens
gccttctccctgggaa

SEQ ID NO: 2044104 - DNA, 17 bp, Homo sapiens
gccttctcctgcctaca

SEQ ID NO: 2044105 - DNA, 15 bp, Homo sapiens
gccttctctgaagga

SEQ ID NO: 2044106 - DNA, 16 bp, Homo sapiens
gccttctctgttcatt

SEQ ID NO: 2044107 - DNA, 19 bp, Homo sapiens
gccttcttattctcactcc

SEQ ID NO: 2044108 - DNA, 20 bp, Homo sapiens
gccttcttattctcactcca

SEQ ID NO: 2044109 - DNA, 21 bp, Homo sapiens
gccttcttattctcactccac

SEQ ID NO: 2044110 - DNA, 13 bp, Homo sapiens
gccttgaaaaaca

SEQ ID NO: 2044111 - DNA, 19 bp, Homo sapiens
gccttgaaaaacaagtctt

SEQ ID NO: 2044112 - DNA, 23 bp, Homo sapiens
gccttgagagaaaaagtgcccct

SEQ ID NO: 2044113 - DNA, 18 bp, Homo sapiens
gccttgatgaagcctgtg

SEQ ID NO: 2044114 - DNA, 21 bp, Homo sapiens
gccttgccacatctgtgtctc

SEQ ID NO: 2044115 - DNA, 14 bp, Homo sapiens
gctatttctggcct

SEQ ID NO: 2044116 - DNA, 15 bp, Homo sapiens
gctatttctggcctc

SEQ ID NO: 2044117 - DNA, 14 bp, Homo sapiens
gctatttgttcaga

SEQ ID NO: 2044118 - DNA, 18 bp, Homo sapiens
gctatttgttcagagagg

SEQ ID NO: 2044119 - DNA, 22 bp, Homo sapiens
gctatttgtttacatgcagatt

SEQ ID NO: 2044120 - DNA, 15 bp, Homo sapiens
gctatttttatggaa

SEQ ID NO: 2044121 - DNA, 13 bp, Homo sapiens
gctcaaaaagttt

SEQ ID NO: 2044122 - DNA, 18 bp, Homo sapiens
gctcaaatctattcagac

SEQ ID NO: 2044123 - DNA, 17 bp, Homo sapiens
gctcaaccactgtggcg

SEQ ID NO: 2044124 - DNA, 14 bp, Homo sapiens
gctcaacctctctc

SEQ ID NO: 2044125 - DNA, 21 bp, Homo sapiens
gctcaagaagacatggagact

SEQ ID NO: 2044126 - DNA, 22 bp, Homo sapiens
gctcaagaatcctctggggttc

SEQ ID NO: 2044127 - DNA, 14 bp, Homo sapiens
gctcaagaggccca

SEQ ID NO: 2044128 - DNA, 19 bp, Homo sapiens
gctcaagaggcccagggag

SEQ ID NO: 2044129 - DNA, 17 bp, Homo sapiens
gctcaagatgacagctc

SEQ ID NO: 2044130 - DNA, 19 bp, Homo sapiens
gctcaagatgacagctctt

SEQ ID NO: 2044131 - DNA, 19 bp, Homo sapiens
gctcaagtcctcttttctg

SEQ ID NO: 2044132 - DNA, 22 bp, Homo sapiens
gctcaagtcctcttttctgaga

SEQ ID NO: 2044133 - DNA, 17 bp, Homo sapiens
gctcaagtcttccctga

SEQ ID NO: 2044134 - DNA, 17 bp, Homo sapiens
gctcacaactgtttttg

SEQ ID NO: 2044135 - DNA, 16 bp, Homo sapiens
gctcacaagcccaggc

SEQ ID NO: 2044136 - DNA, 13 bp, Homo sapiens
gctcacaaggcag

SEQ ID NO: 2044137 - DNA, 22 bp, Homo sapiens
gctcacagtacaatgtttcaga

SEQ ID NO: 2044138 - DNA, 12 bp, Homo sapiens
gctcaccagccc

SEQ ID NO: 2044139 - DNA, 13 bp, Homo sapiens
gctcaccagcccc

SEQ ID NO: 2044140 - DNA, 23 bp, Homo sapiens
gctcaccagccccagtgcccaca

SEQ ID NO: 2044141 - DNA, 18 bp, Homo sapiens
gctcaccttgtgctgggg

SEQ ID NO: 2044142 - DNA, 19 bp, Homo sapiens
gctcacgactcttcctgca

SEQ ID NO: 2044143 - DNA, 23 bp, Homo sapiens
gctcacgactcttcctgcaaagg

SEQ ID NO: 2044144 - DNA, 20 bp, Homo sapiens
gctcacgcctgtaatcccag

SEQ ID NO: 2044145 - DNA, 22 bp, Homo sapiens
gctcacgcctgtaatcccagca

SEQ ID NO: 2044146 - DNA, 19 bp, Homo sapiens
gctcactgacctgcctgta

SEQ ID NO: 2044147 - DNA, 13 bp, Homo sapiens
gctcactgcagcc

SEQ ID NO: 2044148 - DNA, 17 bp, Homo sapiens
gctcactgcagcctcaa

SEQ ID NO: 2044149 - DNA, 19 bp, Homo sapiens
gctcagacccccactctca

SEQ ID NO: 2044150 - DNA, 24 bp, Homo sapiens
gctcagactctgggtccctcggag

SEQ ID NO: 2044151 - DNA, 22 bp, Homo sapiens
gctcagacttgccaggctccct

SEQ ID NO: 2044152 - DNA, 19 bp, Homo sapiens
gctcagatagaatgacagt

SEQ ID NO: 2044153 - DNA, 15 bp, Homo sapiens
gctcagcaaggtgtg

SEQ ID NO: 2044154 - DNA, 16 bp, Homo sapiens
gctcagcaaggtgtga

SEQ ID NO: 2044155 - DNA, 20 bp, Homo sapiens
gctcagcaaggtgtgaatga

SEQ ID NO: 2044156 - DNA, 20 bp, Homo sapiens
gctcagcaatagggtgcagt

SEQ ID NO: 2044157 - DNA, 16 bp, Homo sapiens
gctcagccctccctgc

SEQ ID NO: 2044158 - DNA, 13 bp, Homo sapiens
gctcagcctcccc

SEQ ID NO: 2044159 - DNA, 15 bp, Homo sapiens
gctcagcctcccccc

SEQ ID NO: 2044160 - DNA, 17 bp, Homo sapiens
gctcagcctggtgggcc

SEQ ID NO: 2044161 - DNA, 21 bp, Homo sapiens
gctcagctttttgtcttttct

SEQ ID NO: 2044162 - DNA, 14 bp, Homo sapiens
gctcaggacccagg

SEQ ID NO: 2044163 - DNA, 15 bp, Homo sapiens
gctcaggacccaggc

SEQ ID NO: 2044164 - DNA, 17 bp, Homo sapiens
gctcaggacccaggccc

SEQ ID NO: 2044165 - DNA, 21 bp, Homo sapiens
gctcaggaggcgaataaatgt

SEQ ID NO: 2044166 - DNA, 14 bp, Homo sapiens
gctcaggcaagccc

SEQ ID NO: 2044167 - DNA, 18 bp, Homo sapiens
gctcaggcaagcccctca

SEQ ID NO: 2044168 - DNA, 22 bp, Homo sapiens
gctcaggcaagcccctcagccc

SEQ ID NO: 2044169 - DNA, 23 bp, Homo sapiens
gctcaggcaagcccctcagccct

SEQ ID NO: 2044170 - DNA, 23 bp, Homo sapiens
gctcaggcagacaagagctgctg

SEQ ID NO: 2044171 - DNA, 19 bp, Homo sapiens
gctcaggctgagcccagcc

SEQ ID NO: 2044172 - DNA, 20 bp, Homo sapiens
gctcaggctgagcccagcca

SEQ ID NO: 2044173 - DNA, 22 bp, Homo sapiens
gctcaggctgagcccagccacc

SEQ ID NO: 2044174 - DNA, 23 bp, Homo sapiens
gctcaggctgagcccagccacct

SEQ ID NO: 2044175 - DNA, 12 bp, Homo sapiens
gctcagggctgg

SEQ ID NO: 2044176 - DNA, 14 bp, Homo sapiens
gctcagggctggag

SEQ ID NO: 2044177 - DNA, 15 bp, Homo sapiens
gctcagggctggagt

SEQ ID NO: 2044178 - DNA, 23 bp, Homo sapiens
gctcagggctggagtgcgctctt

SEQ ID NO: 2044179 - DNA, 18 bp, Homo sapiens
gctcaggtgtccctgcac

SEQ ID NO: 2044180 - DNA, 16 bp, Homo sapiens
gctcagtaatttgagg

SEQ ID NO: 2044181 - DNA, 21 bp, Homo sapiens
gctcagtaatttgaggacaac

SEQ ID NO: 2044182 - DNA, 17 bp, Homo sapiens
gctcagtctcaggagca

SEQ ID NO: 2044183 - DNA, 13 bp, Homo sapiens
gctcagtgcctcc

SEQ ID NO: 2044184 - DNA, 14 bp, Homo sapiens
gctcagtgcctcct

SEQ ID NO: 2044185 - DNA, 15 bp, Homo sapiens
gctcagtgcctcctg

SEQ ID NO: 2044186 - DNA, 19 bp, Homo sapiens
gctcataacatctttgaaa

SEQ ID NO: 2044187 - DNA, 22 bp, Homo sapiens
gctcataacatctttgaaaaga

SEQ ID NO: 2044188 - DNA, 13 bp, Homo sapiens
gctcatcacccag

SEQ ID NO: 2044189 - DNA, 23 bp, Homo sapiens
gctcatggcgtaatgggcctgcc

SEQ ID NO: 2044190 - DNA, 23 bp, Homo sapiens
gctccgtcatctgcggggcttct

SEQ ID NO: 2044191 - DNA, 22 bp, Homo sapiens
gctcctaaacccccgctccaga

SEQ ID NO: 2044192 - DNA, 23 bp, Homo sapiens
gctcctaaacccccgctccagat

SEQ ID NO: 2044193 - DNA, 24 bp, Homo sapiens
gctcctaaacccccgctccagatc

SEQ ID NO: 2044194 - DNA, 18 bp, Homo sapiens
gctcctccagggccacgt

SEQ ID NO: 2044195 - DNA, 14 bp, Homo sapiens
gctcctcccggtgc

SEQ ID NO: 2044196 - DNA, 16 bp, Homo sapiens
gctcctcccggtgccc

SEQ ID NO: 2044197 - DNA, 15 bp, Homo sapiens
gctcctccttcccct

SEQ ID NO: 2044198 - DNA, 22 bp, Homo sapiens
gctcctctccaggcacccttct

SEQ ID NO: 2044199 - DNA, 17 bp, Homo sapiens
gctcctctccagtctga

SEQ ID NO: 2044200 - DNA, 16 bp, Homo sapiens
gctcctctccccagca

SEQ ID NO: 2044201 - DNA, 23 bp, Homo sapiens
gctcctctccttgggctcctggc

SEQ ID NO: 2044202 - DNA, 22 bp, Homo sapiens
gctcctctgtctcgagcgccct

SEQ ID NO: 2044203 - DNA, 23 bp, Homo sapiens
gctcctctgtctcgagcgccctg

SEQ ID NO: 2044204 - DNA, 11 bp, Homo sapiens
gctcctgccac

SEQ ID NO: 2044205 - DNA, 22 bp, Homo sapiens
gctcctgccttgatgaagcccg

SEQ ID NO: 2044206 - DNA, 21 bp, Homo sapiens
gctcctggagggggcaagcct

SEQ ID NO: 2044207 - DNA, 15 bp, Homo sapiens
gctcctggctgccag

SEQ ID NO: 2044208 - DNA, 19 bp, Homo sapiens
gctcctggtcttgagatgt

SEQ ID NO: 2044209 - DNA, 23 bp, Homo sapiens
gctcctgtacgaacccctcccct

SEQ ID NO: 2044210 - DNA, 16 bp, Homo sapiens
gctcctgtccctaccc

SEQ ID NO: 2044211 - DNA, 17 bp, Homo sapiens
gctcctgtccctaccca

SEQ ID NO: 2044212 - DNA, 18 bp, Homo sapiens
gctcctgtccctacccac

SEQ ID NO: 2044213 - DNA, 21 bp, Homo sapiens
gctcctgtccctacccactct

SEQ ID NO: 2044214 - DNA, 13 bp, Homo sapiens
gctcctgtcctcc

SEQ ID NO: 2044215 - DNA, 15 bp, Homo sapiens
gctcctgtcctccca

SEQ ID NO: 2044216 - DNA, 14 bp, Homo sapiens
gctcctgtctgcca

SEQ ID NO: 2044217 - DNA, 16 bp, Homo sapiens
gctcctgtctgccagc

SEQ ID NO: 2044218 - DNA, 21 bp, Homo sapiens
gctcctgtctgccagccagca

SEQ ID NO: 2044219 - DNA, 13 bp, Homo sapiens
gctccttctgtcc

SEQ ID NO: 2044220 - DNA, 21 bp, Homo sapiens
gctccttctgtcctactctgt

SEQ ID NO: 2044221 - DNA, 16 bp, Homo sapiens
gctccttgggtcctgc

SEQ ID NO: 2044222 - DNA, 17 bp, Homo sapiens
gctcctttacctaccac

SEQ ID NO: 2044223 - DNA, 18 bp, Homo sapiens
gctcctttacctaccacc

SEQ ID NO: 2044224 - DNA, 17 bp, Homo sapiens
gctcctttagcgcccag

SEQ ID NO: 2044225 - DNA, 16 bp, Homo sapiens
gctcctttctccagcc

SEQ ID NO: 2044226 - DNA, 17 bp, Homo sapiens
gctccttttgtccccag

SEQ ID NO: 2044227 - DNA, 13 bp, Homo sapiens
gctcgcagcctgg

SEQ ID NO: 2044228 - DNA, 16 bp, Homo sapiens
gctcgcccacaaactg

SEQ ID NO: 2044229 - DNA, 21 bp, Homo sapiens
gctcgctccctgtagctctgc

SEQ ID NO: 2044230 - DNA, 23 bp, Homo sapiens
gctcgctccctgtagctctgcct

SEQ ID NO: 2044231 - DNA, 17 bp, Homo sapiens
gctcgggcgctgtggct

SEQ ID NO: 2044232 - DNA, 21 bp, Homo sapiens
gctcgggcgctgtggctcctg

SEQ ID NO: 2044233 - DNA, 22 bp, Homo sapiens
gctcgggcgctgtggctcctgc

SEQ ID NO: 2044234 - DNA, 16 bp, Homo sapiens
gctcggggtgcacagg

SEQ ID NO: 2044235 - DNA, 18 bp, Homo sapiens
gctcggggtgcacaggag

SEQ ID NO: 2044236 - DNA, 17 bp, Homo sapiens
gctcggtggacccaggg

SEQ ID NO: 2044237 - DNA, 15 bp, Homo sapiens
gctcgtggccttccc

SEQ ID NO: 2044238 - DNA, 22 bp, Homo sapiens
gctcgtggccttccccttttgc

SEQ ID NO: 2044239 - DNA, 13 bp, Homo sapiens
gctctaacgcctg

SEQ ID NO: 2044240 - DNA, 15 bp, Homo sapiens
gctctaacgcctgag

SEQ ID NO: 2044241 - DNA, 16 bp, Homo sapiens
gctctaacgcctgagc

SEQ ID NO: 2044242 - DNA, 18 bp, Homo sapiens
gctctaacgcctgagccc

SEQ ID NO: 2044243 - DNA, 23 bp, Homo sapiens
gctctaacgcctgagcccaggga

SEQ ID NO: 2044244 - DNA, 14 bp, Homo sapiens
gctctagccaggag

SEQ ID NO: 2044245 - DNA, 14 bp, Homo sapiens
gctctagcctgggc

SEQ ID NO: 2044246 - DNA, 14 bp, Homo sapiens
gctctagctggcag

SEQ ID NO: 2044247 - DNA, 15 bp, Homo sapiens
gctctagctggcagg

SEQ ID NO: 2044248 - DNA, 18 bp, Homo sapiens
gctctagctggcaggaca

SEQ ID NO: 2044249 - DNA, 22 bp, Homo sapiens
gctctagttttcagccttggga

SEQ ID NO: 2044250 - DNA, 17 bp, Homo sapiens
gctctattgtagcattt

SEQ ID NO: 2044251 - DNA, 16 bp, Homo sapiens
gctctatttccccacc

SEQ ID NO: 2044252 - DNA, 11 bp, Homo sapiens
gctctcagcca

SEQ ID NO: 2044253 - DNA, 21 bp, Homo sapiens
gctctcagcctcccaacccca

SEQ ID NO: 2044254 - DNA, 21 bp, Homo sapiens
gctctcaggggccagtgaggg

SEQ ID NO: 2044255 - DNA, 13 bp, Homo sapiens
gctctcatgcctg

SEQ ID NO: 2044256 - DNA, 20 bp, Homo sapiens
gctctccaaaggggctgctg

SEQ ID NO: 2044257 - DNA, 11 bp, Homo sapiens
gctctccctct

SEQ ID NO: 2044258 - DNA, 19 bp, Homo sapiens
gctctccctctggccctgc

SEQ ID NO: 2044259 - DNA, 17 bp, Homo sapiens
gctctccgaccagacac

SEQ ID NO: 2044260 - DNA, 19 bp, Homo sapiens
gctctccgaccagacacct

SEQ ID NO: 2044261 - DNA, 18 bp, Homo sapiens
gctctcctaccccacctc

SEQ ID NO: 2044262 - DNA, 13 bp, Homo sapiens
gctctcctggctt

SEQ ID NO: 2044263 - DNA, 13 bp, Homo sapiens
ggaaaaatattta

SEQ ID NO: 2044264 - DNA, 17 bp, Homo sapiens
ggaaaaatcttgggcaa

SEQ ID NO: 2044265 - DNA, 18 bp, Homo sapiens
ggaaaagaatacagaaag

SEQ ID NO: 2044266 - DNA, 22 bp, Homo sapiens
ggaaaagaatccctgcagcctg

SEQ ID NO: 2044267 - DNA, 17 bp, Homo sapiens
ggaaaaggcctggggtg

SEQ ID NO: 2044268 - DNA, 22 bp, Homo sapiens
ggaaaaggcctggggtgacccg

SEQ ID NO: 2044269 - DNA, 15 bp, Homo sapiens
ggaaaagtacattta

SEQ ID NO: 2044270 - DNA, 16 bp, Homo sapiens
ggaaaagtcacacaga

SEQ ID NO: 2044271 - DNA, 12 bp, Homo sapiens
ggaaaagtgtta

SEQ ID NO: 2044272 - DNA, 15 bp, Homo sapiens
ggaaacaggaccaca

SEQ ID NO: 2044273 - DNA, 13 bp, Homo sapiens
ggaaacagggagc

SEQ ID NO: 2044274 - DNA, 13 bp, Homo sapiens
ggaaaccttgcag

SEQ ID NO: 2044275 - DNA, 23 bp, Homo sapiens
ggaaacgaacccactgtgcttac

SEQ ID NO: 2044276 - DNA, 16 bp, Homo sapiens
ggaaagaatataaagt

SEQ ID NO: 2044277 - DNA, 11 bp, Homo sapiens
ggaaagcaggt

SEQ ID NO: 2044278 - DNA, 19 bp, Homo sapiens
ggaaagcaggtggcatctc

SEQ ID NO: 2044279 - DNA, 19 bp, Homo sapiens
ggaaagcatcacctcaggc

SEQ ID NO: 2044280 - DNA, 16 bp, Homo sapiens
ggaaagcctctgctgc

SEQ ID NO: 2044281 - DNA, 16 bp, Homo sapiens
ggaaaggatattttct

SEQ ID NO: 2044282 - DNA, 15 bp, Homo sapiens
ggaaaggctctgaaa

SEQ ID NO: 2044283 - DNA, 15 bp, Homo sapiens
ggaaaggggcgagca

SEQ ID NO: 2044284 - DNA, 21 bp, Homo sapiens
ggaaaggtttcaagacttgat

SEQ ID NO: 2044285 - DNA, 19 bp, Homo sapiens
ggaaataaaacctttcaaa

SEQ ID NO: 2044286 - DNA, 22 bp, Homo sapiens
ggaaataaaacctttcaaattt

SEQ ID NO: 2044287 - DNA, 15 bp, Homo sapiens
ggaaatcaaatccca

SEQ ID NO: 2044288 - DNA, 16 bp, Homo sapiens
ggaaatgacagcgggg

SEQ ID NO: 2044289 - DNA, 17 bp, Homo sapiens
ggaaatggagggtgggg

SEQ ID NO: 2044290 - DNA, 18 bp, Homo sapiens
ggaaatggcaacacgtgg

SEQ ID NO: 2044291 - DNA, 18 bp, Homo sapiens
ggaaattgctattttatt

SEQ ID NO: 2044292 - DNA, 16 bp, Homo sapiens
ggaacacccggaaaga

SEQ ID NO: 2044293 - DNA, 18 bp, Homo sapiens
ggaacagacaacagaagt

SEQ ID NO: 2044294 - DNA, 21 bp, Homo sapiens
ggaacagacaacagaagtcat

SEQ ID NO: 2044295 - DNA, 13 bp, Homo sapiens
ggaacagacagga

SEQ ID NO: 2044296 - DNA, 16 bp, Homo sapiens
ggaacagacaggagaa

SEQ ID NO: 2044297 - DNA, 17 bp, Homo sapiens
ggaacagacaggagaaa

SEQ ID NO: 2044298 - DNA, 17 bp, Homo sapiens
ggaacagactggaagca

SEQ ID NO: 2044299 - DNA, 12 bp, Homo sapiens
ggaacagagact

SEQ ID NO: 2044300 - DNA, 22 bp, Homo sapiens
ggaacagagactctggaagccc

SEQ ID NO: 2044301 - DNA, 20 bp, Homo sapiens
ggaacagagtatatatgtac

SEQ ID NO: 2044302 - DNA, 21 bp, Homo sapiens
ggaacagctcttcactcagcc

SEQ ID NO: 2044303 - DNA, 20 bp, Homo sapiens
ggaaccaccgaagaggaagc

SEQ ID NO: 2044304 - DNA, 13 bp, Homo sapiens
ggaaccagggaga

SEQ ID NO: 2044305 - DNA, 17 bp, Homo sapiens
ggaaccagggaggagag

SEQ ID NO: 2044306 - DNA, 14 bp, Homo sapiens
ggaaccatgaagct

SEQ ID NO: 2044307 - DNA, 16 bp, Homo sapiens
ggaaccccgcagcccg

SEQ ID NO: 2044308 - DNA, 17 bp, Homo sapiens
ggaaccccgcagcccgt

SEQ ID NO: 2044309 - DNA, 17 bp, Homo sapiens
ggaacccgactgtgaaa

SEQ ID NO: 2044310 - DNA, 23 bp, Homo sapiens
ggaaccctgcccactcccaggac

SEQ ID NO: 2044311 - DNA, 19 bp, Homo sapiens
ggaacccttttcctccaga

SEQ ID NO: 2044312 - DNA, 20 bp, Homo sapiens
ggaacctagtactctctgct

SEQ ID NO: 2044313 - DNA, 18 bp, Homo sapiens
ggaacctcaaactgggta

SEQ ID NO: 2044314 - DNA, 17 bp, Homo sapiens
ggaacctgtactgggtt

SEQ ID NO: 2044315 - DNA, 12 bp, Homo sapiens
ggaaccttccct

SEQ ID NO: 2044316 - DNA, 15 bp, Homo sapiens
ggaaccttccctcca

SEQ ID NO: 2044317 - DNA, 14 bp, Homo sapiens
ggaacgactgggca

SEQ ID NO: 2044318 - DNA, 13 bp, Homo sapiens
ggaacgagcactg

SEQ ID NO: 2044319 - DNA, 18 bp, Homo sapiens
ggaacggggtccttcaag

SEQ ID NO: 2044320 - DNA, 14 bp, Homo sapiens
gctggcacctcaga

SEQ ID NO: 2044321 - DNA, 18 bp, Homo sapiens
gctggcagagcccccaag

SEQ ID NO: 2044322 - DNA, 19 bp, Homo sapiens
gctggcagcactcagtgag

SEQ ID NO: 2044323 - DNA, 20 bp, Homo sapiens
gctggcagctgagagccctg

SEQ ID NO: 2044324 - DNA, 21 bp, Homo sapiens
gctggcaggacacatcccggc

SEQ ID NO: 2044325 - DNA, 12 bp, Homo sapiens
gctggccagcac

SEQ ID NO: 2044326 - DNA, 15 bp, Homo sapiens
gctggccagcaccct

SEQ ID NO: 2044327 - DNA, 14 bp, Homo sapiens
gctggcccagggta

SEQ ID NO: 2044328 - DNA, 16 bp, Homo sapiens
gctggcccagggtagg

SEQ ID NO: 2044329 - DNA, 21 bp, Homo sapiens
gctggcccagggtaggggagg

SEQ ID NO: 2044330 - DNA, 20 bp, Homo sapiens
gctggcctcccaataaagct

SEQ ID NO: 2044331 - DNA, 21 bp, Homo sapiens
gctggcctcccaataaagctg

SEQ ID NO: 2044332 - DNA, 23 bp, Homo sapiens
gctggcctcccaataaagctgga

SEQ ID NO: 2044333 - DNA, 12 bp, Homo sapiens
gctggcctggat

SEQ ID NO: 2044334 - DNA, 14 bp, Homo sapiens
gctggcctggatct

SEQ ID NO: 2044335 - DNA, 16 bp, Homo sapiens
gctggcctgtggcagg

SEQ ID NO: 2044336 - DNA, 16 bp, Homo sapiens
gctggcggcgcagagg

SEQ ID NO: 2044337 - DNA, 17 bp, Homo sapiens
gctggcggcgcagaggg

SEQ ID NO: 2044338 - DNA, 20 bp, Homo sapiens
gctggcgtgcagtggtgcga

SEQ ID NO: 2044339 - DNA, 17 bp, Homo sapiens
gctggctgaaaatcact

SEQ ID NO: 2044340 - DNA, 14 bp, Homo sapiens
gctggctgcagtga

SEQ ID NO: 2044341 - DNA, 11 bp, Homo sapiens
gctggctgcct

SEQ ID NO: 2044342 - DNA, 14 bp, Homo sapiens
gctggctgccttag

SEQ ID NO: 2044343 - DNA, 18 bp, Homo sapiens
gctggctgctgacaggat

SEQ ID NO: 2044344 - DNA, 19 bp, Homo sapiens
gctggctgctgacaggatg

SEQ ID NO: 2044345 - DNA, 20 bp, Homo sapiens
gctggctgctgacaggatgt

SEQ ID NO: 2044346 - DNA, 16 bp, Homo sapiens
gctggctgggcatgga

SEQ ID NO: 2044347 - DNA, 18 bp, Homo sapiens
gctggctgttggctgggg

SEQ ID NO: 2044348 - DNA, 20 bp, Homo sapiens
gctggctgttggctgggggc

SEQ ID NO: 2044349 - DNA, 17 bp, Homo sapiens
gctggctttgccaagct

SEQ ID NO: 2044350 - DNA, 16 bp, Homo sapiens
gctgggaaacagggag

SEQ ID NO: 2044351 - DNA, 18 bp, Homo sapiens
gctgggaaacagggagcc

SEQ ID NO: 2044352 - DNA, 22 bp, Homo sapiens
gctgggaaacagggagccccta

SEQ ID NO: 2044353 - DNA, 19 bp, Homo sapiens
gctgggaaccccgcagccc

SEQ ID NO: 2044354 - DNA, 23 bp, Homo sapiens
gctgggaagctgtactcagagca

SEQ ID NO: 2044355 - DNA, 22 bp, Homo sapiens
gctgggaccccagctagggctg

SEQ ID NO: 2044356 - DNA, 12 bp, Homo sapiens
gctgggacccct

SEQ ID NO: 2044357 - DNA, 19 bp, Homo sapiens
gctgggactacaggcaccc

SEQ ID NO: 2044358 - DNA, 15 bp, Homo sapiens
gctgggactggccag

SEQ ID NO: 2044359 - DNA, 14 bp, Homo sapiens
gctgggaggcatgg

SEQ ID NO: 2044360 - DNA, 15 bp, Homo sapiens
gctgggaggcatggc

SEQ ID NO: 2044361 - DNA, 18 bp, Homo sapiens
gctgggattacaggtgtg

SEQ ID NO: 2044362 - DNA, 20 bp, Homo sapiens
gctgggatttcttcgctgct

SEQ ID NO: 2044363 - DNA, 22 bp, Homo sapiens
gctgggatttcttcgctgctct

SEQ ID NO: 2044364 - DNA, 24 bp, Homo sapiens
gctgggatttcttcgctgctctag

SEQ ID NO: 2044365 - DNA, 13 bp, Homo sapiens
gctgggccagcct

SEQ ID NO: 2044366 - DNA, 14 bp, Homo sapiens
gctgggccagcctc

SEQ ID NO: 2044367 - DNA, 23 bp, Homo sapiens
gctgggccagcctcagctcagcc

SEQ ID NO: 2044368 - DNA, 14 bp, Homo sapiens
gctgggccccatgc

SEQ ID NO: 2044369 - DNA, 23 bp, Homo sapiens
gctgggccccatgctctgcccca

SEQ ID NO: 2044370 - DNA, 13 bp, Homo sapiens
gctgggcccctgg

SEQ ID NO: 2044371 - DNA, 23 bp, Homo sapiens
gctgggcccctgggatgggacca

SEQ ID NO: 2044372 - DNA, 16 bp, Homo sapiens
gctgggccggccagcc

SEQ ID NO: 2044373 - DNA, 22 bp, Homo sapiens
gctgggctctccacctcagcct

SEQ ID NO: 2044374 - DNA, 12 bp, Homo sapiens
gctgggctgtgg

SEQ ID NO: 2044375 - DNA, 20 bp, Homo sapiens
gctgggcttcagtggcagct

SEQ ID NO: 2044376 - DNA, 21 bp, Homo sapiens
gctgggcttcagtggcagctg

SEQ ID NO: 2044377 - DNA, 21 bp, Homo sapiens
gctgggcttctgtccaaggca

SEQ ID NO: 2044378 - DNA, 16 bp, Homo sapiens
gctggggaacagagcg

SEQ ID NO: 2044379 - DNA, 22 bp, Homo sapiens
gctggggaacagagcgggcctc

SEQ ID NO: 2044380 - DNA, 19 bp, Homo sapiens
gctggggcagaggggcagc

SEQ ID NO: 2044381 - DNA, 13 bp, Homo sapiens
gctggggccacaa

SEQ ID NO: 2044382 - DNA, 15 bp, Homo sapiens
gctggggcctggaga

SEQ ID NO: 2044383 - DNA, 15 bp, Homo sapiens
gctgggggaagggtg

SEQ ID NO: 2044384 - DNA, 16 bp, Homo sapiens
gctgggggaggcggca

SEQ ID NO: 2044385 - DNA, 19 bp, Homo sapiens
gcttatggggtattttaag

SEQ ID NO: 2044386 - DNA, 13 bp, Homo sapiens
gcttatttatatt

SEQ ID NO: 2044387 - DNA, 14 bp, Homo sapiens
gcttatttatattc

SEQ ID NO: 2044388 - DNA, 18 bp, Homo sapiens
gcttattttttaaaataa

SEQ ID NO: 2044389 - DNA, 19 bp, Homo sapiens
gcttattttttaaaataat

SEQ ID NO: 2044390 - DNA, 22 bp, Homo sapiens
gcttcaacattctttgcaagat

SEQ ID NO: 2044391 - DNA, 19 bp, Homo sapiens
gcttcaagtgttgctcttg

SEQ ID NO: 2044392 - DNA, 21 bp, Homo sapiens
gcttcaagtgttgctcttgga

SEQ ID NO: 2044393 - DNA, 14 bp, Homo sapiens
gcttcacccctgca

SEQ ID NO: 2044394 - DNA, 17 bp, Homo sapiens
gcttcacccctgcactt

SEQ ID NO: 2044395 - DNA, 22 bp, Homo sapiens
gcttcagacttttatcaaaatc

SEQ ID NO: 2044396 - DNA, 12 bp, Homo sapiens
gcttcagagcct

SEQ ID NO: 2044397 - DNA, 14 bp, Homo sapiens
gcttcagagcctag

SEQ ID NO: 2044398 - DNA, 16 bp, Homo sapiens
gcttcagagcctagcc

SEQ ID NO: 2044399 - DNA, 17 bp, Homo sapiens
gcttcagagcctagcca

SEQ ID NO: 2044400 - DNA, 20 bp, Homo sapiens
gcttcagagcctagccacct

SEQ ID NO: 2044401 - DNA, 24 bp, Homo sapiens
gcttcagagcctagccacctccca

SEQ ID NO: 2044402 - DNA, 19 bp, Homo sapiens
gcttcagcatatttatagc

SEQ ID NO: 2044403 - DNA, 12 bp, Homo sapiens
gcttcagcctga

SEQ ID NO: 2044404 - DNA, 20 bp, Homo sapiens
gcttcagcctgaggctgaga

SEQ ID NO: 2044405 - DNA, 23 bp, Homo sapiens
gcttcagcctgaggctgagactg

SEQ ID NO: 2044406 - DNA, 16 bp, Homo sapiens
gcttcagtggcagctg

SEQ ID NO: 2044407 - DNA, 20 bp, Homo sapiens
gcttcagtggcagctgcttt

SEQ ID NO: 2044408 - DNA, 14 bp, Homo sapiens
gcttcatcaatttt

SEQ ID NO: 2044409 - DNA, 13 bp, Homo sapiens
gcttcatttcctg

SEQ ID NO: 2044410 - DNA, 16 bp, Homo sapiens
gcttcatttcctgtgt

SEQ ID NO: 2044411 - DNA, 17 bp, Homo sapiens
gcttcatttcctgtgtc

SEQ ID NO: 2044412 - DNA, 12 bp, Homo sapiens
gcttccagacca

SEQ ID NO: 2044413 - DNA, 16 bp, Homo sapiens
gcttccagaccacctg

SEQ ID NO: 2044414 - DNA, 21 bp, Homo sapiens
gcttccagaccacctgccagc

SEQ ID NO: 2044415 - DNA, 13 bp, Homo sapiens
gcttccagagagt

SEQ ID NO: 2044416 - DNA, 22 bp, Homo sapiens
gcttccagagagtcctctggat

SEQ ID NO: 2044417 - DNA, 11 bp, Homo sapiens
gcttccaggct

SEQ ID NO: 2044418 - DNA, 12 bp, Homo sapiens
gcttccaggctc

SEQ ID NO: 2044419 - DNA, 12 bp, Homo sapiens
gcttccattcca

SEQ ID NO: 2044420 - DNA, 17 bp, Homo sapiens
gcttcccagaggccagg

SEQ ID NO: 2044421 - DNA, 18 bp, Homo sapiens
gcttcccatccccagcga

SEQ ID NO: 2044422 - DNA, 17 bp, Homo sapiens
gcttcccatgtctttct

SEQ ID NO: 2044423 - DNA, 15 bp, Homo sapiens
gcttcccgctcagcc

SEQ ID NO: 2044424 - DNA, 18 bp, Homo sapiens
gcttcccgctcagccctc

SEQ ID NO: 2044425 - DNA, 19 bp, Homo sapiens
gcttccctaggctgagctg

SEQ ID NO: 2044426 - DNA, 18 bp, Homo sapiens
gcttcctaggccccagag

SEQ ID NO: 2044427 - DNA, 20 bp, Homo sapiens
gcttcctaggccccagagca

SEQ ID NO: 2044428 - DNA, 22 bp, Homo sapiens
gcttcctcatagtatggtggct

SEQ ID NO: 2044429 - DNA, 18 bp, Homo sapiens
gcttcctccgtccaccca

SEQ ID NO: 2044430 - DNA, 19 bp, Homo sapiens
gcttcctccgtccacccag

SEQ ID NO: 2044431 - DNA, 20 bp, Homo sapiens
gcttcctccgtccacccagg

SEQ ID NO: 2044432 - DNA, 21 bp, Homo sapiens
gcttcctccgtccacccaggc

SEQ ID NO: 2044433 - DNA, 22 bp, Homo sapiens
gcttcctccgtccacccaggct

SEQ ID NO: 2044434 - DNA, 18 bp, Homo sapiens
gcttcctccgtctgcaat

SEQ ID NO: 2044435 - DNA, 11 bp, Homo sapiens
gcttcctcctg

SEQ ID NO: 2044436 - DNA, 21 bp, Homo sapiens
gcttcctgactgacacaggcc

SEQ ID NO: 2044437 - DNA, 17 bp, Homo sapiens
gcttcctgtccactctc

SEQ ID NO: 2044438 - DNA, 17 bp, Homo sapiens
gcttccttctgcaccca

SEQ ID NO: 2044439 - DNA, 18 bp, Homo sapiens
gcttcggggcaagtgaga

SEQ ID NO: 2044440 - DNA, 18 bp, Homo sapiens
gcttctagatctggaacc

SEQ ID NO: 2044441 - DNA, 20 bp, Homo sapiens
gcttctaggagtcaactggc

SEQ ID NO: 2044442 - DNA, 20 bp, Homo sapiens
gcttctatcccaggaggtgg

SEQ ID NO: 2044443 - DNA, 12 bp, Homo sapiens
gcttctccaggc

SEQ ID NO: 2044444 - DNA, 13 bp, Homo sapiens
gcttctccctggc

SEQ ID NO: 2044445 - DNA, 16 bp, Homo sapiens
gcttctccctggctga

SEQ ID NO: 2044446 - DNA, 19 bp, Homo sapiens
gcttctctgtgaacgattt

SEQ ID NO: 2044447 - DNA, 22 bp, Homo sapiens
gcttctctgtgaacgatttaga

SEQ ID NO: 2044448 - DNA, 21 bp, Homo sapiens
gcttctctgtgcccctgtaaa

SEQ ID NO: 2044449 - DNA, 23 bp, Homo sapiens
gcttctcttgggaactccactct

SEQ ID NO: 2044450 - DNA, 18 bp, Homo sapiens
gcttctgcagcaactccc

SEQ ID NO: 2044451 - DNA, 13 bp, Homo sapiens
gcttctggagccc

SEQ ID NO: 2044452 - DNA, 14 bp, Homo sapiens
gcttctggagccct

SEQ ID NO: 2044453 - DNA, 17 bp, Homo sapiens
gcttctggagcccttgg

SEQ ID NO: 2044454 - DNA, 18 bp, Homo sapiens
gcttctgggtggctcctg

SEQ ID NO: 2044455 - DNA, 21 bp, Homo sapiens
gcttctgggtggctcctgcca

SEQ ID NO: 2044456 - DNA, 15 bp, Homo sapiens
gcttctgtccaggac

SEQ ID NO: 2044457 - DNA, 15 bp, Homo sapiens
gcttctgttgcgcca

SEQ ID NO: 2044458 - DNA, 15 bp, Homo sapiens
gcttctgttgtaata

SEQ ID NO: 2044459 - DNA, 19 bp, Homo sapiens
gcttctgttgtaatagtcc

SEQ ID NO: 2044460 - DNA, 15 bp, Homo sapiens
gcttcttaaagagtt

SEQ ID NO: 2044461 - DNA, 16 bp, Homo sapiens
gcttcttcagatcagt

SEQ ID NO: 2044462 - DNA, 19 bp, Homo sapiens
gcttcttcagatcagtgct

SEQ ID NO: 2044463 - DNA, 13 bp, Homo sapiens
gcttcttcatctt

SEQ ID NO: 2044464 - DNA, 12 bp, Homo sapiens
gcttcttgcccc

SEQ ID NO: 2044465 - DNA, 15 bp, Homo sapiens
gcttcttgccccttg

SEQ ID NO: 2044466 - DNA, 19 bp, Homo sapiens
gcttcttgccccttgggcc

SEQ ID NO: 2044467 - DNA, 21 bp, Homo sapiens
gcttcttgccccttgggcctc

SEQ ID NO: 2044468 - DNA, 23 bp, Homo sapiens
gcttgaaaactcacttcaatgaa

SEQ ID NO: 2044469 - DNA, 14 bp, Homo sapiens
gcttgaccagacct

SEQ ID NO: 2044470 - DNA, 22 bp, Homo sapiens
gcttgaccagacctagacctgg

SEQ ID NO: 2044471 - DNA, 16 bp, Homo sapiens
gcttgagcccaggagt

SEQ ID NO: 2044472 - DNA, 15 bp, Homo sapiens
gcttgaggaggggca

SEQ ID NO: 2044473 - DNA, 19 bp, Homo sapiens
gcttgaggaggggcacctg

SEQ ID NO: 2044474 - DNA, 20 bp, Homo sapiens
gcttgaggaggggcacctgc

SEQ ID NO: 2044475 - DNA, 21 bp, Homo sapiens
gcttgcaagaggaggtggttc

SEQ ID NO: 2044476 - DNA, 15 bp, Homo sapiens
gcttgctccagggtc

SEQ ID NO: 2044477 - DNA, 12 bp, Homo sapiens
gcttgctggctt

SEQ ID NO: 2044478 - DNA, 12 bp, Homo sapiens
gcttgcttctgc

SEQ ID NO: 2044479 - DNA, 16 bp, Homo sapiens
gcttggacttcctggg

SEQ ID NO: 2044480 - DNA, 16 bp, Homo sapiens
gcttggagggatggag

SEQ ID NO: 2044481 - DNA, 22 bp, Homo sapiens
gcttggccgccatccgggacgc

SEQ ID NO: 2044482 - DNA, 13 bp, Homo sapiens
gcttgggccctgc

SEQ ID NO: 2044483 - DNA, 15 bp, Homo sapiens
gcttgggccctgcac

SEQ ID NO: 2044484 - DNA, 16 bp, Homo sapiens
gcttgggccctgcaca

SEQ ID NO: 2044485 - DNA, 14 bp, Homo sapiens
gcttggggagcaga

SEQ ID NO: 2044486 - DNA, 21 bp, Homo sapiens
gcttggggagcaggtctctgg

SEQ ID NO: 2044487 - DNA, 17 bp, Homo sapiens
gcttggggctggagagg

SEQ ID NO: 2044488 - DNA, 14 bp, Homo sapiens
gcttggggggtgat

SEQ ID NO: 2044489 - DNA, 21 bp, Homo sapiens
gcttgggtgtaacaggtctcc

SEQ ID NO: 2044490 - DNA, 17 bp, Homo sapiens
gcttggtaaaacacaga

SEQ ID NO: 2044491 - DNA, 21 bp, Homo sapiens
gcttggtggggctcgtggcct

SEQ ID NO: 2044492 - DNA, 17 bp, Homo sapiens
gcttgtaaatagctcag

SEQ ID NO: 2044493 - DNA, 18 bp, Homo sapiens
gcttgtaaatagctcagg

SEQ ID NO: 2044494 - DNA, 15 bp, Homo sapiens
gcttgtagccagccg

SEQ ID NO: 2044495 - DNA, 17 bp, Homo sapiens
gcttgtagccagccggg

SEQ ID NO: 2044496 - DNA, 23 bp, Homo sapiens
gcttgtatatacatattataaat

SEQ ID NO: 2044497 - DNA, 16 bp, Homo sapiens
gcttgtcatctgccac

SEQ ID NO: 2044498 - DNA, 21 bp, Homo sapiens
gcttgtccaacaactccagga

SEQ ID NO: 2044499 - DNA, 15 bp, Homo sapiens
gcttgtccagcgcct

SEQ ID NO: 2044500 - DNA, 21 bp, Homo sapiens
ggacatggggcatagaaactg

SEQ ID NO: 2044501 - DNA, 21 bp, Homo sapiens
ggacatgtttttgttttcttt

SEQ ID NO: 2044502 - DNA, 20 bp, Homo sapiens
ggacattgcggacagccacg

SEQ ID NO: 2044503 - DNA, 20 bp, Homo sapiens
ggaccaaccctgtttcctga

SEQ ID NO: 2044504 - DNA, 23 bp, Homo sapiens
ggaccaactggcttctgtgcact

SEQ ID NO: 2044505 - DNA, 21 bp, Homo sapiens
ggaccaagaatgagctggttt

SEQ ID NO: 2044506 - DNA, 18 bp, Homo sapiens
ggaccaagatgggcacat

SEQ ID NO: 2044507 - DNA, 22 bp, Homo sapiens
ggaccacaaaaatgaaagcatg

SEQ ID NO: 2044508 - DNA, 22 bp, Homo sapiens
ggaccacaggcatctacacagc

SEQ ID NO: 2044509 - DNA, 21 bp, Homo sapiens
ggaccacagtgggtggcacct

SEQ ID NO: 2044510 - DNA, 18 bp, Homo sapiens
ggaccaccagccccagca

SEQ ID NO: 2044511 - DNA, 14 bp, Homo sapiens
ggaccaggacagga

SEQ ID NO: 2044512 - DNA, 12 bp, Homo sapiens
ggaccagggcat

SEQ ID NO: 2044513 - DNA, 16 bp, Homo sapiens
ggaccagtagacaact

SEQ ID NO: 2044514 - DNA, 17 bp, Homo sapiens
ggaccagtcccagagca

SEQ ID NO: 2044515 - DNA, 17 bp, Homo sapiens
ggaccatgaagagactc

SEQ ID NO: 2044516 - DNA, 14 bp, Homo sapiens
ggaccatggacaca

SEQ ID NO: 2044517 - DNA, 10 bp, Homo sapiens
ggacccacca

SEQ ID NO: 2044518 - DNA, 20 bp, Homo sapiens
ggacccaccaaactgcacac

SEQ ID NO: 2044519 - DNA, 18 bp, Homo sapiens
ggacccaggccctccatg

SEQ ID NO: 2044520 - DNA, 20 bp, Homo sapiens
ggacccatagatcttctgaa

SEQ ID NO: 2044521 - DNA, 18 bp, Homo sapiens
ggaccccctggccctgcc

SEQ ID NO: 2044522 - DNA, 23 bp, Homo sapiens
ggacccgaagcccaggctgaaga

SEQ ID NO: 2044523 - DNA, 14 bp, Homo sapiens
ggacccgctctgga

SEQ ID NO: 2044524 - DNA, 15 bp, Homo sapiens
ggacccgctctggac

SEQ ID NO: 2044525 - DNA, 19 bp, Homo sapiens
ggacccgctctggaccaac

SEQ ID NO: 2044526 - DNA, 15 bp, Homo sapiens
ggaccctcgcagcag

SEQ ID NO: 2044527 - DNA, 21 bp, Homo sapiens
ggaccctttccttccttccct

SEQ ID NO: 2044528 - DNA, 22 bp, Homo sapiens
ggaccctttccttccttccctg

SEQ ID NO: 2044529 - DNA, 21 bp, Homo sapiens
ggaccgcgtagagagccgggc

SEQ ID NO: 2044530 - DNA, 19 bp, Homo sapiens
ggaccgctacaccactctg

SEQ ID NO: 2044531 - DNA, 20 bp, Homo sapiens
ggaccgctacaccactctgg

SEQ ID NO: 2044532 - DNA, 22 bp, Homo sapiens
ggaccgctacaccactctggca

SEQ ID NO: 2044533 - DNA, 18 bp, Homo sapiens
ggaccgggtgggcctggc

SEQ ID NO: 2044534 - DNA, 22 bp, Homo sapiens
ggaccgggtgggcctggcctga

SEQ ID NO: 2044535 - DNA, 15 bp, Homo sapiens
ggacctccccctctt

SEQ ID NO: 2044536 - DNA, 14 bp, Homo sapiens
ggacctgagcctgc

SEQ ID NO: 2044537 - DNA, 17 bp, Homo sapiens
ggacctgagcctgccga

SEQ ID NO: 2044538 - DNA, 13 bp, Homo sapiens
ggaccttcctgcc

SEQ ID NO: 2044539 - DNA, 19 bp, Homo sapiens
ggacgccactcatttcatc

SEQ ID NO: 2044540 - DNA, 20 bp, Homo sapiens
ggacgccactcatttcatct

SEQ ID NO: 2044541 - DNA, 15 bp, Homo sapiens
ggacgcgcacacaca

SEQ ID NO: 2044542 - DNA, 19 bp, Homo sapiens
ggacgcttccagaccacct

SEQ ID NO: 2044543 - DNA, 20 bp, Homo sapiens
ggacgcttccagaccacctg

SEQ ID NO: 2044544 - DNA, 23 bp, Homo sapiens
ggacgcttccagaccacctgcca

SEQ ID NO: 2044545 - DNA, 19 bp, Homo sapiens
ggacggaaggtcagttgcc

SEQ ID NO: 2044546 - DNA, 18 bp, Homo sapiens
ggacggcattcctgctta

SEQ ID NO: 2044547 - DNA, 15 bp, Homo sapiens
ggacggttgtaagca

SEQ ID NO: 2044548 - DNA, 14 bp, Homo sapiens
ggacgtcctgctgg

SEQ ID NO: 2044549 - DNA, 18 bp, Homo sapiens
ggactaacactcagaagc

SEQ ID NO: 2044550 - DNA, 23 bp, Homo sapiens
ggactaacactcagaagcctggg

SEQ ID NO: 2044551 - DNA, 18 bp, Homo sapiens
ggactaacataaaatctg

SEQ ID NO: 2044552 - DNA, 19 bp, Homo sapiens
ggactaacataaaatctgt

SEQ ID NO: 2044553 - DNA, 22 bp, Homo sapiens
ggactaaccccaacgcacagga

SEQ ID NO: 2044554 - DNA, 20 bp, Homo sapiens
ggactacaggtgtgagtcac

SEQ ID NO: 2044555 - DNA, 17 bp, Homo sapiens
ggactagaacctggagg

SEQ ID NO: 2044556 - DNA, 19 bp, Homo sapiens
ggactatgaaaagctagaa

SEQ ID NO: 2044557 - DNA, 19 bp, Homo sapiens
ggactcaagggtccagaag

SEQ ID NO: 2044558 - DNA, 16 bp, Homo sapiens
ggactcaatgcactga

SEQ ID NO: 2044559 - DNA, 16 bp, Homo sapiens
ggactccccaggccag

SEQ ID NO: 2044560 - DNA, 17 bp, Homo sapiens
ggactccccaggccagg

SEQ ID NO: 2044561 - DNA, 18 bp, Homo sapiens
ggactccccaggccaggc

SEQ ID NO: 2044562 - DNA, 19 bp, Homo sapiens
ggactccctccatgtggcc

SEQ ID NO: 2044563 - DNA, 18 bp, Homo sapiens
ggactctaagctggagct

SEQ ID NO: 2044564 - DNA, 13 bp, Homo sapiens
ggactctgcacat

SEQ ID NO: 2044565 - DNA, 21 bp, Homo sapiens
ggactctgcacatgtcttgta

SEQ ID NO: 2044566 - DNA, 23 bp, Homo sapiens
ggactctgccccttctgtttcca

SEQ ID NO: 2044567 - DNA, 13 bp, Homo sapiens
ggactgagcctgg

SEQ ID NO: 2044568 - DNA, 13 bp, Homo sapiens
ggactgaggacca

SEQ ID NO: 2044569 - DNA, 16 bp, Homo sapiens
ggactgcgctggacga

SEQ ID NO: 2044570 - DNA, 17 bp, Homo sapiens
ggactggaaccagggag

SEQ ID NO: 2044571 - DNA, 18 bp, Homo sapiens
ggactggaaccagggaga

SEQ ID NO: 2044572 - DNA, 22 bp, Homo sapiens
ggactggcgagtccagagagga

SEQ ID NO: 2044573 - DNA, 11 bp, Homo sapiens
ggactggctca

SEQ ID NO: 2044574 - DNA, 23 bp, Homo sapiens
ggactggggatgtgggagggagc

SEQ ID NO: 2044575 - DNA, 15 bp, Homo sapiens
ggacttaacggctcc

SEQ ID NO: 2044576 - DNA, 19 bp, Homo sapiens
ggacttagctggccacagt

SEQ ID NO: 2044577 - DNA, 16 bp, Homo sapiens
ggacttcctggggccc

SEQ ID NO: 2044578 - DNA, 18 bp, Homo sapiens
ggacttgaggattttgag

SEQ ID NO: 2044579 - DNA, 20 bp, Homo sapiens
ggactttcctaaatgtttaa

SEQ ID NO: 2044580 - DNA, 12 bp, Homo sapiens
ggagaaaaacaa

SEQ ID NO: 2044581 - DNA, 16 bp, Homo sapiens
ggagaaagggcaaatt

SEQ ID NO: 2044582 - DNA, 20 bp, Homo sapiens
ggagaaatgcatccattcct

SEQ ID NO: 2044583 - DNA, 13 bp, Homo sapiens
ggagaactagaga

SEQ ID NO: 2044584 - DNA, 22 bp, Homo sapiens
ggagaagaattttcagacccca

SEQ ID NO: 2044585 - DNA, 23 bp, Homo sapiens
ggagaagagctgttcacagccag

SEQ ID NO: 2044586 - DNA, 16 bp, Homo sapiens
ggagaagcagtgagcc

SEQ ID NO: 2044587 - DNA, 12 bp, Homo sapiens
ggagaagctctg

SEQ ID NO: 2044588 - DNA, 15 bp, Homo sapiens
ggagaagctctgttt

SEQ ID NO: 2044589 - DNA, 16 bp, Homo sapiens
ggagaagctgatgctt

SEQ ID NO: 2044590 - DNA, 14 bp, Homo sapiens
ggagaaggaaaaag

SEQ ID NO: 2044591 - DNA, 12 bp, Homo sapiens
ggagaaggaagg

SEQ ID NO: 2044592 - DNA, 22 bp, Homo sapiens
ggagaaggaaggagactcacct

SEQ ID NO: 2044593 - DNA, 16 bp, Homo sapiens
ggagaaggccgctgcc

SEQ ID NO: 2044594 - DNA, 22 bp, Homo sapiens
ggagaaggccgctgccccagcc

SEQ ID NO: 2044595 - DNA, 14 bp, Homo sapiens
ggagaagggatgga

SEQ ID NO: 2044596 - DNA, 15 bp, Homo sapiens
ggagacaagaaatcc

SEQ ID NO: 2044597 - DNA, 18 bp, Homo sapiens
ggagacaagaaatccctg

SEQ ID NO: 2044598 - DNA, 15 bp, Homo sapiens
ggagacaaggaacca

SEQ ID NO: 2044599 - DNA, 14 bp, Homo sapiens
ggagacagagacag

SEQ ID NO: 2044600 - DNA, 12 bp, Homo sapiens
ggagacagcgaa

SEQ ID NO: 2044601 - DNA, 15 bp, Homo sapiens
ggagaccgcttcacc

SEQ ID NO: 2044602 - DNA, 19 bp, Homo sapiens
ggagaccgcttcacccctg

SEQ ID NO: 2044603 - DNA, 21 bp, Homo sapiens
ggagaccgcttcacccctgca

SEQ ID NO: 2044604 - DNA, 15 bp, Homo sapiens
ggagactatgtgtca

SEQ ID NO: 2044605 - DNA, 13 bp, Homo sapiens
ggagactcacctc

SEQ ID NO: 2044606 - DNA, 17 bp, Homo sapiens
ggagagacactcccagg

SEQ ID NO: 2044607 - DNA, 21 bp, Homo sapiens
ggagagacactcccagggaca

SEQ ID NO: 2044608 - DNA, 15 bp, Homo sapiens
ggagagactgaaagc

SEQ ID NO: 2044609 - DNA, 22 bp, Homo sapiens
ggagagactgaaagcagcagct

SEQ ID NO: 2044610 - DNA, 19 bp, Homo sapiens
ggagagagtattaaatatt

SEQ ID NO: 2044611 - DNA, 22 bp, Homo sapiens
ggagagagtattaaatatttaa

SEQ ID NO: 2044612 - DNA, 17 bp, Homo sapiens
ggagagagttgaaccta

SEQ ID NO: 2044613 - DNA, 20 bp, Homo sapiens
ggagagagttgaacctaaac

SEQ ID NO: 2044614 - DNA, 11 bp, Homo sapiens
ggagagcagct

SEQ ID NO: 2044615 - DNA, 11 bp, Homo sapiens
ggagagccagc

SEQ ID NO: 2044616 - DNA, 19 bp, Homo sapiens
ggagcaggggtctgagcca

SEQ ID NO: 2044617 - DNA, 13 bp, Homo sapiens
ggagcaggtctct

SEQ ID NO: 2044618 - DNA, 15 bp, Homo sapiens
ggagcaggtctctgg

SEQ ID NO: 2044619 - DNA, 14 bp, Homo sapiens
ggagcatctgactc

SEQ ID NO: 2044620 - DNA, 15 bp, Homo sapiens
ggagcatggctgtga

SEQ ID NO: 2044621 - DNA, 19 bp, Homo sapiens
ggagcatttggagagaagg

SEQ ID NO: 2044622 - DNA, 22 bp, Homo sapiens
ggagccccaggcctctgtgtcc

SEQ ID NO: 2044623 - DNA, 16 bp, Homo sapiens
ggagccccgaggcctt

SEQ ID NO: 2044624 - DNA, 22 bp, Homo sapiens
ggagccccgaggccttctctga

SEQ ID NO: 2044625 - DNA, 21 bp, Homo sapiens
ggagcccctaggaaagcagtg

SEQ ID NO: 2044626 - DNA, 21 bp, Homo sapiens
ggagccgagatcacgccactg

SEQ ID NO: 2044627 - DNA, 23 bp, Homo sapiens
ggagccggaccaagatgggcaca

SEQ ID NO: 2044628 - DNA, 16 bp, Homo sapiens
ggagccggtggcggtg

SEQ ID NO: 2044629 - DNA, 21 bp, Homo sapiens
ggagcctcatccgaggcaggg

SEQ ID NO: 2044630 - DNA, 20 bp, Homo sapiens
ggagcctcggtggccatgct

SEQ ID NO: 2044631 - DNA, 13 bp, Homo sapiens
ggagcctggcaca

SEQ ID NO: 2044632 - DNA, 16 bp, Homo sapiens
ggagcctggcacagga

SEQ ID NO: 2044633 - DNA, 14 bp, Homo sapiens
ggagcctgtgaacc

SEQ ID NO: 2044634 - DNA, 19 bp, Homo sapiens
ggagcctgtgaacccagga

SEQ ID NO: 2044635 - DNA, 15 bp, Homo sapiens
ggagcgcacctgccc

SEQ ID NO: 2044636 - DNA, 19 bp, Homo sapiens
ggagcgcacctgccccctg

SEQ ID NO: 2044637 - DNA, 23 bp, Homo sapiens
ggagctacctgtgtggacaggac

SEQ ID NO: 2044638 - DNA, 15 bp, Homo sapiens
ggagctcttggaaga

SEQ ID NO: 2044639 - DNA, 16 bp, Homo sapiens
ggagctgagtcacctc

SEQ ID NO: 2044640 - DNA, 18 bp, Homo sapiens
ggagctgagtcacctcct

SEQ ID NO: 2044641 - DNA, 19 bp, Homo sapiens
ggagctgccgcaaggccct

SEQ ID NO: 2044642 - DNA, 22 bp, Homo sapiens
ggagctggaggagcaggcagtg

SEQ ID NO: 2044643 - DNA, 14 bp, Homo sapiens
ggagctgggaggaa

SEQ ID NO: 2044644 - DNA, 13 bp, Homo sapiens
ggagcttccagtg

SEQ ID NO: 2044645 - DNA, 18 bp, Homo sapiens
ggagcttccagtgcatgt

SEQ ID NO: 2044646 - DNA, 21 bp, Homo sapiens
ggagcttctctgatgtgatat

SEQ ID NO: 2044647 - DNA, 14 bp, Homo sapiens
ggagcttgcagtga

SEQ ID NO: 2044648 - DNA, 15 bp, Homo sapiens
ggagcttgggaatgg

SEQ ID NO: 2044649 - DNA, 20 bp, Homo sapiens
ggaggaaaaccaagccgtgg

SEQ ID NO: 2044650 - DNA, 21 bp, Homo sapiens
ggaggaaaaccaagccgtggc

SEQ ID NO: 2044651 - DNA, 12 bp, Homo sapiens
ggaggaaggcaa

SEQ ID NO: 2044652 - DNA, 21 bp, Homo sapiens
ggaggaaggcaaagcccctgg

SEQ ID NO: 2044653 - DNA, 16 bp, Homo sapiens
ggaggaagggccagga

SEQ ID NO: 2044654 - DNA, 18 bp, Homo sapiens
ggaggaagggccaggaga

SEQ ID NO: 2044655 - DNA, 14 bp, Homo sapiens
ggaggaaggtgctg

SEQ ID NO: 2044656 - DNA, 14 bp, Homo sapiens
ggaggacctgagcc

SEQ ID NO: 2044657 - DNA, 19 bp, Homo sapiens
ggaggacctgagcctgccg

SEQ ID NO: 2044658 - DNA, 22 bp, Homo sapiens
ggaggacctgagcctgccgagc

SEQ ID NO: 2044659 - DNA, 21 bp, Homo sapiens
ggaggactagaacctggaggg

SEQ ID NO: 2044660 - DNA, 12 bp, Homo sapiens
ggaggagaaata

SEQ ID NO: 2044661 - DNA, 18 bp, Homo sapiens
ggaggagaccagctcaga

SEQ ID NO: 2044662 - DNA, 22 bp, Homo sapiens
ggaggagctgccgcaaggccct

SEQ ID NO: 2044663 - DNA, 12 bp, Homo sapiens
ggaggaggaagg

SEQ ID NO: 2044664 - DNA, 15 bp, Homo sapiens
ggaggaggaaggcaa

SEQ ID NO: 2044665 - DNA, 13 bp, Homo sapiens
ggaggaggagctg

SEQ ID NO: 2044666 - DNA, 11 bp, Homo sapiens
ggaggaggagg

SEQ ID NO: 2044667 - DNA, 16 bp, Homo sapiens
ggaggaggaggaaggc

SEQ ID NO: 2044668 - DNA, 18 bp, Homo sapiens
ggaggaggtgtcccaagc

SEQ ID NO: 2044669 - DNA, 16 bp, Homo sapiens
ggaggatcactggagc

SEQ ID NO: 2044670 - DNA, 19 bp, Homo sapiens
ggaggatcactggagccca

SEQ ID NO: 2044671 - DNA, 22 bp, Homo sapiens
ggaggatcactggagcccagga

SEQ ID NO: 2044672 - DNA, 15 bp, Homo sapiens
ggaggatccctccat

SEQ ID NO: 2044673 - DNA, 16 bp, Homo sapiens
ggaggatgccacagcc

SEQ ID NO: 2044674 - DNA, 19 bp, Homo sapiens
ggaggatgccacagcccca

SEQ ID NO: 2044675 - DNA, 22 bp, Homo sapiens
ggaggatgccacagccccacag

SEQ ID NO: 2044676 - DNA, 23 bp, Homo sapiens
ggaggatgccacagccccacagc

SEQ ID NO: 2044677 - DNA, 13 bp, Homo sapiens
ggaggatggagag

SEQ ID NO: 2044678 - DNA, 21 bp, Homo sapiens
ggaggatggagagaggggaat

SEQ ID NO: 2044679 - DNA, 20 bp, Homo sapiens
ggaggattgcttgagcccag

SEQ ID NO: 2044680 - DNA, 22 bp, Homo sapiens
ggaggcaccagctctgtggcct

SEQ ID NO: 2044681 - DNA, 19 bp, Homo sapiens
ggaggcagggccttgccca

SEQ ID NO: 2044682 - DNA, 16 bp, Homo sapiens
ggaggcatcagtgtcc

SEQ ID NO: 2044683 - DNA, 12 bp, Homo sapiens
ggaggcctcagt

SEQ ID NO: 2044684 - DNA, 22 bp, Homo sapiens
ggaggcctcgtaccagccagga

SEQ ID NO: 2044685 - DNA, 14 bp, Homo sapiens
ggaggcctgatgct

SEQ ID NO: 2044686 - DNA, 19 bp, Homo sapiens
ggaggcctgatgctgcccc

SEQ ID NO: 2044687 - DNA, 23 bp, Homo sapiens
ggatgtgggagggagcagacagg

SEQ ID NO: 2044688 - DNA, 13 bp, Homo sapiens
ggatgttctggga

SEQ ID NO: 2044689 - DNA, 16 bp, Homo sapiens
ggatgttctgggacac

SEQ ID NO: 2044690 - DNA, 19 bp, Homo sapiens
ggatgttgtcaggaatcat

SEQ ID NO: 2044691 - DNA, 21 bp, Homo sapiens
ggatgttttgtcccatttcct

SEQ ID NO: 2044692 - DNA, 18 bp, Homo sapiens
ggatgtttttcatgaaaa

SEQ ID NO: 2044693 - DNA, 17 bp, Homo sapiens
ggattagggagagaaga

SEQ ID NO: 2044694 - DNA, 19 bp, Homo sapiens
ggattcaggaaaaggcctg

SEQ ID NO: 2044695 - DNA, 23 bp, Homo sapiens
ggattcccaccaaggtcttcagc

SEQ ID NO: 2044696 - DNA, 13 bp, Homo sapiens
ggattctgggagg

SEQ ID NO: 2044697 - DNA, 19 bp, Homo sapiens
ggattctgggaggaagcag

SEQ ID NO: 2044698 - DNA, 16 bp, Homo sapiens
ggattcttccatctga

SEQ ID NO: 2044699 - DNA, 14 bp, Homo sapiens
ggattgaggaggac

SEQ ID NO: 2044700 - DNA, 20 bp, Homo sapiens
ggattgatcggagcctcctc

SEQ ID NO: 2044701 - DNA, 17 bp, Homo sapiens
ggattgctactgtccta

SEQ ID NO: 2044702 - DNA, 12 bp, Homo sapiens
ggattggggaag

SEQ ID NO: 2044703 - DNA, 19 bp, Homo sapiens
ggattggggaagactgtgg

SEQ ID NO: 2044704 - DNA, 17 bp, Homo sapiens
ggatttacgactgaaga

SEQ ID NO: 2044705 - DNA, 14 bp, Homo sapiens
ggatttatttaaaa

SEQ ID NO: 2044706 - DNA, 19 bp, Homo sapiens
ggatttatttaaaatagca

SEQ ID NO: 2044707 - DNA, 17 bp, Homo sapiens
ggatttcattgactgaa

SEQ ID NO: 2044708 - DNA, 21 bp, Homo sapiens
ggatttcctattttaaaacca

SEQ ID NO: 2044709 - DNA, 21 bp, Homo sapiens
ggatttgaggagcagcttcag

SEQ ID NO: 2044710 - DNA, 21 bp, Homo sapiens
ggattttgatccaagctggtc

SEQ ID NO: 2044711 - DNA, 16 bp, Homo sapiens
ggcaaagaactgcccc

SEQ ID NO: 2044712 - DNA, 13 bp, Homo sapiens
ggcaaatataaaa

SEQ ID NO: 2044713 - DNA, 19 bp, Homo sapiens
ggcaaatgacatgcactga

SEQ ID NO: 2044714 - DNA, 20 bp, Homo sapiens
ggcaaatgacatgcactgac

SEQ ID NO: 2044715 - DNA, 23 bp, Homo sapiens
ggcaaattattttaatattttgt

SEQ ID NO: 2044716 - DNA, 21 bp, Homo sapiens
ggcaacacctccttgctttgc

SEQ ID NO: 2044717 - DNA, 23 bp, Homo sapiens
ggcaacagagcaagactccgtct

SEQ ID NO: 2044718 - DNA, 13 bp, Homo sapiens
ggcaacagatgaa

SEQ ID NO: 2044719 - DNA, 18 bp, Homo sapiens
ggcaaccccagttctgct

SEQ ID NO: 2044720 - DNA, 18 bp, Homo sapiens
ggcaacccccagcctgct

SEQ ID NO: 2044721 - DNA, 19 bp, Homo sapiens
ggcaaccttgtctctatgc

SEQ ID NO: 2044722 - DNA, 19 bp, Homo sapiens
ggcaactaagcagtccctg

SEQ ID NO: 2044723 - DNA, 13 bp, Homo sapiens
ggcaactgaggca

SEQ ID NO: 2044724 - DNA, 15 bp, Homo sapiens
ggcaactgaggcaga

SEQ ID NO: 2044725 - DNA, 23 bp, Homo sapiens
ggcaactgaggcagacagcagct

SEQ ID NO: 2044726 - DNA, 21 bp, Homo sapiens
ggcatgtgtgcctgtggcaga

SEQ ID NO: 2044727 - DNA, 23 bp, Homo sapiens
ggcatgtgtttactttatgttac

SEQ ID NO: 2044728 - DNA, 14 bp, Homo sapiens
ggcatgttcctctg

SEQ ID NO: 2044729 - DNA, 18 bp, Homo sapiens
ggcattatttaatgtttg

SEQ ID NO: 2044730 - DNA, 15 bp, Homo sapiens
ggcattcctgcttat

SEQ ID NO: 2044731 - DNA, 13 bp, Homo sapiens
ggcattgggctga

SEQ ID NO: 2044732 - DNA, 16 bp, Homo sapiens
ggcattggtctgctga

SEQ ID NO: 2044733 - DNA, 16 bp, Homo sapiens
ggcatttcctgggtgg

SEQ ID NO: 2044734 - DNA, 18 bp, Homo sapiens
ggcatttcctgggtggct

SEQ ID NO: 2044735 - DNA, 22 bp, Homo sapiens
ggcatttttactactattctgt

SEQ ID NO: 2044736 - DNA, 19 bp, Homo sapiens
ggccaaaagggcagccagg

SEQ ID NO: 2044737 - DNA, 22 bp, Homo sapiens
ggccaaaagggcagccaggggc

SEQ ID NO: 2044738 - DNA, 13 bp, Homo sapiens
ggccaaagtgtta

SEQ ID NO: 2044739 - DNA, 22 bp, Homo sapiens
ggccaaatgcacaagctcagaa

SEQ ID NO: 2044740 - DNA, 16 bp, Homo sapiens
ggccaagctgaagtga

SEQ ID NO: 2044741 - DNA, 21 bp, Homo sapiens
ggccaagctgaagtgaaggag

SEQ ID NO: 2044742 - DNA, 15 bp, Homo sapiens
ggccaagctgaggtg

SEQ ID NO: 2044743 - DNA, 23 bp, Homo sapiens
ggccacaaatcaaagcaagggct

SEQ ID NO: 2044744 - DNA, 14 bp, Homo sapiens
ggccaccaggatgg

SEQ ID NO: 2044745 - DNA, 12 bp, Homo sapiens
ggccaccctcct

SEQ ID NO: 2044746 - DNA, 14 bp, Homo sapiens
ggccaccctggccc

SEQ ID NO: 2044747 - DNA, 19 bp, Homo sapiens
ggccaccgctctcctgcct

SEQ ID NO: 2044748 - DNA, 14 bp, Homo sapiens
ggccactccttcct

SEQ ID NO: 2044749 - DNA, 15 bp, Homo sapiens
ggccactccttcctg

SEQ ID NO: 2044750 - DNA, 20 bp, Homo sapiens
ggccactccttcctgcccca

SEQ ID NO: 2044751 - DNA, 22 bp, Homo sapiens
ggccactctcccctccctcttc

SEQ ID NO: 2044752 - DNA, 15 bp, Homo sapiens
ggccactgtggccag

SEQ ID NO: 2044753 - DNA, 20 bp, Homo sapiens
ggccactgtggccagagctg

SEQ ID NO: 2044754 - DNA, 21 bp, Homo sapiens
ggccactgtggccagagctgg

SEQ ID NO: 2044755 - DNA, 16 bp, Homo sapiens
ggccagaaggagggca

SEQ ID NO: 2044756 - DNA, 12 bp, Homo sapiens
gggaaaggaaaa

SEQ ID NO: 2044757 - DNA, 18 bp, Homo sapiens
gggaaaggaaaaccaggg

SEQ ID NO: 2044758 - DNA, 22 bp, Homo sapiens
gggaaaggaaaaccagggatag

SEQ ID NO: 2044759 - DNA, 16 bp, Homo sapiens
gggaaatggagggtgg

SEQ ID NO: 2044760 - DNA, 17 bp, Homo sapiens
gggaaatggagggtggg

SEQ ID NO: 2044761 - DNA, 19 bp, Homo sapiens
gggaaattattatgactca

SEQ ID NO: 2044762 - DNA, 16 bp, Homo sapiens
gggaacagacaggaga

SEQ ID NO: 2044763 - DNA, 18 bp, Homo sapiens
gggaacagacaggagaaa

SEQ ID NO: 2044764 - DNA, 14 bp, Homo sapiens
gggaacagactgga

SEQ ID NO: 2044765 - DNA, 20 bp, Homo sapiens
gggaacagtgtttcccataa

SEQ ID NO: 2044766 - DNA, 23 bp, Homo sapiens
gggaaccatgaagctggaagcac

SEQ ID NO: 2044767 - DNA, 15 bp, Homo sapiens
gggaaccctccccaa

SEQ ID NO: 2044768 - DNA, 19 bp, Homo sapiens
gggaaccctgcccactccc

SEQ ID NO: 2044769 - DNA, 19 bp, Homo sapiens
gggaacctagtactctctg

SEQ ID NO: 2044770 - DNA, 14 bp, Homo sapiens
gggaactccactct

SEQ ID NO: 2044771 - DNA, 18 bp, Homo sapiens
gggaactccactctcctt

SEQ ID NO: 2044772 - DNA, 12 bp, Homo sapiens
gggaactggcca

SEQ ID NO: 2044773 - DNA, 15 bp, Homo sapiens
gggaagagaagggaa

SEQ ID NO: 2044774 - DNA, 17 bp, Homo sapiens
gggaagagaagggaagc

SEQ ID NO: 2044775 - DNA, 15 bp, Homo sapiens
gggaagagggcagta

SEQ ID NO: 2044776 - DNA, 13 bp, Homo sapiens
gggaagcaggcag

SEQ ID NO: 2044777 - DNA, 12 bp, Homo sapiens
gggaagccctgg

SEQ ID NO: 2044778 - DNA, 18 bp, Homo sapiens
gggaagctgtactcagag

SEQ ID NO: 2044779 - DNA, 22 bp, Homo sapiens
gggaagctgtactcagagcaga

SEQ ID NO: 2044780 - DNA, 20 bp, Homo sapiens
gggaagcttgctggcttctg

SEQ ID NO: 2044781 - DNA, 14 bp, Homo sapiens
gggaaggcaggcag

SEQ ID NO: 2044782 - DNA, 14 bp, Homo sapiens
gggaaggctgctgt

SEQ ID NO: 2044783 - DNA, 13 bp, Homo sapiens
gggaagggccagt

SEQ ID NO: 2044784 - DNA, 16 bp, Homo sapiens
gggaagggccagtctg

SEQ ID NO: 2044785 - DNA, 22 bp, Homo sapiens
gggaagggccagtctgggctgc

SEQ ID NO: 2044786 - DNA, 18 bp, Homo sapiens
gggaagtgctccccacac

SEQ ID NO: 2044787 - DNA, 22 bp, Homo sapiens
gggaagtgctccccacacgtgc

SEQ ID NO: 2044788 - DNA, 16 bp, Homo sapiens
gggaagtttctgggtg

SEQ ID NO: 2044789 - DNA, 18 bp, Homo sapiens
gggaatccgcctgcagag

SEQ ID NO: 2044790 - DNA, 14 bp, Homo sapiens
gggaatgaacctgg

SEQ ID NO: 2044791 - DNA, 21 bp, Homo sapiens
gggaatgttccctgcaccctg

SEQ ID NO: 2044792 - DNA, 14 bp, Homo sapiens
gggacaaagaaatc

SEQ ID NO: 2044793 - DNA, 13 bp, Homo sapiens
gggacaacatttt

SEQ ID NO: 2044794 - DNA, 12 bp, Homo sapiens
gggacacacaca

SEQ ID NO: 2044795 - DNA, 14 bp, Homo sapiens
gggacacctgccct

SEQ ID NO: 2044796 - DNA, 12 bp, Homo sapiens
gggacagctcct

SEQ ID NO: 2044797 - DNA, 15 bp, Homo sapiens
gggacagtattctca

SEQ ID NO: 2044798 - DNA, 16 bp, Homo sapiens
gggacagttggcagag

SEQ ID NO: 2044799 - DNA, 19 bp, Homo sapiens
gggacagttggcagagaag

SEQ ID NO: 2044800 - DNA, 15 bp, Homo sapiens
gggacatttccctcc

SEQ ID NO: 2044801 - DNA, 14 bp, Homo sapiens
gggaccaggcacca

SEQ ID NO: 2044802 - DNA, 13 bp, Homo sapiens
gggaccagggcat

SEQ ID NO: 2044803 - DNA, 21 bp, Homo sapiens
gggacccagctactctgtcca

SEQ ID NO: 2044804 - DNA, 22 bp, Homo sapiens
gggacccctcccaacctcaatg

SEQ ID NO: 2044805 - DNA, 13 bp, Homo sapiens
gggacgaagaaag

SEQ ID NO: 2044806 - DNA, 20 bp, Homo sapiens
gggacgcgcacacacaccgg

SEQ ID NO: 2044807 - DNA, 11 bp, Homo sapiens
gggacgcttcc

SEQ ID NO: 2044808 - DNA, 13 bp, Homo sapiens
gggacgcttccag

SEQ ID NO: 2044809 - DNA, 20 bp, Homo sapiens
gggacgcttccagaccacct

SEQ ID NO: 2044810 - DNA, 22 bp, Homo sapiens
gggacgcttccagaccacctgc

SEQ ID NO: 2044811 - DNA, 19 bp, Homo sapiens
gggactggaaccagggaga

SEQ ID NO: 2044812 - DNA, 15 bp, Homo sapiens
gggacttggaagctc

SEQ ID NO: 2044813 - DNA, 17 bp, Homo sapiens
gggacttggaagctccg

SEQ ID NO: 2044814 - DNA, 13 bp, Homo sapiens
gggacttgtgcca

SEQ ID NO: 2044815 - DNA, 15 bp, Homo sapiens
gggagaacctcaggc

SEQ ID NO: 2044816 - DNA, 19 bp, Homo sapiens
gggagaagggccagcccta

SEQ ID NO: 2044817 - DNA, 22 bp, Homo sapiens
gggagacaccgcgcatctcttc

SEQ ID NO: 2044818 - DNA, 22 bp, Homo sapiens
gggagacagggcaatcttgtcc

SEQ ID NO: 2044819 - DNA, 11 bp, Homo sapiens
gggagagaact

SEQ ID NO: 2044820 - DNA, 18 bp, Homo sapiens
gggagagagacgtgtaca

SEQ ID NO: 2044821 - DNA, 17 bp, Homo sapiens
gggagaggcatggctgg

SEQ ID NO: 2044822 - DNA, 17 bp, Homo sapiens
gggagagtgcaggcctg

SEQ ID NO: 2044823 - DNA, 16 bp, Homo sapiens
gggagatactctccct

SEQ ID NO: 2044824 - DNA, 22 bp, Homo sapiens
gggagatggtcagtgtggagag

SEQ ID NO: 2044825 - DNA, 14 bp, Homo sapiens
gggagcactggagt

SEQ ID NO: 2044826 - DNA, 22 bp, Homo sapiens
gggagcacttgcgtcctgcaga

SEQ ID NO: 2044827 - DNA, 16 bp, Homo sapiens
gggagcagacaggagg

SEQ ID NO: 2044828 - DNA, 13 bp, Homo sapiens
gggagcaggtctc

SEQ ID NO: 2044829 - DNA, 15 bp, Homo sapiens
gggagcaggtctctg

SEQ ID NO: 2044830 - DNA, 19 bp, Homo sapiens
gggagcagtgtcttccata

SEQ ID NO: 2044831 - DNA, 16 bp, Homo sapiens
gggagccaacagcagc

SEQ ID NO: 2044832 - DNA, 14 bp, Homo sapiens
gggagcccctagga

SEQ ID NO: 2044833 - DNA, 20 bp, Homo sapiens
gggagcccctaggaaagcag

SEQ ID NO: 2044834 - DNA, 19 bp, Homo sapiens
gggagctggttagaaatgc

SEQ ID NO: 2044835 - DNA, 20 bp, Homo sapiens
gggaggaagggccaggagag

SEQ ID NO: 2044836 - DNA, 14 bp, Homo sapiens
gggaggagaatgag

SEQ ID NO: 2044837 - DNA, 21 bp, Homo sapiens
gggaggagaggggaagggcca

SEQ ID NO: 2044838 - DNA, 20 bp, Homo sapiens
gggaggaggtggcagccctg

SEQ ID NO: 2044839 - DNA, 19 bp, Homo sapiens
gggaggatcactggagccc

SEQ ID NO: 2044840 - DNA, 22 bp, Homo sapiens
gggaggatgccacagccccaca

SEQ ID NO: 2044841 - DNA, 22 bp, Homo sapiens
gggaggatgttctgggacacag

SEQ ID NO: 2044842 - DNA, 15 bp, Homo sapiens
gggaggcaccagctc

SEQ ID NO: 2044843 - DNA, 14 bp, Homo sapiens
gggaggctgaggcg

SEQ ID NO: 2044844 - DNA, 20 bp, Homo sapiens
gggaggctggaagctgggag

SEQ ID NO: 2044845 - DNA, 13 bp, Homo sapiens
gggaggctttcaa

SEQ ID NO: 2044846 - DNA, 14 bp, Homo sapiens
gggagggccaggat

SEQ ID NO: 2044847 - DNA, 19 bp, Homo sapiens
gggagggctctgaggcgcc

SEQ ID NO: 2044848 - DNA, 20 bp, Homo sapiens
gggagggctctgaggcgccc

SEQ ID NO: 2044849 - DNA, 14 bp, Homo sapiens
gggagggctgcctg

SEQ ID NO: 2044850 - DNA, 14 bp, Homo sapiens
gggagggggctcca

SEQ ID NO: 2044851 - DNA, 15 bp, Homo sapiens
gggagggtaccagca

SEQ ID NO: 2044852 - DNA, 16 bp, Homo sapiens
gggaggtcgaggtagg

SEQ ID NO: 2044853 - DNA, 23 bp, Homo sapiens
gggagtagcatggactctgggtt

SEQ ID NO: 2044854 - DNA, 17 bp, Homo sapiens
gggagtgacagaggcag

SEQ ID NO: 2044855 - DNA, 18 bp, Homo sapiens
gggagtgacagaggcagc

SEQ ID NO: 2044856 - DNA, 20 bp, Homo sapiens
gggagtgttctgtgggcttg

SEQ ID NO: 2044857 - DNA, 23 bp, Homo sapiens
gggagttcgagaccaacctgacc

SEQ ID NO: 2044858 - DNA, 14 bp, Homo sapiens
gggatcacagggcc

SEQ ID NO: 2044859 - DNA, 21 bp, Homo sapiens
gggatcgcaccttttatacca

SEQ ID NO: 2044860 - DNA, 14 bp, Homo sapiens
gggatggaggagaa

SEQ ID NO: 2044861 - DNA, 12 bp, Homo sapiens
gggatgtagaac

SEQ ID NO: 2044862 - DNA, 23 bp, Homo sapiens
gggattttaaaaacatgagaaat

SEQ ID NO: 2044863 - DNA, 17 bp, Homo sapiens
gggcaaaccatttcaaa

SEQ ID NO: 2044864 - DNA, 18 bp, Homo sapiens
gggcaaacccttctcttc

SEQ ID NO: 2044865 - DNA, 20 bp, Homo sapiens
gggcaaagaactgccccatc

SEQ ID NO: 2044866 - DNA, 21 bp, Homo sapiens
gggcaaatgacatgcactgac

SEQ ID NO: 2044867 - DNA, 16 bp, Homo sapiens
gggcaacccccagcct

SEQ ID NO: 2044868 - DNA, 22 bp, Homo sapiens
gggcaatcttgtccacagtctc

SEQ ID NO: 2044869 - DNA, 11 bp, Homo sapiens
gggcacaccac

SEQ ID NO: 2044870 - DNA, 14 bp, Homo sapiens
gggcacaccactgc

SEQ ID NO: 2044871 - DNA, 16 bp, Homo sapiens
gggtccaggaaggcag

SEQ ID NO: 2044872 - DNA, 19 bp, Homo sapiens
gggtccaggaaggcagctg

SEQ ID NO: 2044873 - DNA, 19 bp, Homo sapiens
gggtccgattaatttatgg

SEQ ID NO: 2044874 - DNA, 19 bp, Homo sapiens
gggtccgcaccagctgctc

SEQ ID NO: 2044875 - DNA, 21 bp, Homo sapiens
gggtccgcaccagctgctctg

SEQ ID NO: 2044876 - DNA, 19 bp, Homo sapiens
gggtcctgcaatctccagg

SEQ ID NO: 2044877 - DNA, 20 bp, Homo sapiens
gggtcctgcaatctccaggg

SEQ ID NO: 2044878 - DNA, 20 bp, Homo sapiens
gggtcgtcaccacctctcct

SEQ ID NO: 2044879 - DNA, 14 bp, Homo sapiens
gggtctagggagag

SEQ ID NO: 2044880 - DNA, 22 bp, Homo sapiens
gggtctcactatgttgcccagg

SEQ ID NO: 2044881 - DNA, 23 bp, Homo sapiens
gggtctcactatgttgcccaggc

SEQ ID NO: 2044882 - DNA, 17 bp, Homo sapiens
gggtctcacttatacca

SEQ ID NO: 2044883 - DNA, 23 bp, Homo sapiens
gggtctgaaggaatagccagaga

SEQ ID NO: 2044884 - DNA, 15 bp, Homo sapiens
gggtctggctgagct

SEQ ID NO: 2044885 - DNA, 19 bp, Homo sapiens
gggtctgtgctgtgcctgc

SEQ ID NO: 2044886 - DNA, 20 bp, Homo sapiens
gggtctgtgctgtgcctgct

SEQ ID NO: 2044887 - DNA, 22 bp, Homo sapiens
gggtcttgggctactggcagct

SEQ ID NO: 2044888 - DNA, 20 bp, Homo sapiens
gggtgactgaatttgggcct

SEQ ID NO: 2044889 - DNA, 17 bp, Homo sapiens
gggtgagaggaagggtg

SEQ ID NO: 2044890 - DNA, 23 bp, Homo sapiens
gggtgatcagaaggctggggcca

SEQ ID NO: 2044891 - DNA, 18 bp, Homo sapiens
gggtgatgagggcagcag

SEQ ID NO: 2044892 - DNA, 13 bp, Homo sapiens
gggtgcacaggag

SEQ ID NO: 2044893 - DNA, 14 bp, Homo sapiens
gggtgcacaggagg

SEQ ID NO: 2044894 - DNA, 19 bp, Homo sapiens
gggtgcacaggagggggtc

SEQ ID NO: 2044895 - DNA, 22 bp, Homo sapiens
gggtgcatggcttggggagcag

SEQ ID NO: 2044896 - DNA, 14 bp, Homo sapiens
gggtgcgagagagg

SEQ ID NO: 2044897 - DNA, 23 bp, Homo sapiens
gggtggaccccctgagtcaactg

SEQ ID NO: 2044898 - DNA, 21 bp, Homo sapiens
gggtggccaatccaggtggga

SEQ ID NO: 2044899 - DNA, 23 bp, Homo sapiens
gggtggccccctgtgccagctca

SEQ ID NO: 2044900 - DNA, 16 bp, Homo sapiens
gggtggccgacggcgg

SEQ ID NO: 2044901 - DNA, 16 bp, Homo sapiens
gggtggctagtcagag

SEQ ID NO: 2044902 - DNA, 16 bp, Homo sapiens
gggtggctcctgccac

SEQ ID NO: 2044903 - DNA, 21 bp, Homo sapiens
gggtggctcctgccactgacc

SEQ ID NO: 2044904 - DNA, 11 bp, Homo sapiens
gggtgggcagg

SEQ ID NO: 2044905 - DNA, 15 bp, Homo sapiens
gggtgggcagggctg

SEQ ID NO: 2044906 - DNA, 16 bp, Homo sapiens
gggtgggcagggctgg

SEQ ID NO: 2044907 - DNA, 13 bp, Homo sapiens
gggtggggcagga

SEQ ID NO: 2044908 - DNA, 16 bp, Homo sapiens
gggtggtctgagcacc

SEQ ID NO: 2044909 - DNA, 22 bp, Homo sapiens
gggtgtctggaagctgagcagg

SEQ ID NO: 2044910 - DNA, 15 bp, Homo sapiens
gggtgtggcctcagc

SEQ ID NO: 2044911 - DNA, 19 bp, Homo sapiens
gggtgtggcctcagccctc

SEQ ID NO: 2044912 - DNA, 14 bp, Homo sapiens
gggtgtgtgtttgt

SEQ ID NO: 2044913 - DNA, 20 bp, Homo sapiens
gggttcagcccctcctctgc

SEQ ID NO: 2044914 - DNA, 21 bp, Homo sapiens
gggttcagcccctcctctgcc

SEQ ID NO: 2044915 - DNA, 18 bp, Homo sapiens
gggttcatctagggacac

SEQ ID NO: 2044916 - DNA, 21 bp, Homo sapiens
gggttcattccccggccctcc

SEQ ID NO: 2044917 - DNA, 13 bp, Homo sapiens
gggttgaaggcag

SEQ ID NO: 2044918 - DNA, 17 bp, Homo sapiens
gggttgaaggcagtctg

SEQ ID NO: 2044919 - DNA, 21 bp, Homo sapiens
gggttgcgggggagctggaaa

SEQ ID NO: 2044920 - DNA, 23 bp, Homo sapiens
gggttgcgggggagctggaaata

SEQ ID NO: 2044921 - DNA, 18 bp, Homo sapiens
gggttggatgggaagatg

SEQ ID NO: 2044922 - DNA, 16 bp, Homo sapiens
gggttggcccctgccc

SEQ ID NO: 2044923 - DNA, 21 bp, Homo sapiens
gggttgggttcatctgagcaa

SEQ ID NO: 2044924 - DNA, 14 bp, Homo sapiens
gggttttatatttt

SEQ ID NO: 2044925 - DNA, 23 bp, Homo sapiens
ggtaaaagtgtgagcagtgagtt

SEQ ID NO: 2044926 - DNA, 13 bp, Homo sapiens
ggtaaaatacttc

SEQ ID NO: 2044927 - DNA, 15 bp, Homo sapiens
ggtaaattaagacat

SEQ ID NO: 2044928 - DNA, 15 bp, Homo sapiens
ggtaagccagagcct

SEQ ID NO: 2044929 - DNA, 13 bp, Homo sapiens
ggtacaagagcca

SEQ ID NO: 2044930 - DNA, 18 bp, Homo sapiens
ggtacatttccctgtgct

SEQ ID NO: 2044931 - DNA, 18 bp, Homo sapiens
ggtaccaatcctggcagg

SEQ ID NO: 2044932 - DNA, 14 bp, Homo sapiens
ggtaccactgattt

SEQ ID NO: 2044933 - DNA, 16 bp, Homo sapiens
ggtacccactgctctg

SEQ ID NO: 2044934 - DNA, 19 bp, Homo sapiens
ggtacccctttctggctct

SEQ ID NO: 2044935 - DNA, 12 bp, Homo sapiens
ggtacctcagtt

SEQ ID NO: 2044936 - DNA, 12 bp, Homo sapiens
ggtaccttgaac

SEQ ID NO: 2044937 - DNA, 14 bp, Homo sapiens
ggtacgtctgggcc

SEQ ID NO: 2044938 - DNA, 22 bp, Homo sapiens
ggtactactgctgcaaagtgca

SEQ ID NO: 2044939 - DNA, 16 bp, Homo sapiens
ggtactgcacattttg

SEQ ID NO: 2044940 - DNA, 18 bp, Homo sapiens
ggtactggggctgagggc

SEQ ID NO: 2044941 - DNA, 11 bp, Homo sapiens
ggtagaacaca

SEQ ID NO: 2044942 - DNA, 11 bp, Homo sapiens
ggtagaagcca

SEQ ID NO: 2044943 - DNA, 14 bp, Homo sapiens
ggtagaggagggca

SEQ ID NO: 2044944 - DNA, 16 bp, Homo sapiens
ggtagatcgcttgagc

SEQ ID NO: 2044945 - DNA, 23 bp, Homo sapiens
ggtagcaattctacccagagcct

SEQ ID NO: 2044946 - DNA, 19 bp, Homo sapiens
ggtagcagataaagacagc

SEQ ID NO: 2044947 - DNA, 20 bp, Homo sapiens
ggtagcccagcactgtgaag

SEQ ID NO: 2044948 - DNA, 16 bp, Homo sapiens
ggtagcgagctgctct

SEQ ID NO: 2044949 - DNA, 22 bp, Homo sapiens
ggtaggaaagcaccgcagcatg

SEQ ID NO: 2044950 - DNA, 19 bp, Homo sapiens
ggtaggaggtttggatggg

SEQ ID NO: 2044951 - DNA, 12 bp, Homo sapiens
ggtaggcccttg

SEQ ID NO: 2044952 - DNA, 14 bp, Homo sapiens
ggtaggcccttgtc

SEQ ID NO: 2044953 - DNA, 19 bp, Homo sapiens
ggtaggcccttgtcctgcc

SEQ ID NO: 2044954 - DNA, 21 bp, Homo sapiens
ggtaggcccttgtcctgccag

SEQ ID NO: 2044955 - DNA, 13 bp, Homo sapiens
ggtagggcagcag

SEQ ID NO: 2044956 - DNA, 21 bp, Homo sapiens
ggtaggggagggtggggcaat

SEQ ID NO: 2044957 - DNA, 13 bp, Homo sapiens
ggtagtactggga

SEQ ID NO: 2044958 - DNA, 14 bp, Homo sapiens
ggtagtactgggaa

SEQ ID NO: 2044959 - DNA, 17 bp, Homo sapiens
ggtatatttagaccctg

SEQ ID NO: 2044960 - DNA, 13 bp, Homo sapiens
ggtatcaggcaca

SEQ ID NO: 2044961 - DNA, 16 bp, Homo sapiens
ggtatctccaggattg

SEQ ID NO: 2044962 - DNA, 19 bp, Homo sapiens
ggtatgaacttgaggacac

SEQ ID NO: 2044963 - DNA, 21 bp, Homo sapiens
ggtatgaacttgaggacacat

SEQ ID NO: 2044964 - DNA, 16 bp, Homo sapiens
ggtatgagctgagggg

SEQ ID NO: 2044965 - DNA, 19 bp, Homo sapiens
ggtatgatccttgttttaa

SEQ ID NO: 2044966 - DNA, 14 bp, Homo sapiens
ggtatgctggccag

SEQ ID NO: 2044967 - DNA, 15 bp, Homo sapiens
ggtatgctggccagc

SEQ ID NO: 2044968 - DNA, 20 bp, Homo sapiens
ggtattacactgtatttgta

SEQ ID NO: 2044969 - DNA, 17 bp, Homo sapiens
ggtattgtaatgaatat

SEQ ID NO: 2044970 - DNA, 21 bp, Homo sapiens
ggtattttcgtgcatttgtga

SEQ ID NO: 2044971 - DNA, 14 bp, Homo sapiens
ggtcaacagagaag

SEQ ID NO: 2044972 - DNA, 20 bp, Homo sapiens
ggtcaacagagaaggcagga

SEQ ID NO: 2044973 - DNA, 15 bp, Homo sapiens
ggtcaacggccctgt

SEQ ID NO: 2044974 - DNA, 13 bp, Homo sapiens
ggtcaatcccaaa

SEQ ID NO: 2044975 - DNA, 18 bp, Homo sapiens
ggtcacaggactctgcct

SEQ ID NO: 2044976 - DNA, 19 bp, Homo sapiens
ggtcacatatgtctgtatc

SEQ ID NO: 2044977 - DNA, 21 bp, Homo sapiens
ggtcacattcaggaagatgaa

SEQ ID NO: 2044978 - DNA, 13 bp, Homo sapiens
ggtcaccaccctc

SEQ ID NO: 2044979 - DNA, 17 bp, Homo sapiens
ggtcagagatgggctga

SEQ ID NO: 2044980 - DNA, 19 bp, Homo sapiens
ggtcagagatgggctgaac

SEQ ID NO: 2044981 - DNA, 23 bp, Homo sapiens
ggtcagagatgggctgaactgag

SEQ ID NO: 2044982 - DNA, 14 bp, Homo sapiens
ggtcagagcctgca

SEQ ID NO: 2044983 - DNA, 12 bp, Homo sapiens
ggtcagccaggg

SEQ ID NO: 2044984 - DNA, 22 bp, Homo sapiens
ggtcaggagaggggcagaacag

SEQ ID NO: 2044985 - DNA, 21 bp, Homo sapiens
ggtcaggagttcctaaccagc

SEQ ID NO: 2044986 - DNA, 15 bp, Homo sapiens
ggttcccctgttcac

SEQ ID NO: 2044987 - DNA, 13 bp, Homo sapiens
ggttcctgtcctc

SEQ ID NO: 2044988 - DNA, 14 bp, Homo sapiens
ggttctttcttcct

SEQ ID NO: 2044989 - DNA, 18 bp, Homo sapiens
ggttctttcttcctctgc

SEQ ID NO: 2044990 - DNA, 16 bp, Homo sapiens
ggttgcaaggccgctg

SEQ ID NO: 2044991 - DNA, 17 bp, Homo sapiens
ggttgccccttccccat

SEQ ID NO: 2044992 - DNA, 22 bp, Homo sapiens
ggttgccccttccccatctcca

SEQ ID NO: 2044993 - DNA, 22 bp, Homo sapiens
ggttgcgggggagctggaaata

SEQ ID NO: 2044994 - DNA, 15 bp, Homo sapiens
ggttggagagctaga

SEQ ID NO: 2044995 - DNA, 11 bp, Homo sapiens
ggttggatggg

SEQ ID NO: 2044996 - DNA, 21 bp, Homo sapiens
ggttggcccctgcccggctgc

SEQ ID NO: 2044997 - DNA, 19 bp, Homo sapiens
ggttgtaaatgctcgtgtg

SEQ ID NO: 2044998 - DNA, 21 bp, Homo sapiens
ggttgtctgtttttgtaactt

SEQ ID NO: 2044999 - DNA, 21 bp, Homo sapiens
ggttgttgcaccatctgcttg

SEQ ID NO: 2045000 - DNA, 22 bp, Homo sapiens
ggttgttgcaccatctgcttgg

SEQ ID NO: 2045001 - DNA, 16 bp, Homo sapiens
ggtttacatgaacaca

SEQ ID NO: 2045002 - DNA, 13 bp, Homo sapiens
ggtttactgctgt

SEQ ID NO: 2045003 - DNA, 14 bp, Homo sapiens
ggtttactgctgtc

SEQ ID NO: 2045004 - DNA, 19 bp, Homo sapiens
ggtttcaccatgttggcca

SEQ ID NO: 2045005 - DNA, 20 bp, Homo sapiens
ggtttcaccatgttggccag

SEQ ID NO: 2045006 - DNA, 23 bp, Homo sapiens
ggtttccactgtcttgcctgcca

SEQ ID NO: 2045007 - DNA, 13 bp, Homo sapiens
ggtttccaggcca

SEQ ID NO: 2045008 - DNA, 11 bp, Homo sapiens
ggtttctcaga

SEQ ID NO: 2045009 - DNA, 18 bp, Homo sapiens
ggtttctgcgtgctttat

SEQ ID NO: 2045010 - DNA, 15 bp, Homo sapiens
ggtttctgttctgtt

SEQ ID NO: 2045011 - DNA, 15 bp, Homo sapiens
ggtttgaatataaac

SEQ ID NO: 2045012 - DNA, 16 bp, Homo sapiens
ggtttgccagtgaaga

SEQ ID NO: 2045013 - DNA, 15 bp, Homo sapiens
ggtttgtattttaaa

SEQ ID NO: 2045014 - DNA, 15 bp, Homo sapiens
ggtttgttgtaaata

SEQ ID NO: 2045015 - DNA, 17 bp, Homo sapiens
ggtttgtttttcaaagc

SEQ ID NO: 2045016 - DNA, 19 bp, Homo sapiens
ggttttattgtccttcaga

SEQ ID NO: 2045017 - DNA, 15 bp, Homo sapiens
ggttttggagtcagt

SEQ ID NO: 2045018 - DNA, 13 bp, Homo sapiens
ggttttgtacaat

SEQ ID NO: 2045019 - DNA, 15 bp, Homo sapiens
ggttttgtattcttt

SEQ ID NO: 2045020 - DNA, 16 bp, Homo sapiens
ggtttttatttctcgg

SEQ ID NO: 2045021 - DNA, 15 bp, Homo sapiens
ggtttttggctcttt

SEQ ID NO: 2045022 - DNA, 20 bp, Homo sapiens
ggtttttggctctttcagag

SEQ ID NO: 2045023 - DNA, 23 bp, Homo sapiens
ggtttttgtttgtttcctttgtt

SEQ ID NO: 2045024 - DNA, 15 bp, Homo sapiens
gtaaaaagattatat

SEQ ID NO: 2045025 - DNA, 11 bp, Homo sapiens
gtaaaacacag

SEQ ID NO: 2045026 - DNA, 14 bp, Homo sapiens
gtaaaaccacagca

SEQ ID NO: 2045027 - DNA, 17 bp, Homo sapiens
gtaaaaccatgtagttt

SEQ ID NO: 2045028 - DNA, 18 bp, Homo sapiens
gtaaaagaacagtaaaca

SEQ ID NO: 2045029 - DNA, 18 bp, Homo sapiens
gtaaaagcaaaaaagaaa

SEQ ID NO: 2045030 - DNA, 19 bp, Homo sapiens
gtaaaagcaaaaaagaaaa

SEQ ID NO: 2045031 - DNA, 13 bp, Homo sapiens
gtaaaagctaatt

SEQ ID NO: 2045032 - DNA, 14 bp, Homo sapiens
gtaaacagaaggag

SEQ ID NO: 2045033 - DNA, 16 bp, Homo sapiens
gtaaacagaaggagat

SEQ ID NO: 2045034 - DNA, 22 bp, Homo sapiens
gtaaacagtgcctgctgaatga

SEQ ID NO: 2045035 - DNA, 23 bp, Homo sapiens
gtaaacataattcttgtatatta

SEQ ID NO: 2045036 - DNA, 14 bp, Homo sapiens
gtaaacatgtgttt

SEQ ID NO: 2045037 - DNA, 22 bp, Homo sapiens
gtaaactataaactactgtaat

SEQ ID NO: 2045038 - DNA, 16 bp, Homo sapiens
gtaaactcaaaatatt

SEQ ID NO: 2045039 - DNA, 23 bp, Homo sapiens
gtaaactcaaaatatttgtacat

SEQ ID NO: 2045040 - DNA, 20 bp, Homo sapiens
gtaaactgtatcaaatctgt

SEQ ID NO: 2045041 - DNA, 16 bp, Homo sapiens
gtaaactgtggatgat

SEQ ID NO: 2045042 - DNA, 14 bp, Homo sapiens
gtaaagaataaatg

SEQ ID NO: 2045043 - DNA, 15 bp, Homo sapiens
gtaaaggcctttaat

SEQ ID NO: 2045044 - DNA, 17 bp, Homo sapiens
gtaaagtgataatttct

SEQ ID NO: 2045045 - DNA, 14 bp, Homo sapiens
gtaaagtttaaaaa

SEQ ID NO: 2045046 - DNA, 14 bp, Homo sapiens
gtaaataaattgtt

SEQ ID NO: 2045047 - DNA, 18 bp, Homo sapiens
gtaaataaattgtttgac

SEQ ID NO: 2045048 - DNA, 13 bp, Homo sapiens
gtaaatacaaaat

SEQ ID NO: 2045049 - DNA, 15 bp, Homo sapiens
gtaaatacaaaataa

SEQ ID NO: 2045050 - DNA, 19 bp, Homo sapiens
gtaaatacacaacacacac

SEQ ID NO: 2045051 - DNA, 21 bp, Homo sapiens
gtaaatacagtggatctcaat

SEQ ID NO: 2045052 - DNA, 15 bp, Homo sapiens
gtaaatacatgtgtg

SEQ ID NO: 2045053 - DNA, 15 bp, Homo sapiens
gtaaatatgactcct

SEQ ID NO: 2045054 - DNA, 13 bp, Homo sapiens
gtaaatattttaa

SEQ ID NO: 2045055 - DNA, 15 bp, Homo sapiens
gtaaatcacttgtaa

SEQ ID NO: 2045056 - DNA, 21 bp, Homo sapiens
gtaaatctaactacaaggaca

SEQ ID NO: 2045057 - DNA, 22 bp, Homo sapiens
gtaaatctaactacaaggacaa

SEQ ID NO: 2045058 - DNA, 17 bp, Homo sapiens
gtaaatggagcttgtac

SEQ ID NO: 2045059 - DNA, 19 bp, Homo sapiens
gtaaatgggcagtgcctcc

SEQ ID NO: 2045060 - DNA, 21 bp, Homo sapiens
gtaaatgggcagtgcctcctg

SEQ ID NO: 2045061 - DNA, 17 bp, Homo sapiens
gtaaatgtccaaaatgt

SEQ ID NO: 2045062 - DNA, 15 bp, Homo sapiens
gtaaatgtggacaca

SEQ ID NO: 2045063 - DNA, 15 bp, Homo sapiens
gtaaattatttcata

SEQ ID NO: 2045064 - DNA, 14 bp, Homo sapiens
gtaaattcctgttg

SEQ ID NO: 2045065 - DNA, 13 bp, Homo sapiens
gtaacaaatgaac

SEQ ID NO: 2045066 - DNA, 16 bp, Homo sapiens
gtaacaagccacccca

SEQ ID NO: 2045067 - DNA, 16 bp, Homo sapiens
gtaacaagccagattt

SEQ ID NO: 2045068 - DNA, 20 bp, Homo sapiens
gtaacacaagccacagaagc

SEQ ID NO: 2045069 - DNA, 18 bp, Homo sapiens
gtaacactgcaagaagtc

SEQ ID NO: 2045070 - DNA, 22 bp, Homo sapiens
gtaacatgtttacttttcaggg

SEQ ID NO: 2045071 - DNA, 17 bp, Homo sapiens
gtaactactttttatac

SEQ ID NO: 2045072 - DNA, 20 bp, Homo sapiens
gtaactaggccatttgtatt

SEQ ID NO: 2045073 - DNA, 19 bp, Homo sapiens
gtaactatcaatatttaag

SEQ ID NO: 2045074 - DNA, 18 bp, Homo sapiens
gtaactcagacattccaa

SEQ ID NO: 2045075 - DNA, 13 bp, Homo sapiens
gtaactcatctgt

SEQ ID NO: 2045076 - DNA, 23 bp, Homo sapiens
gtaactctaattcccattttgca

SEQ ID NO: 2045077 - DNA, 22 bp, Homo sapiens
gtaactctatagttattgtttt

SEQ ID NO: 2045078 - DNA, 22 bp, Homo sapiens
gtaactgctgagccactcgcag

SEQ ID NO: 2045079 - DNA, 18 bp, Homo sapiens
gtaactgtcaagtcatga

SEQ ID NO: 2045080 - DNA, 11 bp, Homo sapiens
gtaagaagccg

SEQ ID NO: 2045081 - DNA, 16 bp, Homo sapiens
gtaagaccttggtagg

SEQ ID NO: 2045082 - DNA, 19 bp, Homo sapiens
gtaagatggcttatttgta

SEQ ID NO: 2045083 - DNA, 15 bp, Homo sapiens
gtaagcattctgagc

SEQ ID NO: 2045084 - DNA, 19 bp, Homo sapiens
gtaagcattctgagctggg

SEQ ID NO: 2045085 - DNA, 16 bp, Homo sapiens
gtaagccagagcctgg

SEQ ID NO: 2045086 - DNA, 20 bp, Homo sapiens
gtaagggagagggagggagc

SEQ ID NO: 2045087 - DNA, 21 bp, Homo sapiens
gtaagtggggttgcaaccact

SEQ ID NO: 2045088 - DNA, 22 bp, Homo sapiens
gtaagtggggttgcaaccactg

SEQ ID NO: 2045089 - DNA, 23 bp, Homo sapiens
gtaagttgaatggcctgccttga

SEQ ID NO: 2045090 - DNA, 14 bp, Homo sapiens
gtaagttgtgtgca

SEQ ID NO: 2045091 - DNA, 12 bp, Homo sapiens
gtaagtttattt

SEQ ID NO: 2045092 - DNA, 23 bp, Homo sapiens
gtaataaaacccagcatgtacaa

SEQ ID NO: 2045093 - DNA, 15 bp, Homo sapiens
gtaataaactctcta

SEQ ID NO: 2045094 - DNA, 14 bp, Homo sapiens
gtaataaaggtctt

SEQ ID NO: 2045095 - DNA, 12 bp, Homo sapiens
gtaataagaaag

SEQ ID NO: 2045096 - DNA, 22 bp, Homo sapiens
gtaataagaaagtataaagtca

SEQ ID NO: 2045097 - DNA, 20 bp, Homo sapiens
gtaatataatggaagagaaa

SEQ ID NO: 2045098 - DNA, 18 bp, Homo sapiens
gtaatatattgctgctgg

SEQ ID NO: 2045099 - DNA, 20 bp, Homo sapiens
gtaatatattgctgctggta

SEQ ID NO: 2045100 - DNA, 21 bp, Homo sapiens
gtaatatctattattataaaa

SEQ ID NO: 2045101 - DNA, 22 bp, Homo sapiens
gtagcaggatgaggaacctcaa

SEQ ID NO: 2045102 - DNA, 18 bp, Homo sapiens
gtagcaggtaccactgat

SEQ ID NO: 2045103 - DNA, 15 bp, Homo sapiens
gtagcatggactctg

SEQ ID NO: 2045104 - DNA, 14 bp, Homo sapiens
gtagccaaaggttc

SEQ ID NO: 2045105 - DNA, 19 bp, Homo sapiens
gtagccaaggtgggctgag

SEQ ID NO: 2045106 - DNA, 15 bp, Homo sapiens
gtagccagccggggc

SEQ ID NO: 2045107 - DNA, 16 bp, Homo sapiens
gtagccatggctcagg

SEQ ID NO: 2045108 - DNA, 18 bp, Homo sapiens
gtagccatggctcaggca

SEQ ID NO: 2045109 - DNA, 21 bp, Homo sapiens
gtagccatggctcaggcaagc

SEQ ID NO: 2045110 - DNA, 22 bp, Homo sapiens
gtagccatggctcaggcaagcc

SEQ ID NO: 2045111 - DNA, 14 bp, Homo sapiens
gtagcccagcactg

SEQ ID NO: 2045112 - DNA, 15 bp, Homo sapiens
gtagccccagtgaca

SEQ ID NO: 2045113 - DNA, 13 bp, Homo sapiens
gtagcccggccag

SEQ ID NO: 2045114 - DNA, 19 bp, Homo sapiens
gtagcccggccagggcctg

SEQ ID NO: 2045115 - DNA, 20 bp, Homo sapiens
gtagcctccgtttatgggcc

SEQ ID NO: 2045116 - DNA, 23 bp, Homo sapiens
gtagccttgcccggattctggga

SEQ ID NO: 2045117 - DNA, 22 bp, Homo sapiens
gtagccttgccttttaaaagaa

SEQ ID NO: 2045118 - DNA, 13 bp, Homo sapiens
gtagcgagctgct

SEQ ID NO: 2045119 - DNA, 16 bp, Homo sapiens
gtagctcctctgctgc

SEQ ID NO: 2045120 - DNA, 16 bp, Homo sapiens
gtagctgagaggaaga

SEQ ID NO: 2045121 - DNA, 21 bp, Homo sapiens
gtagctgagctcacaaggcag

SEQ ID NO: 2045122 - DNA, 21 bp, Homo sapiens
gtagctgggactacaggcacc

SEQ ID NO: 2045123 - DNA, 20 bp, Homo sapiens
gtagctgtgacctgctgagc

SEQ ID NO: 2045124 - DNA, 16 bp, Homo sapiens
gtagctttatccttag

SEQ ID NO: 2045125 - DNA, 15 bp, Homo sapiens
gtaggaatcctttga

SEQ ID NO: 2045126 - DNA, 15 bp, Homo sapiens
gtaggaccaatgttg

SEQ ID NO: 2045127 - DNA, 16 bp, Homo sapiens
gtaggaccaatgttgt

SEQ ID NO: 2045128 - DNA, 14 bp, Homo sapiens
gtaggagcaagaga

SEQ ID NO: 2045129 - DNA, 15 bp, Homo sapiens
gtaggcagagccttt

SEQ ID NO: 2045130 - DNA, 18 bp, Homo sapiens
gtaggcagggaaccttaa

SEQ ID NO: 2045131 - DNA, 22 bp, Homo sapiens
gtaggcccttgtcctgccagct

SEQ ID NO: 2045132 - DNA, 21 bp, Homo sapiens
gtagggaagaaaactatcctg

SEQ ID NO: 2045133 - DNA, 20 bp, Homo sapiens
gtagggagctcactcccact

SEQ ID NO: 2045134 - DNA, 22 bp, Homo sapiens
gtagggcgggaggatgttctgg

SEQ ID NO: 2045135 - DNA, 21 bp, Homo sapiens
gtaggggagggtggggcaatg

SEQ ID NO: 2045136 - DNA, 17 bp, Homo sapiens
gtagggtaaggtgcctt

SEQ ID NO: 2045137 - DNA, 16 bp, Homo sapiens
gtaggtgttgaaaatg

SEQ ID NO: 2045138 - DNA, 22 bp, Homo sapiens
gtagtactcctgcaaaatttta

SEQ ID NO: 2045139 - DNA, 20 bp, Homo sapiens
gtagtagccctttctgtgtg

SEQ ID NO: 2045140 - DNA, 14 bp, Homo sapiens
gtagtagtgtcttc

SEQ ID NO: 2045141 - DNA, 17 bp, Homo sapiens
gtagtagttgatgacca

SEQ ID NO: 2045142 - DNA, 12 bp, Homo sapiens
gtagtcccagcc

SEQ ID NO: 2045143 - DNA, 11 bp, Homo sapiens
gtagttaggaa

SEQ ID NO: 2045144 - DNA, 20 bp, Homo sapiens
gtagttaggaaataaaacct

SEQ ID NO: 2045145 - DNA, 22 bp, Homo sapiens
gtagttaggaaataaaaccttt

SEQ ID NO: 2045146 - DNA, 13 bp, Homo sapiens
gtagttccctgaa

SEQ ID NO: 2045147 - DNA, 14 bp, Homo sapiens
gtataaaagacaaa

SEQ ID NO: 2045148 - DNA, 19 bp, Homo sapiens
gtataaaatgcaaaataaa

SEQ ID NO: 2045149 - DNA, 19 bp, Homo sapiens
gtataaacattaaatgtct

SEQ ID NO: 2045150 - DNA, 14 bp, Homo sapiens
gtataaagtcagga

SEQ ID NO: 2045151 - DNA, 17 bp, Homo sapiens
gtataaatatgaaatga

SEQ ID NO: 2045152 - DNA, 13 bp, Homo sapiens
gtataaatgtata

SEQ ID NO: 2045153 - DNA, 14 bp, Homo sapiens
gtataaatgtatat

SEQ ID NO: 2045154 - DNA, 17 bp, Homo sapiens
gtataaatgtatataca

SEQ ID NO: 2045155 - DNA, 21 bp, Homo sapiens
gtataaatgtatatacacata

SEQ ID NO: 2045156 - DNA, 22 bp, Homo sapiens
gtataaatgtatatacacatat

SEQ ID NO: 2045157 - DNA, 13 bp, Homo sapiens
gtataaattgtcg

SEQ ID NO: 2045158 - DNA, 17 bp, Homo sapiens
gtataagtgcacacaga

SEQ ID NO: 2045159 - DNA, 15 bp, Homo sapiens
gtataatatttttaa

SEQ ID NO: 2045160 - DNA, 15 bp, Homo sapiens
gtatacaatatataa

SEQ ID NO: 2045161 - DNA, 18 bp, Homo sapiens
gtatacaatatataaaaa

SEQ ID NO: 2045162 - DNA, 19 bp, Homo sapiens
gtatacaatatataaaaat

SEQ ID NO: 2045163 - DNA, 21 bp, Homo sapiens
gtatacaatatataaaaatat

SEQ ID NO: 2045164 - DNA, 18 bp, Homo sapiens
gtatacacacatatacat

SEQ ID NO: 2045165 - DNA, 14 bp, Homo sapiens
gtataccatacatt

SEQ ID NO: 2045166 - DNA, 16 bp, Homo sapiens
gtatacttttgtttca

SEQ ID NO: 2045167 - DNA, 14 bp, Homo sapiens
gtatagacagcact

SEQ ID NO: 2045168 - DNA, 14 bp, Homo sapiens
gtatagatgcaaga

SEQ ID NO: 2045169 - DNA, 20 bp, Homo sapiens
gtatagctgacatctcctct

SEQ ID NO: 2045170 - DNA, 15 bp, Homo sapiens
gtataggatggattg

SEQ ID NO: 2045171 - DNA, 15 bp, Homo sapiens
gtataggatgtcaga

SEQ ID NO: 2045172 - DNA, 19 bp, Homo sapiens
gtatagtactggcatggta

SEQ ID NO: 2045173 - DNA, 15 bp, Homo sapiens
gtatagtgtaaaata

SEQ ID NO: 2045174 - DNA, 21 bp, Homo sapiens
gtatataatactaaagtgtct

SEQ ID NO: 2045175 - DNA, 13 bp, Homo sapiens
gtatatacacata

SEQ ID NO: 2045176 - DNA, 15 bp, Homo sapiens
gtatatacacatata

SEQ ID NO: 2045177 - DNA, 11 bp, Homo sapiens
gtatatacatt

SEQ ID NO: 2045178 - DNA, 15 bp, Homo sapiens
gtatatactatacaa

SEQ ID NO: 2045179 - DNA, 20 bp, Homo sapiens
gtatatactatacaacaatg

SEQ ID NO: 2045180 - DNA, 15 bp, Homo sapiens
gtatatacttcactc

SEQ ID NO: 2045181 - DNA, 16 bp, Homo sapiens
gtatatacttcactca

SEQ ID NO: 2045182 - DNA, 14 bp, Homo sapiens
gtatatagatgtgc

SEQ ID NO: 2045183 - DNA, 14 bp, Homo sapiens
gtatatagtatatt

SEQ ID NO: 2045184 - DNA, 23 bp, Homo sapiens
gtatatatatatagtaactactt

SEQ ID NO: 2045185 - DNA, 23 bp, Homo sapiens
gtatatatatatatatgtacagt

SEQ ID NO: 2045186 - DNA, 12 bp, Homo sapiens
gtatatatgtgt

SEQ ID NO: 2045187 - DNA, 23 bp, Homo sapiens
gtatatatgtgtatatatacata

SEQ ID NO: 2045188 - DNA, 20 bp, Homo sapiens
gtatatatgtgtgtttaaat

SEQ ID NO: 2045189 - DNA, 14 bp, Homo sapiens
gtatatcagaaaag

SEQ ID NO: 2045190 - DNA, 16 bp, Homo sapiens
gtatatctatatctct

SEQ ID NO: 2045191 - DNA, 17 bp, Homo sapiens
gtatatctggacaagcc

SEQ ID NO: 2045192 - DNA, 21 bp, Homo sapiens
gtatatctggacaagccaact

SEQ ID NO: 2045193 - DNA, 12 bp, Homo sapiens
gtatatgtatat

SEQ ID NO: 2045194 - DNA, 18 bp, Homo sapiens
gtatatgtatatctatat

SEQ ID NO: 2045195 - DNA, 16 bp, Homo sapiens
gtatatgtatgtgtgt

SEQ ID NO: 2045196 - DNA, 16 bp, Homo sapiens
gtatatgtcatttatt

SEQ ID NO: 2045197 - DNA, 15 bp, Homo sapiens
gtatatgtctcaggt

SEQ ID NO: 2045198 - DNA, 18 bp, Homo sapiens
gtatattatggtgtaatg

SEQ ID NO: 2045199 - DNA, 19 bp, Homo sapiens
gtatattatggtgtaatgc

SEQ ID NO: 2045200 - DNA, 15 bp, Homo sapiens
gtatattccaccatt

SEQ ID NO: 2045201 - DNA, 15 bp, Homo sapiens
gtatatttatactct

SEQ ID NO: 2045202 - DNA, 22 bp, Homo sapiens
gtatatttatagtcacaagagc

SEQ ID NO: 2045203 - DNA, 18 bp, Homo sapiens
gtatatttgtgtatgtgt

SEQ ID NO: 2045204 - DNA, 14 bp, Homo sapiens
gtatcaggcacagg

SEQ ID NO: 2045205 - DNA, 17 bp, Homo sapiens
gtatcaggcacaggcag

SEQ ID NO: 2045206 - DNA, 20 bp, Homo sapiens
gtatcaggcacaggcaggaa

SEQ ID NO: 2045207 - DNA, 22 bp, Homo sapiens
gtatcaggtgctgccatccagg

SEQ ID NO: 2045208 - DNA, 13 bp, Homo sapiens
gtatcatcagtgt

SEQ ID NO: 2045209 - DNA, 19 bp, Homo sapiens
gtatccaattatgtgacaa

SEQ ID NO: 2045210 - DNA, 14 bp, Homo sapiens
gtatccactttgca

SEQ ID NO: 2045211 - DNA, 22 bp, Homo sapiens
gtatccagtgatgtgctggagc

SEQ ID NO: 2045212 - DNA, 19 bp, Homo sapiens
gtatcccatgagcctcagc

SEQ ID NO: 2045213 - DNA, 21 bp, Homo sapiens
gtatcccatgagcctcagcat

SEQ ID NO: 2045214 - DNA, 20 bp, Homo sapiens
gtatcccccccctgtatagt

SEQ ID NO: 2045215 - DNA, 18 bp, Homo sapiens
gtatcgctgccttgccat

SEQ ID NO: 2045216 - DNA, 17 bp, Homo sapiens
gtcactgttccttgtca

SEQ ID NO: 2045217 - DNA, 22 bp, Homo sapiens
gtcacttccagtgttggctgtg

SEQ ID NO: 2045218 - DNA, 22 bp, Homo sapiens
gtcagaagcaggttcttgatgt

SEQ ID NO: 2045219 - DNA, 20 bp, Homo sapiens
gtcagacatccatgtttgta

SEQ ID NO: 2045220 - DNA, 20 bp, Homo sapiens
gtcagactgctgggactggc

SEQ ID NO: 2045221 - DNA, 14 bp, Homo sapiens
gtcagactggctgg

SEQ ID NO: 2045222 - DNA, 23 bp, Homo sapiens
gtcagagacagaccccttggctt

SEQ ID NO: 2045223 - DNA, 16 bp, Homo sapiens
gtcagagatgggctga

SEQ ID NO: 2045224 - DNA, 18 bp, Homo sapiens
gtcagagccaggctctgc

SEQ ID NO: 2045225 - DNA, 16 bp, Homo sapiens
gtcagagcctgcagtt

SEQ ID NO: 2045226 - DNA, 13 bp, Homo sapiens
gtcagagctatgt

SEQ ID NO: 2045227 - DNA, 13 bp, Homo sapiens
gtcagaggagaag

SEQ ID NO: 2045228 - DNA, 14 bp, Homo sapiens
gtcagaggagaaga

SEQ ID NO: 2045229 - DNA, 15 bp, Homo sapiens
gtcagaggccctgga

SEQ ID NO: 2045230 - DNA, 19 bp, Homo sapiens
gtcagaggctaagatgaga

SEQ ID NO: 2045231 - DNA, 18 bp, Homo sapiens
gtcagagtaacatgccag

SEQ ID NO: 2045232 - DNA, 18 bp, Homo sapiens
gtcagatgggaagacatg

SEQ ID NO: 2045233 - DNA, 11 bp, Homo sapiens
gtcagccagcc

SEQ ID NO: 2045234 - DNA, 16 bp, Homo sapiens
gtcagccgagccgggc

SEQ ID NO: 2045235 - DNA, 21 bp, Homo sapiens
gtcagccgagccgggcctggg

SEQ ID NO: 2045236 - DNA, 21 bp, Homo sapiens
gtcagcgcaggtttagtttac

SEQ ID NO: 2045237 - DNA, 19 bp, Homo sapiens
gtcagctcccctcggagaa

SEQ ID NO: 2045238 - DNA, 23 bp, Homo sapiens
gtcagctcccctcggagaagagc

SEQ ID NO: 2045239 - DNA, 13 bp, Homo sapiens
gtcagctttcaga

SEQ ID NO: 2045240 - DNA, 14 bp, Homo sapiens
gtcagctttcagag

SEQ ID NO: 2045241 - DNA, 17 bp, Homo sapiens
gtcagctttcagagcca

SEQ ID NO: 2045242 - DNA, 17 bp, Homo sapiens
gtcaggaacagaaggat

SEQ ID NO: 2045243 - DNA, 23 bp, Homo sapiens
gtcaggacccaggccgcctgcca

SEQ ID NO: 2045244 - DNA, 22 bp, Homo sapiens
gtcaggcccttattttcaagaa

SEQ ID NO: 2045245 - DNA, 17 bp, Homo sapiens
gtcaggtggggcagctt

SEQ ID NO: 2045246 - DNA, 18 bp, Homo sapiens
gtcagtctctctctccct

SEQ ID NO: 2045247 - DNA, 18 bp, Homo sapiens
gtcataactaaataaagc

SEQ ID NO: 2045248 - DNA, 22 bp, Homo sapiens
gtcatagaaattacacccaaag

SEQ ID NO: 2045249 - DNA, 15 bp, Homo sapiens
gtcatatattcatgt

SEQ ID NO: 2045250 - DNA, 14 bp, Homo sapiens
gtcatattcttatg

SEQ ID NO: 2045251 - DNA, 16 bp, Homo sapiens
gtcatcactccctgga

SEQ ID NO: 2045252 - DNA, 23 bp, Homo sapiens
gtcatccagaaaatgtgtcagca

SEQ ID NO: 2045253 - DNA, 18 bp, Homo sapiens
gtcatcccgctcctgctg

SEQ ID NO: 2045254 - DNA, 22 bp, Homo sapiens
gtcatcgattcaaactgctcca

SEQ ID NO: 2045255 - DNA, 12 bp, Homo sapiens
gtcatctcaggg

SEQ ID NO: 2045256 - DNA, 20 bp, Homo sapiens
gtcatgaattcttatgctta

SEQ ID NO: 2045257 - DNA, 15 bp, Homo sapiens
gtcatgatctccctg

SEQ ID NO: 2045258 - DNA, 16 bp, Homo sapiens
gtcatgatctccctgc

SEQ ID NO: 2045259 - DNA, 17 bp, Homo sapiens
gtcatgatctccctgcc

SEQ ID NO: 2045260 - DNA, 20 bp, Homo sapiens
gtcatgatctccctgccgcc

SEQ ID NO: 2045261 - DNA, 22 bp, Homo sapiens
gtcatgatctccctgccgcctc

SEQ ID NO: 2045262 - DNA, 24 bp, Homo sapiens
gtcatgatggatggaaatatgttc

SEQ ID NO: 2045263 - DNA, 17 bp, Homo sapiens
gtcatgcttcagttgta

SEQ ID NO: 2045264 - DNA, 13 bp, Homo sapiens
gtcatgcttttgc

SEQ ID NO: 2045265 - DNA, 14 bp, Homo sapiens
gtcatggaaaagcc

SEQ ID NO: 2045266 - DNA, 14 bp, Homo sapiens
gtcatggacagata

SEQ ID NO: 2045267 - DNA, 15 bp, Homo sapiens
gtcatgtaccatcaa

SEQ ID NO: 2045268 - DNA, 12 bp, Homo sapiens
gtcatgtgtgca

SEQ ID NO: 2045269 - DNA, 15 bp, Homo sapiens
gtcatgtgtgcatgt

SEQ ID NO: 2045270 - DNA, 16 bp, Homo sapiens
gtcatgtgtgcatgtg

SEQ ID NO: 2045271 - DNA, 14 bp, Homo sapiens
gtcattaaaataaa

SEQ ID NO: 2045272 - DNA, 14 bp, Homo sapiens
gtcattatgtagaa

SEQ ID NO: 2045273 - DNA, 17 bp, Homo sapiens
gtcatttgagcagggct

SEQ ID NO: 2045274 - DNA, 19 bp, Homo sapiens
gtcatttgagcagggctca

SEQ ID NO: 2045275 - DNA, 19 bp, Homo sapiens
gtccaaatgtgatcaactg

SEQ ID NO: 2045276 - DNA, 20 bp, Homo sapiens
gtccaacctaacccctttcc

SEQ ID NO: 2045277 - DNA, 24 bp, Homo sapiens
gtccaagcataccaacacgagcag

SEQ ID NO: 2045278 - DNA, 13 bp, Homo sapiens
gtccaagggccat

SEQ ID NO: 2045279 - DNA, 12 bp, Homo sapiens
gtccaatatttg

SEQ ID NO: 2045280 - DNA, 17 bp, Homo sapiens
gtccacaggggcaggcc

SEQ ID NO: 2045281 - DNA, 18 bp, Homo sapiens
gtccacaggggcaggcct

SEQ ID NO: 2045282 - DNA, 23 bp, Homo sapiens
gtccacaggggcaggcctgggac

SEQ ID NO: 2045283 - DNA, 18 bp, Homo sapiens
gtccacagtctcccattc

SEQ ID NO: 2045284 - DNA, 11 bp, Homo sapiens
gtccacccagc

SEQ ID NO: 2045285 - DNA, 13 bp, Homo sapiens
gtccacccaggag

SEQ ID NO: 2045286 - DNA, 15 bp, Homo sapiens
gtccacccaggagcc

SEQ ID NO: 2045287 - DNA, 23 bp, Homo sapiens
gtccacccaggagccccgaggcc

SEQ ID NO: 2045288 - DNA, 13 bp, Homo sapiens
gtccacccaggct

SEQ ID NO: 2045289 - DNA, 14 bp, Homo sapiens
gtccacccaggctg

SEQ ID NO: 2045290 - DNA, 15 bp, Homo sapiens
gtccacccaggctgc

SEQ ID NO: 2045291 - DNA, 17 bp, Homo sapiens
gtccactctcggggccc

SEQ ID NO: 2045292 - DNA, 20 bp, Homo sapiens
gtccactctcggggcccttg

SEQ ID NO: 2045293 - DNA, 22 bp, Homo sapiens
gtccagaagaatattcaggact

SEQ ID NO: 2045294 - DNA, 21 bp, Homo sapiens
gtccagaccattgtcttccaa

SEQ ID NO: 2045295 - DNA, 22 bp, Homo sapiens
gtccagacgtcaaccaggaaca

SEQ ID NO: 2045296 - DNA, 15 bp, Homo sapiens
gtccagatgccttcc

SEQ ID NO: 2045297 - DNA, 15 bp, Homo sapiens
gtccagcacagaagg

SEQ ID NO: 2045298 - DNA, 15 bp, Homo sapiens
gtccagcagctgcgg

SEQ ID NO: 2045299 - DNA, 15 bp, Homo sapiens
gtccagccagctcct

SEQ ID NO: 2045300 - DNA, 23 bp, Homo sapiens
gtccagccagctcctgggcagct

SEQ ID NO: 2045301 - DNA, 14 bp, Homo sapiens
gtccagctcttggc

SEQ ID NO: 2045302 - DNA, 16 bp, Homo sapiens
gtccagcttgctcttc

SEQ ID NO: 2045303 - DNA, 17 bp, Homo sapiens
gtccaggaaggcagctg

SEQ ID NO: 2045304 - DNA, 18 bp, Homo sapiens
gtccaggaaggcagctgc

SEQ ID NO: 2045305 - DNA, 20 bp, Homo sapiens
gtccaggaaggcagctgctc

SEQ ID NO: 2045306 - DNA, 13 bp, Homo sapiens
gtccaggacatga

SEQ ID NO: 2045307 - DNA, 11 bp, Homo sapiens
gtccaggccac

SEQ ID NO: 2045308 - DNA, 14 bp, Homo sapiens
gtccaggccactgt

SEQ ID NO: 2045309 - DNA, 18 bp, Homo sapiens
gtccaggccactgtggcc

SEQ ID NO: 2045310 - DNA, 15 bp, Homo sapiens
gtccagggccctgag

SEQ ID NO: 2045311 - DNA, 19 bp, Homo sapiens
gtccagggcgggagtgggg

SEQ ID NO: 2045312 - DNA, 21 bp, Homo sapiens
gtccagggcgggagtgggggc

SEQ ID NO: 2045313 - DNA, 15 bp, Homo sapiens
gtccaggtcctggtg

SEQ ID NO: 2045314 - DNA, 22 bp, Homo sapiens
gtccaggtcctggtggggcagc

SEQ ID NO: 2045315 - DNA, 20 bp, Homo sapiens
gtccatatcagacctctgat

SEQ ID NO: 2045316 - DNA, 16 bp, Homo sapiens
gtccatattttcacag

SEQ ID NO: 2045317 - DNA, 19 bp, Homo sapiens
gtccatgcctacagataat

SEQ ID NO: 2045318 - DNA, 12 bp, Homo sapiens
gtccatggcacc

SEQ ID NO: 2045319 - DNA, 14 bp, Homo sapiens
gtccatggcaccag

SEQ ID NO: 2045320 - DNA, 21 bp, Homo sapiens
gtccatggcaccagccccctg

SEQ ID NO: 2045321 - DNA, 18 bp, Homo sapiens
gtccatgtattcacacac

SEQ ID NO: 2045322 - DNA, 21 bp, Homo sapiens
gtccatttgggtacgtctggg

SEQ ID NO: 2045323 - DNA, 23 bp, Homo sapiens
gtccatttgggtacgtctgggcc

SEQ ID NO: 2045324 - DNA, 16 bp, Homo sapiens
gtcccaaacagagggc

SEQ ID NO: 2045325 - DNA, 23 bp, Homo sapiens
gtcccaatgcacatccattccca

SEQ ID NO: 2045326 - DNA, 17 bp, Homo sapiens
gtcccacactggtgact

SEQ ID NO: 2045327 - DNA, 13 bp, Homo sapiens
gtcccacatccct

SEQ ID NO: 2045328 - DNA, 18 bp, Homo sapiens
taattgttgattaatttg

SEQ ID NO: 2045329 - DNA, 22 bp, Homo sapiens
taattgttgattaatttgagaa

SEQ ID NO: 2045330 - DNA, 16 bp, Homo sapiens
taattgttgctaatct

SEQ ID NO: 2045331 - DNA, 15 bp, Homo sapiens
taatttaaaaaataa

SEQ ID NO: 2045332 - DNA, 15 bp, Homo sapiens
taatttaaaccagca

SEQ ID NO: 2045333 - DNA, 18 bp, Homo sapiens
taatttaaaccagcagaa

SEQ ID NO: 2045334 - DNA, 20 bp, Homo sapiens
taatttaaaccagcagaaaa

SEQ ID NO: 2045335 - DNA, 16 bp, Homo sapiens
taatttaactaattta

SEQ ID NO: 2045336 - DNA, 18 bp, Homo sapiens
taatttaactaatttaaa

SEQ ID NO: 2045337 - DNA, 14 bp, Homo sapiens
taatttagaaaact

SEQ ID NO: 2045338 - DNA, 14 bp, Homo sapiens
taatttagaaatca

SEQ ID NO: 2045339 - DNA, 22 bp, Homo sapiens
taatttagcagtccaaagaaca

SEQ ID NO: 2045340 - DNA, 17 bp, Homo sapiens
taatttatacaaaataa

SEQ ID NO: 2045341 - DNA, 19 bp, Homo sapiens
taatttatacaaaataatt

SEQ ID NO: 2045342 - DNA, 16 bp, Homo sapiens
taatttatatttgaaa

SEQ ID NO: 2045343 - DNA, 13 bp, Homo sapiens
taatttatggttt

SEQ ID NO: 2045344 - DNA, 10 bp, Homo sapiens
taatttcatc

SEQ ID NO: 2045345 - DNA, 17 bp, Homo sapiens
taatttgggaattgtgt

SEQ ID NO: 2045346 - DNA, 21 bp, Homo sapiens
taatttgtacatatgtaaaat

SEQ ID NO: 2045347 - DNA, 13 bp, Homo sapiens
taatttgtatctg

SEQ ID NO: 2045348 - DNA, 15 bp, Homo sapiens
taatttgttgtactt

SEQ ID NO: 2045349 - DNA, 20 bp, Homo sapiens
taattttattattagattct

SEQ ID NO: 2045350 - DNA, 19 bp, Homo sapiens
taattttcaagagaagaaa

SEQ ID NO: 2045351 - DNA, 15 bp, Homo sapiens
taattttgtagtagt

SEQ ID NO: 2045352 - DNA, 16 bp, Homo sapiens
taatttttacatgacc

SEQ ID NO: 2045353 - DNA, 22 bp, Homo sapiens
taatttttgaaacccattaggc

SEQ ID NO: 2045354 - DNA, 21 bp, Homo sapiens
taattttttaaatgaaaatgt

SEQ ID NO: 2045355 - DNA, 22 bp, Homo sapiens
taattttttttttccttttaaa

SEQ ID NO: 2045356 - DNA, 14 bp, Homo sapiens
tacaaaaacaaaac

SEQ ID NO: 2045357 - DNA, 13 bp, Homo sapiens
tacaaaaacacag

SEQ ID NO: 2045358 - DNA, 15 bp, Homo sapiens
tacaaaaacacagca

SEQ ID NO: 2045359 - DNA, 22 bp, Homo sapiens
tacaaaaattagccgggggtgg

SEQ ID NO: 2045360 - DNA, 17 bp, Homo sapiens
tacaaaagtaccataga

SEQ ID NO: 2045361 - DNA, 20 bp, Homo sapiens
tacaaaataaacaaataaca

SEQ ID NO: 2045362 - DNA, 16 bp, Homo sapiens
tacaaaataatttaac

SEQ ID NO: 2045363 - DNA, 17 bp, Homo sapiens
tacaaaataatttaact

SEQ ID NO: 2045364 - DNA, 11 bp, Homo sapiens
tacaaaatgga

SEQ ID NO: 2045365 - DNA, 12 bp, Homo sapiens
tacaaaatggag

SEQ ID NO: 2045366 - DNA, 17 bp, Homo sapiens
tacaaagcccttttata

SEQ ID NO: 2045367 - DNA, 18 bp, Homo sapiens
tacaaagctgaagaaaat

SEQ ID NO: 2045368 - DNA, 15 bp, Homo sapiens
tacaaagtagagaag

SEQ ID NO: 2045369 - DNA, 13 bp, Homo sapiens
tacaaataaagat

SEQ ID NO: 2045370 - DNA, 19 bp, Homo sapiens
tacaaatatatttaattgt

SEQ ID NO: 2045371 - DNA, 16 bp, Homo sapiens
tacaaattcaaggaga

SEQ ID NO: 2045372 - DNA, 15 bp, Homo sapiens
tacaaatttttcctg

SEQ ID NO: 2045373 - DNA, 19 bp, Homo sapiens
tacaacaagagtttatttc

SEQ ID NO: 2045374 - DNA, 17 bp, Homo sapiens
tacaacacaaagagaaa

SEQ ID NO: 2045375 - DNA, 12 bp, Homo sapiens
tacaaccagagc

SEQ ID NO: 2045376 - DNA, 13 bp, Homo sapiens
tacaaccagagcc

SEQ ID NO: 2045377 - DNA, 14 bp, Homo sapiens
tacaaccagagccc

SEQ ID NO: 2045378 - DNA, 22 bp, Homo sapiens
tacaacctgagccttttcttat

SEQ ID NO: 2045379 - DNA, 19 bp, Homo sapiens
tacaactagatcaaggagc

SEQ ID NO: 2045380 - DNA, 15 bp, Homo sapiens
tacaagaagcatttt

SEQ ID NO: 2045381 - DNA, 16 bp, Homo sapiens
tacaagcgtgagccac

SEQ ID NO: 2045382 - DNA, 22 bp, Homo sapiens
tacaagtagaatggcagctgga

SEQ ID NO: 2045383 - DNA, 21 bp, Homo sapiens
tacaagtgtatatcagaaaag

SEQ ID NO: 2045384 - DNA, 14 bp, Homo sapiens
tacaagttttgtat

SEQ ID NO: 2045385 - DNA, 15 bp, Homo sapiens
tacaataaatattct

SEQ ID NO: 2045386 - DNA, 11 bp, Homo sapiens
tacaataaatg

SEQ ID NO: 2045387 - DNA, 13 bp, Homo sapiens
tacaataaatgct

SEQ ID NO: 2045388 - DNA, 17 bp, Homo sapiens
tacaataaatgctgaat

SEQ ID NO: 2045389 - DNA, 13 bp, Homo sapiens
tacaataacataa

SEQ ID NO: 2045390 - DNA, 16 bp, Homo sapiens
tacaataattctatga

SEQ ID NO: 2045391 - DNA, 12 bp, Homo sapiens
tacaataccaga

SEQ ID NO: 2045392 - DNA, 14 bp, Homo sapiens
tacaatatataaaa

SEQ ID NO: 2045393 - DNA, 13 bp, Homo sapiens
tacaatggccatg

SEQ ID NO: 2045394 - DNA, 19 bp, Homo sapiens
tacaatgttctgttgtaaa

SEQ ID NO: 2045395 - DNA, 18 bp, Homo sapiens
tacaattactaaattgta

SEQ ID NO: 2045396 - DNA, 19 bp, Homo sapiens
tacaattactaaattgtat

SEQ ID NO: 2045397 - DNA, 14 bp, Homo sapiens
tacaattgaactta

SEQ ID NO: 2045398 - DNA, 16 bp, Homo sapiens
tacacaagtaaacatt

SEQ ID NO: 2045399 - DNA, 15 bp, Homo sapiens
tacacaattaattgt

SEQ ID NO: 2045400 - DNA, 11 bp, Homo sapiens
tacacacacac

SEQ ID NO: 2045401 - DNA, 15 bp, Homo sapiens
tacacacacatacac

SEQ ID NO: 2045402 - DNA, 13 bp, Homo sapiens
tacacacatatac

SEQ ID NO: 2045403 - DNA, 21 bp, Homo sapiens
tacacacatatacatatatat

SEQ ID NO: 2045404 - DNA, 19 bp, Homo sapiens
tacacagcagtatgaatga

SEQ ID NO: 2045405 - DNA, 16 bp, Homo sapiens
tacacagcccaagagg

SEQ ID NO: 2045406 - DNA, 23 bp, Homo sapiens
tacacataagaccgtgtcccaag

SEQ ID NO: 2045407 - DNA, 14 bp, Homo sapiens
tacacatacataca

SEQ ID NO: 2045408 - DNA, 18 bp, Homo sapiens
tacacatacatacacata

SEQ ID NO: 2045409 - DNA, 15 bp, Homo sapiens
tacacatacatacat

SEQ ID NO: 2045410 - DNA, 19 bp, Homo sapiens
tacacatacatacatacat

SEQ ID NO: 2045411 - DNA, 13 bp, Homo sapiens
tacacatatacct

SEQ ID NO: 2045412 - DNA, 14 bp, Homo sapiens
tacacatataccta

SEQ ID NO: 2045413 - DNA, 22 bp, Homo sapiens
tacacattctcacaattgtaaa

SEQ ID NO: 2045414 - DNA, 18 bp, Homo sapiens
tacaccacctcactcctg

SEQ ID NO: 2045415 - DNA, 19 bp, Homo sapiens
tacaccacctcactcctgt

SEQ ID NO: 2045416 - DNA, 16 bp, Homo sapiens
tacaccactctggcag

SEQ ID NO: 2045417 - DNA, 20 bp, Homo sapiens
tacaccactctggcagccac

SEQ ID NO: 2045418 - DNA, 24 bp, Homo sapiens
tacaccatgtttgagctcagaccc

SEQ ID NO: 2045419 - DNA, 14 bp, Homo sapiens
tacacccttggact

SEQ ID NO: 2045420 - DNA, 19 bp, Homo sapiens
tacactaacatatttagaa

SEQ ID NO: 2045421 - DNA, 14 bp, Homo sapiens
tacactcctgctgt

SEQ ID NO: 2045422 - DNA, 15 bp, Homo sapiens
tacactcctgctgtg

SEQ ID NO: 2045423 - DNA, 15 bp, Homo sapiens
tacactggatatgtt

SEQ ID NO: 2045424 - DNA, 14 bp, Homo sapiens
tacacttggagccc

SEQ ID NO: 2045425 - DNA, 16 bp, Homo sapiens
tacacttgtataaatg

SEQ ID NO: 2045426 - DNA, 18 bp, Homo sapiens
tacagaaattagccgggc

SEQ ID NO: 2045427 - DNA, 13 bp, Homo sapiens
tacagaatgaatc

SEQ ID NO: 2045428 - DNA, 21 bp, Homo sapiens
tacagaattctgctacctcac

SEQ ID NO: 2045429 - DNA, 11 bp, Homo sapiens
tacagaatttt

SEQ ID NO: 2045430 - DNA, 16 bp, Homo sapiens
tacagaatttttaatg

SEQ ID NO: 2045431 - DNA, 17 bp, Homo sapiens
tacagaatttttaatga

SEQ ID NO: 2045432 - DNA, 18 bp, Homo sapiens
tacagaatttttaatgac

SEQ ID NO: 2045433 - DNA, 20 bp, Homo sapiens
tacagaatttttaatgactt

SEQ ID NO: 2045434 - DNA, 13 bp, Homo sapiens
tacagacgtatgc

SEQ ID NO: 2045435 - DNA, 23 bp, Homo sapiens
tacagagaagtgaataactgcaa

SEQ ID NO: 2045436 - DNA, 19 bp, Homo sapiens
tacagataatttattttgt

SEQ ID NO: 2045437 - DNA, 15 bp, Homo sapiens
tacagatgcacccca

SEQ ID NO: 2045438 - DNA, 13 bp, Homo sapiens
tacagattttaga

SEQ ID NO: 2045439 - DNA, 13 bp, Homo sapiens
tacagcaacagga

SEQ ID NO: 2045440 - DNA, 18 bp, Homo sapiens
tacagcaacaggaatctc

SEQ ID NO: 2045441 - DNA, 23 bp, Homo sapiens
tacagcactccaccttgggacct

SEQ ID NO: 2045442 - DNA, 11 bp, Homo sapiens
tacagcagggt

SEQ ID NO: 2045443 - DNA, 22 bp, Homo sapiens
tacagccaaaaaggaccaactg

SEQ ID NO: 2045444 - DNA, 21 bp, Homo sapiens
tagaagaatacaaacatattt

SEQ ID NO: 2045445 - DNA, 15 bp, Homo sapiens
tagaagagcctgact

SEQ ID NO: 2045446 - DNA, 17 bp, Homo sapiens
tagaagagtcaggaagg

SEQ ID NO: 2045447 - DNA, 19 bp, Homo sapiens
tagaagcgctcatctggct

SEQ ID NO: 2045448 - DNA, 22 bp, Homo sapiens
tagaagcggtttccaggccacc

SEQ ID NO: 2045449 - DNA, 16 bp, Homo sapiens
tagaagctgtagtagc

SEQ ID NO: 2045450 - DNA, 15 bp, Homo sapiens
tagaagtcacacagt

SEQ ID NO: 2045451 - DNA, 14 bp, Homo sapiens
tagaataaatgaag

SEQ ID NO: 2045452 - DNA, 15 bp, Homo sapiens
tagaatataattatc

SEQ ID NO: 2045453 - DNA, 20 bp, Homo sapiens
tagaatatttattacctctg

SEQ ID NO: 2045454 - DNA, 20 bp, Homo sapiens
tagaatgaaaattgtatgtt

SEQ ID NO: 2045455 - DNA, 20 bp, Homo sapiens
tagaatgcatgtaaggtctt

SEQ ID NO: 2045456 - DNA, 18 bp, Homo sapiens
tagaatgtaaagcttgtc

SEQ ID NO: 2045457 - DNA, 18 bp, Homo sapiens
tagaattatatctaattt

SEQ ID NO: 2045458 - DNA, 17 bp, Homo sapiens
tagaattgagtgtttaa

SEQ ID NO: 2045459 - DNA, 19 bp, Homo sapiens
tagaattgagtgtttaaag

SEQ ID NO: 2045460 - DNA, 20 bp, Homo sapiens
tagaatttattcaattcctc

SEQ ID NO: 2045461 - DNA, 23 bp, Homo sapiens
tagaatttgtattttgcttaaaa

SEQ ID NO: 2045462 - DNA, 18 bp, Homo sapiens
tagacaactcttccattt

SEQ ID NO: 2045463 - DNA, 12 bp, Homo sapiens
tagacagaagaa

SEQ ID NO: 2045464 - DNA, 20 bp, Homo sapiens
tagacctcagcctgtgctgc

SEQ ID NO: 2045465 - DNA, 23 bp, Homo sapiens
tagactaggaggttccggtgtct

SEQ ID NO: 2045466 - DNA, 14 bp, Homo sapiens
tagactatatacat

SEQ ID NO: 2045467 - DNA, 23 bp, Homo sapiens
tagactggagtgaggcttccagg

SEQ ID NO: 2045468 - DNA, 17 bp, Homo sapiens
tagacttactttcctat

SEQ ID NO: 2045469 - DNA, 21 bp, Homo sapiens
tagacttcagaacatgctgga

SEQ ID NO: 2045470 - DNA, 18 bp, Homo sapiens
tagacttcgactcaggat

SEQ ID NO: 2045471 - DNA, 22 bp, Homo sapiens
tagacttcgactcaggatccag

SEQ ID NO: 2045472 - DNA, 15 bp, Homo sapiens
tagactttctcagtg

SEQ ID NO: 2045473 - DNA, 13 bp, Homo sapiens
tagagaaggaccc

SEQ ID NO: 2045474 - DNA, 15 bp, Homo sapiens
tagagacacagagat

SEQ ID NO: 2045475 - DNA, 20 bp, Homo sapiens
tagagaggtagcgagctgct

SEQ ID NO: 2045476 - DNA, 17 bp, Homo sapiens
tagagatgactgagtcc

SEQ ID NO: 2045477 - DNA, 11 bp, Homo sapiens
tagagatgtgt

SEQ ID NO: 2045478 - DNA, 20 bp, Homo sapiens
tagagatgtttttaaaagtt

SEQ ID NO: 2045479 - DNA, 14 bp, Homo sapiens
tagagattaatttg

SEQ ID NO: 2045480 - DNA, 15 bp, Homo sapiens
tagagattaatttgt

SEQ ID NO: 2045481 - DNA, 20 bp, Homo sapiens
tagagcacctagtccagtga

SEQ ID NO: 2045482 - DNA, 14 bp, Homo sapiens
tagagctcctgtcc

SEQ ID NO: 2045483 - DNA, 17 bp, Homo sapiens
tagagctcctgtcccta

SEQ ID NO: 2045484 - DNA, 19 bp, Homo sapiens
tagagctcctgtccctacc

SEQ ID NO: 2045485 - DNA, 23 bp, Homo sapiens
tagagctcctgtccctacccact

SEQ ID NO: 2045486 - DNA, 16 bp, Homo sapiens
tagagctgggaaacag

SEQ ID NO: 2045487 - DNA, 21 bp, Homo sapiens
tagagctgggaaacagggagc

SEQ ID NO: 2045488 - DNA, 17 bp, Homo sapiens
tagaggaaaaaaatgac

SEQ ID NO: 2045489 - DNA, 18 bp, Homo sapiens
tagaggaaaaaaatgact

SEQ ID NO: 2045490 - DNA, 19 bp, Homo sapiens
tagaggcagggaggggact

SEQ ID NO: 2045491 - DNA, 16 bp, Homo sapiens
tagaggcttccttcat

SEQ ID NO: 2045492 - DNA, 17 bp, Homo sapiens
tagagtatgcaagaaga

SEQ ID NO: 2045493 - DNA, 18 bp, Homo sapiens
tagagtatgcaagaagaa

SEQ ID NO: 2045494 - DNA, 13 bp, Homo sapiens
tagagtcagcctt

SEQ ID NO: 2045495 - DNA, 12 bp, Homo sapiens
tagagtttaaca

SEQ ID NO: 2045496 - DNA, 13 bp, Homo sapiens
tagagtttaacac

SEQ ID NO: 2045497 - DNA, 17 bp, Homo sapiens
tagatactgttgatctt

SEQ ID NO: 2045498 - DNA, 20 bp, Homo sapiens
tagatactttgctagccggc

SEQ ID NO: 2045499 - DNA, 14 bp, Homo sapiens
tagatagttaaaag

SEQ ID NO: 2045500 - DNA, 17 bp, Homo sapiens
tagatatcacttactca

SEQ ID NO: 2045501 - DNA, 19 bp, Homo sapiens
tagatcaaggagcccagaa

SEQ ID NO: 2045502 - DNA, 16 bp, Homo sapiens
tagatccacacacaga

SEQ ID NO: 2045503 - DNA, 19 bp, Homo sapiens
tagatcccatgtcacctca

SEQ ID NO: 2045504 - DNA, 21 bp, Homo sapiens
tagatcccatgtcacctcagc

SEQ ID NO: 2045505 - DNA, 20 bp, Homo sapiens
tagatcctaggtgctggatg

SEQ ID NO: 2045506 - DNA, 15 bp, Homo sapiens
tagatcgcttgagcc

SEQ ID NO: 2045507 - DNA, 22 bp, Homo sapiens
tagatctcctatttttcagaat

SEQ ID NO: 2045508 - DNA, 20 bp, Homo sapiens
tagatctcctgtaattttgt

SEQ ID NO: 2045509 - DNA, 23 bp, Homo sapiens
tagatctcctgtaattttgtagt

SEQ ID NO: 2045510 - DNA, 13 bp, Homo sapiens
tagatcttctgaa

SEQ ID NO: 2045511 - DNA, 15 bp, Homo sapiens
tagatcttctgaaat

SEQ ID NO: 2045512 - DNA, 18 bp, Homo sapiens
tagatgaatactaaatgg

SEQ ID NO: 2045513 - DNA, 21 bp, Homo sapiens
tagatgagattgttttatcat

SEQ ID NO: 2045514 - DNA, 17 bp, Homo sapiens
tagatgagggtgactgt

SEQ ID NO: 2045515 - DNA, 18 bp, Homo sapiens
tagatggaccagtagaca

SEQ ID NO: 2045516 - DNA, 16 bp, Homo sapiens
tagatgggtctggctg

SEQ ID NO: 2045517 - DNA, 22 bp, Homo sapiens
tagatgggtctggctgagctga

SEQ ID NO: 2045518 - DNA, 23 bp, Homo sapiens
tagattacctgatcatggtcagc

SEQ ID NO: 2045519 - DNA, 15 bp, Homo sapiens
tagattagctctgga

SEQ ID NO: 2045520 - DNA, 15 bp, Homo sapiens
tagattcatctatgg

SEQ ID NO: 2045521 - DNA, 16 bp, Homo sapiens
tagattcatctatgga

SEQ ID NO: 2045522 - DNA, 23 bp, Homo sapiens
tagattcctcttgcctctctcag

SEQ ID NO: 2045523 - DNA, 21 bp, Homo sapiens
tagattgagaagttttgtaca

SEQ ID NO: 2045524 - DNA, 16 bp, Homo sapiens
tagattgttaaaataa

SEQ ID NO: 2045525 - DNA, 19 bp, Homo sapiens
tagattttgtgcagttaat

SEQ ID NO: 2045526 - DNA, 14 bp, Homo sapiens
tagcaaaagaagaa

SEQ ID NO: 2045527 - DNA, 17 bp, Homo sapiens
tagcaaagatatctcat

SEQ ID NO: 2045528 - DNA, 21 bp, Homo sapiens
tagcaatccatgttagttttt

SEQ ID NO: 2045529 - DNA, 13 bp, Homo sapiens
tagcacaagttat

SEQ ID NO: 2045530 - DNA, 14 bp, Homo sapiens
tagcacaatttata

SEQ ID NO: 2045531 - DNA, 20 bp, Homo sapiens
tagcactgggaactctggct

SEQ ID NO: 2045532 - DNA, 22 bp, Homo sapiens
tagcagaagaaaaagttgcagt

SEQ ID NO: 2045533 - DNA, 19 bp, Homo sapiens
tagcagagtcattgttaca

SEQ ID NO: 2045534 - DNA, 18 bp, Homo sapiens
tagcagataaagacagct

SEQ ID NO: 2045535 - DNA, 20 bp, Homo sapiens
tagcagattttaattttgaa

SEQ ID NO: 2045536 - DNA, 17 bp, Homo sapiens
tagcagcaaaaatataa

SEQ ID NO: 2045537 - DNA, 18 bp, Homo sapiens
tagcagcaaaaatataaa

SEQ ID NO: 2045538 - DNA, 19 bp, Homo sapiens
tagcagctcttcccctttc

SEQ ID NO: 2045539 - DNA, 22 bp, Homo sapiens
tagcagctcttcccctttcctg

SEQ ID NO: 2045540 - DNA, 13 bp, Homo sapiens
tagcagctgcagt

SEQ ID NO: 2045541 - DNA, 23 bp, Homo sapiens
tagcagtccaaagaacaagaaat

SEQ ID NO: 2045542 - DNA, 22 bp, Homo sapiens
tagcatcttctggagtctccag

SEQ ID NO: 2045543 - DNA, 19 bp, Homo sapiens
tagcattgaacatttctta

SEQ ID NO: 2045544 - DNA, 13 bp, Homo sapiens
tagcatttcttga

SEQ ID NO: 2045545 - DNA, 16 bp, Homo sapiens
tagcattttcttgaac

SEQ ID NO: 2045546 - DNA, 19 bp, Homo sapiens
tagcattttcttgaaccaa

SEQ ID NO: 2045547 - DNA, 20 bp, Homo sapiens
tagcatttttgatttatgca

SEQ ID NO: 2045548 - DNA, 14 bp, Homo sapiens
tagccaactcctcc

SEQ ID NO: 2045549 - DNA, 19 bp, Homo sapiens
tagccaagttatattgaat

SEQ ID NO: 2045550 - DNA, 21 bp, Homo sapiens
tagccacctcccaccccactc

SEQ ID NO: 2045551 - DNA, 18 bp, Homo sapiens
tagccacttaccttcaat

SEQ ID NO: 2045552 - DNA, 22 bp, Homo sapiens
tagccacttaccttcaataaag

SEQ ID NO: 2045553 - DNA, 13 bp, Homo sapiens
tagccagacacat

SEQ ID NO: 2045554 - DNA, 14 bp, Homo sapiens
tagccagacacatg

SEQ ID NO: 2045555 - DNA, 21 bp, Homo sapiens
tagccagagggtgggagccta

SEQ ID NO: 2045556 - DNA, 20 bp, Homo sapiens
tagccaggagtctgtgctct

SEQ ID NO: 2045557 - DNA, 12 bp, Homo sapiens
tagccagtgact

SEQ ID NO: 2045558 - DNA, 20 bp, Homo sapiens
tataagacaagaatatgttc

SEQ ID NO: 2045559 - DNA, 11 bp, Homo sapiens
tataagatgtc

SEQ ID NO: 2045560 - DNA, 16 bp, Homo sapiens
tataagattagaatga

SEQ ID NO: 2045561 - DNA, 23 bp, Homo sapiens
tataagcaaatttcaaaagacat

SEQ ID NO: 2045562 - DNA, 16 bp, Homo sapiens
tataagtagcaggcca

SEQ ID NO: 2045563 - DNA, 13 bp, Homo sapiens
tataatactaaag

SEQ ID NO: 2045564 - DNA, 20 bp, Homo sapiens
tataatatactatatttatg

SEQ ID NO: 2045565 - DNA, 15 bp, Homo sapiens
tataatatcctttgt

SEQ ID NO: 2045566 - DNA, 14 bp, Homo sapiens
tataatatggaacc

SEQ ID NO: 2045567 - DNA, 22 bp, Homo sapiens
tataatatttttaattaaataa

SEQ ID NO: 2045568 - DNA, 15 bp, Homo sapiens
tataatctatttaca

SEQ ID NO: 2045569 - DNA, 20 bp, Homo sapiens
tataatcttccatacttctt

SEQ ID NO: 2045570 - DNA, 22 bp, Homo sapiens
tataatggaaacatttacaata

SEQ ID NO: 2045571 - DNA, 13 bp, Homo sapiens
tataatgtgtgta

SEQ ID NO: 2045572 - DNA, 17 bp, Homo sapiens
tataatgttgttattta

SEQ ID NO: 2045573 - DNA, 18 bp, Homo sapiens
tataatgttgttatttaa

SEQ ID NO: 2045574 - DNA, 15 bp, Homo sapiens
tataatgtttgctat

SEQ ID NO: 2045575 - DNA, 20 bp, Homo sapiens
tataattaagtaaattacat

SEQ ID NO: 2045576 - DNA, 18 bp, Homo sapiens
tataattgttttatctga

SEQ ID NO: 2045577 - DNA, 15 bp, Homo sapiens
tataatttaacttca

SEQ ID NO: 2045578 - DNA, 11 bp, Homo sapiens
tataatttaat

SEQ ID NO: 2045579 - DNA, 20 bp, Homo sapiens
tataattttgcagcagaagc

SEQ ID NO: 2045580 - DNA, 18 bp, Homo sapiens
tataatttttttcaatat

SEQ ID NO: 2045581 - DNA, 13 bp, Homo sapiens
tatacaaaataat

SEQ ID NO: 2045582 - DNA, 15 bp, Homo sapiens
tatacaaaataattt

SEQ ID NO: 2045583 - DNA, 19 bp, Homo sapiens
tatacaaaataatttaact

SEQ ID NO: 2045584 - DNA, 14 bp, Homo sapiens
tatacaaatatatt

SEQ ID NO: 2045585 - DNA, 14 bp, Homo sapiens
tatacaatgttctg

SEQ ID NO: 2045586 - DNA, 19 bp, Homo sapiens
tatacacaacatttatttc

SEQ ID NO: 2045587 - DNA, 20 bp, Homo sapiens
tatacacaacatttatttca

SEQ ID NO: 2045588 - DNA, 20 bp, Homo sapiens
tatacacacatatacatata

SEQ ID NO: 2045589 - DNA, 21 bp, Homo sapiens
tatacacacatatacatatat

SEQ ID NO: 2045590 - DNA, 13 bp, Homo sapiens
tatacacatacat

SEQ ID NO: 2045591 - DNA, 20 bp, Homo sapiens
tatacacatacatacacata

SEQ ID NO: 2045592 - DNA, 15 bp, Homo sapiens
tatacatacacttgt

SEQ ID NO: 2045593 - DNA, 14 bp, Homo sapiens
tatacatacctctc

SEQ ID NO: 2045594 - DNA, 13 bp, Homo sapiens
tatacatatatat

SEQ ID NO: 2045595 - DNA, 15 bp, Homo sapiens
tatacatatcagaaa

SEQ ID NO: 2045596 - DNA, 16 bp, Homo sapiens
tatacatatgtagact

SEQ ID NO: 2045597 - DNA, 16 bp, Homo sapiens
tatacatattataaat

SEQ ID NO: 2045598 - DNA, 22 bp, Homo sapiens
tatacatattataaataaatgc

SEQ ID NO: 2045599 - DNA, 23 bp, Homo sapiens
tatacatattataaataaatgcc

SEQ ID NO: 2045600 - DNA, 22 bp, Homo sapiens
tatacatcacctttttgacttt

SEQ ID NO: 2045601 - DNA, 16 bp, Homo sapiens
tatacatgtatagtga

SEQ ID NO: 2045602 - DNA, 13 bp, Homo sapiens
tatacatgtgtgt

SEQ ID NO: 2045603 - DNA, 19 bp, Homo sapiens
tatacatgtgtgtatatat

SEQ ID NO: 2045604 - DNA, 18 bp, Homo sapiens
tatacatgtttagtatta

SEQ ID NO: 2045605 - DNA, 13 bp, Homo sapiens
tataccagagacc

SEQ ID NO: 2045606 - DNA, 13 bp, Homo sapiens
tataccatatgtc

SEQ ID NO: 2045607 - DNA, 20 bp, Homo sapiens
tataccatatgtctgcttct

SEQ ID NO: 2045608 - DNA, 22 bp, Homo sapiens
tatactaaaaaatgtctataga

SEQ ID NO: 2045609 - DNA, 16 bp, Homo sapiens
tatactatacaacaat

SEQ ID NO: 2045610 - DNA, 17 bp, Homo sapiens
tatactatacaacaatg

SEQ ID NO: 2045611 - DNA, 17 bp, Homo sapiens
tatacttttttcttatt

SEQ ID NO: 2045612 - DNA, 15 bp, Homo sapiens
tatagaatatttatt

SEQ ID NO: 2045613 - DNA, 11 bp, Homo sapiens
tatagactcta

SEQ ID NO: 2045614 - DNA, 18 bp, Homo sapiens
tatagagagggggctctc

SEQ ID NO: 2045615 - DNA, 23 bp, Homo sapiens
tatagagagggggctctccaaag

SEQ ID NO: 2045616 - DNA, 15 bp, Homo sapiens
tatagagatatgcag

SEQ ID NO: 2045617 - DNA, 21 bp, Homo sapiens
tatagagatatgcagaaggaa

SEQ ID NO: 2045618 - DNA, 19 bp, Homo sapiens
tatagagatatttttgtac

SEQ ID NO: 2045619 - DNA, 21 bp, Homo sapiens
tatagcaatgtaacattaatt

SEQ ID NO: 2045620 - DNA, 19 bp, Homo sapiens
tatagccaaaaatagctaa

SEQ ID NO: 2045621 - DNA, 16 bp, Homo sapiens
tatagctatcatttct

SEQ ID NO: 2045622 - DNA, 12 bp, Homo sapiens
tatagctatttt

SEQ ID NO: 2045623 - DNA, 17 bp, Homo sapiens
tatagctcttctattta

SEQ ID NO: 2045624 - DNA, 22 bp, Homo sapiens
tatagctcttctatttaaaaaa

SEQ ID NO: 2045625 - DNA, 13 bp, Homo sapiens
tataggatggatt

SEQ ID NO: 2045626 - DNA, 23 bp, Homo sapiens
tataggtcacatatgtctgtatc

SEQ ID NO: 2045627 - DNA, 21 bp, Homo sapiens
tataggttactcataaggcat

SEQ ID NO: 2045628 - DNA, 15 bp, Homo sapiens
tataggttgtgcaaa

SEQ ID NO: 2045629 - DNA, 13 bp, Homo sapiens
tatagtatatctg

SEQ ID NO: 2045630 - DNA, 18 bp, Homo sapiens
tatagtatatctggacaa

SEQ ID NO: 2045631 - DNA, 23 bp, Homo sapiens
tatagtatgatttttacaataat

SEQ ID NO: 2045632 - DNA, 20 bp, Homo sapiens
tatagtcccagctactcaga

SEQ ID NO: 2045633 - DNA, 20 bp, Homo sapiens
tatagtgctatatatataaa

SEQ ID NO: 2045634 - DNA, 13 bp, Homo sapiens
tatagtgtaaaat

SEQ ID NO: 2045635 - DNA, 16 bp, Homo sapiens
tatagtttactatttt

SEQ ID NO: 2045636 - DNA, 15 bp, Homo sapiens
tatagtttgtacatg

SEQ ID NO: 2045637 - DNA, 12 bp, Homo sapiens
tatataaaaaga

SEQ ID NO: 2045638 - DNA, 18 bp, Homo sapiens
tatataaaaagaaaagat

SEQ ID NO: 2045639 - DNA, 16 bp, Homo sapiens
tatataactttagaaa

SEQ ID NO: 2045640 - DNA, 18 bp, Homo sapiens
tatataactttagaaata

SEQ ID NO: 2045641 - DNA, 16 bp, Homo sapiens
tatataatactaaagt

SEQ ID NO: 2045642 - DNA, 19 bp, Homo sapiens
tatataatactaaagtgtc

SEQ ID NO: 2045643 - DNA, 14 bp, Homo sapiens
tatataatggttta

SEQ ID NO: 2045644 - DNA, 15 bp, Homo sapiens
tatataatggtttac

SEQ ID NO: 2045645 - DNA, 22 bp, Homo sapiens
tatatacaataacataatttgt

SEQ ID NO: 2045646 - DNA, 13 bp, Homo sapiens
tatatacacatac

SEQ ID NO: 2045647 - DNA, 15 bp, Homo sapiens
tatatacacatacat

SEQ ID NO: 2045648 - DNA, 18 bp, Homo sapiens
tatatacacatataccta

SEQ ID NO: 2045649 - DNA, 14 bp, Homo sapiens
tatatacatatgta

SEQ ID NO: 2045650 - DNA, 15 bp, Homo sapiens
tatatacatatgtag

SEQ ID NO: 2045651 - DNA, 17 bp, Homo sapiens
tatatacatgtatagtg

SEQ ID NO: 2045652 - DNA, 14 bp, Homo sapiens
tatatagatgtgca

SEQ ID NO: 2045653 - DNA, 16 bp, Homo sapiens
tatatagatgtgcaag

SEQ ID NO: 2045654 - DNA, 14 bp, Homo sapiens
tatatagcttgaaa

SEQ ID NO: 2045655 - DNA, 17 bp, Homo sapiens
tatatagtttactattt

SEQ ID NO: 2045656 - DNA, 15 bp, Homo sapiens
tatatatacatgtat

SEQ ID NO: 2045657 - DNA, 19 bp, Homo sapiens
tatatatagtgctatatat

SEQ ID NO: 2045658 - DNA, 14 bp, Homo sapiens
tatatatataaaca

SEQ ID NO: 2045659 - DNA, 14 bp, Homo sapiens
tatatatatatatg

SEQ ID NO: 2045660 - DNA, 16 bp, Homo sapiens
tatatatatatgtata

SEQ ID NO: 2045661 - DNA, 14 bp, Homo sapiens
tatatatatatgtg

SEQ ID NO: 2045662 - DNA, 13 bp, Homo sapiens
tatatatatattt

SEQ ID NO: 2045663 - DNA, 15 bp, Homo sapiens
tatatatatgtatat

SEQ ID NO: 2045664 - DNA, 16 bp, Homo sapiens
tatatatatgtgtgtg

SEQ ID NO: 2045665 - DNA, 15 bp, Homo sapiens
tatatatcagttata

SEQ ID NO: 2045666 - DNA, 20 bp, Homo sapiens
tatatatctatctatttgag

SEQ ID NO: 2045667 - DNA, 18 bp, Homo sapiens
tatatatctgataaaatt

SEQ ID NO: 2045668 - DNA, 19 bp, Homo sapiens
tatatatctgcttcagtgg

SEQ ID NO: 2045669 - DNA, 17 bp, Homo sapiens
tatatatggcatattta

SEQ ID NO: 2045670 - DNA, 23 bp, Homo sapiens
tatatatggcatatttatattgt

SEQ ID NO: 2045671 - DNA, 14 bp, Homo sapiens
tatatatgtacagt

SEQ ID NO: 2045672 - DNA, 19 bp, Homo sapiens
tatatatgtacagttatct

SEQ ID NO: 2045673 - DNA, 20 bp, Homo sapiens
tcaggacttaacggctccag

SEQ ID NO: 2045674 - DNA, 15 bp, Homo sapiens
tcaggacttggtctg

SEQ ID NO: 2045675 - DNA, 12 bp, Homo sapiens
tcaggagcttgc

SEQ ID NO: 2045676 - DNA, 12 bp, Homo sapiens
tcaggaggctga

SEQ ID NO: 2045677 - DNA, 15 bp, Homo sapiens
tcaggaggctgaggg

SEQ ID NO: 2045678 - DNA, 20 bp, Homo sapiens
tcaggagtcccaaggaaagc

SEQ ID NO: 2045679 - DNA, 21 bp, Homo sapiens
tcaggagttcaagaccagcct

SEQ ID NO: 2045680 - DNA, 20 bp, Homo sapiens
tcaggatcaaaccccgacca

SEQ ID NO: 2045681 - DNA, 17 bp, Homo sapiens
tcaggatcaagaaagtg

SEQ ID NO: 2045682 - DNA, 15 bp, Homo sapiens
tcaggcaagcccctc

SEQ ID NO: 2045683 - DNA, 20 bp, Homo sapiens
tcaggcaagcccctcagccc

SEQ ID NO: 2045684 - DNA, 22 bp, Homo sapiens
tcaggcaagcccctcagccctt

SEQ ID NO: 2045685 - DNA, 14 bp, Homo sapiens
tcaggcacaggcag

SEQ ID NO: 2045686 - DNA, 16 bp, Homo sapiens
tcaggcacaggcagga

SEQ ID NO: 2045687 - DNA, 19 bp, Homo sapiens
tcaggcacaggcaggaaga

SEQ ID NO: 2045688 - DNA, 15 bp, Homo sapiens
tcaggcactgagaat

SEQ ID NO: 2045689 - DNA, 14 bp, Homo sapiens
tcaggcactggtgg

SEQ ID NO: 2045690 - DNA, 20 bp, Homo sapiens
tcaggcagacaagagctgct

SEQ ID NO: 2045691 - DNA, 21 bp, Homo sapiens
tcaggcagacaagagctgctg

SEQ ID NO: 2045692 - DNA, 23 bp, Homo sapiens
tcaggcagacaagagctgctgtc

SEQ ID NO: 2045693 - DNA, 20 bp, Homo sapiens
tcaggcagaggatgttctgg

SEQ ID NO: 2045694 - DNA, 23 bp, Homo sapiens
tcaggcagaggatgttctggacc

SEQ ID NO: 2045695 - DNA, 24 bp, Homo sapiens
tcaggcagaggatgttctggacct

SEQ ID NO: 2045696 - DNA, 12 bp, Homo sapiens
tcaggcagcctt

SEQ ID NO: 2045697 - DNA, 15 bp, Homo sapiens
tcaggcagccttcat

SEQ ID NO: 2045698 - DNA, 16 bp, Homo sapiens
tcaggcagccttcata

SEQ ID NO: 2045699 - DNA, 16 bp, Homo sapiens
tcaggcaggtttgcca

SEQ ID NO: 2045700 - DNA, 17 bp, Homo sapiens
tcaggccaggtgcagtg

SEQ ID NO: 2045701 - DNA, 13 bp, Homo sapiens
tcaggccagtgcc

SEQ ID NO: 2045702 - DNA, 16 bp, Homo sapiens
tcaggccagtgccagg

SEQ ID NO: 2045703 - DNA, 21 bp, Homo sapiens
tcaggcccccacctggctcac

SEQ ID NO: 2045704 - DNA, 22 bp, Homo sapiens
tcaggcctataaccccagctcc

SEQ ID NO: 2045705 - DNA, 17 bp, Homo sapiens
tcaggcggggaggagga

SEQ ID NO: 2045706 - DNA, 19 bp, Homo sapiens
tcaggcggggtgctgtggt

SEQ ID NO: 2045707 - DNA, 15 bp, Homo sapiens
tcaggctccattagg

SEQ ID NO: 2045708 - DNA, 13 bp, Homo sapiens
tcaggctgagccc

SEQ ID NO: 2045709 - DNA, 16 bp, Homo sapiens
tcaggctgagcccagc

SEQ ID NO: 2045710 - DNA, 22 bp, Homo sapiens
tcaggctgagcccagccacctc

SEQ ID NO: 2045711 - DNA, 13 bp, Homo sapiens
tcaggctgaggtg

SEQ ID NO: 2045712 - DNA, 14 bp, Homo sapiens
tcaggcttccttgg

SEQ ID NO: 2045713 - DNA, 18 bp, Homo sapiens
tcaggcttgaaatgcatt

SEQ ID NO: 2045714 - DNA, 13 bp, Homo sapiens
tcagggaaatgga

SEQ ID NO: 2045715 - DNA, 20 bp, Homo sapiens
tcagggaaatggagggtggg

SEQ ID NO: 2045716 - DNA, 13 bp, Homo sapiens
tcagggaagcagg

SEQ ID NO: 2045717 - DNA, 17 bp, Homo sapiens
tcagggaagcaggcaga

SEQ ID NO: 2045718 - DNA, 23 bp, Homo sapiens
tcagggccccagcactaaagcag

SEQ ID NO: 2045719 - DNA, 15 bp, Homo sapiens
tcagggtccagaccc

SEQ ID NO: 2045720 - DNA, 23 bp, Homo sapiens
tcagggtgggccactctcccctc

SEQ ID NO: 2045721 - DNA, 19 bp, Homo sapiens
tcagggttggcccctgccc

SEQ ID NO: 2045722 - DNA, 21 bp, Homo sapiens
tcaggtaacaggcagatacag

SEQ ID NO: 2045723 - DNA, 23 bp, Homo sapiens
tcaggtaacaggcagatacagga

SEQ ID NO: 2045724 - DNA, 21 bp, Homo sapiens
tcaggtaggcccttgtcctgc

SEQ ID NO: 2045725 - DNA, 16 bp, Homo sapiens
tcaggtcctcagagaa

SEQ ID NO: 2045726 - DNA, 13 bp, Homo sapiens
tcaggtgaaaatg

SEQ ID NO: 2045727 - DNA, 14 bp, Homo sapiens
tcaggtgaaaatgt

SEQ ID NO: 2045728 - DNA, 18 bp, Homo sapiens
tcaggtgaaaatgttcat

SEQ ID NO: 2045729 - DNA, 16 bp, Homo sapiens
tcaggtgccactccct

SEQ ID NO: 2045730 - DNA, 19 bp, Homo sapiens
tcaggtgcttttgatgtga

SEQ ID NO: 2045731 - DNA, 15 bp, Homo sapiens
tcaggtggggcagct

SEQ ID NO: 2045732 - DNA, 18 bp, Homo sapiens
tcaggtggggcagcttga

SEQ ID NO: 2045733 - DNA, 19 bp, Homo sapiens
tcaggtggggcagcttgag

SEQ ID NO: 2045734 - DNA, 15 bp, Homo sapiens
tcaggtgtccctgca

SEQ ID NO: 2045735 - DNA, 17 bp, Homo sapiens
tcaggtgtccctgcact

SEQ ID NO: 2045736 - DNA, 18 bp, Homo sapiens
tcaggtgtccctgcactt

SEQ ID NO: 2045737 - DNA, 16 bp, Homo sapiens
tcaggttgttaatgtt

SEQ ID NO: 2045738 - DNA, 17 bp, Homo sapiens
tcaggttgttctgtata

SEQ ID NO: 2045739 - DNA, 14 bp, Homo sapiens
tcaggtttcttaaa

SEQ ID NO: 2045740 - DNA, 14 bp, Homo sapiens
tcagtaaataatga

SEQ ID NO: 2045741 - DNA, 15 bp, Homo sapiens
tcagtaatttgagga

SEQ ID NO: 2045742 - DNA, 17 bp, Homo sapiens
tcagtaatttgaggaca

SEQ ID NO: 2045743 - DNA, 18 bp, Homo sapiens
tcagtaatttgaggacaa

SEQ ID NO: 2045744 - DNA, 17 bp, Homo sapiens
tcagtaggtccaagggc

SEQ ID NO: 2045745 - DNA, 20 bp, Homo sapiens
tcagtatgctgttttaataa

SEQ ID NO: 2045746 - DNA, 16 bp, Homo sapiens
tcagtattaatactaa

SEQ ID NO: 2045747 - DNA, 21 bp, Homo sapiens
tcagtattaatactaaaatat

SEQ ID NO: 2045748 - DNA, 13 bp, Homo sapiens
tcagtcagttccc

SEQ ID NO: 2045749 - DNA, 15 bp, Homo sapiens
tcagtcagttcccgg

SEQ ID NO: 2045750 - DNA, 15 bp, Homo sapiens
tcagtcatattctta

SEQ ID NO: 2045751 - DNA, 18 bp, Homo sapiens
tcagtccccgtgaaggag

SEQ ID NO: 2045752 - DNA, 22 bp, Homo sapiens
tcagtccgcctggccggctcca

SEQ ID NO: 2045753 - DNA, 17 bp, Homo sapiens
tcagtctagtgaagatg

SEQ ID NO: 2045754 - DNA, 19 bp, Homo sapiens
tcagtctagtgaagatgtt

SEQ ID NO: 2045755 - DNA, 17 bp, Homo sapiens
tcagtctgattcccaag

SEQ ID NO: 2045756 - DNA, 23 bp, Homo sapiens
tcagtctgattcccaagctctgc

SEQ ID NO: 2045757 - DNA, 15 bp, Homo sapiens
tcagtgacagagttc

SEQ ID NO: 2045758 - DNA, 19 bp, Homo sapiens
tcagtgatacgtacagcca

SEQ ID NO: 2045759 - DNA, 19 bp, Homo sapiens
tcagtgcacacggatgcac

SEQ ID NO: 2045760 - DNA, 17 bp, Homo sapiens
tcagtgccacttgacat

SEQ ID NO: 2045761 - DNA, 13 bp, Homo sapiens
tcagtgcccacca

SEQ ID NO: 2045762 - DNA, 12 bp, Homo sapiens
tcagtgcctcct

SEQ ID NO: 2045763 - DNA, 15 bp, Homo sapiens
tcagtgctcggcagt

SEQ ID NO: 2045764 - DNA, 19 bp, Homo sapiens
tcagtgctgtggcctgggc

SEQ ID NO: 2045765 - DNA, 13 bp, Homo sapiens
tcagtggcagctg

SEQ ID NO: 2045766 - DNA, 23 bp, Homo sapiens
tcagtgggacaaaccagagcaga

SEQ ID NO: 2045767 - DNA, 13 bp, Homo sapiens
tcagtgggagaaa

SEQ ID NO: 2045768 - DNA, 16 bp, Homo sapiens
tcagtgggagaaaaca

SEQ ID NO: 2045769 - DNA, 22 bp, Homo sapiens
tcagtgtagaacctaattcaat

SEQ ID NO: 2045770 - DNA, 13 bp, Homo sapiens
tcagtgtggagag

SEQ ID NO: 2045771 - DNA, 15 bp, Homo sapiens
tcagttactcagccc

SEQ ID NO: 2045772 - DNA, 17 bp, Homo sapiens
tcagttactcagccctg

SEQ ID NO: 2045773 - DNA, 16 bp, Homo sapiens
tcagttactggtttca

SEQ ID NO: 2045774 - DNA, 13 bp, Homo sapiens
tcagttattcaga

SEQ ID NO: 2045775 - DNA, 14 bp, Homo sapiens
tcagttattcagat

SEQ ID NO: 2045776 - DNA, 15 bp, Homo sapiens
tcagttcccggagca

SEQ ID NO: 2045777 - DNA, 17 bp, Homo sapiens
tcagttcctctttgcat

SEQ ID NO: 2045778 - DNA, 20 bp, Homo sapiens
tcagttcctgcccttggcct

SEQ ID NO: 2045779 - DNA, 12 bp, Homo sapiens
tcagttggagaa

SEQ ID NO: 2045780 - DNA, 19 bp, Homo sapiens
tcagttgtacgtaatgtat

SEQ ID NO: 2045781 - DNA, 23 bp, Homo sapiens
tcagtttatccaaggtgtaactc

SEQ ID NO: 2045782 - DNA, 19 bp, Homo sapiens
tcagtttcaattcagtgct

SEQ ID NO: 2045783 - DNA, 12 bp, Homo sapiens
tcagtttcccca

SEQ ID NO: 2045784 - DNA, 10 bp, Homo sapiens
tcagtttctc

SEQ ID NO: 2045785 - DNA, 14 bp, Homo sapiens
tcagtttgtataga

SEQ ID NO: 2045786 - DNA, 17 bp, Homo sapiens
tcagttttatcattttc

SEQ ID NO: 2045787 - DNA, 21 bp, Homo sapiens
tcataaaataaagtatatata

SEQ ID NO: 2045788 - DNA, 16 bp, Homo sapiens
tccattactaaagaca

SEQ ID NO: 2045789 - DNA, 14 bp, Homo sapiens
tccattaggatttg

SEQ ID NO: 2045790 - DNA, 13 bp, Homo sapiens
tccattgctgttg

SEQ ID NO: 2045791 - DNA, 20 bp, Homo sapiens
tccatttagttctttgttat

SEQ ID NO: 2045792 - DNA, 15 bp, Homo sapiens
tccatttcaactcca

SEQ ID NO: 2045793 - DNA, 12 bp, Homo sapiens
tccatttccagt

SEQ ID NO: 2045794 - DNA, 20 bp, Homo sapiens
tccatttccagttcatctat

SEQ ID NO: 2045795 - DNA, 20 bp, Homo sapiens
tccatttcgcccctcattta

SEQ ID NO: 2045796 - DNA, 20 bp, Homo sapiens
tccatttctcaatcagtgca

SEQ ID NO: 2045797 - DNA, 21 bp, Homo sapiens
tccatttctcaatcagtgcag

SEQ ID NO: 2045798 - DNA, 24 bp, Homo sapiens
tccatttctcaatcagtgcagtga

SEQ ID NO: 2045799 - DNA, 12 bp, Homo sapiens
tccatttctggc

SEQ ID NO: 2045800 - DNA, 20 bp, Homo sapiens
tccatttttactaaagcagt

SEQ ID NO: 2045801 - DNA, 15 bp, Homo sapiens
tcccaaaatactaca

SEQ ID NO: 2045802 - DNA, 21 bp, Homo sapiens
tcccaaagtgctgggattaca

SEQ ID NO: 2045803 - DNA, 18 bp, Homo sapiens
tcccaaattccctggacc

SEQ ID NO: 2045804 - DNA, 22 bp, Homo sapiens
tcccaaattccctggacctctg

SEQ ID NO: 2045805 - DNA, 16 bp, Homo sapiens
tcccaaatttcatacc

SEQ ID NO: 2045806 - DNA, 17 bp, Homo sapiens
tcccaacagagctgggc

SEQ ID NO: 2045807 - DNA, 22 bp, Homo sapiens
tcccaaccccagggcccccaca

SEQ ID NO: 2045808 - DNA, 16 bp, Homo sapiens
tcccaacctcaatgcc

SEQ ID NO: 2045809 - DNA, 21 bp, Homo sapiens
tcccaacctcaatgccctgcc

SEQ ID NO: 2045810 - DNA, 23 bp, Homo sapiens
tcccaacctcaatgccctgccat

SEQ ID NO: 2045811 - DNA, 17 bp, Homo sapiens
tcccaactcctataatt

SEQ ID NO: 2045812 - DNA, 16 bp, Homo sapiens
tcccaactgctctgcc

SEQ ID NO: 2045813 - DNA, 13 bp, Homo sapiens
tcccaagagctac

SEQ ID NO: 2045814 - DNA, 12 bp, Homo sapiens
tcccaagctctg

SEQ ID NO: 2045815 - DNA, 13 bp, Homo sapiens
tcccaagctctgc

SEQ ID NO: 2045816 - DNA, 15 bp, Homo sapiens
tcccaagctctgctc

SEQ ID NO: 2045817 - DNA, 22 bp, Homo sapiens
tcccaaggctctgagcaaatgt

SEQ ID NO: 2045818 - DNA, 17 bp, Homo sapiens
tcccaagtgccagtctt

SEQ ID NO: 2045819 - DNA, 13 bp, Homo sapiens
tcccaataaaagt

SEQ ID NO: 2045820 - DNA, 14 bp, Homo sapiens
tcccaataaaagtg

SEQ ID NO: 2045821 - DNA, 15 bp, Homo sapiens
tcccaataaaagtga

SEQ ID NO: 2045822 - DNA, 12 bp, Homo sapiens
tcccaataaagc

SEQ ID NO: 2045823 - DNA, 15 bp, Homo sapiens
tcccaataaagctgg

SEQ ID NO: 2045824 - DNA, 16 bp, Homo sapiens
tcccaataaagctgga

SEQ ID NO: 2045825 - DNA, 13 bp, Homo sapiens
tcccaatcagcac

SEQ ID NO: 2045826 - DNA, 12 bp, Homo sapiens
tcccaattcatt

SEQ ID NO: 2045827 - DNA, 16 bp, Homo sapiens
tcccaattcatttcat

SEQ ID NO: 2045828 - DNA, 18 bp, Homo sapiens
tcccacactggtgactgc

SEQ ID NO: 2045829 - DNA, 23 bp, Homo sapiens
tcccacatccctgggcctgctgc

SEQ ID NO: 2045830 - DNA, 19 bp, Homo sapiens
tcccacattcggaccctgc

SEQ ID NO: 2045831 - DNA, 13 bp, Homo sapiens
tcccaccaactct

SEQ ID NO: 2045832 - DNA, 17 bp, Homo sapiens
tcccaccaactctgcac

SEQ ID NO: 2045833 - DNA, 21 bp, Homo sapiens
tcccaccaactctgcactcca

SEQ ID NO: 2045834 - DNA, 23 bp, Homo sapiens
tcccaccaactctgcactccatg

SEQ ID NO: 2045835 - DNA, 18 bp, Homo sapiens
tcccaccaaggtcttcag

SEQ ID NO: 2045836 - DNA, 21 bp, Homo sapiens
tcccaccaccctcccaccatg

SEQ ID NO: 2045837 - DNA, 22 bp, Homo sapiens
tcccaccaccctcccaccatgc

SEQ ID NO: 2045838 - DNA, 21 bp, Homo sapiens
tcccaccaccttggactcctc

SEQ ID NO: 2045839 - DNA, 20 bp, Homo sapiens
tcccaccagcatgtcactcc

SEQ ID NO: 2045840 - DNA, 16 bp, Homo sapiens
tcccacccaacagctc

SEQ ID NO: 2045841 - DNA, 20 bp, Homo sapiens
tcccacccaacagctcagag

SEQ ID NO: 2045842 - DNA, 23 bp, Homo sapiens
tcccacccaacagctcagagatg

SEQ ID NO: 2045843 - DNA, 22 bp, Homo sapiens
tcccacccacatgtgacacata

SEQ ID NO: 2045844 - DNA, 12 bp, Homo sapiens
tcccaccccacc

SEQ ID NO: 2045845 - DNA, 13 bp, Homo sapiens
tcccaccccaccc

SEQ ID NO: 2045846 - DNA, 13 bp, Homo sapiens
tcccaccccactc

SEQ ID NO: 2045847 - DNA, 16 bp, Homo sapiens
tcccaccccactccag

SEQ ID NO: 2045848 - DNA, 20 bp, Homo sapiens
tcccaccccactccagccct

SEQ ID NO: 2045849 - DNA, 17 bp, Homo sapiens
tcccacccccagccccg

SEQ ID NO: 2045850 - DNA, 12 bp, Homo sapiens
tcccaccgggag

SEQ ID NO: 2045851 - DNA, 18 bp, Homo sapiens
tcccaccgggagcctccc

SEQ ID NO: 2045852 - DNA, 13 bp, Homo sapiens
tcccacctcagcc

SEQ ID NO: 2045853 - DNA, 15 bp, Homo sapiens
tcccacgaatttgct

SEQ ID NO: 2045854 - DNA, 21 bp, Homo sapiens
tcccacgaatttgctggggaa

SEQ ID NO: 2045855 - DNA, 23 bp, Homo sapiens
tcccacgactgttgtacaagctc

SEQ ID NO: 2045856 - DNA, 24 bp, Homo sapiens
tcccacgactgttgtacaagctca

SEQ ID NO: 2045857 - DNA, 14 bp, Homo sapiens
tcccactcagtcca

SEQ ID NO: 2045858 - DNA, 13 bp, Homo sapiens
tcccactggaaca

SEQ ID NO: 2045859 - DNA, 18 bp, Homo sapiens
tcccacttcactgtgagg

SEQ ID NO: 2045860 - DNA, 20 bp, Homo sapiens
tcccagaccacctccctgcc

SEQ ID NO: 2045861 - DNA, 17 bp, Homo sapiens
tcccagactttctacac

SEQ ID NO: 2045862 - DNA, 16 bp, Homo sapiens
tcccagagcaaaataa

SEQ ID NO: 2045863 - DNA, 19 bp, Homo sapiens
tcccagagcttattggcca

SEQ ID NO: 2045864 - DNA, 18 bp, Homo sapiens
tcccagagcttcccagga

SEQ ID NO: 2045865 - DNA, 20 bp, Homo sapiens
tcccagaggttatctgcctg

SEQ ID NO: 2045866 - DNA, 23 bp, Homo sapiens
tcccagaggttatctgcctggcc

SEQ ID NO: 2045867 - DNA, 14 bp, Homo sapiens
tcccagagtcagag

SEQ ID NO: 2045868 - DNA, 19 bp, Homo sapiens
tcccagagtcagaggagaa

SEQ ID NO: 2045869 - DNA, 21 bp, Homo sapiens
tcccagagtcagaggagaaga

SEQ ID NO: 2045870 - DNA, 15 bp, Homo sapiens
tcccagatgctgggg

SEQ ID NO: 2045871 - DNA, 18 bp, Homo sapiens
tcccagcactttgggagg

SEQ ID NO: 2045872 - DNA, 23 bp, Homo sapiens
tcccagcactttgggaggccaag

SEQ ID NO: 2045873 - DNA, 24 bp, Homo sapiens
tcccagcactttgggaggccgagg

SEQ ID NO: 2045874 - DNA, 21 bp, Homo sapiens
tcccagcactttgggaggctg

SEQ ID NO: 2045875 - DNA, 20 bp, Homo sapiens
tcccagcagaagagggaggc

SEQ ID NO: 2045876 - DNA, 21 bp, Homo sapiens
tcccagcagccctaaggatct

SEQ ID NO: 2045877 - DNA, 16 bp, Homo sapiens
tcccagcagctgggcc

SEQ ID NO: 2045878 - DNA, 18 bp, Homo sapiens
tcccagcagctgggccgg

SEQ ID NO: 2045879 - DNA, 21 bp, Homo sapiens
tcccagcagctgggccggcca

SEQ ID NO: 2045880 - DNA, 23 bp, Homo sapiens
tcccagcagctgggccggccagc

SEQ ID NO: 2045881 - DNA, 20 bp, Homo sapiens
tcccagcatgctgagattac

SEQ ID NO: 2045882 - DNA, 20 bp, Homo sapiens
tcccagccactcgggaggct

SEQ ID NO: 2045883 - DNA, 22 bp, Homo sapiens
tcccagccctttgggaggctga

SEQ ID NO: 2045884 - DNA, 10 bp, Homo sapiens
tcccagcctg

SEQ ID NO: 2045885 - DNA, 22 bp, Homo sapiens
tcccagctacacctgaggctga

SEQ ID NO: 2045886 - DNA, 18 bp, Homo sapiens
tcccagctacttgggagg

SEQ ID NO: 2045887 - DNA, 14 bp, Homo sapiens
tcccagctctccct

SEQ ID NO: 2045888 - DNA, 18 bp, Homo sapiens
tcccagctctccctctgg

SEQ ID NO: 2045889 - DNA, 14 bp, Homo sapiens
tcccagctgtctgt

SEQ ID NO: 2045890 - DNA, 22 bp, Homo sapiens
tcccagctgtgctctggacagg

SEQ ID NO: 2045891 - DNA, 23 bp, Homo sapiens
tcccagctgtgctctggacaggc

SEQ ID NO: 2045892 - DNA, 16 bp, Homo sapiens
tcccaggaactgggcc

SEQ ID NO: 2045893 - DNA, 18 bp, Homo sapiens
tcccaggccccatgacct

SEQ ID NO: 2045894 - DNA, 18 bp, Homo sapiens
tcccaggcgccccttccc

SEQ ID NO: 2045895 - DNA, 20 bp, Homo sapiens
tcccagggacaagggaagga

SEQ ID NO: 2045896 - DNA, 16 bp, Homo sapiens
tcccagggcctgtctc

SEQ ID NO: 2045897 - DNA, 21 bp, Homo sapiens
tcccaggtggattttgtggag

SEQ ID NO: 2045898 - DNA, 14 bp, Homo sapiens
tcccaggttggcct

SEQ ID NO: 2045899 - DNA, 19 bp, Homo sapiens
tcccaggttggcctggtgg

SEQ ID NO: 2045900 - DNA, 20 bp, Homo sapiens
tcccagttcaggagtcccaa

SEQ ID NO: 2045901 - DNA, 18 bp, Homo sapiens
tcccagttctacaagcat

SEQ ID NO: 2045902 - DNA, 14 bp, Homo sapiens
tcctagtgaaagag

SEQ ID NO: 2045903 - DNA, 23 bp, Homo sapiens
tcctagtgaaagaggcagcttga

SEQ ID NO: 2045904 - DNA, 21 bp, Homo sapiens
tcctagtttgacctcacagtg

SEQ ID NO: 2045905 - DNA, 20 bp, Homo sapiens
tcctagttttctcctcccag

SEQ ID NO: 2045906 - DNA, 19 bp, Homo sapiens
tcctatccttggagagcag

SEQ ID NO: 2045907 - DNA, 22 bp, Homo sapiens
tcctatccttggagagcagctg

SEQ ID NO: 2045908 - DNA, 15 bp, Homo sapiens
tcctatcgactttat

SEQ ID NO: 2045909 - DNA, 22 bp, Homo sapiens
tcctatctgtatgtctgcctaa

SEQ ID NO: 2045910 - DNA, 17 bp, Homo sapiens
tcctattaaaacacagc

SEQ ID NO: 2045911 - DNA, 15 bp, Homo sapiens
tcctattctcaccag

SEQ ID NO: 2045912 - DNA, 18 bp, Homo sapiens
tcctattctcaccaggaa

SEQ ID NO: 2045913 - DNA, 21 bp, Homo sapiens
tcctatttatgaaaaccatat

SEQ ID NO: 2045914 - DNA, 18 bp, Homo sapiens
tcctatttggggcttgca

SEQ ID NO: 2045915 - DNA, 16 bp, Homo sapiens
tcctatttgttttcat

SEQ ID NO: 2045916 - DNA, 12 bp, Homo sapiens
tcctattttaaa

SEQ ID NO: 2045917 - DNA, 12 bp, Homo sapiens
tcctcacagcct

SEQ ID NO: 2045918 - DNA, 14 bp, Homo sapiens
tcctcacaggagca

SEQ ID NO: 2045919 - DNA, 15 bp, Homo sapiens
tcctcacaggagcag

SEQ ID NO: 2045920 - DNA, 17 bp, Homo sapiens
tcctcacaggagcagac

SEQ ID NO: 2045921 - DNA, 15 bp, Homo sapiens
tcctcaccaataact

SEQ ID NO: 2045922 - DNA, 15 bp, Homo sapiens
tcctcaccatccaca

SEQ ID NO: 2045923 - DNA, 13 bp, Homo sapiens
tcctcacccccag

SEQ ID NO: 2045924 - DNA, 16 bp, Homo sapiens
tcctcacccccagctt

SEQ ID NO: 2045925 - DNA, 20 bp, Homo sapiens
tcctcaccccgtctggggtt

SEQ ID NO: 2045926 - DNA, 15 bp, Homo sapiens
tcctcagactgctca

SEQ ID NO: 2045927 - DNA, 17 bp, Homo sapiens
tcctcagagaatttcta

SEQ ID NO: 2045928 - DNA, 20 bp, Homo sapiens
tcctcagctgccaagcactc

SEQ ID NO: 2045929 - DNA, 24 bp, Homo sapiens
tcctcagggacagagacacctgca

SEQ ID NO: 2045930 - DNA, 16 bp, Homo sapiens
tcctcaggggtggaga

SEQ ID NO: 2045931 - DNA, 17 bp, Homo sapiens
tcctcaggtagtactgg

SEQ ID NO: 2045932 - DNA, 15 bp, Homo sapiens
tcctcagtcctggaa

SEQ ID NO: 2045933 - DNA, 14 bp, Homo sapiens
tcctcatcagtaga

SEQ ID NO: 2045934 - DNA, 22 bp, Homo sapiens
tcctcatcagtagatggtacga

SEQ ID NO: 2045935 - DNA, 23 bp, Homo sapiens
tcctcatcccctcgtcctgtccc

SEQ ID NO: 2045936 - DNA, 14 bp, Homo sapiens
tcctcattcctgaa

SEQ ID NO: 2045937 - DNA, 17 bp, Homo sapiens
tcctccaaactcctgcc

SEQ ID NO: 2045938 - DNA, 19 bp, Homo sapiens
tcctccaacaataaagagc

SEQ ID NO: 2045939 - DNA, 21 bp, Homo sapiens
tcctccaattccacagtctct

SEQ ID NO: 2045940 - DNA, 20 bp, Homo sapiens
tcctccactcactccagccc

SEQ ID NO: 2045941 - DNA, 13 bp, Homo sapiens
tcctccagggcca

SEQ ID NO: 2045942 - DNA, 13 bp, Homo sapiens
tcctccatggtgg

SEQ ID NO: 2045943 - DNA, 15 bp, Homo sapiens
tcctccatggtggaa

SEQ ID NO: 2045944 - DNA, 21 bp, Homo sapiens
tcctccatttcaactccagaa

SEQ ID NO: 2045945 - DNA, 15 bp, Homo sapiens
tcctcccaccaccct

SEQ ID NO: 2045946 - DNA, 22 bp, Homo sapiens
tcctcccaccaccctcccacca

SEQ ID NO: 2045947 - DNA, 21 bp, Homo sapiens
tcctcccacctcagcctcccg

SEQ ID NO: 2045948 - DNA, 13 bp, Homo sapiens
tcctcccaggcgc

SEQ ID NO: 2045949 - DNA, 19 bp, Homo sapiens
tcctcccaggcgccccttc

SEQ ID NO: 2045950 - DNA, 21 bp, Homo sapiens
tcctcccaggcgccccttccc

SEQ ID NO: 2045951 - DNA, 15 bp, Homo sapiens
tcctcccatcccctg

SEQ ID NO: 2045952 - DNA, 19 bp, Homo sapiens
tcctcccatcccctggact

SEQ ID NO: 2045953 - DNA, 19 bp, Homo sapiens
tcctccccaccttccccag

SEQ ID NO: 2045954 - DNA, 17 bp, Homo sapiens
tcctcccctattttaag

SEQ ID NO: 2045955 - DNA, 13 bp, Homo sapiens
tcctccccttcct

SEQ ID NO: 2045956 - DNA, 20 bp, Homo sapiens
tcctccctgttatctgctag

SEQ ID NO: 2045957 - DNA, 12 bp, Homo sapiens
tcctcctccaca

SEQ ID NO: 2045958 - DNA, 13 bp, Homo sapiens
tcctcctccacag

SEQ ID NO: 2045959 - DNA, 20 bp, Homo sapiens
tcctcctgatggccaagagc

SEQ ID NO: 2045960 - DNA, 13 bp, Homo sapiens
tcctcctgccctc

SEQ ID NO: 2045961 - DNA, 16 bp, Homo sapiens
tcctcctgtgtacagg

SEQ ID NO: 2045962 - DNA, 19 bp, Homo sapiens
tcctccttggtgcctggcc

SEQ ID NO: 2045963 - DNA, 20 bp, Homo sapiens
tcctcctttgcctaggaggc

SEQ ID NO: 2045964 - DNA, 16 bp, Homo sapiens
tcctcggatcaccgag

SEQ ID NO: 2045965 - DNA, 15 bp, Homo sapiens
tcctcggccccctcc

SEQ ID NO: 2045966 - DNA, 17 bp, Homo sapiens
tcctcggtactcccata

SEQ ID NO: 2045967 - DNA, 20 bp, Homo sapiens
tcctctaagccactcttcca

SEQ ID NO: 2045968 - DNA, 14 bp, Homo sapiens
tcctctccaattgt

SEQ ID NO: 2045969 - DNA, 16 bp, Homo sapiens
tcctctccactgcctt

SEQ ID NO: 2045970 - DNA, 18 bp, Homo sapiens
tcctctccactgccttcg

SEQ ID NO: 2045971 - DNA, 23 bp, Homo sapiens
tcctctccagccttctctctctg

SEQ ID NO: 2045972 - DNA, 11 bp, Homo sapiens
tcctctccagg

SEQ ID NO: 2045973 - DNA, 20 bp, Homo sapiens
tcctctcccctctgccctgt

SEQ ID NO: 2045974 - DNA, 16 bp, Homo sapiens
tcctctccttgggctc

SEQ ID NO: 2045975 - DNA, 13 bp, Homo sapiens
tcctctcgagccc

SEQ ID NO: 2045976 - DNA, 18 bp, Homo sapiens
tcctctcgagcccagatg

SEQ ID NO: 2045977 - DNA, 22 bp, Homo sapiens
tcctctcgagcccagatggaaa

SEQ ID NO: 2045978 - DNA, 17 bp, Homo sapiens
tcctctctgagactgct

SEQ ID NO: 2045979 - DNA, 13 bp, Homo sapiens
tcctctctgccac

SEQ ID NO: 2045980 - DNA, 15 bp, Homo sapiens
tcctctgattatcag

SEQ ID NO: 2045981 - DNA, 15 bp, Homo sapiens
tcctctgcagcactt

SEQ ID NO: 2045982 - DNA, 18 bp, Homo sapiens
tcctctggcccagcctac

SEQ ID NO: 2045983 - DNA, 13 bp, Homo sapiens
tcctctgtccagg

SEQ ID NO: 2045984 - DNA, 23 bp, Homo sapiens
tcctctgtccagggccctgagct

SEQ ID NO: 2045985 - DNA, 23 bp, Homo sapiens
tcctctgtctcgagcgccctgca

SEQ ID NO: 2045986 - DNA, 13 bp, Homo sapiens
tcctctgtctctg

SEQ ID NO: 2045987 - DNA, 12 bp, Homo sapiens
tcctctgttcta

SEQ ID NO: 2045988 - DNA, 18 bp, Homo sapiens
tcctcttccccttgccct

SEQ ID NO: 2045989 - DNA, 16 bp, Homo sapiens
tcctcttctaactcat

SEQ ID NO: 2045990 - DNA, 19 bp, Homo sapiens
tcctcttgccactgcctct

SEQ ID NO: 2045991 - DNA, 14 bp, Homo sapiens
tcctcttgctcaaa

SEQ ID NO: 2045992 - DNA, 23 bp, Homo sapiens
tcctgaaaaggtttatgaaaaag

SEQ ID NO: 2045993 - DNA, 14 bp, Homo sapiens
tcctgaagccagat

SEQ ID NO: 2045994 - DNA, 19 bp, Homo sapiens
tcctgaagcctctgccctg

SEQ ID NO: 2045995 - DNA, 14 bp, Homo sapiens
tcctgaatgaaata

SEQ ID NO: 2045996 - DNA, 21 bp, Homo sapiens
tcctgaatttattattgttct

SEQ ID NO: 2045997 - DNA, 22 bp, Homo sapiens
tcctgaatttattattgttctt

SEQ ID NO: 2045998 - DNA, 21 bp, Homo sapiens
tcctgacctcctcctgccctc

SEQ ID NO: 2045999 - DNA, 13 bp, Homo sapiens
tcctgacgccctg

SEQ ID NO: 2046000 - DNA, 23 bp, Homo sapiens
tcctgacgccctgcgttggagcc

SEQ ID NO: 2046001 - DNA, 18 bp, Homo sapiens
tcctgactgacacaggcc

SEQ ID NO: 2046002 - DNA, 23 bp, Homo sapiens
tcctgactgacacaggccagccc

SEQ ID NO: 2046003 - DNA, 18 bp, Homo sapiens
tcctgagaaggcgaggag

SEQ ID NO: 2046004 - DNA, 18 bp, Homo sapiens
tcctgagaggtgctgcag

SEQ ID NO: 2046005 - DNA, 16 bp, Homo sapiens
tcctgagcactgccag

SEQ ID NO: 2046006 - DNA, 23 bp, Homo sapiens
tcctgaggagctgttggcctggg

SEQ ID NO: 2046007 - DNA, 17 bp, Homo sapiens
tcctgagggtccccacc

SEQ ID NO: 2046008 - DNA, 17 bp, Homo sapiens
tcctgatactgggtaca

SEQ ID NO: 2046009 - DNA, 15 bp, Homo sapiens
tcctgatggccaaga

SEQ ID NO: 2046010 - DNA, 23 bp, Homo sapiens
tcctgatggtacaggaaagctca

SEQ ID NO: 2046011 - DNA, 13 bp, Homo sapiens
tcctgattcccca

SEQ ID NO: 2046012 - DNA, 18 bp, Homo sapiens
tcctgatttctctgaaca

SEQ ID NO: 2046013 - DNA, 19 bp, Homo sapiens
tcctgatttctctgaacag

SEQ ID NO: 2046014 - DNA, 19 bp, Homo sapiens
tcctgcaaaattttatagc

SEQ ID NO: 2046015 - DNA, 17 bp, Homo sapiens
tcctgcaatctccaggg

SEQ ID NO: 2046016 - DNA, 18 bp, Homo sapiens
tcctgcaatctccagggc

SEQ ID NO: 2046017 - DNA, 22 bp, Homo sapiens
tcgcagcctggcggggcaggag

SEQ ID NO: 2046018 - DNA, 18 bp, Homo sapiens
tcgcaggatccgctgcca

SEQ ID NO: 2046019 - DNA, 21 bp, Homo sapiens
tcgcaggatccgctgccacca

SEQ ID NO: 2046020 - DNA, 22 bp, Homo sapiens
tcgcaggatccgctgccaccac

SEQ ID NO: 2046021 - DNA, 16 bp, Homo sapiens
tcgccacacccggctc

SEQ ID NO: 2046022 - DNA, 20 bp, Homo sapiens
tcgccatcaccccctacccc

SEQ ID NO: 2046023 - DNA, 22 bp, Homo sapiens
tcgcccacaagccttactcacc

SEQ ID NO: 2046024 - DNA, 19 bp, Homo sapiens
tcgcccagtctggaatgca

SEQ ID NO: 2046025 - DNA, 13 bp, Homo sapiens
tcgccccagactc

SEQ ID NO: 2046026 - DNA, 15 bp, Homo sapiens
tcgccgtctgtgaat

SEQ ID NO: 2046027 - DNA, 22 bp, Homo sapiens
tcgccgtgttactgttgcactg

SEQ ID NO: 2046028 - DNA, 18 bp, Homo sapiens
tcgcctgagcccaggagg

SEQ ID NO: 2046029 - DNA, 12 bp, Homo sapiens
tcgcctgccccc

SEQ ID NO: 2046030 - DNA, 14 bp, Homo sapiens
tcgcctgggcccag

SEQ ID NO: 2046031 - DNA, 18 bp, Homo sapiens
tcgcctgtgggaagagaa

SEQ ID NO: 2046032 - DNA, 17 bp, Homo sapiens
tcgccttttaggctcag

SEQ ID NO: 2046033 - DNA, 15 bp, Homo sapiens
tcgctccccactctg

SEQ ID NO: 2046034 - DNA, 20 bp, Homo sapiens
tcgctccccactctgctctg

SEQ ID NO: 2046035 - DNA, 21 bp, Homo sapiens
tcgctccccactctgctctga

SEQ ID NO: 2046036 - DNA, 21 bp, Homo sapiens
tcgctccctgtagctctgcct

SEQ ID NO: 2046037 - DNA, 17 bp, Homo sapiens
tcgctctgctggcctgg

SEQ ID NO: 2046038 - DNA, 12 bp, Homo sapiens
tcgctgccagga

SEQ ID NO: 2046039 - DNA, 14 bp, Homo sapiens
tcgctgccaggaca

SEQ ID NO: 2046040 - DNA, 16 bp, Homo sapiens
tcgctgccaggacacc

SEQ ID NO: 2046041 - DNA, 17 bp, Homo sapiens
tcgctgctctagctggc

SEQ ID NO: 2046042 - DNA, 21 bp, Homo sapiens
tcgctgctctagctggcagga

SEQ ID NO: 2046043 - DNA, 16 bp, Homo sapiens
tcgctgcttcgtggga

SEQ ID NO: 2046044 - DNA, 17 bp, Homo sapiens
tcgctggacaacccaga

SEQ ID NO: 2046045 - DNA, 18 bp, Homo sapiens
tcgctggacaacccagaa

SEQ ID NO: 2046046 - DNA, 17 bp, Homo sapiens
tcgctggcagagaaggc

SEQ ID NO: 2046047 - DNA, 15 bp, Homo sapiens
tcgctgtcctgctgt

SEQ ID NO: 2046048 - DNA, 22 bp, Homo sapiens
tcgctgtgaaaatgaggaggat

SEQ ID NO: 2046049 - DNA, 15 bp, Homo sapiens
tcgcttgagcccagg

SEQ ID NO: 2046050 - DNA, 15 bp, Homo sapiens
tcgcttgcttctgca

SEQ ID NO: 2046051 - DNA, 20 bp, Homo sapiens
tcggaagccgtctgactcca

SEQ ID NO: 2046052 - DNA, 16 bp, Homo sapiens
tcggaagggaaaacag

SEQ ID NO: 2046053 - DNA, 21 bp, Homo sapiens
tcggacccaccaaactgcaca

SEQ ID NO: 2046054 - DNA, 22 bp, Homo sapiens
tcggacccaccaaactgcacac

SEQ ID NO: 2046055 - DNA, 14 bp, Homo sapiens
tcggagaagagctg

SEQ ID NO: 2046056 - DNA, 14 bp, Homo sapiens
tcggagacagtgat

SEQ ID NO: 2046057 - DNA, 20 bp, Homo sapiens
tcggatctggggctctggga

SEQ ID NO: 2046058 - DNA, 12 bp, Homo sapiens
tcggcccacagc

SEQ ID NO: 2046059 - DNA, 15 bp, Homo sapiens
tcgggaacagtgttt

SEQ ID NO: 2046060 - DNA, 19 bp, Homo sapiens
tcgggacacctgccctgcc

SEQ ID NO: 2046061 - DNA, 13 bp, Homo sapiens
tcgggacagagag

SEQ ID NO: 2046062 - DNA, 14 bp, Homo sapiens
tcgggaggctgagg

SEQ ID NO: 2046063 - DNA, 19 bp, Homo sapiens
tcgggaggctgaggcagga

SEQ ID NO: 2046064 - DNA, 15 bp, Homo sapiens
tcgggcgctgtggct

SEQ ID NO: 2046065 - DNA, 17 bp, Homo sapiens
tcgggcgctgtggctcc

SEQ ID NO: 2046066 - DNA, 19 bp, Homo sapiens
tcgggcgctgtggctcctg

SEQ ID NO: 2046067 - DNA, 23 bp, Homo sapiens
tcgggcgctgtggctcctgcctt

SEQ ID NO: 2046068 - DNA, 15 bp, Homo sapiens
tcggggaactcctgg

SEQ ID NO: 2046069 - DNA, 12 bp, Homo sapiens
tcggggccctgt

SEQ ID NO: 2046070 - DNA, 23 bp, Homo sapiens
tcggggcccttggggcctggctt

SEQ ID NO: 2046071 - DNA, 17 bp, Homo sapiens
tcggggcgacccctcag

SEQ ID NO: 2046072 - DNA, 19 bp, Homo sapiens
tcggggtgcacaggagggg

SEQ ID NO: 2046073 - DNA, 22 bp, Homo sapiens
tcggggtgcacaggagggggtc

SEQ ID NO: 2046074 - DNA, 20 bp, Homo sapiens
tcgggtccgattaatttatg

SEQ ID NO: 2046075 - DNA, 21 bp, Homo sapiens
tcggtaagttgaatggcctgc

SEQ ID NO: 2046076 - DNA, 18 bp, Homo sapiens
tcggtgggacagccccag

SEQ ID NO: 2046077 - DNA, 19 bp, Homo sapiens
tcggtgggacagccccagg

SEQ ID NO: 2046078 - DNA, 21 bp, Homo sapiens
tcggtgggacagccccagggc

SEQ ID NO: 2046079 - DNA, 21 bp, Homo sapiens
tcgtcatgttggccaggctgg

SEQ ID NO: 2046080 - DNA, 20 bp, Homo sapiens
tcgtccacaggggcaggcct

SEQ ID NO: 2046081 - DNA, 13 bp, Homo sapiens
tcgtcctccccct

SEQ ID NO: 2046082 - DNA, 18 bp, Homo sapiens
tcgtcctccccctgccag

SEQ ID NO: 2046083 - DNA, 13 bp, Homo sapiens
tcgtcctgtccca

SEQ ID NO: 2046084 - DNA, 16 bp, Homo sapiens
tcgtcctgtcccagag

SEQ ID NO: 2046085 - DNA, 18 bp, Homo sapiens
tcgtgacccttcagggcc

SEQ ID NO: 2046086 - DNA, 17 bp, Homo sapiens
tcgtgcctataaatagt

SEQ ID NO: 2046087 - DNA, 22 bp, Homo sapiens
tcgtgcgcaacaacaaggaccc

SEQ ID NO: 2046088 - DNA, 12 bp, Homo sapiens
tcgtggacacct

SEQ ID NO: 2046089 - DNA, 14 bp, Homo sapiens
tcgtggacacctgc

SEQ ID NO: 2046090 - DNA, 15 bp, Homo sapiens
tcgtggacacctgcc

SEQ ID NO: 2046091 - DNA, 18 bp, Homo sapiens
tcgtggacacctgccctg

SEQ ID NO: 2046092 - DNA, 23 bp, Homo sapiens
tcgtgggagagagacgtgtacat

SEQ ID NO: 2046093 - DNA, 15 bp, Homo sapiens
tcgtgggtgtgtgta

SEQ ID NO: 2046094 - DNA, 22 bp, Homo sapiens
tcgtgggtgtgtgtagccaagg

SEQ ID NO: 2046095 - DNA, 16 bp, Homo sapiens
tcgtggtagaagccag

SEQ ID NO: 2046096 - DNA, 17 bp, Homo sapiens
tcgtggtagaagccagt

SEQ ID NO: 2046097 - DNA, 22 bp, Homo sapiens
tcgtggtgatcaattaaatgta

SEQ ID NO: 2046098 - DNA, 20 bp, Homo sapiens
tcgtgtagtggaagagcagc

SEQ ID NO: 2046099 - DNA, 22 bp, Homo sapiens
tcgtgtagtggaagagcagcct

SEQ ID NO: 2046100 - DNA, 21 bp, Homo sapiens
tcgtgtgatttcctacagaaa

SEQ ID NO: 2046101 - DNA, 13 bp, Homo sapiens
tcgtgtttacaaa

SEQ ID NO: 2046102 - DNA, 15 bp, Homo sapiens
tcgtgtttacaaaag

SEQ ID NO: 2046103 - DNA, 21 bp, Homo sapiens
tcgttcctatacatttctgtt

SEQ ID NO: 2046104 - DNA, 12 bp, Homo sapiens
tcgttgtgaggg

SEQ ID NO: 2046105 - DNA, 18 bp, Homo sapiens
tctaaaaaacagaggcca

SEQ ID NO: 2046106 - DNA, 14 bp, Homo sapiens
tctaaaaacaccaa

SEQ ID NO: 2046107 - DNA, 22 bp, Homo sapiens
tctaaaaataaaccaaaggaca

SEQ ID NO: 2046108 - DNA, 13 bp, Homo sapiens
tctaaaactatgg

SEQ ID NO: 2046109 - DNA, 22 bp, Homo sapiens
tctaaaagaatattcagagaat

SEQ ID NO: 2046110 - DNA, 16 bp, Homo sapiens
tctaaatcttccttgt

SEQ ID NO: 2046111 - DNA, 17 bp, Homo sapiens
tctaaatcttccttgtg

SEQ ID NO: 2046112 - DNA, 16 bp, Homo sapiens
tctaaatgcccagttc

SEQ ID NO: 2046113 - DNA, 21 bp, Homo sapiens
tctaacccccagtgccacaga

SEQ ID NO: 2046114 - DNA, 14 bp, Homo sapiens
tctaacgcctgagc

SEQ ID NO: 2046115 - DNA, 16 bp, Homo sapiens
tctaacgcctgagccc

SEQ ID NO: 2046116 - DNA, 15 bp, Homo sapiens
tctaactacaaggac

SEQ ID NO: 2046117 - DNA, 19 bp, Homo sapiens
tctaactagaaatctgcca

SEQ ID NO: 2046118 - DNA, 17 bp, Homo sapiens
tctaactgtaaatcact

SEQ ID NO: 2046119 - DNA, 23 bp, Homo sapiens
tctaactgtaaatcacttgtaaa

SEQ ID NO: 2046120 - DNA, 15 bp, Homo sapiens
tctaagctgcagctt

SEQ ID NO: 2046121 - DNA, 14 bp, Homo sapiens
tctaagctggagct

SEQ ID NO: 2046122 - DNA, 17 bp, Homo sapiens
tctaagctggagctctt

SEQ ID NO: 2046123 - DNA, 21 bp, Homo sapiens
tctaagctggagctcttggaa

SEQ ID NO: 2046124 - DNA, 14 bp, Homo sapiens
tctaaggttctcat

SEQ ID NO: 2046125 - DNA, 14 bp, Homo sapiens
tctaagtaaaacca

SEQ ID NO: 2046126 - DNA, 15 bp, Homo sapiens
tctaagtaaaaccac

SEQ ID NO: 2046127 - DNA, 23 bp, Homo sapiens
tctaagtaaaaccacagcagttg

SEQ ID NO: 2046128 - DNA, 22 bp, Homo sapiens
tctaagtctccaagaatacaga

SEQ ID NO: 2046129 - DNA, 16 bp, Homo sapiens
tctaagttaatttaaa

SEQ ID NO: 2046130 - DNA, 20 bp, Homo sapiens
tctaagttaatttaaagttg

SEQ ID NO: 2046131 - DNA, 23 bp, Homo sapiens
tctgattggacattttcttcaga

SEQ ID NO: 2046132 - DNA, 16 bp, Homo sapiens
tctgattgtgatgtga

SEQ ID NO: 2046133 - DNA, 12 bp, Homo sapiens
tctgatttaatg

SEQ ID NO: 2046134 - DNA, 17 bp, Homo sapiens
tctgatttaatgttttc

SEQ ID NO: 2046135 - DNA, 13 bp, Homo sapiens
tctgatttcagga

SEQ ID NO: 2046136 - DNA, 21 bp, Homo sapiens
tctgcaaggccctctatttct

SEQ ID NO: 2046137 - DNA, 17 bp, Homo sapiens
tctgcaaggtctttggt

SEQ ID NO: 2046138 - DNA, 16 bp, Homo sapiens
tctgcaatgggcactg

SEQ ID NO: 2046139 - DNA, 21 bp, Homo sapiens
tctgcaatgggcactgggatg

SEQ ID NO: 2046140 - DNA, 18 bp, Homo sapiens
tctgcaatgtcccttgca

SEQ ID NO: 2046141 - DNA, 12 bp, Homo sapiens
tctgcacatgtc

SEQ ID NO: 2046142 - DNA, 13 bp, Homo sapiens
tctgcacccaggg

SEQ ID NO: 2046143 - DNA, 17 bp, Homo sapiens
tctgcactccatggcca

SEQ ID NO: 2046144 - DNA, 16 bp, Homo sapiens
tctgcactgaaaaggt

SEQ ID NO: 2046145 - DNA, 19 bp, Homo sapiens
tctgcagacactgtgggta

SEQ ID NO: 2046146 - DNA, 14 bp, Homo sapiens
tctgcagcaactcc

SEQ ID NO: 2046147 - DNA, 18 bp, Homo sapiens
tctgcagccagcccagcc

SEQ ID NO: 2046148 - DNA, 17 bp, Homo sapiens
tctgcaggcaccttagt

SEQ ID NO: 2046149 - DNA, 22 bp, Homo sapiens
tctgcaggcaccttagtggctt

SEQ ID NO: 2046150 - DNA, 13 bp, Homo sapiens
tctgcataaactt

SEQ ID NO: 2046151 - DNA, 17 bp, Homo sapiens
tctgcataaacttcatc

SEQ ID NO: 2046152 - DNA, 22 bp, Homo sapiens
tctgcattgttattgtggaaga

SEQ ID NO: 2046153 - DNA, 13 bp, Homo sapiens
tctgccaagccct

SEQ ID NO: 2046154 - DNA, 13 bp, Homo sapiens
tctgccagccagc

SEQ ID NO: 2046155 - DNA, 15 bp, Homo sapiens
tctgccagccagcag

SEQ ID NO: 2046156 - DNA, 19 bp, Homo sapiens
tctgccagccagcagccag

SEQ ID NO: 2046157 - DNA, 13 bp, Homo sapiens
tctgccagcccat

SEQ ID NO: 2046158 - DNA, 12 bp, Homo sapiens
tctgccaggccc

SEQ ID NO: 2046159 - DNA, 13 bp, Homo sapiens
tctgccaggccca

SEQ ID NO: 2046160 - DNA, 18 bp, Homo sapiens
tctgccatattctgttgg

SEQ ID NO: 2046161 - DNA, 18 bp, Homo sapiens
tctgcccacattggaccc

SEQ ID NO: 2046162 - DNA, 20 bp, Homo sapiens
tctgccccaagcagccagcc

SEQ ID NO: 2046163 - DNA, 22 bp, Homo sapiens
tctgccccaagcagccagccag

SEQ ID NO: 2046164 - DNA, 14 bp, Homo sapiens
tctgccccaagccc

SEQ ID NO: 2046165 - DNA, 17 bp, Homo sapiens
tctgccccacccaccta

SEQ ID NO: 2046166 - DNA, 13 bp, Homo sapiens
tctgccccaccct

SEQ ID NO: 2046167 - DNA, 14 bp, Homo sapiens
tctgccccagaggc

SEQ ID NO: 2046168 - DNA, 18 bp, Homo sapiens
tctgccccagaggcctct

SEQ ID NO: 2046169 - DNA, 20 bp, Homo sapiens
tctgccccagctctggcttc

SEQ ID NO: 2046170 - DNA, 15 bp, Homo sapiens
tctgccccagcttta

SEQ ID NO: 2046171 - DNA, 20 bp, Homo sapiens
tctgcccccgtcttctctcc

SEQ ID NO: 2046172 - DNA, 17 bp, Homo sapiens
tctgccctccctggcct

SEQ ID NO: 2046173 - DNA, 15 bp, Homo sapiens
tctgccctgcctccc

SEQ ID NO: 2046174 - DNA, 19 bp, Homo sapiens
tctgccctgcctccctttc

SEQ ID NO: 2046175 - DNA, 16 bp, Homo sapiens
tctgcctatttattgg

SEQ ID NO: 2046176 - DNA, 17 bp, Homo sapiens
tctgcctatttattggg

SEQ ID NO: 2046177 - DNA, 15 bp, Homo sapiens
tctgcctcctcttca

SEQ ID NO: 2046178 - DNA, 18 bp, Homo sapiens
tctgcctctgacacacag

SEQ ID NO: 2046179 - DNA, 20 bp, Homo sapiens
tctgcctgaacctggggtca

SEQ ID NO: 2046180 - DNA, 19 bp, Homo sapiens
tctgcctgaagtcacacag

SEQ ID NO: 2046181 - DNA, 21 bp, Homo sapiens
tctgcctgcccaggcccctgc

SEQ ID NO: 2046182 - DNA, 13 bp, Homo sapiens
tctgcctgggcct

SEQ ID NO: 2046183 - DNA, 18 bp, Homo sapiens
tctgcctgggcctgtgca

SEQ ID NO: 2046184 - DNA, 20 bp, Homo sapiens
tctgcctgggcctgtgcagc

SEQ ID NO: 2046185 - DNA, 22 bp, Homo sapiens
tctgcctgggcctgtgcagcag

SEQ ID NO: 2046186 - DNA, 19 bp, Homo sapiens
tctgcctgtggccttgccc

SEQ ID NO: 2046187 - DNA, 21 bp, Homo sapiens
tctgcctgtggccttgcccgc

SEQ ID NO: 2046188 - DNA, 15 bp, Homo sapiens
tctgcctttgtttct

SEQ ID NO: 2046189 - DNA, 19 bp, Homo sapiens
tctgcctttgtttctaaag

SEQ ID NO: 2046190 - DNA, 17 bp, Homo sapiens
tctgcggtggtgccaga

SEQ ID NO: 2046191 - DNA, 20 bp, Homo sapiens
tctgcggtggtgccagaggt

SEQ ID NO: 2046192 - DNA, 17 bp, Homo sapiens
tctgcgtcccccagccc

SEQ ID NO: 2046193 - DNA, 18 bp, Homo sapiens
tctgcgtcccccagccct

SEQ ID NO: 2046194 - DNA, 20 bp, Homo sapiens
tctgcgtcccccagccctca

SEQ ID NO: 2046195 - DNA, 22 bp, Homo sapiens
tctgcgtcccccagccctcagg

SEQ ID NO: 2046196 - DNA, 16 bp, Homo sapiens
tctgcgtgcagggaca

SEQ ID NO: 2046197 - DNA, 22 bp, Homo sapiens
tctgcgtggttcctttctcagc

SEQ ID NO: 2046198 - DNA, 14 bp, Homo sapiens
tctgctaataaaac

SEQ ID NO: 2046199 - DNA, 16 bp, Homo sapiens
tctgctactttgctgc

SEQ ID NO: 2046200 - DNA, 17 bp, Homo sapiens
tctgctcacatatctgt

SEQ ID NO: 2046201 - DNA, 20 bp, Homo sapiens
tctgctcacatatctgtcat

SEQ ID NO: 2046202 - DNA, 17 bp, Homo sapiens
tctgctcagcaggccct

SEQ ID NO: 2046203 - DNA, 14 bp, Homo sapiens
tctgctcctcccat

SEQ ID NO: 2046204 - DNA, 18 bp, Homo sapiens
tctgctcctctccccagc

SEQ ID NO: 2046205 - DNA, 13 bp, Homo sapiens
tctgctctagcca

SEQ ID NO: 2046206 - DNA, 14 bp, Homo sapiens
tctgctctagccag

SEQ ID NO: 2046207 - DNA, 18 bp, Homo sapiens
tctgctctagccaggagt

SEQ ID NO: 2046208 - DNA, 19 bp, Homo sapiens
tctgctctgaggcttccag

SEQ ID NO: 2046209 - DNA, 20 bp, Homo sapiens
tctgctctgaggcttccaga

SEQ ID NO: 2046210 - DNA, 14 bp, Homo sapiens
tctgctctgatgca

SEQ ID NO: 2046211 - DNA, 13 bp, Homo sapiens
tctgctcttgcct

SEQ ID NO: 2046212 - DNA, 16 bp, Homo sapiens
tctgctcttgcctgca

SEQ ID NO: 2046213 - DNA, 17 bp, Homo sapiens
tctgctgacagacacag

SEQ ID NO: 2046214 - DNA, 18 bp, Homo sapiens
tctgctgacagacacagg

SEQ ID NO: 2046215 - DNA, 20 bp, Homo sapiens
tctgctgacagacacaggcc

SEQ ID NO: 2046216 - DNA, 11 bp, Homo sapiens
tctgctgacct

SEQ ID NO: 2046217 - DNA, 19 bp, Homo sapiens
tctgctgcctccctctgct

SEQ ID NO: 2046218 - DNA, 22 bp, Homo sapiens
tctgctggataaaatgaggttc

SEQ ID NO: 2046219 - DNA, 16 bp, Homo sapiens
tctgctggcctggatc

SEQ ID NO: 2046220 - DNA, 17 bp, Homo sapiens
tctgctgttgccatagc

SEQ ID NO: 2046221 - DNA, 18 bp, Homo sapiens
tctgctgttgccatagcc

SEQ ID NO: 2046222 - DNA, 21 bp, Homo sapiens
tctgctgttgccatagcccca

SEQ ID NO: 2046223 - DNA, 13 bp, Homo sapiens
tctgcttaccctt

SEQ ID NO: 2046224 - DNA, 16 bp, Homo sapiens
tctgcttacccttcac

SEQ ID NO: 2046225 - DNA, 13 bp, Homo sapiens
tctgcttcagtgg

SEQ ID NO: 2046226 - DNA, 14 bp, Homo sapiens
tctgcttctagtat

SEQ ID NO: 2046227 - DNA, 14 bp, Homo sapiens
tctgcttctccctg

SEQ ID NO: 2046228 - DNA, 17 bp, Homo sapiens
tctgcttctccctggct

SEQ ID NO: 2046229 - DNA, 19 bp, Homo sapiens
tctgcttctccctggctga

SEQ ID NO: 2046230 - DNA, 19 bp, Homo sapiens
tctgcttctgtccaggaca

SEQ ID NO: 2046231 - DNA, 18 bp, Homo sapiens
tctgcttgtattttccat

SEQ ID NO: 2046232 - DNA, 15 bp, Homo sapiens
tctggaaaaaaaata

SEQ ID NO: 2046233 - DNA, 14 bp, Homo sapiens
tctggaaagcaaag

SEQ ID NO: 2046234 - DNA, 13 bp, Homo sapiens
tctggaaatctgt

SEQ ID NO: 2046235 - DNA, 12 bp, Homo sapiens
tctggaaatttt

SEQ ID NO: 2046236 - DNA, 20 bp, Homo sapiens
tctggaagagaggaatgcct

SEQ ID NO: 2046237 - DNA, 17 bp, Homo sapiens
tctggaaggctggctga

SEQ ID NO: 2046238 - DNA, 16 bp, Homo sapiens
tctggaatgtaatcaa

SEQ ID NO: 2046239 - DNA, 23 bp, Homo sapiens
tctggacaagccaacttgtaaat

SEQ ID NO: 2046240 - DNA, 21 bp, Homo sapiens
tctggacaggcatgttctctg

SEQ ID NO: 2046241 - DNA, 23 bp, Homo sapiens
tctggaccaaccctgtttcctga

SEQ ID NO: 2046242 - DNA, 20 bp, Homo sapiens
tctggacctccccctcttgg

SEQ ID NO: 2046243 - DNA, 16 bp, Homo sapiens
tctggactcctctgtc

SEQ ID NO: 2046244 - DNA, 12 bp, Homo sapiens
tctggagcaaga

SEQ ID NO: 2046245 - DNA, 16 bp, Homo sapiens
tctggagcaagagaga

SEQ ID NO: 2046246 - DNA, 18 bp, Homo sapiens
tgaaagtgtaaaatagaa

SEQ ID NO: 2046247 - DNA, 13 bp, Homo sapiens
tgaaataattaaa

SEQ ID NO: 2046248 - DNA, 18 bp, Homo sapiens
tgaaataattaaaaacca

SEQ ID NO: 2046249 - DNA, 19 bp, Homo sapiens
tgaaataattaaaaaccac

SEQ ID NO: 2046250 - DNA, 16 bp, Homo sapiens
tgaaataccagtgtgg

SEQ ID NO: 2046251 - DNA, 16 bp, Homo sapiens
tgaaatatgatgttaa

SEQ ID NO: 2046252 - DNA, 20 bp, Homo sapiens
tgaaatatgatgttaaaaaa

SEQ ID NO: 2046253 - DNA, 18 bp, Homo sapiens
tgaaatatttgcttattt

SEQ ID NO: 2046254 - DNA, 16 bp, Homo sapiens
tgaaatattttacagt

SEQ ID NO: 2046255 - DNA, 14 bp, Homo sapiens
tgaaatcctgcttc

SEQ ID NO: 2046256 - DNA, 22 bp, Homo sapiens
tgaaatcggaagggacttcctc

SEQ ID NO: 2046257 - DNA, 16 bp, Homo sapiens
tgaaatctcagaattc

SEQ ID NO: 2046258 - DNA, 19 bp, Homo sapiens
tgaaatctcagaattcctt

SEQ ID NO: 2046259 - DNA, 15 bp, Homo sapiens
tgaaatgaaagaact

SEQ ID NO: 2046260 - DNA, 20 bp, Homo sapiens
tgaaatgaggtcagagcctg

SEQ ID NO: 2046261 - DNA, 17 bp, Homo sapiens
tgaaatggatacttata

SEQ ID NO: 2046262 - DNA, 18 bp, Homo sapiens
tgaaatgggctttaacaa

SEQ ID NO: 2046263 - DNA, 13 bp, Homo sapiens
tgaaatgtttcac

SEQ ID NO: 2046264 - DNA, 23 bp, Homo sapiens
tgaaattactacaaaatttgaaa

SEQ ID NO: 2046265 - DNA, 18 bp, Homo sapiens
tgaaattatgtatgttta

SEQ ID NO: 2046266 - DNA, 19 bp, Homo sapiens
tgaaattatgtatgtttac

SEQ ID NO: 2046267 - DNA, 16 bp, Homo sapiens
tgaaattgaacctggt

SEQ ID NO: 2046268 - DNA, 12 bp, Homo sapiens
tgaaattgtaaa

SEQ ID NO: 2046269 - DNA, 22 bp, Homo sapiens
tgaaattgtctagcagagcagg

SEQ ID NO: 2046270 - DNA, 18 bp, Homo sapiens
tgaaattgtttaagtgtt

SEQ ID NO: 2046271 - DNA, 15 bp, Homo sapiens
tgaaatttaaaaata

SEQ ID NO: 2046272 - DNA, 20 bp, Homo sapiens
tgaaatttaaaaataaagct

SEQ ID NO: 2046273 - DNA, 21 bp, Homo sapiens
tgaaatttaaaaataaagcta

SEQ ID NO: 2046274 - DNA, 22 bp, Homo sapiens
tgaaatttaatatagctatttt

SEQ ID NO: 2046275 - DNA, 22 bp, Homo sapiens
tgaaatttcagattcccagagc

SEQ ID NO: 2046276 - DNA, 18 bp, Homo sapiens
tgaaatttgtttctgttt

SEQ ID NO: 2046277 - DNA, 17 bp, Homo sapiens
tgaaattttaaactata

SEQ ID NO: 2046278 - DNA, 17 bp, Homo sapiens
tgaaattttctagactt

SEQ ID NO: 2046279 - DNA, 20 bp, Homo sapiens
tgaaattttctagactttct

SEQ ID NO: 2046280 - DNA, 21 bp, Homo sapiens
tgaaattttctagactttctg

SEQ ID NO: 2046281 - DNA, 17 bp, Homo sapiens
tgaacaaacactgaatc

SEQ ID NO: 2046282 - DNA, 23 bp, Homo sapiens
tgaacaaacactgaatcatgtta

SEQ ID NO: 2046283 - DNA, 19 bp, Homo sapiens
tgaacaaagaaaaaaatat

SEQ ID NO: 2046284 - DNA, 22 bp, Homo sapiens
tgaacaaagggattctccagga

SEQ ID NO: 2046285 - DNA, 15 bp, Homo sapiens
tgaacaaatggcctt

SEQ ID NO: 2046286 - DNA, 11 bp, Homo sapiens
tgaacaagaat

SEQ ID NO: 2046287 - DNA, 18 bp, Homo sapiens
tgaacaagaattggaagc

SEQ ID NO: 2046288 - DNA, 19 bp, Homo sapiens
tgaacacacatggatgcac

SEQ ID NO: 2046289 - DNA, 23 bp, Homo sapiens
tgaacaccaacttttatttggaa

SEQ ID NO: 2046290 - DNA, 14 bp, Homo sapiens
tgaacactggggga

SEQ ID NO: 2046291 - DNA, 22 bp, Homo sapiens
tgaacactgggggaggggacat

SEQ ID NO: 2046292 - DNA, 13 bp, Homo sapiens
tgaacatctgtgt

SEQ ID NO: 2046293 - DNA, 15 bp, Homo sapiens
tgaacatctgtgtgt

SEQ ID NO: 2046294 - DNA, 20 bp, Homo sapiens
tgaacatttgctttgttttc

SEQ ID NO: 2046295 - DNA, 19 bp, Homo sapiens
tgaaccacatcttgctctg

SEQ ID NO: 2046296 - DNA, 22 bp, Homo sapiens
tgaaccaccacacccagcccac

SEQ ID NO: 2046297 - DNA, 14 bp, Homo sapiens
tgaaccactttgcc

SEQ ID NO: 2046298 - DNA, 16 bp, Homo sapiens
tgaaccactttgcctc

SEQ ID NO: 2046299 - DNA, 12 bp, Homo sapiens
tgaacccaggag

SEQ ID NO: 2046300 - DNA, 13 bp, Homo sapiens
tgaaccccatggg

SEQ ID NO: 2046301 - DNA, 19 bp, Homo sapiens
tgaaccccatgggcttgga

SEQ ID NO: 2046302 - DNA, 17 bp, Homo sapiens
tgaacccttgtgcttgg

SEQ ID NO: 2046303 - DNA, 12 bp, Homo sapiens
tgaacctggagg

SEQ ID NO: 2046304 - DNA, 22 bp, Homo sapiens
tgaacctgggaaccatgaagct

SEQ ID NO: 2046305 - DNA, 21 bp, Homo sapiens
tgaaccttggtaaattgtaaa

SEQ ID NO: 2046306 - DNA, 18 bp, Homo sapiens
tgaacctttaaagtaaag

SEQ ID NO: 2046307 - DNA, 15 bp, Homo sapiens
tgaacggggagaaaa

SEQ ID NO: 2046308 - DNA, 16 bp, Homo sapiens
tgaacggggagaaaag

SEQ ID NO: 2046309 - DNA, 16 bp, Homo sapiens
tgaactaataaaagca

SEQ ID NO: 2046310 - DNA, 17 bp, Homo sapiens
tgaactatttctacaca

SEQ ID NO: 2046311 - DNA, 12 bp, Homo sapiens
tgaactcctggc

SEQ ID NO: 2046312 - DNA, 21 bp, Homo sapiens
tgaactcttaatcaaatagca

SEQ ID NO: 2046313 - DNA, 12 bp, Homo sapiens
tgaactgagcca

SEQ ID NO: 2046314 - DNA, 21 bp, Homo sapiens
tgaactgattcacatctcatt

SEQ ID NO: 2046315 - DNA, 13 bp, Homo sapiens
tgaactgtgacag

SEQ ID NO: 2046316 - DNA, 23 bp, Homo sapiens
tgaacttacacttggagcccgtg

SEQ ID NO: 2046317 - DNA, 18 bp, Homo sapiens
tgaacttgaggacacatg

SEQ ID NO: 2046318 - DNA, 14 bp, Homo sapiens
tgaactttccaaaa

SEQ ID NO: 2046319 - DNA, 22 bp, Homo sapiens
tgaactttctcttcatactttt

SEQ ID NO: 2046320 - DNA, 19 bp, Homo sapiens
tgaagaaaaaatacatttt

SEQ ID NO: 2046321 - DNA, 14 bp, Homo sapiens
tgaagaaaccacag

SEQ ID NO: 2046322 - DNA, 21 bp, Homo sapiens
tgaagaaaccttcagatttgt

SEQ ID NO: 2046323 - DNA, 13 bp, Homo sapiens
tgaagaacagtaa

SEQ ID NO: 2046324 - DNA, 11 bp, Homo sapiens
tgaagaagaga

SEQ ID NO: 2046325 - DNA, 22 bp, Homo sapiens
tgaagaagctaaatcctttact

SEQ ID NO: 2046326 - DNA, 11 bp, Homo sapiens
tgaagaatatt

SEQ ID NO: 2046327 - DNA, 13 bp, Homo sapiens
tgaagaatattgt

SEQ ID NO: 2046328 - DNA, 16 bp, Homo sapiens
tgaagaatcaagaggg

SEQ ID NO: 2046329 - DNA, 22 bp, Homo sapiens
tgaagacaaaccactgtacata

SEQ ID NO: 2046330 - DNA, 23 bp, Homo sapiens
tgaagacaaaccactgtacatat

SEQ ID NO: 2046331 - DNA, 20 bp, Homo sapiens
tgaagaccacatccacacac

SEQ ID NO: 2046332 - DNA, 13 bp, Homo sapiens
tgaagacccagca

SEQ ID NO: 2046333 - DNA, 22 bp, Homo sapiens
tgaagacccagcaggaagccag

SEQ ID NO: 2046334 - DNA, 21 bp, Homo sapiens
tgaagacccagtgtaaagaat

SEQ ID NO: 2046335 - DNA, 20 bp, Homo sapiens
tgaagacctaaatgacctca

SEQ ID NO: 2046336 - DNA, 24 bp, Homo sapiens
tgaagacctccacattaagtggct

SEQ ID NO: 2046337 - DNA, 19 bp, Homo sapiens
tgaagactcattcttctgt

SEQ ID NO: 2046338 - DNA, 15 bp, Homo sapiens
tgaagacttcttggg

SEQ ID NO: 2046339 - DNA, 15 bp, Homo sapiens
tgaagagaagctgag

SEQ ID NO: 2046340 - DNA, 21 bp, Homo sapiens
tgaagagaagctgagaagaag

SEQ ID NO: 2046341 - DNA, 17 bp, Homo sapiens
tgaagagacagttattt

SEQ ID NO: 2046342 - DNA, 17 bp, Homo sapiens
tgaagagatttcaacat

SEQ ID NO: 2046343 - DNA, 13 bp, Homo sapiens
tgaagaggaaggg

SEQ ID NO: 2046344 - DNA, 16 bp, Homo sapiens
tgaagaggtgagagta

SEQ ID NO: 2046345 - DNA, 13 bp, Homo sapiens
tgaagagtagttt

SEQ ID NO: 2046346 - DNA, 23 bp, Homo sapiens
tgaagagtttaactttgggccca

SEQ ID NO: 2046347 - DNA, 20 bp, Homo sapiens
tgaagataggagagatacct

SEQ ID NO: 2046348 - DNA, 19 bp, Homo sapiens
tgaagatcgttagtatcta

SEQ ID NO: 2046349 - DNA, 22 bp, Homo sapiens
tgaagatctaaatagcccttgg

SEQ ID NO: 2046350 - DNA, 21 bp, Homo sapiens
tgaagatctcagataaagtga

SEQ ID NO: 2046351 - DNA, 13 bp, Homo sapiens
tgaagatgtaagg

SEQ ID NO: 2046352 - DNA, 16 bp, Homo sapiens
tgaagatgtctaatag

SEQ ID NO: 2046353 - DNA, 19 bp, Homo sapiens
tgaagattctcctgtgcta

SEQ ID NO: 2046354 - DNA, 15 bp, Homo sapiens
tgaagatttcagagg

SEQ ID NO: 2046355 - DNA, 21 bp, Homo sapiens
tgaagcacagagggctaggga

SEQ ID NO: 2046356 - DNA, 15 bp, Homo sapiens
tgaagcagtgcctcg

SEQ ID NO: 2046357 - DNA, 18 bp, Homo sapiens
tgaagcagtgcctcgagg

SEQ ID NO: 2046358 - DNA, 14 bp, Homo sapiens
tgaagcagttgtgt

SEQ ID NO: 2046359 - DNA, 16 bp, Homo sapiens
tgaagcccaagtgaaa

SEQ ID NO: 2046360 - DNA, 20 bp, Homo sapiens
tgagagaaaaagtgcccctt

SEQ ID NO: 2046361 - DNA, 19 bp, Homo sapiens
tgagagaatgggtttactc

SEQ ID NO: 2046362 - DNA, 18 bp, Homo sapiens
tgagagaattgtatcatt

SEQ ID NO: 2046363 - DNA, 18 bp, Homo sapiens
tgagagacattaactcat

SEQ ID NO: 2046364 - DNA, 12 bp, Homo sapiens
tgagagactttt

SEQ ID NO: 2046365 - DNA, 15 bp, Homo sapiens
tgagagagtgctgag

SEQ ID NO: 2046366 - DNA, 23 bp, Homo sapiens
tgagagagtgctgagaaggacac

SEQ ID NO: 2046367 - DNA, 22 bp, Homo sapiens
tgagagccctgctgtgggagag

SEQ ID NO: 2046368 - DNA, 19 bp, Homo sapiens
tgagagctgctctggaaaa

SEQ ID NO: 2046369 - DNA, 18 bp, Homo sapiens
tgagaggcagacttccct

SEQ ID NO: 2046370 - DNA, 22 bp, Homo sapiens
tgagagggcatgcgcacaaggc

SEQ ID NO: 2046371 - DNA, 18 bp, Homo sapiens
tgagaggggaacagactg

SEQ ID NO: 2046372 - DNA, 17 bp, Homo sapiens
tgagagtatcaggtctc

SEQ ID NO: 2046373 - DNA, 20 bp, Homo sapiens
tgagagtctgaaagacagaa

SEQ ID NO: 2046374 - DNA, 12 bp, Homo sapiens
tgagagtgtgac

SEQ ID NO: 2046375 - DNA, 14 bp, Homo sapiens
tgagagtgtgacca

SEQ ID NO: 2046376 - DNA, 20 bp, Homo sapiens
tgagagttggctcaggcaga

SEQ ID NO: 2046377 - DNA, 21 bp, Homo sapiens
tgagagttggctcaggcagac

SEQ ID NO: 2046378 - DNA, 17 bp, Homo sapiens
tgagataatatctgtga

SEQ ID NO: 2046379 - DNA, 18 bp, Homo sapiens
tgagatctccctccaggg

SEQ ID NO: 2046380 - DNA, 19 bp, Homo sapiens
tgagatctccctccaggga

SEQ ID NO: 2046381 - DNA, 22 bp, Homo sapiens
tgagatgaaaaaaatacatcta

SEQ ID NO: 2046382 - DNA, 14 bp, Homo sapiens
tgagatgatgaaaa

SEQ ID NO: 2046383 - DNA, 18 bp, Homo sapiens
tgagatggagtctcactc

SEQ ID NO: 2046384 - DNA, 15 bp, Homo sapiens
tgagatgtgatgctg

SEQ ID NO: 2046385 - DNA, 13 bp, Homo sapiens
tgagattccctct

SEQ ID NO: 2046386 - DNA, 17 bp, Homo sapiens
tgagattccctctcctc

SEQ ID NO: 2046387 - DNA, 15 bp, Homo sapiens
tgagatttcttttaa

SEQ ID NO: 2046388 - DNA, 14 bp, Homo sapiens
tgagatttgccagc

SEQ ID NO: 2046389 - DNA, 18 bp, Homo sapiens
tgagatttgccagcacag

SEQ ID NO: 2046390 - DNA, 20 bp, Homo sapiens
tgagatttgccagcacaggg

SEQ ID NO: 2046391 - DNA, 22 bp, Homo sapiens
tgagatttgccagcacaggggc

SEQ ID NO: 2046392 - DNA, 12 bp, Homo sapiens
tgagatttgtat

SEQ ID NO: 2046393 - DNA, 14 bp, Homo sapiens
tgagatttgtattt

SEQ ID NO: 2046394 - DNA, 20 bp, Homo sapiens
tgagatttgtatttatatta

SEQ ID NO: 2046395 - DNA, 14 bp, Homo sapiens
tgagattttggtat

SEQ ID NO: 2046396 - DNA, 16 bp, Homo sapiens
tgagcaaatgtggctc

SEQ ID NO: 2046397 - DNA, 18 bp, Homo sapiens
tgagcaaatgtggctcct

SEQ ID NO: 2046398 - DNA, 19 bp, Homo sapiens
tgagcaagatcttgtctcc

SEQ ID NO: 2046399 - DNA, 20 bp, Homo sapiens
tgagcaagatcttgtctcca

SEQ ID NO: 2046400 - DNA, 21 bp, Homo sapiens
tgagcaagatcttgtctccac

SEQ ID NO: 2046401 - DNA, 20 bp, Homo sapiens
tgagcaaggacaacctgccc

SEQ ID NO: 2046402 - DNA, 12 bp, Homo sapiens
tgagcaattcat

SEQ ID NO: 2046403 - DNA, 15 bp, Homo sapiens
tgagcacatctggga

SEQ ID NO: 2046404 - DNA, 21 bp, Homo sapiens
tgagcacatctgggaggctgg

SEQ ID NO: 2046405 - DNA, 17 bp, Homo sapiens
tgagcaccgtcatggct

SEQ ID NO: 2046406 - DNA, 19 bp, Homo sapiens
tgagcaccgtcatggctta

SEQ ID NO: 2046407 - DNA, 12 bp, Homo sapiens
tgagcacctgct

SEQ ID NO: 2046408 - DNA, 20 bp, Homo sapiens
tgagcactaaggtgtgctct

SEQ ID NO: 2046409 - DNA, 23 bp, Homo sapiens
tgagcactaaggtgtgctctgat

SEQ ID NO: 2046410 - DNA, 17 bp, Homo sapiens
tgagcactctactgcaa

SEQ ID NO: 2046411 - DNA, 16 bp, Homo sapiens
tgagcactgccaggag

SEQ ID NO: 2046412 - DNA, 18 bp, Homo sapiens
tgagcactgccaggaggg

SEQ ID NO: 2046413 - DNA, 11 bp, Homo sapiens
tgagcagaccg

SEQ ID NO: 2046414 - DNA, 20 bp, Homo sapiens
tgagcagaggagtccagggc

SEQ ID NO: 2046415 - DNA, 16 bp, Homo sapiens
tgagcagggccgggga

SEQ ID NO: 2046416 - DNA, 20 bp, Homo sapiens
tgagcagggccggggaactg

SEQ ID NO: 2046417 - DNA, 13 bp, Homo sapiens
tgagcagggctca

SEQ ID NO: 2046418 - DNA, 14 bp, Homo sapiens
tgagcagggctcag

SEQ ID NO: 2046419 - DNA, 15 bp, Homo sapiens
tgagcagggctcagc

SEQ ID NO: 2046420 - DNA, 19 bp, Homo sapiens
tgagcagggctcagcgggg

SEQ ID NO: 2046421 - DNA, 22 bp, Homo sapiens
tgagcagggctcagcggggaca

SEQ ID NO: 2046422 - DNA, 23 bp, Homo sapiens
tgagcagggctcagcggggacag

SEQ ID NO: 2046423 - DNA, 16 bp, Homo sapiens
tgagcagtagaagcct

SEQ ID NO: 2046424 - DNA, 18 bp, Homo sapiens
tgagcagtcacactgtta

SEQ ID NO: 2046425 - DNA, 20 bp, Homo sapiens
tgagcattcaggcagcactg

SEQ ID NO: 2046426 - DNA, 18 bp, Homo sapiens
tgagccaaacacactgta

SEQ ID NO: 2046427 - DNA, 19 bp, Homo sapiens
tgagccaagcttcaaccct

SEQ ID NO: 2046428 - DNA, 12 bp, Homo sapiens
tgagccactgca

SEQ ID NO: 2046429 - DNA, 13 bp, Homo sapiens
tgagccactgcac

SEQ ID NO: 2046430 - DNA, 14 bp, Homo sapiens
tgagccactgcacc

SEQ ID NO: 2046431 - DNA, 21 bp, Homo sapiens
tgagccatgatcgagccactg

SEQ ID NO: 2046432 - DNA, 13 bp, Homo sapiens
tgagcccagccac

SEQ ID NO: 2046433 - DNA, 17 bp, Homo sapiens
tgagcccagccacctcc

SEQ ID NO: 2046434 - DNA, 19 bp, Homo sapiens
tgagcccagccacctccca

SEQ ID NO: 2046435 - DNA, 14 bp, Homo sapiens
tgagcccaggagct

SEQ ID NO: 2046436 - DNA, 22 bp, Homo sapiens
tgagcccaggagtttgagacaa

SEQ ID NO: 2046437 - DNA, 14 bp, Homo sapiens
tgagcccaggccgt

SEQ ID NO: 2046438 - DNA, 14 bp, Homo sapiens
tgagcccagggagg

SEQ ID NO: 2046439 - DNA, 20 bp, Homo sapiens
tgagccgagattgcgccact

SEQ ID NO: 2046440 - DNA, 23 bp, Homo sapiens
tgagccgagattgcgccactgca

SEQ ID NO: 2046441 - DNA, 20 bp, Homo sapiens
tgagccgcatcttctccatc

SEQ ID NO: 2046442 - DNA, 15 bp, Homo sapiens
tgagcctagctacct

SEQ ID NO: 2046443 - DNA, 16 bp, Homo sapiens
tgagcctccatttctg

SEQ ID NO: 2046444 - DNA, 22 bp, Homo sapiens
tgagcctgacctttctgagtga

SEQ ID NO: 2046445 - DNA, 19 bp, Homo sapiens
tgagcctgtaatcctcagc

SEQ ID NO: 2046446 - DNA, 15 bp, Homo sapiens
tgagccttgagagaa

SEQ ID NO: 2046447 - DNA, 19 bp, Homo sapiens
tgagcgcagagtaaaataa

SEQ ID NO: 2046448 - DNA, 19 bp, Homo sapiens
tgagctagaagctggagga

SEQ ID NO: 2046449 - DNA, 22 bp, Homo sapiens
tgagctagaagctggaggacta

SEQ ID NO: 2046450 - DNA, 22 bp, Homo sapiens
tgagctcacaaggcagcaaggc

SEQ ID NO: 2046451 - DNA, 17 bp, Homo sapiens
tgagctcagacccccac

SEQ ID NO: 2046452 - DNA, 12 bp, Homo sapiens
tgagctcaggca

SEQ ID NO: 2046453 - DNA, 13 bp, Homo sapiens
tgagctcaggcat

SEQ ID NO: 2046454 - DNA, 15 bp, Homo sapiens
tgagctcaggctgag

SEQ ID NO: 2046455 - DNA, 19 bp, Homo sapiens
tgagctcaggctgagccca

SEQ ID NO: 2046456 - DNA, 15 bp, Homo sapiens
tgagctccccaaaaa

SEQ ID NO: 2046457 - DNA, 18 bp, Homo sapiens
tgagctctgagaggccct

SEQ ID NO: 2046458 - DNA, 19 bp, Homo sapiens
tgagctctgagaggccctg

SEQ ID NO: 2046459 - DNA, 22 bp, Homo sapiens
tgagctctgagaggccctggat

SEQ ID NO: 2046460 - DNA, 23 bp, Homo sapiens
tgagctctgagaggccctggatc

SEQ ID NO: 2046461 - DNA, 17 bp, Homo sapiens
tgagctgagatcgtgcc

SEQ ID NO: 2046462 - DNA, 19 bp, Homo sapiens
tgagctgagatcgtgccgt

SEQ ID NO: 2046463 - DNA, 12 bp, Homo sapiens
tgagctgatgtg

SEQ ID NO: 2046464 - DNA, 12 bp, Homo sapiens
tgagctggggcc

SEQ ID NO: 2046465 - DNA, 19 bp, Homo sapiens
tgagctggggcctggagag

SEQ ID NO: 2046466 - DNA, 20 bp, Homo sapiens
tgagctggggcctggagagg

SEQ ID NO: 2046467 - DNA, 23 bp, Homo sapiens
tgagctggggcctggagaggggc

SEQ ID NO: 2046468 - DNA, 16 bp, Homo sapiens
tgagcttctctgtgaa

SEQ ID NO: 2046469 - DNA, 20 bp, Homo sapiens
tgagcttggcagctgaacta

SEQ ID NO: 2046470 - DNA, 23 bp, Homo sapiens
tgagctttggggacagttggcag

SEQ ID NO: 2046471 - DNA, 17 bp, Homo sapiens
tgagcttttcatggaag

SEQ ID NO: 2046472 - DNA, 17 bp, Homo sapiens
tgaggaaagcacacagt

SEQ ID NO: 2046473 - DNA, 18 bp, Homo sapiens
tgaggaacctcaaactgg

SEQ ID NO: 2046474 - DNA, 19 bp, Homo sapiens
tgcacacacacggatgcac

SEQ ID NO: 2046475 - DNA, 19 bp, Homo sapiens
tgcacacacagatgcacac

SEQ ID NO: 2046476 - DNA, 23 bp, Homo sapiens
tgcacacacagatgcacacacag

SEQ ID NO: 2046477 - DNA, 14 bp, Homo sapiens
tgcacacacagctc

SEQ ID NO: 2046478 - DNA, 15 bp, Homo sapiens
tgcacacacagctcc

SEQ ID NO: 2046479 - DNA, 18 bp, Homo sapiens
tgcacacaccagagccca

SEQ ID NO: 2046480 - DNA, 22 bp, Homo sapiens
tgcacacaccagagcccacctt

SEQ ID NO: 2046481 - DNA, 20 bp, Homo sapiens
tgcacacagaaatatatata

SEQ ID NO: 2046482 - DNA, 23 bp, Homo sapiens
tgcacacagaaatatatatacat

SEQ ID NO: 2046483 - DNA, 22 bp, Homo sapiens
tgcacaccaaaaaaatacttga

SEQ ID NO: 2046484 - DNA, 15 bp, Homo sapiens
tgcacacggatgcac

SEQ ID NO: 2046485 - DNA, 15 bp, Homo sapiens
tgcacacttgtatat

SEQ ID NO: 2046486 - DNA, 19 bp, Homo sapiens
tgcacacttgtatattgaa

SEQ ID NO: 2046487 - DNA, 21 bp, Homo sapiens
tgcacagatatttccatttct

SEQ ID NO: 2046488 - DNA, 14 bp, Homo sapiens
tgcacagcgcgggc

SEQ ID NO: 2046489 - DNA, 23 bp, Homo sapiens
tgcacagcgcgggcggaggcggc

SEQ ID NO: 2046490 - DNA, 12 bp, Homo sapiens
tgcacagctgct

SEQ ID NO: 2046491 - DNA, 13 bp, Homo sapiens
tgcacagctgctt

SEQ ID NO: 2046492 - DNA, 18 bp, Homo sapiens
tgcacagctgcttgtcct

SEQ ID NO: 2046493 - DNA, 13 bp, Homo sapiens
tgcacaggagggg

SEQ ID NO: 2046494 - DNA, 16 bp, Homo sapiens
tgcacaggttttcagc

SEQ ID NO: 2046495 - DNA, 19 bp, Homo sapiens
tgcacagtgcatctcagcc

SEQ ID NO: 2046496 - DNA, 20 bp, Homo sapiens
tgcacagtttagaacagagg

SEQ ID NO: 2046497 - DNA, 15 bp, Homo sapiens
tgcacatatggactc

SEQ ID NO: 2046498 - DNA, 19 bp, Homo sapiens
tgcacatatggactctgca

SEQ ID NO: 2046499 - DNA, 16 bp, Homo sapiens
tgcacatatgggtgct

SEQ ID NO: 2046500 - DNA, 16 bp, Homo sapiens
tgcacatccattccca

SEQ ID NO: 2046501 - DNA, 18 bp, Homo sapiens
tgcacatccattcccaag

SEQ ID NO: 2046502 - DNA, 20 bp, Homo sapiens
tgcacattaggaacagagta

SEQ ID NO: 2046503 - DNA, 21 bp, Homo sapiens
tgcacattaggaacagagtat

SEQ ID NO: 2046504 - DNA, 11 bp, Homo sapiens
tgcacattcct

SEQ ID NO: 2046505 - DNA, 14 bp, Homo sapiens
tgcacattcctggc

SEQ ID NO: 2046506 - DNA, 17 bp, Homo sapiens
tgcacattcctggcccc

SEQ ID NO: 2046507 - DNA, 20 bp, Homo sapiens
tgcacatttatatatatatg

SEQ ID NO: 2046508 - DNA, 22 bp, Homo sapiens
tgcacatttatatatatatgta

SEQ ID NO: 2046509 - DNA, 23 bp, Homo sapiens
tgcaccagagtgaaagggctatg

SEQ ID NO: 2046510 - DNA, 19 bp, Homo sapiens
tgcaccagcccttccctgc

SEQ ID NO: 2046511 - DNA, 17 bp, Homo sapiens
tgcaccagtgccgcctg

SEQ ID NO: 2046512 - DNA, 20 bp, Homo sapiens
tgcacccactcaccagggtc

SEQ ID NO: 2046513 - DNA, 15 bp, Homo sapiens
tgcacccaggggtgg

SEQ ID NO: 2046514 - DNA, 16 bp, Homo sapiens
tgcaccccaacattga

SEQ ID NO: 2046515 - DNA, 14 bp, Homo sapiens
tgcacccctcccca

SEQ ID NO: 2046516 - DNA, 15 bp, Homo sapiens
tgcacccctccccat

SEQ ID NO: 2046517 - DNA, 14 bp, Homo sapiens
tgcaccctccgcct

SEQ ID NO: 2046518 - DNA, 21 bp, Homo sapiens
tgcacctaaagaaaaacaaac

SEQ ID NO: 2046519 - DNA, 17 bp, Homo sapiens
tgcacctccccccactg

SEQ ID NO: 2046520 - DNA, 16 bp, Homo sapiens
tgcacctgccagcctg

SEQ ID NO: 2046521 - DNA, 18 bp, Homo sapiens
tgcacctgccagcctggc

SEQ ID NO: 2046522 - DNA, 20 bp, Homo sapiens
  misc_feature (10)..(10): n is a, c, g or t
tgcacctgcnttgtccctgg

SEQ ID NO: 2046523 - DNA, 16 bp, Homo sapiens
tgcaccttacattcct

SEQ ID NO: 2046524 - DNA, 17 bp, Homo sapiens
tgcaccttacattccta

SEQ ID NO: 2046525 - DNA, 20 bp, Homo sapiens
tgcaccttaccaactttctg

SEQ ID NO: 2046526 - DNA, 18 bp, Homo sapiens
tgcacctttctagttgaa

SEQ ID NO: 2046527 - DNA, 17 bp, Homo sapiens
tgcacgaactggactgt

SEQ ID NO: 2046528 - DNA, 19 bp, Homo sapiens
tgcacgtacacacacatac

SEQ ID NO: 2046529 - DNA, 20 bp, Homo sapiens
tgcacgtgctcttctgttct

SEQ ID NO: 2046530 - DNA, 22 bp, Homo sapiens
tgcacgttctatattgtgccaa

SEQ ID NO: 2046531 - DNA, 13 bp, Homo sapiens
tgcactagcattt

SEQ ID NO: 2046532 - DNA, 17 bp, Homo sapiens
tgcactagcctgtgatt

SEQ ID NO: 2046533 - DNA, 22 bp, Homo sapiens
tgcactatagcctaggtgacag

SEQ ID NO: 2046534 - DNA, 23 bp, Homo sapiens
tgcactatagcctaggtgacaga

SEQ ID NO: 2046535 - DNA, 18 bp, Homo sapiens
tgcactatgaaaatcagt

SEQ ID NO: 2046536 - DNA, 12 bp, Homo sapiens
tgcactccagcc

SEQ ID NO: 2046537 - DNA, 13 bp, Homo sapiens
tgcactccagcct

SEQ ID NO: 2046538 - DNA, 15 bp, Homo sapiens
tgcactccagcctgg

SEQ ID NO: 2046539 - DNA, 19 bp, Homo sapiens
tgcactccagcctgggcga

SEQ ID NO: 2046540 - DNA, 20 bp, Homo sapiens
tgcactccatggccaccccg

SEQ ID NO: 2046541 - DNA, 19 bp, Homo sapiens
tgcactccctaagaaaccc

SEQ ID NO: 2046542 - DNA, 17 bp, Homo sapiens
tgcactctagcctggca

SEQ ID NO: 2046543 - DNA, 15 bp, Homo sapiens
tgcactgacaagatg

SEQ ID NO: 2046544 - DNA, 12 bp, Homo sapiens
tgcactgaccct

SEQ ID NO: 2046545 - DNA, 15 bp, Homo sapiens
tgcactgacccttcc

SEQ ID NO: 2046546 - DNA, 16 bp, Homo sapiens
tgcactgacccttcca

SEQ ID NO: 2046547 - DNA, 17 bp, Homo sapiens
tgcactgacccttccag

SEQ ID NO: 2046548 - DNA, 16 bp, Homo sapiens
tgcactggccacccaa

SEQ ID NO: 2046549 - DNA, 15 bp, Homo sapiens
tgcactggccccacc

SEQ ID NO: 2046550 - DNA, 16 bp, Homo sapiens
tgcactggccccaccc

SEQ ID NO: 2046551 - DNA, 15 bp, Homo sapiens
tgcactgtatgctgg

SEQ ID NO: 2046552 - DNA, 12 bp, Homo sapiens
tgcactgtgaca

SEQ ID NO: 2046553 - DNA, 21 bp, Homo sapiens
tgcacttgcagactctacaga

SEQ ID NO: 2046554 - DNA, 16 bp, Homo sapiens
tgcagaaaagcacctg

SEQ ID NO: 2046555 - DNA, 19 bp, Homo sapiens
tgcagaaaagcacctgccg

SEQ ID NO: 2046556 - DNA, 22 bp, Homo sapiens
tgcagaaaagcacctgccgacc

SEQ ID NO: 2046557 - DNA, 23 bp, Homo sapiens
tgcagaaggaagggcatccttct

SEQ ID NO: 2046558 - DNA, 13 bp, Homo sapiens
tgcagacaggcaa

SEQ ID NO: 2046559 - DNA, 14 bp, Homo sapiens
tgcagactcactgt

SEQ ID NO: 2046560 - DNA, 15 bp, Homo sapiens
tgcagactcagtttg

SEQ ID NO: 2046561 - DNA, 16 bp, Homo sapiens
tgcagactctacagag

SEQ ID NO: 2046562 - DNA, 22 bp, Homo sapiens
tgcagactctacagaggccatg

SEQ ID NO: 2046563 - DNA, 12 bp, Homo sapiens
tgcagactgtgg

SEQ ID NO: 2046564 - DNA, 22 bp, Homo sapiens
tgcagactgtggctgcagagac

SEQ ID NO: 2046565 - DNA, 17 bp, Homo sapiens
tgcagagacaggacctg

SEQ ID NO: 2046566 - DNA, 15 bp, Homo sapiens
tgcagagagaagcct

SEQ ID NO: 2046567 - DNA, 21 bp, Homo sapiens
tgcagagatttcctccatggt

SEQ ID NO: 2046568 - DNA, 21 bp, Homo sapiens
tgcagagcaggaaacatgact

SEQ ID NO: 2046569 - DNA, 18 bp, Homo sapiens
tgcagaggacagagctgg

SEQ ID NO: 2046570 - DNA, 13 bp, Homo sapiens
tgcagaggattta

SEQ ID NO: 2046571 - DNA, 20 bp, Homo sapiens
tgcagaggggctttctggag

SEQ ID NO: 2046572 - DNA, 20 bp, Homo sapiens
tgcagaggtaaaagtgtgag

SEQ ID NO: 2046573 - DNA, 12 bp, Homo sapiens
tgcagaggtttc

SEQ ID NO: 2046574 - DNA, 23 bp, Homo sapiens
tgcagatagccagacacatggct

SEQ ID NO: 2046575 - DNA, 23 bp, Homo sapiens
tgcagattcctgggcctgtcccc

SEQ ID NO: 2046576 - DNA, 18 bp, Homo sapiens
tgcagatttcctgtgtgg

SEQ ID NO: 2046577 - DNA, 11 bp, Homo sapiens
tgcagcacttt

SEQ ID NO: 2046578 - DNA, 14 bp, Homo sapiens
tgcagcagcccagc

SEQ ID NO: 2046579 - DNA, 19 bp, Homo sapiens
tgcagcagcccagcttcct

SEQ ID NO: 2046580 - DNA, 22 bp, Homo sapiens
tgcagcagtgagtctcttcaga

SEQ ID NO: 2046581 - DNA, 17 bp, Homo sapiens
tgcagccagcccagccc

SEQ ID NO: 2046582 - DNA, 23 bp, Homo sapiens
tgcagccaggaggagaggaaagg

SEQ ID NO: 2046583 - DNA, 21 bp, Homo sapiens
tgcagccccgcgcctccttcc

SEQ ID NO: 2046584 - DNA, 22 bp, Homo sapiens
tgcagcccggcgccaccatcct

SEQ ID NO: 2046585 - DNA, 13 bp, Homo sapiens
tgcagcccttcct

SEQ ID NO: 2046586 - DNA, 15 bp, Homo sapiens
tgcagcccttcctcc

SEQ ID NO: 2046587 - DNA, 18 bp, Homo sapiens
tgcagcccttcctcctga

SEQ ID NO: 2046588 - DNA, 14 bp, Homo sapiens
tgccgctcttctgt

SEQ ID NO: 2046589 - DNA, 16 bp, Homo sapiens
tgccgctcttctgtca

SEQ ID NO: 2046590 - DNA, 19 bp, Homo sapiens
tgccgctcttctgtcatcc

SEQ ID NO: 2046591 - DNA, 12 bp, Homo sapiens
tgccgctgcacc

SEQ ID NO: 2046592 - DNA, 17 bp, Homo sapiens
tgccgctgcaccacggc

SEQ ID NO: 2046593 - DNA, 16 bp, Homo sapiens
tgccgctgccgctgca

SEQ ID NO: 2046594 - DNA, 19 bp, Homo sapiens
tgccgggttctagtctcct

SEQ ID NO: 2046595 - DNA, 16 bp, Homo sapiens
tgccgttactctccaa

SEQ ID NO: 2046596 - DNA, 19 bp, Homo sapiens
tgccgttactctccaacct

SEQ ID NO: 2046597 - DNA, 16 bp, Homo sapiens
tgcctaatggagaaga

SEQ ID NO: 2046598 - DNA, 18 bp, Homo sapiens
tgcctaattcctggcatg

SEQ ID NO: 2046599 - DNA, 23 bp, Homo sapiens
tgcctaattcctggcatgacact

SEQ ID NO: 2046600 - DNA, 14 bp, Homo sapiens
tgcctacattccct

SEQ ID NO: 2046601 - DNA, 20 bp, Homo sapiens
tgcctacattccctggcctg

SEQ ID NO: 2046602 - DNA, 17 bp, Homo sapiens
tgcctacttgtaatttc

SEQ ID NO: 2046603 - DNA, 18 bp, Homo sapiens
tgcctaggaggccttctc

SEQ ID NO: 2046604 - DNA, 22 bp, Homo sapiens
tgcctaggccaaatgcacaagc

SEQ ID NO: 2046605 - DNA, 15 bp, Homo sapiens
tgcctatccatcctg

SEQ ID NO: 2046606 - DNA, 15 bp, Homo sapiens
tgcctatttattggg

SEQ ID NO: 2046607 - DNA, 13 bp, Homo sapiens
tgcctcaagaaca

SEQ ID NO: 2046608 - DNA, 23 bp, Homo sapiens
tgcctcaatgtgaatcagaccct

SEQ ID NO: 2046609 - DNA, 24 bp, Homo sapiens
tgcctcaatgtgaatcagacccta

SEQ ID NO: 2046610 - DNA, 18 bp, Homo sapiens
tgcctcaatgtgaccagg

SEQ ID NO: 2046611 - DNA, 15 bp, Homo sapiens
tgcctcagagcaggc

SEQ ID NO: 2046612 - DNA, 18 bp, Homo sapiens
tgcctcagctgctcgcac

SEQ ID NO: 2046613 - DNA, 16 bp, Homo sapiens
tgcctcatgaccctcc

SEQ ID NO: 2046614 - DNA, 16 bp, Homo sapiens
tgcctcatttttttcc

SEQ ID NO: 2046615 - DNA, 13 bp, Homo sapiens
tgcctccaccgct

SEQ ID NO: 2046616 - DNA, 17 bp, Homo sapiens
tgcctccaccgctgcct

SEQ ID NO: 2046617 - DNA, 18 bp, Homo sapiens
tgcctccaccgctgccta

SEQ ID NO: 2046618 - DNA, 20 bp, Homo sapiens
tgcctccaccgctgcctaag

SEQ ID NO: 2046619 - DNA, 20 bp, Homo sapiens
tgcctcccagccctgccagg

SEQ ID NO: 2046620 - DNA, 22 bp, Homo sapiens
tgcctcccagccctgccaggag

SEQ ID NO: 2046621 - DNA, 14 bp, Homo sapiens
tgcctccctagctt

SEQ ID NO: 2046622 - DNA, 14 bp, Homo sapiens
tgcctccctctcca

SEQ ID NO: 2046623 - DNA, 12 bp, Homo sapiens
tgcctcctcacc

SEQ ID NO: 2046624 - DNA, 11 bp, Homo sapiens
tgcctcctgtc

SEQ ID NO: 2046625 - DNA, 12 bp, Homo sapiens
tgcctcctgtct

SEQ ID NO: 2046626 - DNA, 18 bp, Homo sapiens
tgcctccttatttatcaa

SEQ ID NO: 2046627 - DNA, 22 bp, Homo sapiens
tgcctcgaggcaccggcgctgc

SEQ ID NO: 2046628 - DNA, 19 bp, Homo sapiens
tgcctctactgggaaggct

SEQ ID NO: 2046629 - DNA, 23 bp, Homo sapiens
tgcctctactgggaaggctactt

SEQ ID NO: 2046630 - DNA, 16 bp, Homo sapiens
tgcctctctgctccag

SEQ ID NO: 2046631 - DNA, 18 bp, Homo sapiens
tgcctctctgctccagag

SEQ ID NO: 2046632 - DNA, 11 bp, Homo sapiens
tgcctctgagg

SEQ ID NO: 2046633 - DNA, 21 bp, Homo sapiens
tgcctctgaggccagcctggc

SEQ ID NO: 2046634 - DNA, 18 bp, Homo sapiens
tgcctctgatatgggact

SEQ ID NO: 2046635 - DNA, 20 bp, Homo sapiens
tgcctctgcctctgacacac

SEQ ID NO: 2046636 - DNA, 12 bp, Homo sapiens
tgcctctgcctg

SEQ ID NO: 2046637 - DNA, 18 bp, Homo sapiens
tgcctctttcctgttgtt

SEQ ID NO: 2046638 - DNA, 15 bp, Homo sapiens
tgcctgagcccagga

SEQ ID NO: 2046639 - DNA, 15 bp, Homo sapiens
tgcctgaggctcaag

SEQ ID NO: 2046640 - DNA, 20 bp, Homo sapiens
tgcctgcaaccttgcatcca

SEQ ID NO: 2046641 - DNA, 20 bp, Homo sapiens
tgcctgcacccttcctcctc

SEQ ID NO: 2046642 - DNA, 14 bp, Homo sapiens
tgcctgcagagaga

SEQ ID NO: 2046643 - DNA, 15 bp, Homo sapiens
tgcctgcagagagaa

SEQ ID NO: 2046644 - DNA, 15 bp, Homo sapiens
tgcctgcagccccgc

SEQ ID NO: 2046645 - DNA, 15 bp, Homo sapiens
tgcctgcagcctccc

SEQ ID NO: 2046646 - DNA, 15 bp, Homo sapiens
tgcctgcccaggccc

SEQ ID NO: 2046647 - DNA, 17 bp, Homo sapiens
tgcctgcccaggcccct

SEQ ID NO: 2046648 - DNA, 11 bp, Homo sapiens
tgcctgccctg

SEQ ID NO: 2046649 - DNA, 12 bp, Homo sapiens
tgcctgccctgg

SEQ ID NO: 2046650 - DNA, 13 bp, Homo sapiens
tgcctgccctgga

SEQ ID NO: 2046651 - DNA, 13 bp, Homo sapiens
tgcctgcctctgc

SEQ ID NO: 2046652 - DNA, 23 bp, Homo sapiens
tgcctgcctctgccatgcccaga

SEQ ID NO: 2046653 - DNA, 13 bp, Homo sapiens
tgcctgctagagc

SEQ ID NO: 2046654 - DNA, 17 bp, Homo sapiens
tgcctgctatttgaagt

SEQ ID NO: 2046655 - DNA, 19 bp, Homo sapiens
tgcctggaggacctgagcc

SEQ ID NO: 2046656 - DNA, 20 bp, Homo sapiens
tgcctggaggacctgagcct

SEQ ID NO: 2046657 - DNA, 21 bp, Homo sapiens
tgcctggaggacctgagcctg

SEQ ID NO: 2046658 - DNA, 21 bp, Homo sapiens
tgcctggaggatccctccatc

SEQ ID NO: 2046659 - DNA, 19 bp, Homo sapiens
tgcctggagtcccgtccct

SEQ ID NO: 2046660 - DNA, 19 bp, Homo sapiens
tgcctggcccccctccagg

SEQ ID NO: 2046661 - DNA, 21 bp, Homo sapiens
tgcctggcccccctccaggca

SEQ ID NO: 2046662 - DNA, 17 bp, Homo sapiens
tgcctggcctggcacac

SEQ ID NO: 2046663 - DNA, 22 bp, Homo sapiens
tgcctggcctggcacacatcag

SEQ ID NO: 2046664 - DNA, 19 bp, Homo sapiens
tgcctggcctggctcccca

SEQ ID NO: 2046665 - DNA, 11 bp, Homo sapiens
tgcctggctgt

SEQ ID NO: 2046666 - DNA, 14 bp, Homo sapiens
tgcctgggaggctt

SEQ ID NO: 2046667 - DNA, 17 bp, Homo sapiens
tgcctgggcctgtgcag

SEQ ID NO: 2046668 - DNA, 21 bp, Homo sapiens
tgcctgggcctgtgcagcagc

SEQ ID NO: 2046669 - DNA, 22 bp, Homo sapiens
tgcctgggcctgtgcagcagcc

SEQ ID NO: 2046670 - DNA, 23 bp, Homo sapiens
tgcctgggcctgtgcagcagccc

SEQ ID NO: 2046671 - DNA, 16 bp, Homo sapiens
tgcctgggtggggctg

SEQ ID NO: 2046672 - DNA, 19 bp, Homo sapiens
tgcctgggtggggctgctc

SEQ ID NO: 2046673 - DNA, 21 bp, Homo sapiens
tgcctgggtggggctgctcct

SEQ ID NO: 2046674 - DNA, 22 bp, Homo sapiens
tgcctgggtggggctgctcctc

SEQ ID NO: 2046675 - DNA, 24 bp, Homo sapiens
tgcctgggtggggctgctcctcca

SEQ ID NO: 2046676 - DNA, 14 bp, Homo sapiens
tgcctgggttttct

SEQ ID NO: 2046677 - DNA, 20 bp, Homo sapiens
tgcctgggttttctaactgt

SEQ ID NO: 2046678 - DNA, 18 bp, Homo sapiens
tgcctggtggcagctgcg

SEQ ID NO: 2046679 - DNA, 19 bp, Homo sapiens
tgcctggtggcagctgcgg

SEQ ID NO: 2046680 - DNA, 15 bp, Homo sapiens
tgcctgtagcagtga

SEQ ID NO: 2046681 - DNA, 15 bp, Homo sapiens
tgcctgtagttagga

SEQ ID NO: 2046682 - DNA, 18 bp, Homo sapiens
tgcctgtagttaggaaat

SEQ ID NO: 2046683 - DNA, 16 bp, Homo sapiens
tgcctgtgaggcaggg

SEQ ID NO: 2046684 - DNA, 21 bp, Homo sapiens
tgcctgtgcacggccagctgc

SEQ ID NO: 2046685 - DNA, 17 bp, Homo sapiens
tgcctgtgtgagcatct

SEQ ID NO: 2046686 - DNA, 23 bp, Homo sapiens
tgcctgtgtgagcatctctgtgt

SEQ ID NO: 2046687 - DNA, 22 bp, Homo sapiens
tgcctgtgtttgtgtggatacc

SEQ ID NO: 2046688 - DNA, 18 bp, Homo sapiens
tgcctgttcagctccagc

SEQ ID NO: 2046689 - DNA, 14 bp, Homo sapiens
tgcctgttcccatt

SEQ ID NO: 2046690 - DNA, 17 bp, Homo sapiens
tgccttaaaaggagaga

SEQ ID NO: 2046691 - DNA, 13 bp, Homo sapiens
tgccttaaagaaa

SEQ ID NO: 2046692 - DNA, 19 bp, Homo sapiens
tgccttaatgagaacattt

SEQ ID NO: 2046693 - DNA, 20 bp, Homo sapiens
tgccttaatgagaacattta

SEQ ID NO: 2046694 - DNA, 17 bp, Homo sapiens
tgccttacctcctgccc

SEQ ID NO: 2046695 - DNA, 19 bp, Homo sapiens
tgccttacctcctgcccag

SEQ ID NO: 2046696 - DNA, 21 bp, Homo sapiens
tgccttagaacctttcttaca

SEQ ID NO: 2046697 - DNA, 14 bp, Homo sapiens
tgccttagcacttc

SEQ ID NO: 2046698 - DNA, 13 bp, Homo sapiens
tgccttcagctct

SEQ ID NO: 2046699 - DNA, 16 bp, Homo sapiens
tgccttcctcatcccc

SEQ ID NO: 2046700 - DNA, 21 bp, Homo sapiens
tgccttcttattctcactcca

SEQ ID NO: 2046701 - DNA, 14 bp, Homo sapiens
tgccttcttcaccc

SEQ ID NO: 2046702 - DNA, 15 bp, Homo sapiens
tgccttgaagccact

SEQ ID NO: 2046703 - DNA, 18 bp, Homo sapiens
tggaactctaccctggta

SEQ ID NO: 2046704 - DNA, 16 bp, Homo sapiens
tggaactgaagggggc

SEQ ID NO: 2046705 - DNA, 20 bp, Homo sapiens
tggaactggaatcctttcag

SEQ ID NO: 2046706 - DNA, 15 bp, Homo sapiens
tggaacttctaatat

SEQ ID NO: 2046707 - DNA, 18 bp, Homo sapiens
tggaacttctaatatatt

SEQ ID NO: 2046708 - DNA, 21 bp, Homo sapiens
tggaacttctaatatattttt

SEQ ID NO: 2046709 - DNA, 18 bp, Homo sapiens
tggaagacaaaatgtttt

SEQ ID NO: 2046710 - DNA, 17 bp, Homo sapiens
tggaagacgcaagggcc

SEQ ID NO: 2046711 - DNA, 13 bp, Homo sapiens
tggaagagaggca

SEQ ID NO: 2046712 - DNA, 19 bp, Homo sapiens
tggaagagaggcacctgct

SEQ ID NO: 2046713 - DNA, 20 bp, Homo sapiens
tggaagagaggcacctgctg

SEQ ID NO: 2046714 - DNA, 23 bp, Homo sapiens
tggaagagaggcacctgctggaa

SEQ ID NO: 2046715 - DNA, 15 bp, Homo sapiens
tggaagagcagcctg

SEQ ID NO: 2046716 - DNA, 16 bp, Homo sapiens
tggaagagcagcctga

SEQ ID NO: 2046717 - DNA, 13 bp, Homo sapiens
tggaagagctctt

SEQ ID NO: 2046718 - DNA, 14 bp, Homo sapiens
tggaagagctcttc

SEQ ID NO: 2046719 - DNA, 22 bp, Homo sapiens
tggaagatttaccttttctgtt

SEQ ID NO: 2046720 - DNA, 16 bp, Homo sapiens
tggaagattttaaatt

SEQ ID NO: 2046721 - DNA, 17 bp, Homo sapiens
tggaagcatgtaggaga

SEQ ID NO: 2046722 - DNA, 15 bp, Homo sapiens
tggaagcctggactc

SEQ ID NO: 2046723 - DNA, 15 bp, Homo sapiens
tggaagctgagcagg

SEQ ID NO: 2046724 - DNA, 18 bp, Homo sapiens
tggaagctgccctgccca

SEQ ID NO: 2046725 - DNA, 14 bp, Homo sapiens
tggaaggcagggca

SEQ ID NO: 2046726 - DNA, 13 bp, Homo sapiens
tggaagggagggg

SEQ ID NO: 2046727 - DNA, 23 bp, Homo sapiens
tggaagggggtgtgcgtgcgtgt

SEQ ID NO: 2046728 - DNA, 17 bp, Homo sapiens
tggaagtgttcaagaaa

SEQ ID NO: 2046729 - DNA, 15 bp, Homo sapiens
tggaagttttcagga

SEQ ID NO: 2046730 - DNA, 14 bp, Homo sapiens
tggaagttttgcat

SEQ ID NO: 2046731 - DNA, 22 bp, Homo sapiens
tggaatacagtgttattttctt

SEQ ID NO: 2046732 - DNA, 14 bp, Homo sapiens
tggaatataattgt

SEQ ID NO: 2046733 - DNA, 16 bp, Homo sapiens
tggaatcaaggaatcc

SEQ ID NO: 2046734 - DNA, 19 bp, Homo sapiens
tggaatcaaggaatcctga

SEQ ID NO: 2046735 - DNA, 20 bp, Homo sapiens
tggaatcaatttcccagaag

SEQ ID NO: 2046736 - DNA, 23 bp, Homo sapiens
tggaatcaatttcccagaaggga

SEQ ID NO: 2046737 - DNA, 18 bp, Homo sapiens
tggaatcacctggagggc

SEQ ID NO: 2046738 - DNA, 19 bp, Homo sapiens
tggaatcacctggagggct

SEQ ID NO: 2046739 - DNA, 20 bp, Homo sapiens
tggaatcacctggagggctt

SEQ ID NO: 2046740 - DNA, 13 bp, Homo sapiens
tggaatcactgta

SEQ ID NO: 2046741 - DNA, 17 bp, Homo sapiens
tggaatgaattaaataa

SEQ ID NO: 2046742 - DNA, 18 bp, Homo sapiens
tggaatgaattaaataaa

SEQ ID NO: 2046743 - DNA, 15 bp, Homo sapiens
tggaatgtgagtgtg

SEQ ID NO: 2046744 - DNA, 22 bp, Homo sapiens
tggaatgtggtacaaattgttc

SEQ ID NO: 2046745 - DNA, 13 bp, Homo sapiens
tggaattcagcac

SEQ ID NO: 2046746 - DNA, 20 bp, Homo sapiens
tggaattcagcaccctgggt

SEQ ID NO: 2046747 - DNA, 21 bp, Homo sapiens
tggaattctaaatgctggtct

SEQ ID NO: 2046748 - DNA, 16 bp, Homo sapiens
tggaattgctgctctc

SEQ ID NO: 2046749 - DNA, 17 bp, Homo sapiens
tggaattgggagcttgg

SEQ ID NO: 2046750 - DNA, 17 bp, Homo sapiens
tggaatttaattcaaag

SEQ ID NO: 2046751 - DNA, 13 bp, Homo sapiens
tggaattttctta

SEQ ID NO: 2046752 - DNA, 23 bp, Homo sapiens
tggaatttttcattgatatgaaa

SEQ ID NO: 2046753 - DNA, 14 bp, Homo sapiens
tggacaaaatggaa

SEQ ID NO: 2046754 - DNA, 11 bp, Homo sapiens
tggacaaccca

SEQ ID NO: 2046755 - DNA, 17 bp, Homo sapiens
tggacaagccaacttgt

SEQ ID NO: 2046756 - DNA, 13 bp, Homo sapiens
tggacaaggaggt

SEQ ID NO: 2046757 - DNA, 16 bp, Homo sapiens
tggacaaggaggtctg

SEQ ID NO: 2046758 - DNA, 20 bp, Homo sapiens
tggacacactgtaaacccct

SEQ ID NO: 2046759 - DNA, 13 bp, Homo sapiens
tggacacagctct

SEQ ID NO: 2046760 - DNA, 22 bp, Homo sapiens
tggacacagctcttctccaggc

SEQ ID NO: 2046761 - DNA, 21 bp, Homo sapiens
tggacacattttctcctagga

SEQ ID NO: 2046762 - DNA, 13 bp, Homo sapiens
tggacacctgccc

SEQ ID NO: 2046763 - DNA, 18 bp, Homo sapiens
tggacacctgccctgccc

SEQ ID NO: 2046764 - DNA, 12 bp, Homo sapiens
tggacagaagat

SEQ ID NO: 2046765 - DNA, 18 bp, Homo sapiens
tggacagatagacagtgc

SEQ ID NO: 2046766 - DNA, 15 bp, Homo sapiens
tggacagctgcttgt

SEQ ID NO: 2046767 - DNA, 16 bp, Homo sapiens
tggacagctgcttgtg

SEQ ID NO: 2046768 - DNA, 16 bp, Homo sapiens
tggacagctgtgcctc

SEQ ID NO: 2046769 - DNA, 23 bp, Homo sapiens
tggacaggactaacactcagaag

SEQ ID NO: 2046770 - DNA, 12 bp, Homo sapiens
tggacagtcctg

SEQ ID NO: 2046771 - DNA, 14 bp, Homo sapiens
tggacagtcctggg

SEQ ID NO: 2046772 - DNA, 15 bp, Homo sapiens
tggaccaccagcccc

SEQ ID NO: 2046773 - DNA, 15 bp, Homo sapiens
tggaccactgggcaa

SEQ ID NO: 2046774 - DNA, 12 bp, Homo sapiens
tggaccagagga

SEQ ID NO: 2046775 - DNA, 19 bp, Homo sapiens
tggaccagaggaagcccct

SEQ ID NO: 2046776 - DNA, 14 bp, Homo sapiens
tggaccaggacagg

SEQ ID NO: 2046777 - DNA, 16 bp, Homo sapiens
tggaccagtagacaac

SEQ ID NO: 2046778 - DNA, 14 bp, Homo sapiens
tggacccagacaca

SEQ ID NO: 2046779 - DNA, 15 bp, Homo sapiens
tggacccctcccttg

SEQ ID NO: 2046780 - DNA, 19 bp, Homo sapiens
tggacccgctctggaccaa

SEQ ID NO: 2046781 - DNA, 16 bp, Homo sapiens
tggaccctcgcagcag

SEQ ID NO: 2046782 - DNA, 14 bp, Homo sapiens
tggaccgggtgggc

SEQ ID NO: 2046783 - DNA, 21 bp, Homo sapiens
tggaccgggtgggcctggcct

SEQ ID NO: 2046784 - DNA, 23 bp, Homo sapiens
tggaccgggtgggcctggcctga

SEQ ID NO: 2046785 - DNA, 16 bp, Homo sapiens
tggacctctgctctga

SEQ ID NO: 2046786 - DNA, 18 bp, Homo sapiens
tggacctctgcttcccca

SEQ ID NO: 2046787 - DNA, 18 bp, Homo sapiens
tggacctgagtcggcccc

SEQ ID NO: 2046788 - DNA, 14 bp, Homo sapiens
tggaccttcctgcc

SEQ ID NO: 2046789 - DNA, 20 bp, Homo sapiens
tggaccttgaactgggtact

SEQ ID NO: 2046790 - DNA, 21 bp, Homo sapiens
tggacctttggggaaggggga

SEQ ID NO: 2046791 - DNA, 21 bp, Homo sapiens
tggactaaccccaacgcacag

SEQ ID NO: 2046792 - DNA, 14 bp, Homo sapiens
tggactcctcccac

SEQ ID NO: 2046793 - DNA, 16 bp, Homo sapiens
tggactcctcccacaa

SEQ ID NO: 2046794 - DNA, 14 bp, Homo sapiens
tggactcctctgtc

SEQ ID NO: 2046795 - DNA, 18 bp, Homo sapiens
tggactctgcacatgtct

SEQ ID NO: 2046796 - DNA, 13 bp, Homo sapiens
tggactgacattt

SEQ ID NO: 2046797 - DNA, 15 bp, Homo sapiens
tggactgcgctggac

SEQ ID NO: 2046798 - DNA, 16 bp, Homo sapiens
tggactgcgctggacg

SEQ ID NO: 2046799 - DNA, 15 bp, Homo sapiens
tggactgtcatagaa

SEQ ID NO: 2046800 - DNA, 11 bp, Homo sapiens
tggacttcaaa

SEQ ID NO: 2046801 - DNA, 15 bp, Homo sapiens
tggacttcctggggc

SEQ ID NO: 2046802 - DNA, 16 bp, Homo sapiens
tggacttccttggttt

SEQ ID NO: 2046803 - DNA, 17 bp, Homo sapiens
tggacttgagcttggca

SEQ ID NO: 2046804 - DNA, 18 bp, Homo sapiens
tggacttgaggattttga

SEQ ID NO: 2046805 - DNA, 14 bp, Homo sapiens
tggactttgttcac

SEQ ID NO: 2046806 - DNA, 17 bp, Homo sapiens
tggagaaaatgaagaaa

SEQ ID NO: 2046807 - DNA, 14 bp, Homo sapiens
tggagaaatattta

SEQ ID NO: 2046808 - DNA, 11 bp, Homo sapiens
tggagaaatta

SEQ ID NO: 2046809 - DNA, 20 bp, Homo sapiens
tggagaactagaacctggag

SEQ ID NO: 2046810 - DNA, 14 bp, Homo sapiens
tggagaactagaga

SEQ ID NO: 2046811 - DNA, 17 bp, Homo sapiens
tggagaactttccatct

SEQ ID NO: 2046812 - DNA, 22 bp, Homo sapiens
tggagaactttccatctgcttg

SEQ ID NO: 2046813 - DNA, 11 bp, Homo sapiens
tggagaaggaa

SEQ ID NO: 2046814 - DNA, 12 bp, Homo sapiens
tggagaaggaag

SEQ ID NO: 2046815 - DNA, 21 bp, Homo sapiens
tggagaccgcttcacccctgc

SEQ ID NO: 2046816 - DNA, 22 bp, Homo sapiens
tggagaccgcttcacccctgca

SEQ ID NO: 2046817 - DNA, 23 bp, Homo sapiens
tggagaccgcttcacccctgcac

SEQ ID NO: 2046818 - DNA, 17 bp, Homo sapiens
tggagactgtctcaaga

SEQ ID NO: 2046819 - DNA, 17 bp, Homo sapiens
tggccgcctccaggagc

SEQ ID NO: 2046820 - DNA, 19 bp, Homo sapiens
tggccggcaaccccagttc

SEQ ID NO: 2046821 - DNA, 24 bp, Homo sapiens
tggccggcaaccccagttctgctc

SEQ ID NO: 2046822 - DNA, 19 bp, Homo sapiens
tggccggcccaggcctcca

SEQ ID NO: 2046823 - DNA, 20 bp, Homo sapiens
tggccggcccaggcctccac

SEQ ID NO: 2046824 - DNA, 19 bp, Homo sapiens
tggccgtggtccagctctt

SEQ ID NO: 2046825 - DNA, 20 bp, Homo sapiens
tggccgtggtccagctcttg

SEQ ID NO: 2046826 - DNA, 17 bp, Homo sapiens
tggcctattatattaaa

SEQ ID NO: 2046827 - DNA, 18 bp, Homo sapiens
tggcctcacgcccagcct

SEQ ID NO: 2046828 - DNA, 13 bp, Homo sapiens
tggcctcactggc

SEQ ID NO: 2046829 - DNA, 16 bp, Homo sapiens
tggcctcactggctgg

SEQ ID NO: 2046830 - DNA, 20 bp, Homo sapiens
tggcctcactggctggggca

SEQ ID NO: 2046831 - DNA, 20 bp, Homo sapiens
tggcctcacttccctgggaa

SEQ ID NO: 2046832 - DNA, 13 bp, Homo sapiens
tggcctcagacca

SEQ ID NO: 2046833 - DNA, 16 bp, Homo sapiens
tggcctcagaccaact

SEQ ID NO: 2046834 - DNA, 20 bp, Homo sapiens
tggcctcccaataaagctgg

SEQ ID NO: 2046835 - DNA, 13 bp, Homo sapiens
tggcctcctgcct

SEQ ID NO: 2046836 - DNA, 16 bp, Homo sapiens
tggcctcctgcctcta

SEQ ID NO: 2046837 - DNA, 22 bp, Homo sapiens
tggcctcgcctgggcccaggct

SEQ ID NO: 2046838 - DNA, 19 bp, Homo sapiens
tggcctcgggacacctgcc

SEQ ID NO: 2046839 - DNA, 21 bp, Homo sapiens
tggcctctagaacacccactg

SEQ ID NO: 2046840 - DNA, 19 bp, Homo sapiens
tggcctctcgagttctcct

SEQ ID NO: 2046841 - DNA, 14 bp, Homo sapiens
tggcctctggccag

SEQ ID NO: 2046842 - DNA, 12 bp, Homo sapiens
tggcctgagctg

SEQ ID NO: 2046843 - DNA, 18 bp, Homo sapiens
tggcctgatcttggctca

SEQ ID NO: 2046844 - DNA, 14 bp, Homo sapiens
tggcctgcactaat

SEQ ID NO: 2046845 - DNA, 16 bp, Homo sapiens
tggcctgcactaattt

SEQ ID NO: 2046846 - DNA, 20 bp, Homo sapiens
tggcctgcggccgggctgcc

SEQ ID NO: 2046847 - DNA, 13 bp, Homo sapiens
tggcctgctggga

SEQ ID NO: 2046848 - DNA, 15 bp, Homo sapiens
tggcctgctgggaac

SEQ ID NO: 2046849 - DNA, 22 bp, Homo sapiens
tggcctgctgggaaccccgcag

SEQ ID NO: 2046850 - DNA, 16 bp, Homo sapiens
tggcctggccggcaac

SEQ ID NO: 2046851 - DNA, 11 bp, Homo sapiens
tggcctggctc

SEQ ID NO: 2046852 - DNA, 23 bp, Homo sapiens
tggcctggtggccatgtcgcctg

SEQ ID NO: 2046853 - DNA, 13 bp, Homo sapiens
tggcctgtgtcca

SEQ ID NO: 2046854 - DNA, 18 bp, Homo sapiens
tggcctgtgtccagcagc

SEQ ID NO: 2046855 - DNA, 18 bp, Homo sapiens
tggccttccctccccaca

SEQ ID NO: 2046856 - DNA, 13 bp, Homo sapiens
tggccttgcccgc

SEQ ID NO: 2046857 - DNA, 19 bp, Homo sapiens
tggccttgtcaggacccag

SEQ ID NO: 2046858 - DNA, 19 bp, Homo sapiens
tggccttgttctgtcacca

SEQ ID NO: 2046859 - DNA, 22 bp, Homo sapiens
tggcctttattaaaaactgagt

SEQ ID NO: 2046860 - DNA, 19 bp, Homo sapiens
tggcctttgaggcaaaggc

SEQ ID NO: 2046861 - DNA, 18 bp, Homo sapiens
tggcgattccctctcacc

SEQ ID NO: 2046862 - DNA, 16 bp, Homo sapiens
tggcggctactcagca

SEQ ID NO: 2046863 - DNA, 15 bp, Homo sapiens
tggcgggcagcccag

SEQ ID NO: 2046864 - DNA, 17 bp, Homo sapiens
tggcggggcaggaggcc

SEQ ID NO: 2046865 - DNA, 22 bp, Homo sapiens
tggcgtgcagtggtgcgatctg

SEQ ID NO: 2046866 - DNA, 19 bp, Homo sapiens
tggcgttctgctgcccctg

SEQ ID NO: 2046867 - DNA, 20 bp, Homo sapiens
tggctaaatgcctaataaac

SEQ ID NO: 2046868 - DNA, 15 bp, Homo sapiens
tggctaattcccaga

SEQ ID NO: 2046869 - DNA, 20 bp, Homo sapiens
tggctactctgtgccagagc

SEQ ID NO: 2046870 - DNA, 13 bp, Homo sapiens
tggctataaatat

SEQ ID NO: 2046871 - DNA, 11 bp, Homo sapiens
tggctatacag

SEQ ID NO: 2046872 - DNA, 19 bp, Homo sapiens
tggctataggtgctacaaa

SEQ ID NO: 2046873 - DNA, 17 bp, Homo sapiens
tggctatcctagagagg

SEQ ID NO: 2046874 - DNA, 13 bp, Homo sapiens
tggctatgttttt

SEQ ID NO: 2046875 - DNA, 18 bp, Homo sapiens
tggctatgtttttaatgt

SEQ ID NO: 2046876 - DNA, 15 bp, Homo sapiens
tggctcacccaagca

SEQ ID NO: 2046877 - DNA, 16 bp, Homo sapiens
tggctcacgcctgtaa

SEQ ID NO: 2046878 - DNA, 22 bp, Homo sapiens
tggctcaggaagaaaccccaag

SEQ ID NO: 2046879 - DNA, 14 bp, Homo sapiens
tggctcaggcaagc

SEQ ID NO: 2046880 - DNA, 18 bp, Homo sapiens
tggctcaggcaagcccct

SEQ ID NO: 2046881 - DNA, 19 bp, Homo sapiens
tggctcaggcaagcccctc

SEQ ID NO: 2046882 - DNA, 13 bp, Homo sapiens
tggctcaggcaga

SEQ ID NO: 2046883 - DNA, 22 bp, Homo sapiens
tggctcatggcgtaatgggcct

SEQ ID NO: 2046884 - DNA, 23 bp, Homo sapiens
tggctcatggcgtaatgggcctg

SEQ ID NO: 2046885 - DNA, 17 bp, Homo sapiens
tggctcccacaggccct

SEQ ID NO: 2046886 - DNA, 23 bp, Homo sapiens
tggctccccacgagtcacctgca

SEQ ID NO: 2046887 - DNA, 14 bp, Homo sapiens
tggctcctcccggt

SEQ ID NO: 2046888 - DNA, 18 bp, Homo sapiens
tggctcctcccggtgccc

SEQ ID NO: 2046889 - DNA, 12 bp, Homo sapiens
tggctcctgcct

SEQ ID NO: 2046890 - DNA, 17 bp, Homo sapiens
tggctcctgtttccatg

SEQ ID NO: 2046891 - DNA, 23 bp, Homo sapiens
tggctcgctccctgtagctctgc

SEQ ID NO: 2046892 - DNA, 14 bp, Homo sapiens
tggctctttcagag

SEQ ID NO: 2046893 - DNA, 12 bp, Homo sapiens
tggctgaaaatc

SEQ ID NO: 2046894 - DNA, 15 bp, Homo sapiens
tggctgaaaatcact

SEQ ID NO: 2046895 - DNA, 13 bp, Homo sapiens
tggctgaagacat

SEQ ID NO: 2046896 - DNA, 21 bp, Homo sapiens
tggctgaccccaaagagcctg

SEQ ID NO: 2046897 - DNA, 13 bp, Homo sapiens
tggctgagggcag

SEQ ID NO: 2046898 - DNA, 23 bp, Homo sapiens
tggctgagggcagttcgcagcca

SEQ ID NO: 2046899 - DNA, 20 bp, Homo sapiens
tggctgagtggaatgcaggg

SEQ ID NO: 2046900 - DNA, 14 bp, Homo sapiens
tggctgataatttt

SEQ ID NO: 2046901 - DNA, 19 bp, Homo sapiens
tggctgataattttaaatt

SEQ ID NO: 2046902 - DNA, 15 bp, Homo sapiens
tggctgcagggagtc

SEQ ID NO: 2046903 - DNA, 12 bp, Homo sapiens
tggctgccaggc

SEQ ID NO: 2046904 - DNA, 15 bp, Homo sapiens
tggctgcctgcatct

SEQ ID NO: 2046905 - DNA, 16 bp, Homo sapiens
tggctgcgctaacccc

SEQ ID NO: 2046906 - DNA, 14 bp, Homo sapiens
tggctgctagcact

SEQ ID NO: 2046907 - DNA, 15 bp, Homo sapiens
tggctgctgacagga

SEQ ID NO: 2046908 - DNA, 13 bp, Homo sapiens
tggctggctgcag

SEQ ID NO: 2046909 - DNA, 12 bp, Homo sapiens
tggctgggcatg

SEQ ID NO: 2046910 - DNA, 16 bp, Homo sapiens
tggctgtaaactataa

SEQ ID NO: 2046911 - DNA, 17 bp, Homo sapiens
tggctgtatttttagag

SEQ ID NO: 2046912 - DNA, 12 bp, Homo sapiens
tggctgtgagga

SEQ ID NO: 2046913 - DNA, 14 bp, Homo sapiens
tggctgtgcctctg

SEQ ID NO: 2046914 - DNA, 19 bp, Homo sapiens
tggctgtgcctctgcctgt

SEQ ID NO: 2046915 - DNA, 22 bp, Homo sapiens
tggctgtgcctctgcctgtctc

SEQ ID NO: 2046916 - DNA, 14 bp, Homo sapiens
tggctgtggaggcc

SEQ ID NO: 2046917 - DNA, 17 bp, Homo sapiens
tggctgtggaggcctga

SEQ ID NO: 2046918 - DNA, 21 bp, Homo sapiens
tggctgtggaggcctgatgct

SEQ ID NO: 2046919 - DNA, 13 bp, Homo sapiens
tggctgtggcaca

SEQ ID NO: 2046920 - DNA, 15 bp, Homo sapiens
tggctgtggcacaga

SEQ ID NO: 2046921 - DNA, 16 bp, Homo sapiens
tggctgtggcacagac

SEQ ID NO: 2046922 - DNA, 18 bp, Homo sapiens
tggctgtggggagtgttt

SEQ ID NO: 2046923 - DNA, 23 bp, Homo sapiens
tggctgtggttcctaagcctgtt

SEQ ID NO: 2046924 - DNA, 15 bp, Homo sapiens
tggcttccaggtatc

SEQ ID NO: 2046925 - DNA, 22 bp, Homo sapiens
tggcttccaggtatctccagga

SEQ ID NO: 2046926 - DNA, 19 bp, Homo sapiens
tggcttcccatccccagcg

SEQ ID NO: 2046927 - DNA, 17 bp, Homo sapiens
tggcttcccatgtcttt

SEQ ID NO: 2046928 - DNA, 18 bp, Homo sapiens
tggcttcccgctcagccc

SEQ ID NO: 2046929 - DNA, 20 bp, Homo sapiens
tggcttcccgctcagccctc

SEQ ID NO: 2046930 - DNA, 11 bp, Homo sapiens
tggcttcctcc

SEQ ID NO: 2046931 - DNA, 23 bp, Homo sapiens
tggcttcctccgtccacccaggc

SEQ ID NO: 2046932 - DNA, 21 bp, Homo sapiens
tggcttcctccgtctgcaatg

SEQ ID NO: 2046933 - DNA, 14 bp, Homo sapiens
tggcttcctcctga

SEQ ID NO: 2046934 - DNA, 12 bp, Homo sapiens
tggggccttggt

SEQ ID NO: 2046935 - DNA, 21 bp, Homo sapiens
tggggctcctttctccagcca

SEQ ID NO: 2046936 - DNA, 20 bp, Homo sapiens
tggggctcgtggccttcccc

SEQ ID NO: 2046937 - DNA, 19 bp, Homo sapiens
tggggctctaacgcctgag

SEQ ID NO: 2046938 - DNA, 13 bp, Homo sapiens
tggggctctggga

SEQ ID NO: 2046939 - DNA, 15 bp, Homo sapiens
tggggctctgtgcag

SEQ ID NO: 2046940 - DNA, 11 bp, Homo sapiens
tggggctgaac

SEQ ID NO: 2046941 - DNA, 20 bp, Homo sapiens
tggggctgcgggacagagga

SEQ ID NO: 2046942 - DNA, 14 bp, Homo sapiens
tgggggaagccctg

SEQ ID NO: 2046943 - DNA, 20 bp, Homo sapiens
tgggggatgactagaggcag

SEQ ID NO: 2046944 - DNA, 21 bp, Homo sapiens
tgggggatgggccagggttta

SEQ ID NO: 2046945 - DNA, 16 bp, Homo sapiens
tgggggcagagggcag

SEQ ID NO: 2046946 - DNA, 20 bp, Homo sapiens
tgggggcagtgactggcagg

SEQ ID NO: 2046947 - DNA, 13 bp, Homo sapiens
tgggggccagctg

SEQ ID NO: 2046948 - DNA, 16 bp, Homo sapiens
tgggggccgctggccc

SEQ ID NO: 2046949 - DNA, 20 bp, Homo sapiens
tgggggccgctggcccaggg

SEQ ID NO: 2046950 - DNA, 19 bp, Homo sapiens
tgggggcgggggagccaac

SEQ ID NO: 2046951 - DNA, 14 bp, Homo sapiens
tggggggccgggca

SEQ ID NO: 2046952 - DNA, 14 bp, Homo sapiens
tgggggtggcaggc

SEQ ID NO: 2046953 - DNA, 16 bp, Homo sapiens
tgggggtggcaggcac

SEQ ID NO: 2046954 - DNA, 23 bp, Homo sapiens
tgggggtggccatccctgggccc

SEQ ID NO: 2046955 - DNA, 22 bp, Homo sapiens
tgggggttctttcttcctctgc

SEQ ID NO: 2046956 - DNA, 17 bp, Homo sapiens
tgggggttggatgggaa

SEQ ID NO: 2046957 - DNA, 16 bp, Homo sapiens
tggggtaagccagagc

SEQ ID NO: 2046958 - DNA, 16 bp, Homo sapiens
tggggtacccactgct

SEQ ID NO: 2046959 - DNA, 18 bp, Homo sapiens
tggggtacccactgctct

SEQ ID NO: 2046960 - DNA, 24 bp, Homo sapiens
tggggtatttaccacagcagctga

SEQ ID NO: 2046961 - DNA, 21 bp, Homo sapiens
tggggtcaccaccctcccctg

SEQ ID NO: 2046962 - DNA, 15 bp, Homo sapiens
tggggtcagccaggg

SEQ ID NO: 2046963 - DNA, 21 bp, Homo sapiens
tggggtcagccagggccaggg

SEQ ID NO: 2046964 - DNA, 15 bp, Homo sapiens
tggggtcccagggaa

SEQ ID NO: 2046965 - DNA, 13 bp, Homo sapiens
tggggtccccatc

SEQ ID NO: 2046966 - DNA, 16 bp, Homo sapiens
tggggtcctggggcct

SEQ ID NO: 2046967 - DNA, 19 bp, Homo sapiens
tggggtctccctctcctgc

SEQ ID NO: 2046968 - DNA, 20 bp, Homo sapiens
tggggtcttgctatattgcc

SEQ ID NO: 2046969 - DNA, 21 bp, Homo sapiens
tggggtgcatcccccagcact

SEQ ID NO: 2046970 - DNA, 12 bp, Homo sapiens
tggggtgggcag

SEQ ID NO: 2046971 - DNA, 15 bp, Homo sapiens
tggggtgggcagggc

SEQ ID NO: 2046972 - DNA, 15 bp, Homo sapiens
tggggtggggcagga

SEQ ID NO: 2046973 - DNA, 19 bp, Homo sapiens
tggggttcagcccctcctc

SEQ ID NO: 2046974 - DNA, 17 bp, Homo sapiens
tggggttttatgtgtgg

SEQ ID NO: 2046975 - DNA, 23 bp, Homo sapiens
tggggttttatgtgtgggaaagg

SEQ ID NO: 2046976 - DNA, 18 bp, Homo sapiens
tgggtaatgaaacaaaga

SEQ ID NO: 2046977 - DNA, 16 bp, Homo sapiens
tgggtacaagagccat

SEQ ID NO: 2046978 - DNA, 16 bp, Homo sapiens
tgggtacatgtgagga

SEQ ID NO: 2046979 - DNA, 18 bp, Homo sapiens
tgggtacttgtggacaca

SEQ ID NO: 2046980 - DNA, 13 bp, Homo sapiens
tgggtattaaact

SEQ ID NO: 2046981 - DNA, 23 bp, Homo sapiens
tgggtccaggaaggcagctgctc

SEQ ID NO: 2046982 - DNA, 22 bp, Homo sapiens
tgggtccgccttaatctggaag

SEQ ID NO: 2046983 - DNA, 22 bp, Homo sapiens
tgggtctcaatccttaacatat

SEQ ID NO: 2046984 - DNA, 18 bp, Homo sapiens
tgggtctggggagggaga

SEQ ID NO: 2046985 - DNA, 14 bp, Homo sapiens
tgggtgacagagca

SEQ ID NO: 2046986 - DNA, 13 bp, Homo sapiens
tgggtgacggtcc

SEQ ID NO: 2046987 - DNA, 23 bp, Homo sapiens
tgggtgacggtcctttaggcagc

SEQ ID NO: 2046988 - DNA, 15 bp, Homo sapiens
tgggtgccatgtgga

SEQ ID NO: 2046989 - DNA, 23 bp, Homo sapiens
tgggtgctaagggtaagggagag

SEQ ID NO: 2046990 - DNA, 11 bp, Homo sapiens
tgggtgctggc

SEQ ID NO: 2046991 - DNA, 13 bp, Homo sapiens
tgggtgctggcag

SEQ ID NO: 2046992 - DNA, 22 bp, Homo sapiens
tgggtggatcaccagaggtcag

SEQ ID NO: 2046993 - DNA, 14 bp, Homo sapiens
tgggtggctactct

SEQ ID NO: 2046994 - DNA, 20 bp, Homo sapiens
tgggtggggaggaaatagaa

SEQ ID NO: 2046995 - DNA, 23 bp, Homo sapiens
tgggtgtaacaggtctcctctta

SEQ ID NO: 2046996 - DNA, 15 bp, Homo sapiens
tgggtgtgccaggct

SEQ ID NO: 2046997 - DNA, 18 bp, Homo sapiens
tgggtgtgtgtagccaag

SEQ ID NO: 2046998 - DNA, 14 bp, Homo sapiens
tgggtgttaatttt

SEQ ID NO: 2046999 - DNA, 16 bp, Homo sapiens
tgggtgttgaccactc

SEQ ID NO: 2047000 - DNA, 19 bp, Homo sapiens
tgggtgttttcaaatgtca

SEQ ID NO: 2047001 - DNA, 18 bp, Homo sapiens
tgggttcactagagctgg

SEQ ID NO: 2047002 - DNA, 13 bp, Homo sapiens
tgggttcctcttc

SEQ ID NO: 2047003 - DNA, 20 bp, Homo sapiens
tgggtttactctcaatgcat

SEQ ID NO: 2047004 - DNA, 17 bp, Homo sapiens
tgggtttgtattttaaa

SEQ ID NO: 2047005 - DNA, 19 bp, Homo sapiens
tgggtttgtttttcaaagc

SEQ ID NO: 2047006 - DNA, 21 bp, Homo sapiens
tgggttttctaactgtaaatc

SEQ ID NO: 2047007 - DNA, 24 bp, Homo sapiens
tgggttttcttcccatcactggag

SEQ ID NO: 2047008 - DNA, 18 bp, Homo sapiens
tggtaaaaagattatata

SEQ ID NO: 2047009 - DNA, 13 bp, Homo sapiens
tggtaaactattt

SEQ ID NO: 2047010 - DNA, 14 bp, Homo sapiens
tggtaaattgtaaa

SEQ ID NO: 2047011 - DNA, 23 bp, Homo sapiens
tggtaagtaccacatctacaatt

SEQ ID NO: 2047012 - DNA, 19 bp, Homo sapiens
tggtaatttgtatctgaag

SEQ ID NO: 2047013 - DNA, 21 bp, Homo sapiens
tggtaatttgtatctgaagga

SEQ ID NO: 2047014 - DNA, 14 bp, Homo sapiens
tggtacagcagggt

SEQ ID NO: 2047015 - DNA, 20 bp, Homo sapiens
tggtacagcagggtcttgct

SEQ ID NO: 2047016 - DNA, 15 bp, Homo sapiens
tggtacatggccagt

SEQ ID NO: 2047017 - DNA, 14 bp, Homo sapiens
tggtaccagctcac

SEQ ID NO: 2047018 - DNA, 23 bp, Homo sapiens
tggtactaagaggctatttaaaa

SEQ ID NO: 2047019 - DNA, 17 bp, Homo sapiens
tggtagggacttaaaaa

SEQ ID NO: 2047020 - DNA, 17 bp, Homo sapiens
tggtatatttgtgtatg

SEQ ID NO: 2047021 - DNA, 20 bp, Homo sapiens
tggtatatttgtgtatgtgt

SEQ ID NO: 2047022 - DNA, 21 bp, Homo sapiens
tggtatgaacttgaggacaca

SEQ ID NO: 2047023 - DNA, 15 bp, Homo sapiens
tggtatgagctgagg

SEQ ID NO: 2047024 - DNA, 16 bp, Homo sapiens
tggtatgagctgaggg

SEQ ID NO: 2047025 - DNA, 15 bp, Homo sapiens
tggtatgctggccag

SEQ ID NO: 2047026 - DNA, 16 bp, Homo sapiens
tggtatgctggccagc

SEQ ID NO: 2047027 - DNA, 17 bp, Homo sapiens
tggtatgctggccagca

SEQ ID NO: 2047028 - DNA, 19 bp, Homo sapiens
tggtatgtagcccggccag

SEQ ID NO: 2047029 - DNA, 20 bp, Homo sapiens
tggtattacactgtatttgt

SEQ ID NO: 2047030 - DNA, 17 bp, Homo sapiens
tggtattttcgtgcatt

SEQ ID NO: 2047031 - DNA, 17 bp, Homo sapiens
tggtcaaaccgcactca

SEQ ID NO: 2047032 - DNA, 20 bp, Homo sapiens
tggtcaaaccgcactcaccc

SEQ ID NO: 2047033 - DNA, 22 bp, Homo sapiens
tggtcaatccgaagtatgaggg

SEQ ID NO: 2047034 - DNA, 13 bp, Homo sapiens
tggtcatggacag

SEQ ID NO: 2047035 - DNA, 15 bp, Homo sapiens
tggtccactcagggc

SEQ ID NO: 2047036 - DNA, 21 bp, Homo sapiens
tggtccagctcttggcccctg

SEQ ID NO: 2047037 - DNA, 22 bp, Homo sapiens
tggtccagcttgctcttcagtg

SEQ ID NO: 2047038 - DNA, 23 bp, Homo sapiens
tggtcccaagtagtagtgtcttc

SEQ ID NO: 2047039 - DNA, 13 bp, Homo sapiens
tggtcccacatcc

SEQ ID NO: 2047040 - DNA, 15 bp, Homo sapiens
tggtcccacatccct

SEQ ID NO: 2047041 - DNA, 17 bp, Homo sapiens
tggtcccacatccctgg

SEQ ID NO: 2047042 - DNA, 21 bp, Homo sapiens
tggtcccacatccctgggcct

SEQ ID NO: 2047043 - DNA, 14 bp, Homo sapiens
tggtccctcgtcca

SEQ ID NO: 2047044 - DNA, 11 bp, Homo sapiens
tggtccctggt

SEQ ID NO: 2047045 - DNA, 15 bp, Homo sapiens
tggtcccttcttccc

SEQ ID NO: 2047046 - DNA, 15 bp, Homo sapiens
tggtccggtgtcctt

SEQ ID NO: 2047047 - DNA, 14 bp, Homo sapiens
tggtcctgagacct

SEQ ID NO: 2047048 - DNA, 17 bp, Homo sapiens
tgtcaccagtcctgccc

SEQ ID NO: 2047049 - DNA, 14 bp, Homo sapiens
tgtcaccctgcaga

SEQ ID NO: 2047050 - DNA, 16 bp, Homo sapiens
tgtcaccctgcagagc

SEQ ID NO: 2047051 - DNA, 18 bp, Homo sapiens
tgtcaccctgcagagcta

SEQ ID NO: 2047052 - DNA, 23 bp, Homo sapiens
tgtcaccgtgagcagctttggaa

SEQ ID NO: 2047053 - DNA, 13 bp, Homo sapiens
tgtcacctcagct

SEQ ID NO: 2047054 - DNA, 15 bp, Homo sapiens
tgtcacctcagctga

SEQ ID NO: 2047055 - DNA, 19 bp, Homo sapiens
tgtcacgtcttgaaaagcc

SEQ ID NO: 2047056 - DNA, 19 bp, Homo sapiens
tgtcacgtgaaatatttaa

SEQ ID NO: 2047057 - DNA, 18 bp, Homo sapiens
tgtcactagcagctgcag

SEQ ID NO: 2047058 - DNA, 13 bp, Homo sapiens
tgtcactcccaga

SEQ ID NO: 2047059 - DNA, 14 bp, Homo sapiens
tgtcactcccagac

SEQ ID NO: 2047060 - DNA, 21 bp, Homo sapiens
tgtcactggtagaccaaaata

SEQ ID NO: 2047061 - DNA, 21 bp, Homo sapiens
tgtcagaaaccagttatgtga

SEQ ID NO: 2047062 - DNA, 12 bp, Homo sapiens
tgtcagaaactc

SEQ ID NO: 2047063 - DNA, 18 bp, Homo sapiens
tgtcagacaataccactg

SEQ ID NO: 2047064 - DNA, 23 bp, Homo sapiens
tgtcagacatccatgtttgtaaa

SEQ ID NO: 2047065 - DNA, 12 bp, Homo sapiens
tgtcagacttta

SEQ ID NO: 2047066 - DNA, 20 bp, Homo sapiens
tgtcagagtaacatgccagc

SEQ ID NO: 2047067 - DNA, 20 bp, Homo sapiens
tgtcagatattttttcagaa

SEQ ID NO: 2047068 - DNA, 18 bp, Homo sapiens
tgtcagcccaagcagagt

SEQ ID NO: 2047069 - DNA, 20 bp, Homo sapiens
tgtcagccgagccgggcctg

SEQ ID NO: 2047070 - DNA, 19 bp, Homo sapiens
tgtcagcgtttctccacct

SEQ ID NO: 2047071 - DNA, 18 bp, Homo sapiens
tgtcaggaacagaaggat

SEQ ID NO: 2047072 - DNA, 15 bp, Homo sapiens
tgtcaggacccaggc

SEQ ID NO: 2047073 - DNA, 16 bp, Homo sapiens
tgtcatagaaattaca

SEQ ID NO: 2047074 - DNA, 18 bp, Homo sapiens
tgtcatatagctggttat

SEQ ID NO: 2047075 - DNA, 17 bp, Homo sapiens
tgtcatatattcatgta

SEQ ID NO: 2047076 - DNA, 21 bp, Homo sapiens
tgtcatatattcatgtaataa

SEQ ID NO: 2047077 - DNA, 14 bp, Homo sapiens
tgtcatcaaatatt

SEQ ID NO: 2047078 - DNA, 15 bp, Homo sapiens
tgtcatcaattaaag

SEQ ID NO: 2047079 - DNA, 18 bp, Homo sapiens
tgtcatcactccctggat

SEQ ID NO: 2047080 - DNA, 17 bp, Homo sapiens
tgtcatcagaagataac

SEQ ID NO: 2047081 - DNA, 17 bp, Homo sapiens
tgtcatccatgcgtgca

SEQ ID NO: 2047082 - DNA, 16 bp, Homo sapiens
tgtcatctagcccctt

SEQ ID NO: 2047083 - DNA, 22 bp, Homo sapiens
tgtcatctctctggggccctgg

SEQ ID NO: 2047084 - DNA, 23 bp, Homo sapiens
tgtcatctttcttctattttatt

SEQ ID NO: 2047085 - DNA, 15 bp, Homo sapiens
tgtcatgtaccatca

SEQ ID NO: 2047086 - DNA, 17 bp, Homo sapiens
tgtcatgtaccatcaat

SEQ ID NO: 2047087 - DNA, 17 bp, Homo sapiens
tgtcattactgcctttg

SEQ ID NO: 2047088 - DNA, 22 bp, Homo sapiens
tgtcattactgcctttggaaga

SEQ ID NO: 2047089 - DNA, 21 bp, Homo sapiens
tgtcattcaaatgggtgatat

SEQ ID NO: 2047090 - DNA, 13 bp, Homo sapiens
tgtcattgtccat

SEQ ID NO: 2047091 - DNA, 14 bp, Homo sapiens
tgtcatttcatttc

SEQ ID NO: 2047092 - DNA, 16 bp, Homo sapiens
tgtcatttcatttcct

SEQ ID NO: 2047093 - DNA, 16 bp, Homo sapiens
tgtcatttgagcaggg

SEQ ID NO: 2047094 - DNA, 12 bp, Homo sapiens
tgtcatttgctt

SEQ ID NO: 2047095 - DNA, 23 bp, Homo sapiens
tgtcattttaaaatctgatttaa

SEQ ID NO: 2047096 - DNA, 13 bp, Homo sapiens
tgtcattttggta

SEQ ID NO: 2047097 - DNA, 21 bp, Homo sapiens
tgtccaacaactccaggaaaa

SEQ ID NO: 2047098 - DNA, 15 bp, Homo sapiens
tgtccaacctaaccc

SEQ ID NO: 2047099 - DNA, 22 bp, Homo sapiens
tgtccaacctaacccctttcct

SEQ ID NO: 2047100 - DNA, 16 bp, Homo sapiens
tgtccaatataaattg

SEQ ID NO: 2047101 - DNA, 16 bp, Homo sapiens
tgtccaattctcttta

SEQ ID NO: 2047102 - DNA, 11 bp, Homo sapiens
tgtccacctgg

SEQ ID NO: 2047103 - DNA, 14 bp, Homo sapiens
tgtccacctggccc

SEQ ID NO: 2047104 - DNA, 18 bp, Homo sapiens
tgtccactctcggggccc

SEQ ID NO: 2047105 - DNA, 19 bp, Homo sapiens
tgtccactctcggggccct

SEQ ID NO: 2047106 - DNA, 23 bp, Homo sapiens
tgtccactctgaataccaagtgt

SEQ ID NO: 2047107 - DNA, 15 bp, Homo sapiens
tgtccagaagaatat

SEQ ID NO: 2047108 - DNA, 22 bp, Homo sapiens
tgtccagaccattgtcttccaa

SEQ ID NO: 2047109 - DNA, 14 bp, Homo sapiens
tgtccagactgtgg

SEQ ID NO: 2047110 - DNA, 16 bp, Homo sapiens
tgtccagcacagaagg

SEQ ID NO: 2047111 - DNA, 14 bp, Homo sapiens
tgtccagcagctgc

SEQ ID NO: 2047112 - DNA, 15 bp, Homo sapiens
tgtccagcagctgcg

SEQ ID NO: 2047113 - DNA, 21 bp, Homo sapiens
tgtccagcagctgcgggtctg

SEQ ID NO: 2047114 - DNA, 14 bp, Homo sapiens
tgtccagcgcctag

SEQ ID NO: 2047115 - DNA, 12 bp, Homo sapiens
tgtccaggccac

SEQ ID NO: 2047116 - DNA, 14 bp, Homo sapiens
tgtccaggccactg

SEQ ID NO: 2047117 - DNA, 13 bp, Homo sapiens
tgtccagggccct

SEQ ID NO: 2047118 - DNA, 17 bp, Homo sapiens
tgtccagggccctgagc

SEQ ID NO: 2047119 - DNA, 23 bp, Homo sapiens
tgtccataaagtaattttgtgaa

SEQ ID NO: 2047120 - DNA, 23 bp, Homo sapiens
tgtcccaaaaagaaaggagggga

SEQ ID NO: 2047121 - DNA, 16 bp, Homo sapiens
tgtcccaacttgtaaa

SEQ ID NO: 2047122 - DNA, 20 bp, Homo sapiens
tgtcccaccaactctgcact

SEQ ID NO: 2047123 - DNA, 13 bp, Homo sapiens
tgtcccaccagct

SEQ ID NO: 2047124 - DNA, 22 bp, Homo sapiens
tgtcccagagcttattggccac

SEQ ID NO: 2047125 - DNA, 13 bp, Homo sapiens
tgtcccatttcct

SEQ ID NO: 2047126 - DNA, 23 bp, Homo sapiens
tgtcccatttccttggaggccac

SEQ ID NO: 2047127 - DNA, 21 bp, Homo sapiens
tgtccccacgtatgtcggcac

SEQ ID NO: 2047128 - DNA, 23 bp, Homo sapiens
tgtcccccaaggttttggagtca

SEQ ID NO: 2047129 - DNA, 22 bp, Homo sapiens
tgtcccccttggaggagggctg

SEQ ID NO: 2047130 - DNA, 18 bp, Homo sapiens
tgtcccctcactctgtca

SEQ ID NO: 2047131 - DNA, 23 bp, Homo sapiens
tgtcccctcactctgtcagccag

SEQ ID NO: 2047132 - DNA, 13 bp, Homo sapiens
tgtcccctgtccc

SEQ ID NO: 2047133 - DNA, 19 bp, Homo sapiens
tgtcccctgtcccaccaac

SEQ ID NO: 2047134 - DNA, 22 bp, Homo sapiens
tgtcccgccttcctcctccaca

SEQ ID NO: 2047135 - DNA, 23 bp, Homo sapiens
tgtcccgccttcctcctccacag

SEQ ID NO: 2047136 - DNA, 12 bp, Homo sapiens
tgtccctacacc

SEQ ID NO: 2047137 - DNA, 12 bp, Homo sapiens
tgtccctaccca

SEQ ID NO: 2047138 - DNA, 16 bp, Homo sapiens
tgtccctacccactct

SEQ ID NO: 2047139 - DNA, 21 bp, Homo sapiens
tgtccctaccgagtctcttct

SEQ ID NO: 2047140 - DNA, 22 bp, Homo sapiens
tgtccctcactgccttccagga

SEQ ID NO: 2047141 - DNA, 15 bp, Homo sapiens
tgtccctctttgcct

SEQ ID NO: 2047142 - DNA, 14 bp, Homo sapiens
tgtccctggtgcag

SEQ ID NO: 2047143 - DNA, 17 bp, Homo sapiens
tgtccctggtgcagagg

SEQ ID NO: 2047144 - DNA, 21 bp, Homo sapiens
tgtccctgtcaccaagctcac

SEQ ID NO: 2047145 - DNA, 13 bp, Homo sapiens
tgtccgcctctgc

SEQ ID NO: 2047146 - DNA, 23 bp, Homo sapiens
tgtccgcctctgcccgcagagcc

SEQ ID NO: 2047147 - DNA, 16 bp, Homo sapiens
tgtcctacccaccctc

SEQ ID NO: 2047148 - DNA, 21 bp, Homo sapiens
tgtcctaggggccgagggaaa

SEQ ID NO: 2047149 - DNA, 20 bp, Homo sapiens
tgtcctatgtcaatttgtat

SEQ ID NO: 2047150 - DNA, 21 bp, Homo sapiens
tgtcctatgtcaatttgtata

SEQ ID NO: 2047151 - DNA, 13 bp, Homo sapiens
tgtcctatgtgtg

SEQ ID NO: 2047152 - DNA, 15 bp, Homo sapiens
tgtcctccagcttcc

SEQ ID NO: 2047153 - DNA, 23 bp, Homo sapiens
tgtcctctcccgcgggcctggac

SEQ ID NO: 2047154 - DNA, 17 bp, Homo sapiens
tgtcctctttactccct

SEQ ID NO: 2047155 - DNA, 13 bp, Homo sapiens
tgtcctgccagct

SEQ ID NO: 2047156 - DNA, 14 bp, Homo sapiens
tgtcctgccagctg

SEQ ID NO: 2047157 - DNA, 16 bp, Homo sapiens
tgtcctgccagctgcc

SEQ ID NO: 2047158 - DNA, 22 bp, Homo sapiens
tgtcctgccagctgccttcctc

SEQ ID NO: 2047159 - DNA, 11 bp, Homo sapiens
tgtcctgcctc

SEQ ID NO: 2047160 - DNA, 23 bp, Homo sapiens
tgtcctgcctctctgctccagag

SEQ ID NO: 2047161 - DNA, 23 bp, Homo sapiens
tgtcctggctgctctcatgcctg

SEQ ID NO: 2047162 - DNA, 17 bp, Homo sapiens
tgtgagtcaccaagccc

SEQ ID NO: 2047163 - DNA, 19 bp, Homo sapiens
tgtgagtcaccaagcccag

SEQ ID NO: 2047164 - DNA, 20 bp, Homo sapiens
tgtgagtggcagccatgcct

SEQ ID NO: 2047165 - DNA, 17 bp, Homo sapiens
tgtgatcactgagacag

SEQ ID NO: 2047166 - DNA, 20 bp, Homo sapiens
tgtgatcaggctatgtatgg

SEQ ID NO: 2047167 - DNA, 21 bp, Homo sapiens
tgtgatccttttatgttattt

SEQ ID NO: 2047168 - DNA, 22 bp, Homo sapiens
tgtgatgatgaaatgaggtcag

SEQ ID NO: 2047169 - DNA, 22 bp, Homo sapiens
tgtgatggggtgggcagggctg

SEQ ID NO: 2047170 - DNA, 17 bp, Homo sapiens
tgtgatgttaactatta

SEQ ID NO: 2047171 - DNA, 23 bp, Homo sapiens
tgtgattccttttgatggggaga

SEQ ID NO: 2047172 - DNA, 16 bp, Homo sapiens
tgtgattctaatgtct

SEQ ID NO: 2047173 - DNA, 18 bp, Homo sapiens
tgtgatttagaactgtat

SEQ ID NO: 2047174 - DNA, 14 bp, Homo sapiens
tgtgatttcctaca

SEQ ID NO: 2047175 - DNA, 15 bp, Homo sapiens
tgtgcaaattaacag

SEQ ID NO: 2047176 - DNA, 19 bp, Homo sapiens
tgtgcaaattttgcattta

SEQ ID NO: 2047177 - DNA, 23 bp, Homo sapiens
tgtgcaagtcttgtcagaattgg

SEQ ID NO: 2047178 - DNA, 16 bp, Homo sapiens
tgtgcacatgcacgtg

SEQ ID NO: 2047179 - DNA, 22 bp, Homo sapiens
tgtgcacatgcacgtgtgtgca

SEQ ID NO: 2047180 - DNA, 13 bp, Homo sapiens
tgtgcacatgtgt

SEQ ID NO: 2047181 - DNA, 19 bp, Homo sapiens
tgtgcaccttacattccta

SEQ ID NO: 2047182 - DNA, 16 bp, Homo sapiens
tgtgcacggcagcttg

SEQ ID NO: 2047183 - DNA, 19 bp, Homo sapiens
tgtgcagactcaataaaat

SEQ ID NO: 2047184 - DNA, 12 bp, Homo sapiens
tgtgcagactga

SEQ ID NO: 2047185 - DNA, 15 bp, Homo sapiens
tgtgcagactgtggc

SEQ ID NO: 2047186 - DNA, 20 bp, Homo sapiens
tgtgcagcagcccagcttcc

SEQ ID NO: 2047187 - DNA, 22 bp, Homo sapiens
tgtgcagcagcccagcttcctg

SEQ ID NO: 2047188 - DNA, 19 bp, Homo sapiens
tgtgcagccccgccctctg

SEQ ID NO: 2047189 - DNA, 20 bp, Homo sapiens
tgtgcagccccgccctctgc

SEQ ID NO: 2047190 - DNA, 23 bp, Homo sapiens
tgtgcagccccgccctctgcgtc

SEQ ID NO: 2047191 - DNA, 13 bp, Homo sapiens
tgtgcagtatttt

SEQ ID NO: 2047192 - DNA, 20 bp, Homo sapiens
tgtgcagtgaaggttgctga

SEQ ID NO: 2047193 - DNA, 12 bp, Homo sapiens
tgtgcagtgttg

SEQ ID NO: 2047194 - DNA, 17 bp, Homo sapiens
tgtgcatgaaagagaaa

SEQ ID NO: 2047195 - DNA, 23 bp, Homo sapiens
tgtgcatgtatgtcttggacact

SEQ ID NO: 2047196 - DNA, 16 bp, Homo sapiens
tgtgcatgtgtgtata

SEQ ID NO: 2047197 - DNA, 17 bp, Homo sapiens
tgtgcatgtgtgtataa

SEQ ID NO: 2047198 - DNA, 17 bp, Homo sapiens
tgtgcatttctgtctct

SEQ ID NO: 2047199 - DNA, 12 bp, Homo sapiens
tgtgccaaacta

SEQ ID NO: 2047200 - DNA, 17 bp, Homo sapiens
tgtgccaatatgtattg

SEQ ID NO: 2047201 - DNA, 18 bp, Homo sapiens
tgtgccaatatgtattgt

SEQ ID NO: 2047202 - DNA, 13 bp, Homo sapiens
tgtgccagagcct

SEQ ID NO: 2047203 - DNA, 15 bp, Homo sapiens
tgtgccagagcctgg

SEQ ID NO: 2047204 - DNA, 18 bp, Homo sapiens
tgtgccagagcctggggc

SEQ ID NO: 2047205 - DNA, 20 bp, Homo sapiens
tgtgccagagcctggggctc

SEQ ID NO: 2047206 - DNA, 20 bp, Homo sapiens
tgtgccaggtttttggtctg

SEQ ID NO: 2047207 - DNA, 20 bp, Homo sapiens
tgtgccatagagtttaacac

SEQ ID NO: 2047208 - DNA, 16 bp, Homo sapiens
tgtgccatgtgccagg

SEQ ID NO: 2047209 - DNA, 14 bp, Homo sapiens
tgtgcccacaggga

SEQ ID NO: 2047210 - DNA, 17 bp, Homo sapiens
tgtgcccacatcccagg

SEQ ID NO: 2047211 - DNA, 21 bp, Homo sapiens
tgtgcccacatcccaggcttc

SEQ ID NO: 2047212 - DNA, 16 bp, Homo sapiens
tgtgccccatgtccaa

SEQ ID NO: 2047213 - DNA, 18 bp, Homo sapiens
tgtgcccctcagagaggc

SEQ ID NO: 2047214 - DNA, 15 bp, Homo sapiens
tgtgccctgccttca

SEQ ID NO: 2047215 - DNA, 14 bp, Homo sapiens
tgtgcctcagcctc

SEQ ID NO: 2047216 - DNA, 15 bp, Homo sapiens
tgtgcctcctcaccc

SEQ ID NO: 2047217 - DNA, 16 bp, Homo sapiens
tgtgcctcctcacccc

SEQ ID NO: 2047218 - DNA, 12 bp, Homo sapiens
tgtgcctctgcc

SEQ ID NO: 2047219 - DNA, 14 bp, Homo sapiens
tgtgcctctgcctg

SEQ ID NO: 2047220 - DNA, 12 bp, Homo sapiens
tgtgcctgccct

SEQ ID NO: 2047221 - DNA, 13 bp, Homo sapiens
tgtgcctgctaga

SEQ ID NO: 2047222 - DNA, 19 bp, Homo sapiens
tgtgcctgctagagcaacc

SEQ ID NO: 2047223 - DNA, 16 bp, Homo sapiens
tgtgccttttatagct

SEQ ID NO: 2047224 - DNA, 19 bp, Homo sapiens
tgtgcgcctacaggagtga

SEQ ID NO: 2047225 - DNA, 22 bp, Homo sapiens
tgtgcgtgcgtgttagtgtgtg

SEQ ID NO: 2047226 - DNA, 20 bp, Homo sapiens
tgtgcgtgtgtgcatgtatg

SEQ ID NO: 2047227 - DNA, 14 bp, Homo sapiens
tgtgctactttgcc

SEQ ID NO: 2047228 - DNA, 16 bp, Homo sapiens
tgtgctactttgcctt

SEQ ID NO: 2047229 - DNA, 15 bp, Homo sapiens
tgtgctattgaactg

SEQ ID NO: 2047230 - DNA, 21 bp, Homo sapiens
tgtgctcacgctcccccgcag

SEQ ID NO: 2047231 - DNA, 23 bp, Homo sapiens
tgtgctgagaatagtgtctgatt

SEQ ID NO: 2047232 - DNA, 20 bp, Homo sapiens
tgtgctgaggactccctcca

SEQ ID NO: 2047233 - DNA, 15 bp, Homo sapiens
tgtgctgtgcctgct

SEQ ID NO: 2047234 - DNA, 16 bp, Homo sapiens
tgtgcttacagtgact

SEQ ID NO: 2047235 - DNA, 12 bp, Homo sapiens
tgtgcttcccta

SEQ ID NO: 2047236 - DNA, 19 bp, Homo sapiens
tgtgcttccctaggctgag

SEQ ID NO: 2047237 - DNA, 17 bp, Homo sapiens
tgtgctttgcattccta

SEQ ID NO: 2047238 - DNA, 16 bp, Homo sapiens
tgtgcttttcctattt

SEQ ID NO: 2047239 - DNA, 16 bp, Homo sapiens
tgtggaaaaatattta

SEQ ID NO: 2047240 - DNA, 17 bp, Homo sapiens
tgtggaaaatgaaaatt

SEQ ID NO: 2047241 - DNA, 19 bp, Homo sapiens
tgtggaaagcctctgctgc

SEQ ID NO: 2047242 - DNA, 13 bp, Homo sapiens
tgtggaaggcagg

SEQ ID NO: 2047243 - DNA, 20 bp, Homo sapiens
tgtggaaggcagggacagag

SEQ ID NO: 2047244 - DNA, 21 bp, Homo sapiens
tgtggaatggattatagagta

SEQ ID NO: 2047245 - DNA, 15 bp, Homo sapiens
tgtggacacagctct

SEQ ID NO: 2047246 - DNA, 14 bp, Homo sapiens
tgtggagaggggtg

SEQ ID NO: 2047247 - DNA, 16 bp, Homo sapiens
tgtggagagtgagaat

SEQ ID NO: 2047248 - DNA, 18 bp, Homo sapiens
tgtggagagtgagaataa

SEQ ID NO: 2047249 - DNA, 20 bp, Homo sapiens
tgtggagagtgagaataatt

SEQ ID NO: 2047250 - DNA, 21 bp, Homo sapiens
tgtggaggtacactcttatag

SEQ ID NO: 2047251 - DNA, 19 bp, Homo sapiens
tgtggcaaagtgctgtacc

SEQ ID NO: 2047252 - DNA, 20 bp, Homo sapiens
tgtggcactgcttgaggagg

SEQ ID NO: 2047253 - DNA, 15 bp, Homo sapiens
tgtggcagaaaagag

SEQ ID NO: 2047254 - DNA, 14 bp, Homo sapiens
tgtggcaggcctag

SEQ ID NO: 2047255 - DNA, 18 bp, Homo sapiens
tgtggcaggcctaggacc

SEQ ID NO: 2047256 - DNA, 14 bp, Homo sapiens
tgtggccagagctg

SEQ ID NO: 2047257 - DNA, 15 bp, Homo sapiens
tgtggccagagctgg

SEQ ID NO: 2047258 - DNA, 19 bp, Homo sapiens
tgtggccagagctggaagg

SEQ ID NO: 2047259 - DNA, 19 bp, Homo sapiens
tgtggccagggtgagagct

SEQ ID NO: 2047260 - DNA, 20 bp, Homo sapiens
tgtggccatatttatagaat

SEQ ID NO: 2047261 - DNA, 17 bp, Homo sapiens
tgtggcccctgaacaag

SEQ ID NO: 2047262 - DNA, 20 bp, Homo sapiens
tgtggccctggcctgctggg

SEQ ID NO: 2047263 - DNA, 15 bp, Homo sapiens
tgtggcctcacttcc

SEQ ID NO: 2047264 - DNA, 13 bp, Homo sapiens
tgtggcctcagcc

SEQ ID NO: 2047265 - DNA, 13 bp, Homo sapiens
tgtggcctgtgtc

SEQ ID NO: 2047266 - DNA, 23 bp, Homo sapiens
tgtggcctgtgtccagcagctgc

SEQ ID NO: 2047267 - DNA, 21 bp, Homo sapiens
tgtggccttgcccgccagcct

SEQ ID NO: 2047268 - DNA, 16 bp, Homo sapiens
tgtggcgggcagtggg

SEQ ID NO: 2047269 - DNA, 13 bp, Homo sapiens
tgtggcggtgcct

SEQ ID NO: 2047270 - DNA, 20 bp, Homo sapiens
tgtggcgttctgctgcccct

SEQ ID NO: 2047271 - DNA, 21 bp, Homo sapiens
tgtggctaaatgcctaataaa

SEQ ID NO: 2047272 - DNA, 15 bp, Homo sapiens
tgtggctcctgcctt

SEQ ID NO: 2047273 - DNA, 14 bp, Homo sapiens
tgtggctgcagaga

SEQ ID NO: 2047274 - DNA, 14 bp, Homo sapiens
tgtggctgctagca

SEQ ID NO: 2047275 - DNA, 17 bp, Homo sapiens
tgtggctttctttcttt

SEQ ID NO: 2047276 - DNA, 15 bp, Homo sapiens
tgtgggaagggagag

SEQ ID NO: 2047277 - DNA, 21 bp, Homo sapiens
ttaaaggggcagaaaaactct

SEQ ID NO: 2047278 - DNA, 12 bp, Homo sapiens
ttaaataaatgt

SEQ ID NO: 2047279 - DNA, 18 bp, Homo sapiens
ttaaataaatgtcattaa

SEQ ID NO: 2047280 - DNA, 20 bp, Homo sapiens
ttaaataaatgtcattaaaa

SEQ ID NO: 2047281 - DNA, 13 bp, Homo sapiens
ttaaataaattca

SEQ ID NO: 2047282 - DNA, 15 bp, Homo sapiens
ttaaataaattcaaa

SEQ ID NO: 2047283 - DNA, 21 bp, Homo sapiens
ttaaataaattcaaaccattt

SEQ ID NO: 2047284 - DNA, 23 bp, Homo sapiens
ttaaataaattcaaaccatttaa

SEQ ID NO: 2047285 - DNA, 16 bp, Homo sapiens
ttaaatacagacacta

SEQ ID NO: 2047286 - DNA, 20 bp, Homo sapiens
ttaaatacagacactaagtt

SEQ ID NO: 2047287 - DNA, 14 bp, Homo sapiens
ttaaatatgaacaa

SEQ ID NO: 2047288 - DNA, 17 bp, Homo sapiens
ttaaatatttacatatg

SEQ ID NO: 2047289 - DNA, 14 bp, Homo sapiens
ttaaatcaaaagct

SEQ ID NO: 2047290 - DNA, 19 bp, Homo sapiens
ttaaatcaaaagctgcttg

SEQ ID NO: 2047291 - DNA, 21 bp, Homo sapiens
ttaaatctgcctttgtttcta

SEQ ID NO: 2047292 - DNA, 15 bp, Homo sapiens
ttaaatgaaagcatg

SEQ ID NO: 2047293 - DNA, 20 bp, Homo sapiens
ttaaatgtatatgtcattta

SEQ ID NO: 2047294 - DNA, 14 bp, Homo sapiens
ttaaatgttgaaat

SEQ ID NO: 2047295 - DNA, 21 bp, Homo sapiens
ttaaattataacttaaaatat

SEQ ID NO: 2047296 - DNA, 16 bp, Homo sapiens
ttaaattataagatgt

SEQ ID NO: 2047297 - DNA, 18 bp, Homo sapiens
ttaaattatactgtagct

SEQ ID NO: 2047298 - DNA, 16 bp, Homo sapiens
ttaaattctttttcaa

SEQ ID NO: 2047299 - DNA, 22 bp, Homo sapiens
ttaaattctttttcaaaaatta

SEQ ID NO: 2047300 - DNA, 16 bp, Homo sapiens
ttaaattgtaaatttt

SEQ ID NO: 2047301 - DNA, 18 bp, Homo sapiens
ttaaattttaagcttgaa

SEQ ID NO: 2047302 - DNA, 17 bp, Homo sapiens
ttaaattttaaggtaga

SEQ ID NO: 2047303 - DNA, 20 bp, Homo sapiens
ttaacaaaacaagaaagaaa

SEQ ID NO: 2047304 - DNA, 14 bp, Homo sapiens
ttaacaacttgtct

SEQ ID NO: 2047305 - DNA, 16 bp, Homo sapiens
ttaacagaaccagagg

SEQ ID NO: 2047306 - DNA, 20 bp, Homo sapiens
ttaacagtgcccttttcatc

SEQ ID NO: 2047307 - DNA, 22 bp, Homo sapiens
ttaacatcatcaggcttggaat

SEQ ID NO: 2047308 - DNA, 13 bp, Homo sapiens
ttaaccctctctt

SEQ ID NO: 2047309 - DNA, 18 bp, Homo sapiens
ttaaccgtttttcaagaa

SEQ ID NO: 2047310 - DNA, 21 bp, Homo sapiens
ttaaccttagagcttggacag

SEQ ID NO: 2047311 - DNA, 13 bp, Homo sapiens
ttaactaatttaa

SEQ ID NO: 2047312 - DNA, 17 bp, Homo sapiens
ttaactaatttaaacca

SEQ ID NO: 2047313 - DNA, 19 bp, Homo sapiens
ttaactaatttaaaccagc

SEQ ID NO: 2047314 - DNA, 23 bp, Homo sapiens
ttaactaatttaaaccagcagaa

SEQ ID NO: 2047315 - DNA, 12 bp, Homo sapiens
ttaactagaatt

SEQ ID NO: 2047316 - DNA, 16 bp, Homo sapiens
ttaactatgtgatgtt

SEQ ID NO: 2047317 - DNA, 17 bp, Homo sapiens
ttaactgtgtgaagaaa

SEQ ID NO: 2047318 - DNA, 21 bp, Homo sapiens
ttaactgtgtgaagaaatgga

SEQ ID NO: 2047319 - DNA, 23 bp, Homo sapiens
ttaacttaaattttaagcttgaa

SEQ ID NO: 2047320 - DNA, 22 bp, Homo sapiens
ttaacttcagagggaaagtaaa

SEQ ID NO: 2047321 - DNA, 16 bp, Homo sapiens
ttaacttgtcaaaaaa

SEQ ID NO: 2047322 - DNA, 22 bp, Homo sapiens
ttaacttgtcaaaaaacaaaaa

SEQ ID NO: 2047323 - DNA, 18 bp, Homo sapiens
ttaactttatcacattat

SEQ ID NO: 2047324 - DNA, 23 bp, Homo sapiens
ttaagaatgcagattcctgggcc

SEQ ID NO: 2047325 - DNA, 15 bp, Homo sapiens
ttaagagagaaatct

SEQ ID NO: 2047326 - DNA, 15 bp, Homo sapiens
ttaagagatacattc

SEQ ID NO: 2047327 - DNA, 16 bp, Homo sapiens
ttaagaggcagggtct

SEQ ID NO: 2047328 - DNA, 19 bp, Homo sapiens
ttaagaggctttggcccaa

SEQ ID NO: 2047329 - DNA, 17 bp, Homo sapiens
ttaagatacactcctgc

SEQ ID NO: 2047330 - DNA, 19 bp, Homo sapiens
ttaagcaaaggaaaccaaa

SEQ ID NO: 2047331 - DNA, 16 bp, Homo sapiens
ttaagcagcctttctg

SEQ ID NO: 2047332 - DNA, 19 bp, Homo sapiens
ttaagcagcctttctgtgg

SEQ ID NO: 2047333 - DNA, 21 bp, Homo sapiens
ttaagcattttactgtctgta

SEQ ID NO: 2047334 - DNA, 16 bp, Homo sapiens
ttaagccaaaacaatg

SEQ ID NO: 2047335 - DNA, 13 bp, Homo sapiens
ttaagccctgagg

SEQ ID NO: 2047336 - DNA, 19 bp, Homo sapiens
ttaagcctcatatttaaag

SEQ ID NO: 2047337 - DNA, 14 bp, Homo sapiens
ttaagctgtttcca

SEQ ID NO: 2047338 - DNA, 12 bp, Homo sapiens
ttaagcttattt

SEQ ID NO: 2047339 - DNA, 20 bp, Homo sapiens
ttaaggattgtgatattttt

SEQ ID NO: 2047340 - DNA, 13 bp, Homo sapiens
ttaagggaaaaat

SEQ ID NO: 2047341 - DNA, 15 bp, Homo sapiens
ttaagggaaaaatat

SEQ ID NO: 2047342 - DNA, 21 bp, Homo sapiens
ttaagtatatagtatatttat

SEQ ID NO: 2047343 - DNA, 11 bp, Homo sapiens
ttaagtattta

SEQ ID NO: 2047344 - DNA, 15 bp, Homo sapiens
ttaagtgcctgagac

SEQ ID NO: 2047345 - DNA, 16 bp, Homo sapiens
ttaagtgctttgtaat

SEQ ID NO: 2047346 - DNA, 19 bp, Homo sapiens
ttaagttagagaatatatt

SEQ ID NO: 2047347 - DNA, 19 bp, Homo sapiens
ttaagttctcaatgtgaaa

SEQ ID NO: 2047348 - DNA, 12 bp, Homo sapiens
ttaataacaatt

SEQ ID NO: 2047349 - DNA, 23 bp, Homo sapiens
ttaataataagataatgatgagt

SEQ ID NO: 2047350 - DNA, 21 bp, Homo sapiens
ttaataattatgtgccatttt

SEQ ID NO: 2047351 - DNA, 19 bp, Homo sapiens
ttaataatttagacttcaa

SEQ ID NO: 2047352 - DNA, 15 bp, Homo sapiens
ttaatactaaaatat

SEQ ID NO: 2047353 - DNA, 19 bp, Homo sapiens
ttaatagaatataattatc

SEQ ID NO: 2047354 - DNA, 15 bp, Homo sapiens
ttaatagcaaagaat

SEQ ID NO: 2047355 - DNA, 16 bp, Homo sapiens
ttaatagcaaagaatt

SEQ ID NO: 2047356 - DNA, 15 bp, Homo sapiens
ttaatatagctattt

SEQ ID NO: 2047357 - DNA, 19 bp, Homo sapiens
ttaatatatcccagaaatt

SEQ ID NO: 2047358 - DNA, 17 bp, Homo sapiens
ttaatatcctaaacatc

SEQ ID NO: 2047359 - DNA, 18 bp, Homo sapiens
ttaatatttaaacagcag

SEQ ID NO: 2047360 - DNA, 16 bp, Homo sapiens
ttaatattttgtattt

SEQ ID NO: 2047361 - DNA, 17 bp, Homo sapiens
ttaatcaactttcctta

SEQ ID NO: 2047362 - DNA, 19 bp, Homo sapiens
ttaatcaagaatattcaaa

SEQ ID NO: 2047363 - DNA, 15 bp, Homo sapiens
ttaatcaccaaagta

SEQ ID NO: 2047364 - DNA, 22 bp, Homo sapiens
ttaatcattttgcctcttttct

SEQ ID NO: 2047365 - DNA, 18 bp, Homo sapiens
ttaatcgaaatgaattta

SEQ ID NO: 2047366 - DNA, 21 bp, Homo sapiens
ttaatcgaaatgaatttatct

SEQ ID NO: 2047367 - DNA, 13 bp, Homo sapiens
ttaatcttcatgg

SEQ ID NO: 2047368 - DNA, 18 bp, Homo sapiens
ttaatctttgtgacagga

SEQ ID NO: 2047369 - DNA, 17 bp, Homo sapiens
ttaatgaactgtgacag

SEQ ID NO: 2047370 - DNA, 22 bp, Homo sapiens
ttaatgaactgtgacaggaagc

SEQ ID NO: 2047371 - DNA, 14 bp, Homo sapiens
ttaatgacttttta

SEQ ID NO: 2047372 - DNA, 15 bp, Homo sapiens
ttaatgactttttat

SEQ ID NO: 2047373 - DNA, 17 bp, Homo sapiens
ttaatgagaacatttac

SEQ ID NO: 2047374 - DNA, 16 bp, Homo sapiens
ttaatgcatttttgat

SEQ ID NO: 2047375 - DNA, 14 bp, Homo sapiens
ttaatgccttccac

SEQ ID NO: 2047376 - DNA, 19 bp, Homo sapiens
ttaatggtgccttcatttg

SEQ ID NO: 2047377 - DNA, 17 bp, Homo sapiens
ttaatgtcacaggcagg

SEQ ID NO: 2047378 - DNA, 18 bp, Homo sapiens
ttaatgtcacaggcaggt

SEQ ID NO: 2047379 - DNA, 19 bp, Homo sapiens
ttaatgtgtgtctgaagac

SEQ ID NO: 2047380 - DNA, 23 bp, Homo sapiens
ttaatgttctgaataatttctta

SEQ ID NO: 2047381 - DNA, 16 bp, Homo sapiens
ttaatgttttctgctg

SEQ ID NO: 2047382 - DNA, 18 bp, Homo sapiens
ttaattaactatgtgatg

SEQ ID NO: 2047383 - DNA, 23 bp, Homo sapiens
ttaattaactatgtgatgttaac

SEQ ID NO: 2047384 - DNA, 14 bp, Homo sapiens
ttaattattattct

SEQ ID NO: 2047385 - DNA, 16 bp, Homo sapiens
ttaattcttatttctg

SEQ ID NO: 2047386 - DNA, 22 bp, Homo sapiens
ttaattgattattctgattcca

SEQ ID NO: 2047387 - DNA, 14 bp, Homo sapiens
ttaatttaaagcca

SEQ ID NO: 2047388 - DNA, 16 bp, Homo sapiens
ttaatttagaaaactt

SEQ ID NO: 2047389 - DNA, 13 bp, Homo sapiens
ttaatttatttca

SEQ ID NO: 2047390 - DNA, 19 bp, Homo sapiens
ttaatttgtttttcttatc

SEQ ID NO: 2047391 - DNA, 11 bp, Homo sapiens
ttcaaaagtgg

SEQ ID NO: 2047392 - DNA, 14 bp, Homo sapiens
ttcaaaatgttcgt

SEQ ID NO: 2047393 - DNA, 15 bp, Homo sapiens
ttcaaacaagaatgt

SEQ ID NO: 2047394 - DNA, 18 bp, Homo sapiens
ttcaaactattgggaggg

SEQ ID NO: 2047395 - DNA, 13 bp, Homo sapiens
ttcaaagaagtca

SEQ ID NO: 2047396 - DNA, 16 bp, Homo sapiens
ttcaaagcatgaaatg

SEQ ID NO: 2047397 - DNA, 20 bp, Homo sapiens
ttcaaagctgtgtgtttgga

SEQ ID NO: 2047398 - DNA, 23 bp, Homo sapiens
ttcaaagctgtgtgtttggaaga

SEQ ID NO: 2047399 - DNA, 14 bp, Homo sapiens
ttcaaagtttaata

SEQ ID NO: 2047400 - DNA, 12 bp, Homo sapiens
ttcaaatcctca

SEQ ID NO: 2047401 - DNA, 12 bp, Homo sapiens
ttcaaatgaagg

SEQ ID NO: 2047402 - DNA, 13 bp, Homo sapiens
ttcaaatgcattt

SEQ ID NO: 2047403 - DNA, 13 bp, Homo sapiens
ttcaaatttcaca

SEQ ID NO: 2047404 - DNA, 14 bp, Homo sapiens
ttcaacaattctaa

SEQ ID NO: 2047405 - DNA, 19 bp, Homo sapiens
ttcaacaattctaaaatga

SEQ ID NO: 2047406 - DNA, 22 bp, Homo sapiens
ttcaacacattacttgcacaag

SEQ ID NO: 2047407 - DNA, 21 bp, Homo sapiens
ttcaacatgttatttgtaata

SEQ ID NO: 2047408 - DNA, 20 bp, Homo sapiens
ttcaaccagcattttactac

SEQ ID NO: 2047409 - DNA, 20 bp, Homo sapiens
ttcaaccattccccatggga

SEQ ID NO: 2047410 - DNA, 16 bp, Homo sapiens
ttcaaccctcagcctt

SEQ ID NO: 2047411 - DNA, 19 bp, Homo sapiens
ttcaacctggtggcaccag

SEQ ID NO: 2047412 - DNA, 16 bp, Homo sapiens
ttcaacctgtgtctta

SEQ ID NO: 2047413 - DNA, 16 bp, Homo sapiens
ttcaacgcagccctgc

SEQ ID NO: 2047414 - DNA, 19 bp, Homo sapiens
ttcaacgcagccctgcttt

SEQ ID NO: 2047415 - DNA, 14 bp, Homo sapiens
ttcaactccagaag

SEQ ID NO: 2047416 - DNA, 17 bp, Homo sapiens
ttcaactgaccagcctc

SEQ ID NO: 2047417 - DNA, 12 bp, Homo sapiens
ttcaactggctg

SEQ ID NO: 2047418 - DNA, 14 bp, Homo sapiens
ttcaacttaaatca

SEQ ID NO: 2047419 - DNA, 12 bp, Homo sapiens
ttcaagaaataa

SEQ ID NO: 2047420 - DNA, 21 bp, Homo sapiens
ttcaagacaccaaattccaaa

SEQ ID NO: 2047421 - DNA, 20 bp, Homo sapiens
ttcaagagaagaaaaaatta

SEQ ID NO: 2047422 - DNA, 20 bp, Homo sapiens
ttcaagctgtcccctctgtc

SEQ ID NO: 2047423 - DNA, 14 bp, Homo sapiens
ttcaaggaaagtga

SEQ ID NO: 2047424 - DNA, 19 bp, Homo sapiens
ttcaaggagatataaaatc

SEQ ID NO: 2047425 - DNA, 19 bp, Homo sapiens
ttcaaggagtatgcaggga

SEQ ID NO: 2047426 - DNA, 17 bp, Homo sapiens
ttcaaggtctgcttttc

SEQ ID NO: 2047427 - DNA, 21 bp, Homo sapiens
ttcaagtattaggggtaatat

SEQ ID NO: 2047428 - DNA, 14 bp, Homo sapiens
ttcaagtgatatat

SEQ ID NO: 2047429 - DNA, 20 bp, Homo sapiens
ttcaagtgcctcttgttgca

SEQ ID NO: 2047430 - DNA, 13 bp, Homo sapiens
ttcaagttaaagt

SEQ ID NO: 2047431 - DNA, 16 bp, Homo sapiens
ttcaagttagctcagg

SEQ ID NO: 2047432 - DNA, 21 bp, Homo sapiens
ttcaataaaaaaaagaaatga

SEQ ID NO: 2047433 - DNA, 13 bp, Homo sapiens
ttcaataaagctg

SEQ ID NO: 2047434 - DNA, 13 bp, Homo sapiens
ttcaataaagtat

SEQ ID NO: 2047435 - DNA, 14 bp, Homo sapiens
ttcaataaagtatc

SEQ ID NO: 2047436 - DNA, 16 bp, Homo sapiens
ttcaatctttgctgta

SEQ ID NO: 2047437 - DNA, 21 bp, Homo sapiens
ttcaatgggacaggaactagg

SEQ ID NO: 2047438 - DNA, 21 bp, Homo sapiens
ttcaatgtgattctaatgtct

SEQ ID NO: 2047439 - DNA, 15 bp, Homo sapiens
ttcaattatttcaat

SEQ ID NO: 2047440 - DNA, 13 bp, Homo sapiens
ttcaattcagtgc

SEQ ID NO: 2047441 - DNA, 16 bp, Homo sapiens
ttcaattcctctggga

SEQ ID NO: 2047442 - DNA, 13 bp, Homo sapiens
ttcaattcctggg

SEQ ID NO: 2047443 - DNA, 13 bp, Homo sapiens
ttcaattctcaaa

SEQ ID NO: 2047444 - DNA, 15 bp, Homo sapiens
ttcaattgtatttta

SEQ ID NO: 2047445 - DNA, 20 bp, Homo sapiens
ttcaattgtattttatatga

SEQ ID NO: 2047446 - DNA, 14 bp, Homo sapiens
ttcacaaaatgcaa

SEQ ID NO: 2047447 - DNA, 21 bp, Homo sapiens
ttcacaacataaggagaatgt

SEQ ID NO: 2047448 - DNA, 18 bp, Homo sapiens
ttcacaaccagccacaca

SEQ ID NO: 2047449 - DNA, 20 bp, Homo sapiens
ttcacaaccagccacacaga

SEQ ID NO: 2047450 - DNA, 13 bp, Homo sapiens
ttcacaactagga

SEQ ID NO: 2047451 - DNA, 16 bp, Homo sapiens
ttcacaactaggacct

SEQ ID NO: 2047452 - DNA, 19 bp, Homo sapiens
ttcacaactaggacctcat

SEQ ID NO: 2047453 - DNA, 20 bp, Homo sapiens
ttcacaatgaaatgctctcc

SEQ ID NO: 2047454 - DNA, 17 bp, Homo sapiens
ttcacacctcacgctct

SEQ ID NO: 2047455 - DNA, 23 bp, Homo sapiens
ttcacacctcacgctctggacat

SEQ ID NO: 2047456 - DNA, 18 bp, Homo sapiens
ttcacaggtgtggtgtaa

SEQ ID NO: 2047457 - DNA, 12 bp, Homo sapiens
ttcacagtgttt

SEQ ID NO: 2047458 - DNA, 17 bp, Homo sapiens
ttcacataccctccccc

SEQ ID NO: 2047459 - DNA, 22 bp, Homo sapiens
ttcacattaatatttgctgaca

SEQ ID NO: 2047460 - DNA, 18 bp, Homo sapiens
ttcacatttgatgtacat

SEQ ID NO: 2047461 - DNA, 20 bp, Homo sapiens
ttcacatttgatgtacatgt

SEQ ID NO: 2047462 - DNA, 14 bp, Homo sapiens
ttcaccaaatcttg

SEQ ID NO: 2047463 - DNA, 20 bp, Homo sapiens
ttcaccagcaactctgactc

SEQ ID NO: 2047464 - DNA, 18 bp, Homo sapiens
ttcacccagctaatctgt

SEQ ID NO: 2047465 - DNA, 17 bp, Homo sapiens
ttcaccccccactcacc

SEQ ID NO: 2047466 - DNA, 12 bp, Homo sapiens
ttcacccctgca

SEQ ID NO: 2047467 - DNA, 21 bp, Homo sapiens
ttcacctggaagcatttgttt

SEQ ID NO: 2047468 - DNA, 23 bp, Homo sapiens
ttcacctgtttttaagctgtttc

SEQ ID NO: 2047469 - DNA, 14 bp, Homo sapiens
ttcactcactgtca

SEQ ID NO: 2047470 - DNA, 19 bp, Homo sapiens
ttcactcactgtcaatgat

SEQ ID NO: 2047471 - DNA, 21 bp, Homo sapiens
ttcactccggtgtgcctgcag

SEQ ID NO: 2047472 - DNA, 24 bp, Homo sapiens
ttcactccggtgtgcctgcagccc

SEQ ID NO: 2047473 - DNA, 17 bp, Homo sapiens
ttcactgctggctgcct

SEQ ID NO: 2047474 - DNA, 21 bp, Homo sapiens
ttcactggcgaggtgcggcca

SEQ ID NO: 2047475 - DNA, 21 bp, Homo sapiens
ttcactgtgaggggaaggcct

SEQ ID NO: 2047476 - DNA, 23 bp, Homo sapiens
ttcacttcgatgactggatacag

SEQ ID NO: 2047477 - DNA, 17 bp, Homo sapiens
ttcactttcaaaaacat

SEQ ID NO: 2047478 - DNA, 18 bp, Homo sapiens
ttcagaaaacataatata

SEQ ID NO: 2047479 - DNA, 20 bp, Homo sapiens
ttcagaaaacataatataag

SEQ ID NO: 2047480 - DNA, 19 bp, Homo sapiens
ttcagaaagcattacattt

SEQ ID NO: 2047481 - DNA, 20 bp, Homo sapiens
ttcagaaagcattacatttc

SEQ ID NO: 2047482 - DNA, 16 bp, Homo sapiens
ttcagaacatcctcca

SEQ ID NO: 2047483 - DNA, 17 bp, Homo sapiens
ttcagaacatgctggat

SEQ ID NO: 2047484 - DNA, 12 bp, Homo sapiens
ttcagaagaaaa

SEQ ID NO: 2047485 - DNA, 14 bp, Homo sapiens
ttcagaagaaaaag

SEQ ID NO: 2047486 - DNA, 13 bp, Homo sapiens
ttcagaagaaatt

SEQ ID NO: 2047487 - DNA, 16 bp, Homo sapiens
ttcagaagacactgca

SEQ ID NO: 2047488 - DNA, 12 bp, Homo sapiens
ttcagaagagat

SEQ ID NO: 2047489 - DNA, 14 bp, Homo sapiens
ttcagaagcatcac

SEQ ID NO: 2047490 - DNA, 23 bp, Homo sapiens
ttcagaagtttggcaatagtttg

SEQ ID NO: 2047491 - DNA, 16 bp, Homo sapiens
ttcagaattttgtata

SEQ ID NO: 2047492 - DNA, 18 bp, Homo sapiens
ttcagaattttgtatatt

SEQ ID NO: 2047493 - DNA, 15 bp, Homo sapiens
ttcagacaagcaaca

SEQ ID NO: 2047494 - DNA, 13 bp, Homo sapiens
ttcagaccccagc

SEQ ID NO: 2047495 - DNA, 12 bp, Homo sapiens
ttcagagaagtc

SEQ ID NO: 2047496 - DNA, 23 bp, Homo sapiens
ttcagagaagtcagttggagaaa

SEQ ID NO: 2047497 - DNA, 15 bp, Homo sapiens
ttcagagaggccttt

SEQ ID NO: 2047498 - DNA, 22 bp, Homo sapiens
ttcagagatgtaccatgttaaa

SEQ ID NO: 2047499 - DNA, 13 bp, Homo sapiens
ttcagagccagtg

SEQ ID NO: 2047500 - DNA, 12 bp, Homo sapiens
ttcagagcctag

SEQ ID NO: 2047501 - DNA, 20 bp, Homo sapiens
ttcagagcctagccacctcc

SEQ ID NO: 2047502 - DNA, 19 bp, Homo sapiens
ttcagaggagccagaagta

SEQ ID NO: 2047503 - DNA, 19 bp, Homo sapiens
ttcagaggctgcaggactt

SEQ ID NO: 2047504 - DNA, 15 bp, Homo sapiens
ttcagatatatatca

SEQ ID NO: 2047505 - DNA, 16 bp, Homo sapiens
ttcagatatatttttc

SEQ ID NO: 2047506 - DNA, 12 bp, Homo sapiens
ttcccgctcagc

SEQ ID NO: 2047507 - DNA, 21 bp, Homo sapiens
ttcccgctcagccctccctgc

SEQ ID NO: 2047508 - DNA, 19 bp, Homo sapiens
ttcccggagcacagccctg

SEQ ID NO: 2047509 - DNA, 20 bp, Homo sapiens
ttccctagaggcaaacattt

SEQ ID NO: 2047510 - DNA, 16 bp, Homo sapiens
ttccctatcaaaacat

SEQ ID NO: 2047511 - DNA, 23 bp, Homo sapiens
ttccctatcaaaacatatcaatt

SEQ ID NO: 2047512 - DNA, 13 bp, Homo sapiens
ttccctatctttt

SEQ ID NO: 2047513 - DNA, 18 bp, Homo sapiens
ttccctcaccccctccca

SEQ ID NO: 2047514 - DNA, 19 bp, Homo sapiens
ttccctcaccccctcccac

SEQ ID NO: 2047515 - DNA, 22 bp, Homo sapiens
ttccctcaccccctcccacccc

SEQ ID NO: 2047516 - DNA, 22 bp, Homo sapiens
ttccctcccaacagagctgggc

SEQ ID NO: 2047517 - DNA, 14 bp, Homo sapiens
ttccctctcccagg

SEQ ID NO: 2047518 - DNA, 15 bp, Homo sapiens
ttccctctcccaggc

SEQ ID NO: 2047519 - DNA, 11 bp, Homo sapiens
ttccctctcta

SEQ ID NO: 2047520 - DNA, 16 bp, Homo sapiens
ttccctctcttgcctt

SEQ ID NO: 2047521 - DNA, 23 bp, Homo sapiens
ttccctctgagaattccaaggag

SEQ ID NO: 2047522 - DNA, 17 bp, Homo sapiens
ttccctgaaaacccaga

SEQ ID NO: 2047523 - DNA, 20 bp, Homo sapiens
ttccctgaaaacccagagag

SEQ ID NO: 2047524 - DNA, 17 bp, Homo sapiens
ttccctgaacatctgtg

SEQ ID NO: 2047525 - DNA, 16 bp, Homo sapiens
ttccctgagtcaccag

SEQ ID NO: 2047526 - DNA, 15 bp, Homo sapiens
ttccctgcaccctgg

SEQ ID NO: 2047527 - DNA, 16 bp, Homo sapiens
ttccctgtcagaggct

SEQ ID NO: 2047528 - DNA, 16 bp, Homo sapiens
ttccctgttttaaatt

SEQ ID NO: 2047529 - DNA, 12 bp, Homo sapiens
ttcccttgacca

SEQ ID NO: 2047530 - DNA, 22 bp, Homo sapiens
ttccgctcctttacctaccacc

SEQ ID NO: 2047531 - DNA, 23 bp, Homo sapiens
ttccgtcacatatacaaaagcaa

SEQ ID NO: 2047532 - DNA, 23 bp, Homo sapiens
ttccgtctccctaaaataaaaac

SEQ ID NO: 2047533 - DNA, 13 bp, Homo sapiens
ttcctaaatgcag

SEQ ID NO: 2047534 - DNA, 14 bp, Homo sapiens
ttcctaaatgcagt

SEQ ID NO: 2047535 - DNA, 19 bp, Homo sapiens
ttcctaagaagtccccagg

SEQ ID NO: 2047536 - DNA, 20 bp, Homo sapiens
ttcctaagcctgttgctgaa

SEQ ID NO: 2047537 - DNA, 14 bp, Homo sapiens
ttcctagccctctc

SEQ ID NO: 2047538 - DNA, 17 bp, Homo sapiens
ttcctaggccccagagc

SEQ ID NO: 2047539 - DNA, 12 bp, Homo sapiens
ttcctagtgaaa

SEQ ID NO: 2047540 - DNA, 19 bp, Homo sapiens
ttcctatttgttttcatgg

SEQ ID NO: 2047541 - DNA, 15 bp, Homo sapiens
ttcctattttaaaac

SEQ ID NO: 2047542 - DNA, 22 bp, Homo sapiens
ttcctattttaaaaccatgcag

SEQ ID NO: 2047543 - DNA, 20 bp, Homo sapiens
ttcctcaccaataacttcag

SEQ ID NO: 2047544 - DNA, 21 bp, Homo sapiens
ttcctcaccaataacttcaga

SEQ ID NO: 2047545 - DNA, 14 bp, Homo sapiens
ttcctcagctgcca

SEQ ID NO: 2047546 - DNA, 17 bp, Homo sapiens
ttcctcagtcctggaag

SEQ ID NO: 2047547 - DNA, 16 bp, Homo sapiens
ttcctcatcagtagat

SEQ ID NO: 2047548 - DNA, 19 bp, Homo sapiens
ttcctcatctgcagaatgg

SEQ ID NO: 2047549 - DNA, 18 bp, Homo sapiens
ttcctccaaactcctgcc

SEQ ID NO: 2047550 - DNA, 22 bp, Homo sapiens
ttcctcccagttctacaagcat

SEQ ID NO: 2047551 - DNA, 19 bp, Homo sapiens
ttcctccccaccttcccca

SEQ ID NO: 2047552 - DNA, 16 bp, Homo sapiens
ttcctccctcatgagc

SEQ ID NO: 2047553 - DNA, 24 bp, Homo sapiens
ttcctccctggcatgaccatcctg

SEQ ID NO: 2047554 - DNA, 14 bp, Homo sapiens
ttcctccgtccacc

SEQ ID NO: 2047555 - DNA, 16 bp, Homo sapiens
ttcctcctccacagtg

SEQ ID NO: 2047556 - DNA, 16 bp, Homo sapiens
ttcctcctgaagcctc

SEQ ID NO: 2047557 - DNA, 19 bp, Homo sapiens
ttcctcgcctaggcctgtg

SEQ ID NO: 2047558 - DNA, 18 bp, Homo sapiens
ttcctctcaagctagcca

SEQ ID NO: 2047559 - DNA, 18 bp, Homo sapiens
ttcctctcactaaacttt

SEQ ID NO: 2047560 - DNA, 12 bp, Homo sapiens
ttcctctccact

SEQ ID NO: 2047561 - DNA, 16 bp, Homo sapiens
ttcctctccagccttc

SEQ ID NO: 2047562 - DNA, 19 bp, Homo sapiens
ttcctctccagccttctct

SEQ ID NO: 2047563 - DNA, 21 bp, Homo sapiens
ttcctctccagccttctctct

SEQ ID NO: 2047564 - DNA, 16 bp, Homo sapiens
ttcctcttccccttgc

SEQ ID NO: 2047565 - DNA, 17 bp, Homo sapiens
ttcctcttgcctctctc

SEQ ID NO: 2047566 - DNA, 17 bp, Homo sapiens
ttcctctttgcatggaa

SEQ ID NO: 2047567 - DNA, 13 bp, Homo sapiens
ttcctgaagccag

SEQ ID NO: 2047568 - DNA, 22 bp, Homo sapiens
ttcctgacctcctcctgccctc

SEQ ID NO: 2047569 - DNA, 23 bp, Homo sapiens
ttcctgagtgtgggcttctgaaa

SEQ ID NO: 2047570 - DNA, 17 bp, Homo sapiens
ttcctgataataattga

SEQ ID NO: 2047571 - DNA, 15 bp, Homo sapiens
ttcctgattccccac

SEQ ID NO: 2047572 - DNA, 15 bp, Homo sapiens
ttcctgcaaagggaa

SEQ ID NO: 2047573 - DNA, 11 bp, Homo sapiens
ttcctgcactc

SEQ ID NO: 2047574 - DNA, 15 bp, Homo sapiens
ttcctgccaccagtc

SEQ ID NO: 2047575 - DNA, 17 bp, Homo sapiens
ttcctgccaccagtcac

SEQ ID NO: 2047576 - DNA, 23 bp, Homo sapiens
ttcctgccccaactccttccagc

SEQ ID NO: 2047577 - DNA, 18 bp, Homo sapiens
ttcctgccgcaacagttt

SEQ ID NO: 2047578 - DNA, 21 bp, Homo sapiens
ttcctgcgggcttttccccgg

SEQ ID NO: 2047579 - DNA, 23 bp, Homo sapiens
ttcctgctgctgtaactgctgag

SEQ ID NO: 2047580 - DNA, 24 bp, Homo sapiens
ttcctgctgctgtaactgctgagc

SEQ ID NO: 2047581 - DNA, 20 bp, Homo sapiens
ttcctggacagctgtgcctc

SEQ ID NO: 2047582 - DNA, 23 bp, Homo sapiens
ttcctggccccgggctctggcca

SEQ ID NO: 2047583 - DNA, 10 bp, Homo sapiens
ttcctggcct

SEQ ID NO: 2047584 - DNA, 18 bp, Homo sapiens
ttcctggcctcactggct

SEQ ID NO: 2047585 - DNA, 22 bp, Homo sapiens
ttcctggcctcactggctgggg

SEQ ID NO: 2047586 - DNA, 20 bp, Homo sapiens
ttcctggggtggattcctaa

SEQ ID NO: 2047587 - DNA, 16 bp, Homo sapiens
ttcctgggtggctact

SEQ ID NO: 2047588 - DNA, 17 bp, Homo sapiens
ttcctgggtggctactc

SEQ ID NO: 2047589 - DNA, 23 bp, Homo sapiens
ttcctggtattatttacaatgca

SEQ ID NO: 2047590 - DNA, 19 bp, Homo sapiens
ttcctggtgaggcccagcc

SEQ ID NO: 2047591 - DNA, 11 bp, Homo sapiens
ttcctgtaaca

SEQ ID NO: 2047592 - DNA, 14 bp, Homo sapiens
ttcctgtcccacct

SEQ ID NO: 2047593 - DNA, 17 bp, Homo sapiens
ttcctgtgccaacctga

SEQ ID NO: 2047594 - DNA, 17 bp, Homo sapiens
ttcctgtgggccaggag

SEQ ID NO: 2047595 - DNA, 22 bp, Homo sapiens
ttcctgtgggccaggagctcag

SEQ ID NO: 2047596 - DNA, 23 bp, Homo sapiens
ttcctgttaggtattagaaagtg

SEQ ID NO: 2047597 - DNA, 20 bp, Homo sapiens
ttcctgttcaccttatgtat

SEQ ID NO: 2047598 - DNA, 21 bp, Homo sapiens
ttcctgttcaccttatgtatt

SEQ ID NO: 2047599 - DNA, 14 bp, Homo sapiens
ttcctgttgtctga

SEQ ID NO: 2047600 - DNA, 15 bp, Homo sapiens
ttccttaagccagga

SEQ ID NO: 2047601 - DNA, 22 bp, Homo sapiens
ttccttagcttagacctcagcc

SEQ ID NO: 2047602 - DNA, 22 bp, Homo sapiens
ttccttcagtgcatctgggaag

SEQ ID NO: 2047603 - DNA, 23 bp, Homo sapiens
ttccttcccccatcccctttcct

SEQ ID NO: 2047604 - DNA, 13 bp, Homo sapiens
ttccttccctggc

SEQ ID NO: 2047605 - DNA, 15 bp, Homo sapiens
ttccttgtcaccagc

SEQ ID NO: 2047606 - DNA, 14 bp, Homo sapiens
ttccttgtctctca

SEQ ID NO: 2047607 - DNA, 15 bp, Homo sapiens
ttccttgtctctcat

SEQ ID NO: 2047608 - DNA, 15 bp, Homo sapiens
ttcctttcctctgca

SEQ ID NO: 2047609 - DNA, 22 bp, Homo sapiens
ttccttttaaaacacttccata

SEQ ID NO: 2047610 - DNA, 15 bp, Homo sapiens
ttccttttgaaagaa

SEQ ID NO: 2047611 - DNA, 15 bp, Homo sapiens
ttccttttgatgggg

SEQ ID NO: 2047612 - DNA, 16 bp, Homo sapiens
ttcctttttgcagtat

SEQ ID NO: 2047613 - DNA, 20 bp, Homo sapiens
ttcgaccctttctctgagag

SEQ ID NO: 2047614 - DNA, 16 bp, Homo sapiens
ttcgaggtgtcaccct

SEQ ID NO: 2047615 - DNA, 21 bp, Homo sapiens
ttcgatgggcccaattcttac

SEQ ID NO: 2047616 - DNA, 19 bp, Homo sapiens
ttcgcagccaccctgagga

SEQ ID NO: 2047617 - DNA, 24 bp, Homo sapiens
ttcgcagccaccctgaggagtctg

SEQ ID NO: 2047618 - DNA, 15 bp, Homo sapiens
ttcgctcctgtgtct

SEQ ID NO: 2047619 - DNA, 12 bp, Homo sapiens
ttcgctgccagg

SEQ ID NO: 2047620 - DNA, 22 bp, Homo sapiens
ttgatttattttttaatcattt

SEQ ID NO: 2047621 - DNA, 23 bp, Homo sapiens
ttgatttattttttaatcattta

SEQ ID NO: 2047622 - DNA, 11 bp, Homo sapiens
ttgcaaaattt

SEQ ID NO: 2047623 - DNA, 16 bp, Homo sapiens
ttgcaaaatttccagt

SEQ ID NO: 2047624 - DNA, 21 bp, Homo sapiens
ttgcaaaatttccagtacctt

SEQ ID NO: 2047625 - DNA, 12 bp, Homo sapiens
ttgcaaccactg

SEQ ID NO: 2047626 - DNA, 14 bp, Homo sapiens
ttgcaaggccgctg

SEQ ID NO: 2047627 - DNA, 19 bp, Homo sapiens
ttgcaatggctatatggca

SEQ ID NO: 2047628 - DNA, 9 bp, Homo sapiens
ttgcacaat

SEQ ID NO: 2047629 - DNA, 16 bp, Homo sapiens
ttgcacatatttgaat

SEQ ID NO: 2047630 - DNA, 13 bp, Homo sapiens
ttgcacatctctg

SEQ ID NO: 2047631 - DNA, 15 bp, Homo sapiens
ttgcacatgtgacca

SEQ ID NO: 2047632 - DNA, 15 bp, Homo sapiens
ttgcactaaagtatg

SEQ ID NO: 2047633 - DNA, 19 bp, Homo sapiens
ttgcactatgaaaatcagt

SEQ ID NO: 2047634 - DNA, 15 bp, Homo sapiens
ttgcactgacaagat

SEQ ID NO: 2047635 - DNA, 17 bp, Homo sapiens
ttgcagaaaagcacctg

SEQ ID NO: 2047636 - DNA, 19 bp, Homo sapiens
ttgcagagatttcctccat

SEQ ID NO: 2047637 - DNA, 18 bp, Homo sapiens
ttgcagattcatttttct

SEQ ID NO: 2047638 - DNA, 15 bp, Homo sapiens
ttgcagcagaagcca

SEQ ID NO: 2047639 - DNA, 12 bp, Homo sapiens
ttgcagcagtga

SEQ ID NO: 2047640 - DNA, 17 bp, Homo sapiens
ttgcagcatttttattt

SEQ ID NO: 2047641 - DNA, 17 bp, Homo sapiens
ttgcaggcccagcagac

SEQ ID NO: 2047642 - DNA, 13 bp, Homo sapiens
ttgcaggctctgg

SEQ ID NO: 2047643 - DNA, 20 bp, Homo sapiens
ttgcaggctctgggctcagg

SEQ ID NO: 2047644 - DNA, 15 bp, Homo sapiens
ttgcagtatatttct

SEQ ID NO: 2047645 - DNA, 17 bp, Homo sapiens
ttgcagtcatcagaagt

SEQ ID NO: 2047646 - DNA, 16 bp, Homo sapiens
ttgcataagattaaag

SEQ ID NO: 2047647 - DNA, 18 bp, Homo sapiens
ttgcatagattccctgag

SEQ ID NO: 2047648 - DNA, 15 bp, Homo sapiens
ttgcatgatgtattt

SEQ ID NO: 2047649 - DNA, 16 bp, Homo sapiens
ttgcatgtaaaatgca

SEQ ID NO: 2047650 - DNA, 19 bp, Homo sapiens
ttgcatgtaaaatgcagtc

SEQ ID NO: 2047651 - DNA, 15 bp, Homo sapiens
ttgcattattcatat

SEQ ID NO: 2047652 - DNA, 14 bp, Homo sapiens
ttgcattccatgat

SEQ ID NO: 2047653 - DNA, 17 bp, Homo sapiens
ttgcattgaatatatta

SEQ ID NO: 2047654 - DNA, 16 bp, Homo sapiens
ttgcatttgtcaaagc

SEQ ID NO: 2047655 - DNA, 17 bp, Homo sapiens
ttgccaactaagccctc

SEQ ID NO: 2047656 - DNA, 17 bp, Homo sapiens
ttgccaagctttcttct

SEQ ID NO: 2047657 - DNA, 15 bp, Homo sapiens
ttgccacaaccctgt

SEQ ID NO: 2047658 - DNA, 21 bp, Homo sapiens
ttgccacaatgcctctcccac

SEQ ID NO: 2047659 - DNA, 21 bp, Homo sapiens
ttgccaccaccagatgagaag

SEQ ID NO: 2047660 - DNA, 17 bp, Homo sapiens
ttgccagaaagcataaa

SEQ ID NO: 2047661 - DNA, 12 bp, Homo sapiens
ttgccagcacag

SEQ ID NO: 2047662 - DNA, 14 bp, Homo sapiens
ttgccagcacaggg

SEQ ID NO: 2047663 - DNA, 17 bp, Homo sapiens
ttgccagcacaggggcc

SEQ ID NO: 2047664 - DNA, 12 bp, Homo sapiens
ttgccagccaga

SEQ ID NO: 2047665 - DNA, 13 bp, Homo sapiens
ttgccagccagaa

SEQ ID NO: 2047666 - DNA, 17 bp, Homo sapiens
ttgccatagccccatat

SEQ ID NO: 2047667 - DNA, 16 bp, Homo sapiens
ttgccatgttggccag

SEQ ID NO: 2047668 - DNA, 17 bp, Homo sapiens
ttgccatgttggccagg

SEQ ID NO: 2047669 - DNA, 14 bp, Homo sapiens
ttgccattcctgga

SEQ ID NO: 2047670 - DNA, 18 bp, Homo sapiens
ttgcccagagatgcctcc

SEQ ID NO: 2047671 - DNA, 14 bp, Homo sapiens
ttgcccaggctggc

SEQ ID NO: 2047672 - DNA, 18 bp, Homo sapiens
ttgcccagggctcagcct

SEQ ID NO: 2047673 - DNA, 19 bp, Homo sapiens
ttgcccagggctcagcctg

SEQ ID NO: 2047674 - DNA, 13 bp, Homo sapiens
ttgccccagagcc

SEQ ID NO: 2047675 - DNA, 14 bp, Homo sapiens
ttgccccagagccc

SEQ ID NO: 2047676 - DNA, 16 bp, Homo sapiens
ttgccccttgggcctc

SEQ ID NO: 2047677 - DNA, 16 bp, Homo sapiens
ttgcccgccagcctca

SEQ ID NO: 2047678 - DNA, 17 bp, Homo sapiens
ttgcccggattctggga

SEQ ID NO: 2047679 - DNA, 19 bp, Homo sapiens
ttgcccggattctgggagg

SEQ ID NO: 2047680 - DNA, 12 bp, Homo sapiens
ttgccctgacct

SEQ ID NO: 2047681 - DNA, 21 bp, Homo sapiens
ttgccctgacctcccagccct

SEQ ID NO: 2047682 - DNA, 13 bp, Homo sapiens
ttgccctgttaaa

SEQ ID NO: 2047683 - DNA, 14 bp, Homo sapiens
ttgcccttcacagt

SEQ ID NO: 2047684 - DNA, 16 bp, Homo sapiens
ttgcccttgccctgac

SEQ ID NO: 2047685 - DNA, 17 bp, Homo sapiens
ttgcccttgccctgacc

SEQ ID NO: 2047686 - DNA, 18 bp, Homo sapiens
ttgcccttgccctgacct

SEQ ID NO: 2047687 - DNA, 18 bp, Homo sapiens
ttgccgagcctaatgaaa

SEQ ID NO: 2047688 - DNA, 21 bp, Homo sapiens
ttgcctccacctctccttgga

SEQ ID NO: 2047689 - DNA, 13 bp, Homo sapiens
ttgcctgccaggg

SEQ ID NO: 2047690 - DNA, 11 bp, Homo sapiens
ttgcctggctg

SEQ ID NO: 2047691 - DNA, 12 bp, Homo sapiens
ttgcctggctgt

SEQ ID NO: 2047692 - DNA, 19 bp, Homo sapiens
ttgcctggctgtggaggcc

SEQ ID NO: 2047693 - DNA, 14 bp, Homo sapiens
ttgcctgtgtgagc

SEQ ID NO: 2047694 - DNA, 20 bp, Homo sapiens
ttgcctgtgtgagcatctct

SEQ ID NO: 2047695 - DNA, 16 bp, Homo sapiens
ttgccttaaagaaagt

SEQ ID NO: 2047696 - DNA, 14 bp, Homo sapiens
ttgcgtcctgcaga

SEQ ID NO: 2047697 - DNA, 15 bp, Homo sapiens
ttgcgtcctgcagag

SEQ ID NO: 2047698 - DNA, 15 bp, Homo sapiens
ttgcgtggactctgc

SEQ ID NO: 2047699 - DNA, 13 bp, Homo sapiens
ttgctacaataaa

SEQ ID NO: 2047700 - DNA, 17 bp, Homo sapiens
ttgctacaataaatgct

SEQ ID NO: 2047701 - DNA, 13 bp, Homo sapiens
ttgctacattttc

SEQ ID NO: 2047702 - DNA, 17 bp, Homo sapiens
ttgctagtgatttcatt

SEQ ID NO: 2047703 - DNA, 13 bp, Homo sapiens
ttgctattggaat

SEQ ID NO: 2047704 - DNA, 20 bp, Homo sapiens
ttgctattttatttgtattc

SEQ ID NO: 2047705 - DNA, 21 bp, Homo sapiens
ttgctcaccaagctgttccac

SEQ ID NO: 2047706 - DNA, 20 bp, Homo sapiens
ttgctcactcaggactttga

SEQ ID NO: 2047707 - DNA, 18 bp, Homo sapiens
ttgctcagtgcctcctgg

SEQ ID NO: 2047708 - DNA, 14 bp, Homo sapiens
ttgctccagggtct

SEQ ID NO: 2047709 - DNA, 12 bp, Homo sapiens
ttgctccttgac

SEQ ID NO: 2047710 - DNA, 21 bp, Homo sapiens
ttgctctcccctgccctgctg

SEQ ID NO: 2047711 - DNA, 20 bp, Homo sapiens
ttgctctctggccttttcct

SEQ ID NO: 2047712 - DNA, 19 bp, Homo sapiens
ttgctgacatggctttgct

SEQ ID NO: 2047713 - DNA, 12 bp, Homo sapiens
ttgctgcaggcc

SEQ ID NO: 2047714 - DNA, 23 bp, Homo sapiens
ttgctggacggggactggggatg

SEQ ID NO: 2047715 - DNA, 16 bp, Homo sapiens
ttgctggactgaggac

SEQ ID NO: 2047716 - DNA, 21 bp, Homo sapiens
ttgctggattaatgttttgta

SEQ ID NO: 2047717 - DNA, 15 bp, Homo sapiens
ttgctgtctttctct

SEQ ID NO: 2047718 - DNA, 21 bp, Homo sapiens
ttgctgttgatgaggcctctt

SEQ ID NO: 2047719 - DNA, 12 bp, Homo sapiens
ttgctgttgttg

SEQ ID NO: 2047720 - DNA, 16 bp, Homo sapiens
ttgctgttgttgcagg

SEQ ID NO: 2047721 - DNA, 15 bp, Homo sapiens
ttgctgtttcctttt

SEQ ID NO: 2047722 - DNA, 14 bp, Homo sapiens
ttgcttaaaatttt

SEQ ID NO: 2047723 - DNA, 21 bp, Homo sapiens
ttgcttctaggagtcaactgg

SEQ ID NO: 2047724 - DNA, 23 bp, Homo sapiens
ttgcttctaggagtcaactggct

SEQ ID NO: 2047725 - DNA, 22 bp, Homo sapiens
ttgcttgccgagcctaatgaaa

SEQ ID NO: 2047726 - DNA, 23 bp, Homo sapiens
ttgctttaatgtgtattgaagaa

SEQ ID NO: 2047727 - DNA, 14 bp, Homo sapiens
ttgctttgaagcag

SEQ ID NO: 2047728 - DNA, 16 bp, Homo sapiens
ttgctttgaagcagtt

SEQ ID NO: 2047729 - DNA, 11 bp, Homo sapiens
ttgctttgctg

SEQ ID NO: 2047730 - DNA, 13 bp, Homo sapiens
ttgctttgtatgc

SEQ ID NO: 2047731 - DNA, 14 bp, Homo sapiens
ttggaaaaaaatta

SEQ ID NO: 2047732 - DNA, 20 bp, Homo sapiens
ttggaaaaagaaagaaacac

SEQ ID NO: 2047733 - DNA, 14 bp, Homo sapiens
ttggaaagagacca

SEQ ID NO: 2047734 - DNA, 22 bp, Homo sapiens
ttggaacatgtcggagtagaaa

SEQ ID NO: 2047735 - DNA, 16 bp, Homo sapiens
ttggaagaaaaaatct

SEQ ID NO: 2047736 - DNA, 17 bp, Homo sapiens
ttgtgcaatgtaaatat

SEQ ID NO: 2047737 - DNA, 22 bp, Homo sapiens
ttgtgccaatatgtattgtaaa

SEQ ID NO: 2047738 - DNA, 22 bp, Homo sapiens
ttgtgccatagtcacatggcct

SEQ ID NO: 2047739 - DNA, 16 bp, Homo sapiens
ttgtgcttttcctatt

SEQ ID NO: 2047740 - DNA, 15 bp, Homo sapiens
ttgtggaacaaaagt

SEQ ID NO: 2047741 - DNA, 17 bp, Homo sapiens
ttgtggacacagctctt

SEQ ID NO: 2047742 - DNA, 22 bp, Homo sapiens
ttgtggaggagctcaggacact

SEQ ID NO: 2047743 - DNA, 15 bp, Homo sapiens
ttgtggatgctccag

SEQ ID NO: 2047744 - DNA, 17 bp, Homo sapiens
ttgtggatgctccaggg

SEQ ID NO: 2047745 - DNA, 18 bp, Homo sapiens
ttgtggcaagtgaatttg

SEQ ID NO: 2047746 - DNA, 22 bp, Homo sapiens
ttgtggcaagtgaatttgcctg

SEQ ID NO: 2047747 - DNA, 22 bp, Homo sapiens
ttgtgtaacaattttaatgcta

SEQ ID NO: 2047748 - DNA, 19 bp, Homo sapiens
ttgtgtaatagaaaactga

SEQ ID NO: 2047749 - DNA, 20 bp, Homo sapiens
ttgtgtacaaagtagagaag

SEQ ID NO: 2047750 - DNA, 20 bp, Homo sapiens
ttgtgtactgataaaatact

SEQ ID NO: 2047751 - DNA, 15 bp, Homo sapiens
ttgtgtagattgtgt

SEQ ID NO: 2047752 - DNA, 14 bp, Homo sapiens
ttgtgtatgtgtat

SEQ ID NO: 2047753 - DNA, 20 bp, Homo sapiens
ttgtgtgttatttaaatgag

SEQ ID NO: 2047754 - DNA, 22 bp, Homo sapiens
ttgtgttgccttagcacttctt

SEQ ID NO: 2047755 - DNA, 12 bp, Homo sapiens
ttgttaaacacg

SEQ ID NO: 2047756 - DNA, 18 bp, Homo sapiens
ttgttaatgaaaatgtca

SEQ ID NO: 2047757 - DNA, 19 bp, Homo sapiens
ttgttaatgaaaatgtcag

SEQ ID NO: 2047758 - DNA, 17 bp, Homo sapiens
ttgttaatggtgcaaat

SEQ ID NO: 2047759 - DNA, 19 bp, Homo sapiens
ttgttaatttagaaaactt

SEQ ID NO: 2047760 - DNA, 17 bp, Homo sapiens
ttgttacaggtgtacta

SEQ ID NO: 2047761 - DNA, 23 bp, Homo sapiens
ttgttattgggcaagtgattgaa

SEQ ID NO: 2047762 - DNA, 17 bp, Homo sapiens
ttgttattgtggaagat

SEQ ID NO: 2047763 - DNA, 22 bp, Homo sapiens
ttgttccttacctttacataat

SEQ ID NO: 2047764 - DNA, 16 bp, Homo sapiens
ttgttccttcacattt

SEQ ID NO: 2047765 - DNA, 22 bp, Homo sapiens
ttgttcgccgcgtggaatgtga

SEQ ID NO: 2047766 - DNA, 23 bp, Homo sapiens
ttgttctccgggtgtggcctcag

SEQ ID NO: 2047767 - DNA, 23 bp, Homo sapiens
ttgttctcctccattgctgttgt

SEQ ID NO: 2047768 - DNA, 14 bp, Homo sapiens
ttgttctttatttg

SEQ ID NO: 2047769 - DNA, 21 bp, Homo sapiens
ttgttgataaattccactgga

SEQ ID NO: 2047770 - DNA, 13 bp, Homo sapiens
ttgttgattaatt

SEQ ID NO: 2047771 - DNA, 16 bp, Homo sapiens
ttgttgattttctaga

SEQ ID NO: 2047772 - DNA, 22 bp, Homo sapiens
ttgttgctccctgtgacaaaat

SEQ ID NO: 2047773 - DNA, 21 bp, Homo sapiens
ttgttggaaaagaatacagaa

SEQ ID NO: 2047774 - DNA, 19 bp, Homo sapiens
ttgttgtcaagtataaagt

SEQ ID NO: 2047775 - DNA, 21 bp, Homo sapiens
ttgttgttaatgaaaatgtca

SEQ ID NO: 2047776 - DNA, 16 bp, Homo sapiens
ttgttgtttttaagat

SEQ ID NO: 2047777 - DNA, 14 bp, Homo sapiens
ttgtttaaaatcat

SEQ ID NO: 2047778 - DNA, 14 bp, Homo sapiens
ttgtttaattgtag

SEQ ID NO: 2047779 - DNA, 20 bp, Homo sapiens
ttgtttcattgactatcaaa

SEQ ID NO: 2047780 - DNA, 14 bp, Homo sapiens
ttgtttcttaaata

SEQ ID NO: 2047781 - DNA, 20 bp, Homo sapiens
ttgtttgagcgcagagtaaa

SEQ ID NO: 2047782 - DNA, 14 bp, Homo sapiens
ttgtttgggagagt

SEQ ID NO: 2047783 - DNA, 17 bp, Homo sapiens
ttgtttggggcaggagt

SEQ ID NO: 2047784 - DNA, 21 bp, Homo sapiens
ttgtttgtttctccccctggg

SEQ ID NO: 2047785 - DNA, 18 bp, Homo sapiens
ttgttttcttctgtatgt

SEQ ID NO: 2047786 - DNA, 13 bp, Homo sapiens
ttgttttgtttta

SEQ ID NO: 2047787 - DNA, 14 bp, Homo sapiens
ttgtttttaaatca

SEQ ID NO: 2047788 - DNA, 13 bp, Homo sapiens
ttgtttttccttg

SEQ ID NO: 2047789 - DNA, 17 bp, Homo sapiens
tttaaaaaagcttaaaa

SEQ ID NO: 2047790 - DNA, 20 bp, Homo sapiens
tttaaaaaagcttaaaactt

SEQ ID NO: 2047791 - DNA, 14 bp, Homo sapiens
tttaaaaaataaat

SEQ ID NO: 2047792 - DNA, 16 bp, Homo sapiens
tttaaaaaataaatat

SEQ ID NO: 2047793 - DNA, 17 bp, Homo sapiens
tttaaaaaataaatata

SEQ ID NO: 2047794 - DNA, 20 bp, Homo sapiens
tttaaaaacatgagaaatgt

SEQ ID NO: 2047795 - DNA, 21 bp, Homo sapiens
tttaaaaacatgagaaatgtg

SEQ ID NO: 2047796 - DNA, 20 bp, Homo sapiens
tttaaaaaccaatcatttta

SEQ ID NO: 2047797 - DNA, 23 bp, Homo sapiens
tttaaaaaccaatcattttaaga

SEQ ID NO: 2047798 - DNA, 16 bp, Homo sapiens
tttaaaagaaatttat

SEQ ID NO: 2047799 - DNA, 20 bp, Homo sapiens
tttaaaagtttcaatgtgat

SEQ ID NO: 2047800 - DNA, 22 bp, Homo sapiens
tttaaaataaggataataatca

SEQ ID NO: 2047801 - DNA, 12 bp, Homo sapiens
tttaaaatagca

SEQ ID NO: 2047802 - DNA, 16 bp, Homo sapiens
tttaaaatcattcaat

SEQ ID NO: 2047803 - DNA, 13 bp, Homo sapiens
tttaaaatctgat

SEQ ID NO: 2047804 - DNA, 16 bp, Homo sapiens
tttaaaatctgattta

SEQ ID NO: 2047805 - DNA, 17 bp, Homo sapiens
tttaaaatgaaatgttt

SEQ ID NO: 2047806 - DNA, 17 bp, Homo sapiens
tttaaaattttatctct

SEQ ID NO: 2047807 - DNA, 15 bp, Homo sapiens
tttaaacaagtattt

SEQ ID NO: 2047808 - DNA, 12 bp, Homo sapiens
tttaaaccagca

SEQ ID NO: 2047809 - DNA, 18 bp, Homo sapiens
tttaaaccagcagaaaag

SEQ ID NO: 2047810 - DNA, 19 bp, Homo sapiens
tttaaaccagcagaaaagt

SEQ ID NO: 2047811 - DNA, 20 bp, Homo sapiens
tttaaaccgctaaaagaaac

SEQ ID NO: 2047812 - DNA, 22 bp, Homo sapiens
tttaaaccgctaaaagaaactt

SEQ ID NO: 2047813 - DNA, 11 bp, Homo sapiens
tttaaaccttt

SEQ ID NO: 2047814 - DNA, 13 bp, Homo sapiens
tttaaagaattgt

SEQ ID NO: 2047815 - DNA, 15 bp, Homo sapiens
tttaaagacttaaga

SEQ ID NO: 2047816 - DNA, 17 bp, Homo sapiens
tttaaagctgactttgt

SEQ ID NO: 2047817 - DNA, 24 bp, Homo sapiens
tttaaagcttattaaaactcattt

SEQ ID NO: 2047818 - DNA, 17 bp, Homo sapiens
tttaaagtacctgtagt

SEQ ID NO: 2047819 - DNA, 12 bp, Homo sapiens
tttaaagtctat

SEQ ID NO: 2047820 - DNA, 21 bp, Homo sapiens
tttaaataaagtatcatgcat

SEQ ID NO: 2047821 - DNA, 23 bp, Homo sapiens
tttaaataaagtatcatgcattc

SEQ ID NO: 2047822 - DNA, 14 bp, Homo sapiens
tttaaatatgaaca

SEQ ID NO: 2047823 - DNA, 22 bp, Homo sapiens
tttaaatcaaactgtaaaactt

SEQ ID NO: 2047824 - DNA, 12 bp, Homo sapiens
tttaaatctgtt

SEQ ID NO: 2047825 - DNA, 19 bp, Homo sapiens
tttaaatcttcaatatgaa

SEQ ID NO: 2047826 - DNA, 16 bp, Homo sapiens
tttaaatgaaaatgta

SEQ ID NO: 2047827 - DNA, 21 bp, Homo sapiens
tttaaatgttgaaatcttaaa

SEQ ID NO: 2047828 - DNA, 19 bp, Homo sapiens
tttaaattataagatgtca

SEQ ID NO: 2047829 - DNA, 19 bp, Homo sapiens
tttaaattctttttcaaaa

SEQ ID NO: 2047830 - DNA, 20 bp, Homo sapiens
tttaaattgtaaattttaga

SEQ ID NO: 2047831 - DNA, 19 bp, Homo sapiens
tttaacaaaacaagaaaga

SEQ ID NO: 2047832 - DNA, 19 bp, Homo sapiens
tttaacaactaatcaagag

SEQ ID NO: 2047833 - DNA, 19 bp, Homo sapiens
tttaacacataactagaaa

SEQ ID NO: 2047834 - DNA, 15 bp, Homo sapiens
tttaacagaaccaga

SEQ ID NO: 2047835 - DNA, 16 bp, Homo sapiens
tttaaccgtttttcaa

SEQ ID NO: 2047836 - DNA, 21 bp, Homo sapiens
tttaacctgtttatataattt

SEQ ID NO: 2047837 - DNA, 22 bp, Homo sapiens
tttaacgaatgaagatgtctaa

SEQ ID NO: 2047838 - DNA, 15 bp, Homo sapiens
tttaactaatttaaa

SEQ ID NO: 2047839 - DNA, 15 bp, Homo sapiens
tttaactagaattta

SEQ ID NO: 2047840 - DNA, 17 bp, Homo sapiens
tttaactagaatttatt

SEQ ID NO: 2047841 - DNA, 15 bp, Homo sapiens
tttaagataaattat

SEQ ID NO: 2047842 - DNA, 14 bp, Homo sapiens
tttaagattgtaat

SEQ ID NO: 2047843 - DNA, 21 bp, Homo sapiens
tttaagattgtaattcagaaa

SEQ ID NO: 2047844 - DNA, 13 bp, Homo sapiens
tttaagcatttta

SEQ ID NO: 2047845 - DNA, 15 bp, Homo sapiens
tttaagccttttgtg

SEQ ID NO: 2047846 - DNA, 13 bp, Homo sapiens
tttaagctgtaaa

SEQ ID NO: 2047847 - DNA, 14 bp, Homo sapiens
tttaagctgtaaaa

SEQ ID NO: 2047848 - DNA, 17 bp, Homo sapiens
tttaagggtttgtggaa

SEQ ID NO: 2047849 - DNA, 20 bp, Homo sapiens
tttaagggtttgtggaaaat

SEQ ID NO: 2047850 - DNA, 16 bp, Homo sapiens
tttgaagttagcttta

SEQ ID NO: 2047851 - DNA, 23 bp, Homo sapiens
tttgaagttagctttaacttaaa

SEQ ID NO: 2047852 - DNA, 10 bp, Homo sapiens
tttgaataaa

SEQ ID NO: 2047853 - DNA, 16 bp, Homo sapiens
tttgaataaagtctga

SEQ ID NO: 2047854 - DNA, 15 bp, Homo sapiens
tttgaatacccccag

SEQ ID NO: 2047855 - DNA, 20 bp, Homo sapiens
tttgaatacccccagagacc

SEQ ID NO: 2047856 - DNA, 21 bp, Homo sapiens
tttgaatacccccagagacct

SEQ ID NO: 2047857 - DNA, 17 bp, Homo sapiens
tttgaatataaacacta

SEQ ID NO: 2047858 - DNA, 13 bp, Homo sapiens
tttgaatatcatt

SEQ ID NO: 2047859 - DNA, 20 bp, Homo sapiens
tttgaatgtttatgttctca

SEQ ID NO: 2047860 - DNA, 15 bp, Homo sapiens
tttgacaacaaatta

SEQ ID NO: 2047861 - DNA, 16 bp, Homo sapiens
tttgacatgaaaagat

SEQ ID NO: 2047862 - DNA, 17 bp, Homo sapiens
tttgacatgaacagaaa

SEQ ID NO: 2047863 - DNA, 20 bp, Homo sapiens
tttgacatttccttctttgt

SEQ ID NO: 2047864 - DNA, 19 bp, Homo sapiens
tttgacgggaggcctcagt

SEQ ID NO: 2047865 - DNA, 19 bp, Homo sapiens
tttgacttattgtccccac

SEQ ID NO: 2047866 - DNA, 14 bp, Homo sapiens
tttgagaatgtgat

SEQ ID NO: 2047867 - DNA, 13 bp, Homo sapiens
tttgagacagagt

SEQ ID NO: 2047868 - DNA, 15 bp, Homo sapiens
tttgagcagggctca

SEQ ID NO: 2047869 - DNA, 20 bp, Homo sapiens
tttgaggaattatcatggga

SEQ ID NO: 2047870 - DNA, 21 bp, Homo sapiens
tttgaggagcagcttcagttg

SEQ ID NO: 2047871 - DNA, 16 bp, Homo sapiens
tttgatacatatgtga

SEQ ID NO: 2047872 - DNA, 18 bp, Homo sapiens
tttgatactaagcattga

SEQ ID NO: 2047873 - DNA, 15 bp, Homo sapiens
tttgatatgagtata

SEQ ID NO: 2047874 - DNA, 15 bp, Homo sapiens
tttgatgggaagaaa

SEQ ID NO: 2047875 - DNA, 14 bp, Homo sapiens
tttgatgtacatgt

SEQ ID NO: 2047876 - DNA, 20 bp, Homo sapiens
tttgattgtaaaaacaaaaa

SEQ ID NO: 2047877 - DNA, 14 bp, Homo sapiens
tttgatttcattaa

SEQ ID NO: 2047878 - DNA, 18 bp, Homo sapiens
tttgatttccaagtaata

SEQ ID NO: 2047879 - DNA, 14 bp, Homo sapiens
tttgcaaggaagcc

SEQ ID NO: 2047880 - DNA, 19 bp, Homo sapiens
tttgcaatggctatatggc

SEQ ID NO: 2047881 - DNA, 12 bp, Homo sapiens
tttgcacagctc

SEQ ID NO: 2047882 - DNA, 23 bp, Homo sapiens
tttgcacatgtaacatagattta

SEQ ID NO: 2047883 - DNA, 14 bp, Homo sapiens
tttgcacatgtgac

SEQ ID NO: 2047884 - DNA, 21 bp, Homo sapiens
tttgcacctttctagttgaaa

SEQ ID NO: 2047885 - DNA, 17 bp, Homo sapiens
tttgcactgagggccac

SEQ ID NO: 2047886 - DNA, 17 bp, Homo sapiens
tttgcactgtatgctgg

SEQ ID NO: 2047887 - DNA, 21 bp, Homo sapiens
tttgcactgttactttttagt

SEQ ID NO: 2047888 - DNA, 14 bp, Homo sapiens
tttgcagacaggca

SEQ ID NO: 2047889 - DNA, 18 bp, Homo sapiens
tttgcaggcccagcagac

SEQ ID NO: 2047890 - DNA, 12 bp, Homo sapiens
tttgcaggctct

SEQ ID NO: 2047891 - DNA, 23 bp, Homo sapiens
tttgcatagtaccaatcatttta

SEQ ID NO: 2047892 - DNA, 13 bp, Homo sapiens
tttgcattccatg

SEQ ID NO: 2047893 - DNA, 17 bp, Homo sapiens
tttgcattccatgattt

SEQ ID NO: 2047894 - DNA, 14 bp, Homo sapiens
tttgcattgtgtga

SEQ ID NO: 2047895 - DNA, 17 bp, Homo sapiens
tttgcatttagttttat

SEQ ID NO: 2047896 - DNA, 20 bp, Homo sapiens
tttgccactttggcttctcc

SEQ ID NO: 2047897 - DNA, 23 bp, Homo sapiens
tttgccagtgaagacttcttggg

SEQ ID NO: 2047898 - DNA, 18 bp, Homo sapiens
tttgccatgttggccagg

SEQ ID NO: 2047899 - DNA, 15 bp, Homo sapiens
tttgccccagttaca

SEQ ID NO: 2047900 - DNA, 21 bp, Homo sapiens
tttgccctgtggattccagca

SEQ ID NO: 2047901 - DNA, 19 bp, Homo sapiens
tttgcctaaatccaaagaa

SEQ ID NO: 2047902 - DNA, 22 bp, Homo sapiens
tttgcctaaatccaaagaaaaa

SEQ ID NO: 2047903 - DNA, 23 bp, Homo sapiens
tttgcctcaaataaaaagtgctt

SEQ ID NO: 2047904 - DNA, 13 bp, Homo sapiens
tttgcctctgcct

SEQ ID NO: 2047905 - DNA, 20 bp, Homo sapiens
tttgcctcttttctctgtgc

SEQ ID NO: 2047906 - DNA, 22 bp, Homo sapiens
tttgcctggctgtggaggcctg

SEQ ID NO: 2047907 - DNA, 22 bp, Homo sapiens
tttgcctgtgtgagcatctctg

SEQ ID NO: 2047908 - DNA, 12 bp, Homo sapiens
tttgccttttgc

SEQ ID NO: 2047909 - DNA, 17 bp, Homo sapiens
tttgcgctggtggacca

SEQ ID NO: 2047910 - DNA, 13 bp, Homo sapiens
tttgctaattaaa

SEQ ID NO: 2047911 - DNA, 14 bp, Homo sapiens
tttgctaattaaaa

SEQ ID NO: 2047912 - DNA, 19 bp, Homo sapiens
tttgctaattaaaaagtta

SEQ ID NO: 2047913 - DNA, 12 bp, Homo sapiens
tttgctacaata

SEQ ID NO: 2047914 - DNA, 14 bp, Homo sapiens
tttgctacaataaa

SEQ ID NO: 2047915 - DNA, 17 bp, Homo sapiens
tttgctacaataaatgc

SEQ ID NO: 2047916 - DNA, 13 bp, Homo sapiens
tttgctctttctt

SEQ ID NO: 2047917 - DNA, 19 bp, Homo sapiens
tttgctgagcatgtactga

SEQ ID NO: 2047918 - DNA, 21 bp, Homo sapiens
tttgctgtctttctctaaata

SEQ ID NO: 2047919 - DNA, 13 bp, Homo sapiens
tttgcttatttat

SEQ ID NO: 2047920 - DNA, 17 bp, Homo sapiens
tttgcttatttatattc

SEQ ID NO: 2047921 - DNA, 12 bp, Homo sapiens
tttgcttggcag

SEQ ID NO: 2047922 - DNA, 16 bp, Homo sapiens
tttgcttggcagagag

SEQ ID NO: 2047923 - DNA, 18 bp, Homo sapiens
tttggaaaaatcttgggc

SEQ ID NO: 2047924 - DNA, 14 bp, Homo sapiens
tttggaaagagacc

SEQ ID NO: 2047925 - DNA, 14 bp, Homo sapiens
tttggaagttttca

SEQ ID NO: 2047926 - DNA, 20 bp, Homo sapiens
tttggaataataattttcct

SEQ ID NO: 2047927 - DNA, 15 bp, Homo sapiens
tttggaatgaacaat

SEQ ID NO: 2047928 - DNA, 19 bp, Homo sapiens
tttggagactctgtggggc

SEQ ID NO: 2047929 - DNA, 22 bp, Homo sapiens
tttggaggaacagctccctagt

SEQ ID NO: 2047930 - DNA, 12 bp, Homo sapiens
tttggagtgtgt

SEQ ID NO: 2047931 - DNA, 23 bp, Homo sapiens
tttggcagcaaagtgtcagtgtt

SEQ ID NO: 2047932 - DNA, 23 bp, Homo sapiens
tttggcaggagaatcaataaaaa

SEQ ID NO: 2047933 - DNA, 23 bp, Homo sapiens
tttggccaatgcacctaaagaaa

SEQ ID NO: 2047934 - DNA, 15 bp, Homo sapiens
tttggctctttcaga

SEQ ID NO: 2047935 - DNA, 16 bp, Homo sapiens
tttggcttctcctgtg

SEQ ID NO: 2047936 - DNA, 20 bp, Homo sapiens
tttgggcagaagggagaagg

SEQ ID NO: 2047937 - DNA, 17 bp, Homo sapiens
tttgggccactgccagc

SEQ ID NO: 2047938 - DNA, 19 bp, Homo sapiens
tttggggagggggaagaga

SEQ ID NO: 2047939 - DNA, 20 bp, Homo sapiens
tttggggcaggagtagctga

SEQ ID NO: 2047940 - DNA, 20 bp, Homo sapiens
tttggtaaaatacttcttga

SEQ ID NO: 2047941 - DNA, 23 bp, Homo sapiens
tttggtcccgtgcagcttctgtc

SEQ ID NO: 2047942 - DNA, 13 bp, Homo sapiens
tttggtccctggg

SEQ ID NO: 2047943 - DNA, 15 bp, Homo sapiens
tttggtgcctgcctc

SEQ ID NO: 2047944 - DNA, 18 bp, Homo sapiens
tttggtgctggtctattt

SEQ ID NO: 2047945 - DNA, 22 bp, Homo sapiens
tttggtgtggctgtattcagat

SEQ ID NO: 2047946 - DNA, 13 bp, Homo sapiens
tttggttctaata

SEQ ID NO: 2047947 - DNA, 22 bp, Homo sapiens
tttggttgtaaatgctcgtgtg

SEQ ID NO: 2047948 - DNA, 23 bp, Homo sapiens
tttgtaaaagaacagtaaacatt

SEQ ID NO: 2047949 - DNA, 16 bp, Homo sapiens
tttgtaaactcaaaat

SEQ ID NO: 2047950 - DNA, 23 bp, Homo sapiens
tttgtaaaggtcagagtcaaaat

SEQ ID NO: 2047951 - DNA, 16 bp, Homo sapiens
tttgtaaattctggaa

SEQ ID NO: 2047952 - DNA, 20 bp, Homo sapiens
tttgtaaattctggaaatgt

SEQ ID NO: 2047953 - DNA, 15 bp, Homo sapiens
tttgtaacttcaaat

SEQ ID NO: 2047954 - DNA, 19 bp, Homo sapiens
tttgtaagcaacttgcttc

SEQ ID NO: 2047955 - DNA, 20 bp, Homo sapiens
tttgtaagcaacttgcttct

SEQ ID NO: 2047956 - DNA, 16 bp, Homo sapiens
tttgtaagttgaagca

SEQ ID NO: 2047957 - DNA, 13 bp, Homo sapiens
tttgtaagtttat

SEQ ID NO: 2047958 - DNA, 14 bp, Homo sapiens
tttgtaataaactc

SEQ ID NO: 2047959 - DNA, 19 bp, Homo sapiens
tttgtaataaactctctag

SEQ ID NO: 2047960 - DNA, 14 bp, Homo sapiens
tttgtaatcctgta

SEQ ID NO: 2047961 - DNA, 15 bp, Homo sapiens
tttgtaatgtatctt

SEQ ID NO: 2047962 - DNA, 21 bp, Homo sapiens
tttgtaatgtatcttatttat

SEQ ID NO: 2047963 - DNA, 23 bp, Homo sapiens
tttgtaatgtcaccaccttccca

SEQ ID NO: 2047964 - DNA, 10 bp, Homo sapiens
tttgtacaga

SEQ ID NO: 2047965 - DNA, 19 bp, Homo sapiens
gctgcatgctctggaagcc

SEQ ID NO: 2047966 - DNA, 21 bp, Homo sapiens
gctgccaagcactcgagacca

SEQ ID NO: 2047967 - DNA, 17 bp, Homo sapiens
gctgccacacttcaggc

SEQ ID NO: 2047968 - DNA, 22 bp, Homo sapiens
gctgccacacttcaggctcttc

SEQ ID NO: 2047969 - DNA, 23 bp, Homo sapiens
gctgccacacttcaggctcttct

SEQ ID NO: 2047970 - DNA, 15 bp, Homo sapiens
gctgccaccacgtct

SEQ ID NO: 2047971 - DNA, 14 bp, Homo sapiens
gctgccagccgggc

SEQ ID NO: 2047972 - DNA, 12 bp, Homo sapiens
gctgccaggaca

SEQ ID NO: 2047973 - DNA, 16 bp, Homo sapiens
gctgccaggacacctg

SEQ ID NO: 2047974 - DNA, 23 bp, Homo sapiens
gctgccaggacacctgccccagc

SEQ ID NO: 2047975 - DNA, 20 bp, Homo sapiens
gctgccaggcgttggtgcca

SEQ ID NO: 2047976 - DNA, 22 bp, Homo sapiens
gctgccaggcgttggtgccact

SEQ ID NO: 2047977 - DNA, 15 bp, Homo sapiens
gctgccatgccactg

SEQ ID NO: 2047978 - DNA, 23 bp, Homo sapiens
gctgccatggcgtgtccctctcg

SEQ ID NO: 2047979 - DNA, 14 bp, Homo sapiens
gctgccccagcccc

SEQ ID NO: 2047980 - DNA, 21 bp, Homo sapiens
gctgccccgggtccccagctc

SEQ ID NO: 2047981 - DNA, 18 bp, Homo sapiens
gctgccccgttccctgtc

SEQ ID NO: 2047982 - DNA, 18 bp, Homo sapiens
gctgccctgctctgggga

SEQ ID NO: 2047983 - DNA, 12 bp, Homo sapiens
gctgccctggtg

SEQ ID NO: 2047984 - DNA, 14 bp, Homo sapiens
gctgccctggtgct

SEQ ID NO: 2047985 - DNA, 17 bp, Homo sapiens
gctgccctggtgctgcc

SEQ ID NO: 2047986 - DNA, 18 bp, Homo sapiens
gctgccctggtgctgcca

SEQ ID NO: 2047987 - DNA, 20 bp, Homo sapiens
gctgccctggtgctgccaca

SEQ ID NO: 2047988 - DNA, 17 bp, Homo sapiens
gctgcccttcgctgcca

SEQ ID NO: 2047989 - DNA, 20 bp, Homo sapiens
gctgcccttcgctgccagga

SEQ ID NO: 2047990 - DNA, 22 bp, Homo sapiens
gctgcccttcgctgccaggaca

SEQ ID NO: 2047991 - DNA, 23 bp, Homo sapiens
gctgcccttcgctgccaggacac

SEQ ID NO: 2047992 - DNA, 13 bp, Homo sapiens
gctgccgcaaggc

SEQ ID NO: 2047993 - DNA, 16 bp, Homo sapiens
gctgccgcaaggccct

SEQ ID NO: 2047994 - DNA, 17 bp, Homo sapiens
gctgccgcaaggccctg

SEQ ID NO: 2047995 - DNA, 14 bp, Homo sapiens
gctgccgcacccca

SEQ ID NO: 2047996 - DNA, 15 bp, Homo sapiens
gctgccgcaccccag

SEQ ID NO: 2047997 - DNA, 18 bp, Homo sapiens
gctgccgcaccccagagt

SEQ ID NO: 2047998 - DNA, 19 bp, Homo sapiens
gctgccgcctcccagcctg

SEQ ID NO: 2047999 - DNA, 18 bp, Homo sapiens
gctgcctaagtggctgct

SEQ ID NO: 2048000 - DNA, 15 bp, Homo sapiens
gctgcctaataaaga

SEQ ID NO: 2048001 - DNA, 15 bp, Homo sapiens
gctgcctgaaaacca

SEQ ID NO: 2048002 - DNA, 20 bp, Homo sapiens
gctgcctgccgcccaaagag

SEQ ID NO: 2048003 - DNA, 20 bp, Homo sapiens
gctgcctgtagttaggaaat

SEQ ID NO: 2048004 - DNA, 13 bp, Homo sapiens
gctgcctgttcag

SEQ ID NO: 2048005 - DNA, 17 bp, Homo sapiens
gctgcctgttcagctcc

SEQ ID NO: 2048006 - DNA, 19 bp, Homo sapiens
gctgcctgttcagctccag

SEQ ID NO: 2048007 - DNA, 15 bp, Homo sapiens
gctgccttagaacct

SEQ ID NO: 2048008 - DNA, 15 bp, Homo sapiens
gctgccttcctcatc

SEQ ID NO: 2048009 - DNA, 21 bp, Homo sapiens
gctgcgaaaacgttgacccct

SEQ ID NO: 2048010 - DNA, 21 bp, Homo sapiens
gctgcgagatcgctggcagag

SEQ ID NO: 2048011 - DNA, 14 bp, Homo sapiens
gctgcgagcatttc

SEQ ID NO: 2048012 - DNA, 22 bp, Homo sapiens
gctgcgctaacccccagcccac

SEQ ID NO: 2048013 - DNA, 18 bp, Homo sapiens
gctgcgggacagaggacc

SEQ ID NO: 2048014 - DNA, 16 bp, Homo sapiens
gctgcgggtctgaagg

SEQ ID NO: 2048015 - DNA, 17 bp, Homo sapiens
gctgcgggtctgaagga

SEQ ID NO: 2048016 - DNA, 15 bp, Homo sapiens
gctgcggtccaccca

SEQ ID NO: 2048017 - DNA, 18 bp, Homo sapiens
gctgcggtccacccagga

SEQ ID NO: 2048018 - DNA, 19 bp, Homo sapiens
gctgcggtccacccaggag

SEQ ID NO: 2048019 - DNA, 22 bp, Homo sapiens
gctgcggtccacccaggagccc

SEQ ID NO: 2048020 - DNA, 12 bp, Homo sapiens
gctgctacccag

SEQ ID NO: 2048021 - DNA, 14 bp, Homo sapiens
gctgctacccagaa

SEQ ID NO: 2048022 - DNA, 23 bp, Homo sapiens
gctgctactacccgagcccagct

SEQ ID NO: 2048023 - DNA, 17 bp, Homo sapiens
gctgctagagaaggggg

SEQ ID NO: 2048024 - DNA, 23 bp, Homo sapiens
gctgctagcacttggagccaagg

SEQ ID NO: 2048025 - DNA, 23 bp, Homo sapiens
gctgctcaacctctctccttctg

SEQ ID NO: 2048026 - DNA, 16 bp, Homo sapiens
gctgctcatcacccag

SEQ ID NO: 2048027 - DNA, 15 bp, Homo sapiens
gctgctcctccaggg

SEQ ID NO: 2048028 - DNA, 13 bp, Homo sapiens
gctgctcctggct

SEQ ID NO: 2048029 - DNA, 19 bp, Homo sapiens
gctgctcggggtgcacagg

SEQ ID NO: 2048030 - DNA, 23 bp, Homo sapiens
gctgctctattgtagcatttctt

SEQ ID NO: 2048031 - DNA, 14 bp, Homo sapiens
gctgctctgcccct

SEQ ID NO: 2048032 - DNA, 13 bp, Homo sapiens
gctgctgaaacaa

SEQ ID NO: 2048033 - DNA, 15 bp, Homo sapiens
ggcagacaagagctg

SEQ ID NO: 2048034 - DNA, 18 bp, Homo sapiens
ggcagacagcagctcagg

SEQ ID NO: 2048035 - DNA, 14 bp, Homo sapiens
ggcagagaaagaag

SEQ ID NO: 2048036 - DNA, 20 bp, Homo sapiens
ggcagagaagaaagaacgga

SEQ ID NO: 2048037 - DNA, 15 bp, Homo sapiens
ggcagagaaggcctc

SEQ ID NO: 2048038 - DNA, 16 bp, Homo sapiens
ggcagagaaggcttcc

SEQ ID NO: 2048039 - DNA, 17 bp, Homo sapiens
ggcagagaaggcttcct

SEQ ID NO: 2048040 - DNA, 15 bp, Homo sapiens
ggcagagaccccagg

SEQ ID NO: 2048041 - DNA, 20 bp, Homo sapiens
ggcagagccaccagggcact

SEQ ID NO: 2048042 - DNA, 24 bp, Homo sapiens
ggcagagccatgggcctgggcctg

SEQ ID NO: 2048043 - DNA, 18 bp, Homo sapiens
ggcagagcggggaggtgc

SEQ ID NO: 2048044 - DNA, 21 bp, Homo sapiens
ggcagagcggggaggtgcctg

SEQ ID NO: 2048045 - DNA, 16 bp, Homo sapiens
ggcagaggatgttctg

SEQ ID NO: 2048046 - DNA, 23 bp, Homo sapiens
ggcagagggaatgttccctgcac

SEQ ID NO: 2048047 - DNA, 17 bp, Homo sapiens
ggcagaggggcagccgc

SEQ ID NO: 2048048 - DNA, 18 bp, Homo sapiens
ggcagaggggcagccgct

SEQ ID NO: 2048049 - DNA, 13 bp, Homo sapiens
ggcagagtgggct

SEQ ID NO: 2048050 - DNA, 14 bp, Homo sapiens
ggcagagtgggctg

SEQ ID NO: 2048051 - DNA, 19 bp, Homo sapiens
ggcagagtgggctgcctgg

SEQ ID NO: 2048052 - DNA, 18 bp, Homo sapiens
ggcagataatcagcctct

SEQ ID NO: 2048053 - DNA, 19 bp, Homo sapiens
ggcagataatcagcctctt

SEQ ID NO: 2048054 - DNA, 20 bp, Homo sapiens
ggcagataatcagcctctta

SEQ ID NO: 2048055 - DNA, 16 bp, Homo sapiens
ggcagatcacaaggtc

SEQ ID NO: 2048056 - DNA, 14 bp, Homo sapiens
ggcagatgtaggag

SEQ ID NO: 2048057 - DNA, 17 bp, Homo sapiens
ggcagatgtaggaggga

SEQ ID NO: 2048058 - DNA, 20 bp, Homo sapiens
ggcagatgtaggagggactg

SEQ ID NO: 2048059 - DNA, 24 bp, Homo sapiens
ggcagatttagtgaaagctagaga

SEQ ID NO: 2048060 - DNA, 12 bp, Homo sapiens
ggcagcaaggcc

SEQ ID NO: 2048061 - DNA, 16 bp, Homo sapiens
ggcagcaaggcccgag

SEQ ID NO: 2048062 - DNA, 17 bp, Homo sapiens
ggcagcaaggcccgagc

SEQ ID NO: 2048063 - DNA, 21 bp, Homo sapiens
ggcagcaaggcccgagcagct

SEQ ID NO: 2048064 - DNA, 23 bp, Homo sapiens
ggcagcaaggcccgagcagctga

SEQ ID NO: 2048065 - DNA, 16 bp, Homo sapiens
ggcagcaccctccccc

SEQ ID NO: 2048066 - DNA, 19 bp, Homo sapiens
ggcagcagccagccctgcc

SEQ ID NO: 2048067 - DNA, 18 bp, Homo sapiens
aaacttgtatctgaagac

SEQ ID NO: 2048068 - DNA, 13 bp, Homo sapiens
aaacttgtcagaa

SEQ ID NO: 2048069 - DNA, 14 bp, Homo sapiens
aaactttctctgca

SEQ ID NO: 2048070 - DNA, 16 bp, Homo sapiens
aaacttttaaacatga

SEQ ID NO: 2048071 - DNA, 17 bp, Homo sapiens
aaacttttttatttaaa

SEQ ID NO: 2048072 - DNA, 18 bp, Homo sapiens
aaagaaaaaaaagaaagc

SEQ ID NO: 2048073 - DNA, 13 bp, Homo sapiens
aaagaaaaagtat

SEQ ID NO: 2048074 - DNA, 14 bp, Homo sapiens
aaagaaaaccattt

SEQ ID NO: 2048075 - DNA, 16 bp, Homo sapiens
aaagaaaaccatttta

SEQ ID NO: 2048076 - DNA, 13 bp, Homo sapiens
aaagaaaaccttt

SEQ ID NO: 2048077 - DNA, 14 bp, Homo sapiens
aaagaaaagataaa

SEQ ID NO: 2048078 - DNA, 22 bp, Homo sapiens
aaagaaaccgtaattttattat

SEQ ID NO: 2048079 - DNA, 23 bp, Homo sapiens
aaagaaagttaggttataagaaa

SEQ ID NO: 2048080 - DNA, 23 bp, Homo sapiens
aaagaaatccccccttcagaaca

SEQ ID NO: 2048081 - DNA, 13 bp, Homo sapiens
aaagaaatgcaaa

SEQ ID NO: 2048082 - DNA, 15 bp, Homo sapiens
aaagaaatgtaaggg

SEQ ID NO: 2048083 - DNA, 16 bp, Homo sapiens
aaagaactccttattt

SEQ ID NO: 2048084 - DNA, 14 bp, Homo sapiens
aaagaactgcccca

SEQ ID NO: 2048085 - DNA, 15 bp, Homo sapiens
aaagaactgccccat

SEQ ID NO: 2048086 - DNA, 14 bp, Homo sapiens
aaagaagactggaa

SEQ ID NO: 2048087 - DNA, 15 bp, Homo sapiens
aaagaagtaaaagca

SEQ ID NO: 2048088 - DNA, 20 bp, Homo sapiens
aaagaagtaaatttgtccaa

SEQ ID NO: 2048089 - DNA, 23 bp, Homo sapiens
aaagaagtaggggaagacatgca

SEQ ID NO: 2048090 - DNA, 15 bp, Homo sapiens
aaagaatacagaaag

SEQ ID NO: 2048091 - DNA, 13 bp, Homo sapiens
aaagaatattcag

SEQ ID NO: 2048092 - DNA, 16 bp, Homo sapiens
aaagaatttaaattct

SEQ ID NO: 2048093 - DNA, 19 bp, Homo sapiens
aaagacacctactgagtgg

SEQ ID NO: 2048094 - DNA, 13 bp, Homo sapiens
aaagacagaatgt

SEQ ID NO: 2048095 - DNA, 16 bp, Homo sapiens
aaagacagaatgtcac

SEQ ID NO: 2048096 - DNA, 14 bp, Homo sapiens
aaagacagagctgg

SEQ ID NO: 2048097 - DNA, 16 bp, Homo sapiens
aaagacagctgacaga

SEQ ID NO: 2048098 - DNA, 16 bp, Homo sapiens
aaagacagtgtgtgtg

SEQ ID NO: 2048099 - DNA, 14 bp, Homo sapiens
aaagacatgttgta

SEQ ID NO: 2048100 - DNA, 21 bp, Homo sapiens
aaagacgctcaagaatcctct

SEQ ID NO: 2048101 - DNA, 20 bp, Homo sapiens
aaagactaatttaaaaaata

SEQ ID NO: 2048102 - DNA, 17 bp, Homo sapiens
aaagactattcaaacag

SEQ ID NO: 2048103 - DNA, 21 bp, Homo sapiens
aaagactattcaaacagtctc

SEQ ID NO: 2048104 - DNA, 23 bp, Homo sapiens
aaagactattcaaacagtctcag

SEQ ID NO: 2048105 - DNA, 21 bp, Homo sapiens
aaagactccaaagaaatgtaa

SEQ ID NO: 2048106 - DNA, 20 bp, Homo sapiens
aaagactgaaagaatacatt

SEQ ID NO: 2048107 - DNA, 18 bp, Homo sapiens
aaagactgcagctgctga

SEQ ID NO: 2048108 - DNA, 15 bp, Homo sapiens
aaagacttaagatta

SEQ ID NO: 2048109 - DNA, 18 bp, Homo sapiens
aaagacttagtatatttt

SEQ ID NO: 2048110 - DNA, 17 bp, Homo sapiens
aaagagaaaaagaaatg

SEQ ID NO: 2048111 - DNA, 14 bp, Homo sapiens
aaagagaaggagcc

SEQ ID NO: 2048112 - DNA, 18 bp, Homo sapiens
aaagagaataaagacttc

SEQ ID NO: 2048113 - DNA, 23 bp, Homo sapiens
aaagagccattggtttttgtagt

SEQ ID NO: 2048114 - DNA, 22 bp, Homo sapiens
aaagagctttagtcctagagga

SEQ ID NO: 2048115 - DNA, 16 bp, Homo sapiens
aaagaggagaccctgg

SEQ ID NO: 2048116 - DNA, 14 bp, Homo sapiens
aaagaggatgattt

SEQ ID NO: 2048117 - DNA, 20 bp, Homo sapiens
aaagaggatgatttcagaag

SEQ ID NO: 2048118 - DNA, 21 bp, Homo sapiens
aaagaggcgtcttgtattttc

SEQ ID NO: 2048119 - DNA, 22 bp, Homo sapiens
aaagaggcgtcttgtattttct

SEQ ID NO: 2048120 - DNA, 18 bp, Homo sapiens
aaagaggtgaccccaggg

SEQ ID NO: 2048121 - DNA, 21 bp, Homo sapiens
aaagaggtgaccccagggcac

SEQ ID NO: 2048122 - DNA, 16 bp, Homo sapiens
aaagagtggagcaaat

SEQ ID NO: 2048123 - DNA, 14 bp, Homo sapiens
aaagagttcaagaa

SEQ ID NO: 2048124 - DNA, 16 bp, Homo sapiens
aaagagttcaagaaat

SEQ ID NO: 2048125 - DNA, 13 bp, Homo sapiens
aaagataaagatg

SEQ ID NO: 2048126 - DNA, 20 bp, Homo sapiens
aaagataacaagatctttca

SEQ ID NO: 2048127 - DNA, 17 bp, Homo sapiens
aaagatatatacacagg

SEQ ID NO: 2048128 - DNA, 17 bp, Homo sapiens
aaagatgaaaatatttg

SEQ ID NO: 2048129 - DNA, 21 bp, Homo sapiens
aaagatgtcaaatatctcaga

SEQ ID NO: 2048130 - DNA, 13 bp, Homo sapiens
aaagatgtgttgt

SEQ ID NO: 2048131 - DNA, 21 bp, Homo sapiens
aaagattatatatcataaagt

SEQ ID NO: 2048132 - DNA, 20 bp, Homo sapiens
aaagattttttaataattta

SEQ ID NO: 2048133 - DNA, 22 bp, Homo sapiens
aaagattttttaataatttaga

SEQ ID NO: 2048134 - DNA, 15 bp, Homo sapiens
aaagcaaaaaagaaa

SEQ ID NO: 2048135 - DNA, 18 bp, Homo sapiens
aaagcaacagtagcaggg

SEQ ID NO: 2048136 - DNA, 14 bp, Homo sapiens
aaagcaacatttta

SEQ ID NO: 2048137 - DNA, 14 bp, Homo sapiens
aaagcaagactgtt

SEQ ID NO: 2048138 - DNA, 20 bp, Homo sapiens
aaagcaagcattcagaagaa

SEQ ID NO: 2048139 - DNA, 17 bp, Homo sapiens
aaagcaagggctccagc

SEQ ID NO: 2048140 - DNA, 20 bp, Homo sapiens
aaagcaagggctccagcatc

SEQ ID NO: 2048141 - DNA, 13 bp, Homo sapiens
aaagcaatatttc

SEQ ID NO: 2048142 - DNA, 13 bp, Homo sapiens
aaagcaattatat

SEQ ID NO: 2048143 - DNA, 16 bp, Homo sapiens
aaagcaattatattgt

SEQ ID NO: 2048144 - DNA, 17 bp, Homo sapiens
aaagcaattgccctgta

SEQ ID NO: 2048145 - DNA, 20 bp, Homo sapiens
aaagcacagtgttaaatgaa

SEQ ID NO: 2048146 - DNA, 18 bp, Homo sapiens
aaagcaccgcagcatgtg

SEQ ID NO: 2048147 - DNA, 12 bp, Homo sapiens
aaagcacctgcc

SEQ ID NO: 2048148 - DNA, 21 bp, Homo sapiens
aaagcactgacttctaagtaa

SEQ ID NO: 2048149 - DNA, 13 bp, Homo sapiens
aaagcagtgtttt

SEQ ID NO: 2048150 - DNA, 14 bp, Homo sapiens
aaagcagtgttttc

SEQ ID NO: 2048151 - DNA, 23 bp, Homo sapiens
aaagcagttaactttaagactga

SEQ ID NO: 2048152 - DNA, 16 bp, Homo sapiens
aaagcatcacctcagg

SEQ ID NO: 2048153 - DNA, 16 bp, Homo sapiens
aaagcatcacttggga

SEQ ID NO: 2048154 - DNA, 20 bp, Homo sapiens
aaagcatcatggctatctgt

SEQ ID NO: 2048155 - DNA, 18 bp, Homo sapiens
aaagcatcattgtaaatt

SEQ ID NO: 2048156 - DNA, 13 bp, Homo sapiens
aaagcatgaatgg

SEQ ID NO: 2048157 - DNA, 17 bp, Homo sapiens
aaagccaaactctgcca

SEQ ID NO: 2048158 - DNA, 12 bp, Homo sapiens
aaagccaaattt

SEQ ID NO: 2048159 - DNA, 11 bp, Homo sapiens
aaagccccacc

SEQ ID NO: 2048160 - DNA, 19 bp, Homo sapiens
aaagcccccacttctctcc

SEQ ID NO: 2048161 - DNA, 12 bp, Homo sapiens
aaagcccctgga

SEQ ID NO: 2048162 - DNA, 22 bp, Homo sapiens
aaagcctctggtggaacctgca

SEQ ID NO: 2048163 - DNA, 18 bp, Homo sapiens
aaagcctgttcatggcag

SEQ ID NO: 2048164 - DNA, 19 bp, Homo sapiens
aaagcgagatcccatctct

SEQ ID NO: 2048165 - DNA, 14 bp, Homo sapiens
aaagcgtttgcaca

SEQ ID NO: 2048166 - DNA, 15 bp, Homo sapiens
aaagctactgaattt

SEQ ID NO: 2048167 - DNA, 17 bp, Homo sapiens
aaagctaggcctggcca

SEQ ID NO: 2048168 - DNA, 16 bp, Homo sapiens
aaagctcctgtcctcc

SEQ ID NO: 2048169 - DNA, 20 bp, Homo sapiens
aaagctctctttggaatgaa

SEQ ID NO: 2048170 - DNA, 17 bp, Homo sapiens
aaagctctgcatgtgtg

SEQ ID NO: 2048171 - DNA, 13 bp, Homo sapiens
aaagctgctgaca

SEQ ID NO: 2048172 - DNA, 23 bp, Homo sapiens
aaagctgcttgactatcacatac

SEQ ID NO: 2048173 - DNA, 18 bp, Homo sapiens
aaagctggtttaatgttt

SEQ ID NO: 2048174 - DNA, 14 bp, Homo sapiens
aaagcttaaaactt

SEQ ID NO: 2048175 - DNA, 19 bp, Homo sapiens
aaagcttaaaactttgaag

SEQ ID NO: 2048176 - DNA, 19 bp, Homo sapiens
aaagcttaaattgcttttg

SEQ ID NO: 2048177 - DNA, 20 bp, Homo sapiens
aaagcttgaagatcgttagt

SEQ ID NO: 2048178 - DNA, 17 bp, Homo sapiens
aaaggaaatgtttgagt

SEQ ID NO: 2048179 - DNA, 17 bp, Homo sapiens
aaaggaacacccggaaa

SEQ ID NO: 2048180 - DNA, 17 bp, Homo sapiens
aaaggaagtcaccaaaa

SEQ ID NO: 2048181 - DNA, 17 bp, Homo sapiens
aaaggagagaagaaagt

SEQ ID NO: 2048182 - DNA, 22 bp, Homo sapiens
aaatttgccaccactagagctg

SEQ ID NO: 2048183 - DNA, 24 bp, Homo sapiens
aaatttgtccaatggctgtaaact

SEQ ID NO: 2048184 - DNA, 22 bp, Homo sapiens
aaatttgttttgacggatgatt

SEQ ID NO: 2048185 - DNA, 14 bp, Homo sapiens
aaattttaacattt

SEQ ID NO: 2048186 - DNA, 19 bp, Homo sapiens
aaattttactgacagaaat

SEQ ID NO: 2048187 - DNA, 23 bp, Homo sapiens
aaattttagcgtgctcactgacc

SEQ ID NO: 2048188 - DNA, 13 bp, Homo sapiens
aaattttattcct

SEQ ID NO: 2048189 - DNA, 13 bp, Homo sapiens
aaattttcaaact

SEQ ID NO: 2048190 - DNA, 20 bp, Homo sapiens
aaattttctagactttctgt

SEQ ID NO: 2048191 - DNA, 18 bp, Homo sapiens
aaattttggccaaagtgt

SEQ ID NO: 2048192 - DNA, 23 bp, Homo sapiens
aaattttgtttcagaattttgta

SEQ ID NO: 2048193 - DNA, 19 bp, Homo sapiens
aaatttttatcttactttt

SEQ ID NO: 2048194 - DNA, 20 bp, Homo sapiens
aaatttttctagaagatatc

SEQ ID NO: 2048195 - DNA, 20 bp, Homo sapiens
aacaaaaaaaaaccatgcat

SEQ ID NO: 2048196 - DNA, 16 bp, Homo sapiens
aacaaaacaagaaaga

SEQ ID NO: 2048197 - DNA, 11 bp, Homo sapiens
aacaaaaccag

SEQ ID NO: 2048198 - DNA, 16 bp, Homo sapiens
aacaaaaccagctgct

SEQ ID NO: 2048199 - DNA, 15 bp, Homo sapiens
aacaaaatcacaagc

SEQ ID NO: 2048200 - DNA, 17 bp, Homo sapiens
aacaaagaaaaaaatat

SEQ ID NO: 2048201 - DNA, 18 bp, Homo sapiens
aacaaagaaaaaaatata

SEQ ID NO: 2048202 - DNA, 17 bp, Homo sapiens
aacaaagagttcaagaa

SEQ ID NO: 2048203 - DNA, 17 bp, Homo sapiens
aacaaagcacagtgtta

SEQ ID NO: 2048204 - DNA, 20 bp, Homo sapiens
aacaaattatgttacatctg

SEQ ID NO: 2048205 - DNA, 15 bp, Homo sapiens
aacaacaaaccaaaa

SEQ ID NO: 2048206 - DNA, 14 bp, Homo sapiens
aacaacaaggaccc

SEQ ID NO: 2048207 - DNA, 13 bp, Homo sapiens
aacaacctggaga

SEQ ID NO: 2048208 - DNA, 17 bp, Homo sapiens
aacaactaatcaagagt

SEQ ID NO: 2048209 - DNA, 16 bp, Homo sapiens
aacaactaggcttcag

SEQ ID NO: 2048210 - DNA, 22 bp, Homo sapiens
aacaacttaatgttctgaataa

SEQ ID NO: 2048211 - DNA, 19 bp, Homo sapiens
aacaagaaattgtttcttt

SEQ ID NO: 2048212 - DNA, 18 bp, Homo sapiens
aacaagaatattgtatgt

SEQ ID NO: 2048213 - DNA, 15 bp, Homo sapiens
aacaaggaccctgtt

SEQ ID NO: 2048214 - DNA, 19 bp, Homo sapiens
aacaaggcttaaaagagta

SEQ ID NO: 2048215 - DNA, 16 bp, Homo sapiens
aacaaggttcttctaa

SEQ ID NO: 2048216 - DNA, 12 bp, Homo sapiens
aacaagtatttg

SEQ ID NO: 2048217 - DNA, 23 bp, Homo sapiens
aacaagtatttgttaatttagaa

SEQ ID NO: 2048218 - DNA, 12 bp, Homo sapiens
aacaagttgcct

SEQ ID NO: 2048219 - DNA, 16 bp, Homo sapiens
aacaataaaacattat

SEQ ID NO: 2048220 - DNA, 13 bp, Homo sapiens
aacaataaagagc

SEQ ID NO: 2048221 - DNA, 18 bp, Homo sapiens
aacaatacaacaagaaca

SEQ ID NO: 2048222 - DNA, 19 bp, Homo sapiens
aacaatagctattgcatgt

SEQ ID NO: 2048223 - DNA, 12 bp, Homo sapiens
aacaatggagat

SEQ ID NO: 2048224 - DNA, 20 bp, Homo sapiens
aacaatggtttacatgaaca

SEQ ID NO: 2048225 - DNA, 21 bp, Homo sapiens
aacaatggtttacatgaacac

SEQ ID NO: 2048226 - DNA, 16 bp, Homo sapiens
aacaatgtcagaaact

SEQ ID NO: 2048227 - DNA, 17 bp, Homo sapiens
aacaattaaacagccaa

SEQ ID NO: 2048228 - DNA, 19 bp, Homo sapiens
aacaattctaaaatgattg

SEQ ID NO: 2048229 - DNA, 23 bp, Homo sapiens
aacaattttaggaggaccagagc

SEQ ID NO: 2048230 - DNA, 20 bp, Homo sapiens
aacacaaagagaaaaagaaa

SEQ ID NO: 2048231 - DNA, 18 bp, Homo sapiens
aacacaagacaccttttg

SEQ ID NO: 2048232 - DNA, 16 bp, Homo sapiens
aacacaagccacagaa

SEQ ID NO: 2048233 - DNA, 17 bp, Homo sapiens
aacacaagccacagaag

SEQ ID NO: 2048234 - DNA, 16 bp, Homo sapiens
aacacaagtcctgtga

SEQ ID NO: 2048235 - DNA, 14 bp, Homo sapiens
aacacactgtaaat

SEQ ID NO: 2048236 - DNA, 19 bp, Homo sapiens
aacacagcagttctgcaga

SEQ ID NO: 2048237 - DNA, 14 bp, Homo sapiens
aacacagttttgaa

SEQ ID NO: 2048238 - DNA, 21 bp, Homo sapiens
aacacataactagaaacctga

SEQ ID NO: 2048239 - DNA, 18 bp, Homo sapiens
aacacattacttgcacaa

SEQ ID NO: 2048240 - DNA, 23 bp, Homo sapiens
aacacattgagtttaagtctctg

SEQ ID NO: 2048241 - DNA, 18 bp, Homo sapiens
aacaccactttgtctctg

SEQ ID NO: 2048242 - DNA, 16 bp, Homo sapiens
aacacccactggccag

SEQ ID NO: 2048243 - DNA, 17 bp, Homo sapiens
aacacccactggccagt

SEQ ID NO: 2048244 - DNA, 21 bp, Homo sapiens
aacacccatgaatcaaagaca

SEQ ID NO: 2048245 - DNA, 19 bp, Homo sapiens
aacacccgccccccccatg

SEQ ID NO: 2048246 - DNA, 21 bp, Homo sapiens
aacacccgccccccccatgtt

SEQ ID NO: 2048247 - DNA, 14 bp, Homo sapiens
aacacccggaaaga

SEQ ID NO: 2048248 - DNA, 18 bp, Homo sapiens
aacacctccttgctttgc

SEQ ID NO: 2048249 - DNA, 24 bp, Homo sapiens
aacaccttcttggcttctgggacc

SEQ ID NO: 2048250 - DNA, 22 bp, Homo sapiens
aacacctttgttttgcactgac

SEQ ID NO: 2048251 - DNA, 15 bp, Homo sapiens
aacacgagcaggcta

SEQ ID NO: 2048252 - DNA, 14 bp, Homo sapiens
aacactaaaaataa

SEQ ID NO: 2048253 - DNA, 18 bp, Homo sapiens
aacactaacatataatgt

SEQ ID NO: 2048254 - DNA, 18 bp, Homo sapiens
aacactatatggcagtgt

SEQ ID NO: 2048255 - DNA, 21 bp, Homo sapiens
aacactcacatttattctgct

SEQ ID NO: 2048256 - DNA, 16 bp, Homo sapiens
aacactcagaagcctg

SEQ ID NO: 2048257 - DNA, 20 bp, Homo sapiens
aacactcagaagcctggggg

SEQ ID NO: 2048258 - DNA, 19 bp, Homo sapiens
aacactccaccccctccag

SEQ ID NO: 2048259 - DNA, 13 bp, Homo sapiens
aacactctatatt

SEQ ID NO: 2048260 - DNA, 14 bp, Homo sapiens
aacactgaatcatg

SEQ ID NO: 2048261 - DNA, 17 bp, Homo sapiens
aacactgaatcatgtta

SEQ ID NO: 2048262 - DNA, 19 bp, Homo sapiens
aacactgaatcatgttaat

SEQ ID NO: 2048263 - DNA, 15 bp, Homo sapiens
aacactgcaagaagt

SEQ ID NO: 2048264 - DNA, 16 bp, Homo sapiens
aacactgcaagaagtc

SEQ ID NO: 2048265 - DNA, 19 bp, Homo sapiens
aacactggcaacaacaaag

SEQ ID NO: 2048266 - DNA, 16 bp, Homo sapiens
aacactgtgtatttat

SEQ ID NO: 2048267 - DNA, 20 bp, Homo sapiens
aacacttctcatcatattgt

SEQ ID NO: 2048268 - DNA, 12 bp, Homo sapiens
aacagaaccaga

SEQ ID NO: 2048269 - DNA, 13 bp, Homo sapiens
aacagaaccagag

SEQ ID NO: 2048270 - DNA, 22 bp, Homo sapiens
aacagaactgctaaatactgta

SEQ ID NO: 2048271 - DNA, 14 bp, Homo sapiens
aacagaagcttcca

SEQ ID NO: 2048272 - DNA, 16 bp, Homo sapiens
aacagaagcttccatt

SEQ ID NO: 2048273 - DNA, 12 bp, Homo sapiens
aacagaaggaga

SEQ ID NO: 2048274 - DNA, 18 bp, Homo sapiens
aacagacaacagaagtca

SEQ ID NO: 2048275 - DNA, 13 bp, Homo sapiens
aacagactattta

SEQ ID NO: 2048276 - DNA, 20 bp, Homo sapiens
aacagactggaagcacagct

SEQ ID NO: 2048277 - DNA, 15 bp, Homo sapiens
aacagagcgggcctc

SEQ ID NO: 2048278 - DNA, 20 bp, Homo sapiens
aacagagcgggcctcttccc

SEQ ID NO: 2048279 - DNA, 22 bp, Homo sapiens
aacagaggaatctacctgtggt

SEQ ID NO: 2048280 - DNA, 21 bp, Homo sapiens
aacagaggcgtctcacatttt

SEQ ID NO: 2048281 - DNA, 19 bp, Homo sapiens
aacagagggaccaaattgc

SEQ ID NO: 2048282 - DNA, 20 bp, Homo sapiens
aacagagggaccaaattgct

SEQ ID NO: 2048283 - DNA, 23 bp, Homo sapiens
aacagagggaccaaattgcttct

SEQ ID NO: 2048284 - DNA, 17 bp, Homo sapiens
aacagagtatatatgta

SEQ ID NO: 2048285 - DNA, 21 bp, Homo sapiens
aacagagtatatatgtacagt

SEQ ID NO: 2048286 - DNA, 22 bp, Homo sapiens
aacagataccatactcatttct

SEQ ID NO: 2048287 - DNA, 23 bp, Homo sapiens
aacagatactggaagttttgcat

SEQ ID NO: 2048288 - DNA, 20 bp, Homo sapiens
aacagatataaatggctggt

SEQ ID NO: 2048289 - DNA, 15 bp, Homo sapiens
aacagattgtttgca

SEQ ID NO: 2048290 - DNA, 16 bp, Homo sapiens
aacagattgtttgcaa

SEQ ID NO: 2048291 - DNA, 20 bp, Homo sapiens
aacagcagactcagctctga

SEQ ID NO: 2048292 - DNA, 17 bp, Homo sapiens
aacagcagaggttcttt

SEQ ID NO: 2048293 - DNA, 9 bp, Homo sapiens
aacagcagc

SEQ ID NO: 2048294 - DNA, 13 bp, Homo sapiens
aacagcagtgttc

SEQ ID NO: 2048295 - DNA, 22 bp, Homo sapiens
aacagccaaataaaacctcagg

SEQ ID NO: 2048296 - DNA, 12 bp, Homo sapiens
aacggggagaaa

SEQ ID NO: 2048297 - DNA, 20 bp, Homo sapiens
aacgggggtgcggcaggagc

SEQ ID NO: 2048298 - DNA, 15 bp, Homo sapiens
aacggggtccttcaa

SEQ ID NO: 2048299 - DNA, 18 bp, Homo sapiens
aacgtaatgattatatga

SEQ ID NO: 2048300 - DNA, 13 bp, Homo sapiens
aacgtcatctcag

SEQ ID NO: 2048301 - DNA, 15 bp, Homo sapiens
aacgtcatctcaggg

SEQ ID NO: 2048302 - DNA, 19 bp, Homo sapiens
aacgttgacccctttcccc

SEQ ID NO: 2048303 - DNA, 20 bp, Homo sapiens
aacgtttaagccaaaacaat

SEQ ID NO: 2048304 - DNA, 15 bp, Homo sapiens
aacgttttgaactaa

SEQ ID NO: 2048305 - DNA, 15 bp, Homo sapiens
aactaaatatatgtc

SEQ ID NO: 2048306 - DNA, 23 bp, Homo sapiens
aactaagaaatatgcacaatagc

SEQ ID NO: 2048307 - DNA, 13 bp, Homo sapiens
aactaatcaagag

SEQ ID NO: 2048308 - DNA, 15 bp, Homo sapiens
aactaatttaaacca

SEQ ID NO: 2048309 - DNA, 21 bp, Homo sapiens
aactaatttaaaccagcagaa

SEQ ID NO: 2048310 - DNA, 14 bp, Homo sapiens
aactacagtctaaa

SEQ ID NO: 2048311 - DNA, 13 bp, Homo sapiens
aactacagtggct

SEQ ID NO: 2048312 - DNA, 22 bp, Homo sapiens
aactactcagctctcctgctgc

SEQ ID NO: 2048313 - DNA, 12 bp, Homo sapiens
aactactgtaat

SEQ ID NO: 2048314 - DNA, 23 bp, Homo sapiens
aactacttttgtaccagtgtgaa

SEQ ID NO: 2048315 - DNA, 15 bp, Homo sapiens
aactactttttatac

SEQ ID NO: 2048316 - DNA, 17 bp, Homo sapiens
aactactttttatactc

SEQ ID NO: 2048317 - DNA, 12 bp, Homo sapiens
aactagaagaaa

SEQ ID NO: 2048318 - DNA, 20 bp, Homo sapiens
aactagagatgactgagtcc

SEQ ID NO: 2048319 - DNA, 20 bp, Homo sapiens
aactagatcaaggagcccag

SEQ ID NO: 2048320 - DNA, 12 bp, Homo sapiens
aactagatctcc

SEQ ID NO: 2048321 - DNA, 20 bp, Homo sapiens
aactagatctcctatttttc

SEQ ID NO: 2048322 - DNA, 22 bp, Homo sapiens
aactagtaatgggccaattaaa

SEQ ID NO: 2048323 - DNA, 17 bp, Homo sapiens
aactatcaatatttaag

SEQ ID NO: 2048324 - DNA, 19 bp, Homo sapiens
aactatccaattaaaatta

SEQ ID NO: 2048325 - DNA, 21 bp, Homo sapiens
aactatccaattaaaattaag

SEQ ID NO: 2048326 - DNA, 15 bp, Homo sapiens
aactatgctgaagag

SEQ ID NO: 2048327 - DNA, 23 bp, Homo sapiens
aactatggttcccaataaaagtg

SEQ ID NO: 2048328 - DNA, 13 bp, Homo sapiens
aactatgtgatgt

SEQ ID NO: 2048329 - DNA, 18 bp, Homo sapiens
aactatttgtctttcagg

SEQ ID NO: 2048330 - DNA, 19 bp, Homo sapiens
aactcaaaacttaacatat

SEQ ID NO: 2048331 - DNA, 12 bp, Homo sapiens
aactcaatattt

SEQ ID NO: 2048332 - DNA, 15 bp, Homo sapiens
aactcaccatgtaaa

SEQ ID NO: 2048333 - DNA, 16 bp, Homo sapiens
aactcaccatgtaaaa

SEQ ID NO: 2048334 - DNA, 17 bp, Homo sapiens
aactcacgatgaaattg

SEQ ID NO: 2048335 - DNA, 14 bp, Homo sapiens
aactcactgctcaa

SEQ ID NO: 2048336 - DNA, 21 bp, Homo sapiens
aactcactgctcaagaagaca

SEQ ID NO: 2048337 - DNA, 17 bp, Homo sapiens
aactcacttcaatgaac

SEQ ID NO: 2048338 - DNA, 16 bp, Homo sapiens
aactcagaatgctcta

SEQ ID NO: 2048339 - DNA, 16 bp, Homo sapiens
aactcagacattccaa

SEQ ID NO: 2048340 - DNA, 15 bp, Homo sapiens
aactcagttttaact

SEQ ID NO: 2048341 - DNA, 16 bp, Homo sapiens
aactcatcataaaata

SEQ ID NO: 2048342 - DNA, 18 bp, Homo sapiens
aactcatgggtacccaga

SEQ ID NO: 2048343 - DNA, 23 bp, Homo sapiens
aactcattagactggaacttgaa

SEQ ID NO: 2048344 - DNA, 16 bp, Homo sapiens
aactcctgacagtctt

SEQ ID NO: 2048345 - DNA, 18 bp, Homo sapiens
aactcctggaaatatcag

SEQ ID NO: 2048346 - DNA, 19 bp, Homo sapiens
aactccttattttgtatta

SEQ ID NO: 2048347 - DNA, 21 bp, Homo sapiens
aactcctttagcaggtggtcc

SEQ ID NO: 2048348 - DNA, 15 bp, Homo sapiens
aactcgttttttaca

SEQ ID NO: 2048349 - DNA, 22 bp, Homo sapiens
aactctaattcccattttgcaa

SEQ ID NO: 2048350 - DNA, 19 bp, Homo sapiens
aactctaccctggtaggaa

SEQ ID NO: 2048351 - DNA, 15 bp, Homo sapiens
aactctccactccat

SEQ ID NO: 2048352 - DNA, 21 bp, Homo sapiens
aactctgcactccatggccac

SEQ ID NO: 2048353 - DNA, 14 bp, Homo sapiens
aactctgccagcca

SEQ ID NO: 2048354 - DNA, 16 bp, Homo sapiens
aactcttcaaggtctg

SEQ ID NO: 2048355 - DNA, 19 bp, Homo sapiens
aactcttcaaggtctgctt

SEQ ID NO: 2048356 - DNA, 16 bp, Homo sapiens
aactgaaaaatgtcag

SEQ ID NO: 2048357 - DNA, 18 bp, Homo sapiens
aactgaaaactgtaaata

SEQ ID NO: 2048358 - DNA, 12 bp, Homo sapiens
aactgaaaatta

SEQ ID NO: 2048359 - DNA, 17 bp, Homo sapiens
aactgaaaattatttaa

SEQ ID NO: 2048360 - DNA, 20 bp, Homo sapiens
aactgaagacctccacatta

SEQ ID NO: 2048361 - DNA, 13 bp, Homo sapiens
aactgaagccaga

SEQ ID NO: 2048362 - DNA, 23 bp, Homo sapiens
aactgagagcagatggtcctcca

SEQ ID NO: 2048363 - DNA, 24 bp, Homo sapiens
aactgagccaaacacactgtaaat

SEQ ID NO: 2048364 - DNA, 17 bp, Homo sapiens
aactgagcctagctacc

SEQ ID NO: 2048365 - DNA, 12 bp, Homo sapiens
aactgaggaatt

SEQ ID NO: 2048366 - DNA, 22 bp, Homo sapiens
aactgaggagtagctgagagga

SEQ ID NO: 2048367 - DNA, 19 bp, Homo sapiens
aactgatcaaaaataaact

SEQ ID NO: 2048368 - DNA, 20 bp, Homo sapiens
aactgatcaaaaataaacta

SEQ ID NO: 2048369 - DNA, 21 bp, Homo sapiens
aactgatcaaaaataaactag

SEQ ID NO: 2048370 - DNA, 17 bp, Homo sapiens
aactgatggaccgggtg

SEQ ID NO: 2048371 - DNA, 20 bp, Homo sapiens
aactgattagtattcaggca

SEQ ID NO: 2048372 - DNA, 19 bp, Homo sapiens
aactgattcacatctcatt

SEQ ID NO: 2048373 - DNA, 15 bp, Homo sapiens
aactgcaaagtgaag

SEQ ID NO: 2048374 - DNA, 19 bp, Homo sapiens
aactgcacactatttccct

SEQ ID NO: 2048375 - DNA, 14 bp, Homo sapiens
aactgcacgttcta

SEQ ID NO: 2048376 - DNA, 22 bp, Homo sapiens
aactgcatatcggaggtggtgg

SEQ ID NO: 2048377 - DNA, 14 bp, Homo sapiens
aactgcattagaaa

SEQ ID NO: 2048378 - DNA, 15 bp, Homo sapiens
aactgcctctttcct

SEQ ID NO: 2048379 - DNA, 21 bp, Homo sapiens
aactgctaaatactgtacata

SEQ ID NO: 2048380 - DNA, 12 bp, Homo sapiens
aactgctctgcc

SEQ ID NO: 2048381 - DNA, 10 bp, Homo sapiens
aactgctgag

SEQ ID NO: 2048382 - DNA, 16 bp, Homo sapiens
aactggaaatctggat

SEQ ID NO: 2048383 - DNA, 18 bp, Homo sapiens
aactggaaatctggattt

SEQ ID NO: 2048384 - DNA, 20 bp, Homo sapiens
aactggaagcatgtaggaga

SEQ ID NO: 2048385 - DNA, 20 bp, Homo sapiens
aactggacatcacagcagaa

SEQ ID NO: 2048386 - DNA, 17 bp, Homo sapiens
aactggacgcccagctg

SEQ ID NO: 2048387 - DNA, 19 bp, Homo sapiens
aactggactggttcaaatg

SEQ ID NO: 2048388 - DNA, 17 bp, Homo sapiens
aactggccaagctgagg

SEQ ID NO: 2048389 - DNA, 11 bp, Homo sapiens
aactggctgca

SEQ ID NO: 2048390 - DNA, 15 bp, Homo sapiens
aactggcttctgtgc

SEQ ID NO: 2048391 - DNA, 22 bp, Homo sapiens
aactggggcttgcaagaggagg

SEQ ID NO: 2048392 - DNA, 19 bp, Homo sapiens
aactggtcaccatgaaact

SEQ ID NO: 2048393 - DNA, 19 bp, Homo sapiens
aactggttcaagagacact

SEQ ID NO: 2048394 - DNA, 22 bp, Homo sapiens
aactggtttagcacaatttata

SEQ ID NO: 2048395 - DNA, 18 bp, Homo sapiens
aactgtaaatatgtttgt

SEQ ID NO: 2048396 - DNA, 13 bp, Homo sapiens
aactgtaaatcac

SEQ ID NO: 2048397 - DNA, 15 bp, Homo sapiens
aactgtaaatcactt

SEQ ID NO: 2048398 - DNA, 16 bp, Homo sapiens
aactgtaaatcacttg

SEQ ID NO: 2048399 - DNA, 17 bp, Homo sapiens
aactgtaaatcacttgt

SEQ ID NO: 2048400 - DNA, 19 bp, Homo sapiens
aactgtcagcccacagcag

SEQ ID NO: 2048401 - DNA, 14 bp, Homo sapiens
aactgtgacaggaa

SEQ ID NO: 2048402 - DNA, 16 bp, Homo sapiens
aactgtgacaggaagc

SEQ ID NO: 2048403 - DNA, 18 bp, Homo sapiens
aactgtgccctgccttca

SEQ ID NO: 2048404 - DNA, 17 bp, Homo sapiens
aactgtgtgaagaaatg

SEQ ID NO: 2048405 - DNA, 17 bp, Homo sapiens
aactgtgttcattagaa

SEQ ID NO: 2048406 - DNA, 14 bp, Homo sapiens
aactgttctgtgtg

SEQ ID NO: 2048407 - DNA, 14 bp, Homo sapiens
aactgtttatggta

SEQ ID NO: 2048408 - DNA, 19 bp, Homo sapiens
aactgtttatggtattttc

SEQ ID NO: 2048409 - DNA, 15 bp, Homo sapiens
aacttaaaagattca

SEQ ID NO: 2048410 - DNA, 14 bp, Homo sapiens
aacttaaaatattt

SEQ ID NO: 2048411 - DNA, 22 bp, Homo sapiens
aaggcagcctccagagccagcc

SEQ ID NO: 2048412 - DNA, 23 bp, Homo sapiens
aaggcagcctccagagccagcct

SEQ ID NO: 2048413 - DNA, 16 bp, Homo sapiens
aaggcaggcagggctc

SEQ ID NO: 2048414 - DNA, 21 bp, Homo sapiens
aaggcaggcagggctctcctg

SEQ ID NO: 2048415 - DNA, 23 bp, Homo sapiens
aaggcagtgaacacactcagcag

SEQ ID NO: 2048416 - DNA, 15 bp, Homo sapiens
aaggcatatacaaat

SEQ ID NO: 2048417 - DNA, 17 bp, Homo sapiens
aaggcatctgacatgca

SEQ ID NO: 2048418 - DNA, 16 bp, Homo sapiens
aaggcatgttcctctg

SEQ ID NO: 2048419 - DNA, 18 bp, Homo sapiens
aaggccagtggaaattca

SEQ ID NO: 2048420 - DNA, 13 bp, Homo sapiens
aaggcctgccctc

SEQ ID NO: 2048421 - DNA, 11 bp, Homo sapiens
aaggcctgggg

SEQ ID NO: 2048422 - DNA, 15 bp, Homo sapiens
aaggcctggggtgac

SEQ ID NO: 2048423 - DNA, 17 bp, Homo sapiens
aaggcctggggtgaccc

SEQ ID NO: 2048424 - DNA, 18 bp, Homo sapiens
aaggccttcaacccgaga

SEQ ID NO: 2048425 - DNA, 17 bp, Homo sapiens
aaggctcagtctcagga

SEQ ID NO: 2048426 - DNA, 16 bp, Homo sapiens
aaggctgaccaagaga

SEQ ID NO: 2048427 - DNA, 17 bp, Homo sapiens
aaggctgaccaagagag

SEQ ID NO: 2048428 - DNA, 11 bp, Homo sapiens
aaggctgctgt

SEQ ID NO: 2048429 - DNA, 14 bp, Homo sapiens
aaggctggggccag

SEQ ID NO: 2048430 - DNA, 12 bp, Homo sapiens
aagggaaaaata

SEQ ID NO: 2048431 - DNA, 18 bp, Homo sapiens
aagggaaggaactctggc

SEQ ID NO: 2048432 - DNA, 19 bp, Homo sapiens
aagggacccgaagcccagg

SEQ ID NO: 2048433 - DNA, 17 bp, Homo sapiens
aagggagggctctgagg

SEQ ID NO: 2048434 - DNA, 19 bp, Homo sapiens
aagggagggctctgaggcg

SEQ ID NO: 2048435 - DNA, 16 bp, Homo sapiens
aagggaggggtcctga

SEQ ID NO: 2048436 - DNA, 20 bp, Homo sapiens
aagggagttgctcactcagg

SEQ ID NO: 2048437 - DNA, 21 bp, Homo sapiens
aagggagttgctcactcagga

SEQ ID NO: 2048438 - DNA, 24 bp, Homo sapiens
aagggatggaggtcacactggtag

SEQ ID NO: 2048439 - DNA, 15 bp, Homo sapiens
aagggattctccagg

SEQ ID NO: 2048440 - DNA, 14 bp, Homo sapiens
aagggcagccaggg

SEQ ID NO: 2048441 - DNA, 16 bp, Homo sapiens
aagggcatcaggcact

SEQ ID NO: 2048442 - DNA, 18 bp, Homo sapiens
aagggcatcaggcactgg

SEQ ID NO: 2048443 - DNA, 14 bp, Homo sapiens
aagggcatccttct

SEQ ID NO: 2048444 - DNA, 14 bp, Homo sapiens
aagggcattttaaa

SEQ ID NO: 2048445 - DNA, 16 bp, Homo sapiens
aagggcattttaaaag

SEQ ID NO: 2048446 - DNA, 12 bp, Homo sapiens
aagggccagccc

SEQ ID NO: 2048447 - DNA, 19 bp, Homo sapiens
aagggccatgctgaaggga

SEQ ID NO: 2048448 - DNA, 19 bp, Homo sapiens
aagggctagaacctggaga

SEQ ID NO: 2048449 - DNA, 13 bp, Homo sapiens
aagggctccagca

SEQ ID NO: 2048450 - DNA, 15 bp, Homo sapiens
aagggctccagcatc

SEQ ID NO: 2048451 - DNA, 21 bp, Homo sapiens
aagggctccagcatccagcct

SEQ ID NO: 2048452 - DNA, 22 bp, Homo sapiens
aagggctccagcatccagcctg

SEQ ID NO: 2048453 - DNA, 24 bp, Homo sapiens
aagggctccagcatccagcctgtg

SEQ ID NO: 2048454 - DNA, 11 bp, Homo sapiens
aagggctgccg

SEQ ID NO: 2048455 - DNA, 12 bp, Homo sapiens
aaggggagaagg

SEQ ID NO: 2048456 - DNA, 19 bp, Homo sapiens
aaggggagaagggccagcc

SEQ ID NO: 2048457 - DNA, 13 bp, Homo sapiens
aaggggcacctgg

SEQ ID NO: 2048458 - DNA, 16 bp, Homo sapiens
aaggggcacctgggaa

SEQ ID NO: 2048459 - DNA, 16 bp, Homo sapiens
aaggggcagataaagg

SEQ ID NO: 2048460 - DNA, 13 bp, Homo sapiens
aaggggcccacaa

SEQ ID NO: 2048461 - DNA, 22 bp, Homo sapiens
aaggggcccacaaaggggagaa

SEQ ID NO: 2048462 - DNA, 17 bp, Homo sapiens
aaggggccccggggctg

SEQ ID NO: 2048463 - DNA, 14 bp, Homo sapiens
aaggggccctggtc

SEQ ID NO: 2048464 - DNA, 17 bp, Homo sapiens
aaggggctcagcaaggt

SEQ ID NO: 2048465 - DNA, 14 bp, Homo sapiens
aaggggctgctggg

SEQ ID NO: 2048466 - DNA, 20 bp, Homo sapiens
aaggggtcggctaagtggga

SEQ ID NO: 2048467 - DNA, 13 bp, Homo sapiens
aaggggtgccctc

SEQ ID NO: 2048468 - DNA, 18 bp, Homo sapiens
aaggggtgccctctggat

SEQ ID NO: 2048469 - DNA, 22 bp, Homo sapiens
aaggggtgccctctggatcctg

SEQ ID NO: 2048470 - DNA, 13 bp, Homo sapiens
aagggtaaagaag

SEQ ID NO: 2048471 - DNA, 14 bp, Homo sapiens
aagggtaagggaga

SEQ ID NO: 2048472 - DNA, 17 bp, Homo sapiens
aagggtcaacggccctg

SEQ ID NO: 2048473 - DNA, 17 bp, Homo sapiens
aagggtctagggagaga

SEQ ID NO: 2048474 - DNA, 16 bp, Homo sapiens
aagggtcttcttggca

SEQ ID NO: 2048475 - DNA, 16 bp, Homo sapiens
aagggtgggaagcttg

SEQ ID NO: 2048476 - DNA, 14 bp, Homo sapiens
aagggttatatttt

SEQ ID NO: 2048477 - DNA, 15 bp, Homo sapiens
aagggttgaaggcag

SEQ ID NO: 2048478 - DNA, 17 bp, Homo sapiens
aagggttgaaggcagtc

SEQ ID NO: 2048479 - DNA, 21 bp, Homo sapiens
aagggttttccaccctggaat

SEQ ID NO: 2048480 - DNA, 12 bp, Homo sapiens
aaggtaatccta

SEQ ID NO: 2048481 - DNA, 19 bp, Homo sapiens
aaggtaatttctgtgtatt

SEQ ID NO: 2048482 - DNA, 19 bp, Homo sapiens
aaggtacaagaagcatttt

SEQ ID NO: 2048483 - DNA, 22 bp, Homo sapiens
aaggtagacatggatttgatga

SEQ ID NO: 2048484 - DNA, 15 bp, Homo sapiens
aaggtagagatgtgt

SEQ ID NO: 2048485 - DNA, 17 bp, Homo sapiens
aaggtagagatgtgtgt

SEQ ID NO: 2048486 - DNA, 18 bp, Homo sapiens
aaggtagagatgtgtgtg

SEQ ID NO: 2048487 - DNA, 19 bp, Homo sapiens
aaggtagatcatcttgaat

SEQ ID NO: 2048488 - DNA, 17 bp, Homo sapiens
aaggtagcccagcactg

SEQ ID NO: 2048489 - DNA, 18 bp, Homo sapiens
aaggtagcccagcactgt

SEQ ID NO: 2048490 - DNA, 18 bp, Homo sapiens
aaggtagcttacctgaca

SEQ ID NO: 2048491 - DNA, 12 bp, Homo sapiens
aaggtagttttt

SEQ ID NO: 2048492 - DNA, 18 bp, Homo sapiens
aaggtattaaattgatgt

SEQ ID NO: 2048493 - DNA, 21 bp, Homo sapiens
aaggtctccttactctgagcc

SEQ ID NO: 2048494 - DNA, 22 bp, Homo sapiens
aaggtctccttactctgagccc

SEQ ID NO: 2048495 - DNA, 13 bp, Homo sapiens
aaggtcttcttgt

SEQ ID NO: 2048496 - DNA, 20 bp, Homo sapiens
aaggtcttcttgtgtcctga

SEQ ID NO: 2048497 - DNA, 13 bp, Homo sapiens
aaggtgctaggat

SEQ ID NO: 2048498 - DNA, 21 bp, Homo sapiens
aaggtgggctgagccctggca

SEQ ID NO: 2048499 - DNA, 21 bp, Homo sapiens
aaggtggggtctttgtgagag

SEQ ID NO: 2048500 - DNA, 17 bp, Homo sapiens
aaggtggtatgtgtgtg

SEQ ID NO: 2048501 - DNA, 19 bp, Homo sapiens
aaggtgtcttttccactcc

SEQ ID NO: 2048502 - DNA, 16 bp, Homo sapiens
aaggttaagccctgag

SEQ ID NO: 2048503 - DNA, 22 bp, Homo sapiens
aaggttactcagcagcagagag

SEQ ID NO: 2048504 - DNA, 16 bp, Homo sapiens
aaggttccctctgaga

SEQ ID NO: 2048505 - DNA, 17 bp, Homo sapiens
aaggttctcataggaaa

SEQ ID NO: 2048506 - DNA, 19 bp, Homo sapiens
aaggttcttcatccctttc

SEQ ID NO: 2048507 - DNA, 20 bp, Homo sapiens
aaggttcttcatccctttcc

SEQ ID NO: 2048508 - DNA, 16 bp, Homo sapiens
aaggttcttctaaaat

SEQ ID NO: 2048509 - DNA, 14 bp, Homo sapiens
aaggtttcaagact

SEQ ID NO: 2048510 - DNA, 20 bp, Homo sapiens
aaggttttcctcttctattt

SEQ ID NO: 2048511 - DNA, 14 bp, Homo sapiens
aagtaaaaccacag

SEQ ID NO: 2048512 - DNA, 15 bp, Homo sapiens
aagtaaaaccacagc

SEQ ID NO: 2048513 - DNA, 18 bp, Homo sapiens
aagtaaaaccacagcagt

SEQ ID NO: 2048514 - DNA, 12 bp, Homo sapiens
aagtaaaacttg

SEQ ID NO: 2048515 - DNA, 13 bp, Homo sapiens
aagtaaaccaaaa

SEQ ID NO: 2048516 - DNA, 15 bp, Homo sapiens
aagtaagttctgaaa

SEQ ID NO: 2048517 - DNA, 21 bp, Homo sapiens
aagtaatataatggaagagaa

SEQ ID NO: 2048518 - DNA, 23 bp, Homo sapiens
aagtaatgccacacattgtgctt

SEQ ID NO: 2048519 - DNA, 11 bp, Homo sapiens
aagtaattatc

SEQ ID NO: 2048520 - DNA, 18 bp, Homo sapiens
aagtaattgcatttctgc

SEQ ID NO: 2048521 - DNA, 16 bp, Homo sapiens
aagtagaaaatttctt

SEQ ID NO: 2048522 - DNA, 13 bp, Homo sapiens
aagtagaagagga

SEQ ID NO: 2048523 - DNA, 14 bp, Homo sapiens
aagtagaagaggag

SEQ ID NO: 2048524 - DNA, 19 bp, Homo sapiens
aagtagaatggcagctgga

SEQ ID NO: 2048525 - DNA, 15 bp, Homo sapiens
aagtagaattatatc

SEQ ID NO: 2048526 - DNA, 18 bp, Homo sapiens
aatgagggccaagaaaga

SEQ ID NO: 2048527 - DNA, 19 bp, Homo sapiens
aatgaggtctgaaatggag

SEQ ID NO: 2048528 - DNA, 15 bp, Homo sapiens
aatgagtctgcataa

SEQ ID NO: 2048529 - DNA, 21 bp, Homo sapiens
aatgagtttttatggggctga

SEQ ID NO: 2048530 - DNA, 15 bp, Homo sapiens
aatgatagctactgt

SEQ ID NO: 2048531 - DNA, 15 bp, Homo sapiens
aatgatatccagtaa

SEQ ID NO: 2048532 - DNA, 17 bp, Homo sapiens
aatgatcttttcaagtt

SEQ ID NO: 2048533 - DNA, 15 bp, Homo sapiens
aatgatgccaaaata

SEQ ID NO: 2048534 - DNA, 15 bp, Homo sapiens
aatgattattttcat

SEQ ID NO: 2048535 - DNA, 12 bp, Homo sapiens
aatgattgttta

SEQ ID NO: 2048536 - DNA, 18 bp, Homo sapiens
aatgatttaagcatttta

SEQ ID NO: 2048537 - DNA, 18 bp, Homo sapiens
aatgatttccaaagagaa

SEQ ID NO: 2048538 - DNA, 12 bp, Homo sapiens
aatgcaaaatga

SEQ ID NO: 2048539 - DNA, 20 bp, Homo sapiens
aatgcaaacacacaaaggta

SEQ ID NO: 2048540 - DNA, 18 bp, Homo sapiens
aatgcaaacactgtgtat

SEQ ID NO: 2048541 - DNA, 20 bp, Homo sapiens
aatgcaacaaaatatttaat

SEQ ID NO: 2048542 - DNA, 15 bp, Homo sapiens
aatgcaacaacatgt

SEQ ID NO: 2048543 - DNA, 21 bp, Homo sapiens
aatgcagattcctgggcctgt

SEQ ID NO: 2048544 - DNA, 16 bp, Homo sapiens
aatgcagtccagaata

SEQ ID NO: 2048545 - DNA, 22 bp, Homo sapiens
aatgcagtccagaataagtgct

SEQ ID NO: 2048546 - DNA, 21 bp, Homo sapiens
aatgcatcatcatagaaaaac

SEQ ID NO: 2048547 - DNA, 18 bp, Homo sapiens
aatgcatgattttataca

SEQ ID NO: 2048548 - DNA, 15 bp, Homo sapiens
aatgcattttcaaga

SEQ ID NO: 2048549 - DNA, 22 bp, Homo sapiens
aatgccaacatacccttcttta

SEQ ID NO: 2048550 - DNA, 21 bp, Homo sapiens
aatgccatggacagaagaagg

SEQ ID NO: 2048551 - DNA, 13 bp, Homo sapiens
aatgccctgccat

SEQ ID NO: 2048552 - DNA, 15 bp, Homo sapiens
aatgcctaataaaca

SEQ ID NO: 2048553 - DNA, 20 bp, Homo sapiens
aatgcctcaatgtgaccagg

SEQ ID NO: 2048554 - DNA, 21 bp, Homo sapiens
aatgccttgacaacagactga

SEQ ID NO: 2048555 - DNA, 17 bp, Homo sapiens
aatgccttgggagagat

SEQ ID NO: 2048556 - DNA, 18 bp, Homo sapiens
aatgcgggtgagagtaat

SEQ ID NO: 2048557 - DNA, 21 bp, Homo sapiens
aatgctattgttgtgggcttt

SEQ ID NO: 2048558 - DNA, 17 bp, Homo sapiens
aatgctcgtgtgatttc

SEQ ID NO: 2048559 - DNA, 21 bp, Homo sapiens
aatgctggctgttggctgggg

SEQ ID NO: 2048560 - DNA, 15 bp, Homo sapiens
aatgctggttttcct

SEQ ID NO: 2048561 - DNA, 18 bp, Homo sapiens
aatgctggttttcctaaa

SEQ ID NO: 2048562 - DNA, 19 bp, Homo sapiens
aatgctgttggtgagaatc

SEQ ID NO: 2048563 - DNA, 14 bp, Homo sapiens
aatgcttggcactc

SEQ ID NO: 2048564 - DNA, 15 bp, Homo sapiens
aatgctttccaaaac

SEQ ID NO: 2048565 - DNA, 12 bp, Homo sapiens
aatgctttgata

SEQ ID NO: 2048566 - DNA, 18 bp, Homo sapiens
aatgctttgatatttcaa

SEQ ID NO: 2048567 - DNA, 17 bp, Homo sapiens
aatgctttgggaggcca

SEQ ID NO: 2048568 - DNA, 20 bp, Homo sapiens
aatgctttgggaggccaagg

SEQ ID NO: 2048569 - DNA, 12 bp, Homo sapiens
aatgcttttcta

SEQ ID NO: 2048570 - DNA, 23 bp, Homo sapiens
aatgcttttctagcaactgttgg

SEQ ID NO: 2048571 - DNA, 15 bp, Homo sapiens
aatggaagagaaatc

SEQ ID NO: 2048572 - DNA, 18 bp, Homo sapiens
aatggaagagaaatctca

SEQ ID NO: 2048573 - DNA, 21 bp, Homo sapiens
aatggaagcaaaattataaga

SEQ ID NO: 2048574 - DNA, 22 bp, Homo sapiens
aatggaagcaaaattataagaa

SEQ ID NO: 2048575 - DNA, 17 bp, Homo sapiens
aatggaattcagtaaca

SEQ ID NO: 2048576 - DNA, 15 bp, Homo sapiens
aatggacttcaaatt

SEQ ID NO: 2048577 - DNA, 16 bp, Homo sapiens
aatggagcttgtacat

SEQ ID NO: 2048578 - DNA, 15 bp, Homo sapiens
aatggagggtggggc

SEQ ID NO: 2048579 - DNA, 17 bp, Homo sapiens
aatggcacagcccaaag

SEQ ID NO: 2048580 - DNA, 16 bp, Homo sapiens
aatggcagccttggca

SEQ ID NO: 2048581 - DNA, 13 bp, Homo sapiens
aatggcagctaga

SEQ ID NO: 2048582 - DNA, 22 bp, Homo sapiens
aatggccaaatggtttttgcaa

SEQ ID NO: 2048583 - DNA, 17 bp, Homo sapiens
aatggccatttgctttt

SEQ ID NO: 2048584 - DNA, 22 bp, Homo sapiens
aatggcctgccttgaagccact

SEQ ID NO: 2048585 - DNA, 13 bp, Homo sapiens
aatggcctttatt

SEQ ID NO: 2048586 - DNA, 15 bp, Homo sapiens
aatggctgataattt

SEQ ID NO: 2048587 - DNA, 16 bp, Homo sapiens
aatggctgataatttt

SEQ ID NO: 2048588 - DNA, 17 bp, Homo sapiens
aatggctgataatttta

SEQ ID NO: 2048589 - DNA, 21 bp, Homo sapiens
aatggctgcagtgacccagat

SEQ ID NO: 2048590 - DNA, 20 bp, Homo sapiens
aatgggccaattaaaatata

SEQ ID NO: 2048591 - DNA, 15 bp, Homo sapiens
aatgggctttaacaa

SEQ ID NO: 2048592 - DNA, 12 bp, Homo sapiens
aatggggcggca

SEQ ID NO: 2048593 - DNA, 18 bp, Homo sapiens
aatggtatgagctgaggg

SEQ ID NO: 2048594 - DNA, 16 bp, Homo sapiens
aatggtccagggttga

SEQ ID NO: 2048595 - DNA, 16 bp, Homo sapiens
aatggtcgcccaggag

SEQ ID NO: 2048596 - DNA, 21 bp, Homo sapiens
aatggtcttctgccagcccat

SEQ ID NO: 2048597 - DNA, 13 bp, Homo sapiens
aatggtgcagaaa

SEQ ID NO: 2048598 - DNA, 20 bp, Homo sapiens
aatggtgggaaccctcccca

SEQ ID NO: 2048599 - DNA, 16 bp, Homo sapiens
aatggtggtttgtcat

SEQ ID NO: 2048600 - DNA, 17 bp, Homo sapiens
aatggtggtttgtcata

SEQ ID NO: 2048601 - DNA, 18 bp, Homo sapiens
aatggtggtttgtcatat

SEQ ID NO: 2048602 - DNA, 21 bp, Homo sapiens
aatggtggtttgtcatatatt

SEQ ID NO: 2048603 - DNA, 14 bp, Homo sapiens
aatggttccatgcc

SEQ ID NO: 2048604 - DNA, 19 bp, Homo sapiens
aatggttccatgcctgagg

SEQ ID NO: 2048605 - DNA, 17 bp, Homo sapiens
aatggttgactgggttt

SEQ ID NO: 2048606 - DNA, 14 bp, Homo sapiens
aatggtttacatga

SEQ ID NO: 2048607 - DNA, 16 bp, Homo sapiens
aatggtttacatgaac

SEQ ID NO: 2048608 - DNA, 18 bp, Homo sapiens
aatggtttacatgaacac

SEQ ID NO: 2048609 - DNA, 16 bp, Homo sapiens
aatggtttactgctgt

SEQ ID NO: 2048610 - DNA, 19 bp, Homo sapiens
aatggtttactgctgtcat

SEQ ID NO: 2048611 - DNA, 23 bp, Homo sapiens
aatggtttgaatataaacactat

SEQ ID NO: 2048612 - DNA, 22 bp, Homo sapiens
aatgtaaatattttaaagaatt

SEQ ID NO: 2048613 - DNA, 22 bp, Homo sapiens
aatgtaacttttcttacagcac

SEQ ID NO: 2048614 - DNA, 19 bp, Homo sapiens
aatgtaatcaatgtttctt

SEQ ID NO: 2048615 - DNA, 15 bp, Homo sapiens
aatgtaatgatcata

SEQ ID NO: 2048616 - DNA, 18 bp, Homo sapiens
aatgtacaagttttgtat

SEQ ID NO: 2048617 - DNA, 20 bp, Homo sapiens
aatgtacaagttttgtataa

SEQ ID NO: 2048618 - DNA, 15 bp, Homo sapiens
aatgtacattaatta

SEQ ID NO: 2048619 - DNA, 18 bp, Homo sapiens
aatgtacccaccgggcca

SEQ ID NO: 2048620 - DNA, 22 bp, Homo sapiens
aatgtacgaaactgtatgatta

SEQ ID NO: 2048621 - DNA, 23 bp, Homo sapiens
aatgtaggtttagatatataact

SEQ ID NO: 2048622 - DNA, 23 bp, Homo sapiens
aatgtagtggagagatcatagct

SEQ ID NO: 2048623 - DNA, 14 bp, Homo sapiens
aatgtatatacaca

SEQ ID NO: 2048624 - DNA, 19 bp, Homo sapiens
aatgtatatacacatatac

SEQ ID NO: 2048625 - DNA, 16 bp, Homo sapiens
aatgtatcatagaaat

SEQ ID NO: 2048626 - DNA, 12 bp, Homo sapiens
aatgtatgtgaa

SEQ ID NO: 2048627 - DNA, 17 bp, Homo sapiens
aatgtatgtgaaagtgt

SEQ ID NO: 2048628 - DNA, 21 bp, Homo sapiens
aatgtatgtgaaagtgtaaaa

SEQ ID NO: 2048629 - DNA, 19 bp, Homo sapiens
aatgtattgaacttggaaa

SEQ ID NO: 2048630 - DNA, 13 bp, Homo sapiens
aatgtcaaaatca

SEQ ID NO: 2048631 - DNA, 14 bp, Homo sapiens
aatgtcacaggcag

SEQ ID NO: 2048632 - DNA, 20 bp, Homo sapiens
aatgtcagagctatgttccc

SEQ ID NO: 2048633 - DNA, 20 bp, Homo sapiens
aatgtcaggaacagaaggat

SEQ ID NO: 2048634 - DNA, 14 bp, Homo sapiens
aatgtcatcaaata

SEQ ID NO: 2048635 - DNA, 14 bp, Homo sapiens
aatgtccaaaatgt

SEQ ID NO: 2048636 - DNA, 18 bp, Homo sapiens
aatgtccatgatggaata

SEQ ID NO: 2048637 - DNA, 20 bp, Homo sapiens
aatgtctcagcgaggtgtaa

SEQ ID NO: 2048638 - DNA, 22 bp, Homo sapiens
aatgtctttgttggaaaagaat

SEQ ID NO: 2048639 - DNA, 15 bp, Homo sapiens
aatgtgaagggtggg

SEQ ID NO: 2048640 - DNA, 12 bp, Homo sapiens
acaacaacaata

SEQ ID NO: 2048641 - DNA, 15 bp, Homo sapiens
acaacaacctggtca

SEQ ID NO: 2048642 - DNA, 13 bp, Homo sapiens
acaacaagagttt

SEQ ID NO: 2048643 - DNA, 13 bp, Homo sapiens
acaacaaggaccc

SEQ ID NO: 2048644 - DNA, 19 bp, Homo sapiens
acaacaataacaacaatgg

SEQ ID NO: 2048645 - DNA, 13 bp, Homo sapiens
acaacagactgaa

SEQ ID NO: 2048646 - DNA, 14 bp, Homo sapiens
acaacagcagatgg

SEQ ID NO: 2048647 - DNA, 21 bp, Homo sapiens
acaacagttgggctgtcaaca

SEQ ID NO: 2048648 - DNA, 22 bp, Homo sapiens
acaacagttgggctgtcaacat

SEQ ID NO: 2048649 - DNA, 16 bp, Homo sapiens
acaacatccatgtcct

SEQ ID NO: 2048650 - DNA, 17 bp, Homo sapiens
acaacatccatgtccta

SEQ ID NO: 2048651 - DNA, 22 bp, Homo sapiens
acaacatccatgtcctatgtgt

SEQ ID NO: 2048652 - DNA, 17 bp, Homo sapiens
acaacatcccacagtgg

SEQ ID NO: 2048653 - DNA, 12 bp, Homo sapiens
acaaccagagcc

SEQ ID NO: 2048654 - DNA, 14 bp, Homo sapiens
acaaccagagcccc

SEQ ID NO: 2048655 - DNA, 17 bp, Homo sapiens
acaaccagagcccccca

SEQ ID NO: 2048656 - DNA, 13 bp, Homo sapiens
acaaccagccaca

SEQ ID NO: 2048657 - DNA, 14 bp, Homo sapiens
acaaccattccaga

SEQ ID NO: 2048658 - DNA, 18 bp, Homo sapiens
acaaccctgttttatact

SEQ ID NO: 2048659 - DNA, 18 bp, Homo sapiens
acaacctgcccctcccca

SEQ ID NO: 2048660 - DNA, 13 bp, Homo sapiens
acaacctgtgcag

SEQ ID NO: 2048661 - DNA, 18 bp, Homo sapiens
acaaccttctgtggctca

SEQ ID NO: 2048662 - DNA, 15 bp, Homo sapiens
acaacctttgtgtaa

SEQ ID NO: 2048663 - DNA, 16 bp, Homo sapiens
acaacctttgtgtaat

SEQ ID NO: 2048664 - DNA, 23 bp, Homo sapiens
acaactagatcaaggagcccaga

SEQ ID NO: 2048665 - DNA, 15 bp, Homo sapiens
acaactaggacctca

SEQ ID NO: 2048666 - DNA, 16 bp, Homo sapiens
acaactaggacctcat

SEQ ID NO: 2048667 - DNA, 19 bp, Homo sapiens
acaactaggcttcagcata

SEQ ID NO: 2048668 - DNA, 20 bp, Homo sapiens
acaactccaggaaaactgtt

SEQ ID NO: 2048669 - DNA, 16 bp, Homo sapiens
acaactgacacaggaa

SEQ ID NO: 2048670 - DNA, 16 bp, Homo sapiens
acaacttgtgttctat

SEQ ID NO: 2048671 - DNA, 18 bp, Homo sapiens
acaagaaatttgatttct

SEQ ID NO: 2048672 - DNA, 13 bp, Homo sapiens
acaagaagaccag

SEQ ID NO: 2048673 - DNA, 14 bp, Homo sapiens
acaagaagctgcta

SEQ ID NO: 2048674 - DNA, 13 bp, Homo sapiens
acaagaatatgtt

SEQ ID NO: 2048675 - DNA, 16 bp, Homo sapiens
acaagaatatgttcac

SEQ ID NO: 2048676 - DNA, 20 bp, Homo sapiens
acaagagcccagcagggcct

SEQ ID NO: 2048677 - DNA, 13 bp, Homo sapiens
acaagagctgctg

SEQ ID NO: 2048678 - DNA, 13 bp, Homo sapiens
acaagatctttca

SEQ ID NO: 2048679 - DNA, 15 bp, Homo sapiens
acaagatctttcagg

SEQ ID NO: 2048680 - DNA, 15 bp, Homo sapiens
acaagattcccagag

SEQ ID NO: 2048681 - DNA, 17 bp, Homo sapiens
acaagattcccagagac

SEQ ID NO: 2048682 - DNA, 18 bp, Homo sapiens
acaagattcccagagaca

SEQ ID NO: 2048683 - DNA, 21 bp, Homo sapiens
acaagattcccagagacagga

SEQ ID NO: 2048684 - DNA, 21 bp, Homo sapiens
acaagcaataattaggatcta

SEQ ID NO: 2048685 - DNA, 19 bp, Homo sapiens
acaagcacaaagctcaaga

SEQ ID NO: 2048686 - DNA, 21 bp, Homo sapiens
acaagcattctgtcttgaagg

SEQ ID NO: 2048687 - DNA, 21 bp, Homo sapiens
acaagccaacttgtaaataca

SEQ ID NO: 2048688 - DNA, 13 bp, Homo sapiens
acaagccacagaa

SEQ ID NO: 2048689 - DNA, 13 bp, Homo sapiens
acaagcccaggct

SEQ ID NO: 2048690 - DNA, 18 bp, Homo sapiens
acaagccttactcacctc

SEQ ID NO: 2048691 - DNA, 18 bp, Homo sapiens
acaagcgtgagccactgc

SEQ ID NO: 2048692 - DNA, 21 bp, Homo sapiens
acaagcgtgagccactgcacc

SEQ ID NO: 2048693 - DNA, 23 bp, Homo sapiens
acaagctcaggaggcgaataaat

SEQ ID NO: 2048694 - DNA, 12 bp, Homo sapiens
acaagcttgtat

SEQ ID NO: 2048695 - DNA, 15 bp, Homo sapiens
acaagcttgtatata

SEQ ID NO: 2048696 - DNA, 20 bp, Homo sapiens
acaagcttgtatatacatat

SEQ ID NO: 2048697 - DNA, 22 bp, Homo sapiens
acaagcttgtatatacatatta

SEQ ID NO: 2048698 - DNA, 15 bp, Homo sapiens
acaaggaagtggggg

SEQ ID NO: 2048699 - DNA, 21 bp, Homo sapiens
acaaggaagtgggggccgctg

SEQ ID NO: 2048700 - DNA, 23 bp, Homo sapiens
acaaggaagtgggggccgctggc

SEQ ID NO: 2048701 - DNA, 18 bp, Homo sapiens
acaaggacaatgccttgg

SEQ ID NO: 2048702 - DNA, 19 bp, Homo sapiens
acaaggaccctgttttcca

SEQ ID NO: 2048703 - DNA, 21 bp, Homo sapiens
acaaggaccctgttttccaca

SEQ ID NO: 2048704 - DNA, 22 bp, Homo sapiens
acaaggcacttgtcactatgct

SEQ ID NO: 2048705 - DNA, 23 bp, Homo sapiens
acaaggctgggcacctctagtgc

SEQ ID NO: 2048706 - DNA, 21 bp, Homo sapiens
acaagggctgacctgcctctc

SEQ ID NO: 2048707 - DNA, 18 bp, Homo sapiens
acaaggggagggccagga

SEQ ID NO: 2048708 - DNA, 18 bp, Homo sapiens
acaagggtctagggagag

SEQ ID NO: 2048709 - DNA, 19 bp, Homo sapiens
acaagggtctagggagaga

SEQ ID NO: 2048710 - DNA, 19 bp, Homo sapiens
acaaggtcaaagttctggt

SEQ ID NO: 2048711 - DNA, 21 bp, Homo sapiens
acaagtatgaataaagacacc

SEQ ID NO: 2048712 - DNA, 17 bp, Homo sapiens
acaagtcacagctgcag

SEQ ID NO: 2048713 - DNA, 17 bp, Homo sapiens
acaagtcctgtgaattt

SEQ ID NO: 2048714 - DNA, 13 bp, Homo sapiens
acaagtggagggg

SEQ ID NO: 2048715 - DNA, 22 bp, Homo sapiens
acaagtggagggggtgtctgga

SEQ ID NO: 2048716 - DNA, 18 bp, Homo sapiens
acaagtgtatatcagaaa

SEQ ID NO: 2048717 - DNA, 15 bp, Homo sapiens
acaagttattctctt

SEQ ID NO: 2048718 - DNA, 21 bp, Homo sapiens
acaagttttgtataaataata

SEQ ID NO: 2048719 - DNA, 19 bp, Homo sapiens
acaataaaaaccaaagcat

SEQ ID NO: 2048720 - DNA, 15 bp, Homo sapiens
acaataaatgtgctt

SEQ ID NO: 2048721 - DNA, 15 bp, Homo sapiens
acaatacaacaagaa

SEQ ID NO: 2048722 - DNA, 16 bp, Homo sapiens
acaataccactggtta

SEQ ID NO: 2048723 - DNA, 20 bp, Homo sapiens
acaataccactggttaaaat

SEQ ID NO: 2048724 - DNA, 15 bp, Homo sapiens
acaatagctattgca

SEQ ID NO: 2048725 - DNA, 17 bp, Homo sapiens
acaatagctattgcatg

SEQ ID NO: 2048726 - DNA, 21 bp, Homo sapiens
acaatatgaatacagggcatg

SEQ ID NO: 2048727 - DNA, 17 bp, Homo sapiens
acaatatgattttaaat

SEQ ID NO: 2048728 - DNA, 16 bp, Homo sapiens
acaatatgtttctaaa

SEQ ID NO: 2048729 - DNA, 14 bp, Homo sapiens
acaatatttaaaat

SEQ ID NO: 2048730 - DNA, 12 bp, Homo sapiens
acaatcacactc

SEQ ID NO: 2048731 - DNA, 16 bp, Homo sapiens
acaatcacagctcctc

SEQ ID NO: 2048732 - DNA, 20 bp, Homo sapiens
acaatcatgagtcagacatt

SEQ ID NO: 2048733 - DNA, 18 bp, Homo sapiens
acaatcatttgctttttg

SEQ ID NO: 2048734 - DNA, 19 bp, Homo sapiens
acaatccactctcaggagg

SEQ ID NO: 2048735 - DNA, 16 bp, Homo sapiens
acaatgaaggaaaacc

SEQ ID NO: 2048736 - DNA, 23 bp, Homo sapiens
acaatgaaggaaaacctcacttg

SEQ ID NO: 2048737 - DNA, 21 bp, Homo sapiens
acaatgatgattaaacacctg

SEQ ID NO: 2048738 - DNA, 13 bp, Homo sapiens
acaatgcctctcc

SEQ ID NO: 2048739 - DNA, 20 bp, Homo sapiens
acaatgcctctcccacgatg

SEQ ID NO: 2048740 - DNA, 19 bp, Homo sapiens
acaatgccttgggagagat

SEQ ID NO: 2048741 - DNA, 23 bp, Homo sapiens
acaatggagtgggagatcagcca

SEQ ID NO: 2048742 - DNA, 21 bp, Homo sapiens
acaatggtttacatgaacaca

SEQ ID NO: 2048743 - DNA, 22 bp, Homo sapiens
acaatggtttacatgaacacag

SEQ ID NO: 2048744 - DNA, 19 bp, Homo sapiens
acaatgtgggcgtttgtaa

SEQ ID NO: 2048745 - DNA, 22 bp, Homo sapiens
acaatgtgggcgtttgtaaatt

SEQ ID NO: 2048746 - DNA, 18 bp, Homo sapiens
acaattactaaattgtat

SEQ ID NO: 2048747 - DNA, 21 bp, Homo sapiens
acaattattgtacactaacat

SEQ ID NO: 2048748 - DNA, 14 bp, Homo sapiens
acaattccatttcc

SEQ ID NO: 2048749 - DNA, 17 bp, Homo sapiens
acaattctaaaatgatt

SEQ ID NO: 2048750 - DNA, 23 bp, Homo sapiens
acaattctaaaatgattgtagta

SEQ ID NO: 2048751 - DNA, 24 bp, Homo sapiens
acaattctaaaatgattgtagtaa

SEQ ID NO: 2048752 - DNA, 20 bp, Homo sapiens
acaattgatacttcaggtgc

SEQ ID NO: 2048753 - DNA, 21 bp, Homo sapiens
acaattgatacttcaggtgct

SEQ ID NO: 2048754 - DNA, 23 bp, Homo sapiens
acatatacctataatgtgtgtat

SEQ ID NO: 2048755 - DNA, 18 bp, Homo sapiens
acatatatatatacacat

SEQ ID NO: 2048756 - DNA, 22 bp, Homo sapiens
acatatatatatacacatacat

SEQ ID NO: 2048757 - DNA, 23 bp, Homo sapiens
acatatatatatacacatacata

SEQ ID NO: 2048758 - DNA, 21 bp, Homo sapiens
acatatatatgccttatgtaa

SEQ ID NO: 2048759 - DNA, 13 bp, Homo sapiens
acatatatgtata

SEQ ID NO: 2048760 - DNA, 17 bp, Homo sapiens
acatatatgtatatgta

SEQ ID NO: 2048761 - DNA, 19 bp, Homo sapiens
acatatcaattcaacacat

SEQ ID NO: 2048762 - DNA, 15 bp, Homo sapiens
acatatcagaaaagt

SEQ ID NO: 2048763 - DNA, 18 bp, Homo sapiens
acatatgaaatttaatat

SEQ ID NO: 2048764 - DNA, 17 bp, Homo sapiens
acatatgggtgctggca

SEQ ID NO: 2048765 - DNA, 14 bp, Homo sapiens
acatatgtaaaata

SEQ ID NO: 2048766 - DNA, 17 bp, Homo sapiens
acatatgtagactatat

SEQ ID NO: 2048767 - DNA, 15 bp, Homo sapiens
acatatgtctgtatc

SEQ ID NO: 2048768 - DNA, 17 bp, Homo sapiens
acatatgtctgtatcta

SEQ ID NO: 2048769 - DNA, 13 bp, Homo sapiens
acatatgtgaata

SEQ ID NO: 2048770 - DNA, 13 bp, Homo sapiens
acatattataaat

SEQ ID NO: 2048771 - DNA, 14 bp, Homo sapiens
acatattataaata

SEQ ID NO: 2048772 - DNA, 15 bp, Homo sapiens
acatattataaataa

SEQ ID NO: 2048773 - DNA, 19 bp, Homo sapiens
acatattataaataaatgc

SEQ ID NO: 2048774 - DNA, 14 bp, Homo sapiens
acatcaaatgcccc

SEQ ID NO: 2048775 - DNA, 17 bp, Homo sapiens
acatcacagcagaatga

SEQ ID NO: 2048776 - DNA, 22 bp, Homo sapiens
acatcacagcagaatgaagacc

SEQ ID NO: 2048777 - DNA, 22 bp, Homo sapiens
acatcaccgacgcgtctcctgt

SEQ ID NO: 2048778 - DNA, 22 bp, Homo sapiens
acatcagagtgacatccaggag

SEQ ID NO: 2048779 - DNA, 14 bp, Homo sapiens
acatcatcctcctt

SEQ ID NO: 2048780 - DNA, 23 bp, Homo sapiens
acatcatcctccttataagccca

SEQ ID NO: 2048781 - DNA, 13 bp, Homo sapiens
acatcatgtaaac

SEQ ID NO: 2048782 - DNA, 22 bp, Homo sapiens
acatccaaggagaaacagagac

SEQ ID NO: 2048783 - DNA, 23 bp, Homo sapiens
acatccaaggagaaacagagaca

SEQ ID NO: 2048784 - DNA, 11 bp, Homo sapiens
acatccagaag

SEQ ID NO: 2048785 - DNA, 13 bp, Homo sapiens
acatccatgtcct

SEQ ID NO: 2048786 - DNA, 16 bp, Homo sapiens
acatcccattgccctg

SEQ ID NO: 2048787 - DNA, 13 bp, Homo sapiens
acatccctgggcc

SEQ ID NO: 2048788 - DNA, 17 bp, Homo sapiens
acatccctgggcctgct

SEQ ID NO: 2048789 - DNA, 16 bp, Homo sapiens
acatcctgctttccct

SEQ ID NO: 2048790 - DNA, 15 bp, Homo sapiens
acatcgcactgtgga

SEQ ID NO: 2048791 - DNA, 22 bp, Homo sapiens
acatctaatgtctcttcctctg

SEQ ID NO: 2048792 - DNA, 18 bp, Homo sapiens
acatctctgaaagcacag

SEQ ID NO: 2048793 - DNA, 14 bp, Homo sapiens
acatctggcatggc

SEQ ID NO: 2048794 - DNA, 17 bp, Homo sapiens
acatctgttttaaattt

SEQ ID NO: 2048795 - DNA, 16 bp, Homo sapiens
acatcttatttacttg

SEQ ID NO: 2048796 - DNA, 17 bp, Homo sapiens
acatcttcagctcccat

SEQ ID NO: 2048797 - DNA, 18 bp, Homo sapiens
acatcttcagctcccata

SEQ ID NO: 2048798 - DNA, 15 bp, Homo sapiens
acatcttgctctgct

SEQ ID NO: 2048799 - DNA, 18 bp, Homo sapiens
acatcttgctctgctgac

SEQ ID NO: 2048800 - DNA, 19 bp, Homo sapiens
acatcttgctctgctgaca

SEQ ID NO: 2048801 - DNA, 13 bp, Homo sapiens
acatctttaagta

SEQ ID NO: 2048802 - DNA, 14 bp, Homo sapiens
acatctttcctgtc

SEQ ID NO: 2048803 - DNA, 18 bp, Homo sapiens
acatctttgaaaagaaaa

SEQ ID NO: 2048804 - DNA, 20 bp, Homo sapiens
acatctttttcctccctttc

SEQ ID NO: 2048805 - DNA, 23 bp, Homo sapiens
acatgaaaagataggtttgagtt

SEQ ID NO: 2048806 - DNA, 13 bp, Homo sapiens
acatgaaacagaa

SEQ ID NO: 2048807 - DNA, 17 bp, Homo sapiens
acatgaacacagctgct

SEQ ID NO: 2048808 - DNA, 20 bp, Homo sapiens
acatgaatcccacccacatg

SEQ ID NO: 2048809 - DNA, 18 bp, Homo sapiens
acatgaattgcattttac

SEQ ID NO: 2048810 - DNA, 12 bp, Homo sapiens
acatgacactga

SEQ ID NO: 2048811 - DNA, 16 bp, Homo sapiens
acatgacactgacctt

SEQ ID NO: 2048812 - DNA, 14 bp, Homo sapiens
acatgacttctgcc

SEQ ID NO: 2048813 - DNA, 19 bp, Homo sapiens
acatgacttttctggaaga

SEQ ID NO: 2048814 - DNA, 15 bp, Homo sapiens
acatgagaaatgtga

SEQ ID NO: 2048815 - DNA, 19 bp, Homo sapiens
acatgaggactcatatatt

SEQ ID NO: 2048816 - DNA, 15 bp, Homo sapiens
acatgaggagggtgc

SEQ ID NO: 2048817 - DNA, 17 bp, Homo sapiens
acatgaggagggtgccc

SEQ ID NO: 2048818 - DNA, 13 bp, Homo sapiens
acatgattcattt

SEQ ID NO: 2048819 - DNA, 18 bp, Homo sapiens
acatgcaagtgagaagct

SEQ ID NO: 2048820 - DNA, 12 bp, Homo sapiens
acatgcactgac

SEQ ID NO: 2048821 - DNA, 17 bp, Homo sapiens
acatgccaccctctcca

SEQ ID NO: 2048822 - DNA, 19 bp, Homo sapiens
acatgccaccctctccatg

SEQ ID NO: 2048823 - DNA, 17 bp, Homo sapiens
acatgctaaatagttct

SEQ ID NO: 2048824 - DNA, 18 bp, Homo sapiens
acatgctaagagaagtag

SEQ ID NO: 2048825 - DNA, 24 bp, Homo sapiens
acatgctaagagaagtagaaatca

SEQ ID NO: 2048826 - DNA, 20 bp, Homo sapiens
acatgctgtgctctttgaag

SEQ ID NO: 2048827 - DNA, 14 bp, Homo sapiens
acatggacacagac

SEQ ID NO: 2048828 - DNA, 15 bp, Homo sapiens
acatggagactcctg

SEQ ID NO: 2048829 - DNA, 16 bp, Homo sapiens
acatggagactcctgc

SEQ ID NO: 2048830 - DNA, 22 bp, Homo sapiens
acatggggttttcaattttgca

SEQ ID NO: 2048831 - DNA, 21 bp, Homo sapiens
acatggtattgtaatgaatat

SEQ ID NO: 2048832 - DNA, 14 bp, Homo sapiens
acatggtctcctct

SEQ ID NO: 2048833 - DNA, 17 bp, Homo sapiens
acatggtttgactcccg

SEQ ID NO: 2048834 - DNA, 21 bp, Homo sapiens
acatgtaacatagatttatgt

SEQ ID NO: 2048835 - DNA, 16 bp, Homo sapiens
acatgtactccagagg

SEQ ID NO: 2048836 - DNA, 14 bp, Homo sapiens
acatgtataatatt

SEQ ID NO: 2048837 - DNA, 18 bp, Homo sapiens
acatgtatctatgcattt

SEQ ID NO: 2048838 - DNA, 21 bp, Homo sapiens
acatgtatctatgcattttct

SEQ ID NO: 2048839 - DNA, 15 bp, Homo sapiens
acatgtccctacacc

SEQ ID NO: 2048840 - DNA, 16 bp, Homo sapiens
acatgtcctatccaaa

SEQ ID NO: 2048841 - DNA, 16 bp, Homo sapiens
acatgtccttgtgtgt

SEQ ID NO: 2048842 - DNA, 21 bp, Homo sapiens
acatgtccttgtgtgttttga

SEQ ID NO: 2048843 - DNA, 14 bp, Homo sapiens
acatgtcttgtaca

SEQ ID NO: 2048844 - DNA, 22 bp, Homo sapiens
acatgtcttgtacatgtgtagc

SEQ ID NO: 2048845 - DNA, 14 bp, Homo sapiens
acatgtgacacata

SEQ ID NO: 2048846 - DNA, 19 bp, Homo sapiens
acatgtgaggactgggggc

SEQ ID NO: 2048847 - DNA, 13 bp, Homo sapiens
acatgtgcctgta

SEQ ID NO: 2048848 - DNA, 22 bp, Homo sapiens
acatgtgctattgaactgagcc

SEQ ID NO: 2048849 - DNA, 18 bp, Homo sapiens
acatgtgtagggaaagtt

SEQ ID NO: 2048850 - DNA, 19 bp, Homo sapiens
acatgtgtctgtgtggtat

SEQ ID NO: 2048851 - DNA, 21 bp, Homo sapiens
acatgtgttttaattccaata

SEQ ID NO: 2048852 - DNA, 14 bp, Homo sapiens
acatgttatatatt

SEQ ID NO: 2048853 - DNA, 15 bp, Homo sapiens
acatgttatatattt

SEQ ID NO: 2048854 - DNA, 23 bp, Homo sapiens
acatgtttatttattctgcattt

SEQ ID NO: 2048855 - DNA, 14 bp, Homo sapiens
acatgtttcacaac

SEQ ID NO: 2048856 - DNA, 12 bp, Homo sapiens
acattaaaagaa

SEQ ID NO: 2048857 - DNA, 21 bp, Homo sapiens
acattaaaagaagactggaag

SEQ ID NO: 2048858 - DNA, 16 bp, Homo sapiens
acattaaacactgtaa

SEQ ID NO: 2048859 - DNA, 19 bp, Homo sapiens
acattaaacactgtaatct

SEQ ID NO: 2048860 - DNA, 12 bp, Homo sapiens
acattaaatgtc

SEQ ID NO: 2048861 - DNA, 14 bp, Homo sapiens
acattaaattaaat

SEQ ID NO: 2048862 - DNA, 13 bp, Homo sapiens
acattaacatcta

SEQ ID NO: 2048863 - DNA, 21 bp, Homo sapiens
acattaatcaatcatctgtgt

SEQ ID NO: 2048864 - DNA, 21 bp, Homo sapiens
acattaatgttaattcagcac

SEQ ID NO: 2048865 - DNA, 17 bp, Homo sapiens
acattatgctccagaaa

SEQ ID NO: 2048866 - DNA, 13 bp, Homo sapiens
acattatgtgtgc

SEQ ID NO: 2048867 - DNA, 17 bp, Homo sapiens
acattatgtgtgcatgt

SEQ ID NO: 2048868 - DNA, 16 bp, Homo sapiens
acattatttattcagc

SEQ ID NO: 2048869 - DNA, 17 bp, Homo sapiens
accctgacctgctgtgc

SEQ ID NO: 2048870 - DNA, 15 bp, Homo sapiens
accctgagactccag

SEQ ID NO: 2048871 - DNA, 17 bp, Homo sapiens
accctgagactccagaa

SEQ ID NO: 2048872 - DNA, 12 bp, Homo sapiens
accctgagcctg

SEQ ID NO: 2048873 - DNA, 13 bp, Homo sapiens
accctgaggagtc

SEQ ID NO: 2048874 - DNA, 22 bp, Homo sapiens
accctgaggagtctgaggtcct

SEQ ID NO: 2048875 - DNA, 14 bp, Homo sapiens
accctgcagagcta

SEQ ID NO: 2048876 - DNA, 21 bp, Homo sapiens
accctgcccttgtttggggca

SEQ ID NO: 2048877 - DNA, 14 bp, Homo sapiens
accctgcctgagcc

SEQ ID NO: 2048878 - DNA, 20 bp, Homo sapiens
accctgcctgagcccaggag

SEQ ID NO: 2048879 - DNA, 20 bp, Homo sapiens
accctgcgaaggggccctgg

SEQ ID NO: 2048880 - DNA, 19 bp, Homo sapiens
accctggaattcagcaccc

SEQ ID NO: 2048881 - DNA, 12 bp, Homo sapiens
accctggcccca

SEQ ID NO: 2048882 - DNA, 11 bp, Homo sapiens
accctggcccg

SEQ ID NO: 2048883 - DNA, 14 bp, Homo sapiens
accctgggtgccat

SEQ ID NO: 2048884 - DNA, 21 bp, Homo sapiens
accctgggtgccattcccagc

SEQ ID NO: 2048885 - DNA, 19 bp, Homo sapiens
accctggtaggaaagcacc

SEQ ID NO: 2048886 - DNA, 18 bp, Homo sapiens
accctggtgtctcctcca

SEQ ID NO: 2048887 - DNA, 11 bp, Homo sapiens
accctgtctct

SEQ ID NO: 2048888 - DNA, 21 bp, Homo sapiens
accctgtctcttaaagaaaaa

SEQ ID NO: 2048889 - DNA, 21 bp, Homo sapiens
accctgtgggggcggctgtgg

SEQ ID NO: 2048890 - DNA, 17 bp, Homo sapiens
accctgttaccattttg

SEQ ID NO: 2048891 - DNA, 14 bp, Homo sapiens
accctgtttcctga

SEQ ID NO: 2048892 - DNA, 17 bp, Homo sapiens
accctgttttccacacc

SEQ ID NO: 2048893 - DNA, 21 bp, Homo sapiens
accctgttttccacaccatca

SEQ ID NO: 2048894 - DNA, 13 bp, Homo sapiens
acccttccagaca

SEQ ID NO: 2048895 - DNA, 21 bp, Homo sapiens
acccttcccaatcagcactga

SEQ ID NO: 2048896 - DNA, 23 bp, Homo sapiens
acccttcccaatcagcactgaaa

SEQ ID NO: 2048897 - DNA, 18 bp, Homo sapiens
acccttctttcctcttcc

SEQ ID NO: 2048898 - DNA, 20 bp, Homo sapiens
acccttctttcctcttcccc

SEQ ID NO: 2048899 - DNA, 18 bp, Homo sapiens
acccttggacttgaggat

SEQ ID NO: 2048900 - DNA, 17 bp, Homo sapiens
acccttggctcaatcct

SEQ ID NO: 2048901 - DNA, 17 bp, Homo sapiens
acccttgtaccccatcc

SEQ ID NO: 2048902 - DNA, 18 bp, Homo sapiens
acccttgtaccccatccc

SEQ ID NO: 2048903 - DNA, 15 bp, Homo sapiens
accctttatctctgt

SEQ ID NO: 2048904 - DNA, 14 bp, Homo sapiens
accctttccttcct

SEQ ID NO: 2048905 - DNA, 14 bp, Homo sapiens
accgaagagccctg

SEQ ID NO: 2048906 - DNA, 17 bp, Homo sapiens
accgaattttattttac

SEQ ID NO: 2048907 - DNA, 18 bp, Homo sapiens
accgacgcgtctcctgtt

SEQ ID NO: 2048908 - DNA, 16 bp, Homo sapiens
accgagaaaaggagaa

SEQ ID NO: 2048909 - DNA, 18 bp, Homo sapiens
accgagacggctggacct

SEQ ID NO: 2048910 - DNA, 18 bp, Homo sapiens
accgagtctcttctccac

SEQ ID NO: 2048911 - DNA, 23 bp, Homo sapiens
accgcagccagccggtgcctggc

SEQ ID NO: 2048912 - DNA, 21 bp, Homo sapiens
accgccacacacacaggagca

SEQ ID NO: 2048913 - DNA, 14 bp, Homo sapiens
accgcgcatctctt

SEQ ID NO: 2048914 - DNA, 17 bp, Homo sapiens
accgcgtctaccctggg

SEQ ID NO: 2048915 - DNA, 18 bp, Homo sapiens
accgcgtctaccctggga

SEQ ID NO: 2048916 - DNA, 15 bp, Homo sapiens
accgctaaaagaaac

SEQ ID NO: 2048917 - DNA, 21 bp, Homo sapiens
accgctacaccactctggcag

SEQ ID NO: 2048918 - DNA, 19 bp, Homo sapiens
accgcttcacccctgcact

SEQ ID NO: 2048919 - DNA, 15 bp, Homo sapiens
accgcttcccagagg

SEQ ID NO: 2048920 - DNA, 16 bp, Homo sapiens
accgcttcccagaggc

SEQ ID NO: 2048921 - DNA, 23 bp, Homo sapiens
accggagctttcaaagaaggaat

SEQ ID NO: 2048922 - DNA, 15 bp, Homo sapiens
accggcatgctggcc

SEQ ID NO: 2048923 - DNA, 18 bp, Homo sapiens
accggcatgctggcctgt

SEQ ID NO: 2048924 - DNA, 19 bp, Homo sapiens
accggcatgctggcctgtg

SEQ ID NO: 2048925 - DNA, 15 bp, Homo sapiens
accggcgctgcaggt

SEQ ID NO: 2048926 - DNA, 19 bp, Homo sapiens
accgggagcctccccctca

SEQ ID NO: 2048927 - DNA, 19 bp, Homo sapiens
accgggatgaacctatcct

SEQ ID NO: 2048928 - DNA, 20 bp, Homo sapiens
accgggccacagagaaagta

SEQ ID NO: 2048929 - DNA, 19 bp, Homo sapiens
accgggccactccttcctg

SEQ ID NO: 2048930 - DNA, 20 bp, Homo sapiens
accgggccactccttcctgc

SEQ ID NO: 2048931 - DNA, 14 bp, Homo sapiens
accgtctacagatg

SEQ ID NO: 2048932 - DNA, 16 bp, Homo sapiens
accgtctgtttttaaa

SEQ ID NO: 2048933 - DNA, 18 bp, Homo sapiens
accgtggcccttcctgga

SEQ ID NO: 2048934 - DNA, 14 bp, Homo sapiens
accgtgtccagcac

SEQ ID NO: 2048935 - DNA, 15 bp, Homo sapiens
accgtgtccagcaca

SEQ ID NO: 2048936 - DNA, 13 bp, Homo sapiens
accgtttttcaag

SEQ ID NO: 2048937 - DNA, 11 bp, Homo sapiens
acctaaatgac

SEQ ID NO: 2048938 - DNA, 17 bp, Homo sapiens
acctaattgaaatttaa

SEQ ID NO: 2048939 - DNA, 14 bp, Homo sapiens
acctacatccccag

SEQ ID NO: 2048940 - DNA, 17 bp, Homo sapiens
acctacatccccaggtc

SEQ ID NO: 2048941 - DNA, 19 bp, Homo sapiens
acctacatccccaggtctc

SEQ ID NO: 2048942 - DNA, 15 bp, Homo sapiens
acctaccacagtgtc

SEQ ID NO: 2048943 - DNA, 17 bp, Homo sapiens
acctaccacagtgtctg

SEQ ID NO: 2048944 - DNA, 19 bp, Homo sapiens
acctaccaccccttcctgt

SEQ ID NO: 2048945 - DNA, 17 bp, Homo sapiens
acctaccagttggccat

SEQ ID NO: 2048946 - DNA, 15 bp, Homo sapiens
acctaccatgctgct

SEQ ID NO: 2048947 - DNA, 16 bp, Homo sapiens
acctaccatgctgctt

SEQ ID NO: 2048948 - DNA, 17 bp, Homo sapiens
acctactcacacaggca

SEQ ID NO: 2048949 - DNA, 15 bp, Homo sapiens
acctagaacttcaaa

SEQ ID NO: 2048950 - DNA, 19 bp, Homo sapiens
acctagaacttcaaaatgt

SEQ ID NO: 2048951 - DNA, 22 bp, Homo sapiens
acctagaatagccatgtactat

SEQ ID NO: 2048952 - DNA, 14 bp, Homo sapiens
acctagcaattcca

SEQ ID NO: 2048953 - DNA, 18 bp, Homo sapiens
acctagtactctctgctc

SEQ ID NO: 2048954 - DNA, 20 bp, Homo sapiens
acctagtactctctgctcta

SEQ ID NO: 2048955 - DNA, 21 bp, Homo sapiens
acctagtactctctgctctag

SEQ ID NO: 2048956 - DNA, 23 bp, Homo sapiens
  misc_feature (6)..(6): n is a, c, g or t
  misc_feature (13)..(13): n is a, c, g or t
acctanccccccnacccccagtg

SEQ ID NO: 2048957 - DNA, 15 bp, Homo sapiens
acctataatgtgtgt

SEQ ID NO: 2048958 - DNA, 18 bp, Homo sapiens
acctatacctgtgtttct

SEQ ID NO: 2048959 - DNA, 13 bp, Homo sapiens
acctatatgattt

SEQ ID NO: 2048960 - DNA, 16 bp, Homo sapiens
acctatggctgcctgc

SEQ ID NO: 2048961 - DNA, 15 bp, Homo sapiens
acctatgtcatttca

SEQ ID NO: 2048962 - DNA, 16 bp, Homo sapiens
acctatgtcatttcat

SEQ ID NO: 2048963 - DNA, 17 bp, Homo sapiens
acctatgtcctaaggac

SEQ ID NO: 2048964 - DNA, 19 bp, Homo sapiens
acctatgtcctaaggacac

SEQ ID NO: 2048965 - DNA, 22 bp, Homo sapiens
acctatgtcctaaggacacact

SEQ ID NO: 2048966 - DNA, 23 bp, Homo sapiens
acctatgtcctaaggacacacta

SEQ ID NO: 2048967 - DNA, 14 bp, Homo sapiens
acctcaaactgggt

SEQ ID NO: 2048968 - DNA, 22 bp, Homo sapiens
acctcaacccccatttctattt

SEQ ID NO: 2048969 - DNA, 17 bp, Homo sapiens
acctcaactaaccctta

SEQ ID NO: 2048970 - DNA, 19 bp, Homo sapiens
acctcaagtttttgttttg

SEQ ID NO: 2048971 - DNA, 17 bp, Homo sapiens
acctcacagaaatgtta

SEQ ID NO: 2048972 - DNA, 16 bp, Homo sapiens
acctcacctttgcaaa

SEQ ID NO: 2048973 - DNA, 15 bp, Homo sapiens
acctcacgctctgga

SEQ ID NO: 2048974 - DNA, 23 bp, Homo sapiens
acctcactatggtatgctggcca

SEQ ID NO: 2048975 - DNA, 24 bp, Homo sapiens
acctcactatggtatgctggccag

SEQ ID NO: 2048976 - DNA, 21 bp, Homo sapiens
acctcagacaatccactctca

SEQ ID NO: 2048977 - DNA, 17 bp, Homo sapiens
acctcagcaaatcctct

SEQ ID NO: 2048978 - DNA, 10 bp, Homo sapiens
acctcagcct

SEQ ID NO: 2048979 - DNA, 11 bp, Homo sapiens
acctcagcctc

SEQ ID NO: 2048980 - DNA, 11 bp, Homo sapiens
acctcagcctg

SEQ ID NO: 2048981 - DNA, 12 bp, Homo sapiens
acctcagcctgt

SEQ ID NO: 2048982 - DNA, 19 bp, Homo sapiens
acctcagcctgtgctgccc

SEQ ID NO: 2048983 - DNA, 14 bp, Homo sapiens
acctcagccttgga

SEQ ID NO: 2048984 - DNA, 19 bp, Homo sapiens
actacatgtggtttataga

SEQ ID NO: 2048985 - DNA, 16 bp, Homo sapiens
actacccgagcccagc

SEQ ID NO: 2048986 - DNA, 21 bp, Homo sapiens
actacccgagcccagctacat

SEQ ID NO: 2048987 - DNA, 20 bp, Homo sapiens
actacgggggggagaaggaa

SEQ ID NO: 2048988 - DNA, 16 bp, Homo sapiens
actactgctgcaaagt

SEQ ID NO: 2048989 - DNA, 22 bp, Homo sapiens
actactgtggaaaaatatttaa

SEQ ID NO: 2048990 - DNA, 16 bp, Homo sapiens
actacttcttggaaaa

SEQ ID NO: 2048991 - DNA, 14 bp, Homo sapiens
actactttttatac

SEQ ID NO: 2048992 - DNA, 17 bp, Homo sapiens
actactttttatactcc

SEQ ID NO: 2048993 - DNA, 13 bp, Homo sapiens
actagaactctcc

SEQ ID NO: 2048994 - DNA, 15 bp, Homo sapiens
actagaatttattca

SEQ ID NO: 2048995 - DNA, 19 bp, Homo sapiens
actagagctgggaaacagg

SEQ ID NO: 2048996 - DNA, 15 bp, Homo sapiens
actagaggcagggag

SEQ ID NO: 2048997 - DNA, 21 bp, Homo sapiens
actagaggtgagaaatttaaa

SEQ ID NO: 2048998 - DNA, 23 bp, Homo sapiens
actagatctcctatttttcagaa

SEQ ID NO: 2048999 - DNA, 14 bp, Homo sapiens
actagatctcctgt

SEQ ID NO: 2049000 - DNA, 17 bp, Homo sapiens
actagatctcctgtaat

SEQ ID NO: 2049001 - DNA, 13 bp, Homo sapiens
actagcagctgca

SEQ ID NO: 2049002 - DNA, 21 bp, Homo sapiens
actagggtgagggttttctgt

SEQ ID NO: 2049003 - DNA, 23 bp, Homo sapiens
actagtgacaagctcctggtctt

SEQ ID NO: 2049004 - DNA, 20 bp, Homo sapiens
actagttgtgtctggcagtt

SEQ ID NO: 2049005 - DNA, 20 bp, Homo sapiens
actataaacattaaaagaag

SEQ ID NO: 2049006 - DNA, 18 bp, Homo sapiens
actataaactactgtaat

SEQ ID NO: 2049007 - DNA, 20 bp, Homo sapiens
actataaactactgtaatta

SEQ ID NO: 2049008 - DNA, 14 bp, Homo sapiens
actatacaacaatg

SEQ ID NO: 2049009 - DNA, 15 bp, Homo sapiens
actatacaacaatgt

SEQ ID NO: 2049010 - DNA, 20 bp, Homo sapiens
actatagcctaggtgacaga

SEQ ID NO: 2049011 - DNA, 22 bp, Homo sapiens
actatagcctaggtgacagagt

SEQ ID NO: 2049012 - DNA, 13 bp, Homo sapiens
actatatacatgt

SEQ ID NO: 2049013 - DNA, 14 bp, Homo sapiens
actatattttagat

SEQ ID NO: 2049014 - DNA, 17 bp, Homo sapiens
actatattttagatgca

SEQ ID NO: 2049015 - DNA, 21 bp, Homo sapiens
actatattttagatgcaatgt

SEQ ID NO: 2049016 - DNA, 15 bp, Homo sapiens
actatcacatacaat

SEQ ID NO: 2049017 - DNA, 17 bp, Homo sapiens
actatcacatacaattt

SEQ ID NO: 2049018 - DNA, 18 bp, Homo sapiens
actatcacatacaatttg

SEQ ID NO: 2049019 - DNA, 21 bp, Homo sapiens
actatcacatacaatttgcac

SEQ ID NO: 2049020 - DNA, 20 bp, Homo sapiens
actatccaattaaaattaag

SEQ ID NO: 2049021 - DNA, 23 bp, Homo sapiens
actatctcttgtcatataaacct

SEQ ID NO: 2049022 - DNA, 22 bp, Homo sapiens
actatctttttgcttacagttt

SEQ ID NO: 2049023 - DNA, 19 bp, Homo sapiens
actatgaaaagctagaatt

SEQ ID NO: 2049024 - DNA, 21 bp, Homo sapiens
actatgaaaagctagaattga

SEQ ID NO: 2049025 - DNA, 17 bp, Homo sapiens
actatgaaatgaaagaa

SEQ ID NO: 2049026 - DNA, 15 bp, Homo sapiens
actatgacactgagc

SEQ ID NO: 2049027 - DNA, 14 bp, Homo sapiens
actatgatctcagg

SEQ ID NO: 2049028 - DNA, 16 bp, Homo sapiens
actatgatctcaggag

SEQ ID NO: 2049029 - DNA, 17 bp, Homo sapiens
actatgatctcaggagc

SEQ ID NO: 2049030 - DNA, 23 bp, Homo sapiens
actatggagcctggcacaggact

SEQ ID NO: 2049031 - DNA, 22 bp, Homo sapiens
actatggctgtatttttagaga

SEQ ID NO: 2049032 - DNA, 22 bp, Homo sapiens
actatggtatgctggccagcac

SEQ ID NO: 2049033 - DNA, 22 bp, Homo sapiens
actatggttcccaataaaagtg

SEQ ID NO: 2049034 - DNA, 16 bp, Homo sapiens
actatgtgatgttaac

SEQ ID NO: 2049035 - DNA, 15 bp, Homo sapiens
actatgttgcccagg

SEQ ID NO: 2049036 - DNA, 17 bp, Homo sapiens
actatgttgcccaggca

SEQ ID NO: 2049037 - DNA, 18 bp, Homo sapiens
actatgttgcccaggcag

SEQ ID NO: 2049038 - DNA, 18 bp, Homo sapiens
actatgttgcccaggctg

SEQ ID NO: 2049039 - DNA, 18 bp, Homo sapiens
actattaagagcaataaa

SEQ ID NO: 2049040 - DNA, 13 bp, Homo sapiens
actattaattcca

SEQ ID NO: 2049041 - DNA, 16 bp, Homo sapiens
actattacttgaactt

SEQ ID NO: 2049042 - DNA, 17 bp, Homo sapiens
actattataatttaatg

SEQ ID NO: 2049043 - DNA, 21 bp, Homo sapiens
actattataatttaatgcatg

SEQ ID NO: 2049044 - DNA, 18 bp, Homo sapiens
actattatccccatttct

SEQ ID NO: 2049045 - DNA, 13 bp, Homo sapiens
actattattaata

SEQ ID NO: 2049046 - DNA, 16 bp, Homo sapiens
actattcaaacagtct

SEQ ID NO: 2049047 - DNA, 13 bp, Homo sapiens
actattcaagtat

SEQ ID NO: 2049048 - DNA, 19 bp, Homo sapiens
actattgcaagtcatactt

SEQ ID NO: 2049049 - DNA, 14 bp, Homo sapiens
actattgcattgtt

SEQ ID NO: 2049050 - DNA, 13 bp, Homo sapiens
actattggagggt

SEQ ID NO: 2049051 - DNA, 16 bp, Homo sapiens
actattgtttaaaaac

SEQ ID NO: 2049052 - DNA, 12 bp, Homo sapiens
actatttatctg

SEQ ID NO: 2049053 - DNA, 16 bp, Homo sapiens
actatttgtctttcag

SEQ ID NO: 2049054 - DNA, 14 bp, Homo sapiens
actattttttaata

SEQ ID NO: 2049055 - DNA, 15 bp, Homo sapiens
actcaaaatatttgt

SEQ ID NO: 2049056 - DNA, 17 bp, Homo sapiens
actcaaaatatttgtac

SEQ ID NO: 2049057 - DNA, 20 bp, Homo sapiens
actcaaaatatttgtacata

SEQ ID NO: 2049058 - DNA, 16 bp, Homo sapiens
actcaacaataaagac

SEQ ID NO: 2049059 - DNA, 18 bp, Homo sapiens
actcaataaaatcatgta

SEQ ID NO: 2049060 - DNA, 18 bp, Homo sapiens
actcaatattttccatga

SEQ ID NO: 2049061 - DNA, 21 bp, Homo sapiens
actcacaagaagaccagactg

SEQ ID NO: 2049062 - DNA, 20 bp, Homo sapiens
actcacacaggcatttcctg

SEQ ID NO: 2049063 - DNA, 23 bp, Homo sapiens
actcacacaggcatttcctgggt

SEQ ID NO: 2049064 - DNA, 19 bp, Homo sapiens
actcacatgccgcccccag

SEQ ID NO: 2049065 - DNA, 20 bp, Homo sapiens
actcacatggctatgtttta

SEQ ID NO: 2049066 - DNA, 11 bp, Homo sapiens
actcacctcct

SEQ ID NO: 2049067 - DNA, 12 bp, Homo sapiens
actcacctcctc

SEQ ID NO: 2049068 - DNA, 14 bp, Homo sapiens
actcacctcctccc

SEQ ID NO: 2049069 - DNA, 17 bp, Homo sapiens
actcacctctctctaag

SEQ ID NO: 2049070 - DNA, 23 bp, Homo sapiens
actcacgataaataatcggccca

SEQ ID NO: 2049071 - DNA, 18 bp, Homo sapiens
actcactcttatgaaatg

SEQ ID NO: 2049072 - DNA, 15 bp, Homo sapiens
actcactgctcaaga

SEQ ID NO: 2049073 - DNA, 14 bp, Homo sapiens
actcagaaattttt

SEQ ID NO: 2049074 - DNA, 16 bp, Homo sapiens
actcagaagcctgagg

SEQ ID NO: 2049075 - DNA, 17 bp, Homo sapiens
actcagaagcctgaggc

SEQ ID NO: 2049076 - DNA, 16 bp, Homo sapiens
actcagaagcctgggg

SEQ ID NO: 2049077 - DNA, 17 bp, Homo sapiens
actcagaagcctggggg

SEQ ID NO: 2049078 - DNA, 17 bp, Homo sapiens
actcagagcccctccct

SEQ ID NO: 2049079 - DNA, 14 bp, Homo sapiens
actcagcagcagag

SEQ ID NO: 2049080 - DNA, 15 bp, Homo sapiens
actcagcagcagaga

SEQ ID NO: 2049081 - DNA, 13 bp, Homo sapiens
actcagcagccct

SEQ ID NO: 2049082 - DNA, 20 bp, Homo sapiens
actcagcagccctcctcacc

SEQ ID NO: 2049083 - DNA, 21 bp, Homo sapiens
actcagcagccctcctcaccc

SEQ ID NO: 2049084 - DNA, 14 bp, Homo sapiens
actcagccacaccc

SEQ ID NO: 2049085 - DNA, 12 bp, Homo sapiens
actcagccctgg

SEQ ID NO: 2049086 - DNA, 14 bp, Homo sapiens
actcagccctgggc

SEQ ID NO: 2049087 - DNA, 22 bp, Homo sapiens
actcagccctgggccccaccac

SEQ ID NO: 2049088 - DNA, 23 bp, Homo sapiens
actcagccggcgtggcaaatata

SEQ ID NO: 2049089 - DNA, 14 bp, Homo sapiens
actcagctccagaa

SEQ ID NO: 2049090 - DNA, 18 bp, Homo sapiens
actcaggaggctgaggca

SEQ ID NO: 2049091 - DNA, 17 bp, Homo sapiens
actcaggaggctgaggg

SEQ ID NO: 2049092 - DNA, 18 bp, Homo sapiens
actcaggatccagtccct

SEQ ID NO: 2049093 - DNA, 22 bp, Homo sapiens
actcaggcccccacctggctca

SEQ ID NO: 2049094 - DNA, 23 bp, Homo sapiens
actcaggcccccacctggctcac

SEQ ID NO: 2049095 - DNA, 14 bp, Homo sapiens
actcagggccccag

SEQ ID NO: 2049096 - DNA, 14 bp, Homo sapiens
actcagtcccccac

SEQ ID NO: 2049097 - DNA, 18 bp, Homo sapiens
actcagtcccccaccaca

SEQ ID NO: 2049098 - DNA, 23 bp, Homo sapiens
actcagtcccccaccacactgaa

SEQ ID NO: 2049099 - DNA, 22 bp, Homo sapiens
acttcccagttcaggagtccca

SEQ ID NO: 2049100 - DNA, 23 bp, Homo sapiens
acttcccagttcaggagtcccaa

SEQ ID NO: 2049101 - DNA, 12 bp, Homo sapiens
acttcctcctga

SEQ ID NO: 2049102 - DNA, 23 bp, Homo sapiens
acttcctcctgatggccaagagc

SEQ ID NO: 2049103 - DNA, 17 bp, Homo sapiens
acttcctcgcctctccc

SEQ ID NO: 2049104 - DNA, 18 bp, Homo sapiens
acttcctcgcctctccca

SEQ ID NO: 2049105 - DNA, 15 bp, Homo sapiens
acttcctctccagcc

SEQ ID NO: 2049106 - DNA, 13 bp, Homo sapiens
acttcctggggcc

SEQ ID NO: 2049107 - DNA, 23 bp, Homo sapiens
acttcctggtgaggcccagcctg

SEQ ID NO: 2049108 - DNA, 15 bp, Homo sapiens
acttcctgtgacttc

SEQ ID NO: 2049109 - DNA, 12 bp, Homo sapiens
acttcctgtgta

SEQ ID NO: 2049110 - DNA, 19 bp, Homo sapiens
acttctaagtaaaaccaca

SEQ ID NO: 2049111 - DNA, 23 bp, Homo sapiens
acttctaagtaaaaccacagcag

SEQ ID NO: 2049112 - DNA, 22 bp, Homo sapiens
acttctcaggacacaggcctgt

SEQ ID NO: 2049113 - DNA, 11 bp, Homo sapiens
acttctctcca

SEQ ID NO: 2049114 - DNA, 12 bp, Homo sapiens
acttctctccag

SEQ ID NO: 2049115 - DNA, 16 bp, Homo sapiens
acttctctccaggctg

SEQ ID NO: 2049116 - DNA, 23 bp, Homo sapiens
acttctctttcttattttgtaat

SEQ ID NO: 2049117 - DNA, 16 bp, Homo sapiens
acttctctttgcctca

SEQ ID NO: 2049118 - DNA, 12 bp, Homo sapiens
acttctgcagct

SEQ ID NO: 2049119 - DNA, 18 bp, Homo sapiens
acttctgccatattctgt

SEQ ID NO: 2049120 - DNA, 19 bp, Homo sapiens
acttctgccatattctgtt

SEQ ID NO: 2049121 - DNA, 17 bp, Homo sapiens
acttctggaaggctggc

SEQ ID NO: 2049122 - DNA, 23 bp, Homo sapiens
acttcttaaaggcctggaaccag

SEQ ID NO: 2049123 - DNA, 22 bp, Homo sapiens
acttcttaatgctttcctccct

SEQ ID NO: 2049124 - DNA, 17 bp, Homo sapiens
acttcttgaaacagcct

SEQ ID NO: 2049125 - DNA, 23 bp, Homo sapiens
acttctttcctctccaattgtaa

SEQ ID NO: 2049126 - DNA, 21 bp, Homo sapiens
acttgaaaaaatgttctatat

SEQ ID NO: 2049127 - DNA, 19 bp, Homo sapiens
acttgaaataccagtgaac

SEQ ID NO: 2049128 - DNA, 23 bp, Homo sapiens
acttgaaattatatctgtggtct

SEQ ID NO: 2049129 - DNA, 13 bp, Homo sapiens
acttgaactgatt

SEQ ID NO: 2049130 - DNA, 20 bp, Homo sapiens
acttgaactttccaaaacct

SEQ ID NO: 2049131 - DNA, 16 bp, Homo sapiens
acttgaatcaaagcag

SEQ ID NO: 2049132 - DNA, 21 bp, Homo sapiens
acttgaatctgttactgaaat

SEQ ID NO: 2049133 - DNA, 18 bp, Homo sapiens
acttgacagaacactgtc

SEQ ID NO: 2049134 - DNA, 13 bp, Homo sapiens
acttgacagtgga

SEQ ID NO: 2049135 - DNA, 20 bp, Homo sapiens
acttgagcaccgtcatggct

SEQ ID NO: 2049136 - DNA, 19 bp, Homo sapiens
acttgagcctccatttctg

SEQ ID NO: 2049137 - DNA, 15 bp, Homo sapiens
acttgagctgtatat

SEQ ID NO: 2049138 - DNA, 19 bp, Homo sapiens
acttgaggacacatgtcca

SEQ ID NO: 2049139 - DNA, 18 bp, Homo sapiens
acttgaggattttgagta

SEQ ID NO: 2049140 - DNA, 18 bp, Homo sapiens
acttgaggctggcactcc

SEQ ID NO: 2049141 - DNA, 19 bp, Homo sapiens
acttgagggtaataaactt

SEQ ID NO: 2049142 - DNA, 18 bp, Homo sapiens
acttgatatatttcattc

SEQ ID NO: 2049143 - DNA, 14 bp, Homo sapiens
acttgcacaagctt

SEQ ID NO: 2049144 - DNA, 20 bp, Homo sapiens
acttgcacaagcttgtatat

SEQ ID NO: 2049145 - DNA, 17 bp, Homo sapiens
acttgcacatctctgca

SEQ ID NO: 2049146 - DNA, 16 bp, Homo sapiens
acttgcgtcctgcaga

SEQ ID NO: 2049147 - DNA, 17 bp, Homo sapiens
acttgctgcctgaagaa

SEQ ID NO: 2049148 - DNA, 19 bp, Homo sapiens
acttgcttagtatggttct

SEQ ID NO: 2049149 - DNA, 23 bp, Homo sapiens
acttgcttctaaatgcccagttc

SEQ ID NO: 2049150 - DNA, 23 bp, Homo sapiens
acttggaaaaagaaagaaacact

SEQ ID NO: 2049151 - DNA, 19 bp, Homo sapiens
acttggaaaggtttcaaga

SEQ ID NO: 2049152 - DNA, 22 bp, Homo sapiens
acttggagagggacgaagaaag

SEQ ID NO: 2049153 - DNA, 11 bp, Homo sapiens
acttggagcca

SEQ ID NO: 2049154 - DNA, 12 bp, Homo sapiens
acttggagcccg

SEQ ID NO: 2049155 - DNA, 14 bp, Homo sapiens
acttggagcccgtg

SEQ ID NO: 2049156 - DNA, 22 bp, Homo sapiens
acttgggaaacagagaaccctg

SEQ ID NO: 2049157 - DNA, 22 bp, Homo sapiens
acttgggagcttgtatatactt

SEQ ID NO: 2049158 - DNA, 22 bp, Homo sapiens
acttgggcacccccagcctggg

SEQ ID NO: 2049159 - DNA, 23 bp, Homo sapiens
acttgggcacccccagcctgggc

SEQ ID NO: 2049160 - DNA, 20 bp, Homo sapiens
acttggggagatggagttct

SEQ ID NO: 2049161 - DNA, 22 bp, Homo sapiens
acttggtgtaattaataaacga

SEQ ID NO: 2049162 - DNA, 17 bp, Homo sapiens
acttgtaaataaataga

SEQ ID NO: 2049163 - DNA, 20 bp, Homo sapiens
acttgtaaataaatagattt

SEQ ID NO: 2049164 - DNA, 13 bp, Homo sapiens
acttgtaaataca

SEQ ID NO: 2049165 - DNA, 20 bp, Homo sapiens
acttgtacaaaataaacaaa

SEQ ID NO: 2049166 - DNA, 13 bp, Homo sapiens
acttgtagaaatc

SEQ ID NO: 2049167 - DNA, 15 bp, Homo sapiens
acttgtagaaatctg

SEQ ID NO: 2049168 - DNA, 16 bp, Homo sapiens
acttgtagaaatctgt

SEQ ID NO: 2049169 - DNA, 23 bp, Homo sapiens
acttgtagaaatctgtaattcta

SEQ ID NO: 2049170 - DNA, 15 bp, Homo sapiens
acttgtataaatgta

SEQ ID NO: 2049171 - DNA, 15 bp, Homo sapiens
acttgtatctgaaga

SEQ ID NO: 2049172 - DNA, 16 bp, Homo sapiens
acttgtatctgaagac

SEQ ID NO: 2049173 - DNA, 23 bp, Homo sapiens
acttgtccttttgtaccatggtg

SEQ ID NO: 2049174 - DNA, 20 bp, Homo sapiens
acttgtctgaggcctcatcc

SEQ ID NO: 2049175 - DNA, 18 bp, Homo sapiens
acttgtggacacagctct

SEQ ID NO: 2049176 - DNA, 19 bp, Homo sapiens
acttgtggacacagctctt

SEQ ID NO: 2049177 - DNA, 21 bp, Homo sapiens
acttgtgtactgataaaatac

SEQ ID NO: 2049178 - DNA, 21 bp, Homo sapiens
acttgtgtctctgtgctttta

SEQ ID NO: 2049179 - DNA, 15 bp, Homo sapiens
acttgtgttctatta

SEQ ID NO: 2049180 - DNA, 15 bp, Homo sapiens
acttgttccttctgc

SEQ ID NO: 2049181 - DNA, 12 bp, Homo sapiens
actttaaagtct

SEQ ID NO: 2049182 - DNA, 21 bp, Homo sapiens
actttaaagtctttccgtctc

SEQ ID NO: 2049183 - DNA, 18 bp, Homo sapiens
actttaaccctctcttcc

SEQ ID NO: 2049184 - DNA, 17 bp, Homo sapiens
actttaagactgagcac

SEQ ID NO: 2049185 - DNA, 13 bp, Homo sapiens
actttaattgtgt

SEQ ID NO: 2049186 - DNA, 21 bp, Homo sapiens
actttacactctctgtacaaa

SEQ ID NO: 2049187 - DNA, 14 bp, Homo sapiens
actttacaggaggt

SEQ ID NO: 2049188 - DNA, 21 bp, Homo sapiens
actttacaggaggttgtggat

SEQ ID NO: 2049189 - DNA, 15 bp, Homo sapiens
actttagagtagcat

SEQ ID NO: 2049190 - DNA, 19 bp, Homo sapiens
actttagagtagcatgaga

SEQ ID NO: 2049191 - DNA, 17 bp, Homo sapiens
actttagtatttttact

SEQ ID NO: 2049192 - DNA, 14 bp, Homo sapiens
actttatcacatta

SEQ ID NO: 2049193 - DNA, 17 bp, Homo sapiens
actttatccaatcctca

SEQ ID NO: 2049194 - DNA, 21 bp, Homo sapiens
actttatctgtgaccacacgc

SEQ ID NO: 2049195 - DNA, 13 bp, Homo sapiens
actttcctacaaa

SEQ ID NO: 2049196 - DNA, 21 bp, Homo sapiens
actttcctattttcttttcca

SEQ ID NO: 2049197 - DNA, 19 bp, Homo sapiens
actttctgtaaactcaaaa

SEQ ID NO: 2049198 - DNA, 12 bp, Homo sapiens
actttgaaggac

SEQ ID NO: 2049199 - DNA, 15 bp, Homo sapiens
actttgctctttctt

SEQ ID NO: 2049200 - DNA, 20 bp, Homo sapiens
actttggcttctcctgtgac

SEQ ID NO: 2049201 - DNA, 20 bp, Homo sapiens
actttgggaggccaaggtgg

SEQ ID NO: 2049202 - DNA, 19 bp, Homo sapiens
actttggttctctccagga

SEQ ID NO: 2049203 - DNA, 20 bp, Homo sapiens
actttgtacagtggagaaat

SEQ ID NO: 2049204 - DNA, 16 bp, Homo sapiens
actttgtgttcacctt

SEQ ID NO: 2049205 - DNA, 11 bp, Homo sapiens
actttgttcac

SEQ ID NO: 2049206 - DNA, 19 bp, Homo sapiens
actttgttgccttatcttg

SEQ ID NO: 2049207 - DNA, 20 bp, Homo sapiens
acttttcataacctagcctt

SEQ ID NO: 2049208 - DNA, 17 bp, Homo sapiens
acttttccattcccaat

SEQ ID NO: 2049209 - DNA, 18 bp, Homo sapiens
acttttcctttgaatcct

SEQ ID NO: 2049210 - DNA, 22 bp, Homo sapiens
acttttctaaagctctgaacaa

SEQ ID NO: 2049211 - DNA, 18 bp, Homo sapiens
acttttcttacagcacat

SEQ ID NO: 2049212 - DNA, 20 bp, Homo sapiens
acttttgggggttggatggg

SEQ ID NO: 2049213 - DNA, 21 bp, Homo sapiens
agaagtcataaacagcattta

SEQ ID NO: 2049214 - DNA, 20 bp, Homo sapiens
agaagtcatggcccaaatcc

SEQ ID NO: 2049215 - DNA, 16 bp, Homo sapiens
agaagtgcaaaggtgt

SEQ ID NO: 2049216 - DNA, 18 bp, Homo sapiens
agaagtgggccaggacag

SEQ ID NO: 2049217 - DNA, 19 bp, Homo sapiens
agaagtgggccaggacagg

SEQ ID NO: 2049218 - DNA, 12 bp, Homo sapiens
agaagtggtttc

SEQ ID NO: 2049219 - DNA, 13 bp, Homo sapiens
agaagtgtatata

SEQ ID NO: 2049220 - DNA, 20 bp, Homo sapiens
agaagttaagcagcctttct

SEQ ID NO: 2049221 - DNA, 19 bp, Homo sapiens
agaagttgccaagagttct

SEQ ID NO: 2049222 - DNA, 23 bp, Homo sapiens
agaagtttcatcattttttactt

SEQ ID NO: 2049223 - DNA, 15 bp, Homo sapiens
agaagtttgtcaagt

SEQ ID NO: 2049224 - DNA, 12 bp, Homo sapiens
agaataaaattg

SEQ ID NO: 2049225 - DNA, 23 bp, Homo sapiens
agaataaatccttgggagtcatt

SEQ ID NO: 2049226 - DNA, 14 bp, Homo sapiens
agaataaatgaaga

SEQ ID NO: 2049227 - DNA, 14 bp, Homo sapiens
agaataaatgaatc

SEQ ID NO: 2049228 - DNA, 20 bp, Homo sapiens
agaataagaaaacaatcaca

SEQ ID NO: 2049229 - DNA, 21 bp, Homo sapiens
agaataagagaaagaaaatga

SEQ ID NO: 2049230 - DNA, 13 bp, Homo sapiens
agaataagtgctg

SEQ ID NO: 2049231 - DNA, 14 bp, Homo sapiens
agaataagtgctgt

SEQ ID NO: 2049232 - DNA, 17 bp, Homo sapiens
agaataataataaaaag

SEQ ID NO: 2049233 - DNA, 15 bp, Homo sapiens
agaataattgtgtac

SEQ ID NO: 2049234 - DNA, 17 bp, Homo sapiens
agaataattgtgtacaa

SEQ ID NO: 2049235 - DNA, 18 bp, Homo sapiens
agaatacagaaagatgga

SEQ ID NO: 2049236 - DNA, 22 bp, Homo sapiens
agaatacagtaagctgctctat

SEQ ID NO: 2049237 - DNA, 12 bp, Homo sapiens
agaatacttttt

SEQ ID NO: 2049238 - DNA, 16 bp, Homo sapiens
agaatagatgctgact

SEQ ID NO: 2049239 - DNA, 18 bp, Homo sapiens
agaatagggtatgatcct

SEQ ID NO: 2049240 - DNA, 14 bp, Homo sapiens
agaatagtgtctga

SEQ ID NO: 2049241 - DNA, 15 bp, Homo sapiens
agaatataattatcg

SEQ ID NO: 2049242 - DNA, 17 bp, Homo sapiens
agaatataattatcgga

SEQ ID NO: 2049243 - DNA, 14 bp, Homo sapiens
agaatattcaaatg

SEQ ID NO: 2049244 - DNA, 15 bp, Homo sapiens
agaatattcaaatgt

SEQ ID NO: 2049245 - DNA, 12 bp, Homo sapiens
agaatattcagg

SEQ ID NO: 2049246 - DNA, 14 bp, Homo sapiens
agaatcaaaactct

SEQ ID NO: 2049247 - DNA, 16 bp, Homo sapiens
agaatcacacaagttt

SEQ ID NO: 2049248 - DNA, 21 bp, Homo sapiens
agaatcagggcaggcttgcca

SEQ ID NO: 2049249 - DNA, 15 bp, Homo sapiens
agaatcataattttc

SEQ ID NO: 2049250 - DNA, 17 bp, Homo sapiens
agaatcatagtgccata

SEQ ID NO: 2049251 - DNA, 17 bp, Homo sapiens
agaatccaaagatcaca

SEQ ID NO: 2049252 - DNA, 14 bp, Homo sapiens
agaatccctgcagc

SEQ ID NO: 2049253 - DNA, 16 bp, Homo sapiens
agaatccctgcagcct

SEQ ID NO: 2049254 - DNA, 17 bp, Homo sapiens
agaatccctgcagcctg

SEQ ID NO: 2049255 - DNA, 12 bp, Homo sapiens
agaatcctgcct

SEQ ID NO: 2049256 - DNA, 15 bp, Homo sapiens
agaatcctgcctctc

SEQ ID NO: 2049257 - DNA, 21 bp, Homo sapiens
agaatcctgcctctccccaaa

SEQ ID NO: 2049258 - DNA, 18 bp, Homo sapiens
agaatctatatttaacaa

SEQ ID NO: 2049259 - DNA, 12 bp, Homo sapiens
agaatctgcctg

SEQ ID NO: 2049260 - DNA, 22 bp, Homo sapiens
agaatctgtgtgaagttacaca

SEQ ID NO: 2049261 - DNA, 16 bp, Homo sapiens
agaatgaaagggccca

SEQ ID NO: 2049262 - DNA, 16 bp, Homo sapiens
agaatgagggccaaga

SEQ ID NO: 2049263 - DNA, 11 bp, Homo sapiens
agaatgcacac

SEQ ID NO: 2049264 - DNA, 13 bp, Homo sapiens
agaatgctggttt

SEQ ID NO: 2049265 - DNA, 15 bp, Homo sapiens
agaatggggtgcatg

SEQ ID NO: 2049266 - DNA, 16 bp, Homo sapiens
agaatgtcattttggt

SEQ ID NO: 2049267 - DNA, 20 bp, Homo sapiens
agaatgtcattttggtactt

SEQ ID NO: 2049268 - DNA, 18 bp, Homo sapiens
agaatgtgttttctgaat

SEQ ID NO: 2049269 - DNA, 14 bp, Homo sapiens
agaatgttaagact

SEQ ID NO: 2049270 - DNA, 13 bp, Homo sapiens
agaattatatcta

SEQ ID NO: 2049271 - DNA, 21 bp, Homo sapiens
agaattatatctaatttatac

SEQ ID NO: 2049272 - DNA, 24 bp, Homo sapiens
agaattatatctaatttatacaaa

SEQ ID NO: 2049273 - DNA, 12 bp, Homo sapiens
agaattcacttt

SEQ ID NO: 2049274 - DNA, 14 bp, Homo sapiens
agaattccaaggag

SEQ ID NO: 2049275 - DNA, 20 bp, Homo sapiens
agaattccaaggagttccat

SEQ ID NO: 2049276 - DNA, 18 bp, Homo sapiens
agaattcctgaagccaga

SEQ ID NO: 2049277 - DNA, 19 bp, Homo sapiens
agaattcctgaagccagat

SEQ ID NO: 2049278 - DNA, 16 bp, Homo sapiens
agaattctaagattgt

SEQ ID NO: 2049279 - DNA, 13 bp, Homo sapiens
agaattctttcaa

SEQ ID NO: 2049280 - DNA, 14 bp, Homo sapiens
agaattctttcaag

SEQ ID NO: 2049281 - DNA, 16 bp, Homo sapiens
agaattgaacccagga

SEQ ID NO: 2049282 - DNA, 22 bp, Homo sapiens
agaattgaacccaggaggtgga

SEQ ID NO: 2049283 - DNA, 21 bp, Homo sapiens
agaattgcttgaaccggggag

SEQ ID NO: 2049284 - DNA, 12 bp, Homo sapiens
agaattggcctc

SEQ ID NO: 2049285 - DNA, 13 bp, Homo sapiens
agaattgggaagc

SEQ ID NO: 2049286 - DNA, 21 bp, Homo sapiens
agaattgtgcgacttcacaaa

SEQ ID NO: 2049287 - DNA, 23 bp, Homo sapiens
agaattgtgcgacttcacaaaat

SEQ ID NO: 2049288 - DNA, 19 bp, Homo sapiens
agaattgtgtcagactgtt

SEQ ID NO: 2049289 - DNA, 23 bp, Homo sapiens
agaattgtgtcagactgtttagt

SEQ ID NO: 2049290 - DNA, 20 bp, Homo sapiens
agaatttaaattctttttca

SEQ ID NO: 2049291 - DNA, 20 bp, Homo sapiens
agaatttctaccatttcaga

SEQ ID NO: 2049292 - DNA, 21 bp, Homo sapiens
agaatttctaccatttcagag

SEQ ID NO: 2049293 - DNA, 13 bp, Homo sapiens
agaatttcttggt

SEQ ID NO: 2049294 - DNA, 15 bp, Homo sapiens
agaattttaaattat

SEQ ID NO: 2049295 - DNA, 18 bp, Homo sapiens
agaattttaaattataac

SEQ ID NO: 2049296 - DNA, 12 bp, Homo sapiens
agaattttgtat

SEQ ID NO: 2049297 - DNA, 21 bp, Homo sapiens
agaattttttgagtaattcta

SEQ ID NO: 2049298 - DNA, 14 bp, Homo sapiens
agacaaaatgtttt

SEQ ID NO: 2049299 - DNA, 14 bp, Homo sapiens
agacaaaccactgt

SEQ ID NO: 2049300 - DNA, 13 bp, Homo sapiens
agacaagaaatcc

SEQ ID NO: 2049301 - DNA, 17 bp, Homo sapiens
agacaagaaatccctgt

SEQ ID NO: 2049302 - DNA, 14 bp, Homo sapiens
agacaagagctgct

SEQ ID NO: 2049303 - DNA, 17 bp, Homo sapiens
agacaagagctgctgtc

SEQ ID NO: 2049304 - DNA, 20 bp, Homo sapiens
agacaagagctgctgtcctt

SEQ ID NO: 2049305 - DNA, 14 bp, Homo sapiens
agacaagcaacagg

SEQ ID NO: 2049306 - DNA, 13 bp, Homo sapiens
agacaagccctgg

SEQ ID NO: 2049307 - DNA, 16 bp, Homo sapiens
agacaagccctggcaa

SEQ ID NO: 2049308 - DNA, 17 bp, Homo sapiens
agacaagccctggcaac

SEQ ID NO: 2049309 - DNA, 18 bp, Homo sapiens
agacaatccactctcagg

SEQ ID NO: 2049310 - DNA, 19 bp, Homo sapiens
agacaatccactctcagga

SEQ ID NO: 2049311 - DNA, 20 bp, Homo sapiens
agacaatccactctcaggag

SEQ ID NO: 2049312 - DNA, 21 bp, Homo sapiens
agacacagagtggagccctca

SEQ ID NO: 2049313 - DNA, 22 bp, Homo sapiens
agacacaggcccggctccaggc

SEQ ID NO: 2049314 - DNA, 16 bp, Homo sapiens
agacacatactcattt

SEQ ID NO: 2049315 - DNA, 21 bp, Homo sapiens
agacaccaaattccaaacttc

SEQ ID NO: 2049316 - DNA, 16 bp, Homo sapiens
agacacctgcacctcc

SEQ ID NO: 2049317 - DNA, 16 bp, Homo sapiens
agacacctgtgcaccc

SEQ ID NO: 2049318 - DNA, 17 bp, Homo sapiens
agacaccttgacagggc

SEQ ID NO: 2049319 - DNA, 19 bp, Homo sapiens
agacaccttttgtatttaa

SEQ ID NO: 2049320 - DNA, 21 bp, Homo sapiens
agacaccttttgtatttaaaa

SEQ ID NO: 2049321 - DNA, 19 bp, Homo sapiens
agacactcccagggacaag

SEQ ID NO: 2049322 - DNA, 20 bp, Homo sapiens
agacactgccacacagggtc

SEQ ID NO: 2049323 - DNA, 13 bp, Homo sapiens
agacacttcatgg

SEQ ID NO: 2049324 - DNA, 22 bp, Homo sapiens
agacacttcatggaccaagaat

SEQ ID NO: 2049325 - DNA, 20 bp, Homo sapiens
agacacttctaaatgaagtg

SEQ ID NO: 2049326 - DNA, 14 bp, Homo sapiens
agacagaaacagag

SEQ ID NO: 2049327 - DNA, 15 bp, Homo sapiens
agacagaatgtcacc

SEQ ID NO: 2049328 - DNA, 20 bp, Homo sapiens
agaggaccacagtgggtggc

SEQ ID NO: 2049329 - DNA, 21 bp, Homo sapiens
agaggactacacatcagggct

SEQ ID NO: 2049330 - DNA, 15 bp, Homo sapiens
agaggagatcagggc

SEQ ID NO: 2049331 - DNA, 23 bp, Homo sapiens
agaggagatcagggcgacctgca

SEQ ID NO: 2049332 - DNA, 17 bp, Homo sapiens
agaggagggatgctgcc

SEQ ID NO: 2049333 - DNA, 14 bp, Homo sapiens
agaggcaaacattt

SEQ ID NO: 2049334 - DNA, 17 bp, Homo sapiens
agaggcaaacatttctt

SEQ ID NO: 2049335 - DNA, 20 bp, Homo sapiens
agaggcaagagacagaatga

SEQ ID NO: 2049336 - DNA, 15 bp, Homo sapiens
agaggcacctgctgg

SEQ ID NO: 2049337 - DNA, 16 bp, Homo sapiens
agaggcacctgctgga

SEQ ID NO: 2049338 - DNA, 22 bp, Homo sapiens
agaggcagagaaagaagagaca

SEQ ID NO: 2049339 - DNA, 22 bp, Homo sapiens
agaggcagccccattctgcctg

SEQ ID NO: 2049340 - DNA, 23 bp, Homo sapiens
agaggcagccccattctgcctgc

SEQ ID NO: 2049341 - DNA, 13 bp, Homo sapiens
agaggcagggtct

SEQ ID NO: 2049342 - DNA, 18 bp, Homo sapiens
agaggccaggaatctgcc

SEQ ID NO: 2049343 - DNA, 23 bp, Homo sapiens
agaggccatggcagaataatctt

SEQ ID NO: 2049344 - DNA, 12 bp, Homo sapiens
agaggcccaggg

SEQ ID NO: 2049345 - DNA, 13 bp, Homo sapiens
agaggcccaggga

SEQ ID NO: 2049346 - DNA, 14 bp, Homo sapiens
agaggcccagggag

SEQ ID NO: 2049347 - DNA, 15 bp, Homo sapiens
agaggcccagggagc

SEQ ID NO: 2049348 - DNA, 22 bp, Homo sapiens
agaggcccagggagcaatggga

SEQ ID NO: 2049349 - DNA, 12 bp, Homo sapiens
agaggccctgga

SEQ ID NO: 2049350 - DNA, 20 bp, Homo sapiens
agaggccctggatcagcgtg

SEQ ID NO: 2049351 - DNA, 14 bp, Homo sapiens
agaggccttttgtt

SEQ ID NO: 2049352 - DNA, 17 bp, Homo sapiens
agaggcggaaaccttgc

SEQ ID NO: 2049353 - DNA, 18 bp, Homo sapiens
agaggcggaaaccttgca

SEQ ID NO: 2049354 - DNA, 14 bp, Homo sapiens
agaggcgtcttgta

SEQ ID NO: 2049355 - DNA, 17 bp, Homo sapiens
agaggcgtcttgtattt

SEQ ID NO: 2049356 - DNA, 19 bp, Homo sapiens
agaggcgtcttgtattttc

SEQ ID NO: 2049357 - DNA, 13 bp, Homo sapiens
agaggctgaggac

SEQ ID NO: 2049358 - DNA, 13 bp, Homo sapiens
agaggctgaggca

SEQ ID NO: 2049359 - DNA, 21 bp, Homo sapiens
agaggctgcagaaggccaaga

SEQ ID NO: 2049360 - DNA, 22 bp, Homo sapiens
agaggctgcagaaggccaagaa

SEQ ID NO: 2049361 - DNA, 12 bp, Homo sapiens
agaggctgcagg

SEQ ID NO: 2049362 - DNA, 16 bp, Homo sapiens
agaggctggaggcagg

SEQ ID NO: 2049363 - DNA, 16 bp, Homo sapiens
agaggctggtgctgtg

SEQ ID NO: 2049364 - DNA, 21 bp, Homo sapiens
agaggctggtgctgtggccag

SEQ ID NO: 2049365 - DNA, 22 bp, Homo sapiens
agaggctggtgctgtggccagg

SEQ ID NO: 2049366 - DNA, 17 bp, Homo sapiens
agaggctttggggtcct

SEQ ID NO: 2049367 - DNA, 17 bp, Homo sapiens
agagggaagagtgcatt

SEQ ID NO: 2049368 - DNA, 19 bp, Homo sapiens
agagggaatgttccctgca

SEQ ID NO: 2049369 - DNA, 15 bp, Homo sapiens
agagggagtgacaga

SEQ ID NO: 2049370 - DNA, 18 bp, Homo sapiens
agagggatgtaactattg

SEQ ID NO: 2049371 - DNA, 21 bp, Homo sapiens
agagggcagcccccactttcc

SEQ ID NO: 2049372 - DNA, 15 bp, Homo sapiens
agagggcagtacctg

SEQ ID NO: 2049373 - DNA, 16 bp, Homo sapiens
agagggcagtacctgg

SEQ ID NO: 2049374 - DNA, 20 bp, Homo sapiens
agagggcagtacctgggaaa

SEQ ID NO: 2049375 - DNA, 23 bp, Homo sapiens
agagggcatgcgcacaaggctga

SEQ ID NO: 2049376 - DNA, 17 bp, Homo sapiens
agagggccaagagagac

SEQ ID NO: 2049377 - DNA, 16 bp, Homo sapiens
agagggcccagctgta

SEQ ID NO: 2049378 - DNA, 22 bp, Homo sapiens
agaggggaaaccagtgtagcct

SEQ ID NO: 2049379 - DNA, 20 bp, Homo sapiens
agaggggaataatagaagaa

SEQ ID NO: 2049380 - DNA, 15 bp, Homo sapiens
agaggggaggggcct

SEQ ID NO: 2049381 - DNA, 13 bp, Homo sapiens
agaggggcagccg

SEQ ID NO: 2049382 - DNA, 15 bp, Homo sapiens
agaggggcagccgct

SEQ ID NO: 2049383 - DNA, 12 bp, Homo sapiens
agaggggcaggg

SEQ ID NO: 2049384 - DNA, 17 bp, Homo sapiens
agaggggcaggggagtg

SEQ ID NO: 2049385 - DNA, 17 bp, Homo sapiens
agaggggcctgggaaag

SEQ ID NO: 2049386 - DNA, 14 bp, Homo sapiens
agagggggctctcc

SEQ ID NO: 2049387 - DNA, 20 bp, Homo sapiens
agagggtctgaggaatccag

SEQ ID NO: 2049388 - DNA, 22 bp, Homo sapiens
agagggtggtgacctctgcctg

SEQ ID NO: 2049389 - DNA, 16 bp, Homo sapiens
agaggtaaaagtgtga

SEQ ID NO: 2049390 - DNA, 22 bp, Homo sapiens
agaggtaaaagtgtgagcagtg

SEQ ID NO: 2049391 - DNA, 23 bp, Homo sapiens
agaggtaaaagtgtgagcagtga

SEQ ID NO: 2049392 - DNA, 20 bp, Homo sapiens
agaggtagcgagctgctctg

SEQ ID NO: 2049393 - DNA, 13 bp, Homo sapiens
agaggtccctgct

SEQ ID NO: 2049394 - DNA, 15 bp, Homo sapiens
agaggtctgagccct

SEQ ID NO: 2049395 - DNA, 17 bp, Homo sapiens
agaggtgagaaatttaa

SEQ ID NO: 2049396 - DNA, 23 bp, Homo sapiens
agaggtgagaccaaaggatccag

SEQ ID NO: 2049397 - DNA, 17 bp, Homo sapiens
agaggtggattcctggg

SEQ ID NO: 2049398 - DNA, 19 bp, Homo sapiens
agaggtggattcctgggca

SEQ ID NO: 2049399 - DNA, 13 bp, Homo sapiens
agaggtggggacc

SEQ ID NO: 2049400 - DNA, 13 bp, Homo sapiens
agaggtggggagg

SEQ ID NO: 2049401 - DNA, 21 bp, Homo sapiens
agaggtggggagggagacaga

SEQ ID NO: 2049402 - DNA, 20 bp, Homo sapiens
agaggttaaggtgggtccag

SEQ ID NO: 2049403 - DNA, 22 bp, Homo sapiens
agaggttaaggtgggtccagga

SEQ ID NO: 2049404 - DNA, 23 bp, Homo sapiens
agaggttaaggtgggtccaggaa

SEQ ID NO: 2049405 - DNA, 17 bp, Homo sapiens
agaggttatctgcctgg

SEQ ID NO: 2049406 - DNA, 21 bp, Homo sapiens
agaggttatctgcctggcctg

SEQ ID NO: 2049407 - DNA, 15 bp, Homo sapiens
agaggttctggggag

SEQ ID NO: 2049408 - DNA, 19 bp, Homo sapiens
agaggttctggggaggaag

SEQ ID NO: 2049409 - DNA, 23 bp, Homo sapiens
agaggttttaggaaacctggcat

SEQ ID NO: 2049410 - DNA, 19 bp, Homo sapiens
agagtaacatgccagcttc

SEQ ID NO: 2049411 - DNA, 22 bp, Homo sapiens
agagtagcaagttctagagaag

SEQ ID NO: 2049412 - DNA, 23 bp, Homo sapiens
agagtagcaagttctagagaaga

SEQ ID NO: 2049413 - DNA, 23 bp, Homo sapiens
agagtagccgagagcctgctccc

SEQ ID NO: 2049414 - DNA, 14 bp, Homo sapiens
agagtatatatgta

SEQ ID NO: 2049415 - DNA, 17 bp, Homo sapiens
agagtatatatgtacag

SEQ ID NO: 2049416 - DNA, 17 bp, Homo sapiens
agagtatgcaagaagaa

SEQ ID NO: 2049417 - DNA, 18 bp, Homo sapiens
agagtatgcaagaagaat

SEQ ID NO: 2049418 - DNA, 14 bp, Homo sapiens
agagtcctctggat

SEQ ID NO: 2049419 - DNA, 22 bp, Homo sapiens
agagtctcactgttgcccaggc

SEQ ID NO: 2049420 - DNA, 12 bp, Homo sapiens
agagtctgagcc

SEQ ID NO: 2049421 - DNA, 18 bp, Homo sapiens
agagtgaaataattaaaa

SEQ ID NO: 2049422 - DNA, 23 bp, Homo sapiens
agagtgagaataattgtgtacaa

SEQ ID NO: 2049423 - DNA, 15 bp, Homo sapiens
agagtgagaccctgt

SEQ ID NO: 2049424 - DNA, 19 bp, Homo sapiens
agagtgagactcgtctcaa

SEQ ID NO: 2049425 - DNA, 20 bp, Homo sapiens
agagtgagactcgtctcaaa

SEQ ID NO: 2049426 - DNA, 15 bp, Homo sapiens
agagtgagactctgt

SEQ ID NO: 2049427 - DNA, 16 bp, Homo sapiens
agagtgagactctgtc

SEQ ID NO: 2049428 - DNA, 14 bp, Homo sapiens
agagtgagagggca

SEQ ID NO: 2049429 - DNA, 20 bp, Homo sapiens
agagtgctgagaaggacacc

SEQ ID NO: 2049430 - DNA, 20 bp, Homo sapiens
agagtggactgaatgtgcct

SEQ ID NO: 2049431 - DNA, 17 bp, Homo sapiens
agagtggagtctgagtc

SEQ ID NO: 2049432 - DNA, 23 bp, Homo sapiens
agagtggcccagaattgcattct

SEQ ID NO: 2049433 - DNA, 13 bp, Homo sapiens
agagtggcccctc

SEQ ID NO: 2049434 - DNA, 12 bp, Homo sapiens
agagtggctcct

SEQ ID NO: 2049435 - DNA, 13 bp, Homo sapiens
agagtggctcctc

SEQ ID NO: 2049436 - DNA, 19 bp, Homo sapiens
agagtggctcctcccggtg

SEQ ID NO: 2049437 - DNA, 16 bp, Homo sapiens
agagtggttgttgcca

SEQ ID NO: 2049438 - DNA, 19 bp, Homo sapiens
agagtggttgttgccaact

SEQ ID NO: 2049439 - DNA, 15 bp, Homo sapiens
agagtgtgcagactg

SEQ ID NO: 2049440 - DNA, 15 bp, Homo sapiens
agagttattgaatct

SEQ ID NO: 2049441 - DNA, 14 bp, Homo sapiens
agagttcaagaaat

SEQ ID NO: 2049442 - DNA, 17 bp, Homo sapiens
agcaggaacctgtactg

SEQ ID NO: 2049443 - DNA, 14 bp, Homo sapiens
agcaggcacaggac

SEQ ID NO: 2049444 - DNA, 15 bp, Homo sapiens
agcaggcacaggaca

SEQ ID NO: 2049445 - DNA, 14 bp, Homo sapiens
agcaggcacatgga

SEQ ID NO: 2049446 - DNA, 17 bp, Homo sapiens
agcaggcagagcgggga

SEQ ID NO: 2049447 - DNA, 16 bp, Homo sapiens
agcaggcccgacagag

SEQ ID NO: 2049448 - DNA, 18 bp, Homo sapiens
agcaggcccgacagagag

SEQ ID NO: 2049449 - DNA, 19 bp, Homo sapiens
agcaggctactgtcagctc

SEQ ID NO: 2049450 - DNA, 15 bp, Homo sapiens
agcagggaaacagct

SEQ ID NO: 2049451 - DNA, 16 bp, Homo sapiens
agcagggaaagctcca

SEQ ID NO: 2049452 - DNA, 19 bp, Homo sapiens
agcagggaaagctccacgg

SEQ ID NO: 2049453 - DNA, 21 bp, Homo sapiens
agcagggaaagctccacggtg

SEQ ID NO: 2049454 - DNA, 23 bp, Homo sapiens
agcagggccggggaactggccaa

SEQ ID NO: 2049455 - DNA, 21 bp, Homo sapiens
agcagggtagtctggtttcta

SEQ ID NO: 2049456 - DNA, 15 bp, Homo sapiens
agcagggtgctgtgg

SEQ ID NO: 2049457 - DNA, 15 bp, Homo sapiens
agcaggtctctggca

SEQ ID NO: 2049458 - DNA, 16 bp, Homo sapiens
agcaggtctctggcag

SEQ ID NO: 2049459 - DNA, 19 bp, Homo sapiens
agcaggtctctggcagaga

SEQ ID NO: 2049460 - DNA, 21 bp, Homo sapiens
agcaggtctctggcagagaag

SEQ ID NO: 2049461 - DNA, 22 bp, Homo sapiens
agcaggtgcctggtgggccacg

SEQ ID NO: 2049462 - DNA, 16 bp, Homo sapiens
agcaggtggcatctct

SEQ ID NO: 2049463 - DNA, 19 bp, Homo sapiens
agcaggtggcatctctaat

SEQ ID NO: 2049464 - DNA, 18 bp, Homo sapiens
agcaggtggtcctgagac

SEQ ID NO: 2049465 - DNA, 14 bp, Homo sapiens
agcaggtgtggtgg

SEQ ID NO: 2049466 - DNA, 15 bp, Homo sapiens
agcaggttcttgatg

SEQ ID NO: 2049467 - DNA, 13 bp, Homo sapiens
agcagtcacactg

SEQ ID NO: 2049468 - DNA, 14 bp, Homo sapiens
agcagtcctcttat

SEQ ID NO: 2049469 - DNA, 14 bp, Homo sapiens
agcagtgagccgca

SEQ ID NO: 2049470 - DNA, 19 bp, Homo sapiens
agcagtgccttccataatt

SEQ ID NO: 2049471 - DNA, 23 bp, Homo sapiens
agcagtgccttccataattatga

SEQ ID NO: 2049472 - DNA, 15 bp, Homo sapiens
agcagtggacaccag

SEQ ID NO: 2049473 - DNA, 13 bp, Homo sapiens
agcagtgtcatca

SEQ ID NO: 2049474 - DNA, 15 bp, Homo sapiens
agcagtgtcatcaga

SEQ ID NO: 2049475 - DNA, 19 bp, Homo sapiens
agcagtgtcatcagaagat

SEQ ID NO: 2049476 - DNA, 16 bp, Homo sapiens
agcagtgtcttccata

SEQ ID NO: 2049477 - DNA, 22 bp, Homo sapiens
agcagtgtcttccataatgtat

SEQ ID NO: 2049478 - DNA, 22 bp, Homo sapiens
agcagttaactttaagactgag

SEQ ID NO: 2049479 - DNA, 23 bp, Homo sapiens
agcagttgagtcgtcatcacttt

SEQ ID NO: 2049480 - DNA, 13 bp, Homo sapiens
agcagttgtgtca

SEQ ID NO: 2049481 - DNA, 14 bp, Homo sapiens
agcataaatgcaaa

SEQ ID NO: 2049482 - DNA, 17 bp, Homo sapiens
agcataagtttctggga

SEQ ID NO: 2049483 - DNA, 23 bp, Homo sapiens
agcataagtttctgggacctcag

SEQ ID NO: 2049484 - DNA, 20 bp, Homo sapiens
agcatacatttataatgttt

SEQ ID NO: 2049485 - DNA, 20 bp, Homo sapiens
agcataccagtactcagtat

SEQ ID NO: 2049486 - DNA, 22 bp, Homo sapiens
agcataccagtactcagtatag

SEQ ID NO: 2049487 - DNA, 19 bp, Homo sapiens
agcatacctttattgtgat

SEQ ID NO: 2049488 - DNA, 13 bp, Homo sapiens
agcatatttgaga

SEQ ID NO: 2049489 - DNA, 14 bp, Homo sapiens
agcatcacctcagg

SEQ ID NO: 2049490 - DNA, 15 bp, Homo sapiens
agcatcacctcaggc

SEQ ID NO: 2049491 - DNA, 19 bp, Homo sapiens
agcatcacctcaggccagg

SEQ ID NO: 2049492 - DNA, 18 bp, Homo sapiens
agcatcatgcctctgagg

SEQ ID NO: 2049493 - DNA, 22 bp, Homo sapiens
agcatcatgcctctgaggccag

SEQ ID NO: 2049494 - DNA, 23 bp, Homo sapiens
agcatcatgcctctgaggccagc

SEQ ID NO: 2049495 - DNA, 21 bp, Homo sapiens
agcatcattatttgcagagac

SEQ ID NO: 2049496 - DNA, 12 bp, Homo sapiens
agcatccagcct

SEQ ID NO: 2049497 - DNA, 13 bp, Homo sapiens
agcatccagcctg

SEQ ID NO: 2049498 - DNA, 12 bp, Homo sapiens
agcatcctgctt

SEQ ID NO: 2049499 - DNA, 19 bp, Homo sapiens
agcatcctgcttcctaggc

SEQ ID NO: 2049500 - DNA, 17 bp, Homo sapiens
agcatcctggcacccgg

SEQ ID NO: 2049501 - DNA, 21 bp, Homo sapiens
agcatccttttctgcagaggg

SEQ ID NO: 2049502 - DNA, 23 bp, Homo sapiens
agcatcgtgacccttcagggcca

SEQ ID NO: 2049503 - DNA, 15 bp, Homo sapiens
agcatctctgtgtac

SEQ ID NO: 2049504 - DNA, 15 bp, Homo sapiens
agcatgatcttgtta

SEQ ID NO: 2049505 - DNA, 20 bp, Homo sapiens
agcatgatcttgttaatgca

SEQ ID NO: 2049506 - DNA, 21 bp, Homo sapiens
agcatgcaataatgtgcaaat

SEQ ID NO: 2049507 - DNA, 20 bp, Homo sapiens
agcatgcacagctgcttgtc

SEQ ID NO: 2049508 - DNA, 23 bp, Homo sapiens
agcatggactaaccccaacgcac

SEQ ID NO: 2049509 - DNA, 17 bp, Homo sapiens
agcatgggtgtgccctt

SEQ ID NO: 2049510 - DNA, 22 bp, Homo sapiens
agcatggtcccacatccctggg

SEQ ID NO: 2049511 - DNA, 11 bp, Homo sapiens
agcatgtacaa

SEQ ID NO: 2049512 - DNA, 21 bp, Homo sapiens
agcatgtactgagccttgtaa

SEQ ID NO: 2049513 - DNA, 17 bp, Homo sapiens
agcatgtcactcccaga

SEQ ID NO: 2049514 - DNA, 17 bp, Homo sapiens
agcatgtggcatgttca

SEQ ID NO: 2049515 - DNA, 17 bp, Homo sapiens
agcatgtggggaagcaa

SEQ ID NO: 2049516 - DNA, 18 bp, Homo sapiens
agcattacgtgagccagg

SEQ ID NO: 2049517 - DNA, 19 bp, Homo sapiens
agcattatgatgtgggtca

SEQ ID NO: 2049518 - DNA, 15 bp, Homo sapiens
agcattcaggcagca

SEQ ID NO: 2049519 - DNA, 20 bp, Homo sapiens
agcattctcactcctacctg

SEQ ID NO: 2049520 - DNA, 22 bp, Homo sapiens
agcattctcactcctacctggt

SEQ ID NO: 2049521 - DNA, 17 bp, Homo sapiens
agcattctgagctgggc

SEQ ID NO: 2049522 - DNA, 21 bp, Homo sapiens
agcattcttagactagttgaa

SEQ ID NO: 2049523 - DNA, 18 bp, Homo sapiens
agcattgtaaatgtgctt

SEQ ID NO: 2049524 - DNA, 15 bp, Homo sapiens
agcatttactttgaa

SEQ ID NO: 2049525 - DNA, 20 bp, Homo sapiens
agcatttagtccaatgtctt

SEQ ID NO: 2049526 - DNA, 21 bp, Homo sapiens
agcatttagtccaatgtcttt

SEQ ID NO: 2049527 - DNA, 23 bp, Homo sapiens
agcatttcttatttgtttggtca

SEQ ID NO: 2049528 - DNA, 17 bp, Homo sapiens
agcatttgccattcctg

SEQ ID NO: 2049529 - DNA, 19 bp, Homo sapiens
agcattttactacttgtta

SEQ ID NO: 2049530 - DNA, 17 bp, Homo sapiens
agcattttactgtctgt

SEQ ID NO: 2049531 - DNA, 19 bp, Homo sapiens
agcattttatatccacatc

SEQ ID NO: 2049532 - DNA, 18 bp, Homo sapiens
agcatttttgatttatgc

SEQ ID NO: 2049533 - DNA, 15 bp, Homo sapiens
agccaaaaatagcta

SEQ ID NO: 2049534 - DNA, 17 bp, Homo sapiens
agccaaacacactgtaa

SEQ ID NO: 2049535 - DNA, 16 bp, Homo sapiens
agccaaacacagagcg

SEQ ID NO: 2049536 - DNA, 19 bp, Homo sapiens
agccaaacccatgaggcaa

SEQ ID NO: 2049537 - DNA, 21 bp, Homo sapiens
agccaaagagaaaagattaaa

SEQ ID NO: 2049538 - DNA, 23 bp, Homo sapiens
agccaacaggtggcaggaccagg

SEQ ID NO: 2049539 - DNA, 21 bp, Homo sapiens
agccaacagtcaaaacagaga

SEQ ID NO: 2049540 - DNA, 21 bp, Homo sapiens
agccaacgacaaagccaaact

SEQ ID NO: 2049541 - DNA, 14 bp, Homo sapiens
agccaactcctcct

SEQ ID NO: 2049542 - DNA, 18 bp, Homo sapiens
agccaacttgtaaataca

SEQ ID NO: 2049543 - DNA, 22 bp, Homo sapiens
agccaagggttcagagactcag

SEQ ID NO: 2049544 - DNA, 19 bp, Homo sapiens
agccaaggtgggctgagcc

SEQ ID NO: 2049545 - DNA, 23 bp, Homo sapiens
agccaaggtgggctgagccctgg

SEQ ID NO: 2049546 - DNA, 23 bp, Homo sapiens
agccaagttatattgaatatatc

SEQ ID NO: 2049547 - DNA, 14 bp, Homo sapiens
agccaatttggaaa

SEQ ID NO: 2049548 - DNA, 19 bp, Homo sapiens
agccacaaaataaatgttg

SEQ ID NO: 2049549 - DNA, 13 bp, Homo sapiens
agccacacagagc

SEQ ID NO: 2049550 - DNA, 15 bp, Homo sapiens
agccacacagagcct

SEQ ID NO: 2049551 - DNA, 19 bp, Homo sapiens
agccacacttctcaggaca

SEQ ID NO: 2049552 - DNA, 18 bp, Homo sapiens
agccacagaagccaggag

SEQ ID NO: 2049553 - DNA, 20 bp, Homo sapiens
agccacagaagccaggagca

SEQ ID NO: 2049554 - DNA, 23 bp, Homo sapiens
agccacagaagccaggagcaaat

SEQ ID NO: 2049555 - DNA, 11 bp, Homo sapiens
agccacaggag

SEQ ID NO: 2049556 - DNA, 17 bp, Homo sapiens
agcctgtggcggtgcct

SEQ ID NO: 2049557 - DNA, 18 bp, Homo sapiens
agcctgtggcggtgcctg

SEQ ID NO: 2049558 - DNA, 19 bp, Homo sapiens
agcctgtggcggtgcctgg

SEQ ID NO: 2049559 - DNA, 18 bp, Homo sapiens
agcctgtgggagtagaaa

SEQ ID NO: 2049560 - DNA, 18 bp, Homo sapiens
agcctgttcatggcagat

SEQ ID NO: 2049561 - DNA, 14 bp, Homo sapiens
agcctgttgagact

SEQ ID NO: 2049562 - DNA, 20 bp, Homo sapiens
agcctgttgagacttagata

SEQ ID NO: 2049563 - DNA, 14 bp, Homo sapiens
agccttactcacct

SEQ ID NO: 2049564 - DNA, 23 bp, Homo sapiens
agccttcacaaccagccacacag

SEQ ID NO: 2049565 - DNA, 13 bp, Homo sapiens
agccttctcctgc

SEQ ID NO: 2049566 - DNA, 13 bp, Homo sapiens
agccttctctctc

SEQ ID NO: 2049567 - DNA, 15 bp, Homo sapiens
agccttctctgttca

SEQ ID NO: 2049568 - DNA, 19 bp, Homo sapiens
agccttctctgttcatttc

SEQ ID NO: 2049569 - DNA, 22 bp, Homo sapiens
agccttctctgttcatttcctc

SEQ ID NO: 2049570 - DNA, 21 bp, Homo sapiens
agccttgcccggattctggga

SEQ ID NO: 2049571 - DNA, 21 bp, Homo sapiens
agccttgccttttaaaagaaa

SEQ ID NO: 2049572 - DNA, 22 bp, Homo sapiens
agccttggataatgctgttgcc

SEQ ID NO: 2049573 - DNA, 23 bp, Homo sapiens
agccttggataatgctgttgcct

SEQ ID NO: 2049574 - DNA, 16 bp, Homo sapiens
agccttggggattctt

SEQ ID NO: 2049575 - DNA, 17 bp, Homo sapiens
agccttggtgtccacct

SEQ ID NO: 2049576 - DNA, 16 bp, Homo sapiens
agccttgtaattctaa

SEQ ID NO: 2049577 - DNA, 14 bp, Homo sapiens
agcctttccataag

SEQ ID NO: 2049578 - DNA, 22 bp, Homo sapiens
agcctttccataaggaatgtag

SEQ ID NO: 2049579 - DNA, 23 bp, Homo sapiens
agcgaaaaaatcaggtggctttt

SEQ ID NO: 2049580 - DNA, 18 bp, Homo sapiens
agcgaacatgcctgattt

SEQ ID NO: 2049581 - DNA, 15 bp, Homo sapiens
agcgaagcagagagg

SEQ ID NO: 2049582 - DNA, 12 bp, Homo sapiens
agcgagaccctt

SEQ ID NO: 2049583 - DNA, 16 bp, Homo sapiens
agcgagctgctctgct

SEQ ID NO: 2049584 - DNA, 18 bp, Homo sapiens
agcgatgaatttggagac

SEQ ID NO: 2049585 - DNA, 18 bp, Homo sapiens
agcgatggtctcagaaac

SEQ ID NO: 2049586 - DNA, 22 bp, Homo sapiens
agcgattccctctcccaggccc

SEQ ID NO: 2049587 - DNA, 17 bp, Homo sapiens
agcgattcttctgcttc

SEQ ID NO: 2049588 - DNA, 18 bp, Homo sapiens
agcgcacctgccccctgg

SEQ ID NO: 2049589 - DNA, 17 bp, Homo sapiens
agcgcagggaggatgcc

SEQ ID NO: 2049590 - DNA, 19 bp, Homo sapiens
agcgcaggtttagtttact

SEQ ID NO: 2049591 - DNA, 14 bp, Homo sapiens
agcgccctgcagac

SEQ ID NO: 2049592 - DNA, 18 bp, Homo sapiens
agcgccctgcagaccctg

SEQ ID NO: 2049593 - DNA, 20 bp, Homo sapiens
agcgccctgcagaccctgcc

SEQ ID NO: 2049594 - DNA, 21 bp, Homo sapiens
agcgccctggagtcccctggg

SEQ ID NO: 2049595 - DNA, 21 bp, Homo sapiens
agcgcctagtggggtctccct

SEQ ID NO: 2049596 - DNA, 12 bp, Homo sapiens
agcgcctccctc

SEQ ID NO: 2049597 - DNA, 21 bp, Homo sapiens
agcgcctccctccaccccagg

SEQ ID NO: 2049598 - DNA, 18 bp, Homo sapiens
agcgcggcttggccgcca

SEQ ID NO: 2049599 - DNA, 14 bp, Homo sapiens
agcgcgggcggagg

SEQ ID NO: 2049600 - DNA, 17 bp, Homo sapiens
agcgctgccgcacccca

SEQ ID NO: 2049601 - DNA, 20 bp, Homo sapiens
agcgctgccgcaccccagag

SEQ ID NO: 2049602 - DNA, 15 bp, Homo sapiens
agcgctggctcagga

SEQ ID NO: 2049603 - DNA, 18 bp, Homo sapiens
agcgctggctcaggaaga

SEQ ID NO: 2049604 - DNA, 18 bp, Homo sapiens
agcggagacggagtccca

SEQ ID NO: 2049605 - DNA, 20 bp, Homo sapiens
agcggaggagaccagctcag

SEQ ID NO: 2049606 - DNA, 13 bp, Homo sapiens
agcggctctcctg

SEQ ID NO: 2049607 - DNA, 14 bp, Homo sapiens
agcggctctcctga

SEQ ID NO: 2049608 - DNA, 19 bp, Homo sapiens
agcggctgagtcatgatct

SEQ ID NO: 2049609 - DNA, 21 bp, Homo sapiens
agcggctgagtcatgatctcc

SEQ ID NO: 2049610 - DNA, 13 bp, Homo sapiens
agcgggcctcttc

SEQ ID NO: 2049611 - DNA, 20 bp, Homo sapiens
agcgggcctcttccctcagt

SEQ ID NO: 2049612 - DNA, 15 bp, Homo sapiens
agcggggacagctcc

SEQ ID NO: 2049613 - DNA, 21 bp, Homo sapiens
agcggggccccagggctaccc

SEQ ID NO: 2049614 - DNA, 19 bp, Homo sapiens
agcggttgcttctggctcc

SEQ ID NO: 2049615 - DNA, 23 bp, Homo sapiens
agcgtagctaagtgaaaaggtca

SEQ ID NO: 2049616 - DNA, 22 bp, Homo sapiens
agcgtcccctgctactcctgtg

SEQ ID NO: 2049617 - DNA, 16 bp, Homo sapiens
agcgtgagccactgca

SEQ ID NO: 2049618 - DNA, 15 bp, Homo sapiens
agcgtgccctgcccc

SEQ ID NO: 2049619 - DNA, 20 bp, Homo sapiens
agctaaatacctcaatcagt

SEQ ID NO: 2049620 - DNA, 18 bp, Homo sapiens
agctaacagggaaggcag

SEQ ID NO: 2049621 - DNA, 19 bp, Homo sapiens
agctaacagggaaggcagg

SEQ ID NO: 2049622 - DNA, 20 bp, Homo sapiens
agctaacagggaaggcaggc

SEQ ID NO: 2049623 - DNA, 22 bp, Homo sapiens
agctaacattttaaataaaaga

SEQ ID NO: 2049624 - DNA, 23 bp, Homo sapiens
agctaacattttaaataaaagaa

SEQ ID NO: 2049625 - DNA, 23 bp, Homo sapiens
agctaactccagtctcctgacat

SEQ ID NO: 2049626 - DNA, 17 bp, Homo sapiens
agctaagctaggaatga

SEQ ID NO: 2049627 - DNA, 21 bp, Homo sapiens
agctaatcagcattctcactc

SEQ ID NO: 2049628 - DNA, 13 bp, Homo sapiens
agctaatctgtag

SEQ ID NO: 2049629 - DNA, 17 bp, Homo sapiens
agctaatctgtagggct

SEQ ID NO: 2049630 - DNA, 13 bp, Homo sapiens
agctaatgggaca

SEQ ID NO: 2049631 - DNA, 14 bp, Homo sapiens
agctaatgggacac

SEQ ID NO: 2049632 - DNA, 18 bp, Homo sapiens
agctacattcctcagctg

SEQ ID NO: 2049633 - DNA, 20 bp, Homo sapiens
agctacattcctcagctgcc

SEQ ID NO: 2049634 - DNA, 21 bp, Homo sapiens
agctacattcctcagctgcca

SEQ ID NO: 2049635 - DNA, 24 bp, Homo sapiens
agctacattcctcagctgccaagc

SEQ ID NO: 2049636 - DNA, 16 bp, Homo sapiens
agctacccaaaagaga

SEQ ID NO: 2049637 - DNA, 22 bp, Homo sapiens
agctactcaagaggctgaggca

SEQ ID NO: 2049638 - DNA, 15 bp, Homo sapiens
agctactcagaagcc

SEQ ID NO: 2049639 - DNA, 19 bp, Homo sapiens
agctactcagaagcctgag

SEQ ID NO: 2049640 - DNA, 20 bp, Homo sapiens
agctactcagaagcctgagg

SEQ ID NO: 2049641 - DNA, 16 bp, Homo sapiens
agctactctgtccagg

SEQ ID NO: 2049642 - DNA, 20 bp, Homo sapiens
agctactctgtccaggccac

SEQ ID NO: 2049643 - DNA, 20 bp, Homo sapiens
agctactgaatttattgccg

SEQ ID NO: 2049644 - DNA, 18 bp, Homo sapiens
agctactgcggaaaagga

SEQ ID NO: 2049645 - DNA, 17 bp, Homo sapiens
agctacttaagagaaat

SEQ ID NO: 2049646 - DNA, 18 bp, Homo sapiens
agctacttaagagaaatg

SEQ ID NO: 2049647 - DNA, 18 bp, Homo sapiens
agctagaacctggagagc

SEQ ID NO: 2049648 - DNA, 16 bp, Homo sapiens
agctagaacctggagg

SEQ ID NO: 2049649 - DNA, 19 bp, Homo sapiens
agctagaactttgaaggac

SEQ ID NO: 2049650 - DNA, 14 bp, Homo sapiens
agctagaaggccac

SEQ ID NO: 2049651 - DNA, 16 bp, Homo sapiens
agctagaaggccacat

SEQ ID NO: 2049652 - DNA, 15 bp, Homo sapiens
agctagaagtgggcc

SEQ ID NO: 2049653 - DNA, 15 bp, Homo sapiens
agctagactggagtg

SEQ ID NO: 2049654 - DNA, 21 bp, Homo sapiens
agctagactggagtgaggctt

SEQ ID NO: 2049655 - DNA, 18 bp, Homo sapiens
agctagccaactcctcct

SEQ ID NO: 2049656 - DNA, 21 bp, Homo sapiens
agctagccaactcctccttgc

SEQ ID NO: 2049657 - DNA, 15 bp, Homo sapiens
agctaggactgagga

SEQ ID NO: 2049658 - DNA, 15 bp, Homo sapiens
agctaggagcaaagc

SEQ ID NO: 2049659 - DNA, 17 bp, Homo sapiens
agctaggagcaaagcct

SEQ ID NO: 2049660 - DNA, 12 bp, Homo sapiens
agctaggcatgg

SEQ ID NO: 2049661 - DNA, 17 bp, Homo sapiens
agctagtgacccacatg

SEQ ID NO: 2049662 - DNA, 18 bp, Homo sapiens
agctagtgacccacatgc

SEQ ID NO: 2049663 - DNA, 19 bp, Homo sapiens
agctagtggcttcaaaata

SEQ ID NO: 2049664 - DNA, 17 bp, Homo sapiens
agctagttcgtagcttt

SEQ ID NO: 2049665 - DNA, 14 bp, Homo sapiens
agctatcatttctt

SEQ ID NO: 2049666 - DNA, 17 bp, Homo sapiens
agctatgcgcaatgtgg

SEQ ID NO: 2049667 - DNA, 18 bp, Homo sapiens
agctatgcgcaatgtggc

SEQ ID NO: 2049668 - DNA, 20 bp, Homo sapiens
agctattactgtctggtttt

SEQ ID NO: 2049669 - DNA, 18 bp, Homo sapiens
agctattagcaactgtgc

SEQ ID NO: 2049670 - DNA, 12 bp, Homo sapiens
agctgtttaaga

SEQ ID NO: 2049671 - DNA, 22 bp, Homo sapiens
agctgtttatttattcactgta

SEQ ID NO: 2049672 - DNA, 14 bp, Homo sapiens
agctgtttccatag

SEQ ID NO: 2049673 - DNA, 18 bp, Homo sapiens
agctgtttttttcattag

SEQ ID NO: 2049674 - DNA, 21 bp, Homo sapiens
agcttaaaattggtaattgaa

SEQ ID NO: 2049675 - DNA, 21 bp, Homo sapiens
agcttaaataaattcaaacca

SEQ ID NO: 2049676 - DNA, 13 bp, Homo sapiens
agcttacctgaca

SEQ ID NO: 2049677 - DNA, 17 bp, Homo sapiens
agcttacctgacacaag

SEQ ID NO: 2049678 - DNA, 22 bp, Homo sapiens
agcttagccttgtgccctgccc

SEQ ID NO: 2049679 - DNA, 13 bp, Homo sapiens
agcttcaagtgat

SEQ ID NO: 2049680 - DNA, 17 bp, Homo sapiens
agcttcaagtgatatat

SEQ ID NO: 2049681 - DNA, 20 bp, Homo sapiens
agcttcagagcctagccacc

SEQ ID NO: 2049682 - DNA, 21 bp, Homo sapiens
agcttcagagcctagccacct

SEQ ID NO: 2049683 - DNA, 22 bp, Homo sapiens
agcttcagagcctagccacctc

SEQ ID NO: 2049684 - DNA, 19 bp, Homo sapiens
agcttcagttgttttcccg

SEQ ID NO: 2049685 - DNA, 16 bp, Homo sapiens
agcttcatcaattttt

SEQ ID NO: 2049686 - DNA, 22 bp, Homo sapiens
agcttcatcaatttttatacat

SEQ ID NO: 2049687 - DNA, 15 bp, Homo sapiens
agcttcatttccgtg

SEQ ID NO: 2049688 - DNA, 13 bp, Homo sapiens
agcttcatttgtg

SEQ ID NO: 2049689 - DNA, 17 bp, Homo sapiens
agcttcatttgtgtcaa

SEQ ID NO: 2049690 - DNA, 20 bp, Homo sapiens
agcttcatttgtgtcaatgg

SEQ ID NO: 2049691 - DNA, 23 bp, Homo sapiens
agcttccattccaagcctgacca

SEQ ID NO: 2049692 - DNA, 23 bp, Homo sapiens
agcttccctcccgtgtgttctcc

SEQ ID NO: 2049693 - DNA, 22 bp, Homo sapiens
agcttcctccagacccctgtgg

SEQ ID NO: 2049694 - DNA, 17 bp, Homo sapiens
agcttcggggcaagtga

SEQ ID NO: 2049695 - DNA, 18 bp, Homo sapiens
agcttctatcccaggagg

SEQ ID NO: 2049696 - DNA, 12 bp, Homo sapiens
agcttctgtcct

SEQ ID NO: 2049697 - DNA, 19 bp, Homo sapiens
agcttcttcatctttaaaa

SEQ ID NO: 2049698 - DNA, 17 bp, Homo sapiens
agcttgaaaactcactt

SEQ ID NO: 2049699 - DNA, 17 bp, Homo sapiens
agcttgaaactgagatg

SEQ ID NO: 2049700 - DNA, 23 bp, Homo sapiens
agcttgaaagcagttaaactgat

SEQ ID NO: 2049701 - DNA, 13 bp, Homo sapiens
agcttgaccagac

SEQ ID NO: 2049702 - DNA, 16 bp, Homo sapiens
agcttgaccagaccta

SEQ ID NO: 2049703 - DNA, 18 bp, Homo sapiens
agcttgaccagacctaga

SEQ ID NO: 2049704 - DNA, 15 bp, Homo sapiens
agcttgagcctgaaa

SEQ ID NO: 2049705 - DNA, 14 bp, Homo sapiens
agcttgagggttgg

SEQ ID NO: 2049706 - DNA, 13 bp, Homo sapiens
agcttgcaagaag

SEQ ID NO: 2049707 - DNA, 16 bp, Homo sapiens
agcttggacagtctga

SEQ ID NO: 2049708 - DNA, 19 bp, Homo sapiens
agcttggacagtctgagct

SEQ ID NO: 2049709 - DNA, 12 bp, Homo sapiens
agcttgggaatg

SEQ ID NO: 2049710 - DNA, 23 bp, Homo sapiens
agcttggtggctgagcttggccc

SEQ ID NO: 2049711 - DNA, 14 bp, Homo sapiens
agcttgtagccagc

SEQ ID NO: 2049712 - DNA, 15 bp, Homo sapiens
agcttgtagccagcc

SEQ ID NO: 2049713 - DNA, 16 bp, Homo sapiens
agcttgtatatacata

SEQ ID NO: 2049714 - DNA, 18 bp, Homo sapiens
agcttgtatatacatatt

SEQ ID NO: 2049715 - DNA, 15 bp, Homo sapiens
agcttgtgagagctg

SEQ ID NO: 2049716 - DNA, 17 bp, Homo sapiens
agcttgtggcaagtgaa

SEQ ID NO: 2049717 - DNA, 18 bp, Homo sapiens
agcttgtggcaagtgaat

SEQ ID NO: 2049718 - DNA, 16 bp, Homo sapiens
agcttgttatttataa

SEQ ID NO: 2049719 - DNA, 18 bp, Homo sapiens
agctttatctgtcacaca

SEQ ID NO: 2049720 - DNA, 19 bp, Homo sapiens
agctttattttttaagtat

SEQ ID NO: 2049721 - DNA, 17 bp, Homo sapiens
agctttcaaagaaggaa

SEQ ID NO: 2049722 - DNA, 12 bp, Homo sapiens
agctttcagagc

SEQ ID NO: 2049723 - DNA, 17 bp, Homo sapiens
agctttcagagccagtg

SEQ ID NO: 2049724 - DNA, 23 bp, Homo sapiens
agctttctcagggggtcagcaga

SEQ ID NO: 2049725 - DNA, 20 bp, Homo sapiens
agctttctgtccttttggca

SEQ ID NO: 2049726 - DNA, 22 bp, Homo sapiens
agctttctgtccttttggcact

SEQ ID NO: 2049727 - DNA, 17 bp, Homo sapiens
agctttcttctacaacc

SEQ ID NO: 2049728 - DNA, 22 bp, Homo sapiens
agctttcttctacaaccagagc

SEQ ID NO: 2049729 - DNA, 22 bp, Homo sapiens
agctttgaaggccgaaggcagt

SEQ ID NO: 2049730 - DNA, 21 bp, Homo sapiens
agctttgctaccaaagcacct

SEQ ID NO: 2049731 - DNA, 10 bp, Homo sapiens
agctttgctc

SEQ ID NO: 2049732 - DNA, 21 bp, Homo sapiens
agctttgctctttggtagaaa

SEQ ID NO: 2049733 - DNA, 18 bp, Homo sapiens
agctttgttttatatatt

SEQ ID NO: 2049734 - DNA, 16 bp, Homo sapiens
agcttttaataaaatt

SEQ ID NO: 2049735 - DNA, 12 bp, Homo sapiens
agcttttcaaac

SEQ ID NO: 2049736 - DNA, 20 bp, Homo sapiens
agcttttcaaacaagaatgt

SEQ ID NO: 2049737 - DNA, 17 bp, Homo sapiens
agcttttcatggaagtg

SEQ ID NO: 2049738 - DNA, 18 bp, Homo sapiens
agcttttcccaggagacc

SEQ ID NO: 2049739 - DNA, 16 bp, Homo sapiens
agcttttcccttcttt

SEQ ID NO: 2049740 - DNA, 14 bp, Homo sapiens
aggaaaaaaaataa

SEQ ID NO: 2049741 - DNA, 14 bp, Homo sapiens
aggaaaaaaatgac

SEQ ID NO: 2049742 - DNA, 16 bp, Homo sapiens
aggaaaaccagggata

SEQ ID NO: 2049743 - DNA, 19 bp, Homo sapiens
aggaaaaccagggatagct

SEQ ID NO: 2049744 - DNA, 18 bp, Homo sapiens
aggaaaacgggaaagaat

SEQ ID NO: 2049745 - DNA, 13 bp, Homo sapiens
aggaaaaggcctg

SEQ ID NO: 2049746 - DNA, 17 bp, Homo sapiens
aggaaaagtgcaatgcg

SEQ ID NO: 2049747 - DNA, 20 bp, Homo sapiens
aggaaagcaccgcagcatgt

SEQ ID NO: 2049748 - DNA, 21 bp, Homo sapiens
aggaaagcgtggttccaagaa

SEQ ID NO: 2049749 - DNA, 23 bp, Homo sapiens
aggaaatagtgttctttttaaaa

SEQ ID NO: 2049750 - DNA, 22 bp, Homo sapiens
aggaaatcaaatatgcaaagca

SEQ ID NO: 2049751 - DNA, 23 bp, Homo sapiens
aggaaatcaaatatgcaaagcac

SEQ ID NO: 2049752 - DNA, 23 bp, Homo sapiens
aggaaatgctattgttgtgggct

SEQ ID NO: 2049753 - DNA, 23 bp, Homo sapiens
aggaacacccgactcctcaaaag

SEQ ID NO: 2049754 - DNA, 16 bp, Homo sapiens
aggaacacccggaaag

SEQ ID NO: 2049755 - DNA, 13 bp, Homo sapiens
aggaacagaagga

SEQ ID NO: 2049756 - DNA, 13 bp, Homo sapiens
aggaacagagact

SEQ ID NO: 2049757 - DNA, 14 bp, Homo sapiens
aggaacagagactc

SEQ ID NO: 2049758 - DNA, 16 bp, Homo sapiens
aggaacagagactctg

SEQ ID NO: 2049759 - DNA, 18 bp, Homo sapiens
aggaacagagactctgga

SEQ ID NO: 2049760 - DNA, 19 bp, Homo sapiens
aggaacagagactctggaa

SEQ ID NO: 2049761 - DNA, 23 bp, Homo sapiens
aggaacagagactctggaagccc

SEQ ID NO: 2049762 - DNA, 19 bp, Homo sapiens
aggaacagagtatatatgt

SEQ ID NO: 2049763 - DNA, 14 bp, Homo sapiens
aggaacatgtaact

SEQ ID NO: 2049764 - DNA, 16 bp, Homo sapiens
aggaacctaattgaaa

SEQ ID NO: 2049765 - DNA, 18 bp, Homo sapiens
aggaacctaattgaaatt

SEQ ID NO: 2049766 - DNA, 16 bp, Homo sapiens
aggaacctcaaactgg

SEQ ID NO: 2049767 - DNA, 18 bp, Homo sapiens
aggaacgagcactggcca

SEQ ID NO: 2049768 - DNA, 21 bp, Homo sapiens
aggaacgagcactggccagag

SEQ ID NO: 2049769 - DNA, 13 bp, Homo sapiens
aggaactctggct

SEQ ID NO: 2049770 - DNA, 16 bp, Homo sapiens
aggaactctggcttcc

SEQ ID NO: 2049771 - DNA, 14 bp, Homo sapiens
aggaagagaaggag

SEQ ID NO: 2049772 - DNA, 17 bp, Homo sapiens
aggaagatgaagagaag

SEQ ID NO: 2049773 - DNA, 23 bp, Homo sapiens
aggaagattccctcttcctgcca

SEQ ID NO: 2049774 - DNA, 16 bp, Homo sapiens
aggaagcatgagtgct

SEQ ID NO: 2049775 - DNA, 16 bp, Homo sapiens
aggaagccaggctgag

SEQ ID NO: 2049776 - DNA, 11 bp, Homo sapiens
aggaaggaaaa

SEQ ID NO: 2049777 - DNA, 23 bp, Homo sapiens
aggaaggagactcacctctgcct

SEQ ID NO: 2049778 - DNA, 14 bp, Homo sapiens
aggaaggaggcaga

SEQ ID NO: 2049779 - DNA, 19 bp, Homo sapiens
aggaaggcagcattccatg

SEQ ID NO: 2049780 - DNA, 16 bp, Homo sapiens
aggaaggcagggagga

SEQ ID NO: 2049781 - DNA, 18 bp, Homo sapiens
aggaaggcagggaggagg

SEQ ID NO: 2049782 - DNA, 20 bp, Homo sapiens
aggaaggcagggaggaggca

SEQ ID NO: 2049783 - DNA, 14 bp, Homo sapiens
aggaagggacacac

SEQ ID NO: 2049784 - DNA, 22 bp, Homo sapiens
aggctcaagaggcccagggagc

SEQ ID NO: 2049785 - DNA, 23 bp, Homo sapiens
aggctcagtctcaggagcatggg

SEQ ID NO: 2049786 - DNA, 15 bp, Homo sapiens
aggctctgcctggag

SEQ ID NO: 2049787 - DNA, 12 bp, Homo sapiens
aggctctgggct

SEQ ID NO: 2049788 - DNA, 17 bp, Homo sapiens
aggctctgggctcaggg

SEQ ID NO: 2049789 - DNA, 23 bp, Homo sapiens
aggctctgggctcagggctggag

SEQ ID NO: 2049790 - DNA, 17 bp, Homo sapiens
aggctcttccatcccca

SEQ ID NO: 2049791 - DNA, 16 bp, Homo sapiens
aggctcttcctggacc

SEQ ID NO: 2049792 - DNA, 17 bp, Homo sapiens
aggctcttcctggacct

SEQ ID NO: 2049793 - DNA, 18 bp, Homo sapiens
aggctctttctgggccaa

SEQ ID NO: 2049794 - DNA, 23 bp, Homo sapiens
aggctctttggggtcagccaggg

SEQ ID NO: 2049795 - DNA, 12 bp, Homo sapiens
aggctgaagagt

SEQ ID NO: 2049796 - DNA, 15 bp, Homo sapiens
aggctgagacaggag

SEQ ID NO: 2049797 - DNA, 16 bp, Homo sapiens
aggctgagcccagcca

SEQ ID NO: 2049798 - DNA, 19 bp, Homo sapiens
aggctgagcccagccacct

SEQ ID NO: 2049799 - DNA, 21 bp, Homo sapiens
aggctgagcccagccacctcc

SEQ ID NO: 2049800 - DNA, 15 bp, Homo sapiens
aggctgagctggcat

SEQ ID NO: 2049801 - DNA, 21 bp, Homo sapiens
aggctgaggcgggtggatcac

SEQ ID NO: 2049802 - DNA, 17 bp, Homo sapiens
aggctgagtgagccaca

SEQ ID NO: 2049803 - DNA, 15 bp, Homo sapiens
aggctgatttctagg

SEQ ID NO: 2049804 - DNA, 13 bp, Homo sapiens
aggctgcactgca

SEQ ID NO: 2049805 - DNA, 16 bp, Homo sapiens
aggctgcactgcagtg

SEQ ID NO: 2049806 - DNA, 21 bp, Homo sapiens
aggctgcactgcagtgatggc

SEQ ID NO: 2049807 - DNA, 21 bp, Homo sapiens
aggctgcagaaggccaagaat

SEQ ID NO: 2049808 - DNA, 16 bp, Homo sapiens
aggctgcatgctctgg

SEQ ID NO: 2049809 - DNA, 17 bp, Homo sapiens
aggctgcatgctctgga

SEQ ID NO: 2049810 - DNA, 20 bp, Homo sapiens
aggctgcatgctctggaagc

SEQ ID NO: 2049811 - DNA, 19 bp, Homo sapiens
aggctgcctcatgaccctc

SEQ ID NO: 2049812 - DNA, 14 bp, Homo sapiens
aggctgctcagagg

SEQ ID NO: 2049813 - DNA, 14 bp, Homo sapiens
aggctgctcttgaa

SEQ ID NO: 2049814 - DNA, 18 bp, Homo sapiens
aggctggaagctgggagg

SEQ ID NO: 2049815 - DNA, 16 bp, Homo sapiens
aggctggaggcagggc

SEQ ID NO: 2049816 - DNA, 11 bp, Homo sapiens
aggctggcctg

SEQ ID NO: 2049817 - DNA, 22 bp, Homo sapiens
aggctggcctgatcttggctca

SEQ ID NO: 2049818 - DNA, 23 bp, Homo sapiens
aggctggcctgatcttggctcac

SEQ ID NO: 2049819 - DNA, 20 bp, Homo sapiens
aggctggcgtgcagtggtgc

SEQ ID NO: 2049820 - DNA, 15 bp, Homo sapiens
aggctggctgagtgg

SEQ ID NO: 2049821 - DNA, 13 bp, Homo sapiens
aggctggctggcc

SEQ ID NO: 2049822 - DNA, 13 bp, Homo sapiens
aggctgggccagc

SEQ ID NO: 2049823 - DNA, 14 bp, Homo sapiens
aggctgggccagcc

SEQ ID NO: 2049824 - DNA, 22 bp, Homo sapiens
aggctgggccagcctcagctca

SEQ ID NO: 2049825 - DNA, 12 bp, Homo sapiens
aggctgggcccc

SEQ ID NO: 2049826 - DNA, 16 bp, Homo sapiens
aggctgggcccctggg

SEQ ID NO: 2049827 - DNA, 14 bp, Homo sapiens
aggctgggcttcag

SEQ ID NO: 2049828 - DNA, 20 bp, Homo sapiens
aggctgggcttcagtggcag

SEQ ID NO: 2049829 - DNA, 12 bp, Homo sapiens
aggctggggcca

SEQ ID NO: 2049830 - DNA, 23 bp, Homo sapiens
aggctggtctccctccagctgga

SEQ ID NO: 2049831 - DNA, 22 bp, Homo sapiens
aggctggtgctgtggccagggt

SEQ ID NO: 2049832 - DNA, 23 bp, Homo sapiens
aggctggtgctgtggccagggtg

SEQ ID NO: 2049833 - DNA, 21 bp, Homo sapiens
aggctgtatcccatgagcctc

SEQ ID NO: 2049834 - DNA, 23 bp, Homo sapiens
aggctgtatcccatgagcctcag

SEQ ID NO: 2049835 - DNA, 24 bp, Homo sapiens
aggctgtatcccatgagcctcagc

SEQ ID NO: 2049836 - DNA, 19 bp, Homo sapiens
aggctgttctgcactgaaa

SEQ ID NO: 2049837 - DNA, 15 bp, Homo sapiens
aggctgtttcttttt

SEQ ID NO: 2049838 - DNA, 23 bp, Homo sapiens
aggcttaaggagaggagaaactg

SEQ ID NO: 2049839 - DNA, 23 bp, Homo sapiens
aggcttaattctgagctggccct

SEQ ID NO: 2049840 - DNA, 15 bp, Homo sapiens
aggcttccaggctct

SEQ ID NO: 2049841 - DNA, 20 bp, Homo sapiens
aggcttccaggctcttcctg

SEQ ID NO: 2049842 - DNA, 15 bp, Homo sapiens
aggcttcctgactga

SEQ ID NO: 2049843 - DNA, 24 bp, Homo sapiens
aggcttcctgactgacacaggcca

SEQ ID NO: 2049844 - DNA, 14 bp, Homo sapiens
aggcttccttcatt

SEQ ID NO: 2049845 - DNA, 23 bp, Homo sapiens
aggcttcggacagtgcccatgca

SEQ ID NO: 2049846 - DNA, 23 bp, Homo sapiens
aggcttctagttagctgctttaa

SEQ ID NO: 2049847 - DNA, 16 bp, Homo sapiens
aggcttcttcagatca

SEQ ID NO: 2049848 - DNA, 17 bp, Homo sapiens
aggcttggggctggaga

SEQ ID NO: 2049849 - DNA, 19 bp, Homo sapiens
aggcttgtcactagcagct

SEQ ID NO: 2049850 - DNA, 22 bp, Homo sapiens
aggctttgccatgggcctgctg

SEQ ID NO: 2049851 - DNA, 14 bp, Homo sapiens
aggctttggcccaa

SEQ ID NO: 2049852 - DNA, 22 bp, Homo sapiens
aggctttggggtcctagcccag

SEQ ID NO: 2049853 - DNA, 16 bp, Homo sapiens
agggaaaactcttcat

SEQ ID NO: 2049854 - DNA, 14 bp, Homo sapiens
agggaaactgccag

SEQ ID NO: 2049855 - DNA, 15 bp, Homo sapiens
agggaaactgccagc

SEQ ID NO: 2049856 - DNA, 13 bp, Homo sapiens
agggaaatgctgt

SEQ ID NO: 2049857 - DNA, 15 bp, Homo sapiens
agggaaatgctgttg

SEQ ID NO: 2049858 - DNA, 14 bp, Homo sapiens
agggaacagacagg

SEQ ID NO: 2049859 - DNA, 15 bp, Homo sapiens
agggaacagacagga

SEQ ID NO: 2049860 - DNA, 20 bp, Homo sapiens
agggaacagacaggagaaat

SEQ ID NO: 2049861 - DNA, 23 bp, Homo sapiens
agggaagaaaactatcctgcggg

SEQ ID NO: 2049862 - DNA, 21 bp, Homo sapiens
agggaagacaggtctagactt

SEQ ID NO: 2049863 - DNA, 12 bp, Homo sapiens
agggaagagcag

SEQ ID NO: 2049864 - DNA, 15 bp, Homo sapiens
agggaagcaggcaga

SEQ ID NO: 2049865 - DNA, 19 bp, Homo sapiens
agggaagcaggcagagcgg

SEQ ID NO: 2049866 - DNA, 12 bp, Homo sapiens
agggaagcaggg

SEQ ID NO: 2049867 - DNA, 18 bp, Homo sapiens
agggaaggaactctggct

SEQ ID NO: 2049868 - DNA, 15 bp, Homo sapiens
agggaaggcaggcag

SEQ ID NO: 2049869 - DNA, 16 bp, Homo sapiens
agggaaggcaggcagg

SEQ ID NO: 2049870 - DNA, 13 bp, Homo sapiens
agggaaggctgct

SEQ ID NO: 2049871 - DNA, 13 bp, Homo sapiens
agggaagttttgt

SEQ ID NO: 2049872 - DNA, 21 bp, Homo sapiens
agggaatccgcctgcagagga

SEQ ID NO: 2049873 - DNA, 16 bp, Homo sapiens
agggaatgttccctgc

SEQ ID NO: 2049874 - DNA, 18 bp, Homo sapiens
agggaatgttccctgcac

SEQ ID NO: 2049875 - DNA, 19 bp, Homo sapiens
agggaatgttccctgcacc

SEQ ID NO: 2049876 - DNA, 23 bp, Homo sapiens
agggaatgttccctgcaccctgg

SEQ ID NO: 2049877 - DNA, 15 bp, Homo sapiens
agggacaaaggagcc

SEQ ID NO: 2049878 - DNA, 17 bp, Homo sapiens
agggacaagggggagga

SEQ ID NO: 2049879 - DNA, 18 bp, Homo sapiens
agggacagagacacctgc

SEQ ID NO: 2049880 - DNA, 19 bp, Homo sapiens
agggacagagacacctgca

SEQ ID NO: 2049881 - DNA, 15 bp, Homo sapiens
agggacagagatgga

SEQ ID NO: 2049882 - DNA, 13 bp, Homo sapiens
agggacagggctt

SEQ ID NO: 2049883 - DNA, 14 bp, Homo sapiens
agggaccttgaagg

SEQ ID NO: 2049884 - DNA, 19 bp, Homo sapiens
agggacggggactggccct

SEQ ID NO: 2049885 - DNA, 12 bp, Homo sapiens
agggacttaaaa

SEQ ID NO: 2049886 - DNA, 21 bp, Homo sapiens
agggagaagactatattgtac

SEQ ID NO: 2049887 - DNA, 17 bp, Homo sapiens
agggagcagacaggagg

SEQ ID NO: 2049888 - DNA, 14 bp, Homo sapiens
agggagcatggctg

SEQ ID NO: 2049889 - DNA, 15 bp, Homo sapiens
agggagcccctagga

SEQ ID NO: 2049890 - DNA, 17 bp, Homo sapiens
agggagcccctttgatg

SEQ ID NO: 2049891 - DNA, 23 bp, Homo sapiens
agggaggagaggaaatgctattg

SEQ ID NO: 2049892 - DNA, 14 bp, Homo sapiens
agggaggcccagcc

SEQ ID NO: 2049893 - DNA, 18 bp, Homo sapiens
agggaggcttcctgactg

SEQ ID NO: 2049894 - DNA, 13 bp, Homo sapiens
agggagggagagg

SEQ ID NO: 2049895 - DNA, 13 bp, Homo sapiens
agggagggctctg

SEQ ID NO: 2049896 - DNA, 20 bp, Homo sapiens
agggagggggcgctcaggac

SEQ ID NO: 2049897 - DNA, 15 bp, Homo sapiens
agggaggggtcctga

SEQ ID NO: 2049898 - DNA, 17 bp, Homo sapiens
agggaggtgaccccagg

SEQ ID NO: 2049899 - DNA, 14 bp, Homo sapiens
aggtgtaaagttgt

SEQ ID NO: 2049900 - DNA, 11 bp, Homo sapiens
aggtgtaaata

SEQ ID NO: 2049901 - DNA, 15 bp, Homo sapiens
aggtgtcaccctgca

SEQ ID NO: 2049902 - DNA, 17 bp, Homo sapiens
aggtgtcaccctgcaga

SEQ ID NO: 2049903 - DNA, 21 bp, Homo sapiens
aggtgtcaccctgcagagcta

SEQ ID NO: 2049904 - DNA, 14 bp, Homo sapiens
aggtgtctatccac

SEQ ID NO: 2049905 - DNA, 21 bp, Homo sapiens
aggtgtctgcacccaggggtg

SEQ ID NO: 2049906 - DNA, 17 bp, Homo sapiens
aggtgtgaaccaccaca

SEQ ID NO: 2049907 - DNA, 20 bp, Homo sapiens
aggtgtgagtcaccaagccc

SEQ ID NO: 2049908 - DNA, 12 bp, Homo sapiens
aggtgtgctctg

SEQ ID NO: 2049909 - DNA, 15 bp, Homo sapiens
aggtgtgctctgatc

SEQ ID NO: 2049910 - DNA, 16 bp, Homo sapiens
aggtgtttccatttct

SEQ ID NO: 2049911 - DNA, 18 bp, Homo sapiens
aggtgtttccatttctca

SEQ ID NO: 2049912 - DNA, 18 bp, Homo sapiens
aggttaaggtgggtccag

SEQ ID NO: 2049913 - DNA, 17 bp, Homo sapiens
aggttaccctgtaacat

SEQ ID NO: 2049914 - DNA, 21 bp, Homo sapiens
aggttaccctgtaacatgcaa

SEQ ID NO: 2049915 - DNA, 20 bp, Homo sapiens
aggttagaacctagaagggc

SEQ ID NO: 2049916 - DNA, 17 bp, Homo sapiens
aggttaggaaggcagca

SEQ ID NO: 2049917 - DNA, 14 bp, Homo sapiens
aggttagtgacaaa

SEQ ID NO: 2049918 - DNA, 13 bp, Homo sapiens
aggttatctgcct

SEQ ID NO: 2049919 - DNA, 15 bp, Homo sapiens
aggttccagtgagcc

SEQ ID NO: 2049920 - DNA, 16 bp, Homo sapiens
aggttcccagcagctg

SEQ ID NO: 2049921 - DNA, 17 bp, Homo sapiens
aggttcccagcagctgg

SEQ ID NO: 2049922 - DNA, 12 bp, Homo sapiens
aggttgaaagac

SEQ ID NO: 2049923 - DNA, 20 bp, Homo sapiens
aggttgacagtcccttgctg

SEQ ID NO: 2049924 - DNA, 20 bp, Homo sapiens
aggttgccccttccccatct

SEQ ID NO: 2049925 - DNA, 13 bp, Homo sapiens
aggttggtgactg

SEQ ID NO: 2049926 - DNA, 14 bp, Homo sapiens
aggttggtgactga

SEQ ID NO: 2049927 - DNA, 20 bp, Homo sapiens
aggttggtgactgaaacatt

SEQ ID NO: 2049928 - DNA, 16 bp, Homo sapiens
aggttgtctgaagtca

SEQ ID NO: 2049929 - DNA, 21 bp, Homo sapiens
aggtttatgaaaaagaagaat

SEQ ID NO: 2049930 - DNA, 23 bp, Homo sapiens
aggtttctgaaaattaacactgc

SEQ ID NO: 2049931 - DNA, 19 bp, Homo sapiens
aggtttctgagttcctgca

SEQ ID NO: 2049932 - DNA, 12 bp, Homo sapiens
aggtttcttgaa

SEQ ID NO: 2049933 - DNA, 18 bp, Homo sapiens
aggtttgccctgcctgca

SEQ ID NO: 2049934 - DNA, 21 bp, Homo sapiens
aggtttggatgggagtgagac

SEQ ID NO: 2049935 - DNA, 21 bp, Homo sapiens
aggtttggggagggggaagag

SEQ ID NO: 2049936 - DNA, 10 bp, Homo sapiens
aggttttcag

SEQ ID NO: 2049937 - DNA, 22 bp, Homo sapiens
aggttttcctcttctattttgt

SEQ ID NO: 2049938 - DNA, 13 bp, Homo sapiens
aggttttgtaaag

SEQ ID NO: 2049939 - DNA, 12 bp, Homo sapiens
aggttttgttgt

SEQ ID NO: 2049940 - DNA, 19 bp, Homo sapiens
aggtttttgtttgtttcct

SEQ ID NO: 2049941 - DNA, 22 bp, Homo sapiens
aggtttttttgtatagtaaagt

SEQ ID NO: 2049942 - DNA, 15 bp, Homo sapiens
agtaaaaccacagca

SEQ ID NO: 2049943 - DNA, 17 bp, Homo sapiens
agtaaaaccacagcagt

SEQ ID NO: 2049944 - DNA, 16 bp, Homo sapiens
agtaaaagcaaaaaag

SEQ ID NO: 2049945 - DNA, 13 bp, Homo sapiens
agtaaaagctaat

SEQ ID NO: 2049946 - DNA, 14 bp, Homo sapiens
agtaaaagctaatt

SEQ ID NO: 2049947 - DNA, 20 bp, Homo sapiens
agtaaaagctaattaggatt

SEQ ID NO: 2049948 - DNA, 18 bp, Homo sapiens
agtaaagtcaaggagaaa

SEQ ID NO: 2049949 - DNA, 19 bp, Homo sapiens
agtaaagtgataatttctg

SEQ ID NO: 2049950 - DNA, 12 bp, Homo sapiens
agtaaagtttaa

SEQ ID NO: 2049951 - DNA, 17 bp, Homo sapiens
agtaaagtttatttcat

SEQ ID NO: 2049952 - DNA, 18 bp, Homo sapiens
agtaaagtttatttcatg

SEQ ID NO: 2049953 - DNA, 11 bp, Homo sapiens
agtaaagtttt

SEQ ID NO: 2049954 - DNA, 19 bp, Homo sapiens
agtaaataaattgtttgac

SEQ ID NO: 2049955 - DNA, 20 bp, Homo sapiens
agtaaatcacgctttttgaa

SEQ ID NO: 2049956 - DNA, 17 bp, Homo sapiens
agtaaatccacagccaa

SEQ ID NO: 2049957 - DNA, 16 bp, Homo sapiens
agtaaatttgtccaat

SEQ ID NO: 2049958 - DNA, 15 bp, Homo sapiens
agtaacatgccagct

SEQ ID NO: 2049959 - DNA, 13 bp, Homo sapiens
agtaactactttt

SEQ ID NO: 2049960 - DNA, 19 bp, Homo sapiens
agtaactactttttatact

SEQ ID NO: 2049961 - DNA, 21 bp, Homo sapiens
agtaactactttttatactcc

SEQ ID NO: 2049962 - DNA, 19 bp, Homo sapiens
agtaagagctaagttctaa

SEQ ID NO: 2049963 - DNA, 20 bp, Homo sapiens
agtaataaaacccagcatgt

SEQ ID NO: 2049964 - DNA, 22 bp, Homo sapiens
agtaatagtccaatatttggcg

SEQ ID NO: 2049965 - DNA, 19 bp, Homo sapiens
agtaatgggccaattaaaa

SEQ ID NO: 2049966 - DNA, 23 bp, Homo sapiens
agtaatgggccaattaaaatata

SEQ ID NO: 2049967 - DNA, 17 bp, Homo sapiens
agtaattgtagatggaa

SEQ ID NO: 2049968 - DNA, 20 bp, Homo sapiens
agtacacagcaccagaatgt

SEQ ID NO: 2049969 - DNA, 20 bp, Homo sapiens
agtacagtagcttaaataaa

SEQ ID NO: 2049970 - DNA, 23 bp, Homo sapiens
agtacagtagcttaaataaattc

SEQ ID NO: 2049971 - DNA, 17 bp, Homo sapiens
agtacatgaagagcagc

SEQ ID NO: 2049972 - DNA, 20 bp, Homo sapiens
agtaccaaatccacaagcca

SEQ ID NO: 2049973 - DNA, 21 bp, Homo sapiens
agtaccaaatccacaagccat

SEQ ID NO: 2049974 - DNA, 15 bp, Homo sapiens
agtaccaatcatttt

SEQ ID NO: 2049975 - DNA, 16 bp, Homo sapiens
agtaccaatcatttta

SEQ ID NO: 2049976 - DNA, 15 bp, Homo sapiens
agtaccactcaggcc

SEQ ID NO: 2049977 - DNA, 13 bp, Homo sapiens
agtacctttgtca

SEQ ID NO: 2049978 - DNA, 22 bp, Homo sapiens
agtacgtttttgcattattcat

SEQ ID NO: 2049979 - DNA, 16 bp, Homo sapiens
agtactcctgcaaaat

SEQ ID NO: 2049980 - DNA, 20 bp, Homo sapiens
agtactcctgcaaaatttta

SEQ ID NO: 2049981 - DNA, 15 bp, Homo sapiens
agtactctctgctct

SEQ ID NO: 2049982 - DNA, 16 bp, Homo sapiens
agtactctctgctcta

SEQ ID NO: 2049983 - DNA, 17 bp, Homo sapiens
agtactctctgctctag

SEQ ID NO: 2049984 - DNA, 20 bp, Homo sapiens
agtactctctgctctagcca

SEQ ID NO: 2049985 - DNA, 22 bp, Homo sapiens
agtactctctgctctagccagg

SEQ ID NO: 2049986 - DNA, 15 bp, Homo sapiens
agtactggcatggta

SEQ ID NO: 2049987 - DNA, 17 bp, Homo sapiens
agtacttctccaccctg

SEQ ID NO: 2049988 - DNA, 12 bp, Homo sapiens
agtacttctttt

SEQ ID NO: 2049989 - DNA, 21 bp, Homo sapiens
agtagaaagacagagctggga

SEQ ID NO: 2049990 - DNA, 14 bp, Homo sapiens
agtagaaattgttc

SEQ ID NO: 2049991 - DNA, 18 bp, Homo sapiens
agtagaataaagaaaaac

SEQ ID NO: 2049992 - DNA, 18 bp, Homo sapiens
agtagaatggcagctgga

SEQ ID NO: 2049993 - DNA, 21 bp, Homo sapiens
agtagaattatatctaattta

SEQ ID NO: 2049994 - DNA, 16 bp, Homo sapiens
agtagagaagtatcca

SEQ ID NO: 2049995 - DNA, 18 bp, Homo sapiens
agtagcaaccttcatttt

SEQ ID NO: 2049996 - DNA, 22 bp, Homo sapiens
agtagcagtgattgtcttaata

SEQ ID NO: 2049997 - DNA, 18 bp, Homo sapiens
agtagcatggactctggg

SEQ ID NO: 2049998 - DNA, 15 bp, Homo sapiens
agtagccctttctgt

SEQ ID NO: 2049999 - DNA, 17 bp, Homo sapiens
agtagccctttctgtgt

SEQ ID NO: 2050000 - DNA, 21 bp, Homo sapiens
agtagccctttctgtgtgcac

SEQ ID NO: 2050001 - DNA, 17 bp, Homo sapiens
agtagccgagagcctgc

SEQ ID NO: 2050002 - DNA, 21 bp, Homo sapiens
agtagctgagaggaagatgaa

SEQ ID NO: 2050003 - DNA, 14 bp, Homo sapiens
agtagctgagctca

SEQ ID NO: 2050004 - DNA, 13 bp, Homo sapiens
agtagctgggact

SEQ ID NO: 2050005 - DNA, 18 bp, Homo sapiens
agtagcttaaataaattc

SEQ ID NO: 2050006 - DNA, 19 bp, Homo sapiens
agtagcttaaataaattca

SEQ ID NO: 2050007 - DNA, 15 bp, Homo sapiens
agtagtagtgtcttc

SEQ ID NO: 2050008 - DNA, 21 bp, Homo sapiens
agtagttgatgaccaatctct

SEQ ID NO: 2050009 - DNA, 17 bp, Homo sapiens
agtagtttgagaccagc

SEQ ID NO: 2050010 - DNA, 19 bp, Homo sapiens
agtagtttgagaccagcct

SEQ ID NO: 2050011 - DNA, 15 bp, Homo sapiens
agtagttttgaaact

SEQ ID NO: 2050012 - DNA, 13 bp, Homo sapiens
agtagtttttcag

SEQ ID NO: 2050013 - DNA, 13 bp, Homo sapiens
agtataaaaacaa

SEQ ID NO: 2050014 - DNA, 16 bp, Homo sapiens
agtggctaattcaatt

SEQ ID NO: 2050015 - DNA, 14 bp, Homo sapiens
agtggctgctgact

SEQ ID NO: 2050016 - DNA, 23 bp, Homo sapiens
agtggcttaaaacaacactcaca

SEQ ID NO: 2050017 - DNA, 12 bp, Homo sapiens
agtggcttcctc

SEQ ID NO: 2050018 - DNA, 20 bp, Homo sapiens
agtggcttgtgattctggga

SEQ ID NO: 2050019 - DNA, 21 bp, Homo sapiens
agtggcttgtgattctgggat

SEQ ID NO: 2050020 - DNA, 19 bp, Homo sapiens
agtggcttttttcctcctg

SEQ ID NO: 2050021 - DNA, 17 bp, Homo sapiens
agtgggaagtgaagccc

SEQ ID NO: 2050022 - DNA, 19 bp, Homo sapiens
agtgggacagggcatggcc

SEQ ID NO: 2050023 - DNA, 21 bp, Homo sapiens
agtgggacagggcatggccag

SEQ ID NO: 2050024 - DNA, 12 bp, Homo sapiens
agtgggagaaaa

SEQ ID NO: 2050025 - DNA, 19 bp, Homo sapiens
agtgggccaggacaggccc

SEQ ID NO: 2050026 - DNA, 21 bp, Homo sapiens
agtgggccaggacaggcccgg

SEQ ID NO: 2050027 - DNA, 14 bp, Homo sapiens
agtgggctgcctgg

SEQ ID NO: 2050028 - DNA, 18 bp, Homo sapiens
agtgggctgcctggggat

SEQ ID NO: 2050029 - DNA, 13 bp, Homo sapiens
agtggggctctgg

SEQ ID NO: 2050030 - DNA, 17 bp, Homo sapiens
agtgggggccgctggcc

SEQ ID NO: 2050031 - DNA, 18 bp, Homo sapiens
agtggggtctccctctcc

SEQ ID NO: 2050032 - DNA, 20 bp, Homo sapiens
agtggggtctccctctcctg

SEQ ID NO: 2050033 - DNA, 14 bp, Homo sapiens
agtgggtgaatgtg

SEQ ID NO: 2050034 - DNA, 18 bp, Homo sapiens
agtgggtggtggatctgt

SEQ ID NO: 2050035 - DNA, 22 bp, Homo sapiens
agtgggttttattgtccttcag

SEQ ID NO: 2050036 - DNA, 13 bp, Homo sapiens
agtggtaccagct

SEQ ID NO: 2050037 - DNA, 15 bp, Homo sapiens
agtggtaccagctca

SEQ ID NO: 2050038 - DNA, 22 bp, Homo sapiens
agtggtcaaaccgcactcaccc

SEQ ID NO: 2050039 - DNA, 20 bp, Homo sapiens
agtggtctttcctatcatgg

SEQ ID NO: 2050040 - DNA, 16 bp, Homo sapiens
agtggtgcgatctggg

SEQ ID NO: 2050041 - DNA, 17 bp, Homo sapiens
agtggtgcgatctgggt

SEQ ID NO: 2050042 - DNA, 11 bp, Homo sapiens
agtgtaaaata

SEQ ID NO: 2050043 - DNA, 18 bp, Homo sapiens
agtgtaaagaataaatga

SEQ ID NO: 2050044 - DNA, 14 bp, Homo sapiens
agtgtaacactgca

SEQ ID NO: 2050045 - DNA, 14 bp, Homo sapiens
agtgtaaggcatag

SEQ ID NO: 2050046 - DNA, 14 bp, Homo sapiens
agtgtactgctttc

SEQ ID NO: 2050047 - DNA, 20 bp, Homo sapiens
agtgtagaacctaattcaat

SEQ ID NO: 2050048 - DNA, 22 bp, Homo sapiens
agtgtatggaaataaatgtatc

SEQ ID NO: 2050049 - DNA, 19 bp, Homo sapiens
agtgtcacttacctagatt

SEQ ID NO: 2050050 - DNA, 12 bp, Homo sapiens
agtgtcagtgtt

SEQ ID NO: 2050051 - DNA, 20 bp, Homo sapiens
agtgtcatcagaagataact

SEQ ID NO: 2050052 - DNA, 14 bp, Homo sapiens
agtgtcccctccac

SEQ ID NO: 2050053 - DNA, 19 bp, Homo sapiens
agtgtcccctccactgtca

SEQ ID NO: 2050054 - DNA, 14 bp, Homo sapiens
agtgtcctcagggg

SEQ ID NO: 2050055 - DNA, 22 bp, Homo sapiens
agtgtctattagttttctttgt

SEQ ID NO: 2050056 - DNA, 22 bp, Homo sapiens
agtgtctcggagggattcccct

SEQ ID NO: 2050057 - DNA, 21 bp, Homo sapiens
agtgtcttaattaaaagaata

SEQ ID NO: 2050058 - DNA, 23 bp, Homo sapiens
agtgtgacaaggattgctactgt

SEQ ID NO: 2050059 - DNA, 19 bp, Homo sapiens
agtgtgaccaaaagttaca

SEQ ID NO: 2050060 - DNA, 22 bp, Homo sapiens
agtgtgaccaaaagttacatgt

SEQ ID NO: 2050061 - DNA, 12 bp, Homo sapiens
agtgtgagaatc

SEQ ID NO: 2050062 - DNA, 16 bp, Homo sapiens
agtgtgagtggcagcc

SEQ ID NO: 2050063 - DNA, 19 bp, Homo sapiens
agtgtgagtggcagccatg

SEQ ID NO: 2050064 - DNA, 16 bp, Homo sapiens
agtgtgcagactgatg

SEQ ID NO: 2050065 - DNA, 13 bp, Homo sapiens
agtgtgcgtgtgt

SEQ ID NO: 2050066 - DNA, 16 bp, Homo sapiens
agtgtgcgtgtgtgca

SEQ ID NO: 2050067 - DNA, 21 bp, Homo sapiens
agtgtggtagggacttaaaaa

SEQ ID NO: 2050068 - DNA, 13 bp, Homo sapiens
agtgtgtcagagt

SEQ ID NO: 2050069 - DNA, 21 bp, Homo sapiens
agtgtgtccttggggcacagt

SEQ ID NO: 2050070 - DNA, 12 bp, Homo sapiens
agtgtgtgtgca

SEQ ID NO: 2050071 - DNA, 15 bp, Homo sapiens
agtgtgtgtgcatgt

SEQ ID NO: 2050072 - DNA, 16 bp, Homo sapiens
agtgtgttgtctgtgc

SEQ ID NO: 2050073 - DNA, 22 bp, Homo sapiens
agtgttattttctttgaaattg

SEQ ID NO: 2050074 - DNA, 18 bp, Homo sapiens
agtgttccagctgcctgg

SEQ ID NO: 2050075 - DNA, 17 bp, Homo sapiens
agtgttcctcaccaata

SEQ ID NO: 2050076 - DNA, 12 bp, Homo sapiens
agtgttctgtat

SEQ ID NO: 2050077 - DNA, 17 bp, Homo sapiens
agtgttctgtattttaa

SEQ ID NO: 2050078 - DNA, 17 bp, Homo sapiens
agtgttctgtgggcttg

SEQ ID NO: 2050079 - DNA, 23 bp, Homo sapiens
agtgttctgtgggcttggccttg

SEQ ID NO: 2050080 - DNA, 17 bp, Homo sapiens
agtgttgaaaatgttca

SEQ ID NO: 2050081 - DNA, 13 bp, Homo sapiens
agtgttgaagaag

SEQ ID NO: 2050082 - DNA, 14 bp, Homo sapiens
agtgttgctcttgg

SEQ ID NO: 2050083 - DNA, 18 bp, Homo sapiens
agtgttgctcttggaaag

SEQ ID NO: 2050084 - DNA, 17 bp, Homo sapiens
agtgttggctgtgtgac

SEQ ID NO: 2050085 - DNA, 19 bp, Homo sapiens
agtgttggctgtgtgacag

SEQ ID NO: 2050086 - DNA, 17 bp, Homo sapiens
agtgtttaacttgtcaa

SEQ ID NO: 2050087 - DNA, 17 bp, Homo sapiens
agtgtttatttttcata

SEQ ID NO: 2050088 - DNA, 22 bp, Homo sapiens
agtgtttatttttcatattgtg

SEQ ID NO: 2050089 - DNA, 15 bp, Homo sapiens
agtgtttcccataat

SEQ ID NO: 2050090 - DNA, 21 bp, Homo sapiens
agttaacattaacatctatta

SEQ ID NO: 2050091 - DNA, 15 bp, Homo sapiens
agttaagcagccttt

SEQ ID NO: 2050092 - DNA, 15 bp, Homo sapiens
agttaagtgaatgtc

SEQ ID NO: 2050093 - DNA, 17 bp, Homo sapiens
agttaatacttaacatt

SEQ ID NO: 2050094 - DNA, 20 bp, Homo sapiens
agttaatacttaacattgat

SEQ ID NO: 2050095 - DNA, 21 bp, Homo sapiens
agttaatatatcccagaaatt

SEQ ID NO: 2050096 - DNA, 14 bp, Homo sapiens
agttacaaaaatag

SEQ ID NO: 2050097 - DNA, 18 bp, Homo sapiens
agttacagatgcacccca

SEQ ID NO: 2050098 - DNA, 17 bp, Homo sapiens
agttacagcgagaggca

SEQ ID NO: 2050099 - DNA, 15 bp, Homo sapiens
agttacttacctgca

SEQ ID NO: 2050100 - DNA, 23 bp, Homo sapiens
agttacttgaaaaaatgttctat

SEQ ID NO: 2050101 - DNA, 22 bp, Homo sapiens
agttagaaatctccagtgtgcg

SEQ ID NO: 2050102 - DNA, 14 bp, Homo sapiens
agttagctcaggag

SEQ ID NO: 2050103 - DNA, 18 bp, Homo sapiens
agttaggaaataaaacct

SEQ ID NO: 2050104 - DNA, 20 bp, Homo sapiens
agttaggggagaggaaaagt

SEQ ID NO: 2050105 - DNA, 14 bp, Homo sapiens
agttaggtgtgcca

SEQ ID NO: 2050106 - DNA, 17 bp, Homo sapiens
agttaggtgtgccaaac

SEQ ID NO: 2050107 - DNA, 18 bp, Homo sapiens
agttaggttataagaaac

SEQ ID NO: 2050108 - DNA, 21 bp, Homo sapiens
agttataagtagcaggccaag

SEQ ID NO: 2050109 - DNA, 14 bp, Homo sapiens
agttatattcttta

SEQ ID NO: 2050110 - DNA, 15 bp, Homo sapiens
agttatattctttaa

SEQ ID NO: 2050111 - DNA, 21 bp, Homo sapiens
agttatccagagggttgtgat

SEQ ID NO: 2050112 - DNA, 15 bp, Homo sapiens
agttatctaagttaa

SEQ ID NO: 2050113 - DNA, 16 bp, Homo sapiens
agttatgagggtcagg

SEQ ID NO: 2050114 - DNA, 19 bp, Homo sapiens
agttatggctataggtgct

SEQ ID NO: 2050115 - DNA, 14 bp, Homo sapiens
agttatgttaaaat

SEQ ID NO: 2050116 - DNA, 20 bp, Homo sapiens
agttattaacgggcatgtat

SEQ ID NO: 2050117 - DNA, 22 bp, Homo sapiens
agttattaacgggcatgtatta

SEQ ID NO: 2050118 - DNA, 23 bp, Homo sapiens
agttattaacgggcatgtattat

SEQ ID NO: 2050119 - DNA, 16 bp, Homo sapiens
agttattcaaatgaag

SEQ ID NO: 2050120 - DNA, 13 bp, Homo sapiens
agttattgtacag

SEQ ID NO: 2050121 - DNA, 21 bp, Homo sapiens
agttattgtacagctgtttaa

SEQ ID NO: 2050122 - DNA, 22 bp, Homo sapiens
agttattgtacagctgtttaag

SEQ ID NO: 2050123 - DNA, 22 bp, Homo sapiens
agttatttatgcctctgtattt

SEQ ID NO: 2050124 - DNA, 21 bp, Homo sapiens
agttatttatttattggagat

SEQ ID NO: 2050125 - DNA, 12 bp, Homo sapiens
agttattttagg

SEQ ID NO: 2050126 - DNA, 15 bp, Homo sapiens
agttattttaggaga

SEQ ID NO: 2050127 - DNA, 13 bp, Homo sapiens
agttcaaagaagt

SEQ ID NO: 2050128 - DNA, 15 bp, Homo sapiens
agttcaaagaagtca

SEQ ID NO: 2050129 - DNA, 16 bp, Homo sapiens
ataaatgtgtaaatgt

SEQ ID NO: 2050130 - DNA, 11 bp, Homo sapiens
ataaatgtgtg

SEQ ID NO: 2050131 - DNA, 13 bp, Homo sapiens
ataaatgttcaaa

SEQ ID NO: 2050132 - DNA, 12 bp, Homo sapiens
ataaatgtttgt

SEQ ID NO: 2050133 - DNA, 13 bp, Homo sapiens
ataaattaagact

SEQ ID NO: 2050134 - DNA, 14 bp, Homo sapiens
ataaattaagactt

SEQ ID NO: 2050135 - DNA, 13 bp, Homo sapiens
ataaattataagt

SEQ ID NO: 2050136 - DNA, 22 bp, Homo sapiens
ataaattcacataggcaatatc

SEQ ID NO: 2050137 - DNA, 19 bp, Homo sapiens
ataaattggtgataagtgg

SEQ ID NO: 2050138 - DNA, 22 bp, Homo sapiens
ataaattggtgataagtggaaa

SEQ ID NO: 2050139 - DNA, 17 bp, Homo sapiens
ataaattgtttgaccat

SEQ ID NO: 2050140 - DNA, 16 bp, Homo sapiens
ataaattttgtttcag

SEQ ID NO: 2050141 - DNA, 23 bp, Homo sapiens
ataacaaaatcacaagcaataat

SEQ ID NO: 2050142 - DNA, 15 bp, Homo sapiens
ataacaactccctga

SEQ ID NO: 2050143 - DNA, 12 bp, Homo sapiens
ataacaagaaaa

SEQ ID NO: 2050144 - DNA, 14 bp, Homo sapiens
ataaccagctgtaa

SEQ ID NO: 2050145 - DNA, 18 bp, Homo sapiens
ataacctatatgatttat

SEQ ID NO: 2050146 - DNA, 14 bp, Homo sapiens
ataactaaataaag

SEQ ID NO: 2050147 - DNA, 16 bp, Homo sapiens
ataactagatctcctg

SEQ ID NO: 2050148 - DNA, 18 bp, Homo sapiens
ataactagatctcctgta

SEQ ID NO: 2050149 - DNA, 20 bp, Homo sapiens
ataactagatctcctgtaat

SEQ ID NO: 2050150 - DNA, 18 bp, Homo sapiens
ataactcatcataaaata

SEQ ID NO: 2050151 - DNA, 17 bp, Homo sapiens
ataactgaaaattattt

SEQ ID NO: 2050152 - DNA, 21 bp, Homo sapiens
ataactgaaaattatttaaac

SEQ ID NO: 2050153 - DNA, 18 bp, Homo sapiens
ataactgaaggagaaggt

SEQ ID NO: 2050154 - DNA, 12 bp, Homo sapiens
ataacttaaaaa

SEQ ID NO: 2050155 - DNA, 19 bp, Homo sapiens
ataacttcttaaaagttgt

SEQ ID NO: 2050156 - DNA, 21 bp, Homo sapiens
ataacttgctgaatttcaggc

SEQ ID NO: 2050157 - DNA, 22 bp, Homo sapiens
ataacttgctgaatttcaggca

SEQ ID NO: 2050158 - DNA, 13 bp, Homo sapiens
ataagaaactttt

SEQ ID NO: 2050159 - DNA, 13 bp, Homo sapiens
ataagaagaatgc

SEQ ID NO: 2050160 - DNA, 15 bp, Homo sapiens
ataagaagaatgctt

SEQ ID NO: 2050161 - DNA, 14 bp, Homo sapiens
ataagaagcaaata

SEQ ID NO: 2050162 - DNA, 22 bp, Homo sapiens
ataagaatcatagtgccataga

SEQ ID NO: 2050163 - DNA, 21 bp, Homo sapiens
ataagaatgctggttttccta

SEQ ID NO: 2050164 - DNA, 14 bp, Homo sapiens
ataagagaaagaaa

SEQ ID NO: 2050165 - DNA, 16 bp, Homo sapiens
ataagattaaaggaag

SEQ ID NO: 2050166 - DNA, 17 bp, Homo sapiens
ataagattagaatgaaa

SEQ ID NO: 2050167 - DNA, 17 bp, Homo sapiens
ataagcaaattagtaat

SEQ ID NO: 2050168 - DNA, 14 bp, Homo sapiens
ataagcaaatttca

SEQ ID NO: 2050169 - DNA, 22 bp, Homo sapiens
ataagcaaatttcaaaagacat

SEQ ID NO: 2050170 - DNA, 16 bp, Homo sapiens
ataagcaagaaggcaa

SEQ ID NO: 2050171 - DNA, 23 bp, Homo sapiens
ataagcaagaaggcaaaaatagt

SEQ ID NO: 2050172 - DNA, 16 bp, Homo sapiens
ataagcagatttaaca

SEQ ID NO: 2050173 - DNA, 17 bp, Homo sapiens
ataagcatctgtgtaac

SEQ ID NO: 2050174 - DNA, 22 bp, Homo sapiens
ataagcatctgtgtaacctcca

SEQ ID NO: 2050175 - DNA, 21 bp, Homo sapiens
ataagcctccatttagttctt

SEQ ID NO: 2050176 - DNA, 13 bp, Homo sapiens
ataagctaagcct

SEQ ID NO: 2050177 - DNA, 22 bp, Homo sapiens
ataagctgggaaaaaagttttg

SEQ ID NO: 2050178 - DNA, 13 bp, Homo sapiens
ataaggagaatgt

SEQ ID NO: 2050179 - DNA, 14 bp, Homo sapiens
ataaggatcagaac

SEQ ID NO: 2050180 - DNA, 20 bp, Homo sapiens
ataaggatcagaacagcaga

SEQ ID NO: 2050181 - DNA, 15 bp, Homo sapiens
ataaggcctgccctc

SEQ ID NO: 2050182 - DNA, 17 bp, Homo sapiens
ataaggcctgccctccc

SEQ ID NO: 2050183 - DNA, 16 bp, Homo sapiens
ataaggccttaatatg

SEQ ID NO: 2050184 - DNA, 19 bp, Homo sapiens
ataagtactgtgtacagaa

SEQ ID NO: 2050185 - DNA, 14 bp, Homo sapiens
ataagtctaaataa

SEQ ID NO: 2050186 - DNA, 13 bp, Homo sapiens
ataagtgaaaata

SEQ ID NO: 2050187 - DNA, 12 bp, Homo sapiens
ataagtgctgtt

SEQ ID NO: 2050188 - DNA, 11 bp, Homo sapiens
ataagtggaaa

SEQ ID NO: 2050189 - DNA, 18 bp, Homo sapiens
ataagtggaaaaaagaga

SEQ ID NO: 2050190 - DNA, 21 bp, Homo sapiens
ataagtggaaaaaagagaaaa

SEQ ID NO: 2050191 - DNA, 21 bp, Homo sapiens
ataagtgtgtggtcccaagtt

SEQ ID NO: 2050192 - DNA, 14 bp, Homo sapiens
ataataaaaagata

SEQ ID NO: 2050193 - DNA, 13 bp, Homo sapiens
ataataaactaga

SEQ ID NO: 2050194 - DNA, 14 bp, Homo sapiens
ataataaagtgttt

SEQ ID NO: 2050195 - DNA, 17 bp, Homo sapiens
ataataactagatctcc

SEQ ID NO: 2050196 - DNA, 17 bp, Homo sapiens
ataataatgttctctgg

SEQ ID NO: 2050197 - DNA, 17 bp, Homo sapiens
ataatactaaagtgtct

SEQ ID NO: 2050198 - DNA, 18 bp, Homo sapiens
ataatataagaatcatag

SEQ ID NO: 2050199 - DNA, 15 bp, Homo sapiens
ataatatctgtgagg

SEQ ID NO: 2050200 - DNA, 13 bp, Homo sapiens
ataatatgatttt

SEQ ID NO: 2050201 - DNA, 23 bp, Homo sapiens
ataatatggaaccttccctccaa

SEQ ID NO: 2050202 - DNA, 20 bp, Homo sapiens
ataatcaattattacattta

SEQ ID NO: 2050203 - DNA, 14 bp, Homo sapiens
ataatcagcctctt

SEQ ID NO: 2050204 - DNA, 15 bp, Homo sapiens
ataatcagcctctta

SEQ ID NO: 2050205 - DNA, 17 bp, Homo sapiens
ataatcagcctcttaaa

SEQ ID NO: 2050206 - DNA, 20 bp, Homo sapiens
ataatcagcgccctggagtc

SEQ ID NO: 2050207 - DNA, 15 bp, Homo sapiens
ataatctagaacaca

SEQ ID NO: 2050208 - DNA, 15 bp, Homo sapiens
ataatctatttacat

SEQ ID NO: 2050209 - DNA, 13 bp, Homo sapiens
ataatgaacagaa

SEQ ID NO: 2050210 - DNA, 17 bp, Homo sapiens
ataatgaacagaacata

SEQ ID NO: 2050211 - DNA, 14 bp, Homo sapiens
ataatgaacagcag

SEQ ID NO: 2050212 - DNA, 21 bp, Homo sapiens
ataatgagtctgcataaactt

SEQ ID NO: 2050213 - DNA, 17 bp, Homo sapiens
ataatggaaacatttac

SEQ ID NO: 2050214 - DNA, 20 bp, Homo sapiens
ataatggaagagaaatctca

SEQ ID NO: 2050215 - DNA, 22 bp, Homo sapiens
ataatggtttactgctgtcatt

SEQ ID NO: 2050216 - DNA, 22 bp, Homo sapiens
ataatgtataaagaacaaggta

SEQ ID NO: 2050217 - DNA, 16 bp, Homo sapiens
ataatgtatataaagt

SEQ ID NO: 2050218 - DNA, 20 bp, Homo sapiens
ataatgtgcaaattttgcat

SEQ ID NO: 2050219 - DNA, 15 bp, Homo sapiens
ataatgtgtgtatgt

SEQ ID NO: 2050220 - DNA, 19 bp, Homo sapiens
ataatgtgtgtatgtgtat

SEQ ID NO: 2050221 - DNA, 19 bp, Homo sapiens
ataatgttctttaatgttg

SEQ ID NO: 2050222 - DNA, 13 bp, Homo sapiens
ataatgtttgcta

SEQ ID NO: 2050223 - DNA, 17 bp, Homo sapiens
ataattaatgtgtgtct

SEQ ID NO: 2050224 - DNA, 13 bp, Homo sapiens
ataattagaacaa

SEQ ID NO: 2050225 - DNA, 21 bp, Homo sapiens
ataattagaacaatagctatt

SEQ ID NO: 2050226 - DNA, 14 bp, Homo sapiens
ataattaggatcta

SEQ ID NO: 2050227 - DNA, 20 bp, Homo sapiens
ataattaggatctatgcaat

SEQ ID NO: 2050228 - DNA, 17 bp, Homo sapiens
ataattatccagagttt

SEQ ID NO: 2050229 - DNA, 20 bp, Homo sapiens
ataattatcggaagcagtgc

SEQ ID NO: 2050230 - DNA, 21 bp, Homo sapiens
ataattatcggaagcagtgcc

SEQ ID NO: 2050231 - DNA, 19 bp, Homo sapiens
ataattatgacagttatac

SEQ ID NO: 2050232 - DNA, 16 bp, Homo sapiens
ataattatttatttaa

SEQ ID NO: 2050233 - DNA, 21 bp, Homo sapiens
ataattatttatttaataaca

SEQ ID NO: 2050234 - DNA, 20 bp, Homo sapiens
ataattccctatcttttagt

SEQ ID NO: 2050235 - DNA, 22 bp, Homo sapiens
ataattcttccagtgcaacaaa

SEQ ID NO: 2050236 - DNA, 19 bp, Homo sapiens
ataattcttgtatattatg

SEQ ID NO: 2050237 - DNA, 14 bp, Homo sapiens
ataattgatcaaat

SEQ ID NO: 2050238 - DNA, 14 bp, Homo sapiens
ataattgtgtacaa

SEQ ID NO: 2050239 - DNA, 21 bp, Homo sapiens
ataattgttgattaatttgag

SEQ ID NO: 2050240 - DNA, 22 bp, Homo sapiens
ataattgttgattaatttgaga

SEQ ID NO: 2050241 - DNA, 21 bp, Homo sapiens
ataattgttttatctgaattt

SEQ ID NO: 2050242 - DNA, 15 bp, Homo sapiens
ataatttaatgcatg

SEQ ID NO: 2050243 - DNA, 19 bp, Homo sapiens
ataatttgtacatatgtaa

SEQ ID NO: 2050244 - DNA, 19 bp, Homo sapiens
atataaccattacatgttt

SEQ ID NO: 2050245 - DNA, 18 bp, Homo sapiens
atataactttagaaataa

SEQ ID NO: 2050246 - DNA, 19 bp, Homo sapiens
atataagaacttgatatat

SEQ ID NO: 2050247 - DNA, 19 bp, Homo sapiens
atataatggaagagaaatc

SEQ ID NO: 2050248 - DNA, 18 bp, Homo sapiens
atataatggtttactgct

SEQ ID NO: 2050249 - DNA, 22 bp, Homo sapiens
atataatggtttactgctgtca

SEQ ID NO: 2050250 - DNA, 21 bp, Homo sapiens
atataattatcggaagcagtg

SEQ ID NO: 2050251 - DNA, 15 bp, Homo sapiens
atataattgggattt

SEQ ID NO: 2050252 - DNA, 16 bp, Homo sapiens
atatacaataacataa

SEQ ID NO: 2050253 - DNA, 13 bp, Homo sapiens
atatacacataca

SEQ ID NO: 2050254 - DNA, 14 bp, Homo sapiens
atatacacatacat

SEQ ID NO: 2050255 - DNA, 16 bp, Homo sapiens
atatacacatatacct

SEQ ID NO: 2050256 - DNA, 16 bp, Homo sapiens
atatacatacacttgt

SEQ ID NO: 2050257 - DNA, 21 bp, Homo sapiens
atatacatacacttgtataaa

SEQ ID NO: 2050258 - DNA, 18 bp, Homo sapiens
atatacatatatatatac

SEQ ID NO: 2050259 - DNA, 21 bp, Homo sapiens
atatacatattataaataaat

SEQ ID NO: 2050260 - DNA, 15 bp, Homo sapiens
atatacatgtatagt

SEQ ID NO: 2050261 - DNA, 13 bp, Homo sapiens
atatacatgtgtg

SEQ ID NO: 2050262 - DNA, 18 bp, Homo sapiens
atatacctataatgtgtg

SEQ ID NO: 2050263 - DNA, 19 bp, Homo sapiens
atatacctataatgtgtgt

SEQ ID NO: 2050264 - DNA, 13 bp, Homo sapiens
atatactatacaa

SEQ ID NO: 2050265 - DNA, 22 bp, Homo sapiens
atatacttttttcttatttaac

SEQ ID NO: 2050266 - DNA, 13 bp, Homo sapiens
atatagagaaagt

SEQ ID NO: 2050267 - DNA, 14 bp, Homo sapiens
atatagagatgttt

SEQ ID NO: 2050268 - DNA, 23 bp, Homo sapiens
atatagatcagttataagtagca

SEQ ID NO: 2050269 - DNA, 12 bp, Homo sapiens
atatagatgtgc

SEQ ID NO: 2050270 - DNA, 21 bp, Homo sapiens
atatagctatttttatggaat

SEQ ID NO: 2050271 - DNA, 18 bp, Homo sapiens
atatagctgatcagtttt

SEQ ID NO: 2050272 - DNA, 15 bp, Homo sapiens
atataggaagcatat

SEQ ID NO: 2050273 - DNA, 14 bp, Homo sapiens
atataggagcaata

SEQ ID NO: 2050274 - DNA, 16 bp, Homo sapiens
atataggttgtgcaaa

SEQ ID NO: 2050275 - DNA, 22 bp, Homo sapiens
atataggttgtgcaaattaaca

SEQ ID NO: 2050276 - DNA, 23 bp, Homo sapiens
atatagtaactactttttatact

SEQ ID NO: 2050277 - DNA, 20 bp, Homo sapiens
atatagtatatttatactct

SEQ ID NO: 2050278 - DNA, 17 bp, Homo sapiens
atatataaatatatatt

SEQ ID NO: 2050279 - DNA, 18 bp, Homo sapiens
atatataatggtttactg

SEQ ID NO: 2050280 - DNA, 22 bp, Homo sapiens
atatataatggtttactgctgt

SEQ ID NO: 2050281 - DNA, 13 bp, Homo sapiens
atatatacacata

SEQ ID NO: 2050282 - DNA, 14 bp, Homo sapiens
atatatacatacac

SEQ ID NO: 2050283 - DNA, 13 bp, Homo sapiens
atatatagagaaa

SEQ ID NO: 2050284 - DNA, 17 bp, Homo sapiens
atatataggctaaagat

SEQ ID NO: 2050285 - DNA, 13 bp, Homo sapiens
atatatataaata

SEQ ID NO: 2050286 - DNA, 13 bp, Homo sapiens
atatatatacata

SEQ ID NO: 2050287 - DNA, 15 bp, Homo sapiens
atatatatatgtaca

SEQ ID NO: 2050288 - DNA, 14 bp, Homo sapiens
atatatatatgtgt

SEQ ID NO: 2050289 - DNA, 14 bp, Homo sapiens
atatatatatttaa

SEQ ID NO: 2050290 - DNA, 14 bp, Homo sapiens
atatatatgtgcag

SEQ ID NO: 2050291 - DNA, 15 bp, Homo sapiens
atatatatttaaagg

SEQ ID NO: 2050292 - DNA, 15 bp, Homo sapiens
atatatctatctatt

SEQ ID NO: 2050293 - DNA, 15 bp, Homo sapiens
atatatctatcttat

SEQ ID NO: 2050294 - DNA, 12 bp, Homo sapiens
atatatctgaaa

SEQ ID NO: 2050295 - DNA, 17 bp, Homo sapiens
atatatctgcttcagtg

SEQ ID NO: 2050296 - DNA, 16 bp, Homo sapiens
atatatggcatattta

SEQ ID NO: 2050297 - DNA, 13 bp, Homo sapiens
atatatgtacagt

SEQ ID NO: 2050298 - DNA, 19 bp, Homo sapiens
atatatgtatatatatgca

SEQ ID NO: 2050299 - DNA, 16 bp, Homo sapiens
atatatgtatatgtat

SEQ ID NO: 2050300 - DNA, 19 bp, Homo sapiens
atatatgtatatgtatata

SEQ ID NO: 2050301 - DNA, 20 bp, Homo sapiens
atatatgtatatgtatatct

SEQ ID NO: 2050302 - DNA, 21 bp, Homo sapiens
atatatgtatatgtatatcta

SEQ ID NO: 2050303 - DNA, 16 bp, Homo sapiens
atatatgtgcagtatt

SEQ ID NO: 2050304 - DNA, 19 bp, Homo sapiens
atatatgtgtatatataca

SEQ ID NO: 2050305 - DNA, 23 bp, Homo sapiens
atatatgtgtatatatacataca

SEQ ID NO: 2050306 - DNA, 20 bp, Homo sapiens
atatatgtgtgtttaaataa

SEQ ID NO: 2050307 - DNA, 23 bp, Homo sapiens
atatatgtgtgtttaaataaagt

SEQ ID NO: 2050308 - DNA, 21 bp, Homo sapiens
atatatgttttaagaggcagg

SEQ ID NO: 2050309 - DNA, 12 bp, Homo sapiens
atatattcatgt

SEQ ID NO: 2050310 - DNA, 13 bp, Homo sapiens
atatattcatgta

SEQ ID NO: 2050311 - DNA, 14 bp, Homo sapiens
atatattcatgtaa

SEQ ID NO: 2050312 - DNA, 15 bp, Homo sapiens
atatattcatgtaat

SEQ ID NO: 2050313 - DNA, 21 bp, Homo sapiens
atatattcatgtaataaatct

SEQ ID NO: 2050314 - DNA, 12 bp, Homo sapiens
atatattgctgc

SEQ ID NO: 2050315 - DNA, 21 bp, Homo sapiens
atatattggtaacatcctttc

SEQ ID NO: 2050316 - DNA, 18 bp, Homo sapiens
atatatttactaaaagaa

SEQ ID NO: 2050317 - DNA, 10 bp, Homo sapiens
atatatttat

SEQ ID NO: 2050318 - DNA, 13 bp, Homo sapiens
atatatttataac

SEQ ID NO: 2050319 - DNA, 14 bp, Homo sapiens
atatatttataact

SEQ ID NO: 2050320 - DNA, 22 bp, Homo sapiens
atatatttcacgtgttccctct

SEQ ID NO: 2050321 - DNA, 14 bp, Homo sapiens
atatatttcagata

SEQ ID NO: 2050322 - DNA, 18 bp, Homo sapiens
atatatttgaatatcatt

SEQ ID NO: 2050323 - DNA, 13 bp, Homo sapiens
atatattttatga

SEQ ID NO: 2050324 - DNA, 14 bp, Homo sapiens
atatatttttatat

SEQ ID NO: 2050325 - DNA, 20 bp, Homo sapiens
atatatttttcaaccagcat

SEQ ID NO: 2050326 - DNA, 22 bp, Homo sapiens
atatatttttcaaccagcattt

SEQ ID NO: 2050327 - DNA, 14 bp, Homo sapiens
atatattttttgta

SEQ ID NO: 2050328 - DNA, 14 bp, Homo sapiens
atatcaaaaagact

SEQ ID NO: 2050329 - DNA, 15 bp, Homo sapiens
atatcaagatgattc

SEQ ID NO: 2050330 - DNA, 17 bp, Homo sapiens
atatcaaggatgttctg

SEQ ID NO: 2050331 - DNA, 14 bp, Homo sapiens
atatcaattcaaca

SEQ ID NO: 2050332 - DNA, 16 bp, Homo sapiens
atatcaattcaacaca

SEQ ID NO: 2050333 - DNA, 11 bp, Homo sapiens
atatcacctct

SEQ ID NO: 2050334 - DNA, 17 bp, Homo sapiens
atatcacctctcttcag

SEQ ID NO: 2050335 - DNA, 14 bp, Homo sapiens
atatcagaaaagta

SEQ ID NO: 2050336 - DNA, 15 bp, Homo sapiens
atatcagacctctga

SEQ ID NO: 2050337 - DNA, 20 bp, Homo sapiens
atatcagacctctgatccct

SEQ ID NO: 2050338 - DNA, 20 bp, Homo sapiens
atatcagttactcagccctg

SEQ ID NO: 2050339 - DNA, 21 bp, Homo sapiens
atatcagttactcagccctgg

SEQ ID NO: 2050340 - DNA, 23 bp, Homo sapiens
atatcagttactcagccctgggc

SEQ ID NO: 2050341 - DNA, 19 bp, Homo sapiens
atatcatattggtattcac

SEQ ID NO: 2050342 - DNA, 22 bp, Homo sapiens
atatcctaaacatcattcattt

SEQ ID NO: 2050343 - DNA, 23 bp, Homo sapiens
atatcggaggtggtggaggagga

SEQ ID NO: 2050344 - DNA, 19 bp, Homo sapiens
atatctaatttatacaaaa

SEQ ID NO: 2050345 - DNA, 22 bp, Homo sapiens
atatctaatttatacaaaataa

SEQ ID NO: 2050346 - DNA, 23 bp, Homo sapiens
atatctacctgccctctctcagt

SEQ ID NO: 2050347 - DNA, 20 bp, Homo sapiens
atatctatagtagtcaatta

SEQ ID NO: 2050348 - DNA, 13 bp, Homo sapiens
atatctatatctc

SEQ ID NO: 2050349 - DNA, 14 bp, Homo sapiens
atatctatctattt

SEQ ID NO: 2050350 - DNA, 20 bp, Homo sapiens
atatctatcttatatagttt

SEQ ID NO: 2050351 - DNA, 23 bp, Homo sapiens
atatctattattataaaaataat

SEQ ID NO: 2050352 - DNA, 13 bp, Homo sapiens
atatctcagaggc

SEQ ID NO: 2050353 - DNA, 12 bp, Homo sapiens
atatctcatctc

SEQ ID NO: 2050354 - DNA, 23 bp, Homo sapiens
atatctcctgaaaaggtttatga

SEQ ID NO: 2050355 - DNA, 17 bp, Homo sapiens
atatctctaaactgctg

SEQ ID NO: 2050356 - DNA, 21 bp, Homo sapiens
atatctgacatcttatttact

SEQ ID NO: 2050357 - DNA, 19 bp, Homo sapiens
atatctgagaagtgtatat

SEQ ID NO: 2050358 - DNA, 17 bp, Homo sapiens
atatctgataaaattgt

SEQ ID NO: 2050359 - DNA, 17 bp, Homo sapiens
atcccatgtcacctcag

SEQ ID NO: 2050360 - DNA, 16 bp, Homo sapiens
atccccaaactgtgcc

SEQ ID NO: 2050361 - DNA, 23 bp, Homo sapiens
atccccaaactgtgccctgcctt

SEQ ID NO: 2050362 - DNA, 12 bp, Homo sapiens
atccccagccag

SEQ ID NO: 2050363 - DNA, 14 bp, Homo sapiens
atccccagtcccaa

SEQ ID NO: 2050364 - DNA, 18 bp, Homo sapiens
atcccccactgccacacc

SEQ ID NO: 2050365 - DNA, 22 bp, Homo sapiens
atcccccactgccacaccctcc

SEQ ID NO: 2050366 - DNA, 13 bp, Homo sapiens
atccccggctgct

SEQ ID NO: 2050367 - DNA, 21 bp, Homo sapiens
atccccttgtgtcagagacag

SEQ ID NO: 2050368 - DNA, 12 bp, Homo sapiens
atcccctttcct

SEQ ID NO: 2050369 - DNA, 15 bp, Homo sapiens
atcccctttcctccc

SEQ ID NO: 2050370 - DNA, 18 bp, Homo sapiens
atcccctttcctccccac

SEQ ID NO: 2050371 - DNA, 19 bp, Homo sapiens
atcccctttcctccccacc

SEQ ID NO: 2050372 - DNA, 15 bp, Homo sapiens
atcccgctcctgctg

SEQ ID NO: 2050373 - DNA, 13 bp, Homo sapiens
atcccggcctctt

SEQ ID NO: 2050374 - DNA, 14 bp, Homo sapiens
atccctagctgtga

SEQ ID NO: 2050375 - DNA, 17 bp, Homo sapiens
atccctatgggattcag

SEQ ID NO: 2050376 - DNA, 13 bp, Homo sapiens
atccctatttaat

SEQ ID NO: 2050377 - DNA, 22 bp, Homo sapiens
atccctcggaagccgtctgact

SEQ ID NO: 2050378 - DNA, 15 bp, Homo sapiens
atccctgggcccctc

SEQ ID NO: 2050379 - DNA, 17 bp, Homo sapiens
atccctgggcccctcca

SEQ ID NO: 2050380 - DNA, 21 bp, Homo sapiens
atccctgggcccctccacgcc

SEQ ID NO: 2050381 - DNA, 13 bp, Homo sapiens
atccctgggcctg

SEQ ID NO: 2050382 - DNA, 15 bp, Homo sapiens
atccctgggcctgct

SEQ ID NO: 2050383 - DNA, 19 bp, Homo sapiens
atccctgttacccagagaa

SEQ ID NO: 2050384 - DNA, 13 bp, Homo sapiens
atccctgtttaat

SEQ ID NO: 2050385 - DNA, 14 bp, Homo sapiens
atccctgtttaata

SEQ ID NO: 2050386 - DNA, 15 bp, Homo sapiens
atcccttcctcccca

SEQ ID NO: 2050387 - DNA, 16 bp, Homo sapiens
atcccttcctccccag

SEQ ID NO: 2050388 - DNA, 22 bp, Homo sapiens
atcccttgtacctatggctgcc

SEQ ID NO: 2050389 - DNA, 17 bp, Homo sapiens
atccgattcgccatcac

SEQ ID NO: 2050390 - DNA, 18 bp, Homo sapiens
atccgggacgcttccaga

SEQ ID NO: 2050391 - DNA, 17 bp, Homo sapiens
atccgtagttccctgaa

SEQ ID NO: 2050392 - DNA, 23 bp, Homo sapiens
atccgtttcagctgacagctgct

SEQ ID NO: 2050393 - DNA, 18 bp, Homo sapiens
atcctaactgaagagaca

SEQ ID NO: 2050394 - DNA, 20 bp, Homo sapiens
atcctaagtgggaagtgaag

SEQ ID NO: 2050395 - DNA, 15 bp, Homo sapiens
atcctaccaatgcat

SEQ ID NO: 2050396 - DNA, 16 bp, Homo sapiens
atcctagaaccaagct

SEQ ID NO: 2050397 - DNA, 21 bp, Homo sapiens
atcctagaaccaagcttcaga

SEQ ID NO: 2050398 - DNA, 21 bp, Homo sapiens
atcctattaaaacacagcttt

SEQ ID NO: 2050399 - DNA, 17 bp, Homo sapiens
atcctattatgtgttca

SEQ ID NO: 2050400 - DNA, 17 bp, Homo sapiens
atcctcaaagcccccac

SEQ ID NO: 2050401 - DNA, 14 bp, Homo sapiens
atcctcaacaacaa

SEQ ID NO: 2050402 - DNA, 16 bp, Homo sapiens
atcctcacaggagcag

SEQ ID NO: 2050403 - DNA, 17 bp, Homo sapiens
atcctcacaggagcaga

SEQ ID NO: 2050404 - DNA, 20 bp, Homo sapiens
atcctcacaggagcagacag

SEQ ID NO: 2050405 - DNA, 17 bp, Homo sapiens
atcctcaggatttcatt

SEQ ID NO: 2050406 - DNA, 22 bp, Homo sapiens
atcctcaggtagtactgggaat

SEQ ID NO: 2050407 - DNA, 20 bp, Homo sapiens
atcctccaacgttaaaagac

SEQ ID NO: 2050408 - DNA, 18 bp, Homo sapiens
atcctccaattccacagt

SEQ ID NO: 2050409 - DNA, 19 bp, Homo sapiens
atcctcccacctcagcctc

SEQ ID NO: 2050410 - DNA, 20 bp, Homo sapiens
atcctcccacctcagcctcc

SEQ ID NO: 2050411 - DNA, 18 bp, Homo sapiens
atcctctgagtgtgacca

SEQ ID NO: 2050412 - DNA, 10 bp, Homo sapiens
atcctctggc

SEQ ID NO: 2050413 - DNA, 13 bp, Homo sapiens
atcctctggggtt

SEQ ID NO: 2050414 - DNA, 17 bp, Homo sapiens
atcctcttctaactcat

SEQ ID NO: 2050415 - DNA, 13 bp, Homo sapiens
atcctgaagaaac

SEQ ID NO: 2050416 - DNA, 16 bp, Homo sapiens
atcctgaagaaaccac

SEQ ID NO: 2050417 - DNA, 18 bp, Homo sapiens
atcctgaagaaaccacag

SEQ ID NO: 2050418 - DNA, 20 bp, Homo sapiens
atcctgcaggaacgagcact

SEQ ID NO: 2050419 - DNA, 21 bp, Homo sapiens
atcctgcaggaacgagcactg

SEQ ID NO: 2050420 - DNA, 22 bp, Homo sapiens
atcctgcccccagccatggtga

SEQ ID NO: 2050421 - DNA, 21 bp, Homo sapiens
atcctgccttcatggaactca

SEQ ID NO: 2050422 - DNA, 19 bp, Homo sapiens
atcctgctcataacatctt

SEQ ID NO: 2050423 - DNA, 16 bp, Homo sapiens
atcctgctgtggcctc

SEQ ID NO: 2050424 - DNA, 17 bp, Homo sapiens
atcctgctgtggcctca

SEQ ID NO: 2050425 - DNA, 14 bp, Homo sapiens
atcctgcttcagtg

SEQ ID NO: 2050426 - DNA, 19 bp, Homo sapiens
atcctggcacccggcccct

SEQ ID NO: 2050427 - DNA, 20 bp, Homo sapiens
atcctggcacccggcccctg

SEQ ID NO: 2050428 - DNA, 17 bp, Homo sapiens
atcctggccaacatggt

SEQ ID NO: 2050429 - DNA, 20 bp, Homo sapiens
atcctggcccctccagaccc

SEQ ID NO: 2050430 - DNA, 22 bp, Homo sapiens
atcctggcccctccagaccctg

SEQ ID NO: 2050431 - DNA, 21 bp, Homo sapiens
atcctgtatattatggtgtaa

SEQ ID NO: 2050432 - DNA, 23 bp, Homo sapiens
atcctgtatattatggtgtaatg

SEQ ID NO: 2050433 - DNA, 21 bp, Homo sapiens
atcctgtcgattagactggac

SEQ ID NO: 2050434 - DNA, 19 bp, Homo sapiens
atcctgttaggggaaaata

SEQ ID NO: 2050435 - DNA, 21 bp, Homo sapiens
atccttaggaaaatgcttctg

SEQ ID NO: 2050436 - DNA, 23 bp, Homo sapiens
atccttaggaaaatgcttctgtt

SEQ ID NO: 2050437 - DNA, 23 bp, Homo sapiens
atccttcatcgaacaaactgatg

SEQ ID NO: 2050438 - DNA, 22 bp, Homo sapiens
atccttcatctggattccagag

SEQ ID NO: 2050439 - DNA, 14 bp, Homo sapiens
atccttccagtggc

SEQ ID NO: 2050440 - DNA, 16 bp, Homo sapiens
atccttgaactgtcag

SEQ ID NO: 2050441 - DNA, 19 bp, Homo sapiens
atccttggagagcagctgg

SEQ ID NO: 2050442 - DNA, 14 bp, Homo sapiens
atcctttgccccaa

SEQ ID NO: 2050443 - DNA, 16 bp, Homo sapiens
atccttttatgttatt

SEQ ID NO: 2050444 - DNA, 17 bp, Homo sapiens
atccttttatgttattt

SEQ ID NO: 2050445 - DNA, 22 bp, Homo sapiens
atccttttttaaaagtaaatgt

SEQ ID NO: 2050446 - DNA, 17 bp, Homo sapiens
atcgaaaattcatttca

SEQ ID NO: 2050447 - DNA, 17 bp, Homo sapiens
atcgagaactgccattg

SEQ ID NO: 2050448 - DNA, 18 bp, Homo sapiens
atcgattcaaactgctcc

SEQ ID NO: 2050449 - DNA, 11 bp, Homo sapiens
atcgattggct

SEQ ID NO: 2050450 - DNA, 16 bp, Homo sapiens
atcgcttgagcccagg

SEQ ID NO: 2050451 - DNA, 18 bp, Homo sapiens
atcggaagcagtgccttc

SEQ ID NO: 2050452 - DNA, 22 bp, Homo sapiens
atcggaagcagtgccttccata

SEQ ID NO: 2050453 - DNA, 15 bp, Homo sapiens
atcggagcctcctct

SEQ ID NO: 2050454 - DNA, 21 bp, Homo sapiens
atcgggaacagtgtttcccat

SEQ ID NO: 2050455 - DNA, 16 bp, Homo sapiens
atcgggagcagtgtct

SEQ ID NO: 2050456 - DNA, 21 bp, Homo sapiens
atcgggagcagtgtcttccat

SEQ ID NO: 2050457 - DNA, 20 bp, Homo sapiens
atcgggataacaaaatcaca

SEQ ID NO: 2050458 - DNA, 22 bp, Homo sapiens
atcgggataacaaaatcacaag

SEQ ID NO: 2050459 - DNA, 19 bp, Homo sapiens
atcggtcttgcccagagga

SEQ ID NO: 2050460 - DNA, 19 bp, Homo sapiens
atcgtgccgttactctcca

SEQ ID NO: 2050461 - DNA, 15 bp, Homo sapiens
atcgtgctaaatttt

SEQ ID NO: 2050462 - DNA, 16 bp, Homo sapiens
atcgtgctaaattttc

SEQ ID NO: 2050463 - DNA, 22 bp, Homo sapiens
atcgttagtatctaacatgtat

SEQ ID NO: 2050464 - DNA, 18 bp, Homo sapiens
atcgttatgtgtgtatat

SEQ ID NO: 2050465 - DNA, 23 bp, Homo sapiens
atcgttcctatacatttctgttc

SEQ ID NO: 2050466 - DNA, 21 bp, Homo sapiens
atctaaaagaatttaaattct

SEQ ID NO: 2050467 - DNA, 17 bp, Homo sapiens
atctaaataatacagga

SEQ ID NO: 2050468 - DNA, 17 bp, Homo sapiens
atctaagcctttccata

SEQ ID NO: 2050469 - DNA, 14 bp, Homo sapiens
atctaagctgcagc

SEQ ID NO: 2050470 - DNA, 15 bp, Homo sapiens
atctaagctgcagct

SEQ ID NO: 2050471 - DNA, 16 bp, Homo sapiens
atctaagctgcagctt

SEQ ID NO: 2050472 - DNA, 18 bp, Homo sapiens
atctaagctgcagcttcc

SEQ ID NO: 2050473 - DNA, 13 bp, Homo sapiens
atgagggcagcag

SEQ ID NO: 2050474 - DNA, 16 bp, Homo sapiens
atgagggcagcagcca

SEQ ID NO: 2050475 - DNA, 18 bp, Homo sapiens
atgagggcagcagccagc

SEQ ID NO: 2050476 - DNA, 23 bp, Homo sapiens
atgagggcagcagccagccctgc

SEQ ID NO: 2050477 - DNA, 21 bp, Homo sapiens
atgaggggcttcctgggtcct

SEQ ID NO: 2050478 - DNA, 15 bp, Homo sapiens
atgaggtcagagcct

SEQ ID NO: 2050479 - DNA, 22 bp, Homo sapiens
atgaggtcagagcctgcagtta

SEQ ID NO: 2050480 - DNA, 14 bp, Homo sapiens
atgaggtcccaggc

SEQ ID NO: 2050481 - DNA, 17 bp, Homo sapiens
atgagtatacaatatat

SEQ ID NO: 2050482 - DNA, 18 bp, Homo sapiens
atgagtatacaatatata

SEQ ID NO: 2050483 - DNA, 23 bp, Homo sapiens
atgagtatacaatatataaaaat

SEQ ID NO: 2050484 - DNA, 20 bp, Homo sapiens
atgagtcagacatttggtat

SEQ ID NO: 2050485 - DNA, 17 bp, Homo sapiens
atgagtctacctgagca

SEQ ID NO: 2050486 - DNA, 22 bp, Homo sapiens
atgagtctacctgagcattcag

SEQ ID NO: 2050487 - DNA, 20 bp, Homo sapiens
atgagtctgcataaacttca

SEQ ID NO: 2050488 - DNA, 23 bp, Homo sapiens
atgagtgattgacacacagcact

SEQ ID NO: 2050489 - DNA, 14 bp, Homo sapiens
atgataaagatgtc

SEQ ID NO: 2050490 - DNA, 12 bp, Homo sapiens
atgataaatatt

SEQ ID NO: 2050491 - DNA, 23 bp, Homo sapiens
atgataatcaattattacattta

SEQ ID NO: 2050492 - DNA, 16 bp, Homo sapiens
atgatactgatgccat

SEQ ID NO: 2050493 - DNA, 19 bp, Homo sapiens
atgatagtaataggataca

SEQ ID NO: 2050494 - DNA, 21 bp, Homo sapiens
atgatatgtaaacataattct

SEQ ID NO: 2050495 - DNA, 18 bp, Homo sapiens
atgatcacagtgacttta

SEQ ID NO: 2050496 - DNA, 18 bp, Homo sapiens
atgatcacggctcactgc

SEQ ID NO: 2050497 - DNA, 19 bp, Homo sapiens
atgatcacggctcactgca

SEQ ID NO: 2050498 - DNA, 23 bp, Homo sapiens
atgatcacggctcactgcagcct

SEQ ID NO: 2050499 - DNA, 14 bp, Homo sapiens
atgatcatgtaaat

SEQ ID NO: 2050500 - DNA, 21 bp, Homo sapiens
atgatcatgtaaatgattatc

SEQ ID NO: 2050501 - DNA, 16 bp, Homo sapiens
atgatccttgttttaa

SEQ ID NO: 2050502 - DNA, 14 bp, Homo sapiens
atgatctactcaga

SEQ ID NO: 2050503 - DNA, 15 bp, Homo sapiens
atgatctactcagaa

SEQ ID NO: 2050504 - DNA, 12 bp, Homo sapiens
atgatctcagga

SEQ ID NO: 2050505 - DNA, 14 bp, Homo sapiens
atgatctctctgaa

SEQ ID NO: 2050506 - DNA, 15 bp, Homo sapiens
atgatctgactttaa

SEQ ID NO: 2050507 - DNA, 22 bp, Homo sapiens
atgatctgtatttaatggtttt

SEQ ID NO: 2050508 - DNA, 22 bp, Homo sapiens
atgatcttgagatttcttttaa

SEQ ID NO: 2050509 - DNA, 16 bp, Homo sapiens
atgatctttaaaatac

SEQ ID NO: 2050510 - DNA, 19 bp, Homo sapiens
atgatctttgcagacaggc

SEQ ID NO: 2050511 - DNA, 21 bp, Homo sapiens
atgatctttgcagacaggcaa

SEQ ID NO: 2050512 - DNA, 16 bp, Homo sapiens
atgatgaaaataataa

SEQ ID NO: 2050513 - DNA, 17 bp, Homo sapiens
atgatgaccaagaatta

SEQ ID NO: 2050514 - DNA, 13 bp, Homo sapiens
atgatgatgatga

SEQ ID NO: 2050515 - DNA, 19 bp, Homo sapiens
atgatgattaaacacctga

SEQ ID NO: 2050516 - DNA, 21 bp, Homo sapiens
atgatgattccttgagcattt

SEQ ID NO: 2050517 - DNA, 20 bp, Homo sapiens
atgatgccgctcttctgtca

SEQ ID NO: 2050518 - DNA, 23 bp, Homo sapiens
atgatgccgctcttctgtcatcc

SEQ ID NO: 2050519 - DNA, 17 bp, Homo sapiens
atgatggatgagaaaaa

SEQ ID NO: 2050520 - DNA, 15 bp, Homo sapiens
atgatgtatttttgt

SEQ ID NO: 2050521 - DNA, 18 bp, Homo sapiens
atgatgtccagaagaata

SEQ ID NO: 2050522 - DNA, 15 bp, Homo sapiens
atgatgtctcttgta

SEQ ID NO: 2050523 - DNA, 19 bp, Homo sapiens
atgatgtctcttgtagaag

SEQ ID NO: 2050524 - DNA, 13 bp, Homo sapiens
atgattaaacacc

SEQ ID NO: 2050525 - DNA, 15 bp, Homo sapiens
atgattaaacacctg

SEQ ID NO: 2050526 - DNA, 18 bp, Homo sapiens
atgattaaacacctgaca

SEQ ID NO: 2050527 - DNA, 16 bp, Homo sapiens
atgattaattcacctt

SEQ ID NO: 2050528 - DNA, 17 bp, Homo sapiens
atgattatgccactgct

SEQ ID NO: 2050529 - DNA, 14 bp, Homo sapiens
atgattcataacaa

SEQ ID NO: 2050530 - DNA, 15 bp, Homo sapiens
atgattggattattc

SEQ ID NO: 2050531 - DNA, 22 bp, Homo sapiens
atgattggattattcatttaaa

SEQ ID NO: 2050532 - DNA, 17 bp, Homo sapiens
atgattgtttaattgta

SEQ ID NO: 2050533 - DNA, 16 bp, Homo sapiens
atgatttaaaaaataa

SEQ ID NO: 2050534 - DNA, 15 bp, Homo sapiens
atgatttatagtttg

SEQ ID NO: 2050535 - DNA, 21 bp, Homo sapiens
atgatttcatgctatctctgt

SEQ ID NO: 2050536 - DNA, 15 bp, Homo sapiens
atgattttacagaga

SEQ ID NO: 2050537 - DNA, 22 bp, Homo sapiens
atgattttatacatagtcacaa

SEQ ID NO: 2050538 - DNA, 11 bp, Homo sapiens
atgatttttag

SEQ ID NO: 2050539 - DNA, 20 bp, Homo sapiens
atgattttttaaaagaaatt

SEQ ID NO: 2050540 - DNA, 22 bp, Homo sapiens
atgattttttaaaagaaattta

SEQ ID NO: 2050541 - DNA, 18 bp, Homo sapiens
atgcaaaaaatcttccaa

SEQ ID NO: 2050542 - DNA, 16 bp, Homo sapiens
atgcaaacactgtgta

SEQ ID NO: 2050543 - DNA, 13 bp, Homo sapiens
atgcaaagcactg

SEQ ID NO: 2050544 - DNA, 16 bp, Homo sapiens
atgcaacaacatgtat

SEQ ID NO: 2050545 - DNA, 18 bp, Homo sapiens
atgcaagagtggactgaa

SEQ ID NO: 2050546 - DNA, 23 bp, Homo sapiens
atgcaagctagtggcttcaaaat

SEQ ID NO: 2050547 - DNA, 13 bp, Homo sapiens
atgcaaggaagga

SEQ ID NO: 2050548 - DNA, 14 bp, Homo sapiens
atgcaatatgtatt

SEQ ID NO: 2050549 - DNA, 14 bp, Homo sapiens
atgcaatttttaaa

SEQ ID NO: 2050550 - DNA, 21 bp, Homo sapiens
atgcaatttttaaactagtaa

SEQ ID NO: 2050551 - DNA, 12 bp, Homo sapiens
atgcacaattta

SEQ ID NO: 2050552 - DNA, 15 bp, Homo sapiens
atgcacaatttagaa

SEQ ID NO: 2050553 - DNA, 16 bp, Homo sapiens
atgcacaatttagaaa

SEQ ID NO: 2050554 - DNA, 17 bp, Homo sapiens
atgcacaatttagaaaa

SEQ ID NO: 2050555 - DNA, 20 bp, Homo sapiens
atgcacactagcctctccag

SEQ ID NO: 2050556 - DNA, 17 bp, Homo sapiens
atgcacagctgcttgtc

SEQ ID NO: 2050557 - DNA, 22 bp, Homo sapiens
atgcacagctgcttgtcctgct

SEQ ID NO: 2050558 - DNA, 21 bp, Homo sapiens
atgcacatccattcccaagaa

SEQ ID NO: 2050559 - DNA, 22 bp, Homo sapiens
atgcacatgtaacccaaatgtc

SEQ ID NO: 2050560 - DNA, 16 bp, Homo sapiens
atgcacatttatatat

SEQ ID NO: 2050561 - DNA, 22 bp, Homo sapiens
atgcaccagcccttagcaggga

SEQ ID NO: 2050562 - DNA, 20 bp, Homo sapiens
atgcaccagtgccgcctgtg

SEQ ID NO: 2050563 - DNA, 16 bp, Homo sapiens
atgcacctaaagaaaa

SEQ ID NO: 2050564 - DNA, 19 bp, Homo sapiens
atgcacggtgaggccgggc

SEQ ID NO: 2050565 - DNA, 17 bp, Homo sapiens
atgcactgacccttcca

SEQ ID NO: 2050566 - DNA, 23 bp, Homo sapiens
atgcactgacccttccagacata

SEQ ID NO: 2050567 - DNA, 14 bp, Homo sapiens
atgcactggccacc

SEQ ID NO: 2050568 - DNA, 20 bp, Homo sapiens
atgcagaatgtttttaaaat

SEQ ID NO: 2050569 - DNA, 21 bp, Homo sapiens
atgcagactcctcagatctga

SEQ ID NO: 2050570 - DNA, 15 bp, Homo sapiens
atgcagagtatttct

SEQ ID NO: 2050571 - DNA, 17 bp, Homo sapiens
atgcagattcctgggcc

SEQ ID NO: 2050572 - DNA, 21 bp, Homo sapiens
atgcagcctaaggctgtatga

SEQ ID NO: 2050573 - DNA, 22 bp, Homo sapiens
atgcagcgaaccaatatttgta

SEQ ID NO: 2050574 - DNA, 17 bp, Homo sapiens
atgcagctgaggtctgt

SEQ ID NO: 2050575 - DNA, 12 bp, Homo sapiens
atgcagcttcat

SEQ ID NO: 2050576 - DNA, 18 bp, Homo sapiens
atgcagcttcatcaattt

SEQ ID NO: 2050577 - DNA, 21 bp, Homo sapiens
atgcagcttcatcaattttta

SEQ ID NO: 2050578 - DNA, 22 bp, Homo sapiens
atgcagcttcatcaatttttat

SEQ ID NO: 2050579 - DNA, 15 bp, Homo sapiens
atgcagtattgagca

SEQ ID NO: 2050580 - DNA, 16 bp, Homo sapiens
atgcagtattgccaca

SEQ ID NO: 2050581 - DNA, 19 bp, Homo sapiens
atgcagtccagaataagtg

SEQ ID NO: 2050582 - DNA, 22 bp, Homo sapiens
atgcagtccagaataagtgctg

SEQ ID NO: 2050583 - DNA, 23 bp, Homo sapiens
atgcagtggtatgatcacggctc

SEQ ID NO: 2050584 - DNA, 15 bp, Homo sapiens
atgcatcagaaaggg

SEQ ID NO: 2050585 - DNA, 20 bp, Homo sapiens
atgcatcagaaagggagggc

SEQ ID NO: 2050586 - DNA, 18 bp, Homo sapiens
atgcatccattcctcagg

SEQ ID NO: 2050587 - DNA, 21 bp, Homo sapiens
atgtagactatatacatgtgt

SEQ ID NO: 2050588 - DNA, 19 bp, Homo sapiens
atgtagattaaggtgatgt

SEQ ID NO: 2050589 - DNA, 14 bp, Homo sapiens
atgtagccctcatg

SEQ ID NO: 2050590 - DNA, 14 bp, Homo sapiens
atgtagctggtttc

SEQ ID NO: 2050591 - DNA, 15 bp, Homo sapiens
atgtagctggtttcc

SEQ ID NO: 2050592 - DNA, 16 bp, Homo sapiens
atgtaggtatgaataa

SEQ ID NO: 2050593 - DNA, 15 bp, Homo sapiens
atgtaggtgtctgca

SEQ ID NO: 2050594 - DNA, 19 bp, Homo sapiens
atgtagtccgttaacacta

SEQ ID NO: 2050595 - DNA, 15 bp, Homo sapiens
atgtatacacacata

SEQ ID NO: 2050596 - DNA, 12 bp, Homo sapiens
atgtatagtaaa

SEQ ID NO: 2050597 - DNA, 19 bp, Homo sapiens
atgtatagtgagtgtggct

SEQ ID NO: 2050598 - DNA, 12 bp, Homo sapiens
atgtatatacac

SEQ ID NO: 2050599 - DNA, 13 bp, Homo sapiens
atgtatatacaca

SEQ ID NO: 2050600 - DNA, 14 bp, Homo sapiens
atgtatatagatgt

SEQ ID NO: 2050601 - DNA, 15 bp, Homo sapiens
atgtatatgtatata

SEQ ID NO: 2050602 - DNA, 17 bp, Homo sapiens
atgtatatgtatatcta

SEQ ID NO: 2050603 - DNA, 22 bp, Homo sapiens
atgtatcctgataaacattaaa

SEQ ID NO: 2050604 - DNA, 13 bp, Homo sapiens
atgtatcttattt

SEQ ID NO: 2050605 - DNA, 20 bp, Homo sapiens
atgtatcttatttatatatg

SEQ ID NO: 2050606 - DNA, 22 bp, Homo sapiens
atgtatcttatttatatatgaa

SEQ ID NO: 2050607 - DNA, 20 bp, Homo sapiens
atgtatggaatacagtgtta

SEQ ID NO: 2050608 - DNA, 17 bp, Homo sapiens
atgtatgtgaaagtgta

SEQ ID NO: 2050609 - DNA, 19 bp, Homo sapiens
atgtatgtgcacatgtgtc

SEQ ID NO: 2050610 - DNA, 14 bp, Homo sapiens
atgtatgtgtgtat

SEQ ID NO: 2050611 - DNA, 15 bp, Homo sapiens
atgtatgtgtgtatg

SEQ ID NO: 2050612 - DNA, 19 bp, Homo sapiens
atgtatgttcagaagaaat

SEQ ID NO: 2050613 - DNA, 12 bp, Homo sapiens
atgtatgtttac

SEQ ID NO: 2050614 - DNA, 17 bp, Homo sapiens
atgtatgtttacatatc

SEQ ID NO: 2050615 - DNA, 18 bp, Homo sapiens
atgtatgtttacatatca

SEQ ID NO: 2050616 - DNA, 20 bp, Homo sapiens
atgtattaagccaaacatga

SEQ ID NO: 2050617 - DNA, 17 bp, Homo sapiens
atgtattaatattcatt

SEQ ID NO: 2050618 - DNA, 13 bp, Homo sapiens
atgtattatcaca

SEQ ID NO: 2050619 - DNA, 17 bp, Homo sapiens
atgtattattttctata

SEQ ID NO: 2050620 - DNA, 18 bp, Homo sapiens
atgtattattttctatag

SEQ ID NO: 2050621 - DNA, 17 bp, Homo sapiens
atgtattcacacacccc

SEQ ID NO: 2050622 - DNA, 17 bp, Homo sapiens
atgtatttataaatata

SEQ ID NO: 2050623 - DNA, 23 bp, Homo sapiens
atgtatttattgtcattactgcc

SEQ ID NO: 2050624 - DNA, 12 bp, Homo sapiens
atgtcaaaatca

SEQ ID NO: 2050625 - DNA, 16 bp, Homo sapiens
atgtcaaggactcctg

SEQ ID NO: 2050626 - DNA, 16 bp, Homo sapiens
atgtcaagtaccaaaa

SEQ ID NO: 2050627 - DNA, 20 bp, Homo sapiens
atgtcaatttgtatatcatg

SEQ ID NO: 2050628 - DNA, 13 bp, Homo sapiens
atgtcacaggcag

SEQ ID NO: 2050629 - DNA, 14 bp, Homo sapiens
atgtcacaggcagg

SEQ ID NO: 2050630 - DNA, 15 bp, Homo sapiens
atgtcacaggcaggt

SEQ ID NO: 2050631 - DNA, 19 bp, Homo sapiens
atgtcacaggcaggtccag

SEQ ID NO: 2050632 - DNA, 15 bp, Homo sapiens
atgtcaccaccttcc

SEQ ID NO: 2050633 - DNA, 19 bp, Homo sapiens
atgtcaccaccttcccagc

SEQ ID NO: 2050634 - DNA, 23 bp, Homo sapiens
atgtcaccgtggaccttcctgcc

SEQ ID NO: 2050635 - DNA, 13 bp, Homo sapiens
atgtcacctcagc

SEQ ID NO: 2050636 - DNA, 17 bp, Homo sapiens
atgtcacgtcttgaaaa

SEQ ID NO: 2050637 - DNA, 14 bp, Homo sapiens
atgtcactcccaga

SEQ ID NO: 2050638 - DNA, 19 bp, Homo sapiens
atgtcagacaataccactg

SEQ ID NO: 2050639 - DNA, 14 bp, Homo sapiens
atgtcagacatgaa

SEQ ID NO: 2050640 - DNA, 16 bp, Homo sapiens
atgtcagagccaggct

SEQ ID NO: 2050641 - DNA, 19 bp, Homo sapiens
atgtcagccgagccgggcc

SEQ ID NO: 2050642 - DNA, 15 bp, Homo sapiens
atgtcaggaacagaa

SEQ ID NO: 2050643 - DNA, 17 bp, Homo sapiens
atgtcaggaacagaagg

SEQ ID NO: 2050644 - DNA, 12 bp, Homo sapiens
atgtcaggcctg

SEQ ID NO: 2050645 - DNA, 20 bp, Homo sapiens
atgtcatccccttgtgtcag

SEQ ID NO: 2050646 - DNA, 17 bp, Homo sapiens
atgtcattaaaataaat

SEQ ID NO: 2050647 - DNA, 20 bp, Homo sapiens
atgtcattaaaataaataaa

SEQ ID NO: 2050648 - DNA, 13 bp, Homo sapiens
atgtcattaaatg

SEQ ID NO: 2050649 - DNA, 17 bp, Homo sapiens
atgtcattatgtagaaa

SEQ ID NO: 2050650 - DNA, 15 bp, Homo sapiens
atgtcatttcatttc

SEQ ID NO: 2050651 - DNA, 23 bp, Homo sapiens
atgtccaagtccaacctgcctgt

SEQ ID NO: 2050652 - DNA, 12 bp, Homo sapiens
atgtccagaaga

SEQ ID NO: 2050653 - DNA, 16 bp, Homo sapiens
atgtcccatctgctcc

SEQ ID NO: 2050654 - DNA, 14 bp, Homo sapiens
atgtcccctgtccc

SEQ ID NO: 2050655 - DNA, 16 bp, Homo sapiens
atgtcccctgtcccac

SEQ ID NO: 2050656 - DNA, 21 bp, Homo sapiens
atgtcccctgtcccaccaact

SEQ ID NO: 2050657 - DNA, 24 bp, Homo sapiens
atgtccctaccgagtctcttctcc

SEQ ID NO: 2050658 - DNA, 14 bp, Homo sapiens
atgtcccttctcat

SEQ ID NO: 2050659 - DNA, 17 bp, Homo sapiens
atgtcctaaggacacac

SEQ ID NO: 2050660 - DNA, 20 bp, Homo sapiens
atgtcctaaggacacactaa

SEQ ID NO: 2050661 - DNA, 22 bp, Homo sapiens
atgtcctaggggccgagggaaa

SEQ ID NO: 2050662 - DNA, 13 bp, Homo sapiens
atgtcgcctctgc

SEQ ID NO: 2050663 - DNA, 15 bp, Homo sapiens
atgtcgcctctgcat

SEQ ID NO: 2050664 - DNA, 14 bp, Homo sapiens
atgtcgcctgcccc

SEQ ID NO: 2050665 - DNA, 20 bp, Homo sapiens
atgtcggcacgtcccatgtg

SEQ ID NO: 2050666 - DNA, 11 bp, Homo sapiens
atgtctaaaga

SEQ ID NO: 2050667 - DNA, 15 bp, Homo sapiens
atgtctatttaagcc

SEQ ID NO: 2050668 - DNA, 20 bp, Homo sapiens
atgtctcaatagtaaaagat

SEQ ID NO: 2050669 - DNA, 22 bp, Homo sapiens
atgtctcaggtccctgcagggc

SEQ ID NO: 2050670 - DNA, 16 bp, Homo sapiens
atgtctctcagaattc

SEQ ID NO: 2050671 - DNA, 15 bp, Homo sapiens
atgtctcttcctctg

SEQ ID NO: 2050672 - DNA, 13 bp, Homo sapiens
atgtctcttgtag

SEQ ID NO: 2050673 - DNA, 12 bp, Homo sapiens
atgtctgcttct

SEQ ID NO: 2050674 - DNA, 20 bp, Homo sapiens
atgtctgcttctgtccagga

SEQ ID NO: 2050675 - DNA, 21 bp, Homo sapiens
atgtctgcttctgtccaggac

SEQ ID NO: 2050676 - DNA, 14 bp, Homo sapiens
atgtctgtggattt

SEQ ID NO: 2050677 - DNA, 16 bp, Homo sapiens
atgtctgttgatgact

SEQ ID NO: 2050678 - DNA, 17 bp, Homo sapiens
atgtcttcatttcattg

SEQ ID NO: 2050679 - DNA, 22 bp, Homo sapiens
atgtcttgtacatgtgtagcct

SEQ ID NO: 2050680 - DNA, 23 bp, Homo sapiens
atgtctttgttggaaaagaatac

SEQ ID NO: 2050681 - DNA, 18 bp, Homo sapiens
atgtctttttaagcttat

SEQ ID NO: 2050682 - DNA, 17 bp, Homo sapiens
atgtgaaagtgtaaaat

SEQ ID NO: 2050683 - DNA, 14 bp, Homo sapiens
atgtgaagggtggg

SEQ ID NO: 2050684 - DNA, 21 bp, Homo sapiens
atgtgaatcagaccctacccc

SEQ ID NO: 2050685 - DNA, 19 bp, Homo sapiens
atgtgaattctgtgaagaa

SEQ ID NO: 2050686 - DNA, 23 bp, Homo sapiens
atgtgacaacctttgtgtaataa

SEQ ID NO: 2050687 - DNA, 18 bp, Homo sapiens
atgtgaccacatacgtgt

SEQ ID NO: 2050688 - DNA, 21 bp, Homo sapiens
atgtgagattactttgtcccg

SEQ ID NO: 2050689 - DNA, 12 bp, Homo sapiens
atgtgagcctga

SEQ ID NO: 2050690 - DNA, 17 bp, Homo sapiens
atgtgagtgtgtgtgat

SEQ ID NO: 2050691 - DNA, 17 bp, Homo sapiens
atgtgatcaactgttca

SEQ ID NO: 2050692 - DNA, 18 bp, Homo sapiens
atgtgatccttttatgtt

SEQ ID NO: 2050693 - DNA, 21 bp, Homo sapiens
atgtgatccttttatgttatt

SEQ ID NO: 2050694 - DNA, 14 bp, Homo sapiens
atgtgatgctggta

SEQ ID NO: 2050695 - DNA, 14 bp, Homo sapiens
atgtgcaaatgcaa

SEQ ID NO: 2050696 - DNA, 14 bp, Homo sapiens
atgtgcagtatttt

SEQ ID NO: 2050697 - DNA, 22 bp, Homo sapiens
atgtgccaggtttttggtctga

SEQ ID NO: 2050698 - DNA, 17 bp, Homo sapiens
atgtgccattttaataa

SEQ ID NO: 2050699 - DNA, 19 bp, Homo sapiens
atgtgcctaatggagaaga

SEQ ID NO: 2050700 - DNA, 11 bp, Homo sapiens
atgtgcctgga

SEQ ID NO: 2050701 - DNA, 13 bp, Homo sapiens
atgtgcctggaaa

SEQ ID NO: 2050702 - DNA, 16 bp, Homo sapiens
atgtgcgcacacacag

SEQ ID NO: 2050703 - DNA, 14 bp, Homo sapiens
attcatgtaataaa

SEQ ID NO: 2050704 - DNA, 18 bp, Homo sapiens
attcatgtaataaatctg

SEQ ID NO: 2050705 - DNA, 19 bp, Homo sapiens
attcatgtaataaatctga

SEQ ID NO: 2050706 - DNA, 14 bp, Homo sapiens
attcatttaaaatg

SEQ ID NO: 2050707 - DNA, 16 bp, Homo sapiens
attcatttaaaatgat

SEQ ID NO: 2050708 - DNA, 17 bp, Homo sapiens
attcatttaaaatgatt

SEQ ID NO: 2050709 - DNA, 15 bp, Homo sapiens
attcatttcacttta

SEQ ID NO: 2050710 - DNA, 19 bp, Homo sapiens
attcatttgagttatttta

SEQ ID NO: 2050711 - DNA, 18 bp, Homo sapiens
attcattttaacatctga

SEQ ID NO: 2050712 - DNA, 17 bp, Homo sapiens
attccaaagaacagcct

SEQ ID NO: 2050713 - DNA, 20 bp, Homo sapiens
attccaacagctcaagtctt

SEQ ID NO: 2050714 - DNA, 22 bp, Homo sapiens
attccaagggtatgggaagcca

SEQ ID NO: 2050715 - DNA, 18 bp, Homo sapiens
attccaatatgatgactc

SEQ ID NO: 2050716 - DNA, 18 bp, Homo sapiens
attccacagtctctggga

SEQ ID NO: 2050717 - DNA, 22 bp, Homo sapiens
attccacagtgcccagctaatt

SEQ ID NO: 2050718 - DNA, 16 bp, Homo sapiens
attccaccattcacat

SEQ ID NO: 2050719 - DNA, 18 bp, Homo sapiens
attccagacctgaagaat

SEQ ID NO: 2050720 - DNA, 23 bp, Homo sapiens
attccagactgcttccaattttc

SEQ ID NO: 2050721 - DNA, 21 bp, Homo sapiens
attccagagagtggctcctcc

SEQ ID NO: 2050722 - DNA, 17 bp, Homo sapiens
attccagagcactgctc

SEQ ID NO: 2050723 - DNA, 14 bp, Homo sapiens
attccatccatata

SEQ ID NO: 2050724 - DNA, 23 bp, Homo sapiens
attccatgaccagaaacagggac

SEQ ID NO: 2050725 - DNA, 12 bp, Homo sapiens
attccatgattt

SEQ ID NO: 2050726 - DNA, 14 bp, Homo sapiens
attccatgatttta

SEQ ID NO: 2050727 - DNA, 20 bp, Homo sapiens
attccatgattttacagaga

SEQ ID NO: 2050728 - DNA, 16 bp, Homo sapiens
attccatgggatgtta

SEQ ID NO: 2050729 - DNA, 17 bp, Homo sapiens
attccatgggatgttaa

SEQ ID NO: 2050730 - DNA, 16 bp, Homo sapiens
attccatttccagttc

SEQ ID NO: 2050731 - DNA, 21 bp, Homo sapiens
attcccaactagacattacca

SEQ ID NO: 2050732 - DNA, 17 bp, Homo sapiens
attcccaactgctctgc

SEQ ID NO: 2050733 - DNA, 18 bp, Homo sapiens
attcccaactgctctgcc

SEQ ID NO: 2050734 - DNA, 14 bp, Homo sapiens
attcccaagctctg

SEQ ID NO: 2050735 - DNA, 19 bp, Homo sapiens
attcccaagctctgctcct

SEQ ID NO: 2050736 - DNA, 15 bp, Homo sapiens
attcccaccaaggtc

SEQ ID NO: 2050737 - DNA, 19 bp, Homo sapiens
attcccactaagctttctc

SEQ ID NO: 2050738 - DNA, 21 bp, Homo sapiens
attcccactaagctttctcct

SEQ ID NO: 2050739 - DNA, 22 bp, Homo sapiens
attcccactaagctttctcctt

SEQ ID NO: 2050740 - DNA, 23 bp, Homo sapiens
attcccagagacaggaaaatcct

SEQ ID NO: 2050741 - DNA, 17 bp, Homo sapiens
attcccagagcaaaata

SEQ ID NO: 2050742 - DNA, 15 bp, Homo sapiens
attcccagagtcaga

SEQ ID NO: 2050743 - DNA, 15 bp, Homo sapiens
attcccatctgtcac

SEQ ID NO: 2050744 - DNA, 15 bp, Homo sapiens
attccccatcttcca

SEQ ID NO: 2050745 - DNA, 13 bp, Homo sapiens
attcccccacttg

SEQ ID NO: 2050746 - DNA, 17 bp, Homo sapiens
attccctatcaaaacat

SEQ ID NO: 2050747 - DNA, 20 bp, Homo sapiens
attccctatcaaaacatatc

SEQ ID NO: 2050748 - DNA, 14 bp, Homo sapiens
attccctctcccag

SEQ ID NO: 2050749 - DNA, 20 bp, Homo sapiens
attccctgcatccaatctgc

SEQ ID NO: 2050750 - DNA, 12 bp, Homo sapiens
attccctggcct

SEQ ID NO: 2050751 - DNA, 19 bp, Homo sapiens
attcccttttatttccaaa

SEQ ID NO: 2050752 - DNA, 22 bp, Homo sapiens
attccgaagagggaatggatgg

SEQ ID NO: 2050753 - DNA, 14 bp, Homo sapiens
attcctaagcagtg

SEQ ID NO: 2050754 - DNA, 19 bp, Homo sapiens
attcctaagcagtgcttgt

SEQ ID NO: 2050755 - DNA, 19 bp, Homo sapiens
attcctaaggtaatcctat

SEQ ID NO: 2050756 - DNA, 16 bp, Homo sapiens
attcctagagagcaga

SEQ ID NO: 2050757 - DNA, 17 bp, Homo sapiens
attcctcagctgccaag

SEQ ID NO: 2050758 - DNA, 13 bp, Homo sapiens
attcctctctcag

SEQ ID NO: 2050759 - DNA, 12 bp, Homo sapiens
attcctctggga

SEQ ID NO: 2050760 - DNA, 19 bp, Homo sapiens
attcctcttgcctctctca

SEQ ID NO: 2050761 - DNA, 20 bp, Homo sapiens
attcctcttgcctctctcag

SEQ ID NO: 2050762 - DNA, 14 bp, Homo sapiens
attcctgaagccag

SEQ ID NO: 2050763 - DNA, 17 bp, Homo sapiens
attcctgaccctcccta

SEQ ID NO: 2050764 - DNA, 15 bp, Homo sapiens
attcctgggcaagaa

SEQ ID NO: 2050765 - DNA, 16 bp, Homo sapiens
attcctgggcctgtcc

SEQ ID NO: 2050766 - DNA, 22 bp, Homo sapiens
attccttagcttagacctcagc

SEQ ID NO: 2050767 - DNA, 24 bp, Homo sapiens
attccttagcttagacctcagcct

SEQ ID NO: 2050768 - DNA, 14 bp, Homo sapiens
attccttcactcat

SEQ ID NO: 2050769 - DNA, 12 bp, Homo sapiens
attccttcccac

SEQ ID NO: 2050770 - DNA, 12 bp, Homo sapiens
attccttctgga

SEQ ID NO: 2050771 - DNA, 18 bp, Homo sapiens
attccttttgatggggag

SEQ ID NO: 2050772 - DNA, 13 bp, Homo sapiens
attcggaccctgc

SEQ ID NO: 2050773 - DNA, 21 bp, Homo sapiens
attcggaccctgcccataccc

SEQ ID NO: 2050774 - DNA, 17 bp, Homo sapiens
attctaaatgaatgttt

SEQ ID NO: 2050775 - DNA, 18 bp, Homo sapiens
attctaaatgaatgttta

SEQ ID NO: 2050776 - DNA, 15 bp, Homo sapiens
attctaaatgctggt

SEQ ID NO: 2050777 - DNA, 17 bp, Homo sapiens
attctaagattgtacat

SEQ ID NO: 2050778 - DNA, 23 bp, Homo sapiens
attctaagattgtacatatggaa

SEQ ID NO: 2050779 - DNA, 12 bp, Homo sapiens
attctaatgtct

SEQ ID NO: 2050780 - DNA, 19 bp, Homo sapiens
attctacacatatatgtat

SEQ ID NO: 2050781 - DNA, 20 bp, Homo sapiens
attctacacatatatgtata

SEQ ID NO: 2050782 - DNA, 14 bp, Homo sapiens
attctactaaatat

SEQ ID NO: 2050783 - DNA, 16 bp, Homo sapiens
attctactaaatattt

SEQ ID NO: 2050784 - DNA, 16 bp, Homo sapiens
attctagccaaactat

SEQ ID NO: 2050785 - DNA, 20 bp, Homo sapiens
attctaggcatcccagggga

SEQ ID NO: 2050786 - DNA, 19 bp, Homo sapiens
attctagtgtaacactgca

SEQ ID NO: 2050787 - DNA, 21 bp, Homo sapiens
attctatccacatccctaaca

SEQ ID NO: 2050788 - DNA, 14 bp, Homo sapiens
attctattcaaaag

SEQ ID NO: 2050789 - DNA, 14 bp, Homo sapiens
attctcaccaggaa

SEQ ID NO: 2050790 - DNA, 15 bp, Homo sapiens
attctcactccacca

SEQ ID NO: 2050791 - DNA, 19 bp, Homo sapiens
attctcatatgtagccctc

SEQ ID NO: 2050792 - DNA, 15 bp, Homo sapiens
attctcatgtctcag

SEQ ID NO: 2050793 - DNA, 12 bp, Homo sapiens
attctcatgtga

SEQ ID NO: 2050794 - DNA, 15 bp, Homo sapiens
attctccaaatgatt

SEQ ID NO: 2050795 - DNA, 16 bp, Homo sapiens
attctccaaatgattt

SEQ ID NO: 2050796 - DNA, 11 bp, Homo sapiens
attctcctgcc

SEQ ID NO: 2050797 - DNA, 14 bp, Homo sapiens
attctcctgcctca

SEQ ID NO: 2050798 - DNA, 20 bp, Homo sapiens
attctcctgcctcagcctcc

SEQ ID NO: 2050799 - DNA, 22 bp, Homo sapiens
attctcctgcctgtagcagtga

SEQ ID NO: 2050800 - DNA, 16 bp, Homo sapiens
attctcctgtgcccct

SEQ ID NO: 2050801 - DNA, 14 bp, Homo sapiens
attctcctgtgcta

SEQ ID NO: 2050802 - DNA, 17 bp, Homo sapiens
attctcgggaaattatt

SEQ ID NO: 2050803 - DNA, 16 bp, Homo sapiens
attctcggggccctgt

SEQ ID NO: 2050804 - DNA, 12 bp, Homo sapiens
attctctctcct

SEQ ID NO: 2050805 - DNA, 13 bp, Homo sapiens
attctcttaccca

SEQ ID NO: 2050806 - DNA, 14 bp, Homo sapiens
attctcttcactcc

SEQ ID NO: 2050807 - DNA, 14 bp, Homo sapiens
attctgacttcctc

SEQ ID NO: 2050808 - DNA, 14 bp, Homo sapiens
attctgagccttga

SEQ ID NO: 2050809 - DNA, 13 bp, Homo sapiens
attctgattccac

SEQ ID NO: 2050810 - DNA, 21 bp, Homo sapiens
attctgattcgaatgacactg

SEQ ID NO: 2050811 - DNA, 15 bp, Homo sapiens
attctgcctgcccag

SEQ ID NO: 2050812 - DNA, 19 bp, Homo sapiens
attctgcctgcccaggccc

SEQ ID NO: 2050813 - DNA, 21 bp, Homo sapiens
attctgcctgcccaggcccct

SEQ ID NO: 2050814 - DNA, 21 bp, Homo sapiens
attctgctcacatatctgtca

SEQ ID NO: 2050815 - DNA, 22 bp, Homo sapiens
attctgctcacatatctgtcat

SEQ ID NO: 2050816 - DNA, 20 bp, Homo sapiens
attctgcttctagtattttt

SEQ ID NO: 2050817 - DNA, 15 bp, Homo sapiens
attctggaggaagaa

SEQ ID NO: 2050818 - DNA, 13 bp, Homo sapiens
atttatatatttg

SEQ ID NO: 2050819 - DNA, 14 bp, Homo sapiens
atttatattagagt

SEQ ID NO: 2050820 - DNA, 15 bp, Homo sapiens
atttatattcagaga

SEQ ID NO: 2050821 - DNA, 15 bp, Homo sapiens
atttatattgtaaat

SEQ ID NO: 2050822 - DNA, 18 bp, Homo sapiens
atttatattgtaaatatt

SEQ ID NO: 2050823 - DNA, 18 bp, Homo sapiens
atttatattgtatattct

SEQ ID NO: 2050824 - DNA, 22 bp, Homo sapiens
atttatattgtatattctggaa

SEQ ID NO: 2050825 - DNA, 18 bp, Homo sapiens
atttatatttggaaagag

SEQ ID NO: 2050826 - DNA, 17 bp, Homo sapiens
atttatcaccagcatat

SEQ ID NO: 2050827 - DNA, 15 bp, Homo sapiens
atttatcagtgacag

SEQ ID NO: 2050828 - DNA, 21 bp, Homo sapiens
atttatcctgaaatttcagat

SEQ ID NO: 2050829 - DNA, 14 bp, Homo sapiens
atttatctctattt

SEQ ID NO: 2050830 - DNA, 19 bp, Homo sapiens
atttatctctatttaatat

SEQ ID NO: 2050831 - DNA, 20 bp, Homo sapiens
atttatctgtattttttaca

SEQ ID NO: 2050832 - DNA, 13 bp, Homo sapiens
atttatgaaaaga

SEQ ID NO: 2050833 - DNA, 18 bp, Homo sapiens
atttatgagtttttgata

SEQ ID NO: 2050834 - DNA, 20 bp, Homo sapiens
atttatgcctctgtatttaa

SEQ ID NO: 2050835 - DNA, 20 bp, Homo sapiens
atttatgcttaaaatatgta

SEQ ID NO: 2050836 - DNA, 17 bp, Homo sapiens
atttatggcttataaat

SEQ ID NO: 2050837 - DNA, 21 bp, Homo sapiens
atttatggcttataaatgtgt

SEQ ID NO: 2050838 - DNA, 21 bp, Homo sapiens
atttattaaaatgattgtaaa

SEQ ID NO: 2050839 - DNA, 16 bp, Homo sapiens
atttattaagtctggg

SEQ ID NO: 2050840 - DNA, 14 bp, Homo sapiens
atttattacctctg

SEQ ID NO: 2050841 - DNA, 23 bp, Homo sapiens
atttattagttaggtgtgccaaa

SEQ ID NO: 2050842 - DNA, 14 bp, Homo sapiens
atttattcactgta

SEQ ID NO: 2050843 - DNA, 16 bp, Homo sapiens
atttattcactgtaag

SEQ ID NO: 2050844 - DNA, 20 bp, Homo sapiens
atttattcactgtaagttta

SEQ ID NO: 2050845 - DNA, 13 bp, Homo sapiens
atttattcattca

SEQ ID NO: 2050846 - DNA, 19 bp, Homo sapiens
atttattgcttgatacttt

SEQ ID NO: 2050847 - DNA, 13 bp, Homo sapiens
atttattggggtg

SEQ ID NO: 2050848 - DNA, 17 bp, Homo sapiens
atttattgtcattactg

SEQ ID NO: 2050849 - DNA, 19 bp, Homo sapiens
atttattgtttatttatca

SEQ ID NO: 2050850 - DNA, 21 bp, Homo sapiens
atttattgtttatttatcagt

SEQ ID NO: 2050851 - DNA, 14 bp, Homo sapiens
atttatttaaaata

SEQ ID NO: 2050852 - DNA, 16 bp, Homo sapiens
atttatttaataacaa

SEQ ID NO: 2050853 - DNA, 12 bp, Homo sapiens
atttatttctgt

SEQ ID NO: 2050854 - DNA, 14 bp, Homo sapiens
atttattttgacat

SEQ ID NO: 2050855 - DNA, 19 bp, Homo sapiens
atttattttgtatttttga

SEQ ID NO: 2050856 - DNA, 15 bp, Homo sapiens
atttattttgtttaa

SEQ ID NO: 2050857 - DNA, 19 bp, Homo sapiens
atttattttttaatcattt

SEQ ID NO: 2050858 - DNA, 14 bp, Homo sapiens
atttcaaaagacat

SEQ ID NO: 2050859 - DNA, 12 bp, Homo sapiens
atttcaaaataa

SEQ ID NO: 2050860 - DNA, 15 bp, Homo sapiens
atttcaacaagaata

SEQ ID NO: 2050861 - DNA, 15 bp, Homo sapiens
atttcaactccagaa

SEQ ID NO: 2050862 - DNA, 19 bp, Homo sapiens
atttcacaacagcctgaca

SEQ ID NO: 2050863 - DNA, 22 bp, Homo sapiens
atttcacattaatatttgctga

SEQ ID NO: 2050864 - DNA, 15 bp, Homo sapiens
atttcagaggctgca

SEQ ID NO: 2050865 - DNA, 22 bp, Homo sapiens
atttcaggatactctgtcagat

SEQ ID NO: 2050866 - DNA, 16 bp, Homo sapiens
atttcaggcattttgt

SEQ ID NO: 2050867 - DNA, 19 bp, Homo sapiens
atttcaggcattttgttct

SEQ ID NO: 2050868 - DNA, 19 bp, Homo sapiens
atttcaggggtcgtcacca

SEQ ID NO: 2050869 - DNA, 20 bp, Homo sapiens
atttcataaggcctgccctc

SEQ ID NO: 2050870 - DNA, 18 bp, Homo sapiens
atttcatacaaaactgtt

SEQ ID NO: 2050871 - DNA, 18 bp, Homo sapiens
atttcatccctatttata

SEQ ID NO: 2050872 - DNA, 15 bp, Homo sapiens
atttcatctcattta

SEQ ID NO: 2050873 - DNA, 23 bp, Homo sapiens
atttcatctcatttaagggaaaa

SEQ ID NO: 2050874 - DNA, 22 bp, Homo sapiens
atttcatctgctgctgaaactg

SEQ ID NO: 2050875 - DNA, 15 bp, Homo sapiens
atttcatgatttcat

SEQ ID NO: 2050876 - DNA, 18 bp, Homo sapiens
atttcatgctatctctgt

SEQ ID NO: 2050877 - DNA, 15 bp, Homo sapiens
atttcattgactgaa

SEQ ID NO: 2050878 - DNA, 21 bp, Homo sapiens
atttcattgtatgatgtgttg

SEQ ID NO: 2050879 - DNA, 23 bp, Homo sapiens
atttcattttgtaacaaatgaac

SEQ ID NO: 2050880 - DNA, 20 bp, Homo sapiens
atttccaaaataaaatgaaa

SEQ ID NO: 2050881 - DNA, 16 bp, Homo sapiens
atttccaaagagaaaa

SEQ ID NO: 2050882 - DNA, 18 bp, Homo sapiens
atttccaaataaaatgag

SEQ ID NO: 2050883 - DNA, 17 bp, Homo sapiens
atttccaaatgaatgac

SEQ ID NO: 2050884 - DNA, 15 bp, Homo sapiens
atttccacataaagg

SEQ ID NO: 2050885 - DNA, 17 bp, Homo sapiens
atttccacataaaggta

SEQ ID NO: 2050886 - DNA, 18 bp, Homo sapiens
atttccaggcccctgagg

SEQ ID NO: 2050887 - DNA, 18 bp, Homo sapiens
atttcccctctgtgtcct

SEQ ID NO: 2050888 - DNA, 15 bp, Homo sapiens
atttccctcccggga

SEQ ID NO: 2050889 - DNA, 18 bp, Homo sapiens
atttccctgactcctcta

SEQ ID NO: 2050890 - DNA, 23 bp, Homo sapiens
atttccgaagaccttctgaagat

SEQ ID NO: 2050891 - DNA, 14 bp, Homo sapiens
atttccgggtggaa

SEQ ID NO: 2050892 - DNA, 16 bp, Homo sapiens
atttcctattttaaaa

SEQ ID NO: 2050893 - DNA, 18 bp, Homo sapiens
atttcctattttaaaacc

SEQ ID NO: 2050894 - DNA, 14 bp, Homo sapiens
atttcctccatggt

SEQ ID NO: 2050895 - DNA, 16 bp, Homo sapiens
atttcctccatggtgg

SEQ ID NO: 2050896 - DNA, 23 bp, Homo sapiens
atttcctgctacacaaaagccaa

SEQ ID NO: 2050897 - DNA, 22 bp, Homo sapiens
atttcctgtataatttaacagt

SEQ ID NO: 2050898 - DNA, 11 bp, Homo sapiens
atttccttgga

SEQ ID NO: 2050899 - DNA, 19 bp, Homo sapiens
atttccttttttgttatta

SEQ ID NO: 2050900 - DNA, 17 bp, Homo sapiens
atttctaaaatataaga

SEQ ID NO: 2050901 - DNA, 20 bp, Homo sapiens
atttctaacatatgtattaa

SEQ ID NO: 2050902 - DNA, 21 bp, Homo sapiens
atttctacatagtaactctta

SEQ ID NO: 2050903 - DNA, 17 bp, Homo sapiens
atttctaccatttcaga

SEQ ID NO: 2050904 - DNA, 18 bp, Homo sapiens
atttctaccatttcagag

SEQ ID NO: 2050905 - DNA, 16 bp, Homo sapiens
atttctactgtgactg

SEQ ID NO: 2050906 - DNA, 23 bp, Homo sapiens
atttctatagccaaaaatagcta

SEQ ID NO: 2050907 - DNA, 12 bp, Homo sapiens
atttctatttat

SEQ ID NO: 2050908 - DNA, 12 bp, Homo sapiens
atttctattttt

SEQ ID NO: 2050909 - DNA, 19 bp, Homo sapiens
atttctcaacaaagcacag

SEQ ID NO: 2050910 - DNA, 13 bp, Homo sapiens
atttctcctactt

SEQ ID NO: 2050911 - DNA, 23 bp, Homo sapiens
atttctctctttcttggtgtctg

SEQ ID NO: 2050912 - DNA, 18 bp, Homo sapiens
atttctctgaacagaaaa

SEQ ID NO: 2050913 - DNA, 13 bp, Homo sapiens
atttctgaaatga

SEQ ID NO: 2050914 - DNA, 20 bp, Homo sapiens
atttctgaaatgacctcaag

SEQ ID NO: 2050915 - DNA, 11 bp, Homo sapiens
atttctgagaa

SEQ ID NO: 2050916 - DNA, 23 bp, Homo sapiens
atttctgagtttcattctcctgc

SEQ ID NO: 2050917 - DNA, 15 bp, Homo sapiens
atttctgctcttcca

SEQ ID NO: 2050918 - DNA, 19 bp, Homo sapiens
atttctgtaaaatttgttt

SEQ ID NO: 2050919 - DNA, 20 bp, Homo sapiens
atttctgtgtattttgagat

SEQ ID NO: 2050920 - DNA, 21 bp, Homo sapiens
atttctgtgtattttgagata

SEQ ID NO: 2050921 - DNA, 15 bp, Homo sapiens
atttcttaaaatgtt

SEQ ID NO: 2050922 - DNA, 20 bp, Homo sapiens
atttcttactaaacattttg

SEQ ID NO: 2050923 - DNA, 11 bp, Homo sapiens
atttcttatag

SEQ ID NO: 2050924 - DNA, 14 bp, Homo sapiens
atttcttatgattt

SEQ ID NO: 2050925 - DNA, 24 bp, Homo sapiens
atttcttatttgtttggtcactgc

SEQ ID NO: 2050926 - DNA, 16 bp, Homo sapiens
atttcttcctcactat

SEQ ID NO: 2050927 - DNA, 22 bp, Homo sapiens
atttcttgacttcacagcagcc

SEQ ID NO: 2050928 - DNA, 20 bp, Homo sapiens
atttcttggtaagaagccgg

SEQ ID NO: 2050929 - DNA, 17 bp, Homo sapiens
atttctttgtgataaca

SEQ ID NO: 2050930 - DNA, 16 bp, Homo sapiens
atttcttttaaagaag

SEQ ID NO: 2050931 - DNA, 14 bp, Homo sapiens
atttcttttccaaa

SEQ ID NO: 2050932 - DNA, 22 bp, Homo sapiens
atttcttttttaaatgaagaaa

SEQ ID NO: 2050933 - DNA, 17 bp, Homo sapiens
caaagcaaaagaagtaa

SEQ ID NO: 2050934 - DNA, 19 bp, Homo sapiens
caaagcaagggctccagca

SEQ ID NO: 2050935 - DNA, 13 bp, Homo sapiens
caaagcacagtgt

SEQ ID NO: 2050936 - DNA, 15 bp, Homo sapiens
caaagcacagtgtta

SEQ ID NO: 2050937 - DNA, 22 bp, Homo sapiens
caaagcacagtgttaaatgaaa

SEQ ID NO: 2050938 - DNA, 12 bp, Homo sapiens
caaagcaccagc

SEQ ID NO: 2050939 - DNA, 20 bp, Homo sapiens
caaagcacgaaatgttattt

SEQ ID NO: 2050940 - DNA, 22 bp, Homo sapiens
caaagcacgaaatgttattttt

SEQ ID NO: 2050941 - DNA, 16 bp, Homo sapiens
caaagcatgaaatgga

SEQ ID NO: 2050942 - DNA, 20 bp, Homo sapiens
caaagccaaagctaggcctg

SEQ ID NO: 2050943 - DNA, 22 bp, Homo sapiens
caaagccaaagctaggcctggc

SEQ ID NO: 2050944 - DNA, 21 bp, Homo sapiens
caaagcctgttcatggcagat

SEQ ID NO: 2050945 - DNA, 13 bp, Homo sapiens
caaagctaggcct

SEQ ID NO: 2050946 - DNA, 15 bp, Homo sapiens
caaagctaggcctgg

SEQ ID NO: 2050947 - DNA, 17 bp, Homo sapiens
caaagctaggcctggcc

SEQ ID NO: 2050948 - DNA, 18 bp, Homo sapiens
caaagctaggcctggcca

SEQ ID NO: 2050949 - DNA, 19 bp, Homo sapiens
caaagcttctatcccagga

SEQ ID NO: 2050950 - DNA, 19 bp, Homo sapiens
caaagcttgaagatcgtta

SEQ ID NO: 2050951 - DNA, 19 bp, Homo sapiens
caaaggacattatgtgtgc

SEQ ID NO: 2050952 - DNA, 11 bp, Homo sapiens
caaaggagcct

SEQ ID NO: 2050953 - DNA, 16 bp, Homo sapiens
caaaggagcctgtgaa

SEQ ID NO: 2050954 - DNA, 16 bp, Homo sapiens
caaaggccagcagcag

SEQ ID NO: 2050955 - DNA, 16 bp, Homo sapiens
caaagggcagtaaagt

SEQ ID NO: 2050956 - DNA, 18 bp, Homo sapiens
caaagggctgaaagccat

SEQ ID NO: 2050957 - DNA, 22 bp, Homo sapiens
caaaggggaggcatcagtgtcc

SEQ ID NO: 2050958 - DNA, 14 bp, Homo sapiens
caaaggggctgctg

SEQ ID NO: 2050959 - DNA, 17 bp, Homo sapiens
caaaggggctgctgggg

SEQ ID NO: 2050960 - DNA, 18 bp, Homo sapiens
caaagggtatcaggtgct

SEQ ID NO: 2050961 - DNA, 19 bp, Homo sapiens
caaagggtatcaggtgctg

SEQ ID NO: 2050962 - DNA, 21 bp, Homo sapiens
caaagggtatcaggtgctgcc

SEQ ID NO: 2050963 - DNA, 13 bp, Homo sapiens
caaaggtcttttt

SEQ ID NO: 2050964 - DNA, 13 bp, Homo sapiens
caaaggtggctct

SEQ ID NO: 2050965 - DNA, 17 bp, Homo sapiens
caaaggtgtgcaaactt

SEQ ID NO: 2050966 - DNA, 15 bp, Homo sapiens
caaaggttgagatgt

SEQ ID NO: 2050967 - DNA, 21 bp, Homo sapiens
caaagtaaaaaattaaagccc

SEQ ID NO: 2050968 - DNA, 18 bp, Homo sapiens
caaagtaaaacttgctgc

SEQ ID NO: 2050969 - DNA, 14 bp, Homo sapiens
caaagtagagaagt

SEQ ID NO: 2050970 - DNA, 16 bp, Homo sapiens
caaagtagagaagtat

SEQ ID NO: 2050971 - DNA, 13 bp, Homo sapiens
caaagtctaaagt

SEQ ID NO: 2050972 - DNA, 16 bp, Homo sapiens
caaagtgcagcccttc

SEQ ID NO: 2050973 - DNA, 19 bp, Homo sapiens
caaagtgcagcccttcctc

SEQ ID NO: 2050974 - DNA, 21 bp, Homo sapiens
caaagtgcagcccttcctcct

SEQ ID NO: 2050975 - DNA, 22 bp, Homo sapiens
caaagtgcagcccttcctcctg

SEQ ID NO: 2050976 - DNA, 23 bp, Homo sapiens
caaagtgctgggattacaagcgt

SEQ ID NO: 2050977 - DNA, 23 bp, Homo sapiens
caaagtgctgggattacaggtgt

SEQ ID NO: 2050978 - DNA, 14 bp, Homo sapiens
caaagttatattta

SEQ ID NO: 2050979 - DNA, 13 bp, Homo sapiens
caaagttatccag

SEQ ID NO: 2050980 - DNA, 17 bp, Homo sapiens
caaagttggggcaggct

SEQ ID NO: 2050981 - DNA, 13 bp, Homo sapiens
caaagtttaataa

SEQ ID NO: 2050982 - DNA, 20 bp, Homo sapiens
caaagtttaataaatttatt

SEQ ID NO: 2050983 - DNA, 15 bp, Homo sapiens
caaagtttgtggcat

SEQ ID NO: 2050984 - DNA, 13 bp, Homo sapiens
caaataaatgtgt

SEQ ID NO: 2050985 - DNA, 17 bp, Homo sapiens
caaataaatgtgtaaat

SEQ ID NO: 2050986 - DNA, 19 bp, Homo sapiens
caaataaatgtgtaaatgt

SEQ ID NO: 2050987 - DNA, 23 bp, Homo sapiens
caaatactcattttaggaaaaaa

SEQ ID NO: 2050988 - DNA, 18 bp, Homo sapiens
caaatactccaagcttca

SEQ ID NO: 2050989 - DNA, 15 bp, Homo sapiens
caaatagcataagtt

SEQ ID NO: 2050990 - DNA, 13 bp, Homo sapiens
caaatataaactt

SEQ ID NO: 2050991 - DNA, 19 bp, Homo sapiens
caaatatagcgttcccaac

SEQ ID NO: 2050992 - DNA, 14 bp, Homo sapiens
caaatatatttaat

SEQ ID NO: 2050993 - DNA, 21 bp, Homo sapiens
caaatatatttaattgtgtca

SEQ ID NO: 2050994 - DNA, 15 bp, Homo sapiens
caaatatctcagagg

SEQ ID NO: 2050995 - DNA, 17 bp, Homo sapiens
caaatatgcaaagcact

SEQ ID NO: 2050996 - DNA, 17 bp, Homo sapiens
caaatattagcaaagaa

SEQ ID NO: 2050997 - DNA, 21 bp, Homo sapiens
caaatattagcaaagaagctt

SEQ ID NO: 2050998 - DNA, 23 bp, Homo sapiens
caaatattattcaagtgcctctt

SEQ ID NO: 2050999 - DNA, 16 bp, Homo sapiens
caaatatttattttct

SEQ ID NO: 2051000 - DNA, 22 bp, Homo sapiens
caaatcaaagcaagggctccag

SEQ ID NO: 2051001 - DNA, 18 bp, Homo sapiens
caaatcacacctctgggc

SEQ ID NO: 2051002 - DNA, 21 bp, Homo sapiens
caaatcagtcctttgattcca

SEQ ID NO: 2051003 - DNA, 16 bp, Homo sapiens
caaatctaatgtaaga

SEQ ID NO: 2051004 - DNA, 14 bp, Homo sapiens
caaatctattcaga

SEQ ID NO: 2051005 - DNA, 22 bp, Homo sapiens
caaatctattcagacaagcaac

SEQ ID NO: 2051006 - DNA, 20 bp, Homo sapiens
caaatcttcaaggtgtaaaa

SEQ ID NO: 2051007 - DNA, 22 bp, Homo sapiens
caaatcttggttgatgccaaaa

SEQ ID NO: 2051008 - DNA, 22 bp, Homo sapiens
caaatgaatgttgtctgtttgt

SEQ ID NO: 2051009 - DNA, 10 bp, Homo sapiens
caaatgacat

SEQ ID NO: 2051010 - DNA, 20 bp, Homo sapiens
caaatgagatctaagccttt

SEQ ID NO: 2051011 - DNA, 16 bp, Homo sapiens
caaatgagcattagct

SEQ ID NO: 2051012 - DNA, 20 bp, Homo sapiens
caaatgagcattagctactt

SEQ ID NO: 2051013 - DNA, 16 bp, Homo sapiens
caaatgcacaagctca

SEQ ID NO: 2051014 - DNA, 18 bp, Homo sapiens
caaatgcacaagctcaga

SEQ ID NO: 2051015 - DNA, 17 bp, Homo sapiens
caaatgcgcgtgtgcac

SEQ ID NO: 2051016 - DNA, 13 bp, Homo sapiens
caaatgctgtctc

SEQ ID NO: 2051017 - DNA, 22 bp, Homo sapiens
caaatggcagcagttccatgaa

SEQ ID NO: 2051018 - DNA, 22 bp, Homo sapiens
caaatgtagtatggcctgtgtc

SEQ ID NO: 2051019 - DNA, 15 bp, Homo sapiens
caaatgtcagagcta

SEQ ID NO: 2051020 - DNA, 20 bp, Homo sapiens
caaatgtcagcttaaaattg

SEQ ID NO: 2051021 - DNA, 16 bp, Homo sapiens
caaatgtgatcaactg

SEQ ID NO: 2051022 - DNA, 15 bp, Homo sapiens
caaattaatctttct

SEQ ID NO: 2051023 - DNA, 19 bp, Homo sapiens
caaattactctttctccat

SEQ ID NO: 2051024 - DNA, 12 bp, Homo sapiens
caaattagaaac

SEQ ID NO: 2051025 - DNA, 23 bp, Homo sapiens
caaattagaaacaccattcatct

SEQ ID NO: 2051026 - DNA, 18 bp, Homo sapiens
caaattaggttttgtaca

SEQ ID NO: 2051027 - DNA, 21 bp, Homo sapiens
caaattaggttttgtacaatt

SEQ ID NO: 2051028 - DNA, 12 bp, Homo sapiens
caaattatttgt

SEQ ID NO: 2051029 - DNA, 14 bp, Homo sapiens
caaattcatttttt

SEQ ID NO: 2051030 - DNA, 19 bp, Homo sapiens
caaattccctggacctctg

SEQ ID NO: 2051031 - DNA, 15 bp, Homo sapiens
caaattctcaccaaa

SEQ ID NO: 2051032 - DNA, 23 bp, Homo sapiens
caaattgcttctaggagtcaact

SEQ ID NO: 2051033 - DNA, 11 bp, Homo sapiens
caaatttcaca

SEQ ID NO: 2051034 - DNA, 20 bp, Homo sapiens
caaattttgcatttagtttt

SEQ ID NO: 2051035 - DNA, 23 bp, Homo sapiens
caacaaagcgagatcccatctct

SEQ ID NO: 2051036 - DNA, 13 bp, Homo sapiens
caacaacaacaat

SEQ ID NO: 2051037 - DNA, 13 bp, Homo sapiens
caacaacatccat

SEQ ID NO: 2051038 - DNA, 22 bp, Homo sapiens
caacaacatgtataatattttt

SEQ ID NO: 2051039 - DNA, 19 bp, Homo sapiens
caacaactccaggaaaact

SEQ ID NO: 2051040 - DNA, 11 bp, Homo sapiens
caacaagaaca

SEQ ID NO: 2051041 - DNA, 17 bp, Homo sapiens
caacaagagcaaaatga

SEQ ID NO: 2051042 - DNA, 14 bp, Homo sapiens
caacaagagcgaaa

SEQ ID NO: 2051043 - DNA, 15 bp, Homo sapiens
caacaagagtttatt

SEQ ID NO: 2051044 - DNA, 12 bp, Homo sapiens
caacaaggaccc

SEQ ID NO: 2051045 - DNA, 20 bp, Homo sapiens
caacaaggaccctgttttcc

SEQ ID NO: 2051046 - DNA, 14 bp, Homo sapiens
caacaataaaacat

SEQ ID NO: 2051047 - DNA, 16 bp, Homo sapiens
caacaataaagagctc

SEQ ID NO: 2051048 - DNA, 23 bp, Homo sapiens
caatgaaatacacaagtaaacat

SEQ ID NO: 2051049 - DNA, 22 bp, Homo sapiens
caatgaaatatttgcttattta

SEQ ID NO: 2051050 - DNA, 23 bp, Homo sapiens
caatgaaatatttgcttatttat

SEQ ID NO: 2051051 - DNA, 21 bp, Homo sapiens
caatgaaatgctctcctttcc

SEQ ID NO: 2051052 - DNA, 20 bp, Homo sapiens
caatgacagggatgccaaca

SEQ ID NO: 2051053 - DNA, 16 bp, Homo sapiens
caatgagctgtatctg

SEQ ID NO: 2051054 - DNA, 19 bp, Homo sapiens
caatgagctgtatctgtaa

SEQ ID NO: 2051055 - DNA, 19 bp, Homo sapiens
caatgaggtctgaaatgga

SEQ ID NO: 2051056 - DNA, 20 bp, Homo sapiens
caatgatgattaaacacctg

SEQ ID NO: 2051057 - DNA, 21 bp, Homo sapiens
caatgatgattaaacacctga

SEQ ID NO: 2051058 - DNA, 16 bp, Homo sapiens
caatgatggcaatttt

SEQ ID NO: 2051059 - DNA, 24 bp, Homo sapiens
caatgatggcaattttgtaacgaa

SEQ ID NO: 2051060 - DNA, 13 bp, Homo sapiens
caatgattatttt

SEQ ID NO: 2051061 - DNA, 16 bp, Homo sapiens
caatgcacacacacag

SEQ ID NO: 2051062 - DNA, 17 bp, Homo sapiens
caatgcacctaaagaaa

SEQ ID NO: 2051063 - DNA, 20 bp, Homo sapiens
caatgcattgtcttgtggag

SEQ ID NO: 2051064 - DNA, 16 bp, Homo sapiens
caatgcattttcaaga

SEQ ID NO: 2051065 - DNA, 14 bp, Homo sapiens
caatgccaagataa

SEQ ID NO: 2051066 - DNA, 20 bp, Homo sapiens
caatgcccgtaatgcttaga

SEQ ID NO: 2051067 - DNA, 14 bp, Homo sapiens
caatgccctgccat

SEQ ID NO: 2051068 - DNA, 14 bp, Homo sapiens
caatgcctctccca

SEQ ID NO: 2051069 - DNA, 17 bp, Homo sapiens
caatgccttgacaacag

SEQ ID NO: 2051070 - DNA, 12 bp, Homo sapiens
caatgccttggg

SEQ ID NO: 2051071 - DNA, 22 bp, Homo sapiens
caatgctttgggaggccaaggc

SEQ ID NO: 2051072 - DNA, 22 bp, Homo sapiens
caatgcttttctagcaactgtt

SEQ ID NO: 2051073 - DNA, 11 bp, Homo sapiens
caatggcagcc

SEQ ID NO: 2051074 - DNA, 16 bp, Homo sapiens
caatggcagccttggc

SEQ ID NO: 2051075 - DNA, 23 bp, Homo sapiens
caatggcagctagactggagtga

SEQ ID NO: 2051076 - DNA, 23 bp, Homo sapiens
caatggctaattcccagagtgtg

SEQ ID NO: 2051077 - DNA, 22 bp, Homo sapiens
caatggctatatggcaagaaag

SEQ ID NO: 2051078 - DNA, 21 bp, Homo sapiens
caatgggagggggctccatgg

SEQ ID NO: 2051079 - DNA, 12 bp, Homo sapiens
caatggggagag

SEQ ID NO: 2051080 - DNA, 13 bp, Homo sapiens
caatggggagagg

SEQ ID NO: 2051081 - DNA, 14 bp, Homo sapiens
caatggggagaggc

SEQ ID NO: 2051082 - DNA, 17 bp, Homo sapiens
caatgggtaaccattaa

SEQ ID NO: 2051083 - DNA, 22 bp, Homo sapiens
caatggtgttcaccatcggcag

SEQ ID NO: 2051084 - DNA, 17 bp, Homo sapiens
caatggtgttgccctga

SEQ ID NO: 2051085 - DNA, 20 bp, Homo sapiens
caatggtttgcaaggaagcc

SEQ ID NO: 2051086 - DNA, 14 bp, Homo sapiens
caatgtaaatattt

SEQ ID NO: 2051087 - DNA, 17 bp, Homo sapiens
caatgtacccaccgggc

SEQ ID NO: 2051088 - DNA, 23 bp, Homo sapiens
caatgtatgtgaaagtgtaaaat

SEQ ID NO: 2051089 - DNA, 14 bp, Homo sapiens
caatgtcacttaaa

SEQ ID NO: 2051090 - DNA, 21 bp, Homo sapiens
caatgtcaggaacagaaggat

SEQ ID NO: 2051091 - DNA, 11 bp, Homo sapiens
caatgtgaaaa

SEQ ID NO: 2051092 - DNA, 18 bp, Homo sapiens
caatgtgaaaaatgtgtc

SEQ ID NO: 2051093 - DNA, 14 bp, Homo sapiens
caatgtgaatcaga

SEQ ID NO: 2051094 - DNA, 19 bp, Homo sapiens
caatgtgaatcagacccta

SEQ ID NO: 2051095 - DNA, 13 bp, Homo sapiens
caatgtgaccagg

SEQ ID NO: 2051096 - DNA, 17 bp, Homo sapiens
caatgtgaccaggggtg

SEQ ID NO: 2051097 - DNA, 15 bp, Homo sapiens
caatgtgattctaat

SEQ ID NO: 2051098 - DNA, 21 bp, Homo sapiens
caatgtggttgcaaggccgct

SEQ ID NO: 2051099 - DNA, 22 bp, Homo sapiens
caatgttagcctcaatttctga

SEQ ID NO: 2051100 - DNA, 23 bp, Homo sapiens
caatgttctgttgtaaagagtgg

SEQ ID NO: 2051101 - DNA, 17 bp, Homo sapiens
caatgttgttttaagac

SEQ ID NO: 2051102 - DNA, 20 bp, Homo sapiens
caatgtttatgcaaggaagg

SEQ ID NO: 2051103 - DNA, 17 bp, Homo sapiens
caatgtttcttctaggt

SEQ ID NO: 2051104 - DNA, 16 bp, Homo sapiens
caatgtttcttttatc

SEQ ID NO: 2051105 - DNA, 17 bp, Homo sapiens
caatgtttttaaaaatc

SEQ ID NO: 2051106 - DNA, 18 bp, Homo sapiens
caatgtttttaaaaatct

SEQ ID NO: 2051107 - DNA, 12 bp, Homo sapiens
caattaaaatat

SEQ ID NO: 2051108 - DNA, 17 bp, Homo sapiens
caattaaaatatatata

SEQ ID NO: 2051109 - DNA, 14 bp, Homo sapiens
caattaaatgtagg

SEQ ID NO: 2051110 - DNA, 22 bp, Homo sapiens
caattaaatgtaggtatgaata

SEQ ID NO: 2051111 - DNA, 18 bp, Homo sapiens
caattaataaaaaatgga

SEQ ID NO: 2051112 - DNA, 21 bp, Homo sapiens
caattaattgtccctgtttca

SEQ ID NO: 2051113 - DNA, 14 bp, Homo sapiens
caattagtacagta

SEQ ID NO: 2051114 - DNA, 17 bp, Homo sapiens
caattatcttatttaat

SEQ ID NO: 2051115 - DNA, 20 bp, Homo sapiens
caattatgtgacaacctttg

SEQ ID NO: 2051116 - DNA, 13 bp, Homo sapiens
caattattctaat

SEQ ID NO: 2051117 - DNA, 21 bp, Homo sapiens
caattattctaattttatata

SEQ ID NO: 2051118 - DNA, 13 bp, Homo sapiens
caattcaggactg

SEQ ID NO: 2051119 - DNA, 19 bp, Homo sapiens
caattcaggactggctcac

SEQ ID NO: 2051120 - DNA, 14 bp, Homo sapiens
caattcatttcact

SEQ ID NO: 2051121 - DNA, 17 bp, Homo sapiens
caattccacagtctctg

SEQ ID NO: 2051122 - DNA, 18 bp, Homo sapiens
caattccacagtctctgg

SEQ ID NO: 2051123 - DNA, 13 bp, Homo sapiens
caattccacctgc

SEQ ID NO: 2051124 - DNA, 15 bp, Homo sapiens
caattccatttccag

SEQ ID NO: 2051125 - DNA, 19 bp, Homo sapiens
caattctacagtttcttac

SEQ ID NO: 2051126 - DNA, 20 bp, Homo sapiens
caattctacccagagccttc

SEQ ID NO: 2051127 - DNA, 17 bp, Homo sapiens
caattcttacaaacatg

SEQ ID NO: 2051128 - DNA, 16 bp, Homo sapiens
caattgatacttcagg

SEQ ID NO: 2051129 - DNA, 12 bp, Homo sapiens
caattgccctgt

SEQ ID NO: 2051130 - DNA, 16 bp, Homo sapiens
caattggttaatcttt

SEQ ID NO: 2051131 - DNA, 12 bp, Homo sapiens
caattgtaaaaa

SEQ ID NO: 2051132 - DNA, 17 bp, Homo sapiens
caattgtacattccctg

SEQ ID NO: 2051133 - DNA, 12 bp, Homo sapiens
caattgtatttt

SEQ ID NO: 2051134 - DNA, 17 bp, Homo sapiens
caattgtcatttataaa

SEQ ID NO: 2051135 - DNA, 19 bp, Homo sapiens
caatttaattcttatttct

SEQ ID NO: 2051136 - DNA, 13 bp, Homo sapiens
caatttagaaaac

SEQ ID NO: 2051137 - DNA, 16 bp, Homo sapiens
caatttagaaaacatt

SEQ ID NO: 2051138 - DNA, 16 bp, Homo sapiens
caatttatattttccc

SEQ ID NO: 2051139 - DNA, 17 bp, Homo sapiens
caatttcaaattactct

SEQ ID NO: 2051140 - DNA, 13 bp, Homo sapiens
caatttcccagaa

SEQ ID NO: 2051141 - DNA, 14 bp, Homo sapiens
caatttcccagaag

SEQ ID NO: 2051142 - DNA, 15 bp, Homo sapiens
caatttcctttatat

SEQ ID NO: 2051143 - DNA, 18 bp, Homo sapiens
caatttgagcaattcatt

SEQ ID NO: 2051144 - DNA, 14 bp, Homo sapiens
caatttgtatatca

SEQ ID NO: 2051145 - DNA, 19 bp, Homo sapiens
caatttgtatatcatgaaa

SEQ ID NO: 2051146 - DNA, 19 bp, Homo sapiens
caattttctggaatacatg

SEQ ID NO: 2051147 - DNA, 18 bp, Homo sapiens
caatttttatacatatca

SEQ ID NO: 2051148 - DNA, 12 bp, Homo sapiens
cacaaaaaagaa

SEQ ID NO: 2051149 - DNA, 13 bp, Homo sapiens
cacaaaagccaaa

SEQ ID NO: 2051150 - DNA, 15 bp, Homo sapiens
cacaaacacctccta

SEQ ID NO: 2051151 - DNA, 18 bp, Homo sapiens
cacaaaccacaactgaca

SEQ ID NO: 2051152 - DNA, 19 bp, Homo sapiens
cacaaaccacaactgacac

SEQ ID NO: 2051153 - DNA, 20 bp, Homo sapiens
cacaaaccacaactgacaca

SEQ ID NO: 2051154 - DNA, 18 bp, Homo sapiens
cacaaagctcaagatgac

SEQ ID NO: 2051155 - DNA, 21 bp, Homo sapiens
cacaaagctcaagatgacagc

SEQ ID NO: 2051156 - DNA, 15 bp, Homo sapiens
cacaaaggggagaag

SEQ ID NO: 2051157 - DNA, 23 bp, Homo sapiens
cacaaatatttattttctttctg

SEQ ID NO: 2051158 - DNA, 23 bp, Homo sapiens
cacaaccttctgtggctcacaga

SEQ ID NO: 2051159 - DNA, 12 bp, Homo sapiens
cacaactaggac

SEQ ID NO: 2051160 - DNA, 16 bp, Homo sapiens
cacaactaggacctca

SEQ ID NO: 2051161 - DNA, 18 bp, Homo sapiens
cacaactaggacctcata

SEQ ID NO: 2051162 - DNA, 16 bp, Homo sapiens
cacaactgacacagga

SEQ ID NO: 2051163 - DNA, 18 bp, Homo sapiens
caccagctgctctgcccc

SEQ ID NO: 2051164 - DNA, 21 bp, Homo sapiens
caccaggaatgttaaagtcag

SEQ ID NO: 2051165 - DNA, 23 bp, Homo sapiens
caccaggaatgttaaagtcagtg

SEQ ID NO: 2051166 - DNA, 13 bp, Homo sapiens
caccaggatggcc

SEQ ID NO: 2051167 - DNA, 21 bp, Homo sapiens
caccaggcacgaacccacctg

SEQ ID NO: 2051168 - DNA, 24 bp, Homo sapiens
caccaggcacgaacccacctgctg

SEQ ID NO: 2051169 - DNA, 16 bp, Homo sapiens
caccagtgccgcctgt

SEQ ID NO: 2051170 - DNA, 18 bp, Homo sapiens
caccagttcctttcaatg

SEQ ID NO: 2051171 - DNA, 17 bp, Homo sapiens
caccagtttctgcggcc

SEQ ID NO: 2051172 - DNA, 14 bp, Homo sapiens
caccatcacacatg

SEQ ID NO: 2051173 - DNA, 20 bp, Homo sapiens
caccatcaccctctgggcag

SEQ ID NO: 2051174 - DNA, 17 bp, Homo sapiens
caccatcatgtctggct

SEQ ID NO: 2051175 - DNA, 13 bp, Homo sapiens
caccatcctgctg

SEQ ID NO: 2051176 - DNA, 13 bp, Homo sapiens
caccatctgcttg

SEQ ID NO: 2051177 - DNA, 11 bp, Homo sapiens
caccatgaaac

SEQ ID NO: 2051178 - DNA, 14 bp, Homo sapiens
caccatgccaggct

SEQ ID NO: 2051179 - DNA, 14 bp, Homo sapiens
caccatggaggcag

SEQ ID NO: 2051180 - DNA, 23 bp, Homo sapiens
caccatggaggcaggctccccct

SEQ ID NO: 2051181 - DNA, 23 bp, Homo sapiens
caccatgtttgagctcagacccc

SEQ ID NO: 2051182 - DNA, 14 bp, Homo sapiens
cacccaaaagtcaa

SEQ ID NO: 2051183 - DNA, 23 bp, Homo sapiens
cacccaaaagtcaaaaggtgcct

SEQ ID NO: 2051184 - DNA, 21 bp, Homo sapiens
cacccaagtatacaataaagt

SEQ ID NO: 2051185 - DNA, 13 bp, Homo sapiens
cacccacagggct

SEQ ID NO: 2051186 - DNA, 13 bp, Homo sapiens
cacccacatgtga

SEQ ID NO: 2051187 - DNA, 12 bp, Homo sapiens
cacccacctcag

SEQ ID NO: 2051188 - DNA, 16 bp, Homo sapiens
cacccacctcagcctc

SEQ ID NO: 2051189 - DNA, 18 bp, Homo sapiens
cacccacctcagcctccc

SEQ ID NO: 2051190 - DNA, 15 bp, Homo sapiens
cacccactcaccagg

SEQ ID NO: 2051191 - DNA, 21 bp, Homo sapiens
cacccactctcctctgcctca

SEQ ID NO: 2051192 - DNA, 18 bp, Homo sapiens
cacccactggccagtcct

SEQ ID NO: 2051193 - DNA, 23 bp, Homo sapiens
cacccactggccagtcctagagc

SEQ ID NO: 2051194 - DNA, 19 bp, Homo sapiens
cacccactgtccgcctctg

SEQ ID NO: 2051195 - DNA, 12 bp, Homo sapiens
cacccagagggt

SEQ ID NO: 2051196 - DNA, 11 bp, Homo sapiens
cacccagccca

SEQ ID NO: 2051197 - DNA, 16 bp, Homo sapiens
cacccaggagccccga

SEQ ID NO: 2051198 - DNA, 22 bp, Homo sapiens
cacccaggctctggagccagag

SEQ ID NO: 2051199 - DNA, 12 bp, Homo sapiens
cacccaggctgc

SEQ ID NO: 2051200 - DNA, 21 bp, Homo sapiens
cacccagggctccctcctgga

SEQ ID NO: 2051201 - DNA, 24 bp, Homo sapiens
cacccagggctccctcctggagca

SEQ ID NO: 2051202 - DNA, 13 bp, Homo sapiens
cacccagtcctgg

SEQ ID NO: 2051203 - DNA, 14 bp, Homo sapiens
cacccagtcctggc

SEQ ID NO: 2051204 - DNA, 17 bp, Homo sapiens
cacccagtcctggccat

SEQ ID NO: 2051205 - DNA, 17 bp, Homo sapiens
cacccagtctgttcccc

SEQ ID NO: 2051206 - DNA, 15 bp, Homo sapiens
cacccagtgctgcca

SEQ ID NO: 2051207 - DNA, 17 bp, Homo sapiens
cacccagtgctgccatg

SEQ ID NO: 2051208 - DNA, 18 bp, Homo sapiens
cacccagtgctgccatgc

SEQ ID NO: 2051209 - DNA, 22 bp, Homo sapiens
cacccagtgctgccatgccact

SEQ ID NO: 2051210 - DNA, 23 bp, Homo sapiens
cacccagtgctgccatgccactg

SEQ ID NO: 2051211 - DNA, 19 bp, Homo sapiens
cacccatagtgcacacttg

SEQ ID NO: 2051212 - DNA, 17 bp, Homo sapiens
cacccatcttcctgctg

SEQ ID NO: 2051213 - DNA, 19 bp, Homo sapiens
cacccatgaatcaaagaca

SEQ ID NO: 2051214 - DNA, 15 bp, Homo sapiens
cacccattttcacat

SEQ ID NO: 2051215 - DNA, 23 bp, Homo sapiens
caccccacattggacttccttgg

SEQ ID NO: 2051216 - DNA, 14 bp, Homo sapiens
caccccactccagc

SEQ ID NO: 2051217 - DNA, 11 bp, Homo sapiens
caccccagagt

SEQ ID NO: 2051218 - DNA, 11 bp, Homo sapiens
caccccaggac

SEQ ID NO: 2051219 - DNA, 17 bp, Homo sapiens
caccccaggacgccact

SEQ ID NO: 2051220 - DNA, 20 bp, Homo sapiens
caccccaggacgccactcat

SEQ ID NO: 2051221 - DNA, 21 bp, Homo sapiens
cacccccagccccgactccag

SEQ ID NO: 2051222 - DNA, 14 bp, Homo sapiens
caccccccaagctg

SEQ ID NO: 2051223 - DNA, 23 bp, Homo sapiens
caccccccagtcgagccctgcag

SEQ ID NO: 2051224 - DNA, 11 bp, Homo sapiens
caccccctcat

SEQ ID NO: 2051225 - DNA, 15 bp, Homo sapiens
caccccctcccaccc

SEQ ID NO: 2051226 - DNA, 14 bp, Homo sapiens
caccccctccccag

SEQ ID NO: 2051227 - DNA, 18 bp, Homo sapiens
caccccctccccagggga

SEQ ID NO: 2051228 - DNA, 12 bp, Homo sapiens
caccccctgcag

SEQ ID NO: 2051229 - DNA, 13 bp, Homo sapiens
caccccctgcagc

SEQ ID NO: 2051230 - DNA, 22 bp, Homo sapiens
caccccgtctggggttcagccc

SEQ ID NO: 2051231 - DNA, 23 bp, Homo sapiens
caccccgtctggggttcagcccc

SEQ ID NO: 2051232 - DNA, 15 bp, Homo sapiens
caccccgtgccaccc

SEQ ID NO: 2051233 - DNA, 15 bp, Homo sapiens
cacccctaaagagat

SEQ ID NO: 2051234 - DNA, 15 bp, Homo sapiens
cacccctaacctggc

SEQ ID NO: 2051235 - DNA, 12 bp, Homo sapiens
cacccctcactc

SEQ ID NO: 2051236 - DNA, 19 bp, Homo sapiens
cacccctccaaagccccac

SEQ ID NO: 2051237 - DNA, 13 bp, Homo sapiens
cacccctgtctct

SEQ ID NO: 2051238 - DNA, 18 bp, Homo sapiens
caccccttatccaggact

SEQ ID NO: 2051239 - DNA, 19 bp, Homo sapiens
caccccttatccaggactc

SEQ ID NO: 2051240 - DNA, 16 bp, Homo sapiens
caccccttcctgtccc

SEQ ID NO: 2051241 - DNA, 15 bp, Homo sapiens
cacccgactcctcaa

SEQ ID NO: 2051242 - DNA, 15 bp, Homo sapiens
cacccgaggctgccc

SEQ ID NO: 2051243 - DNA, 18 bp, Homo sapiens
cacccggcccctgctggt

SEQ ID NO: 2051244 - DNA, 15 bp, Homo sapiens
cacccggctccccct

SEQ ID NO: 2051245 - DNA, 18 bp, Homo sapiens
cacccggctccccctgct

SEQ ID NO: 2051246 - DNA, 21 bp, Homo sapiens
cacccggttaccttggccgtg

SEQ ID NO: 2051247 - DNA, 21 bp, Homo sapiens
caccctatccctgtacagagt

SEQ ID NO: 2051248 - DNA, 14 bp, Homo sapiens
caccctattcccta

SEQ ID NO: 2051249 - DNA, 17 bp, Homo sapiens
caccctcaccaggatga

SEQ ID NO: 2051250 - DNA, 19 bp, Homo sapiens
caccctcataccatctgct

SEQ ID NO: 2051251 - DNA, 19 bp, Homo sapiens
caccctcgtggacacctgc

SEQ ID NO: 2051252 - DNA, 21 bp, Homo sapiens
caccctcgtggacacctgccc

SEQ ID NO: 2051253 - DNA, 23 bp, Homo sapiens
caccctcgtggacacctgccctg

SEQ ID NO: 2051254 - DNA, 15 bp, Homo sapiens
caccctctcctgggg

SEQ ID NO: 2051255 - DNA, 14 bp, Homo sapiens
caccctctgggcag

SEQ ID NO: 2051256 - DNA, 22 bp, Homo sapiens
caccctctgggcagctgtcatg

SEQ ID NO: 2051257 - DNA, 18 bp, Homo sapiens
caccctgaatggttccat

SEQ ID NO: 2051258 - DNA, 13 bp, Homo sapiens
caccctgagcctg

SEQ ID NO: 2051259 - DNA, 16 bp, Homo sapiens
caccctggcccgcccc

SEQ ID NO: 2051260 - DNA, 19 bp, Homo sapiens
caccctggcccgcccctcg

SEQ ID NO: 2051261 - DNA, 17 bp, Homo sapiens
caccctgggtgccattc

SEQ ID NO: 2051262 - DNA, 17 bp, Homo sapiens
caccctgtctaaaaaac

SEQ ID NO: 2051263 - DNA, 19 bp, Homo sapiens
caccctgttccctctttct

SEQ ID NO: 2051264 - DNA, 13 bp, Homo sapiens
cacccttctttcc

SEQ ID NO: 2051265 - DNA, 15 bp, Homo sapiens
cacccttctttcctc

SEQ ID NO: 2051266 - DNA, 16 bp, Homo sapiens
cacccttctttcctct

SEQ ID NO: 2051267 - DNA, 21 bp, Homo sapiens
cacccttctttcctcttcccc

SEQ ID NO: 2051268 - DNA, 17 bp, Homo sapiens
caccgaagagccctgag

SEQ ID NO: 2051269 - DNA, 19 bp, Homo sapiens
caccgaagagccctgagct

SEQ ID NO: 2051270 - DNA, 16 bp, Homo sapiens
caccgaagaggaagca

SEQ ID NO: 2051271 - DNA, 17 bp, Homo sapiens
caccgacgcgtctcctg

SEQ ID NO: 2051272 - DNA, 18 bp, Homo sapiens
caccgagacggctggacc

SEQ ID NO: 2051273 - DNA, 18 bp, Homo sapiens
caccgagagtagccgaga

SEQ ID NO: 2051274 - DNA, 23 bp, Homo sapiens
caccgctgccttttgctgctgct

SEQ ID NO: 2051275 - DNA, 16 bp, Homo sapiens
caccggcatgctggcc

SEQ ID NO: 2051276 - DNA, 17 bp, Homo sapiens
caccggcatgctggcct

SEQ ID NO: 2051277 - DNA, 13 bp, Homo sapiens
caccggcgctgca

SEQ ID NO: 2051278 - DNA, 17 bp, Homo sapiens
caccttggactcctccc

SEQ ID NO: 2051279 - DNA, 18 bp, Homo sapiens
caccttggactcctccca

SEQ ID NO: 2051280 - DNA, 16 bp, Homo sapiens
caccttggctgcaggg

SEQ ID NO: 2051281 - DNA, 23 bp, Homo sapiens
caccttgtcatgtaccatcaata

SEQ ID NO: 2051282 - DNA, 17 bp, Homo sapiens
caccttgtgtctgtaca

SEQ ID NO: 2051283 - DNA, 21 bp, Homo sapiens
caccttgtgtctgtacacgtg

SEQ ID NO: 2051284 - DNA, 12 bp, Homo sapiens
cacctttctagt

SEQ ID NO: 2051285 - DNA, 17 bp, Homo sapiens
cacctttctagttgaaa

SEQ ID NO: 2051286 - DNA, 14 bp, Homo sapiens
cacctttgggatca

SEQ ID NO: 2051287 - DNA, 16 bp, Homo sapiens
cacctttggtgcagag

SEQ ID NO: 2051288 - DNA, 15 bp, Homo sapiens
caccttttgtattta

SEQ ID NO: 2051289 - DNA, 15 bp, Homo sapiens
cacgaaatgttattt

SEQ ID NO: 2051290 - DNA, 14 bp, Homo sapiens
cacgaacccacctg

SEQ ID NO: 2051291 - DNA, 22 bp, Homo sapiens
cacgaatttggtgtggctgtat

SEQ ID NO: 2051292 - DNA, 20 bp, Homo sapiens
cacgactgttgtacaagctc

SEQ ID NO: 2051293 - DNA, 21 bp, Homo sapiens
cacgactgttgtacaagctca

SEQ ID NO: 2051294 - DNA, 22 bp, Homo sapiens
cacgactgttgtacaagctcag

SEQ ID NO: 2051295 - DNA, 22 bp, Homo sapiens
cacgagcaggctactgtcagct

SEQ ID NO: 2051296 - DNA, 13 bp, Homo sapiens
cacgaggagcttc

SEQ ID NO: 2051297 - DNA, 20 bp, Homo sapiens
cacgagtcacctgcaagccc

SEQ ID NO: 2051298 - DNA, 20 bp, Homo sapiens
cacgataaataatcggccca

SEQ ID NO: 2051299 - DNA, 21 bp, Homo sapiens
cacgatgtcaaggactcctgt

SEQ ID NO: 2051300 - DNA, 15 bp, Homo sapiens
cacgcaacccttgct

SEQ ID NO: 2051301 - DNA, 21 bp, Homo sapiens
cacgcaagggcatcaggcact

SEQ ID NO: 2051302 - DNA, 23 bp, Homo sapiens
cacgcaagggcatcaggcactgg

SEQ ID NO: 2051303 - DNA, 23 bp, Homo sapiens
cacgcacatgccaatgcacgcac

SEQ ID NO: 2051304 - DNA, 19 bp, Homo sapiens
cacgcactgcgtagagcct

SEQ ID NO: 2051305 - DNA, 13 bp, Homo sapiens
cacgccactgcac

SEQ ID NO: 2051306 - DNA, 14 bp, Homo sapiens
cacgccactgcact

SEQ ID NO: 2051307 - DNA, 22 bp, Homo sapiens
cacgccactgcactccagcctg

SEQ ID NO: 2051308 - DNA, 15 bp, Homo sapiens
cacgcccagcctcct

SEQ ID NO: 2051309 - DNA, 19 bp, Homo sapiens
cacgcccagcctcctccca

SEQ ID NO: 2051310 - DNA, 17 bp, Homo sapiens
cacgcctgcccagcctc

SEQ ID NO: 2051311 - DNA, 17 bp, Homo sapiens
cacgcctgtaatcccag

SEQ ID NO: 2051312 - DNA, 17 bp, Homo sapiens
cacgctcccccgcagtc

SEQ ID NO: 2051313 - DNA, 14 bp, Homo sapiens
cacgctgtcctctc

SEQ ID NO: 2051314 - DNA, 17 bp, Homo sapiens
cacggacgtttccatca

SEQ ID NO: 2051315 - DNA, 14 bp, Homo sapiens
cacggagagaaggc

SEQ ID NO: 2051316 - DNA, 20 bp, Homo sapiens
cacggatccatgtagcagga

SEQ ID NO: 2051317 - DNA, 23 bp, Homo sapiens
cacggatccatgtagcaggactg

SEQ ID NO: 2051318 - DNA, 12 bp, Homo sapiens
cacggcagctgt

SEQ ID NO: 2051319 - DNA, 14 bp, Homo sapiens
cacggcagcttgag

SEQ ID NO: 2051320 - DNA, 19 bp, Homo sapiens
cacggcagcttgagcctgt

SEQ ID NO: 2051321 - DNA, 11 bp, Homo sapiens
cacggccaccc

SEQ ID NO: 2051322 - DNA, 13 bp, Homo sapiens
cacggccaccctc

SEQ ID NO: 2051323 - DNA, 22 bp, Homo sapiens
cacggccagctgcatctactca

SEQ ID NO: 2051324 - DNA, 14 bp, Homo sapiens
cacggccaggccag

SEQ ID NO: 2051325 - DNA, 17 bp, Homo sapiens
cacggccaggccagagg

SEQ ID NO: 2051326 - DNA, 16 bp, Homo sapiens
cacggccctgccccat

SEQ ID NO: 2051327 - DNA, 17 bp, Homo sapiens
cacggcgtttttttaca

SEQ ID NO: 2051328 - DNA, 14 bp, Homo sapiens
cacggctcactgca

SEQ ID NO: 2051329 - DNA, 17 bp, Homo sapiens
cacggctcactgcagcc

SEQ ID NO: 2051330 - DNA, 18 bp, Homo sapiens
cacgggcctcagtttccc

SEQ ID NO: 2051331 - DNA, 16 bp, Homo sapiens
cacggtgaaatccagg

SEQ ID NO: 2051332 - DNA, 14 bp, Homo sapiens
cacggtgcgtggct

SEQ ID NO: 2051333 - DNA, 16 bp, Homo sapiens
cacggtgcgtggctgt

SEQ ID NO: 2051334 - DNA, 21 bp, Homo sapiens
cacggtgcgtggctgtggcac

SEQ ID NO: 2051335 - DNA, 18 bp, Homo sapiens
cacgtacacacacataca

SEQ ID NO: 2051336 - DNA, 21 bp, Homo sapiens
cacgtagagatgattcggatt

SEQ ID NO: 2051337 - DNA, 17 bp, Homo sapiens
cacgtccccctggggct

SEQ ID NO: 2051338 - DNA, 20 bp, Homo sapiens
cacgtccccctggggcttct

SEQ ID NO: 2051339 - DNA, 12 bp, Homo sapiens
cacgtctgccag

SEQ ID NO: 2051340 - DNA, 17 bp, Homo sapiens
cacgtctgccaggccca

SEQ ID NO: 2051341 - DNA, 21 bp, Homo sapiens
cacgtctgccaggcccatctc

SEQ ID NO: 2051342 - DNA, 22 bp, Homo sapiens
cacgtctgccaggcccatctca

SEQ ID NO: 2051343 - DNA, 14 bp, Homo sapiens
cacgtgaaatattt

SEQ ID NO: 2051344 - DNA, 20 bp, Homo sapiens
cacgtgaaatatttaagtat

SEQ ID NO: 2051345 - DNA, 23 bp, Homo sapiens
cacgtgaaatatttaagtatata

SEQ ID NO: 2051346 - DNA, 12 bp, Homo sapiens
cacgtgaatggc

SEQ ID NO: 2051347 - DNA, 19 bp, Homo sapiens
cacgtgctcgcagcctggc

SEQ ID NO: 2051348 - DNA, 20 bp, Homo sapiens
cacgtgctcgcagcctggcg

SEQ ID NO: 2051349 - DNA, 19 bp, Homo sapiens
cacgtgctcttctgttctc

SEQ ID NO: 2051350 - DNA, 20 bp, Homo sapiens
cacgtggtcaaggcccggcc

SEQ ID NO: 2051351 - DNA, 20 bp, Homo sapiens
cacgtgtgcagactgtggct

SEQ ID NO: 2051352 - DNA, 17 bp, Homo sapiens
cacgtttggcatttctc

SEQ ID NO: 2051353 - DNA, 18 bp, Homo sapiens
cacgtttgtgagaagaaa

SEQ ID NO: 2051354 - DNA, 22 bp, Homo sapiens
cactaaactttacccaaaaact

SEQ ID NO: 2051355 - DNA, 15 bp, Homo sapiens
cactaaagtatgtaa

SEQ ID NO: 2051356 - DNA, 17 bp, Homo sapiens
cactaaatgagctcctg

SEQ ID NO: 2051357 - DNA, 17 bp, Homo sapiens
cactaagctttctcctt

SEQ ID NO: 2051358 - DNA, 18 bp, Homo sapiens
cactaagctttctccttt

SEQ ID NO: 2051359 - DNA, 18 bp, Homo sapiens
cactaaggtgtgctctga

SEQ ID NO: 2051360 - DNA, 17 bp, Homo sapiens
cactaagttatagtata

SEQ ID NO: 2051361 - DNA, 22 bp, Homo sapiens
cactaagttatagtatatctgg

SEQ ID NO: 2051362 - DNA, 15 bp, Homo sapiens
cactaatacaccagg

SEQ ID NO: 2051363 - DNA, 17 bp, Homo sapiens
cactaatttgatgttta

SEQ ID NO: 2051364 - DNA, 22 bp, Homo sapiens
cactacaagtttataagcccaa

SEQ ID NO: 2051365 - DNA, 20 bp, Homo sapiens
cactacactccagcctgagc

SEQ ID NO: 2051366 - DNA, 20 bp, Homo sapiens
cactacctttgtccaggcct

SEQ ID NO: 2051367 - DNA, 13 bp, Homo sapiens
cactagaaaacat

SEQ ID NO: 2051368 - DNA, 15 bp, Homo sapiens
cactagaactctcca

SEQ ID NO: 2051369 - DNA, 17 bp, Homo sapiens
cactagaactctccatc

SEQ ID NO: 2051370 - DNA, 14 bp, Homo sapiens
cactagcagctgca

SEQ ID NO: 2051371 - DNA, 17 bp, Homo sapiens
cactaggttcaattccc

SEQ ID NO: 2051372 - DNA, 20 bp, Homo sapiens
cactaggttctaggtcctgg

SEQ ID NO: 2051373 - DNA, 12 bp, Homo sapiens
cactagttttgt

SEQ ID NO: 2051374 - DNA, 22 bp, Homo sapiens
cactataaccatcagttactgg

SEQ ID NO: 2051375 - DNA, 23 bp, Homo sapiens
cactataaccatcagttactggt

SEQ ID NO: 2051376 - DNA, 14 bp, Homo sapiens
cactatagcctagg

SEQ ID NO: 2051377 - DNA, 21 bp, Homo sapiens
cactatagcctaggtgacaga

SEQ ID NO: 2051378 - DNA, 17 bp, Homo sapiens
cactatctttctgataa

SEQ ID NO: 2051379 - DNA, 15 bp, Homo sapiens
cactatgaaaatcag

SEQ ID NO: 2051380 - DNA, 15 bp, Homo sapiens
cactatgacactgag

SEQ ID NO: 2051381 - DNA, 16 bp, Homo sapiens
cactatgctatttctg

SEQ ID NO: 2051382 - DNA, 23 bp, Homo sapiens
cactatgctatttctggcctcag

SEQ ID NO: 2051383 - DNA, 19 bp, Homo sapiens
cactatggtatgctggcca

SEQ ID NO: 2051384 - DNA, 18 bp, Homo sapiens
cactatgtccagctagcc

SEQ ID NO: 2051385 - DNA, 15 bp, Homo sapiens
cactatgttgcccag

SEQ ID NO: 2051386 - DNA, 16 bp, Homo sapiens
cactatgttgcccagg

SEQ ID NO: 2051387 - DNA, 20 bp, Homo sapiens
cactatgttgcccaggcagg

SEQ ID NO: 2051388 - DNA, 12 bp, Homo sapiens
cactattagaga

SEQ ID NO: 2051389 - DNA, 17 bp, Homo sapiens
cactattgcattgttca

SEQ ID NO: 2051390 - DNA, 19 bp, Homo sapiens
cactatttatctgtgcaaa

SEQ ID NO: 2051391 - DNA, 20 bp, Homo sapiens
cactcaaattaatctttctt

SEQ ID NO: 2051392 - DNA, 22 bp, Homo sapiens
cagaaactcaaccatcaatgga

SEQ ID NO: 2051393 - DNA, 19 bp, Homo sapiens
cagaaagatggatgtgctt

SEQ ID NO: 2051394 - DNA, 18 bp, Homo sapiens
cagaaagcataaaattct

SEQ ID NO: 2051395 - DNA, 15 bp, Homo sapiens
cagaaagggagggct

SEQ ID NO: 2051396 - DNA, 16 bp, Homo sapiens
cagaaagggagggctc

SEQ ID NO: 2051397 - DNA, 18 bp, Homo sapiens
cagaaagggagggctctg

SEQ ID NO: 2051398 - DNA, 20 bp, Homo sapiens
cagaaagggagggctctgag

SEQ ID NO: 2051399 - DNA, 22 bp, Homo sapiens
cagaaagggagggctctgaggc

SEQ ID NO: 2051400 - DNA, 20 bp, Homo sapiens
cagaaagtgaggaagcctaa

SEQ ID NO: 2051401 - DNA, 22 bp, Homo sapiens
cagaaataaaatgaaatgtctt

SEQ ID NO: 2051402 - DNA, 17 bp, Homo sapiens
cagaaatactgctctga

SEQ ID NO: 2051403 - DNA, 22 bp, Homo sapiens
cagaaatatatatacatatgta

SEQ ID NO: 2051404 - DNA, 16 bp, Homo sapiens
cagaaattagccgggc

SEQ ID NO: 2051405 - DNA, 14 bp, Homo sapiens
cagaaatttttatt

SEQ ID NO: 2051406 - DNA, 18 bp, Homo sapiens
cagaaatttttatttttc

SEQ ID NO: 2051407 - DNA, 19 bp, Homo sapiens
cagaaatttttatttttct

SEQ ID NO: 2051408 - DNA, 20 bp, Homo sapiens
cagaacactgggtagtagct

SEQ ID NO: 2051409 - DNA, 12 bp, Homo sapiens
cagaacagccgc

SEQ ID NO: 2051410 - DNA, 17 bp, Homo sapiens
cagaacagccgctcctg

SEQ ID NO: 2051411 - DNA, 14 bp, Homo sapiens
cagaaccacactgt

SEQ ID NO: 2051412 - DNA, 22 bp, Homo sapiens
cagaacccttggagccaatgga

SEQ ID NO: 2051413 - DNA, 20 bp, Homo sapiens
cagaacctggagggctagaa

SEQ ID NO: 2051414 - DNA, 15 bp, Homo sapiens
cagaactgaggtcac

SEQ ID NO: 2051415 - DNA, 17 bp, Homo sapiens
cagaactgctaaatact

SEQ ID NO: 2051416 - DNA, 23 bp, Homo sapiens
cagaactgctaaatactgtacat

SEQ ID NO: 2051417 - DNA, 19 bp, Homo sapiens
cagaactgcttactagccc

SEQ ID NO: 2051418 - DNA, 19 bp, Homo sapiens
cagaactggacgcccagct

SEQ ID NO: 2051419 - DNA, 11 bp, Homo sapiens
cagaagaaaga

SEQ ID NO: 2051420 - DNA, 14 bp, Homo sapiens
cagaagaatattca

SEQ ID NO: 2051421 - DNA, 17 bp, Homo sapiens
cagaagaatattcagga

SEQ ID NO: 2051422 - DNA, 19 bp, Homo sapiens
cagaagaatattcaggact

SEQ ID NO: 2051423 - DNA, 19 bp, Homo sapiens
cagaagacactgcaaaggc

SEQ ID NO: 2051424 - DNA, 13 bp, Homo sapiens
cagaagatgccct

SEQ ID NO: 2051425 - DNA, 23 bp, Homo sapiens
cagaagcagttgagtcgtcatca

SEQ ID NO: 2051426 - DNA, 14 bp, Homo sapiens
cagaagccaaattt

SEQ ID NO: 2051427 - DNA, 14 bp, Homo sapiens
cagaagcctgaggc

SEQ ID NO: 2051428 - DNA, 13 bp, Homo sapiens
cagaagcctgggg

SEQ ID NO: 2051429 - DNA, 19 bp, Homo sapiens
cagaagcctgggggcctgg

SEQ ID NO: 2051430 - DNA, 24 bp, Homo sapiens
cagaagcctgggggcctggctggc

SEQ ID NO: 2051431 - DNA, 17 bp, Homo sapiens
cagaagctaagctgcag

SEQ ID NO: 2051432 - DNA, 22 bp, Homo sapiens
cagaaggaaggcagggaggagg

SEQ ID NO: 2051433 - DNA, 14 bp, Homo sapiens
cagaaggaatctgt

SEQ ID NO: 2051434 - DNA, 17 bp, Homo sapiens
cagaaggagggcagagc

SEQ ID NO: 2051435 - DNA, 18 bp, Homo sapiens
cagaaggagggcagagcc

SEQ ID NO: 2051436 - DNA, 19 bp, Homo sapiens
cagaaggagggcagagcca

SEQ ID NO: 2051437 - DNA, 21 bp, Homo sapiens
cagaaggagggcagagccatg

SEQ ID NO: 2051438 - DNA, 22 bp, Homo sapiens
cagaaggagggcagagccatgg

SEQ ID NO: 2051439 - DNA, 13 bp, Homo sapiens
cagaaggcaggga

SEQ ID NO: 2051440 - DNA, 12 bp, Homo sapiens
cagaaggctggg

SEQ ID NO: 2051441 - DNA, 17 bp, Homo sapiens
cagaagggagttgctca

SEQ ID NO: 2051442 - DNA, 21 bp, Homo sapiens
cagaaggggcacgcctgccca

SEQ ID NO: 2051443 - DNA, 15 bp, Homo sapiens
cagaaggtattcctt

SEQ ID NO: 2051444 - DNA, 23 bp, Homo sapiens
cagaaggttgctctagattgaga

SEQ ID NO: 2051445 - DNA, 16 bp, Homo sapiens
cagaagtcatgaagcc

SEQ ID NO: 2051446 - DNA, 19 bp, Homo sapiens
cagaagtcatgaagcccaa

SEQ ID NO: 2051447 - DNA, 14 bp, Homo sapiens
cagaagtgcaaagg

SEQ ID NO: 2051448 - DNA, 16 bp, Homo sapiens
cagaagtggggctctg

SEQ ID NO: 2051449 - DNA, 14 bp, Homo sapiens
cagaataagtgctg

SEQ ID NO: 2051450 - DNA, 17 bp, Homo sapiens
cagaataatctttgggt

SEQ ID NO: 2051451 - DNA, 23 bp, Homo sapiens
cagaatacagtaagctgctctat

SEQ ID NO: 2051452 - DNA, 15 bp, Homo sapiens
cagaataccttcttc

SEQ ID NO: 2051453 - DNA, 17 bp, Homo sapiens
cagaatcaacttgaagc

SEQ ID NO: 2051454 - DNA, 15 bp, Homo sapiens
cagaatcataatttt

SEQ ID NO: 2051455 - DNA, 22 bp, Homo sapiens
cagaatctgctgttgccatagc

SEQ ID NO: 2051456 - DNA, 15 bp, Homo sapiens
cagaatcttcgtcct

SEQ ID NO: 2051457 - DNA, 16 bp, Homo sapiens
cagaatcttgtatttg

SEQ ID NO: 2051458 - DNA, 18 bp, Homo sapiens
cagaatgaggaataataa

SEQ ID NO: 2051459 - DNA, 16 bp, Homo sapiens
cagaatgctgttttaa

SEQ ID NO: 2051460 - DNA, 15 bp, Homo sapiens
cagaatggaaagaaa

SEQ ID NO: 2051461 - DNA, 15 bp, Homo sapiens
cagaattaactccat

SEQ ID NO: 2051462 - DNA, 13 bp, Homo sapiens
cagaattctgcta

SEQ ID NO: 2051463 - DNA, 13 bp, Homo sapiens
cagaattgatcat

SEQ ID NO: 2051464 - DNA, 19 bp, Homo sapiens
cagaattgtgcaaatggaa

SEQ ID NO: 2051465 - DNA, 22 bp, Homo sapiens
cagaatttctttgtcattcaag

SEQ ID NO: 2051466 - DNA, 12 bp, Homo sapiens
cagaattttacc

SEQ ID NO: 2051467 - DNA, 14 bp, Homo sapiens
cagaattttgtata

SEQ ID NO: 2051468 - DNA, 16 bp, Homo sapiens
cagaatttttaatgac

SEQ ID NO: 2051469 - DNA, 15 bp, Homo sapiens
cagacaacagaagtc

SEQ ID NO: 2051470 - DNA, 16 bp, Homo sapiens
cagacaagagctgctg

SEQ ID NO: 2051471 - DNA, 17 bp, Homo sapiens
cagacaagagctgctgt

SEQ ID NO: 2051472 - DNA, 19 bp, Homo sapiens
cagacaagagctgctgtcc

SEQ ID NO: 2051473 - DNA, 19 bp, Homo sapiens
cagacaagcaacaggtttt

SEQ ID NO: 2051474 - DNA, 23 bp, Homo sapiens
cagacaagcaacaggttttataa

SEQ ID NO: 2051475 - DNA, 22 bp, Homo sapiens
cagacacaggcccggctccagg

SEQ ID NO: 2051476 - DNA, 16 bp, Homo sapiens
cagacacattctcctg

SEQ ID NO: 2051477 - DNA, 15 bp, Homo sapiens
cagacagcagctcag

SEQ ID NO: 2051478 - DNA, 17 bp, Homo sapiens
cagacagcagctcaggc

SEQ ID NO: 2051479 - DNA, 19 bp, Homo sapiens
cagacagcagctcaggcac

SEQ ID NO: 2051480 - DNA, 12 bp, Homo sapiens
cagacaggagga

SEQ ID NO: 2051481 - DNA, 21 bp, Homo sapiens
cagacaggcaagcacctcctg

SEQ ID NO: 2051482 - DNA, 23 bp, Homo sapiens
cagacaggcaagcacctcctgcc

SEQ ID NO: 2051483 - DNA, 18 bp, Homo sapiens
cagacatacgaaacacaa

SEQ ID NO: 2051484 - DNA, 19 bp, Homo sapiens
cagacatacgaaacacaaa

SEQ ID NO: 2051485 - DNA, 19 bp, Homo sapiens
cagacatccatgtttgtaa

SEQ ID NO: 2051486 - DNA, 18 bp, Homo sapiens
cagacatgtggtgggaca

SEQ ID NO: 2051487 - DNA, 17 bp, Homo sapiens
cagacattaaacctgga

SEQ ID NO: 2051488 - DNA, 18 bp, Homo sapiens
cagaccaactctctcctg

SEQ ID NO: 2051489 - DNA, 12 bp, Homo sapiens
cagaccacctgc

SEQ ID NO: 2051490 - DNA, 14 bp, Homo sapiens
cagaccacctgcca

SEQ ID NO: 2051491 - DNA, 15 bp, Homo sapiens
cagaccacctgccag

SEQ ID NO: 2051492 - DNA, 21 bp, Homo sapiens
cagaccacctgccagccatca

SEQ ID NO: 2051493 - DNA, 18 bp, Homo sapiens
cagaccattgtcttccaa

SEQ ID NO: 2051494 - DNA, 22 bp, Homo sapiens
cagaccattgtcttccaacccc

SEQ ID NO: 2051495 - DNA, 24 bp, Homo sapiens
cagaccattgtcttccaaccccag

SEQ ID NO: 2051496 - DNA, 12 bp, Homo sapiens
cagaccccagcg

SEQ ID NO: 2051497 - DNA, 23 bp, Homo sapiens
cagacccctggcttttcactgct

SEQ ID NO: 2051498 - DNA, 14 bp, Homo sapiens
cagacccctgtggc

SEQ ID NO: 2051499 - DNA, 17 bp, Homo sapiens
cagacccctgtggcaga

SEQ ID NO: 2051500 - DNA, 21 bp, Homo sapiens
cagacccctgtggcagaccgg

SEQ ID NO: 2051501 - DNA, 12 bp, Homo sapiens
cagacccggctg

SEQ ID NO: 2051502 - DNA, 14 bp, Homo sapiens
cagacccggctgcg

SEQ ID NO: 2051503 - DNA, 16 bp, Homo sapiens
cagacccggctgcgtg

SEQ ID NO: 2051504 - DNA, 18 bp, Homo sapiens
cagaccctaccccaccac

SEQ ID NO: 2051505 - DNA, 15 bp, Homo sapiens
cagaccctgcccttg

SEQ ID NO: 2051506 - DNA, 18 bp, Homo sapiens
cagaccctgcctgagccc

SEQ ID NO: 2051507 - DNA, 16 bp, Homo sapiens
cagcagaagagggagg

SEQ ID NO: 2051508 - DNA, 24 bp, Homo sapiens
cagcagaagagggaggcttcctga

SEQ ID NO: 2051509 - DNA, 11 bp, Homo sapiens
cagcagaagcc

SEQ ID NO: 2051510 - DNA, 15 bp, Homo sapiens
cagcagactcagctc

SEQ ID NO: 2051511 - DNA, 13 bp, Homo sapiens
cagcagagagccc

SEQ ID NO: 2051512 - DNA, 22 bp, Homo sapiens
cagcagagttattgaatcttaa

SEQ ID NO: 2051513 - DNA, 16 bp, Homo sapiens
cagcagcactgcagat

SEQ ID NO: 2051514 - DNA, 21 bp, Homo sapiens
cagcagccacttgactaatac

SEQ ID NO: 2051515 - DNA, 11 bp, Homo sapiens
cagcagccagc

SEQ ID NO: 2051516 - DNA, 13 bp, Homo sapiens
cagcagccagccc

SEQ ID NO: 2051517 - DNA, 13 bp, Homo sapiens
cagcagccagctc

SEQ ID NO: 2051518 - DNA, 14 bp, Homo sapiens
cagcagccagctct

SEQ ID NO: 2051519 - DNA, 15 bp, Homo sapiens
cagcagccagctctc

SEQ ID NO: 2051520 - DNA, 18 bp, Homo sapiens
cagcagccagctctcagc

SEQ ID NO: 2051521 - DNA, 19 bp, Homo sapiens
cagcagcccagcttcctgg

SEQ ID NO: 2051522 - DNA, 21 bp, Homo sapiens
cagcagcccagcttcctggtg

SEQ ID NO: 2051523 - DNA, 19 bp, Homo sapiens
cagcagcccatggcctctg

SEQ ID NO: 2051524 - DNA, 12 bp, Homo sapiens
cagcagcccccc

SEQ ID NO: 2051525 - DNA, 14 bp, Homo sapiens
cagcagccccccag

SEQ ID NO: 2051526 - DNA, 16 bp, Homo sapiens
cagcagccccctgccc

SEQ ID NO: 2051527 - DNA, 16 bp, Homo sapiens
cagcagccctaaggat

SEQ ID NO: 2051528 - DNA, 20 bp, Homo sapiens
cagcagccctaaggatctct

SEQ ID NO: 2051529 - DNA, 19 bp, Homo sapiens
cagcagccctcctcacccc

SEQ ID NO: 2051530 - DNA, 15 bp, Homo sapiens
cagcagctaggactg

SEQ ID NO: 2051531 - DNA, 19 bp, Homo sapiens
cagcagctaggactgagga

SEQ ID NO: 2051532 - DNA, 12 bp, Homo sapiens
cagcagctcagg

SEQ ID NO: 2051533 - DNA, 13 bp, Homo sapiens
cagcagctcaggc

SEQ ID NO: 2051534 - DNA, 16 bp, Homo sapiens
cagcagctcaggcaca

SEQ ID NO: 2051535 - DNA, 20 bp, Homo sapiens
cagcagctgaacagccaaat

SEQ ID NO: 2051536 - DNA, 11 bp, Homo sapiens
cagcagctgcg

SEQ ID NO: 2051537 - DNA, 17 bp, Homo sapiens
cagcagctgcgggtctg

SEQ ID NO: 2051538 - DNA, 23 bp, Homo sapiens
cagcagctgcgggtctgaaggaa

SEQ ID NO: 2051539 - DNA, 13 bp, Homo sapiens
cagcagctgggcc

SEQ ID NO: 2051540 - DNA, 15 bp, Homo sapiens
cagcagctgggccgg

SEQ ID NO: 2051541 - DNA, 17 bp, Homo sapiens
cagcagcttttaataca

SEQ ID NO: 2051542 - DNA, 15 bp, Homo sapiens
cagcaggaagccagg

SEQ ID NO: 2051543 - DNA, 18 bp, Homo sapiens
cagcaggaagccaggctg

SEQ ID NO: 2051544 - DNA, 14 bp, Homo sapiens
cagcagggcctcaa

SEQ ID NO: 2051545 - DNA, 18 bp, Homo sapiens
cagcagggctgctgtgaa

SEQ ID NO: 2051546 - DNA, 20 bp, Homo sapiens
cagcagggtagtctggtttc

SEQ ID NO: 2051547 - DNA, 17 bp, Homo sapiens
cagcagggtcttgctgt

SEQ ID NO: 2051548 - DNA, 15 bp, Homo sapiens
cagcaggtgcaagag

SEQ ID NO: 2051549 - DNA, 18 bp, Homo sapiens
cagcaggtgcaagagaca

SEQ ID NO: 2051550 - DNA, 22 bp, Homo sapiens
cagcaggtgcaagagacagagc

SEQ ID NO: 2051551 - DNA, 16 bp, Homo sapiens
cagcaggtgtggtggc

SEQ ID NO: 2051552 - DNA, 17 bp, Homo sapiens
cagcaggtgtggtggct

SEQ ID NO: 2051553 - DNA, 20 bp, Homo sapiens
cagcaggtgtggtggctcat

SEQ ID NO: 2051554 - DNA, 16 bp, Homo sapiens
cagcagtatgaatgat

SEQ ID NO: 2051555 - DNA, 19 bp, Homo sapiens
cagcagtgagtctcttcag

SEQ ID NO: 2051556 - DNA, 13 bp, Homo sapiens
cagcagtgttccc

SEQ ID NO: 2051557 - DNA, 19 bp, Homo sapiens
cagcagtgttccccatctg

SEQ ID NO: 2051558 - DNA, 21 bp, Homo sapiens
cagcagtgttccccatctggg

SEQ ID NO: 2051559 - DNA, 23 bp, Homo sapiens
cagcagtgttccccatctgggtc

SEQ ID NO: 2051560 - DNA, 21 bp, Homo sapiens
cagcagttgaaaagactccaa

SEQ ID NO: 2051561 - DNA, 23 bp, Homo sapiens
cagcagttgaatgacaacagaag

SEQ ID NO: 2051562 - DNA, 17 bp, Homo sapiens
cagcagtttgggaggtc

SEQ ID NO: 2051563 - DNA, 16 bp, Homo sapiens
cagcatacctgctggt

SEQ ID NO: 2051564 - DNA, 18 bp, Homo sapiens
cagcatatttatagcaat

SEQ ID NO: 2051565 - DNA, 13 bp, Homo sapiens
cagcatccagcct

SEQ ID NO: 2051566 - DNA, 15 bp, Homo sapiens
cagcatccagcctgt

SEQ ID NO: 2051567 - DNA, 14 bp, Homo sapiens
cagcatcctgcttc

SEQ ID NO: 2051568 - DNA, 15 bp, Homo sapiens
cagcatcctggcacc

SEQ ID NO: 2051569 - DNA, 16 bp, Homo sapiens
cagcatcctggcaccc

SEQ ID NO: 2051570 - DNA, 19 bp, Homo sapiens
cagcatcctggcacccggc

SEQ ID NO: 2051571 - DNA, 20 bp, Homo sapiens
cagcatcctggcacccggcc

SEQ ID NO: 2051572 - DNA, 23 bp, Homo sapiens
cagcatccttttctgcagagggg

SEQ ID NO: 2051573 - DNA, 20 bp, Homo sapiens
cagcatgggcccaggaatgc

SEQ ID NO: 2051574 - DNA, 13 bp, Homo sapiens
cagcatgtacaaa

SEQ ID NO: 2051575 - DNA, 14 bp, Homo sapiens
cagcatgtacaaaa

SEQ ID NO: 2051576 - DNA, 17 bp, Homo sapiens
cagcatgtcactcccag

SEQ ID NO: 2051577 - DNA, 15 bp, Homo sapiens
cagcattaggctttt

SEQ ID NO: 2051578 - DNA, 21 bp, Homo sapiens
cagcattaggcttttaagaaa

SEQ ID NO: 2051579 - DNA, 17 bp, Homo sapiens
cagcattattcctccag

SEQ ID NO: 2051580 - DNA, 17 bp, Homo sapiens
cagcattcagcacaccc

SEQ ID NO: 2051581 - DNA, 20 bp, Homo sapiens
cagcattcagcacaccccaa

SEQ ID NO: 2051582 - DNA, 15 bp, Homo sapiens
cagcattttactact

SEQ ID NO: 2051583 - DNA, 21 bp, Homo sapiens
cagcattttcacattttgcct

SEQ ID NO: 2051584 - DNA, 16 bp, Homo sapiens
cagccaaacacagagc

SEQ ID NO: 2051585 - DNA, 16 bp, Homo sapiens
cagccaaacagagcct

SEQ ID NO: 2051586 - DNA, 17 bp, Homo sapiens
cagccaaacccatgagg

SEQ ID NO: 2051587 - DNA, 20 bp, Homo sapiens
cagccaaataaaacctcagg

SEQ ID NO: 2051588 - DNA, 22 bp, Homo sapiens
cagccaaatgtaattgaataaa

SEQ ID NO: 2051589 - DNA, 19 bp, Homo sapiens
cagccaacaggtggcagga

SEQ ID NO: 2051590 - DNA, 16 bp, Homo sapiens
cagccacacagagcct

SEQ ID NO: 2051591 - DNA, 16 bp, Homo sapiens
cagccacacttctcag

SEQ ID NO: 2051592 - DNA, 17 bp, Homo sapiens
cagccacacttctcagg

SEQ ID NO: 2051593 - DNA, 19 bp, Homo sapiens
cagccacacttctcaggac

SEQ ID NO: 2051594 - DNA, 16 bp, Homo sapiens
cagccaccctgaggag

SEQ ID NO: 2051595 - DNA, 15 bp, Homo sapiens
cagccacctctcttt

SEQ ID NO: 2051596 - DNA, 22 bp, Homo sapiens
cagccacctcttgggcatgctc

SEQ ID NO: 2051597 - DNA, 14 bp, Homo sapiens
cagccacggccagg

SEQ ID NO: 2051598 - DNA, 15 bp, Homo sapiens
cagccacggccaggc

SEQ ID NO: 2051599 - DNA, 16 bp, Homo sapiens
cagccacggccaggcc

SEQ ID NO: 2051600 - DNA, 18 bp, Homo sapiens
cagccacggccaggccag

SEQ ID NO: 2051601 - DNA, 21 bp, Homo sapiens
cagccacggccaggccagagg

SEQ ID NO: 2051602 - DNA, 22 bp, Homo sapiens
cagccacggccaggccagaggg

SEQ ID NO: 2051603 - DNA, 17 bp, Homo sapiens
cagccagaagcccatgg

SEQ ID NO: 2051604 - DNA, 20 bp, Homo sapiens
cagccagactggcacagttt

SEQ ID NO: 2051605 - DNA, 18 bp, Homo sapiens
cagccagcagccagctct

SEQ ID NO: 2051606 - DNA, 13 bp, Homo sapiens
cagccagccctgc

SEQ ID NO: 2051607 - DNA, 20 bp, Homo sapiens
cagccagccctgcctggagg

SEQ ID NO: 2051608 - DNA, 14 bp, Homo sapiens
cagccagccgccct

SEQ ID NO: 2051609 - DNA, 17 bp, Homo sapiens
cagccagccgccctggg

SEQ ID NO: 2051610 - DNA, 18 bp, Homo sapiens
cagccagccgccctgggc

SEQ ID NO: 2051611 - DNA, 19 bp, Homo sapiens
cagccagccggtgcctggc

SEQ ID NO: 2051612 - DNA, 21 bp, Homo sapiens
cagccagcgcctccctccacc

SEQ ID NO: 2051613 - DNA, 17 bp, Homo sapiens
cagccagctcctgggca

SEQ ID NO: 2051614 - DNA, 20 bp, Homo sapiens
cagccagctcctgggcagct

SEQ ID NO: 2051615 - DNA, 17 bp, Homo sapiens
cagccagctctcagcca

SEQ ID NO: 2051616 - DNA, 20 bp, Homo sapiens
cagccagggaggacaagcag

SEQ ID NO: 2051617 - DNA, 15 bp, Homo sapiens
cagccagggccaggg

SEQ ID NO: 2051618 - DNA, 21 bp, Homo sapiens
cagccaggggctgctcatcac

SEQ ID NO: 2051619 - DNA, 16 bp, Homo sapiens
cagccatcacaagggg

SEQ ID NO: 2051620 - DNA, 20 bp, Homo sapiens
cagccatcacaaggggaacg

SEQ ID NO: 2051621 - DNA, 20 bp, Homo sapiens
cagccatgcctcatgccaca

SEQ ID NO: 2051622 - DNA, 21 bp, Homo sapiens
cagcttttaataaaattgaca

SEQ ID NO: 2051623 - DNA, 15 bp, Homo sapiens
cagcttttcccagga

SEQ ID NO: 2051624 - DNA, 11 bp, Homo sapiens
caggaaaaaaa

SEQ ID NO: 2051625 - DNA, 20 bp, Homo sapiens
caggaaaactgacagaggag

SEQ ID NO: 2051626 - DNA, 23 bp, Homo sapiens
caggaaaactgacagaggagggc

SEQ ID NO: 2051627 - DNA, 14 bp, Homo sapiens
caggaaaactgttt

SEQ ID NO: 2051628 - DNA, 17 bp, Homo sapiens
caggaaaactgtttttc

SEQ ID NO: 2051629 - DNA, 18 bp, Homo sapiens
caggaaaactgtttttca

SEQ ID NO: 2051630 - DNA, 15 bp, Homo sapiens
caggaaaagctgctg

SEQ ID NO: 2051631 - DNA, 18 bp, Homo sapiens
caggaaaagctgctgaca

SEQ ID NO: 2051632 - DNA, 20 bp, Homo sapiens
caggaaaagctgctgacagt

SEQ ID NO: 2051633 - DNA, 14 bp, Homo sapiens
caggaaaaggcctg

SEQ ID NO: 2051634 - DNA, 17 bp, Homo sapiens
caggaaaattgaatgca

SEQ ID NO: 2051635 - DNA, 13 bp, Homo sapiens
caggaaaccaaca

SEQ ID NO: 2051636 - DNA, 14 bp, Homo sapiens
caggaacagaagga

SEQ ID NO: 2051637 - DNA, 15 bp, Homo sapiens
caggaacagaaggat

SEQ ID NO: 2051638 - DNA, 18 bp, Homo sapiens
caggaacagaaggatgaa

SEQ ID NO: 2051639 - DNA, 14 bp, Homo sapiens
caggaacgagcact

SEQ ID NO: 2051640 - DNA, 18 bp, Homo sapiens
caggaacgagcactggcc

SEQ ID NO: 2051641 - DNA, 22 bp, Homo sapiens
caggaacgagcactggccagag

SEQ ID NO: 2051642 - DNA, 17 bp, Homo sapiens
caggaagaaaccccaag

SEQ ID NO: 2051643 - DNA, 22 bp, Homo sapiens
caggaagaaaccccaagcagca

SEQ ID NO: 2051644 - DNA, 21 bp, Homo sapiens
caggaagatgaaagaggaggt

SEQ ID NO: 2051645 - DNA, 12 bp, Homo sapiens
caggaagccagg

SEQ ID NO: 2051646 - DNA, 16 bp, Homo sapiens
caggaaggactatgaa

SEQ ID NO: 2051647 - DNA, 19 bp, Homo sapiens
caggaaggatggcaagcac

SEQ ID NO: 2051648 - DNA, 15 bp, Homo sapiens
caggaaggcagctgc

SEQ ID NO: 2051649 - DNA, 22 bp, Homo sapiens
caggaaggtagcccagcactgt

SEQ ID NO: 2051650 - DNA, 17 bp, Homo sapiens
caggaataggcatttgc

SEQ ID NO: 2051651 - DNA, 16 bp, Homo sapiens
caggaatcatgatctg

SEQ ID NO: 2051652 - DNA, 24 bp, Homo sapiens
caggaatctcagagacaggtggcc

SEQ ID NO: 2051653 - DNA, 15 bp, Homo sapiens
caggaatctgccatt

SEQ ID NO: 2051654 - DNA, 21 bp, Homo sapiens
caggaatgccaaggagacatc

SEQ ID NO: 2051655 - DNA, 18 bp, Homo sapiens
caggaatgttaaagtcag

SEQ ID NO: 2051656 - DNA, 17 bp, Homo sapiens
caggacacaggcctgtg

SEQ ID NO: 2051657 - DNA, 20 bp, Homo sapiens
caggacacaggcctgtgtag

SEQ ID NO: 2051658 - DNA, 19 bp, Homo sapiens
caggacacatcccggcctc

SEQ ID NO: 2051659 - DNA, 21 bp, Homo sapiens
caggacacatcccggcctctt

SEQ ID NO: 2051660 - DNA, 13 bp, Homo sapiens
caggacacctgcc

SEQ ID NO: 2051661 - DNA, 15 bp, Homo sapiens
caggacacctgcccc

SEQ ID NO: 2051662 - DNA, 19 bp, Homo sapiens
caggacacctgccccagcg

SEQ ID NO: 2051663 - DNA, 22 bp, Homo sapiens
caggacacctggccgcctccag

SEQ ID NO: 2051664 - DNA, 13 bp, Homo sapiens
caggacaggacca

SEQ ID NO: 2051665 - DNA, 22 bp, Homo sapiens
caggacagtgcttcagcctgag

SEQ ID NO: 2051666 - DNA, 15 bp, Homo sapiens
caggacatggggcat

SEQ ID NO: 2051667 - DNA, 18 bp, Homo sapiens
caggacatggggcataga

SEQ ID NO: 2051668 - DNA, 16 bp, Homo sapiens
caggaccacaaaaatg

SEQ ID NO: 2051669 - DNA, 13 bp, Homo sapiens
caggaccaggact

SEQ ID NO: 2051670 - DNA, 20 bp, Homo sapiens
caggaccagtcccagagcag

SEQ ID NO: 2051671 - DNA, 11 bp, Homo sapiens
caggacccagg

SEQ ID NO: 2051672 - DNA, 12 bp, Homo sapiens
caggacccaggc

SEQ ID NO: 2051673 - DNA, 18 bp, Homo sapiens
caggacccaggccctcca

SEQ ID NO: 2051674 - DNA, 21 bp, Homo sapiens
caggacccaggccctccatgg

SEQ ID NO: 2051675 - DNA, 15 bp, Homo sapiens
caggaccccaacccc

SEQ ID NO: 2051676 - DNA, 13 bp, Homo sapiens
caggacctccggg

SEQ ID NO: 2051677 - DNA, 13 bp, Homo sapiens
caggacctgacta

SEQ ID NO: 2051678 - DNA, 13 bp, Homo sapiens
caggacctggctt

SEQ ID NO: 2051679 - DNA, 15 bp, Homo sapiens
caggacctggcttgg

SEQ ID NO: 2051680 - DNA, 20 bp, Homo sapiens
caggaccttttgaagtagtt

SEQ ID NO: 2051681 - DNA, 12 bp, Homo sapiens
caggacgccact

SEQ ID NO: 2051682 - DNA, 18 bp, Homo sapiens
caggacgccactcatttc

SEQ ID NO: 2051683 - DNA, 19 bp, Homo sapiens
caggacgccactcatttca

SEQ ID NO: 2051684 - DNA, 20 bp, Homo sapiens
caggacgccactcatttcat

SEQ ID NO: 2051685 - DNA, 21 bp, Homo sapiens
caggactaacactcagaagcc

SEQ ID NO: 2051686 - DNA, 22 bp, Homo sapiens
caggactaacactcagaagcct

SEQ ID NO: 2051687 - DNA, 12 bp, Homo sapiens
caggactcaccc

SEQ ID NO: 2051688 - DNA, 17 bp, Homo sapiens
caggactccccaggcca

SEQ ID NO: 2051689 - DNA, 18 bp, Homo sapiens
caggactccccaggccag

SEQ ID NO: 2051690 - DNA, 16 bp, Homo sapiens
caggactctgcctcct

SEQ ID NO: 2051691 - DNA, 18 bp, Homo sapiens
caggactgaattgtcccc

SEQ ID NO: 2051692 - DNA, 20 bp, Homo sapiens
caggactgaattgtccccag

SEQ ID NO: 2051693 - DNA, 21 bp, Homo sapiens
caggacttaacggctccagga

SEQ ID NO: 2051694 - DNA, 21 bp, Homo sapiens
caggactttgatgcatttcca

SEQ ID NO: 2051695 - DNA, 23 bp, Homo sapiens
caggactttgatgcatttccaca

SEQ ID NO: 2051696 - DNA, 14 bp, Homo sapiens
caggagaagaaaga

SEQ ID NO: 2051697 - DNA, 20 bp, Homo sapiens
caggagaagaaagaggtgac

SEQ ID NO: 2051698 - DNA, 15 bp, Homo sapiens
caggagacaggaagg

SEQ ID NO: 2051699 - DNA, 18 bp, Homo sapiens
caggagagacgcagccct

SEQ ID NO: 2051700 - DNA, 11 bp, Homo sapiens
caggagagaga

SEQ ID NO: 2051701 - DNA, 13 bp, Homo sapiens
caggagagccagc

SEQ ID NO: 2051702 - DNA, 21 bp, Homo sapiens
caggagagccagccctccctg

SEQ ID NO: 2051703 - DNA, 23 bp, Homo sapiens
caggagagccagccctccctgtc

SEQ ID NO: 2051704 - DNA, 15 bp, Homo sapiens
caggagaggggcaga

SEQ ID NO: 2051705 - DNA, 20 bp, Homo sapiens
caggagatggaagttgcagt

SEQ ID NO: 2051706 - DNA, 19 bp, Homo sapiens
caggagcaaatgtttctgc

SEQ ID NO: 2051707 - DNA, 16 bp, Homo sapiens
caggagcacaggcagc

SEQ ID NO: 2051708 - DNA, 18 bp, Homo sapiens
caggagcacaggcagctg

SEQ ID NO: 2051709 - DNA, 23 bp, Homo sapiens
caggagcacaggcagctggatga

SEQ ID NO: 2051710 - DNA, 14 bp, Homo sapiens
caggagcagacaga

SEQ ID NO: 2051711 - DNA, 15 bp, Homo sapiens
caggagcagacagag

SEQ ID NO: 2051712 - DNA, 18 bp, Homo sapiens
caggagcaggaacagaga

SEQ ID NO: 2051713 - DNA, 20 bp, Homo sapiens
caggagccccgaggccttct

SEQ ID NO: 2051714 - DNA, 22 bp, Homo sapiens
caggagccccgaggccttctct

SEQ ID NO: 2051715 - DNA, 23 bp, Homo sapiens
caggagccccgaggccttctctg

SEQ ID NO: 2051716 - DNA, 16 bp, Homo sapiens
caggagcctaccccct

SEQ ID NO: 2051717 - DNA, 12 bp, Homo sapiens
caggagcctggc

SEQ ID NO: 2051718 - DNA, 15 bp, Homo sapiens
caggagcctgtgcct

SEQ ID NO: 2051719 - DNA, 16 bp, Homo sapiens
caggagcctgtgcctc

SEQ ID NO: 2051720 - DNA, 17 bp, Homo sapiens
caggagctacctgtgtg

SEQ ID NO: 2051721 - DNA, 22 bp, Homo sapiens
caggagctacctgtgtggacag

SEQ ID NO: 2051722 - DNA, 13 bp, Homo sapiens
caggagctcagcc

SEQ ID NO: 2051723 - DNA, 21 bp, Homo sapiens
caggagctgagtcacctcctc

SEQ ID NO: 2051724 - DNA, 16 bp, Homo sapiens
caggagctgctcctgg

SEQ ID NO: 2051725 - DNA, 17 bp, Homo sapiens
caggagcttgcaagaag

SEQ ID NO: 2051726 - DNA, 23 bp, Homo sapiens
caggaggattgcttgagcccagg

SEQ ID NO: 2051727 - DNA, 23 bp, Homo sapiens
caggaggccctggtgtcaggcag

SEQ ID NO: 2051728 - DNA, 20 bp, Homo sapiens
caggaggcctggccttgtca

SEQ ID NO: 2051729 - DNA, 18 bp, Homo sapiens
caggaggcgaataaatgt

SEQ ID NO: 2051730 - DNA, 20 bp, Homo sapiens
caggaggcgaataaatgttc

SEQ ID NO: 2051731 - DNA, 16 bp, Homo sapiens
caggaggcgcagcccg

SEQ ID NO: 2051732 - DNA, 18 bp, Homo sapiens
caggaggcgcagcccgaa

SEQ ID NO: 2051733 - DNA, 22 bp, Homo sapiens
caggaggcgcagcccgaagccc

SEQ ID NO: 2051734 - DNA, 23 bp, Homo sapiens
caggaggcgcagcccgaagccca

SEQ ID NO: 2051735 - DNA, 20 bp, Homo sapiens
caggaggcggaggttgcagt

SEQ ID NO: 2051736 - DNA, 13 bp, Homo sapiens
caggtctggggct

SEQ ID NO: 2051737 - DNA, 20 bp, Homo sapiens
caggtcttgaactcctggcc

SEQ ID NO: 2051738 - DNA, 13 bp, Homo sapiens
caggtgaaaatgt

SEQ ID NO: 2051739 - DNA, 13 bp, Homo sapiens
caggtgcaagaga

SEQ ID NO: 2051740 - DNA, 18 bp, Homo sapiens
caggtgcaagagacagag

SEQ ID NO: 2051741 - DNA, 19 bp, Homo sapiens
caggtgcaagagacagagc

SEQ ID NO: 2051742 - DNA, 20 bp, Homo sapiens
caggtgccaccaataaaaat

SEQ ID NO: 2051743 - DNA, 16 bp, Homo sapiens
caggtgccactccctg

SEQ ID NO: 2051744 - DNA, 19 bp, Homo sapiens
caggtgccactccctgagc

SEQ ID NO: 2051745 - DNA, 20 bp, Homo sapiens
caggtggagagcactagaag

SEQ ID NO: 2051746 - DNA, 12 bp, Homo sapiens
caggtggatcac

SEQ ID NO: 2051747 - DNA, 18 bp, Homo sapiens
caggtggatcacctgacg

SEQ ID NO: 2051748 - DNA, 17 bp, Homo sapiens
caggtggcaggaccagg

SEQ ID NO: 2051749 - DNA, 18 bp, Homo sapiens
caggtggcaggaccagga

SEQ ID NO: 2051750 - DNA, 15 bp, Homo sapiens
caggtggccactcca

SEQ ID NO: 2051751 - DNA, 16 bp, Homo sapiens
caggtggccactccag

SEQ ID NO: 2051752 - DNA, 15 bp, Homo sapiens
caggtggggcagctt

SEQ ID NO: 2051753 - DNA, 11 bp, Homo sapiens
caggtgtccct

SEQ ID NO: 2051754 - DNA, 15 bp, Homo sapiens
caggtgtccctgcac

SEQ ID NO: 2051755 - DNA, 16 bp, Homo sapiens
caggtgtccctgcact

SEQ ID NO: 2051756 - DNA, 19 bp, Homo sapiens
caggtgtccctgcacttgc

SEQ ID NO: 2051757 - DNA, 22 bp, Homo sapiens
caggtgtctatccacctggggt

SEQ ID NO: 2051758 - DNA, 16 bp, Homo sapiens
caggtgtgaaccacca

SEQ ID NO: 2051759 - DNA, 22 bp, Homo sapiens
caggtgtgaaccaccacaccca

SEQ ID NO: 2051760 - DNA, 21 bp, Homo sapiens
caggtgtgagtcaccaagccc

SEQ ID NO: 2051761 - DNA, 16 bp, Homo sapiens
caggtgtggtggctca

SEQ ID NO: 2051762 - DNA, 22 bp, Homo sapiens
caggtgttgccatttctctgct

SEQ ID NO: 2051763 - DNA, 23 bp, Homo sapiens
caggtgttgccatttctctgctt

SEQ ID NO: 2051764 - DNA, 19 bp, Homo sapiens
caggttagaacctagaagg

SEQ ID NO: 2051765 - DNA, 13 bp, Homo sapiens
caggttcagcttg

SEQ ID NO: 2051766 - DNA, 14 bp, Homo sapiens
caggttcccagcag

SEQ ID NO: 2051767 - DNA, 12 bp, Homo sapiens
caggttcctaag

SEQ ID NO: 2051768 - DNA, 20 bp, Homo sapiens
caggttgaggggctcctgga

SEQ ID NO: 2051769 - DNA, 21 bp, Homo sapiens
caggttgaggggctcctggaa

SEQ ID NO: 2051770 - DNA, 23 bp, Homo sapiens
caggttgtctgaagtcactgcac

SEQ ID NO: 2051771 - DNA, 20 bp, Homo sapiens
cagtaaaaacttgtactatg

SEQ ID NO: 2051772 - DNA, 21 bp, Homo sapiens
cagtaaaaacttgtactatgt

SEQ ID NO: 2051773 - DNA, 15 bp, Homo sapiens
cagtaaagtttaaaa

SEQ ID NO: 2051774 - DNA, 19 bp, Homo sapiens
cagtaaagtttaaaaaata

SEQ ID NO: 2051775 - DNA, 20 bp, Homo sapiens
cagtaaagtttaaaaaatac

SEQ ID NO: 2051776 - DNA, 19 bp, Homo sapiens
cagtaaataaattgtttga

SEQ ID NO: 2051777 - DNA, 21 bp, Homo sapiens
cagtaattggtccgatctttg

SEQ ID NO: 2051778 - DNA, 14 bp, Homo sapiens
cagtaatttagaaa

SEQ ID NO: 2051779 - DNA, 17 bp, Homo sapiens
cagtaatttgaggacaa

SEQ ID NO: 2051780 - DNA, 18 bp, Homo sapiens
cagtacctgggaaaggac

SEQ ID NO: 2051781 - DNA, 21 bp, Homo sapiens
cagtacctgggaaaggaccca

SEQ ID NO: 2051782 - DNA, 22 bp, Homo sapiens
cagtacctgggaaaggacccac

SEQ ID NO: 2051783 - DNA, 22 bp, Homo sapiens
cagtagatggtacgatgcatcc

SEQ ID NO: 2051784 - DNA, 21 bp, Homo sapiens
cagtagcacaagttatttaaa

SEQ ID NO: 2051785 - DNA, 12 bp, Homo sapiens
cagtagcaggga

SEQ ID NO: 2051786 - DNA, 20 bp, Homo sapiens
cagtagccaagttatattga

SEQ ID NO: 2051787 - DNA, 18 bp, Homo sapiens
cagtagcttaaataaatt

SEQ ID NO: 2051788 - DNA, 20 bp, Homo sapiens
cagtaggctttatgctgtgt

SEQ ID NO: 2051789 - DNA, 22 bp, Homo sapiens
cagtaggtaatgattatgtgtc

SEQ ID NO: 2051790 - DNA, 16 bp, Homo sapiens
cagtaggtccaagggc

SEQ ID NO: 2051791 - DNA, 21 bp, Homo sapiens
cagtagtaattgatttgaccc

SEQ ID NO: 2051792 - DNA, 16 bp, Homo sapiens
cagtagtctctgtgct

SEQ ID NO: 2051793 - DNA, 17 bp, Homo sapiens
cagtagtctctgtgctt

SEQ ID NO: 2051794 - DNA, 23 bp, Homo sapiens
cagtagtctctgtgctttgactc

SEQ ID NO: 2051795 - DNA, 18 bp, Homo sapiens
cagtagtttgagaccagc

SEQ ID NO: 2051796 - DNA, 22 bp, Homo sapiens
cagtagtttgagaccagcctgg

SEQ ID NO: 2051797 - DNA, 16 bp, Homo sapiens
cagtataaaagacaaa

SEQ ID NO: 2051798 - DNA, 14 bp, Homo sapiens
cagtatatttatag

SEQ ID NO: 2051799 - DNA, 14 bp, Homo sapiens
cagtatatttctga

SEQ ID NO: 2051800 - DNA, 14 bp, Homo sapiens
cagtatatttgaaa

SEQ ID NO: 2051801 - DNA, 15 bp, Homo sapiens
cagtatggccatggg

SEQ ID NO: 2051802 - DNA, 16 bp, Homo sapiens
cagtattacttctgct

SEQ ID NO: 2051803 - DNA, 18 bp, Homo sapiens
cagtattacttctgctac

SEQ ID NO: 2051804 - DNA, 19 bp, Homo sapiens
cagtattacttctgctaca

SEQ ID NO: 2051805 - DNA, 18 bp, Homo sapiens
cagtattccatgggatgt

SEQ ID NO: 2051806 - DNA, 19 bp, Homo sapiens
cagtattcttgtcaaaaaa

SEQ ID NO: 2051807 - DNA, 20 bp, Homo sapiens
cagtattgccacaatgcctc

SEQ ID NO: 2051808 - DNA, 19 bp, Homo sapiens
cagtatttgtacaaatact

SEQ ID NO: 2051809 - DNA, 15 bp, Homo sapiens
cagtattttattaaa

SEQ ID NO: 2051810 - DNA, 18 bp, Homo sapiens
cagtattttattaaagca

SEQ ID NO: 2051811 - DNA, 21 bp, Homo sapiens
cagtattttggagaaattatt

SEQ ID NO: 2051812 - DNA, 23 bp, Homo sapiens
cagtattttggagaaattattta

SEQ ID NO: 2051813 - DNA, 19 bp, Homo sapiens
cagtcagttcccggagcac

SEQ ID NO: 2051814 - DNA, 20 bp, Homo sapiens
cagtcagttcccggagcaca

SEQ ID NO: 2051815 - DNA, 11 bp, Homo sapiens
cagtcatttaa

SEQ ID NO: 2051816 - DNA, 18 bp, Homo sapiens
cagtccagatgccttcct

SEQ ID NO: 2051817 - DNA, 19 bp, Homo sapiens
cagtccagatgccttcctg

SEQ ID NO: 2051818 - DNA, 20 bp, Homo sapiens
cagtccagatgccttcctgt

SEQ ID NO: 2051819 - DNA, 15 bp, Homo sapiens
cagtcccagagcagg

SEQ ID NO: 2051820 - DNA, 19 bp, Homo sapiens
cagtccccagcccttctgc

SEQ ID NO: 2051821 - DNA, 15 bp, Homo sapiens
cagtccccagtcacc

SEQ ID NO: 2051822 - DNA, 17 bp, Homo sapiens
cagtccccctgccccag

SEQ ID NO: 2051823 - DNA, 23 bp, Homo sapiens
cagtccccgtgaaggagagccct

SEQ ID NO: 2051824 - DNA, 14 bp, Homo sapiens
cagtcccgtggagg

SEQ ID NO: 2051825 - DNA, 16 bp, Homo sapiens
cagtcccgtggagggt

SEQ ID NO: 2051826 - DNA, 22 bp, Homo sapiens
cagtccctgggggaagccctgg

SEQ ID NO: 2051827 - DNA, 21 bp, Homo sapiens
cagtcccttgctgacatggct

SEQ ID NO: 2051828 - DNA, 18 bp, Homo sapiens
cagtccgcagtctggcct

SEQ ID NO: 2051829 - DNA, 17 bp, Homo sapiens
cagtccgtccaccacct

SEQ ID NO: 2051830 - DNA, 17 bp, Homo sapiens
cagtcctagagctcctg

SEQ ID NO: 2051831 - DNA, 21 bp, Homo sapiens
cagtcctagagctcctgtccc

SEQ ID NO: 2051832 - DNA, 17 bp, Homo sapiens
cagtcctcacagcctct

SEQ ID NO: 2051833 - DNA, 11 bp, Homo sapiens
cagtcctggaa

SEQ ID NO: 2051834 - DNA, 21 bp, Homo sapiens
cagtcctgggagaacctcagg

SEQ ID NO: 2051835 - DNA, 22 bp, Homo sapiens
cagtctaaagctggtttaatgt

SEQ ID NO: 2051836 - DNA, 22 bp, Homo sapiens
cagtctacgttctccagcccac

SEQ ID NO: 2051837 - DNA, 23 bp, Homo sapiens
cagtctacgttctccagcccaca

SEQ ID NO: 2051838 - DNA, 19 bp, Homo sapiens
cagtctcaagcactaaaaa

SEQ ID NO: 2051839 - DNA, 11 bp, Homo sapiens
cagtctcagaa

SEQ ID NO: 2051840 - DNA, 21 bp, Homo sapiens
cagtctcagaatgtcattttg

SEQ ID NO: 2051841 - DNA, 15 bp, Homo sapiens
cagtctcaggaaatc

SEQ ID NO: 2051842 - DNA, 17 bp, Homo sapiens
cagtctcagtccagatg

SEQ ID NO: 2051843 - DNA, 14 bp, Homo sapiens
cagtctcccattct

SEQ ID NO: 2051844 - DNA, 16 bp, Homo sapiens
cagtctctctctccct

SEQ ID NO: 2051845 - DNA, 17 bp, Homo sapiens
cagtctctctctccctt

SEQ ID NO: 2051846 - DNA, 11 bp, Homo sapiens
cagtctgagct

SEQ ID NO: 2051847 - DNA, 15 bp, Homo sapiens
cagtctgatctgtga

SEQ ID NO: 2051848 - DNA, 21 bp, Homo sapiens
cagtctgattcccaagctctg

SEQ ID NO: 2051849 - DNA, 15 bp, Homo sapiens
cagtctggaatgcag

SEQ ID NO: 2051850 - DNA, 17 bp, Homo sapiens
catcagttactggtttc

SEQ ID NO: 2051851 - DNA, 12 bp, Homo sapiens
catcataaaata

SEQ ID NO: 2051852 - DNA, 13 bp, Homo sapiens
catcataaaataa

SEQ ID NO: 2051853 - DNA, 18 bp, Homo sapiens
catcataaaataaagtat

SEQ ID NO: 2051854 - DNA, 23 bp, Homo sapiens
catcataaaataaagtatatata

SEQ ID NO: 2051855 - DNA, 12 bp, Homo sapiens
catcataaccat

SEQ ID NO: 2051856 - DNA, 22 bp, Homo sapiens
catcatatcctttgccccaagg

SEQ ID NO: 2051857 - DNA, 12 bp, Homo sapiens
catcatattgta

SEQ ID NO: 2051858 - DNA, 16 bp, Homo sapiens
catcatattgtatgta

SEQ ID NO: 2051859 - DNA, 20 bp, Homo sapiens
catcatattgtatgtaagta

SEQ ID NO: 2051860 - DNA, 21 bp, Homo sapiens
catcatcaggcttggaatgaa

SEQ ID NO: 2051861 - DNA, 19 bp, Homo sapiens
catcatgcctctgaggcca

SEQ ID NO: 2051862 - DNA, 15 bp, Homo sapiens
catcatggctatctg

SEQ ID NO: 2051863 - DNA, 16 bp, Homo sapiens
catcatgtgcctggaa

SEQ ID NO: 2051864 - DNA, 17 bp, Homo sapiens
catcatgtgcctggaaa

SEQ ID NO: 2051865 - DNA, 17 bp, Homo sapiens
catcattataaacgtga

SEQ ID NO: 2051866 - DNA, 22 bp, Homo sapiens
catcattccttgagaaaaacaa

SEQ ID NO: 2051867 - DNA, 14 bp, Homo sapiens
catcattttttact

SEQ ID NO: 2051868 - DNA, 15 bp, Homo sapiens
catccaaccccccac

SEQ ID NO: 2051869 - DNA, 16 bp, Homo sapiens
catccaaccccccacc

SEQ ID NO: 2051870 - DNA, 21 bp, Homo sapiens
catccaactcctggagatttc

SEQ ID NO: 2051871 - DNA, 22 bp, Homo sapiens
catccaaggagaaacagagaca

SEQ ID NO: 2051872 - DNA, 16 bp, Homo sapiens
catccaatctgctcag

SEQ ID NO: 2051873 - DNA, 14 bp, Homo sapiens
catccaccaatctc

SEQ ID NO: 2051874 - DNA, 19 bp, Homo sapiens
catccacccagtgctgcca

SEQ ID NO: 2051875 - DNA, 14 bp, Homo sapiens
catccaccccactg

SEQ ID NO: 2051876 - DNA, 23 bp, Homo sapiens
catccactgtgccatgtgccagg

SEQ ID NO: 2051877 - DNA, 12 bp, Homo sapiens
catccagcctgt

SEQ ID NO: 2051878 - DNA, 14 bp, Homo sapiens
catccagcctgtgt

SEQ ID NO: 2051879 - DNA, 15 bp, Homo sapiens
catccagcctgtgtg

SEQ ID NO: 2051880 - DNA, 16 bp, Homo sapiens
catccagcctgtgtgt

SEQ ID NO: 2051881 - DNA, 22 bp, Homo sapiens
catccaggaggaataagctccc

SEQ ID NO: 2051882 - DNA, 16 bp, Homo sapiens
catccagttgcaataa

SEQ ID NO: 2051883 - DNA, 20 bp, Homo sapiens
catccagttgcaataaaata

SEQ ID NO: 2051884 - DNA, 15 bp, Homo sapiens
catccagtttgttct

SEQ ID NO: 2051885 - DNA, 16 bp, Homo sapiens
catccagtttgttctc

SEQ ID NO: 2051886 - DNA, 19 bp, Homo sapiens
catccataaagcaagctca

SEQ ID NO: 2051887 - DNA, 20 bp, Homo sapiens
catccatagtgcactagcat

SEQ ID NO: 2051888 - DNA, 15 bp, Homo sapiens
catccatcagctccc

SEQ ID NO: 2051889 - DNA, 18 bp, Homo sapiens
catccatgtcctatgtgt

SEQ ID NO: 2051890 - DNA, 14 bp, Homo sapiens
catccattcccaag

SEQ ID NO: 2051891 - DNA, 14 bp, Homo sapiens
catccattcctcag

SEQ ID NO: 2051892 - DNA, 20 bp, Homo sapiens
catccatttcatctatttct

SEQ ID NO: 2051893 - DNA, 16 bp, Homo sapiens
catcccaggaggggcc

SEQ ID NO: 2051894 - DNA, 19 bp, Homo sapiens
catcccaggaggggcctct

SEQ ID NO: 2051895 - DNA, 13 bp, Homo sapiens
catcccaggggac

SEQ ID NO: 2051896 - DNA, 14 bp, Homo sapiens
catcccaggggacc

SEQ ID NO: 2051897 - DNA, 16 bp, Homo sapiens
catcccatcatggctg

SEQ ID NO: 2051898 - DNA, 11 bp, Homo sapiens
catcccatccc

SEQ ID NO: 2051899 - DNA, 19 bp, Homo sapiens
catcccatctaagctgcag

SEQ ID NO: 2051900 - DNA, 21 bp, Homo sapiens
catcccatctaagctgcagct

SEQ ID NO: 2051901 - DNA, 12 bp, Homo sapiens
catcccattgcc

SEQ ID NO: 2051902 - DNA, 16 bp, Homo sapiens
catcccattgccctgg

SEQ ID NO: 2051903 - DNA, 19 bp, Homo sapiens
catccccagaggtgaccca

SEQ ID NO: 2051904 - DNA, 21 bp, Homo sapiens
catccccaggtctctccactg

SEQ ID NO: 2051905 - DNA, 23 bp, Homo sapiens
catcccccactgccacaccctcc

SEQ ID NO: 2051906 - DNA, 21 bp, Homo sapiens
catcccctcgtcctgtcccag

SEQ ID NO: 2051907 - DNA, 12 bp, Homo sapiens
catcccctttcc

SEQ ID NO: 2051908 - DNA, 17 bp, Homo sapiens
catcccctttcctcccc

SEQ ID NO: 2051909 - DNA, 21 bp, Homo sapiens
catcccctttcctccccacct

SEQ ID NO: 2051910 - DNA, 17 bp, Homo sapiens
catcccgctcctgctga

SEQ ID NO: 2051911 - DNA, 18 bp, Homo sapiens
catcccggcctcttccac

SEQ ID NO: 2051912 - DNA, 16 bp, Homo sapiens
catcccgtcttctcca

SEQ ID NO: 2051913 - DNA, 18 bp, Homo sapiens
catcccgtcttctccaac

SEQ ID NO: 2051914 - DNA, 16 bp, Homo sapiens
catccctatttatagt

SEQ ID NO: 2051915 - DNA, 11 bp, Homo sapiens
catccctgggc

SEQ ID NO: 2051916 - DNA, 12 bp, Homo sapiens
catccctgggcc

SEQ ID NO: 2051917 - DNA, 17 bp, Homo sapiens
catccctgggcccctcc

SEQ ID NO: 2051918 - DNA, 16 bp, Homo sapiens
catccctgggcctgct

SEQ ID NO: 2051919 - DNA, 20 bp, Homo sapiens
catccctgggcctgctgctg

SEQ ID NO: 2051920 - DNA, 16 bp, Homo sapiens
catcccttcctcccca

SEQ ID NO: 2051921 - DNA, 19 bp, Homo sapiens
catcccttcctccccagtc

SEQ ID NO: 2051922 - DNA, 14 bp, Homo sapiens
catccgaggcaggg

SEQ ID NO: 2051923 - DNA, 15 bp, Homo sapiens
catccgcagcccagg

SEQ ID NO: 2051924 - DNA, 20 bp, Homo sapiens
catccggagaattgcctcta

SEQ ID NO: 2051925 - DNA, 13 bp, Homo sapiens
catccggctcctg

SEQ ID NO: 2051926 - DNA, 16 bp, Homo sapiens
catccgggacgcttcc

SEQ ID NO: 2051927 - DNA, 17 bp, Homo sapiens
catccgggacgcttcca

SEQ ID NO: 2051928 - DNA, 18 bp, Homo sapiens
catccgggacgcttccag

SEQ ID NO: 2051929 - DNA, 21 bp, Homo sapiens
catccgggacgcttccagacc

SEQ ID NO: 2051930 - DNA, 24 bp, Homo sapiens
catccgggacgcttccagaccacc

SEQ ID NO: 2051931 - DNA, 21 bp, Homo sapiens
catccgtagttccctgaaaac

SEQ ID NO: 2051932 - DNA, 19 bp, Homo sapiens
catcctaccaatgcatgca

SEQ ID NO: 2051933 - DNA, 12 bp, Homo sapiens
catcctgcagcc

SEQ ID NO: 2051934 - DNA, 22 bp, Homo sapiens
catcctgccttcatggaactca

SEQ ID NO: 2051935 - DNA, 19 bp, Homo sapiens
catcctgctttccctcccc

SEQ ID NO: 2051936 - DNA, 23 bp, Homo sapiens
catcctggcacccggcccctgct

SEQ ID NO: 2051937 - DNA, 12 bp, Homo sapiens
catcctggcccc

SEQ ID NO: 2051938 - DNA, 17 bp, Homo sapiens
catcctggcccctccag

SEQ ID NO: 2051939 - DNA, 14 bp, Homo sapiens
catcctggcctcct

SEQ ID NO: 2051940 - DNA, 23 bp, Homo sapiens
catcctgggccttacctcccctg

SEQ ID NO: 2051941 - DNA, 13 bp, Homo sapiens
catccttcaccag

SEQ ID NO: 2051942 - DNA, 12 bp, Homo sapiens
catccttctgcc

SEQ ID NO: 2051943 - DNA, 15 bp, Homo sapiens
catccttggcctggc

SEQ ID NO: 2051944 - DNA, 15 bp, Homo sapiens
catcgaacaaactga

SEQ ID NO: 2051945 - DNA, 13 bp, Homo sapiens
catcgccagacaa

SEQ ID NO: 2051946 - DNA, 19 bp, Homo sapiens
catcggaggctgggcccct

SEQ ID NO: 2051947 - DNA, 18 bp, Homo sapiens
catcgtgacccttcaggg

SEQ ID NO: 2051948 - DNA, 20 bp, Homo sapiens
catcgtgacccttcagggcc

SEQ ID NO: 2051949 - DNA, 16 bp, Homo sapiens
catctaagctgcagct

SEQ ID NO: 2051950 - DNA, 21 bp, Homo sapiens
catctaagctgcagcttcctg

SEQ ID NO: 2051951 - DNA, 23 bp, Homo sapiens
catctaagctgcagcttcctgtc

SEQ ID NO: 2051952 - DNA, 23 bp, Homo sapiens
catctaatagcgggttactttca

SEQ ID NO: 2051953 - DNA, 16 bp, Homo sapiens
catctacaagcatttg

SEQ ID NO: 2051954 - DNA, 16 bp, Homo sapiens
catctacacagcctgg

SEQ ID NO: 2051955 - DNA, 17 bp, Homo sapiens
catctacacagcctgga

SEQ ID NO: 2051956 - DNA, 15 bp, Homo sapiens
catctactacagggt

SEQ ID NO: 2051957 - DNA, 23 bp, Homo sapiens
catctactcattgtctcagtgct

SEQ ID NO: 2051958 - DNA, 21 bp, Homo sapiens
catctagagattttcttggca

SEQ ID NO: 2051959 - DNA, 22 bp, Homo sapiens
catctagaggcttccttcattt

SEQ ID NO: 2051960 - DNA, 23 bp, Homo sapiens
catctagaggcttccttcatttc

SEQ ID NO: 2051961 - DNA, 17 bp, Homo sapiens
catctatggagggcaga

SEQ ID NO: 2051962 - DNA, 20 bp, Homo sapiens
catctatggcagtccagcca

SEQ ID NO: 2051963 - DNA, 17 bp, Homo sapiens
catctattctttcccta

SEQ ID NO: 2051964 - DNA, 23 bp, Homo sapiens
catctattctttccctagaggca

SEQ ID NO: 2051965 - DNA, 13 bp, Homo sapiens
cattatgtagaaa

SEQ ID NO: 2051966 - DNA, 17 bp, Homo sapiens
cattatgtagaaatatt

SEQ ID NO: 2051967 - DNA, 13 bp, Homo sapiens
cattatgtgtgca

SEQ ID NO: 2051968 - DNA, 17 bp, Homo sapiens
cattatgtgtgcatgtg

SEQ ID NO: 2051969 - DNA, 14 bp, Homo sapiens
cattattcatatgc

SEQ ID NO: 2051970 - DNA, 18 bp, Homo sapiens
cattattggaatataatt

SEQ ID NO: 2051971 - DNA, 17 bp, Homo sapiens
cattatttaatgtttga

SEQ ID NO: 2051972 - DNA, 19 bp, Homo sapiens
cattatttaatgtttgatt

SEQ ID NO: 2051973 - DNA, 13 bp, Homo sapiens
cattatttgcatg

SEQ ID NO: 2051974 - DNA, 14 bp, Homo sapiens
cattatttgcatgt

SEQ ID NO: 2051975 - DNA, 22 bp, Homo sapiens
cattcaactttagtatttttac

SEQ ID NO: 2051976 - DNA, 18 bp, Homo sapiens
cattcaagcctgtgaata

SEQ ID NO: 2051977 - DNA, 13 bp, Homo sapiens
cattcaatgttta

SEQ ID NO: 2051978 - DNA, 17 bp, Homo sapiens
cattcacatttgatgta

SEQ ID NO: 2051979 - DNA, 21 bp, Homo sapiens
cattcacatttgatgtacatg

SEQ ID NO: 2051980 - DNA, 18 bp, Homo sapiens
cattcagcacaccccaag

SEQ ID NO: 2051981 - DNA, 20 bp, Homo sapiens
cattcaggaccccaacccct

SEQ ID NO: 2051982 - DNA, 17 bp, Homo sapiens
cattcaggcagcactga

SEQ ID NO: 2051983 - DNA, 15 bp, Homo sapiens
cattcataactttca

SEQ ID NO: 2051984 - DNA, 18 bp, Homo sapiens
cattcatgccaaagcaaa

SEQ ID NO: 2051985 - DNA, 18 bp, Homo sapiens
cattccaagtcaacactc

SEQ ID NO: 2051986 - DNA, 20 bp, Homo sapiens
cattccaagtcaacactctt

SEQ ID NO: 2051987 - DNA, 17 bp, Homo sapiens
cattccaccttcccatg

SEQ ID NO: 2051988 - DNA, 13 bp, Homo sapiens
cattccatgattt

SEQ ID NO: 2051989 - DNA, 23 bp, Homo sapiens
cattcccagagtcagaggagaag

SEQ ID NO: 2051990 - DNA, 22 bp, Homo sapiens
cattccccaattatcttattta

SEQ ID NO: 2051991 - DNA, 13 bp, Homo sapiens
cattccccaggtg

SEQ ID NO: 2051992 - DNA, 13 bp, Homo sapiens
cattccccatggg

SEQ ID NO: 2051993 - DNA, 16 bp, Homo sapiens
cattccccgctgccca

SEQ ID NO: 2051994 - DNA, 11 bp, Homo sapiens
cattcccctcg

SEQ ID NO: 2051995 - DNA, 23 bp, Homo sapiens
cattcccgtggtctccttgcact

SEQ ID NO: 2051996 - DNA, 11 bp, Homo sapiens
cattccctgag

SEQ ID NO: 2051997 - DNA, 18 bp, Homo sapiens
cattccctgagtcaccag

SEQ ID NO: 2051998 - DNA, 21 bp, Homo sapiens
cattccctgagtcaccaggaa

SEQ ID NO: 2051999 - DNA, 13 bp, Homo sapiens
cattccctggcct

SEQ ID NO: 2052000 - DNA, 18 bp, Homo sapiens
cattccctggcctggctc

SEQ ID NO: 2052001 - DNA, 13 bp, Homo sapiens
cattcctatttct

SEQ ID NO: 2052002 - DNA, 14 bp, Homo sapiens
cattcctcagctgc

SEQ ID NO: 2052003 - DNA, 16 bp, Homo sapiens
cattcctcagctgcca

SEQ ID NO: 2052004 - DNA, 17 bp, Homo sapiens
cattcctcagctgccaa

SEQ ID NO: 2052005 - DNA, 13 bp, Homo sapiens
cattcctcaggga

SEQ ID NO: 2052006 - DNA, 19 bp, Homo sapiens
cattccttctggaggacac

SEQ ID NO: 2052007 - DNA, 15 bp, Homo sapiens
cattccttgtcacca

SEQ ID NO: 2052008 - DNA, 16 bp, Homo sapiens
cattccttgtcaccag

SEQ ID NO: 2052009 - DNA, 23 bp, Homo sapiens
cattcgaggtgtcaccctgcaga

SEQ ID NO: 2052010 - DNA, 15 bp, Homo sapiens
cattcggaccctgcc

SEQ ID NO: 2052011 - DNA, 17 bp, Homo sapiens
cattctcactcctacct

SEQ ID NO: 2052012 - DNA, 22 bp, Homo sapiens
cattctcatatgtagccctcat

SEQ ID NO: 2052013 - DNA, 15 bp, Homo sapiens
cattctcctgcctgt

SEQ ID NO: 2052014 - DNA, 23 bp, Homo sapiens
cattctcctgcctgtagcagtga

SEQ ID NO: 2052015 - DNA, 21 bp, Homo sapiens
cattctcctgtgcccctcaga

SEQ ID NO: 2052016 - DNA, 12 bp, Homo sapiens
cattctctctcc

SEQ ID NO: 2052017 - DNA, 15 bp, Homo sapiens
cattctctctcctgt

SEQ ID NO: 2052018 - DNA, 16 bp, Homo sapiens
cattctctctcctgtc

SEQ ID NO: 2052019 - DNA, 18 bp, Homo sapiens
cattctctctcctgtcca

SEQ ID NO: 2052020 - DNA, 18 bp, Homo sapiens
cattctctttctttttct

SEQ ID NO: 2052021 - DNA, 16 bp, Homo sapiens
cattctgaatgaataa

SEQ ID NO: 2052022 - DNA, 22 bp, Homo sapiens
cattctgattcgaatgacactg

SEQ ID NO: 2052023 - DNA, 16 bp, Homo sapiens
cattctgcctgcccag

SEQ ID NO: 2052024 - DNA, 18 bp, Homo sapiens
cattctgcctgcccaggc

SEQ ID NO: 2052025 - DNA, 19 bp, Homo sapiens
cattctgcctgcccaggcc

SEQ ID NO: 2052026 - DNA, 14 bp, Homo sapiens
cattctgtctgttt

SEQ ID NO: 2052027 - DNA, 20 bp, Homo sapiens
cattctgttgcccaggctgg

SEQ ID NO: 2052028 - DNA, 17 bp, Homo sapiens
cattcttgaaagctgtg

SEQ ID NO: 2052029 - DNA, 18 bp, Homo sapiens
cattctttatcttgacat

SEQ ID NO: 2052030 - DNA, 15 bp, Homo sapiens
cattctttcccctca

SEQ ID NO: 2052031 - DNA, 19 bp, Homo sapiens
cattctttcccctcagagc

SEQ ID NO: 2052032 - DNA, 21 bp, Homo sapiens
cattctttcccctcagagctc

SEQ ID NO: 2052033 - DNA, 22 bp, Homo sapiens
cattgaaagagaaccagtttca

SEQ ID NO: 2052034 - DNA, 14 bp, Homo sapiens
cattgaacagcaaa

SEQ ID NO: 2052035 - DNA, 20 bp, Homo sapiens
cattgaacatttcttatgat

SEQ ID NO: 2052036 - DNA, 23 bp, Homo sapiens
cattgaccaagatgatcacatgg

SEQ ID NO: 2052037 - DNA, 23 bp, Homo sapiens
cattgacctcagctgcacattcc

SEQ ID NO: 2052038 - DNA, 19 bp, Homo sapiens
cattgactatcaaactgaa

SEQ ID NO: 2052039 - DNA, 20 bp, Homo sapiens
cattgactgaactgcacgtt

SEQ ID NO: 2052040 - DNA, 14 bp, Homo sapiens
cattgacttcttgg

SEQ ID NO: 2052041 - DNA, 22 bp, Homo sapiens
cattgagatgtgtttttaatgt

SEQ ID NO: 2052042 - DNA, 19 bp, Homo sapiens
cattgagtttaagtctctg

SEQ ID NO: 2052043 - DNA, 20 bp, Homo sapiens
cattgagtttaagtctctga

SEQ ID NO: 2052044 - DNA, 18 bp, Homo sapiens
cattgatatgaaaaatat

SEQ ID NO: 2052045 - DNA, 19 bp, Homo sapiens
cattgatatgaaaaatatg

SEQ ID NO: 2052046 - DNA, 22 bp, Homo sapiens
cattgatatgaaaaatatgata

SEQ ID NO: 2052047 - DNA, 18 bp, Homo sapiens
cattgcatgtattgtaaa

SEQ ID NO: 2052048 - DNA, 11 bp, Homo sapiens
cattgcctcca

SEQ ID NO: 2052049 - DNA, 18 bp, Homo sapiens
cattgctgttgttgcagg

SEQ ID NO: 2052050 - DNA, 21 bp, Homo sapiens
cattgcttattcttgagcaca

SEQ ID NO: 2052051 - DNA, 22 bp, Homo sapiens
cattggatgtggagctcctgct

SEQ ID NO: 2052052 - DNA, 16 bp, Homo sapiens
cattggcagtgtgtca

SEQ ID NO: 2052053 - DNA, 18 bp, Homo sapiens
cattggcagtgtgtcaca

SEQ ID NO: 2052054 - DNA, 18 bp, Homo sapiens
cattggtctttctacata

SEQ ID NO: 2052055 - DNA, 14 bp, Homo sapiens
cattgtaaattatt

SEQ ID NO: 2052056 - DNA, 15 bp, Homo sapiens
cattgtagagcttct

SEQ ID NO: 2052057 - DNA, 16 bp, Homo sapiens
cattgtagagcttctg

SEQ ID NO: 2052058 - DNA, 21 bp, Homo sapiens
cattgtagagcttctggcact

SEQ ID NO: 2052059 - DNA, 15 bp, Homo sapiens
cattgtataaaaata

SEQ ID NO: 2052060 - DNA, 16 bp, Homo sapiens
cattgtataaaaatag

SEQ ID NO: 2052061 - DNA, 15 bp, Homo sapiens
cattgtatatatgtg

SEQ ID NO: 2052062 - DNA, 16 bp, Homo sapiens
cattgtatgatgtgtt

SEQ ID NO: 2052063 - DNA, 20 bp, Homo sapiens
cattgtatgatgtgttgtga

SEQ ID NO: 2052064 - DNA, 15 bp, Homo sapiens
cattgtatgtatcta

SEQ ID NO: 2052065 - DNA, 16 bp, Homo sapiens
cattgtatgtatctat

SEQ ID NO: 2052066 - DNA, 15 bp, Homo sapiens
cattgtattagatct

SEQ ID NO: 2052067 - DNA, 15 bp, Homo sapiens
cattgtccatgccta

SEQ ID NO: 2052068 - DNA, 13 bp, Homo sapiens
cattgtcttccaa

SEQ ID NO: 2052069 - DNA, 19 bp, Homo sapiens
cattgtcttccaaccccag

SEQ ID NO: 2052070 - DNA, 21 bp, Homo sapiens
cattgtcttccaaccccagct

SEQ ID NO: 2052071 - DNA, 23 bp, Homo sapiens
cattgtcttccaaccccagctgg

SEQ ID NO: 2052072 - DNA, 19 bp, Homo sapiens
cattgtgtgagcttctaca

SEQ ID NO: 2052073 - DNA, 19 bp, Homo sapiens
cattgttattgtggaagat

SEQ ID NO: 2052074 - DNA, 17 bp, Homo sapiens
cattgttggccaaagcc

SEQ ID NO: 2052075 - DNA, 18 bp, Homo sapiens
cattgttggccaaagcca

SEQ ID NO: 2052076 - DNA, 18 bp, Homo sapiens
cattgtttgtctgtcttc

SEQ ID NO: 2052077 - DNA, 21 bp, Homo sapiens
catttaaaaaaaaaatttgtt

SEQ ID NO: 2052078 - DNA, 20 bp, Homo sapiens
catttaaaaatatatagctt

SEQ ID NO: 2052079 - DNA, 12 bp, Homo sapiens
catttaaaatga

SEQ ID NO: 2052080 - DNA, 22 bp, Homo sapiens
ccaccaccctcccaccatgcgc

SEQ ID NO: 2052081 - DNA, 20 bp, Homo sapiens
ccaccacgatgtggccctgg

SEQ ID NO: 2052082 - DNA, 21 bp, Homo sapiens
ccaccacgatgtggccctggc

SEQ ID NO: 2052083 - DNA, 14 bp, Homo sapiens
ccaccactagagct

SEQ ID NO: 2052084 - DNA, 22 bp, Homo sapiens
ccaccagcatgtcactcccaga

SEQ ID NO: 2052085 - DNA, 14 bp, Homo sapiens
ccaccagccacctc

SEQ ID NO: 2052086 - DNA, 16 bp, Homo sapiens
ccaccagccccagcaa

SEQ ID NO: 2052087 - DNA, 13 bp, Homo sapiens
ccaccagggcact

SEQ ID NO: 2052088 - DNA, 23 bp, Homo sapiens
ccaccatattcagtgctgtggcc

SEQ ID NO: 2052089 - DNA, 18 bp, Homo sapiens
ccaccatcatgtctggct

SEQ ID NO: 2052090 - DNA, 14 bp, Homo sapiens
ccaccatcctgcag

SEQ ID NO: 2052091 - DNA, 15 bp, Homo sapiens
ccaccatgcgctgct

SEQ ID NO: 2052092 - DNA, 14 bp, Homo sapiens
ccacccaacagctc

SEQ ID NO: 2052093 - DNA, 16 bp, Homo sapiens
ccacccacctcagcct

SEQ ID NO: 2052094 - DNA, 22 bp, Homo sapiens
ccacccagcccattctctctcc

SEQ ID NO: 2052095 - DNA, 17 bp, Homo sapiens
ccacccaggctgcactg

SEQ ID NO: 2052096 - DNA, 16 bp, Homo sapiens
ccacccagtgctgcca

SEQ ID NO: 2052097 - DNA, 20 bp, Homo sapiens
ccacccagtgctgccatgcc

SEQ ID NO: 2052098 - DNA, 20 bp, Homo sapiens
ccacccatcttcctgctgct

SEQ ID NO: 2052099 - DNA, 16 bp, Homo sapiens
ccacccattcccccat

SEQ ID NO: 2052100 - DNA, 16 bp, Homo sapiens
ccaccccagagttggg

SEQ ID NO: 2052101 - DNA, 12 bp, Homo sapiens
ccacccccagcc

SEQ ID NO: 2052102 - DNA, 21 bp, Homo sapiens
ccacccccgccacggccaccc

SEQ ID NO: 2052103 - DNA, 15 bp, Homo sapiens
ccaccccctccagct

SEQ ID NO: 2052104 - DNA, 18 bp, Homo sapiens
ccaccccctccagctcca

SEQ ID NO: 2052105 - DNA, 17 bp, Homo sapiens
ccaccccctccccaggg

SEQ ID NO: 2052106 - DNA, 16 bp, Homo sapiens
ccaccccgtgccaccc

SEQ ID NO: 2052107 - DNA, 17 bp, Homo sapiens
ccaccccgtgccacccg

SEQ ID NO: 2052108 - DNA, 22 bp, Homo sapiens
ccacccgttctgctggcctgga

SEQ ID NO: 2052109 - DNA, 18 bp, Homo sapiens
ccaccctcgtggacacct

SEQ ID NO: 2052110 - DNA, 21 bp, Homo sapiens
ccaccctcgtggacacctgcc

SEQ ID NO: 2052111 - DNA, 15 bp, Homo sapiens
ccaccctctccatgc

SEQ ID NO: 2052112 - DNA, 14 bp, Homo sapiens
ccaccctgagcctg

SEQ ID NO: 2052113 - DNA, 19 bp, Homo sapiens
ccaccgaagagccctgagc

SEQ ID NO: 2052114 - DNA, 21 bp, Homo sapiens
ccaccgaagagccctgagctc

SEQ ID NO: 2052115 - DNA, 17 bp, Homo sapiens
ccaccgattgcaggaca

SEQ ID NO: 2052116 - DNA, 13 bp, Homo sapiens
ccaccgggccact

SEQ ID NO: 2052117 - DNA, 14 bp, Homo sapiens
ccaccgggccactc

SEQ ID NO: 2052118 - DNA, 15 bp, Homo sapiens
ccaccgggccactcc

SEQ ID NO: 2052119 - DNA, 20 bp, Homo sapiens
ccaccgggccactccttcct

SEQ ID NO: 2052120 - DNA, 23 bp, Homo sapiens
ccaccgggctgggagctctgcag

SEQ ID NO: 2052121 - DNA, 21 bp, Homo sapiens
ccaccggggaacccagccctg

SEQ ID NO: 2052122 - DNA, 19 bp, Homo sapiens
ccacctacttgtgactgaa

SEQ ID NO: 2052123 - DNA, 16 bp, Homo sapiens
ccacctaggccactcc

SEQ ID NO: 2052124 - DNA, 17 bp, Homo sapiens
ccacctaggccactcct

SEQ ID NO: 2052125 - DNA, 18 bp, Homo sapiens
ccacctcactcctgttac

SEQ ID NO: 2052126 - DNA, 18 bp, Homo sapiens
ccacctcagcctcccaga

SEQ ID NO: 2052127 - DNA, 17 bp, Homo sapiens
ccacctcatgcctggcc

SEQ ID NO: 2052128 - DNA, 15 bp, Homo sapiens
ccacctccacccact

SEQ ID NO: 2052129 - DNA, 14 bp, Homo sapiens
ccacctcccaagga

SEQ ID NO: 2052130 - DNA, 14 bp, Homo sapiens
ccacctcccacccc

SEQ ID NO: 2052131 - DNA, 23 bp, Homo sapiens
ccacctcccaccccactccagcc

SEQ ID NO: 2052132 - DNA, 17 bp, Homo sapiens
ccacctcccctatccac

SEQ ID NO: 2052133 - DNA, 13 bp, Homo sapiens
ccacctccctgcc

SEQ ID NO: 2052134 - DNA, 15 bp, Homo sapiens
ccacctccctgccct

SEQ ID NO: 2052135 - DNA, 13 bp, Homo sapiens
ccacctcttcctt

SEQ ID NO: 2052136 - DNA, 16 bp, Homo sapiens
ccacctcttctcttcc

SEQ ID NO: 2052137 - DNA, 20 bp, Homo sapiens
ccacctcttctcttcctgta

SEQ ID NO: 2052138 - DNA, 23 bp, Homo sapiens
ccacctcttgggcatgctcagcc

SEQ ID NO: 2052139 - DNA, 20 bp, Homo sapiens
ccacctgaagtgatgatgga

SEQ ID NO: 2052140 - DNA, 21 bp, Homo sapiens
ccacctgacaatggcagctag

SEQ ID NO: 2052141 - DNA, 14 bp, Homo sapiens
ccacctgccagcca

SEQ ID NO: 2052142 - DNA, 16 bp, Homo sapiens
ccacctgccagccatc

SEQ ID NO: 2052143 - DNA, 21 bp, Homo sapiens
ccacctgcctatccatcctgc

SEQ ID NO: 2052144 - DNA, 23 bp, Homo sapiens
ccacctgctgagagacccaagga

SEQ ID NO: 2052145 - DNA, 13 bp, Homo sapiens
ccacctgcttctg

SEQ ID NO: 2052146 - DNA, 13 bp, Homo sapiens
ccacctgctttct

SEQ ID NO: 2052147 - DNA, 15 bp, Homo sapiens
ccacctgctttctcc

SEQ ID NO: 2052148 - DNA, 19 bp, Homo sapiens
ccacctgctttctcctggg

SEQ ID NO: 2052149 - DNA, 12 bp, Homo sapiens
ccacctggctca

SEQ ID NO: 2052150 - DNA, 19 bp, Homo sapiens
ccacctgttaaaatgtaca

SEQ ID NO: 2052151 - DNA, 19 bp, Homo sapiens
ccaccttcaagcaccctgt

SEQ ID NO: 2052152 - DNA, 17 bp, Homo sapiens
ccaccttcaattcctgg

SEQ ID NO: 2052153 - DNA, 18 bp, Homo sapiens
ccaccttcaattcctggg

SEQ ID NO: 2052154 - DNA, 11 bp, Homo sapiens
ccaccttcccc

SEQ ID NO: 2052155 - DNA, 20 bp, Homo sapiens
ccaccttccccagactcagc

SEQ ID NO: 2052156 - DNA, 22 bp, Homo sapiens
ccaccttggactcctcccacaa

SEQ ID NO: 2052157 - DNA, 12 bp, Homo sapiens
ccaccttggctg

SEQ ID NO: 2052158 - DNA, 19 bp, Homo sapiens
ccacctttgggatcagcct

SEQ ID NO: 2052159 - DNA, 23 bp, Homo sapiens
ccacgaatttgctggggaatctc

SEQ ID NO: 2052160 - DNA, 20 bp, Homo sapiens
ccacgaggagcttccagtgc

SEQ ID NO: 2052161 - DNA, 15 bp, Homo sapiens
ccacgagtcacctgc

SEQ ID NO: 2052162 - DNA, 21 bp, Homo sapiens
ccacgagtcacctgcaagccc

SEQ ID NO: 2052163 - DNA, 13 bp, Homo sapiens
ccacgatgtcaag

SEQ ID NO: 2052164 - DNA, 17 bp, Homo sapiens
ccacgcacacatggaca

SEQ ID NO: 2052165 - DNA, 19 bp, Homo sapiens
ccacgcccgactagcaggc

SEQ ID NO: 2052166 - DNA, 20 bp, Homo sapiens
ccacgcccgactagcaggca

SEQ ID NO: 2052167 - DNA, 15 bp, Homo sapiens
ccacgcctcctggcc

SEQ ID NO: 2052168 - DNA, 16 bp, Homo sapiens
ccacgctcaggcccgg

SEQ ID NO: 2052169 - DNA, 18 bp, Homo sapiens
ccacgctggaccttgaac

SEQ ID NO: 2052170 - DNA, 19 bp, Homo sapiens
ccacgctggagtgcagtga

SEQ ID NO: 2052171 - DNA, 21 bp, Homo sapiens
ccacgctgtcctctcgagccc

SEQ ID NO: 2052172 - DNA, 18 bp, Homo sapiens
ccacggacgtttccatca

SEQ ID NO: 2052173 - DNA, 19 bp, Homo sapiens
ccacggcacctgggccctg

SEQ ID NO: 2052174 - DNA, 20 bp, Homo sapiens
ccacggcacctgggccctgg

SEQ ID NO: 2052175 - DNA, 14 bp, Homo sapiens
ccacggccaccctc

SEQ ID NO: 2052176 - DNA, 17 bp, Homo sapiens
ccacggccaccctcctt

SEQ ID NO: 2052177 - DNA, 22 bp, Homo sapiens
ccacggccaccctccttcccgc

SEQ ID NO: 2052178 - DNA, 16 bp, Homo sapiens
ccacgggcctcagttt

SEQ ID NO: 2052179 - DNA, 17 bp, Homo sapiens
ccacgggcctcagtttc

SEQ ID NO: 2052180 - DNA, 19 bp, Homo sapiens
ccacgggggcggcaggctg

SEQ ID NO: 2052181 - DNA, 16 bp, Homo sapiens
ccacggtgcgtggctg

SEQ ID NO: 2052182 - DNA, 13 bp, Homo sapiens
ccacgtctgccag

SEQ ID NO: 2052183 - DNA, 15 bp, Homo sapiens
ccacgtctgccaggc

SEQ ID NO: 2052184 - DNA, 18 bp, Homo sapiens
ccacgtctgccaggccca

SEQ ID NO: 2052185 - DNA, 21 bp, Homo sapiens
ccacgtgagagaatctgcctg

SEQ ID NO: 2052186 - DNA, 16 bp, Homo sapiens
ccacgtggtgtccctg

SEQ ID NO: 2052187 - DNA, 18 bp, Homo sapiens
ccacgtggtgtccctgcg

SEQ ID NO: 2052188 - DNA, 20 bp, Homo sapiens
ccacgttccttactgcagaa

SEQ ID NO: 2052189 - DNA, 21 bp, Homo sapiens
ccactaaaacaaaacaaaaaa

SEQ ID NO: 2052190 - DNA, 22 bp, Homo sapiens
ccactaaaacaaaacaaaaaac

SEQ ID NO: 2052191 - DNA, 18 bp, Homo sapiens
ccactaaatgagctcctg

SEQ ID NO: 2052192 - DNA, 19 bp, Homo sapiens
ccactaaatgagctcctgc

SEQ ID NO: 2052193 - DNA, 18 bp, Homo sapiens
ccactaagctttctcctt

SEQ ID NO: 2052194 - DNA, 19 bp, Homo sapiens
ccagtgccaggacagctgg

SEQ ID NO: 2052195 - DNA, 17 bp, Homo sapiens
ccagtgccgcctgtgcc

SEQ ID NO: 2052196 - DNA, 20 bp, Homo sapiens
ccagtgccttacctcctgcc

SEQ ID NO: 2052197 - DNA, 23 bp, Homo sapiens
ccagtgccttacctcctgcccag

SEQ ID NO: 2052198 - DNA, 19 bp, Homo sapiens
ccagtgctgccatgccact

SEQ ID NO: 2052199 - DNA, 20 bp, Homo sapiens
ccagtgctgccatgccactg

SEQ ID NO: 2052200 - DNA, 23 bp, Homo sapiens
ccagtgctgccatgccactgcca

SEQ ID NO: 2052201 - DNA, 17 bp, Homo sapiens
ccagtgggacagaggag

SEQ ID NO: 2052202 - DNA, 15 bp, Homo sapiens
ccagtggtaccagct

SEQ ID NO: 2052203 - DNA, 17 bp, Homo sapiens
ccagtgtaaggcatagg

SEQ ID NO: 2052204 - DNA, 14 bp, Homo sapiens
ccagtgtagccttg

SEQ ID NO: 2052205 - DNA, 15 bp, Homo sapiens
ccagtgtagccttgc

SEQ ID NO: 2052206 - DNA, 20 bp, Homo sapiens
ccagtgtggccccagcccga

SEQ ID NO: 2052207 - DNA, 21 bp, Homo sapiens
ccagtgttacttttaattcct

SEQ ID NO: 2052208 - DNA, 19 bp, Homo sapiens
ccagtgtttagaagagcct

SEQ ID NO: 2052209 - DNA, 20 bp, Homo sapiens
ccagtgtttagaagagcctg

SEQ ID NO: 2052210 - DNA, 21 bp, Homo sapiens
ccagtgtttagaagagcctga

SEQ ID NO: 2052211 - DNA, 13 bp, Homo sapiens
ccagttaaggacc

SEQ ID NO: 2052212 - DNA, 14 bp, Homo sapiens
ccagttatggctat

SEQ ID NO: 2052213 - DNA, 21 bp, Homo sapiens
ccagttcacttctttgcagag

SEQ ID NO: 2052214 - DNA, 18 bp, Homo sapiens
ccagttcaggagtcccaa

SEQ ID NO: 2052215 - DNA, 23 bp, Homo sapiens
ccagttcctttcaatggtttgca

SEQ ID NO: 2052216 - DNA, 16 bp, Homo sapiens
ccagttctgctcctct

SEQ ID NO: 2052217 - DNA, 19 bp, Homo sapiens
ccagttctgctcctctcca

SEQ ID NO: 2052218 - DNA, 22 bp, Homo sapiens
ccagttctgctcctctccaggc

SEQ ID NO: 2052219 - DNA, 15 bp, Homo sapiens
ccagttggggccccg

SEQ ID NO: 2052220 - DNA, 19 bp, Homo sapiens
ccagttgggtggatgcctg

SEQ ID NO: 2052221 - DNA, 22 bp, Homo sapiens
ccagtttccaagttcctgcact

SEQ ID NO: 2052222 - DNA, 14 bp, Homo sapiens
ccagtttcccacca

SEQ ID NO: 2052223 - DNA, 22 bp, Homo sapiens
ccataaacacccatgaatcaaa

SEQ ID NO: 2052224 - DNA, 15 bp, Homo sapiens
ccataaagcaagctc

SEQ ID NO: 2052225 - DNA, 21 bp, Homo sapiens
ccataaagcaagctcaacctt

SEQ ID NO: 2052226 - DNA, 15 bp, Homo sapiens
ccataacagccaaca

SEQ ID NO: 2052227 - DNA, 21 bp, Homo sapiens
ccataagcctccatttagttc

SEQ ID NO: 2052228 - DNA, 20 bp, Homo sapiens
ccataatagttagccctcag

SEQ ID NO: 2052229 - DNA, 13 bp, Homo sapiens
ccataatgccact

SEQ ID NO: 2052230 - DNA, 20 bp, Homo sapiens
ccataattttttttttcctt

SEQ ID NO: 2052231 - DNA, 20 bp, Homo sapiens
ccataccatcactgagtggc

SEQ ID NO: 2052232 - DNA, 15 bp, Homo sapiens
ccataccgctgggga

SEQ ID NO: 2052233 - DNA, 16 bp, Homo sapiens
ccataccgctggggaa

SEQ ID NO: 2052234 - DNA, 12 bp, Homo sapiens
ccatagaacaga

SEQ ID NO: 2052235 - DNA, 16 bp, Homo sapiens
ccatagatcttctgaa

SEQ ID NO: 2052236 - DNA, 21 bp, Homo sapiens
ccatagatgggtctggctgag

SEQ ID NO: 2052237 - DNA, 21 bp, Homo sapiens
ccatagcaagattgcttaaaa

SEQ ID NO: 2052238 - DNA, 14 bp, Homo sapiens
ccatagcgctggct

SEQ ID NO: 2052239 - DNA, 16 bp, Homo sapiens
ccatagcgctggctca

SEQ ID NO: 2052240 - DNA, 19 bp, Homo sapiens
ccatagcgctggctcagga

SEQ ID NO: 2052241 - DNA, 15 bp, Homo sapiens
ccatagtcacatggc

SEQ ID NO: 2052242 - DNA, 12 bp, Homo sapiens
ccatatgatatt

SEQ ID NO: 2052243 - DNA, 15 bp, Homo sapiens
ccatatgtctgcttc

SEQ ID NO: 2052244 - DNA, 16 bp, Homo sapiens
ccatatgtctgcttct

SEQ ID NO: 2052245 - DNA, 16 bp, Homo sapiens
ccatattcacacctca

SEQ ID NO: 2052246 - DNA, 15 bp, Homo sapiens
ccatcaaaaatattc

SEQ ID NO: 2052247 - DNA, 21 bp, Homo sapiens
ccatcaatggaaacagggcag

SEQ ID NO: 2052248 - DNA, 15 bp, Homo sapiens
ccatcagaggctggg

SEQ ID NO: 2052249 - DNA, 12 bp, Homo sapiens
ccatcaggactt

SEQ ID NO: 2052250 - DNA, 13 bp, Homo sapiens
ccatcagggtggg

SEQ ID NO: 2052251 - DNA, 24 bp, Homo sapiens
ccatcagggtgggccactctcccc

SEQ ID NO: 2052252 - DNA, 13 bp, Homo sapiens
ccatcagttactg

SEQ ID NO: 2052253 - DNA, 18 bp, Homo sapiens
ccatcagttactggtttc

SEQ ID NO: 2052254 - DNA, 14 bp, Homo sapiens
ccatcatcccagct

SEQ ID NO: 2052255 - DNA, 16 bp, Homo sapiens
ccatcatcccagctgc

SEQ ID NO: 2052256 - DNA, 13 bp, Homo sapiens
ccatcatgtctgg

SEQ ID NO: 2052257 - DNA, 19 bp, Homo sapiens
ccatcatgtgcctggaaat

SEQ ID NO: 2052258 - DNA, 17 bp, Homo sapiens
ccatcattataaacgtg

SEQ ID NO: 2052259 - DNA, 16 bp, Homo sapiens
ccatccatcagctccc

SEQ ID NO: 2052260 - DNA, 21 bp, Homo sapiens
ccatccccaaactgtgccctg

SEQ ID NO: 2052261 - DNA, 22 bp, Homo sapiens
ccatcccccactgccacaccct

SEQ ID NO: 2052262 - DNA, 13 bp, Homo sapiens
ccatcccctttcc

SEQ ID NO: 2052263 - DNA, 14 bp, Homo sapiens
ccatcccctttcct

SEQ ID NO: 2052264 - DNA, 15 bp, Homo sapiens
ccatcccctttcctc

SEQ ID NO: 2052265 - DNA, 18 bp, Homo sapiens
ccatcccctttcctcccc

SEQ ID NO: 2052266 - DNA, 19 bp, Homo sapiens
ccatcccgaaaatctctcg

SEQ ID NO: 2052267 - DNA, 13 bp, Homo sapiens
ccatccctgggcc

SEQ ID NO: 2052268 - DNA, 14 bp, Homo sapiens
ccatccctgggccc

SEQ ID NO: 2052269 - DNA, 19 bp, Homo sapiens
ccatccctgggcccctcca

SEQ ID NO: 2052270 - DNA, 18 bp, Homo sapiens
ccatcccttcctccccag

SEQ ID NO: 2052271 - DNA, 21 bp, Homo sapiens
ccatccgggacgcttccagac

SEQ ID NO: 2052272 - DNA, 15 bp, Homo sapiens
ccatcctaccaatgc

SEQ ID NO: 2052273 - DNA, 22 bp, Homo sapiens
ccatcctgcagcctcctcctga

SEQ ID NO: 2052274 - DNA, 18 bp, Homo sapiens
ccatcctggcccctccag

SEQ ID NO: 2052275 - DNA, 13 bp, Homo sapiens
ccatcctgggcct

SEQ ID NO: 2052276 - DNA, 13 bp, Homo sapiens
ccatccttggcct

SEQ ID NO: 2052277 - DNA, 15 bp, Homo sapiens
ccatctaagctgcag

SEQ ID NO: 2052278 - DNA, 17 bp, Homo sapiens
ccatctagtggaaatga

SEQ ID NO: 2052279 - DNA, 20 bp, Homo sapiens
ccatctatgtcccttgctgt

SEQ ID NO: 2052280 - DNA, 15 bp, Homo sapiens
ccatctcaggtgcca

SEQ ID NO: 2052281 - DNA, 23 bp, Homo sapiens
ccatctcaggtgccactccctga

SEQ ID NO: 2052282 - DNA, 14 bp, Homo sapiens
ccatctccaccctg

SEQ ID NO: 2052283 - DNA, 11 bp, Homo sapiens
ccatctccagc

SEQ ID NO: 2052284 - DNA, 15 bp, Homo sapiens
ccatctccatttcac

SEQ ID NO: 2052285 - DNA, 20 bp, Homo sapiens
ccatctccccaggcctccag

SEQ ID NO: 2052286 - DNA, 23 bp, Homo sapiens
ccatctcccccatcccccactgc

SEQ ID NO: 2052287 - DNA, 18 bp, Homo sapiens
ccatctcctgatttctct

SEQ ID NO: 2052288 - DNA, 18 bp, Homo sapiens
ccatctcctttcagggaa

SEQ ID NO: 2052289 - DNA, 20 bp, Homo sapiens
ccatctctctactcctacct

SEQ ID NO: 2052290 - DNA, 23 bp, Homo sapiens
ccatctctgattttcaaagcttt

SEQ ID NO: 2052291 - DNA, 14 bp, Homo sapiens
ccatctgctcctcc

SEQ ID NO: 2052292 - DNA, 14 bp, Homo sapiens
ccatctggcagggt

SEQ ID NO: 2052293 - DNA, 16 bp, Homo sapiens
ccatctggcagggtgg

SEQ ID NO: 2052294 - DNA, 17 bp, Homo sapiens
ccatctgggtccttgca

SEQ ID NO: 2052295 - DNA, 18 bp, Homo sapiens
ccatctgtcttgccagcc

SEQ ID NO: 2052296 - DNA, 19 bp, Homo sapiens
ccatctgtcttgccagcca

SEQ ID NO: 2052297 - DNA, 23 bp, Homo sapiens
ccatcttggtcctgtcaccctgg

SEQ ID NO: 2052298 - DNA, 13 bp, Homo sapiens
ccatgaagacagg

SEQ ID NO: 2052299 - DNA, 14 bp, Homo sapiens
ccatgaagagactc

SEQ ID NO: 2052300 - DNA, 23 bp, Homo sapiens
ccatgaagctggaagcactgctg

SEQ ID NO: 2052301 - DNA, 14 bp, Homo sapiens
ccatgacctccagc

SEQ ID NO: 2052302 - DNA, 21 bp, Homo sapiens
ccatgacctccagctttcctg

SEQ ID NO: 2052303 - DNA, 13 bp, Homo sapiens
ccatgagaagagg

SEQ ID NO: 2052304 - DNA, 18 bp, Homo sapiens
ccatgagaagagggcctg

SEQ ID NO: 2052305 - DNA, 19 bp, Homo sapiens
ccatgagaagagggcctgt

SEQ ID NO: 2052306 - DNA, 13 bp, Homo sapiens
ccatgagcctcag

SEQ ID NO: 2052307 - DNA, 22 bp, Homo sapiens
ccatgaggcctttccccagtgt

SEQ ID NO: 2052308 - DNA, 13 bp, Homo sapiens
ccatgatccagaa

SEQ ID NO: 2052309 - DNA, 14 bp, Homo sapiens
cccagcgcggcttg

SEQ ID NO: 2052310 - DNA, 23 bp, Homo sapiens
cccagctaatctgtagggctgga

SEQ ID NO: 2052311 - DNA, 17 bp, Homo sapiens
cccagctacattcctca

SEQ ID NO: 2052312 - DNA, 20 bp, Homo sapiens
cccagctacattcctcagct

SEQ ID NO: 2052313 - DNA, 21 bp, Homo sapiens
cccagctactcaagaggctga

SEQ ID NO: 2052314 - DNA, 17 bp, Homo sapiens
cccagctactcagaagc

SEQ ID NO: 2052315 - DNA, 17 bp, Homo sapiens
cccagctactctgtcca

SEQ ID NO: 2052316 - DNA, 23 bp, Homo sapiens
cccagctactctgtccaggccac

SEQ ID NO: 2052317 - DNA, 15 bp, Homo sapiens
cccagctacttggga

SEQ ID NO: 2052318 - DNA, 15 bp, Homo sapiens
cccagctagggctgg

SEQ ID NO: 2052319 - DNA, 17 bp, Homo sapiens
cccagctagggctggac

SEQ ID NO: 2052320 - DNA, 21 bp, Homo sapiens
cccagctatggccccagggtt

SEQ ID NO: 2052321 - DNA, 16 bp, Homo sapiens
cccagctctccctctg

SEQ ID NO: 2052322 - DNA, 17 bp, Homo sapiens
cccagctctccctctgg

SEQ ID NO: 2052323 - DNA, 19 bp, Homo sapiens
cccagctctccctctggcc

SEQ ID NO: 2052324 - DNA, 23 bp, Homo sapiens
cccagctctccctctggccctgc

SEQ ID NO: 2052325 - DNA, 12 bp, Homo sapiens
cccagctgcacc

SEQ ID NO: 2052326 - DNA, 12 bp, Homo sapiens
cccagctggcct

SEQ ID NO: 2052327 - DNA, 16 bp, Homo sapiens
cccagctggcctctag

SEQ ID NO: 2052328 - DNA, 18 bp, Homo sapiens
cccagctggcctctagaa

SEQ ID NO: 2052329 - DNA, 15 bp, Homo sapiens
cccagctgtagccat

SEQ ID NO: 2052330 - DNA, 20 bp, Homo sapiens
cccagctgtagccatggctc

SEQ ID NO: 2052331 - DNA, 24 bp, Homo sapiens
cccagctgtagccatggctcaggc

SEQ ID NO: 2052332 - DNA, 15 bp, Homo sapiens
cccagctgtctgtgt

SEQ ID NO: 2052333 - DNA, 16 bp, Homo sapiens
cccagctgtctgtgtc

SEQ ID NO: 2052334 - DNA, 21 bp, Homo sapiens
cccagctttatctgtcacaca

SEQ ID NO: 2052335 - DNA, 21 bp, Homo sapiens
cccaggacaagcatggtccca

SEQ ID NO: 2052336 - DNA, 22 bp, Homo sapiens
cccaggacgccactcatttcat

SEQ ID NO: 2052337 - DNA, 15 bp, Homo sapiens
cccaggagacagttc

SEQ ID NO: 2052338 - DNA, 21 bp, Homo sapiens
cccaggagagccagccctccc

SEQ ID NO: 2052339 - DNA, 22 bp, Homo sapiens
cccaggagagccagccctccct

SEQ ID NO: 2052340 - DNA, 22 bp, Homo sapiens
cccaggagtttgaggctgcagc

SEQ ID NO: 2052341 - DNA, 16 bp, Homo sapiens
cccaggatcccagagc

SEQ ID NO: 2052342 - DNA, 17 bp, Homo sapiens
cccaggatcccagagct

SEQ ID NO: 2052343 - DNA, 18 bp, Homo sapiens
cccaggatcccagagctt

SEQ ID NO: 2052344 - DNA, 21 bp, Homo sapiens
cccaggatccctcccagatcc

SEQ ID NO: 2052345 - DNA, 13 bp, Homo sapiens
cccaggccaggcc

SEQ ID NO: 2052346 - DNA, 20 bp, Homo sapiens
cccaggccccatgacctcca

SEQ ID NO: 2052347 - DNA, 11 bp, Homo sapiens
cccaggcccct

SEQ ID NO: 2052348 - DNA, 12 bp, Homo sapiens
cccaggccctcc

SEQ ID NO: 2052349 - DNA, 15 bp, Homo sapiens
cccaggccctccatg

SEQ ID NO: 2052350 - DNA, 20 bp, Homo sapiens
cccaggccctccatgggcta

SEQ ID NO: 2052351 - DNA, 13 bp, Homo sapiens
cccaggccctccc

SEQ ID NO: 2052352 - DNA, 15 bp, Homo sapiens
cccaggccctccctg

SEQ ID NO: 2052353 - DNA, 18 bp, Homo sapiens
cccaggcctccagcctct

SEQ ID NO: 2052354 - DNA, 19 bp, Homo sapiens
cccaggcctccagcctctc

SEQ ID NO: 2052355 - DNA, 16 bp, Homo sapiens
cccaggctctgggaag

SEQ ID NO: 2052356 - DNA, 15 bp, Homo sapiens
cccaggctgaagagt

SEQ ID NO: 2052357 - DNA, 13 bp, Homo sapiens
cccaggctgcact

SEQ ID NO: 2052358 - DNA, 14 bp, Homo sapiens
cccaggctgcactg

SEQ ID NO: 2052359 - DNA, 15 bp, Homo sapiens
cccaggctgcactgc

SEQ ID NO: 2052360 - DNA, 20 bp, Homo sapiens
cccaggctgcactgcagtga

SEQ ID NO: 2052361 - DNA, 21 bp, Homo sapiens
cccaggctggcgtgcagtggt

SEQ ID NO: 2052362 - DNA, 18 bp, Homo sapiens
cccagggaggccgaagct

SEQ ID NO: 2052363 - DNA, 13 bp, Homo sapiens
cccagggcacagg

SEQ ID NO: 2052364 - DNA, 19 bp, Homo sapiens
cccagggcacttcagagta

SEQ ID NO: 2052365 - DNA, 15 bp, Homo sapiens
cccagggccagggcc

SEQ ID NO: 2052366 - DNA, 18 bp, Homo sapiens
cccagggccagggccctg

SEQ ID NO: 2052367 - DNA, 11 bp, Homo sapiens
cccagggcccc

SEQ ID NO: 2052368 - DNA, 18 bp, Homo sapiens
cccagggcccccacaggc

SEQ ID NO: 2052369 - DNA, 14 bp, Homo sapiens
cccagggcccctcc

SEQ ID NO: 2052370 - DNA, 13 bp, Homo sapiens
cccagggcctggg

SEQ ID NO: 2052371 - DNA, 16 bp, Homo sapiens
cccagggcctgggggc

SEQ ID NO: 2052372 - DNA, 20 bp, Homo sapiens
cccagggcctgggggcagtg

SEQ ID NO: 2052373 - DNA, 24 bp, Homo sapiens
cccagggcctgggggcagtgactg

SEQ ID NO: 2052374 - DNA, 16 bp, Homo sapiens
cccagggctcagcctg

SEQ ID NO: 2052375 - DNA, 19 bp, Homo sapiens
cccagggctccctcctgga

SEQ ID NO: 2052376 - DNA, 17 bp, Homo sapiens
cccaggggaaaatgaag

SEQ ID NO: 2052377 - DNA, 13 bp, Homo sapiens
cccaggggagagg

SEQ ID NO: 2052378 - DNA, 17 bp, Homo sapiens
cccaggggcccacaggg

SEQ ID NO: 2052379 - DNA, 18 bp, Homo sapiens
cccaggggcccacaggga

SEQ ID NO: 2052380 - DNA, 14 bp, Homo sapiens
cccaggggtgcctg

SEQ ID NO: 2052381 - DNA, 13 bp, Homo sapiens
cccaggtccttcc

SEQ ID NO: 2052382 - DNA, 21 bp, Homo sapiens
cccaggtctccctggatcaga

SEQ ID NO: 2052383 - DNA, 18 bp, Homo sapiens
cccaggtctctccactgc

SEQ ID NO: 2052384 - DNA, 22 bp, Homo sapiens
cccaggtctctccactgctctc

SEQ ID NO: 2052385 - DNA, 18 bp, Homo sapiens
cccaggtgccaccaataa

SEQ ID NO: 2052386 - DNA, 19 bp, Homo sapiens
cccaggtgccaccaataaa

SEQ ID NO: 2052387 - DNA, 16 bp, Homo sapiens
cccaggtggctgaccc

SEQ ID NO: 2052388 - DNA, 19 bp, Homo sapiens
cccaggtggctgacccagt

SEQ ID NO: 2052389 - DNA, 13 bp, Homo sapiens
cccaggtttctat

SEQ ID NO: 2052390 - DNA, 13 bp, Homo sapiens
cccagtccccgtg

SEQ ID NO: 2052391 - DNA, 16 bp, Homo sapiens
cccagtccctggggga

SEQ ID NO: 2052392 - DNA, 23 bp, Homo sapiens
cccagtccctgggggaagccctg

SEQ ID NO: 2052393 - DNA, 21 bp, Homo sapiens
cccagtcgagccctgcagcca

SEQ ID NO: 2052394 - DNA, 24 bp, Homo sapiens
cccagtctacgttctccagcccac

SEQ ID NO: 2052395 - DNA, 15 bp, Homo sapiens
cccagtgacagctag

SEQ ID NO: 2052396 - DNA, 15 bp, Homo sapiens
cccagtgacctgacc

SEQ ID NO: 2052397 - DNA, 19 bp, Homo sapiens
cccagtgagattacagagg

SEQ ID NO: 2052398 - DNA, 20 bp, Homo sapiens
cccagtgcccacaggatcag

SEQ ID NO: 2052399 - DNA, 12 bp, Homo sapiens
cccagtgctgcc

SEQ ID NO: 2052400 - DNA, 15 bp, Homo sapiens
cccagtgctgccatg

SEQ ID NO: 2052401 - DNA, 17 bp, Homo sapiens
cccagtgctgccatgcc

SEQ ID NO: 2052402 - DNA, 21 bp, Homo sapiens
cccagtgctgccatgccactg

SEQ ID NO: 2052403 - DNA, 14 bp, Homo sapiens
cccagtgggacaga

SEQ ID NO: 2052404 - DNA, 15 bp, Homo sapiens
cccagtgtggcccca

SEQ ID NO: 2052405 - DNA, 21 bp, Homo sapiens
cccagttctacaagcatattt

SEQ ID NO: 2052406 - DNA, 13 bp, Homo sapiens
cccagttctgctc

SEQ ID NO: 2052407 - DNA, 14 bp, Homo sapiens
cccagttctgctcc

SEQ ID NO: 2052408 - DNA, 23 bp, Homo sapiens
cccagttctgctcctctccaggc

SEQ ID NO: 2052409 - DNA, 15 bp, Homo sapiens
cccagtttcccttct

SEQ ID NO: 2052410 - DNA, 17 bp, Homo sapiens
cccataaggccagaaac

SEQ ID NO: 2052411 - DNA, 20 bp, Homo sapiens
cccataatagttagccctca

SEQ ID NO: 2052412 - DNA, 19 bp, Homo sapiens
cccataattttcttcatgc

SEQ ID NO: 2052413 - DNA, 15 bp, Homo sapiens
cccatagaaacatga

SEQ ID NO: 2052414 - DNA, 22 bp, Homo sapiens
cccatagaaacatgacactgac

SEQ ID NO: 2052415 - DNA, 23 bp, Homo sapiens
cccatagaaacatgacactgacc

SEQ ID NO: 2052416 - DNA, 23 bp, Homo sapiens
cccatcacctactcacacaggca

SEQ ID NO: 2052417 - DNA, 13 bp, Homo sapiens
cccatcactggag

SEQ ID NO: 2052418 - DNA, 15 bp, Homo sapiens
cccatcactggagca

SEQ ID NO: 2052419 - DNA, 16 bp, Homo sapiens
cccatcagaggctggg

SEQ ID NO: 2052420 - DNA, 12 bp, Homo sapiens
cccatcagcacc

SEQ ID NO: 2052421 - DNA, 21 bp, Homo sapiens
cccatcatatgacatgccacc

SEQ ID NO: 2052422 - DNA, 12 bp, Homo sapiens
cccatcatccca

SEQ ID NO: 2052423 - DNA, 14 bp, Homo sapiens
cccatcatggctgc

SEQ ID NO: 2052424 - DNA, 16 bp, Homo sapiens
cccggccagggcctgg

SEQ ID NO: 2052425 - DNA, 14 bp, Homo sapiens
cccggcccagagac

SEQ ID NO: 2052426 - DNA, 17 bp, Homo sapiens
cccggcctgctcccagc

SEQ ID NO: 2052427 - DNA, 18 bp, Homo sapiens
cccggcctgctcccagca

SEQ ID NO: 2052428 - DNA, 21 bp, Homo sapiens
cccggcctgctcccagcagcc

SEQ ID NO: 2052429 - DNA, 14 bp, Homo sapiens
cccggcgcggtggc

SEQ ID NO: 2052430 - DNA, 19 bp, Homo sapiens
cccggcgcggtggctcacg

SEQ ID NO: 2052431 - DNA, 14 bp, Homo sapiens
cccggctccaggct

SEQ ID NO: 2052432 - DNA, 14 bp, Homo sapiens
cccggctccccctg

SEQ ID NO: 2052433 - DNA, 18 bp, Homo sapiens
cccggctccccctgcttc

SEQ ID NO: 2052434 - DNA, 16 bp, Homo sapiens
cccgggcctgcctctg

SEQ ID NO: 2052435 - DNA, 22 bp, Homo sapiens
cccgggcctgcctctgactcac

SEQ ID NO: 2052436 - DNA, 16 bp, Homo sapiens
cccggggctggcaagc

SEQ ID NO: 2052437 - DNA, 22 bp, Homo sapiens
cccgggtgtgcctgccctggag

SEQ ID NO: 2052438 - DNA, 22 bp, Homo sapiens
cccggtcccttgagacctcagc

SEQ ID NO: 2052439 - DNA, 22 bp, Homo sapiens
cccgtaggcagcctctctgcta

SEQ ID NO: 2052440 - DNA, 14 bp, Homo sapiens
cccgtcttcagcct

SEQ ID NO: 2052441 - DNA, 15 bp, Homo sapiens
cccgtcttcagccta

SEQ ID NO: 2052442 - DNA, 16 bp, Homo sapiens
cccgtcttcagcctag

SEQ ID NO: 2052443 - DNA, 15 bp, Homo sapiens
cccgtgaagcagtgc

SEQ ID NO: 2052444 - DNA, 22 bp, Homo sapiens
cccgtgaatgcttacctgtgag

SEQ ID NO: 2052445 - DNA, 12 bp, Homo sapiens
cccgtgccaccc

SEQ ID NO: 2052446 - DNA, 12 bp, Homo sapiens
cccgtggagggt

SEQ ID NO: 2052447 - DNA, 21 bp, Homo sapiens
cccgtggtctttgaataaagt

SEQ ID NO: 2052448 - DNA, 19 bp, Homo sapiens
cccgtgtccccggcctcag

SEQ ID NO: 2052449 - DNA, 14 bp, Homo sapiens
ccctaaaataaaaa

SEQ ID NO: 2052450 - DNA, 23 bp, Homo sapiens
ccctaacgggggtgcggcaggag

SEQ ID NO: 2052451 - DNA, 14 bp, Homo sapiens
ccctaagagagcac

SEQ ID NO: 2052452 - DNA, 23 bp, Homo sapiens
ccctaaggaatctgaaagtatat

SEQ ID NO: 2052453 - DNA, 18 bp, Homo sapiens
ccctacacccctcccctg

SEQ ID NO: 2052454 - DNA, 19 bp, Homo sapiens
ccctacatcttcagctccc

SEQ ID NO: 2052455 - DNA, 13 bp, Homo sapiens
ccctacccactct

SEQ ID NO: 2052456 - DNA, 16 bp, Homo sapiens
ccctacccactctttg

SEQ ID NO: 2052457 - DNA, 19 bp, Homo sapiens
ccctacttcattttcagag

SEQ ID NO: 2052458 - DNA, 19 bp, Homo sapiens
ccctacttcttttgctctt

SEQ ID NO: 2052459 - DNA, 14 bp, Homo sapiens
ccctaggagaccaa

SEQ ID NO: 2052460 - DNA, 21 bp, Homo sapiens
ccctaggctgagctggcattg

SEQ ID NO: 2052461 - DNA, 13 bp, Homo sapiens
ccctatagagagg

SEQ ID NO: 2052462 - DNA, 18 bp, Homo sapiens
ccctatagagagggggct

SEQ ID NO: 2052463 - DNA, 15 bp, Homo sapiens
ccctatcaaaacata

SEQ ID NO: 2052464 - DNA, 20 bp, Homo sapiens
ccctatcaaaacatatcaat

SEQ ID NO: 2052465 - DNA, 21 bp, Homo sapiens
ccctatcaaaacatatcaatt

SEQ ID NO: 2052466 - DNA, 14 bp, Homo sapiens
ccctatccacccag

SEQ ID NO: 2052467 - DNA, 15 bp, Homo sapiens
ccctattccctaact

SEQ ID NO: 2052468 - DNA, 18 bp, Homo sapiens
ccctcaaaaaaagccttt

SEQ ID NO: 2052469 - DNA, 19 bp, Homo sapiens
ccctcaaaaaaagccttta

SEQ ID NO: 2052470 - DNA, 18 bp, Homo sapiens
ccctcaaatgacccaaag

SEQ ID NO: 2052471 - DNA, 18 bp, Homo sapiens
ccctcacccccaggtgtt

SEQ ID NO: 2052472 - DNA, 16 bp, Homo sapiens
ccctcactctggcctc

SEQ ID NO: 2052473 - DNA, 12 bp, Homo sapiens
ccctcagagctc

SEQ ID NO: 2052474 - DNA, 13 bp, Homo sapiens
ccctcagccttga

SEQ ID NO: 2052475 - DNA, 16 bp, Homo sapiens
ccctcaggccagtgcc

SEQ ID NO: 2052476 - DNA, 22 bp, Homo sapiens
ccctcaggccagtgccaggaca

SEQ ID NO: 2052477 - DNA, 23 bp, Homo sapiens
ccctcaggccagtgccaggacag

SEQ ID NO: 2052478 - DNA, 12 bp, Homo sapiens
ccctcagggatc

SEQ ID NO: 2052479 - DNA, 22 bp, Homo sapiens
ccctcagtcagttcccggagca

SEQ ID NO: 2052480 - DNA, 16 bp, Homo sapiens
ccctcataccatctgc

SEQ ID NO: 2052481 - DNA, 22 bp, Homo sapiens
ccctcatcttgccccctcatct

SEQ ID NO: 2052482 - DNA, 16 bp, Homo sapiens
ccctcattcaggaaaa

SEQ ID NO: 2052483 - DNA, 17 bp, Homo sapiens
ccctcattcaggaaaac

SEQ ID NO: 2052484 - DNA, 18 bp, Homo sapiens
ccctccaaagccccacct

SEQ ID NO: 2052485 - DNA, 18 bp, Homo sapiens
ccctccaccgcagaagga

SEQ ID NO: 2052486 - DNA, 14 bp, Homo sapiens
ccctccagaccctg

SEQ ID NO: 2052487 - DNA, 15 bp, Homo sapiens
ccctccagaccctgc

SEQ ID NO: 2052488 - DNA, 11 bp, Homo sapiens
ccctccagagt

SEQ ID NO: 2052489 - DNA, 15 bp, Homo sapiens
ccctccaggcatgct

SEQ ID NO: 2052490 - DNA, 19 bp, Homo sapiens
ccctccaggcatgctggcc

SEQ ID NO: 2052491 - DNA, 22 bp, Homo sapiens
ccctccaggcatgctggcctcc

SEQ ID NO: 2052492 - DNA, 13 bp, Homo sapiens
ccctccatgggct

SEQ ID NO: 2052493 - DNA, 22 bp, Homo sapiens
ccctccccaaacccatcagaca

SEQ ID NO: 2052494 - DNA, 17 bp, Homo sapiens
ccctccccattcacaga

SEQ ID NO: 2052495 - DNA, 14 bp, Homo sapiens
ccctcccccctgta

SEQ ID NO: 2052496 - DNA, 15 bp, Homo sapiens
ccctcccccttcccc

SEQ ID NO: 2052497 - DNA, 16 bp, Homo sapiens
ccctccccgcaccccc

SEQ ID NO: 2052498 - DNA, 13 bp, Homo sapiens
ccctccctctgcc

SEQ ID NO: 2052499 - DNA, 14 bp, Homo sapiens
ccctccctctgccc

SEQ ID NO: 2052500 - DNA, 20 bp, Homo sapiens
ccctccctgactccctgtgg

SEQ ID NO: 2052501 - DNA, 21 bp, Homo sapiens
ccctccctggcatgtcagagc

SEQ ID NO: 2052502 - DNA, 15 bp, Homo sapiens
ccctccctggcctca

SEQ ID NO: 2052503 - DNA, 18 bp, Homo sapiens
ccctcccttgctcagtgc

SEQ ID NO: 2052504 - DNA, 22 bp, Homo sapiens
ccctccgccttcactccggtgt

SEQ ID NO: 2052505 - DNA, 19 bp, Homo sapiens
ccctcctccccttcctgca

SEQ ID NO: 2052506 - DNA, 20 bp, Homo sapiens
ccctcctccccttcctgcac

SEQ ID NO: 2052507 - DNA, 16 bp, Homo sapiens
ccctcctctgccacct

SEQ ID NO: 2052508 - DNA, 14 bp, Homo sapiens
ccctcctctggccc

SEQ ID NO: 2052509 - DNA, 21 bp, Homo sapiens
ccctcctgctgcctaataaag

SEQ ID NO: 2052510 - DNA, 13 bp, Homo sapiens
ccctcctggagca

SEQ ID NO: 2052511 - DNA, 14 bp, Homo sapiens
ccctccttcccttc

SEQ ID NO: 2052512 - DNA, 15 bp, Homo sapiens
ccctccttcccttct

SEQ ID NO: 2052513 - DNA, 23 bp, Homo sapiens
ccctccttgctctgcaggcacct

SEQ ID NO: 2052514 - DNA, 16 bp, Homo sapiens
ccctcgaaccaaggca

SEQ ID NO: 2052515 - DNA, 17 bp, Homo sapiens
ccctcgaaccaaggcag

SEQ ID NO: 2052516 - DNA, 18 bp, Homo sapiens
ccctcgaaccaaggcagc

SEQ ID NO: 2052517 - DNA, 24 bp, Homo sapiens
ccctcgaaccaaggcagcctccag

SEQ ID NO: 2052518 - DNA, 17 bp, Homo sapiens
ccctcgctgctgctact

SEQ ID NO: 2052519 - DNA, 19 bp, Homo sapiens
ccctcgctgtcctgctgtg

SEQ ID NO: 2052520 - DNA, 22 bp, Homo sapiens
ccctcggaagccgtctgactcc

SEQ ID NO: 2052521 - DNA, 14 bp, Homo sapiens
ccctcggacccacc

SEQ ID NO: 2052522 - DNA, 13 bp, Homo sapiens
ccctcgtccacag

SEQ ID NO: 2052523 - DNA, 17 bp, Homo sapiens
ccctcgtcctgtcccag

SEQ ID NO: 2052524 - DNA, 16 bp, Homo sapiens
ccctcgtggacacctg

SEQ ID NO: 2052525 - DNA, 13 bp, Homo sapiens
ccctctcccaggc

SEQ ID NO: 2052526 - DNA, 14 bp, Homo sapiens
ccctctcccaggcc

SEQ ID NO: 2052527 - DNA, 20 bp, Homo sapiens
ccctctcccaggccccatga

SEQ ID NO: 2052528 - DNA, 11 bp, Homo sapiens
ccctctcctgc

SEQ ID NO: 2052529 - DNA, 14 bp, Homo sapiens
ccctctccttcctt

SEQ ID NO: 2052530 - DNA, 13 bp, Homo sapiens
ccctctcttgcct

SEQ ID NO: 2052531 - DNA, 22 bp, Homo sapiens
ccctctgaatggtccagggttg

SEQ ID NO: 2052532 - DNA, 21 bp, Homo sapiens
ccctctgagaattccaaggag

SEQ ID NO: 2052533 - DNA, 17 bp, Homo sapiens
ccctctgccccaagcag

SEQ ID NO: 2052534 - DNA, 20 bp, Homo sapiens
ccctctgccccaagcagcca

SEQ ID NO: 2052535 - DNA, 23 bp, Homo sapiens
ccctctgccccaagcagccagcc

SEQ ID NO: 2052536 - DNA, 19 bp, Homo sapiens
ccctctgcgtcccccagcc

SEQ ID NO: 2052537 - DNA, 22 bp, Homo sapiens
ccctctgcgtcccccagccctc

SEQ ID NO: 2052538 - DNA, 22 bp, Homo sapiens
ccctctggatcctgctgtggcc

SEQ ID NO: 2052539 - DNA, 12 bp, Homo sapiens
ccggctgcctgc

SEQ ID NO: 2052540 - DNA, 13 bp, Homo sapiens
ccggctgcttcct

SEQ ID NO: 2052541 - DNA, 22 bp, Homo sapiens
ccgggacagacctggacactag

SEQ ID NO: 2052542 - DNA, 17 bp, Homo sapiens
ccgggaccattgacctc

SEQ ID NO: 2052543 - DNA, 16 bp, Homo sapiens
ccgggacgcttccaga

SEQ ID NO: 2052544 - DNA, 17 bp, Homo sapiens
ccgggacgcttccagac

SEQ ID NO: 2052545 - DNA, 20 bp, Homo sapiens
ccgggacgcttccagaccac

SEQ ID NO: 2052546 - DNA, 12 bp, Homo sapiens
ccgggagaggag

SEQ ID NO: 2052547 - DNA, 16 bp, Homo sapiens
ccgggagcctccccct

SEQ ID NO: 2052548 - DNA, 19 bp, Homo sapiens
ccgggcaggtcctgcccat

SEQ ID NO: 2052549 - DNA, 15 bp, Homo sapiens
ccgggcctgaaccac

SEQ ID NO: 2052550 - DNA, 15 bp, Homo sapiens
ccgggcctgcctctg

SEQ ID NO: 2052551 - DNA, 16 bp, Homo sapiens
ccgggcggaaggggac

SEQ ID NO: 2052552 - DNA, 13 bp, Homo sapiens
ccgggctctggcc

SEQ ID NO: 2052553 - DNA, 18 bp, Homo sapiens
ccgggctctggccaccct

SEQ ID NO: 2052554 - DNA, 21 bp, Homo sapiens
ccgggctgcccttcgctgcca

SEQ ID NO: 2052555 - DNA, 22 bp, Homo sapiens
ccgggctgcccttcgctgccag

SEQ ID NO: 2052556 - DNA, 13 bp, Homo sapiens
ccgggctgggagc

SEQ ID NO: 2052557 - DNA, 18 bp, Homo sapiens
ccgggctgggagctctgc

SEQ ID NO: 2052558 - DNA, 20 bp, Homo sapiens
ccgggcttgggccctgcaca

SEQ ID NO: 2052559 - DNA, 13 bp, Homo sapiens
ccggggcccctca

SEQ ID NO: 2052560 - DNA, 19 bp, Homo sapiens
ccggggctggcaagcaggg

SEQ ID NO: 2052561 - DNA, 20 bp, Homo sapiens
ccggggctggcaagcaggga

SEQ ID NO: 2052562 - DNA, 15 bp, Homo sapiens
ccgggggaggaaggg

SEQ ID NO: 2052563 - DNA, 14 bp, Homo sapiens
ccggggtctgtgct

SEQ ID NO: 2052564 - DNA, 15 bp, Homo sapiens
ccggggtctgtgctg

SEQ ID NO: 2052565 - DNA, 17 bp, Homo sapiens
ccggggtctgtgctgtg

SEQ ID NO: 2052566 - DNA, 20 bp, Homo sapiens
ccggggtctgtgctgtgcct

SEQ ID NO: 2052567 - DNA, 23 bp, Homo sapiens
ccggggtctgtgctgtgcctgct

SEQ ID NO: 2052568 - DNA, 15 bp, Homo sapiens
ccgggtacctcagtt

SEQ ID NO: 2052569 - DNA, 17 bp, Homo sapiens
ccgggtacctcagtttc

SEQ ID NO: 2052570 - DNA, 13 bp, Homo sapiens
ccgggtccccagc

SEQ ID NO: 2052571 - DNA, 17 bp, Homo sapiens
ccgggtccccagctccc

SEQ ID NO: 2052572 - DNA, 16 bp, Homo sapiens
ccgggtgccattccca

SEQ ID NO: 2052573 - DNA, 14 bp, Homo sapiens
ccgggtgggcctgg

SEQ ID NO: 2052574 - DNA, 18 bp, Homo sapiens
ccgggtgtgcctgccctg

SEQ ID NO: 2052575 - DNA, 22 bp, Homo sapiens
ccgggtgtggcctcagccctca

SEQ ID NO: 2052576 - DNA, 20 bp, Homo sapiens
ccgggttctagtctcctttg

SEQ ID NO: 2052577 - DNA, 14 bp, Homo sapiens
ccggtcctggcccc

SEQ ID NO: 2052578 - DNA, 11 bp, Homo sapiens
ccggtgtcctt

SEQ ID NO: 2052579 - DNA, 19 bp, Homo sapiens
ccgtacccccgtggtcttt

SEQ ID NO: 2052580 - DNA, 15 bp, Homo sapiens
ccgtagttccctgaa

SEQ ID NO: 2052581 - DNA, 22 bp, Homo sapiens
ccgtcaaaacagattgtttgca

SEQ ID NO: 2052582 - DNA, 17 bp, Homo sapiens
ccgtcagccaaatgtaa

SEQ ID NO: 2052583 - DNA, 16 bp, Homo sapiens
ccgtcatgttcctcaa

SEQ ID NO: 2052584 - DNA, 12 bp, Homo sapiens
ccgtccacccag

SEQ ID NO: 2052585 - DNA, 16 bp, Homo sapiens
ccgtccacccaggctg

SEQ ID NO: 2052586 - DNA, 14 bp, Homo sapiens
ccgtccatggcacc

SEQ ID NO: 2052587 - DNA, 22 bp, Homo sapiens
ccgtctgactccagagtctgag

SEQ ID NO: 2052588 - DNA, 20 bp, Homo sapiens
ccgtctggggttcagcccct

SEQ ID NO: 2052589 - DNA, 22 bp, Homo sapiens
ccgtcttagaagtggaccagga

SEQ ID NO: 2052590 - DNA, 15 bp, Homo sapiens
ccgtcttcagcctag

SEQ ID NO: 2052591 - DNA, 13 bp, Homo sapiens
ccgtcttctctcc

SEQ ID NO: 2052592 - DNA, 15 bp, Homo sapiens
ccgtcttctctccat

SEQ ID NO: 2052593 - DNA, 19 bp, Homo sapiens
ccgtgaagggcaccgagaa

SEQ ID NO: 2052594 - DNA, 23 bp, Homo sapiens
ccgtgatgtagggtaaggtgcct

SEQ ID NO: 2052595 - DNA, 19 bp, Homo sapiens
ccgtgatttggaagagagg

SEQ ID NO: 2052596 - DNA, 17 bp, Homo sapiens
ccgtgcactccctaaga

SEQ ID NO: 2052597 - DNA, 22 bp, Homo sapiens
ccgtgccacccgtaggcagcct

SEQ ID NO: 2052598 - DNA, 17 bp, Homo sapiens
ccgtggaccttcctgcc

SEQ ID NO: 2052599 - DNA, 16 bp, Homo sapiens
ccgtggccctgccctc

SEQ ID NO: 2052600 - DNA, 14 bp, Homo sapiens
ccgtggcccttcct

SEQ ID NO: 2052601 - DNA, 21 bp, Homo sapiens
ccgtggcccttcctggacagc

SEQ ID NO: 2052602 - DNA, 14 bp, Homo sapiens
ccgtggcttcccgc

SEQ ID NO: 2052603 - DNA, 21 bp, Homo sapiens
ccgtggcttcccgctcagccc

SEQ ID NO: 2052604 - DNA, 17 bp, Homo sapiens
ccgtggtctttgaataa

SEQ ID NO: 2052605 - DNA, 20 bp, Homo sapiens
ccgtggtctttgaataaagt

SEQ ID NO: 2052606 - DNA, 22 bp, Homo sapiens
ccgtggtctttgaataaagtct

SEQ ID NO: 2052607 - DNA, 18 bp, Homo sapiens
ccgtgtccagcacagaag

SEQ ID NO: 2052608 - DNA, 23 bp, Homo sapiens
ccgtgtccagcacagaaggaatc

SEQ ID NO: 2052609 - DNA, 14 bp, Homo sapiens
ccgtgtcccaagga

SEQ ID NO: 2052610 - DNA, 16 bp, Homo sapiens
ccgtgtcctgccttga

SEQ ID NO: 2052611 - DNA, 14 bp, Homo sapiens
ccgttactctccaa

SEQ ID NO: 2052612 - DNA, 17 bp, Homo sapiens
ccgttactctccaacct

SEQ ID NO: 2052613 - DNA, 15 bp, Homo sapiens
ccgttccaggagcac

SEQ ID NO: 2052614 - DNA, 14 bp, Homo sapiens
ccgttccccttggc

SEQ ID NO: 2052615 - DNA, 14 bp, Homo sapiens
ccgttccctgtcag

SEQ ID NO: 2052616 - DNA, 19 bp, Homo sapiens
ccgtttatgggccttgctt

SEQ ID NO: 2052617 - DNA, 18 bp, Homo sapiens
ccgttttcatcctggcct

SEQ ID NO: 2052618 - DNA, 21 bp, Homo sapiens
ccgttttcatcctggcctcct

SEQ ID NO: 2052619 - DNA, 12 bp, Homo sapiens
ccgtttttcaag

SEQ ID NO: 2052620 - DNA, 12 bp, Homo sapiens
cctaaaataaaa

SEQ ID NO: 2052621 - DNA, 19 bp, Homo sapiens
cctaaacccccgctccaga

SEQ ID NO: 2052622 - DNA, 12 bp, Homo sapiens
cctaaagagata

SEQ ID NO: 2052623 - DNA, 19 bp, Homo sapiens
cctaaatgacctcagcaaa

SEQ ID NO: 2052624 - DNA, 20 bp, Homo sapiens
cctaaatgacctcagcaaat

SEQ ID NO: 2052625 - DNA, 14 bp, Homo sapiens
cctaaccaaatgct

SEQ ID NO: 2052626 - DNA, 15 bp, Homo sapiens
cctaacctggcttat

SEQ ID NO: 2052627 - DNA, 16 bp, Homo sapiens
cctaactgaagagaca

SEQ ID NO: 2052628 - DNA, 22 bp, Homo sapiens
cctaagaaaccccagggcaggg

SEQ ID NO: 2052629 - DNA, 23 bp, Homo sapiens
cctaagaaaccccagggcaggga

SEQ ID NO: 2052630 - DNA, 22 bp, Homo sapiens
cctaagaagctctggccccagg

SEQ ID NO: 2052631 - DNA, 20 bp, Homo sapiens
cctaagaccggcggccatga

SEQ ID NO: 2052632 - DNA, 20 bp, Homo sapiens
cctaagaggcgacttcctct

SEQ ID NO: 2052633 - DNA, 24 bp, Homo sapiens
cctaagaggcgacttcctctccag

SEQ ID NO: 2052634 - DNA, 13 bp, Homo sapiens
cctaaggacacac

SEQ ID NO: 2052635 - DNA, 17 bp, Homo sapiens
cctaaggacacactaat

SEQ ID NO: 2052636 - DNA, 22 bp, Homo sapiens
cctaaggatctctcaggagcac

SEQ ID NO: 2052637 - DNA, 24 bp, Homo sapiens
cctaaggatctctcaggagcacag

SEQ ID NO: 2052638 - DNA, 20 bp, Homo sapiens
cctaagtgggaagtgaagcc

SEQ ID NO: 2052639 - DNA, 18 bp, Homo sapiens
cctaagtgttgaagaaga

SEQ ID NO: 2052640 - DNA, 22 bp, Homo sapiens
cctaataaacatccttcaagaa

SEQ ID NO: 2052641 - DNA, 21 bp, Homo sapiens
cctaatctcatacctctgacc

SEQ ID NO: 2052642 - DNA, 14 bp, Homo sapiens
cctaattcctggca

SEQ ID NO: 2052643 - DNA, 16 bp, Homo sapiens
cctaattgaaatttaa

SEQ ID NO: 2052644 - DNA, 13 bp, Homo sapiens
cctacaaaatgga

SEQ ID NO: 2052645 - DNA, 14 bp, Homo sapiens
cctacacctccctc

SEQ ID NO: 2052646 - DNA, 17 bp, Homo sapiens
cctacagaaatactgct

SEQ ID NO: 2052647 - DNA, 21 bp, Homo sapiens
cctacagaaatactgctctga

SEQ ID NO: 2052648 - DNA, 14 bp, Homo sapiens
cctacatccccagg

SEQ ID NO: 2052649 - DNA, 18 bp, Homo sapiens
cctacatccccaggtctc

SEQ ID NO: 2052650 - DNA, 14 bp, Homo sapiens
cctacatcttcagc

SEQ ID NO: 2052651 - DNA, 17 bp, Homo sapiens
cctacattccctggcct

SEQ ID NO: 2052652 - DNA, 18 bp, Homo sapiens
cctacattccctggcctg

SEQ ID NO: 2052653 - DNA, 12 bp, Homo sapiens
cctaccaatgca

SEQ ID NO: 2052654 - DNA, 20 bp, Homo sapiens
cctctcaatattcaataaag

SEQ ID NO: 2052655 - DNA, 13 bp, Homo sapiens
cctctcacacaca

SEQ ID NO: 2052656 - DNA, 14 bp, Homo sapiens
cctctcacacacat

SEQ ID NO: 2052657 - DNA, 23 bp, Homo sapiens
cctctcatcagtgtcctcttgct

SEQ ID NO: 2052658 - DNA, 13 bp, Homo sapiens
cctctccactgcc

SEQ ID NO: 2052659 - DNA, 14 bp, Homo sapiens
cctctccactgcct

SEQ ID NO: 2052660 - DNA, 22 bp, Homo sapiens
cctctccagccttctctctctg

SEQ ID NO: 2052661 - DNA, 17 bp, Homo sapiens
cctctccaggcaccctt

SEQ ID NO: 2052662 - DNA, 17 bp, Homo sapiens
cctctccatatctcctt

SEQ ID NO: 2052663 - DNA, 20 bp, Homo sapiens
cctctccatatctccttccc

SEQ ID NO: 2052664 - DNA, 13 bp, Homo sapiens
cctctccatgccc

SEQ ID NO: 2052665 - DNA, 16 bp, Homo sapiens
cctctcccacgatgtc

SEQ ID NO: 2052666 - DNA, 23 bp, Homo sapiens
cctctcccaggccccatgacctc

SEQ ID NO: 2052667 - DNA, 13 bp, Homo sapiens
cctctcccatgca

SEQ ID NO: 2052668 - DNA, 16 bp, Homo sapiens
cctctcccctcatgga

SEQ ID NO: 2052669 - DNA, 19 bp, Homo sapiens
cctctcccctctgccctgt

SEQ ID NO: 2052670 - DNA, 17 bp, Homo sapiens
cctctcccgcaccaggc

SEQ ID NO: 2052671 - DNA, 16 bp, Homo sapiens
cctctcccggctgcct

SEQ ID NO: 2052672 - DNA, 14 bp, Homo sapiens
cctctccctgggga

SEQ ID NO: 2052673 - DNA, 11 bp, Homo sapiens
cctctcctgcc

SEQ ID NO: 2052674 - DNA, 13 bp, Homo sapiens
cctctcctgccta

SEQ ID NO: 2052675 - DNA, 17 bp, Homo sapiens
cctctcctgcctactca

SEQ ID NO: 2052676 - DNA, 17 bp, Homo sapiens
cctctccttccttaccc

SEQ ID NO: 2052677 - DNA, 15 bp, Homo sapiens
cctctccttgcctgg

SEQ ID NO: 2052678 - DNA, 16 bp, Homo sapiens
cctctccttgggctcc

SEQ ID NO: 2052679 - DNA, 21 bp, Homo sapiens
cctctcggaaggctggctggg

SEQ ID NO: 2052680 - DNA, 16 bp, Homo sapiens
cctctctaagccacag

SEQ ID NO: 2052681 - DNA, 23 bp, Homo sapiens
cctctctaagccacagcttcttc

SEQ ID NO: 2052682 - DNA, 19 bp, Homo sapiens
cctctctcaggagtatctt

SEQ ID NO: 2052683 - DNA, 14 bp, Homo sapiens
cctctctccttctg

SEQ ID NO: 2052684 - DNA, 16 bp, Homo sapiens
cctctctccttctggc

SEQ ID NO: 2052685 - DNA, 13 bp, Homo sapiens
cctctctctaagt

SEQ ID NO: 2052686 - DNA, 13 bp, Homo sapiens
cctctcttcagcc

SEQ ID NO: 2052687 - DNA, 21 bp, Homo sapiens
cctctcttcagcccctagtgc

SEQ ID NO: 2052688 - DNA, 11 bp, Homo sapiens
cctctcttgcc

SEQ ID NO: 2052689 - DNA, 18 bp, Homo sapiens
cctctgaaatttcccaca

SEQ ID NO: 2052690 - DNA, 16 bp, Homo sapiens
cctctgacacacagct

SEQ ID NO: 2052691 - DNA, 17 bp, Homo sapiens
cctctgacacacagctc

SEQ ID NO: 2052692 - DNA, 18 bp, Homo sapiens
cctctgacacacagctct

SEQ ID NO: 2052693 - DNA, 21 bp, Homo sapiens
cctctgacacacagctctgtc

SEQ ID NO: 2052694 - DNA, 18 bp, Homo sapiens
cctctgaccaacaggctg

SEQ ID NO: 2052695 - DNA, 16 bp, Homo sapiens
cctctgacctgcaggc

SEQ ID NO: 2052696 - DNA, 17 bp, Homo sapiens
cctctgacctgcaggcc

SEQ ID NO: 2052697 - DNA, 20 bp, Homo sapiens
cctctgacctgcaggccaag

SEQ ID NO: 2052698 - DNA, 12 bp, Homo sapiens
cctctgaggcca

SEQ ID NO: 2052699 - DNA, 19 bp, Homo sapiens
cctctgaggccagcctggc

SEQ ID NO: 2052700 - DNA, 24 bp, Homo sapiens
cctctgattttggcatgtggagac

SEQ ID NO: 2052701 - DNA, 16 bp, Homo sapiens
cctctgcagcacttta

SEQ ID NO: 2052702 - DNA, 11 bp, Homo sapiens
cctctgccacc

SEQ ID NO: 2052703 - DNA, 14 bp, Homo sapiens
cctctgccacctcc

SEQ ID NO: 2052704 - DNA, 16 bp, Homo sapiens
cctctgccacctcccc

SEQ ID NO: 2052705 - DNA, 14 bp, Homo sapiens
cctctgccccaagc

SEQ ID NO: 2052706 - DNA, 17 bp, Homo sapiens
cctctgccccaagcagc

SEQ ID NO: 2052707 - DNA, 21 bp, Homo sapiens
cctctgccccaagcagccagc

SEQ ID NO: 2052708 - DNA, 17 bp, Homo sapiens
cctctgcccgcagagcc

SEQ ID NO: 2052709 - DNA, 18 bp, Homo sapiens
cctctgcccgcagagccc

SEQ ID NO: 2052710 - DNA, 17 bp, Homo sapiens
cctctgccctgcctccc

SEQ ID NO: 2052711 - DNA, 12 bp, Homo sapiens
cctctgccctgt

SEQ ID NO: 2052712 - DNA, 14 bp, Homo sapiens
cctctgcctcaatg

SEQ ID NO: 2052713 - DNA, 15 bp, Homo sapiens
cctctgcctgtctcc

SEQ ID NO: 2052714 - DNA, 23 bp, Homo sapiens
cctctgcgtcccccagccctcag

SEQ ID NO: 2052715 - DNA, 14 bp, Homo sapiens
cctctgctgccatg

SEQ ID NO: 2052716 - DNA, 16 bp, Homo sapiens
cctctggaaagcaaag

SEQ ID NO: 2052717 - DNA, 18 bp, Homo sapiens
cctctggatcctgctgtg

SEQ ID NO: 2052718 - DNA, 21 bp, Homo sapiens
cctctggatggcaccagaggc

SEQ ID NO: 2052719 - DNA, 15 bp, Homo sapiens
cctctggcccagcct

SEQ ID NO: 2052720 - DNA, 16 bp, Homo sapiens
cctctggcccagccta

SEQ ID NO: 2052721 - DNA, 10 bp, Homo sapiens
cctctgggct

SEQ ID NO: 2052722 - DNA, 23 bp, Homo sapiens
cctctggggttcatctagggaca

SEQ ID NO: 2052723 - DNA, 19 bp, Homo sapiens
cctctgtcatcactccctg

SEQ ID NO: 2052724 - DNA, 22 bp, Homo sapiens
cctctgtcatcactccctggat

SEQ ID NO: 2052725 - DNA, 15 bp, Homo sapiens
cctctgtccagggcc

SEQ ID NO: 2052726 - DNA, 20 bp, Homo sapiens
cctctgtctcgagcgccctg

SEQ ID NO: 2052727 - DNA, 14 bp, Homo sapiens
cctctgtctctgct

SEQ ID NO: 2052728 - DNA, 23 bp, Homo sapiens
cctctgtgaggaaagcacacagt

SEQ ID NO: 2052729 - DNA, 19 bp, Homo sapiens
cctcttaaaaaataaaaac

SEQ ID NO: 2052730 - DNA, 17 bp, Homo sapiens
cctcttaaagctgcctg

SEQ ID NO: 2052731 - DNA, 19 bp, Homo sapiens
cctcttaaagctgcctgta

SEQ ID NO: 2052732 - DNA, 17 bp, Homo sapiens
cctcttaccgtagcctc

SEQ ID NO: 2052733 - DNA, 13 bp, Homo sapiens
cctcttcaccccc

SEQ ID NO: 2052734 - DNA, 17 bp, Homo sapiens
cctcttccccttgccct

SEQ ID NO: 2052735 - DNA, 18 bp, Homo sapiens
cctcttccgtgacgtcac

SEQ ID NO: 2052736 - DNA, 15 bp, Homo sapiens
cctcttcctccctca

SEQ ID NO: 2052737 - DNA, 14 bp, Homo sapiens
cctcttcctcctgg

SEQ ID NO: 2052738 - DNA, 12 bp, Homo sapiens
cctcttccttcc

SEQ ID NO: 2052739 - DNA, 18 bp, Homo sapiens
cctcttctattttgtaaa

SEQ ID NO: 2052740 - DNA, 12 bp, Homo sapiens
cctcttctcttc

SEQ ID NO: 2052741 - DNA, 16 bp, Homo sapiens
cctcttcttcttcaga

SEQ ID NO: 2052742 - DNA, 23 bp, Homo sapiens
cctcttgccactgcctcttcctc

SEQ ID NO: 2052743 - DNA, 14 bp, Homo sapiens
cctcttgcctctct

SEQ ID NO: 2052744 - DNA, 15 bp, Homo sapiens
cctcttgcctctctc

SEQ ID NO: 2052745 - DNA, 16 bp, Homo sapiens
cctcttgcctctctca

SEQ ID NO: 2052746 - DNA, 18 bp, Homo sapiens
cctcttggacctctgctc

SEQ ID NO: 2052747 - DNA, 19 bp, Homo sapiens
cctcttggacctctgctct

SEQ ID NO: 2052748 - DNA, 13 bp, Homo sapiens
cctcttgggttca

SEQ ID NO: 2052749 - DNA, 12 bp, Homo sapiens
cctcttgttgca

SEQ ID NO: 2052750 - DNA, 18 bp, Homo sapiens
cctctttaacctcatcta

SEQ ID NO: 2052751 - DNA, 22 bp, Homo sapiens
cctctttctacattctcatcta

SEQ ID NO: 2052752 - DNA, 16 bp, Homo sapiens
cctctttgcctgtgtg

SEQ ID NO: 2052753 - DNA, 17 bp, Homo sapiens
cctctttgcctgtgtga

SEQ ID NO: 2052754 - DNA, 22 bp, Homo sapiens
cctgaaaaactgatcaaaaata

SEQ ID NO: 2052755 - DNA, 23 bp, Homo sapiens
cctgaaaaactgatcaaaaataa

SEQ ID NO: 2052756 - DNA, 16 bp, Homo sapiens
cctgaaaacccagaga

SEQ ID NO: 2052757 - DNA, 21 bp, Homo sapiens
cctgaaaacgaaggggccccg

SEQ ID NO: 2052758 - DNA, 18 bp, Homo sapiens
cctgaaagtgacagagac

SEQ ID NO: 2052759 - DNA, 14 bp, Homo sapiens
cctgaaatttcaga

SEQ ID NO: 2052760 - DNA, 13 bp, Homo sapiens
cctgaaccacagc

SEQ ID NO: 2052761 - DNA, 17 bp, Homo sapiens
cctgaaccccatgggct

SEQ ID NO: 2052762 - DNA, 19 bp, Homo sapiens
cctgaaccccatgggcttg

SEQ ID NO: 2052763 - DNA, 20 bp, Homo sapiens
cctgaaccccatgggcttgg

SEQ ID NO: 2052764 - DNA, 19 bp, Homo sapiens
cctgaagaaaccacaggtt

SEQ ID NO: 2052765 - DNA, 14 bp, Homo sapiens
cctgaagaacagta

SEQ ID NO: 2052766 - DNA, 12 bp, Homo sapiens
cctgaagccaga

SEQ ID NO: 2052767 - DNA, 15 bp, Homo sapiens
cctgaagcctctgcc

SEQ ID NO: 2052768 - DNA, 22 bp, Homo sapiens
cctgaagcctctgccctgcctc

SEQ ID NO: 2052769 - DNA, 20 bp, Homo sapiens
cctgaagggtgacatcccag

SEQ ID NO: 2052770 - DNA, 15 bp, Homo sapiens
cctgtacaatattta

SEQ ID NO: 2052771 - DNA, 21 bp, Homo sapiens
cctgtacaatatttaaaattt

SEQ ID NO: 2052772 - DNA, 14 bp, Homo sapiens
cctgtacccagctc

SEQ ID NO: 2052773 - DNA, 17 bp, Homo sapiens
cctgtaccccagcactt

SEQ ID NO: 2052774 - DNA, 13 bp, Homo sapiens
cctgtactcagga

SEQ ID NO: 2052775 - DNA, 23 bp, Homo sapiens
cctgtactcaggaggctgagggg

SEQ ID NO: 2052776 - DNA, 13 bp, Homo sapiens
cctgtagcagtga

SEQ ID NO: 2052777 - DNA, 13 bp, Homo sapiens
cctgtagcatctt

SEQ ID NO: 2052778 - DNA, 21 bp, Homo sapiens
cctgtagcatcttctggagtc

SEQ ID NO: 2052779 - DNA, 19 bp, Homo sapiens
cctgtagtcccagccactc

SEQ ID NO: 2052780 - DNA, 16 bp, Homo sapiens
cctgtagtgccccctc

SEQ ID NO: 2052781 - DNA, 19 bp, Homo sapiens
cctgtagttgcgtggactc

SEQ ID NO: 2052782 - DNA, 23 bp, Homo sapiens
cctgtagttgcgtggactctgca

SEQ ID NO: 2052783 - DNA, 20 bp, Homo sapiens
cctgtataatctctctcctg

SEQ ID NO: 2052784 - DNA, 12 bp, Homo sapiens
cctgtatagtta

SEQ ID NO: 2052785 - DNA, 21 bp, Homo sapiens
cctgtatattatggtgtaatg

SEQ ID NO: 2052786 - DNA, 17 bp, Homo sapiens
cctgtcaccctggcccc

SEQ ID NO: 2052787 - DNA, 18 bp, Homo sapiens
cctgtcatcccctacact

SEQ ID NO: 2052788 - DNA, 20 bp, Homo sapiens
cctgtcatggtgtccagaca

SEQ ID NO: 2052789 - DNA, 12 bp, Homo sapiens
cctgtccaacct

SEQ ID NO: 2052790 - DNA, 19 bp, Homo sapiens
cctgtccaacctaacccct

SEQ ID NO: 2052791 - DNA, 17 bp, Homo sapiens
cctgtccacctcaccag

SEQ ID NO: 2052792 - DNA, 19 bp, Homo sapiens
cctgtcccaccaactctgc

SEQ ID NO: 2052793 - DNA, 20 bp, Homo sapiens
cctgtcccaccaactctgca

SEQ ID NO: 2052794 - DNA, 21 bp, Homo sapiens
cctgtcccaccaactctgcac

SEQ ID NO: 2052795 - DNA, 23 bp, Homo sapiens
cctgtcccaccaactctgcactc

SEQ ID NO: 2052796 - DNA, 22 bp, Homo sapiens
cctgtccccctgagatcagagt

SEQ ID NO: 2052797 - DNA, 16 bp, Homo sapiens
cctgtcccctgaaaaa

SEQ ID NO: 2052798 - DNA, 22 bp, Homo sapiens
cctgtcccgccttcctcctcca

SEQ ID NO: 2052799 - DNA, 12 bp, Homo sapiens
cctgtccctacc

SEQ ID NO: 2052800 - DNA, 19 bp, Homo sapiens
cctgtccctacccactctt

SEQ ID NO: 2052801 - DNA, 16 bp, Homo sapiens
cctgtcccttcttggg

SEQ ID NO: 2052802 - DNA, 22 bp, Homo sapiens
cctgtcctcaaaataaggggca

SEQ ID NO: 2052803 - DNA, 23 bp, Homo sapiens
cctgtcctcccatcccctggact

SEQ ID NO: 2052804 - DNA, 13 bp, Homo sapiens
cctgtcctgcctc

SEQ ID NO: 2052805 - DNA, 22 bp, Homo sapiens
cctgtcctgcctctctgctcca

SEQ ID NO: 2052806 - DNA, 23 bp, Homo sapiens
cctgtcctgcctctctgctccag

SEQ ID NO: 2052807 - DNA, 16 bp, Homo sapiens
cctgtcctggtacagc

SEQ ID NO: 2052808 - DNA, 20 bp, Homo sapiens
cctgtcctggtacagcaggg

SEQ ID NO: 2052809 - DNA, 14 bp, Homo sapiens
cctgtcgagacact

SEQ ID NO: 2052810 - DNA, 15 bp, Homo sapiens
cctgtcgagacactt

SEQ ID NO: 2052811 - DNA, 20 bp, Homo sapiens
cctgtcgagacacttgcctt

SEQ ID NO: 2052812 - DNA, 21 bp, Homo sapiens
cctgtctgccagccagcagcc

SEQ ID NO: 2052813 - DNA, 23 bp, Homo sapiens
cctgtctgccagccagcagccag

SEQ ID NO: 2052814 - DNA, 19 bp, Homo sapiens
cctgtctgtcgctgggctg

SEQ ID NO: 2052815 - DNA, 18 bp, Homo sapiens
cctgtgaacccaggacaa

SEQ ID NO: 2052816 - DNA, 14 bp, Homo sapiens
cctgtgaggcaggg

SEQ ID NO: 2052817 - DNA, 17 bp, Homo sapiens
cctgtgaggcaggggcg

SEQ ID NO: 2052818 - DNA, 20 bp, Homo sapiens
cctgtgaggtaactgggatc

SEQ ID NO: 2052819 - DNA, 13 bp, Homo sapiens
cctgtgcagcagc

SEQ ID NO: 2052820 - DNA, 14 bp, Homo sapiens
cctgtgcagcagcc

SEQ ID NO: 2052821 - DNA, 20 bp, Homo sapiens
cctgtgcagcagcccagctt

SEQ ID NO: 2052822 - DNA, 22 bp, Homo sapiens
cctgtgcagcagcccagcttcc

SEQ ID NO: 2052823 - DNA, 21 bp, Homo sapiens
cctgtgcagtcccgtggaggg

SEQ ID NO: 2052824 - DNA, 17 bp, Homo sapiens
cctgtgcatgtatgtct

SEQ ID NO: 2052825 - DNA, 14 bp, Homo sapiens
cctgtgccacctgc

SEQ ID NO: 2052826 - DNA, 12 bp, Homo sapiens
cctgtgccagct

SEQ ID NO: 2052827 - DNA, 14 bp, Homo sapiens
cctgtgcccacgtg

SEQ ID NO: 2052828 - DNA, 21 bp, Homo sapiens
cctgtgccctctggattctct

SEQ ID NO: 2052829 - DNA, 15 bp, Homo sapiens
cctgtgcctcctcac

SEQ ID NO: 2052830 - DNA, 20 bp, Homo sapiens
cctgtgcctcctcaccccca

SEQ ID NO: 2052831 - DNA, 13 bp, Homo sapiens
cctgtgctctgga

SEQ ID NO: 2052832 - DNA, 18 bp, Homo sapiens
cctgtgctctggaggctg

SEQ ID NO: 2052833 - DNA, 23 bp, Homo sapiens
cctgtgctgcccgtcttcagcct

SEQ ID NO: 2052834 - DNA, 16 bp, Homo sapiens
cctgtggccaggaggt

SEQ ID NO: 2052835 - DNA, 13 bp, Homo sapiens
cctgtggccttgc

SEQ ID NO: 2052836 - DNA, 14 bp, Homo sapiens
cctgtgggagcctc

SEQ ID NO: 2052837 - DNA, 16 bp, Homo sapiens
cctgtgggagcctcgc

SEQ ID NO: 2052838 - DNA, 21 bp, Homo sapiens
cctgtgggccaggagctcagc

SEQ ID NO: 2052839 - DNA, 19 bp, Homo sapiens
cctgtgggggcggctgtgg

SEQ ID NO: 2052840 - DNA, 21 bp, Homo sapiens
cctgtggtcttggaagtgtgt

SEQ ID NO: 2052841 - DNA, 15 bp, Homo sapiens
cctgtgtagctgtga

SEQ ID NO: 2052842 - DNA, 22 bp, Homo sapiens
cctgtgtagctgtgacctgctg

SEQ ID NO: 2052843 - DNA, 23 bp, Homo sapiens
cctgtgtagctgtgacctgctga

SEQ ID NO: 2052844 - DNA, 15 bp, Homo sapiens
cctgtgtccagcagc

SEQ ID NO: 2052845 - DNA, 21 bp, Homo sapiens
cctgtgtggaagaaggaaaca

SEQ ID NO: 2052846 - DNA, 17 bp, Homo sapiens
cctgtgtggacaggact

SEQ ID NO: 2052847 - DNA, 15 bp, Homo sapiens
cctgtgtggggaggc

SEQ ID NO: 2052848 - DNA, 14 bp, Homo sapiens
cctgtgtttcttgc

SEQ ID NO: 2052849 - DNA, 19 bp, Homo sapiens
cctgtgtttcttgcctcat

SEQ ID NO: 2052850 - DNA, 21 bp, Homo sapiens
cctgttaaaagatgaaaatat

SEQ ID NO: 2052851 - DNA, 24 bp, Homo sapiens
cctgttacttaaatagcatctgct

SEQ ID NO: 2052852 - DNA, 18 bp, Homo sapiens
cctgttagctgttatttc

SEQ ID NO: 2052853 - DNA, 21 bp, Homo sapiens
cctgttcagctccagctcacc

SEQ ID NO: 2052854 - DNA, 18 bp, Homo sapiens
cctgttcatggcagatgt

SEQ ID NO: 2052855 - DNA, 17 bp, Homo sapiens
cctgttccctctttctt

SEQ ID NO: 2052856 - DNA, 20 bp, Homo sapiens
cctgttggacccgctctgga

SEQ ID NO: 2052857 - DNA, 18 bp, Homo sapiens
cctgttgttcccatctgc

SEQ ID NO: 2052858 - DNA, 12 bp, Homo sapiens
cctgtttatata

SEQ ID NO: 2052859 - DNA, 14 bp, Homo sapiens
cctgttttccacac

SEQ ID NO: 2052860 - DNA, 17 bp, Homo sapiens
cctgtttttaagctgtt

SEQ ID NO: 2052861 - DNA, 18 bp, Homo sapiens
cctgtttttaagctgttt

SEQ ID NO: 2052862 - DNA, 19 bp, Homo sapiens
cctgtttttaagctgtttc

SEQ ID NO: 2052863 - DNA, 15 bp, Homo sapiens
cctgtttttctgggt

SEQ ID NO: 2052864 - DNA, 16 bp, Homo sapiens
cctgtttttctgggtg

SEQ ID NO: 2052865 - DNA, 16 bp, Homo sapiens
ccttaaaataatgatt

SEQ ID NO: 2052866 - DNA, 21 bp, Homo sapiens
ccttaacctctctaagccaca

SEQ ID NO: 2052867 - DNA, 23 bp, Homo sapiens
ccttaatcaggtcctcagagaat

SEQ ID NO: 2052868 - DNA, 12 bp, Homo sapiens
ccttaatgagaa

SEQ ID NO: 2052869 - DNA, 18 bp, Homo sapiens
ccttaccaactttctgta

SEQ ID NO: 2052870 - DNA, 16 bp, Homo sapiens
ccttacctcccctgcc

SEQ ID NO: 2052871 - DNA, 22 bp, Homo sapiens
ccttactacttcttggaaaaaa

SEQ ID NO: 2052872 - DNA, 15 bp, Homo sapiens
ccttactcacctctc

SEQ ID NO: 2052873 - DNA, 16 bp, Homo sapiens
ccttactcacctctct

SEQ ID NO: 2052874 - DNA, 13 bp, Homo sapiens
ccttactcctgtg

SEQ ID NO: 2052875 - DNA, 15 bp, Homo sapiens
ccttactcctgtggg

SEQ ID NO: 2052876 - DNA, 19 bp, Homo sapiens
ccttactcctgtgggagcc

SEQ ID NO: 2052877 - DNA, 22 bp, Homo sapiens
ccttactcctgtgggagcctcg

SEQ ID NO: 2052878 - DNA, 19 bp, Homo sapiens
ccttactctgagcccaggc

SEQ ID NO: 2052879 - DNA, 21 bp, Homo sapiens
ccttactctgagcccaggccg

SEQ ID NO: 2052880 - DNA, 22 bp, Homo sapiens
ccttactctgagcccaggccgt

SEQ ID NO: 2052881 - DNA, 21 bp, Homo sapiens
ccttagaaatcattgtagaaa

SEQ ID NO: 2052882 - DNA, 15 bp, Homo sapiens
ccttagaacctttct

SEQ ID NO: 2052883 - DNA, 16 bp, Homo sapiens
ccttagaacctttctt

SEQ ID NO: 2052884 - DNA, 21 bp, Homo sapiens
cctttttccccaaagtcttaa

SEQ ID NO: 2052885 - DNA, 20 bp, Homo sapiens
cctttttctttataaacttt

SEQ ID NO: 2052886 - DNA, 14 bp, Homo sapiens
cctttttgcagtat

SEQ ID NO: 2052887 - DNA, 22 bp, Homo sapiens
ccttttttaggaagcaagctta

SEQ ID NO: 2052888 - DNA, 16 bp, Homo sapiens
cctttttttctctcct

SEQ ID NO: 2052889 - DNA, 21 bp, Homo sapiens
cgaaaaaaaaaaatgcactgt

SEQ ID NO: 2052890 - DNA, 12 bp, Homo sapiens
cgaaaacttgaa

SEQ ID NO: 2052891 - DNA, 23 bp, Homo sapiens
cgaaacacaaaccacaactgaca

SEQ ID NO: 2052892 - DNA, 13 bp, Homo sapiens
cgaaatgttattt

SEQ ID NO: 2052893 - DNA, 20 bp, Homo sapiens
cgaacatgcctgattttaaa

SEQ ID NO: 2052894 - DNA, 12 bp, Homo sapiens
cgaaccaaggca

SEQ ID NO: 2052895 - DNA, 17 bp, Homo sapiens
cgaaccaaggcagcctc

SEQ ID NO: 2052896 - DNA, 14 bp, Homo sapiens
cgaacccctcccct

SEQ ID NO: 2052897 - DNA, 13 bp, Homo sapiens
cgaaccctgccag

SEQ ID NO: 2052898 - DNA, 14 bp, Homo sapiens
cgaaccctgccagg

SEQ ID NO: 2052899 - DNA, 15 bp, Homo sapiens
cgaacgctcttagct

SEQ ID NO: 2052900 - DNA, 21 bp, Homo sapiens
cgaagaacaatgtcagaaact

SEQ ID NO: 2052901 - DNA, 16 bp, Homo sapiens
cgaagaccttctgaag

SEQ ID NO: 2052902 - DNA, 13 bp, Homo sapiens
cgaagagccctga

SEQ ID NO: 2052903 - DNA, 15 bp, Homo sapiens
cgaagagccctgagc

SEQ ID NO: 2052904 - DNA, 23 bp, Homo sapiens
cgaagagggaatggatggggaga

SEQ ID NO: 2052905 - DNA, 14 bp, Homo sapiens
cgaagcccaggctg

SEQ ID NO: 2052906 - DNA, 14 bp, Homo sapiens
cgaagcccttccag

SEQ ID NO: 2052907 - DNA, 18 bp, Homo sapiens
cgaagctttgaaggccga

SEQ ID NO: 2052908 - DNA, 23 bp, Homo sapiens
cgaaggcagtgcaagagactctg

SEQ ID NO: 2052909 - DNA, 17 bp, Homo sapiens
cgaaggggaaaacccgc

SEQ ID NO: 2052910 - DNA, 22 bp, Homo sapiens
cgaaggggccccggggctggca

SEQ ID NO: 2052911 - DNA, 16 bp, Homo sapiens
cgaataaatgttcaaa

SEQ ID NO: 2052912 - DNA, 12 bp, Homo sapiens
cgaatcatctca

SEQ ID NO: 2052913 - DNA, 13 bp, Homo sapiens
cgaatgacactgt

SEQ ID NO: 2052914 - DNA, 15 bp, Homo sapiens
cgaatgtttcaaatc

SEQ ID NO: 2052915 - DNA, 16 bp, Homo sapiens
cgaattaatagctttt

SEQ ID NO: 2052916 - DNA, 20 bp, Homo sapiens
cgaattgagataatatctgt

SEQ ID NO: 2052917 - DNA, 22 bp, Homo sapiens
cgaatttggtgtggctgtattc

SEQ ID NO: 2052918 - DNA, 15 bp, Homo sapiens
cgaattttattttac

SEQ ID NO: 2052919 - DNA, 17 bp, Homo sapiens
cgaatttttcagatgat

SEQ ID NO: 2052920 - DNA, 21 bp, Homo sapiens
cgacactgctgcaccagagtg

SEQ ID NO: 2052921 - DNA, 12 bp, Homo sapiens
cgacagagagat

SEQ ID NO: 2052922 - DNA, 11 bp, Homo sapiens
cgacagcccag

SEQ ID NO: 2052923 - DNA, 14 bp, Homo sapiens
cgacagcctggcac

SEQ ID NO: 2052924 - DNA, 15 bp, Homo sapiens
cgaccctttctctga

SEQ ID NO: 2052925 - DNA, 12 bp, Homo sapiens
cgacctcagcct

SEQ ID NO: 2052926 - DNA, 14 bp, Homo sapiens
cgacctcgtcctcc

SEQ ID NO: 2052927 - DNA, 15 bp, Homo sapiens
cgacgcgtctcctgt

SEQ ID NO: 2052928 - DNA, 10 bp, Homo sapiens
cgactccagc

SEQ ID NO: 2052929 - DNA, 12 bp, Homo sapiens
cgactccagcca

SEQ ID NO: 2052930 - DNA, 18 bp, Homo sapiens
cgactccagccagcgcct

SEQ ID NO: 2052931 - DNA, 21 bp, Homo sapiens
cgactccagccagcgcctccc

SEQ ID NO: 2052932 - DNA, 18 bp, Homo sapiens
cgactctatagactctag

SEQ ID NO: 2052933 - DNA, 20 bp, Homo sapiens
cgactctatagactctagga

SEQ ID NO: 2052934 - DNA, 14 bp, Homo sapiens
cgactcttcctgca

SEQ ID NO: 2052935 - DNA, 16 bp, Homo sapiens
cgactgcacagcggcc

SEQ ID NO: 2052936 - DNA, 21 bp, Homo sapiens
cgactgttgtacaagctcagg

SEQ ID NO: 2052937 - DNA, 17 bp, Homo sapiens
cgagaccaacctgacca

SEQ ID NO: 2052938 - DNA, 14 bp, Homo sapiens
cgagaccagcctgg

SEQ ID NO: 2052939 - DNA, 16 bp, Homo sapiens
cgagaccagcctggcc

SEQ ID NO: 2052940 - DNA, 15 bp, Homo sapiens
cgagaccatcctggc

SEQ ID NO: 2052941 - DNA, 17 bp, Homo sapiens
cgagacggctggacctg

SEQ ID NO: 2052942 - DNA, 18 bp, Homo sapiens
cgagactgagaggcagaa

SEQ ID NO: 2052943 - DNA, 18 bp, Homo sapiens
cgagagaggtgggcagca

SEQ ID NO: 2052944 - DNA, 22 bp, Homo sapiens
cgagagaggtgggcagcagctc

SEQ ID NO: 2052945 - DNA, 16 bp, Homo sapiens
cgagaggtccctgctt

SEQ ID NO: 2052946 - DNA, 17 bp, Homo sapiens
cgagaggtccctgctta

SEQ ID NO: 2052947 - DNA, 19 bp, Homo sapiens
cgagagtagccgagagcct

SEQ ID NO: 2052948 - DNA, 15 bp, Homo sapiens
cgagagtctgtctca

SEQ ID NO: 2052949 - DNA, 15 bp, Homo sapiens
cgagataatgtatat

SEQ ID NO: 2052950 - DNA, 16 bp, Homo sapiens
cgagatcacgccactg

SEQ ID NO: 2052951 - DNA, 15 bp, Homo sapiens
cgagatcccatctct

SEQ ID NO: 2052952 - DNA, 20 bp, Homo sapiens
cgagcaaagtctaaagttta

SEQ ID NO: 2052953 - DNA, 15 bp, Homo sapiens
cgagcaaccgtggcc

SEQ ID NO: 2052954 - DNA, 18 bp, Homo sapiens
cgagcactggccagagag

SEQ ID NO: 2052955 - DNA, 21 bp, Homo sapiens
cgagcactggccagagagggc

SEQ ID NO: 2052956 - DNA, 12 bp, Homo sapiens
cgagcagctgag

SEQ ID NO: 2052957 - DNA, 13 bp, Homo sapiens
cgagcatttccct

SEQ ID NO: 2052958 - DNA, 20 bp, Homo sapiens
cgagcatttccctcccggga

SEQ ID NO: 2052959 - DNA, 14 bp, Homo sapiens
cgagcccagctaca

SEQ ID NO: 2052960 - DNA, 14 bp, Homo sapiens
cgagccccctggat

SEQ ID NO: 2052961 - DNA, 15 bp, Homo sapiens
cgagccctgcagcca

SEQ ID NO: 2052962 - DNA, 15 bp, Homo sapiens
cgagccgggcctggg

SEQ ID NO: 2052963 - DNA, 17 bp, Homo sapiens
cgagccgggcctggggc

SEQ ID NO: 2052964 - DNA, 19 bp, Homo sapiens
cgagcgccctgcagaccct

SEQ ID NO: 2052965 - DNA, 16 bp, Homo sapiens
cgagctactctcttgc

SEQ ID NO: 2052966 - DNA, 21 bp, Homo sapiens
cgagctccttgggtcctgcaa

SEQ ID NO: 2052967 - DNA, 12 bp, Homo sapiens
cgaggacaggga

SEQ ID NO: 2052968 - DNA, 22 bp, Homo sapiens
cgaggaccctggttactctggt

SEQ ID NO: 2052969 - DNA, 20 bp, Homo sapiens
cgaggagcttccagtgcatg

SEQ ID NO: 2052970 - DNA, 14 bp, Homo sapiens
cgaggcagggtcag

SEQ ID NO: 2052971 - DNA, 18 bp, Homo sapiens
cgaggccttctctgaagg

SEQ ID NO: 2052972 - DNA, 17 bp, Homo sapiens
cgaggcggtttccagga

SEQ ID NO: 2052973 - DNA, 22 bp, Homo sapiens
cgaggcggtttccaggaagagt

SEQ ID NO: 2052974 - DNA, 15 bp, Homo sapiens
cgaggctcttccatc

SEQ ID NO: 2052975 - DNA, 19 bp, Homo sapiens
cgagggatgggatttcatg

SEQ ID NO: 2052976 - DNA, 23 bp, Homo sapiens
cgaggtgtcaccctgcagagcta

SEQ ID NO: 2052977 - DNA, 13 bp, Homo sapiens
cgaggttgcccct

SEQ ID NO: 2052978 - DNA, 17 bp, Homo sapiens
cgaggttgccccttccc

SEQ ID NO: 2052979 - DNA, 15 bp, Homo sapiens
cgagtaatatgcctg

SEQ ID NO: 2052980 - DNA, 13 bp, Homo sapiens
cgagtcacctgca

SEQ ID NO: 2052981 - DNA, 15 bp, Homo sapiens
cgagtcacctgcaag

SEQ ID NO: 2052982 - DNA, 17 bp, Homo sapiens
cgagtctcttctccact

SEQ ID NO: 2052983 - DNA, 22 bp, Homo sapiens
cgagttgtggaaagcctctgct

SEQ ID NO: 2052984 - DNA, 17 bp, Homo sapiens
cgagtttacttcatgag

SEQ ID NO: 2052985 - DNA, 15 bp, Homo sapiens
cgatcaagtccagag

SEQ ID NO: 2052986 - DNA, 16 bp, Homo sapiens
cgatcaagtccagagc

SEQ ID NO: 2052987 - DNA, 20 bp, Homo sapiens
cgatcttggctcactgcaac

SEQ ID NO: 2052988 - DNA, 16 bp, Homo sapiens
cgatgacagtgctcta

SEQ ID NO: 2052989 - DNA, 21 bp, Homo sapiens
cgatgggcccaattcttacaa

SEQ ID NO: 2052990 - DNA, 17 bp, Homo sapiens
cgatgtcaaggactcct

SEQ ID NO: 2052991 - DNA, 18 bp, Homo sapiens
cgatgtgcgcacacacag

SEQ ID NO: 2052992 - DNA, 13 bp, Homo sapiens
cgatgtggccctg

SEQ ID NO: 2052993 - DNA, 15 bp, Homo sapiens
cgatgtggccctggc

SEQ ID NO: 2052994 - DNA, 18 bp, Homo sapiens
cgatgtggccctggcctg

SEQ ID NO: 2052995 - DNA, 13 bp, Homo sapiens
cgattaatttatg

SEQ ID NO: 2052996 - DNA, 15 bp, Homo sapiens
cgattaatttatggt

SEQ ID NO: 2052997 - DNA, 16 bp, Homo sapiens
cgattaatttatggtt

SEQ ID NO: 2052998 - DNA, 16 bp, Homo sapiens
cgattatttatttctg

SEQ ID NO: 2052999 - DNA, 19 bp, Homo sapiens
cgattatttatttctgtaa

SEQ ID NO: 2053000 - DNA, 17 bp, Homo sapiens
cgggtccccagctcccc

SEQ ID NO: 2053001 - DNA, 19 bp, Homo sapiens
cgggtccccagctccccag

SEQ ID NO: 2053002 - DNA, 18 bp, Homo sapiens
cgggtggatcacctgagg

SEQ ID NO: 2053003 - DNA, 17 bp, Homo sapiens
cgggtgggcctggcctg

SEQ ID NO: 2053004 - DNA, 20 bp, Homo sapiens
cggtaaaacaccggagacta

SEQ ID NO: 2053005 - DNA, 23 bp, Homo sapiens
cggtcaccgagacggctggacct

SEQ ID NO: 2053006 - DNA, 19 bp, Homo sapiens
cggtcagatttgctgttca

SEQ ID NO: 2053007 - DNA, 23 bp, Homo sapiens
cggtcatgcttttgccactttgg

SEQ ID NO: 2053008 - DNA, 18 bp, Homo sapiens
cggtcatgtgtgcatgtg

SEQ ID NO: 2053009 - DNA, 15 bp, Homo sapiens
cggtccacccaggag

SEQ ID NO: 2053010 - DNA, 21 bp, Homo sapiens
cggtcccccctcactccacac

SEQ ID NO: 2053011 - DNA, 21 bp, Homo sapiens
cggtcccttgagacctcagcc

SEQ ID NO: 2053012 - DNA, 22 bp, Homo sapiens
cggtcccttgagacctcagcca

SEQ ID NO: 2053013 - DNA, 13 bp, Homo sapiens
cggtcctggcccc

SEQ ID NO: 2053014 - DNA, 15 bp, Homo sapiens
cggtcctggccccag

SEQ ID NO: 2053015 - DNA, 18 bp, Homo sapiens
cggtgcatccacgcacac

SEQ ID NO: 2053016 - DNA, 22 bp, Homo sapiens
cggtgcatccacgcacacatgg

SEQ ID NO: 2053017 - DNA, 17 bp, Homo sapiens
cggtgcgtggctgtggc

SEQ ID NO: 2053018 - DNA, 20 bp, Homo sapiens
cggtgcgtggctgtggcaca

SEQ ID NO: 2053019 - DNA, 15 bp, Homo sapiens
cggtggccatgcttc

SEQ ID NO: 2053020 - DNA, 20 bp, Homo sapiens
cggtggccatgcttcttgcc

SEQ ID NO: 2053021 - DNA, 20 bp, Homo sapiens
cggtggctcacacctgtaat
